United States Patent 7,691,997 (FUNCTIONAL AND HYPERFUNCTIONAL SIRNA) - sequence listing, part 10

SEQ ID NO: 374394 - RNA, 19 nt, Homo sapiens
guucucagcuuccuugcuu

SEQ ID NO: 374395 - RNA, 19 nt, Homo sapiens
gggaugaccuucggcaaga

SEQ ID NO: 374396 - RNA, 19 nt, Homo sapiens
gcagaacaacucagcuaaa

SEQ ID NO: 374397 - RNA, 19 nt, Homo sapiens
gggaugguguggacaguga

SEQ ID NO: 374398 - RNA, 19 nt, Homo sapiens
gauuacacuugguugacua

SEQ ID NO: 374399 - RNA, 19 nt, Homo sapiens
guuagccacuugugucauu

SEQ ID NO: 374400 - RNA, 19 nt, Homo sapiens
gaugguggauggcaguaug

SEQ ID NO: 374401 - RNA, 19 nt, Homo sapiens
gcaagagcuucuggccuuu

SEQ ID NO: 374402 - RNA, 19 nt, Homo sapiens
gcauaagucucagcagcaa

SEQ ID NO: 374403 - RNA, 19 nt, Homo sapiens
ccuuuaagcugaccacaga

SEQ ID NO: 374404 - RNA, 19 nt, Homo sapiens
gacaacaucucccaguucu

SEQ ID NO: 374405 - RNA, 19 nt, Homo sapiens
gaugggugaugagguauga

SEQ ID NO: 374406 - RNA, 19 nt, Homo sapiens
ggaauucccuacccugacu

SEQ ID NO: 374407 - RNA, 19 nt, Homo sapiens
gaaacacgaaggaucaugu

SEQ ID NO: 374408 - RNA, 19 nt, Homo sapiens
ggacagacacaaugggaau

SEQ ID NO: 374409 - RNA, 19 nt, Homo sapiens
caaacgagacccagaagau

SEQ ID NO: 374410 - RNA, 19 nt, Homo sapiens
cggaacagcuggcucauac

SEQ ID NO: 374411 - RNA, 19 nt, Homo sapiens
ccgagaguauugauaauuc

SEQ ID NO: 374412 - RNA, 19 nt, Homo sapiens
gcguggaaauugaaugaga

SEQ ID NO: 374413 - RNA, 19 nt, Homo sapiens
uggaaguccuugaauguga

SEQ ID NO: 374414 - RNA, 19 nt, Homo sapiens
cccaguugcuuaacaugua

SEQ ID NO: 374415 - RNA, 19 nt, Homo sapiens
cuagagggcccuugucuga

SEQ ID NO: 374416 - RNA, 19 nt, Homo sapiens
ggacucaccagcgcucuaa

SEQ ID NO: 374417 - RNA, 19 nt, Homo sapiens
gagauccguugccuagaug

SEQ ID NO: 374418 - RNA, 19 nt, Homo sapiens
caugggagauacaguagug

SEQ ID NO: 374419 - RNA, 19 nt, Homo sapiens
cuucagacaugcacauuuc

SEQ ID NO: 374420 - RNA, 19 nt, Homo sapiens
gaaaguacggcggaucaga

SEQ ID NO: 374421 - RNA, 19 nt, Homo sapiens
gagaaaguacggcggauca

SEQ ID NO: 374422 - RNA, 19 nt, Homo sapiens
gagcaaggagccuguguuc

SEQ ID NO: 374423 - RNA, 19 nt, Homo sapiens
ugagauccguugccuagau

SEQ ID NO: 374424 - RNA, 19 nt, Homo sapiens
gcgacauguucaacuacua

SEQ ID NO: 374425 - RNA, 19 nt, Homo sapiens
guagaaaacuugcccgaau

SEQ ID NO: 374426 - RNA, 19 nt, Homo sapiens
ggacguggacuucuaucug

SEQ ID NO: 374427 - RNA, 19 nt, Homo sapiens
gcugauaguggcaugauug

SEQ ID NO: 374428 - RNA, 19 nt, Homo sapiens
ggaucaagccauacaagau

SEQ ID NO: 374429 - RNA, 19 nt, Homo sapiens
ugaagcaacugcaguccau

SEQ ID NO: 374430 - RNA, 19 nt, Homo sapiens
agagagaauucaucaaguc

SEQ ID NO: 374431 - RNA, 19 nt, Homo sapiens
gcacauuuccacucaacga

SEQ ID NO: 374432 - RNA, 19 nt, Homo sapiens
ggaguacaagccuacauug

SEQ ID NO: 374433 - RNA, 19 nt, Homo sapiens
cagaacaacucagcuaaac

SEQ ID NO: 374434 - RNA, 19 nt, Homo sapiens
gugacaacaucucccaguu

SEQ ID NO: 374435 - RNA, 19 nt, Homo sapiens
cgagaguauugauaauuca

SEQ ID NO: 374436 - RNA, 19 nt, Homo sapiens
acccuaaaguggagaauga

SEQ ID NO: 374437 - RNA, 19 nt, Homo sapiens
ggccuauucuucagacaug

SEQ ID NO: 374438 - RNA, 19 nt, Homo sapiens
cacaggccauccucuuauu

SEQ ID NO: 374439 - RNA, 19 nt, Homo sapiens
agagggcccuugucugaga

SEQ ID NO: 374440 - RNA, 19 nt, Homo sapiens
caucauccacaucgacuuu

SEQ ID NO: 374441 - RNA, 19 nt, Homo sapiens
gcccaacuaugacaacgau

SEQ ID NO: 374442 - RNA, 19 nt, Homo sapiens
ccauuaagcccuacauagu

SEQ ID NO: 374443 - RNA, 19 nt, Homo sapiens
ggaggaggaagaugagaug

SEQ ID NO: 374444 - RNA, 19 nt, Homo sapiens
ccacaggccauccucuuau

SEQ ID NO: 374445 - RNA, 19 nt, Homo sapiens
ggccaugggagauacagua

SEQ ID NO: 374446 - RNA, 19 nt, Homo sapiens
guucaacuacuauaagaug

SEQ ID NO: 374447 - RNA, 19 nt, Homo sapiens
ccacuaagagggaugaaca

SEQ ID NO: 374448 - RNA, 19 nt, Homo sapiens
ggccuuccauguucucuca

SEQ ID NO: 374449 - RNA, 19 nt, Homo sapiens
ccacuggaguuggucaaug

SEQ ID NO: 374450 - RNA, 19 nt, Homo sapiens
guccuuaguuagccacuug

SEQ ID NO: 374451 - RNA, 19 nt, Homo sapiens
cccgaaaucugggcuuuga

SEQ ID NO: 374452 - RNA, 19 nt, Homo sapiens
gauaguggcaugauugaac

SEQ ID NO: 374453 - RNA, 19 nt, Homo sapiens
ccaacuaugacaacgauga

SEQ ID NO: 374454 - RNA, 19 nt, Homo sapiens
gcaacgaggacguggacuu

SEQ ID NO: 374455 - RNA, 19 nt, Homo sapiens
gaaauggaaggcaagaaac

SEQ ID NO: 374456 - RNA, 19 nt, Homo sapiens
cgaaaucugggcuuugaga

SEQ ID NO: 374457 - RNA, 19 nt, Homo sapiens
uacaggagcacggcaguua

SEQ ID NO: 374458 - RNA, 19 nt, Homo sapiens
caacaucucccaguucucu

SEQ ID NO: 374459 - RNA, 19 nt, Homo sapiens
caaagagagguuccacaug

SEQ ID NO: 374460 - RNA, 19 nt, Homo sapiens
gcugauugccgcucggaaa

SEQ ID NO: 374461 - RNA, 19 nt, Homo sapiens
uaagcugaccacagaguuu

SEQ ID NO: 374462 - RNA, 19 nt, Homo sapiens
ucagggaggaggaagauga

SEQ ID NO: 374463 - RNA, 19 nt, Homo sapiens
uaccaccucuucccugaga

SEQ ID NO: 374464 - RNA, 19 nt, Homo sapiens
ggcaguaugcggucuauca

SEQ ID NO: 374465 - RNA, 19 nt, Homo sapiens
uuugagacgucagccuuua

SEQ ID NO: 374466 - RNA, 19 nt, Homo sapiens
ggacgcagaaggccacauc

SEQ ID NO: 374467 - RNA, 19 nt, Homo sapiens
ugagagagaauucaucaag

SEQ ID NO: 374468 - RNA, 19 nt, Homo sapiens
gaaaagaacuggaagaaaa

SEQ ID NO: 374469 - RNA, 19 nt, Homo sapiens
gccagaagaucuccuauaa

SEQ ID NO: 374470 - RNA, 19 nt, Homo sapiens
ccagagagccuuugacaua

SEQ ID NO: 374471 - RNA, 19 nt, Homo sapiens
gcaguagccuguuuguuaa

SEQ ID NO: 374472 - RNA, 19 nt, Homo sapiens
aagagcagaucaacaauua

SEQ ID NO: 374473 - RNA, 19 nt, Homo sapiens
ggcaguagccuguuuguua

SEQ ID NO: 374474 - RNA, 19 nt, Homo sapiens
gaacgccacugccuucuuc

SEQ ID NO: 374475 - RNA, 19 nt, Homo sapiens
gagaaggccuggucuaagu

SEQ ID NO: 374476 - RNA, 19 nt, Homo sapiens
caaagaagauguggcaguu

SEQ ID NO: 374477 - RNA, 19 nt, Homo sapiens
gaagaaaaguaguggauuu

SEQ ID NO: 374478 - RNA, 19 nt, Homo sapiens
gacauaaggucuaucaauc

SEQ ID NO: 374479 - RNA, 19 nt, Homo sapiens
ccaaagagcagaucaacaa

SEQ ID NO: 374480 - RNA, 19 nt, Homo sapiens
cauaaggucuaucaaucua

SEQ ID NO: 374481 - RNA, 19 nt, Homo sapiens
gcaaguggaaagauaaauu

SEQ ID NO: 374482 - RNA, 19 nt, Homo sapiens
caacaauuauguggagaaa

SEQ ID NO: 374483 - RNA, 19 nt, Homo sapiens
ucaccgaccucgccuuuga

SEQ ID NO: 374484 - RNA, 19 nt, Homo sapiens
cagagagccuuugacauaa

SEQ ID NO: 374485 - RNA, 19 nt, Homo sapiens
cagaagaucuccuauaacg

SEQ ID NO: 374486 - RNA, 19 nt, Homo sapiens
gagcagaucaacaauuaug

SEQ ID NO: 374487 - RNA, 19 nt, Homo sapiens
ucacaaccagcaugucuua

SEQ ID NO: 374488 - RNA, 19 nt, Homo sapiens
ucaccaagaucuucagcaa

SEQ ID NO: 374489 - RNA, 19 nt, Homo sapiens
uacaagagcuggcugaucu

SEQ ID NO: 374490 - RNA, 19 nt, Homo sapiens
uaacaagaguaugaagcua

SEQ ID NO: 374491 - RNA, 19 nt, Homo sapiens
uaaaccaccuggguagauu

SEQ ID NO: 374492 - RNA, 19 nt, Homo sapiens
ggaccuugcuugccagaag

SEQ ID NO: 374493 - RNA, 19 nt, Homo sapiens
gaagcuaguggacacguuu

SEQ ID NO: 374494 - RNA, 19 nt, Homo sapiens
gcuauggccuuucgaaugc

SEQ ID NO: 374495 - RNA, 19 nt, Homo sapiens
ucaagagagucccuaggaa

SEQ ID NO: 374496 - RNA, 19 nt, Homo sapiens
ucagagugccuaugauaaa

SEQ ID NO: 374497 - RNA, 19 nt, Homo sapiens
guggaaagauaaauucaag

SEQ ID NO: 374498 - RNA, 19 nt, Homo sapiens
cgaccucgccuuugauuug

SEQ ID NO: 374499 - RNA, 19 nt, Homo sapiens
uggauuacauuuccuuuca

SEQ ID NO: 374500 - RNA, 19 nt, Homo sapiens
caaccagcaugucuuaguc

SEQ ID NO: 374501 - RNA, 19 nt, Homo sapiens
gucuugcccugguggauua

SEQ ID NO: 374502 - RNA, 19 nt, Homo sapiens
caacuuuccgcucuucauu

SEQ ID NO: 374503 - RNA, 19 nt, Homo sapiens
caagagagucccuaggaau

SEQ ID NO: 374504 - RNA, 19 nt, Homo sapiens
ugacauaaggucuaucaau

SEQ ID NO: 374505 - RNA, 19 nt, Homo sapiens
cacggcaaguggaaagaua

SEQ ID NO: 374506 - RNA, 19 nt, Homo sapiens
uggcugugcucaccauuga

SEQ ID NO: 374507 - RNA, 19 nt, Homo sapiens
uaaggucuaucaaucuaca

SEQ ID NO: 374508 - RNA, 19 nt, Homo sapiens
caaguggaaagauaaauuc

SEQ ID NO: 374509 - RNA, 19 nt, Homo sapiens
gaagcuguaccacucagaa

SEQ ID NO: 374510 - RNA, 19 nt, Homo sapiens
ggaguacaucaccaacuuu

SEQ ID NO: 374511 - RNA, 19 nt, Homo sapiens
cgaccucucuggagucagu

SEQ ID NO: 374512 - RNA, 19 nt, Homo sapiens
gcagaucaacaauuaugug

SEQ ID NO: 374513 - RNA, 19 nt, Homo sapiens
gaccuugcuugccagaaga

SEQ ID NO: 374514 - RNA, 19 nt, Homo sapiens
gaagauguggcaguuggaa

SEQ ID NO: 374515 - RNA, 19 nt, Homo sapiens
aaagagcagaucaacaauu

SEQ ID NO: 374516 - RNA, 19 nt, Homo sapiens
aggaguacaucaccaacuu

SEQ ID NO: 374517 - RNA, 19 nt, Homo sapiens
gaaggccuggucuaaguau

SEQ ID NO: 374518 - RNA, 19 nt, Homo sapiens
uggaaggccugaaugucaa

SEQ ID NO: 374519 - RNA, 19 nt, Homo sapiens
ucuggaaccuacaaacuca

SEQ ID NO: 374520 - RNA, 19 nt, Homo sapiens
ggagaaggccuggucuaag

SEQ ID NO: 374521 - RNA, 19 nt, Homo sapiens
gaggagaaggccuggucua

SEQ ID NO: 374522 - RNA, 19 nt, Homo sapiens
ggucuaucaaucuacauuu

SEQ ID NO: 374523 - RNA, 19 nt, Homo sapiens
gaaccuacaaacucaagag

SEQ ID NO: 374524 - RNA, 19 nt, Homo sapiens
gaccucgccuuugauuugu

SEQ ID NO: 374525 - RNA, 19 nt, Homo sapiens
gaaaaguaguggauuuggu

SEQ ID NO: 374526 - RNA, 19 nt, Homo sapiens
caccggcaguagccuguuu

SEQ ID NO: 374527 - RNA, 19 nt, Homo sapiens
aagcguggcuauggccuuu

SEQ ID NO: 374528 - RNA, 19 nt, Homo sapiens
acaagaguaugaagcuagu

SEQ ID NO: 374529 - RNA, 19 nt, Homo sapiens
gagagucccuaggaaucug

SEQ ID NO: 374530 - RNA, 19 nt, Homo sapiens
aggccaagauccacgaaug

SEQ ID NO: 374531 - RNA, 19 nt, Homo sapiens
ggcuauggccuuucgaaug

SEQ ID NO: 374532 - RNA, 19 nt, Homo sapiens
gaguacaucaccaacuuuc

SEQ ID NO: 374533 - RNA, 19 nt, Homo sapiens
gauaaaccaccuggguaga

SEQ ID NO: 374534 - RNA, 19 nt, Homo sapiens
gguagagggcuuccaugug

SEQ ID NO: 374535 - RNA, 19 nt, Homo sapiens
gaccuacagccaccuugaa

SEQ ID NO: 374536 - RNA, 19 nt, Homo sapiens
gagaaaagaacuggaagaa

SEQ ID NO: 374537 - RNA, 19 nt, Homo sapiens
caaagagcagaucaacaau

SEQ ID NO: 374538 - RNA, 19 nt, Homo sapiens
ggacaccgaggaggccaaa

SEQ ID NO: 374539 - RNA, 19 nt, Homo sapiens
ucaaggaguacaucaccaa

SEQ ID NO: 374540 - RNA, 19 nt, Homo sapiens
uaucagacagucauguuca

SEQ ID NO: 374541 - RNA, 19 nt, Homo sapiens
ggaacgccacugccuucuu

SEQ ID NO: 374542 - RNA, 19 nt, Homo sapiens
auaagaccaucaucagagu

SEQ ID NO: 374543 - RNA, 19 nt, Homo sapiens
auucaaggcugagcgcauu

SEQ ID NO: 374544 - RNA, 19 nt, Homo sapiens
acaauuauguggagaaaag

SEQ ID NO: 374545 - RNA, 19 nt, Homo sapiens
ccaccgggacagggaguua

SEQ ID NO: 374546 - RNA, 19 nt, Homo sapiens
caagaagcuguaccacuca

SEQ ID NO: 374547 - RNA, 19 nt, Homo sapiens
ugaagcuaguggacacguu

SEQ ID NO: 374548 - RNA, 19 nt, Homo sapiens
cagcugaccaccggcagua

SEQ ID NO: 374549 - RNA, 19 nt, Homo sapiens
ucaccaacuuuccgcucuu

SEQ ID NO: 374550 - RNA, 19 nt, Homo sapiens
gggcaucaccaagaucuuc

SEQ ID NO: 374551 - RNA, 19 nt, Homo sapiens
aaucugggcaucaccaaga

SEQ ID NO: 374552 - RNA, 19 nt, Homo sapiens
caagagcuggcugaucuau

SEQ ID NO: 374553 - RNA, 19 nt, Homo sapiens
caaucuacauuuucccaaa

SEQ ID NO: 374554 - RNA, 19 nt, Homo sapiens
agagagccuuugacauaag

SEQ ID NO: 374555 - RNA, 19 nt, Homo sapiens
ccaacaagcguggcuaugg

SEQ ID NO: 374556 - RNA, 19 nt, Homo sapiens
guacaagagcuggcugauc

SEQ ID NO: 374557 - RNA, 19 nt, Homo sapiens
gcugugcucaccauugaug

SEQ ID NO: 374558 - RNA, 19 nt, Homo sapiens
auacaucccaccaugauca

SEQ ID NO: 374559 - RNA, 19 nt, Homo sapiens
cagagugccuaugauaaac

SEQ ID NO: 374560 - RNA, 19 nt, Homo sapiens
gauccuggaaggccugaau

SEQ ID NO: 374561 - RNA, 19 nt, Homo sapiens
acaccgaggaggccaaaga

SEQ ID NO: 374562 - RNA, 19 nt, Homo sapiens
agaaggccuggucuaagua

SEQ ID NO: 374563 - RNA, 19 nt, Homo sapiens
cgucaccgaccucgccuuu

SEQ ID NO: 374564 - RNA, 19 nt, Homo sapiens
ugccagaagaucuccuaua

SEQ ID NO: 374565 - RNA, 19 nt, Homo sapiens
cuggaaggccugaauguca

SEQ ID NO: 374566 - RNA, 19 nt, Homo sapiens
gccuuugauuuguacaaga

SEQ ID NO: 374567 - RNA, 19 nt, Homo sapiens
uucccaaacuguccauuuc

SEQ ID NO: 374568 - RNA, 19 nt, Homo sapiens
gccgaauuguuucuaguua

SEQ ID NO: 374569 - RNA, 19 nt, Homo sapiens
ucgcaaaggugaacacuca

SEQ ID NO: 374570 - RNA, 19 nt, Homo sapiens
gcagaggucagaugcagaa

SEQ ID NO: 374571 - RNA, 19 nt, Homo sapiens
cagcagcagugguggcaaa

SEQ ID NO: 374572 - RNA, 19 nt, Homo sapiens
cagauucucccuuaaggaa

SEQ ID NO: 374573 - RNA, 19 nt, Homo sapiens
gcaaaggugaacacucaug

SEQ ID NO: 374574 - RNA, 19 nt, Homo sapiens
gcucaggccgaguguacua

SEQ ID NO: 374575 - RNA, 19 nt, Homo sapiens
cgucacacaguauuuauug

SEQ ID NO: 374576 - RNA, 19 nt, Homo sapiens
gcagaagccauuugaagac

SEQ ID NO: 374577 - RNA, 19 nt, Homo sapiens
gcaacugugcagacccuuu

SEQ ID NO: 374578 - RNA, 19 nt, Homo sapiens
cgaauuguuucuaguuagg

SEQ ID NO: 374579 - RNA, 19 nt, Homo sapiens
ccaauuaaacccagaacca

SEQ ID NO: 374580 - RNA, 19 nt, Homo sapiens
cacacaguauuuauuguuc

SEQ ID NO: 374581 - RNA, 19 nt, Homo sapiens
caacugugcagacccuuuc

SEQ ID NO: 374582 - RNA, 19 nt, Homo sapiens
caccgucacacaguauuua

SEQ ID NO: 374583 - RNA, 19 nt, Homo sapiens
ucucuggccucacaguuca

SEQ ID NO: 374584 - RNA, 19 nt, Homo sapiens
ccgaauuguuucuaguuag

SEQ ID NO: 374585 - RNA, 19 nt, Homo sapiens
cgggagaggaggacuuuga

SEQ ID NO: 374586 - RNA, 19 nt, Homo sapiens
gccagauucucccuuaagg

SEQ ID NO: 374587 - RNA, 19 nt, Homo sapiens
cucgagggccgaauuguuu

SEQ ID NO: 374588 - RNA, 19 nt, Homo sapiens
gggccgaauuguuucuagu

SEQ ID NO: 374589 - RNA, 19 nt, Homo sapiens
aggccacgcuccucuguuc

SEQ ID NO: 374590 - RNA, 19 nt, Homo sapiens
ggccgaauuguuucuaguu

SEQ ID NO: 374591 - RNA, 19 nt, Homo sapiens
ugcagaagccauuugaaga

SEQ ID NO: 374592 - RNA, 19 nt, Homo sapiens
ccaccgucacacaguauuu

SEQ ID NO: 374593 - RNA, 19 nt, Homo sapiens
gcugaucaacggcuacauc

SEQ ID NO: 374594 - RNA, 19 nt, Homo sapiens
ccgccagauucucccuuaa

SEQ ID NO: 374595 - RNA, 19 nt, Homo sapiens
ggccgaguguacuacuuca

SEQ ID NO: 374596 - RNA, 19 nt, Homo sapiens
cugccaccgucacacagua

SEQ ID NO: 374597 - RNA, 19 nt, Homo sapiens
caacggcuacauccagaag

SEQ ID NO: 374598 - RNA, 19 nt, Homo sapiens
accgccagauucucccuua

SEQ ID NO: 374599 - RNA, 19 nt, Homo sapiens
ggagaggaggacuuugagu

SEQ ID NO: 374600 - RNA, 19 nt, Homo sapiens
ggacaguguucacggauuc

SEQ ID NO: 374601 - RNA, 19 nt, Homo sapiens
gcaaaggucagaugcagaa

SEQ ID NO: 374602 - RNA, 19 nt, Homo sapiens
ccagaguuguuuguaguua

SEQ ID NO: 374603 - RNA, 19 nt, Homo sapiens
gagaugagcgggacagugu

SEQ ID NO: 374604 - RNA, 19 nt, Homo sapiens
ccuccagacucuccauuaa

SEQ ID NO: 374605 - RNA, 19 nt, Homo sapiens
gcucgcaccugcuagugaa

SEQ ID NO: 374606 - RNA, 19 nt, Homo sapiens
caacuuugcagcacccuuu

SEQ ID NO: 374607 - RNA, 19 nt, Homo sapiens
gaggaguguuccaaagaga

SEQ ID NO: 374608 - RNA, 19 nt, Homo sapiens
ggaggaguguuccaaagag

SEQ ID NO: 374609 - RNA, 19 nt, Homo sapiens
gaucaaggcaggagagaag

SEQ ID NO: 374610 - RNA, 19 nt, Homo sapiens
cagcagcaguggcggcaaa

SEQ ID NO: 374611 - RNA, 19 nt, Homo sapiens
gcccagaguuguuuguagu

SEQ ID NO: 374612 - RNA, 19 nt, Homo sapiens
caggagagaaggacuuuga

SEQ ID NO: 374613 - RNA, 19 nt, Homo sapiens
ccaauuaaauccggaacca

SEQ ID NO: 374614 - RNA, 19 nt, Homo sapiens
gggaggaguguuccaaaga

SEQ ID NO: 374615 - RNA, 19 nt, Homo sapiens
gggacaguguucacggauu

SEQ ID NO: 374616 - RNA, 19 nt, Homo sapiens
gcggcuacauccagaagau

SEQ ID NO: 374617 - RNA, 19 nt, Homo sapiens
gcagaagccauuugaagac

SEQ ID NO: 374618 - RNA, 19 nt, Homo sapiens
gcugcgaccuccagacucu

SEQ ID NO: 374619 - RNA, 19 nt, Homo sapiens
ugucacacaguauuuauug

SEQ ID NO: 374620 - RNA, 19 nt, Homo sapiens
ggagagaaggacuuugagu

SEQ ID NO: 374621 - RNA, 19 nt, Homo sapiens
acgcuucucuguucaguag

SEQ ID NO: 374622 - RNA, 19 nt, Homo sapiens
ccauuaaggaguugacuuc

SEQ ID NO: 374623 - RNA, 19 nt, Homo sapiens
guaguuaggccacgcuucu

SEQ ID NO: 374624 - RNA, 19 nt, Homo sapiens
cagaguuguuuguaguuag

SEQ ID NO: 374625 - RNA, 19 nt, Homo sapiens
gguacuacuucaaccacau

SEQ ID NO: 374626 - RNA, 19 nt, Homo sapiens
aggccacgcuucucuguuc

SEQ ID NO: 374627 - RNA, 19 nt, Homo sapiens
ggccgaggguacuacuuca

SEQ ID NO: 374628 - RNA, 19 nt, Homo sapiens
ggcccagaguuguuuguag

SEQ ID NO: 374629 - RNA, 19 nt, Homo sapiens
acaagagcgugaggaggaa

SEQ ID NO: 374630 - RNA, 19 nt, Homo sapiens
gaugagcgggacaguguuc

SEQ ID NO: 374631 - RNA, 19 nt, Homo sapiens
ucuccggccucacaauuca

SEQ ID NO: 374632 - RNA, 19 nt, Homo sapiens
gaugcgagggcccagaguu

SEQ ID NO: 374633 - RNA, 19 nt, Homo sapiens
ugcagaagccauuugaaga

SEQ ID NO: 374634 - RNA, 19 nt, Homo sapiens
gcgagggcccagaguuguu

SEQ ID NO: 374635 - RNA, 19 nt, Homo sapiens
cgagggcccagaguuguuu

SEQ ID NO: 374636 - RNA, 19 nt, Homo sapiens
ggaguguuccaaagagaag

SEQ ID NO: 374637 - RNA, 19 nt, Homo sapiens
uccagacucuccauuaagg

SEQ ID NO: 374638 - RNA, 19 nt, Homo sapiens
ggcaggagagaaggacuuu

SEQ ID NO: 374639 - RNA, 19 nt, Homo sapiens
gauggcggacgaggagaaa

SEQ ID NO: 374640 - RNA, 19 nt, Homo sapiens
gcaacaagcuuccaagaug

SEQ ID NO: 374641 - RNA, 19 nt, Homo sapiens
gauaucaacucacacuauu

SEQ ID NO: 374642 - RNA, 19 nt, Homo sapiens
gcauuugccuugccuguaa

SEQ ID NO: 374643 - RNA, 19 nt, Homo sapiens
ggaagcagauaucaacuca

SEQ ID NO: 374644 - RNA, 19 nt, Homo sapiens
gguauuagcuccacugucu

SEQ ID NO: 374645 - RNA, 19 nt, Homo sapiens
guuaugccuuucaguguua

SEQ ID NO: 374646 - RNA, 19 nt, Homo sapiens
gcuccacugucuuaacaua

SEQ ID NO: 374647 - RNA, 19 nt, Homo sapiens
gauauuggaugcuccuugu

SEQ ID NO: 374648 - RNA, 19 nt, Homo sapiens
caaauagauuaguguguga

SEQ ID NO: 374649 - RNA, 19 nt, Homo sapiens
aguguuaacuccuuucuuu

SEQ ID NO: 374650 - RNA, 19 nt, Homo sapiens
ugugaaagcucuaaguaug

SEQ ID NO: 374651 - RNA, 19 nt, Homo sapiens
ucaagcagacucccuuuaa

SEQ ID NO: 374652 - RNA, 19 nt, Homo sapiens
ugacagugcugacaagaag

SEQ ID NO: 374653 - RNA, 19 nt, Homo sapiens
guaaaggucagacacauuc

SEQ ID NO: 374654 - RNA, 19 nt, Homo sapiens
ggauaagccuguguuuaca

SEQ ID NO: 374655 - RNA, 19 nt, Homo sapiens
guuaaagucugggaugaga

SEQ ID NO: 374656 - RNA, 19 nt, Homo sapiens
aagcagauaucaacucaca

SEQ ID NO: 374657 - RNA, 19 nt, Homo sapiens
ccacugucuuaacauagua

SEQ ID NO: 374658 - RNA, 19 nt, Homo sapiens
cuaagugaaugucaacugu

SEQ ID NO: 374659 - RNA, 19 nt, Homo sapiens
gaaaauauugggcaucaaa

SEQ ID NO: 374660 - RNA, 19 nt, Homo sapiens
cagucugucccauaaauua

SEQ ID NO: 374661 - RNA, 19 nt, Homo sapiens
gugaaugucaacuguagua

SEQ ID NO: 374662 - RNA, 19 nt, Homo sapiens
uguaguagguauucaguca

SEQ ID NO: 374663 - RNA, 19 nt, Homo sapiens
ggugggaccauuucaagaa

SEQ ID NO: 374664 - RNA, 19 nt, Homo sapiens
gaacuauaucugacucuca

SEQ ID NO: 374665 - RNA, 19 nt, Homo sapiens
caaaggugguggcaaugca

SEQ ID NO: 374666 - RNA, 19 nt, Homo sapiens
cacaguauagugaagauaa

SEQ ID NO: 374667 - RNA, 19 nt, Homo sapiens
uaaagucugggaugagauu

SEQ ID NO: 374668 - RNA, 19 nt, Homo sapiens
uagcuccacugucuuaaca

SEQ ID NO: 374669 - RNA, 19 nt, Homo sapiens
uauuagcuccacugucuua

SEQ ID NO: 374670 - RNA, 19 nt, Homo sapiens
guauggguuuguaggugua

SEQ ID NO: 374671 - RNA, 19 nt, Homo sapiens
ggcaucaaauagauuagug

SEQ ID NO: 374672 - RNA, 19 nt, Homo sapiens
caagcagacucccuuuaac

SEQ ID NO: 374673 - RNA, 19 nt, Homo sapiens
gcacaguauagugaagaua

SEQ ID NO: 374674 - RNA, 19 nt, Homo sapiens
gcagauaucaacucacacu

SEQ ID NO: 374675 - RNA, 19 nt, Homo sapiens
gcaguaaaggucagacaca

SEQ ID NO: 374676 - RNA, 19 nt, Homo sapiens
uaucaacucacacuauuca

SEQ ID NO: 374677 - RNA, 19 nt, Homo sapiens
gagcugcaaggaaauacaa

SEQ ID NO: 374678 - RNA, 19 nt, Homo sapiens
ggagugacagugcugacaa

SEQ ID NO: 374679 - RNA, 19 nt, Homo sapiens
uaagugaaugucaacugua

SEQ ID NO: 374680 - RNA, 19 nt, Homo sapiens
cguuaugccuuucaguguu

SEQ ID NO: 374681 - RNA, 19 nt, Homo sapiens
ccuuuaaccuguauucucu

SEQ ID NO: 374682 - RNA, 19 nt, Homo sapiens
ucagucagucuuucucaaa

SEQ ID NO: 374683 - RNA, 19 nt, Homo sapiens
gguauucagucagucuuuc

SEQ ID NO: 374684 - RNA, 19 nt, Homo sapiens
ucccaaaggugguggcaau

SEQ ID NO: 374685 - RNA, 19 nt, Homo sapiens
gaugcuccuuguauucugu

SEQ ID NO: 374686 - RNA, 19 nt, Homo sapiens
uggauaagccuguguuuac

SEQ ID NO: 374687 - RNA, 19 nt, Homo sapiens
uuagucaacucugaucuuc

SEQ ID NO: 374688 - RNA, 19 nt, Homo sapiens
caacuguaguagguauuca

SEQ ID NO: 374689 - RNA, 19 nt, Homo sapiens
ugucaacuguaguagguau

SEQ ID NO: 374690 - RNA, 19 nt, Homo sapiens
aaugucaacuguaguaggu

SEQ ID NO: 374691 - RNA, 19 nt, Homo sapiens
agacucccuuuaaccugua

SEQ ID NO: 374692 - RNA, 19 nt, Homo sapiens
cuccuuguauucugugaaa

SEQ ID NO: 374693 - RNA, 19 nt, Homo sapiens
ggucgaaggaagaaaauaa

SEQ ID NO: 374694 - RNA, 19 nt, Homo sapiens
gauggauaagccuguguuu

SEQ ID NO: 374695 - RNA, 19 nt, Homo sapiens
gagugacagugcugacaag

SEQ ID NO: 374696 - RNA, 19 nt, Homo sapiens
gucaagcagacucccuuua

SEQ ID NO: 374697 - RNA, 19 nt, Homo sapiens
ucugugaaagcucuaagua

SEQ ID NO: 374698 - RNA, 19 nt, Homo sapiens
caggacaggugguauuagc

SEQ ID NO: 374699 - RNA, 19 nt, Homo sapiens
acacuauucacacaacuga

SEQ ID NO: 374700 - RNA, 19 nt, Homo sapiens
ggcaacaagcuuccaagau

SEQ ID NO: 374701 - RNA, 19 nt, Homo sapiens
aagugaaugucaacuguag

SEQ ID NO: 374702 - RNA, 19 nt, Homo sapiens
ggaugcuccuuguauucug

SEQ ID NO: 374703 - RNA, 19 nt, Homo sapiens
ggauggauaagccuguguu

SEQ ID NO: 374704 - RNA, 19 nt, Homo sapiens
acauguuagucaacucuga

SEQ ID NO: 374705 - RNA, 19 nt, Homo sapiens
uaaguuccuagacaacauu

SEQ ID NO: 374706 - RNA, 19 nt, Homo sapiens
uagauuagugugugagaau

SEQ ID NO: 374707 - RNA, 19 nt, Homo sapiens
uaaccuguauucucuuucc

SEQ ID NO: 374708 - RNA, 19 nt, Homo sapiens
caguaaaggucagacacau

SEQ ID NO: 374709 - RNA, 19 nt, Homo sapiens
agauaucaacucacacuau

SEQ ID NO: 374710 - RNA, 19 nt, Homo sapiens
gcuaagugaaugucaacug

SEQ ID NO: 374711 - RNA, 19 nt, Homo sapiens
gagcagccucugggaguga

SEQ ID NO: 374712 - RNA, 19 nt, Homo sapiens
gggaccauuucaagaagca

SEQ ID NO: 374713 - RNA, 19 nt, Homo sapiens
agucaacucugaucuucca

SEQ ID NO: 374714 - RNA, 19 nt, Homo sapiens
uaguagguauucagucagu

SEQ ID NO: 374715 - RNA, 19 nt, Homo sapiens
aaguuaaagucugggauga

SEQ ID NO: 374716 - RNA, 19 nt, Homo sapiens
gugggaccauuucaagaag

SEQ ID NO: 374717 - RNA, 19 nt, Homo sapiens
ggugguggcaaugcaguaa

SEQ ID NO: 374718 - RNA, 19 nt, Homo sapiens
aaaggucagacacauucua

SEQ ID NO: 374719 - RNA, 19 nt, Homo sapiens
ccuguaagugggauggaua

SEQ ID NO: 374720 - RNA, 19 nt, Homo sapiens
uuucaguguuaacuccuuu

SEQ ID NO: 374721 - RNA, 19 nt, Homo sapiens
ggaagccauggaaaaguua

SEQ ID NO: 374722 - RNA, 19 nt, Homo sapiens
gcaucaaauagauuagugu

SEQ ID NO: 374723 - RNA, 19 nt, Homo sapiens
cucagucugucccauaaau

SEQ ID NO: 374724 - RNA, 19 nt, Homo sapiens
gugaaagcucuaaguaugg

SEQ ID NO: 374725 - RNA, 19 nt, Homo sapiens
guuagucaacucugaucuu

SEQ ID NO: 374726 - RNA, 19 nt, Homo sapiens
uauuggaugcuccuuguau

SEQ ID NO: 374727 - RNA, 19 nt, Homo sapiens
gugacagugcugacaagaa

SEQ ID NO: 374728 - RNA, 19 nt, Homo sapiens
uccaggacaggugguauua

SEQ ID NO: 374729 - RNA, 19 nt, Homo sapiens
ucaacucacacuauucaca

SEQ ID NO: 374730 - RNA, 19 nt, Homo sapiens
ugacaagaaggcucaaggu

SEQ ID NO: 374731 - RNA, 19 nt, Homo sapiens
gcucuaaguauggguuugu

SEQ ID NO: 374732 - RNA, 19 nt, Homo sapiens
caaggugcauuuaacuaua

SEQ ID NO: 374733 - RNA, 19 nt, Homo sapiens
uaaagaaacuuggcuggaa

SEQ ID NO: 374734 - RNA, 19 nt, Homo sapiens
caacaaagcucaggacaac

SEQ ID NO: 374735 - RNA, 19 nt, Homo sapiens
ggacaacacucggaagauc

SEQ ID NO: 374736 - RNA, 19 nt, Homo sapiens
aaacuuggcuggaauuucu

SEQ ID NO: 374737 - RNA, 19 nt, Homo sapiens
cggaagaucauaauaaaga

SEQ ID NO: 374738 - RNA, 19 nt, Homo sapiens
aagaaugcauggugguuaa

SEQ ID NO: 374739 - RNA, 19 nt, Homo sapiens
cagcaucccucuacaaggu

SEQ ID NO: 374740 - RNA, 19 nt, Homo sapiens
gcauggugguuaaaacuua

SEQ ID NO: 374741 - RNA, 19 nt, Homo sapiens
gguuaaaacuuaccucauu

SEQ ID NO: 374742 - RNA, 19 nt, Homo sapiens
gaaagaaugcauggugguu

SEQ ID NO: 374743 - RNA, 19 nt, Homo sapiens
aaagaaacuuggcuggaau

SEQ ID NO: 374744 - RNA, 19 nt, Homo sapiens
uggaagcccugucuguuug

SEQ ID NO: 374745 - RNA, 19 nt, Homo sapiens
uuucugcuguggucuauaa

SEQ ID NO: 374746 - RNA, 19 nt, Homo sapiens
ggugauuuccucuaaagaa

SEQ ID NO: 374747 - RNA, 19 nt, Homo sapiens
gcuguggucuauaaaauaa

SEQ ID NO: 374748 - RNA, 19 nt, Homo sapiens
cucggaagaucauaauaaa

SEQ ID NO: 374749 - RNA, 19 nt, Homo sapiens
gaauuucugcuguggucua

SEQ ID NO: 374750 - RNA, 19 nt, Homo sapiens
ccaggugauuuccucuaaa

SEQ ID NO: 374751 - RNA, 19 nt, Homo sapiens
ugaugaugcugcuguaauc

SEQ ID NO: 374752 - RNA, 19 nt, Homo sapiens
aaagaaugcauggugguua

SEQ ID NO: 374753 - RNA, 19 nt, Homo sapiens
cccaggugauuuccucuaa

SEQ ID NO: 374754 - RNA, 19 nt, Homo sapiens
gcuugcaguucaaacagaa

SEQ ID NO: 374755 - RNA, 19 nt, Homo sapiens
caggugauuuccucuaaag

SEQ ID NO: 374756 - RNA, 19 nt, Homo sapiens
cuauugaaauccuaaaggu

SEQ ID NO: 374757 - RNA, 19 nt, Homo sapiens
acucggaagaucauaauaa

SEQ ID NO: 374758 - RNA, 19 nt, Homo sapiens
ggacacauugccuucuguu

SEQ ID NO: 374759 - RNA, 19 nt, Homo sapiens
uccuaaagguagaauaaug

SEQ ID NO: 374760 - RNA, 19 nt, Homo sapiens
acaaggugcauuuaacuau

SEQ ID NO: 374761 - RNA, 19 nt, Homo sapiens
gcagccgucguugauguua

SEQ ID NO: 374762 - RNA, 19 nt, Homo sapiens
uauacugccugccuaugug

SEQ ID NO: 374763 - RNA, 19 nt, Homo sapiens
ccaagucaguacguccaaa

SEQ ID NO: 374764 - RNA, 19 nt, Homo sapiens
guauacugccugccuaugu

SEQ ID NO: 374765 - RNA, 19 nt, Homo sapiens
ccaacaaagcucaggacaa

SEQ ID NO: 374766 - RNA, 19 nt, Homo sapiens
gacaacacucggaagauca

SEQ ID NO: 374767 - RNA, 19 nt, Homo sapiens
gggacacauugccuucugu

SEQ ID NO: 374768 - RNA, 19 nt, Homo sapiens
ucuacaaggugcauuuaac

SEQ ID NO: 374769 - RNA, 19 nt, Homo sapiens
caggacaacacucggaaga

SEQ ID NO: 374770 - RNA, 19 nt, Homo sapiens
uaauggaagcccugucugu

SEQ ID NO: 374771 - RNA, 19 nt, Homo sapiens
gcuguaauccccaucaaaa

SEQ ID NO: 374772 - RNA, 19 nt, Homo sapiens
uacaaggugcauuuaacua

SEQ ID NO: 374773 - RNA, 19 nt, Homo sapiens
caagucaguacguccaaau

SEQ ID NO: 374774 - RNA, 19 nt, Homo sapiens
gacacauugccuucuguuu

SEQ ID NO: 374775 - RNA, 19 nt, Homo sapiens
caaccgguuuuauacuauu

SEQ ID NO: 374776 - RNA, 19 nt, Homo sapiens
agccgucguugauguuauu

SEQ ID NO: 374777 - RNA, 19 nt, Homo sapiens
cugccuaugugacgacaau

SEQ ID NO: 374778 - RNA, 19 nt, Homo sapiens
ccucuacaaggugcauuua

SEQ ID NO: 374779 - RNA, 19 nt, Homo sapiens
gaaauccuaaagguagaau

SEQ ID NO: 374780 - RNA, 19 nt, Homo sapiens
acacauugccuucuguuuu

SEQ ID NO: 374781 - RNA, 19 nt, Homo sapiens
agucaguacguccaaauga

SEQ ID NO: 374782 - RNA, 19 nt, Homo sapiens
uugcagccgucguugaugu

SEQ ID NO: 374783 - RNA, 19 nt, Homo sapiens
ccuaaagguagaauaaugg

SEQ ID NO: 374784 - RNA, 19 nt, Homo sapiens
uugaaauccuaaagguaga

SEQ ID NO: 374785 - RNA, 19 nt, Homo sapiens
cagccgucguugauguuau

SEQ ID NO: 374786 - RNA, 19 nt, Homo sapiens
uaugugacgacaauccaaa

SEQ ID NO: 374787 - RNA, 19 nt, Homo sapiens
gcagugcuugcaguucaaa

SEQ ID NO: 374788 - RNA, 19 nt, Homo sapiens
ggaauuaagugccaugaaa

SEQ ID NO: 374789 - RNA, 19 nt, Homo sapiens
ucaaaucccuguuauguug

SEQ ID NO: 374790 - RNA, 19 nt, Homo sapiens
ggacagacaugaacauugg

SEQ ID NO: 374791 - RNA, 19 nt, Homo sapiens
gaucaagauuuccagaauu

SEQ ID NO: 374792 - RNA, 19 nt, Homo sapiens
aaauaaagguggacaauca

SEQ ID NO: 374793 - RNA, 19 nt, Homo sapiens
ccaaagaacugccaacucu

SEQ ID NO: 374794 - RNA, 19 nt, Homo sapiens
uagagaagcuagugacaaa

SEQ ID NO: 374795 - RNA, 19 nt, Homo sapiens
guaaaccacucgaucaaug

SEQ ID NO: 374796 - RNA, 19 nt, Homo sapiens
gaacaucgacgucuaugga

SEQ ID NO: 374797 - RNA, 19 nt, Homo sapiens
gaaauaccaccaguacaua

SEQ ID NO: 374798 - RNA, 19 nt, Homo sapiens
gcuacucgcuuuacagcua

SEQ ID NO: 374799 - RNA, 19 nt, Homo sapiens
acaacauccugaagaaaua

SEQ ID NO: 374800 - RNA, 19 nt, Homo sapiens
gaagaaauaccaccaguac

SEQ ID NO: 374801 - RNA, 19 nt, Homo sapiens
ucaagacuauuaccaguga

SEQ ID NO: 374802 - RNA, 19 nt, Homo sapiens
gaugccagaugacuucaaa

SEQ ID NO: 374803 - RNA, 19 nt, Homo sapiens
ugccaacucugaaagauaa

SEQ ID NO: 374804 - RNA, 19 nt, Homo sapiens
gccgagccauuucaaguuu

SEQ ID NO: 374805 - RNA, 19 nt, Homo sapiens
ucaaugaacugagccaugu

SEQ ID NO: 374806 - RNA, 19 nt, Homo sapiens
aaagaaagcugcccaugcu

SEQ ID NO: 374807 - RNA, 19 nt, Homo sapiens
ggagagguuuggaauugau

SEQ ID NO: 374808 - RNA, 19 nt, Homo sapiens
gugaagacguggccgaaau

SEQ ID NO: 374809 - RNA, 19 nt, Homo sapiens
aaagauacaucaucaagac

SEQ ID NO: 374810 - RNA, 19 nt, Homo sapiens
cgggagagguuuggaauug

SEQ ID NO: 374811 - RNA, 19 nt, Homo sapiens
gagaagcuagugacaaaga

SEQ ID NO: 374812 - RNA, 19 nt, Homo sapiens
ggaguugaaauauauguga

SEQ ID NO: 374813 - RNA, 19 nt, Homo sapiens
ggaagcaaaccuccuuguu

SEQ ID NO: 374814 - RNA, 19 nt, Homo sapiens
gauacaucaucaagacuau

SEQ ID NO: 374815 - RNA, 19 nt, Homo sapiens
aggccaagaugacugauuu

SEQ ID NO: 374816 - RNA, 19 nt, Homo sapiens
gcaagaccaagaccaagaa

SEQ ID NO: 374817 - RNA, 19 nt, Homo sapiens
gcauguaccggcuuaaugu

SEQ ID NO: 374818 - RNA, 19 nt, Homo sapiens
ugacauccuuacucauuau

SEQ ID NO: 374819 - RNA, 19 nt, Homo sapiens
cgacgucuauggaauuaag

SEQ ID NO: 374820 - RNA, 19 nt, Homo sapiens
cgagccauuucaaguuuaa

SEQ ID NO: 374821 - RNA, 19 nt, Homo sapiens
gaagcuagugacaaagaaa

SEQ ID NO: 374822 - RNA, 19 nt, Homo sapiens
gcacaacauccugaagaaa

SEQ ID NO: 374823 - RNA, 19 nt, Homo sapiens
guucaaaucccuguuaugu

SEQ ID NO: 374824 - RNA, 19 nt, Homo sapiens
cuuuacagcuaccugauuu

SEQ ID NO: 374825 - RNA, 19 nt, Homo sapiens
gacaaaagauacaucauca

SEQ ID NO: 374826 - RNA, 19 nt, Homo sapiens
gggagagguuuggaauuga

SEQ ID NO: 374827 - RNA, 19 nt, Homo sapiens
gcagaaagugaagcuguuu

SEQ ID NO: 374828 - RNA, 19 nt, Homo sapiens
uaauguugauggaguugaa

SEQ ID NO: 374829 - RNA, 19 nt, Homo sapiens
ugaucaagauuuccagaau

SEQ ID NO: 374830 - RNA, 19 nt, Homo sapiens
aaaccaaacucagugaagu

SEQ ID NO: 374831 - RNA, 19 nt, Homo sapiens
caaacucagugaaguacuc

SEQ ID NO: 374832 - RNA, 19 nt, Homo sapiens
ggacuuuauuggccacauc

SEQ ID NO: 374833 - RNA, 19 nt, Homo sapiens
aaagaacugccaacucuga

SEQ ID NO: 374834 - RNA, 19 nt, Homo sapiens
agaccaagaccaagaagaa

SEQ ID NO: 374835 - RNA, 19 nt, Homo sapiens
uugacauccuuacucauua

SEQ ID NO: 374836 - RNA, 19 nt, Homo sapiens
gcccgauggucuuccguaa

SEQ ID NO: 374837 - RNA, 19 nt, Homo sapiens
gaacugccaacucugaaag

SEQ ID NO: 374838 - RNA, 19 nt, Homo sapiens
cagauccacuucggucaaa

SEQ ID NO: 374839 - RNA, 19 nt, Homo sapiens
aggaggaaguggaguguga

SEQ ID NO: 374840 - RNA, 19 nt, Homo sapiens
cauguucaaaucccuguua

SEQ ID NO: 374841 - RNA, 19 nt, Homo sapiens
ucagugaaguacucaucuu

SEQ ID NO: 374842 - RNA, 19 nt, Homo sapiens
ggugggaauucaugaugug

SEQ ID NO: 374843 - RNA, 19 nt, Homo sapiens
uaaaccacucgaucaauga

SEQ ID NO: 374844 - RNA, 19 nt, Homo sapiens
agaaauaccaccaguacau

SEQ ID NO: 374845 - RNA, 19 nt, Homo sapiens
ugaagaaauaccaccagua

SEQ ID NO: 374846 - RNA, 19 nt, Homo sapiens
ccgagccauuucaaguuua

SEQ ID NO: 374847 - RNA, 19 nt, Homo sapiens
uuauugacauccuuacuca

SEQ ID NO: 374848 - RNA, 19 nt, Homo sapiens
guacuucauggcaauuauu

SEQ ID NO: 374849 - RNA, 19 nt, Homo sapiens
caugaaaacucgccuagga

SEQ ID NO: 374850 - RNA, 19 nt, Homo sapiens
cacaacauccugaagaaau

SEQ ID NO: 374851 - RNA, 19 nt, Homo sapiens
gaaaacaugccgagccauu

SEQ ID NO: 374852 - RNA, 19 nt, Homo sapiens
gugaaguacucaucuugca

SEQ ID NO: 374853 - RNA, 19 nt, Homo sapiens
gaacccagaacaguauuca

SEQ ID NO: 374854 - RNA, 19 nt, Homo sapiens
gcuuaauguugauggaguu

SEQ ID NO: 374855 - RNA, 19 nt, Homo sapiens
ucacacuuccuacgacaaa

SEQ ID NO: 374856 - RNA, 19 nt, Homo sapiens
caucgacgucuauggaauu

SEQ ID NO: 374857 - RNA, 19 nt, Homo sapiens
caacucugaaagauaauga

SEQ ID NO: 374858 - RNA, 19 nt, Homo sapiens
ggccacaucuugacguaac

SEQ ID NO: 374859 - RNA, 19 nt, Homo sapiens
uaggaaauacgacuuaaag

SEQ ID NO: 374860 - RNA, 19 nt, Homo sapiens
uguaccggcuuaauguuga

SEQ ID NO: 374861 - RNA, 19 nt, Homo sapiens
agaagcuagugacaaagaa

SEQ ID NO: 374862 - RNA, 19 nt, Homo sapiens
gcacuucguagcgcagaaa

SEQ ID NO: 374863 - RNA, 19 nt, Homo sapiens
agagguggcuucgguguag

SEQ ID NO: 374864 - RNA, 19 nt, Homo sapiens
ccagaacaguauucaaagc

SEQ ID NO: 374865 - RNA, 19 nt, Homo sapiens
aaacaugccgagccauuuc

SEQ ID NO: 374866 - RNA, 19 nt, Homo sapiens
cuucaaagccuauucaaaa

SEQ ID NO: 374867 - RNA, 19 nt, Homo sapiens
guuugucuguguauaggaa

SEQ ID NO: 374868 - RNA, 19 nt, Homo sapiens
ugcacaacauccugaagaa

SEQ ID NO: 374869 - RNA, 19 nt, Homo sapiens
cgcagaaagugaagcuguu

SEQ ID NO: 374870 - RNA, 19 nt, Homo sapiens
uuauguugaugccagauga

SEQ ID NO: 374871 - RNA, 19 nt, Homo sapiens
gaauuaagugccaugaaaa

SEQ ID NO: 374872 - RNA, 19 nt, Homo sapiens
caaagaaaaggccaaagaa

SEQ ID NO: 374873 - RNA, 19 nt, Homo sapiens
cgagcaagaccaagaccaa

SEQ ID NO: 374874 - RNA, 19 nt, Homo sapiens
acccagaacaguauucaaa

SEQ ID NO: 374875 - RNA, 19 nt, Homo sapiens
guauucagccaccguuugu

SEQ ID NO: 374876 - RNA, 19 nt, Homo sapiens
ggguaaaccacucgaucaa

SEQ ID NO: 374877 - RNA, 19 nt, Homo sapiens
agauacaucaucaagacua

SEQ ID NO: 374878 - RNA, 19 nt, Homo sapiens
gagccgaacaggaggaagu

SEQ ID NO: 374879 - RNA, 19 nt, Homo sapiens
guugauggaguugaaauau

SEQ ID NO: 374880 - RNA, 19 nt, Homo sapiens
caugggaucacccuucuuc

SEQ ID NO: 374881 - RNA, 19 nt, Homo sapiens
aucaagauuuccagaauuc

SEQ ID NO: 374882 - RNA, 19 nt, Homo sapiens
gguaaaccacucgaucaau

SEQ ID NO: 374883 - RNA, 19 nt, Homo sapiens
cuaggaaggagguguacuu

SEQ ID NO: 374884 - RNA, 19 nt, Homo sapiens
aaaaggauguugaguuucu

SEQ ID NO: 374885 - RNA, 19 nt, Homo sapiens
acugagccauguucaaauc

SEQ ID NO: 374886 - RNA, 19 nt, Homo sapiens
aaccaaacucagugaagua

SEQ ID NO: 374887 - RNA, 19 nt, Homo sapiens
ggcauguaccggcuuaaug

SEQ ID NO: 374888 - RNA, 19 nt, Homo sapiens
gcagaaccguuauuacaaa

SEQ ID NO: 374889 - RNA, 19 nt, Homo sapiens
caagagaggcgucuguuua

SEQ ID NO: 374890 - RNA, 19 nt, Homo sapiens
cagaaggacugcccauaua

SEQ ID NO: 374891 - RNA, 19 nt, Homo sapiens
gaaccguuauuacaaauga

SEQ ID NO: 374892 - RNA, 19 nt, Homo sapiens
uagaugcccuucaguauug

SEQ ID NO: 374893 - RNA, 19 nt, Homo sapiens
gagcagagcacgacgaaga

SEQ ID NO: 374894 - RNA, 19 nt, Homo sapiens
agagacagcuggaugaaau

SEQ ID NO: 374895 - RNA, 19 nt, Homo sapiens
caaaugaguacaugaaaga

SEQ ID NO: 374896 - RNA, 19 nt, Homo sapiens
ugaaugagcccuacgagaa

SEQ ID NO: 374897 - RNA, 19 nt, Homo sapiens
cguggaagccguauauaua

SEQ ID NO: 374898 - RNA, 19 nt, Homo sapiens
gagcaaaguacccacguuu

SEQ ID NO: 374899 - RNA, 19 nt, Homo sapiens
caaggaguaucgaguaauc

SEQ ID NO: 374900 - RNA, 19 nt, Homo sapiens
cgagauacguggcguguag

SEQ ID NO: 374901 - RNA, 19 nt, Homo sapiens
gcucaaggaguaucgagua

SEQ ID NO: 374902 - RNA, 19 nt, Homo sapiens
gcaagagaggcgucuguuu

SEQ ID NO: 374903 - RNA, 19 nt, Homo sapiens
gcuccacccucccaaguga

SEQ ID NO: 374904 - RNA, 19 nt, Homo sapiens
gcaagacaguggucaacag

SEQ ID NO: 374905 - RNA, 19 nt, Homo sapiens
gaacuucauccauaagcaa

SEQ ID NO: 374906 - RNA, 19 nt, Homo sapiens
ggacugcccauauaugugu

SEQ ID NO: 374907 - RNA, 19 nt, Homo sapiens
gaaggacugcccauauaug

SEQ ID NO: 374908 - RNA, 19 nt, Homo sapiens
cgagaaggacggugagaaa

SEQ ID NO: 374909 - RNA, 19 nt, Homo sapiens
agacaguggucaacaggaa

SEQ ID NO: 374910 - RNA, 19 nt, Homo sapiens
caaccuuuauuuccaagug

SEQ ID NO: 374911 - RNA, 19 nt, Homo sapiens
gaagagacagcuggaugaa

SEQ ID NO: 374912 - RNA, 19 nt, Homo sapiens
agaggcgucuguuuacaaa

SEQ ID NO: 374913 - RNA, 19 nt, Homo sapiens
ccagaaggacugcccauau

SEQ ID NO: 374914 - RNA, 19 nt, Homo sapiens
ggaagacccagcaaaauuu

SEQ ID NO: 374915 - RNA, 19 nt, Homo sapiens
aaugacagcagaugacuaa

SEQ ID NO: 374916 - RNA, 19 nt, Homo sapiens
cgaagagacagcuggauga

SEQ ID NO: 374917 - RNA, 19 nt, Homo sapiens
ggguugaccugaccaugga

SEQ ID NO: 374918 - RNA, 19 nt, Homo sapiens
cgaguaauccugccugugu

SEQ ID NO: 374919 - RNA, 19 nt, Homo sapiens
gacagcagaugacuaaagc

SEQ ID NO: 374920 - RNA, 19 nt, Homo sapiens
ucuguuggcucgauaagug

SEQ ID NO: 374921 - RNA, 19 nt, Homo sapiens
gagaggcgucuguuuacaa

SEQ ID NO: 374922 - RNA, 19 nt, Homo sapiens
gaagacccagcaaaauuua

SEQ ID NO: 374923 - RNA, 19 nt, Homo sapiens
uggagguccuggugaauga

SEQ ID NO: 374924 - RNA, 19 nt, Homo sapiens
acaaaugaguacaugaaag

SEQ ID NO: 374925 - RNA, 19 nt, Homo sapiens
gaaugagcccuacgagaag

SEQ ID NO: 374926 - RNA, 19 nt, Homo sapiens
cuagaugcccuucaguauu

SEQ ID NO: 374927 - RNA, 19 nt, Homo sapiens
gaaugacagcagaugacua

SEQ ID NO: 374928 - RNA, 19 nt, Homo sapiens
gaagccguauauauagaca

SEQ ID NO: 374929 - RNA, 19 nt, Homo sapiens
cagaaccguuauuacaaau

SEQ ID NO: 374930 - RNA, 19 nt, Homo sapiens
gcguggagguccuggugaa

SEQ ID NO: 374931 - RNA, 19 nt, Homo sapiens
acagcuggaugaaaugaga

SEQ ID NO: 374932 - RNA, 19 nt, Homo sapiens
gcaggagaaugugcauaag

SEQ ID NO: 374933 - RNA, 19 nt, Homo sapiens
guacccacguuuguucgaa

SEQ ID NO: 374934 - RNA, 19 nt, Homo sapiens
cguguagguugcuguaguu

SEQ ID NO: 374935 - RNA, 19 nt, Homo sapiens
gaaaggaaugacagcagau

SEQ ID NO: 374936 - RNA, 19 nt, Homo sapiens
uggaagccguauauauaga

SEQ ID NO: 374937 - RNA, 19 nt, Homo sapiens
gcguguagguugcuguagu

SEQ ID NO: 374938 - RNA, 19 nt, Homo sapiens
uacuguagcuaauucuaga

SEQ ID NO: 374939 - RNA, 19 nt, Homo sapiens
augaguacaugaaagaaga

SEQ ID NO: 374940 - RNA, 19 nt, Homo sapiens
acacguggaagccguauau

SEQ ID NO: 374941 - RNA, 19 nt, Homo sapiens
cgcaggagaaugugcauaa

SEQ ID NO: 374942 - RNA, 19 nt, Homo sapiens
cucaaggaguaucgaguaa

SEQ ID NO: 374943 - RNA, 19 nt, Homo sapiens
guggaagccguauauauag

SEQ ID NO: 374944 - RNA, 19 nt, Homo sapiens
acauggugcugcucaagga

SEQ ID NO: 374945 - RNA, 19 nt, Homo sapiens
cugcagaaccguuauuaca

SEQ ID NO: 374946 - RNA, 19 nt, Homo sapiens
agccguauauauagacauu

SEQ ID NO: 374947 - RNA, 19 nt, Homo sapiens
uuacagcgccuccgucucu

SEQ ID NO: 374948 - RNA, 19 nt, Homo sapiens
agaaggacugcccauauau

SEQ ID NO: 374949 - RNA, 19 nt, Homo sapiens
aaaguacccacguuuguuc

SEQ ID NO: 374950 - RNA, 19 nt, Homo sapiens
ugacagcagaugacuaaag

SEQ ID NO: 374951 - RNA, 19 nt, Homo sapiens
ggauuacaaggcagaggaa

SEQ ID NO: 374952 - RNA, 19 nt, Homo sapiens
ugagaaaggccaguacaca

SEQ ID NO: 374953 - RNA, 19 nt, Homo sapiens
ucuagaugcccuucaguau

SEQ ID NO: 374954 - RNA, 19 nt, Homo sapiens
ucaggcaacuuucgauucc

SEQ ID NO: 374955 - RNA, 19 nt, Homo sapiens
agaaaggccaguacacaca

SEQ ID NO: 374956 - RNA, 19 nt, Homo sapiens
cagaggaagacccagcaaa

SEQ ID NO: 374957 - RNA, 19 nt, Homo sapiens
gagaaggacggugagaaag

SEQ ID NO: 374958 - RNA, 19 nt, Homo sapiens
ggagaacuucauccauaag

SEQ ID NO: 374959 - RNA, 19 nt, Homo sapiens
agagcaaaguacccacguu

SEQ ID NO: 374960 - RNA, 19 nt, Homo sapiens
aauccugccugugucugua

SEQ ID NO: 374961 - RNA, 19 nt, Homo sapiens
gcucagcaaggauuacaag

SEQ ID NO: 374962 - RNA, 19 nt, Homo sapiens
cgagaaagccuggaaugcu

SEQ ID NO: 374963 - RNA, 19 nt, Homo sapiens
guucugugcccauucuuca

SEQ ID NO: 374964 - RNA, 19 nt, Homo sapiens
ccaccugcagagcaaagua

SEQ ID NO: 374965 - RNA, 19 nt, Homo sapiens
ucuaccaccugcagagcaa

SEQ ID NO: 374966 - RNA, 19 nt, Homo sapiens
uauagacauugcagaucga

SEQ ID NO: 374967 - RNA, 19 nt, Homo sapiens
ggcaacuuucgauuccuua

SEQ ID NO: 374968 - RNA, 19 nt, Homo sapiens
gcagaggaagacccagcaa

SEQ ID NO: 374969 - RNA, 19 nt, Homo sapiens
cuccgucucucuccauugu

SEQ ID NO: 374970 - RNA, 19 nt, Homo sapiens
gcgacauggugcugcucaa

SEQ ID NO: 374971 - RNA, 19 nt, Homo sapiens
ccaagugacaggccauuuu

SEQ ID NO: 374972 - RNA, 19 nt, Homo sapiens
ggaaugacagcagaugacu

SEQ ID NO: 374973 - RNA, 19 nt, Homo sapiens
ggacccagugaaaggaaug

SEQ ID NO: 374974 - RNA, 19 nt, Homo sapiens
acaaaaggacccagugaaa

SEQ ID NO: 374975 - RNA, 19 nt, Homo sapiens
gagacagcuggaugaaaug

SEQ ID NO: 374976 - RNA, 19 nt, Homo sapiens
auugaaaccuggcacaaac

SEQ ID NO: 374977 - RNA, 19 nt, Homo sapiens
ugcagaaccguuauuacaa

SEQ ID NO: 374978 - RNA, 19 nt, Homo sapiens
aggcaacuuucgauuccuu

SEQ ID NO: 374979 - RNA, 19 nt, Homo sapiens
agagaggcgucuguuuaca

SEQ ID NO: 374980 - RNA, 19 nt, Homo sapiens
acacggagcugccagagaa

SEQ ID NO: 374981 - RNA, 19 nt, Homo sapiens
ccaaacagcacucgucguu

SEQ ID NO: 374982 - RNA, 19 nt, Homo sapiens
ggagguccaucucagaaca

SEQ ID NO: 374983 - RNA, 19 nt, Homo sapiens
ggacugacuguaauaaauc

SEQ ID NO: 374984 - RNA, 19 nt, Homo sapiens
ggagaaaagugccgcgaaa

SEQ ID NO: 374985 - RNA, 19 nt, Homo sapiens
gugcgggucugguucaaga

SEQ ID NO: 374986 - RNA, 19 nt, Homo sapiens
ggccuggacuugccuagga

SEQ ID NO: 374987 - RNA, 19 nt, Homo sapiens
ugugcgcgcugucgcuuua

SEQ ID NO: 374988 - RNA, 19 nt, Homo sapiens
uggacugacuguaauaaau

SEQ ID NO: 374989 - RNA, 19 nt, Homo sapiens
uauguuggacugacuguaa

SEQ ID NO: 374990 - RNA, 19 nt, Homo sapiens
cagcgucccuguguauguu

SEQ ID NO: 374991 - RNA, 19 nt, Homo sapiens
caacguacgcacuucacaa

SEQ ID NO: 374992 - RNA, 19 nt, Homo sapiens
ggcguaagcgcgagcguaa

SEQ ID NO: 374993 - RNA, 19 nt, Homo sapiens
gagcuucaccuucuucaac

SEQ ID NO: 374994 - RNA, 19 nt, Homo sapiens
caagccagcaguugcaaga

SEQ ID NO: 374995 - RNA, 19 nt, Homo sapiens
gcaguucagcggccuagug

SEQ ID NO: 374996 - RNA, 19 nt, Homo sapiens
uggaugaguugcaauuucu

SEQ ID NO: 374997 - RNA, 19 nt, Homo sapiens
accaagagcuucaccuucu

SEQ ID NO: 374998 - RNA, 19 nt, Homo sapiens
gcagacgacccagccaaga

SEQ ID NO: 374999 - RNA, 19 nt, Homo sapiens
aaauggaugaguugcaauu

SEQ ID NO: 375000 - RNA, 19 nt, Homo sapiens
ggacuugccuaggauuucc

SEQ ID NO: 375001 - RNA, 19 nt, Homo sapiens
cagacgacccagccaagaa

SEQ ID NO: 375002 - RNA, 19 nt, Homo sapiens
ucaacaacaucaacaaccu

SEQ ID NO: 375003 - RNA, 19 nt, Homo sapiens
ccaccaagagcuucaccuu

SEQ ID NO: 375004 - RNA, 19 nt, Homo sapiens
gacugacuguaauaaaucu

SEQ ID NO: 375005 - RNA, 19 nt, Homo sapiens
ccggagcccuauauuaagg

SEQ ID NO: 375006 - RNA, 19 nt, Homo sapiens
guggcuacgugccgcaguu

SEQ ID NO: 375007 - RNA, 19 nt, Homo sapiens
acucgggccucaacaacau

SEQ ID NO: 375008 - RNA, 19 nt, Homo sapiens
ccaacucgggccucaacaa

SEQ ID NO: 375009 - RNA, 19 nt, Homo sapiens
ucacaagccagcaguugca

SEQ ID NO: 375010 - RNA, 19 nt, Homo sapiens
gcaacguacgcacuucaca

SEQ ID NO: 375011 - RNA, 19 nt, Homo sapiens
caacucgggccucaacaac

SEQ ID NO: 375012 - RNA, 19 nt, Homo sapiens
ccucaacgcgugccaguac

SEQ ID NO: 375013 - RNA, 19 nt, Homo sapiens
gccugcggcucaaguccaa

SEQ ID NO: 375014 - RNA, 19 nt, Homo sapiens
agagagagcuccuuugauu

SEQ ID NO: 375015 - RNA, 19 nt, Homo sapiens
caaccuacccuguguauaa

SEQ ID NO: 375016 - RNA, 19 nt, Homo sapiens
gagaagcuauauagagaaa

SEQ ID NO: 375017 - RNA, 19 nt, Homo sapiens
ggaaaccacugaaucaaag

SEQ ID NO: 375018 - RNA, 19 nt, Homo sapiens
ggcguuagcuuuccuuauu

SEQ ID NO: 375019 - RNA, 19 nt, Homo sapiens
ggacacauacacaaacaaa

SEQ ID NO: 375020 - RNA, 19 nt, Homo sapiens
aagagaagcuauauagaga

SEQ ID NO: 375021 - RNA, 19 nt, Homo sapiens
gaagccugcucccuaaaga

SEQ ID NO: 375022 - RNA, 19 nt, Homo sapiens
gcaaggacacauacacaaa

SEQ ID NO: 375023 - RNA, 19 nt, Homo sapiens
gaaagagaagcuauauaga

SEQ ID NO: 375024 - RNA, 19 nt, Homo sapiens
gagagaaagagaagcuaua

SEQ ID NO: 375025 - RNA, 19 nt, Homo sapiens
caacuccgcccuugaaaga

SEQ ID NO: 375026 - RNA, 19 nt, Homo sapiens
ucaaagggauguccucagu

SEQ ID NO: 375027 - RNA, 19 nt, Homo sapiens
gagaaagagaagcuauaua

SEQ ID NO: 375028 - RNA, 19 nt, Homo sapiens
caagggaguguauauacua

SEQ ID NO: 375029 - RNA, 19 nt, Homo sapiens
gagcaagggaguguauaua

SEQ ID NO: 375030 - RNA, 19 nt, Homo sapiens
gaaagggagagaaagagaa

SEQ ID NO: 375031 - RNA, 19 nt, Homo sapiens
cgacuccuccguauguuua

SEQ ID NO: 375032 - RNA, 19 nt, Homo sapiens
ucaacagccugaauaacuu

SEQ ID NO: 375033 - RNA, 19 nt, Homo sapiens
gggaguguauauacuaaau

SEQ ID NO: 375034 - RNA, 19 nt, Homo sapiens
gcaagggaguguauauacu

SEQ ID NO: 375035 - RNA, 19 nt, Homo sapiens
agaaagagaagcuauauag

SEQ ID NO: 375036 - RNA, 19 nt, Homo sapiens
gaucuaauaucaccuaccu

SEQ ID NO: 375037 - RNA, 19 nt, Homo sapiens
ugacugaaaggauguauau

SEQ ID NO: 375038 - RNA, 19 nt, Homo sapiens
aaagggauguccucagugu

SEQ ID NO: 375039 - RNA, 19 nt, Homo sapiens
gagagagcuccuuugauuu

SEQ ID NO: 375040 - RNA, 19 nt, Homo sapiens
cuaaagaaagggagagaaa

SEQ ID NO: 375041 - RNA, 19 nt, Homo sapiens
cuugaaagacugggaauua

SEQ ID NO: 375042 - RNA, 19 nt, Homo sapiens
gaggacccgucuaagaaga

SEQ ID NO: 375043 - RNA, 19 nt, Homo sapiens
cagcuuggcuugagaacuc

SEQ ID NO: 375044 - RNA, 19 nt, Homo sapiens
acacauacacaaacaaaug

SEQ ID NO: 375045 - RNA, 19 nt, Homo sapiens
aaaggaaaccacugaauca

SEQ ID NO: 375046 - RNA, 19 nt, Homo sapiens
aaagaaagggagagaaaga

SEQ ID NO: 375047 - RNA, 19 nt, Homo sapiens
ggagggagggagagaagaa

SEQ ID NO: 375048 - RNA, 19 nt, Homo sapiens
ccugagugcuugccaguau

SEQ ID NO: 375049 - RNA, 19 nt, Homo sapiens
gcaguucaaugggcucaug

SEQ ID NO: 375050 - RNA, 19 nt, Homo sapiens
gacuggauaugacauuuua

SEQ ID NO: 375051 - RNA, 19 nt, Homo sapiens
cuacaaguauuucuaacag

SEQ ID NO: 375052 - RNA, 19 nt, Homo sapiens
gaaagacugggaauuaugc

SEQ ID NO: 375053 - RNA, 19 nt, Homo sapiens
ugacaucuuucacuacaag

SEQ ID NO: 375054 - RNA, 19 nt, Homo sapiens
ggagagaaagagaagcuau

SEQ ID NO: 375055 - RNA, 19 nt, Homo sapiens
gaguguauauacuaaaugc

SEQ ID NO: 375056 - RNA, 19 nt, Homo sapiens
gcguuagcuuuccuuauug

SEQ ID NO: 375057 - RNA, 19 nt, Homo sapiens
aaagagaagcuauauagag

SEQ ID NO: 375058 - RNA, 19 nt, Homo sapiens
gaaggucgugggcacuaaa

SEQ ID NO: 375059 - RNA, 19 nt, Homo sapiens
ccgaggacccgucuaagaa

SEQ ID NO: 375060 - RNA, 19 nt, Homo sapiens
gcaguuguuaguaauauca

SEQ ID NO: 375061 - RNA, 19 nt, Homo sapiens
gccgagcuaugcaagaaug

SEQ ID NO: 375062 - RNA, 19 nt, Homo sapiens
gaugcaaugauguuucuga

SEQ ID NO: 375063 - RNA, 19 nt, Homo sapiens
cgacauguacccaggcuau

SEQ ID NO: 375064 - RNA, 19 nt, Homo sapiens
aagggaguguauauacuaa

SEQ ID NO: 375065 - RNA, 19 nt, Homo sapiens
cggcagcggacucacuuua

SEQ ID NO: 375066 - RNA, 19 nt, Homo sapiens
uaaaugccacacuguaugu

SEQ ID NO: 375067 - RNA, 19 nt, Homo sapiens
cagaagcgauuaggauuuu

SEQ ID NO: 375068 - RNA, 19 nt, Homo sapiens
gagagcuccuuugauuuca

SEQ ID NO: 375069 - RNA, 19 nt, Homo sapiens
agagagcuccuuugauuuc

SEQ ID NO: 375070 - RNA, 19 nt, Homo sapiens
ggucgugggcacuaaagaa

SEQ ID NO: 375071 - RNA, 19 nt, Homo sapiens
gccugagacugaaagcaaa

SEQ ID NO: 375072 - RNA, 19 nt, Homo sapiens
uuggaagccugcucccuaa

SEQ ID NO: 375073 - RNA, 19 nt, Homo sapiens
gaaaccacugaaucaaaga

SEQ ID NO: 375074 - RNA, 19 nt, Homo sapiens
caucccaugucuucguuug

SEQ ID NO: 375075 - RNA, 19 nt, Homo sapiens
gaagcuauauagagaaaag

SEQ ID NO: 375076 - RNA, 19 nt, Homo sapiens
ugaaagacugggaauuaug

SEQ ID NO: 375077 - RNA, 19 nt, Homo sapiens
uugaaagacugggaauuau

SEQ ID NO: 375078 - RNA, 19 nt, Homo sapiens
caacagccugaauaacuug

SEQ ID NO: 375079 - RNA, 19 nt, Homo sapiens
caagaaucgucgggccaaa

SEQ ID NO: 375080 - RNA, 19 nt, Homo sapiens
ccacacuguauguuucuaa

SEQ ID NO: 375081 - RNA, 19 nt, Homo sapiens
acagaagcgauuaggauuu

SEQ ID NO: 375082 - RNA, 19 nt, Homo sapiens
ccacucuuguuucgcuuug

SEQ ID NO: 375083 - RNA, 19 nt, Homo sapiens
ucugacaucuuucacuaca

SEQ ID NO: 375084 - RNA, 19 nt, Homo sapiens
ugaauaacuugaacaaccu

SEQ ID NO: 375085 - RNA, 19 nt, Homo sapiens
gccgaggacccgucuaaga

SEQ ID NO: 375086 - RNA, 19 nt, Homo sapiens
cuaaaugccacacuguaug

SEQ ID NO: 375087 - RNA, 19 nt, Homo sapiens
ggaagccugcucccuaaag

SEQ ID NO: 375088 - RNA, 19 nt, Homo sapiens
aguaauaucacaacagugu

SEQ ID NO: 375089 - RNA, 19 nt, Homo sapiens
caaguauuucuaacaguug

SEQ ID NO: 375090 - RNA, 19 nt, Homo sapiens
ccacugaaucaaagagaga

SEQ ID NO: 375091 - RNA, 19 nt, Homo sapiens
ucaacucuaugaacgucaa

SEQ ID NO: 375092 - RNA, 19 nt, Homo sapiens
uacccuguguauaacauuu

SEQ ID NO: 375093 - RNA, 19 nt, Homo sapiens
aaacugcuauguacaaccu

SEQ ID NO: 375094 - RNA, 19 nt, Homo sapiens
gaaaaggaaaccacugaau

SEQ ID NO: 375095 - RNA, 19 nt, Homo sapiens
gagaaaaggaaaccacuga

SEQ ID NO: 375096 - RNA, 19 nt, Homo sapiens
gacugggaauuaugcuaga

SEQ ID NO: 375097 - RNA, 19 nt, Homo sapiens
uguacaaccuacccugugu

SEQ ID NO: 375098 - RNA, 19 nt, Homo sapiens
ggaguguauauacuaaaug

SEQ ID NO: 375099 - RNA, 19 nt, Homo sapiens
cgagcaagggaguguauau

SEQ ID NO: 375100 - RNA, 19 nt, Homo sapiens
ggucuuugcccacucuugu

SEQ ID NO: 375101 - RNA, 19 nt, Homo sapiens
agagaaagagaagcuauau

SEQ ID NO: 375102 - RNA, 19 nt, Homo sapiens
ccaacucuaucucguccau

SEQ ID NO: 375103 - RNA, 19 nt, Homo sapiens
gcuguguggaccaaccuua

SEQ ID NO: 375104 - RNA, 19 nt, Homo sapiens
uacagaagcgauuaggauu

SEQ ID NO: 375105 - RNA, 19 nt, Homo sapiens
agaaggucgugggcacuaa

SEQ ID NO: 375106 - RNA, 19 nt, Homo sapiens
agucucaacagccugaaua

SEQ ID NO: 375107 - RNA, 19 nt, Homo sapiens
gggcaguagccaaggacua

SEQ ID NO: 375108 - RNA, 19 nt, Homo sapiens
auacagaagcgauuaggau

SEQ ID NO: 375109 - RNA, 19 nt, Homo sapiens
uaaaugacugaaaggaugu

SEQ ID NO: 375110 - RNA, 19 nt, Homo sapiens
aaggacacauacacaaaca

SEQ ID NO: 375111 - RNA, 19 nt, Homo sapiens
acaguugcaaggacacaua

SEQ ID NO: 375112 - RNA, 19 nt, Homo sapiens
caucuuucacuacaaguau

SEQ ID NO: 375113 - RNA, 19 nt, Homo sapiens
aggaaaccacugaaucaaa

SEQ ID NO: 375114 - RNA, 19 nt, Homo sapiens
agagagagcuccuuugauu

SEQ ID NO: 375115 - RNA, 19 nt, Homo sapiens
caaccuacccuguguauaa

SEQ ID NO: 375116 - RNA, 19 nt, Homo sapiens
gagaagcuauauagagaaa

SEQ ID NO: 375117 - RNA, 19 nt, Homo sapiens
ggaaaccacugaaucaaag

SEQ ID NO: 375118 - RNA, 19 nt, Homo sapiens
caaagacuccgaaaucaaa

SEQ ID NO: 375119 - RNA, 19 nt, Homo sapiens
gaaugucucuucuccaaag

SEQ ID NO: 375120 - RNA, 19 nt, Homo sapiens
ggacacauacacaaacaaa

SEQ ID NO: 375121 - RNA, 19 nt, Homo sapiens
aagagaagcuauauagaga

SEQ ID NO: 375122 - RNA, 19 nt, Homo sapiens
gcaaggacacauacacaaa

SEQ ID NO: 375123 - RNA, 19 nt, Homo sapiens
gaaagagaagcuauauaga

SEQ ID NO: 375124 - RNA, 19 nt, Homo sapiens
gagagaaagagaagcuaua

SEQ ID NO: 375125 - RNA, 19 nt, Homo sapiens
caacuccgcccuugaaaga

SEQ ID NO: 375126 - RNA, 19 nt, Homo sapiens
ucaaagggauguccucagu

SEQ ID NO: 375127 - RNA, 19 nt, Homo sapiens
gagaaagagaagcuauaua

SEQ ID NO: 375128 - RNA, 19 nt, Homo sapiens
caagggaguguauauacua

SEQ ID NO: 375129 - RNA, 19 nt, Homo sapiens
gagcaagggaguguauaua

SEQ ID NO: 375130 - RNA, 19 nt, Homo sapiens
gaaagggagagaaagagaa

SEQ ID NO: 375131 - RNA, 19 nt, Homo sapiens
cgacuccuccguauguuua

SEQ ID NO: 375132 - RNA, 19 nt, Homo sapiens
ucaacagccugaauaacuu

SEQ ID NO: 375133 - RNA, 19 nt, Homo sapiens
gggaguguauauacuaaau

SEQ ID NO: 375134 - RNA, 19 nt, Homo sapiens
gcaagggaguguauauacu

SEQ ID NO: 375135 - RNA, 19 nt, Homo sapiens
agaaagagaagcuauauag

SEQ ID NO: 375136 - RNA, 19 nt, Homo sapiens
ugacugaaaggauguauau

SEQ ID NO: 375137 - RNA, 19 nt, Homo sapiens
aaagggauguccucagugu

SEQ ID NO: 375138 - RNA, 19 nt, Homo sapiens
gagagagcuccuuugauuu

SEQ ID NO: 375139 - RNA, 19 nt, Homo sapiens
cuaaagaaagggagagaaa

SEQ ID NO: 375140 - RNA, 19 nt, Homo sapiens
cuugaaagacugggaauua

SEQ ID NO: 375141 - RNA, 19 nt, Homo sapiens
gaggacccgucuaagaaga

SEQ ID NO: 375142 - RNA, 19 nt, Homo sapiens
ggagaggagcagaaagaaa

SEQ ID NO: 375143 - RNA, 19 nt, Homo sapiens
ggaguuugguggaaucucu

SEQ ID NO: 375144 - RNA, 19 nt, Homo sapiens
gcaguggaguuugguggaa

SEQ ID NO: 375145 - RNA, 19 nt, Homo sapiens
acacauacacaaacaaaug

SEQ ID NO: 375146 - RNA, 19 nt, Homo sapiens
aaaggaaaccacugaauca

SEQ ID NO: 375147 - RNA, 19 nt, Homo sapiens
aaagaaagggagagaaaga

SEQ ID NO: 375148 - RNA, 19 nt, Homo sapiens
ccugagugcuugccaguau

SEQ ID NO: 375149 - RNA, 19 nt, Homo sapiens
gcaguucaaugggcucaug

SEQ ID NO: 375150 - RNA, 19 nt, Homo sapiens
gagaggagcagaaagaaac

SEQ ID NO: 375151 - RNA, 19 nt, Homo sapiens
gacuggauaugacauuuua

SEQ ID NO: 375152 - RNA, 19 nt, Homo sapiens
cuacaaguauuucuaacag

SEQ ID NO: 375153 - RNA, 19 nt, Homo sapiens
gaaagacugggaauuaugc

SEQ ID NO: 375154 - RNA, 19 nt, Homo sapiens
ugacaucuuucacuacaag

SEQ ID NO: 375155 - RNA, 19 nt, Homo sapiens
ggagagaaagagaagcuau

SEQ ID NO: 375156 - RNA, 19 nt, Homo sapiens
gaguguauauacuaaaugc

SEQ ID NO: 375157 - RNA, 19 nt, Homo sapiens
gcgccaaugagaaagauaa

SEQ ID NO: 375158 - RNA, 19 nt, Homo sapiens
ccaaagacuccgaaaucaa

SEQ ID NO: 375159 - RNA, 19 nt, Homo sapiens
aaagagaagcuauauagag

SEQ ID NO: 375160 - RNA, 19 nt, Homo sapiens
gaaggucgugggcacuaaa

SEQ ID NO: 375161 - RNA, 19 nt, Homo sapiens
ccgaggacccgucuaagaa

SEQ ID NO: 375162 - RNA, 19 nt, Homo sapiens
gcaguuguuaguaauauca

SEQ ID NO: 375163 - RNA, 19 nt, Homo sapiens
gccgagcuaugcaagaaug

SEQ ID NO: 375164 - RNA, 19 nt, Homo sapiens
gaugcaaugauguuucuga

SEQ ID NO: 375165 - RNA, 19 nt, Homo sapiens
cgacauguacccaggcuau

SEQ ID NO: 375166 - RNA, 19 nt, Homo sapiens
uugaaugucucuucuccaa

SEQ ID NO: 375167 - RNA, 19 nt, Homo sapiens
gagaccaacugccgcaaac

SEQ ID NO: 375168 - RNA, 19 nt, Homo sapiens
aagggaguguauauacuaa

SEQ ID NO: 375169 - RNA, 19 nt, Homo sapiens
cggcagcggacucacuuua

SEQ ID NO: 375170 - RNA, 19 nt, Homo sapiens
uaaaugccacacuguaugu

SEQ ID NO: 375171 - RNA, 19 nt, Homo sapiens
cagaagcgauuaggauuuu

SEQ ID NO: 375172 - RNA, 19 nt, Homo sapiens
gagagcuccuuugauuuca

SEQ ID NO: 375173 - RNA, 19 nt, Homo sapiens
agagagcuccuuugauuuc

SEQ ID NO: 375174 - RNA, 19 nt, Homo sapiens
ggucgugggcacuaaagaa

SEQ ID NO: 375175 - RNA, 19 nt, Homo sapiens
gccugagacugaaagcaaa

SEQ ID NO: 375176 - RNA, 19 nt, Homo sapiens
ggagaccaacugccgcaaa

SEQ ID NO: 375177 - RNA, 19 nt, Homo sapiens
gaaaccacugaaucaaaga

SEQ ID NO: 375178 - RNA, 19 nt, Homo sapiens
gaagcuauauagagaaaag

SEQ ID NO: 375179 - RNA, 19 nt, Homo sapiens
ugaaagacugggaauuaug

SEQ ID NO: 375180 - RNA, 19 nt, Homo sapiens
uugaaagacugggaauuau

SEQ ID NO: 375181 - RNA, 19 nt, Homo sapiens
caacagccugaauaacuug

SEQ ID NO: 375182 - RNA, 19 nt, Homo sapiens
caagaaucgucgggccaaa

SEQ ID NO: 375183 - RNA, 19 nt, Homo sapiens
ccacacuguauguuucuaa

SEQ ID NO: 375184 - RNA, 19 nt, Homo sapiens
acagaagcgauuaggauuu

SEQ ID NO: 375185 - RNA, 19 nt, Homo sapiens
uccaaagacuccgaaauca

SEQ ID NO: 375186 - RNA, 19 nt, Homo sapiens
ucugacaucuuucacuaca

SEQ ID NO: 375187 - RNA, 19 nt, Homo sapiens
gcuccucgguuggcuccua

SEQ ID NO: 375188 - RNA, 19 nt, Homo sapiens
ugaauaacuugaacaaccu

SEQ ID NO: 375189 - RNA, 19 nt, Homo sapiens
gccgaggacccgucuaaga

SEQ ID NO: 375190 - RNA, 19 nt, Homo sapiens
gcagcauccuggcgccaau

SEQ ID NO: 375191 - RNA, 19 nt, Homo sapiens
cuaaaugccacacuguaug

SEQ ID NO: 375192 - RNA, 19 nt, Homo sapiens
aguaauaucacaacagugu

SEQ ID NO: 375193 - RNA, 19 nt, Homo sapiens
caaguauuucuaacaguug

SEQ ID NO: 375194 - RNA, 19 nt, Homo sapiens
ccacugaaucaaagagaga

SEQ ID NO: 375195 - RNA, 19 nt, Homo sapiens
ucaacucuaugaacgucaa

SEQ ID NO: 375196 - RNA, 19 nt, Homo sapiens
uacccuguguauaacauuu

SEQ ID NO: 375197 - RNA, 19 nt, Homo sapiens
aaacugcuauguacaaccu

SEQ ID NO: 375198 - RNA, 19 nt, Homo sapiens
gaaaaggaaaccacugaau

SEQ ID NO: 375199 - RNA, 19 nt, Homo sapiens
gagaaaaggaaaccacuga

SEQ ID NO: 375200 - RNA, 19 nt, Homo sapiens
gacugggaauuaugcuaga

SEQ ID NO: 375201 - RNA, 19 nt, Homo sapiens
uguacaaccuacccugugu

SEQ ID NO: 375202 - RNA, 19 nt, Homo sapiens
ggaguguauauacuaaaug

SEQ ID NO: 375203 - RNA, 19 nt, Homo sapiens
cgagcaagggaguguauau

SEQ ID NO: 375204 - RNA, 19 nt, Homo sapiens
agagaaagagaagcuauau

SEQ ID NO: 375205 - RNA, 19 nt, Homo sapiens
ccaacucuaucucguccau

SEQ ID NO: 375206 - RNA, 19 nt, Homo sapiens
gcuguguggaccaaccuua

SEQ ID NO: 375207 - RNA, 19 nt, Homo sapiens
uacagaagcgauuaggauu

SEQ ID NO: 375208 - RNA, 19 nt, Homo sapiens
agaaggucgugggcacuaa

SEQ ID NO: 375209 - RNA, 19 nt, Homo sapiens
agucucaacagccugaaua

SEQ ID NO: 375210 - RNA, 19 nt, Homo sapiens
gaccaacugccgcaaacug

SEQ ID NO: 375211 - RNA, 19 nt, Homo sapiens
auacagaagcgauuaggau

SEQ ID NO: 375212 - RNA, 19 nt, Homo sapiens
uaaaugacugaaaggaugu

SEQ ID NO: 375213 - RNA, 19 nt, Homo sapiens
aaggacacauacacaaaca

SEQ ID NO: 375214 - RNA, 19 nt, Homo sapiens
agagagagcuccuuugauu

SEQ ID NO: 375215 - RNA, 19 nt, Homo sapiens
caaccuacccuguguauaa

SEQ ID NO: 375216 - RNA, 19 nt, Homo sapiens
gagaagcuauauagagaaa

SEQ ID NO: 375217 - RNA, 19 nt, Homo sapiens
ggaaaccacugaaucaaag

SEQ ID NO: 375218 - RNA, 19 nt, Homo sapiens
ggacacauacacaaacaaa

SEQ ID NO: 375219 - RNA, 19 nt, Homo sapiens
aagagaagcuauauagaga

SEQ ID NO: 375220 - RNA, 19 nt, Homo sapiens
gcaaggacacauacacaaa

SEQ ID NO: 375221 - RNA, 19 nt, Homo sapiens
gaaagagaagcuauauaga

SEQ ID NO: 375222 - RNA, 19 nt, Homo sapiens
gagagaaagagaagcuaua

SEQ ID NO: 375223 - RNA, 19 nt, Homo sapiens
caacuccgcccuugaaaga

SEQ ID NO: 375224 - RNA, 19 nt, Homo sapiens
ucaaagggauguccucagu

SEQ ID NO: 375225 - RNA, 19 nt, Homo sapiens
gagaaagagaagcuauaua

SEQ ID NO: 375226 - RNA, 19 nt, Homo sapiens
caagggaguguauauacua

SEQ ID NO: 375227 - RNA, 19 nt, Homo sapiens
gagcaagggaguguauaua

SEQ ID NO: 375228 - RNA, 19 nt, Homo sapiens
gaaagggagagaaagagaa

SEQ ID NO: 375229 - RNA, 19 nt, Homo sapiens
cgacuccuccguauguuua

SEQ ID NO: 375230 - RNA, 19 nt, Homo sapiens
ucaacagccugaauaacuu

SEQ ID NO: 375231 - RNA, 19 nt, Homo sapiens
gggaguguauauacuaaau

SEQ ID NO: 375232 - RNA, 19 nt, Homo sapiens
gcaagggaguguauauacu

SEQ ID NO: 375233 - RNA, 19 nt, Homo sapiens
agaaagagaagcuauauag

SEQ ID NO: 375234 - RNA, 19 nt, Homo sapiens
ugacugaaaggauguauau

SEQ ID NO: 375235 - RNA, 19 nt, Homo sapiens
aaagggauguccucagugu

SEQ ID NO: 375236 - RNA, 19 nt, Homo sapiens
gagagagcuccuuugauuu

SEQ ID NO: 375237 - RNA, 19 nt, Homo sapiens
cuaaagaaagggagagaaa

SEQ ID NO: 375238 - RNA, 19 nt, Homo sapiens
cuugaaagacugggaauua

SEQ ID NO: 375239 - RNA, 19 nt, Homo sapiens
gaggacccgucuaagaaga

SEQ ID NO: 375240 - RNA, 19 nt, Homo sapiens
ggagaggagcagaaagaaa

SEQ ID NO: 375241 - RNA, 19 nt, Homo sapiens
ggaguuugguggaaucucu

SEQ ID NO: 375242 - RNA, 19 nt, Homo sapiens
acacauacacaaacaaaug

SEQ ID NO: 375243 - RNA, 19 nt, Homo sapiens
gcaguggaguuugguggaa

SEQ ID NO: 375244 - RNA, 19 nt, Homo sapiens
aaaggaaaccacugaauca

SEQ ID NO: 375245 - RNA, 19 nt, Homo sapiens
aaagaaagggagagaaaga

SEQ ID NO: 375246 - RNA, 19 nt, Homo sapiens
ccugagugcuugccaguau

SEQ ID NO: 375247 - RNA, 19 nt, Homo sapiens
gcaguucaaugggcucaug

SEQ ID NO: 375248 - RNA, 19 nt, Homo sapiens
gagaggagcagaaagaaac

SEQ ID NO: 375249 - RNA, 19 nt, Homo sapiens
gacuggauaugacauuuua

SEQ ID NO: 375250 - RNA, 19 nt, Homo sapiens
cuacaaguauuucuaacag

SEQ ID NO: 375251 - RNA, 19 nt, Homo sapiens
gaaagacugggaauuaugc

SEQ ID NO: 375252 - RNA, 19 nt, Homo sapiens
ugacaucuuucacuacaag

SEQ ID NO: 375253 - RNA, 19 nt, Homo sapiens
ggagagaaagagaagcuau

SEQ ID NO: 375254 - RNA, 19 nt, Homo sapiens
gaguguauauacuaaaugc

SEQ ID NO: 375255 - RNA, 19 nt, Homo sapiens
aaagagaagcuauauagag

SEQ ID NO: 375256 - RNA, 19 nt, Homo sapiens
gaaggucgugggcacuaaa

SEQ ID NO: 375257 - RNA, 19 nt, Homo sapiens
ccgaggacccgucuaagaa

SEQ ID NO: 375258 - RNA, 19 nt, Homo sapiens
gcaguuguuaguaauauca

SEQ ID NO: 375259 - RNA, 19 nt, Homo sapiens
gccgagcuaugcaagaaug

SEQ ID NO: 375260 - RNA, 19 nt, Homo sapiens
gaugcaaugauguuucuga

SEQ ID NO: 375261 - RNA, 19 nt, Homo sapiens
cgacauguacccaggcuau

SEQ ID NO: 375262 - RNA, 19 nt, Homo sapiens
gagaccaacugccgcaaac

SEQ ID NO: 375263 - RNA, 19 nt, Homo sapiens
aagggaguguauauacuaa

SEQ ID NO: 375264 - RNA, 19 nt, Homo sapiens
cggcagcggacucacuuua

SEQ ID NO: 375265 - RNA, 19 nt, Homo sapiens
uaaaugccacacuguaugu

SEQ ID NO: 375266 - RNA, 19 nt, Homo sapiens
cagaagcgauuaggauuuu

SEQ ID NO: 375267 - RNA, 19 nt, Homo sapiens
gagagcuccuuugauuuca

SEQ ID NO: 375268 - RNA, 19 nt, Homo sapiens
agagagcuccuuugauuuc

SEQ ID NO: 375269 - RNA, 19 nt, Homo sapiens
ggucgugggcacuaaagaa

SEQ ID NO: 375270 - RNA, 19 nt, Homo sapiens
gccugagacugaaagcaaa

SEQ ID NO: 375271 - RNA, 19 nt, Homo sapiens
ggagaccaacugccgcaaa

SEQ ID NO: 375272 - RNA, 19 nt, Homo sapiens
gaaaccacugaaucaaaga

SEQ ID NO: 375273 - RNA, 19 nt, Homo sapiens
gaagcuauauagagaaaag

SEQ ID NO: 375274 - RNA, 19 nt, Homo sapiens
ugaaagacugggaauuaug

SEQ ID NO: 375275 - RNA, 19 nt, Homo sapiens
uugaaagacugggaauuau

SEQ ID NO: 375276 - RNA, 19 nt, Homo sapiens
caacagccugaauaacuug

SEQ ID NO: 375277 - RNA, 19 nt, Homo sapiens
caagaaucgucgggccaaa

SEQ ID NO: 375278 - RNA, 19 nt, Homo sapiens
ccacacuguauguuucuaa

SEQ ID NO: 375279 - RNA, 19 nt, Homo sapiens
acagaagcgauuaggauuu

SEQ ID NO: 375280 - RNA, 19 nt, Homo sapiens
ucugacaucuuucacuaca

SEQ ID NO: 375281 - RNA, 19 nt, Homo sapiens
gcuccucgguuggcuccua

SEQ ID NO: 375282 - RNA, 19 nt, Homo sapiens
ugaauaacuugaacaaccu

SEQ ID NO: 375283 - RNA, 19 nt, Homo sapiens
gccgaggacccgucuaaga

SEQ ID NO: 375284 - RNA, 19 nt, Homo sapiens
cuaaaugccacacuguaug

SEQ ID NO: 375285 - RNA, 19 nt, Homo sapiens
aguaauaucacaacagugu

SEQ ID NO: 375286 - RNA, 19 nt, Homo sapiens
caaguauuucuaacaguug

SEQ ID NO: 375287 - RNA, 19 nt, Homo sapiens
ccacugaaucaaagagaga

SEQ ID NO: 375288 - RNA, 19 nt, Homo sapiens
ucaacucuaugaacgucaa

SEQ ID NO: 375289 - RNA, 19 nt, Homo sapiens
uacccuguguauaacauuu

SEQ ID NO: 375290 - RNA, 19 nt, Homo sapiens
aaacugcuauguacaaccu

SEQ ID NO: 375291 - RNA, 19 nt, Homo sapiens
gaaaaggaaaccacugaau

SEQ ID NO: 375292 - RNA, 19 nt, Homo sapiens
gagaaaaggaaaccacuga

SEQ ID NO: 375293 - RNA, 19 nt, Homo sapiens
gacugggaauuaugcuaga

SEQ ID NO: 375294 - RNA, 19 nt, Homo sapiens
uguacaaccuacccugugu

SEQ ID NO: 375295 - RNA, 19 nt, Homo sapiens
ggaguguauauacuaaaug

SEQ ID NO: 375296 - RNA, 19 nt, Homo sapiens
cgagcaagggaguguauau

SEQ ID NO: 375297 - RNA, 19 nt, Homo sapiens
agagaaagagaagcuauau

SEQ ID NO: 375298 - RNA, 19 nt, Homo sapiens
ccaacucuaucucguccau

SEQ ID NO: 375299 - RNA, 19 nt, Homo sapiens
gcuguguggaccaaccuua

SEQ ID NO: 375300 - RNA, 19 nt, Homo sapiens
uacagaagcgauuaggauu

SEQ ID NO: 375301 - RNA, 19 nt, Homo sapiens
agaaggucgugggcacuaa

SEQ ID NO: 375302 - RNA, 19 nt, Homo sapiens
agucucaacagccugaaua

SEQ ID NO: 375303 - RNA, 19 nt, Homo sapiens
gaccaacugccgcaaacug

SEQ ID NO: 375304 - RNA, 19 nt, Homo sapiens
aggcucggcucgcuggaaa

SEQ ID NO: 375305 - RNA, 19 nt, Homo sapiens
ggaagagagagggaugaga

SEQ ID NO: 375306 - RNA, 19 nt, Homo sapiens
auacagaagcgauuaggau

SEQ ID NO: 375307 - RNA, 19 nt, Homo sapiens
gaaccgcuacccggacaug

SEQ ID NO: 375308 - RNA, 19 nt, Homo sapiens
uaaaugacugaaaggaugu

SEQ ID NO: 375309 - RNA, 19 nt, Homo sapiens
aaggacacauacacaaaca

SEQ ID NO: 375310 - RNA, 19 nt, Homo sapiens
acaguugcaaggacacaua

SEQ ID NO: 375311 - RNA, 19 nt, Homo sapiens
caucuuucacuacaaguau

SEQ ID NO: 375312 - RNA, 19 nt, Homo sapiens
aggaaaccacugaaucaaa

SEQ ID NO: 375313 - RNA, 19 nt, Homo sapiens
agaaagggagagaaagaga

SEQ ID NO: 375314 - RNA, 19 nt, Homo sapiens
gagcacagcgacucagaaa

SEQ ID NO: 375315 - RNA, 19 nt, Homo sapiens
gccaagaccuuuccauucg

SEQ ID NO: 375316 - RNA, 19 nt, Homo sapiens
ccaaacagcacgccuccuu

SEQ ID NO: 375317 - RNA, 19 nt, Homo sapiens
gugcgggugugguucaaga

SEQ ID NO: 375318 - RNA, 19 nt, Homo sapiens
gcacuagcccucccuccau

SEQ ID NO: 375319 - RNA, 19 nt, Homo sapiens
agaggacgguucgcugaaa

SEQ ID NO: 375320 - RNA, 19 nt, Homo sapiens
aaacagcacgccuccuuca

SEQ ID NO: 375321 - RNA, 19 nt, Homo sapiens
gcacagcgacucagaaaag

SEQ ID NO: 375322 - RNA, 19 nt, Homo sapiens
gcaggccgagcuaugcaaa

SEQ ID NO: 375323 - RNA, 19 nt, Homo sapiens
ggagcacagcgacucagaa

SEQ ID NO: 375324 - RNA, 19 nt, Homo sapiens
ggacuaaagccaggaacag

SEQ ID NO: 375325 - RNA, 19 nt, Homo sapiens
aaacgugcgcggacuguca

SEQ ID NO: 375326 - RNA, 19 nt, Homo sapiens
cgccaagaccuuuccauuc

SEQ ID NO: 375327 - RNA, 19 nt, Homo sapiens
ccgccaagaccuuuccauu

SEQ ID NO: 375328 - RNA, 19 nt, Homo sapiens
gaggacgguucgcugaaaa

SEQ ID NO: 375329 - RNA, 19 nt, Homo sapiens
gccguguccugcccuuaug

SEQ ID NO: 375330 - RNA, 19 nt, Homo sapiens
ggccguguccugcccuuau

SEQ ID NO: 375331 - RNA, 19 nt, Homo sapiens
cguggaaaggcccguauga

SEQ ID NO: 375332 - RNA, 19 nt, Homo sapiens
caacaagauuucuacguua

SEQ ID NO: 375333 - RNA, 19 nt, Homo sapiens
ccucugagaugcuaauuua

SEQ ID NO: 375334 - RNA, 19 nt, Homo sapiens
gaugaagagugacuuguuu

SEQ ID NO: 375335 - RNA, 19 nt, Homo sapiens
gaacagggcgcauuacuuc

SEQ ID NO: 375336 - RNA, 19 nt, Homo sapiens
caacaucucugcugccaau

SEQ ID NO: 375337 - RNA, 19 nt, Homo sapiens
gaagaaggaauauuugcua

SEQ ID NO: 375338 - RNA, 19 nt, Homo sapiens
gcacguacguucagcaaca

SEQ ID NO: 375339 - RNA, 19 nt, Homo sapiens
gcacuacugcuuuguguuu

SEQ ID NO: 375340 - RNA, 19 nt, Homo sapiens
gaaggacacagcaguauug

SEQ ID NO: 375341 - RNA, 19 nt, Homo sapiens
guuauuaccucuccaguuc

SEQ ID NO: 375342 - RNA, 19 nt, Homo sapiens
caucaggucugggcaagua

SEQ ID NO: 375343 - RNA, 19 nt, Homo sapiens
gaacccagcugccgucaac

SEQ ID NO: 375344 - RNA, 19 nt, Homo sapiens
gauauaagcaacaacaaga

SEQ ID NO: 375345 - RNA, 19 nt, Homo sapiens
gcagugaugugcgcuauuc

SEQ ID NO: 375346 - RNA, 19 nt, Homo sapiens
gacccaggcuccuaucuug

SEQ ID NO: 375347 - RNA, 19 nt, Homo sapiens
ggacaccgcucaguauuac

SEQ ID NO: 375348 - RNA, 19 nt, Homo sapiens
gcaacagccuggacaucuu

SEQ ID NO: 375349 - RNA, 19 nt, Homo sapiens
gaucacagcgcaacuacuu

SEQ ID NO: 375350 - RNA, 19 nt, Homo sapiens
acaacaagauuucuacguu

SEQ ID NO: 375351 - RNA, 19 nt, Homo sapiens
gcacaucuggcucuccaua

SEQ ID NO: 375352 - RNA, 19 nt, Homo sapiens
uggcagagcuggauauaag

SEQ ID NO: 375353 - RNA, 19 nt, Homo sapiens
ugaccgugcuggcaucuaa

SEQ ID NO: 375354 - RNA, 19 nt, Homo sapiens
gaggagcucuggccaugga

SEQ ID NO: 375355 - RNA, 19 nt, Homo sapiens
ggaacccguuugaguguga

SEQ ID NO: 375356 - RNA, 19 nt, Homo sapiens
cagcguggcuucuuugaca

SEQ ID NO: 375357 - RNA, 19 nt, Homo sapiens
cgacagcggauguaaacua

SEQ ID NO: 375358 - RNA, 19 nt, Homo sapiens
ucaccgugcugaacgagua

SEQ ID NO: 375359 - RNA, 19 nt, Homo sapiens
gaccaacgauacccuguuc

SEQ ID NO: 375360 - RNA, 19 nt, Homo sapiens
ccgggcagcugguccauuu

SEQ ID NO: 375361 - RNA, 19 nt, Homo sapiens
ggacagcaucuucgucuau

SEQ ID NO: 375362 - RNA, 19 nt, Homo sapiens
gcuccuaucuugugacagu

SEQ ID NO: 375363 - RNA, 19 nt, Homo sapiens
gcaccaagcagacaaaguc

SEQ ID NO: 375364 - RNA, 19 nt, Homo sapiens
ggaguucugugucuacaag

SEQ ID NO: 375365 - RNA, 19 nt, Homo sapiens
ggagacagcauccucaaca

SEQ ID NO: 375366 - RNA, 19 nt, Homo sapiens
caacagcacaggugacuuc

SEQ ID NO: 375367 - RNA, 19 nt, Homo sapiens
ggacucagcguggacauga

SEQ ID NO: 375368 - RNA, 19 nt, Homo sapiens
ggaaggacacagcaguauu

SEQ ID NO: 375369 - RNA, 19 nt, Homo sapiens
ucagcaaggucaaggaguu

SEQ ID NO: 375370 - RNA, 19 nt, Homo sapiens
caccagcgauuacgacguu

SEQ ID NO: 375371 - RNA, 19 nt, Homo sapiens
gugggcaccuucaauauca

SEQ ID NO: 375372 - RNA, 19 nt, Homo sapiens
caaccucuccugcagcuuu

SEQ ID NO: 375373 - RNA, 19 nt, Homo sapiens
gcaaggcacaggccgugua

SEQ ID NO: 375374 - RNA, 19 nt, Homo sapiens
ggugugcgcugaacuuugg

SEQ ID NO: 375375 - RNA, 19 nt, Homo sapiens
gcaccaacgucuccuacag

SEQ ID NO: 375376 - RNA, 19 nt, Homo sapiens
gggcauggccgcuucuaga

SEQ ID NO: 375377 - RNA, 19 nt, Homo sapiens
caagacacccacauggaaa

SEQ ID NO: 375378 - RNA, 19 nt, Homo sapiens
gcaaggaggaggccaccaa

SEQ ID NO: 375379 - RNA, 19 nt, Homo sapiens
gagcagcacggucaccauu

SEQ ID NO: 375380 - RNA, 19 nt, Homo sapiens
ucgcugcucuuccugcuuu

SEQ ID NO: 375381 - RNA, 19 nt, Homo sapiens
ccaagacacccacauggaa

SEQ ID NO: 375382 - RNA, 19 nt, Homo sapiens
gaacguggucuucaauguc

SEQ ID NO: 375383 - RNA, 19 nt, Homo sapiens
acacgucccugugccagua

SEQ ID NO: 375384 - RNA, 19 nt, Homo sapiens
gaaccucuccagccacuuc

SEQ ID NO: 375385 - RNA, 19 nt, Homo sapiens
cccuacaccuucuucauuu

SEQ ID NO: 375386 - RNA, 19 nt, Homo sapiens
caacaguggagcaugugua

SEQ ID NO: 375387 - RNA, 19 nt, Homo sapiens
gcuccuacguguacuugga

SEQ ID NO: 375388 - RNA, 19 nt, Homo sapiens
gggcacuacugcuuugugu

SEQ ID NO: 375389 - RNA, 19 nt, Homo sapiens
ggaaggugacugugugugu

SEQ ID NO: 375390 - RNA, 19 nt, Homo sapiens
gcgaggaguucugugucua

SEQ ID NO: 375391 - RNA, 19 nt, Homo sapiens
ucaccuaccagacugagua

SEQ ID NO: 375392 - RNA, 19 nt, Homo sapiens
aagcagacaaagucaauaa

SEQ ID NO: 375393 - RNA, 19 nt, Homo sapiens
gcugcagcguggcuucuuu

SEQ ID NO: 375394 - RNA, 19 nt, Homo sapiens
gacagcauccucaacauca

SEQ ID NO: 375395 - RNA, 19 nt, Homo sapiens
gcgcgagugugcuguaugg

SEQ ID NO: 375396 - RNA, 19 nt, Homo sapiens
ccacggcuuugcacucuuc

SEQ ID NO: 375397 - RNA, 19 nt, Homo sapiens
gcccuacaccuucuucauu

SEQ ID NO: 375398 - RNA, 19 nt, Homo sapiens
gaccagacgccgcucaguu

SEQ ID NO: 375399 - RNA, 19 nt, Homo sapiens
gcuagcagccuuccacauc

SEQ ID NO: 375400 - RNA, 19 nt, Homo sapiens
gacagcaucuucgucuaug

SEQ ID NO: 375401 - RNA, 19 nt, Homo sapiens
caucuaaugccuucgagaa

SEQ ID NO: 375402 - RNA, 19 nt, Homo sapiens
cagcaguauuggacgguuu

SEQ ID NO: 375403 - RNA, 19 nt, Homo sapiens
uuggacagaugaagaguga

SEQ ID NO: 375404 - RNA, 19 nt, Homo sapiens
gacagcggauguaaacuac

SEQ ID NO: 375405 - RNA, 19 nt, Homo sapiens
caucugcagcucaacuaua

SEQ ID NO: 375406 - RNA, 19 nt, Homo sapiens
uccaaucccuuucccuuug

SEQ ID NO: 375407 - RNA, 19 nt, Homo sapiens
gagacagcauccucaacau

SEQ ID NO: 375408 - RNA, 19 nt, Homo sapiens
gagcccagauacgcaagaa

SEQ ID NO: 375409 - RNA, 19 nt, Homo sapiens
gaguggacaccgcucagua

SEQ ID NO: 375410 - RNA, 19 nt, Homo sapiens
gcaacaacaagauuucuac

SEQ ID NO: 375411 - RNA, 19 nt, Homo sapiens
ggauauaagcaacaacaag

SEQ ID NO: 375412 - RNA, 19 nt, Homo sapiens
uacguuagaagaaggaaua

SEQ ID NO: 375413 - RNA, 19 nt, Homo sapiens
gcccugaggugacguucau

SEQ ID NO: 375414 - RNA, 19 nt, Homo sapiens
acaaugucaugcacaccua

SEQ ID NO: 375415 - RNA, 19 nt, Homo sapiens
gacgguuucuagccucuga

SEQ ID NO: 375416 - RNA, 19 nt, Homo sapiens
gggcuccugugccguguau

SEQ ID NO: 375417 - RNA, 19 nt, Homo sapiens
gaugacacccugguagaga

SEQ ID NO: 375418 - RNA, 19 nt, Homo sapiens
uaaacuacaucgucaugcu

SEQ ID NO: 375419 - RNA, 19 nt, Homo sapiens
gcccgacggugacacacaa

SEQ ID NO: 375420 - RNA, 19 nt, Homo sapiens
gcagacaaagucaauaaaa

SEQ ID NO: 375421 - RNA, 19 nt, Homo sapiens
ucaaggaguuccgccacaa

SEQ ID NO: 375422 - RNA, 19 nt, Homo sapiens
gggagaguccucacaaugg

SEQ ID NO: 375423 - RNA, 19 nt, Homo sapiens
ucagugacccguccauugu

SEQ ID NO: 375424 - RNA, 19 nt, Homo sapiens
cguccucggugcagaguga

SEQ ID NO: 375425 - RNA, 19 nt, Homo sapiens
ccuccaaccuggugagcuu

SEQ ID NO: 375426 - RNA, 19 nt, Homo sapiens
gcgugaacagggcgcauua

SEQ ID NO: 375427 - RNA, 19 nt, Homo sapiens
agaacguggucuucaaugu

SEQ ID NO: 375428 - RNA, 19 nt, Homo sapiens
gguggaccaucaacgacaa

SEQ ID NO: 375429 - RNA, 19 nt, Homo sapiens
ccaagcagacaaagucaau

SEQ ID NO: 375430 - RNA, 19 nt, Homo sapiens
gcagacgggcgacaacauc

SEQ ID NO: 375431 - RNA, 19 nt, Homo sapiens
ccguggaggucaugguauu

SEQ ID NO: 375432 - RNA, 19 nt, Homo sapiens
ggacauagcuccagaagga

SEQ ID NO: 375433 - RNA, 19 nt, Homo sapiens
gcagaaagcugaaauggaa

SEQ ID NO: 375434 - RNA, 19 nt, Homo sapiens
ggaaacagcugcacaaguu

SEQ ID NO: 375435 - RNA, 19 nt, Homo sapiens
ggauuaagcucuucaaauu

SEQ ID NO: 375436 - RNA, 19 nt, Homo sapiens
ggaaggaacuccaaacuau

SEQ ID NO: 375437 - RNA, 19 nt, Homo sapiens
ucaaagggcuucugaguuu

SEQ ID NO: 375438 - RNA, 19 nt, Homo sapiens
gaagagauauuggaaauuc

SEQ ID NO: 375439 - RNA, 19 nt, Homo sapiens
guaacaagcacacuauuua

SEQ ID NO: 375440 - RNA, 19 nt, Homo sapiens
ggaaguggcuguccugaau

SEQ ID NO: 375441 - RNA, 19 nt, Homo sapiens
gagaccaacuuacuaaauu

SEQ ID NO: 375442 - RNA, 19 nt, Homo sapiens
gcaaggaggaggcaaguua

SEQ ID NO: 375443 - RNA, 19 nt, Homo sapiens
gaaacuccaucucuacaaa

SEQ ID NO: 375444 - RNA, 19 nt, Homo sapiens
gaucguaucugaugucugu

SEQ ID NO: 375445 - RNA, 19 nt, Homo sapiens
gcacuaaccgagagaaaua

SEQ ID NO: 375446 - RNA, 19 nt, Homo sapiens
caauauagcugcugucaca

SEQ ID NO: 375447 - RNA, 19 nt, Homo sapiens
ccagaucagucaugguuua

SEQ ID NO: 375448 - RNA, 19 nt, Homo sapiens
ucucagaucuuaucagaaa

SEQ ID NO: 375449 - RNA, 19 nt, Homo sapiens
ggacuaacuguaucacuua

SEQ ID NO: 375450 - RNA, 19 nt, Homo sapiens
gaaucugugugaaugguua

SEQ ID NO: 375451 - RNA, 19 nt, Homo sapiens
ggaauugucuggauguugu

SEQ ID NO: 375452 - RNA, 19 nt, Homo sapiens
gauagaaucugugugaaug

SEQ ID NO: 375453 - RNA, 19 nt, Homo sapiens
cagauacaguucaacaaua

SEQ ID NO: 375454 - RNA, 19 nt, Homo sapiens
guaaguugaucguaucuga

SEQ ID NO: 375455 - RNA, 19 nt, Homo sapiens
gaaaugggaguucuaaugu

SEQ ID NO: 375456 - RNA, 19 nt, Homo sapiens
gcuaguacgugaagaguug

SEQ ID NO: 375457 - RNA, 19 nt, Homo sapiens
gcacucaggucgaugacuu

SEQ ID NO: 375458 - RNA, 19 nt, Homo sapiens
ggaaggagcccuaaguugu

SEQ ID NO: 375459 - RNA, 19 nt, Homo sapiens
ggaaaugggaguucuaaug

SEQ ID NO: 375460 - RNA, 19 nt, Homo sapiens
guucauacauuagacagua

SEQ ID NO: 375461 - RNA, 19 nt, Homo sapiens
gcuauuaucuggauuuguc

SEQ ID NO: 375462 - RNA, 19 nt, Homo sapiens
gcuccaauguguacuacua

SEQ ID NO: 375463 - RNA, 19 nt, Homo sapiens
ggaccaauuuauuucacua

SEQ ID NO: 375464 - RNA, 19 nt, Homo sapiens
gauaucaacuuugcagaga

SEQ ID NO: 375465 - RNA, 19 nt, Homo sapiens
gugcagcuauuauguggua

SEQ ID NO: 375466 - RNA, 19 nt, Homo sapiens
ccauguggcucuacucauu

SEQ ID NO: 375467 - RNA, 19 nt, Homo sapiens
ccaaagaucaguuauagga

SEQ ID NO: 375468 - RNA, 19 nt, Homo sapiens
ugaggaagcuaaucgaguu

SEQ ID NO: 375469 - RNA, 19 nt, Homo sapiens
cuuuaaagcugauccgaua

SEQ ID NO: 375470 - RNA, 19 nt, Homo sapiens
ccucauggcuucaucucua

SEQ ID NO: 375471 - RNA, 19 nt, Homo sapiens
gaagauagcggacauagcu

SEQ ID NO: 375472 - RNA, 19 nt, Homo sapiens
gcuaugaugucuacucugu

SEQ ID NO: 375473 - RNA, 19 nt, Homo sapiens
caaauggagcucagucuaa

SEQ ID NO: 375474 - RNA, 19 nt, Homo sapiens
gggaggaccuggauuugga

SEQ ID NO: 375475 - RNA, 19 nt, Homo sapiens
agagaauccugucguuuaa

SEQ ID NO: 375476 - RNA, 19 nt, Homo sapiens
ggacuugagagaugaaauu

SEQ ID NO: 375477 - RNA, 19 nt, Homo sapiens
gggacuaacuguaucacuu

SEQ ID NO: 375478 - RNA, 19 nt, Homo sapiens
agaaagggcuaccauaaag

SEQ ID NO: 375479 - RNA, 19 nt, Homo sapiens
gaaauucgcauucacaaac

SEQ ID NO: 375480 - RNA, 19 nt, Homo sapiens
ggaaucauugcaacuuaua

SEQ ID NO: 375481 - RNA, 19 nt, Homo sapiens
agaaauggauccugcucua

SEQ ID NO: 375482 - RNA, 19 nt, Homo sapiens
ucacagcucuuccuagaca

SEQ ID NO: 375483 - RNA, 19 nt, Homo sapiens
caauuauggucacuagaaa

SEQ ID NO: 375484 - RNA, 19 nt, Homo sapiens
ggcuucaucucuaucuuua

SEQ ID NO: 375485 - RNA, 19 nt, Homo sapiens
gaaacaggcgaaucacuug

SEQ ID NO: 375486 - RNA, 19 nt, Homo sapiens
ugauauguguguuucagua

SEQ ID NO: 375487 - RNA, 19 nt, Homo sapiens
gagacgacuuggagaaaga

SEQ ID NO: 375488 - RNA, 19 nt, Homo sapiens
uacgggaacuggucacaua

SEQ ID NO: 375489 - RNA, 19 nt, Homo sapiens
aagagaauccugucguuua

SEQ ID NO: 375490 - RNA, 19 nt, Homo sapiens
gcaaauggagcucagucua

SEQ ID NO: 375491 - RNA, 19 nt, Homo sapiens
uaaguugucacucaguuua

SEQ ID NO: 375492 - RNA, 19 nt, Homo sapiens
caccaaagaucaguuauag

SEQ ID NO: 375493 - RNA, 19 nt, Homo sapiens
ucagaaagggcuaccauaa

SEQ ID NO: 375494 - RNA, 19 nt, Homo sapiens
ucaaugauacuuacucuga

SEQ ID NO: 375495 - RNA, 19 nt, Homo sapiens
ccaagagaauccugucguu

SEQ ID NO: 375496 - RNA, 19 nt, Homo sapiens
augcagugcuguugaauaa

SEQ ID NO: 375497 - RNA, 19 nt, Homo sapiens
cuaaucuucugcacuuuaa

SEQ ID NO: 375498 - RNA, 19 nt, Homo sapiens
gcuaaucuucugcacuuua

SEQ ID NO: 375499 - RNA, 19 nt, Homo sapiens
cgaccaagauggagaccaa

SEQ ID NO: 375500 - RNA, 19 nt, Homo sapiens
gaaauggaacucucagauc

SEQ ID NO: 375501 - RNA, 19 nt, Homo sapiens
gcagauacaguucaacaau

SEQ ID NO: 375502 - RNA, 19 nt, Homo sapiens
uaguggagcuggcuauuau

SEQ ID NO: 375503 - RNA, 19 nt, Homo sapiens
caagcacacuauuuauaug

SEQ ID NO: 375504 - RNA, 19 nt, Homo sapiens
gaggcaauauucacaaagu

SEQ ID NO: 375505 - RNA, 19 nt, Homo sapiens
gggaaucauugcaacuuau

SEQ ID NO: 375506 - RNA, 19 nt, Homo sapiens
gaaauuaaagagugcuaug

SEQ ID NO: 375507 - RNA, 19 nt, Homo sapiens
uaacacaggagaauuggaa

SEQ ID NO: 375508 - RNA, 19 nt, Homo sapiens
cagaaagggcuaccauaaa

SEQ ID NO: 375509 - RNA, 19 nt, Homo sapiens
uaucaacuuugcagagauu

SEQ ID NO: 375510 - RNA, 19 nt, Homo sapiens
uggaagagauauuggaaau

SEQ ID NO: 375511 - RNA, 19 nt, Homo sapiens
ugucacagcucuuccuaga

SEQ ID NO: 375512 - RNA, 19 nt, Homo sapiens
gcuauuaugugguauccau

SEQ ID NO: 375513 - RNA, 19 nt, Homo sapiens
ugaauaugcuacacaaagu

SEQ ID NO: 375514 - RNA, 19 nt, Homo sapiens
gggaaggaacuccaaacua

SEQ ID NO: 375515 - RNA, 19 nt, Homo sapiens
cauguguacugguauuauu

SEQ ID NO: 375516 - RNA, 19 nt, Homo sapiens
uguuauaacucaucuagug

SEQ ID NO: 375517 - RNA, 19 nt, Homo sapiens
cuguuuggcuuugcuauua

SEQ ID NO: 375518 - RNA, 19 nt, Homo sapiens
ggaaauucgcauucacaaa

SEQ ID NO: 375519 - RNA, 19 nt, Homo sapiens
ccaccaaagaucaguuaua

SEQ ID NO: 375520 - RNA, 19 nt, Homo sapiens
ugaggaggaugacgaugaa

SEQ ID NO: 375521 - RNA, 19 nt, Homo sapiens
uggcauaccuugucuuugg

SEQ ID NO: 375522 - RNA, 19 nt, Homo sapiens
uccgauaugucacaacuuu

SEQ ID NO: 375523 - RNA, 19 nt, Homo sapiens
gaaauggaaccgcuuggau

SEQ ID NO: 375524 - RNA, 19 nt, Homo sapiens
acagaaauguugaguaagg

SEQ ID NO: 375525 - RNA, 19 nt, Homo sapiens
uggcgaaacuccaucucua

SEQ ID NO: 375526 - RNA, 19 nt, Homo sapiens
gaauggugguggagaugga

SEQ ID NO: 375527 - RNA, 19 nt, Homo sapiens
gaaggaacuccaaacuaug

SEQ ID NO: 375528 - RNA, 19 nt, Homo sapiens
guuaaacuuugacgaacuu

SEQ ID NO: 375529 - RNA, 19 nt, Homo sapiens
acucugaagugaaaucuga

SEQ ID NO: 375530 - RNA, 19 nt, Homo sapiens
agugguagcuauaggaauu

SEQ ID NO: 375531 - RNA, 19 nt, Homo sapiens
acauuaaccuguucugugu

SEQ ID NO: 375532 - RNA, 19 nt, Homo sapiens
gaaagucuguguccaauua

SEQ ID NO: 375533 - RNA, 19 nt, Homo sapiens
gaagagguuugaugaaauc

SEQ ID NO: 375534 - RNA, 19 nt, Homo sapiens
gugaagagguuugaugaaa

SEQ ID NO: 375535 - RNA, 19 nt, Homo sapiens
gacuauaacugucaucuag

SEQ ID NO: 375536 - RNA, 19 nt, Homo sapiens
gggcaagccuguugucugu

SEQ ID NO: 375537 - RNA, 19 nt, Homo sapiens
ggucaugggucucuaaguc

SEQ ID NO: 375538 - RNA, 19 nt, Homo sapiens
gcaugucgauccaggagaa

SEQ ID NO: 375539 - RNA, 19 nt, Homo sapiens
uaaguccucucuucucuau

SEQ ID NO: 375540 - RNA, 19 nt, Homo sapiens
gcaucaagaucaucagcaa

SEQ ID NO: 375541 - RNA, 19 nt, Homo sapiens
ggacacggcaucaagauca

SEQ ID NO: 375542 - RNA, 19 nt, Homo sapiens
gcaaaguccauccugauug

SEQ ID NO: 375543 - RNA, 19 nt, Homo sapiens
ccaaagagacuuagcaaag

SEQ ID NO: 375544 - RNA, 19 nt, Homo sapiens
guggagagcuuugcagguu

SEQ ID NO: 375545 - RNA, 19 nt, Homo sapiens
ugaagagguuugaugaaau

SEQ ID NO: 375546 - RNA, 19 nt, Homo sapiens
caaaguccauccugauugg

SEQ ID NO: 375547 - RNA, 19 nt, Homo sapiens
gcucagaagaugaugauug

SEQ ID NO: 375548 - RNA, 19 nt, Homo sapiens
gaaggacacggcaucaaga

SEQ ID NO: 375549 - RNA, 19 nt, Homo sapiens
gcccuaagaugccuugagu

SEQ ID NO: 375550 - RNA, 19 nt, Homo sapiens
gaacauugcgcgacucaac

SEQ ID NO: 375551 - RNA, 19 nt, Homo sapiens
cagcaccaauuguacauuc

SEQ ID NO: 375552 - RNA, 19 nt, Homo sapiens
ggaaggacacggcaucaag

SEQ ID NO: 375553 - RNA, 19 nt, Homo sapiens
uaucugagacuauaacugu

SEQ ID NO: 375554 - RNA, 19 nt, Homo sapiens
caucgucuuugccuccuuu

SEQ ID NO: 375555 - RNA, 19 nt, Homo sapiens
caacagcaccaauuguaca

SEQ ID NO: 375556 - RNA, 19 nt, Homo sapiens
cccaacagcaccaauugua

SEQ ID NO: 375557 - RNA, 19 nt, Homo sapiens
ggaccuaggcaucgagauc

SEQ ID NO: 375558 - RNA, 19 nt, Homo sapiens
uuggagaccuggugauugu

SEQ ID NO: 375559 - RNA, 19 nt, Homo sapiens
uacauucucugcauccaau

SEQ ID NO: 375560 - RNA, 19 nt, Homo sapiens
aggccuaucugagacuaua

SEQ ID NO: 375561 - RNA, 19 nt, Homo sapiens
aguccucucuucucuauuc

SEQ ID NO: 375562 - RNA, 19 nt, Homo sapiens
ggcccagccuacccuugua

SEQ ID NO: 375563 - RNA, 19 nt, Homo sapiens
gcgugaagagguuugauga

SEQ ID NO: 375564 - RNA, 19 nt, Homo sapiens
ggugagcgacggcaucaug

SEQ ID NO: 375565 - RNA, 19 nt, Homo sapiens
ccacccaacagcaccaauu

SEQ ID NO: 375566 - RNA, 19 nt, Homo sapiens
gauccaggagaacauauca

SEQ ID NO: 375567 - RNA, 19 nt, Homo sapiens
uggaagcggugaagaugca

SEQ ID NO: 375568 - RNA, 19 nt, Homo sapiens
acgaaggcgugaagagguu

SEQ ID NO: 375569 - RNA, 19 nt, Homo sapiens
cucagaagaugaugauugg

SEQ ID NO: 375570 - RNA, 19 nt, Homo sapiens
aggcagaggccgcagugua

SEQ ID NO: 375571 - RNA, 19 nt, Homo sapiens
gggcagagacaagcgaugu

SEQ ID NO: 375572 - RNA, 19 nt, Homo sapiens
caacgagggcagagacaag

SEQ ID NO: 375573 - RNA, 19 nt, Homo sapiens
uggagagcaugauuaccaa

SEQ ID NO: 375574 - RNA, 19 nt, Homo sapiens
gaucccagcagagaagguu

SEQ ID NO: 375575 - RNA, 19 nt, Homo sapiens
ccuaagaugccuugagucu

SEQ ID NO: 375576 - RNA, 19 nt, Homo sapiens
guacauucucugcauccaa

SEQ ID NO: 375577 - RNA, 19 nt, Homo sapiens
cugaaagucuguguccaau

SEQ ID NO: 375578 - RNA, 19 nt, Homo sapiens
gauugggcgcugcaacuug

SEQ ID NO: 375579 - RNA, 19 nt, Homo sapiens
cgcaguaccagcaucauug

SEQ ID NO: 375580 - RNA, 19 nt, Homo sapiens
gcucagcaggcccuaagau

SEQ ID NO: 375581 - RNA, 19 nt, Homo sapiens
agacuauaacugucaucua

SEQ ID NO: 375582 - RNA, 19 nt, Homo sapiens
cugggcagaugauguagau

SEQ ID NO: 375583 - RNA, 19 nt, Homo sapiens
uagcaaaguccauccugau

SEQ ID NO: 375584 - RNA, 19 nt, Homo sapiens
ccaucgcccuggacaccaa

SEQ ID NO: 375585 - RNA, 19 nt, Homo sapiens
ccugaaagucuguguccaa

SEQ ID NO: 375586 - RNA, 19 nt, Homo sapiens
cgagaucccagcagagaag

SEQ ID NO: 375587 - RNA, 19 nt, Homo sapiens
caucaagaucaucagcaaa

SEQ ID NO: 375588 - RNA, 19 nt, Homo sapiens
gacacggcaucaagaucau

SEQ ID NO: 375589 - RNA, 19 nt, Homo sapiens
ggaaguggagcuggugaag

SEQ ID NO: 375590 - RNA, 19 nt, Homo sapiens
gaggugagcgacggcauca

SEQ ID NO: 375591 - RNA, 19 nt, Homo sapiens
ggguggacaucgucuuugc

SEQ ID NO: 375592 - RNA, 19 nt, Homo sapiens
ugaaagucuguguccaauu

SEQ ID NO: 375593 - RNA, 19 nt, Homo sapiens
ugaggccuaucugagacua

SEQ ID NO: 375594 - RNA, 19 nt, Homo sapiens
uuuaaguccucucuucucu

SEQ ID NO: 375595 - RNA, 19 nt, Homo sapiens
ggaacaccucugccuacug

SEQ ID NO: 375596 - RNA, 19 nt, Homo sapiens
gaaggcgugaagagguuug

SEQ ID NO: 375597 - RNA, 19 nt, Homo sapiens
gaacaugccuucccuaguu

SEQ ID NO: 375598 - RNA, 19 nt, Homo sapiens
gaaauacgcucagguguuu

SEQ ID NO: 375599 - RNA, 19 nt, Homo sapiens
gaaguuauauccaguugua

SEQ ID NO: 375600 - RNA, 19 nt, Homo sapiens
gaacaaacaucacaauuac

SEQ ID NO: 375601 - RNA, 19 nt, Homo sapiens
gcauaaagcugugauacua

SEQ ID NO: 375602 - RNA, 19 nt, Homo sapiens
gcauuuagcugccuaguga

SEQ ID NO: 375603 - RNA, 19 nt, Homo sapiens
gcaagaaguugguuuauag

SEQ ID NO: 375604 - RNA, 19 nt, Homo sapiens
gaaaauaucucuucaagga

SEQ ID NO: 375605 - RNA, 19 nt, Homo sapiens
gcacggagaugagauauau

SEQ ID NO: 375606 - RNA, 19 nt, Homo sapiens
cgagauagcuguacuuuca

SEQ ID NO: 375607 - RNA, 19 nt, Homo sapiens
gcagaagacucccaaguug

SEQ ID NO: 375608 - RNA, 19 nt, Homo sapiens
gagaauauccaguagguua

SEQ ID NO: 375609 - RNA, 19 nt, Homo sapiens
uauaauagcuccuguaaca

SEQ ID NO: 375610 - RNA, 19 nt, Homo sapiens
gaaaguaccugaccaacag

SEQ ID NO: 375611 - RNA, 19 nt, Homo sapiens
gauaaccucuuguauguug

SEQ ID NO: 375612 - RNA, 19 nt, Homo sapiens
gcagagaacaguggaauua

SEQ ID NO: 375613 - RNA, 19 nt, Homo sapiens
guacucaucuguugaauuc

SEQ ID NO: 375614 - RNA, 19 nt, Homo sapiens
gcacaugcuuucuuucauu

SEQ ID NO: 375615 - RNA, 19 nt, Homo sapiens
guauauggcuggauuauca

SEQ ID NO: 375616 - RNA, 19 nt, Homo sapiens
caaauaauggcacuuguua

SEQ ID NO: 375617 - RNA, 19 nt, Homo sapiens
gguauggucucuuuguaua

SEQ ID NO: 375618 - RNA, 19 nt, Homo sapiens
ccaauuaccgucaagauua

SEQ ID NO: 375619 - RNA, 19 nt, Homo sapiens
guauagaacuguugauuuc

SEQ ID NO: 375620 - RNA, 19 nt, Homo sapiens
aaacaaccacugucaauua

SEQ ID NO: 375621 - RNA, 19 nt, Homo sapiens
gaaguaaccucuccaacuc

SEQ ID NO: 375622 - RNA, 19 nt, Homo sapiens
ugaaaugccugcaaacuau

SEQ ID NO: 375623 - RNA, 19 nt, Homo sapiens
gaaacuaucucaaaaguga

SEQ ID NO: 375624 - RNA, 19 nt, Homo sapiens
ucagucagcuuccuuauug

SEQ ID NO: 375625 - RNA, 19 nt, Homo sapiens
aaggaaaucucacuaauga

SEQ ID NO: 375626 - RNA, 19 nt, Homo sapiens
auacagaccucuaucuuaa

SEQ ID NO: 375627 - RNA, 19 nt, Homo sapiens
caaccaagcuucuauaaaa

SEQ ID NO: 375628 - RNA, 19 nt, Homo sapiens
caagguggauuuacuguga

SEQ ID NO: 375629 - RNA, 19 nt, Homo sapiens
gaacgaggcccagaaguuu

SEQ ID NO: 375630 - RNA, 19 nt, Homo sapiens
gaaagucaaugguccacaa

SEQ ID NO: 375631 - RNA, 19 nt, Homo sapiens
caacucaccuaucugguuu

SEQ ID NO: 375632 - RNA, 19 nt, Homo sapiens
caacuuccuugcaauguaa

SEQ ID NO: 375633 - RNA, 19 nt, Homo sapiens
gcagaaacauaagcaauau

SEQ ID NO: 375634 - RNA, 19 nt, Homo sapiens
caccagcucuuacagaaua

SEQ ID NO: 375635 - RNA, 19 nt, Homo sapiens
gauuaucacuggaagauug

SEQ ID NO: 375636 - RNA, 19 nt, Homo sapiens
gaacuugcccuucaauaga

SEQ ID NO: 375637 - RNA, 19 nt, Homo sapiens
gagaagauaugagaaugaa

SEQ ID NO: 375638 - RNA, 19 nt, Homo sapiens
ggauacagaucuuccauuc

SEQ ID NO: 375639 - RNA, 19 nt, Homo sapiens
guaauugucaccugucuua

SEQ ID NO: 375640 - RNA, 19 nt, Homo sapiens
gaaaaggucuggucagcua

SEQ ID NO: 375641 - RNA, 19 nt, Homo sapiens
gauaacauguccacggauu

SEQ ID NO: 375642 - RNA, 19 nt, Homo sapiens
cuacucaacucccuucuuu

SEQ ID NO: 375643 - RNA, 19 nt, Homo sapiens
ucagagccauggacaauuu

SEQ ID NO: 375644 - RNA, 19 nt, Homo sapiens
gcugagcucuaaccagaua

SEQ ID NO: 375645 - RNA, 19 nt, Homo sapiens
gaagcaauguucugagugu

SEQ ID NO: 375646 - RNA, 19 nt, Homo sapiens
gaacugugauguugagaca

SEQ ID NO: 375647 - RNA, 19 nt, Homo sapiens
uggagaagaugaugcauaa

SEQ ID NO: 375648 - RNA, 19 nt, Homo sapiens
gaacagaaauguacauacc

SEQ ID NO: 375649 - RNA, 19 nt, Homo sapiens
acacagauuugccgccuua

SEQ ID NO: 375650 - RNA, 19 nt, Homo sapiens
ggccuuaccucuacauuug

SEQ ID NO: 375651 - RNA, 19 nt, Homo sapiens
gaauugaucucuauuucuc

SEQ ID NO: 375652 - RNA, 19 nt, Homo sapiens
cagaugggauuugcuaaua

SEQ ID NO: 375653 - RNA, 19 nt, Homo sapiens
ugacaucacugcacucaga

SEQ ID NO: 375654 - RNA, 19 nt, Homo sapiens
ggaaggagcaucagacuca

SEQ ID NO: 375655 - RNA, 19 nt, Homo sapiens
caacguaggccucucauga

SEQ ID NO: 375656 - RNA, 19 nt, Homo sapiens
gaccauuucuccaugcuuu

SEQ ID NO: 375657 - RNA, 19 nt, Homo sapiens
ggaaugauuugcaagaagu

SEQ ID NO: 375658 - RNA, 19 nt, Homo sapiens
uaugaccacuguucuauuu

SEQ ID NO: 375659 - RNA, 19 nt, Homo sapiens
gagaggagcccauugaaau

SEQ ID NO: 375660 - RNA, 19 nt, Homo sapiens
gaacuguccuuguggauac

SEQ ID NO: 375661 - RNA, 19 nt, Homo sapiens
ggaaauagagguagaugga

SEQ ID NO: 375662 - RNA, 19 nt, Homo sapiens
gaauugcacucuuuucaua

SEQ ID NO: 375663 - RNA, 19 nt, Homo sapiens
gcgagcaucuggugugaaa

SEQ ID NO: 375664 - RNA, 19 nt, Homo sapiens
uaaaggcaauuucaccaaa

SEQ ID NO: 375665 - RNA, 19 nt, Homo sapiens
ccuauacugucacuaauaa

SEQ ID NO: 375666 - RNA, 19 nt, Homo sapiens
gauauugccucaggaaaug

SEQ ID NO: 375667 - RNA, 19 nt, Homo sapiens
gagcucagaucacacucua

SEQ ID NO: 375668 - RNA, 19 nt, Homo sapiens
aauguuagcuucucaguau

SEQ ID NO: 375669 - RNA, 19 nt, Homo sapiens
ggacucauuucucucaaga

SEQ ID NO: 375670 - RNA, 19 nt, Homo sapiens
ggccaacucuaaauuuauu

SEQ ID NO: 375671 - RNA, 19 nt, Homo sapiens
gcuauaaacaucuucagua

SEQ ID NO: 375672 - RNA, 19 nt, Homo sapiens
cuaacuaacuucuuacaga

SEQ ID NO: 375673 - RNA, 19 nt, Homo sapiens
gcagguacauuuagagaag

SEQ ID NO: 375674 - RNA, 19 nt, Homo sapiens
caacgcagguacauuuaga

SEQ ID NO: 375675 - RNA, 19 nt, Homo sapiens
guucuacuuuccuucauua

SEQ ID NO: 375676 - RNA, 19 nt, Homo sapiens
ggaccaggaugcuaaagau

SEQ ID NO: 375677 - RNA, 19 nt, Homo sapiens
ccacgucagucuauauuga

SEQ ID NO: 375678 - RNA, 19 nt, Homo sapiens
ggaagccucuugaccauag

SEQ ID NO: 375679 - RNA, 19 nt, Homo sapiens
ggaagguguuagccugaua

SEQ ID NO: 375680 - RNA, 19 nt, Homo sapiens
gaccagaaaucuagaaguc

SEQ ID NO: 375681 - RNA, 19 nt, Homo sapiens
caaacagacugaccaagug

SEQ ID NO: 375682 - RNA, 19 nt, Homo sapiens
gaacuucgggucaccauug

SEQ ID NO: 375683 - RNA, 19 nt, Homo sapiens
auacagggcugcacaguga

SEQ ID NO: 375684 - RNA, 19 nt, Homo sapiens
uaucuuaagucaccuuuga

SEQ ID NO: 375685 - RNA, 19 nt, Homo sapiens
gcagugaugccucggauaa

SEQ ID NO: 375686 - RNA, 19 nt, Homo sapiens
caucuauccucuccaagua

SEQ ID NO: 375687 - RNA, 19 nt, Homo sapiens
ggacuauucugcaguucuu

SEQ ID NO: 375688 - RNA, 19 nt, Homo sapiens
aaacaaccauugaggaguu

SEQ ID NO: 375689 - RNA, 19 nt, Homo sapiens
ggcauuccaugugauauua

SEQ ID NO: 375690 - RNA, 19 nt, Homo sapiens
caccugaguuuacauauug

SEQ ID NO: 375691 - RNA, 19 nt, Homo sapiens
uaggccaacucuaaauuua

SEQ ID NO: 375692 - RNA, 19 nt, Homo sapiens
gggcuuugcugagaguuua

SEQ ID NO: 375693 - RNA, 19 nt, Homo sapiens
caacuuugcuccugguaau

SEQ ID NO: 375694 - RNA, 19 nt, Homo sapiens
gaauugacgucuuggaaag

SEQ ID NO: 375695 - RNA, 19 nt, Homo sapiens
uuccagagcuucacaguuu

SEQ ID NO: 375696 - RNA, 19 nt, Homo sapiens
gucaggacauggaaauaua

SEQ ID NO: 375697 - RNA, 19 nt, Homo sapiens
gcaggaagcugaacuuuga

SEQ ID NO: 375698 - RNA, 19 nt, Homo sapiens
gaacaaacaucacaauuac

SEQ ID NO: 375699 - RNA, 19 nt, Homo sapiens
gaaaauaucucuucaagga

SEQ ID NO: 375700 - RNA, 19 nt, Homo sapiens
gcacggagaugagauauau

SEQ ID NO: 375701 - RNA, 19 nt, Homo sapiens
cgagauagcuguacuuuca

SEQ ID NO: 375702 - RNA, 19 nt, Homo sapiens
gcagaagacucccaaguug

SEQ ID NO: 375703 - RNA, 19 nt, Homo sapiens
uauaauagcuccuguaaca

SEQ ID NO: 375704 - RNA, 19 nt, Homo sapiens
gcagagaacaguggaauua

SEQ ID NO: 375705 - RNA, 19 nt, Homo sapiens
guacucaucuguugaauuc

SEQ ID NO: 375706 - RNA, 19 nt, Homo sapiens
guauauggcuggauuauca

SEQ ID NO: 375707 - RNA, 19 nt, Homo sapiens
gguauggucucuuuguaua

SEQ ID NO: 375708 - RNA, 19 nt, Homo sapiens
ccaauuaccgucaagauua

SEQ ID NO: 375709 - RNA, 19 nt, Homo sapiens
ggaaauaguuacagauaca

SEQ ID NO: 375710 - RNA, 19 nt, Homo sapiens
aaacaaccacugucaauua

SEQ ID NO: 375711 - RNA, 19 nt, Homo sapiens
ggaaagacuuguuaagaca

SEQ ID NO: 375712 - RNA, 19 nt, Homo sapiens
gaaguaaccucuccaacuc

SEQ ID NO: 375713 - RNA, 19 nt, Homo sapiens
aaggaaaucucacuaauga

SEQ ID NO: 375714 - RNA, 19 nt, Homo sapiens
auacagaccucuaucuuaa

SEQ ID NO: 375715 - RNA, 19 nt, Homo sapiens
gagcaggcuuugaagauuu

SEQ ID NO: 375716 - RNA, 19 nt, Homo sapiens
caagguggauuuacuguga

SEQ ID NO: 375717 - RNA, 19 nt, Homo sapiens
gaacgaggcccagaaguuu

SEQ ID NO: 375718 - RNA, 19 nt, Homo sapiens
gaaagucaaugguccacaa

SEQ ID NO: 375719 - RNA, 19 nt, Homo sapiens
gccaugaccuuaagcagua

SEQ ID NO: 375720 - RNA, 19 nt, Homo sapiens
caacucaccuaucugguuu

SEQ ID NO: 375721 - RNA, 19 nt, Homo sapiens
caacuuccuugcaauguaa

SEQ ID NO: 375722 - RNA, 19 nt, Homo sapiens
gcagaaacauaagcaauau

SEQ ID NO: 375723 - RNA, 19 nt, Homo sapiens
caccagcucuuacagaaua

SEQ ID NO: 375724 - RNA, 19 nt, Homo sapiens
gauuaucacuggaagauug

SEQ ID NO: 375725 - RNA, 19 nt, Homo sapiens
gagaggagcaauucagaua

SEQ ID NO: 375726 - RNA, 19 nt, Homo sapiens
agaagaggaugguugcuua

SEQ ID NO: 375727 - RNA, 19 nt, Homo sapiens
ggauacagaucuuccauuc

SEQ ID NO: 375728 - RNA, 19 nt, Homo sapiens
guaauugucaccugucuua

SEQ ID NO: 375729 - RNA, 19 nt, Homo sapiens
gaggagcaauucagauauu

SEQ ID NO: 375730 - RNA, 19 nt, Homo sapiens
cuacucaacucccuucuuu

SEQ ID NO: 375731 - RNA, 19 nt, Homo sapiens
gauaacauguccacggauu

SEQ ID NO: 375732 - RNA, 19 nt, Homo sapiens
gaagcaauguucugagugu

SEQ ID NO: 375733 - RNA, 19 nt, Homo sapiens
gaacugugauguugagaca

SEQ ID NO: 375734 - RNA, 19 nt, Homo sapiens
gcugagcucuaaccagaua

SEQ ID NO: 375735 - RNA, 19 nt, Homo sapiens
gaggaaauaguuacagaua

SEQ ID NO: 375736 - RNA, 19 nt, Homo sapiens
acacagauuugccgccuua

SEQ ID NO: 375737 - RNA, 19 nt, Homo sapiens
ggccuuaccucuacauuug

SEQ ID NO: 375738 - RNA, 19 nt, Homo sapiens
gaauugaucucuauuucuc

SEQ ID NO: 375739 - RNA, 19 nt, Homo sapiens
cagaugggauuugcuaaua

SEQ ID NO: 375740 - RNA, 19 nt, Homo sapiens
caaauggaaagacuuguua

SEQ ID NO: 375741 - RNA, 19 nt, Homo sapiens
gaacuguccuuguggauac

SEQ ID NO: 375742 - RNA, 19 nt, Homo sapiens
ggaaauagagguagaugga

SEQ ID NO: 375743 - RNA, 19 nt, Homo sapiens
gaauugcacucuuuucaua

SEQ ID NO: 375744 - RNA, 19 nt, Homo sapiens
gcgagcaucuggugugaaa

SEQ ID NO: 375745 - RNA, 19 nt, Homo sapiens
ccuauacugucacuaauaa

SEQ ID NO: 375746 - RNA, 19 nt, Homo sapiens
gauauugccucaggaaaug

SEQ ID NO: 375747 - RNA, 19 nt, Homo sapiens
gagcucagaucacacucua

SEQ ID NO: 375748 - RNA, 19 nt, Homo sapiens
aauguuagcuucucaguau

SEQ ID NO: 375749 - RNA, 19 nt, Homo sapiens
gagagggugucaacaguga

SEQ ID NO: 375750 - RNA, 19 nt, Homo sapiens
guucuacuuuccuucauua

SEQ ID NO: 375751 - RNA, 19 nt, Homo sapiens
ggaccaggaugcuaaagau

SEQ ID NO: 375752 - RNA, 19 nt, Homo sapiens
ccacgucagucuauauuga

SEQ ID NO: 375753 - RNA, 19 nt, Homo sapiens
ggaagccucuugaccauag

SEQ ID NO: 375754 - RNA, 19 nt, Homo sapiens
ggaagguguuagccugaua

SEQ ID NO: 375755 - RNA, 19 nt, Homo sapiens
aauuagagcuuuggagaua

SEQ ID NO: 375756 - RNA, 19 nt, Homo sapiens
gaacuucgggucaccauug

SEQ ID NO: 375757 - RNA, 19 nt, Homo sapiens
auacagggcugcacaguga

SEQ ID NO: 375758 - RNA, 19 nt, Homo sapiens
uaucuuaagucaccuuuga

SEQ ID NO: 375759 - RNA, 19 nt, Homo sapiens
gcagugaugccucggauaa

SEQ ID NO: 375760 - RNA, 19 nt, Homo sapiens
caucuauccucuccaagua

SEQ ID NO: 375761 - RNA, 19 nt, Homo sapiens
ggacuauucugcaguucuu

SEQ ID NO: 375762 - RNA, 19 nt, Homo sapiens
aaacaaccauugaggaguu

SEQ ID NO: 375763 - RNA, 19 nt, Homo sapiens
ggcauuccaugugauauua

SEQ ID NO: 375764 - RNA, 19 nt, Homo sapiens
caccugaguuuacauauug

SEQ ID NO: 375765 - RNA, 19 nt, Homo sapiens
gaugguugcuuaagcuuug

SEQ ID NO: 375766 - RNA, 19 nt, Homo sapiens
gaagcagggugaagaaugg

SEQ ID NO: 375767 - RNA, 19 nt, Homo sapiens
caacuuugcuccugguaau

SEQ ID NO: 375768 - RNA, 19 nt, Homo sapiens
gaauugacgucuuggaaag

SEQ ID NO: 375769 - RNA, 19 nt, Homo sapiens
uuccagagcuucacaguuu

SEQ ID NO: 375770 - RNA, 19 nt, Homo sapiens
gucaggacauggaaauaua

SEQ ID NO: 375771 - RNA, 19 nt, Homo sapiens
gaagguggacaguaaugua

SEQ ID NO: 375772 - RNA, 19 nt, Homo sapiens
gaacaccacgucagucuau

SEQ ID NO: 375773 - RNA, 19 nt, Homo sapiens
gguguuagccugauauuau

SEQ ID NO: 375774 - RNA, 19 nt, Homo sapiens
gaacacguguggaccuugu

SEQ ID NO: 375775 - RNA, 19 nt, Homo sapiens
gaaggaggaucuauacacu

SEQ ID NO: 375776 - RNA, 19 nt, Homo sapiens
gcuaucggcuagaucagua

SEQ ID NO: 375777 - RNA, 19 nt, Homo sapiens
gaggauugguguccagauu

SEQ ID NO: 375778 - RNA, 19 nt, Homo sapiens
gaacguggaucacagucau

SEQ ID NO: 375779 - RNA, 19 nt, Homo sapiens
ugagcaaucuuaagaguau

SEQ ID NO: 375780 - RNA, 19 nt, Homo sapiens
ggaaaugagagaauuauag

SEQ ID NO: 375781 - RNA, 19 nt, Homo sapiens
ucaaagggcuguaugugau

SEQ ID NO: 375782 - RNA, 19 nt, Homo sapiens
caaccacugucaauuaugu

SEQ ID NO: 375783 - RNA, 19 nt, Homo sapiens
gaacugauggugucuaaca

SEQ ID NO: 375784 - RNA, 19 nt, Homo sapiens
gaacauugcacauucuugu

SEQ ID NO: 375785 - RNA, 19 nt, Homo sapiens
ggacaguaauguauucuac

SEQ ID NO: 375786 - RNA, 19 nt, Homo sapiens
gacacacucagaaauauua

SEQ ID NO: 375787 - RNA, 19 nt, Homo sapiens
ccagacacacucagaaaua

SEQ ID NO: 375788 - RNA, 19 nt, Homo sapiens
gggaagcuguuauccuauu

SEQ ID NO: 375789 - RNA, 19 nt, Homo sapiens
gagauaaauugcagcuaga

SEQ ID NO: 375790 - RNA, 19 nt, Homo sapiens
gaacugcuuuggucugaca

SEQ ID NO: 375791 - RNA, 19 nt, Homo sapiens
gacccgaaauauacaaauu

SEQ ID NO: 375792 - RNA, 19 nt, Homo sapiens
auacagaucuuccauucuu

SEQ ID NO: 375793 - RNA, 19 nt, Homo sapiens
caucguaugucuauugguu

SEQ ID NO: 375794 - RNA, 19 nt, Homo sapiens
gggaacugauggugucuaa

SEQ ID NO: 375795 - RNA, 19 nt, Homo sapiens
ggaaagugaugcaaauacu

SEQ ID NO: 375796 - RNA, 19 nt, Homo sapiens
gcacacgccauccuuguuu

SEQ ID NO: 375797 - RNA, 19 nt, Homo sapiens
ggaaagaacaucaagauua

SEQ ID NO: 375798 - RNA, 19 nt, Homo sapiens
gcagaaaggugccgacuuc

SEQ ID NO: 375799 - RNA, 19 nt, Homo sapiens
gaagggagauguggucauu

SEQ ID NO: 375800 - RNA, 19 nt, Homo sapiens
gaucaacgccucacugaaa

SEQ ID NO: 375801 - RNA, 19 nt, Homo sapiens
gaagggagccacucucaaa

SEQ ID NO: 375802 - RNA, 19 nt, Homo sapiens
gaacuucucucauggaacu

SEQ ID NO: 375803 - RNA, 19 nt, Homo sapiens
gauuaagucuggaaugaau

SEQ ID NO: 375804 - RNA, 19 nt, Homo sapiens
ugaaggagaugauuaaguc

SEQ ID NO: 375805 - RNA, 19 nt, Homo sapiens
gcacugggcuguuguucca

SEQ ID NO: 375806 - RNA, 19 nt, Homo sapiens
gaauguggcucgucugaac

SEQ ID NO: 375807 - RNA, 19 nt, Homo sapiens
ggcaucaucuguaccauug

SEQ ID NO: 375808 - RNA, 19 nt, Homo sapiens
aaacagccagcaagaguua

SEQ ID NO: 375809 - RNA, 19 nt, Homo sapiens
cgucugaacuucucucaug

SEQ ID NO: 375810 - RNA, 19 nt, Homo sapiens
gcagugauguggccaaugc

SEQ ID NO: 375811 - RNA, 19 nt, Homo sapiens
guucggagguuugaugaaa

SEQ ID NO: 375812 - RNA, 19 nt, Homo sapiens
cagcaacgcuuguagaacu

SEQ ID NO: 375813 - RNA, 19 nt, Homo sapiens
gcucagaagaugaugauug

SEQ ID NO: 375814 - RNA, 19 nt, Homo sapiens
gaaacagccagcaagaguu

SEQ ID NO: 375815 - RNA, 19 nt, Homo sapiens
gggacugccuucauucaga

SEQ ID NO: 375816 - RNA, 19 nt, Homo sapiens
ggaagguccugggagagaa

SEQ ID NO: 375817 - RNA, 19 nt, Homo sapiens
gcaauuauuugaggaacuc

SEQ ID NO: 375818 - RNA, 19 nt, Homo sapiens
gaacuuugccaugaauguu

SEQ ID NO: 375819 - RNA, 19 nt, Homo sapiens
caucuaccacuugcaauua

SEQ ID NO: 375820 - RNA, 19 nt, Homo sapiens
caagaaacagccagcaaga

SEQ ID NO: 375821 - RNA, 19 nt, Homo sapiens
gaagugggcagcaagaucu

SEQ ID NO: 375822 - RNA, 19 nt, Homo sapiens
gcacagccacggaaagcuu

SEQ ID NO: 375823 - RNA, 19 nt, Homo sapiens
ggagagaagggaaagaaca

SEQ ID NO: 375824 - RNA, 19 nt, Homo sapiens
cgagcaggauguugauaug

SEQ ID NO: 375825 - RNA, 19 nt, Homo sapiens
caucaagauuaucagcaaa

SEQ ID NO: 375826 - RNA, 19 nt, Homo sapiens
ggauguugauaugguguuu

SEQ ID NO: 375827 - RNA, 19 nt, Homo sapiens
gauccgaacugggcucauc

SEQ ID NO: 375828 - RNA, 19 nt, Homo sapiens
gggaaagaacaucaagauu

SEQ ID NO: 375829 - RNA, 19 nt, Homo sapiens
ggugaacuuugccaugaau

SEQ ID NO: 375830 - RNA, 19 nt, Homo sapiens
gcggagaccaucaagaaug

SEQ ID NO: 375831 - RNA, 19 nt, Homo sapiens
cgggugaacuuugccauga

SEQ ID NO: 375832 - RNA, 19 nt, Homo sapiens
gagaagggaaagaacauca

SEQ ID NO: 375833 - RNA, 19 nt, Homo sapiens
cugcagagguggagcugaa

SEQ ID NO: 375834 - RNA, 19 nt, Homo sapiens
gaacacuggcaucaucugu

SEQ ID NO: 375835 - RNA, 19 nt, Homo sapiens
gcccuuacuugcuucucua

SEQ ID NO: 375836 - RNA, 19 nt, Homo sapiens
gggcuguuguuccauugaa

SEQ ID NO: 375837 - RNA, 19 nt, Homo sapiens
uggagagcaugaucaagaa

SEQ ID NO: 375838 - RNA, 19 nt, Homo sapiens
cggagaccaucaagaaugu

SEQ ID NO: 375839 - RNA, 19 nt, Homo sapiens
gagggugacagcuuccuuu

SEQ ID NO: 375840 - RNA, 19 nt, Homo sapiens
gaacucacucugggcugua

SEQ ID NO: 375841 - RNA, 19 nt, Homo sapiens
ugagauuccugcagagaag

SEQ ID NO: 375842 - RNA, 19 nt, Homo sapiens
guggugaucuaggcauuga

SEQ ID NO: 375843 - RNA, 19 nt, Homo sapiens
ggaagugggcagcaagauc

SEQ ID NO: 375844 - RNA, 19 nt, Homo sapiens
gaucaguggagacguugaa

SEQ ID NO: 375845 - RNA, 19 nt, Homo sapiens
ggugacagcuuccuuuccu

SEQ ID NO: 375846 - RNA, 19 nt, Homo sapiens
caugcugucuggagaaaca

SEQ ID NO: 375847 - RNA, 19 nt, Homo sapiens
acaucaagauuaucagcaa

SEQ ID NO: 375848 - RNA, 19 nt, Homo sapiens
gaagggaaagaacaucaag

SEQ ID NO: 375849 - RNA, 19 nt, Homo sapiens
ccggaacacuggcaucauc

SEQ ID NO: 375850 - RNA, 19 nt, Homo sapiens
gggugaacuuugccaugaa

SEQ ID NO: 375851 - RNA, 19 nt, Homo sapiens
ugggaagccugucaucugu

SEQ ID NO: 375852 - RNA, 19 nt, Homo sapiens
ggacaccagggaagaagau

SEQ ID NO: 375853 - RNA, 19 nt, Homo sapiens
caugguggcucguggugau

SEQ ID NO: 375854 - RNA, 19 nt, Homo sapiens
gagagaagggaaagaacau

SEQ ID NO: 375855 - RNA, 19 nt, Homo sapiens
uguguacucuguccaguuc

SEQ ID NO: 375856 - RNA, 19 nt, Homo sapiens
gcaagaagggugugaaccu

SEQ ID NO: 375857 - RNA, 19 nt, Homo sapiens
acacuggcaucaucuguac

SEQ ID NO: 375858 - RNA, 19 nt, Homo sapiens
acacauuccuggagcacau

SEQ ID NO: 375859 - RNA, 19 nt, Homo sapiens
gaugaugggcuuauuucuc

SEQ ID NO: 375860 - RNA, 19 nt, Homo sapiens
augauuaagucuggaauga

SEQ ID NO: 375861 - RNA, 19 nt, Homo sapiens
agaaacagccagcaagagu

SEQ ID NO: 375862 - RNA, 19 nt, Homo sapiens
uccaggaucugaaguuugg

SEQ ID NO: 375863 - RNA, 19 nt, Homo sapiens
ugacggagguggaaaaugg

SEQ ID NO: 375864 - RNA, 19 nt, Homo sapiens
acaagaacaucugcaaggu

SEQ ID NO: 375865 - RNA, 19 nt, Homo sapiens
ggaaaagugugacgagaac

SEQ ID NO: 375866 - RNA, 19 nt, Homo sapiens
gccagcaacgcuuguagaa

SEQ ID NO: 375867 - RNA, 19 nt, Homo sapiens
agggagauguggucauugu

SEQ ID NO: 375868 - RNA, 19 nt, Homo sapiens
uggcccagcuucccgauca

SEQ ID NO: 375869 - RNA, 19 nt, Homo sapiens
uuauuucucuccaggugaa

SEQ ID NO: 375870 - RNA, 19 nt, Homo sapiens
gagaugauuaagucuggaa

SEQ ID NO: 375871 - RNA, 19 nt, Homo sapiens
ggcaagagggugacagcuu

SEQ ID NO: 375872 - RNA, 19 nt, Homo sapiens
ccaaucaagggaagaagga

SEQ ID NO: 375873 - RNA, 19 nt, Homo sapiens
ccaucuaccacuugcaauu

SEQ ID NO: 375874 - RNA, 19 nt, Homo sapiens
cuggagagcaugaucaaga

SEQ ID NO: 375875 - RNA, 19 nt, Homo sapiens
gcaagaucuacguggauga

SEQ ID NO: 375876 - RNA, 19 nt, Homo sapiens
cguugaaggagaugauuaa

SEQ ID NO: 375877 - RNA, 19 nt, Homo sapiens
cucagaagaugaugauugg

SEQ ID NO: 375878 - RNA, 19 nt, Homo sapiens
ucugauguccaugaaguua

SEQ ID NO: 375879 - RNA, 19 nt, Homo sapiens
gcagagguggagcugaaga

SEQ ID NO: 375880 - RNA, 19 nt, Homo sapiens
uuagggcacugggcuguug

SEQ ID NO: 375881 - RNA, 19 nt, Homo sapiens
gaugauuaagucuggaaug

SEQ ID NO: 375882 - RNA, 19 nt, Homo sapiens
ccauaaucguccucaccaa

SEQ ID NO: 375883 - RNA, 19 nt, Homo sapiens
augaugggcuuauuucucu

SEQ ID NO: 375884 - RNA, 19 nt, Homo sapiens
guggaugaugggcuuauuu

SEQ ID NO: 375885 - RNA, 19 nt, Homo sapiens
cugaacuucucucauggaa

SEQ ID NO: 375886 - RNA, 19 nt, Homo sapiens
ggaccuccgggugaacuuu

SEQ ID NO: 375887 - RNA, 19 nt, Homo sapiens
cuaccacuugcaauuauuu

SEQ ID NO: 375888 - RNA, 19 nt, Homo sapiens
gcgcaugcagaaccugauu

SEQ ID NO: 375889 - RNA, 19 nt, Homo sapiens
ggugaucuaggcauugaga

SEQ ID NO: 375890 - RNA, 19 nt, Homo sapiens
caguggagacguugaagga

SEQ ID NO: 375891 - RNA, 19 nt, Homo sapiens
agccgggacugccuucauu

SEQ ID NO: 375892 - RNA, 19 nt, Homo sapiens
ucuaccacuugcaauuauu

SEQ ID NO: 375893 - RNA, 19 nt, Homo sapiens
gauaugguguuugcgucau

SEQ ID NO: 375894 - RNA, 19 nt, Homo sapiens
aagaucaacgccucacuga

SEQ ID NO: 375895 - RNA, 19 nt, Homo sapiens
gacacuaaaggaccugaga

SEQ ID NO: 375896 - RNA, 19 nt, Homo sapiens
gcccguugcuguggcucua

SEQ ID NO: 375897 - RNA, 19 nt, Homo sapiens
gaacugucuucucauauuu

SEQ ID NO: 375898 - RNA, 19 nt, Homo sapiens
uaagugaggugaaauggua

SEQ ID NO: 375899 - RNA, 19 nt, Homo sapiens
cagcagauauucagacuuu

SEQ ID NO: 375900 - RNA, 19 nt, Homo sapiens
ggacuucuguuuccuggua

SEQ ID NO: 375901 - RNA, 19 nt, Homo sapiens
gaauguagacucauguaua

SEQ ID NO: 375902 - RNA, 19 nt, Homo sapiens
cauaucaucugaaauggua

SEQ ID NO: 375903 - RNA, 19 nt, Homo sapiens
ggauaaagaucacuuagag

SEQ ID NO: 375904 - RNA, 19 nt, Homo sapiens
ucagugggcugguugauuu

SEQ ID NO: 375905 - RNA, 19 nt, Homo sapiens
acacagacauuaaguauag

SEQ ID NO: 375906 - RNA, 19 nt, Homo sapiens
gagaaagggugcuuaugga

SEQ ID NO: 375907 - RNA, 19 nt, Homo sapiens
gaaaugguauggcugaagu

SEQ ID NO: 375908 - RNA, 19 nt, Homo sapiens
caccuugaaucccuaauua

SEQ ID NO: 375909 - RNA, 19 nt, Homo sapiens
ugaauuggaugaugacuau

SEQ ID NO: 375910 - RNA, 19 nt, Homo sapiens
ggguagugaugaacauuua

SEQ ID NO: 375911 - RNA, 19 nt, Homo sapiens
gaaaucacauucacuaagc

SEQ ID NO: 375912 - RNA, 19 nt, Homo sapiens
gacaaucuuugaaauguga

SEQ ID NO: 375913 - RNA, 19 nt, Homo sapiens
ggccgagaaugacaucuua

SEQ ID NO: 375914 - RNA, 19 nt, Homo sapiens
gggaaugucuucaguucuu

SEQ ID NO: 375915 - RNA, 19 nt, Homo sapiens
aaacacccaugcugaauga

SEQ ID NO: 375916 - RNA, 19 nt, Homo sapiens
gaagauccagaaacugaua

SEQ ID NO: 375917 - RNA, 19 nt, Homo sapiens
gggaagcucuggccugaga

SEQ ID NO: 375918 - RNA, 19 nt, Homo sapiens
ugaacugucuucucauauu

SEQ ID NO: 375919 - RNA, 19 nt, Homo sapiens
aagcaauucuccuuccuua

SEQ ID NO: 375920 - RNA, 19 nt, Homo sapiens
aaagauaucugcuaaacag

SEQ ID NO: 375921 - RNA, 19 nt, Homo sapiens
gauauguaaugcucagauu

SEQ ID NO: 375922 - RNA, 19 nt, Homo sapiens
auacauugcuugucugaaa

SEQ ID NO: 375923 - RNA, 19 nt, Homo sapiens
gcacuuagagacagaaaga

SEQ ID NO: 375924 - RNA, 19 nt, Homo sapiens
gaagaaacaauacaugcuu

SEQ ID NO: 375925 - RNA, 19 nt, Homo sapiens
cauacagaaugucuucaua

SEQ ID NO: 375926 - RNA, 19 nt, Homo sapiens
ucagcaaucuuucguucua

SEQ ID NO: 375927 - RNA, 19 nt, Homo sapiens
gcuaagggcucugggaguu

SEQ ID NO: 375928 - RNA, 19 nt, Homo sapiens
ggacauagccugaguuucc

SEQ ID NO: 375929 - RNA, 19 nt, Homo sapiens
ucagugagccuguuucauu

SEQ ID NO: 375930 - RNA, 19 nt, Homo sapiens
aagaaacccucacggcuaa

SEQ ID NO: 375931 - RNA, 19 nt, Homo sapiens
ugaaagacuugguuaucaa

SEQ ID NO: 375932 - RNA, 19 nt, Homo sapiens
uaauugagguuaagaaguc

SEQ ID NO: 375933 - RNA, 19 nt, Homo sapiens
guuaugaauuggaugauga

SEQ ID NO: 375934 - RNA, 19 nt, Homo sapiens
ccucuaagauuucguuuua

SEQ ID NO: 375935 - RNA, 19 nt, Homo sapiens
uggaauaacuguaggacuu

SEQ ID NO: 375936 - RNA, 19 nt, Homo sapiens
cacgugagauuuggaauaa

SEQ ID NO: 375937 - RNA, 19 nt, Homo sapiens
cagcuucaguuacaguuaa

SEQ ID NO: 375938 - RNA, 19 nt, Homo sapiens
caacagaugcaaguaguaa

SEQ ID NO: 375939 - RNA, 19 nt, Homo sapiens
agaaagaacucagcaaucu

SEQ ID NO: 375940 - RNA, 19 nt, Homo sapiens
gagagaaucuguaaaagug

SEQ ID NO: 375941 - RNA, 19 nt, Homo sapiens
gaauagcgcugccauuuuc

SEQ ID NO: 375942 - RNA, 19 nt, Homo sapiens
uaagaugaguggaaguguu

SEQ ID NO: 375943 - RNA, 19 nt, Homo sapiens
cagaaugucuucauaucau

SEQ ID NO: 375944 - RNA, 19 nt, Homo sapiens
cauguuagcuguguauugu

SEQ ID NO: 375945 - RNA, 19 nt, Homo sapiens
aaacaggacuucagguaag

SEQ ID NO: 375946 - RNA, 19 nt, Homo sapiens
gcccauggauuugaaagaa

SEQ ID NO: 375947 - RNA, 19 nt, Homo sapiens
guuuaacgcuagauuguga

SEQ ID NO: 375948 - RNA, 19 nt, Homo sapiens
uaagaaagcaagagaagga

SEQ ID NO: 375949 - RNA, 19 nt, Homo sapiens
cuaguuauauucggucuuu

SEQ ID NO: 375950 - RNA, 19 nt, Homo sapiens
caaacuuucuucaacuuuc

SEQ ID NO: 375951 - RNA, 19 nt, Homo sapiens
gggaaacacacagaaauuu

SEQ ID NO: 375952 - RNA, 19 nt, Homo sapiens
gguagccagugacccguua

SEQ ID NO: 375953 - RNA, 19 nt, Homo sapiens
cgaaagauaucugcuaaac

SEQ ID NO: 375954 - RNA, 19 nt, Homo sapiens
cagugagccuguuucauuu

SEQ ID NO: 375955 - RNA, 19 nt, Homo sapiens
gauccaaacugcucugaac

SEQ ID NO: 375956 - RNA, 19 nt, Homo sapiens
ugugaacugucuucucaua

SEQ ID NO: 375957 - RNA, 19 nt, Homo sapiens
gggcaauggugcaaucuca

SEQ ID NO: 375958 - RNA, 19 nt, Homo sapiens
gaaguucauuuguuuacag

SEQ ID NO: 375959 - RNA, 19 nt, Homo sapiens
gcagauauucagacuuuau

SEQ ID NO: 375960 - RNA, 19 nt, Homo sapiens
gcacacgccuagacugagu

SEQ ID NO: 375961 - RNA, 19 nt, Homo sapiens
guucaucaaugccagaaga

SEQ ID NO: 375962 - RNA, 19 nt, Homo sapiens
ggacaagcaggccauuuau

SEQ ID NO: 375963 - RNA, 19 nt, Homo sapiens
gggacuagcuuggccuuug

SEQ ID NO: 375964 - RNA, 19 nt, Homo sapiens
gucaacaacugguucauca

SEQ ID NO: 375965 - RNA, 19 nt, Homo sapiens
gugaagauccagaaacuga

SEQ ID NO: 375966 - RNA, 19 nt, Homo sapiens
caccacacccggcuaauuu

SEQ ID NO: 375967 - RNA, 19 nt, Homo sapiens
aaacucugaugaaccauga

SEQ ID NO: 375968 - RNA, 19 nt, Homo sapiens
gugaagcaauugauuuauc

SEQ ID NO: 375969 - RNA, 19 nt, Homo sapiens
gaaacugacaaucuuugaa

SEQ ID NO: 375970 - RNA, 19 nt, Homo sapiens
ggcaagcuguuucaguuug

SEQ ID NO: 375971 - RNA, 19 nt, Homo sapiens
gcaaacuuucuucaacuuu

SEQ ID NO: 375972 - RNA, 19 nt, Homo sapiens
cuagaaaucacauucacua

SEQ ID NO: 375973 - RNA, 19 nt, Homo sapiens
cggguuggcuccuacguuu

SEQ ID NO: 375974 - RNA, 19 nt, Homo sapiens
guuaugcacagaauguuua

SEQ ID NO: 375975 - RNA, 19 nt, Homo sapiens
uaaacaggacuucagguaa

SEQ ID NO: 375976 - RNA, 19 nt, Homo sapiens
gacaagcaggccauuuaua

SEQ ID NO: 375977 - RNA, 19 nt, Homo sapiens
gauaguaagaugaguggaa

SEQ ID NO: 375978 - RNA, 19 nt, Homo sapiens
ggagggcaauggugcaauc

SEQ ID NO: 375979 - RNA, 19 nt, Homo sapiens
gcaaacagcagauauucag

SEQ ID NO: 375980 - RNA, 19 nt, Homo sapiens
uuaccuugcuggaauuauu

SEQ ID NO: 375981 - RNA, 19 nt, Homo sapiens
gauucaaguuguucagaga

SEQ ID NO: 375982 - RNA, 19 nt, Homo sapiens
gcaguggauugaauuuaag

SEQ ID NO: 375983 - RNA, 19 nt, Homo sapiens
ccaaagugcugggauuaca

SEQ ID NO: 375984 - RNA, 19 nt, Homo sapiens
gagccuguuucauuugcua

SEQ ID NO: 375985 - RNA, 19 nt, Homo sapiens
gcaaacauuuuacacaguu

SEQ ID NO: 375986 - RNA, 19 nt, Homo sapiens
uagccugaguuuccuuuaa

SEQ ID NO: 375987 - RNA, 19 nt, Homo sapiens
aauguagacucauguauag

SEQ ID NO: 375988 - RNA, 19 nt, Homo sapiens
cacccaagaugauuugaug

SEQ ID NO: 375989 - RNA, 19 nt, Homo sapiens
ccacgugagauuuggaaua

SEQ ID NO: 375990 - RNA, 19 nt, Homo sapiens
cuaaacaggacuucaggua

SEQ ID NO: 375991 - RNA, 19 nt, Homo sapiens
caugauggcuacacagaca

SEQ ID NO: 375992 - RNA, 19 nt, Homo sapiens
ucagacaaauuugacacua

SEQ ID NO: 375993 - RNA, 19 nt, Homo sapiens
uuaacgaacucugcaaaga

SEQ ID NO: 375994 - RNA, 19 nt, Homo sapiens
gcgcuuugauuccagauag

SEQ ID NO: 375995 - RNA, 19 nt, Homo sapiens
aaagaucacuuagagaaag

SEQ ID NO: 375996 - RNA, 19 nt, Homo sapiens
ucagguaagugaggugaaa

SEQ ID NO: 375997 - RNA, 19 nt, Homo sapiens
gaacaugcugggaaccuua

SEQ ID NO: 375998 - RNA, 19 nt, Homo sapiens
gaacuucaccucccgauuc

SEQ ID NO: 375999 - RNA, 19 nt, Homo sapiens
ggaugaaucugccaagcaa

SEQ ID NO: 376000 - RNA, 19 nt, Homo sapiens
acaagaaacugagaagaaa

SEQ ID NO: 376001 - RNA, 19 nt, Homo sapiens
gcgacaagaugaugaacaa

SEQ ID NO: 376002 - RNA, 19 nt, Homo sapiens
ugacugggcugcucuggaa

SEQ ID NO: 376003 - RNA, 19 nt, Homo sapiens
ggugguauauccugucuga

SEQ ID NO: 376004 - RNA, 19 nt, Homo sapiens
gaaaagggccugccacaaa

SEQ ID NO: 376005 - RNA, 19 nt, Homo sapiens
gcagugagcccgaccucua

SEQ ID NO: 376006 - RNA, 19 nt, Homo sapiens
caaucgagguuccauguau

SEQ ID NO: 376007 - RNA, 19 nt, Homo sapiens
gauauccgaucuacaaugg

SEQ ID NO: 376008 - RNA, 19 nt, Homo sapiens
aaacugagaagaaaccuaa

SEQ ID NO: 376009 - RNA, 19 nt, Homo sapiens
gcucauugauucccucaug

SEQ ID NO: 376010 - RNA, 19 nt, Homo sapiens
gcaccuaccugaaccucau

SEQ ID NO: 376011 - RNA, 19 nt, Homo sapiens
ugggaaaguucacaagaaa

SEQ ID NO: 376012 - RNA, 19 nt, Homo sapiens
gauaugacccagcugagaa

SEQ ID NO: 376013 - RNA, 19 nt, Homo sapiens
caacaagagcgacaagaug

SEQ ID NO: 376014 - RNA, 19 nt, Homo sapiens
acucagggcucauugauuc

SEQ ID NO: 376015 - RNA, 19 nt, Homo sapiens
gcuccaagaucugcaguga

SEQ ID NO: 376016 - RNA, 19 nt, Homo sapiens
ggucagaaggccauaaaga

SEQ ID NO: 376017 - RNA, 19 nt, Homo sapiens
gcagcaugcucaacaacau

SEQ ID NO: 376018 - RNA, 19 nt, Homo sapiens
acaagaugaugaacaacaa

SEQ ID NO: 376019 - RNA, 19 nt, Homo sapiens
gcaacaagagcgacaagau

SEQ ID NO: 376020 - RNA, 19 nt, Homo sapiens
ccugaggucuucuucaaug

SEQ ID NO: 376021 - RNA, 19 nt, Homo sapiens
cacaagaaacugagaagaa

SEQ ID NO: 376022 - RNA, 19 nt, Homo sapiens
ggcaugagccaguugauug

SEQ ID NO: 376023 - RNA, 19 nt, Homo sapiens
gaccaugcguaacuacuca

SEQ ID NO: 376024 - RNA, 19 nt, Homo sapiens
gaagagacuguccaagcaa

SEQ ID NO: 376025 - RNA, 19 nt, Homo sapiens
gagccucccuccugagcaa

SEQ ID NO: 376026 - RNA, 19 nt, Homo sapiens
uauccgaucuacaauggaa

SEQ ID NO: 376027 - RNA, 19 nt, Homo sapiens
agaagagacuguccaagca

SEQ ID NO: 376028 - RNA, 19 nt, Homo sapiens
ggaacaugcugggaaccuu

SEQ ID NO: 376029 - RNA, 19 nt, Homo sapiens
guggauaguggaaagauuu

SEQ ID NO: 376030 - RNA, 19 nt, Homo sapiens
gaugaugaacaacaacuau

SEQ ID NO: 376031 - RNA, 19 nt, Homo sapiens
caacaugucccgggaagug

SEQ ID NO: 376032 - RNA, 19 nt, Homo sapiens
ccaagcaacaggucuauca

SEQ ID NO: 376033 - RNA, 19 nt, Homo sapiens
ggcaagagcaagaaagaug

SEQ ID NO: 376034 - RNA, 19 nt, Homo sapiens
gucagaaggccauaaagaa

SEQ ID NO: 376035 - RNA, 19 nt, Homo sapiens
gaaacugagaagaaaccua

SEQ ID NO: 376036 - RNA, 19 nt, Homo sapiens
cagcaagguuucgauagga

SEQ ID NO: 376037 - RNA, 19 nt, Homo sapiens
gcugaaggaggaacucauu

SEQ ID NO: 376038 - RNA, 19 nt, Homo sapiens
ccuauuacauccagcauac

SEQ ID NO: 376039 - RNA, 19 nt, Homo sapiens
ccagaaccgcuacagcuuu

SEQ ID NO: 376040 - RNA, 19 nt, Homo sapiens
uggcuuggcugacaauuac

SEQ ID NO: 376041 - RNA, 19 nt, Homo sapiens
ccaacagccucaggaacuu

SEQ ID NO: 376042 - RNA, 19 nt, Homo sapiens
gacaagaugaugaacaaca

SEQ ID NO: 376043 - RNA, 19 nt, Homo sapiens
cggcagaaguccaagucuu

SEQ ID NO: 376044 - RNA, 19 nt, Homo sapiens
agacagcaagguuucgaua

SEQ ID NO: 376045 - RNA, 19 nt, Homo sapiens
gacgacaagucuguggaaa

SEQ ID NO: 376046 - RNA, 19 nt, Homo sapiens
gcucccaggaugagaagua

SEQ ID NO: 376047 - RNA, 19 nt, Homo sapiens
gccagaagaccacccagaa

SEQ ID NO: 376048 - RNA, 19 nt, Homo sapiens
gaucugcagugaggacauc

SEQ ID NO: 376049 - RNA, 19 nt, Homo sapiens
uaugauggcuuggcugaca

SEQ ID NO: 376050 - RNA, 19 nt, Homo sapiens
cagcaacuccgaagacauc

SEQ ID NO: 376051 - RNA, 19 nt, Homo sapiens
ugaugaacaacaacuauga

SEQ ID NO: 376052 - RNA, 19 nt, Homo sapiens
gccagaccaugcguaacua

SEQ ID NO: 376053 - RNA, 19 nt, Homo sapiens
agaaggccauaaagaagug

SEQ ID NO: 376054 - RNA, 19 nt, Homo sapiens
ggauauccgaucuacaaug

SEQ ID NO: 376055 - RNA, 19 nt, Homo sapiens
uugggaaaguucacaagaa

SEQ ID NO: 376056 - RNA, 19 nt, Homo sapiens
aacaagagcgacaagauga

SEQ ID NO: 376057 - RNA, 19 nt, Homo sapiens
uaacuacucagggcucauu

SEQ ID NO: 376058 - RNA, 19 nt, Homo sapiens
acgcggaccucgcacucua

SEQ ID NO: 376059 - RNA, 19 nt, Homo sapiens
accgccagcuggaguauaa

SEQ ID NO: 376060 - RNA, 19 nt, Homo sapiens
ggcugacaauuacaacuau

SEQ ID NO: 376061 - RNA, 19 nt, Homo sapiens
uccauccugugcaguauuu

SEQ ID NO: 376062 - RNA, 19 nt, Homo sapiens
ccacugacgagcugaagga

SEQ ID NO: 376063 - RNA, 19 nt, Homo sapiens
ucagaaggccauaaagaag

SEQ ID NO: 376064 - RNA, 19 nt, Homo sapiens
gcugacaauuacaacuaug

SEQ ID NO: 376065 - RNA, 19 nt, Homo sapiens
gcagcuacuacuccaaguu

SEQ ID NO: 376066 - RNA, 19 nt, Homo sapiens
agacuguccaagcaaguua

SEQ ID NO: 376067 - RNA, 19 nt, Homo sapiens
cuucaccucccgauucuaa

SEQ ID NO: 376068 - RNA, 19 nt, Homo sapiens
ugauugggcugaaggaaaa

SEQ ID NO: 376069 - RNA, 19 nt, Homo sapiens
gaaccgggaacgccgagau

SEQ ID NO: 376070 - RNA, 19 nt, Homo sapiens
ucgccucucugcucuccua

SEQ ID NO: 376071 - RNA, 19 nt, Homo sapiens
caagagcgacaagaugaug

SEQ ID NO: 376072 - RNA, 19 nt, Homo sapiens
gaaaacugcauguguguuc

SEQ ID NO: 376073 - RNA, 19 nt, Homo sapiens
cagaaggccauaaagaagu

SEQ ID NO: 376074 - RNA, 19 nt, Homo sapiens
cagaaccgcuacagcuuuu

SEQ ID NO: 376075 - RNA, 19 nt, Homo sapiens
aaucgagguuccauguaug

SEQ ID NO: 376076 - RNA, 19 nt, Homo sapiens
uggcugacaauuacaacua

SEQ ID NO: 376077 - RNA, 19 nt, Homo sapiens
ucaacaacaucaucaaccu

SEQ ID NO: 376078 - RNA, 19 nt, Homo sapiens
ccaaucgagguuccaugua

SEQ ID NO: 376079 - RNA, 19 nt, Homo sapiens
gagaaguaccaggccauug

SEQ ID NO: 376080 - RNA, 19 nt, Homo sapiens
aaaagggccugccacaaau

SEQ ID NO: 376081 - RNA, 19 nt, Homo sapiens
cgauggcaauagcaacaug

SEQ ID NO: 376082 - RNA, 19 nt, Homo sapiens
ggaacgccgagauccagaa

SEQ ID NO: 376083 - RNA, 19 nt, Homo sapiens
agcccgaccucuacuguga

SEQ ID NO: 376084 - RNA, 19 nt, Homo sapiens
ggaacuucaccucccgauu

SEQ ID NO: 376085 - RNA, 19 nt, Homo sapiens
gccaacagccucaggaacu

SEQ ID NO: 376086 - RNA, 19 nt, Homo sapiens
acagcaagguuucgauagg

SEQ ID NO: 376087 - RNA, 19 nt, Homo sapiens
acccugaggucuucuucaa

SEQ ID NO: 376088 - RNA, 19 nt, Homo sapiens
cagcuacuacuccaaguuc

SEQ ID NO: 376089 - RNA, 19 nt, Homo sapiens
gcccaucuccugcaacaag

SEQ ID NO: 376090 - RNA, 19 nt, Homo sapiens
gaacuggagccggcacuac

SEQ ID NO: 376091 - RNA, 19 nt, Homo sapiens
ccugcaaucuggcaacucu

SEQ ID NO: 376092 - RNA, 19 nt, Homo sapiens
gagacuguccaagcaaguu

SEQ ID NO: 376093 - RNA, 19 nt, Homo sapiens
cgucaucauucccuucucu

SEQ ID NO: 376094 - RNA, 19 nt, Homo sapiens
gaacgccgagauccagaag

SEQ ID NO: 376095 - RNA, 19 nt, Homo sapiens
ggggauauccgaucuacaa

SEQ ID NO: 376096 - RNA, 19 nt, Homo sapiens
caggagcaggugaugauga

SEQ ID NO: 376097 - RNA, 19 nt, Homo sapiens
gaaagaagcuguugcauua

SEQ ID NO: 376098 - RNA, 19 nt, Homo sapiens
ggagauacuuuaccuauaa

SEQ ID NO: 376099 - RNA, 19 nt, Homo sapiens
caagaaauaucugcaguua

SEQ ID NO: 376100 - RNA, 19 nt, Homo sapiens
guacugaccuucucauuga

SEQ ID NO: 376101 - RNA, 19 nt, Homo sapiens
gaggaaccauugcagauua

SEQ ID NO: 376102 - RNA, 19 nt, Homo sapiens
gaacuaaggccuucuauca

SEQ ID NO: 376103 - RNA, 19 nt, Homo sapiens
gaauggaaaugacaagaaa

SEQ ID NO: 376104 - RNA, 19 nt, Homo sapiens
ggagguggcugaacuaaau

SEQ ID NO: 376105 - RNA, 19 nt, Homo sapiens
caacauuuguccuaaguaa

SEQ ID NO: 376106 - RNA, 19 nt, Homo sapiens
agaauggacucuaucuuua

SEQ ID NO: 376107 - RNA, 19 nt, Homo sapiens
gaagucauguugaagaaga

SEQ ID NO: 376108 - RNA, 19 nt, Homo sapiens
gaaugaaauugccaaagaa

SEQ ID NO: 376109 - RNA, 19 nt, Homo sapiens
ugaagaagauguaagaaug

SEQ ID NO: 376110 - RNA, 19 nt, Homo sapiens
gcacauugcuucgccauug

SEQ ID NO: 376111 - RNA, 19 nt, Homo sapiens
gaagggacauuaauccaau

SEQ ID NO: 376112 - RNA, 19 nt, Homo sapiens
ccaaaucucuucuaaacga

SEQ ID NO: 376113 - RNA, 19 nt, Homo sapiens
gcacagcgauuaccaguac

SEQ ID NO: 376114 - RNA, 19 nt, Homo sapiens
gcacaacugccacuuauga

SEQ ID NO: 376115 - RNA, 19 nt, Homo sapiens
agaaauaucugcaguuauc

SEQ ID NO: 376116 - RNA, 19 nt, Homo sapiens
ggaaagaagcuguugcauu

SEQ ID NO: 376117 - RNA, 19 nt, Homo sapiens
gccacaggcucgacaaaua

SEQ ID NO: 376118 - RNA, 19 nt, Homo sapiens
gaagugaucauagcaaauu

SEQ ID NO: 376119 - RNA, 19 nt, Homo sapiens
aagaaacucucccugauuu

SEQ ID NO: 376120 - RNA, 19 nt, Homo sapiens
caaagaaacucucccugau

SEQ ID NO: 376121 - RNA, 19 nt, Homo sapiens
ccagagacuuggagacuaa

SEQ ID NO: 376122 - RNA, 19 nt, Homo sapiens
gaaaauacggcucauguua

SEQ ID NO: 376123 - RNA, 19 nt, Homo sapiens
cagaagaccuuugcaaguu

SEQ ID NO: 376124 - RNA, 19 nt, Homo sapiens
ggagagaauuuauaugucu

SEQ ID NO: 376125 - RNA, 19 nt, Homo sapiens
gaagaagucauguugaaga

SEQ ID NO: 376126 - RNA, 19 nt, Homo sapiens
gccacuagaucucauauga

SEQ ID NO: 376127 - RNA, 19 nt, Homo sapiens
gagaaaguauaauggcaaa

SEQ ID NO: 376128 - RNA, 19 nt, Homo sapiens
agaaugaaauugccaaaga

SEQ ID NO: 376129 - RNA, 19 nt, Homo sapiens
uaacugcgcuaugauuaaa

SEQ ID NO: 376130 - RNA, 19 nt, Homo sapiens
gugaagaagucauguugaa

SEQ ID NO: 376131 - RNA, 19 nt, Homo sapiens
ggauguaucuguccuugau

SEQ ID NO: 376132 - RNA, 19 nt, Homo sapiens
ugaagacaaugacaacaaa

SEQ ID NO: 376133 - RNA, 19 nt, Homo sapiens
gaccauacagucaauuuaa

SEQ ID NO: 376134 - RNA, 19 nt, Homo sapiens
aaaggcaacugugaugaua

SEQ ID NO: 376135 - RNA, 19 nt, Homo sapiens
gaagaccuuugcaaguuug

SEQ ID NO: 376136 - RNA, 19 nt, Homo sapiens
caagaaggcucaguuuaag

SEQ ID NO: 376137 - RNA, 19 nt, Homo sapiens
acaagaaggcucaguuuaa

SEQ ID NO: 376138 - RNA, 19 nt, Homo sapiens
gaagaggguuaaccagcuu

SEQ ID NO: 376139 - RNA, 19 nt, Homo sapiens
aagcaugccuuguuucuau

SEQ ID NO: 376140 - RNA, 19 nt, Homo sapiens
ucaagaaucucaugauaac

SEQ ID NO: 376141 - RNA, 19 nt, Homo sapiens
gaagaggaacagcacagua

SEQ ID NO: 376142 - RNA, 19 nt, Homo sapiens
gaagcaaaccagagacuug

SEQ ID NO: 376143 - RNA, 19 nt, Homo sapiens
gugggaaucugcucacuga

SEQ ID NO: 376144 - RNA, 19 nt, Homo sapiens
gugaaagaauggacucuau

SEQ ID NO: 376145 - RNA, 19 nt, Homo sapiens
acucaagaaucucaugaua

SEQ ID NO: 376146 - RNA, 19 nt, Homo sapiens
gcuaaaggcuggcacaacu

SEQ ID NO: 376147 - RNA, 19 nt, Homo sapiens
ucaagaccauccagaaaug

SEQ ID NO: 376148 - RNA, 19 nt, Homo sapiens
gaagaaaagugaagaaguc

SEQ ID NO: 376149 - RNA, 19 nt, Homo sapiens
aggcagagcucccagagaa

SEQ ID NO: 376150 - RNA, 19 nt, Homo sapiens
ucuaaacgauggcauucua

SEQ ID NO: 376151 - RNA, 19 nt, Homo sapiens
gaagaagauguaagaaugu

SEQ ID NO: 376152 - RNA, 19 nt, Homo sapiens
aaauacggcucauguuaau

SEQ ID NO: 376153 - RNA, 19 nt, Homo sapiens
gaaaagcgaugagaagaug

SEQ ID NO: 376154 - RNA, 19 nt, Homo sapiens
ccagaaaugauaugagaaa

SEQ ID NO: 376155 - RNA, 19 nt, Homo sapiens
gaauggacucuaucuuuau

SEQ ID NO: 376156 - RNA, 19 nt, Homo sapiens
ggagagcgcacuugacugu

SEQ ID NO: 376157 - RNA, 19 nt, Homo sapiens
gcaggcagcgccacuuuga

SEQ ID NO: 376158 - RNA, 19 nt, Homo sapiens
ggaaaugacaagaaauauc

SEQ ID NO: 376159 - RNA, 19 nt, Homo sapiens
agaagaccuuugcaaguuu

SEQ ID NO: 376160 - RNA, 19 nt, Homo sapiens
gcugaaugaagacaacuua

SEQ ID NO: 376161 - RNA, 19 nt, Homo sapiens
gaaagaauggacucuaucu

SEQ ID NO: 376162 - RNA, 19 nt, Homo sapiens
gaaaggcaacugugaugau

SEQ ID NO: 376163 - RNA, 19 nt, Homo sapiens
caugauaacagaagcauug

SEQ ID NO: 376164 - RNA, 19 nt, Homo sapiens
caagaaaacucuagagaag

SEQ ID NO: 376165 - RNA, 19 nt, Homo sapiens
gagaaaggcaacugugaug

SEQ ID NO: 376166 - RNA, 19 nt, Homo sapiens
gaaacagaauggaaaugac

SEQ ID NO: 376167 - RNA, 19 nt, Homo sapiens
guauuguucugcaguguug

SEQ ID NO: 376168 - RNA, 19 nt, Homo sapiens
ggaagggacauuaauccaa

SEQ ID NO: 376169 - RNA, 19 nt, Homo sapiens
guuauuagggcuuauggua

SEQ ID NO: 376170 - RNA, 19 nt, Homo sapiens
caacaaagcaaguaaagcu

SEQ ID NO: 376171 - RNA, 19 nt, Homo sapiens
uaacagaccauacagucaa

SEQ ID NO: 376172 - RNA, 19 nt, Homo sapiens
ugaggagacuggagauuuc

SEQ ID NO: 376173 - RNA, 19 nt, Homo sapiens
acuaaggccuucuaucaga

SEQ ID NO: 376174 - RNA, 19 nt, Homo sapiens
gcacgcgaccuucuaaaca

SEQ ID NO: 376175 - RNA, 19 nt, Homo sapiens
caacaaaaguauuggaugu

SEQ ID NO: 376176 - RNA, 19 nt, Homo sapiens
ggagaauugugugugcauu

SEQ ID NO: 376177 - RNA, 19 nt, Homo sapiens
uugacucacugguccauua

SEQ ID NO: 376178 - RNA, 19 nt, Homo sapiens
gaaugaagacaacuuaggu

SEQ ID NO: 376179 - RNA, 19 nt, Homo sapiens
gagaggaagugaucauagc

SEQ ID NO: 376180 - RNA, 19 nt, Homo sapiens
gauuacagaguaugcauga

SEQ ID NO: 376181 - RNA, 19 nt, Homo sapiens
ugaaacagaauggaaauga

SEQ ID NO: 376182 - RNA, 19 nt, Homo sapiens
ugaggaaaaugacaaagua

SEQ ID NO: 376183 - RNA, 19 nt, Homo sapiens
cagauuaccagccagauga

SEQ ID NO: 376184 - RNA, 19 nt, Homo sapiens
uguggaauuugucaucuaa

SEQ ID NO: 376185 - RNA, 19 nt, Homo sapiens
gaagcucggaagaggguua

SEQ ID NO: 376186 - RNA, 19 nt, Homo sapiens
ucacagagccacuagaucu

SEQ ID NO: 376187 - RNA, 19 nt, Homo sapiens
ccagcaguguuccugagua

SEQ ID NO: 376188 - RNA, 19 nt, Homo sapiens
gcaguguuccugaguaugu

SEQ ID NO: 376189 - RNA, 19 nt, Homo sapiens
ucaaaagcaugccuuguuu

SEQ ID NO: 376190 - RNA, 19 nt, Homo sapiens
aagaagucauguugaagaa

SEQ ID NO: 376191 - RNA, 19 nt, Homo sapiens
cagccuugcccaccauuua

SEQ ID NO: 376192 - RNA, 19 nt, Homo sapiens
acgauggcauucuauguaa

SEQ ID NO: 376193 - RNA, 19 nt, Homo sapiens
aggcaacugugaugauaaa

SEQ ID NO: 376194 - RNA, 19 nt, Homo sapiens
cagcaguguuccugaguau

SEQ ID NO: 376195 - RNA, 19 nt, Homo sapiens
aaagaaacucucccugauu

SEQ ID NO: 376196 - RNA, 19 nt, Homo sapiens
caagaaaccucaaaagcau

SEQ ID NO: 376197 - RNA, 19 nt, Homo sapiens
acacuguacucuccaauaa

SEQ ID NO: 376198 - RNA, 19 nt, Homo sapiens
uaaagcaccuuguugaaag

SEQ ID NO: 376199 - RNA, 19 nt, Homo sapiens
caauaaagcaccuuguuga

SEQ ID NO: 376200 - RNA, 19 nt, Homo sapiens
caagaaguauugucagagu

SEQ ID NO: 376201 - RNA, 19 nt, Homo sapiens
acaagaaccuggacaccaa

SEQ ID NO: 376202 - RNA, 19 nt, Homo sapiens
ggacagcuguaaauuucug

SEQ ID NO: 376203 - RNA, 19 nt, Homo sapiens
gaaguauugucagaguuga

SEQ ID NO: 376204 - RNA, 19 nt, Homo sapiens
uggaugaacuggacaagug

SEQ ID NO: 376205 - RNA, 19 nt, Homo sapiens
gcuaugaccaggccaagaa

SEQ ID NO: 376206 - RNA, 19 nt, Homo sapiens
gaugaaacuccuugugcua

SEQ ID NO: 376207 - RNA, 19 nt, Homo sapiens
cuggacagcuguaaauuuc

SEQ ID NO: 376208 - RNA, 19 nt, Homo sapiens
caacuacggcugcuacugu

SEQ ID NO: 376209 - RNA, 19 nt, Homo sapiens
ccaauaaagcaccuuguug

SEQ ID NO: 376210 - RNA, 19 nt, Homo sapiens
ggacaagugcugccagaca

SEQ ID NO: 376211 - RNA, 19 nt, Homo sapiens
gcucggcaaucaccuguag

SEQ ID NO: 376212 - RNA, 19 nt, Homo sapiens
uaacaaggcacacaagaac

SEQ ID NO: 376213 - RNA, 19 nt, Homo sapiens
aaagcaccuuguugaaaga

SEQ ID NO: 376214 - RNA, 19 nt, Homo sapiens
caacgcugccaucugcuuu

SEQ ID NO: 376215 - RNA, 19 nt, Homo sapiens
ugccucaucucacacugua

SEQ ID NO: 376216 - RNA, 19 nt, Homo sapiens
ucaaaagcaucaccucuau

SEQ ID NO: 376217 - RNA, 19 nt, Homo sapiens
gaaccuggacaccaagaag

SEQ ID NO: 376218 - RNA, 19 nt, Homo sapiens
auaaagcaccuuguugaaa

SEQ ID NO: 376219 - RNA, 19 nt, Homo sapiens
acacccacaccuauucaua

SEQ ID NO: 376220 - RNA, 19 nt, Homo sapiens
gaauaucaccucucaaaag

SEQ ID NO: 376221 - RNA, 19 nt, Homo sapiens
caaaagcuccauauaacaa

SEQ ID NO: 376222 - RNA, 19 nt, Homo sapiens
aauaaagcaccuuguugaa

SEQ ID NO: 376223 - RNA, 19 nt, Homo sapiens
acuguacucuccaauaaag

SEQ ID NO: 376224 - RNA, 19 nt, Homo sapiens
agaaguauugucagaguug

SEQ ID NO: 376225 - RNA, 19 nt, Homo sapiens
accaagaaguauugucaga

SEQ ID NO: 376226 - RNA, 19 nt, Homo sapiens
agacacaugacaacugcua

SEQ ID NO: 376227 - RNA, 19 nt, Homo sapiens
aagaaguauugucagaguu

SEQ ID NO: 376228 - RNA, 19 nt, Homo sapiens
acaccaagaaguauuguca

SEQ ID NO: 376229 - RNA, 19 nt, Homo sapiens
gcaacgcugccaucugcuu

SEQ ID NO: 376230 - RNA, 19 nt, Homo sapiens
gagugugaggccuucauuu

SEQ ID NO: 376231 - RNA, 19 nt, Homo sapiens
cauauaacaaggcacacaa

SEQ ID NO: 376232 - RNA, 19 nt, Homo sapiens
uuucucaccuugacugcaa

SEQ ID NO: 376233 - RNA, 19 nt, Homo sapiens
cacacuguacucuccaaua

SEQ ID NO: 376234 - RNA, 19 nt, Homo sapiens
uauaacaaggcacacaaga

SEQ ID NO: 376235 - RNA, 19 nt, Homo sapiens
gaaacuccuugugcuagcu

SEQ ID NO: 376236 - RNA, 19 nt, Homo sapiens
gugaggccuucauuugcaa

SEQ ID NO: 376237 - RNA, 19 nt, Homo sapiens
ugugaggccuucauuugca

SEQ ID NO: 376238 - RNA, 19 nt, Homo sapiens
guacacccacaccuauuca

SEQ ID NO: 376239 - RNA, 19 nt, Homo sapiens
auaacaaggcacacaagaa

SEQ ID NO: 376240 - RNA, 19 nt, Homo sapiens
aaucaccuguagcagcaaa

SEQ ID NO: 376241 - RNA, 19 nt, Homo sapiens
ugucagaguugaauaucac

SEQ ID NO: 376242 - RNA, 19 nt, Homo sapiens
agugugaggccuucauuug

SEQ ID NO: 376243 - RNA, 19 nt, Homo sapiens
aguugaauaucaccucuca

SEQ ID NO: 376244 - RNA, 19 nt, Homo sapiens
cacaugacaacugcuauga

SEQ ID NO: 376245 - RNA, 19 nt, Homo sapiens
cuaucugccucaucucaca

SEQ ID NO: 376246 - RNA, 19 nt, Homo sapiens
acacaugacaacugcuaug

SEQ ID NO: 376247 - RNA, 19 nt, Homo sapiens
gaaacaagacgaccuacaa

SEQ ID NO: 376248 - RNA, 19 nt, Homo sapiens
gcaccaaauuucugagcua

SEQ ID NO: 376249 - RNA, 19 nt, Homo sapiens
uuucugagcuacaaguuua

SEQ ID NO: 376250 - RNA, 19 nt, Homo sapiens
gaauuucccucucucauac

SEQ ID NO: 376251 - RNA, 19 nt, Homo sapiens
acaagacgaccuacaauaa

SEQ ID NO: 376252 - RNA, 19 nt, Homo sapiens
cuacaaacgucuggagaaa

SEQ ID NO: 376253 - RNA, 19 nt, Homo sapiens
caagacgaccuacaauaaa

SEQ ID NO: 376254 - RNA, 19 nt, Homo sapiens
ccaaauuucugagcuacaa

SEQ ID NO: 376255 - RNA, 19 nt, Homo sapiens
ugaagacccuccuacuguu

SEQ ID NO: 376256 - RNA, 19 nt, Homo sapiens
agagggagcagcuauuuaa

SEQ ID NO: 376257 - RNA, 19 nt, Homo sapiens
ugaauuucccucucucaua

SEQ ID NO: 376258 - RNA, 19 nt, Homo sapiens
gcagaagucaacuguguga

SEQ ID NO: 376259 - RNA, 19 nt, Homo sapiens
caccucaacuccgugcuua

SEQ ID NO: 376260 - RNA, 19 nt, Homo sapiens
ugagacauccagcagauuu

SEQ ID NO: 376261 - RNA, 19 nt, Homo sapiens
gcauucaccugcccugucu

SEQ ID NO: 376262 - RNA, 19 nt, Homo sapiens
ggaagccgcacucaguuau

SEQ ID NO: 376263 - RNA, 19 nt, Homo sapiens
gaagacccuccuacuguug

SEQ ID NO: 376264 - RNA, 19 nt, Homo sapiens
gcagauuuccagccuucua

SEQ ID NO: 376265 - RNA, 19 nt, Homo sapiens
ggcaggagcccuucuauac

SEQ ID NO: 376266 - RNA, 19 nt, Homo sapiens
ggauguggcaccaaauuuc

SEQ ID NO: 376267 - RNA, 19 nt, Homo sapiens
ucaugacuguugcuacaaa

SEQ ID NO: 376268 - RNA, 19 nt, Homo sapiens
cugcagaagucaacugugu

SEQ ID NO: 376269 - RNA, 19 nt, Homo sapiens
caccugcccugucuccaaa

SEQ ID NO: 376270 - RNA, 19 nt, Homo sapiens
aaaggaagccgcacucagu

SEQ ID NO: 376271 - RNA, 19 nt, Homo sapiens
ccagagggagcagcuauuu

SEQ ID NO: 376272 - RNA, 19 nt, Homo sapiens
gcugcugugucacucauga

SEQ ID NO: 376273 - RNA, 19 nt, Homo sapiens
cagagggagcagcuauuua

SEQ ID NO: 376274 - RNA, 19 nt, Homo sapiens
gugaauuuccacagaauga

SEQ ID NO: 376275 - RNA, 19 nt, Homo sapiens
gcaggcccaugggaauuug

SEQ ID NO: 376276 - RNA, 19 nt, Homo sapiens
gcuacaaacgucuggagaa

SEQ ID NO: 376277 - RNA, 19 nt, Homo sapiens
acggaucgcugcuguguca

SEQ ID NO: 376278 - RNA, 19 nt, Homo sapiens
aaugagacauccagcagau

SEQ ID NO: 376279 - RNA, 19 nt, Homo sapiens
aacaagacgaccuacaaua

SEQ ID NO: 376280 - RNA, 19 nt, Homo sapiens
aaacaagacgaccuacaau

SEQ ID NO: 376281 - RNA, 19 nt, Homo sapiens
caacugugugagugugaua

SEQ ID NO: 376282 - RNA, 19 nt, Homo sapiens
caacggaucgcugcugugu

SEQ ID NO: 376283 - RNA, 19 nt, Homo sapiens
cuagaaacaagacgaccua

SEQ ID NO: 376284 - RNA, 19 nt, Homo sapiens
gagcuaggccaguccaucu

SEQ ID NO: 376285 - RNA, 19 nt, Homo sapiens
acaaacgucuggagaaacg

SEQ ID NO: 376286 - RNA, 19 nt, Homo sapiens
ggccaguccaucugcauuu

SEQ ID NO: 376287 - RNA, 19 nt, Homo sapiens
acucaugacuguugcuaca

SEQ ID NO: 376288 - RNA, 19 nt, Homo sapiens
gccaguccaucugcauuug

SEQ ID NO: 376289 - RNA, 19 nt, Homo sapiens
gugcugaauuucccucucu

SEQ ID NO: 376290 - RNA, 19 nt, Homo sapiens
ggaaaggaagccgcacuca

SEQ ID NO: 376291 - RNA, 19 nt, Homo sapiens
gaauuuccacagaaugauc

SEQ ID NO: 376292 - RNA, 19 nt, Homo sapiens
caacagauccagggagcau

SEQ ID NO: 376293 - RNA, 19 nt, Homo sapiens
caugaucuuuggccuacug

SEQ ID NO: 376294 - RNA, 19 nt, Homo sapiens
ggucucuucugaauaaagc

SEQ ID NO: 376295 - RNA, 19 nt, Homo sapiens
caugaagacccuccuacug

SEQ ID NO: 376296 - RNA, 19 nt, Homo sapiens
gcacucaguuauggcuucu

SEQ ID NO: 376297 - RNA, 19 nt, Homo sapiens
gaagccgcacucaguuaug

SEQ ID NO: 376298 - RNA, 19 nt, Homo sapiens
gcagaaucaccugugcaaa

SEQ ID NO: 376299 - RNA, 19 nt, Homo sapiens
guggauguggcaccaaauu

SEQ ID NO: 376300 - RNA, 19 nt, Homo sapiens
aagacgaccuacaauaaaa

SEQ ID NO: 376301 - RNA, 19 nt, Homo sapiens
cagaaucaccugugcaaaa

SEQ ID NO: 376302 - RNA, 19 nt, Homo sapiens
aggaagccgcacucaguua

SEQ ID NO: 376303 - RNA, 19 nt, Homo sapiens
ucaacuccgugcuuaacca

SEQ ID NO: 376304 - RNA, 19 nt, Homo sapiens
cugcauuugucacccaaga

SEQ ID NO: 376305 - RNA, 19 nt, Homo sapiens
gauguggcaccaaauuucu

SEQ ID NO: 376306 - RNA, 19 nt, Homo sapiens
ccaggcaggagcccuucua

SEQ ID NO: 376307 - RNA, 19 nt, Homo sapiens
uccacagaaugaucaaguu

SEQ ID NO: 376308 - RNA, 19 nt, Homo sapiens
ccaugggaauuuggugaau

SEQ ID NO: 376309 - RNA, 19 nt, Homo sapiens
augaagacccuccuacugu

SEQ ID NO: 376310 - RNA, 19 nt, Homo sapiens
caacuccgugcuuaaccaa

SEQ ID NO: 376311 - RNA, 19 nt, Homo sapiens
gagacauccagcagauuuc

SEQ ID NO: 376312 - RNA, 19 nt, Homo sapiens
aggcaggagcccuucuaua

SEQ ID NO: 376313 - RNA, 19 nt, Homo sapiens
uggauguggcaccaaauuu

SEQ ID NO: 376314 - RNA, 19 nt, Homo sapiens
uuggugaauuuccacagaa

SEQ ID NO: 376315 - RNA, 19 nt, Homo sapiens
cuauacccacccagaauga

SEQ ID NO: 376316 - RNA, 19 nt, Homo sapiens
uccacccagugcugaauuu

SEQ ID NO: 376317 - RNA, 19 nt, Homo sapiens
gaacagucguuaagaagua

SEQ ID NO: 376318 - RNA, 19 nt, Homo sapiens
uaaguuaggugacaaauga

SEQ ID NO: 376319 - RNA, 19 nt, Homo sapiens
ggagaaacacuaauucaua

SEQ ID NO: 376320 - RNA, 19 nt, Homo sapiens
caaagcauauugugaguaa

SEQ ID NO: 376321 - RNA, 19 nt, Homo sapiens
ggaaugagaccuuugaauu

SEQ ID NO: 376322 - RNA, 19 nt, Homo sapiens
gaaugagaccuuugaauuu

SEQ ID NO: 376323 - RNA, 19 nt, Homo sapiens
ucaauaagaccucgcauua

SEQ ID NO: 376324 - RNA, 19 nt, Homo sapiens
ggagaagacuuucagacaa

SEQ ID NO: 376325 - RNA, 19 nt, Homo sapiens
guacaaggcuccagguguu

SEQ ID NO: 376326 - RNA, 19 nt, Homo sapiens
ggagauuaaugaagaacua

SEQ ID NO: 376327 - RNA, 19 nt, Homo sapiens
agaaaugucucuugaaguu

SEQ ID NO: 376328 - RNA, 19 nt, Homo sapiens
acaaggaguuucuaaguaa

SEQ ID NO: 376329 - RNA, 19 nt, Homo sapiens
uuacuuagcugcaugagaa

SEQ ID NO: 376330 - RNA, 19 nt, Homo sapiens
ggagugcuaugucuuuaaa

SEQ ID NO: 376331 - RNA, 19 nt, Homo sapiens
ggaagugacuaucaaagug

SEQ ID NO: 376332 - RNA, 19 nt, Homo sapiens
caugacaacuggauuuaaa

SEQ ID NO: 376333 - RNA, 19 nt, Homo sapiens
cagaggagauuaaugaaga

SEQ ID NO: 376334 - RNA, 19 nt, Homo sapiens
ugaaaugguucuagaaaug

SEQ ID NO: 376335 - RNA, 19 nt, Homo sapiens
uaaguaaacccaaagcaua

SEQ ID NO: 376336 - RNA, 19 nt, Homo sapiens
acagugggcucacauuuaa

SEQ ID NO: 376337 - RNA, 19 nt, Homo sapiens
ggugagugauucagcuuua

SEQ ID NO: 376338 - RNA, 19 nt, Homo sapiens
ccaagucacugaaaugguu

SEQ ID NO: 376339 - RNA, 19 nt, Homo sapiens
guuauucacugacuagauu

SEQ ID NO: 376340 - RNA, 19 nt, Homo sapiens
gaucuuaugcacuucaaua

SEQ ID NO: 376341 - RNA, 19 nt, Homo sapiens
gaaggagugcuaugucuuu

SEQ ID NO: 376342 - RNA, 19 nt, Homo sapiens
cauaaucuccuuugacuuu

SEQ ID NO: 376343 - RNA, 19 nt, Homo sapiens
caaguuggauucaucguau

SEQ ID NO: 376344 - RNA, 19 nt, Homo sapiens
ggauauacuuagcuacauu

SEQ ID NO: 376345 - RNA, 19 nt, Homo sapiens
gaagagaacaagacauuuc

SEQ ID NO: 376346 - RNA, 19 nt, Homo sapiens
aaacauuucucaccaacuu

SEQ ID NO: 376347 - RNA, 19 nt, Homo sapiens
agaaaucgcugacuuugau

SEQ ID NO: 376348 - RNA, 19 nt, Homo sapiens
gagcugauguuugcagauu

SEQ ID NO: 376349 - RNA, 19 nt, Homo sapiens
aaauuggcauggcuaaaua

SEQ ID NO: 376350 - RNA, 19 nt, Homo sapiens
gaaauuggcauggcuaaau

SEQ ID NO: 376351 - RNA, 19 nt, Homo sapiens
gauugauccuuauguguuu

SEQ ID NO: 376352 - RNA, 19 nt, Homo sapiens
uuccaaagauugauccuua

SEQ ID NO: 376353 - RNA, 19 nt, Homo sapiens
gacagugggcucacauuua

SEQ ID NO: 376354 - RNA, 19 nt, Homo sapiens
gaauauagaagacagaauc

SEQ ID NO: 376355 - RNA, 19 nt, Homo sapiens
cacaauggaggaagaauua

SEQ ID NO: 376356 - RNA, 19 nt, Homo sapiens
gaauuuaguccauacgaaa

SEQ ID NO: 376357 - RNA, 19 nt, Homo sapiens
uagcagauccugaugaauu

SEQ ID NO: 376358 - RNA, 19 nt, Homo sapiens
gggauucucuggugugaug

SEQ ID NO: 376359 - RNA, 19 nt, Homo sapiens
agaaagaaaucgcugacuu

SEQ ID NO: 376360 - RNA, 19 nt, Homo sapiens
ggaugcagcuguagcagau

SEQ ID NO: 376361 - RNA, 19 nt, Homo sapiens
gaugaaggcauuauacgaa

SEQ ID NO: 376362 - RNA, 19 nt, Homo sapiens
gaccuacgauuuaguaugg

SEQ ID NO: 376363 - RNA, 19 nt, Homo sapiens
ggacagugggcucacauuu

SEQ ID NO: 376364 - RNA, 19 nt, Homo sapiens
ucacugaaaugguucuaga

SEQ ID NO: 376365 - RNA, 19 nt, Homo sapiens
gaccucgcauuauguauga

SEQ ID NO: 376366 - RNA, 19 nt, Homo sapiens
gagacuggcugauacucaa

SEQ ID NO: 376367 - RNA, 19 nt, Homo sapiens
ucaauacucugaacaacau

SEQ ID NO: 376368 - RNA, 19 nt, Homo sapiens
gaagugacuaucaaaguga

SEQ ID NO: 376369 - RNA, 19 nt, Homo sapiens
aacaaggaguuucuaagua

SEQ ID NO: 376370 - RNA, 19 nt, Homo sapiens
cagauuggguugaauuuag

SEQ ID NO: 376371 - RNA, 19 nt, Homo sapiens
caaggaguuucuaaguaaa

SEQ ID NO: 376372 - RNA, 19 nt, Homo sapiens
caacaaggaguuucuaagu

SEQ ID NO: 376373 - RNA, 19 nt, Homo sapiens
gcagauuggguugaauuua

SEQ ID NO: 376374 - RNA, 19 nt, Homo sapiens
ggccagaggagauuaauga

SEQ ID NO: 376375 - RNA, 19 nt, Homo sapiens
caaagaauagugaaggauu

SEQ ID NO: 376376 - RNA, 19 nt, Homo sapiens
gagaagacuuucagacaac

SEQ ID NO: 376377 - RNA, 19 nt, Homo sapiens
ccaagaauccugauaugga

SEQ ID NO: 376378 - RNA, 19 nt, Homo sapiens
aaagaauagugaaggauug

SEQ ID NO: 376379 - RNA, 19 nt, Homo sapiens
gcaaguuggauucaucgua

SEQ ID NO: 376380 - RNA, 19 nt, Homo sapiens
gaagaaaaccccuugcauu

SEQ ID NO: 376381 - RNA, 19 nt, Homo sapiens
guuaauaggagaaacacua

SEQ ID NO: 376382 - RNA, 19 nt, Homo sapiens
caccuuuacugacaucuuu

SEQ ID NO: 376383 - RNA, 19 nt, Homo sapiens
gcagaaaagugggcuaaaa

SEQ ID NO: 376384 - RNA, 19 nt, Homo sapiens
aaaugucucuugaaguuug

SEQ ID NO: 376385 - RNA, 19 nt, Homo sapiens
uacaugaucuuaugcacuu

SEQ ID NO: 376386 - RNA, 19 nt, Homo sapiens
ugaacuggaugcagcugua

SEQ ID NO: 376387 - RNA, 19 nt, Homo sapiens
caagcaaguuggauucauc

SEQ ID NO: 376388 - RNA, 19 nt, Homo sapiens
caaaggcacugaaaaugaa

SEQ ID NO: 376389 - RNA, 19 nt, Homo sapiens
gaaagggccagaggagauu

SEQ ID NO: 376390 - RNA, 19 nt, Homo sapiens
ggauugugcuaccuacguu

SEQ ID NO: 376391 - RNA, 19 nt, Homo sapiens
uaagggagagcaugaagaa

SEQ ID NO: 376392 - RNA, 19 nt, Homo sapiens
cuagaaaugucucuugaag

SEQ ID NO: 376393 - RNA, 19 nt, Homo sapiens
aagcauaguucauguacug

SEQ ID NO: 376394 - RNA, 19 nt, Homo sapiens
aaagauugauccuuaugug

SEQ ID NO: 376395 - RNA, 19 nt, Homo sapiens
uauaugagccucuggaugu

SEQ ID NO: 376396 - RNA, 19 nt, Homo sapiens
gaauuugagcgaauauaug

SEQ ID NO: 376397 - RNA, 19 nt, Homo sapiens
caacauuuacuguaucuuc

SEQ ID NO: 376398 - RNA, 19 nt, Homo sapiens
caugagagacuggcugaua

SEQ ID NO: 376399 - RNA, 19 nt, Homo sapiens
ggaaacugaggaagagaaa

SEQ ID NO: 376400 - RNA, 19 nt, Homo sapiens
caacaucaacuucagaaag

SEQ ID NO: 376401 - RNA, 19 nt, Homo sapiens
gaacccaaaggcacugaaa

SEQ ID NO: 376402 - RNA, 19 nt, Homo sapiens
gaaaugguucuagaaaugu

SEQ ID NO: 376403 - RNA, 19 nt, Homo sapiens
ccaacuuucuuaugugugu

SEQ ID NO: 376404 - RNA, 19 nt, Homo sapiens
ggugacaaaugauguugau

SEQ ID NO: 376405 - RNA, 19 nt, Homo sapiens
caagggaaacugaggaaga

SEQ ID NO: 376406 - RNA, 19 nt, Homo sapiens
aaaugaagaugcuggaagu

SEQ ID NO: 376407 - RNA, 19 nt, Homo sapiens
auacuacucugagcaguuu

SEQ ID NO: 376408 - RNA, 19 nt, Homo sapiens
gcaccaguauucccacaag

SEQ ID NO: 376409 - RNA, 19 nt, Homo sapiens
acugaaagcuagaggcauu

SEQ ID NO: 376410 - RNA, 19 nt, Homo sapiens
gauccuuaccagcacauua

SEQ ID NO: 376411 - RNA, 19 nt, Homo sapiens
uaagaccucgcauuaugua

SEQ ID NO: 376412 - RNA, 19 nt, Homo sapiens
gaaaagugggcuaaaauga

SEQ ID NO: 376413 - RNA, 19 nt, Homo sapiens
ugaauuuaguccauacgaa

SEQ ID NO: 376414 - RNA, 19 nt, Homo sapiens
ccagaccuacgauuuagua

SEQ ID NO: 376415 - RNA, 19 nt, Homo sapiens
gaaaugucucuugaaguuu

SEQ ID NO: 376416 - RNA, 19 nt, Homo sapiens
ggaagagaacaagacauuu

SEQ ID NO: 376417 - RNA, 19 nt, Homo sapiens
gcacacaguccuacaaaua

SEQ ID NO: 376418 - RNA, 19 nt, Homo sapiens
gagaagggcugcaacauuc

SEQ ID NO: 376419 - RNA, 19 nt, Homo sapiens
caaauugacucucuaaauc

SEQ ID NO: 376420 - RNA, 19 nt, Homo sapiens
gagagaggcuccuaaguca

SEQ ID NO: 376421 - RNA, 19 nt, Homo sapiens
gcaagaagagccaaauuga

SEQ ID NO: 376422 - RNA, 19 nt, Homo sapiens
gccaagagcucuccuccaa

SEQ ID NO: 376423 - RNA, 19 nt, Homo sapiens
ggaagaacgcccugacaaa

SEQ ID NO: 376424 - RNA, 19 nt, Homo sapiens
ggagaagggcugcaacauu

SEQ ID NO: 376425 - RNA, 19 nt, Homo sapiens
agaacgcccugacaaacua

SEQ ID NO: 376426 - RNA, 19 nt, Homo sapiens
ccaaauugacucucuaaau

SEQ ID NO: 376427 - RNA, 19 nt, Homo sapiens
caagagcucuccuccaacu

SEQ ID NO: 376428 - RNA, 19 nt, Homo sapiens
gagccaaauugacucucua

SEQ ID NO: 376429 - RNA, 19 nt, Homo sapiens
gaggcuugcuggaccuaaa

SEQ ID NO: 376430 - RNA, 19 nt, Homo sapiens
ccaccacccuccagagaau

SEQ ID NO: 376431 - RNA, 19 nt, Homo sapiens
gaagaacgcccugacaaac

SEQ ID NO: 376432 - RNA, 19 nt, Homo sapiens
agagaaaccuacggagcua

SEQ ID NO: 376433 - RNA, 19 nt, Homo sapiens
ccaauacuuucccaacauc

SEQ ID NO: 376434 - RNA, 19 nt, Homo sapiens
ggagcuacaacccacagua

SEQ ID NO: 376435 - RNA, 19 nt, Homo sapiens
gggaagaacgcccugacaa

SEQ ID NO: 376436 - RNA, 19 nt, Homo sapiens
gagaggcuccuaagucaca

SEQ ID NO: 376437 - RNA, 19 nt, Homo sapiens
ucuacugccucaagagaaa

SEQ ID NO: 376438 - RNA, 19 nt, Homo sapiens
ccaaggauggcaccgauug

SEQ ID NO: 376439 - RNA, 19 nt, Homo sapiens
ugagagaggcuccuaaguc

SEQ ID NO: 376440 - RNA, 19 nt, Homo sapiens
guacugacucugccugguu

SEQ ID NO: 376441 - RNA, 19 nt, Homo sapiens
acacaguccuacaaauaca

SEQ ID NO: 376442 - RNA, 19 nt, Homo sapiens
gcgaucagauuaucaucac

SEQ ID NO: 376443 - RNA, 19 nt, Homo sapiens
uaccaauacuuucccaaca

SEQ ID NO: 376444 - RNA, 19 nt, Homo sapiens
gaccucagucuuucucgaa

SEQ ID NO: 376445 - RNA, 19 nt, Homo sapiens
cuacaacacagaguacuga

SEQ ID NO: 376446 - RNA, 19 nt, Homo sapiens
ccaacauccucugcuccua

SEQ ID NO: 376447 - RNA, 19 nt, Homo sapiens
cgcaagaagagccaaauug

SEQ ID NO: 376448 - RNA, 19 nt, Homo sapiens
gggcccuucugccauguga

SEQ ID NO: 376449 - RNA, 19 nt, Homo sapiens
gaggagaagggcugcaaca

SEQ ID NO: 376450 - RNA, 19 nt, Homo sapiens
gcgcaugaccacugcuaug

SEQ ID NO: 376451 - RNA, 19 nt, Homo sapiens
gacaaacuacggcuucuac

SEQ ID NO: 376452 - RNA, 19 nt, Homo sapiens
aagaagagccaaauugacu

SEQ ID NO: 376453 - RNA, 19 nt, Homo sapiens
gaccaagacuuuuguucug

SEQ ID NO: 376454 - RNA, 19 nt, Homo sapiens
gagcuacaacccacaguac

SEQ ID NO: 376455 - RNA, 19 nt, Homo sapiens
ucugguguauggguauuaa

SEQ ID NO: 376456 - RNA, 19 nt, Homo sapiens
cucuaaaucugguguaugg

SEQ ID NO: 376457 - RNA, 19 nt, Homo sapiens
ccucccagaccaagacuuu

SEQ ID NO: 376458 - RNA, 19 nt, Homo sapiens
acaacccacaguaccaaua

SEQ ID NO: 376459 - RNA, 19 nt, Homo sapiens
caagacuuuuguucuguuu

SEQ ID NO: 376460 - RNA, 19 nt, Homo sapiens
gagaaggugacagggaaga

SEQ ID NO: 376461 - RNA, 19 nt, Homo sapiens
caagaagagccaaauugac

SEQ ID NO: 376462 - RNA, 19 nt, Homo sapiens
cagagaauuuuacgcaaga

SEQ ID NO: 376463 - RNA, 19 nt, Homo sapiens
accggaagcucgucuacug

SEQ ID NO: 376464 - RNA, 19 nt, Homo sapiens
uccagggucugcccaagga

SEQ ID NO: 376465 - RNA, 19 nt, Homo sapiens
ccaaagagaaccccagaga

SEQ ID NO: 376466 - RNA, 19 nt, Homo sapiens
caacccacaguaccaauac

SEQ ID NO: 376467 - RNA, 19 nt, Homo sapiens
uagugugccugcugugcaa

SEQ ID NO: 376468 - RNA, 19 nt, Homo sapiens
aaagagaaccccagagaug

SEQ ID NO: 376469 - RNA, 19 nt, Homo sapiens
ugacaaacuacggcuucua

SEQ ID NO: 376470 - RNA, 19 nt, Homo sapiens
aauugacucucuaaaucug

SEQ ID NO: 376471 - RNA, 19 nt, Homo sapiens
gaaggugacagggaagaac

SEQ ID NO: 376472 - RNA, 19 nt, Homo sapiens
gcugcaacauucgcacaca

SEQ ID NO: 376473 - RNA, 19 nt, Homo sapiens
gggcgcaugaccacugcua

SEQ ID NO: 376474 - RNA, 19 nt, Homo sapiens
caaagaagcagacuauuua

SEQ ID NO: 376475 - RNA, 19 nt, Homo sapiens
ggaaacggauugcaucaua

SEQ ID NO: 376476 - RNA, 19 nt, Homo sapiens
gaaccagaaugaauguuua

SEQ ID NO: 376477 - RNA, 19 nt, Homo sapiens
uaacagcccuuugaauuua

SEQ ID NO: 376478 - RNA, 19 nt, Homo sapiens
gcauagcgcuuauaucauu

SEQ ID NO: 376479 - RNA, 19 nt, Homo sapiens
guagaucucuuuagucuuu

SEQ ID NO: 376480 - RNA, 19 nt, Homo sapiens
gaaaucaaguggcuuauca

SEQ ID NO: 376481 - RNA, 19 nt, Homo sapiens
gaaauaacacuucagagua

SEQ ID NO: 376482 - RNA, 19 nt, Homo sapiens
uauauaagcuucaguggua

SEQ ID NO: 376483 - RNA, 19 nt, Homo sapiens
cagaaacacuccuucaaua

SEQ ID NO: 376484 - RNA, 19 nt, Homo sapiens
gaucacaacuuuaccuuug

SEQ ID NO: 376485 - RNA, 19 nt, Homo sapiens
ucaaguggcuuaucaugua

SEQ ID NO: 376486 - RNA, 19 nt, Homo sapiens
gugaauaacucaaggguuu

SEQ ID NO: 376487 - RNA, 19 nt, Homo sapiens
ggaaugacaugcccaauag

SEQ ID NO: 376488 - RNA, 19 nt, Homo sapiens
gauguuaucuuucugauuc

SEQ ID NO: 376489 - RNA, 19 nt, Homo sapiens
ggaaagccauuauuaguag

SEQ ID NO: 376490 - RNA, 19 nt, Homo sapiens
acacaaagcaucaguauuu

SEQ ID NO: 376491 - RNA, 19 nt, Homo sapiens
guaaaugugugccuaaguu

SEQ ID NO: 376492 - RNA, 19 nt, Homo sapiens
ggaaagaggcguaaggaaa

SEQ ID NO: 376493 - RNA, 19 nt, Homo sapiens
gaagaagagucacaaucaa

SEQ ID NO: 376494 - RNA, 19 nt, Homo sapiens
caaguuaggucaccaaaca

SEQ ID NO: 376495 - RNA, 19 nt, Homo sapiens
gaauagcgccauauaugua

SEQ ID NO: 376496 - RNA, 19 nt, Homo sapiens
gcgcuuauaucauuucuug

SEQ ID NO: 376497 - RNA, 19 nt, Homo sapiens
gcacauggcuacucauucu

SEQ ID NO: 376498 - RNA, 19 nt, Homo sapiens
gaaacacuccuucaauauu

SEQ ID NO: 376499 - RNA, 19 nt, Homo sapiens
gagugcagauuacugaaua

SEQ ID NO: 376500 - RNA, 19 nt, Homo sapiens
uaaaugguccucccuauaa

SEQ ID NO: 376501 - RNA, 19 nt, Homo sapiens
gaagccaccuaaagcuaua

SEQ ID NO: 376502 - RNA, 19 nt, Homo sapiens
ucacauagaucuacauaag

SEQ ID NO: 376503 - RNA, 19 nt, Homo sapiens
gcacuacuuuauucuguuu

SEQ ID NO: 376504 - RNA, 19 nt, Homo sapiens
ggacauggauucauuacag

SEQ ID NO: 376505 - RNA, 19 nt, Homo sapiens
uuaugaagcugcagugaua

SEQ ID NO: 376506 - RNA, 19 nt, Homo sapiens
gaggcagacucgcuuauuu

SEQ ID NO: 376507 - RNA, 19 nt, Homo sapiens
caauuguccuggcugauua

SEQ ID NO: 376508 - RNA, 19 nt, Homo sapiens
ggaaggaucuuggcacugu

SEQ ID NO: 376509 - RNA, 19 nt, Homo sapiens
ggaguaccaggauuuauua

SEQ ID NO: 376510 - RNA, 19 nt, Homo sapiens
ugacagagcacaaauagaa

SEQ ID NO: 376511 - RNA, 19 nt, Homo sapiens
gauggagaauuugaaguua

SEQ ID NO: 376512 - RNA, 19 nt, Homo sapiens
acacacacaugcacacaua

SEQ ID NO: 376513 - RNA, 19 nt, Homo sapiens
gaaacuagcuuuuaaacug

SEQ ID NO: 376514 - RNA, 19 nt, Homo sapiens
ccaaagaagcagacuauuu

SEQ ID NO: 376515 - RNA, 19 nt, Homo sapiens
caucauaccugaacauaag

SEQ ID NO: 376516 - RNA, 19 nt, Homo sapiens
gaaacagauugcuuaccua

SEQ ID NO: 376517 - RNA, 19 nt, Homo sapiens
aaacagaaccaguggauuu

SEQ ID NO: 376518 - RNA, 19 nt, Homo sapiens
cuacauaaguugugcaguu

SEQ ID NO: 376519 - RNA, 19 nt, Homo sapiens
ggaguaguauaauuuguug

SEQ ID NO: 376520 - RNA, 19 nt, Homo sapiens
aaacuucucugucucauuc

SEQ ID NO: 376521 - RNA, 19 nt, Homo sapiens
gaaaugacacagaacuauu

SEQ ID NO: 376522 - RNA, 19 nt, Homo sapiens
gaacuacaauaccaagcuu

SEQ ID NO: 376523 - RNA, 19 nt, Homo sapiens
gaagcagacuauuuauugu

SEQ ID NO: 376524 - RNA, 19 nt, Homo sapiens
caauagauauggacacugu

SEQ ID NO: 376525 - RNA, 19 nt, Homo sapiens
gcacuuagggccuuucuau

SEQ ID NO: 376526 - RNA, 19 nt, Homo sapiens
gcaggaagauagacgugaa

SEQ ID NO: 376527 - RNA, 19 nt, Homo sapiens
caagugccauuagaugaua

SEQ ID NO: 376528 - RNA, 19 nt, Homo sapiens
ucaaacugcuccuagcuuu

SEQ ID NO: 376529 - RNA, 19 nt, Homo sapiens
aaucaaaguugcucucuga

SEQ ID NO: 376530 - RNA, 19 nt, Homo sapiens
acacauaccgcacuucaua

SEQ ID NO: 376531 - RNA, 19 nt, Homo sapiens
ucaaauauccguucaguuc

SEQ ID NO: 376532 - RNA, 19 nt, Homo sapiens
ggaucaugcugcuaaugua

SEQ ID NO: 376533 - RNA, 19 nt, Homo sapiens
gaggagaucuuuuaaaugu

SEQ ID NO: 376534 - RNA, 19 nt, Homo sapiens
ccauugauguauacaagua

SEQ ID NO: 376535 - RNA, 19 nt, Homo sapiens
guaccaggauuuauuaagu

SEQ ID NO: 376536 - RNA, 19 nt, Homo sapiens
aaacaaacccuaaacacaa

SEQ ID NO: 376537 - RNA, 19 nt, Homo sapiens
uaucaaagccauucacaaa

SEQ ID NO: 376538 - RNA, 19 nt, Homo sapiens
ccaaggccuuuguuucuaa

SEQ ID NO: 376539 - RNA, 19 nt, Homo sapiens
gggaauagcgccauauaug

SEQ ID NO: 376540 - RNA, 19 nt, Homo sapiens
cuacuccgauguuaucuuu

SEQ ID NO: 376541 - RNA, 19 nt, Homo sapiens
ccaccuuucuuucaaauau

SEQ ID NO: 376542 - RNA, 19 nt, Homo sapiens
guaggccuuugauauauaa

SEQ ID NO: 376543 - RNA, 19 nt, Homo sapiens
acagauugcuuaccuaaau

SEQ ID NO: 376544 - RNA, 19 nt, Homo sapiens
cagagucgauauauaggua

SEQ ID NO: 376545 - RNA, 19 nt, Homo sapiens
cacaaagcaucaguauuua

SEQ ID NO: 376546 - RNA, 19 nt, Homo sapiens
guaccacccucccacguuu

SEQ ID NO: 376547 - RNA, 19 nt, Homo sapiens
ggaaaugauaggaguauug

SEQ ID NO: 376548 - RNA, 19 nt, Homo sapiens
ugaagcacaugguuacauu

SEQ ID NO: 376549 - RNA, 19 nt, Homo sapiens
uuugacaucuggcucauua

SEQ ID NO: 376550 - RNA, 19 nt, Homo sapiens
gggaaugacaugcccaaua

SEQ ID NO: 376551 - RNA, 19 nt, Homo sapiens
ucaaagccauucacaaaca

SEQ ID NO: 376552 - RNA, 19 nt, Homo sapiens
acacagaacuauugcuaau

SEQ ID NO: 376553 - RNA, 19 nt, Homo sapiens
gacauuaaccuaagaaaca

SEQ ID NO: 376554 - RNA, 19 nt, Homo sapiens
ggauuuccuugacccauuu

SEQ ID NO: 376555 - RNA, 19 nt, Homo sapiens
ggccuacaguguuauguuu

SEQ ID NO: 376556 - RNA, 19 nt, Homo sapiens
aagcuggacugcugaaauu

SEQ ID NO: 376557 - RNA, 19 nt, Homo sapiens
gaauguuuaucuucucaga

SEQ ID NO: 376558 - RNA, 19 nt, Homo sapiens
caucuuuccuugcaauauu

SEQ ID NO: 376559 - RNA, 19 nt, Homo sapiens
agaguuaccugauggaguu

SEQ ID NO: 376560 - RNA, 19 nt, Homo sapiens
gcaaucacauuaugaagcu

SEQ ID NO: 376561 - RNA, 19 nt, Homo sapiens
gaaguugaguguggaagga

SEQ ID NO: 376562 - RNA, 19 nt, Homo sapiens
cagacucgcuuauuugaau

SEQ ID NO: 376563 - RNA, 19 nt, Homo sapiens
ggaauagcgccauauaugu

SEQ ID NO: 376564 - RNA, 19 nt, Homo sapiens
uauguaggccuuugauaua

SEQ ID NO: 376565 - RNA, 19 nt, Homo sapiens
uauacugacugaaacauga

SEQ ID NO: 376566 - RNA, 19 nt, Homo sapiens
acaaagagacguuuaagug

SEQ ID NO: 376567 - RNA, 19 nt, Homo sapiens
gcagugauacuacauuuua

SEQ ID NO: 376568 - RNA, 19 nt, Homo sapiens
gauggaaggcagugucuuu

SEQ ID NO: 376569 - RNA, 19 nt, Homo sapiens
ucuuauagguuaugccuuu

SEQ ID NO: 376570 - RNA, 19 nt, Homo sapiens
ggauggagaauuugaaguu

SEQ ID NO: 376571 - RNA, 19 nt, Homo sapiens
caaugugucugugccuaua

SEQ ID NO: 376572 - RNA, 19 nt, Homo sapiens
gagagaggcccuacaagug

SEQ ID NO: 376573 - RNA, 19 nt, Homo sapiens
agaagcagacuauuuauug

SEQ ID NO: 376574 - RNA, 19 nt, Homo sapiens
gcaauagaguucuccauuu

SEQ ID NO: 376575 - RNA, 19 nt, Homo sapiens
gggaaaugcugguaaagua

SEQ ID NO: 376576 - RNA, 19 nt, Homo sapiens
ccagaaaucucaccagugu

SEQ ID NO: 376577 - RNA, 19 nt, Homo sapiens
cacaggagcugaugaaaga

SEQ ID NO: 376578 - RNA, 19 nt, Homo sapiens
gaguuaaucuugucucuuc

SEQ ID NO: 376579 - RNA, 19 nt, Homo sapiens
uaagggaaaugcugguaaa

SEQ ID NO: 376580 - RNA, 19 nt, Homo sapiens
ggaaaugcugguaaaguaa

SEQ ID NO: 376581 - RNA, 19 nt, Homo sapiens
acaagaugcugcaauguga

SEQ ID NO: 376582 - RNA, 19 nt, Homo sapiens
uuaaagcuccauugucuua

SEQ ID NO: 376583 - RNA, 19 nt, Homo sapiens
gaaaugcugguaaaguaaa

SEQ ID NO: 376584 - RNA, 19 nt, Homo sapiens
cagcagauguucccuguca

SEQ ID NO: 376585 - RNA, 19 nt, Homo sapiens
caaagcagauacuaaaggu

SEQ ID NO: 376586 - RNA, 19 nt, Homo sapiens
aaugacggcugcuauauau

SEQ ID NO: 376587 - RNA, 19 nt, Homo sapiens
caucaugcauucagauaau

SEQ ID NO: 376588 - RNA, 19 nt, Homo sapiens
ugacuaggcuguguauuuc

SEQ ID NO: 376589 - RNA, 19 nt, Homo sapiens
uaacagggaauuuaaggaa

SEQ ID NO: 376590 - RNA, 19 nt, Homo sapiens
ugacggcugcuauauauaa

SEQ ID NO: 376591 - RNA, 19 nt, Homo sapiens
caauagaguucuccauuuu

SEQ ID NO: 376592 - RNA, 19 nt, Homo sapiens
gagccucagucaccucaaa

SEQ ID NO: 376593 - RNA, 19 nt, Homo sapiens
ccucaaagcagauacuaaa

SEQ ID NO: 376594 - RNA, 19 nt, Homo sapiens
aagaaagacuaaacugguu

SEQ ID NO: 376595 - RNA, 19 nt, Homo sapiens
agacugggacuauggcuua

SEQ ID NO: 376596 - RNA, 19 nt, Homo sapiens
gcuccauugucuuauguuu

SEQ ID NO: 376597 - RNA, 19 nt, Homo sapiens
cagguuaagugguaaaaua

SEQ ID NO: 376598 - RNA, 19 nt, Homo sapiens
uaaccaacauccaaaauga

SEQ ID NO: 376599 - RNA, 19 nt, Homo sapiens
uagccaaccuguaguuuua

SEQ ID NO: 376600 - RNA, 19 nt, Homo sapiens
ggcuugagaugauaagaga

SEQ ID NO: 376601 - RNA, 19 nt, Homo sapiens
gcaauaucaguuuguuuga

SEQ ID NO: 376602 - RNA, 19 nt, Homo sapiens
aagcagauacuaaagguuu

SEQ ID NO: 376603 - RNA, 19 nt, Homo sapiens
gcaaauauugucauaacca

SEQ ID NO: 376604 - RNA, 19 nt, Homo sapiens
agaacgggcuugcaaguag

SEQ ID NO: 376605 - RNA, 19 nt, Homo sapiens
acaccaugcugggcuauaa

SEQ ID NO: 376606 - RNA, 19 nt, Homo sapiens
ugacuggcuugagaugaua

SEQ ID NO: 376607 - RNA, 19 nt, Homo sapiens
gcugugaaccuaacaauac

SEQ ID NO: 376608 - RNA, 19 nt, Homo sapiens
cuagguauuugcauaggaa

SEQ ID NO: 376609 - RNA, 19 nt, Homo sapiens
aaaugacggcugcuauaua

SEQ ID NO: 376610 - RNA, 19 nt, Homo sapiens
gccaaucuguccugagugu

SEQ ID NO: 376611 - RNA, 19 nt, Homo sapiens
aaguaaaccugcccaagga

SEQ ID NO: 376612 - RNA, 19 nt, Homo sapiens
ucagaggaguuaaucuugu

SEQ ID NO: 376613 - RNA, 19 nt, Homo sapiens
ccaagaagacccacucaca

SEQ ID NO: 376614 - RNA, 19 nt, Homo sapiens
caucagucauuauuagcuu

SEQ ID NO: 376615 - RNA, 19 nt, Homo sapiens
gcagaugcugugaaccuaa

SEQ ID NO: 376616 - RNA, 19 nt, Homo sapiens
gaugcugcaaugugaguua

SEQ ID NO: 376617 - RNA, 19 nt, Homo sapiens
ggacuauggcuuauucagu

SEQ ID NO: 376618 - RNA, 19 nt, Homo sapiens
ccggaaagaccaccugaaa

SEQ ID NO: 376619 - RNA, 19 nt, Homo sapiens
caagauaaagaccuuaaag

SEQ ID NO: 376620 - RNA, 19 nt, Homo sapiens
aaucuugucucuucucaca

SEQ ID NO: 376621 - RNA, 19 nt, Homo sapiens
aaacgagacugggacuaug

SEQ ID NO: 376622 - RNA, 19 nt, Homo sapiens
gaagauguuuuaagaagca

SEQ ID NO: 376623 - RNA, 19 nt, Homo sapiens
ggaaucagaggaguuaauc

SEQ ID NO: 376624 - RNA, 19 nt, Homo sapiens
caucucgccuucauuccaa

SEQ ID NO: 376625 - RNA, 19 nt, Homo sapiens
ugugaaagaugcuucuaca

SEQ ID NO: 376626 - RNA, 19 nt, Homo sapiens
guaauccaaacugcaaaua

SEQ ID NO: 376627 - RNA, 19 nt, Homo sapiens
gugccaaucuguccugagu

SEQ ID NO: 376628 - RNA, 19 nt, Homo sapiens
gcugcaaugugaguuauca

SEQ ID NO: 376629 - RNA, 19 nt, Homo sapiens
uaagggaacuauggaaagg

SEQ ID NO: 376630 - RNA, 19 nt, Homo sapiens
caaaaugacggcugcuaua

SEQ ID NO: 376631 - RNA, 19 nt, Homo sapiens
ggaagaaguacaacaccau

SEQ ID NO: 376632 - RNA, 19 nt, Homo sapiens
aaagcuccauugucuuaug

SEQ ID NO: 376633 - RNA, 19 nt, Homo sapiens
gugugucucucccuuucua

SEQ ID NO: 376634 - RNA, 19 nt, Homo sapiens
ucaaagcccaugcggaaga

SEQ ID NO: 376635 - RNA, 19 nt, Homo sapiens
gaaagacuaaacugguugu

SEQ ID NO: 376636 - RNA, 19 nt, Homo sapiens
ggaacuauggaaagguuug

SEQ ID NO: 376637 - RNA, 19 nt, Homo sapiens
gcugcuauauauaaguguu

SEQ ID NO: 376638 - RNA, 19 nt, Homo sapiens
agugaugacuggcuugaga

SEQ ID NO: 376639 - RNA, 19 nt, Homo sapiens
ucauuuccaucaugcauuc

SEQ ID NO: 376640 - RNA, 19 nt, Homo sapiens
gcuacuggaccaccucaaa

SEQ ID NO: 376641 - RNA, 19 nt, Homo sapiens
gugcauuuguaauucauca

SEQ ID NO: 376642 - RNA, 19 nt, Homo sapiens
uauggaaagguuuggauuu

SEQ ID NO: 376643 - RNA, 19 nt, Homo sapiens
cugcaaauauugucauaac

SEQ ID NO: 376644 - RNA, 19 nt, Homo sapiens
uaacaauaccugccucucu

SEQ ID NO: 376645 - RNA, 19 nt, Homo sapiens
gcauuuugcugacuuuaau

SEQ ID NO: 376646 - RNA, 19 nt, Homo sapiens
uaccauagccaaccuguag

SEQ ID NO: 376647 - RNA, 19 nt, Homo sapiens
cagaggaguuaaucuuguc

SEQ ID NO: 376648 - RNA, 19 nt, Homo sapiens
guaagggaacuauggaaag

SEQ ID NO: 376649 - RNA, 19 nt, Homo sapiens
cagaacgggcuugcaagua

SEQ ID NO: 376650 - RNA, 19 nt, Homo sapiens
aacagggaauuuaaggaaa

SEQ ID NO: 376651 - RNA, 19 nt, Homo sapiens
aaucagaggaguuaaucuu

SEQ ID NO: 376652 - RNA, 19 nt, Homo sapiens
auaggaaucagaggaguua

SEQ ID NO: 376653 - RNA, 19 nt, Homo sapiens
ucucacagguuugaaucuu

SEQ ID NO: 376654 - RNA, 19 nt, Homo sapiens
gaagacguucaaccggaaa

SEQ ID NO: 376655 - RNA, 19 nt, Homo sapiens
caauaucaguuuguuugag

SEQ ID NO: 376656 - RNA, 19 nt, Homo sapiens
auaaguguuuguccauaug

SEQ ID NO: 376657 - RNA, 19 nt, Homo sapiens
cggcugcuauauauaagug

SEQ ID NO: 376658 - RNA, 19 nt, Homo sapiens
ugucauaaccaacauccaa

SEQ ID NO: 376659 - RNA, 19 nt, Homo sapiens
ugcaauaucaguuuguuug

SEQ ID NO: 376660 - RNA, 19 nt, Homo sapiens
aagauaacuuugugugucu

SEQ ID NO: 376661 - RNA, 19 nt, Homo sapiens
gauguaaaaccuaaccuuu

SEQ ID NO: 376662 - RNA, 19 nt, Homo sapiens
uccacaagaugcugcaaug

SEQ ID NO: 376663 - RNA, 19 nt, Homo sapiens
gguauuugcauaggaauca

SEQ ID NO: 376664 - RNA, 19 nt, Homo sapiens
ugucucuucucacagguuu

SEQ ID NO: 376665 - RNA, 19 nt, Homo sapiens
cauccugccucauuuccau

SEQ ID NO: 376666 - RNA, 19 nt, Homo sapiens
gcugcugccuugccuccuu

SEQ ID NO: 376667 - RNA, 19 nt, Homo sapiens
gaaaauauuaccugggaau

SEQ ID NO: 376668 - RNA, 19 nt, Homo sapiens
augacuaggcuguguauuu

SEQ ID NO: 376669 - RNA, 19 nt, Homo sapiens
gcuaagggaaaugcuggua

SEQ ID NO: 376670 - RNA, 19 nt, Homo sapiens
ggacuuccugugccaguuc

SEQ ID NO: 376671 - RNA, 19 nt, Homo sapiens
agggaacuauggaaagguu

SEQ ID NO: 376672 - RNA, 19 nt, Homo sapiens
ugaguguucaugcuuugua

SEQ ID NO: 376673 - RNA, 19 nt, Homo sapiens
caaucuguccugaguguuc

SEQ ID NO: 376674 - RNA, 19 nt, Homo sapiens
gcaauagaguucuccauuu

SEQ ID NO: 376675 - RNA, 19 nt, Homo sapiens
gggaaaugcugguaaagua

SEQ ID NO: 376676 - RNA, 19 nt, Homo sapiens
ggaaauaucucucuacacu

SEQ ID NO: 376677 - RNA, 19 nt, Homo sapiens
uaacgugacugauuucaaa

SEQ ID NO: 376678 - RNA, 19 nt, Homo sapiens
ucacuaagcuugugguuug

SEQ ID NO: 376679 - RNA, 19 nt, Homo sapiens
gaacucaaguggaauuugu

SEQ ID NO: 376680 - RNA, 19 nt, Homo sapiens
ccagaaaucucaccagugu

SEQ ID NO: 376681 - RNA, 19 nt, Homo sapiens
cacaggagcugaugaaaga

SEQ ID NO: 376682 - RNA, 19 nt, Homo sapiens
gaaagugguucugauuaga

SEQ ID NO: 376683 - RNA, 19 nt, Homo sapiens
aaauaucucucuacacuga

SEQ ID NO: 376684 - RNA, 19 nt, Homo sapiens
auucagagcucaagauaaa

SEQ ID NO: 376685 - RNA, 19 nt, Homo sapiens
gcaaucauuuccaucuuau

SEQ ID NO: 376686 - RNA, 19 nt, Homo sapiens
ugaccuaacugacucacua

SEQ ID NO: 376687 - RNA, 19 nt, Homo sapiens
ggauugcugucacgucuaa

SEQ ID NO: 376688 - RNA, 19 nt, Homo sapiens
uaagggaaaugcugguaaa

SEQ ID NO: 376689 - RNA, 19 nt, Homo sapiens
ccagagcucucagcacuaa

SEQ ID NO: 376690 - RNA, 19 nt, Homo sapiens
ggaaaugcugguaaaguaa

SEQ ID NO: 376691 - RNA, 19 nt, Homo sapiens
acaagaugcugcaauguga

SEQ ID NO: 376692 - RNA, 19 nt, Homo sapiens
ggaagcaugugccaaccaa

SEQ ID NO: 376693 - RNA, 19 nt, Homo sapiens
uuaaagcuccauugucuua

SEQ ID NO: 376694 - RNA, 19 nt, Homo sapiens
gaaaugcugguaaaguaaa

SEQ ID NO: 376695 - RNA, 19 nt, Homo sapiens
uaaaggaagccacaugaaa

SEQ ID NO: 376696 - RNA, 19 nt, Homo sapiens
cagcagauguucccuguca

SEQ ID NO: 376697 - RNA, 19 nt, Homo sapiens
uggauaacgugacugauuu

SEQ ID NO: 376698 - RNA, 19 nt, Homo sapiens
gacaugcccaucagauuua

SEQ ID NO: 376699 - RNA, 19 nt, Homo sapiens
gcaagugacaggaacauau

SEQ ID NO: 376700 - RNA, 19 nt, Homo sapiens
caaagcagauacuaaaggu

SEQ ID NO: 376701 - RNA, 19 nt, Homo sapiens
guacugaccauuacuacaa

SEQ ID NO: 376702 - RNA, 19 nt, Homo sapiens
caccacagauuggaaagua

SEQ ID NO: 376703 - RNA, 19 nt, Homo sapiens
aaugacggcugcuauauau

SEQ ID NO: 376704 - RNA, 19 nt, Homo sapiens
caucaugcauucagauaau

SEQ ID NO: 376705 - RNA, 19 nt, Homo sapiens
ugacuaggcuguguauuuc

SEQ ID NO: 376706 - RNA, 19 nt, Homo sapiens
ugacggcugcuauauauaa

SEQ ID NO: 376707 - RNA, 19 nt, Homo sapiens
caauagaguucuccauuuu

SEQ ID NO: 376708 - RNA, 19 nt, Homo sapiens
gagccucagucaccucaaa

SEQ ID NO: 376709 - RNA, 19 nt, Homo sapiens
gcuauagugaugcagauua

SEQ ID NO: 376710 - RNA, 19 nt, Homo sapiens
ugacaugcccaucagauuu

SEQ ID NO: 376711 - RNA, 19 nt, Homo sapiens
guagguauuugcccauguu

SEQ ID NO: 376712 - RNA, 19 nt, Homo sapiens
ccucaaagcagauacuaaa

SEQ ID NO: 376713 - RNA, 19 nt, Homo sapiens
ugcaaucauuuccaucuua

SEQ ID NO: 376714 - RNA, 19 nt, Homo sapiens
gccaugaucauaauguuaa

SEQ ID NO: 376715 - RNA, 19 nt, Homo sapiens
aagaaagacuaaacugguu

SEQ ID NO: 376716 - RNA, 19 nt, Homo sapiens
agacugggacuauggcuua

SEQ ID NO: 376717 - RNA, 19 nt, Homo sapiens
cagaggaguuaaucuuguu

SEQ ID NO: 376718 - RNA, 19 nt, Homo sapiens
caauucagagcucaagaua

SEQ ID NO: 376719 - RNA, 19 nt, Homo sapiens
gcggaaauaucucucuaca

SEQ ID NO: 376720 - RNA, 19 nt, Homo sapiens
gcuccauugucuuauguuu

SEQ ID NO: 376721 - RNA, 19 nt, Homo sapiens
cagguuaagugguaaaaua

SEQ ID NO: 376722 - RNA, 19 nt, Homo sapiens
uaaccaacauccaaaauga

SEQ ID NO: 376723 - RNA, 19 nt, Homo sapiens
cggcauaucuuuggcguau

SEQ ID NO: 376724 - RNA, 19 nt, Homo sapiens
cacccuagcuuccguguuc

SEQ ID NO: 376725 - RNA, 19 nt, Homo sapiens
caagugacaggaacauauu

SEQ ID NO: 376726 - RNA, 19 nt, Homo sapiens
uagccaaccuguaguuuua

SEQ ID NO: 376727 - RNA, 19 nt, Homo sapiens
gcuugagacugcauguaaa

SEQ ID NO: 376728 - RNA, 19 nt, Homo sapiens
gcauaucuuuggcguaucu

SEQ ID NO: 376729 - RNA, 19 nt, Homo sapiens
caauauggaucugccucua

SEQ ID NO: 376730 - RNA, 19 nt, Homo sapiens
gcagcagcauugugauuag

SEQ ID NO: 376731 - RNA, 19 nt, Homo sapiens
ggcuugagaugauaagaga

SEQ ID NO: 376732 - RNA, 19 nt, Homo sapiens
gcaauaucaguuuguuuga

SEQ ID NO: 376733 - RNA, 19 nt, Homo sapiens
aagcagauacuaaagguuu

SEQ ID NO: 376734 - RNA, 19 nt, Homo sapiens
caaagcccauggccacguu

SEQ ID NO: 376735 - RNA, 19 nt, Homo sapiens
cuucuuggguacaauuuaa

SEQ ID NO: 376736 - RNA, 19 nt, Homo sapiens
uuccuugccuugugaguua

SEQ ID NO: 376737 - RNA, 19 nt, Homo sapiens
cguaagccaugaucauaau

SEQ ID NO: 376738 - RNA, 19 nt, Homo sapiens
gcaaauauugucauaacca

SEQ ID NO: 376739 - RNA, 19 nt, Homo sapiens
agaacgggcuugcaaguag

SEQ ID NO: 376740 - RNA, 19 nt, Homo sapiens
acaccaugcugggcuauaa

SEQ ID NO: 376741 - RNA, 19 nt, Homo sapiens
gaaguucacgauucacaau

SEQ ID NO: 376742 - RNA, 19 nt, Homo sapiens
caucugaaacucaucugua

SEQ ID NO: 376743 - RNA, 19 nt, Homo sapiens
ccucuagcaugcggaaaua

SEQ ID NO: 376744 - RNA, 19 nt, Homo sapiens
ugacuggcuugagaugaua

SEQ ID NO: 376745 - RNA, 19 nt, Homo sapiens
gcugugaaccuaacaauac

SEQ ID NO: 376746 - RNA, 19 nt, Homo sapiens
aaaugacggcugcuauaua

SEQ ID NO: 376747 - RNA, 19 nt, Homo sapiens
gccaaucuguccugagugu

SEQ ID NO: 376748 - RNA, 19 nt, Homo sapiens
aaguaaaccugcccaagga

SEQ ID NO: 376749 - RNA, 19 nt, Homo sapiens
ccaagaagacccacucaca

SEQ ID NO: 376750 - RNA, 19 nt, Homo sapiens
aguucacgauucacaauua

SEQ ID NO: 376751 - RNA, 19 nt, Homo sapiens
gcaccaucguucuguuugu

SEQ ID NO: 376752 - RNA, 19 nt, Homo sapiens
cauguaaacugggaugugu

SEQ ID NO: 376753 - RNA, 19 nt, Homo sapiens
ucagaggaguuaaucuugu

SEQ ID NO: 376754 - RNA, 19 nt, Homo sapiens
cuagguauuugcauaggaa

SEQ ID NO: 376755 - RNA, 19 nt, Homo sapiens
ggcagcagcauugugauua

SEQ ID NO: 376756 - RNA, 19 nt, Homo sapiens
caucagucauuauuagcuu

SEQ ID NO: 376757 - RNA, 19 nt, Homo sapiens
gcagucgacagaaaccuaa

SEQ ID NO: 376758 - RNA, 19 nt, Homo sapiens
uacaacaucuuacagucaa

SEQ ID NO: 376759 - RNA, 19 nt, Homo sapiens
gaauuuguuuggauaacgu

SEQ ID NO: 376760 - RNA, 19 nt, Homo sapiens
cuaaaauccucuucaguuu

SEQ ID NO: 376761 - RNA, 19 nt, Homo sapiens
aaaguagccuccuguaggu

SEQ ID NO: 376762 - RNA, 19 nt, Homo sapiens
gaagccacaugaaaauuga

SEQ ID NO: 376763 - RNA, 19 nt, Homo sapiens
gcagaugcugugaaccuaa

SEQ ID NO: 376764 - RNA, 19 nt, Homo sapiens
gcugcucucuuuccucuuc

SEQ ID NO: 376765 - RNA, 19 nt, Homo sapiens
cugcaaguacugaccauua

SEQ ID NO: 376766 - RNA, 19 nt, Homo sapiens
cccaucagauuuaauagug

SEQ ID NO: 376767 - RNA, 19 nt, Homo sapiens
gcagcauugugauuagaau

SEQ ID NO: 376768 - RNA, 19 nt, Homo sapiens
gaugcugcaaugugaguua

SEQ ID NO: 376769 - RNA, 19 nt, Homo sapiens
ggacuauggcuuauucagu

SEQ ID NO: 376770 - RNA, 19 nt, Homo sapiens
ccggaaagaccaccugaaa

SEQ ID NO: 376771 - RNA, 19 nt, Homo sapiens
guucacgauucacaauuau

SEQ ID NO: 376772 - RNA, 19 nt, Homo sapiens
uggagaaguucacgauuca

SEQ ID NO: 376773 - RNA, 19 nt, Homo sapiens
caagauaaagaccuuaaag

SEQ ID NO: 376774 - RNA, 19 nt, Homo sapiens
gaaauaaacugacuuugga

SEQ ID NO: 376775 - RNA, 19 nt, Homo sapiens
ugaauaaccucuuggagua

SEQ ID NO: 376776 - RNA, 19 nt, Homo sapiens
gaagugggcuggaaacuag

SEQ ID NO: 376777 - RNA, 19 nt, Homo sapiens
gcaccagccugaaccauuu

SEQ ID NO: 376778 - RNA, 19 nt, Homo sapiens
guagauagcuaaguccuaa

SEQ ID NO: 376779 - RNA, 19 nt, Homo sapiens
ggacagaagccauggcaua

SEQ ID NO: 376780 - RNA, 19 nt, Homo sapiens
ggagagaaggccuuuauuu

SEQ ID NO: 376781 - RNA, 19 nt, Homo sapiens
ggacuucagguauuauuua

SEQ ID NO: 376782 - RNA, 19 nt, Homo sapiens
gaccauagcuagccaguca

SEQ ID NO: 376783 - RNA, 19 nt, Homo sapiens
gggaacaccuuucucaaau

SEQ ID NO: 376784 - RNA, 19 nt, Homo sapiens
gcuagccagucauuucuua

SEQ ID NO: 376785 - RNA, 19 nt, Homo sapiens
gaugaccucuagagaaauu

SEQ ID NO: 376786 - RNA, 19 nt, Homo sapiens
gcaccacccugccucguuu

SEQ ID NO: 376787 - RNA, 19 nt, Homo sapiens
gcucguagauauuguccua

SEQ ID NO: 376788 - RNA, 19 nt, Homo sapiens
cagaagccauggcauauga

SEQ ID NO: 376789 - RNA, 19 nt, Homo sapiens
gaacaccuuucucaaaugg

SEQ ID NO: 376790 - RNA, 19 nt, Homo sapiens
gcacagggcauaucuuugu

SEQ ID NO: 376791 - RNA, 19 nt, Homo sapiens
ucaaaucacuuccacuuuc

SEQ ID NO: 376792 - RNA, 19 nt, Homo sapiens
ggaagaagaguuugcagaa

SEQ ID NO: 376793 - RNA, 19 nt, Homo sapiens
ccaaugagguucccugcaa

SEQ ID NO: 376794 - RNA, 19 nt, Homo sapiens
ggaaauaaacugacuuugg

SEQ ID NO: 376795 - RNA, 19 nt, Homo sapiens
ggaauaauaucugccuuca

SEQ ID NO: 376796 - RNA, 19 nt, Homo sapiens
gaaaucuucuagcacuuug

SEQ ID NO: 376797 - RNA, 19 nt, Homo sapiens
gaagcaauuuggaguaagu

SEQ ID NO: 376798 - RNA, 19 nt, Homo sapiens
gcuguuagccuuagaguga

SEQ ID NO: 376799 - RNA, 19 nt, Homo sapiens
gagagaaggccuuuauuuc

SEQ ID NO: 376800 - RNA, 19 nt, Homo sapiens
guuauugggacuuguauua

SEQ ID NO: 376801 - RNA, 19 nt, Homo sapiens
uggaugaccucuagagaaa

SEQ ID NO: 376802 - RNA, 19 nt, Homo sapiens
ucaauaacauggcccuuug

SEQ ID NO: 376803 - RNA, 19 nt, Homo sapiens
ggaacaccuuucucaaaug

SEQ ID NO: 376804 - RNA, 19 nt, Homo sapiens
gaagugccaaugugaaauu

SEQ ID NO: 376805 - RNA, 19 nt, Homo sapiens
aagcaggugugauuacuuu

SEQ ID NO: 376806 - RNA, 19 nt, Homo sapiens
gcacauggccacccacuca

SEQ ID NO: 376807 - RNA, 19 nt, Homo sapiens
uauaggcgaugguauguga

SEQ ID NO: 376808 - RNA, 19 nt, Homo sapiens
cuagagaaauugcccaaga

SEQ ID NO: 376809 - RNA, 19 nt, Homo sapiens
caagugaagugccaaugug

SEQ ID NO: 376810 - RNA, 19 nt, Homo sapiens
gaagaagaguuugcagaag

SEQ ID NO: 376811 - RNA, 19 nt, Homo sapiens
cguaggacuucagguauua

SEQ ID NO: 376812 - RNA, 19 nt, Homo sapiens
caaaggaucucugcaucau

SEQ ID NO: 376813 - RNA, 19 nt, Homo sapiens
uagaagcaauuuggaguaa

SEQ ID NO: 376814 - RNA, 19 nt, Homo sapiens
gcaacuguuuaaacccuuu

SEQ ID NO: 376815 - RNA, 19 nt, Homo sapiens
caaagcaacuguuuaaacc

SEQ ID NO: 376816 - RNA, 19 nt, Homo sapiens
gcaaagcaacuguuuaaac

SEQ ID NO: 376817 - RNA, 19 nt, Homo sapiens
cagcaacccuucucaccuu

SEQ ID NO: 376818 - RNA, 19 nt, Homo sapiens
caagaggauuggagcaguu

SEQ ID NO: 376819 - RNA, 19 nt, Homo sapiens
guacugugauaagauguuu

SEQ ID NO: 376820 - RNA, 19 nt, Homo sapiens
cagacuagaugauuugcuu

SEQ ID NO: 376821 - RNA, 19 nt, Homo sapiens
ggaauggguagauagcuaa

SEQ ID NO: 376822 - RNA, 19 nt, Homo sapiens
ucacaggucugcaauucug

SEQ ID NO: 376823 - RNA, 19 nt, Homo sapiens
gaaccuccuucucuuugga

SEQ ID NO: 376824 - RNA, 19 nt, Homo sapiens
ggaagugggcuggaaacua

SEQ ID NO: 376825 - RNA, 19 nt, Homo sapiens
gauauuguccuaaguugga

SEQ ID NO: 376826 - RNA, 19 nt, Homo sapiens
guucaaaggauaagaauag

SEQ ID NO: 376827 - RNA, 19 nt, Homo sapiens
acacacuucuaccucuuua

SEQ ID NO: 376828 - RNA, 19 nt, Homo sapiens
uagagaaauugcccaagaa

SEQ ID NO: 376829 - RNA, 19 nt, Homo sapiens
cugcagaccuuugagagua

SEQ ID NO: 376830 - RNA, 19 nt, Homo sapiens
guacagaggaauaauaucu

SEQ ID NO: 376831 - RNA, 19 nt, Homo sapiens
ucccuacacucucaguuua

SEQ ID NO: 376832 - RNA, 19 nt, Homo sapiens
uaaaaugucuggcaagguu

SEQ ID NO: 376833 - RNA, 19 nt, Homo sapiens
gacaaacuaccaaggaauu

SEQ ID NO: 376834 - RNA, 19 nt, Homo sapiens
gcuaguauccggcaagguu

SEQ ID NO: 376835 - RNA, 19 nt, Homo sapiens
ggccuucccuggcauguug

SEQ ID NO: 376836 - RNA, 19 nt, Homo sapiens
cagggcauaucuuuguuaa

SEQ ID NO: 376837 - RNA, 19 nt, Homo sapiens
gggaaaggagcgccaauga

SEQ ID NO: 376838 - RNA, 19 nt, Homo sapiens
gggaaguuguggaauuguu

SEQ ID NO: 376839 - RNA, 19 nt, Homo sapiens
gcugacuucucuucauuug

SEQ ID NO: 376840 - RNA, 19 nt, Homo sapiens
uaccagcggucaaggcuuu

SEQ ID NO: 376841 - RNA, 19 nt, Homo sapiens
uggcaaagcaacuguuuaa

SEQ ID NO: 376842 - RNA, 19 nt, Homo sapiens
gcuaaguccuaaucuaugg

SEQ ID NO: 376843 - RNA, 19 nt, Homo sapiens
ggacuucucccaccuacug

SEQ ID NO: 376844 - RNA, 19 nt, Homo sapiens
aaguggagguggauaguuu

SEQ ID NO: 376845 - RNA, 19 nt, Homo sapiens
gagcagagaccauauagcu

SEQ ID NO: 376846 - RNA, 19 nt, Homo sapiens
guagauauuguccuaaguu

SEQ ID NO: 376847 - RNA, 19 nt, Homo sapiens
ucuuaaaccucccuuccua

SEQ ID NO: 376848 - RNA, 19 nt, Homo sapiens
gguuaggaauggguagaua

SEQ ID NO: 376849 - RNA, 19 nt, Homo sapiens
caucuuccaugacugcauu

SEQ ID NO: 376850 - RNA, 19 nt, Homo sapiens
ugacuucucuucauuugag

SEQ ID NO: 376851 - RNA, 19 nt, Homo sapiens
uaacuggaguccuguuuac

SEQ ID NO: 376852 - RNA, 19 nt, Homo sapiens
caaaggauaagaauagcuu

SEQ ID NO: 376853 - RNA, 19 nt, Homo sapiens
ugagaugcuuccacucuga

SEQ ID NO: 376854 - RNA, 19 nt, Homo sapiens
caugagcuguuguuauuag

SEQ ID NO: 376855 - RNA, 19 nt, Homo sapiens
aucaugagcuguuguuauu

SEQ ID NO: 376856 - RNA, 19 nt, Homo sapiens
gaaggucacuuggcuccau

SEQ ID NO: 376857 - RNA, 19 nt, Homo sapiens
gacccaugauccuaacaaa

SEQ ID NO: 376858 - RNA, 19 nt, Homo sapiens
guauaagugccauuagaaa

SEQ ID NO: 376859 - RNA, 19 nt, Homo sapiens
cgagcgcggugaagagauu

SEQ ID NO: 376860 - RNA, 19 nt, Homo sapiens
ucuaggagcuguuuguaag

SEQ ID NO: 376861 - RNA, 19 nt, Homo sapiens
cgaacucacuucaguaugc

SEQ ID NO: 376862 - RNA, 19 nt, Homo sapiens
ggaagcaggugugauuacu

SEQ ID NO: 376863 - RNA, 19 nt, Homo sapiens
caucaaaucacuuccacuu

SEQ ID NO: 376864 - RNA, 19 nt, Homo sapiens
ggaaggaauuggccaugac

SEQ ID NO: 376865 - RNA, 19 nt, Homo sapiens
ucccaucuauccugucuuu

SEQ ID NO: 376866 - RNA, 19 nt, Homo sapiens
ggacaaacuaccaaggaau

SEQ ID NO: 376867 - RNA, 19 nt, Homo sapiens
cagaugcagucagcaguuu

SEQ ID NO: 376868 - RNA, 19 nt, Homo sapiens
caaugucccuucugucucu

SEQ ID NO: 376869 - RNA, 19 nt, Homo sapiens
gaagacaggcaagaggauu

SEQ ID NO: 376870 - RNA, 19 nt, Homo sapiens
ccucugcgcugcuaaugug

SEQ ID NO: 376871 - RNA, 19 nt, Homo sapiens
gccauuagccuugccauga

SEQ ID NO: 376872 - RNA, 19 nt, Homo sapiens
ccagagcagagaccauaua

SEQ ID NO: 376873 - RNA, 19 nt, Homo sapiens
ucacccaccuucugucuag

SEQ ID NO: 376874 - RNA, 19 nt, Homo sapiens
gaaggaggcucaugucaga

SEQ ID NO: 376875 - RNA, 19 nt, Homo sapiens
ggaaagacggauugcauua

SEQ ID NO: 376876 - RNA, 19 nt, Homo sapiens
gcagaaauuugaagucgaa

SEQ ID NO: 376877 - RNA, 19 nt, Homo sapiens
aagcaugucucaauaguaa

SEQ ID NO: 376878 - RNA, 19 nt, Homo sapiens
gaaagcaugucucaauagu

SEQ ID NO: 376879 - RNA, 19 nt, Homo sapiens
gaagugcugugaaauagau

SEQ ID NO: 376880 - RNA, 19 nt, Homo sapiens
ggagcaagccgugaauuua

SEQ ID NO: 376881 - RNA, 19 nt, Homo sapiens
gcaaccggguggaauauug

SEQ ID NO: 376882 - RNA, 19 nt, Homo sapiens
gaagcaaccggguggaaua

SEQ ID NO: 376883 - RNA, 19 nt, Homo sapiens
gagcaagccgugaauuuaa

SEQ ID NO: 376884 - RNA, 19 nt, Homo sapiens
acaccaagguuaccaacua

SEQ ID NO: 376885 - RNA, 19 nt, Homo sapiens
ggaauucgaugaugacacu

SEQ ID NO: 376886 - RNA, 19 nt, Homo sapiens
gcugggaagugcugugaaa

SEQ ID NO: 376887 - RNA, 19 nt, Homo sapiens
gggaagugcugugaaauag

SEQ ID NO: 376888 - RNA, 19 nt, Homo sapiens
ggaauuccaugauccugau

SEQ ID NO: 376889 - RNA, 19 nt, Homo sapiens
cagcagggccucaaaguug

SEQ ID NO: 376890 - RNA, 19 nt, Homo sapiens
aaagacggauugcauuaga

SEQ ID NO: 376891 - RNA, 19 nt, Homo sapiens
ggaaguacagcucagaguu

SEQ ID NO: 376892 - RNA, 19 nt, Homo sapiens
gaacacccgacuccucaaa

SEQ ID NO: 376893 - RNA, 19 nt, Homo sapiens
gcgaggaggagcagaaauu

SEQ ID NO: 376894 - RNA, 19 nt, Homo sapiens
acacuagccucuccaggaa

SEQ ID NO: 376895 - RNA, 19 nt, Homo sapiens
gaaguacagcucagaguuc

SEQ ID NO: 376896 - RNA, 19 nt, Homo sapiens
agacaugaaugcacacuag

SEQ ID NO: 376897 - RNA, 19 nt, Homo sapiens
guacagccagccucaguuu

SEQ ID NO: 376898 - RNA, 19 nt, Homo sapiens
ggaaggagcaagccgugaa

SEQ ID NO: 376899 - RNA, 19 nt, Homo sapiens
aaacgcagaugauauacca

SEQ ID NO: 376900 - RNA, 19 nt, Homo sapiens
gagagaauuguaucauuug

SEQ ID NO: 376901 - RNA, 19 nt, Homo sapiens
auaaggaauucgaugauga

SEQ ID NO: 376902 - RNA, 19 nt, Homo sapiens
cauaauuacugccggaauc

SEQ ID NO: 376903 - RNA, 19 nt, Homo sapiens
aaacccagaucgagacuca

SEQ ID NO: 376904 - RNA, 19 nt, Homo sapiens
augaaagcaugucucaaua

SEQ ID NO: 376905 - RNA, 19 nt, Homo sapiens
gcccuguacuucucagauu

SEQ ID NO: 376906 - RNA, 19 nt, Homo sapiens
uaacaagaucuuucaggaa

SEQ ID NO: 376907 - RNA, 19 nt, Homo sapiens
ccaacuaccuagacuggau

SEQ ID NO: 376908 - RNA, 19 nt, Homo sapiens
cugcacaucacaacauuua

SEQ ID NO: 376909 - RNA, 19 nt, Homo sapiens
gcagcgagccaagguguuu

SEQ ID NO: 376910 - RNA, 19 nt, Homo sapiens
gugagcagcuuuggaaaca

SEQ ID NO: 376911 - RNA, 19 nt, Homo sapiens
cauaaggaauucgaugaug

SEQ ID NO: 376912 - RNA, 19 nt, Homo sapiens
gaaagacggauugcauuag

SEQ ID NO: 376913 - RNA, 19 nt, Homo sapiens
gaacagucaccgacaacau

SEQ ID NO: 376914 - RNA, 19 nt, Homo sapiens
ccacaacccuguuuuauac

SEQ ID NO: 376915 - RNA, 19 nt, Homo sapiens
ugaugacacuuacgacaau

SEQ ID NO: 376916 - RNA, 19 nt, Homo sapiens
agccagaucuuaccaagug

SEQ ID NO: 376917 - RNA, 19 nt, Homo sapiens
uagaguagcaugagagaau

SEQ ID NO: 376918 - RNA, 19 nt, Homo sapiens
ggauugcauuagaaauaga

SEQ ID NO: 376919 - RNA, 19 nt, Homo sapiens
gugcuucucuacagacuuc

SEQ ID NO: 376920 - RNA, 19 nt, Homo sapiens
gaucccgccucuucuucuu

SEQ ID NO: 376921 - RNA, 19 nt, Homo sapiens
uagcaauccauguuaguuu

SEQ ID NO: 376922 - RNA, 19 nt, Homo sapiens
aaugaaagcaugucucaau

SEQ ID NO: 376923 - RNA, 19 nt, Homo sapiens
gcucugagggaaacaguga

SEQ ID NO: 376924 - RNA, 19 nt, Homo sapiens
uuacuuaacagaacaguca

SEQ ID NO: 376925 - RNA, 19 nt, Homo sapiens
gcacaucacaacauuuacu

SEQ ID NO: 376926 - RNA, 19 nt, Homo sapiens
gaggaggagcagaaauuug

SEQ ID NO: 376927 - RNA, 19 nt, Homo sapiens
ggaagugcugugaaauaga

SEQ ID NO: 376928 - RNA, 19 nt, Homo sapiens
ugggaagugcugugaaaua

SEQ ID NO: 376929 - RNA, 19 nt, Homo sapiens
acggauugcauuagaaaua

SEQ ID NO: 376930 - RNA, 19 nt, Homo sapiens
gaagcaaucauggaugcaa

SEQ ID NO: 376931 - RNA, 19 nt, Homo sapiens
gagagggaagagugcauuu

SEQ ID NO: 376932 - RNA, 19 nt, Homo sapiens
acagaacagucaccgacaa

SEQ ID NO: 376933 - RNA, 19 nt, Homo sapiens
aggaggagcagaaauuuga

SEQ ID NO: 376934 - RNA, 19 nt, Homo sapiens
ggccugggcaaacauaauu

SEQ ID NO: 376935 - RNA, 19 nt, Homo sapiens
ccagauacuucccauuuug

SEQ ID NO: 376936 - RNA, 19 nt, Homo sapiens
ucccagauacuucccauuu

SEQ ID NO: 376937 - RNA, 19 nt, Homo sapiens
gaaggagcaagccgugaau

SEQ ID NO: 376938 - RNA, 19 nt, Homo sapiens
ggugccacgugcugaagaa

SEQ ID NO: 376939 - RNA, 19 nt, Homo sapiens
aaccacaacuacugcagaa

SEQ ID NO: 376940 - RNA, 19 nt, Homo sapiens
ggagagggaagagugcauu

SEQ ID NO: 376941 - RNA, 19 nt, Homo sapiens
cgaggaggagcagaaauuu

SEQ ID NO: 376942 - RNA, 19 nt, Homo sapiens
ugacgugggaguacuguga

SEQ ID NO: 376943 - RNA, 19 nt, Homo sapiens
agaguagcaugagagaauu

SEQ ID NO: 376944 - RNA, 19 nt, Homo sapiens
cggauugcauuagaaauag

SEQ ID NO: 376945 - RNA, 19 nt, Homo sapiens
gaugauauaccagcaacau

SEQ ID NO: 376946 - RNA, 19 nt, Homo sapiens
guggagcagucuucguuuc

SEQ ID NO: 376947 - RNA, 19 nt, Homo sapiens
aaugagaucccgccucuuc

SEQ ID NO: 376948 - RNA, 19 nt, Homo sapiens
gaacgauggccgcaugacu

SEQ ID NO: 376949 - RNA, 19 nt, Homo sapiens
cagccucaguuucgcauca

SEQ ID NO: 376950 - RNA, 19 nt, Homo sapiens
uagcaugagagaauuguau

SEQ ID NO: 376951 - RNA, 19 nt, Homo sapiens
gcauuagaaauagacagua

SEQ ID NO: 376952 - RNA, 19 nt, Homo sapiens
gcagaugauauaccagcaa

SEQ ID NO: 376953 - RNA, 19 nt, Homo sapiens
gaugacacuuacgacaaug

SEQ ID NO: 376954 - RNA, 19 nt, Homo sapiens
gaucuugggcagaacauac

SEQ ID NO: 376955 - RNA, 19 nt, Homo sapiens
gcccuggugcuacgucuuu

SEQ ID NO: 376956 - RNA, 19 nt, Homo sapiens
acucaaagcccuggugcua

SEQ ID NO: 376957 - RNA, 19 nt, Homo sapiens
agacggauugcauuagaaa

SEQ ID NO: 376958 - RNA, 19 nt, Homo sapiens
ugaaagcaugucucaauag

SEQ ID NO: 376959 - RNA, 19 nt, Homo sapiens
caacuaccuagacuggauu

SEQ ID NO: 376960 - RNA, 19 nt, Homo sapiens
cagaagaggagccagaucu

SEQ ID NO: 376961 - RNA, 19 nt, Homo sapiens
gaccagggcaucagcuaca

SEQ ID NO: 376962 - RNA, 19 nt, Homo sapiens
gggacgcugugaagcaauc

SEQ ID NO: 376963 - RNA, 19 nt, Homo sapiens
caggaaagacggauugcau

SEQ ID NO: 376964 - RNA, 19 nt, Homo sapiens
ggaggagcagaaauuugaa

SEQ ID NO: 376965 - RNA, 19 nt, Homo sapiens
uaagggacgcugugaagca

SEQ ID NO: 376966 - RNA, 19 nt, Homo sapiens
gauaggcaagguuuacaca

SEQ ID NO: 376967 - RNA, 19 nt, Homo sapiens
aaacuuuagaguagcauga

SEQ ID NO: 376968 - RNA, 19 nt, Homo sapiens
ccagcagggccucaaaguu

SEQ ID NO: 376969 - RNA, 19 nt, Homo sapiens
aaagcaugucucaauagua

SEQ ID NO: 376970 - RNA, 19 nt, Homo sapiens
caucaaaggagggcucuuc

SEQ ID NO: 376971 - RNA, 19 nt, Homo sapiens
gaauuccaugauccugaua

SEQ ID NO: 376972 - RNA, 19 nt, Homo sapiens
ccacaacuacugcagaaac

SEQ ID NO: 376973 - RNA, 19 nt, Homo sapiens
uuauagcaauccauguuag

SEQ ID NO: 376974 - RNA, 19 nt, Homo sapiens
gaaggaggcucaugucaga

SEQ ID NO: 376975 - RNA, 19 nt, Homo sapiens
ggaaagacggauugcauua

SEQ ID NO: 376976 - RNA, 19 nt, Homo sapiens
aagcaugucucaauaguaa

SEQ ID NO: 376977 - RNA, 19 nt, Homo sapiens
gaaagcaugucucaauagu

SEQ ID NO: 376978 - RNA, 19 nt, Homo sapiens
gaagugcugugaaauagau

SEQ ID NO: 376979 - RNA, 19 nt, Homo sapiens
ggagcaagccgugaauuua

SEQ ID NO: 376980 - RNA, 19 nt, Homo sapiens
gcaaccggguggaauauug

SEQ ID NO: 376981 - RNA, 19 nt, Homo sapiens
gaagcaaccggguggaaua

SEQ ID NO: 376982 - RNA, 19 nt, Homo sapiens
gagcaagccgugaauuuaa

SEQ ID NO: 376983 - RNA, 19 nt, Homo sapiens
acaccaagguuaccaacua

SEQ ID NO: 376984 - RNA, 19 nt, Homo sapiens
gcugggaagugcugugaaa

SEQ ID NO: 376985 - RNA, 19 nt, Homo sapiens
gggaagugcugugaaauag

SEQ ID NO: 376986 - RNA, 19 nt, Homo sapiens
ggccuugucuccuuucuau

SEQ ID NO: 376987 - RNA, 19 nt, Homo sapiens
ggaauuccaugauccugau

SEQ ID NO: 376988 - RNA, 19 nt, Homo sapiens
cagcagggccucaaaguug

SEQ ID NO: 376989 - RNA, 19 nt, Homo sapiens
aaagacggauugcauuaga

SEQ ID NO: 376990 - RNA, 19 nt, Homo sapiens
ggaaguacagcucagaguu

SEQ ID NO: 376991 - RNA, 19 nt, Homo sapiens
gaacacccgacuccucaaa

SEQ ID NO: 376992 - RNA, 19 nt, Homo sapiens
acacuagccucuccaggaa

SEQ ID NO: 376993 - RNA, 19 nt, Homo sapiens
gaaguacagcucagaguuc

SEQ ID NO: 376994 - RNA, 19 nt, Homo sapiens
agacaugaaugcacacuag

SEQ ID NO: 376995 - RNA, 19 nt, Homo sapiens
ggaaggagcaagccgugaa

SEQ ID NO: 376996 - RNA, 19 nt, Homo sapiens
aaacgcagaugauauacca

SEQ ID NO: 376997 - RNA, 19 nt, Homo sapiens
gagagaauuguaucauuug

SEQ ID NO: 376998 - RNA, 19 nt, Homo sapiens
aaacccagaucgagacuca

SEQ ID NO: 376999 - RNA, 19 nt, Homo sapiens
augaaagcaugucucaaua

SEQ ID NO: 377000 - RNA, 19 nt, Homo sapiens
gcccuguacuucucagauu

SEQ ID NO: 377001 - RNA, 19 nt, Homo sapiens
uaacaagaucuuucaggaa

SEQ ID NO: 377002 - RNA, 19 nt, Homo sapiens
ccaacuaccuagacuggau

SEQ ID NO: 377003 - RNA, 19 nt, Homo sapiens
cugcacaucacaacauuua

SEQ ID NO: 377004 - RNA, 19 nt, Homo sapiens
caugaggccuugucuccuu

SEQ ID NO: 377005 - RNA, 19 nt, Homo sapiens
gcagcgagccaagguguuu

SEQ ID NO: 377006 - RNA, 19 nt, Homo sapiens
gugagcagcuuuggaaaca

SEQ ID NO: 377007 - RNA, 19 nt, Homo sapiens
gaaagacggauugcauuag

SEQ ID NO: 377008 - RNA, 19 nt, Homo sapiens
gaacagucaccgacaacau

SEQ ID NO: 377009 - RNA, 19 nt, Homo sapiens
ccacaacccuguuuuauac

SEQ ID NO: 377010 - RNA, 19 nt, Homo sapiens
agccagaucuuaccaagug

SEQ ID NO: 377011 - RNA, 19 nt, Homo sapiens
uagaguagcaugagagaau

SEQ ID NO: 377012 - RNA, 19 nt, Homo sapiens
ggauugcauuagaaauaga

SEQ ID NO: 377013 - RNA, 19 nt, Homo sapiens
gugcuucucuacagacuuc

SEQ ID NO: 377014 - RNA, 19 nt, Homo sapiens
gaucccgccucuucuucuu

SEQ ID NO: 377015 - RNA, 19 nt, Homo sapiens
uagcaauccauguuaguuu

SEQ ID NO: 377016 - RNA, 19 nt, Homo sapiens
aaugaaagcaugucucaau

SEQ ID NO: 377017 - RNA, 19 nt, Homo sapiens
gcucugagggaaacaguga

SEQ ID NO: 377018 - RNA, 19 nt, Homo sapiens
uuacuuaacagaacaguca

SEQ ID NO: 377019 - RNA, 19 nt, Homo sapiens
gcacaucacaacauuuacu

SEQ ID NO: 377020 - RNA, 19 nt, Homo sapiens
ggaagugcugugaaauaga

SEQ ID NO: 377021 - RNA, 19 nt, Homo sapiens
ugggaagugcugugaaaua

SEQ ID NO: 377022 - RNA, 19 nt, Homo sapiens
gaagcaaucauggaugcaa

SEQ ID NO: 377023 - RNA, 19 nt, Homo sapiens
acggauugcauuagaaaua

SEQ ID NO: 377024 - RNA, 19 nt, Homo sapiens
gagagggaagagugcauuu

SEQ ID NO: 377025 - RNA, 19 nt, Homo sapiens
acagaacagucaccgacaa

SEQ ID NO: 377026 - RNA, 19 nt, Homo sapiens
ggccugggcaaacauaauu

SEQ ID NO: 377027 - RNA, 19 nt, Homo sapiens
gaaggagcaagccgugaau

SEQ ID NO: 377028 - RNA, 19 nt, Homo sapiens
ccagauacuucccauuuug

SEQ ID NO: 377029 - RNA, 19 nt, Homo sapiens
ucccagauacuucccauuu

SEQ ID NO: 377030 - RNA, 19 nt, Homo sapiens
aaccacaacuacugcagaa

SEQ ID NO: 377031 - RNA, 19 nt, Homo sapiens
ggagagggaagagugcauu

SEQ ID NO: 377032 - RNA, 19 nt, Homo sapiens
agaguagcaugagagaauu

SEQ ID NO: 377033 - RNA, 19 nt, Homo sapiens
cggauugcauuagaaauag

SEQ ID NO: 377034 - RNA, 19 nt, Homo sapiens
gaugauauaccagcaacau

SEQ ID NO: 377035 - RNA, 19 nt, Homo sapiens
aaugagaucccgccucuuc

SEQ ID NO: 377036 - RNA, 19 nt, Homo sapiens
gaacgauggccgcaugacu

SEQ ID NO: 377037 - RNA, 19 nt, Homo sapiens
guggagcagucuucguuuc

SEQ ID NO: 377038 - RNA, 19 nt, Homo sapiens
uagcaugagagaauuguau

SEQ ID NO: 377039 - RNA, 19 nt, Homo sapiens
gcauuagaaauagacagua

SEQ ID NO: 377040 - RNA, 19 nt, Homo sapiens
gcccuggugcuacgucuuu

SEQ ID NO: 377041 - RNA, 19 nt, Homo sapiens
acucaaagcccuggugcua

SEQ ID NO: 377042 - RNA, 19 nt, Homo sapiens
gcagaugauauaccagcaa

SEQ ID NO: 377043 - RNA, 19 nt, Homo sapiens
agacggauugcauuagaaa

SEQ ID NO: 377044 - RNA, 19 nt, Homo sapiens
ugaaagcaugucucaauag

SEQ ID NO: 377045 - RNA, 19 nt, Homo sapiens
caacuaccuagacuggauu

SEQ ID NO: 377046 - RNA, 19 nt, Homo sapiens
gaccagggcaucagcuaca

SEQ ID NO: 377047 - RNA, 19 nt, Homo sapiens
gggacgcugugaagcaauc

SEQ ID NO: 377048 - RNA, 19 nt, Homo sapiens
cagaagaggagccagaucu

SEQ ID NO: 377049 - RNA, 19 nt, Homo sapiens
caggaaagacggauugcau

SEQ ID NO: 377050 - RNA, 19 nt, Homo sapiens
uaagggacgcugugaagca

SEQ ID NO: 377051 - RNA, 19 nt, Homo sapiens
gauaggcaagguuuacaca

SEQ ID NO: 377052 - RNA, 19 nt, Homo sapiens
aaacuuuagaguagcauga

SEQ ID NO: 377053 - RNA, 19 nt, Homo sapiens
ccagcagggccucaaaguu

SEQ ID NO: 377054 - RNA, 19 nt, Homo sapiens
aaagcaugucucaauagua

SEQ ID NO: 377055 - RNA, 19 nt, Homo sapiens
gaauuccaugauccugaua

SEQ ID NO: 377056 - RNA, 19 nt, Homo sapiens
ccacaacuacugcagaaac

SEQ ID NO: 377057 - RNA, 19 nt, Homo sapiens
uuauagcaauccauguuag

SEQ ID NO: 377058 - RNA, 19 nt, Homo sapiens
aagacggauugcauuagaa

SEQ ID NO: 377059 - RNA, 19 nt, Homo sapiens
cccuguacuucucagauuu

SEQ ID NO: 377060 - RNA, 19 nt, Homo sapiens
gcauauuuauagcaaucca

SEQ ID NO: 377061 - RNA, 19 nt, Homo sapiens
gcaugagagaauuguauca

SEQ ID NO: 377062 - RNA, 19 nt, Homo sapiens
cagaugggaagacaugaau

SEQ ID NO: 377063 - RNA, 19 nt, Homo sapiens
gagaucccgccucuucuuc

SEQ ID NO: 377064 - RNA, 19 nt, Homo sapiens
aggagcaagccgugaauuu

SEQ ID NO: 377065 - RNA, 19 nt, Homo sapiens
gaugggaagacaugaaugc

SEQ ID NO: 377066 - RNA, 19 nt, Homo sapiens
aagcaaucauggaugcaau

SEQ ID NO: 377067 - RNA, 19 nt, Homo sapiens
gccacaacccuguuuuaua

SEQ ID NO: 377068 - RNA, 19 nt, Homo sapiens
gagugcauuuucccagaua

SEQ ID NO: 377069 - RNA, 19 nt, Homo sapiens
caccaagguuaccaacuac

SEQ ID NO: 377070 - RNA, 19 nt, Homo sapiens
ccuccucccugggcagaaa

SEQ ID NO: 377071 - RNA, 19 nt, Homo sapiens
acuagccucuccaggaaug

SEQ ID NO: 377072 - RNA, 19 nt, Homo sapiens
ucagaugggaagacaugaa

SEQ ID NO: 377073 - RNA, 19 nt, Homo sapiens
guguggagcagucuucguu

SEQ ID NO: 377074 - RNA, 19 nt, Homo sapiens
gaaggaggcucaugucaga

SEQ ID NO: 377075 - RNA, 19 nt, Homo sapiens
ggaaagacggauugcauua

SEQ ID NO: 377076 - RNA, 19 nt, Homo sapiens
gcagaaauuugaagucgaa

SEQ ID NO: 377077 - RNA, 19 nt, Homo sapiens
aagcaugucucaauaguaa

SEQ ID NO: 377078 - RNA, 19 nt, Homo sapiens
gaaagcaugucucaauagu

SEQ ID NO: 377079 - RNA, 19 nt, Homo sapiens
gaagugcugugaaauagau

SEQ ID NO: 377080 - RNA, 19 nt, Homo sapiens
ggagcaagccgugaauuua

SEQ ID NO: 377081 - RNA, 19 nt, Homo sapiens
gagcaagccgugaauuuaa

SEQ ID NO: 377082 - RNA, 19 nt, Homo sapiens
acaccaagguuaccaacua

SEQ ID NO: 377083 - RNA, 19 nt, Homo sapiens
ggaauucgaugaugacacu

SEQ ID NO: 377084 - RNA, 19 nt, Homo sapiens
gcugggaagugcugugaaa

SEQ ID NO: 377085 - RNA, 19 nt, Homo sapiens
gggaagugcugugaaauag

SEQ ID NO: 377086 - RNA, 19 nt, Homo sapiens
ggaauuccaugauccugau

SEQ ID NO: 377087 - RNA, 19 nt, Homo sapiens
cagcagggccucaaaguug

SEQ ID NO: 377088 - RNA, 19 nt, Homo sapiens
aaagacggauugcauuaga

SEQ ID NO: 377089 - RNA, 19 nt, Homo sapiens
ggaaguacagcucagaguu

SEQ ID NO: 377090 - RNA, 19 nt, Homo sapiens
gaacacccgacuccucaaa

SEQ ID NO: 377091 - RNA, 19 nt, Homo sapiens
gcgaggaggagcagaaauu

SEQ ID NO: 377092 - RNA, 19 nt, Homo sapiens
acacuagccucuccaggaa

SEQ ID NO: 377093 - RNA, 19 nt, Homo sapiens
gaaguacagcucagaguuc

SEQ ID NO: 377094 - RNA, 19 nt, Homo sapiens
agacaugaaugcacacuag

SEQ ID NO: 377095 - RNA, 19 nt, Homo sapiens
ggaaggagcaagccgugaa

SEQ ID NO: 377096 - RNA, 19 nt, Homo sapiens
guacagccagccucaguuu

SEQ ID NO: 377097 - RNA, 19 nt, Homo sapiens
gagagaauuguaucauuug

SEQ ID NO: 377098 - RNA, 19 nt, Homo sapiens
auaaggaauucgaugauga

SEQ ID NO: 377099 - RNA, 19 nt, Homo sapiens
cauaauuacugccggaauc

SEQ ID NO: 377100 - RNA, 19 nt, Homo sapiens
aaacccagaucgagacuca

SEQ ID NO: 377101 - RNA, 19 nt, Homo sapiens
augaaagcaugucucaaua

SEQ ID NO: 377102 - RNA, 19 nt, Homo sapiens
gcccuguacuucucagauu

SEQ ID NO: 377103 - RNA, 19 nt, Homo sapiens
uaacaagaucuuucaggaa

SEQ ID NO: 377104 - RNA, 19 nt, Homo sapiens
ccaacuaccuagacuggau

SEQ ID NO: 377105 - RNA, 19 nt, Homo sapiens
cugcacaucacaacauuua

SEQ ID NO: 377106 - RNA, 19 nt, Homo sapiens
gcagcgagccaagguguuu

SEQ ID NO: 377107 - RNA, 19 nt, Homo sapiens
gugagcagcuuuggaaaca

SEQ ID NO: 377108 - RNA, 19 nt, Homo sapiens
cauaaggaauucgaugaug

SEQ ID NO: 377109 - RNA, 19 nt, Homo sapiens
gaaagacggauugcauuag

SEQ ID NO: 377110 - RNA, 19 nt, Homo sapiens
gaacagucaccgacaacau

SEQ ID NO: 377111 - RNA, 19 nt, Homo sapiens
ccacaacccuguuuuauac

SEQ ID NO: 377112 - RNA, 19 nt, Homo sapiens
ugaugacacuuacgacaau

SEQ ID NO: 377113 - RNA, 19 nt, Homo sapiens
uagaguagcaugagagaau

SEQ ID NO: 377114 - RNA, 19 nt, Homo sapiens
ggauugcauuagaaauaga

SEQ ID NO: 377115 - RNA, 19 nt, Homo sapiens
gugcuucucuacagacuuc

SEQ ID NO: 377116 - RNA, 19 nt, Homo sapiens
gaucccgccucuucuucuu

SEQ ID NO: 377117 - RNA, 19 nt, Homo sapiens
uagcaauccauguuaguuu

SEQ ID NO: 377118 - RNA, 19 nt, Homo sapiens
aaugaaagcaugucucaau

SEQ ID NO: 377119 - RNA, 19 nt, Homo sapiens
gcucugagggaaacaguga

SEQ ID NO: 377120 - RNA, 19 nt, Homo sapiens
uuacuuaacagaacaguca

SEQ ID NO: 377121 - RNA, 19 nt, Homo sapiens
gcacaucacaacauuuacu

SEQ ID NO: 377122 - RNA, 19 nt, Homo sapiens
gaggaggagcagaaauuug

SEQ ID NO: 377123 - RNA, 19 nt, Homo sapiens
ggaagugcugugaaauaga

SEQ ID NO: 377124 - RNA, 19 nt, Homo sapiens
ugggaagugcugugaaaua

SEQ ID NO: 377125 - RNA, 19 nt, Homo sapiens
acggauugcauuagaaaua

SEQ ID NO: 377126 - RNA, 19 nt, Homo sapiens
gagagggaagagugcauuu

SEQ ID NO: 377127 - RNA, 19 nt, Homo sapiens
acagaacagucaccgacaa

SEQ ID NO: 377128 - RNA, 19 nt, Homo sapiens
gaagcaaucauggaugcaa

SEQ ID NO: 377129 - RNA, 19 nt, Homo sapiens
aggaggagcagaaauuuga

SEQ ID NO: 377130 - RNA, 19 nt, Homo sapiens
ggccugggcaaacauaauu

SEQ ID NO: 377131 - RNA, 19 nt, Homo sapiens
gaaggagcaagccgugaau

SEQ ID NO: 377132 - RNA, 19 nt, Homo sapiens
ccagauacuucccauuuug

SEQ ID NO: 377133 - RNA, 19 nt, Homo sapiens
ucccagauacuucccauuu

SEQ ID NO: 377134 - RNA, 19 nt, Homo sapiens
ggugccacgugcugaagaa

SEQ ID NO: 377135 - RNA, 19 nt, Homo sapiens
aaccacaacuacugcagaa

SEQ ID NO: 377136 - RNA, 19 nt, Homo sapiens
ggagagggaagagugcauu

SEQ ID NO: 377137 - RNA, 19 nt, Homo sapiens
cgaggaggagcagaaauuu

SEQ ID NO: 377138 - RNA, 19 nt, Homo sapiens
ugacgugggaguacuguga

SEQ ID NO: 377139 - RNA, 19 nt, Homo sapiens
agccagaucuuaccaaggu

SEQ ID NO: 377140 - RNA, 19 nt, Homo sapiens
agaguagcaugagagaauu

SEQ ID NO: 377141 - RNA, 19 nt, Homo sapiens
cggauugcauuagaaauag

SEQ ID NO: 377142 - RNA, 19 nt, Homo sapiens
aaugagaucccgccucuuc

SEQ ID NO: 377143 - RNA, 19 nt, Homo sapiens
gaacgauggccgcaugacu

SEQ ID NO: 377144 - RNA, 19 nt, Homo sapiens
guggagcagucuucguuuc

SEQ ID NO: 377145 - RNA, 19 nt, Homo sapiens
cagccucaguuucgcauca

SEQ ID NO: 377146 - RNA, 19 nt, Homo sapiens
uagcaugagagaauuguau

SEQ ID NO: 377147 - RNA, 19 nt, Homo sapiens
gcauuagaaauagacagua

SEQ ID NO: 377148 - RNA, 19 nt, Homo sapiens
gaugacacuuacgacaaug

SEQ ID NO: 377149 - RNA, 19 nt, Homo sapiens
gaucuugggcagaacauac

SEQ ID NO: 377150 - RNA, 19 nt, Homo sapiens
gcccuggugcuacgucuuu

SEQ ID NO: 377151 - RNA, 19 nt, Homo sapiens
acucaaagcccuggugcua

SEQ ID NO: 377152 - RNA, 19 nt, Homo sapiens
agacggauugcauuagaaa

SEQ ID NO: 377153 - RNA, 19 nt, Homo sapiens
ugaaagcaugucucaauag

SEQ ID NO: 377154 - RNA, 19 nt, Homo sapiens
caacuaccuagacuggauu

SEQ ID NO: 377155 - RNA, 19 nt, Homo sapiens
gggacgcugugaagcaauc

SEQ ID NO: 377156 - RNA, 19 nt, Homo sapiens
cagaagaggagccagaucu

SEQ ID NO: 377157 - RNA, 19 nt, Homo sapiens
gaccagggcaucagcuaca

SEQ ID NO: 377158 - RNA, 19 nt, Homo sapiens
caggaaagacggauugcau

SEQ ID NO: 377159 - RNA, 19 nt, Homo sapiens
ggaggagcagaaauuugaa

SEQ ID NO: 377160 - RNA, 19 nt, Homo sapiens
gauaggcaagguuuacaca

SEQ ID NO: 377161 - RNA, 19 nt, Homo sapiens
uaagggacgcugugaagca

SEQ ID NO: 377162 - RNA, 19 nt, Homo sapiens
aaacuuuagaguagcauga

SEQ ID NO: 377163 - RNA, 19 nt, Homo sapiens
ccagcagggccucaaaguu

SEQ ID NO: 377164 - RNA, 19 nt, Homo sapiens
aaagcaugucucaauagua

SEQ ID NO: 377165 - RNA, 19 nt, Homo sapiens
caucaaaggagggcucuuc

SEQ ID NO: 377166 - RNA, 19 nt, Homo sapiens
gaauuccaugauccugaua

SEQ ID NO: 377167 - RNA, 19 nt, Homo sapiens
ccacaacuacugcagaaac

SEQ ID NO: 377168 - RNA, 19 nt, Homo sapiens
uuauagcaauccauguuag

SEQ ID NO: 377169 - RNA, 19 nt, Homo sapiens
aagacggauugcauuagaa

SEQ ID NO: 377170 - RNA, 19 nt, Homo sapiens
cccuguacuucucagauuu

SEQ ID NO: 377171 - RNA, 19 nt, Homo sapiens
gcauauuuauagcaaucca

SEQ ID NO: 377172 - RNA, 19 nt, Homo sapiens
gcaugagagaauuguauca

SEQ ID NO: 377173 - RNA, 19 nt, Homo sapiens
cagaugggaagacaugaau

SEQ ID NO: 377174 - RNA, 19 nt, Homo sapiens
gaacauguguguccaacaa

SEQ ID NO: 377175 - RNA, 19 nt, Homo sapiens
gcucaaggcuuaacuccaa

SEQ ID NO: 377176 - RNA, 19 nt, Homo sapiens
aguaagagcuggugucuga

SEQ ID NO: 377177 - RNA, 19 nt, Homo sapiens
ccacagaucugaugcucuu

SEQ ID NO: 377178 - RNA, 19 nt, Homo sapiens
gggcagggcucugauauuc

SEQ ID NO: 377179 - RNA, 19 nt, Homo sapiens
gcuggugucugauuguuaa

SEQ ID NO: 377180 - RNA, 19 nt, Homo sapiens
gaacugugacugucuaaau

SEQ ID NO: 377181 - RNA, 19 nt, Homo sapiens
gaaaaugacuguugugaag

SEQ ID NO: 377182 - RNA, 19 nt, Homo sapiens
gacauugccuugcugaaga

SEQ ID NO: 377183 - RNA, 19 nt, Homo sapiens
acacacugcuucauugauu

SEQ ID NO: 377184 - RNA, 19 nt, Homo sapiens
agaagagacugggaagaua

SEQ ID NO: 377185 - RNA, 19 nt, Homo sapiens
ggaccacuccuuacacuga

SEQ ID NO: 377186 - RNA, 19 nt, Homo sapiens
uaaacuguguggacuguga

SEQ ID NO: 377187 - RNA, 19 nt, Homo sapiens
gggcagcacugugaaauag

SEQ ID NO: 377188 - RNA, 19 nt, Homo sapiens
gcaacugcccaaagaaauu

SEQ ID NO: 377189 - RNA, 19 nt, Homo sapiens
gacagugccugggaaugua

SEQ ID NO: 377190 - RNA, 19 nt, Homo sapiens
gcagagacacuaacgacuu

SEQ ID NO: 377191 - RNA, 19 nt, Homo sapiens
gaugugcccugaaggacaa

SEQ ID NO: 377192 - RNA, 19 nt, Homo sapiens
ugagggagcuuagccaaug

SEQ ID NO: 377193 - RNA, 19 nt, Homo sapiens
gcucugaagucaccaccaa

SEQ ID NO: 377194 - RNA, 19 nt, Homo sapiens
ugagaucacuggcuuugga

SEQ ID NO: 377195 - RNA, 19 nt, Homo sapiens
gguccugacucaacauguu

SEQ ID NO: 377196 - RNA, 19 nt, Homo sapiens
gcagcacugugaaauagau

SEQ ID NO: 377197 - RNA, 19 nt, Homo sapiens
guaagcagcugaggucucu

SEQ ID NO: 377198 - RNA, 19 nt, Homo sapiens
gcccaugguugagaaauga

SEQ ID NO: 377199 - RNA, 19 nt, Homo sapiens
cugggucgcucaaggcuua

SEQ ID NO: 377200 - RNA, 19 nt, Homo sapiens
gaagagacugggaagauag

SEQ ID NO: 377201 - RNA, 19 nt, Homo sapiens
gcagggcucugauauucca

SEQ ID NO: 377202 - RNA, 19 nt, Homo sapiens
gaggaaaggccagcacuga

SEQ ID NO: 377203 - RNA, 19 nt, Homo sapiens
gccacacacugcuucauug

SEQ ID NO: 377204 - RNA, 19 nt, Homo sapiens
ggaaaggccagcacugaca

SEQ ID NO: 377205 - RNA, 19 nt, Homo sapiens
cagagacacuaacgacuuc

SEQ ID NO: 377206 - RNA, 19 nt, Homo sapiens
caaagaaggaggacuacau

SEQ ID NO: 377207 - RNA, 19 nt, Homo sapiens
cacacugcuucauugauua

SEQ ID NO: 377208 - RNA, 19 nt, Homo sapiens
gagcuggugucugauuguu

SEQ ID NO: 377209 - RNA, 19 nt, Homo sapiens
ugacucaacauguuacuga

SEQ ID NO: 377210 - RNA, 19 nt, Homo sapiens
gcaguagagucaucuccau

SEQ ID NO: 377211 - RNA, 19 nt, Homo sapiens
ccaugaauguaucaggaaa

SEQ ID NO: 377212 - RNA, 19 nt, Homo sapiens
uccaucagcuguaagaaga

SEQ ID NO: 377213 - RNA, 19 nt, Homo sapiens
guauaacgauccccaguuu

SEQ ID NO: 377214 - RNA, 19 nt, Homo sapiens
ggugaacgacaauagcuuu

SEQ ID NO: 377215 - RNA, 19 nt, Homo sapiens
ggacaagccaggcgucuac

SEQ ID NO: 377216 - RNA, 19 nt, Homo sapiens
gaccacuccuuacacugaa

SEQ ID NO: 377217 - RNA, 19 nt, Homo sapiens
caguuucacuuucacauag

SEQ ID NO: 377218 - RNA, 19 nt, Homo sapiens
gcagucacaccaaggaaga

SEQ ID NO: 377219 - RNA, 19 nt, Homo sapiens
caaggccgcaugacuuuga

SEQ ID NO: 377220 - RNA, 19 nt, Homo sapiens
gaugaaguuugagguggaa

SEQ ID NO: 377221 - RNA, 19 nt, Homo sapiens
agagaauucuaccgacuau

SEQ ID NO: 377222 - RNA, 19 nt, Homo sapiens
gugcaugacugcgcagaug

SEQ ID NO: 377223 - RNA, 19 nt, Homo sapiens
gcuuuacccucacggauag

SEQ ID NO: 377224 - RNA, 19 nt, Homo sapiens
gacuuugacuggaauugug

SEQ ID NO: 377225 - RNA, 19 nt, Homo sapiens
caaguacuucuccaacauu

SEQ ID NO: 377226 - RNA, 19 nt, Homo sapiens
uaagagcuggugucugauu

SEQ ID NO: 377227 - RNA, 19 nt, Homo sapiens
gaacgacaauagcuuuacc

SEQ ID NO: 377228 - RNA, 19 nt, Homo sapiens
acaaguacuucuccaacau

SEQ ID NO: 377229 - RNA, 19 nt, Homo sapiens
ugccugcccucgauguaua

SEQ ID NO: 377230 - RNA, 19 nt, Homo sapiens
gggcucugauauuccauga

SEQ ID NO: 377231 - RNA, 19 nt, Homo sapiens
gaacucugccacuguccuu

SEQ ID NO: 377232 - RNA, 19 nt, Homo sapiens
gugcaacugcccaaagaaa

SEQ ID NO: 377233 - RNA, 19 nt, Homo sapiens
gaagccugcaggaguuaaa

SEQ ID NO: 377234 - RNA, 19 nt, Homo sapiens
gcaugacuuugacuggaau

SEQ ID NO: 377235 - RNA, 19 nt, Homo sapiens
caaaggcagcaaugaacuu

SEQ ID NO: 377236 - RNA, 19 nt, Homo sapiens
cuccuuacacugaauauuu

SEQ ID NO: 377237 - RNA, 19 nt, Homo sapiens
ucaguuucacuuucacaua

SEQ ID NO: 377238 - RNA, 19 nt, Homo sapiens
gcugugaguguaaguguga

SEQ ID NO: 377239 - RNA, 19 nt, Homo sapiens
gugaacgacaauagcuuua

SEQ ID NO: 377240 - RNA, 19 nt, Homo sapiens
gcccuccucuccuccagaa

SEQ ID NO: 377241 - RNA, 19 nt, Homo sapiens
uagccuaguucauccaauc

SEQ ID NO: 377242 - RNA, 19 nt, Homo sapiens
ugucucaguuucacuuuca

SEQ ID NO: 377243 - RNA, 19 nt, Homo sapiens
ggagggcagcacugugaaa

SEQ ID NO: 377244 - RNA, 19 nt, Homo sapiens
gcagccaucccggacuaua

SEQ ID NO: 377245 - RNA, 19 nt, Homo sapiens
ccacacacugcuucauuga

SEQ ID NO: 377246 - RNA, 19 nt, Homo sapiens
ccacuguccuucagcaaac

SEQ ID NO: 377247 - RNA, 19 nt, Homo sapiens
gagggagcuuagccaaugu

SEQ ID NO: 377248 - RNA, 19 nt, Homo sapiens
caucagcuguaagaagaga

SEQ ID NO: 377249 - RNA, 19 nt, Homo sapiens
gccugggaauguacuuauu

SEQ ID NO: 377250 - RNA, 19 nt, Homo sapiens
ggcccaugguugagaaaug

SEQ ID NO: 377251 - RNA, 19 nt, Homo sapiens
acugaagccugcaggaguu

SEQ ID NO: 377252 - RNA, 19 nt, Homo sapiens
ugacagugccugggaaugu

SEQ ID NO: 377253 - RNA, 19 nt, Homo sapiens
caacugcccaaagaaauuc

SEQ ID NO: 377254 - RNA, 19 nt, Homo sapiens
cuaaauggaggaacaugug

SEQ ID NO: 377255 - RNA, 19 nt, Homo sapiens
guccugacucaacauguua

SEQ ID NO: 377256 - RNA, 19 nt, Homo sapiens
ugugugggcugugagugua

SEQ ID NO: 377257 - RNA, 19 nt, Homo sapiens
cgcaugacuuugacuggaa

SEQ ID NO: 377258 - RNA, 19 nt, Homo sapiens
ccacuccuuacacugaaua

SEQ ID NO: 377259 - RNA, 19 nt, Homo sapiens
ccaguuaucccuuccuuuu

SEQ ID NO: 377260 - RNA, 19 nt, Homo sapiens
ggccaguuaucccuuccuu

SEQ ID NO: 377261 - RNA, 19 nt, Homo sapiens
ugaggcccaugguugagaa

SEQ ID NO: 377262 - RNA, 19 nt, Homo sapiens
aaagaaggaggacuacauc

SEQ ID NO: 377263 - RNA, 19 nt, Homo sapiens
cgaccucgccaccaugaga

SEQ ID NO: 377264 - RNA, 19 nt, Homo sapiens
aacaaguacuucuccaaca

SEQ ID NO: 377265 - RNA, 19 nt, Homo sapiens
ggugucugauuguuaaguc

SEQ ID NO: 377266 - RNA, 19 nt, Homo sapiens
aacugugacugucuaaaug

SEQ ID NO: 377267 - RNA, 19 nt, Homo sapiens
ccacuacuacggcucugaa

SEQ ID NO: 377268 - RNA, 19 nt, Homo sapiens
uggugcaacugcccaaaga

SEQ ID NO: 377269 - RNA, 19 nt, Homo sapiens
cuucauugauuacccaaag

SEQ ID NO: 377270 - RNA, 19 nt, Homo sapiens
aagagcuggugucugauug

SEQ ID NO: 377271 - RNA, 19 nt, Homo sapiens
ugaccagcaacuugucuuu

SEQ ID NO: 377272 - RNA, 19 nt, Homo sapiens
cauguguguccaacaagua

SEQ ID NO: 377273 - RNA, 19 nt, Homo sapiens
aagaagagacugggaagau

SEQ ID NO: 377274 - RNA, 19 nt, Homo sapiens
ggagagcucuuguuauuau

SEQ ID NO: 377275 - RNA, 19 nt, Homo sapiens
gaagagacuuuccucauug

SEQ ID NO: 377276 - RNA, 19 nt, Homo sapiens
ugaagagacuuuccucauu

SEQ ID NO: 377277 - RNA, 19 nt, Homo sapiens
ugggagagcucuuguuauu

SEQ ID NO: 377278 - RNA, 19 nt, Homo sapiens
gaaaacagcuaucucacaa

SEQ ID NO: 377279 - RNA, 19 nt, Homo sapiens
ucagccacauucauauuua

SEQ ID NO: 377280 - RNA, 19 nt, Homo sapiens
caaauaaucagccacauuc

SEQ ID NO: 377281 - RNA, 19 nt, Homo sapiens
acagcuaucucacaaaguu

SEQ ID NO: 377282 - RNA, 19 nt, Homo sapiens
caucagacaugagcuguga

SEQ ID NO: 377283 - RNA, 19 nt, Homo sapiens
ggugacgccuucagcauga

SEQ ID NO: 377284 - RNA, 19 nt, Homo sapiens
aaacagcuaucucacaaag

SEQ ID NO: 377285 - RNA, 19 nt, Homo sapiens
ccaaagcuauaugguaaga

SEQ ID NO: 377286 - RNA, 19 nt, Homo sapiens
caacgacaccuuccacuuc

SEQ ID NO: 377287 - RNA, 19 nt, Homo sapiens
gaagaagggcguccaaagg

SEQ ID NO: 377288 - RNA, 19 nt, Homo sapiens
gaugucuccugcuguacua

SEQ ID NO: 377289 - RNA, 19 nt, Homo sapiens
ccaaugguuuccacaacaa

SEQ ID NO: 377290 - RNA, 19 nt, Homo sapiens
auaaucagccacauucaua

SEQ ID NO: 377291 - RNA, 19 nt, Homo sapiens
ccaaauaaucagccacauu

SEQ ID NO: 377292 - RNA, 19 nt, Homo sapiens
gcuguuguguuguuguuau

SEQ ID NO: 377293 - RNA, 19 nt, Homo sapiens
gaaaagcuguacccacuca

SEQ ID NO: 377294 - RNA, 19 nt, Homo sapiens
gcccaauccuggagcuuga

SEQ ID NO: 377295 - RNA, 19 nt, Homo sapiens
gagagcucuuguuauuauu

SEQ ID NO: 377296 - RNA, 19 nt, Homo sapiens
gggagagcucuuguuauua

SEQ ID NO: 377297 - RNA, 19 nt, Homo sapiens
aaugggagagcucuuguua

SEQ ID NO: 377298 - RNA, 19 nt, Homo sapiens
cggacuggcuugaagauca

SEQ ID NO: 377299 - RNA, 19 nt, Homo sapiens
ccuguuagccaaauaauca

SEQ ID NO: 377300 - RNA, 19 nt, Homo sapiens
uugaagaucaccagccuua

SEQ ID NO: 377301 - RNA, 19 nt, Homo sapiens
ccgaagccguuaccucgaa

SEQ ID NO: 377302 - RNA, 19 nt, Homo sapiens
cauauuuaccgucaaaguu

SEQ ID NO: 377303 - RNA, 19 nt, Homo sapiens
gauccaggaaggugaagaa

SEQ ID NO: 377304 - RNA, 19 nt, Homo sapiens
aagagacuuuccucauuga

SEQ ID NO: 377305 - RNA, 19 nt, Homo sapiens
gggaacagcacccauggau

SEQ ID NO: 377306 - RNA, 19 nt, Homo sapiens
gcaacaccaccaaaugcaa

SEQ ID NO: 377307 - RNA, 19 nt, Homo sapiens
gccguuaccucgaaugcau

SEQ ID NO: 377308 - RNA, 19 nt, Homo sapiens
agagagagaacugggauuu

SEQ ID NO: 377309 - RNA, 19 nt, Homo sapiens
uaauauuguugccgcuguu

SEQ ID NO: 377310 - RNA, 19 nt, Homo sapiens
gagagagaacugggauuug

SEQ ID NO: 377311 - RNA, 19 nt, Homo sapiens
cauggaugcuccucugaag

SEQ ID NO: 377312 - RNA, 19 nt, Homo sapiens
agagagaacugggauuugc

SEQ ID NO: 377313 - RNA, 19 nt, Homo sapiens
auugaugucuccugcugua

SEQ ID NO: 377314 - RNA, 19 nt, Homo sapiens
aagaagggcguccaaagga

SEQ ID NO: 377315 - RNA, 19 nt, Homo sapiens
gggauugccguguggaaga

SEQ ID NO: 377316 - RNA, 19 nt, Homo sapiens
ucccagcccuacagacuug

SEQ ID NO: 377317 - RNA, 19 nt, Homo sapiens
ccgcagcccugaagaacag

SEQ ID NO: 377318 - RNA, 19 nt, Homo sapiens
gcaaugggagagcucuugu

SEQ ID NO: 377319 - RNA, 19 nt, Homo sapiens
agaagggcguccaaaggau

SEQ ID NO: 377320 - RNA, 19 nt, Homo sapiens
gaggaaggccgugggcaau

SEQ ID NO: 377321 - RNA, 19 nt, Homo sapiens
gcugcaacaccaccaaaug

SEQ ID NO: 377322 - RNA, 19 nt, Homo sapiens
ugaagaagggcguccaaag

SEQ ID NO: 377323 - RNA, 19 nt, Homo sapiens
ggacuggcuugaagaucac

SEQ ID NO: 377324 - RNA, 19 nt, Homo sapiens
uguugccgcuguuguguug

SEQ ID NO: 377325 - RNA, 19 nt, Homo sapiens
cagcaugaaccacauugau

SEQ ID NO: 377326 - RNA, 19 nt, Homo sapiens
aaucagccacauucauauu

SEQ ID NO: 377327 - RNA, 19 nt, Homo sapiens
gagguuguguguggguuag

SEQ ID NO: 377328 - RNA, 19 nt, Homo sapiens
gcuguacccacucagagaa

SEQ ID NO: 377329 - RNA, 19 nt, Homo sapiens
ccgcuguuguguuguuguu

SEQ ID NO: 377330 - RNA, 19 nt, Homo sapiens
caccaucacccugcuaaug

SEQ ID NO: 377331 - RNA, 19 nt, Homo sapiens
gaagaucaccagccuuacc

SEQ ID NO: 377332 - RNA, 19 nt, Homo sapiens
uaaucagccacauucauau

SEQ ID NO: 377333 - RNA, 19 nt, Homo sapiens
caccuuccacuuccugaaa

SEQ ID NO: 377334 - RNA, 19 nt, Homo sapiens
uccaaugguuuccacaaca

SEQ ID NO: 377335 - RNA, 19 nt, Homo sapiens
cgagguuguguguggguua

SEQ ID NO: 377336 - RNA, 19 nt, Homo sapiens
ugcggugcaugcaguguaa

SEQ ID NO: 377337 - RNA, 19 nt, Homo sapiens
aaauccuguuagccaaaua

SEQ ID NO: 377338 - RNA, 19 nt, Homo sapiens
caugaaucaaugucuggua

SEQ ID NO: 377339 - RNA, 19 nt, Homo sapiens
cgaagccguuaccucgaau

SEQ ID NO: 377340 - RNA, 19 nt, Homo sapiens
ggauugccguguggaagag

SEQ ID NO: 377341 - RNA, 19 nt, Homo sapiens
ugaagaacagugccuggau

SEQ ID NO: 377342 - RNA, 19 nt, Homo sapiens
ucagacaugagcugugaga

SEQ ID NO: 377343 - RNA, 19 nt, Homo sapiens
cagccacauucauauuuac

SEQ ID NO: 377344 - RNA, 19 nt, Homo sapiens
accaucacccugcuaauga

SEQ ID NO: 377345 - RNA, 19 nt, Homo sapiens
gcgcuugugggaagaagga

SEQ ID NO: 377346 - RNA, 19 nt, Homo sapiens
ccauggaugcuccucugaa

SEQ ID NO: 377347 - RNA, 19 nt, Homo sapiens
gcuccaaugguuuccacaa

SEQ ID NO: 377348 - RNA, 19 nt, Homo sapiens
gagagaacugggauuugca

SEQ ID NO: 377349 - RNA, 19 nt, Homo sapiens
gcaugcaguguaagaccaa

SEQ ID NO: 377350 - RNA, 19 nt, Homo sapiens
ucacagagcucaaggcaua

SEQ ID NO: 377351 - RNA, 19 nt, Homo sapiens
gagcaaaucuccaaaauga

SEQ ID NO: 377352 - RNA, 19 nt, Homo sapiens
gcaagauccucaucaagaa

SEQ ID NO: 377353 - RNA, 19 nt, Homo sapiens
gaugagaucuucacuucuu

SEQ ID NO: 377354 - RNA, 19 nt, Homo sapiens
ggaagaggcuaugaaagaa

SEQ ID NO: 377355 - RNA, 19 nt, Homo sapiens
gaaccgaaguuaugucauc

SEQ ID NO: 377356 - RNA, 19 nt, Homo sapiens
gagauggaguuucuggaua

SEQ ID NO: 377357 - RNA, 19 nt, Homo sapiens
gaaccugucuacaagaguu

SEQ ID NO: 377358 - RNA, 19 nt, Homo sapiens
ccacagacaucuucuucaa

SEQ ID NO: 377359 - RNA, 19 nt, Homo sapiens
acaguugccucuccaguua

SEQ ID NO: 377360 - RNA, 19 nt, Homo sapiens
gaacaagaagaaccaguuu

SEQ ID NO: 377361 - RNA, 19 nt, Homo sapiens
guaaggagauggaguuucu

SEQ ID NO: 377362 - RNA, 19 nt, Homo sapiens
gggaagaggcuaugaaaga

SEQ ID NO: 377363 - RNA, 19 nt, Homo sapiens
ggaggaaggcaacaaguuu

SEQ ID NO: 377364 - RNA, 19 nt, Homo sapiens
caaaugggaugaugaaacu

SEQ ID NO: 377365 - RNA, 19 nt, Homo sapiens
ggaggagcccuuugucuuu

SEQ ID NO: 377366 - RNA, 19 nt, Homo sapiens
gaacauggcaguauuugag

SEQ ID NO: 377367 - RNA, 19 nt, Homo sapiens
cauuugcucuccugaauuu

SEQ ID NO: 377368 - RNA, 19 nt, Homo sapiens
ggagaugaaggacuacaua

SEQ ID NO: 377369 - RNA, 19 nt, Homo sapiens
ggcaagggcucucgcaaga

SEQ ID NO: 377370 - RNA, 19 nt, Homo sapiens
ggacuuuccugauaacagu

SEQ ID NO: 377371 - RNA, 19 nt, Homo sapiens
gaacgacaccaaagagaug

SEQ ID NO: 377372 - RNA, 19 nt, Homo sapiens
cauaugaccugcucuccaa

SEQ ID NO: 377373 - RNA, 19 nt, Homo sapiens
gaagaagagauuaagaaga

SEQ ID NO: 377374 - RNA, 19 nt, Homo sapiens
gaucuucacuucuuaccau

SEQ ID NO: 377375 - RNA, 19 nt, Homo sapiens
uacaagaguuuccucauga

SEQ ID NO: 377376 - RNA, 19 nt, Homo sapiens
ucaagcagaugacggagaa

SEQ ID NO: 377377 - RNA, 19 nt, Homo sapiens
gggauaugcugcucacaga

SEQ ID NO: 377378 - RNA, 19 nt, Homo sapiens
ccaaauucaucaaccagaa

SEQ ID NO: 377379 - RNA, 19 nt, Homo sapiens
gguggaagcugcucucagu

SEQ ID NO: 377380 - RNA, 19 nt, Homo sapiens
gacaaggucagcaucauuu

SEQ ID NO: 377381 - RNA, 19 nt, Homo sapiens
ccacucaccuccacucuag

SEQ ID NO: 377382 - RNA, 19 nt, Homo sapiens
gcagaacauggcaguauuu

SEQ ID NO: 377383 - RNA, 19 nt, Homo sapiens
aacauggacuuuccugaua

SEQ ID NO: 377384 - RNA, 19 nt, Homo sapiens
ugauggagcuggccagaga

SEQ ID NO: 377385 - RNA, 19 nt, Homo sapiens
agaaggagcugcgagaguu

SEQ ID NO: 377386 - RNA, 19 nt, Homo sapiens
cuacaagaguuuccucaug

SEQ ID NO: 377387 - RNA, 19 nt, Homo sapiens
gaggagcccuuugucuuug

SEQ ID NO: 377388 - RNA, 19 nt, Homo sapiens
uguccagccuagucaauua

SEQ ID NO: 377389 - RNA, 19 nt, Homo sapiens
aggcuaagauggcugagua

SEQ ID NO: 377390 - RNA, 19 nt, Homo sapiens
gaaccucgucccagugaaa

SEQ ID NO: 377391 - RNA, 19 nt, Homo sapiens
agagagagauuaacaacuc

SEQ ID NO: 377392 - RNA, 19 nt, Homo sapiens
ggcaagauccucaucaaga

SEQ ID NO: 377393 - RNA, 19 nt, Homo sapiens
aggagaagcuggaggagaa

SEQ ID NO: 377394 - RNA, 19 nt, Homo sapiens
aagaggcgcuaucgaacua

SEQ ID NO: 377395 - RNA, 19 nt, Homo sapiens
cgcagccacucaaucauua

SEQ ID NO: 377396 - RNA, 19 nt, Homo sapiens
agaugcagcucaacucuga

SEQ ID NO: 377397 - RNA, 19 nt, Homo sapiens
gcaccuuccuggacaagau

SEQ ID NO: 377398 - RNA, 19 nt, Homo sapiens
gagcaggacccacucauag

SEQ ID NO: 377399 - RNA, 19 nt, Homo sapiens
caagggcucucgcaagaag

SEQ ID NO: 377400 - RNA, 19 nt, Homo sapiens
ccaaguucgucuccuuuga

SEQ ID NO: 377401 - RNA, 19 nt, Homo sapiens
gaagagagagauuaacaac

SEQ ID NO: 377402 - RNA, 19 nt, Homo sapiens
acagacaucuucuucaaag

SEQ ID NO: 377403 - RNA, 19 nt, Homo sapiens
caaaagaaccgaaguuaug

SEQ ID NO: 377404 - RNA, 19 nt, Homo sapiens
uaagauggcugaguauugc

SEQ ID NO: 377405 - RNA, 19 nt, Homo sapiens
gcacguggccgagcaaauc

SEQ ID NO: 377406 - RNA, 19 nt, Homo sapiens
gcgcaccuauguagaagug

SEQ ID NO: 377407 - RNA, 19 nt, Homo sapiens
aggagcaccugaccaaauu

SEQ ID NO: 377408 - RNA, 19 nt, Homo sapiens
caacauggacuuuccugau

SEQ ID NO: 377409 - RNA, 19 nt, Homo sapiens
aggaggcgcuggcagagua

SEQ ID NO: 377410 - RNA, 19 nt, Homo sapiens
ugaaggagacgucggagaa

SEQ ID NO: 377411 - RNA, 19 nt, Homo sapiens
gcuauaagagcaacuagau

SEQ ID NO: 377412 - RNA, 19 nt, Homo sapiens
gccuggaagugacggcuua

SEQ ID NO: 377413 - RNA, 19 nt, Homo sapiens
gauacucgcuuugggaagu

SEQ ID NO: 377414 - RNA, 19 nt, Homo sapiens
gccaccacccuuuccauua

SEQ ID NO: 377415 - RNA, 19 nt, Homo sapiens
ccaccaaguucgucuccuu

SEQ ID NO: 377416 - RNA, 19 nt, Homo sapiens
cgaaggagcaccugaccaa

SEQ ID NO: 377417 - RNA, 19 nt, Homo sapiens
acauggacuuuccugauaa

SEQ ID NO: 377418 - RNA, 19 nt, Homo sapiens
gcagaugacggagaacuug

SEQ ID NO: 377419 - RNA, 19 nt, Homo sapiens
ggagcuggccagagagaaa

SEQ ID NO: 377420 - RNA, 19 nt, Homo sapiens
ccacaacaccuaccugaca

SEQ ID NO: 377421 - RNA, 19 nt, Homo sapiens
acuaagcugucacccagua

SEQ ID NO: 377422 - RNA, 19 nt, Homo sapiens
ggugaucucugggcaguuc

SEQ ID NO: 377423 - RNA, 19 nt, Homo sapiens
aagaagcaauugaggcuau

SEQ ID NO: 377424 - RNA, 19 nt, Homo sapiens
ggccagaaauagaugagau

SEQ ID NO: 377425 - RNA, 19 nt, Homo sapiens
agauggaguuucuggauau

SEQ ID NO: 377426 - RNA, 19 nt, Homo sapiens
ggacguaucaaaguaagga

SEQ ID NO: 377427 - RNA, 19 nt, Homo sapiens
ggaacgggaggcugaaaug

SEQ ID NO: 377428 - RNA, 19 nt, Homo sapiens
gagaacgacaccaaagaga

SEQ ID NO: 377429 - RNA, 19 nt, Homo sapiens
cgaagucugugaagcucaa

SEQ ID NO: 377430 - RNA, 19 nt, Homo sapiens
ccaccacccuuuccauuac

SEQ ID NO: 377431 - RNA, 19 nt, Homo sapiens
aaaccuggaugaagaagag

SEQ ID NO: 377432 - RNA, 19 nt, Homo sapiens
ggagauggaguuucuggau

SEQ ID NO: 377433 - RNA, 19 nt, Homo sapiens
ucacagagccccuggaaaa

SEQ ID NO: 377434 - RNA, 19 nt, Homo sapiens
ugacgcagccacucaauca

SEQ ID NO: 377435 - RNA, 19 nt, Homo sapiens
caaauucaucaaccagaaa

SEQ ID NO: 377436 - RNA, 19 nt, Homo sapiens
ggacuccuccaacuacaug

SEQ ID NO: 377437 - RNA, 19 nt, Homo sapiens
ggagauguccagccuaguc

SEQ ID NO: 377438 - RNA, 19 nt, Homo sapiens
gaugaagaagagauuaaga

SEQ ID NO: 377439 - RNA, 19 nt, Homo sapiens
aaaguaaggagauggaguu

SEQ ID NO: 377440 - RNA, 19 nt, Homo sapiens
gaccucaccuuccacaacu

SEQ ID NO: 377441 - RNA, 19 nt, Homo sapiens
gccugugucugcugagauu

SEQ ID NO: 377442 - RNA, 19 nt, Homo sapiens
gcggcuaccuccucaagca

SEQ ID NO: 377443 - RNA, 19 nt, Homo sapiens
cuaagauggcugaguauug

SEQ ID NO: 377444 - RNA, 19 nt, Homo sapiens
gaccacagacaucuucuuc

SEQ ID NO: 377445 - RNA, 19 nt, Homo sapiens
ggcauggucugguuucucu

SEQ ID NO: 377446 - RNA, 19 nt, Homo sapiens
gagcggauccagggcauga

SEQ ID NO: 377447 - RNA, 19 nt, Homo sapiens
ggagaacgacaccaaagag

SEQ ID NO: 377448 - RNA, 19 nt, Homo sapiens
ggacuggaaggcagaaagu

SEQ ID NO: 377449 - RNA, 19 nt, Homo sapiens
gggagcgcuucaucaaaug

SEQ ID NO: 377450 - RNA, 19 nt, Homo sapiens
ggaguaaguucaucaaaug

SEQ ID NO: 377451 - RNA, 19 nt, Homo sapiens
gaacaaaugcuucgagaug

SEQ ID NO: 377452 - RNA, 19 nt, Homo sapiens
agaaggagcugcagaagau

SEQ ID NO: 377453 - RNA, 19 nt, Homo sapiens
ccauggaguuuguggaaua

SEQ ID NO: 377454 - RNA, 19 nt, Homo sapiens
gaggaggaacccuucauua

SEQ ID NO: 377455 - RNA, 19 nt, Homo sapiens
gggaguaaguucaucaaau

SEQ ID NO: 377456 - RNA, 19 nt, Homo sapiens
ggaauccuguggccucaaa

SEQ ID NO: 377457 - RNA, 19 nt, Homo sapiens
aggcaaagauggcugagua

SEQ ID NO: 377458 - RNA, 19 nt, Homo sapiens
ucaagaggcugaaagagau

SEQ ID NO: 377459 - RNA, 19 nt, Homo sapiens
ucaagaacauccugaagau

SEQ ID NO: 377460 - RNA, 19 nt, Homo sapiens
ccaauggcuucuucuugua

SEQ ID NO: 377461 - RNA, 19 nt, Homo sapiens
gaaagaggaacaaaugcuu

SEQ ID NO: 377462 - RNA, 19 nt, Homo sapiens
gaacguagggugccagcuu

SEQ ID NO: 377463 - RNA, 19 nt, Homo sapiens
ucagggaggucguccuuga

SEQ ID NO: 377464 - RNA, 19 nt, Homo sapiens
ggucucagccguccucaaa

SEQ ID NO: 377465 - RNA, 19 nt, Homo sapiens
ggaggaagaugaggaagag

SEQ ID NO: 377466 - RNA, 19 nt, Homo sapiens
gaucugagcacggacauga

SEQ ID NO: 377467 - RNA, 19 nt, Homo sapiens
agaagauccuggacagaaa

SEQ ID NO: 377468 - RNA, 19 nt, Homo sapiens
uguccacgcuugucaacua

SEQ ID NO: 377469 - RNA, 19 nt, Homo sapiens
guacugccgcuccaucuuu

SEQ ID NO: 377470 - RNA, 19 nt, Homo sapiens
ccucgucgguggagaugua

SEQ ID NO: 377471 - RNA, 19 nt, Homo sapiens
gagaccagauguccaugga

SEQ ID NO: 377472 - RNA, 19 nt, Homo sapiens
ucacaaggcucuggucaag

SEQ ID NO: 377473 - RNA, 19 nt, Homo sapiens
ggucuggucugaggagcua

SEQ ID NO: 377474 - RNA, 19 nt, Homo sapiens
ugcaacagcuggcagaaga

SEQ ID NO: 377475 - RNA, 19 nt, Homo sapiens
gggacaagcauaagaagga

SEQ ID NO: 377476 - RNA, 19 nt, Homo sapiens
ucgagccucuggacaagua

SEQ ID NO: 377477 - RNA, 19 nt, Homo sapiens
caaagcaacaggcaaagau

SEQ ID NO: 377478 - RNA, 19 nt, Homo sapiens
cccaauggcuucuucuugu

SEQ ID NO: 377479 - RNA, 19 nt, Homo sapiens
ggccggacauugacaagau

SEQ ID NO: 377480 - RNA, 19 nt, Homo sapiens
gaaugccacugaggagaug

SEQ ID NO: 377481 - RNA, 19 nt, Homo sapiens
gacaugacccagccacuga

SEQ ID NO: 377482 - RNA, 19 nt, Homo sapiens
ggagaacacgcagcucuga

SEQ ID NO: 377483 - RNA, 19 nt, Homo sapiens
cagaagauccuggacagaa

SEQ ID NO: 377484 - RNA, 19 nt, Homo sapiens
gcaaagcaacaggcaaaga

SEQ ID NO: 377485 - RNA, 19 nt, Homo sapiens
cagccaaggucuggucuga

SEQ ID NO: 377486 - RNA, 19 nt, Homo sapiens
ggaagaggaggaacagaca

SEQ ID NO: 377487 - RNA, 19 nt, Homo sapiens
gagacgcgcuacucaucga

SEQ ID NO: 377488 - RNA, 19 nt, Homo sapiens
ggacagaaagcgccauaac

SEQ ID NO: 377489 - RNA, 19 nt, Homo sapiens
gacagaaagcgccauaaca

SEQ ID NO: 377490 - RNA, 19 nt, Homo sapiens
acaggaaggugggcaucua

SEQ ID NO: 377491 - RNA, 19 nt, Homo sapiens
ggacuccuccaacuacaug

SEQ ID NO: 377492 - RNA, 19 nt, Homo sapiens
gggaggagguagggcuuga

SEQ ID NO: 377493 - RNA, 19 nt, Homo sapiens
ggagguagggcuugagaag

SEQ ID NO: 377494 - RNA, 19 nt, Homo sapiens
ugaacauccuggcucagaa

SEQ ID NO: 377495 - RNA, 19 nt, Homo sapiens
ugaacgagagggagaagaa

SEQ ID NO: 377496 - RNA, 19 nt, Homo sapiens
gccguauccuggugaagaa

SEQ ID NO: 377497 - RNA, 19 nt, Homo sapiens
cagaacgccucccggaaca

SEQ ID NO: 377498 - RNA, 19 nt, Homo sapiens
gaacagacagaccccaaaa

SEQ ID NO: 377499 - RNA, 19 nt, Homo sapiens
gcauaacaccuaucucacu

SEQ ID NO: 377500 - RNA, 19 nt, Homo sapiens
gcgccaagggcaagccaua

SEQ ID NO: 377501 - RNA, 19 nt, Homo sapiens
gucaagaacauccugaaga

SEQ ID NO: 377502 - RNA, 19 nt, Homo sapiens
ggucugaggagcuauucaa

SEQ ID NO: 377503 - RNA, 19 nt, Homo sapiens
cggcaaagcaacaggcaaa

SEQ ID NO: 377504 - RNA, 19 nt, Homo sapiens
caacgcgacccgagacuca

SEQ ID NO: 377505 - RNA, 19 nt, Homo sapiens
gaaagcgccauaacagcau

SEQ ID NO: 377506 - RNA, 19 nt, Homo sapiens
agaagaaggagcugcagaa

SEQ ID NO: 377507 - RNA, 19 nt, Homo sapiens
gguaucaggaguuccagaa

SEQ ID NO: 377508 - RNA, 19 nt, Homo sapiens
caaagauggcugaguacug

SEQ ID NO: 377509 - RNA, 19 nt, Homo sapiens
acccacggcuucaccauga

SEQ ID NO: 377510 - RNA, 19 nt, Homo sapiens
uucaucaacuccucgcaua

SEQ ID NO: 377511 - RNA, 19 nt, Homo sapiens
caagcuggcuaugaacauc

SEQ ID NO: 377512 - RNA, 19 nt, Homo sapiens
gaagaaggagcugcagaag

SEQ ID NO: 377513 - RNA, 19 nt, Homo sapiens
gcuucgagaugucguccuu

SEQ ID NO: 377514 - RNA, 19 nt, Homo sapiens
gcucgaaagaggaacaaau

SEQ ID NO: 377515 - RNA, 19 nt, Homo sapiens
ucgcauaacaccuaucuca

SEQ ID NO: 377516 - RNA, 19 nt, Homo sapiens
gcucauggacuucaucaac

SEQ ID NO: 377517 - RNA, 19 nt, Homo sapiens
ccuguggccucaaauucaa

SEQ ID NO: 377518 - RNA, 19 nt, Homo sapiens
gguggagacugcgcuggaa

SEQ ID NO: 377519 - RNA, 19 nt, Homo sapiens
ugagggacaagcauaagaa

SEQ ID NO: 377520 - RNA, 19 nt, Homo sapiens
gaagauccuggacagaaag

SEQ ID NO: 377521 - RNA, 19 nt, Homo sapiens
gaacaccuuccugcgcaaa

SEQ ID NO: 377522 - RNA, 19 nt, Homo sapiens
cgaagccucggacuacauu

SEQ ID NO: 377523 - RNA, 19 nt, Homo sapiens
gcggaacugacggagauua

SEQ ID NO: 377524 - RNA, 19 nt, Homo sapiens
acaaggcucuggucaagcu

SEQ ID NO: 377525 - RNA, 19 nt, Homo sapiens
guagggugccagcuuguug

SEQ ID NO: 377526 - RNA, 19 nt, Homo sapiens
gaaccgaggccccuauguu

SEQ ID NO: 377527 - RNA, 19 nt, Homo sapiens
acaagauccugcuggagau

SEQ ID NO: 377528 - RNA, 19 nt, Homo sapiens
ccaaggccauggagcaacu

SEQ ID NO: 377529 - RNA, 19 nt, Homo sapiens
acaaaugcuucgagauguc

SEQ ID NO: 377530 - RNA, 19 nt, Homo sapiens
gaacauccuggcucagaac

SEQ ID NO: 377531 - RNA, 19 nt, Homo sapiens
caagauccugcuggagaua

SEQ ID NO: 377532 - RNA, 19 nt, Homo sapiens
gcagcggcaugaccgucuu

SEQ ID NO: 377533 - RNA, 19 nt, Homo sapiens
aggcggaacugacggagau

SEQ ID NO: 377534 - RNA, 19 nt, Homo sapiens
gggaaguucugggcuuugg

SEQ ID NO: 377535 - RNA, 19 nt, Homo sapiens
ggacgaggcaaagcgguau

SEQ ID NO: 377536 - RNA, 19 nt, Homo sapiens
cgagaugucguccuuugug

SEQ ID NO: 377537 - RNA, 19 nt, Homo sapiens
aagaugagggacaagcaua

SEQ ID NO: 377538 - RNA, 19 nt, Homo sapiens
acagaaagcgccauaacag

SEQ ID NO: 377539 - RNA, 19 nt, Homo sapiens
gaugcaaacacaacucagu

SEQ ID NO: 377540 - RNA, 19 nt, Homo sapiens
uggagcaacugaccaagag

SEQ ID NO: 377541 - RNA, 19 nt, Homo sapiens
gaggagguagggcuugaga

SEQ ID NO: 377542 - RNA, 19 nt, Homo sapiens
ggaggaacccuucauuacc

SEQ ID NO: 377543 - RNA, 19 nt, Homo sapiens
caacauggagguggacaca

SEQ ID NO: 377544 - RNA, 19 nt, Homo sapiens
aagcauacacgaagcugaa

SEQ ID NO: 377545 - RNA, 19 nt, Homo sapiens
aacaaaugcuucgagaugu

SEQ ID NO: 377546 - RNA, 19 nt, Homo sapiens
ggaacaaaugcuucgagau

SEQ ID NO: 377547 - RNA, 19 nt, Homo sapiens
gagauguccacgcuuguca

SEQ ID NO: 377548 - RNA, 19 nt, Homo sapiens
ugaggaggaacccuucauu

SEQ ID NO: 377549 - RNA, 19 nt, Homo sapiens
gauuaaccgucggcacauc

SEQ ID NO: 377550 - RNA, 19 nt, Homo sapiens
gaagaaacaugcaaaggaa

SEQ ID NO: 377551 - RNA, 19 nt, Homo sapiens
gaaagagacuugccaugaa

SEQ ID NO: 377552 - RNA, 19 nt, Homo sapiens
ggaaguaauugucuugaaa

SEQ ID NO: 377553 - RNA, 19 nt, Homo sapiens
guaauucucuccuuugaaa

SEQ ID NO: 377554 - RNA, 19 nt, Homo sapiens
gaagacacaugcaauugaa

SEQ ID NO: 377555 - RNA, 19 nt, Homo sapiens
caaggaagcuguugcaaau

SEQ ID NO: 377556 - RNA, 19 nt, Homo sapiens
gaauagcuguguaugauga

SEQ ID NO: 377557 - RNA, 19 nt, Homo sapiens
ccacuaauauccauccaua

SEQ ID NO: 377558 - RNA, 19 nt, Homo sapiens
gaagucgacucaugagaaa

SEQ ID NO: 377559 - RNA, 19 nt, Homo sapiens
caagaaagguauugaacuu

SEQ ID NO: 377560 - RNA, 19 nt, Homo sapiens
ccaaagaaauggaucaguu

SEQ ID NO: 377561 - RNA, 19 nt, Homo sapiens
gagaauagcuguguaugau

SEQ ID NO: 377562 - RNA, 19 nt, Homo sapiens
gauggaagcuggagaaucu

SEQ ID NO: 377563 - RNA, 19 nt, Homo sapiens
gcugaaaccugaaguugaa

SEQ ID NO: 377564 - RNA, 19 nt, Homo sapiens
ggaccuggcugucuugaga

SEQ ID NO: 377565 - RNA, 19 nt, Homo sapiens
gaagaacgcaauauucauu

SEQ ID NO: 377566 - RNA, 19 nt, Homo sapiens
gcagauguguugaacuuga

SEQ ID NO: 377567 - RNA, 19 nt, Homo sapiens
gaugaaggcuuacuugaag

SEQ ID NO: 377568 - RNA, 19 nt, Homo sapiens
ugagggaaauaaaccauua

SEQ ID NO: 377569 - RNA, 19 nt, Homo sapiens
uaaaugagcuuggugugaa

SEQ ID NO: 377570 - RNA, 19 nt, Homo sapiens
gaagaaagaaagagacuug

SEQ ID NO: 377571 - RNA, 19 nt, Homo sapiens
ggucagaaaugaucaauac

SEQ ID NO: 377572 - RNA, 19 nt, Homo sapiens
gauccucgauugaaugaaa

SEQ ID NO: 377573 - RNA, 19 nt, Homo sapiens
ggaugaaagcuguuuauuu

SEQ ID NO: 377574 - RNA, 19 nt, Homo sapiens
gaacucgcaugguuaugaa

SEQ ID NO: 377575 - RNA, 19 nt, Homo sapiens
gcaaauaucaacaguacaa

SEQ ID NO: 377576 - RNA, 19 nt, Homo sapiens
uuuaacagcuugaguauug

SEQ ID NO: 377577 - RNA, 19 nt, Homo sapiens
gaaaaucacugcagcaaau

SEQ ID NO: 377578 - RNA, 19 nt, Homo sapiens
aaagcaauguguacagaua

SEQ ID NO: 377579 - RNA, 19 nt, Homo sapiens
gaccaagaaccaauaauaa

SEQ ID NO: 377580 - RNA, 19 nt, Homo sapiens
guaauuacaugccucagau

SEQ ID NO: 377581 - RNA, 19 nt, Homo sapiens
aguacaagauguccaaaua

SEQ ID NO: 377582 - RNA, 19 nt, Homo sapiens
caaggaaacugcauuuguc

SEQ ID NO: 377583 - RNA, 19 nt, Homo sapiens
gaucgaaagugcugaccaa

SEQ ID NO: 377584 - RNA, 19 nt, Homo sapiens
guaugaaccugaugaagau

SEQ ID NO: 377585 - RNA, 19 nt, Homo sapiens
gcaaugagagguaauuuua

SEQ ID NO: 377586 - RNA, 19 nt, Homo sapiens
ggacuaguuugggaaauga

SEQ ID NO: 377587 - RNA, 19 nt, Homo sapiens
gugaacaacucuuccuuug

SEQ ID NO: 377588 - RNA, 19 nt, Homo sapiens
acaaaggaauggucagaaa

SEQ ID NO: 377589 - RNA, 19 nt, Homo sapiens
aaagagaagucgacucaug

SEQ ID NO: 377590 - RNA, 19 nt, Homo sapiens
gcaaagccaucagccaaga

SEQ ID NO: 377591 - RNA, 19 nt, Homo sapiens
gaaaugaucaauacucaca

SEQ ID NO: 377592 - RNA, 19 nt, Homo sapiens
guuuagaacuuuaccaaga

SEQ ID NO: 377593 - RNA, 19 nt, Homo sapiens
cgaaggagaugcagcagau

SEQ ID NO: 377594 - RNA, 19 nt, Homo sapiens
agaaauggaucaguugaaa

SEQ ID NO: 377595 - RNA, 19 nt, Homo sapiens
aaagagagcagaccaaaug

SEQ ID NO: 377596 - RNA, 19 nt, Homo sapiens
ucaauccaguuuacaauga

SEQ ID NO: 377597 - RNA, 19 nt, Homo sapiens
gaauguguguuucuuucuu

SEQ ID NO: 377598 - RNA, 19 nt, Homo sapiens
gaacacaaacuccauggau

SEQ ID NO: 377599 - RNA, 19 nt, Homo sapiens
gcagaagaacgcaauauuc

SEQ ID NO: 377600 - RNA, 19 nt, Homo sapiens
gaaauuggaagccgagaug

SEQ ID NO: 377601 - RNA, 19 nt, Homo sapiens
ccaaugaccucaaaagaaa

SEQ ID NO: 377602 - RNA, 19 nt, Homo sapiens
cagcaaauaucaacaguac

SEQ ID NO: 377603 - RNA, 19 nt, Homo sapiens
gaaccaauaauaacucaug

SEQ ID NO: 377604 - RNA, 19 nt, Homo sapiens
cagaaaugaucaauacuca

SEQ ID NO: 377605 - RNA, 19 nt, Homo sapiens
gaaagguauugaacuuauc

SEQ ID NO: 377606 - RNA, 19 nt, Homo sapiens
uaucguggaugcuuuauca

SEQ ID NO: 377607 - RNA, 19 nt, Homo sapiens
gagauaucguggaugcuuu

SEQ ID NO: 377608 - RNA, 19 nt, Homo sapiens
cgaaagugcugaccaagag

SEQ ID NO: 377609 - RNA, 19 nt, Homo sapiens
aacaauaacuggaaugugu

SEQ ID NO: 377610 - RNA, 19 nt, Homo sapiens
cagcaacaguaguaugaaa

SEQ ID NO: 377611 - RNA, 19 nt, Homo sapiens
gcuugaacaucuagaauuc

SEQ ID NO: 377612 - RNA, 19 nt, Homo sapiens
uaaagaaacagcagaagga

SEQ ID NO: 377613 - RNA, 19 nt, Homo sapiens
gcagaucauugagauguau

SEQ ID NO: 377614 - RNA, 19 nt, Homo sapiens
agaaggcaaugaagaagaa

SEQ ID NO: 377615 - RNA, 19 nt, Homo sapiens
cgacacauuucccuucgaa

SEQ ID NO: 377616 - RNA, 19 nt, Homo sapiens
cagcuugaguauugcauuu

SEQ ID NO: 377617 - RNA, 19 nt, Homo sapiens
gcacaccaggcuaagauuu

SEQ ID NO: 377618 - RNA, 19 nt, Homo sapiens
gggaaguaauugucuugaa

SEQ ID NO: 377619 - RNA, 19 nt, Homo sapiens
gauaacaacaagcugauug

SEQ ID NO: 377620 - RNA, 19 nt, Homo sapiens
ccacugacaccauacguaa

SEQ ID NO: 377621 - RNA, 19 nt, Homo sapiens
guucuucccauaacacuua

SEQ ID NO: 377622 - RNA, 19 nt, Homo sapiens
aaacagugcauuagcaauu

SEQ ID NO: 377623 - RNA, 19 nt, Homo sapiens
ccacaaugaucaacuaugc

SEQ ID NO: 377624 - RNA, 19 nt, Homo sapiens
gaucuuugcaucagagaaa

SEQ ID NO: 377625 - RNA, 19 nt, Homo sapiens
ccugauggauuuggagaua

SEQ ID NO: 377626 - RNA, 19 nt, Homo sapiens
gauucaaguugcaucacua

SEQ ID NO: 377627 - RNA, 19 nt, Homo sapiens
gcucacuacuucaucaguu

SEQ ID NO: 377628 - RNA, 19 nt, Homo sapiens
cuagaucguuuagaacuuu

SEQ ID NO: 377629 - RNA, 19 nt, Homo sapiens
gaagcaguccaaagaaaug

SEQ ID NO: 377630 - RNA, 19 nt, Homo sapiens
gcacagcacacaaaggaau

SEQ ID NO: 377631 - RNA, 19 nt, Homo sapiens
gagagcagaccaaaugaga

SEQ ID NO: 377632 - RNA, 19 nt, Homo sapiens
cagaagaacgcaauauuca

SEQ ID NO: 377633 - RNA, 19 nt, Homo sapiens
ggacacugaggacuaguuu

SEQ ID NO: 377634 - RNA, 19 nt, Homo sapiens
guccaaauauugcgaagau

SEQ ID NO: 377635 - RNA, 19 nt, Homo sapiens
gaacugacacaaaagauuu

SEQ ID NO: 377636 - RNA, 19 nt, Homo sapiens
caaagaaauggaucaguug

SEQ ID NO: 377637 - RNA, 19 nt, Homo sapiens
gcagaugaaggcuuacuug

SEQ ID NO: 377638 - RNA, 19 nt, Homo sapiens
uauaacaaacggcaaauga

SEQ ID NO: 377639 - RNA, 19 nt, Homo sapiens
ggaaagaaugaugaaauug

SEQ ID NO: 377640 - RNA, 19 nt, Homo sapiens
cugacugacuucuauuuaa

SEQ ID NO: 377641 - RNA, 19 nt, Homo sapiens
ggaauggucagaaaugauc

SEQ ID NO: 377642 - RNA, 19 nt, Homo sapiens
ucacaaaucuaaggucaag

SEQ ID NO: 377643 - RNA, 19 nt, Homo sapiens
guacaagauguccaaauau

SEQ ID NO: 377644 - RNA, 19 nt, Homo sapiens
gaaaagcaauguguacaga

SEQ ID NO: 377645 - RNA, 19 nt, Homo sapiens
gaacauuugcaucgggaaa

SEQ ID NO: 377646 - RNA, 19 nt, Homo sapiens
caacaccgccaaagcaaau

SEQ ID NO: 377647 - RNA, 19 nt, Homo sapiens
cuuccuagaucguuuagaa

SEQ ID NO: 377648 - RNA, 19 nt, Homo sapiens
agaaagagacuugccauga

SEQ ID NO: 377649 - RNA, 19 nt, Homo sapiens
uuaaacagcagcaacacua

SEQ ID NO: 377650 - RNA, 19 nt, Homo sapiens
gaacagacuccuccaacua

SEQ ID NO: 377651 - RNA, 19 nt, Homo sapiens
ucaaggagcugcagaacuu

SEQ ID NO: 377652 - RNA, 19 nt, Homo sapiens
ggagagagcgguucuacaa

SEQ ID NO: 377653 - RNA, 19 nt, Homo sapiens
ggccagagauggacgugua

SEQ ID NO: 377654 - RNA, 19 nt, Homo sapiens
acacggaguuugcguuuga

SEQ ID NO: 377655 - RNA, 19 nt, Homo sapiens
gacaugggccagccacuua

SEQ ID NO: 377656 - RNA, 19 nt, Homo sapiens
gaaguucgcccgugaugug

SEQ ID NO: 377657 - RNA, 19 nt, Homo sapiens
agacgaggcugcugagaug

SEQ ID NO: 377658 - RNA, 19 nt, Homo sapiens
ugaaggagcucaacaucca

SEQ ID NO: 377659 - RNA, 19 nt, Homo sapiens
gagagcgguucuacaaguu

SEQ ID NO: 377660 - RNA, 19 nt, Homo sapiens
ggaguuugcguuugaggua

SEQ ID NO: 377661 - RNA, 19 nt, Homo sapiens
ggacacggaguuugcguuu

SEQ ID NO: 377662 - RNA, 19 nt, Homo sapiens
gcacggagggucuggagaa

SEQ ID NO: 377663 - RNA, 19 nt, Homo sapiens
gcagccagcuccugaaggu

SEQ ID NO: 377664 - RNA, 19 nt, Homo sapiens
uaugaugccuccuccaaga

SEQ ID NO: 377665 - RNA, 19 nt, Homo sapiens
ggaagcggcucaacaucag

SEQ ID NO: 377666 - RNA, 19 nt, Homo sapiens
cugcugagauggaggauga

SEQ ID NO: 377667 - RNA, 19 nt, Homo sapiens
gcaauacacuagaccucau

SEQ ID NO: 377668 - RNA, 19 nt, Homo sapiens
gaccgcugcuucuccauug

SEQ ID NO: 377669 - RNA, 19 nt, Homo sapiens
cggagggucuggagaaguu

SEQ ID NO: 377670 - RNA, 19 nt, Homo sapiens
cacaggagcucucugacau

SEQ ID NO: 377671 - RNA, 19 nt, Homo sapiens
gcacaggagcucucugaca

SEQ ID NO: 377672 - RNA, 19 nt, Homo sapiens
gccgaugccuggagcuuga

SEQ ID NO: 377673 - RNA, 19 nt, Homo sapiens
gcacggaagcggcucaaca

SEQ ID NO: 377674 - RNA, 19 nt, Homo sapiens
aaacaaggacaacaagaug

SEQ ID NO: 377675 - RNA, 19 nt, Homo sapiens
cuacagcacuggauucacu

SEQ ID NO: 377676 - RNA, 19 nt, Homo sapiens
ggaccagcgucagaagcua

SEQ ID NO: 377677 - RNA, 19 nt, Homo sapiens
gaucguggcccugaauuuc

SEQ ID NO: 377678 - RNA, 19 nt, Homo sapiens
gcuauacuuucacuuccaa

SEQ ID NO: 377679 - RNA, 19 nt, Homo sapiens
gaagcuacagcacuggauu

SEQ ID NO: 377680 - RNA, 19 nt, Homo sapiens
gcaaggauaccgccauguc

SEQ ID NO: 377681 - RNA, 19 nt, Homo sapiens
agagagcgguucuacaagu

SEQ ID NO: 377682 - RNA, 19 nt, Homo sapiens
ggacaugggccagccacuu

SEQ ID NO: 377683 - RNA, 19 nt, Homo sapiens
cagccacccucuuugugaa

SEQ ID NO: 377684 - RNA, 19 nt, Homo sapiens
uaccacggcuauacuuuca

SEQ ID NO: 377685 - RNA, 19 nt, Homo sapiens
agacugcugucaucaccaa

SEQ ID NO: 377686 - RNA, 19 nt, Homo sapiens
acaacaagaugagcuucaa

SEQ ID NO: 377687 - RNA, 19 nt, Homo sapiens
cuucagcccuaacauagug

SEQ ID NO: 377688 - RNA, 19 nt, Homo sapiens
ggaccgcugcuucuccauu

SEQ ID NO: 377689 - RNA, 19 nt, Homo sapiens
caagaucauccaccacuca

SEQ ID NO: 377690 - RNA, 19 nt, Homo sapiens
gaccagcgcaauacacuag

SEQ ID NO: 377691 - RNA, 19 nt, Homo sapiens
gagaaguucgcccgugaug

SEQ ID NO: 377692 - RNA, 19 nt, Homo sapiens
gauugaggccuucuacaag

SEQ ID NO: 377693 - RNA, 19 nt, Homo sapiens
gaacagccucaagcaagga

SEQ ID NO: 377694 - RNA, 19 nt, Homo sapiens
ccaaaagucaacaagaaua

SEQ ID NO: 377695 - RNA, 19 nt, Homo sapiens
uagcacaggagcucucuga

SEQ ID NO: 377696 - RNA, 19 nt, Homo sapiens
ggaccagcgcaauacacua

SEQ ID NO: 377697 - RNA, 19 nt, Homo sapiens
ugacuucauuggccagagu

SEQ ID NO: 377698 - RNA, 19 nt, Homo sapiens
ugagaaccgugcccuucga

SEQ ID NO: 377699 - RNA, 19 nt, Homo sapiens
ucuacgagauggcguccuu

SEQ ID NO: 377700 - RNA, 19 nt, Homo sapiens
gaugccuccuccaagaaug

SEQ ID NO: 377701 - RNA, 19 nt, Homo sapiens
cggaagcggcucaacauca

SEQ ID NO: 377702 - RNA, 19 nt, Homo sapiens
gacaggccuucuacgagau

SEQ ID NO: 377703 - RNA, 19 nt, Homo sapiens
auugaggccuucuacaaga

SEQ ID NO: 377704 - RNA, 19 nt, Homo sapiens
ccagguggacgacagcuau

SEQ ID NO: 377705 - RNA, 19 nt, Homo sapiens
ucagccacccucuuuguga

SEQ ID NO: 377706 - RNA, 19 nt, Homo sapiens
caucagccacccucuuugu

SEQ ID NO: 377707 - RNA, 19 nt, Homo sapiens
gcugucaucaccaacaaug

SEQ ID NO: 377708 - RNA, 19 nt, Homo sapiens
caaccaggaaccaaucauc

SEQ ID NO: 377709 - RNA, 19 nt, Homo sapiens
gccagccacuuagccacua

SEQ ID NO: 377710 - RNA, 19 nt, Homo sapiens
agauugaggccuucuacaa

SEQ ID NO: 377711 - RNA, 19 nt, Homo sapiens
ggagauugaggccuucuac

SEQ ID NO: 377712 - RNA, 19 nt, Homo sapiens
agaucucccuccaggacua

SEQ ID NO: 377713 - RNA, 19 nt, Homo sapiens
ccacggcuauacuuucacu

SEQ ID NO: 377714 - RNA, 19 nt, Homo sapiens
ggacggcuuccucauguac

SEQ ID NO: 377715 - RNA, 19 nt, Homo sapiens
ccuacaggaugaugaggau

SEQ ID NO: 377716 - RNA, 19 nt, Homo sapiens
caaagugacaguggagauc

SEQ ID NO: 377717 - RNA, 19 nt, Homo sapiens
caacaucagggucauuucg

SEQ ID NO: 377718 - RNA, 19 nt, Homo sapiens
gcuaugcccggaagaucuu

SEQ ID NO: 377719 - RNA, 19 nt, Homo sapiens
gacaacaagaugagcuuca

SEQ ID NO: 377720 - RNA, 19 nt, Homo sapiens
agcgaguggucaaggauuu

SEQ ID NO: 377721 - RNA, 19 nt, Homo sapiens
gccagcgaguggucaagga

SEQ ID NO: 377722 - RNA, 19 nt, Homo sapiens
agaacagacuccuccaacu

SEQ ID NO: 377723 - RNA, 19 nt, Homo sapiens
ccucuucacacaacaccua

SEQ ID NO: 377724 - RNA, 19 nt, Homo sapiens
cuggagcuguccuucauuc

SEQ ID NO: 377725 - RNA, 19 nt, Homo sapiens
acaggaugaugaggaucua

SEQ ID NO: 377726 - RNA, 19 nt, Homo sapiens
gacacggaguuugcguuug

SEQ ID NO: 377727 - RNA, 19 nt, Homo sapiens
agaaucaggaaacggcuuu

SEQ ID NO: 377728 - RNA, 19 nt, Homo sapiens
uggaucaguuagugacguu

SEQ ID NO: 377729 - RNA, 19 nt, Homo sapiens
gaggagagagcgguucuac

SEQ ID NO: 377730 - RNA, 19 nt, Homo sapiens
ccgccagacugcugucauc

SEQ ID NO: 377731 - RNA, 19 nt, Homo sapiens
ggucauuuacugcaagagu

SEQ ID NO: 377732 - RNA, 19 nt, Homo sapiens
gaagacgaggcugcugaga

SEQ ID NO: 377733 - RNA, 19 nt, Homo sapiens
uccaucagccacccucuuu

SEQ ID NO: 377734 - RNA, 19 nt, Homo sapiens
ccaaagugacaguggagau

SEQ ID NO: 377735 - RNA, 19 nt, Homo sapiens
ugccaaaagucaacaagaa

SEQ ID NO: 377736 - RNA, 19 nt, Homo sapiens
ggcccugaauuuccagaca

SEQ ID NO: 377737 - RNA, 19 nt, Homo sapiens
ucagggccauccgggacua

SEQ ID NO: 377738 - RNA, 19 nt, Homo sapiens
aaucaucuaccacggcuau

SEQ ID NO: 377739 - RNA, 19 nt, Homo sapiens
gcuucuccauugucuucaa

SEQ ID NO: 377740 - RNA, 19 nt, Homo sapiens
aaauugccuucagcccuaa

SEQ ID NO: 377741 - RNA, 19 nt, Homo sapiens
ucaaggaccagcgcaauac

SEQ ID NO: 377742 - RNA, 19 nt, Homo sapiens
uacuuucacuuccaagauc

SEQ ID NO: 377743 - RNA, 19 nt, Homo sapiens
gagagagcgguucuacaag

SEQ ID NO: 377744 - RNA, 19 nt, Homo sapiens
ccaggaaccaaucaucuac

SEQ ID NO: 377745 - RNA, 19 nt, Homo sapiens
gccuucagcccuaacauag

SEQ ID NO: 377746 - RNA, 19 nt, Homo sapiens
guccaccucaugucuaaga

SEQ ID NO: 377747 - RNA, 19 nt, Homo sapiens
ccggugcugucgcuacuca

SEQ ID NO: 377748 - RNA, 19 nt, Homo sapiens
ggagaaguucgcccgugau

SEQ ID NO: 377749 - RNA, 19 nt, Homo sapiens
gccagcuccugaaggugaa

SEQ ID NO: 377750 - RNA, 19 nt, Homo sapiens
gcacauagauucucucuuu

SEQ ID NO: 377751 - RNA, 19 nt, Homo sapiens
gcaauaaacucuauacuga

SEQ ID NO: 377752 - RNA, 19 nt, Homo sapiens
uaacagauauggcagcuua

SEQ ID NO: 377753 - RNA, 19 nt, Homo sapiens
guagggagcucucugauuu

SEQ ID NO: 377754 - RNA, 19 nt, Homo sapiens
gaagaaaguucgggaauau

SEQ ID NO: 377755 - RNA, 19 nt, Homo sapiens
ggaagaaaguucgggaaua

SEQ ID NO: 377756 - RNA, 19 nt, Homo sapiens
guacuugaguguaauguuu

SEQ ID NO: 377757 - RNA, 19 nt, Homo sapiens
gguaauggcucaacagaug

SEQ ID NO: 377758 - RNA, 19 nt, Homo sapiens
ccacacaucuaugauauaa

SEQ ID NO: 377759 - RNA, 19 nt, Homo sapiens
ugaaagcucuguugcaauu

SEQ ID NO: 377760 - RNA, 19 nt, Homo sapiens
gcacagaagcgcagucuuu

SEQ ID NO: 377761 - RNA, 19 nt, Homo sapiens
gauacgaacuuucugaaga

SEQ ID NO: 377762 - RNA, 19 nt, Homo sapiens
ggaaugggauuauguugga

SEQ ID NO: 377763 - RNA, 19 nt, Homo sapiens
guaagcagccucuugauuu

SEQ ID NO: 377764 - RNA, 19 nt, Homo sapiens
gaaccaauccuuuguaauc

SEQ ID NO: 377765 - RNA, 19 nt, Homo sapiens
ggagaucuguugaagaaug

SEQ ID NO: 377766 - RNA, 19 nt, Homo sapiens
gaaguaagcagccucuuga

SEQ ID NO: 377767 - RNA, 19 nt, Homo sapiens
ugaagaagcucaaaugucu

SEQ ID NO: 377768 - RNA, 19 nt, Homo sapiens
gccauuaucucacuacuau

SEQ ID NO: 377769 - RNA, 19 nt, Homo sapiens
gcucaaaugucucgaagga

SEQ ID NO: 377770 - RNA, 19 nt, Homo sapiens
gaaggaagccaaauuuauc

SEQ ID NO: 377771 - RNA, 19 nt, Homo sapiens
gcuuagagguguuggcuuu

SEQ ID NO: 377772 - RNA, 19 nt, Homo sapiens
gaggauauaugcuuagaca

SEQ ID NO: 377773 - RNA, 19 nt, Homo sapiens
ggaccuaguugccaauuca

SEQ ID NO: 377774 - RNA, 19 nt, Homo sapiens
gaucaucaguggucagaau

SEQ ID NO: 377775 - RNA, 19 nt, Homo sapiens
gagcugauauaaauucugu

SEQ ID NO: 377776 - RNA, 19 nt, Homo sapiens
aaggagaucuguugaagaa

SEQ ID NO: 377777 - RNA, 19 nt, Homo sapiens
gaaggaugucgguagauua

SEQ ID NO: 377778 - RNA, 19 nt, Homo sapiens
guaggaaggucucauucuu

SEQ ID NO: 377779 - RNA, 19 nt, Homo sapiens
caaggacucugguuucuca

SEQ ID NO: 377780 - RNA, 19 nt, Homo sapiens
ucaagaaucuauccaagug

SEQ ID NO: 377781 - RNA, 19 nt, Homo sapiens
gauaaugaaccaauccuuu

SEQ ID NO: 377782 - RNA, 19 nt, Homo sapiens
cuaaagagcacuuacugua

SEQ ID NO: 377783 - RNA, 19 nt, Homo sapiens
guucuaaggccgucuauaa

SEQ ID NO: 377784 - RNA, 19 nt, Homo sapiens
ggucauuucuucagucaga

SEQ ID NO: 377785 - RNA, 19 nt, Homo sapiens
ucuauucuguguugcauua

SEQ ID NO: 377786 - RNA, 19 nt, Homo sapiens
gagcuuugcuuggaacauu

SEQ ID NO: 377787 - RNA, 19 nt, Homo sapiens
caacucaacccuacucuga

SEQ ID NO: 377788 - RNA, 19 nt, Homo sapiens
aaagaaagaccucgagaaa

SEQ ID NO: 377789 - RNA, 19 nt, Homo sapiens
gaucuuagcauagcuuauu

SEQ ID NO: 377790 - RNA, 19 nt, Homo sapiens
gauauaugcuuagacauca

SEQ ID NO: 377791 - RNA, 19 nt, Homo sapiens
ccuaaugucuucauaaagu

SEQ ID NO: 377792 - RNA, 19 nt, Homo sapiens
gauuuggugucuauuugua

SEQ ID NO: 377793 - RNA, 19 nt, Homo sapiens
gauauaacccuaacacaca

SEQ ID NO: 377794 - RNA, 19 nt, Homo sapiens
gcaauuaggauuugaugug

SEQ ID NO: 377795 - RNA, 19 nt, Homo sapiens
gaagccaaauuuaucaaag

SEQ ID NO: 377796 - RNA, 19 nt, Homo sapiens
ugaagaaugccaagaauga

SEQ ID NO: 377797 - RNA, 19 nt, Homo sapiens
ggacauagauauuuucaca

SEQ ID NO: 377798 - RNA, 19 nt, Homo sapiens
ggauggcacuggcaauuca

SEQ ID NO: 377799 - RNA, 19 nt, Homo sapiens
gaagaaaacucaacaaagc

SEQ ID NO: 377800 - RNA, 19 nt, Homo sapiens
gacaacccauguuuccuuu

SEQ ID NO: 377801 - RNA, 19 nt, Homo sapiens
gaagguugcccaagauaug

SEQ ID NO: 377802 - RNA, 19 nt, Homo sapiens
gagcaaggagucacccaua

SEQ ID NO: 377803 - RNA, 19 nt, Homo sapiens
caagaucagguuaaaguuu

SEQ ID NO: 377804 - RNA, 19 nt, Homo sapiens
caauuaggauuugauguga

SEQ ID NO: 377805 - RNA, 19 nt, Homo sapiens
ggacucugguuucucauuc

SEQ ID NO: 377806 - RNA, 19 nt, Homo sapiens
cgaaggaugucgguagauu

SEQ ID NO: 377807 - RNA, 19 nt, Homo sapiens
gauaugacccagccauuau

SEQ ID NO: 377808 - RNA, 19 nt, Homo sapiens
gaacauuacaguauugaag

SEQ ID NO: 377809 - RNA, 19 nt, Homo sapiens
aaauagcgguucauccauu

SEQ ID NO: 377810 - RNA, 19 nt, Homo sapiens
gggaugugguuauguucua

SEQ ID NO: 377811 - RNA, 19 nt, Homo sapiens
caccgaggauauaugcuua

SEQ ID NO: 377812 - RNA, 19 nt, Homo sapiens
guucuaugguuaugaaaga

SEQ ID NO: 377813 - RNA, 19 nt, Homo sapiens
gaaguuuucuguagucauu

SEQ ID NO: 377814 - RNA, 19 nt, Homo sapiens
cuuaugaucugaugauuca

SEQ ID NO: 377815 - RNA, 19 nt, Homo sapiens
gcaauauacgauaccauuu

SEQ ID NO: 377816 - RNA, 19 nt, Homo sapiens
ggaugucgguagauuacaa

SEQ ID NO: 377817 - RNA, 19 nt, Homo sapiens
uaagugaugguucagauaa

SEQ ID NO: 377818 - RNA, 19 nt, Homo sapiens
ucucauaacaccuaucuaa

SEQ ID NO: 377819 - RNA, 19 nt, Homo sapiens
uuaaagaaauccagaagag

SEQ ID NO: 377820 - RNA, 19 nt, Homo sapiens
agaaagaccucgagaaagc

SEQ ID NO: 377821 - RNA, 19 nt, Homo sapiens
aaagagagagagagaaauu

SEQ ID NO: 377822 - RNA, 19 nt, Homo sapiens
gcagagagagagaaagaga

SEQ ID NO: 377823 - RNA, 19 nt, Homo sapiens
ucacccaucuuaucaagga

SEQ ID NO: 377824 - RNA, 19 nt, Homo sapiens
gcaaucgugucuauuaagg

SEQ ID NO: 377825 - RNA, 19 nt, Homo sapiens
ccacauagcaauaacuaau

SEQ ID NO: 377826 - RNA, 19 nt, Homo sapiens
ccacaggacuuuuggaauu

SEQ ID NO: 377827 - RNA, 19 nt, Homo sapiens
cauagauucucucuuugaa

SEQ ID NO: 377828 - RNA, 19 nt, Homo sapiens
ggagauacgaacuuucuga

SEQ ID NO: 377829 - RNA, 19 nt, Homo sapiens
gcugggaaccuucaaagaa

SEQ ID NO: 377830 - RNA, 19 nt, Homo sapiens
gcugugaguugaagaaagu

SEQ ID NO: 377831 - RNA, 19 nt, Homo sapiens
aaaagaugcugacugcuua

SEQ ID NO: 377832 - RNA, 19 nt, Homo sapiens
aauagcgguucauccauua

SEQ ID NO: 377833 - RNA, 19 nt, Homo sapiens
ggaaaccuagagaagauaa

SEQ ID NO: 377834 - RNA, 19 nt, Homo sapiens
gcaaggucauuucuucagu

SEQ ID NO: 377835 - RNA, 19 nt, Homo sapiens
ggaaaguagugaggagaau

SEQ ID NO: 377836 - RNA, 19 nt, Homo sapiens
agaaugcaaucgugucuau

SEQ ID NO: 377837 - RNA, 19 nt, Homo sapiens
gaagaaaguccggccaaau

SEQ ID NO: 377838 - RNA, 19 nt, Homo sapiens
uagauucucucuuugaaca

SEQ ID NO: 377839 - RNA, 19 nt, Homo sapiens
ugaaggaagccaaauuuau

SEQ ID NO: 377840 - RNA, 19 nt, Homo sapiens
ucucugccuuugacauuua

SEQ ID NO: 377841 - RNA, 19 nt, Homo sapiens
ccaaggagaucuguugaag

SEQ ID NO: 377842 - RNA, 19 nt, Homo sapiens
caauauacgauaccauuug

SEQ ID NO: 377843 - RNA, 19 nt, Homo sapiens
aguaacagaugaagaugaa

SEQ ID NO: 377844 - RNA, 19 nt, Homo sapiens
ggauauaugcuuagacauc

SEQ ID NO: 377845 - RNA, 19 nt, Homo sapiens
gaagaaugccaagaaugaa

SEQ ID NO: 377846 - RNA, 19 nt, Homo sapiens
gaucugaugauucaagaga

SEQ ID NO: 377847 - RNA, 19 nt, Homo sapiens
ucaggaauaucggucuuaa

SEQ ID NO: 377848 - RNA, 19 nt, Homo sapiens
gaacaaagaacuaaaacug

SEQ ID NO: 377849 - RNA, 19 nt, Homo sapiens
aagcaaauccgacucugua

SEQ ID NO: 377850 - RNA, 19 nt, Homo sapiens
gcacagagcugcacuccaa

SEQ ID NO: 377851 - RNA, 19 nt, Homo sapiens
gagcugaccuucaucaaga

SEQ ID NO: 377852 - RNA, 19 nt, Homo sapiens
ccaaggagcuacugacauu

SEQ ID NO: 377853 - RNA, 19 nt, Homo sapiens
agagaaacauggcccaaua

SEQ ID NO: 377854 - RNA, 19 nt, Homo sapiens
gaaaccaagccauuaauga

SEQ ID NO: 377855 - RNA, 19 nt, Homo sapiens
aaaccaaggcugagaaaua

SEQ ID NO: 377856 - RNA, 19 nt, Homo sapiens
ggaagaagcagcugugguu

SEQ ID NO: 377857 - RNA, 19 nt, Homo sapiens
gagcugcacuccaaugaga

SEQ ID NO: 377858 - RNA, 19 nt, Homo sapiens
ccaaccagcuuaagaggaa

SEQ ID NO: 377859 - RNA, 19 nt, Homo sapiens
ccaaggaccugaagaacau

SEQ ID NO: 377860 - RNA, 19 nt, Homo sapiens
gaagugaacauguggauca

SEQ ID NO: 377861 - RNA, 19 nt, Homo sapiens
gagcagugccuuugaagaa

SEQ ID NO: 377862 - RNA, 19 nt, Homo sapiens
gaaccaggcccucuucaug

SEQ ID NO: 377863 - RNA, 19 nt, Homo sapiens
aaacauggcccaauacuuc

SEQ ID NO: 377864 - RNA, 19 nt, Homo sapiens
gaggaccacugcagcauug

SEQ ID NO: 377865 - RNA, 19 nt, Homo sapiens
ggaagauccucaucaagca

SEQ ID NO: 377866 - RNA, 19 nt, Homo sapiens
gcaccaagcagaagacaga

SEQ ID NO: 377867 - RNA, 19 nt, Homo sapiens
gcaacucuaucaagaaugg

SEQ ID NO: 377868 - RNA, 19 nt, Homo sapiens
caaacccuaugccaacuuu

SEQ ID NO: 377869 - RNA, 19 nt, Homo sapiens
gcagcaagaucuacuacuc

SEQ ID NO: 377870 - RNA, 19 nt, Homo sapiens
aggaagacauguuuaguga

SEQ ID NO: 377871 - RNA, 19 nt, Homo sapiens
caaacuacguggaagagau

SEQ ID NO: 377872 - RNA, 19 nt, Homo sapiens
caagagggccagacaguga

SEQ ID NO: 377873 - RNA, 19 nt, Homo sapiens
cagcaacucuaucaagaau

SEQ ID NO: 377874 - RNA, 19 nt, Homo sapiens
gggcuuaacuuggcugaug

SEQ ID NO: 377875 - RNA, 19 nt, Homo sapiens
ucacauugcuuugucauuc

SEQ ID NO: 377876 - RNA, 19 nt, Homo sapiens
gacagaaaccaagccauua

SEQ ID NO: 377877 - RNA, 19 nt, Homo sapiens
ggagaauggugaccucagu

SEQ ID NO: 377878 - RNA, 19 nt, Homo sapiens
caacucauaugccaucucu

SEQ ID NO: 377879 - RNA, 19 nt, Homo sapiens
ggauguugcugccgacuca

SEQ ID NO: 377880 - RNA, 19 nt, Homo sapiens
guacuguguuucgcauuaa

SEQ ID NO: 377881 - RNA, 19 nt, Homo sapiens
ucucugaacuugucgucua

SEQ ID NO: 377882 - RNA, 19 nt, Homo sapiens
gaugggaugccaguuauuu

SEQ ID NO: 377883 - RNA, 19 nt, Homo sapiens
uguacuguguuucgcauua

SEQ ID NO: 377884 - RNA, 19 nt, Homo sapiens
gagugucccuuccugaguu

SEQ ID NO: 377885 - RNA, 19 nt, Homo sapiens
ggaccagucacauugcuuu

SEQ ID NO: 377886 - RNA, 19 nt, Homo sapiens
ggaaaccaaggcugagaaa

SEQ ID NO: 377887 - RNA, 19 nt, Homo sapiens
gcacagcugagccugacua

SEQ ID NO: 377888 - RNA, 19 nt, Homo sapiens
gaaacauggcccaauacuu

SEQ ID NO: 377889 - RNA, 19 nt, Homo sapiens
cuacugacauuccuaagag

SEQ ID NO: 377890 - RNA, 19 nt, Homo sapiens
gcaccgucaugacuuuguu

SEQ ID NO: 377891 - RNA, 19 nt, Homo sapiens
gagacaaccgccucuaguu

SEQ ID NO: 377892 - RNA, 19 nt, Homo sapiens
gaagaccucacgggacuuu

SEQ ID NO: 377893 - RNA, 19 nt, Homo sapiens
caugugccaucucuauuga

SEQ ID NO: 377894 - RNA, 19 nt, Homo sapiens
caucagcuacuaugagaaa

SEQ ID NO: 377895 - RNA, 19 nt, Homo sapiens
acauuguccuguagcuuua

SEQ ID NO: 377896 - RNA, 19 nt, Homo sapiens
gaggaagacauguuuagug

SEQ ID NO: 377897 - RNA, 19 nt, Homo sapiens
ggagcucucugaacuuguc

SEQ ID NO: 377898 - RNA, 19 nt, Homo sapiens
gaugggcugucgcugcauu

SEQ ID NO: 377899 - RNA, 19 nt, Homo sapiens
gcauuaagcacacacaucu

SEQ ID NO: 377900 - RNA, 19 nt, Homo sapiens
gaaggacucgggucaaugg

SEQ ID NO: 377901 - RNA, 19 nt, Homo sapiens
gcagugccuuugaagaaca

SEQ ID NO: 377902 - RNA, 19 nt, Homo sapiens
gcagcuggaugcaguaugc

SEQ ID NO: 377903 - RNA, 19 nt, Homo sapiens
acagaaaccaagccauuaa

SEQ ID NO: 377904 - RNA, 19 nt, Homo sapiens
agacagaaaccaagccauu

SEQ ID NO: 377905 - RNA, 19 nt, Homo sapiens
ugaagaacaacuacaguga

SEQ ID NO: 377906 - RNA, 19 nt, Homo sapiens
cgacaucugccaaagaaug

SEQ ID NO: 377907 - RNA, 19 nt, Homo sapiens
gaccaguucuccagugagu

SEQ ID NO: 377908 - RNA, 19 nt, Homo sapiens
gggaccaguucuccaguga

SEQ ID NO: 377909 - RNA, 19 nt, Homo sapiens
gaauggaauuucgccugaa

SEQ ID NO: 377910 - RNA, 19 nt, Homo sapiens
gagcuacugacauuccuaa

SEQ ID NO: 377911 - RNA, 19 nt, Homo sapiens
ugacaagccuaugcagaug

SEQ ID NO: 377912 - RNA, 19 nt, Homo sapiens
acgcaacccuggcuucuau

SEQ ID NO: 377913 - RNA, 19 nt, Homo sapiens
gcgacuacacgcucucuuu

SEQ ID NO: 377914 - RNA, 19 nt, Homo sapiens
ccagucauccuguccauug

SEQ ID NO: 377915 - RNA, 19 nt, Homo sapiens
ccaccaagaucaaguucuc

SEQ ID NO: 377916 - RNA, 19 nt, Homo sapiens
gcaguuccuucuugacuac

SEQ ID NO: 377917 - RNA, 19 nt, Homo sapiens
gcaguuugcucagcuguac

SEQ ID NO: 377918 - RNA, 19 nt, Homo sapiens
acagagcagugccuuugaa

SEQ ID NO: 377919 - RNA, 19 nt, Homo sapiens
cccgacaucugccaaagaa

SEQ ID NO: 377920 - RNA, 19 nt, Homo sapiens
acucauaugccaucucuuu

SEQ ID NO: 377921 - RNA, 19 nt, Homo sapiens
ugacauucgugaaauuaag

SEQ ID NO: 377922 - RNA, 19 nt, Homo sapiens
guaugaggaagacauguuu

SEQ ID NO: 377923 - RNA, 19 nt, Homo sapiens
aagagaagauuggcacaga

SEQ ID NO: 377924 - RNA, 19 nt, Homo sapiens
gggacacacuccucaccaa

SEQ ID NO: 377925 - RNA, 19 nt, Homo sapiens
gcugauggaggauacauug

SEQ ID NO: 377926 - RNA, 19 nt, Homo sapiens
uuucaagugugcagucaaa

SEQ ID NO: 377927 - RNA, 19 nt, Homo sapiens
gacaucagcaacucuauca

SEQ ID NO: 377928 - RNA, 19 nt, Homo sapiens
ggagacaaccgccucuagu

SEQ ID NO: 377929 - RNA, 19 nt, Homo sapiens
cauugacauucgugaaauu

SEQ ID NO: 377930 - RNA, 19 nt, Homo sapiens
gcauugcccagcagagaaa

SEQ ID NO: 377931 - RNA, 19 nt, Homo sapiens
cggaugggaugccaguuau

SEQ ID NO: 377932 - RNA, 19 nt, Homo sapiens
gaucgaggagccauacuuc

SEQ ID NO: 377933 - RNA, 19 nt, Homo sapiens
gggagcacuuggacgagaa

SEQ ID NO: 377934 - RNA, 19 nt, Homo sapiens
aagcugcgcuaucccauca

SEQ ID NO: 377935 - RNA, 19 nt, Homo sapiens
ggaguucgacagccuuguu

SEQ ID NO: 377936 - RNA, 19 nt, Homo sapiens
aagaucaaguucucagaug

SEQ ID NO: 377937 - RNA, 19 nt, Homo sapiens
gcagugaaugcuagacaga

SEQ ID NO: 377938 - RNA, 19 nt, Homo sapiens
agagaagauuggcacagaa

SEQ ID NO: 377939 - RNA, 19 nt, Homo sapiens
gcugagcgccugcuuacug

SEQ ID NO: 377940 - RNA, 19 nt, Homo sapiens
acaacccucuuucccacua

SEQ ID NO: 377941 - RNA, 19 nt, Homo sapiens
ugacuuuguucuacuccaa

SEQ ID NO: 377942 - RNA, 19 nt, Homo sapiens
ccaagcagaagacagaguu

SEQ ID NO: 377943 - RNA, 19 nt, Homo sapiens
ccggaugggaugccaguua

SEQ ID NO: 377944 - RNA, 19 nt, Homo sapiens
uggaugaguuugucaccuu

SEQ ID NO: 377945 - RNA, 19 nt, Homo sapiens
gcuacugacauuccuaaga

SEQ ID NO: 377946 - RNA, 19 nt, Homo sapiens
agugaaugcuagacagaaa

SEQ ID NO: 377947 - RNA, 19 nt, Homo sapiens
gagcaucucgcagaccauu

SEQ ID NO: 377948 - RNA, 19 nt, Homo sapiens
gcuaccagcagccguuuga

SEQ ID NO: 377949 - RNA, 19 nt, Homo sapiens
cucagucccuucaguggua

SEQ ID NO: 377950 - RNA, 19 nt, Homo sapiens
gggaagaacuccaaagauu

SEQ ID NO: 377951 - RNA, 19 nt, Homo sapiens
ggaagacgcuaaucuguga

SEQ ID NO: 377952 - RNA, 19 nt, Homo sapiens
gaaccaggauccagcagua

SEQ ID NO: 377953 - RNA, 19 nt, Homo sapiens
guuaaagaguucaguguua

SEQ ID NO: 377954 - RNA, 19 nt, Homo sapiens
gcuaaucugugacaucuuu

SEQ ID NO: 377955 - RNA, 19 nt, Homo sapiens
ggaaauaggagcacacaaa

SEQ ID NO: 377956 - RNA, 19 nt, Homo sapiens
gcagaugaaucacgcauug

SEQ ID NO: 377957 - RNA, 19 nt, Homo sapiens
ugaaagcucuguaugacua

SEQ ID NO: 377958 - RNA, 19 nt, Homo sapiens
ccaaguuccuuaaagauaa

SEQ ID NO: 377959 - RNA, 19 nt, Homo sapiens
ggacaacuucuaacuuaua

SEQ ID NO: 377960 - RNA, 19 nt, Homo sapiens
ucaaggacauuucuuaaga

SEQ ID NO: 377961 - RNA, 19 nt, Homo sapiens
ucacauaacacguaccuua

SEQ ID NO: 377962 - RNA, 19 nt, Homo sapiens
guucagcgaucccaacuuu

SEQ ID NO: 377963 - RNA, 19 nt, Homo sapiens
ggaagaacuccaaagauuu

SEQ ID NO: 377964 - RNA, 19 nt, Homo sapiens
gagaaccacuccagcugua

SEQ ID NO: 377965 - RNA, 19 nt, Homo sapiens
agaaguugcugcaggaaua

SEQ ID NO: 377966 - RNA, 19 nt, Homo sapiens
gagaagagccagaucaaga

SEQ ID NO: 377967 - RNA, 19 nt, Homo sapiens
gagaaaugguuccacaaga

SEQ ID NO: 377968 - RNA, 19 nt, Homo sapiens
gggaugcccugguuaaaga

SEQ ID NO: 377969 - RNA, 19 nt, Homo sapiens
gggagaagaucaucaucaa

SEQ ID NO: 377970 - RNA, 19 nt, Homo sapiens
agacgacgguugugaauga

SEQ ID NO: 377971 - RNA, 19 nt, Homo sapiens
gaucaaaccagaagaaaca

SEQ ID NO: 377972 - RNA, 19 nt, Homo sapiens
ugagaaagcagauauauuc

SEQ ID NO: 377973 - RNA, 19 nt, Homo sapiens
gaagaacuccaaagauuuc

SEQ ID NO: 377974 - RNA, 19 nt, Homo sapiens
gcaaggagaacaacaugaa

SEQ ID NO: 377975 - RNA, 19 nt, Homo sapiens
uuggacaacuucuaacuua

SEQ ID NO: 377976 - RNA, 19 nt, Homo sapiens
ugguggagcucgucaguua

SEQ ID NO: 377977 - RNA, 19 nt, Homo sapiens
agaaaugguuccacaagaa

SEQ ID NO: 377978 - RNA, 19 nt, Homo sapiens
gcgggacccugaaauacua

SEQ ID NO: 377979 - RNA, 19 nt, Homo sapiens
gaaauggacucggcacuac

SEQ ID NO: 377980 - RNA, 19 nt, Homo sapiens
caccagaacuugcgcaaug

SEQ ID NO: 377981 - RNA, 19 nt, Homo sapiens
cgacgguugugaaugauaa

SEQ ID NO: 377982 - RNA, 19 nt, Homo sapiens
guaaagcauugucgcauca

SEQ ID NO: 377983 - RNA, 19 nt, Homo sapiens
guaaggguauugugugugu

SEQ ID NO: 377984 - RNA, 19 nt, Homo sapiens
gaaaugcaacaagagguua

SEQ ID NO: 377985 - RNA, 19 nt, Homo sapiens
caggagaaaugcaacaaga

SEQ ID NO: 377986 - RNA, 19 nt, Homo sapiens
acaaccagcucuuucugua

SEQ ID NO: 377987 - RNA, 19 nt, Homo sapiens
gcaugaggacagagaaaua

SEQ ID NO: 377988 - RNA, 19 nt, Homo sapiens
gcagaggacaugcugauga

SEQ ID NO: 377989 - RNA, 19 nt, Homo sapiens
ggacggugaugacuguguu

SEQ ID NO: 377990 - RNA, 19 nt, Homo sapiens
aacaagagguuaagagaga

SEQ ID NO: 377991 - RNA, 19 nt, Homo sapiens
gcaacaagagguuaagaga

SEQ ID NO: 377992 - RNA, 19 nt, Homo sapiens
caucucaacugcagacuuc

SEQ ID NO: 377993 - RNA, 19 nt, Homo sapiens
cuaaagaggaugcaguuaa

SEQ ID NO: 377994 - RNA, 19 nt, Homo sapiens
cgagaaauccgcuccuuug

SEQ ID NO: 377995 - RNA, 19 nt, Homo sapiens
gagaaggugacauuugaaa

SEQ ID NO: 377996 - RNA, 19 nt, Homo sapiens
aggagaaggugacauuuga

SEQ ID NO: 377997 - RNA, 19 nt, Homo sapiens
gauaaguacaugcagauga

SEQ ID NO: 377998 - RNA, 19 nt, Homo sapiens
gggauuccauugaccagaa

SEQ ID NO: 377999 - RNA, 19 nt, Homo sapiens
gaaauaggagcacacaaag

SEQ ID NO: 378000 - RNA, 19 nt, Homo sapiens
gccaaguuccuuaaagaua

SEQ ID NO: 378001 - RNA, 19 nt, Homo sapiens
uaaagaggaugcaguuaac

SEQ ID NO: 378002 - RNA, 19 nt, Homo sapiens
gagaagagagucagcaaca

SEQ ID NO: 378003 - RNA, 19 nt, Homo sapiens
aagaagaacugaacaacca

SEQ ID NO: 378004 - RNA, 19 nt, Homo sapiens
gaagaaacagcaucagucu

SEQ ID NO: 378005 - RNA, 19 nt, Homo sapiens
cauuaaagcagucaaauca

SEQ ID NO: 378006 - RNA, 19 nt, Homo sapiens
ggacgagugccgagaaguu

SEQ ID NO: 378007 - RNA, 19 nt, Homo sapiens
acaagaagguggagaagag

SEQ ID NO: 378008 - RNA, 19 nt, Homo sapiens
ggacuaccaagaucaaguu

SEQ ID NO: 378009 - RNA, 19 nt, Homo sapiens
gugccaaguuccuuaaaga

SEQ ID NO: 378010 - RNA, 19 nt, Homo sapiens
auaaguacaugcagaugaa

SEQ ID NO: 378011 - RNA, 19 nt, Homo sapiens
ccaaagggacaaagaguug

SEQ ID NO: 378012 - RNA, 19 nt, Homo sapiens
gaugacaccaugcgugaaa

SEQ ID NO: 378013 - RNA, 19 nt, Homo sapiens
gaaauccgcccagggaaga

SEQ ID NO: 378014 - RNA, 19 nt, Homo sapiens
caucaaggacauuucuuaa

SEQ ID NO: 378015 - RNA, 19 nt, Homo sapiens
ccaucaaggacauuucuua

SEQ ID NO: 378016 - RNA, 19 nt, Homo sapiens
gaugaaucacgcauuguuu

SEQ ID NO: 378017 - RNA, 19 nt, Homo sapiens
ucucugaccugguugucua

SEQ ID NO: 378018 - RNA, 19 nt, Homo sapiens
ggaagccggucaucuacca

SEQ ID NO: 378019 - RNA, 19 nt, Homo sapiens
ggagaaccguccaggugau

SEQ ID NO: 378020 - RNA, 19 nt, Homo sapiens
gcugugcgguucucagaug

SEQ ID NO: 378021 - RNA, 19 nt, Homo sapiens
gauauauucuguggaucaa

SEQ ID NO: 378022 - RNA, 19 nt, Homo sapiens
ugaaauacuacuugacuga

SEQ ID NO: 378023 - RNA, 19 nt, Homo sapiens
caucuuggacaacuucuaa

SEQ ID NO: 378024 - RNA, 19 nt, Homo sapiens
gaacaaccagcucuuucug

SEQ ID NO: 378025 - RNA, 19 nt, Homo sapiens
cgagaagcauucacucuac

SEQ ID NO: 378026 - RNA, 19 nt, Homo sapiens
gaaggacgaacacaagcaa

SEQ ID NO: 378027 - RNA, 19 nt, Homo sapiens
ccaccacggucaauguaga

SEQ ID NO: 378028 - RNA, 19 nt, Homo sapiens
guauguggaucccagugaa

SEQ ID NO: 378029 - RNA, 19 nt, Homo sapiens
gaugguggcacucaauuuc

SEQ ID NO: 378030 - RNA, 19 nt, Homo sapiens
aauccugacuuccgagaaa

SEQ ID NO: 378031 - RNA, 19 nt, Homo sapiens
gaaaugguuccacaagaag

SEQ ID NO: 378032 - RNA, 19 nt, Homo sapiens
ggagaaaugguuccacaag

SEQ ID NO: 378033 - RNA, 19 nt, Homo sapiens
ggauuccauugaccagaaa

SEQ ID NO: 378034 - RNA, 19 nt, Homo sapiens
guacaugugggauuccauu

SEQ ID NO: 378035 - RNA, 19 nt, Homo sapiens
caagaaggacgaacacaag

SEQ ID NO: 378036 - RNA, 19 nt, Homo sapiens
caacauggaggacaagaag

SEQ ID NO: 378037 - RNA, 19 nt, Homo sapiens
gcugagccuuucuuguuug

SEQ ID NO: 378038 - RNA, 19 nt, Homo sapiens
acaguuccaucucuucuau

SEQ ID NO: 378039 - RNA, 19 nt, Homo sapiens
cgagcucucugaccugguu

SEQ ID NO: 378040 - RNA, 19 nt, Homo sapiens
gaagagccagaucaagaga

SEQ ID NO: 378041 - RNA, 19 nt, Homo sapiens
gagcgaagaggaacuuuac

SEQ ID NO: 378042 - RNA, 19 nt, Homo sapiens
agaacaacaugaaguacug

SEQ ID NO: 378043 - RNA, 19 nt, Homo sapiens
ccggaugccucugcuguuu

SEQ ID NO: 378044 - RNA, 19 nt, Homo sapiens
gcagugccaaguuccuuaa

SEQ ID NO: 378045 - RNA, 19 nt, Homo sapiens
guccuucagugaugacauu

SEQ ID NO: 378046 - RNA, 19 nt, Homo sapiens
ggacgcggacuaccaagau

SEQ ID NO: 378047 - RNA, 19 nt, Homo sapiens
ccaccauuaucgagaguug

SEQ ID NO: 378048 - RNA, 19 nt, Homo sapiens
gcaguucgccagaaagaag

SEQ ID NO: 378049 - RNA, 19 nt, Homo sapiens
caauacggaaagagauaua

SEQ ID NO: 378050 - RNA, 19 nt, Homo sapiens
gaaaacaacuggaagauua

SEQ ID NO: 378051 - RNA, 19 nt, Homo sapiens
uaacugagcuuaucuaugu

SEQ ID NO: 378052 - RNA, 19 nt, Homo sapiens
gaagaacaauuccuuggua

SEQ ID NO: 378053 - RNA, 19 nt, Homo sapiens
caacagaguuucuugauau

SEQ ID NO: 378054 - RNA, 19 nt, Homo sapiens
gaagauuacuugacaaaga

SEQ ID NO: 378055 - RNA, 19 nt, Homo sapiens
ggaaaggacuacugcaauu

SEQ ID NO: 378056 - RNA, 19 nt, Homo sapiens
gguaaucaguggauaaauu

SEQ ID NO: 378057 - RNA, 19 nt, Homo sapiens
guaccaagcuggccgguuu

SEQ ID NO: 378058 - RNA, 19 nt, Homo sapiens
cagcaagacuuuauaauuc

SEQ ID NO: 378059 - RNA, 19 nt, Homo sapiens
ucucaaagaucaucgauuu

SEQ ID NO: 378060 - RNA, 19 nt, Homo sapiens
caacaaggguaccaaguau

SEQ ID NO: 378061 - RNA, 19 nt, Homo sapiens
gauaagagaagaacaauuc

SEQ ID NO: 378062 - RNA, 19 nt, Homo sapiens
gaaaugcucuacaggcaau

SEQ ID NO: 378063 - RNA, 19 nt, Homo sapiens
gagaacagcaggcacuaua

SEQ ID NO: 378064 - RNA, 19 nt, Homo sapiens
ggagugaggaucuucauaa

SEQ ID NO: 378065 - RNA, 19 nt, Homo sapiens
gguuuggacuuaagagaua

SEQ ID NO: 378066 - RNA, 19 nt, Homo sapiens
ggaagagccugcuacagau

SEQ ID NO: 378067 - RNA, 19 nt, Homo sapiens
gaaaauugcugcugacaug

SEQ ID NO: 378068 - RNA, 19 nt, Homo sapiens
ccauggagguuuggacuua

SEQ ID NO: 378069 - RNA, 19 nt, Homo sapiens
gacagcaccuccaguuauu

SEQ ID NO: 378070 - RNA, 19 nt, Homo sapiens
gggaagagccugcuacaga

SEQ ID NO: 378071 - RNA, 19 nt, Homo sapiens
gaacaauuccuugguagaa

SEQ ID NO: 378072 - RNA, 19 nt, Homo sapiens
gaaggcggcucgugaugug

SEQ ID NO: 378073 - RNA, 19 nt, Homo sapiens
ggauugaccuggccuaugg

SEQ ID NO: 378074 - RNA, 19 nt, Homo sapiens
guggaacgcuucacaucua

SEQ ID NO: 378075 - RNA, 19 nt, Homo sapiens
caagauaggcgaugccauu

SEQ ID NO: 378076 - RNA, 19 nt, Homo sapiens
gcaauggagucuauggaau

SEQ ID NO: 378077 - RNA, 19 nt, Homo sapiens
uauaauuccuucugccuaa

SEQ ID NO: 378078 - RNA, 19 nt, Homo sapiens
gaaaggacuacugcaauuu

SEQ ID NO: 378079 - RNA, 19 nt, Homo sapiens
gaaggugggacgacaauga

SEQ ID NO: 378080 - RNA, 19 nt, Homo sapiens
ucauaaugcucuacaaaga

SEQ ID NO: 378081 - RNA, 19 nt, Homo sapiens
ccagaaaucuuccugaaac

SEQ ID NO: 378082 - RNA, 19 nt, Homo sapiens
ccuuaagacucaaagauaa

SEQ ID NO: 378083 - RNA, 19 nt, Homo sapiens
acaaggguaccaaguauua

SEQ ID NO: 378084 - RNA, 19 nt, Homo sapiens
uauaaacaagcccguauua

SEQ ID NO: 378085 - RNA, 19 nt, Homo sapiens
ggacugcauucuuaaacga

SEQ ID NO: 378086 - RNA, 19 nt, Homo sapiens
uauggaauccgaauugaua

SEQ ID NO: 378087 - RNA, 19 nt, Homo sapiens
acaacagaguuucuugaua

SEQ ID NO: 378088 - RNA, 19 nt, Homo sapiens
uaaggaagaucccauucga

SEQ ID NO: 378089 - RNA, 19 nt, Homo sapiens
aaggaaaccuaguaacuga

SEQ ID NO: 378090 - RNA, 19 nt, Homo sapiens
uagaagaauucauccagaa

SEQ ID NO: 378091 - RNA, 19 nt, Homo sapiens
gaaggagacagaaacgaaa

SEQ ID NO: 378092 - RNA, 19 nt, Homo sapiens
ccggguauaugucgugaua

SEQ ID NO: 378093 - RNA, 19 nt, Homo sapiens
gaagaguauugaugaugug

SEQ ID NO: 378094 - RNA, 19 nt, Homo sapiens
gugaggaucuucauaaugc

SEQ ID NO: 378095 - RNA, 19 nt, Homo sapiens
cacagcaaguuguuaauug

SEQ ID NO: 378096 - RNA, 19 nt, Homo sapiens
gaaggaaaccuaguaacug

SEQ ID NO: 378097 - RNA, 19 nt, Homo sapiens
ugauuggucugcugguaua

SEQ ID NO: 378098 - RNA, 19 nt, Homo sapiens
ggacgacaaugagcacaga

SEQ ID NO: 378099 - RNA, 19 nt, Homo sapiens
ggauuuaaggagccuaaua

SEQ ID NO: 378100 - RNA, 19 nt, Homo sapiens
cagcugagagacuuuauaa

SEQ ID NO: 378101 - RNA, 19 nt, Homo sapiens
gaauaggaaagccaagaaa

SEQ ID NO: 378102 - RNA, 19 nt, Homo sapiens
caaagggcauagaagguau

SEQ ID NO: 378103 - RNA, 19 nt, Homo sapiens
augcagagcucgaaggaaa

SEQ ID NO: 378104 - RNA, 19 nt, Homo sapiens
gagugaggaucuucauaau

SEQ ID NO: 378105 - RNA, 19 nt, Homo sapiens
gaaacauggcaccaacuuu

SEQ ID NO: 378106 - RNA, 19 nt, Homo sapiens
gaaauauggaauccgaauu

SEQ ID NO: 378107 - RNA, 19 nt, Homo sapiens
ccaaagggcauagaaggua

SEQ ID NO: 378108 - RNA, 19 nt, Homo sapiens
aaaguuaacaugucacuga

SEQ ID NO: 378109 - RNA, 19 nt, Homo sapiens
gggaaagcgugacagugaa

SEQ ID NO: 378110 - RNA, 19 nt, Homo sapiens
ucccagcgaucccaagaua

SEQ ID NO: 378111 - RNA, 19 nt, Homo sapiens
gaacagcaggcacuauauc

SEQ ID NO: 378112 - RNA, 19 nt, Homo sapiens
ggaauaggaaagccaagaa

SEQ ID NO: 378113 - RNA, 19 nt, Homo sapiens
ugagaagcuugucaucauu

SEQ ID NO: 378114 - RNA, 19 nt, Homo sapiens
gcgucuacaucccaacaua

SEQ ID NO: 378115 - RNA, 19 nt, Homo sapiens
aagaggaaauucaagcauu

SEQ ID NO: 378116 - RNA, 19 nt, Homo sapiens
gauuuaaggagccuaauau

SEQ ID NO: 378117 - RNA, 19 nt, Homo sapiens
gcucgaaggaaaccuagua

SEQ ID NO: 378118 - RNA, 19 nt, Homo sapiens
aagcugugcugaugacaaa

SEQ ID NO: 378119 - RNA, 19 nt, Homo sapiens
gauagcaucagcagcauug

SEQ ID NO: 378120 - RNA, 19 nt, Homo sapiens
caaauuuagucucuacaag

SEQ ID NO: 378121 - RNA, 19 nt, Homo sapiens
gauauaagccagcugucuu

SEQ ID NO: 378122 - RNA, 19 nt, Homo sapiens
gguagcauguacucuguug

SEQ ID NO: 378123 - RNA, 19 nt, Homo sapiens
guaaacaucagcaagacuu

SEQ ID NO: 378124 - RNA, 19 nt, Homo sapiens
cuauagaagucaucacaau

SEQ ID NO: 378125 - RNA, 19 nt, Homo sapiens
acauaaaggugaugagaca

SEQ ID NO: 378126 - RNA, 19 nt, Homo sapiens
uguaaggacuguaaacauc

SEQ ID NO: 378127 - RNA, 19 nt, Homo sapiens
ggaaagcgugacagugaaa

SEQ ID NO: 378128 - RNA, 19 nt, Homo sapiens
agaagaguauugaugaugu

SEQ ID NO: 378129 - RNA, 19 nt, Homo sapiens
gaagauguggcaaaugcaa

SEQ ID NO: 378130 - RNA, 19 nt, Homo sapiens
gcuaaaugguauguuaaug

SEQ ID NO: 378131 - RNA, 19 nt, Homo sapiens
gaauucauccagaaacaug

SEQ ID NO: 378132 - RNA, 19 nt, Homo sapiens
uuaaggagccuaauauaca

SEQ ID NO: 378133 - RNA, 19 nt, Homo sapiens
gaccaaagaggccauagug

SEQ ID NO: 378134 - RNA, 19 nt, Homo sapiens
gcugagagacuuuauaaac

SEQ ID NO: 378135 - RNA, 19 nt, Homo sapiens
aaauaucggucccuuucuu

SEQ ID NO: 378136 - RNA, 19 nt, Homo sapiens
cuacugcaauuucgucuuc

SEQ ID NO: 378137 - RNA, 19 nt, Homo sapiens
aaaaugagccuguucaaaa

SEQ ID NO: 378138 - RNA, 19 nt, Homo sapiens
caacauaaaggugaugaga

SEQ ID NO: 378139 - RNA, 19 nt, Homo sapiens
caagagaaugcuuuagcua

SEQ ID NO: 378140 - RNA, 19 nt, Homo sapiens
gaauaccaggcuugaauug

SEQ ID NO: 378141 - RNA, 19 nt, Homo sapiens
gaaacuaucaugccacaac

SEQ ID NO: 378142 - RNA, 19 nt, Homo sapiens
guccagaaaucuuccugaa

SEQ ID NO: 378143 - RNA, 19 nt, Homo sapiens
agaggcaaaugaagagauu

SEQ ID NO: 378144 - RNA, 19 nt, Homo sapiens
aaacauggcaccaacuuuc

SEQ ID NO: 378145 - RNA, 19 nt, Homo sapiens
gaugguuaauagugaaaga

SEQ ID NO: 378146 - RNA, 19 nt, Homo sapiens
caucagcaagacuuuauaa

SEQ ID NO: 378147 - RNA, 19 nt, Homo sapiens
cguauuagcuaaggaagau

SEQ ID NO: 378148 - RNA, 19 nt, Homo sapiens
ggucugcugguauaaagua

SEQ ID NO: 378149 - RNA, 19 nt, Homo sapiens
cagaauaccaggcuugaau

SEQ ID NO: 378150 - RNA, 19 nt, Homo sapiens
agaaauaccuggagaauua

SEQ ID NO: 378151 - RNA, 19 nt, Homo sapiens
ggacaaccaagaagaaaua

SEQ ID NO: 378152 - RNA, 19 nt, Homo sapiens
gaagggaacuagagguguu

SEQ ID NO: 378153 - RNA, 19 nt, Homo sapiens
gacagacacuaacuuugua

SEQ ID NO: 378154 - RNA, 19 nt, Homo sapiens
gagcaacgccaauaucuau

SEQ ID NO: 378155 - RNA, 19 nt, Homo sapiens
ucagucagcuguccuuuau

SEQ ID NO: 378156 - RNA, 19 nt, Homo sapiens
ggaccggccuuucgaagau

SEQ ID NO: 378157 - RNA, 19 nt, Homo sapiens
agaauuaccucaacugucu

SEQ ID NO: 378158 - RNA, 19 nt, Homo sapiens
aagaagaaauaccgucauu

SEQ ID NO: 378159 - RNA, 19 nt, Homo sapiens
gaaccugcacucuguauuc

SEQ ID NO: 378160 - RNA, 19 nt, Homo sapiens
gaccugcacuaccgacuga

SEQ ID NO: 378161 - RNA, 19 nt, Homo sapiens
gaauuggccuugggcauca

SEQ ID NO: 378162 - RNA, 19 nt, Homo sapiens
cagcauggcgggacuauau

SEQ ID NO: 378163 - RNA, 19 nt, Homo sapiens
gcaaucuuaucaccaagga

SEQ ID NO: 378164 - RNA, 19 nt, Homo sapiens
guacaggucuugcgaucag

SEQ ID NO: 378165 - RNA, 19 nt, Homo sapiens
ugucuauucugcuguuuaa

SEQ ID NO: 378166 - RNA, 19 nt, Homo sapiens
ucuaugagcuucagucucu

SEQ ID NO: 378167 - RNA, 19 nt, Homo sapiens
gaaggaaggagggcacauu

SEQ ID NO: 378168 - RNA, 19 nt, Homo sapiens
ugacagacacuaacuuugu

SEQ ID NO: 378169 - RNA, 19 nt, Homo sapiens
ggucaagccucuuauucca

SEQ ID NO: 378170 - RNA, 19 nt, Homo sapiens
gcaacgccaauaucuauga

SEQ ID NO: 378171 - RNA, 19 nt, Homo sapiens
ucucggagcucaucuacau

SEQ ID NO: 378172 - RNA, 19 nt, Homo sapiens
gccgagaccaaguuuguua

SEQ ID NO: 378173 - RNA, 19 nt, Homo sapiens
gcugacagacacuaacuuu

SEQ ID NO: 378174 - RNA, 19 nt, Homo sapiens
gaaccaucccucaugaaug

SEQ ID NO: 378175 - RNA, 19 nt, Homo sapiens
ggaaccaucccucaugaau

SEQ ID NO: 378176 - RNA, 19 nt, Homo sapiens
caaggugggcgaugagauu

SEQ ID NO: 378177 - RNA, 19 nt, Homo sapiens
ugaacaaggugggcgauga

SEQ ID NO: 378178 - RNA, 19 nt, Homo sapiens
caagguggagggaaggaua

SEQ ID NO: 378179 - RNA, 19 nt, Homo sapiens
gugaugacuucuuccaguu

SEQ ID NO: 378180 - RNA, 19 nt, Homo sapiens
gcacugcuucggugugauu

SEQ ID NO: 378181 - RNA, 19 nt, Homo sapiens
acagcaaucuuaucaccaa

SEQ ID NO: 378182 - RNA, 19 nt, Homo sapiens
gugggaaccugcacucugu

SEQ ID NO: 378183 - RNA, 19 nt, Homo sapiens
ggugccaucucauuuguuc

SEQ ID NO: 378184 - RNA, 19 nt, Homo sapiens
gcagugcccuuugagaucu

SEQ ID NO: 378185 - RNA, 19 nt, Homo sapiens
gcugagagcaacgccaaua

SEQ ID NO: 378186 - RNA, 19 nt, Homo sapiens
gacuggaccuugccuaugg

SEQ ID NO: 378187 - RNA, 19 nt, Homo sapiens
gaaguguggacauaguuga

SEQ ID NO: 378188 - RNA, 19 nt, Homo sapiens
gcauggcgggacuauauuu

SEQ ID NO: 378189 - RNA, 19 nt, Homo sapiens
gguugaguccugagguuua

SEQ ID NO: 378190 - RNA, 19 nt, Homo sapiens
gaugacuucuuccaguugu

SEQ ID NO: 378191 - RNA, 19 nt, Homo sapiens
uucauuagcugcucagaug

SEQ ID NO: 378192 - RNA, 19 nt, Homo sapiens
ccaccaaggccaaguacaa

SEQ ID NO: 378193 - RNA, 19 nt, Homo sapiens
gacaggugccaucucauuu

SEQ ID NO: 378194 - RNA, 19 nt, Homo sapiens
agagguggcugguggugaa

SEQ ID NO: 378195 - RNA, 19 nt, Homo sapiens
ggaaggagggcacauuaac

SEQ ID NO: 378196 - RNA, 19 nt, Homo sapiens
gggacuauauuuccaucug

SEQ ID NO: 378197 - RNA, 19 nt, Homo sapiens
ggcaaggacuacagcaauc

SEQ ID NO: 378198 - RNA, 19 nt, Homo sapiens
uguuaucgcugguccaaga

SEQ ID NO: 378199 - RNA, 19 nt, Homo sapiens
cuauucugcuguuuaaaga

SEQ ID NO: 378200 - RNA, 19 nt, Homo sapiens
cuuuguauccguucaauaa

SEQ ID NO: 378201 - RNA, 19 nt, Homo sapiens
ggagaauuaccucaacugu

SEQ ID NO: 378202 - RNA, 19 nt, Homo sapiens
aaggaaggagggcacauua

SEQ ID NO: 378203 - RNA, 19 nt, Homo sapiens
gacccuuacgugagaaaua

SEQ ID NO: 378204 - RNA, 19 nt, Homo sapiens
gagagcaacgccaauaucu

SEQ ID NO: 378205 - RNA, 19 nt, Homo sapiens
cagcagggacucuggagaa

SEQ ID NO: 378206 - RNA, 19 nt, Homo sapiens
gaaggagggcacauuaacu

SEQ ID NO: 378207 - RNA, 19 nt, Homo sapiens
gaccggacagucaucauug

SEQ ID NO: 378208 - RNA, 19 nt, Homo sapiens
ccauucugcacuuuacuua

SEQ ID NO: 378209 - RNA, 19 nt, Homo sapiens
gggcaaggacuacagcaau

SEQ ID NO: 378210 - RNA, 19 nt, Homo sapiens
agaccucucucacaaccaa

SEQ ID NO: 378211 - RNA, 19 nt, Homo sapiens
agacaggugccaucucauu

SEQ ID NO: 378212 - RNA, 19 nt, Homo sapiens
guacaugugccucgagaca

SEQ ID NO: 378213 - RNA, 19 nt, Homo sapiens
cuagaaguguggacauagu

SEQ ID NO: 378214 - RNA, 19 nt, Homo sapiens
caucauugguucugcaaac

SEQ ID NO: 378215 - RNA, 19 nt, Homo sapiens
gaacaaggugggcgaugag

SEQ ID NO: 378216 - RNA, 19 nt, Homo sapiens
ggacuacagcaaucuuauc

SEQ ID NO: 378217 - RNA, 19 nt, Homo sapiens
aacaguggcuauagcaaga

SEQ ID NO: 378218 - RNA, 19 nt, Homo sapiens
gacacaaagucuugaugag

SEQ ID NO: 378219 - RNA, 19 nt, Homo sapiens
ggacuggaccuugccuaug

SEQ ID NO: 378220 - RNA, 19 nt, Homo sapiens
gaauggggcagguuacuuu

SEQ ID NO: 378221 - RNA, 19 nt, Homo sapiens
ucccacagguccuugauuc

SEQ ID NO: 378222 - RNA, 19 nt, Homo sapiens
gcucuuugacccuggcuuu

SEQ ID NO: 378223 - RNA, 19 nt, Homo sapiens
guucugcaaacaucaauga

SEQ ID NO: 378224 - RNA, 19 nt, Homo sapiens
gacuacagcaaucuuauca

SEQ ID NO: 378225 - RNA, 19 nt, Homo sapiens
cacagguccuugauucuca

SEQ ID NO: 378226 - RNA, 19 nt, Homo sapiens
caggugccaucucauuugu

SEQ ID NO: 378227 - RNA, 19 nt, Homo sapiens
ccuagaggaugagucuuug

SEQ ID NO: 378228 - RNA, 19 nt, Homo sapiens
aauccugcaucgccuuaaa

SEQ ID NO: 378229 - RNA, 19 nt, Homo sapiens
cagaaauaccuggagaauu

SEQ ID NO: 378230 - RNA, 19 nt, Homo sapiens
gagaugcaggcaacagaga

SEQ ID NO: 378231 - RNA, 19 nt, Homo sapiens
cccuagaaguguggacaua

SEQ ID NO: 378232 - RNA, 19 nt, Homo sapiens
cagcacuuccucuacauug

SEQ ID NO: 378233 - RNA, 19 nt, Homo sapiens
gcaccaccguacaggucuu

SEQ ID NO: 378234 - RNA, 19 nt, Homo sapiens
gaccggccuuucgaagauu

SEQ ID NO: 378235 - RNA, 19 nt, Homo sapiens
guuuaaagaaguggaauug

SEQ ID NO: 378236 - RNA, 19 nt, Homo sapiens
gugguugaguccugagguu

SEQ ID NO: 378237 - RNA, 19 nt, Homo sapiens
gcagccagcaaacagaaau

SEQ ID NO: 378238 - RNA, 19 nt, Homo sapiens
ggaaccugcacucuguauu

SEQ ID NO: 378239 - RNA, 19 nt, Homo sapiens
caacgccaauaucuaugag

SEQ ID NO: 378240 - RNA, 19 nt, Homo sapiens
acggaaccaucccucauga

SEQ ID NO: 378241 - RNA, 19 nt, Homo sapiens
gacggaaccaucccucaug

SEQ ID NO: 378242 - RNA, 19 nt, Homo sapiens
aaucaguucuucauuagcu

SEQ ID NO: 378243 - RNA, 19 nt, Homo sapiens
gagaacuccauccucaaug

SEQ ID NO: 378244 - RNA, 19 nt, Homo sapiens
caucaacaguggcuauagc

SEQ ID NO: 378245 - RNA, 19 nt, Homo sapiens
gucagucagcuguccuuua

SEQ ID NO: 378246 - RNA, 19 nt, Homo sapiens
cagggacucuggagaacuc

SEQ ID NO: 378247 - RNA, 19 nt, Homo sapiens
cgcuggaacuucaccaaga

SEQ ID NO: 378248 - RNA, 19 nt, Homo sapiens
ucaucuacauccacagcaa

SEQ ID NO: 378249 - RNA, 19 nt, Homo sapiens
ccugcacucuguauucugu

SEQ ID NO: 378250 - RNA, 19 nt, Homo sapiens
ggagaacgcugccuacuuu

SEQ ID NO: 378251 - RNA, 19 nt, Homo sapiens
gcaaggagaugucagugua

SEQ ID NO: 378252 - RNA, 19 nt, Homo sapiens
gcaagacggugaccauuug

SEQ ID NO: 378253 - RNA, 19 nt, Homo sapiens
gcacaucagugaccuguau

SEQ ID NO: 378254 - RNA, 19 nt, Homo sapiens
gcagaucucucucuuccaa

SEQ ID NO: 378255 - RNA, 19 nt, Homo sapiens
ggaagcagaucaccaugga

SEQ ID NO: 378256 - RNA, 19 nt, Homo sapiens
gcacucaucuugcgugaca

SEQ ID NO: 378257 - RNA, 19 nt, Homo sapiens
gagcuaauguggcugaaug

SEQ ID NO: 378258 - RNA, 19 nt, Homo sapiens
ccacgcagguguacacuga

SEQ ID NO: 378259 - RNA, 19 nt, Homo sapiens
caaagacccugcccaaugg

SEQ ID NO: 378260 - RNA, 19 nt, Homo sapiens
cagagaagaugcucaagga

SEQ ID NO: 378261 - RNA, 19 nt, Homo sapiens
uaauguggcugaaugagaa

SEQ ID NO: 378262 - RNA, 19 nt, Homo sapiens
ucagugaccuguaugaaga

SEQ ID NO: 378263 - RNA, 19 nt, Homo sapiens
ggaacagggugcacaggaa

SEQ ID NO: 378264 - RNA, 19 nt, Homo sapiens
acaaugcccugaagaaaga

SEQ ID NO: 378265 - RNA, 19 nt, Homo sapiens
aggaacagcugaacgagua

SEQ ID NO: 378266 - RNA, 19 nt, Homo sapiens
ggaggaggcugagaagaug

SEQ ID NO: 378267 - RNA, 19 nt, Homo sapiens
gcaaggaggccgagcaaga

SEQ ID NO: 378268 - RNA, 19 nt, Homo sapiens
ggacaaucauucugcacuu

SEQ ID NO: 378269 - RNA, 19 nt, Homo sapiens
cuaccaggcucucaagaaa

SEQ ID NO: 378270 - RNA, 19 nt, Homo sapiens
ggcagaagcugaguaucua

SEQ ID NO: 378271 - RNA, 19 nt, Homo sapiens
gaaccgcgcacucaucuug

SEQ ID NO: 378272 - RNA, 19 nt, Homo sapiens
ugaccaagcugcagaugga

SEQ ID NO: 378273 - RNA, 19 nt, Homo sapiens
gacgagaaguccaucauca

SEQ ID NO: 378274 - RNA, 19 nt, Homo sapiens
ggagaagcauaagaaauuc

SEQ ID NO: 378275 - RNA, 19 nt, Homo sapiens
cagagaagcugcgcaagga

SEQ ID NO: 378276 - RNA, 19 nt, Homo sapiens
ggagcuggcugaacaagag

SEQ ID NO: 378277 - RNA, 19 nt, Homo sapiens
ccaaggaggccgacaagaa

SEQ ID NO: 378278 - RNA, 19 nt, Homo sapiens
gcaagacgacggucaagga

SEQ ID NO: 378279 - RNA, 19 nt, Homo sapiens
ggccucaucuggacaauca

SEQ ID NO: 378280 - RNA, 19 nt, Homo sapiens
gagaaggucaucaagauuc

SEQ ID NO: 378281 - RNA, 19 nt, Homo sapiens
agaagaugcucaaggagaa

SEQ ID NO: 378282 - RNA, 19 nt, Homo sapiens
guagagggcccugguguuu

SEQ ID NO: 378283 - RNA, 19 nt, Homo sapiens
ucgaggaggucaccaagaa

SEQ ID NO: 378284 - RNA, 19 nt, Homo sapiens
uggagaagcauaagaaauu

SEQ ID NO: 378285 - RNA, 19 nt, Homo sapiens
ggaggaggcugaggcacaa

SEQ ID NO: 378286 - RNA, 19 nt, Homo sapiens
ccaagugggucaacaagca

SEQ ID NO: 378287 - RNA, 19 nt, Homo sapiens
caaguggugccuaaaguuu

SEQ ID NO: 378288 - RNA, 19 nt, Homo sapiens
ggaggaggcugugcguaug

SEQ ID NO: 378289 - RNA, 19 nt, Homo sapiens
gaagcugaguaucuacaau

SEQ ID NO: 378290 - RNA, 19 nt, Homo sapiens
augagaagcugaguguuua

SEQ ID NO: 378291 - RNA, 19 nt, Homo sapiens
aacaagagcuggagaagca

SEQ ID NO: 378292 - RNA, 19 nt, Homo sapiens
uggagaagaucaucaagau

SEQ ID NO: 378293 - RNA, 19 nt, Homo sapiens
gggaagacgugcgccacua

SEQ ID NO: 378294 - RNA, 19 nt, Homo sapiens
ggaaccagcgccuguaugu

SEQ ID NO: 378295 - RNA, 19 nt, Homo sapiens
ggagaaggucaucaagauu

SEQ ID NO: 378296 - RNA, 19 nt, Homo sapiens
guacaagggccaccucuca

SEQ ID NO: 378297 - RNA, 19 nt, Homo sapiens
caacaugaccgccaagaag

SEQ ID NO: 378298 - RNA, 19 nt, Homo sapiens
gcccaacccugucuguaga

SEQ ID NO: 378299 - RNA, 19 nt, Homo sapiens
acaaagacccugcccaaug

SEQ ID NO: 378300 - RNA, 19 nt, Homo sapiens
agaaguccaucaucaccua

SEQ ID NO: 378301 - RNA, 19 nt, Homo sapiens
cugcaucgcuggugucuuc

SEQ ID NO: 378302 - RNA, 19 nt, Homo sapiens
uggagaaggucaucaagau

SEQ ID NO: 378303 - RNA, 19 nt, Homo sapiens
caagaagggcauuugaaga

SEQ ID NO: 378304 - RNA, 19 nt, Homo sapiens
gaggaugcguuuccacaag

SEQ ID NO: 378305 - RNA, 19 nt, Homo sapiens
gggaucgugugcagaagaa

SEQ ID NO: 378306 - RNA, 19 nt, Homo sapiens
ucaucgagaucauugagaa

SEQ ID NO: 378307 - RNA, 19 nt, Homo sapiens
aggagaagguguccaucua

SEQ ID NO: 378308 - RNA, 19 nt, Homo sapiens
ucgcagggcuguugcugaa

SEQ ID NO: 378309 - RNA, 19 nt, Homo sapiens
gcaccaguccaucgaagaa

SEQ ID NO: 378310 - RNA, 19 nt, Homo sapiens
gggacacacugcccuggaa

SEQ ID NO: 378311 - RNA, 19 nt, Homo sapiens
gaggagcgcgugcagaaga

SEQ ID NO: 378312 - RNA, 19 nt, Homo sapiens
ccaagggcaucuaccaauc

SEQ ID NO: 378313 - RNA, 19 nt, Homo sapiens
agaagggccugauccugaa

SEQ ID NO: 378314 - RNA, 19 nt, Homo sapiens
gacaagaagggcauuugaa

SEQ ID NO: 378315 - RNA, 19 nt, Homo sapiens
gcaaagcuuccucucugaa

SEQ ID NO: 378316 - RNA, 19 nt, Homo sapiens
uaccucaccugcccuaaga

SEQ ID NO: 378317 - RNA, 19 nt, Homo sapiens
gcaccaagaccaagauguc

SEQ ID NO: 378318 - RNA, 19 nt, Homo sapiens
ggcaagacggugaccauuu

SEQ ID NO: 378319 - RNA, 19 nt, Homo sapiens
ccaaugagaagcugagugu

SEQ ID NO: 378320 - RNA, 19 nt, Homo sapiens
caaagcuuccucucugaaa

SEQ ID NO: 378321 - RNA, 19 nt, Homo sapiens
uggagaagcucaagaccau

SEQ ID NO: 378322 - RNA, 19 nt, Homo sapiens
ggaggugacugugcacaag

SEQ ID NO: 378323 - RNA, 19 nt, Homo sapiens
uccacaagcugcagaaugu

SEQ ID NO: 378324 - RNA, 19 nt, Homo sapiens
caacaagcaccucaucaag

SEQ ID NO: 378325 - RNA, 19 nt, Homo sapiens
guggcuaccucaacaagga

SEQ ID NO: 378326 - RNA, 19 nt, Homo sapiens
gcagagcgucucccuguuc

SEQ ID NO: 378327 - RNA, 19 nt, Homo sapiens
gggcagaagcugaguaucu

SEQ ID NO: 378328 - RNA, 19 nt, Homo sapiens
aaugagaagcugaguguuu

SEQ ID NO: 378329 - RNA, 19 nt, Homo sapiens
ucaacgccaucaaggacua

SEQ ID NO: 378330 - RNA, 19 nt, Homo sapiens
agaccaagcucaagaucuc

SEQ ID NO: 378331 - RNA, 19 nt, Homo sapiens
acaagggccugguggacaa

SEQ ID NO: 378332 - RNA, 19 nt, Homo sapiens
cagcguggcuaccucaaca

SEQ ID NO: 378333 - RNA, 19 nt, Homo sapiens
gggagcuggucuacacuga

SEQ ID NO: 378334 - RNA, 19 nt, Homo sapiens
ggaagcaggcggaggagau

SEQ ID NO: 378335 - RNA, 19 nt, Homo sapiens
aggcacaccugaaggagaa

SEQ ID NO: 378336 - RNA, 19 nt, Homo sapiens
cugaagaugucuccaaugg

SEQ ID NO: 378337 - RNA, 19 nt, Homo sapiens
aggaacggcucucggugua

SEQ ID NO: 378338 - RNA, 19 nt, Homo sapiens
caucaacucggaauacuuc

SEQ ID NO: 378339 - RNA, 19 nt, Homo sapiens
gcugcagaauguccagauu

SEQ ID NO: 378340 - RNA, 19 nt, Homo sapiens
ucacguaccugcagcuacu

SEQ ID NO: 378341 - RNA, 19 nt, Homo sapiens
gagaagcucaagaccauca

SEQ ID NO: 378342 - RNA, 19 nt, Homo sapiens
cggaagacguccuccaagu

SEQ ID NO: 378343 - RNA, 19 nt, Homo sapiens
ucaccuaccugcagcugau

SEQ ID NO: 378344 - RNA, 19 nt, Homo sapiens
ggcagacacugagcaucua

SEQ ID NO: 378345 - RNA, 19 nt, Homo sapiens
ucaagauucucauuaccau

SEQ ID NO: 378346 - RNA, 19 nt, Homo sapiens
gagcuggucuacacugacu

SEQ ID NO: 378347 - RNA, 19 nt, Homo sapiens
aggcggagcugcagagcaa

SEQ ID NO: 378348 - RNA, 19 nt, Homo sapiens
ccacuaaggagcuaaugug

SEQ ID NO: 378349 - RNA, 19 nt, Homo sapiens
cucaagaucuccuauaagg

SEQ ID NO: 378350 - RNA, 19 nt, Homo sapiens
gaagaagacuguauguuug

SEQ ID NO: 378351 - RNA, 19 nt, Homo sapiens
acaagaaccugaagaagaa

SEQ ID NO: 378352 - RNA, 19 nt, Homo sapiens
ggacguggguagggauuua

SEQ ID NO: 378353 - RNA, 19 nt, Homo sapiens
gaauccagaugccgauaaa

SEQ ID NO: 378354 - RNA, 19 nt, Homo sapiens
caagaaaacuuuacgacua

SEQ ID NO: 378355 - RNA, 19 nt, Homo sapiens
gaccaugucuggacuggaa

SEQ ID NO: 378356 - RNA, 19 nt, Homo sapiens
ggagugaugagaaauaauu

SEQ ID NO: 378357 - RNA, 19 nt, Homo sapiens
gcaagucagucuuagaaca

SEQ ID NO: 378358 - RNA, 19 nt, Homo sapiens
gcuaugaguuucugaaugg

SEQ ID NO: 378359 - RNA, 19 nt, Homo sapiens
gaacaagguuuggaaugca

SEQ ID NO: 378360 - RNA, 19 nt, Homo sapiens
ggauuuagcaugcuggaaa

SEQ ID NO: 378361 - RNA, 19 nt, Homo sapiens
gcagggcauuccaauauca

SEQ ID NO: 378362 - RNA, 19 nt, Homo sapiens
gauauugccuugcuaaagc

SEQ ID NO: 378363 - RNA, 19 nt, Homo sapiens
caaacaagaaccugaagaa

SEQ ID NO: 378364 - RNA, 19 nt, Homo sapiens
ccgaagaaauguccuggaa

SEQ ID NO: 378365 - RNA, 19 nt, Homo sapiens
gcucauggauacauuccuu

SEQ ID NO: 378366 - RNA, 19 nt, Homo sapiens
guaguaaggugacauagcu

SEQ ID NO: 378367 - RNA, 19 nt, Homo sapiens
gaaguccuccauaaucauu

SEQ ID NO: 378368 - RNA, 19 nt, Homo sapiens
aagaagaauuacugucgua

SEQ ID NO: 378369 - RNA, 19 nt, Homo sapiens
gauacauuccuuccaaauu

SEQ ID NO: 378370 - RNA, 19 nt, Homo sapiens
cagagggacuggaggagaa

SEQ ID NO: 378371 - RNA, 19 nt, Homo sapiens
gagggagugaugagaaaua

SEQ ID NO: 378372 - RNA, 19 nt, Homo sapiens
gagaauaaagugugcaauc

SEQ ID NO: 378373 - RNA, 19 nt, Homo sapiens
gagaacuacugcaggaauc

SEQ ID NO: 378374 - RNA, 19 nt, Homo sapiens
aacaagcgcugggaacuuu

SEQ ID NO: 378375 - RNA, 19 nt, Homo sapiens
ccaaauuuccaaacaagaa

SEQ ID NO: 378376 - RNA, 19 nt, Homo sapiens
gcgacauucuugaguguga

SEQ ID NO: 378377 - RNA, 19 nt, Homo sapiens
gcauuccaauaucacagua

SEQ ID NO: 378378 - RNA, 19 nt, Homo sapiens
gcaagagggcgaccacugu

SEQ ID NO: 378379 - RNA, 19 nt, Homo sapiens
cgagaaggacaaauacauu

SEQ ID NO: 378380 - RNA, 19 nt, Homo sapiens
ggagaaacccaagguacuu

SEQ ID NO: 378381 - RNA, 19 nt, Homo sapiens
guaagauaccguccuguga

SEQ ID NO: 378382 - RNA, 19 nt, Homo sapiens
gaaaagauauugccuugcu

SEQ ID NO: 378383 - RNA, 19 nt, Homo sapiens
uaacccugauggugaugua

SEQ ID NO: 378384 - RNA, 19 nt, Homo sapiens
ggaauccagaugccgauaa

SEQ ID NO: 378385 - RNA, 19 nt, Homo sapiens
ccagaaaacuacccaaaug

SEQ ID NO: 378386 - RNA, 19 nt, Homo sapiens
gggaacaggugaaaacuau

SEQ ID NO: 378387 - RNA, 19 nt, Homo sapiens
gcaggaauccagacaacga

SEQ ID NO: 378388 - RNA, 19 nt, Homo sapiens
gaccgaauguuucaucacu

SEQ ID NO: 378389 - RNA, 19 nt, Homo sapiens
ugucuaggcuguucuugga

SEQ ID NO: 378390 - RNA, 19 nt, Homo sapiens
cauaacaggacaccagaaa

SEQ ID NO: 378391 - RNA, 19 nt, Homo sapiens
gcaagacugggaauggaaa

SEQ ID NO: 378392 - RNA, 19 nt, Homo sapiens
ucccugugauugagaauaa

SEQ ID NO: 378393 - RNA, 19 nt, Homo sapiens
gagaaacccaagguacuuu

SEQ ID NO: 378394 - RNA, 19 nt, Homo sapiens
caagucagucuuagaacaa

SEQ ID NO: 378395 - RNA, 19 nt, Homo sapiens
aaagauauugccuugcuaa

SEQ ID NO: 378396 - RNA, 19 nt, Homo sapiens
ggagaacuacugcaggaau

SEQ ID NO: 378397 - RNA, 19 nt, Homo sapiens
aaagaaaguguaucucuca

SEQ ID NO: 378398 - RNA, 19 nt, Homo sapiens
ggaguacugcaaccugaaa

SEQ ID NO: 378399 - RNA, 19 nt, Homo sapiens
caacaccuccaccaucuuc

SEQ ID NO: 378400 - RNA, 19 nt, Homo sapiens
ccuagauucucaccugcua

SEQ ID NO: 378401 - RNA, 19 nt, Homo sapiens
acucuguacuuaacuuuga

SEQ ID NO: 378402 - RNA, 19 nt, Homo sapiens
cacaacaccuccaccaucu

SEQ ID NO: 378403 - RNA, 19 nt, Homo sapiens
aacaagaaccugaagaaga

SEQ ID NO: 378404 - RNA, 19 nt, Homo sapiens
caaaguaaucccagcuugu

SEQ ID NO: 378405 - RNA, 19 nt, Homo sapiens
gaaaacuacugccgcaauc

SEQ ID NO: 378406 - RNA, 19 nt, Homo sapiens
gugcaagacugggaaugga

SEQ ID NO: 378407 - RNA, 19 nt, Homo sapiens
cuggaugacuaugugaaua

SEQ ID NO: 378408 - RNA, 19 nt, Homo sapiens
aaaggccccugguguuuua

SEQ ID NO: 378409 - RNA, 19 nt, Homo sapiens
gcccacacgcucauggaua

SEQ ID NO: 378410 - RNA, 19 nt, Homo sapiens
gaaaagaaaguguaucucu

SEQ ID NO: 378411 - RNA, 19 nt, Homo sapiens
acugcuggauucuguagua

SEQ ID NO: 378412 - RNA, 19 nt, Homo sapiens
guucguguuucaagguuug

SEQ ID NO: 378413 - RNA, 19 nt, Homo sapiens
agaagaaugugcagcaaaa

SEQ ID NO: 378414 - RNA, 19 nt, Homo sapiens
cugcagggcauuccaauau

SEQ ID NO: 378415 - RNA, 19 nt, Homo sapiens
gugcaaucgcuaugaguuu

SEQ ID NO: 378416 - RNA, 19 nt, Homo sapiens
ccacaggaaagaaguguca

SEQ ID NO: 378417 - RNA, 19 nt, Homo sapiens
gugggaguacuguaagaua

SEQ ID NO: 378418 - RNA, 19 nt, Homo sapiens
caacaagcgcugggaacuu

SEQ ID NO: 378419 - RNA, 19 nt, Homo sapiens
gagcugcggccuugguguu

SEQ ID NO: 378420 - RNA, 19 nt, Homo sapiens
ggauacauuccuuccaaau

SEQ ID NO: 378421 - RNA, 19 nt, Homo sapiens
gaaaagagauaugacuacu

SEQ ID NO: 378422 - RNA, 19 nt, Homo sapiens
gcuggauucuguaguaagg

SEQ ID NO: 378423 - RNA, 19 nt, Homo sapiens
agggagugaugagaaauaa

SEQ ID NO: 378424 - RNA, 19 nt, Homo sapiens
guccugccgucaucacuga

SEQ ID NO: 378425 - RNA, 19 nt, Homo sapiens
caagagggcgaccacuguu

SEQ ID NO: 378426 - RNA, 19 nt, Homo sapiens
gggcccuggugcuauacua

SEQ ID NO: 378427 - RNA, 19 nt, Homo sapiens
agaauaaagugugcaaucg

SEQ ID NO: 378428 - RNA, 19 nt, Homo sapiens
ccaagaagugaaucucgaa

SEQ ID NO: 378429 - RNA, 19 nt, Homo sapiens
caaguggagccgaagaaau

SEQ ID NO: 378430 - RNA, 19 nt, Homo sapiens
caaaugcuggccugacaau

SEQ ID NO: 378431 - RNA, 19 nt, Homo sapiens
caaaauggaacauaaggaa

SEQ ID NO: 378432 - RNA, 19 nt, Homo sapiens
gcaguaaucaaacgaagac

SEQ ID NO: 378433 - RNA, 19 nt, Homo sapiens
ccaauccaccgaacucugu

SEQ ID NO: 378434 - RNA, 19 nt, Homo sapiens
uggcaagucagucuuagaa

SEQ ID NO: 378435 - RNA, 19 nt, Homo sapiens
aaguggagccgaagaaaug

SEQ ID NO: 378436 - RNA, 19 nt, Homo sapiens
gguggucccuggugcuaca

SEQ ID NO: 378437 - RNA, 19 nt, Homo sapiens
gacuguauguuugggaaug

SEQ ID NO: 378438 - RNA, 19 nt, Homo sapiens
ggacugcuaccauggugau

SEQ ID NO: 378439 - RNA, 19 nt, Homo sapiens
gcgggaauguggcuguuac

SEQ ID NO: 378440 - RNA, 19 nt, Homo sapiens
gcugggaacuuugcgacau

SEQ ID NO: 378441 - RNA, 19 nt, Homo sapiens
uaaagugugcaaucgcuau

SEQ ID NO: 378442 - RNA, 19 nt, Homo sapiens
gaagcccagcucccuguga

SEQ ID NO: 378443 - RNA, 19 nt, Homo sapiens
agaacaagguuuggaaugc

SEQ ID NO: 378444 - RNA, 19 nt, Homo sapiens
agaaccugaagaagaauua

SEQ ID NO: 378445 - RNA, 19 nt, Homo sapiens
cuauacuacugauccagaa

SEQ ID NO: 378446 - RNA, 19 nt, Homo sapiens
uugagggagugaugagaaa

SEQ ID NO: 378447 - RNA, 19 nt, Homo sapiens
gaccggaccgaauguuuca

SEQ ID NO: 378448 - RNA, 19 nt, Homo sapiens
agaagugucuaggcuguuc

SEQ ID NO: 378449 - RNA, 19 nt, Homo sapiens
gauaaaggccccugguguu

SEQ ID NO: 378450 - RNA, 19 nt, Homo sapiens
gaagagaauuccagugaug

SEQ ID NO: 378451 - RNA, 19 nt, Homo sapiens
ugacuuaggugccuuauau

SEQ ID NO: 378452 - RNA, 19 nt, Homo sapiens
gagcauuucucuaacguuu

SEQ ID NO: 378453 - RNA, 19 nt, Homo sapiens
cagaugaagugcacuauuu

SEQ ID NO: 378454 - RNA, 19 nt, Homo sapiens
gaauguaacucaccaugug

SEQ ID NO: 378455 - RNA, 19 nt, Homo sapiens
gagauucuguuucauuuga

SEQ ID NO: 378456 - RNA, 19 nt, Homo sapiens
gcaacugccuggugaaugu

SEQ ID NO: 378457 - RNA, 19 nt, Homo sapiens
uaaagagacuccugcauuc

SEQ ID NO: 378458 - RNA, 19 nt, Homo sapiens
guaaagagacuccugcauu

SEQ ID NO: 378459 - RNA, 19 nt, Homo sapiens
guuagaagauggaauugaa

SEQ ID NO: 378460 - RNA, 19 nt, Homo sapiens
gaaaggagaguagaacauu

SEQ ID NO: 378461 - RNA, 19 nt, Homo sapiens
gaaggaggccagaaauuug

SEQ ID NO: 378462 - RNA, 19 nt, Homo sapiens
cauguggguuguauuguua

SEQ ID NO: 378463 - RNA, 19 nt, Homo sapiens
aaggagggcucucuucuuu

SEQ ID NO: 378464 - RNA, 19 nt, Homo sapiens
gaaagaaaggagaguagaa

SEQ ID NO: 378465 - RNA, 19 nt, Homo sapiens
gcauuucucuaacguuuau

SEQ ID NO: 378466 - RNA, 19 nt, Homo sapiens
ccacuucugugacaaauca

SEQ ID NO: 378467 - RNA, 19 nt, Homo sapiens
gaacugggaaguaaagaga

SEQ ID NO: 378468 - RNA, 19 nt, Homo sapiens
cauuugagguuuacagaaa

SEQ ID NO: 378469 - RNA, 19 nt, Homo sapiens
gugagauucuguuucauuu

SEQ ID NO: 378470 - RNA, 19 nt, Homo sapiens
ggaaguucaucuugagaga

SEQ ID NO: 378471 - RNA, 19 nt, Homo sapiens
gcagggauguuuacugaag

SEQ ID NO: 378472 - RNA, 19 nt, Homo sapiens
gccagaaaccauugacuua

SEQ ID NO: 378473 - RNA, 19 nt, Homo sapiens
aagcagggauguuuacuga

SEQ ID NO: 378474 - RNA, 19 nt, Homo sapiens
gagaaggacaagaagauuu

SEQ ID NO: 378475 - RNA, 19 nt, Homo sapiens
ccagaaauuugccaggaaa

SEQ ID NO: 378476 - RNA, 19 nt, Homo sapiens
caucuucaguucuccagua

SEQ ID NO: 378477 - RNA, 19 nt, Homo sapiens
guaacugcgucauugauug

SEQ ID NO: 378478 - RNA, 19 nt, Homo sapiens
ggaaugaucccgcugaaag

SEQ ID NO: 378479 - RNA, 19 nt, Homo sapiens
gaugauggguuaauacaac

SEQ ID NO: 378480 - RNA, 19 nt, Homo sapiens
ggagggcucucuucuuucu

SEQ ID NO: 378481 - RNA, 19 nt, Homo sapiens
caaccagucuguuaggaau

SEQ ID NO: 378482 - RNA, 19 nt, Homo sapiens
agagagggcuaccuuguga

SEQ ID NO: 378483 - RNA, 19 nt, Homo sapiens
gaaagacagcacccauuga

SEQ ID NO: 378484 - RNA, 19 nt, Homo sapiens
gaagaaauucaacuaguag

SEQ ID NO: 378485 - RNA, 19 nt, Homo sapiens
ugaaggaggccagaaauuu

SEQ ID NO: 378486 - RNA, 19 nt, Homo sapiens
ucaauagccuagagguaaa

SEQ ID NO: 378487 - RNA, 19 nt, Homo sapiens
gugaggaaguucaucuuga

SEQ ID NO: 378488 - RNA, 19 nt, Homo sapiens
aaaggagaguagaacauuu

SEQ ID NO: 378489 - RNA, 19 nt, Homo sapiens
gggaacuuauuugcaauuu

SEQ ID NO: 378490 - RNA, 19 nt, Homo sapiens
gcaggaagagugaggaaga

SEQ ID NO: 378491 - RNA, 19 nt, Homo sapiens
aaucacugcuucacaggua

SEQ ID NO: 378492 - RNA, 19 nt, Homo sapiens
ccagaugguuuuaucaaua

SEQ ID NO: 378493 - RNA, 19 nt, Homo sapiens
gagaaagacagcacccauu

SEQ ID NO: 378494 - RNA, 19 nt, Homo sapiens
guucgugccucagcuuuaa

SEQ ID NO: 378495 - RNA, 19 nt, Homo sapiens
uaaaugauauugcguucgu

SEQ ID NO: 378496 - RNA, 19 nt, Homo sapiens
gagggaagcccauggacaa

SEQ ID NO: 378497 - RNA, 19 nt, Homo sapiens
gugaagagaauuccaguga

SEQ ID NO: 378498 - RNA, 19 nt, Homo sapiens
gaucagagagggcuaccuu

SEQ ID NO: 378499 - RNA, 19 nt, Homo sapiens
caggaaggccucaugauug

SEQ ID NO: 378500 - RNA, 19 nt, Homo sapiens
ccaggaaggccucaugauu

SEQ ID NO: 378501 - RNA, 19 nt, Homo sapiens
uaagaucacuacgaccaaa

SEQ ID NO: 378502 - RNA, 19 nt, Homo sapiens
ccauguggguuguauuguu

SEQ ID NO: 378503 - RNA, 19 nt, Homo sapiens
acagguaacugcgucauug

SEQ ID NO: 378504 - RNA, 19 nt, Homo sapiens
aaagggagcacucugacua

SEQ ID NO: 378505 - RNA, 19 nt, Homo sapiens
gagaggggcuguuagcauu

SEQ ID NO: 378506 - RNA, 19 nt, Homo sapiens
ggacucagagccacacaga

SEQ ID NO: 378507 - RNA, 19 nt, Homo sapiens
guuccuuucuggagcauuu

SEQ ID NO: 378508 - RNA, 19 nt, Homo sapiens
ugagaggaguugccugaga

SEQ ID NO: 378509 - RNA, 19 nt, Homo sapiens
aaagacagcacccauugaa

SEQ ID NO: 378510 - RNA, 19 nt, Homo sapiens
ucugugagauucuguuuca

SEQ ID NO: 378511 - RNA, 19 nt, Homo sapiens
gcagaugaagugcacuauu

SEQ ID NO: 378512 - RNA, 19 nt, Homo sapiens
gaauuccagugaugaugau

SEQ ID NO: 378513 - RNA, 19 nt, Homo sapiens
uuaggugccuuauauuugu

SEQ ID NO: 378514 - RNA, 19 nt, Homo sapiens
ccaaacagcaggaccacuu

SEQ ID NO: 378515 - RNA, 19 nt, Homo sapiens
ggauguuuguguuuaagau

SEQ ID NO: 378516 - RNA, 19 nt, Homo sapiens
ggaaagaaaggagaguaga

SEQ ID NO: 378517 - RNA, 19 nt, Homo sapiens
agauaugugugugaaagua

SEQ ID NO: 378518 - RNA, 19 nt, Homo sapiens
caaauggcaggaagaguga

SEQ ID NO: 378519 - RNA, 19 nt, Homo sapiens
gggagcaauucacuugaga

SEQ ID NO: 378520 - RNA, 19 nt, Homo sapiens
cugccuaccugcacuacua

SEQ ID NO: 378521 - RNA, 19 nt, Homo sapiens
gccagaaauuugccaggaa

SEQ ID NO: 378522 - RNA, 19 nt, Homo sapiens
ggaagagugaggaagagaa

SEQ ID NO: 378523 - RNA, 19 nt, Homo sapiens
ucaguucuccaguaaauga

SEQ ID NO: 378524 - RNA, 19 nt, Homo sapiens
gguccuuucugugcccuua

SEQ ID NO: 378525 - RNA, 19 nt, Homo sapiens
ugaagugcacuauuucuug

SEQ ID NO: 378526 - RNA, 19 nt, Homo sapiens
ugacuucaguggagagcaa

SEQ ID NO: 378527 - RNA, 19 nt, Homo sapiens
uaucaagcagggauguuua

SEQ ID NO: 378528 - RNA, 19 nt, Homo sapiens
cuucaguucuccaguaaau

SEQ ID NO: 378529 - RNA, 19 nt, Homo sapiens
gccuugagaucguguaaca

SEQ ID NO: 378530 - RNA, 19 nt, Homo sapiens
agaaagacagcacccauug

SEQ ID NO: 378531 - RNA, 19 nt, Homo sapiens
ggucucccuuuguuccuuu

SEQ ID NO: 378532 - RNA, 19 nt, Homo sapiens
gugaaacuguugcugaucu

SEQ ID NO: 378533 - RNA, 19 nt, Homo sapiens
cagauggccucccgaacug

SEQ ID NO: 378534 - RNA, 19 nt, Homo sapiens
gagagugaccuuugcaucu

SEQ ID NO: 378535 - RNA, 19 nt, Homo sapiens
guauccaaccagucuguua

SEQ ID NO: 378536 - RNA, 19 nt, Homo sapiens
gguaacugcgucauugauu

SEQ ID NO: 378537 - RNA, 19 nt, Homo sapiens
ccuggaaaguugugucuuc

SEQ ID NO: 378538 - RNA, 19 nt, Homo sapiens
gauucuaacacucgcagua

SEQ ID NO: 378539 - RNA, 19 nt, Homo sapiens
guggagagcaacucaaaug

SEQ ID NO: 378540 - RNA, 19 nt, Homo sapiens
cgucauugauuggcuggua

SEQ ID NO: 378541 - RNA, 19 nt, Homo sapiens
cagaaaccauugacuuagg

SEQ ID NO: 378542 - RNA, 19 nt, Homo sapiens
gcccagaggagcccuauuc

SEQ ID NO: 378543 - RNA, 19 nt, Homo sapiens
ggccuucaguuaucuucaa

SEQ ID NO: 378544 - RNA, 19 nt, Homo sapiens
gagaagacccugccuaccu

SEQ ID NO: 378545 - RNA, 19 nt, Homo sapiens
gaugaugaugugauucuga

SEQ ID NO: 378546 - RNA, 19 nt, Homo sapiens
cuucaguuaucuucaaaug

SEQ ID NO: 378547 - RNA, 19 nt, Homo sapiens
ugaagagaauuccagugau

SEQ ID NO: 378548 - RNA, 19 nt, Homo sapiens
ccuuauauuuguccaugaa

SEQ ID NO: 378549 - RNA, 19 nt, Homo sapiens
gccaacgccucccugugaa

SEQ ID NO: 378550 - RNA, 19 nt, Homo sapiens
gaacaugguugcuuucuau

SEQ ID NO: 378551 - RNA, 19 nt, Homo sapiens
gaccaaagaugacuauguu

SEQ ID NO: 378552 - RNA, 19 nt, Homo sapiens
gaacucucaucacauguuu

SEQ ID NO: 378553 - RNA, 19 nt, Homo sapiens
cuacauaccuucucuugug

SEQ ID NO: 378554 - RNA, 19 nt, Homo sapiens
ggacugaaguaaacauauc

SEQ ID NO: 378555 - RNA, 19 nt, Homo sapiens
ccaacuguauuuaggauaa

SEQ ID NO: 378556 - RNA, 19 nt, Homo sapiens
auagaagaaugccuaguua

SEQ ID NO: 378557 - RNA, 19 nt, Homo sapiens
cagaauaugugaauaagca

SEQ ID NO: 378558 - RNA, 19 nt, Homo sapiens
cauauaaccuacauaccuu

SEQ ID NO: 378559 - RNA, 19 nt, Homo sapiens
gcagggcauuccaauauca

SEQ ID NO: 378560 - RNA, 19 nt, Homo sapiens
ugaugucgauguucaacua

SEQ ID NO: 378561 - RNA, 19 nt, Homo sapiens
uuagaacucucaucacaug

SEQ ID NO: 378562 - RNA, 19 nt, Homo sapiens
gaaguccuccauaaucauu

SEQ ID NO: 378563 - RNA, 19 nt, Homo sapiens
guauggagguuucuugaag

SEQ ID NO: 378564 - RNA, 19 nt, Homo sapiens
gagaaaagaccaaagauga

SEQ ID NO: 378565 - RNA, 19 nt, Homo sapiens
ucaagucccuuauguaaaa

SEQ ID NO: 378566 - RNA, 19 nt, Homo sapiens
ucucaagucccuuauguaa

SEQ ID NO: 378567 - RNA, 19 nt, Homo sapiens
gcauuccaauaucacagua

SEQ ID NO: 378568 - RNA, 19 nt, Homo sapiens
agaagaaugccuaguuaaa

SEQ ID NO: 378569 - RNA, 19 nt, Homo sapiens
cauagaagaaugccuaguu

SEQ ID NO: 378570 - RNA, 19 nt, Homo sapiens
aguagaacaugguugcuuu

SEQ ID NO: 378571 - RNA, 19 nt, Homo sapiens
ugucgauguucaacuauuu

SEQ ID NO: 378572 - RNA, 19 nt, Homo sapiens
ugaauaagcagacagaaag

SEQ ID NO: 378573 - RNA, 19 nt, Homo sapiens
gaagaaugccuaguuaaaa

SEQ ID NO: 378574 - RNA, 19 nt, Homo sapiens
gaagaccuagaacauagaa

SEQ ID NO: 378575 - RNA, 19 nt, Homo sapiens
gaauaagcagacagaaaga

SEQ ID NO: 378576 - RNA, 19 nt, Homo sapiens
gauguggaacccauggaua

SEQ ID NO: 378577 - RNA, 19 nt, Homo sapiens
ugcaaucccuaauauaaug

SEQ ID NO: 378578 - RNA, 19 nt, Homo sapiens
gcaagacugggaauggaaa

SEQ ID NO: 378579 - RNA, 19 nt, Homo sapiens
ccuagaacauagaagaaug

SEQ ID NO: 378580 - RNA, 19 nt, Homo sapiens
gugaauaagcagacagaaa

SEQ ID NO: 378581 - RNA, 19 nt, Homo sapiens
ugugcaaucccuaauauaa

SEQ ID NO: 378582 - RNA, 19 nt, Homo sapiens
gcauauaaccuacauaccu

SEQ ID NO: 378583 - RNA, 19 nt, Homo sapiens
uugaagaccuagaacauag

SEQ ID NO: 378584 - RNA, 19 nt, Homo sapiens
uaaccuacauaccuucucu

SEQ ID NO: 378585 - RNA, 19 nt, Homo sapiens
caaaccagaauaugugaau

SEQ ID NO: 378586 - RNA, 19 nt, Homo sapiens
ggccaaaucugagaaaaga

SEQ ID NO: 378587 - RNA, 19 nt, Homo sapiens
cagagggccaacuguauuu

SEQ ID NO: 378588 - RNA, 19 nt, Homo sapiens
gugcaagacugggaaugga

SEQ ID NO: 378589 - RNA, 19 nt, Homo sapiens
uagaagaaugccuaguuaa

SEQ ID NO: 378590 - RNA, 19 nt, Homo sapiens
caugguugcuuucuauuuu

SEQ ID NO: 378591 - RNA, 19 nt, Homo sapiens
cuggaugacuaugugaaua

SEQ ID NO: 378592 - RNA, 19 nt, Homo sapiens
guucaucuacuguaaagug

SEQ ID NO: 378593 - RNA, 19 nt, Homo sapiens
uaccuucucuugugcaauc

SEQ ID NO: 378594 - RNA, 19 nt, Homo sapiens
cugcagggcauuccaauau

SEQ ID NO: 378595 - RNA, 19 nt, Homo sapiens
agaagaaugugcagcaaaa

SEQ ID NO: 378596 - RNA, 19 nt, Homo sapiens
gaccuagaacauagaagaa

SEQ ID NO: 378597 - RNA, 19 nt, Homo sapiens
cacaguugguugaauuugu

SEQ ID NO: 378598 - RNA, 19 nt, Homo sapiens
caaaauccaugcuucucaa

SEQ ID NO: 378599 - RNA, 19 nt, Homo sapiens
ugacuauguuugggacuga

SEQ ID NO: 378600 - RNA, 19 nt, Homo sapiens
ggccaacuguauuuaggau

SEQ ID NO: 378601 - RNA, 19 nt, Homo sapiens
acaguugguugaauuugug

SEQ ID NO: 378602 - RNA, 19 nt, Homo sapiens
gugcaaucccuaauauaau

SEQ ID NO: 378603 - RNA, 19 nt, Homo sapiens
cuugugcaaucccuaauau

SEQ ID NO: 378604 - RNA, 19 nt, Homo sapiens
guaaaguguccgucugugu

SEQ ID NO: 378605 - RNA, 19 nt, Homo sapiens
caaaauggaacauaaggaa

SEQ ID NO: 378606 - RNA, 19 nt, Homo sapiens
cuucucaagucccuuaugu

SEQ ID NO: 378607 - RNA, 19 nt, Homo sapiens
ggucagacuuuuccuuuca

SEQ ID NO: 378608 - RNA, 19 nt, Homo sapiens
agaccuagaacauagaaga

SEQ ID NO: 378609 - RNA, 19 nt, Homo sapiens
uauguaaaauggugcagua

SEQ ID NO: 378610 - RNA, 19 nt, Homo sapiens
ggauacagagggccaacug

SEQ ID NO: 378611 - RNA, 19 nt, Homo sapiens
uggaacccauggauacaga

SEQ ID NO: 378612 - RNA, 19 nt, Homo sapiens
gagagccccuggaugacua

SEQ ID NO: 378613 - RNA, 19 nt, Homo sapiens
caaauuguggagcaaaaua

SEQ ID NO: 378614 - RNA, 19 nt, Homo sapiens
gguauggagguuucuugaa

SEQ ID NO: 378615 - RNA, 19 nt, Homo sapiens
cuugaagaccuagaacaua

SEQ ID NO: 378616 - RNA, 19 nt, Homo sapiens
aauccaugcuucucaaguc

SEQ ID NO: 378617 - RNA, 19 nt, Homo sapiens
guguucaucuacuguaaag

SEQ ID NO: 378618 - RNA, 19 nt, Homo sapiens
ggguauggagguuucuuga

SEQ ID NO: 378619 - RNA, 19 nt, Homo sapiens
gcaaucccuaauauaaugu

SEQ ID NO: 378620 - RNA, 19 nt, Homo sapiens
gggacugaaguaaacauau

SEQ ID NO: 378621 - RNA, 19 nt, Homo sapiens
aaagaccaaagaugacuau

SEQ ID NO: 378622 - RNA, 19 nt, Homo sapiens
aaauggaacauaaggaagu

SEQ ID NO: 378623 - RNA, 19 nt, Homo sapiens
gugguucuucuacuucuuu

SEQ ID NO: 378624 - RNA, 19 nt, Homo sapiens
ggaacauaaggaagugguu

SEQ ID NO: 378625 - RNA, 19 nt, Homo sapiens
agaccaaagaugacuaugu

SEQ ID NO: 378626 - RNA, 19 nt, Homo sapiens
uccaauaucacaguaaaga

SEQ ID NO: 378627 - RNA, 19 nt, Homo sapiens
auccacaguugguugaauu

SEQ ID NO: 378628 - RNA, 19 nt, Homo sapiens
gacuuuuccuuucaucuuu

SEQ ID NO: 378629 - RNA, 19 nt, Homo sapiens
aaaauggcaucaccuguca

SEQ ID NO: 378630 - RNA, 19 nt, Homo sapiens
gucccaaaauggaacauaa

SEQ ID NO: 378631 - RNA, 19 nt, Homo sapiens
acaugguugcuuucuauuu

SEQ ID NO: 378632 - RNA, 19 nt, Homo sapiens
cauaccuucucuugugcaa

SEQ ID NO: 378633 - RNA, 19 nt, Homo sapiens
acucucaucacauguuuga

SEQ ID NO: 378634 - RNA, 19 nt, Homo sapiens
agaacucucaucacauguu

SEQ ID NO: 378635 - RNA, 19 nt, Homo sapiens
uaagcagacagaaagaauc

SEQ ID NO: 378636 - RNA, 19 nt, Homo sapiens
ggauguggaacccauggau

SEQ ID NO: 378637 - RNA, 19 nt, Homo sapiens
cauccacaguugguugaau

SEQ ID NO: 378638 - RNA, 19 nt, Homo sapiens
ucaucuuuguguucaucua

SEQ ID NO: 378639 - RNA, 19 nt, Homo sapiens
guagaacaugguugcuuuc

SEQ ID NO: 378640 - RNA, 19 nt, Homo sapiens
gagggccaacuguauuuag

SEQ ID NO: 378641 - RNA, 19 nt, Homo sapiens
agacugggaauggaaagaa

SEQ ID NO: 378642 - RNA, 19 nt, Homo sapiens
ccacaguugguugaauuug

SEQ ID NO: 378643 - RNA, 19 nt, Homo sapiens
ccaggggccuucacuguuc

SEQ ID NO: 378644 - RNA, 19 nt, Homo sapiens
ggagagggcugccuuugga

SEQ ID NO: 378645 - RNA, 19 nt, Homo sapiens
ggaacaauccgaacagcua

SEQ ID NO: 378646 - RNA, 19 nt, Homo sapiens
ggaccagccucuccacuca

SEQ ID NO: 378647 - RNA, 19 nt, Homo sapiens
ggauguaccugcagaaagg

SEQ ID NO: 378648 - RNA, 19 nt, Homo sapiens
ggagggaggugcuucuagu

SEQ ID NO: 378649 - RNA, 19 nt, Homo sapiens
gagcagguguccccacuua

SEQ ID NO: 378650 - RNA, 19 nt, Homo sapiens
gaagaugaccuggcaaaca

SEQ ID NO: 378651 - RNA, 19 nt, Homo sapiens
gagccugacccucaucuuu

SEQ ID NO: 378652 - RNA, 19 nt, Homo sapiens
uggcaaacaucaaccaaug

SEQ ID NO: 378653 - RNA, 19 nt, Homo sapiens
gcaugucccuguccuccuu

SEQ ID NO: 378654 - RNA, 19 nt, Homo sapiens
ccacucaugugacucuuuc

SEQ ID NO: 378655 - RNA, 19 nt, Homo sapiens
gaacaauccgaacagcuau

SEQ ID NO: 378656 - RNA, 19 nt, Homo sapiens
ugccuaagcuguaucugaa

SEQ ID NO: 378657 - RNA, 19 nt, Homo sapiens
aagaugaccuggcaaacau

SEQ ID NO: 378658 - RNA, 19 nt, Homo sapiens
ggccuaaccugccgagagu

SEQ ID NO: 378659 - RNA, 19 nt, Homo sapiens
cgggaaagcaggaagauga

SEQ ID NO: 378660 - RNA, 19 nt, Homo sapiens
gaacgugucccagguacug

SEQ ID NO: 378661 - RNA, 19 nt, Homo sapiens
ucucugggcugccggaaga

SEQ ID NO: 378662 - RNA, 19 nt, Homo sapiens
ugagagaggccauucuuuc

SEQ ID NO: 378663 - RNA, 19 nt, Homo sapiens
ucaaggaacagcaggauuc

SEQ ID NO: 378664 - RNA, 19 nt, Homo sapiens
gauuucccaucaaagaaga

SEQ ID NO: 378665 - RNA, 19 nt, Homo sapiens
gggaggugcuucuaguucu

SEQ ID NO: 378666 - RNA, 19 nt, Homo sapiens
ccuuaaggcucuuuuguaa

SEQ ID NO: 378667 - RNA, 19 nt, Homo sapiens
ccacccacuuugaauggaa

SEQ ID NO: 378668 - RNA, 19 nt, Homo sapiens
gaaccgaggcagggaagga

SEQ ID NO: 378669 - RNA, 19 nt, Homo sapiens
ucccaacacugccagcauu

SEQ ID NO: 378670 - RNA, 19 nt, Homo sapiens
ggaggugcuucuaguucug

SEQ ID NO: 378671 - RNA, 19 nt, Homo sapiens
agauccagguggcucauuu

SEQ ID NO: 378672 - RNA, 19 nt, Homo sapiens
cgcgggagcucaaggaaca

SEQ ID NO: 378673 - RNA, 19 nt, Homo sapiens
gagcuuugugguccuugua

SEQ ID NO: 378674 - RNA, 19 nt, Homo sapiens
ccucaacgccauccacuuc

SEQ ID NO: 378675 - RNA, 19 nt, Homo sapiens
gaucccaugagcuccuuaa

SEQ ID NO: 378676 - RNA, 19 nt, Homo sapiens
guacuggccaaccugaguu

SEQ ID NO: 378677 - RNA, 19 nt, Homo sapiens
aagaacaacaugagcuuug

SEQ ID NO: 378678 - RNA, 19 nt, Homo sapiens
uaagaacaacaugagcuuu

SEQ ID NO: 378679 - RNA, 19 nt, Homo sapiens
gagggaggugcuucuaguu

SEQ ID NO: 378680 - RNA, 19 nt, Homo sapiens
ggauuucccaucaaagaag

SEQ ID NO: 378681 - RNA, 19 nt, Homo sapiens
guaccugcagaaaggauuu

SEQ ID NO: 378682 - RNA, 19 nt, Homo sapiens
guacccacccacuuugaau

SEQ ID NO: 378683 - RNA, 19 nt, Homo sapiens
ccaagguccggcugccuaa

SEQ ID NO: 378684 - RNA, 19 nt, Homo sapiens
caacaccucuuggggaguu

SEQ ID NO: 378685 - RNA, 19 nt, Homo sapiens
ccaccagcauugccauguc

SEQ ID NO: 378686 - RNA, 19 nt, Homo sapiens
caggguuucuggaggaaca

SEQ ID NO: 378687 - RNA, 19 nt, Homo sapiens
aaggauuucccaucaaaga

SEQ ID NO: 378688 - RNA, 19 nt, Homo sapiens
uaaagaaugaaugggcaaa

SEQ ID NO: 378689 - RNA, 19 nt, Homo sapiens
aaguuugacccgagccuua

SEQ ID NO: 378690 - RNA, 19 nt, Homo sapiens
acaauccgaacagcuauuu

SEQ ID NO: 378691 - RNA, 19 nt, Homo sapiens
gccagcauuucccuuccuu

SEQ ID NO: 378692 - RNA, 19 nt, Homo sapiens
uccaucagccuccauccua

SEQ ID NO: 378693 - RNA, 19 nt, Homo sapiens
ccucaucuuucuuccaaac

SEQ ID NO: 378694 - RNA, 19 nt, Homo sapiens
acccucaucuuucuuccaa

SEQ ID NO: 378695 - RNA, 19 nt, Homo sapiens
gagagaggccauucuuucc

SEQ ID NO: 378696 - RNA, 19 nt, Homo sapiens
cagcugguccugccugcaa

SEQ ID NO: 378697 - RNA, 19 nt, Homo sapiens
uaucugaaacaccaaaugg

SEQ ID NO: 378698 - RNA, 19 nt, Homo sapiens
ccauccacuuccaggguuu

SEQ ID NO: 378699 - RNA, 19 nt, Homo sapiens
ccacaggccuuccccucuu

SEQ ID NO: 378700 - RNA, 19 nt, Homo sapiens
ccuaagcuguaucugaaac

SEQ ID NO: 378701 - RNA, 19 nt, Homo sapiens
ccuuguacccacccacuuu

SEQ ID NO: 378702 - RNA, 19 nt, Homo sapiens
uuaagaacaacaugagcuu

SEQ ID NO: 378703 - RNA, 19 nt, Homo sapiens
ggcccugacuuaaaacuug

SEQ ID NO: 378704 - RNA, 19 nt, Homo sapiens
gcucauuuccccuuuaaga

SEQ ID NO: 378705 - RNA, 19 nt, Homo sapiens
ucccacggcuccucgagau

SEQ ID NO: 378706 - RNA, 19 nt, Homo sapiens
gccugacccucaucuuucu

SEQ ID NO: 378707 - RNA, 19 nt, Homo sapiens
gugcucagaaccacacguu

SEQ ID NO: 378708 - RNA, 19 nt, Homo sapiens
gauccagguggcucauuuc

SEQ ID NO: 378709 - RNA, 19 nt, Homo sapiens
gcacugaacuccucuguga

SEQ ID NO: 378710 - RNA, 19 nt, Homo sapiens
gcucuuggguguuuauuua

SEQ ID NO: 378711 - RNA, 19 nt, Homo sapiens
uuacauggcuuguuuauga

SEQ ID NO: 378712 - RNA, 19 nt, Homo sapiens
ggaagaaguugaagcuuga

SEQ ID NO: 378713 - RNA, 19 nt, Homo sapiens
gcacauacccugcagaaga

SEQ ID NO: 378714 - RNA, 19 nt, Homo sapiens
guaauugccuaacuugauu

SEQ ID NO: 378715 - RNA, 19 nt, Homo sapiens
ggauacgccuuauuugauu

SEQ ID NO: 378716 - RNA, 19 nt, Homo sapiens
ugcaaacgaugcuauaaua

SEQ ID NO: 378717 - RNA, 19 nt, Homo sapiens
ggguuucucuaacaaauaa

SEQ ID NO: 378718 - RNA, 19 nt, Homo sapiens
ccaacacccucucucgaua

SEQ ID NO: 378719 - RNA, 19 nt, Homo sapiens
gaacuccucugugaucuag

SEQ ID NO: 378720 - RNA, 19 nt, Homo sapiens
gcaaacgaugcuauaauaa

SEQ ID NO: 378721 - RNA, 19 nt, Homo sapiens
cagagacacugcggaauuu

SEQ ID NO: 378722 - RNA, 19 nt, Homo sapiens
uuaacuaguucccuaauga

SEQ ID NO: 378723 - RNA, 19 nt, Homo sapiens
ggaauuugcugccaacacu

SEQ ID NO: 378724 - RNA, 19 nt, Homo sapiens
gaggauggcagucaacaaa

SEQ ID NO: 378725 - RNA, 19 nt, Homo sapiens
gauaaauauuugccacgaa

SEQ ID NO: 378726 - RNA, 19 nt, Homo sapiens
ccaaaauggugaugauaua

SEQ ID NO: 378727 - RNA, 19 nt, Homo sapiens
caaaagcucuuggguguuu

SEQ ID NO: 378728 - RNA, 19 nt, Homo sapiens
ggaggaggaggaagaauug

SEQ ID NO: 378729 - RNA, 19 nt, Homo sapiens
gauacgccuuauuugauuu

SEQ ID NO: 378730 - RNA, 19 nt, Homo sapiens
aaagauauuugaccguuuc

SEQ ID NO: 378731 - RNA, 19 nt, Homo sapiens
gagcgaggauggcagucaa

SEQ ID NO: 378732 - RNA, 19 nt, Homo sapiens
uugagaaggugguggagua

SEQ ID NO: 378733 - RNA, 19 nt, Homo sapiens
ccagagacacugcggaauu

SEQ ID NO: 378734 - RNA, 19 nt, Homo sapiens
guucacagcugccaaugag

SEQ ID NO: 378735 - RNA, 19 nt, Homo sapiens
uaauacagcuuggagagau

SEQ ID NO: 378736 - RNA, 19 nt, Homo sapiens
ggugccaucucuuguguau

SEQ ID NO: 378737 - RNA, 19 nt, Homo sapiens
ugccuuacauggcuuguuu

SEQ ID NO: 378738 - RNA, 19 nt, Homo sapiens
uggcuugguuguuacuaua

SEQ ID NO: 378739 - RNA, 19 nt, Homo sapiens
gagcguugccacuuucaaa

SEQ ID NO: 378740 - RNA, 19 nt, Homo sapiens
uggacacaguggugcauua

SEQ ID NO: 378741 - RNA, 19 nt, Homo sapiens
aggaagaauuggagacuga

SEQ ID NO: 378742 - RNA, 19 nt, Homo sapiens
ccucugcggauaaauauuu

SEQ ID NO: 378743 - RNA, 19 nt, Homo sapiens
ccucugugaucuaggauga

SEQ ID NO: 378744 - RNA, 19 nt, Homo sapiens
gcggguuucucuaacaaau

SEQ ID NO: 378745 - RNA, 19 nt, Homo sapiens
ugaagggcguuacugacaa

SEQ ID NO: 378746 - RNA, 19 nt, Homo sapiens
agacugaggagaacaaguu

SEQ ID NO: 378747 - RNA, 19 nt, Homo sapiens
gauggccacauaauaacua

SEQ ID NO: 378748 - RNA, 19 nt, Homo sapiens
gcucccagcaggcuacuuu

SEQ ID NO: 378749 - RNA, 19 nt, Homo sapiens
aagaguaauugccuaacuu

SEQ ID NO: 378750 - RNA, 19 nt, Homo sapiens
uaagaguaauugccuaacu

SEQ ID NO: 378751 - RNA, 19 nt, Homo sapiens
gaagggcguuacugacaac

SEQ ID NO: 378752 - RNA, 19 nt, Homo sapiens
uuugauggccacauaauaa

SEQ ID NO: 378753 - RNA, 19 nt, Homo sapiens
ccuagucuucgaaauguua

SEQ ID NO: 378754 - RNA, 19 nt, Homo sapiens
ggauggcagucaacaaagg

SEQ ID NO: 378755 - RNA, 19 nt, Homo sapiens
gauauuugaccguuuccaa

SEQ ID NO: 378756 - RNA, 19 nt, Homo sapiens
guccaggccugugugcuuu

SEQ ID NO: 378757 - RNA, 19 nt, Homo sapiens
gauucugccucugcggaua

SEQ ID NO: 378758 - RNA, 19 nt, Homo sapiens
cugaaaagauugcuucuga

SEQ ID NO: 378759 - RNA, 19 nt, Homo sapiens
uaauauggauacgccuuau

SEQ ID NO: 378760 - RNA, 19 nt, Homo sapiens
ggaacaaucagaugcaaaa

SEQ ID NO: 378761 - RNA, 19 nt, Homo sapiens
gacacauucuuagcacuga

SEQ ID NO: 378762 - RNA, 19 nt, Homo sapiens
uuaaagggaagaaguugaa

SEQ ID NO: 378763 - RNA, 19 nt, Homo sapiens
uucuauggcuugguuguua

SEQ ID NO: 378764 - RNA, 19 nt, Homo sapiens
cuaguucccuaaugaugga

SEQ ID NO: 378765 - RNA, 19 nt, Homo sapiens
ccagcaggcuacuuugaag

SEQ ID NO: 378766 - RNA, 19 nt, Homo sapiens
gacagaagguuuugacaca

SEQ ID NO: 378767 - RNA, 19 nt, Homo sapiens
uaacuccugucaccacucu

SEQ ID NO: 378768 - RNA, 19 nt, Homo sapiens
ggucagcgacagcuucuuc

SEQ ID NO: 378769 - RNA, 19 nt, Homo sapiens
gcauucauacaauuacaga

SEQ ID NO: 378770 - RNA, 19 nt, Homo sapiens
acagccacauuuccauuug

SEQ ID NO: 378771 - RNA, 19 nt, Homo sapiens
caaguucagugagguagca

SEQ ID NO: 378772 - RNA, 19 nt, Homo sapiens
gauuuaacuaguucccuaa

SEQ ID NO: 378773 - RNA, 19 nt, Homo sapiens
auauggauacgccuuauuu

SEQ ID NO: 378774 - RNA, 19 nt, Homo sapiens
gcaaaaggaugugugucuu

SEQ ID NO: 378775 - RNA, 19 nt, Homo sapiens
cauagucacucuuuugaug

SEQ ID NO: 378776 - RNA, 19 nt, Homo sapiens
aaauauuugccacgaauga

SEQ ID NO: 378777 - RNA, 19 nt, Homo sapiens
gccuucaccugcauaguca

SEQ ID NO: 378778 - RNA, 19 nt, Homo sapiens
aggcgagcguugccacuuu

SEQ ID NO: 378779 - RNA, 19 nt, Homo sapiens
cggaggaggaggaagaauu

SEQ ID NO: 378780 - RNA, 19 nt, Homo sapiens
caacccuagucuucgaaau

SEQ ID NO: 378781 - RNA, 19 nt, Homo sapiens
ucacagccacauuuccauu

SEQ ID NO: 378782 - RNA, 19 nt, Homo sapiens
acacaguggugcauuacgu

SEQ ID NO: 378783 - RNA, 19 nt, Homo sapiens
gauacaccgugcagaccau

SEQ ID NO: 378784 - RNA, 19 nt, Homo sapiens
uaaaucccacucgcucuuu

SEQ ID NO: 378785 - RNA, 19 nt, Homo sapiens
ugccaucucuuguguaugc

SEQ ID NO: 378786 - RNA, 19 nt, Homo sapiens
cugauucuauggcuugguu

SEQ ID NO: 378787 - RNA, 19 nt, Homo sapiens
ggccaugucccuaucagau

SEQ ID NO: 378788 - RNA, 19 nt, Homo sapiens
uacauggcuuguuuaugaa

SEQ ID NO: 378789 - RNA, 19 nt, Homo sapiens
gugcaaugccuaugagaag

SEQ ID NO: 378790 - RNA, 19 nt, Homo sapiens
gaacauuaaagggaagaag

SEQ ID NO: 378791 - RNA, 19 nt, Homo sapiens
acacggaggaggaggaaga

SEQ ID NO: 378792 - RNA, 19 nt, Homo sapiens
ggacacggaggaggaggaa

SEQ ID NO: 378793 - RNA, 19 nt, Homo sapiens
auaauauggauacgccuua

SEQ ID NO: 378794 - RNA, 19 nt, Homo sapiens
gcaggcacguguguaugca

SEQ ID NO: 378795 - RNA, 19 nt, Homo sapiens
uaacuaguucccuaaugau

SEQ ID NO: 378796 - RNA, 19 nt, Homo sapiens
uggauacgccuuauuugau

SEQ ID NO: 378797 - RNA, 19 nt, Homo sapiens
gcucacagccacauuucca

SEQ ID NO: 378798 - RNA, 19 nt, Homo sapiens
gggaacaaucagaugcaaa

SEQ ID NO: 378799 - RNA, 19 nt, Homo sapiens
cagaagguuuugacacauu

SEQ ID NO: 378800 - RNA, 19 nt, Homo sapiens
gaguaauugccuaacuuga

SEQ ID NO: 378801 - RNA, 19 nt, Homo sapiens
ggcgagcguugccacuuuc

SEQ ID NO: 378802 - RNA, 19 nt, Homo sapiens
cacauacccugcagaagac

SEQ ID NO: 378803 - RNA, 19 nt, Homo sapiens
aauacagcuuggagagauu

SEQ ID NO: 378804 - RNA, 19 nt, Homo sapiens
cgccuuauuugauuuaacu

SEQ ID NO: 378805 - RNA, 19 nt, Homo sapiens
gugcagagcgccaguagcu

SEQ ID NO: 378806 - RNA, 19 nt, Homo sapiens
cacagccacauuuccauuu

SEQ ID NO: 378807 - RNA, 19 nt, Homo sapiens
cauuuccauuugcaucauu

SEQ ID NO: 378808 - RNA, 19 nt, Homo sapiens
agaccuacaccagcacuaa

SEQ ID NO: 378809 - RNA, 19 nt, Homo sapiens
caaccaaagucgaauauga

SEQ ID NO: 378810 - RNA, 19 nt, Homo sapiens
gcaaguggguggacuauuc

SEQ ID NO: 378811 - RNA, 19 nt, Homo sapiens
gagaagauguccauggaaa

SEQ ID NO: 378812 - RNA, 19 nt, Homo sapiens
gaagaucacccuccuuaaa

SEQ ID NO: 378813 - RNA, 19 nt, Homo sapiens
gaagauguccauggaaaua

SEQ ID NO: 378814 - RNA, 19 nt, Homo sapiens
caacacgccucauccucua

SEQ ID NO: 378815 - RNA, 19 nt, Homo sapiens
gcaagaaagggcacaguuu

SEQ ID NO: 378816 - RNA, 19 nt, Homo sapiens
caagaagaaugaauacagu

SEQ ID NO: 378817 - RNA, 19 nt, Homo sapiens
gggagaagauguccaugga

SEQ ID NO: 378818 - RNA, 19 nt, Homo sapiens
ggaucaagaagaaugaaua

SEQ ID NO: 378819 - RNA, 19 nt, Homo sapiens
gccaguaccugcaccgaaa

SEQ ID NO: 378820 - RNA, 19 nt, Homo sapiens
gcaccgaaaccgaguuauu

SEQ ID NO: 378821 - RNA, 19 nt, Homo sapiens
ccauaugaauuguacagaa

SEQ ID NO: 378822 - RNA, 19 nt, Homo sapiens
ucacccuccuuaaauauuu

SEQ ID NO: 378823 - RNA, 19 nt, Homo sapiens
ggaggaaagcccugacuga

SEQ ID NO: 378824 - RNA, 19 nt, Homo sapiens
gcacauaccgccugagucu

SEQ ID NO: 378825 - RNA, 19 nt, Homo sapiens
agaucacccuccuuaaaua

SEQ ID NO: 378826 - RNA, 19 nt, Homo sapiens
aagaagaucacccuccuua

SEQ ID NO: 378827 - RNA, 19 nt, Homo sapiens
gcaagauugugccuaaguc

SEQ ID NO: 378828 - RNA, 19 nt, Homo sapiens
ugaccuacaucgacgagaa

SEQ ID NO: 378829 - RNA, 19 nt, Homo sapiens
ucacaguccucaauaaagg

SEQ ID NO: 378830 - RNA, 19 nt, Homo sapiens
gcucuucaaugacucaaca

SEQ ID NO: 378831 - RNA, 19 nt, Homo sapiens
gauacuaccuacggcaaau

SEQ ID NO: 378832 - RNA, 19 nt, Homo sapiens
gcacuaugguggacaagcu

SEQ ID NO: 378833 - RNA, 19 nt, Homo sapiens
gaucacccuccuuaaauau

SEQ ID NO: 378834 - RNA, 19 nt, Homo sapiens
ugugugggacuccuaauua

SEQ ID NO: 378835 - RNA, 19 nt, Homo sapiens
guucuuuacuucuggcuau

SEQ ID NO: 378836 - RNA, 19 nt, Homo sapiens
ucucaaggccuccuaauag

SEQ ID NO: 378837 - RNA, 19 nt, Homo sapiens
cuaagucucugcugcucaa

SEQ ID NO: 378838 - RNA, 19 nt, Homo sapiens
ccaccaagguuuucgauug

SEQ ID NO: 378839 - RNA, 19 nt, Homo sapiens
augaagaucuggaggugaa

SEQ ID NO: 378840 - RNA, 19 nt, Homo sapiens
ucaauaaaggcuuggagaa

SEQ ID NO: 378841 - RNA, 19 nt, Homo sapiens
gacgaguucuuuacuucug

SEQ ID NO: 378842 - RNA, 19 nt, Homo sapiens
ccuuaaauauuuccgcaau

SEQ ID NO: 378843 - RNA, 19 nt, Homo sapiens
gcaagaggaggcugaggau

SEQ ID NO: 378844 - RNA, 19 nt, Homo sapiens
gaccauuccaccaagguuu

SEQ ID NO: 378845 - RNA, 19 nt, Homo sapiens
gaucaagaagaaugaauac

SEQ ID NO: 378846 - RNA, 19 nt, Homo sapiens
gcgugcagaucaacuucuu

SEQ ID NO: 378847 - RNA, 19 nt, Homo sapiens
ccucacaguccucaauaaa

SEQ ID NO: 378848 - RNA, 19 nt, Homo sapiens
ggagaagauguccauggaa

SEQ ID NO: 378849 - RNA, 19 nt, Homo sapiens
cuuaaugacgaguucuuua

SEQ ID NO: 378850 - RNA, 19 nt, Homo sapiens
uuugagacuucuugccuaa

SEQ ID NO: 378851 - RNA, 19 nt, Homo sapiens
ggguugcuguguaaguuau

SEQ ID NO: 378852 - RNA, 19 nt, Homo sapiens
gaucaacuucuuccaggau

SEQ ID NO: 378853 - RNA, 19 nt, Homo sapiens
gaagaagaucacccuccuu

SEQ ID NO: 378854 - RNA, 19 nt, Homo sapiens
aaaccgaguuauucaucga

SEQ ID NO: 378855 - RNA, 19 nt, Homo sapiens
aagaucacccuccuuaaau

SEQ ID NO: 378856 - RNA, 19 nt, Homo sapiens
ggugacagccugcaguaca

SEQ ID NO: 378857 - RNA, 19 nt, Homo sapiens
ugggacuccuaauuacaua

SEQ ID NO: 378858 - RNA, 19 nt, Homo sapiens
caugagugcugcagugacu

SEQ ID NO: 378859 - RNA, 19 nt, Homo sapiens
ucaagaagaaugaauacag

SEQ ID NO: 378860 - RNA, 19 nt, Homo sapiens
cgaaaccgaguuauucauc

SEQ ID NO: 378861 - RNA, 19 nt, Homo sapiens
aaugacgaguucuuuacuu

SEQ ID NO: 378862 - RNA, 19 nt, Homo sapiens
ccgccucccucauccagaa

SEQ ID NO: 378863 - RNA, 19 nt, Homo sapiens
gaucacaccaagcucaucu

SEQ ID NO: 378864 - RNA, 19 nt, Homo sapiens
gccaagugcuucgagaucu

SEQ ID NO: 378865 - RNA, 19 nt, Homo sapiens
agaccuaccuccggaucaa

SEQ ID NO: 378866 - RNA, 19 nt, Homo sapiens
uccauuggguguaucaugu

SEQ ID NO: 378867 - RNA, 19 nt, Homo sapiens
caccgaaaccgaguuauuc

SEQ ID NO: 378868 - RNA, 19 nt, Homo sapiens
gcagcgugcagaucaacuu

SEQ ID NO: 378869 - RNA, 19 nt, Homo sapiens
gugacagccugcaguacau

SEQ ID NO: 378870 - RNA, 19 nt, Homo sapiens
gaauucggaacuguccuuu

SEQ ID NO: 378871 - RNA, 19 nt, Homo sapiens
guugcuguguaaguuauuu

SEQ ID NO: 378872 - RNA, 19 nt, Homo sapiens
gucucaaggccuccuaaua

SEQ ID NO: 378873 - RNA, 19 nt, Homo sapiens
ugagacuucuugccuaaaa

SEQ ID NO: 378874 - RNA, 19 nt, Homo sapiens
cauuggguguaucauguau

SEQ ID NO: 378875 - RNA, 19 nt, Homo sapiens
gagcgugacggcacugagu

SEQ ID NO: 378876 - RNA, 19 nt, Homo sapiens
caauaaaggcuuggagaac

SEQ ID NO: 378877 - RNA, 19 nt, Homo sapiens
gcuuaaugacgaguucuuu

SEQ ID NO: 378878 - RNA, 19 nt, Homo sapiens
ggcaaccaaagucgaauau

SEQ ID NO: 378879 - RNA, 19 nt, Homo sapiens
ugacagccugcaguacaua

SEQ ID NO: 378880 - RNA, 19 nt, Homo sapiens
ccauuggguguaucaugua

SEQ ID NO: 378881 - RNA, 19 nt, Homo sapiens
gugugggacuccuaauuac

SEQ ID NO: 378882 - RNA, 19 nt, Homo sapiens
cguaggauuccacggcuuu

SEQ ID NO: 378883 - RNA, 19 nt, Homo sapiens
agauguccauggaaauauc

SEQ ID NO: 378884 - RNA, 19 nt, Homo sapiens
ccaagugcuucgagaucuc

SEQ ID NO: 378885 - RNA, 19 nt, Homo sapiens
uggacuauucggacaagua

SEQ ID NO: 378886 - RNA, 19 nt, Homo sapiens
gcugcuuaaugacgaguuc

SEQ ID NO: 378887 - RNA, 19 nt, Homo sapiens
guccuuuccuuggcuuuau

SEQ ID NO: 378888 - RNA, 19 nt, Homo sapiens
uggcagccgugaccuacau

SEQ ID NO: 378889 - RNA, 19 nt, Homo sapiens
agaagaucacccuccuuaa

SEQ ID NO: 378890 - RNA, 19 nt, Homo sapiens
ugacucaacacgccucauc

SEQ ID NO: 378891 - RNA, 19 nt, Homo sapiens
gcaaccaaagucgaauaug

SEQ ID NO: 378892 - RNA, 19 nt, Homo sapiens
uggcaaccaaagucgaaua

SEQ ID NO: 378893 - RNA, 19 nt, Homo sapiens
caccagagggagaagaugu

SEQ ID NO: 378894 - RNA, 19 nt, Homo sapiens
ucaacuucuuccaggauca

SEQ ID NO: 378895 - RNA, 19 nt, Homo sapiens
uuacaugagcgagcacuug

SEQ ID NO: 378896 - RNA, 19 nt, Homo sapiens
cccucacaguccucaauaa

SEQ ID NO: 378897 - RNA, 19 nt, Homo sapiens
augacgaguucuuuacuuc

SEQ ID NO: 378898 - RNA, 19 nt, Homo sapiens
accauuaacgagcugcuua

SEQ ID NO: 378899 - RNA, 19 nt, Homo sapiens
ucauguauaccuuguuagu

SEQ ID NO: 378900 - RNA, 19 nt, Homo sapiens
cgccaagacuuccaauaaa

SEQ ID NO: 378901 - RNA, 19 nt, Homo sapiens
ggcagaaaguccaaaggaa

SEQ ID NO: 378902 - RNA, 19 nt, Homo sapiens
gaagaugccggugcaaguu

SEQ ID NO: 378903 - RNA, 19 nt, Homo sapiens
ccgccaagacuuccaauaa

SEQ ID NO: 378904 - RNA, 19 nt, Homo sapiens
gaucggaggccucgucauc

SEQ ID NO: 378905 - RNA, 19 nt, Homo sapiens
gccaagacuuccaauaaaa

SEQ ID NO: 378906 - RNA, 19 nt, Homo sapiens
aacacgacccguucacuua

SEQ ID NO: 378907 - RNA, 19 nt, Homo sapiens
ggccugagcgagcagaauu

SEQ ID NO: 378908 - RNA, 19 nt, Homo sapiens
cagaaaguccaaaggaaca

SEQ ID NO: 378909 - RNA, 19 nt, Homo sapiens
gggacaauggcgucucuug

SEQ ID NO: 378910 - RNA, 19 nt, Homo sapiens
ugaagaggagggaacuuuc

SEQ ID NO: 378911 - RNA, 19 nt, Homo sapiens
cagggacaauggcgucucu

SEQ ID NO: 378912 - RNA, 19 nt, Homo sapiens
cgccaagacuuccaauaaa

SEQ ID NO: 378913 - RNA, 19 nt, Homo sapiens
ggcagaaaguccaaaggaa

SEQ ID NO: 378914 - RNA, 19 nt, Homo sapiens
gaagaugccggugcaaguu

SEQ ID NO: 378915 - RNA, 19 nt, Homo sapiens
ccgccaagacuuccaauaa

SEQ ID NO: 378916 - RNA, 19 nt, Homo sapiens
gaucggaggccucgucauc

SEQ ID NO: 378917 - RNA, 19 nt, Homo sapiens
gggcacagcaggacguuug

SEQ ID NO: 378918 - RNA, 19 nt, Homo sapiens
gccaagacuuccaauaaaa

SEQ ID NO: 378919 - RNA, 19 nt, Homo sapiens
aacacgacccguucacuua

SEQ ID NO: 378920 - RNA, 19 nt, Homo sapiens
cagaaaguccaaaggaaca

SEQ ID NO: 378921 - RNA, 19 nt, Homo sapiens
gggacaauggcgucucuug

SEQ ID NO: 378922 - RNA, 19 nt, Homo sapiens
ugaagaggagggaacuuuc

SEQ ID NO: 378923 - RNA, 19 nt, Homo sapiens
ccaaugaccuagaagauaa

SEQ ID NO: 378924 - RNA, 19 nt, Homo sapiens
ggacagaccagcugaaauu

SEQ ID NO: 378925 - RNA, 19 nt, Homo sapiens
gcacugagccugcuuguug

SEQ ID NO: 378926 - RNA, 19 nt, Homo sapiens
gcaagcccguuaaauaauu

SEQ ID NO: 378927 - RNA, 19 nt, Homo sapiens
acaauaaacucgugacuug

SEQ ID NO: 378928 - RNA, 19 nt, Homo sapiens
aaacaguccuuucuacuau

SEQ ID NO: 378929 - RNA, 19 nt, Homo sapiens
gaaguguucagacaguuua

SEQ ID NO: 378930 - RNA, 19 nt, Homo sapiens
ggacgccaaugaccuagaa

SEQ ID NO: 378931 - RNA, 19 nt, Homo sapiens
gaagugagguuugcuuagg

SEQ ID NO: 378932 - RNA, 19 nt, Homo sapiens
ccugcaagcccguuaaaua

SEQ ID NO: 378933 - RNA, 19 nt, Homo sapiens
cccgagaccucacuuuauu

SEQ ID NO: 378934 - RNA, 19 nt, Homo sapiens
cauaugcaauuugggauuu

SEQ ID NO: 378935 - RNA, 19 nt, Homo sapiens
agaccucacuuuauuacaa

SEQ ID NO: 378936 - RNA, 19 nt, Homo sapiens
caugggaccucauaugcaa

SEQ ID NO: 378937 - RNA, 19 nt, Homo sapiens
aaacacaucaucuaaggaa

SEQ ID NO: 378938 - RNA, 19 nt, Homo sapiens
uaauaaggcaugcgaaaug

SEQ ID NO: 378939 - RNA, 19 nt, Homo sapiens
caagcagccuggagacuuc

SEQ ID NO: 378940 - RNA, 19 nt, Homo sapiens
cugcaagcccguuaaauaa

SEQ ID NO: 378941 - RNA, 19 nt, Homo sapiens
ccugagacaugaacccaaa

SEQ ID NO: 378942 - RNA, 19 nt, Homo sapiens
aacauacaaugaccacaua

SEQ ID NO: 378943 - RNA, 19 nt, Homo sapiens
ggaaguguucagacaguuu

SEQ ID NO: 378944 - RNA, 19 nt, Homo sapiens
gccaaugaccuagaagaua

SEQ ID NO: 378945 - RNA, 19 nt, Homo sapiens
ugugagaacuuccaacaag

SEQ ID NO: 378946 - RNA, 19 nt, Homo sapiens
ccuaugcuacccuuaauaa

SEQ ID NO: 378947 - RNA, 19 nt, Homo sapiens
gaccucauaugcaauuugg

SEQ ID NO: 378948 - RNA, 19 nt, Homo sapiens
gaggacagaccagcugaaa

SEQ ID NO: 378949 - RNA, 19 nt, Homo sapiens
gagccugcuuguugggaaa

SEQ ID NO: 378950 - RNA, 19 nt, Homo sapiens
uaacauacaaugaccacau

SEQ ID NO: 378951 - RNA, 19 nt, Homo sapiens
gauggaacacuggaacauu

SEQ ID NO: 378952 - RNA, 19 nt, Homo sapiens
acacagaggcuggcacuga

SEQ ID NO: 378953 - RNA, 19 nt, Homo sapiens
cguggcagcuucggauaaa

SEQ ID NO: 378954 - RNA, 19 nt, Homo sapiens
gaaaagaagugagguuugc

SEQ ID NO: 378955 - RNA, 19 nt, Homo sapiens
aaagagacccacaauaaac

SEQ ID NO: 378956 - RNA, 19 nt, Homo sapiens
caaaacacaucaucuaagg

SEQ ID NO: 378957 - RNA, 19 nt, Homo sapiens
caagcccguuaaauaauuc

SEQ ID NO: 378958 - RNA, 19 nt, Homo sapiens
gaccucacuuuauuacaag

SEQ ID NO: 378959 - RNA, 19 nt, Homo sapiens
gcucuaaccagauggaaca

SEQ ID NO: 378960 - RNA, 19 nt, Homo sapiens
caaagcugaugaggacaga

SEQ ID NO: 378961 - RNA, 19 nt, Homo sapiens
ugcgaaauguucucaugaa

SEQ ID NO: 378962 - RNA, 19 nt, Homo sapiens
guuaaauaauucccuaugc

SEQ ID NO: 378963 - RNA, 19 nt, Homo sapiens
aauaaggcaugcgaaaugu

SEQ ID NO: 378964 - RNA, 19 nt, Homo sapiens
ugauggaaguguucagaca

SEQ ID NO: 378965 - RNA, 19 nt, Homo sapiens
acaguccuuucuacuauga

SEQ ID NO: 378966 - RNA, 19 nt, Homo sapiens
aagaagugagguuugcuua

SEQ ID NO: 378967 - RNA, 19 nt, Homo sapiens
gcaauuugggauuuacuag

SEQ ID NO: 378968 - RNA, 19 nt, Homo sapiens
uaaggcaugcgaaauguuc

SEQ ID NO: 378969 - RNA, 19 nt, Homo sapiens
ccuaauaaggcaugcgaaa

SEQ ID NO: 378970 - RNA, 19 nt, Homo sapiens
ccgagaccucacuuuauua

SEQ ID NO: 378971 - RNA, 19 nt, Homo sapiens
guguucagacaguuuauaa

SEQ ID NO: 378972 - RNA, 19 nt, Homo sapiens
ggauuuacuaguagccaaa

SEQ ID NO: 378973 - RNA, 19 nt, Homo sapiens
ggaccucauaugcaauuug

SEQ ID NO: 378974 - RNA, 19 nt, Homo sapiens
ccuggagacuuccuaugug

SEQ ID NO: 378975 - RNA, 19 nt, Homo sapiens
gaaacuugaacuccaggau

SEQ ID NO: 378976 - RNA, 19 nt, Homo sapiens
uaugcuacccuuaauaaca

SEQ ID NO: 378977 - RNA, 19 nt, Homo sapiens
ccaagcagccuggagacuu

SEQ ID NO: 378978 - RNA, 19 nt, Homo sapiens
aaaagagacccacaauaaa

SEQ ID NO: 378979 - RNA, 19 nt, Homo sapiens
caagaucuuuccaaauacc

SEQ ID NO: 378980 - RNA, 19 nt, Homo sapiens
ccgcuaugauggaaguguu

SEQ ID NO: 378981 - RNA, 19 nt, Homo sapiens
auggaacacuggaacauuc

SEQ ID NO: 378982 - RNA, 19 nt, Homo sapiens
acaagaucuuuccaaauac

SEQ ID NO: 378983 - RNA, 19 nt, Homo sapiens
ggaaaagaagugagguuug

SEQ ID NO: 378984 - RNA, 19 nt, Homo sapiens
cuggagacuuccuaugugu

SEQ ID NO: 378985 - RNA, 19 nt, Homo sapiens
gccuggagacuuccuaugu

SEQ ID NO: 378986 - RNA, 19 nt, Homo sapiens
gcguggcagcuucggauaa

SEQ ID NO: 378987 - RNA, 19 nt, Homo sapiens
auacaaugaccacauagug

SEQ ID NO: 378988 - RNA, 19 nt, Homo sapiens
caaugaccuagaagauaaa

SEQ ID NO: 378989 - RNA, 19 nt, Homo sapiens
caacacgccuaaaacucaa

SEQ ID NO: 378990 - RNA, 19 nt, Homo sapiens
cuaauaaggcaugcgaaau

SEQ ID NO: 378991 - RNA, 19 nt, Homo sapiens
augcuacccuuaauaacau

SEQ ID NO: 378992 - RNA, 19 nt, Homo sapiens
ggaaaacugggacauagga

SEQ ID NO: 378993 - RNA, 19 nt, Homo sapiens
gacagaccagcugaaauug

SEQ ID NO: 378994 - RNA, 19 nt, Homo sapiens
cuccacaacugccagcaau

SEQ ID NO: 378995 - RNA, 19 nt, Homo sapiens
uacaaugaccacauagugu

SEQ ID NO: 378996 - RNA, 19 nt, Homo sapiens
aaagaagugagguuugcuu

SEQ ID NO: 378997 - RNA, 19 nt, Homo sapiens
aaaacaguccuuucuacua

SEQ ID NO: 378998 - RNA, 19 nt, Homo sapiens
ggcaaaacacaucaucuaa

SEQ ID NO: 378999 - RNA, 19 nt, Homo sapiens
aguggacccuggaccauuc

SEQ ID NO: 379000 - RNA, 19 nt, Homo sapiens
ccaaaaggaaugaaagaga

SEQ ID NO: 379001 - RNA, 19 nt, Homo sapiens
gcaaguuuggccagaaguc

SEQ ID NO: 379002 - RNA, 19 nt, Homo sapiens
cuuuccaaauacccaaaua

SEQ ID NO: 379003 - RNA, 19 nt, Homo sapiens
cgagaccucacuuuauuac

SEQ ID NO: 379004 - RNA, 19 nt, Homo sapiens
gcaaaacacaucaucuaag

SEQ ID NO: 379005 - RNA, 19 nt, Homo sapiens
cacaauaaacucgugacuu

SEQ ID NO: 379006 - RNA, 19 nt, Homo sapiens
caggaaaacugggacauag

SEQ ID NO: 379007 - RNA, 19 nt, Homo sapiens
ucauaugcaauuugggauu

SEQ ID NO: 379008 - RNA, 19 nt, Homo sapiens
ccuuguggcuugggacaug

SEQ ID NO: 379009 - RNA, 19 nt, Homo sapiens
gggcaucaucaucgucaug

SEQ ID NO: 379010 - RNA, 19 nt, Homo sapiens
ccaaugaccuagaagauaa

SEQ ID NO: 379011 - RNA, 19 nt, Homo sapiens
ggacagaccagcugaaauu

SEQ ID NO: 379012 - RNA, 19 nt, Homo sapiens
gcacugagccugcuuguug

SEQ ID NO: 379013 - RNA, 19 nt, Homo sapiens
gcaagcccguuaaauaauu

SEQ ID NO: 379014 - RNA, 19 nt, Homo sapiens
acaauaaacucgugacuug

SEQ ID NO: 379015 - RNA, 19 nt, Homo sapiens
aaacaguccuuucuacuau

SEQ ID NO: 379016 - RNA, 19 nt, Homo sapiens
gaaguguucagacaguuua

SEQ ID NO: 379017 - RNA, 19 nt, Homo sapiens
ggacgccaaugaccuagaa

SEQ ID NO: 379018 - RNA, 19 nt, Homo sapiens
gaagugagguuugcuuagg

SEQ ID NO: 379019 - RNA, 19 nt, Homo sapiens
ccugcaagcccguuaaaua

SEQ ID NO: 379020 - RNA, 19 nt, Homo sapiens
cccgagaccucacuuuauu

SEQ ID NO: 379021 - RNA, 19 nt, Homo sapiens
cauaugcaauuugggauuu

SEQ ID NO: 379022 - RNA, 19 nt, Homo sapiens
agaccucacuuuauuacaa

SEQ ID NO: 379023 - RNA, 19 nt, Homo sapiens
caugggaccucauaugcaa

SEQ ID NO: 379024 - RNA, 19 nt, Homo sapiens
aaacacaucaucuaaggaa

SEQ ID NO: 379025 - RNA, 19 nt, Homo sapiens
uaauaaggcaugcgaaaug

SEQ ID NO: 379026 - RNA, 19 nt, Homo sapiens
caagcagccuggagacuuc

SEQ ID NO: 379027 - RNA, 19 nt, Homo sapiens
cugcaagcccguuaaauaa

SEQ ID NO: 379028 - RNA, 19 nt, Homo sapiens
ccugagacaugaacccaaa

SEQ ID NO: 379029 - RNA, 19 nt, Homo sapiens
aacauacaaugaccacaua

SEQ ID NO: 379030 - RNA, 19 nt, Homo sapiens
ggaaguguucagacaguuu

SEQ ID NO: 379031 - RNA, 19 nt, Homo sapiens
gccaaugaccuagaagaua

SEQ ID NO: 379032 - RNA, 19 nt, Homo sapiens
ugugagaacuuccaacaag

SEQ ID NO: 379033 - RNA, 19 nt, Homo sapiens
ccuaugcuacccuuaauaa

SEQ ID NO: 379034 - RNA, 19 nt, Homo sapiens
gaccucauaugcaauuugg

SEQ ID NO: 379035 - RNA, 19 nt, Homo sapiens
gaggacagaccagcugaaa

SEQ ID NO: 379036 - RNA, 19 nt, Homo sapiens
gagccugcuuguugggaaa

SEQ ID NO: 379037 - RNA, 19 nt, Homo sapiens
uaacauacaaugaccacau

SEQ ID NO: 379038 - RNA, 19 nt, Homo sapiens
gauggaacacuggaacauu

SEQ ID NO: 379039 - RNA, 19 nt, Homo sapiens
acacagaggcuggcacuga

SEQ ID NO: 379040 - RNA, 19 nt, Homo sapiens
cguggcagcuucggauaaa

SEQ ID NO: 379041 - RNA, 19 nt, Homo sapiens
gaaaagaagugagguuugc

SEQ ID NO: 379042 - RNA, 19 nt, Homo sapiens
aaagagacccacaauaaac

SEQ ID NO: 379043 - RNA, 19 nt, Homo sapiens
caaaacacaucaucuaagg

SEQ ID NO: 379044 - RNA, 19 nt, Homo sapiens
caagcccguuaaauaauuc

SEQ ID NO: 379045 - RNA, 19 nt, Homo sapiens
gaccucacuuuauuacaag

SEQ ID NO: 379046 - RNA, 19 nt, Homo sapiens
gcucuaaccagauggaaca

SEQ ID NO: 379047 - RNA, 19 nt, Homo sapiens
caaagcugaugaggacaga

SEQ ID NO: 379048 - RNA, 19 nt, Homo sapiens
ugcgaaauguucucaugaa

SEQ ID NO: 379049 - RNA, 19 nt, Homo sapiens
guuaaauaauucccuaugc

SEQ ID NO: 379050 - RNA, 19 nt, Homo sapiens
aauaaggcaugcgaaaugu

SEQ ID NO: 379051 - RNA, 19 nt, Homo sapiens
ugauggaaguguucagaca

SEQ ID NO: 379052 - RNA, 19 nt, Homo sapiens
acaguccuuucuacuauga

SEQ ID NO: 379053 - RNA, 19 nt, Homo sapiens
aagaagugagguuugcuua

SEQ ID NO: 379054 - RNA, 19 nt, Homo sapiens
gcaauuugggauuuacuag

SEQ ID NO: 379055 - RNA, 19 nt, Homo sapiens
uaaggcaugcgaaauguuc

SEQ ID NO: 379056 - RNA, 19 nt, Homo sapiens
ccuaauaaggcaugcgaaa

SEQ ID NO: 379057 - RNA, 19 nt, Homo sapiens
ccgagaccucacuuuauua

SEQ ID NO: 379058 - RNA, 19 nt, Homo sapiens
guguucagacaguuuauaa

SEQ ID NO: 379059 - RNA, 19 nt, Homo sapiens
ggauuuacuaguagccaaa

SEQ ID NO: 379060 - RNA, 19 nt, Homo sapiens
ggaccucauaugcaauuug

SEQ ID NO: 379061 - RNA, 19 nt, Homo sapiens
ccuggagacuuccuaugug

SEQ ID NO: 379062 - RNA, 19 nt, Homo sapiens
gaaacuugaacuccaggau

SEQ ID NO: 379063 - RNA, 19 nt, Homo sapiens
uaugcuacccuuaauaaca

SEQ ID NO: 379064 - RNA, 19 nt, Homo sapiens
ccaagcagccuggagacuu

SEQ ID NO: 379065 - RNA, 19 nt, Homo sapiens
aaaagagacccacaauaaa

SEQ ID NO: 379066 - RNA, 19 nt, Homo sapiens
caagaucuuuccaaauacc

SEQ ID NO: 379067 - RNA, 19 nt, Homo sapiens
ccgcuaugauggaaguguu

SEQ ID NO: 379068 - RNA, 19 nt, Homo sapiens
auggaacacuggaacauuc

SEQ ID NO: 379069 - RNA, 19 nt, Homo sapiens
acaagaucuuuccaaauac

SEQ ID NO: 379070 - RNA, 19 nt, Homo sapiens
ggaaaagaagugagguuug

SEQ ID NO: 379071 - RNA, 19 nt, Homo sapiens
cuggagacuuccuaugugu

SEQ ID NO: 379072 - RNA, 19 nt, Homo sapiens
gccuggagacuuccuaugu

SEQ ID NO: 379073 - RNA, 19 nt, Homo sapiens
gcguggcagcuucggauaa

SEQ ID NO: 379074 - RNA, 19 nt, Homo sapiens
auacaaugaccacauagug

SEQ ID NO: 379075 - RNA, 19 nt, Homo sapiens
ccacacaggcccgaguuuc

SEQ ID NO: 379076 - RNA, 19 nt, Homo sapiens
caaugaccuagaagauaaa

SEQ ID NO: 379077 - RNA, 19 nt, Homo sapiens
caacacgccuaaaacucaa

SEQ ID NO: 379078 - RNA, 19 nt, Homo sapiens
cuaauaaggcaugcgaaau

SEQ ID NO: 379079 - RNA, 19 nt, Homo sapiens
augcuacccuuaauaacau

SEQ ID NO: 379080 - RNA, 19 nt, Homo sapiens
ggaaaacugggacauagga

SEQ ID NO: 379081 - RNA, 19 nt, Homo sapiens
gacagaccagcugaaauug

SEQ ID NO: 379082 - RNA, 19 nt, Homo sapiens
cuccacaacugccagcaau

SEQ ID NO: 379083 - RNA, 19 nt, Homo sapiens
uacaaugaccacauagugu

SEQ ID NO: 379084 - RNA, 19 nt, Homo sapiens
aaagaagugagguuugcuu

SEQ ID NO: 379085 - RNA, 19 nt, Homo sapiens
ggcaaaacacaucaucuaa

SEQ ID NO: 379086 - RNA, 19 nt, Homo sapiens
aguggacccuggaccauuc

SEQ ID NO: 379087 - RNA, 19 nt, Homo sapiens
ccaaaaggaaugaaagaga

SEQ ID NO: 379088 - RNA, 19 nt, Homo sapiens
gcaaguuuggccagaaguc

SEQ ID NO: 379089 - RNA, 19 nt, Homo sapiens
aaaacaguccuuucuacua

SEQ ID NO: 379090 - RNA, 19 nt, Homo sapiens
cuuuccaaauacccaaaua

SEQ ID NO: 379091 - RNA, 19 nt, Homo sapiens
cgagaccucacuuuauuac

SEQ ID NO: 379092 - RNA, 19 nt, Homo sapiens
gcaaaacacaucaucuaag

SEQ ID NO: 379093 - RNA, 19 nt, Homo sapiens
cacaauaaacucgugacuu

SEQ ID NO: 379094 - RNA, 19 nt, Homo sapiens
caggaaaacugggacauag

SEQ ID NO: 379095 - RNA, 19 nt, Homo sapiens
ucauaugcaauuugggauu

SEQ ID NO: 379096 - RNA, 19 nt, Homo sapiens
ccuuguggcuugggacaug

SEQ ID NO: 379097 - RNA, 19 nt, Homo sapiens
gggcaucaucaucgucaug

SEQ ID NO: 379098 - RNA, 19 nt, Homo sapiens
caacauggcucacaaauuu

SEQ ID NO: 379099 - RNA, 19 nt, Homo sapiens
ugaauucucucuccaaaua

SEQ ID NO: 379100 - RNA, 19 nt, Homo sapiens
gaugagaacuggugguuaa

SEQ ID NO: 379101 - RNA, 19 nt, Homo sapiens
ccauaaaccuuacugauaa

SEQ ID NO: 379102 - RNA, 19 nt, Homo sapiens
ccucacaucuguuaucuua

SEQ ID NO: 379103 - RNA, 19 nt, Homo sapiens
gccauacucuuacauaaua

SEQ ID NO: 379104 - RNA, 19 nt, Homo sapiens
gaagacaguuaucucauau

SEQ ID NO: 379105 - RNA, 19 nt, Homo sapiens
caauuucugucucaucuua

SEQ ID NO: 379106 - RNA, 19 nt, Homo sapiens
caugaaaccuuaagacuuc

SEQ ID NO: 379107 - RNA, 19 nt, Homo sapiens
gagaacuggugguuaauau

SEQ ID NO: 379108 - RNA, 19 nt, Homo sapiens
agaagacaguuaucucaua

SEQ ID NO: 379109 - RNA, 19 nt, Homo sapiens
ugaaaugccucaacaagca

SEQ ID NO: 379110 - RNA, 19 nt, Homo sapiens
gaacuggugguuaauaugu

SEQ ID NO: 379111 - RNA, 19 nt, Homo sapiens
gugaaaaggucaagauuaa

SEQ ID NO: 379112 - RNA, 19 nt, Homo sapiens
agaagagccucaaccauug

SEQ ID NO: 379113 - RNA, 19 nt, Homo sapiens
acaauacucuauacuguga

SEQ ID NO: 379114 - RNA, 19 nt, Homo sapiens
ccuuaagacuucagaauga

SEQ ID NO: 379115 - RNA, 19 nt, Homo sapiens
gaagaugaagaguuuaguu

SEQ ID NO: 379116 - RNA, 19 nt, Homo sapiens
ucacagaauucuaguacau

SEQ ID NO: 379117 - RNA, 19 nt, Homo sapiens
acacaauacucuauacugu

SEQ ID NO: 379118 - RNA, 19 nt, Homo sapiens
caacagaaucuaaucuuca

SEQ ID NO: 379119 - RNA, 19 nt, Homo sapiens
acagaccacuuccugagua

SEQ ID NO: 379120 - RNA, 19 nt, Homo sapiens
aagaagagccucaaccauu

SEQ ID NO: 379121 - RNA, 19 nt, Homo sapiens
acaguuaucucauauuugg

SEQ ID NO: 379122 - RNA, 19 nt, Homo sapiens
gacauaugaucaacagaug

SEQ ID NO: 379123 - RNA, 19 nt, Homo sapiens
cuuguuggcccaucuauua

SEQ ID NO: 379124 - RNA, 19 nt, Homo sapiens
ugaauuaucugagcuagag

SEQ ID NO: 379125 - RNA, 19 nt, Homo sapiens
acagugagauuagucauau

SEQ ID NO: 379126 - RNA, 19 nt, Homo sapiens
aaacugcacugccaacaag

SEQ ID NO: 379127 - RNA, 19 nt, Homo sapiens
ucuaguacauguagguaaa

SEQ ID NO: 379128 - RNA, 19 nt, Homo sapiens
gcuacaaccucuagaucug

SEQ ID NO: 379129 - RNA, 19 nt, Homo sapiens
uaauaugucucuugcugau

SEQ ID NO: 379130 - RNA, 19 nt, Homo sapiens
uaagacauaugaucaacag

SEQ ID NO: 379131 - RNA, 19 nt, Homo sapiens
ugacuccucacaucuguua

SEQ ID NO: 379132 - RNA, 19 nt, Homo sapiens
uaugaauucucucuccaaa

SEQ ID NO: 379133 - RNA, 19 nt, Homo sapiens
ccauauguauucaucuguu

SEQ ID NO: 379134 - RNA, 19 nt, Homo sapiens
cuauugaccauaaaccuua

SEQ ID NO: 379135 - RNA, 19 nt, Homo sapiens
guauucaucuguuggaucu

SEQ ID NO: 379136 - RNA, 19 nt, Homo sapiens
gaacuuguuggcccaucua

SEQ ID NO: 379137 - RNA, 19 nt, Homo sapiens
cagcuaaacacccguaaga

SEQ ID NO: 379138 - RNA, 19 nt, Homo sapiens
gacagugagauuagucaua

SEQ ID NO: 379139 - RNA, 19 nt, Homo sapiens
gaaaaggucaagauuaaga

SEQ ID NO: 379140 - RNA, 19 nt, Homo sapiens
cguaagacuucauacaaca

SEQ ID NO: 379141 - RNA, 19 nt, Homo sapiens
ucgcucagcuauaagaaga

SEQ ID NO: 379142 - RNA, 19 nt, Homo sapiens
gcccaucuauuacaucuac

SEQ ID NO: 379143 - RNA, 19 nt, Homo sapiens
uuaccuagcuuaccauacu

SEQ ID NO: 379144 - RNA, 19 nt, Homo sapiens
ucaccaaguaucaaaguaa

SEQ ID NO: 379145 - RNA, 19 nt, Homo sapiens
ucagaaaacuccccagcua

SEQ ID NO: 379146 - RNA, 19 nt, Homo sapiens
gcuacagaaucuauuuauc

SEQ ID NO: 379147 - RNA, 19 nt, Homo sapiens
accauaaaccuuacugaua

SEQ ID NO: 379148 - RNA, 19 nt, Homo sapiens
acaacagaaucuaaucuuc

SEQ ID NO: 379149 - RNA, 19 nt, Homo sapiens
caccaaguaucaaaguaau

SEQ ID NO: 379150 - RNA, 19 nt, Homo sapiens
aaagaagacaguuaucuca

SEQ ID NO: 379151 - RNA, 19 nt, Homo sapiens
cauauguauucaucuguug

SEQ ID NO: 379152 - RNA, 19 nt, Homo sapiens
cuaaacacccguaagacuu

SEQ ID NO: 379153 - RNA, 19 nt, Homo sapiens
guucuaagacauaugauca

SEQ ID NO: 379154 - RNA, 19 nt, Homo sapiens
gaccauaaaccuuacugau

SEQ ID NO: 379155 - RNA, 19 nt, Homo sapiens
aggucaagauuaagacuaa

SEQ ID NO: 379156 - RNA, 19 nt, Homo sapiens
acagaauucuaguacaugu

SEQ ID NO: 379157 - RNA, 19 nt, Homo sapiens
uaaaagauuuccagugaca

SEQ ID NO: 379158 - RNA, 19 nt, Homo sapiens
ugagaacuggugguuaaua

SEQ ID NO: 379159 - RNA, 19 nt, Homo sapiens
gaucaacagaugagaacug

SEQ ID NO: 379160 - RNA, 19 nt, Homo sapiens
guaacuaucagaaucuaca

SEQ ID NO: 379161 - RNA, 19 nt, Homo sapiens
ggucaagauuaagacuaaa

SEQ ID NO: 379162 - RNA, 19 nt, Homo sapiens
ugucucaucuuaauauguc

SEQ ID NO: 379163 - RNA, 19 nt, Homo sapiens
caauaaaguaagcuagaga

SEQ ID NO: 379164 - RNA, 19 nt, Homo sapiens
gaccacuuccugaguagaa

SEQ ID NO: 379165 - RNA, 19 nt, Homo sapiens
agccuacuauugaccauaa

SEQ ID NO: 379166 - RNA, 19 nt, Homo sapiens
ucaugaaaccuuaagacuu

SEQ ID NO: 379167 - RNA, 19 nt, Homo sapiens
uuggaaucaugaaaccuua

SEQ ID NO: 379168 - RNA, 19 nt, Homo sapiens
cuauaucuuuggaaucaug

SEQ ID NO: 379169 - RNA, 19 nt, Homo sapiens
ucaacauggcucacaaauu

SEQ ID NO: 379170 - RNA, 19 nt, Homo sapiens
caucuuaauaugucucuug

SEQ ID NO: 379171 - RNA, 19 nt, Homo sapiens
gaaaguccaauaccucacu

SEQ ID NO: 379172 - RNA, 19 nt, Homo sapiens
agaguuaccuagcuuacca

SEQ ID NO: 379173 - RNA, 19 nt, Homo sapiens
uaaacacccguaagacuuc

SEQ ID NO: 379174 - RNA, 19 nt, Homo sapiens
gcuaaacacccguaagacu

SEQ ID NO: 379175 - RNA, 19 nt, Homo sapiens
ggccauacucuuacauaau

SEQ ID NO: 379176 - RNA, 19 nt, Homo sapiens
aggccauacucuuacauaa

SEQ ID NO: 379177 - RNA, 19 nt, Homo sapiens
guuaccauauguauucauc

SEQ ID NO: 379178 - RNA, 19 nt, Homo sapiens
uagcuuaccauacuauauc

SEQ ID NO: 379179 - RNA, 19 nt, Homo sapiens
uucugaagaugaagaguuu

SEQ ID NO: 379180 - RNA, 19 nt, Homo sapiens
cucacucgcucagcuauaa

SEQ ID NO: 379181 - RNA, 19 nt, Homo sapiens
agacauaugaucaacagau

SEQ ID NO: 379182 - RNA, 19 nt, Homo sapiens
guacauguagguaaaucau

SEQ ID NO: 379183 - RNA, 19 nt, Homo sapiens
uuucaggucuucaccaagu

SEQ ID NO: 379184 - RNA, 19 nt, Homo sapiens
uaccauauguauucaucug

SEQ ID NO: 379185 - RNA, 19 nt, Homo sapiens
gcaaaaucuuaacuaccua

SEQ ID NO: 379186 - RNA, 19 nt, Homo sapiens
cagcugacccuugaacaug

SEQ ID NO: 379187 - RNA, 19 nt, Homo sapiens
gacuucauacaacacaaua

SEQ ID NO: 379188 - RNA, 19 nt, Homo sapiens
gucaaaagcuacagaaucu

SEQ ID NO: 379189 - RNA, 19 nt, Homo sapiens
gaauucucucuccaaauau

SEQ ID NO: 379190 - RNA, 19 nt, Homo sapiens
uaucugagcuagaguuacc

SEQ ID NO: 379191 - RNA, 19 nt, Homo sapiens
ucucugaaguucugcuaca

SEQ ID NO: 379192 - RNA, 19 nt, Homo sapiens
acaauaaaguaagcuagag

SEQ ID NO: 379193 - RNA, 19 nt, Homo sapiens
cugcugguaucauggagaa

SEQ ID NO: 379194 - RNA, 19 nt, Homo sapiens
aaagauuuccagugacaga

SEQ ID NO: 379195 - RNA, 19 nt, Homo sapiens
ggaaucaugaaaccuuaag

SEQ ID NO: 379196 - RNA, 19 nt, Homo sapiens
gagaaucaaguauggaaaa

SEQ ID NO: 379197 - RNA, 19 nt, Homo sapiens
acaacacaauacucuauac

SEQ ID NO: 379198 - RNA, 19 nt, Homo sapiens
ucaaagagauucaaagaga

SEQ ID NO: 379199 - RNA, 19 nt, Homo sapiens
gaagaaagcucuggagaag

SEQ ID NO: 379200 - RNA, 19 nt, Homo sapiens
gggaggcucugaccauuua

SEQ ID NO: 379201 - RNA, 19 nt, Homo sapiens
cgaggaaccuggccuauga

SEQ ID NO: 379202 - RNA, 19 nt, Homo sapiens
ccauaucggucccguauuu

SEQ ID NO: 379203 - RNA, 19 nt, Homo sapiens
gauaagguccuguuucauu

SEQ ID NO: 379204 - RNA, 19 nt, Homo sapiens
acaaauuccugcuggagua

SEQ ID NO: 379205 - RNA, 19 nt, Homo sapiens
ggaaugugcccuauauuuc

SEQ ID NO: 379206 - RNA, 19 nt, Homo sapiens
gaacagcccacgccguuug

SEQ ID NO: 379207 - RNA, 19 nt, Homo sapiens
ggacagaccgucagaaacu

SEQ ID NO: 379208 - RNA, 19 nt, Homo sapiens
agaaguacauccaccagaa

SEQ ID NO: 379209 - RNA, 19 nt, Homo sapiens
gaaugugcccuauauuuca

SEQ ID NO: 379210 - RNA, 19 nt, Homo sapiens
caaggaggaucuggucauu

SEQ ID NO: 379211 - RNA, 19 nt, Homo sapiens
ugaacuaccugggcaacua

SEQ ID NO: 379212 - RNA, 19 nt, Homo sapiens
caaagagauucaaagagau

SEQ ID NO: 379213 - RNA, 19 nt, Homo sapiens
gaccaccgcugccguaucu

SEQ ID NO: 379214 - RNA, 19 nt, Homo sapiens
agaaagcucuggagaagca

SEQ ID NO: 379215 - RNA, 19 nt, Homo sapiens
ucuuggaccuuucuucuuu

SEQ ID NO: 379216 - RNA, 19 nt, Homo sapiens
cagaaacacaugcgacuuu

SEQ ID NO: 379217 - RNA, 19 nt, Homo sapiens
gcgcucagcucaguucuuc

SEQ ID NO: 379218 - RNA, 19 nt, Homo sapiens
auaagguccuguuucauuu

SEQ ID NO: 379219 - RNA, 19 nt, Homo sapiens
cuggagaguuucuauuaaa

SEQ ID NO: 379220 - RNA, 19 nt, Homo sapiens
gagcgggaguggcacaaau

SEQ ID NO: 379221 - RNA, 19 nt, Homo sapiens
gagacaccauucacuuuua

SEQ ID NO: 379222 - RNA, 19 nt, Homo sapiens
gagaacgugccgacuauug

SEQ ID NO: 379223 - RNA, 19 nt, Homo sapiens
gcccggaugucuauugguu

SEQ ID NO: 379224 - RNA, 19 nt, Homo sapiens
gagaguuucuauuaaaggu

SEQ ID NO: 379225 - RNA, 19 nt, Homo sapiens
cuucgucgaucccuaauug

SEQ ID NO: 379226 - RNA, 19 nt, Homo sapiens
cuggacgacucacgcauua

SEQ ID NO: 379227 - RNA, 19 nt, Homo sapiens
agagggagcagaucaauau

SEQ ID NO: 379228 - RNA, 19 nt, Homo sapiens
gagcugcaguccucagauc

SEQ ID NO: 379229 - RNA, 19 nt, Homo sapiens
cccgggagcuccugaagaa

SEQ ID NO: 379230 - RNA, 19 nt, Homo sapiens
gagaagagggagcagauca

SEQ ID NO: 379231 - RNA, 19 nt, Homo sapiens
caugaugccuccaccuuca

SEQ ID NO: 379232 - RNA, 19 nt, Homo sapiens
caucugcucucccuagaca

SEQ ID NO: 379233 - RNA, 19 nt, Homo sapiens
gagaaccucuugggagaca

SEQ ID NO: 379234 - RNA, 19 nt, Homo sapiens
caaccugucuuccugaaaa

SEQ ID NO: 379235 - RNA, 19 nt, Homo sapiens
caccagaacuacaccaaag

SEQ ID NO: 379236 - RNA, 19 nt, Homo sapiens
gcagcaggauguguucaug

SEQ ID NO: 379237 - RNA, 19 nt, Homo sapiens
uggaaugugcccuauauuu

SEQ ID NO: 379238 - RNA, 19 nt, Homo sapiens
ucuggaaugugcccuauau

SEQ ID NO: 379239 - RNA, 19 nt, Homo sapiens
gggagcuccugaagaaguu

SEQ ID NO: 379240 - RNA, 19 nt, Homo sapiens
gggugagacuugagcagaa

SEQ ID NO: 379241 - RNA, 19 nt, Homo sapiens
ugaagaaagcucuggagaa

SEQ ID NO: 379242 - RNA, 19 nt, Homo sapiens
ggacuggaauguggagaag

SEQ ID NO: 379243 - RNA, 19 nt, Homo sapiens
gguguaguucucacucuua

SEQ ID NO: 379244 - RNA, 19 nt, Homo sapiens
gguaaagacaccuggauca

SEQ ID NO: 379245 - RNA, 19 nt, Homo sapiens
cuauugacauccacaugaa

SEQ ID NO: 379246 - RNA, 19 nt, Homo sapiens
uugauaagguccuguuuca

SEQ ID NO: 379247 - RNA, 19 nt, Homo sapiens
gaagagggagcagaucaau

SEQ ID NO: 379248 - RNA, 19 nt, Homo sapiens
gcuaugacgugcuguuugc

SEQ ID NO: 379249 - RNA, 19 nt, Homo sapiens
ccuccuggcuguugacuuc

SEQ ID NO: 379250 - RNA, 19 nt, Homo sapiens
uuucauuucucgugacauu

SEQ ID NO: 379251 - RNA, 19 nt, Homo sapiens
gaaugaggauccuguuuuc

SEQ ID NO: 379252 - RNA, 19 nt, Homo sapiens
ccacccaccugcacaacga

SEQ ID NO: 379253 - RNA, 19 nt, Homo sapiens
cuaaggagaccgagggauu

SEQ ID NO: 379254 - RNA, 19 nt, Homo sapiens
ugaaccagaucggcuuuga

SEQ ID NO: 379255 - RNA, 19 nt, Homo sapiens
uggaggagauggagcacuu

SEQ ID NO: 379256 - RNA, 19 nt, Homo sapiens
ggaaggagaaguacaucca

SEQ ID NO: 379257 - RNA, 19 nt, Homo sapiens
cagugcagauggcuacuau

SEQ ID NO: 379258 - RNA, 19 nt, Homo sapiens
ggucccguauuucacauug

SEQ ID NO: 379259 - RNA, 19 nt, Homo sapiens
acuggagaguuucuauuaa

SEQ ID NO: 379260 - RNA, 19 nt, Homo sapiens
uaaagacaccuggaucaga

SEQ ID NO: 379261 - RNA, 19 nt, Homo sapiens
gaucuggucauucucuuca

SEQ ID NO: 379262 - RNA, 19 nt, Homo sapiens
cagggaggcucugaccauu

SEQ ID NO: 379263 - RNA, 19 nt, Homo sapiens
ggagguggccugugaugag

SEQ ID NO: 379264 - RNA, 19 nt, Homo sapiens
gucauucucuucacagaca

SEQ ID NO: 379265 - RNA, 19 nt, Homo sapiens
aaauguagguguaguucuc

SEQ ID NO: 379266 - RNA, 19 nt, Homo sapiens
gcacacccuuggccaucug

SEQ ID NO: 379267 - RNA, 19 nt, Homo sapiens
gcgaguaccagucugugaa

SEQ ID NO: 379268 - RNA, 19 nt, Homo sapiens
gcucagcucaguucuucaa

SEQ ID NO: 379269 - RNA, 19 nt, Homo sapiens
gggauuccgucgcuucaag

SEQ ID NO: 379270 - RNA, 19 nt, Homo sapiens
gcuguugacuucccauugc

SEQ ID NO: 379271 - RNA, 19 nt, Homo sapiens
gaccgcagcugcaccuacu

SEQ ID NO: 379272 - RNA, 19 nt, Homo sapiens
ggagaagcacgcagacaag

SEQ ID NO: 379273 - RNA, 19 nt, Homo sapiens
ggccggaacacaccuuuau

SEQ ID NO: 379274 - RNA, 19 nt, Homo sapiens
acgagaacgugccgacuau

SEQ ID NO: 379275 - RNA, 19 nt, Homo sapiens
cagcugcaccuacuacuuc

SEQ ID NO: 379276 - RNA, 19 nt, Homo sapiens
ggacuacguggacauugug

SEQ ID NO: 379277 - RNA, 19 nt, Homo sapiens
ggagacaccauucacuuuu

SEQ ID NO: 379278 - RNA, 19 nt, Homo sapiens
ucugggagguguucagcaa

SEQ ID NO: 379279 - RNA, 19 nt, Homo sapiens
gcaguccucagaucucuuc

SEQ ID NO: 379280 - RNA, 19 nt, Homo sapiens
cuggaggcuucaucgguua

SEQ ID NO: 379281 - RNA, 19 nt, Homo sapiens
gcaggcuggagaccaagua

SEQ ID NO: 379282 - RNA, 19 nt, Homo sapiens
aggaggaucuggucauucu

SEQ ID NO: 379283 - RNA, 19 nt, Homo sapiens
ggagugacagguccacaca

SEQ ID NO: 379284 - RNA, 19 nt, Homo sapiens
ggagccagguggucuucuc

SEQ ID NO: 379285 - RNA, 19 nt, Homo sapiens
gaaccucuugggagacaga

SEQ ID NO: 379286 - RNA, 19 nt, Homo sapiens
gaggagauggagcacuuug

SEQ ID NO: 379287 - RNA, 19 nt, Homo sapiens
aggcucagguggaagaguu

SEQ ID NO: 379288 - RNA, 19 nt, Homo sapiens
gggagcagaucaauaucac

SEQ ID NO: 379289 - RNA, 19 nt, Homo sapiens
ggccuucugugccaacauc

SEQ ID NO: 379290 - RNA, 19 nt, Homo sapiens
gcagcugcaccuacuacuu

SEQ ID NO: 379291 - RNA, 19 nt, Homo sapiens
gaacuaccugggcaacuac

SEQ ID NO: 379292 - RNA, 19 nt, Homo sapiens
uagaaugaggauccuguuu

SEQ ID NO: 379293 - RNA, 19 nt, Homo sapiens
gcaccagggacuucugcuu

SEQ ID NO: 379294 - RNA, 19 nt, Homo sapiens
uggagacaccauucacuuu

SEQ ID NO: 379295 - RNA, 19 nt, Homo sapiens
ccaucaacaucgcccugaa

SEQ ID NO: 379296 - RNA, 19 nt, Homo sapiens
agaacgugccgacuauuga

SEQ ID NO: 379297 - RNA, 19 nt, Homo sapiens
gcaccacccaccugcacaa

SEQ ID NO: 379298 - RNA, 19 nt, Homo sapiens
gauaauggcugcacucuuu

SEQ ID NO: 379299 - RNA, 19 nt, Homo sapiens
gaucauugcuccucuugua

SEQ ID NO: 379300 - RNA, 19 nt, Homo sapiens
ggaaagcugugguccaauu

SEQ ID NO: 379301 - RNA, 19 nt, Homo sapiens
gaacacgucuuugaaguug

SEQ ID NO: 379302 - RNA, 19 nt, Homo sapiens
gaucagagaugaaugaaag

SEQ ID NO: 379303 - RNA, 19 nt, Homo sapiens
gaaacuauguacccaauuc

SEQ ID NO: 379304 - RNA, 19 nt, Homo sapiens
gggaaacgcuaucugaauu

SEQ ID NO: 379305 - RNA, 19 nt, Homo sapiens
gaagaugagaggaauauuu

SEQ ID NO: 379306 - RNA, 19 nt, Homo sapiens
aaacacagauugaagaaga

SEQ ID NO: 379307 - RNA, 19 nt, Homo sapiens
ggucuuauuuacaguguua

SEQ ID NO: 379308 - RNA, 19 nt, Homo sapiens
gaaagacacuccgaucaga

SEQ ID NO: 379309 - RNA, 19 nt, Homo sapiens
ccauaaacauugcacuuaa

SEQ ID NO: 379310 - RNA, 19 nt, Homo sapiens
gauuugcacuacugaauuu

SEQ ID NO: 379311 - RNA, 19 nt, Homo sapiens
gggaggugguugcaaauuu

SEQ ID NO: 379312 - RNA, 19 nt, Homo sapiens
caugaugcuucuacauuua

SEQ ID NO: 379313 - RNA, 19 nt, Homo sapiens
aaauggagcuguagaugaa

SEQ ID NO: 379314 - RNA, 19 nt, Homo sapiens
caaguguccuuaagucaaa

SEQ ID NO: 379315 - RNA, 19 nt, Homo sapiens
gggaacacacaaagaauua

SEQ ID NO: 379316 - RNA, 19 nt, Homo sapiens
gaccuuaaauggagcugua

SEQ ID NO: 379317 - RNA, 19 nt, Homo sapiens
gcagacaaguauccuguug

SEQ ID NO: 379318 - RNA, 19 nt, Homo sapiens
gaaauggacccaccaagau

SEQ ID NO: 379319 - RNA, 19 nt, Homo sapiens
ggaaauggacccaccaaga

SEQ ID NO: 379320 - RNA, 19 nt, Homo sapiens
ugaaugcuuugaugucaua

SEQ ID NO: 379321 - RNA, 19 nt, Homo sapiens
uagaggaaauguagacaaa

SEQ ID NO: 379322 - RNA, 19 nt, Homo sapiens
gaagggauuugcacuacug

SEQ ID NO: 379323 - RNA, 19 nt, Homo sapiens
ugaaagaagucauggaaca

SEQ ID NO: 379324 - RNA, 19 nt, Homo sapiens
uauguuaacuucccucuau

SEQ ID NO: 379325 - RNA, 19 nt, Homo sapiens
gcaacuaaguauuucugaa

SEQ ID NO: 379326 - RNA, 19 nt, Homo sapiens
gagagguggugauggaauu

SEQ ID NO: 379327 - RNA, 19 nt, Homo sapiens
gcaaauuucuaagguacaa

SEQ ID NO: 379328 - RNA, 19 nt, Homo sapiens
cgacuugucugcaguagau

SEQ ID NO: 379329 - RNA, 19 nt, Homo sapiens
ggaggugguugcaaauuuc

SEQ ID NO: 379330 - RNA, 19 nt, Homo sapiens
ucaugaugcuucuacauuu

SEQ ID NO: 379331 - RNA, 19 nt, Homo sapiens
uaaacuggauccugauaug

SEQ ID NO: 379332 - RNA, 19 nt, Homo sapiens
gaucagcucuuuuacacua

SEQ ID NO: 379333 - RNA, 19 nt, Homo sapiens
ggugauggaauuaauagua

SEQ ID NO: 379334 - RNA, 19 nt, Homo sapiens
gaaggucuuugcaggcuau

SEQ ID NO: 379335 - RNA, 19 nt, Homo sapiens
ccaccaagauucuccugaa

SEQ ID NO: 379336 - RNA, 19 nt, Homo sapiens
uuacauugauccacugaaa

SEQ ID NO: 379337 - RNA, 19 nt, Homo sapiens
gaaacgcuaucugaauuca

SEQ ID NO: 379338 - RNA, 19 nt, Homo sapiens
gagaugaguagugcauuua

SEQ ID NO: 379339 - RNA, 19 nt, Homo sapiens
ugagaugaguagugcauuu

SEQ ID NO: 379340 - RNA, 19 nt, Homo sapiens
cagaacaacuucacuuugg

SEQ ID NO: 379341 - RNA, 19 nt, Homo sapiens
ucagggaggugguugcaaa

SEQ ID NO: 379342 - RNA, 19 nt, Homo sapiens
gcuucuacauuuaccauaa

SEQ ID NO: 379343 - RNA, 19 nt, Homo sapiens
gaacaaaacagaaagauca

SEQ ID NO: 379344 - RNA, 19 nt, Homo sapiens
ggaacacuaugcugaucaa

SEQ ID NO: 379345 - RNA, 19 nt, Homo sapiens
gcagucagccaaauauuuc

SEQ ID NO: 379346 - RNA, 19 nt, Homo sapiens
gauucuaacugauuguaug

SEQ ID NO: 379347 - RNA, 19 nt, Homo sapiens
gaauucaggaggauuuauu

SEQ ID NO: 379348 - RNA, 19 nt, Homo sapiens
uaagggaacacacaaagaa

SEQ ID NO: 379349 - RNA, 19 nt, Homo sapiens
gauaaacuggauccugaua

SEQ ID NO: 379350 - RNA, 19 nt, Homo sapiens
caacagaacaacuucacuu

SEQ ID NO: 379351 - RNA, 19 nt, Homo sapiens
uaacgugggagaagacuuu

SEQ ID NO: 379352 - RNA, 19 nt, Homo sapiens
ggaguucauugcaccaguu

SEQ ID NO: 379353 - RNA, 19 nt, Homo sapiens
ugacaaauccaaggacuuu

SEQ ID NO: 379354 - RNA, 19 nt, Homo sapiens
ugauaaagcuaagcaugaa

SEQ ID NO: 379355 - RNA, 19 nt, Homo sapiens
gaugaguagugcauuuaau

SEQ ID NO: 379356 - RNA, 19 nt, Homo sapiens
gcaaguguccuuaagucaa

SEQ ID NO: 379357 - RNA, 19 nt, Homo sapiens
gcaaguugaucuggagaau

SEQ ID NO: 379358 - RNA, 19 nt, Homo sapiens
gaauuuggaaggcuauuau

SEQ ID NO: 379359 - RNA, 19 nt, Homo sapiens
ccgaaaugcuagagaaaug

SEQ ID NO: 379360 - RNA, 19 nt, Homo sapiens
cauguuuacugaaugcuuu

SEQ ID NO: 379361 - RNA, 19 nt, Homo sapiens
acacuaugcugaucaagau

SEQ ID NO: 379362 - RNA, 19 nt, Homo sapiens
gaucagcaaguguccuuaa

SEQ ID NO: 379363 - RNA, 19 nt, Homo sapiens
gcagguauuagauuuagaa

SEQ ID NO: 379364 - RNA, 19 nt, Homo sapiens
gagaagaugagaggaauau

SEQ ID NO: 379365 - RNA, 19 nt, Homo sapiens
agucauaacuguagcaaca

SEQ ID NO: 379366 - RNA, 19 nt, Homo sapiens
gaaaaugucccaacugaug

SEQ ID NO: 379367 - RNA, 19 nt, Homo sapiens
gaaagcugugguccaauuu

SEQ ID NO: 379368 - RNA, 19 nt, Homo sapiens
uaaauggagcuguagauga

SEQ ID NO: 379369 - RNA, 19 nt, Homo sapiens
gaauagaguaggaguaugg

SEQ ID NO: 379370 - RNA, 19 nt, Homo sapiens
ggccagaaagugagauuaa

SEQ ID NO: 379371 - RNA, 19 nt, Homo sapiens
gauuguaugcaacuaagua

SEQ ID NO: 379372 - RNA, 19 nt, Homo sapiens
gcagugucauuuauagauc

SEQ ID NO: 379373 - RNA, 19 nt, Homo sapiens
gcuauuauacgaagggauu

SEQ ID NO: 379374 - RNA, 19 nt, Homo sapiens
gugaugaauugguagaaga

SEQ ID NO: 379375 - RNA, 19 nt, Homo sapiens
gagugucuauguuaacuuc

SEQ ID NO: 379376 - RNA, 19 nt, Homo sapiens
gaacacacaaagaauuaca

SEQ ID NO: 379377 - RNA, 19 nt, Homo sapiens
cagaaagugagauuaauga

SEQ ID NO: 379378 - RNA, 19 nt, Homo sapiens
gcaaagccagagcuaagaa

SEQ ID NO: 379379 - RNA, 19 nt, Homo sapiens
ggaaucuccaggauaauga

SEQ ID NO: 379380 - RNA, 19 nt, Homo sapiens
ggaauuuuguggccagaua

SEQ ID NO: 379381 - RNA, 19 nt, Homo sapiens
ccguauaucuggugguuau

SEQ ID NO: 379382 - RNA, 19 nt, Homo sapiens
gaucugguugucauguuua

SEQ ID NO: 379383 - RNA, 19 nt, Homo sapiens
cagcaaguguccuuaaguc

SEQ ID NO: 379384 - RNA, 19 nt, Homo sapiens
gcaugaacacgucuuugaa

SEQ ID NO: 379385 - RNA, 19 nt, Homo sapiens
caaagaauuacacaacguu

SEQ ID NO: 379386 - RNA, 19 nt, Homo sapiens
ggauuugcacuacugaauu

SEQ ID NO: 379387 - RNA, 19 nt, Homo sapiens
cuagagaaauggguguauu

SEQ ID NO: 379388 - RNA, 19 nt, Homo sapiens
gcucuuugccgaaaugcua

SEQ ID NO: 379389 - RNA, 19 nt, Homo sapiens
ccagaaacaugggaaugga

SEQ ID NO: 379390 - RNA, 19 nt, Homo sapiens
guugcaaauuucuaaggua

SEQ ID NO: 379391 - RNA, 19 nt, Homo sapiens
aaguugaucuggagaaugu

SEQ ID NO: 379392 - RNA, 19 nt, Homo sapiens
uggcuaauguguacuuaau

SEQ ID NO: 379393 - RNA, 19 nt, Homo sapiens
gggaauagaguaggaguau

SEQ ID NO: 379394 - RNA, 19 nt, Homo sapiens
ggauauuguucaagggaau

SEQ ID NO: 379395 - RNA, 19 nt, Homo sapiens
acaaauccaaggacuuuaa

SEQ ID NO: 379396 - RNA, 19 nt, Homo sapiens
cauuaccaguggcaauuaa

SEQ ID NO: 379397 - RNA, 19 nt, Homo sapiens
ucauaacuguagcaacaaa

SEQ ID NO: 379398 - RNA, 19 nt, Homo sapiens
gaaacuagcuuacaugaga

SEQ ID NO: 379399 - RNA, 19 nt, Homo sapiens
agaaaugucuggagaauaa

SEQ ID NO: 379400 - RNA, 19 nt, Homo sapiens
caaagugguuucagcaaua

SEQ ID NO: 379401 - RNA, 19 nt, Homo sapiens
gaaacaaaguggaaggaaa

SEQ ID NO: 379402 - RNA, 19 nt, Homo sapiens
cugaauagcucccagauuu

SEQ ID NO: 379403 - RNA, 19 nt, Homo sapiens
gaacaaagucagccacaaa

SEQ ID NO: 379404 - RNA, 19 nt, Homo sapiens
gaaggaaacuagcuuacau

SEQ ID NO: 379405 - RNA, 19 nt, Homo sapiens
caagaccucugccaguaua

SEQ ID NO: 379406 - RNA, 19 nt, Homo sapiens
gauaacagcuaccaugaca

SEQ ID NO: 379407 - RNA, 19 nt, Homo sapiens
ggccaaauauauucucuuu

SEQ ID NO: 379408 - RNA, 19 nt, Homo sapiens
gauaaaggacagugaagua

SEQ ID NO: 379409 - RNA, 19 nt, Homo sapiens
gaaggaaagauuuguacua

SEQ ID NO: 379410 - RNA, 19 nt, Homo sapiens
gaauggaggcucuaauuga

SEQ ID NO: 379411 - RNA, 19 nt, Homo sapiens
guaaagaguuguguuguuc

SEQ ID NO: 379412 - RNA, 19 nt, Homo sapiens
caaccuuacuuacagcaua

SEQ ID NO: 379413 - RNA, 19 nt, Homo sapiens
ggaaaugccuaagaagaug

SEQ ID NO: 379414 - RNA, 19 nt, Homo sapiens
ccaacuggcccucuucuua

SEQ ID NO: 379415 - RNA, 19 nt, Homo sapiens
gaaguaauccguaccuugu

SEQ ID NO: 379416 - RNA, 19 nt, Homo sapiens
cuacaaguauucugccuuu

SEQ ID NO: 379417 - RNA, 19 nt, Homo sapiens
ugucauaucuucacaaugg

SEQ ID NO: 379418 - RNA, 19 nt, Homo sapiens
gauuaagucucucuuugga

SEQ ID NO: 379419 - RNA, 19 nt, Homo sapiens
caacuuugccguccuuaaa

SEQ ID NO: 379420 - RNA, 19 nt, Homo sapiens
gaaacagauuuggugaauu

SEQ ID NO: 379421 - RNA, 19 nt, Homo sapiens
caggauagauaacucuuug

SEQ ID NO: 379422 - RNA, 19 nt, Homo sapiens
gacaugggcuuguuagagu

SEQ ID NO: 379423 - RNA, 19 nt, Homo sapiens
ccaaagacaugggcuuguu

SEQ ID NO: 379424 - RNA, 19 nt, Homo sapiens
caucguaggugauuugaag

SEQ ID NO: 379425 - RNA, 19 nt, Homo sapiens
gugauuaagucucucuuug

SEQ ID NO: 379426 - RNA, 19 nt, Homo sapiens
guaagaaaccaaucaagau

SEQ ID NO: 379427 - RNA, 19 nt, Homo sapiens
ggaauggaggcucuaauug

SEQ ID NO: 379428 - RNA, 19 nt, Homo sapiens
gagcgggugugucauuguu

SEQ ID NO: 379429 - RNA, 19 nt, Homo sapiens
gguagacacaggauagaua

SEQ ID NO: 379430 - RNA, 19 nt, Homo sapiens
ggagagucuugcagugauu

SEQ ID NO: 379431 - RNA, 19 nt, Homo sapiens
gagaaggaaugucuuuggu

SEQ ID NO: 379432 - RNA, 19 nt, Homo sapiens
caaagacaugggcuuguua

SEQ ID NO: 379433 - RNA, 19 nt, Homo sapiens
ccaaagugguuucagcaau

SEQ ID NO: 379434 - RNA, 19 nt, Homo sapiens
uagaaucuguguagacgaa

SEQ ID NO: 379435 - RNA, 19 nt, Homo sapiens
ggacauuaagcaucacaaa

SEQ ID NO: 379436 - RNA, 19 nt, Homo sapiens
guagacacaggauagauaa

SEQ ID NO: 379437 - RNA, 19 nt, Homo sapiens
caaaggguacuuccacuga

SEQ ID NO: 379438 - RNA, 19 nt, Homo sapiens
ggaacugccucuuucuucu

SEQ ID NO: 379439 - RNA, 19 nt, Homo sapiens
acacauauauacacacaca

SEQ ID NO: 379440 - RNA, 19 nt, Homo sapiens
caaaccaguauacaagaua

SEQ ID NO: 379441 - RNA, 19 nt, Homo sapiens
cagauuuggugaauuugaa

SEQ ID NO: 379442 - RNA, 19 nt, Homo sapiens
gcccaaaucugccuauugc

SEQ ID NO: 379443 - RNA, 19 nt, Homo sapiens
agaaacagauuuggugaau

SEQ ID NO: 379444 - RNA, 19 nt, Homo sapiens
aauggaggcucuaauugaa

SEQ ID NO: 379445 - RNA, 19 nt, Homo sapiens
ucucccaucuuaacucuuu

SEQ ID NO: 379446 - RNA, 19 nt, Homo sapiens
acaucaagcucauucuuug

SEQ ID NO: 379447 - RNA, 19 nt, Homo sapiens
uuucauguauucccaguuu

SEQ ID NO: 379448 - RNA, 19 nt, Homo sapiens
ugaaggucuugauuuguuu

SEQ ID NO: 379449 - RNA, 19 nt, Homo sapiens
gguauuauccauucaguca

SEQ ID NO: 379450 - RNA, 19 nt, Homo sapiens
guacagagaaggaaugucu

SEQ ID NO: 379451 - RNA, 19 nt, Homo sapiens
ggacaucccgacaaguuug

SEQ ID NO: 379452 - RNA, 19 nt, Homo sapiens
aaccaacccuucccugaaa

SEQ ID NO: 379453 - RNA, 19 nt, Homo sapiens
ggagauguaagaggcuuua

SEQ ID NO: 379454 - RNA, 19 nt, Homo sapiens
cuugguguguuaagaguua

SEQ ID NO: 379455 - RNA, 19 nt, Homo sapiens
ugaguaaucugaucguucu

SEQ ID NO: 379456 - RNA, 19 nt, Homo sapiens
gagcguagaaucuguguag

SEQ ID NO: 379457 - RNA, 19 nt, Homo sapiens
gggaaaugccuaagaagau

SEQ ID NO: 379458 - RNA, 19 nt, Homo sapiens
ggagucagagucccaaaga

SEQ ID NO: 379459 - RNA, 19 nt, Homo sapiens
gcagaucuuuggcgacuac

SEQ ID NO: 379460 - RNA, 19 nt, Homo sapiens
aaaggacagugaaguaauc

SEQ ID NO: 379461 - RNA, 19 nt, Homo sapiens
gaauagcucccagauuuca

SEQ ID NO: 379462 - RNA, 19 nt, Homo sapiens
gauuugaaggucuugauuu

SEQ ID NO: 379463 - RNA, 19 nt, Homo sapiens
aaugggaaaugccuaagaa

SEQ ID NO: 379464 - RNA, 19 nt, Homo sapiens
gcucugcugugcccgugua

SEQ ID NO: 379465 - RNA, 19 nt, Homo sapiens
gaguaucucaucaauguga

SEQ ID NO: 379466 - RNA, 19 nt, Homo sapiens
acacaaagagaguuaauca

SEQ ID NO: 379467 - RNA, 19 nt, Homo sapiens
caagauaaaggacagugaa

SEQ ID NO: 379468 - RNA, 19 nt, Homo sapiens
uguaaagaguuguguuguu

SEQ ID NO: 379469 - RNA, 19 nt, Homo sapiens
uugaaggucuugauuuguu

SEQ ID NO: 379470 - RNA, 19 nt, Homo sapiens
gcuaggacaucccgacaag

SEQ ID NO: 379471 - RNA, 19 nt, Homo sapiens
aaccucacaugcauacaua

SEQ ID NO: 379472 - RNA, 19 nt, Homo sapiens
gaaaugccuaagaagauga

SEQ ID NO: 379473 - RNA, 19 nt, Homo sapiens
gaacugccucuuucuucuu

SEQ ID NO: 379474 - RNA, 19 nt, Homo sapiens
ucacaugcauacauacaca

SEQ ID NO: 379475 - RNA, 19 nt, Homo sapiens
cugcucaccuucaugauug

SEQ ID NO: 379476 - RNA, 19 nt, Homo sapiens
caaaacagcugaguuccaa

SEQ ID NO: 379477 - RNA, 19 nt, Homo sapiens
ggccugagcgcaacgguaa

SEQ ID NO: 379478 - RNA, 19 nt, Homo sapiens
gcuccaaccuucuguccau

SEQ ID NO: 379479 - RNA, 19 nt, Homo sapiens
cuaccaagacuaugaguau

SEQ ID NO: 379480 - RNA, 19 nt, Homo sapiens
gcacagaaaagcuaauuga

SEQ ID NO: 379481 - RNA, 19 nt, Homo sapiens
acacacacaaagagaguua

SEQ ID NO: 379482 - RNA, 19 nt, Homo sapiens
uaaccaacccuucccugaa

SEQ ID NO: 379483 - RNA, 19 nt, Homo sapiens
caaguauucugccuuugca

SEQ ID NO: 379484 - RNA, 19 nt, Homo sapiens
ggauagauaacucuuugga

SEQ ID NO: 379485 - RNA, 19 nt, Homo sapiens
gcaagaccucugccaguau

SEQ ID NO: 379486 - RNA, 19 nt, Homo sapiens
caacaucaagcucauucuu

SEQ ID NO: 379487 - RNA, 19 nt, Homo sapiens
gauccaugccuuccaguau

SEQ ID NO: 379488 - RNA, 19 nt, Homo sapiens
ucaaaccaguauacaagau

SEQ ID NO: 379489 - RNA, 19 nt, Homo sapiens
guguuaagaguuagguuua

SEQ ID NO: 379490 - RNA, 19 nt, Homo sapiens
uagcuuacaugagaacaga

SEQ ID NO: 379491 - RNA, 19 nt, Homo sapiens
aaacuagcuuacaugagaa

SEQ ID NO: 379492 - RNA, 19 nt, Homo sapiens
ggaaacaaaguggaaggaa

SEQ ID NO: 379493 - RNA, 19 nt, Homo sapiens
acagcugaguuccaaauga

SEQ ID NO: 379494 - RNA, 19 nt, Homo sapiens
gcgggugugucauuguuug

SEQ ID NO: 379495 - RNA, 19 nt, Homo sapiens
ucaucaggcuauucaguug

SEQ ID NO: 379496 - RNA, 19 nt, Homo sapiens
uaacagaaugcaccaguca

SEQ ID NO: 379497 - RNA, 19 nt, Homo sapiens
gguguucucccauggauug

SEQ ID NO: 379498 - RNA, 19 nt, Homo sapiens
gcaaauaacuccuccauug

SEQ ID NO: 379499 - RNA, 19 nt, Homo sapiens
gaacuucccucauuucucu

SEQ ID NO: 379500 - RNA, 19 nt, Homo sapiens
gaaagggaauccuccuguu

SEQ ID NO: 379501 - RNA, 19 nt, Homo sapiens
uaacuccuccauugaaaua

SEQ ID NO: 379502 - RNA, 19 nt, Homo sapiens
gcaauccucuaccugauca

SEQ ID NO: 379503 - RNA, 19 nt, Homo sapiens
caaauaacuccuccauuga

SEQ ID NO: 379504 - RNA, 19 nt, Homo sapiens
gaugauccuugcugcuauu

SEQ ID NO: 379505 - RNA, 19 nt, Homo sapiens
gagaggaaaccacuccaaa

SEQ ID NO: 379506 - RNA, 19 nt, Homo sapiens
gagaugauccuugcugcua

SEQ ID NO: 379507 - RNA, 19 nt, Homo sapiens
uaggcgaacuucccucauu

SEQ ID NO: 379508 - RNA, 19 nt, Homo sapiens
aauaacuccuccauugaaa

SEQ ID NO: 379509 - RNA, 19 nt, Homo sapiens
caagauaccauucaucaac

SEQ ID NO: 379510 - RNA, 19 nt, Homo sapiens
ccuguuugcugagauuaua

SEQ ID NO: 379511 - RNA, 19 nt, Homo sapiens
cugaucaccuccauuguug

SEQ ID NO: 379512 - RNA, 19 nt, Homo sapiens
aaauaacuccuccauugaa

SEQ ID NO: 379513 - RNA, 19 nt, Homo sapiens
aaagggaauccuccuguuu

SEQ ID NO: 379514 - RNA, 19 nt, Homo sapiens
gcccuggagugauuucuuc

SEQ ID NO: 379515 - RNA, 19 nt, Homo sapiens
gggacccacuccaaauaau

SEQ ID NO: 379516 - RNA, 19 nt, Homo sapiens
aggcgaacuucccucauuu

SEQ ID NO: 379517 - RNA, 19 nt, Homo sapiens
gaaguggggaguuagauuu

SEQ ID NO: 379518 - RNA, 19 nt, Homo sapiens
ccucauuucucucugcaau

SEQ ID NO: 379519 - RNA, 19 nt, Homo sapiens
ggaaaccacuccaaaaucg

SEQ ID NO: 379520 - RNA, 19 nt, Homo sapiens
guucggcagccaagacaua

SEQ ID NO: 379521 - RNA, 19 nt, Homo sapiens
ccaccuaagucacaaaaug

SEQ ID NO: 379522 - RNA, 19 nt, Homo sapiens
cgaaaccacgagcaaguga

SEQ ID NO: 379523 - RNA, 19 nt, Homo sapiens
ggacccacuccaaauaauc

SEQ ID NO: 379524 - RNA, 19 nt, Homo sapiens
ggagacaccaguucugacu

SEQ ID NO: 379525 - RNA, 19 nt, Homo sapiens
gcacaccaagauaccauuc

SEQ ID NO: 379526 - RNA, 19 nt, Homo sapiens
gauccuugcugcuauuuuc

SEQ ID NO: 379527 - RNA, 19 nt, Homo sapiens
ccauuguuguccuuguuga

SEQ ID NO: 379528 - RNA, 19 nt, Homo sapiens
acaccaagauaccauucau

SEQ ID NO: 379529 - RNA, 19 nt, Homo sapiens
gaggaaaccacuccaaaau

SEQ ID NO: 379530 - RNA, 19 nt, Homo sapiens
ccugaucaccuccauuguu

SEQ ID NO: 379531 - RNA, 19 nt, Homo sapiens
uaccugaucaccuccauug

SEQ ID NO: 379532 - RNA, 19 nt, Homo sapiens
ugagggaaguggggaguua

SEQ ID NO: 379533 - RNA, 19 nt, Homo sapiens
ccaauaggagacaccaguu

SEQ ID NO: 379534 - RNA, 19 nt, Homo sapiens
ucauuucucucugcaaucu

SEQ ID NO: 379535 - RNA, 19 nt, Homo sapiens
ucaacuggcccuggaguga

SEQ ID NO: 379536 - RNA, 19 nt, Homo sapiens
ucuauagagggauaaauga

SEQ ID NO: 379537 - RNA, 19 nt, Homo sapiens
aagggaauccuccuguuug

SEQ ID NO: 379538 - RNA, 19 nt, Homo sapiens
gaucaccuccauuguuguc

SEQ ID NO: 379539 - RNA, 19 nt, Homo sapiens
ugaccugcacaccaagaua

SEQ ID NO: 379540 - RNA, 19 nt, Homo sapiens
cuauagagggauaaaugaa

SEQ ID NO: 379541 - RNA, 19 nt, Homo sapiens
caauaggagacaccaguuc

SEQ ID NO: 379542 - RNA, 19 nt, Homo sapiens
cggcaauccucuaccugau

SEQ ID NO: 379543 - RNA, 19 nt, Homo sapiens
ccaagauaccauucaucaa

SEQ ID NO: 379544 - RNA, 19 nt, Homo sapiens
ccuccuguuugcugagauu

SEQ ID NO: 379545 - RNA, 19 nt, Homo sapiens
uaggagacaccaguucuga

SEQ ID NO: 379546 - RNA, 19 nt, Homo sapiens
agaugauccuugcugcuau

SEQ ID NO: 379547 - RNA, 19 nt, Homo sapiens
ucugcacgauccaauagga

SEQ ID NO: 379548 - RNA, 19 nt, Homo sapiens
guguacagcguccucgaaa

SEQ ID NO: 379549 - RNA, 19 nt, Homo sapiens
aagauaccauucaucaacu

SEQ ID NO: 379550 - RNA, 19 nt, Homo sapiens
gguguacagcguccucgaa

SEQ ID NO: 379551 - RNA, 19 nt, Homo sapiens
gaccugcacaccaagauac

SEQ ID NO: 379552 - RNA, 19 nt, Homo sapiens
gacccacuccaaauaaucu

SEQ ID NO: 379553 - RNA, 19 nt, Homo sapiens
ugucggugauugagaugau

SEQ ID NO: 379554 - RNA, 19 nt, Homo sapiens
ggaaaucagugguuuguua

SEQ ID NO: 379555 - RNA, 19 nt, Homo sapiens
gcagaaccacaaauuauua

SEQ ID NO: 379556 - RNA, 19 nt, Homo sapiens
gauggaaguuucauucaaa

SEQ ID NO: 379557 - RNA, 19 nt, Homo sapiens
gcccauaucuguucucuug

SEQ ID NO: 379558 - RNA, 19 nt, Homo sapiens
ggacuuggcuaguggcaaa

SEQ ID NO: 379559 - RNA, 19 nt, Homo sapiens
gaaagucgauuacuaacag

SEQ ID NO: 379560 - RNA, 19 nt, Homo sapiens
caagaacucugcacugaug

SEQ ID NO: 379561 - RNA, 19 nt, Homo sapiens
gaccaaggcugaugcaaau

SEQ ID NO: 379562 - RNA, 19 nt, Homo sapiens
gcauuaucauggacauuua

SEQ ID NO: 379563 - RNA, 19 nt, Homo sapiens
caaucaagcuucguaauga

SEQ ID NO: 379564 - RNA, 19 nt, Homo sapiens
ugacagaacuauaaagauc

SEQ ID NO: 379565 - RNA, 19 nt, Homo sapiens
ggacagugaaucaggaaua

SEQ ID NO: 379566 - RNA, 19 nt, Homo sapiens
gacaaucgauguguuggua

SEQ ID NO: 379567 - RNA, 19 nt, Homo sapiens
ggagaacuggcuacaauuu

SEQ ID NO: 379568 - RNA, 19 nt, Homo sapiens
gcugggaucucgaauacaa

SEQ ID NO: 379569 - RNA, 19 nt, Homo sapiens
cuacagcgaugaauucaau

SEQ ID NO: 379570 - RNA, 19 nt, Homo sapiens
gaagagagucacaaacgaa

SEQ ID NO: 379571 - RNA, 19 nt, Homo sapiens
gcacggauuugggauguga

SEQ ID NO: 379572 - RNA, 19 nt, Homo sapiens
uaagugcaguguaugguuu

SEQ ID NO: 379573 - RNA, 19 nt, Homo sapiens
uccaagacauuacacauuu

SEQ ID NO: 379574 - RNA, 19 nt, Homo sapiens
uggaaacucuacaggguua

SEQ ID NO: 379575 - RNA, 19 nt, Homo sapiens
gcaaucaagcuucguaaug

SEQ ID NO: 379576 - RNA, 19 nt, Homo sapiens
caaaugcaguugcuacagu

SEQ ID NO: 379577 - RNA, 19 nt, Homo sapiens
auacuaagauccagagaau

SEQ ID NO: 379578 - RNA, 19 nt, Homo sapiens
ggagaagacaaacaaguga

SEQ ID NO: 379579 - RNA, 19 nt, Homo sapiens
gcaacggauucauauguuc

SEQ ID NO: 379580 - RNA, 19 nt, Homo sapiens
guuuguagcugauaaugga

SEQ ID NO: 379581 - RNA, 19 nt, Homo sapiens
cacauuaucuggacauaca

SEQ ID NO: 379582 - RNA, 19 nt, Homo sapiens
ggaagugaauaccgacauc

SEQ ID NO: 379583 - RNA, 19 nt, Homo sapiens
gaagaaacucauccaguca

SEQ ID NO: 379584 - RNA, 19 nt, Homo sapiens
agagugacauuaacaaauc

SEQ ID NO: 379585 - RNA, 19 nt, Homo sapiens
gaaaugcugggaucucgaa

SEQ ID NO: 379586 - RNA, 19 nt, Homo sapiens
gacagugaaucaggaauau

SEQ ID NO: 379587 - RNA, 19 nt, Homo sapiens
gcacaaggagcccauaucu

SEQ ID NO: 379588 - RNA, 19 nt, Homo sapiens
acaaggagcccauaucugu

SEQ ID NO: 379589 - RNA, 19 nt, Homo sapiens
gaaaaccugugccuuuaga

SEQ ID NO: 379590 - RNA, 19 nt, Homo sapiens
gacgguaaauucugaugga

SEQ ID NO: 379591 - RNA, 19 nt, Homo sapiens
aaacaagagugacauuaac

SEQ ID NO: 379592 - RNA, 19 nt, Homo sapiens
gagaaugccaagugaauca

SEQ ID NO: 379593 - RNA, 19 nt, Homo sapiens
cagugaaucaggaauauuu

SEQ ID NO: 379594 - RNA, 19 nt, Homo sapiens
ccaagacauuacacauuug

SEQ ID NO: 379595 - RNA, 19 nt, Homo sapiens
gcugcagaaccacaaauua

SEQ ID NO: 379596 - RNA, 19 nt, Homo sapiens
ccauuaaaguauacagaga

SEQ ID NO: 379597 - RNA, 19 nt, Homo sapiens
caagagugacauuaacaaa

SEQ ID NO: 379598 - RNA, 19 nt, Homo sapiens
agagaaggguccucagaau

SEQ ID NO: 379599 - RNA, 19 nt, Homo sapiens
ccacaaauuauuacaggaa

SEQ ID NO: 379600 - RNA, 19 nt, Homo sapiens
ggacauacaaaugcaguug

SEQ ID NO: 379601 - RNA, 19 nt, Homo sapiens
acauuuaagugcaguguau

SEQ ID NO: 379602 - RNA, 19 nt, Homo sapiens
gcugacagaacuauaaaga

SEQ ID NO: 379603 - RNA, 19 nt, Homo sapiens
gagaaggguccucagaaug

SEQ ID NO: 379604 - RNA, 19 nt, Homo sapiens
ugaagagagucacaaacga

SEQ ID NO: 379605 - RNA, 19 nt, Homo sapiens
gacagcagauacuaagauc

SEQ ID NO: 379606 - RNA, 19 nt, Homo sapiens
ucugaaagucgauuacuaa

SEQ ID NO: 379607 - RNA, 19 nt, Homo sapiens
gcauaugccuacuucaaaa

SEQ ID NO: 379608 - RNA, 19 nt, Homo sapiens
ugaguaugguccuguguug

SEQ ID NO: 379609 - RNA, 19 nt, Homo sapiens
cuggagaacuggcuacaau

SEQ ID NO: 379610 - RNA, 19 nt, Homo sapiens
uaacauaaagcaguggaaa

SEQ ID NO: 379611 - RNA, 19 nt, Homo sapiens
gaacuaaagccaguguaca

SEQ ID NO: 379612 - RNA, 19 nt, Homo sapiens
acucugcacugauggcuaa

SEQ ID NO: 379613 - RNA, 19 nt, Homo sapiens
ugauggaaguuucauucaa

SEQ ID NO: 379614 - RNA, 19 nt, Homo sapiens
caaaaucuuuccggucaua

SEQ ID NO: 379615 - RNA, 19 nt, Homo sapiens
acauaaagcaguggaaauu

SEQ ID NO: 379616 - RNA, 19 nt, Homo sapiens
ccauaucuguucucuugug

SEQ ID NO: 379617 - RNA, 19 nt, Homo sapiens
guccuuagcgguggcauua

SEQ ID NO: 379618 - RNA, 19 nt, Homo sapiens
cauugacgguaaauucuga

SEQ ID NO: 379619 - RNA, 19 nt, Homo sapiens
acacauugacgguaaauuc

SEQ ID NO: 379620 - RNA, 19 nt, Homo sapiens
ggcauuaucauggacauuu

SEQ ID NO: 379621 - RNA, 19 nt, Homo sapiens
gaagacaaacaagugaaau

SEQ ID NO: 379622 - RNA, 19 nt, Homo sapiens
gagaagacaaacaagugaa

SEQ ID NO: 379623 - RNA, 19 nt, Homo sapiens
ucauugacugggcauauua

SEQ ID NO: 379624 - RNA, 19 nt, Homo sapiens
gaggagguacagaaacauu

SEQ ID NO: 379625 - RNA, 19 nt, Homo sapiens
gaaaucagugguuuguuac

SEQ ID NO: 379626 - RNA, 19 nt, Homo sapiens
aaccagaaauuaucaagag

SEQ ID NO: 379627 - RNA, 19 nt, Homo sapiens
gucugaaagucgauuacua

SEQ ID NO: 379628 - RNA, 19 nt, Homo sapiens
gaauauuugcuugugcuuu

SEQ ID NO: 379629 - RNA, 19 nt, Homo sapiens
gauacuaagauccagagaa

SEQ ID NO: 379630 - RNA, 19 nt, Homo sapiens
ccagaaauuaucaagagaa

SEQ ID NO: 379631 - RNA, 19 nt, Homo sapiens
gaaaccagaaauuaucaag

SEQ ID NO: 379632 - RNA, 19 nt, Homo sapiens
auuaacacauugacgguaa

SEQ ID NO: 379633 - RNA, 19 nt, Homo sapiens
agauucaacugcacggauu

SEQ ID NO: 379634 - RNA, 19 nt, Homo sapiens
cuauaaagaucugggacuu

SEQ ID NO: 379635 - RNA, 19 nt, Homo sapiens
ggucgaggagguacagaaa

SEQ ID NO: 379636 - RNA, 19 nt, Homo sapiens
caucuuggcuggguucgau

SEQ ID NO: 379637 - RNA, 19 nt, Homo sapiens
caaucaaggacaagaaguu

SEQ ID NO: 379638 - RNA, 19 nt, Homo sapiens
acaguacccugccaaucaa

SEQ ID NO: 379639 - RNA, 19 nt, Homo sapiens
ucgaggagguacagaaaca

SEQ ID NO: 379640 - RNA, 19 nt, Homo sapiens
gagugacauuaacaaauca

SEQ ID NO: 379641 - RNA, 19 nt, Homo sapiens
accaagaacucugcacuga

SEQ ID NO: 379642 - RNA, 19 nt, Homo sapiens
gaaggguccucagaaugca

SEQ ID NO: 379643 - RNA, 19 nt, Homo sapiens
uaaaguauacagagaggau

SEQ ID NO: 379644 - RNA, 19 nt, Homo sapiens
ugacauguuuguagcugau

SEQ ID NO: 379645 - RNA, 19 nt, Homo sapiens
gaucucgaauacaauaagg

SEQ ID NO: 379646 - RNA, 19 nt, Homo sapiens
gccuuuagaugaagagagu

SEQ ID NO: 379647 - RNA, 19 nt, Homo sapiens
ucaggaauauuugcuugug

SEQ ID NO: 379648 - RNA, 19 nt, Homo sapiens
uggaaaaccugugccuuua

SEQ ID NO: 379649 - RNA, 19 nt, Homo sapiens
uaucauggacauuuaagug

SEQ ID NO: 379650 - RNA, 19 nt, Homo sapiens
cagagaaugccaagugaau

SEQ ID NO: 379651 - RNA, 19 nt, Homo sapiens
gggaucugguggcuggaaa

SEQ ID NO: 379652 - RNA, 19 nt, Homo sapiens
gaagccaugauacuacaau

SEQ ID NO: 379653 - RNA, 19 nt, Homo sapiens
acaggaagccaugauacua

SEQ ID NO: 379654 - RNA, 19 nt, Homo sapiens
gaaaggaauucaacacuua

SEQ ID NO: 379655 - RNA, 19 nt, Homo sapiens
caugaaaucuggcacuuua

SEQ ID NO: 379656 - RNA, 19 nt, Homo sapiens
ggaggaacuucaacuauuu

SEQ ID NO: 379657 - RNA, 19 nt, Homo sapiens
uaacacagcuuuaacuaug

SEQ ID NO: 379658 - RNA, 19 nt, Homo sapiens
gaaaugaucaggagagaaa

SEQ ID NO: 379659 - RNA, 19 nt, Homo sapiens
gcuagaacaucccaagaua

SEQ ID NO: 379660 - RNA, 19 nt, Homo sapiens
ggagucaacccauacauua

SEQ ID NO: 379661 - RNA, 19 nt, Homo sapiens
gcacacagcauucuuauuc

SEQ ID NO: 379662 - RNA, 19 nt, Homo sapiens
aaaguucacucucuuguuu

SEQ ID NO: 379663 - RNA, 19 nt, Homo sapiens
gcugauacuucaugauuaa

SEQ ID NO: 379664 - RNA, 19 nt, Homo sapiens
acaaagcccuggagaauga

SEQ ID NO: 379665 - RNA, 19 nt, Homo sapiens
gaaagagccaucaauaaga

SEQ ID NO: 379666 - RNA, 19 nt, Homo sapiens
ccaaauacuuguagccaaa

SEQ ID NO: 379667 - RNA, 19 nt, Homo sapiens
ccuguuagcuucauauuau

SEQ ID NO: 379668 - RNA, 19 nt, Homo sapiens
gguaggauguuauuagaga

SEQ ID NO: 379669 - RNA, 19 nt, Homo sapiens
gaaaaggacugaacagaau

SEQ ID NO: 379670 - RNA, 19 nt, Homo sapiens
aaagaucggugcccggaua

SEQ ID NO: 379671 - RNA, 19 nt, Homo sapiens
ggaagaacaaggccaaauu

SEQ ID NO: 379672 - RNA, 19 nt, Homo sapiens
ggaccuaaaugaaaggaau

SEQ ID NO: 379673 - RNA, 19 nt, Homo sapiens
aaagagccaucaauaagaa

SEQ ID NO: 379674 - RNA, 19 nt, Homo sapiens
gggaagggauuacugcuau

SEQ ID NO: 379675 - RNA, 19 nt, Homo sapiens
caacaaagauggcaaaauc

SEQ ID NO: 379676 - RNA, 19 nt, Homo sapiens
uuccaaaucucaagugaua

SEQ ID NO: 379677 - RNA, 19 nt, Homo sapiens
gagcaauacuguugugcaa

SEQ ID NO: 379678 - RNA, 19 nt, Homo sapiens
gaaugaagcucugauugca

SEQ ID NO: 379679 - RNA, 19 nt, Homo sapiens
gaacuucaagaccuguuua

SEQ ID NO: 379680 - RNA, 19 nt, Homo sapiens
ggaggagcuugaagaacua

SEQ ID NO: 379681 - RNA, 19 nt, Homo sapiens
caacaaaccuccuuauccu

SEQ ID NO: 379682 - RNA, 19 nt, Homo sapiens
gaagcgugcuggacucaug

SEQ ID NO: 379683 - RNA, 19 nt, Homo sapiens
gagggaacaugaagaagau

SEQ ID NO: 379684 - RNA, 19 nt, Homo sapiens
caacauuggugcaucagau

SEQ ID NO: 379685 - RNA, 19 nt, Homo sapiens
agaaugacccugacuguaa

SEQ ID NO: 379686 - RNA, 19 nt, Homo sapiens
agacaagacuaaaucauuc

SEQ ID NO: 379687 - RNA, 19 nt, Homo sapiens
gaagaacaaggccaaauuc

SEQ ID NO: 379688 - RNA, 19 nt, Homo sapiens
gggaggagcuugaagaacu

SEQ ID NO: 379689 - RNA, 19 nt, Homo sapiens
uaaauucccuuucuaccau

SEQ ID NO: 379690 - RNA, 19 nt, Homo sapiens
gggcaggaccuaaaugaaa

SEQ ID NO: 379691 - RNA, 19 nt, Homo sapiens
aagcaaagauaucagcaaa

SEQ ID NO: 379692 - RNA, 19 nt, Homo sapiens
auaaagaccugaagauagu

SEQ ID NO: 379693 - RNA, 19 nt, Homo sapiens
gaaauguaguggguguaaa

SEQ ID NO: 379694 - RNA, 19 nt, Homo sapiens
gaacuaccaucugaccaau

SEQ ID NO: 379695 - RNA, 19 nt, Homo sapiens
gaagcuuucucccgaggaa

SEQ ID NO: 379696 - RNA, 19 nt, Homo sapiens
cuacaagaggcauuuaaua

SEQ ID NO: 379697 - RNA, 19 nt, Homo sapiens
gcccauguguuuagaauag

SEQ ID NO: 379698 - RNA, 19 nt, Homo sapiens
caacugauacagauaauag

SEQ ID NO: 379699 - RNA, 19 nt, Homo sapiens
ggagggaacaugaagaaga

SEQ ID NO: 379700 - RNA, 19 nt, Homo sapiens
caaggaagagagaacauuu

SEQ ID NO: 379701 - RNA, 19 nt, Homo sapiens
gaacuacaagaggcauuua

SEQ ID NO: 379702 - RNA, 19 nt, Homo sapiens
uggaggaacuucaacuauu

SEQ ID NO: 379703 - RNA, 19 nt, Homo sapiens
gcuacagcuuggacuauuu

SEQ ID NO: 379704 - RNA, 19 nt, Homo sapiens
ucacagcccguuacaaauu

SEQ ID NO: 379705 - RNA, 19 nt, Homo sapiens
ugugaaaugugguuugauu

SEQ ID NO: 379706 - RNA, 19 nt, Homo sapiens
cgauaugaauuuacuggaa

SEQ ID NO: 379707 - RNA, 19 nt, Homo sapiens
agaauaugcccacugaaua

SEQ ID NO: 379708 - RNA, 19 nt, Homo sapiens
caagauaugcugacacugu

SEQ ID NO: 379709 - RNA, 19 nt, Homo sapiens
gcugaacaaugcuaaauac

SEQ ID NO: 379710 - RNA, 19 nt, Homo sapiens
gagagaacauuucggaacu

SEQ ID NO: 379711 - RNA, 19 nt, Homo sapiens
gaccugccauugccauuga

SEQ ID NO: 379712 - RNA, 19 nt, Homo sapiens
guacaguggucaacauugg

SEQ ID NO: 379713 - RNA, 19 nt, Homo sapiens
gaaugacccugacuguaag

SEQ ID NO: 379714 - RNA, 19 nt, Homo sapiens
aaacaaagcccuggagaau

SEQ ID NO: 379715 - RNA, 19 nt, Homo sapiens
uaagagagacugcccaugu

SEQ ID NO: 379716 - RNA, 19 nt, Homo sapiens
gauaagaccagcagaagca

SEQ ID NO: 379717 - RNA, 19 nt, Homo sapiens
caaaugcaguucgucaaga

SEQ ID NO: 379718 - RNA, 19 nt, Homo sapiens
gaugagaagguacacauug

SEQ ID NO: 379719 - RNA, 19 nt, Homo sapiens
gcacaagccgaauaauaau

SEQ ID NO: 379720 - RNA, 19 nt, Homo sapiens
caacuucagccaagacauu

SEQ ID NO: 379721 - RNA, 19 nt, Homo sapiens
aaaugaaggugaggaacua

SEQ ID NO: 379722 - RNA, 19 nt, Homo sapiens
ggaagggauuacugcuauu

SEQ ID NO: 379723 - RNA, 19 nt, Homo sapiens
uuucggaacuggaugaauu

SEQ ID NO: 379724 - RNA, 19 nt, Homo sapiens
ugaaagagccaucaauaag

SEQ ID NO: 379725 - RNA, 19 nt, Homo sapiens
gacgguguuugcaugcuua

SEQ ID NO: 379726 - RNA, 19 nt, Homo sapiens
gaacauuucggaacuggau

SEQ ID NO: 379727 - RNA, 19 nt, Homo sapiens
ccauugaccuuucaggaau

SEQ ID NO: 379728 - RNA, 19 nt, Homo sapiens
gugaaugaguagucuaaau

SEQ ID NO: 379729 - RNA, 19 nt, Homo sapiens
acaauugaauccagaaauc

SEQ ID NO: 379730 - RNA, 19 nt, Homo sapiens
ggcaauguuugguuaaugu

SEQ ID NO: 379731 - RNA, 19 nt, Homo sapiens
cagccaaccaucaguauuu

SEQ ID NO: 379732 - RNA, 19 nt, Homo sapiens
gcugugaaaugugguuuga

SEQ ID NO: 379733 - RNA, 19 nt, Homo sapiens
ggaaggagagagcaaggaa

SEQ ID NO: 379734 - RNA, 19 nt, Homo sapiens
ggucaacauuggugcauca

SEQ ID NO: 379735 - RNA, 19 nt, Homo sapiens
ccaugaaucccaaugauga

SEQ ID NO: 379736 - RNA, 19 nt, Homo sapiens
gagaaugacccugacugua

SEQ ID NO: 379737 - RNA, 19 nt, Homo sapiens
gaagaguuugugucacuaa

SEQ ID NO: 379738 - RNA, 19 nt, Homo sapiens
gguaacacagcuuuaacua

SEQ ID NO: 379739 - RNA, 19 nt, Homo sapiens
ucaagaagcagauaaacug

SEQ ID NO: 379740 - RNA, 19 nt, Homo sapiens
ggaauuaaugagacaaaug

SEQ ID NO: 379741 - RNA, 19 nt, Homo sapiens
gaacuagaggagcugauga

SEQ ID NO: 379742 - RNA, 19 nt, Homo sapiens
aaaccuagcucugaauucu

SEQ ID NO: 379743 - RNA, 19 nt, Homo sapiens
uaguuuaggucucuauaga

SEQ ID NO: 379744 - RNA, 19 nt, Homo sapiens
ccucacaguuuacaggauu

SEQ ID NO: 379745 - RNA, 19 nt, Homo sapiens
cuucaacuauuuccaguga

SEQ ID NO: 379746 - RNA, 19 nt, Homo sapiens
caacagguggaauuugaaa

SEQ ID NO: 379747 - RNA, 19 nt, Homo sapiens
ggauguuauuagagagaua

SEQ ID NO: 379748 - RNA, 19 nt, Homo sapiens
ugaauucaauauccuguuc

SEQ ID NO: 379749 - RNA, 19 nt, Homo sapiens
gcaaggaagagagaacauu

SEQ ID NO: 379750 - RNA, 19 nt, Homo sapiens
gauauaaagaccugaagau

SEQ ID NO: 379751 - RNA, 19 nt, Homo sapiens
ugcacaagccgaauaauaa

SEQ ID NO: 379752 - RNA, 19 nt, Homo sapiens
cagcagaagcagauauaaa

SEQ ID NO: 379753 - RNA, 19 nt, Homo sapiens
gcagaagcagauauaaaga

SEQ ID NO: 379754 - RNA, 19 nt, Homo sapiens
gaaagaaccuuccguaacu

SEQ ID NO: 379755 - RNA, 19 nt, Homo sapiens
gaagagagcugagaguaug

SEQ ID NO: 379756 - RNA, 19 nt, Homo sapiens
caaacucucucucuaaauu

SEQ ID NO: 379757 - RNA, 19 nt, Homo sapiens
aaagaaauguggucacuaa

SEQ ID NO: 379758 - RNA, 19 nt, Homo sapiens
gaaauugucuccagaagag

SEQ ID NO: 379759 - RNA, 19 nt, Homo sapiens
gaacauuggugcagaagau

SEQ ID NO: 379760 - RNA, 19 nt, Homo sapiens
gcaaagcaaucaacaggaa

SEQ ID NO: 379761 - RNA, 19 nt, Homo sapiens
gaauuaaaguuccuguuga

SEQ ID NO: 379762 - RNA, 19 nt, Homo sapiens
gauauugacuggacucuau

SEQ ID NO: 379763 - RNA, 19 nt, Homo sapiens
uggcuaaccuguuuaauaa

SEQ ID NO: 379764 - RNA, 19 nt, Homo sapiens
gugaagugcuuauggcuua

SEQ ID NO: 379765 - RNA, 19 nt, Homo sapiens
gaagauauacccucaaugu

SEQ ID NO: 379766 - RNA, 19 nt, Homo sapiens
uaacaggacuagcuuauca

SEQ ID NO: 379767 - RNA, 19 nt, Homo sapiens
gaaccaaacccugacuuua

SEQ ID NO: 379768 - RNA, 19 nt, Homo sapiens
gaacucugcuucugccauu

SEQ ID NO: 379769 - RNA, 19 nt, Homo sapiens
gcacaauaaugccaaguau

SEQ ID NO: 379770 - RNA, 19 nt, Homo sapiens
gaagaugacaagcacaaua

SEQ ID NO: 379771 - RNA, 19 nt, Homo sapiens
ccacucagauuuccaaaga

SEQ ID NO: 379772 - RNA, 19 nt, Homo sapiens
uggaggaacuuaugaaauu

SEQ ID NO: 379773 - RNA, 19 nt, Homo sapiens
gaaccacggauagauauua

SEQ ID NO: 379774 - RNA, 19 nt, Homo sapiens
gagaagauauacccucaau

SEQ ID NO: 379775 - RNA, 19 nt, Homo sapiens
gauguaaucugguagcaau

SEQ ID NO: 379776 - RNA, 19 nt, Homo sapiens
uaaacaagacugcugauuu

SEQ ID NO: 379777 - RNA, 19 nt, Homo sapiens
gaacacagcauucuuacuc

SEQ ID NO: 379778 - RNA, 19 nt, Homo sapiens
aaagagcaaucaacaagaa

SEQ ID NO: 379779 - RNA, 19 nt, Homo sapiens
ggauagauauuaacauguc

SEQ ID NO: 379780 - RNA, 19 nt, Homo sapiens
guucaaagcuguuggugau

SEQ ID NO: 379781 - RNA, 19 nt, Homo sapiens
ugaaacagaugauuugaag

SEQ ID NO: 379782 - RNA, 19 nt, Homo sapiens
gaacagaacguugagugaa

SEQ ID NO: 379783 - RNA, 19 nt, Homo sapiens
aaagugauguaaucuggua

SEQ ID NO: 379784 - RNA, 19 nt, Homo sapiens
gauauuaacaugucagguu

SEQ ID NO: 379785 - RNA, 19 nt, Homo sapiens
gcaacggauucauuuguga

SEQ ID NO: 379786 - RNA, 19 nt, Homo sapiens
caacuccucuuucccauag

SEQ ID NO: 379787 - RNA, 19 nt, Homo sapiens
gaaagccaaugacgacauc

SEQ ID NO: 379788 - RNA, 19 nt, Homo sapiens
caacagcaacggauucauu

SEQ ID NO: 379789 - RNA, 19 nt, Homo sapiens
aaacaagacugcugauuuu

SEQ ID NO: 379790 - RNA, 19 nt, Homo sapiens
gcacugaacucugcuucug

SEQ ID NO: 379791 - RNA, 19 nt, Homo sapiens
ggauauaaagugagagaaa

SEQ ID NO: 379792 - RNA, 19 nt, Homo sapiens
ccaggacucugcgacuuua

SEQ ID NO: 379793 - RNA, 19 nt, Homo sapiens
ggaggaacuuaugaaauug

SEQ ID NO: 379794 - RNA, 19 nt, Homo sapiens
gaauuaagcaggaaugaag

SEQ ID NO: 379795 - RNA, 19 nt, Homo sapiens
guagacauguuauaccaau

SEQ ID NO: 379796 - RNA, 19 nt, Homo sapiens
gcagauaaauuagguugca

SEQ ID NO: 379797 - RNA, 19 nt, Homo sapiens
gaaagagcaaucaacaaga

SEQ ID NO: 379798 - RNA, 19 nt, Homo sapiens
ccaaagaugagcuugauga

SEQ ID NO: 379799 - RNA, 19 nt, Homo sapiens
agagugugcucagaacuua

SEQ ID NO: 379800 - RNA, 19 nt, Homo sapiens
caucaaacucucucucuaa

SEQ ID NO: 379801 - RNA, 19 nt, Homo sapiens
uugcuuagaugaugggaua

SEQ ID NO: 379802 - RNA, 19 nt, Homo sapiens
ggacuagcuuaucaugaga

SEQ ID NO: 379803 - RNA, 19 nt, Homo sapiens
ugacuguguuugcauguuu

SEQ ID NO: 379804 - RNA, 19 nt, Homo sapiens
aggagaaacucgugaagaa

SEQ ID NO: 379805 - RNA, 19 nt, Homo sapiens
ucaaucaaaucgcaccaaa

SEQ ID NO: 379806 - RNA, 19 nt, Homo sapiens
gccauugggugucauguug

SEQ ID NO: 379807 - RNA, 19 nt, Homo sapiens
gccaagaccuuccgcaaag

SEQ ID NO: 379808 - RNA, 19 nt, Homo sapiens
gaacuuagacgggauuugg

SEQ ID NO: 379809 - RNA, 19 nt, Homo sapiens
ucacuugguucaauacaug

SEQ ID NO: 379810 - RNA, 19 nt, Homo sapiens
ggaaccaaacccugacuuu

SEQ ID NO: 379811 - RNA, 19 nt, Homo sapiens
guggcuaaccuguuuaaua

SEQ ID NO: 379812 - RNA, 19 nt, Homo sapiens
gcaauguaguaguucaaau

SEQ ID NO: 379813 - RNA, 19 nt, Homo sapiens
ggucagagcguauuuggau

SEQ ID NO: 379814 - RNA, 19 nt, Homo sapiens
guuauuucuugcucuguua

SEQ ID NO: 379815 - RNA, 19 nt, Homo sapiens
ggaaguaaagcccaagaug

SEQ ID NO: 379816 - RNA, 19 nt, Homo sapiens
caaugaaacagaugauuug

SEQ ID NO: 379817 - RNA, 19 nt, Homo sapiens
guaaucugguagcaaugua

SEQ ID NO: 379818 - RNA, 19 nt, Homo sapiens
gggaaaggguuuaagaaaa

SEQ ID NO: 379819 - RNA, 19 nt, Homo sapiens
uaacaugucagguuucaau

SEQ ID NO: 379820 - RNA, 19 nt, Homo sapiens
ggagagagugugcucagaa

SEQ ID NO: 379821 - RNA, 19 nt, Homo sapiens
guaacuggcugugcagaau

SEQ ID NO: 379822 - RNA, 19 nt, Homo sapiens
cgaauuaaaguuccuguug

SEQ ID NO: 379823 - RNA, 19 nt, Homo sapiens
caaagccuauuuccaucuu

SEQ ID NO: 379824 - RNA, 19 nt, Homo sapiens
gugcugacaucaaggauuc

SEQ ID NO: 379825 - RNA, 19 nt, Homo sapiens
uacccaagcuguaaacaau

SEQ ID NO: 379826 - RNA, 19 nt, Homo sapiens
gcucauagccaaaacauuu

SEQ ID NO: 379827 - RNA, 19 nt, Homo sapiens
gagugaagcuggaaaauca

SEQ ID NO: 379828 - RNA, 19 nt, Homo sapiens
uaauaaauacccagcacua

SEQ ID NO: 379829 - RNA, 19 nt, Homo sapiens
ggugaaccacggauagaua

SEQ ID NO: 379830 - RNA, 19 nt, Homo sapiens
gaugaaagagcaaucaaca

SEQ ID NO: 379831 - RNA, 19 nt, Homo sapiens
ugucuuaaaucacuugguu

SEQ ID NO: 379832 - RNA, 19 nt, Homo sapiens
ccaagauggucaugacugu

SEQ ID NO: 379833 - RNA, 19 nt, Homo sapiens
gugaagaguggcaaucuaa

SEQ ID NO: 379834 - RNA, 19 nt, Homo sapiens
cagcugaugagaagauaua

SEQ ID NO: 379835 - RNA, 19 nt, Homo sapiens
gggcaagaccugaaugaug

SEQ ID NO: 379836 - RNA, 19 nt, Homo sapiens
guaacuggaugaacucucu

SEQ ID NO: 379837 - RNA, 19 nt, Homo sapiens
aagaugagcuugaugaacu

SEQ ID NO: 379838 - RNA, 19 nt, Homo sapiens
caagcuguuugcuauaguu

SEQ ID NO: 379839 - RNA, 19 nt, Homo sapiens
caucguagcuagaagaaaa

SEQ ID NO: 379840 - RNA, 19 nt, Homo sapiens
uauaaacuaugaccuugug

SEQ ID NO: 379841 - RNA, 19 nt, Homo sapiens
ucacguaaaccaucucuau

SEQ ID NO: 379842 - RNA, 19 nt, Homo sapiens
ggagaaacucgugaagaaa

SEQ ID NO: 379843 - RNA, 19 nt, Homo sapiens
cagagaaccaggauauuga

SEQ ID NO: 379844 - RNA, 19 nt, Homo sapiens
caacaggaaagaagguauu

SEQ ID NO: 379845 - RNA, 19 nt, Homo sapiens
ggccaaguaugcuaagugu

SEQ ID NO: 379846 - RNA, 19 nt, Homo sapiens
gagcguauuuggauaugag

SEQ ID NO: 379847 - RNA, 19 nt, Homo sapiens
ccaguaugcuaguucuuau

SEQ ID NO: 379848 - RNA, 19 nt, Homo sapiens
gaagaguggcaaucuaaca

SEQ ID NO: 379849 - RNA, 19 nt, Homo sapiens
gccauuaccaggauauaaa

SEQ ID NO: 379850 - RNA, 19 nt, Homo sapiens
ggaaggugaaccacggaua

SEQ ID NO: 379851 - RNA, 19 nt, Homo sapiens
caacuuuagugcugacauc

SEQ ID NO: 379852 - RNA, 19 nt, Homo sapiens
ggaaaaugauccugauugu

SEQ ID NO: 379853 - RNA, 19 nt, Homo sapiens
guagugauauugccaagac

SEQ ID NO: 379854 - RNA, 19 nt, Homo sapiens
gagacuaucuaaacucaua

SEQ ID NO: 379855 - RNA, 19 nt, Homo sapiens
caaaucagccaguguauaa

SEQ ID NO: 379856 - RNA, 19 nt, Homo sapiens
ccaaggaccuccaggauau

SEQ ID NO: 379857 - RNA, 19 nt, Homo sapiens
gaaaucaugcuacacuuaa

SEQ ID NO: 379858 - RNA, 19 nt, Homo sapiens
ggagugugguaguggauua

SEQ ID NO: 379859 - RNA, 19 nt, Homo sapiens
ggacagaggguuuacuuug

SEQ ID NO: 379860 - RNA, 19 nt, Homo sapiens
uacagacgcugauaacuuu

SEQ ID NO: 379861 - RNA, 19 nt, Homo sapiens
caggaaaucugaagucugu

SEQ ID NO: 379862 - RNA, 19 nt, Homo sapiens
aaacaaaacucacagauga

SEQ ID NO: 379863 - RNA, 19 nt, Homo sapiens
guaccaauagguuauguua

SEQ ID NO: 379864 - RNA, 19 nt, Homo sapiens
gaaaagagaggauguacua

SEQ ID NO: 379865 - RNA, 19 nt, Homo sapiens
acacuuaacuucuccuaga

SEQ ID NO: 379866 - RNA, 19 nt, Homo sapiens
gcaaaugccauauauucaa

SEQ ID NO: 379867 - RNA, 19 nt, Homo sapiens
gaagcuaaucuauaccaua

SEQ ID NO: 379868 - RNA, 19 nt, Homo sapiens
ggagagaccacuaagaugu

SEQ ID NO: 379869 - RNA, 19 nt, Homo sapiens
cuaccaaaguuuacaauuc

SEQ ID NO: 379870 - RNA, 19 nt, Homo sapiens
gaaauuaagaacagcuuug

SEQ ID NO: 379871 - RNA, 19 nt, Homo sapiens
ucugaagucuguauauuga

SEQ ID NO: 379872 - RNA, 19 nt, Homo sapiens
gcacuggacuggaauuuug

SEQ ID NO: 379873 - RNA, 19 nt, Homo sapiens
gaaaucugaagucuguaua

SEQ ID NO: 379874 - RNA, 19 nt, Homo sapiens
ucacagaguauaaaccuaa

SEQ ID NO: 379875 - RNA, 19 nt, Homo sapiens
uaaauacuccuucacucua

SEQ ID NO: 379876 - RNA, 19 nt, Homo sapiens
gagagaccacuaagaugua

SEQ ID NO: 379877 - RNA, 19 nt, Homo sapiens
uaauaugggucaagaaguc

SEQ ID NO: 379878 - RNA, 19 nt, Homo sapiens
gcaaauugaacuucuggaa

SEQ ID NO: 379879 - RNA, 19 nt, Homo sapiens
cuuuagaccuugauguuaa

SEQ ID NO: 379880 - RNA, 19 nt, Homo sapiens
gaauccaguucccuuuaga

SEQ ID NO: 379881 - RNA, 19 nt, Homo sapiens
aaauacuccuucacucuaa

SEQ ID NO: 379882 - RNA, 19 nt, Homo sapiens
gaagauacugauugcugua

SEQ ID NO: 379883 - RNA, 19 nt, Homo sapiens
ucagauagaucagauacug

SEQ ID NO: 379884 - RNA, 19 nt, Homo sapiens
gguguuggcgcaaagguua

SEQ ID NO: 379885 - RNA, 19 nt, Homo sapiens
ccaguucccuuuagaccuu

SEQ ID NO: 379886 - RNA, 19 nt, Homo sapiens
ccaccuggauuagaauauu

SEQ ID NO: 379887 - RNA, 19 nt, Homo sapiens
ccagagaacuguuuuaauc

SEQ ID NO: 379888 - RNA, 19 nt, Homo sapiens
caugaaauguuuagcucuu

SEQ ID NO: 379889 - RNA, 19 nt, Homo sapiens
aaagagaggauguacuaaa

SEQ ID NO: 379890 - RNA, 19 nt, Homo sapiens
aagaacagcuuuggacaga

SEQ ID NO: 379891 - RNA, 19 nt, Homo sapiens
ggaaaucugaagucuguau

SEQ ID NO: 379892 - RNA, 19 nt, Homo sapiens
guacguaagauucaggaaa

SEQ ID NO: 379893 - RNA, 19 nt, Homo sapiens
agaaaucaugcuacacuua

SEQ ID NO: 379894 - RNA, 19 nt, Homo sapiens
gccuguagcucugguugua

SEQ ID NO: 379895 - RNA, 19 nt, Homo sapiens
gcacccaugucuaccaaag

SEQ ID NO: 379896 - RNA, 19 nt, Homo sapiens
gauaauaugggucaagaag

SEQ ID NO: 379897 - RNA, 19 nt, Homo sapiens
uaagucagauagaucagau

SEQ ID NO: 379898 - RNA, 19 nt, Homo sapiens
guuuagcucuuacacucua

SEQ ID NO: 379899 - RNA, 19 nt, Homo sapiens
ugcauaagagcuaauguua

SEQ ID NO: 379900 - RNA, 19 nt, Homo sapiens
guuauguuauucagacuug

SEQ ID NO: 379901 - RNA, 19 nt, Homo sapiens
ggacuggaauuuugagaga

SEQ ID NO: 379902 - RNA, 19 nt, Homo sapiens
caccuggauuagaauauuu

SEQ ID NO: 379903 - RNA, 19 nt, Homo sapiens
caagaaaucaugcuacacu

SEQ ID NO: 379904 - RNA, 19 nt, Homo sapiens
gcugauaacuuuggaaucc

SEQ ID NO: 379905 - RNA, 19 nt, Homo sapiens
gucaagaagucauaacucu

SEQ ID NO: 379906 - RNA, 19 nt, Homo sapiens
ccaaaucagccaguguaua

SEQ ID NO: 379907 - RNA, 19 nt, Homo sapiens
ccucauugacuucauguuu

SEQ ID NO: 379908 - RNA, 19 nt, Homo sapiens
ugaaagcuguaaugauugg

SEQ ID NO: 379909 - RNA, 19 nt, Homo sapiens
ugagagaggcauuuacaga

SEQ ID NO: 379910 - RNA, 19 nt, Homo sapiens
ccaagcuccuccuggugua

SEQ ID NO: 379911 - RNA, 19 nt, Homo sapiens
gacagaggguuuacuuugc

SEQ ID NO: 379912 - RNA, 19 nt, Homo sapiens
gaaaccguguuguguacgu

SEQ ID NO: 379913 - RNA, 19 nt, Homo sapiens
uuacagacgcugauaacuu

SEQ ID NO: 379914 - RNA, 19 nt, Homo sapiens
ccaugucuaccaaaguuua

SEQ ID NO: 379915 - RNA, 19 nt, Homo sapiens
ucugauucauuguccauuu

SEQ ID NO: 379916 - RNA, 19 nt, Homo sapiens
cuguagcucugguuguaua

SEQ ID NO: 379917 - RNA, 19 nt, Homo sapiens
gguaguggauuagugaaag

SEQ ID NO: 379918 - RNA, 19 nt, Homo sapiens
ccuuuuaccuugaggauua

SEQ ID NO: 379919 - RNA, 19 nt, Homo sapiens
gcucuuacacucuauccuu

SEQ ID NO: 379920 - RNA, 19 nt, Homo sapiens
gauugagacuaucuaaacu

SEQ ID NO: 379921 - RNA, 19 nt, Homo sapiens
cgccacagccuccauuaaa

SEQ ID NO: 379922 - RNA, 19 nt, Homo sapiens
guaagauucaggaaacgaa

SEQ ID NO: 379923 - RNA, 19 nt, Homo sapiens
gaagucuguauauugauug

SEQ ID NO: 379924 - RNA, 19 nt, Homo sapiens
gugcagcuguuguggagau

SEQ ID NO: 379925 - RNA, 19 nt, Homo sapiens
aauaagugguccauguguu

SEQ ID NO: 379926 - RNA, 19 nt, Homo sapiens
uguagcagcuguuguuguc

SEQ ID NO: 379927 - RNA, 19 nt, Homo sapiens
ggagauagaaauccaagcu

SEQ ID NO: 379928 - RNA, 19 nt, Homo sapiens
cacagaguauaaaccuaaa

SEQ ID NO: 379929 - RNA, 19 nt, Homo sapiens
gagcuaauguuauuuugca

SEQ ID NO: 379930 - RNA, 19 nt, Homo sapiens
guaguggauuagugaaagu

SEQ ID NO: 379931 - RNA, 19 nt, Homo sapiens
guggagauguugauuuuga

SEQ ID NO: 379932 - RNA, 19 nt, Homo sapiens
cagcggaagauacugauug

SEQ ID NO: 379933 - RNA, 19 nt, Homo sapiens
guauauaaucagccaguug

SEQ ID NO: 379934 - RNA, 19 nt, Homo sapiens
ccuagaaaaugguaauuga

SEQ ID NO: 379935 - RNA, 19 nt, Homo sapiens
uugcaaaugccauauauuc

SEQ ID NO: 379936 - RNA, 19 nt, Homo sapiens
gucuguauauugauugaga

SEQ ID NO: 379937 - RNA, 19 nt, Homo sapiens
aagagaggauguacuaaaa

SEQ ID NO: 379938 - RNA, 19 nt, Homo sapiens
aaggaaaccguguugugua

SEQ ID NO: 379939 - RNA, 19 nt, Homo sapiens
aaacagcggcagccagaga

SEQ ID NO: 379940 - RNA, 19 nt, Homo sapiens
cagcuguuguggagauguu

SEQ ID NO: 379941 - RNA, 19 nt, Homo sapiens
acccaugucuaccaaaguu

SEQ ID NO: 379942 - RNA, 19 nt, Homo sapiens
gcauuuacagacgcugaua

SEQ ID NO: 379943 - RNA, 19 nt, Homo sapiens
aagaaaucaugcuacacuu

SEQ ID NO: 379944 - RNA, 19 nt, Homo sapiens
uagcucugguuguauacuu

SEQ ID NO: 379945 - RNA, 19 nt, Homo sapiens
aaaggaaaccguguugugu

SEQ ID NO: 379946 - RNA, 19 nt, Homo sapiens
acagaggguuuacuuugca

SEQ ID NO: 379947 - RNA, 19 nt, Homo sapiens
gcgccacagccuccauuaa

SEQ ID NO: 379948 - RNA, 19 nt, Homo sapiens
ggaccuccaggauauagug

SEQ ID NO: 379949 - RNA, 19 nt, Homo sapiens
gaaauguuuagcucuuaca

SEQ ID NO: 379950 - RNA, 19 nt, Homo sapiens
ugaaauguuuagcucuuac

SEQ ID NO: 379951 - RNA, 19 nt, Homo sapiens
cuguaugaauuaagcugua

SEQ ID NO: 379952 - RNA, 19 nt, Homo sapiens
gugccuguuuccucauuga

SEQ ID NO: 379953 - RNA, 19 nt, Homo sapiens
gccacagccuccauuaaac

SEQ ID NO: 379954 - RNA, 19 nt, Homo sapiens
ucaagaagguguaugauuu

SEQ ID NO: 379955 - RNA, 19 nt, Homo sapiens
ggagacagcugcucuacug

SEQ ID NO: 379956 - RNA, 19 nt, Homo sapiens
ggaugaaaguguccaaugu

SEQ ID NO: 379957 - RNA, 19 nt, Homo sapiens
gagaggugauugagaagaa

SEQ ID NO: 379958 - RNA, 19 nt, Homo sapiens
gaagcuguacccaauuuaa

SEQ ID NO: 379959 - RNA, 19 nt, Homo sapiens
ggacgagcuuguuggcauu

SEQ ID NO: 379960 - RNA, 19 nt, Homo sapiens
caacaucucugaggugaag

SEQ ID NO: 379961 - RNA, 19 nt, Homo sapiens
gaaccggccugcugauguc

SEQ ID NO: 379962 - RNA, 19 nt, Homo sapiens
agcaagagcuggagacuau

SEQ ID NO: 379963 - RNA, 19 nt, Homo sapiens
ccacagagaagacgggauu

SEQ ID NO: 379964 - RNA, 19 nt, Homo sapiens
gggcugaucuccacuuugc

SEQ ID NO: 379965 - RNA, 19 nt, Homo sapiens
gcugagggccaccuacuuu

SEQ ID NO: 379966 - RNA, 19 nt, Homo sapiens
gacgggauuugaagcugua

SEQ ID NO: 379967 - RNA, 19 nt, Homo sapiens
gacagcugcucuacugguu

SEQ ID NO: 379968 - RNA, 19 nt, Homo sapiens
gcuggagacuaucaccauu

SEQ ID NO: 379969 - RNA, 19 nt, Homo sapiens
uugaagcuguacccaauuu

SEQ ID NO: 379970 - RNA, 19 nt, Homo sapiens
gagaagacgggauuugaag

SEQ ID NO: 379971 - RNA, 19 nt, Homo sapiens
ugcgagaggugauugagaa

SEQ ID NO: 379972 - RNA, 19 nt, Homo sapiens
ucuacugguucuucuauga

SEQ ID NO: 379973 - RNA, 19 nt, Homo sapiens
acuauucccucaugaagga

SEQ ID NO: 379974 - RNA, 19 nt, Homo sapiens
cagagaagacgggauuuga

SEQ ID NO: 379975 - RNA, 19 nt, Homo sapiens
ccacauucauagccuguag

SEQ ID NO: 379976 - RNA, 19 nt, Homo sapiens
ugacgaaccaugcgggauu

SEQ ID NO: 379977 - RNA, 19 nt, Homo sapiens
ugaagaccaugcugcagau

SEQ ID NO: 379978 - RNA, 19 nt, Homo sapiens
ugcaugagguggugacgaa

SEQ ID NO: 379979 - RNA, 19 nt, Homo sapiens
gagcaagagcuggagacua

SEQ ID NO: 379980 - RNA, 19 nt, Homo sapiens
ggccuucucugaguucuuc

SEQ ID NO: 379981 - RNA, 19 nt, Homo sapiens
aggaagagcggauggugua

SEQ ID NO: 379982 - RNA, 19 nt, Homo sapiens
gaagagcggaugguguaug

SEQ ID NO: 379983 - RNA, 19 nt, Homo sapiens
ugaugcccaugcucaauga

SEQ ID NO: 379984 - RNA, 19 nt, Homo sapiens
aagagcggaugguguaugu

SEQ ID NO: 379985 - RNA, 19 nt, Homo sapiens
gagcugcaacugacaucuu

SEQ ID NO: 379986 - RNA, 19 nt, Homo sapiens
ccacuucuacuacaacauc

SEQ ID NO: 379987 - RNA, 19 nt, Homo sapiens
gaugaaaguguccaauguc

SEQ ID NO: 379988 - RNA, 19 nt, Homo sapiens
uauguggccuucucugagu

SEQ ID NO: 379989 - RNA, 19 nt, Homo sapiens
caagagcuggagacuauca

SEQ ID NO: 379990 - RNA, 19 nt, Homo sapiens
gcucuacugguucuucuau

SEQ ID NO: 379991 - RNA, 19 nt, Homo sapiens
gaagacgggauuugaagcu

SEQ ID NO: 379992 - RNA, 19 nt, Homo sapiens
gaaggucacagagcugcaa

SEQ ID NO: 379993 - RNA, 19 nt, Homo sapiens
gacgaaccaugcgggauuc

SEQ ID NO: 379994 - RNA, 19 nt, Homo sapiens
ucucugaguucuucuucga

SEQ ID NO: 379995 - RNA, 19 nt, Homo sapiens
cauugacuauucccucaug

SEQ ID NO: 379996 - RNA, 19 nt, Homo sapiens
caucuuccgagcucgauuu

SEQ ID NO: 379997 - RNA, 19 nt, Homo sapiens
agagaagacgggauuugaa

SEQ ID NO: 379998 - RNA, 19 nt, Homo sapiens
gugauugacuccccauuga

SEQ ID NO: 379999 - RNA, 19 nt, Homo sapiens
gaagaaccggccugcugau

SEQ ID NO: 380000 - RNA, 19 nt, Homo sapiens
ugaagcuguacccaauuua

SEQ ID NO: 380001 - RNA, 19 nt, Homo sapiens
agaccaugcugcagauugg

SEQ ID NO: 380002 - RNA, 19 nt, Homo sapiens
uggagucgcuggcucugau

SEQ ID NO: 380003 - RNA, 19 nt, Homo sapiens
caagaagguguaugauuuu

SEQ ID NO: 380004 - RNA, 19 nt, Homo sapiens
gaagguguaugauuuucuc

SEQ ID NO: 380005 - RNA, 19 nt, Homo sapiens
gaagaccaugcugcagauu

SEQ ID NO: 380006 - RNA, 19 nt, Homo sapiens
cagcugcucuacugguucu

SEQ ID NO: 380007 - RNA, 19 nt, Homo sapiens
caggagcugaugcuucaaa

SEQ ID NO: 380008 - RNA, 19 nt, Homo sapiens
cgcuggagcuggugaagca

SEQ ID NO: 380009 - RNA, 19 nt, Homo sapiens
auuugaagcuguacccaau

SEQ ID NO: 380010 - RNA, 19 nt, Homo sapiens
gugaugcccaugcucaaug

SEQ ID NO: 380011 - RNA, 19 nt, Homo sapiens
ggccacuucuacuacaaca

SEQ ID NO: 380012 - RNA, 19 nt, Homo sapiens
ugacuauucccucaugaag

SEQ ID NO: 380013 - RNA, 19 nt, Homo sapiens
cuuccgagcucgauuucca

SEQ ID NO: 380014 - RNA, 19 nt, Homo sapiens
cggaugaaaguguccaaug

SEQ ID NO: 380015 - RNA, 19 nt, Homo sapiens
uaccugagggcaucaacuu

SEQ ID NO: 380016 - RNA, 19 nt, Homo sapiens
ggaagagcggaugguguau

SEQ ID NO: 380017 - RNA, 19 nt, Homo sapiens
gcuggacggaugaaagugu

SEQ ID NO: 380018 - RNA, 19 nt, Homo sapiens
ggagauguguaccuagaua

SEQ ID NO: 380019 - RNA, 19 nt, Homo sapiens
gaaaaugacugucuccuuu

SEQ ID NO: 380020 - RNA, 19 nt, Homo sapiens
ucaaugagaucuacuccua

SEQ ID NO: 380021 - RNA, 19 nt, Homo sapiens
gagaggagauguguaccua

SEQ ID NO: 380022 - RNA, 19 nt, Homo sapiens
agacauagguguuugacuu

SEQ ID NO: 380023 - RNA, 19 nt, Homo sapiens
gaggagauguguaccuaga

SEQ ID NO: 380024 - RNA, 19 nt, Homo sapiens
ccacacaccuguauauucu

SEQ ID NO: 380025 - RNA, 19 nt, Homo sapiens
gagcuggucuuugauaugu

SEQ ID NO: 380026 - RNA, 19 nt, Homo sapiens
ccaacaagcugcucuaugc

SEQ ID NO: 380027 - RNA, 19 nt, Homo sapiens
gcacaaguaugcaccaaac

SEQ ID NO: 380028 - RNA, 19 nt, Homo sapiens
gagagacauuggagagaaa

SEQ ID NO: 380029 - RNA, 19 nt, Homo sapiens
gaaaguugauuuggagaca

SEQ ID NO: 380030 - RNA, 19 nt, Homo sapiens
gcuggaaacugagcuuuau

SEQ ID NO: 380031 - RNA, 19 nt, Homo sapiens
gggaaauaaugagaacuuu

SEQ ID NO: 380032 - RNA, 19 nt, Homo sapiens
ccacgagguuccauuugaa

SEQ ID NO: 380033 - RNA, 19 nt, Homo sapiens
gcuggucuuugauauguuu

SEQ ID NO: 380034 - RNA, 19 nt, Homo sapiens
gcaccaaacacuucgcaaa

SEQ ID NO: 380035 - RNA, 19 nt, Homo sapiens
gaagaaugaugagcacaag

SEQ ID NO: 380036 - RNA, 19 nt, Homo sapiens
agaaagaggagaagaagaa

SEQ ID NO: 380037 - RNA, 19 nt, Homo sapiens
ccagccaaguuucgucaua

SEQ ID NO: 380038 - RNA, 19 nt, Homo sapiens
gggugaacgugauuaagaa

SEQ ID NO: 380039 - RNA, 19 nt, Homo sapiens
gagagaaagaggagaagaa

SEQ ID NO: 380040 - RNA, 19 nt, Homo sapiens
gagaucuacuccuauguca

SEQ ID NO: 380041 - RNA, 19 nt, Homo sapiens
gagguuccauuugaaaguu

SEQ ID NO: 380042 - RNA, 19 nt, Homo sapiens
gaggagcuggucuuugaua

SEQ ID NO: 380043 - RNA, 19 nt, Homo sapiens
augaggagcuggucuuuga

SEQ ID NO: 380044 - RNA, 19 nt, Homo sapiens
gcagagaugcugagagaca

SEQ ID NO: 380045 - RNA, 19 nt, Homo sapiens
guuaaucccguccaacuuu

SEQ ID NO: 380046 - RNA, 19 nt, Homo sapiens
ugagagacauuggagagaa

SEQ ID NO: 380047 - RNA, 19 nt, Homo sapiens
ggaaacugagcuuuaucua

SEQ ID NO: 380048 - RNA, 19 nt, Homo sapiens
agaaugaugagcacaagua

SEQ ID NO: 380049 - RNA, 19 nt, Homo sapiens
ucccauuccuccuucuuua

SEQ ID NO: 380050 - RNA, 19 nt, Homo sapiens
agagcuggguggagagaua

SEQ ID NO: 380051 - RNA, 19 nt, Homo sapiens
gaaacugagcuuuaucuac

SEQ ID NO: 380052 - RNA, 19 nt, Homo sapiens
uccuaaaccucaacaaaug

SEQ ID NO: 380053 - RNA, 19 nt, Homo sapiens
aagaggagaagaagaauga

SEQ ID NO: 380054 - RNA, 19 nt, Homo sapiens
gauggaaggacaagugaug

SEQ ID NO: 380055 - RNA, 19 nt, Homo sapiens
gacauagguguuugacuuu

SEQ ID NO: 380056 - RNA, 19 nt, Homo sapiens
aaugagaucuacuccuaug

SEQ ID NO: 380057 - RNA, 19 nt, Homo sapiens
aaguugauuuggagacaua

SEQ ID NO: 380058 - RNA, 19 nt, Homo sapiens
uaucaaucccugucauaaa

SEQ ID NO: 380059 - RNA, 19 nt, Homo sapiens
gauguguaccuagauagua

SEQ ID NO: 380060 - RNA, 19 nt, Homo sapiens
ccauuccuccuucuuuaua

SEQ ID NO: 380061 - RNA, 19 nt, Homo sapiens
cauaucaaucccugucaua

SEQ ID NO: 380062 - RNA, 19 nt, Homo sapiens
caaaugaggagcuggucuu

SEQ ID NO: 380063 - RNA, 19 nt, Homo sapiens
gguggacaauuugaccuuu

SEQ ID NO: 380064 - RNA, 19 nt, Homo sapiens
gaaugaugagcacaaguau

SEQ ID NO: 380065 - RNA, 19 nt, Homo sapiens
cgucguccauccucaguga

SEQ ID NO: 380066 - RNA, 19 nt, Homo sapiens
gagcacaaguaugcaccaa

SEQ ID NO: 380067 - RNA, 19 nt, Homo sapiens
gaaagaggagaagaagaau

SEQ ID NO: 380068 - RNA, 19 nt, Homo sapiens
aaagagagaaagaggagaa

SEQ ID NO: 380069 - RNA, 19 nt, Homo sapiens
cccuucagguggacaauuu

SEQ ID NO: 380070 - RNA, 19 nt, Homo sapiens
cacccuggcuggcuggaaa

SEQ ID NO: 380071 - RNA, 19 nt, Homo sapiens
ugacugcugcuuugcauga

SEQ ID NO: 380072 - RNA, 19 nt, Homo sapiens
uccacgagguuccauuuga

SEQ ID NO: 380073 - RNA, 19 nt, Homo sapiens
caauuucccuaaaguuacu

SEQ ID NO: 380074 - RNA, 19 nt, Homo sapiens
uagauaguaccaaugcuuu

SEQ ID NO: 380075 - RNA, 19 nt, Homo sapiens
acacaccuguauauucuca

SEQ ID NO: 380076 - RNA, 19 nt, Homo sapiens
ccgcaugcauucucaaguc

SEQ ID NO: 380077 - RNA, 19 nt, Homo sapiens
guggacaauuugaccuuug

SEQ ID NO: 380078 - RNA, 19 nt, Homo sapiens
gaggagaagaagaaugaug

SEQ ID NO: 380079 - RNA, 19 nt, Homo sapiens
gagaaagaggagaagaaga

SEQ ID NO: 380080 - RNA, 19 nt, Homo sapiens
uggacaauuugaccuuuga

SEQ ID NO: 380081 - RNA, 19 nt, Homo sapiens
gagauacuacgcagacauc

SEQ ID NO: 380082 - RNA, 19 nt, Homo sapiens
ucagugaccaggacaugaa

SEQ ID NO: 380083 - RNA, 19 nt, Homo sapiens
ccaaggacauccccagcua

SEQ ID NO: 380084 - RNA, 19 nt, Homo sapiens
ggagcuggucuuugauaug

SEQ ID NO: 380085 - RNA, 19 nt, Homo sapiens
ggcuggaaacugagcuuua

SEQ ID NO: 380086 - RNA, 19 nt, Homo sapiens
ucagugagaacaccagaga

SEQ ID NO: 380087 - RNA, 19 nt, Homo sapiens
ccuguauauucucaucuuu

SEQ ID NO: 380088 - RNA, 19 nt, Homo sapiens
cuggcuggcuggaaacuga

SEQ ID NO: 380089 - RNA, 19 nt, Homo sapiens
ucaagucuucucugccuuu

SEQ ID NO: 380090 - RNA, 19 nt, Homo sapiens
ccagaggaguauggaacuu

SEQ ID NO: 380091 - RNA, 19 nt, Homo sapiens
acuccuaugucagcaagua

SEQ ID NO: 380092 - RNA, 19 nt, Homo sapiens
aauccuaaaccucaacaaa

SEQ ID NO: 380093 - RNA, 19 nt, Homo sapiens
cuaccacacaccuguauau

SEQ ID NO: 380094 - RNA, 19 nt, Homo sapiens
gaacuuccagaacuuugca

SEQ ID NO: 380095 - RNA, 19 nt, Homo sapiens
caugcauucucaagucuuc

SEQ ID NO: 380096 - RNA, 19 nt, Homo sapiens
aggagaagaagaaugauga

SEQ ID NO: 380097 - RNA, 19 nt, Homo sapiens
ucagauggaaggacaagug

SEQ ID NO: 380098 - RNA, 19 nt, Homo sapiens
cccauuuucuuccauuuua

SEQ ID NO: 380099 - RNA, 19 nt, Homo sapiens
gcuccugggugaacgugau

SEQ ID NO: 380100 - RNA, 19 nt, Homo sapiens
cagccaaguuucgucauag

SEQ ID NO: 380101 - RNA, 19 nt, Homo sapiens
ccuaaaccucaacaaauga

SEQ ID NO: 380102 - RNA, 19 nt, Homo sapiens
agaccuucauggacucuug

SEQ ID NO: 380103 - RNA, 19 nt, Homo sapiens
gagagauacuacgcagaca

SEQ ID NO: 380104 - RNA, 19 nt, Homo sapiens
cauagguguuugacuuugg

SEQ ID NO: 380105 - RNA, 19 nt, Homo sapiens
aacccuggcuggacccauu

SEQ ID NO: 380106 - RNA, 19 nt, Homo sapiens
cagauggaaggacaaguga

SEQ ID NO: 380107 - RNA, 19 nt, Homo sapiens
ugggugaacgugauuaaga

SEQ ID NO: 380108 - RNA, 19 nt, Homo sapiens
gguguuugacuuuggaguu

SEQ ID NO: 380109 - RNA, 19 nt, Homo sapiens
cuagauaguaccaaugcuu

SEQ ID NO: 380110 - RNA, 19 nt, Homo sapiens
gagaugcugagagacauug

SEQ ID NO: 380111 - RNA, 19 nt, Homo sapiens
acauagguguuugacuuug

SEQ ID NO: 380112 - RNA, 19 nt, Homo sapiens
ggacccauuuucuuccauu

SEQ ID NO: 380113 - RNA, 19 nt, Homo sapiens
ccauuugaaaguugauuug

SEQ ID NO: 380114 - RNA, 19 nt, Homo sapiens
aaaguuacuaugagaagug

SEQ ID NO: 380115 - RNA, 19 nt, Homo sapiens
cccuaaaguuacuaugaga

SEQ ID NO: 380116 - RNA, 19 nt, Homo sapiens
gacaauuugaccuuugaug

SEQ ID NO: 380117 - RNA, 19 nt, Homo sapiens
caaauugcaaagccaucaa

SEQ ID NO: 380118 - RNA, 19 nt, Homo sapiens
gcaaacaucugauaacaug

SEQ ID NO: 380119 - RNA, 19 nt, Homo sapiens
gcagagaccucaccuuuga

SEQ ID NO: 380120 - RNA, 19 nt, Homo sapiens
ucacagaccucaugacuga

SEQ ID NO: 380121 - RNA, 19 nt, Homo sapiens
acaaguacaucaacaagua

SEQ ID NO: 380122 - RNA, 19 nt, Homo sapiens
ugaacacacugcagcauua

SEQ ID NO: 380123 - RNA, 19 nt, Homo sapiens
gagaggagccgacuacgua

SEQ ID NO: 380124 - RNA, 19 nt, Homo sapiens
ggucacagaucuauaggaa

SEQ ID NO: 380125 - RNA, 19 nt, Homo sapiens
gagcagagaccucaccuuu

SEQ ID NO: 380126 - RNA, 19 nt, Homo sapiens
aaacuucccucucuuucua

SEQ ID NO: 380127 - RNA, 19 nt, Homo sapiens
gaccuugaaugcacuauug

SEQ ID NO: 380128 - RNA, 19 nt, Homo sapiens
gaacaacugcggugugaga

SEQ ID NO: 380129 - RNA, 19 nt, Homo sapiens
ugcaugaacucuacaagua

SEQ ID NO: 380130 - RNA, 19 nt, Homo sapiens
guucagggcuccacguuga

SEQ ID NO: 380131 - RNA, 19 nt, Homo sapiens
augggaagcuugaguauuu

SEQ ID NO: 380132 - RNA, 19 nt, Homo sapiens
ggaccgagguggccuacau

SEQ ID NO: 380133 - RNA, 19 nt, Homo sapiens
ccacaccuuucuccuauga

SEQ ID NO: 380134 - RNA, 19 nt, Homo sapiens
ugacugacaagcagaguua

SEQ ID NO: 380135 - RNA, 19 nt, Homo sapiens
ucaacaaacuucuguaugc

SEQ ID NO: 380136 - RNA, 19 nt, Homo sapiens
gcaagaaggaauucacaga

SEQ ID NO: 380137 - RNA, 19 nt, Homo sapiens
gaaccuggaccuugcaaug

SEQ ID NO: 380138 - RNA, 19 nt, Homo sapiens
cagaacaacugcgguguga

SEQ ID NO: 380139 - RNA, 19 nt, Homo sapiens
ggaauucacagaccucaug

SEQ ID NO: 380140 - RNA, 19 nt, Homo sapiens
gaucaacaaacuucuguau

SEQ ID NO: 380141 - RNA, 19 nt, Homo sapiens
gcaguagccagcaauuuga

SEQ ID NO: 380142 - RNA, 19 nt, Homo sapiens
caaguacuaugaccagauc

SEQ ID NO: 380143 - RNA, 19 nt, Homo sapiens
gaacuguccuggaacuacu

SEQ ID NO: 380144 - RNA, 19 nt, Homo sapiens
ccaaauacaccuugaacga

SEQ ID NO: 380145 - RNA, 19 nt, Homo sapiens
ugacaggcaaggccaaaua

SEQ ID NO: 380146 - RNA, 19 nt, Homo sapiens
uggagaagcugcucaccaa

SEQ ID NO: 380147 - RNA, 19 nt, Homo sapiens
gcucagauuuggcgcuguu

SEQ ID NO: 380148 - RNA, 19 nt, Homo sapiens
aguaugaugucaauucuga

SEQ ID NO: 380149 - RNA, 19 nt, Homo sapiens
ucagagaggauguggagua

SEQ ID NO: 380150 - RNA, 19 nt, Homo sapiens
caaccuggucuuugacuuu

SEQ ID NO: 380151 - RNA, 19 nt, Homo sapiens
gaggagccgugccauguca

SEQ ID NO: 380152 - RNA, 19 nt, Homo sapiens
uggcugaacuguccuggaa

SEQ ID NO: 380153 - RNA, 19 nt, Homo sapiens
caacaaacuucuguaugca

SEQ ID NO: 380154 - RNA, 19 nt, Homo sapiens
gugcaaacaucugauaaca

SEQ ID NO: 380155 - RNA, 19 nt, Homo sapiens
ggaggugguggcuaugaua

SEQ ID NO: 380156 - RNA, 19 nt, Homo sapiens
gaaagguacuaugcagaca

SEQ ID NO: 380157 - RNA, 19 nt, Homo sapiens
gcggacaguucaaguauac

SEQ ID NO: 380158 - RNA, 19 nt, Homo sapiens
gcuggaagccacaccaauu

SEQ ID NO: 380159 - RNA, 19 nt, Homo sapiens
accaacagcuugccucuga

SEQ ID NO: 380160 - RNA, 19 nt, Homo sapiens
guucguggaugaccuguuc

SEQ ID NO: 380161 - RNA, 19 nt, Homo sapiens
caucaucauuguccucaug

SEQ ID NO: 380162 - RNA, 19 nt, Homo sapiens
agaccagccuugucacuug

SEQ ID NO: 380163 - RNA, 19 nt, Homo sapiens
cuauguaucucgagugugu

SEQ ID NO: 380164 - RNA, 19 nt, Homo sapiens
gaggagaggccaccuucuu

SEQ ID NO: 380165 - RNA, 19 nt, Homo sapiens
gcuaucggcuccagcagau

SEQ ID NO: 380166 - RNA, 19 nt, Homo sapiens
gcagacggcccacuguaga

SEQ ID NO: 380167 - RNA, 19 nt, Homo sapiens
gagcagacggcccacugua

SEQ ID NO: 380168 - RNA, 19 nt, Homo sapiens
gcacccgucucacccugaa

SEQ ID NO: 380169 - RNA, 19 nt, Homo sapiens
ggcagguucuggcuccaua

SEQ ID NO: 380170 - RNA, 19 nt, Homo sapiens
caucagagcccgcuugucu

SEQ ID NO: 380171 - RNA, 19 nt, Homo sapiens
caagcugccuucuccuaug

SEQ ID NO: 380172 - RNA, 19 nt, Homo sapiens
uggacacccuggaugcuua

SEQ ID NO: 380173 - RNA, 19 nt, Homo sapiens
cugagguucuggaucaaua

SEQ ID NO: 380174 - RNA, 19 nt, Homo sapiens
ugaagguccuagacuguga

SEQ ID NO: 380175 - RNA, 19 nt, Homo sapiens
gcacccgccuucuccacuu

SEQ ID NO: 380176 - RNA, 19 nt, Homo sapiens
caaggucacagaucuauag

SEQ ID NO: 380177 - RNA, 19 nt, Homo sapiens
uggccuacaucgaguauga

SEQ ID NO: 380178 - RNA, 19 nt, Homo sapiens
gcacuacuacuccuaugug

SEQ ID NO: 380179 - RNA, 19 nt, Homo sapiens
guacuaugcagacaucaga

SEQ ID NO: 380180 - RNA, 19 nt, Homo sapiens
cagagacugugguggagaa

SEQ ID NO: 380181 - RNA, 19 nt, Homo sapiens
gagcguccacguuguguga

SEQ ID NO: 380182 - RNA, 19 nt, Homo sapiens
ccagagcaguggcuaugga

SEQ ID NO: 380183 - RNA, 19 nt, Homo sapiens
acgaggaugucacuucuga

SEQ ID NO: 380184 - RNA, 19 nt, Homo sapiens
gagcaccuguaugucauga

SEQ ID NO: 380185 - RNA, 19 nt, Homo sapiens
ucuuugaccugcuggauga

SEQ ID NO: 380186 - RNA, 19 nt, Homo sapiens
cccaguauguggccaagaa

SEQ ID NO: 380187 - RNA, 19 nt, Homo sapiens
uugacaaccuggucuuuga

SEQ ID NO: 380188 - RNA, 19 nt, Homo sapiens
ggguguaacuggugugucu

SEQ ID NO: 380189 - RNA, 19 nt, Homo sapiens
ucauauuccugccacuuug

SEQ ID NO: 380190 - RNA, 19 nt, Homo sapiens
ccaaggccaucccugagau

SEQ ID NO: 380191 - RNA, 19 nt, Homo sapiens
ggguggaauuuauccuuga

SEQ ID NO: 380192 - RNA, 19 nt, Homo sapiens
gagguggaccggcuugcua

SEQ ID NO: 380193 - RNA, 19 nt, Homo sapiens
gaggugcucuuugcagcuu

SEQ ID NO: 380194 - RNA, 19 nt, Homo sapiens
aaacaaggucacagaucua

SEQ ID NO: 380195 - RNA, 19 nt, Homo sapiens
ugcagaaguucguggauga

SEQ ID NO: 380196 - RNA, 19 nt, Homo sapiens
aagaggacguggugucuca

SEQ ID NO: 380197 - RNA, 19 nt, Homo sapiens
ggagaggccaccuucuuag

SEQ ID NO: 380198 - RNA, 19 nt, Homo sapiens
caugaacucuacaaguaca

SEQ ID NO: 380199 - RNA, 19 nt, Homo sapiens
gguucuggaucaauauaau

SEQ ID NO: 380200 - RNA, 19 nt, Homo sapiens
gagguucuggaucaauaua

SEQ ID NO: 380201 - RNA, 19 nt, Homo sapiens
cagggucgccucuccauga

SEQ ID NO: 380202 - RNA, 19 nt, Homo sapiens
aagcugccuucuccuauga

SEQ ID NO: 380203 - RNA, 19 nt, Homo sapiens
caccugugaugccugauga

SEQ ID NO: 380204 - RNA, 19 nt, Homo sapiens
cgaguaugaugucaauucu

SEQ ID NO: 380205 - RNA, 19 nt, Homo sapiens
aggagaggccaccuucuua

SEQ ID NO: 380206 - RNA, 19 nt, Homo sapiens
guacagacgccaagaaucc

SEQ ID NO: 380207 - RNA, 19 nt, Homo sapiens
gauacccagugccauguca

SEQ ID NO: 380208 - RNA, 19 nt, Homo sapiens
gguucuggcuccauaucuu

SEQ ID NO: 380209 - RNA, 19 nt, Homo sapiens
ggaggcgccugaacacacu

SEQ ID NO: 380210 - RNA, 19 nt, Homo sapiens
uggacuggcucacgagaga

SEQ ID NO: 380211 - RNA, 19 nt, Homo sapiens
gaacucuacaaguacauca

SEQ ID NO: 380212 - RNA, 19 nt, Homo sapiens
gacgugcaaacaucugaua

SEQ ID NO: 380213 - RNA, 19 nt, Homo sapiens
ccaucugucuguauaccuu

SEQ ID NO: 380214 - RNA, 19 nt, Homo sapiens
ucucuaaccugcucaacag

SEQ ID NO: 380215 - RNA, 19 nt, Homo sapiens
gaauucacagaccucauga

SEQ ID NO: 380216 - RNA, 19 nt, Homo sapiens
auaagaagguucagaucca

SEQ ID NO: 380217 - RNA, 19 nt, Homo sapiens
aggaggaggugguggcuau

SEQ ID NO: 380218 - RNA, 19 nt, Homo sapiens
caaagugacugaccuguga

SEQ ID NO: 380219 - RNA, 19 nt, Homo sapiens
caccugagauuguuucuaa

SEQ ID NO: 380220 - RNA, 19 nt, Homo sapiens
ggaagagacucaacaccuu

SEQ ID NO: 380221 - RNA, 19 nt, Homo sapiens
aaacggacccugaaugaua

SEQ ID NO: 380222 - RNA, 19 nt, Homo sapiens
gaaccgagccagccacuga

SEQ ID NO: 380223 - RNA, 19 nt, Homo sapiens
caacacccaugcucuuuau

SEQ ID NO: 380224 - RNA, 19 nt, Homo sapiens
gcagaugaauacuuccauu

SEQ ID NO: 380225 - RNA, 19 nt, Homo sapiens
ggaugcagaugaauacuuc

SEQ ID NO: 380226 - RNA, 19 nt, Homo sapiens
cagcuuggcucauguggaa

SEQ ID NO: 380227 - RNA, 19 nt, Homo sapiens
gaugaauacuuccauugug

SEQ ID NO: 380228 - RNA, 19 nt, Homo sapiens
gagaugaacucugcuuugg

SEQ ID NO: 380229 - RNA, 19 nt, Homo sapiens
acaccaaccuguacuccua

SEQ ID NO: 380230 - RNA, 19 nt, Homo sapiens
ggagcugccuggagaacuu

SEQ ID NO: 380231 - RNA, 19 nt, Homo sapiens
gaacccacagcucaucuuu

SEQ ID NO: 380232 - RNA, 19 nt, Homo sapiens
ccaaacggacccugaauga

SEQ ID NO: 380233 - RNA, 19 nt, Homo sapiens
ggacaacacccaugcucuu

SEQ ID NO: 380234 - RNA, 19 nt, Homo sapiens
ggagaugaacucugcuuug

SEQ ID NO: 380235 - RNA, 19 nt, Homo sapiens
uggaugagcuagcagagaa

SEQ ID NO: 380236 - RNA, 19 nt, Homo sapiens
cagguacuaugaucagauu

SEQ ID NO: 380237 - RNA, 19 nt, Homo sapiens
gcccagaccuucauugacu

SEQ ID NO: 380238 - RNA, 19 nt, Homo sapiens
acccacagcucaucuuuga

SEQ ID NO: 380239 - RNA, 19 nt, Homo sapiens
ugcggaaccuucaacauuu

SEQ ID NO: 380240 - RNA, 19 nt, Homo sapiens
gugcggaaccuucaacauu

SEQ ID NO: 380241 - RNA, 19 nt, Homo sapiens
ccaaggccauuccggaaau

SEQ ID NO: 380242 - RNA, 19 nt, Homo sapiens
aaucacauccggaaauaaa

SEQ ID NO: 380243 - RNA, 19 nt, Homo sapiens
caagaccaggugccacuua

SEQ ID NO: 380244 - RNA, 19 nt, Homo sapiens
ucacccaggucaaggagaa

SEQ ID NO: 380245 - RNA, 19 nt, Homo sapiens
ccaacuggcuguccaucug

SEQ ID NO: 380246 - RNA, 19 nt, Homo sapiens
uggagaaacugcucaccaa

SEQ ID NO: 380247 - RNA, 19 nt, Homo sapiens
gagguacuaugcggacauu

SEQ ID NO: 380248 - RNA, 19 nt, Homo sapiens
uguuugaccuucuggauga

SEQ ID NO: 380249 - RNA, 19 nt, Homo sapiens
gcagaugggcacaugauag

SEQ ID NO: 380250 - RNA, 19 nt, Homo sapiens
guacuaugaucagauuauc

SEQ ID NO: 380251 - RNA, 19 nt, Homo sapiens
acaaccacauccacaggua

SEQ ID NO: 380252 - RNA, 19 nt, Homo sapiens
cagagaccaugguggagaa

SEQ ID NO: 380253 - RNA, 19 nt, Homo sapiens
ggaguucacagaccucaug

SEQ ID NO: 380254 - RNA, 19 nt, Homo sapiens
cagcugaacugagcguaug

SEQ ID NO: 380255 - RNA, 19 nt, Homo sapiens
gcggaaccuucaacauuuc

SEQ ID NO: 380256 - RNA, 19 nt, Homo sapiens
ccaccaacuucuccuuuua

SEQ ID NO: 380257 - RNA, 19 nt, Homo sapiens
gaaaaucacauccggaaau

SEQ ID NO: 380258 - RNA, 19 nt, Homo sapiens
agaaacugcucaccaacug

SEQ ID NO: 380259 - RNA, 19 nt, Homo sapiens
accaguggcuguggaguua

SEQ ID NO: 380260 - RNA, 19 nt, Homo sapiens
gacaacacccaugcucuuu

SEQ ID NO: 380261 - RNA, 19 nt, Homo sapiens
aaaaucacauccggaaaua

SEQ ID NO: 380262 - RNA, 19 nt, Homo sapiens
caagccagcacuucaccua

SEQ ID NO: 380263 - RNA, 19 nt, Homo sapiens
aagaccaggugccacuuaa

SEQ ID NO: 380264 - RNA, 19 nt, Homo sapiens
ugcaagaacucuacaacca

SEQ ID NO: 380265 - RNA, 19 nt, Homo sapiens
ggagaucccacgcuacaag

SEQ ID NO: 380266 - RNA, 19 nt, Homo sapiens
gaagaacccacagcucauc

SEQ ID NO: 380267 - RNA, 19 nt, Homo sapiens
ggucccagauggagcaaca

SEQ ID NO: 380268 - RNA, 19 nt, Homo sapiens
gcgagugccuggugaagac

SEQ ID NO: 380269 - RNA, 19 nt, Homo sapiens
ucaacaccuugcaacacua

SEQ ID NO: 380270 - RNA, 19 nt, Homo sapiens
ucacgcagcucuccaaccu

SEQ ID NO: 380271 - RNA, 19 nt, Homo sapiens
gguacuaugaucagauuau

SEQ ID NO: 380272 - RNA, 19 nt, Homo sapiens
cccauuacgugcacaggaa

SEQ ID NO: 380273 - RNA, 19 nt, Homo sapiens
acaacacccaugcucuuua

SEQ ID NO: 380274 - RNA, 19 nt, Homo sapiens
gcacgcugcagaaguuugu

SEQ ID NO: 380275 - RNA, 19 nt, Homo sapiens
ucaaggagaagguguugga

SEQ ID NO: 380276 - RNA, 19 nt, Homo sapiens
ggaggagcagcccagcuuu

SEQ ID NO: 380277 - RNA, 19 nt, Homo sapiens
gagaagcagcgguccuugu

SEQ ID NO: 380278 - RNA, 19 nt, Homo sapiens
ccaggcagaugggcacaug

SEQ ID NO: 380279 - RNA, 19 nt, Homo sapiens
ccugagauuguuucuaauu

SEQ ID NO: 380280 - RNA, 19 nt, Homo sapiens
ucuggaggcucugcaagaa

SEQ ID NO: 380281 - RNA, 19 nt, Homo sapiens
guaccaccucggagcauaa

SEQ ID NO: 380282 - RNA, 19 nt, Homo sapiens
gggugaaugccuugaagaa

SEQ ID NO: 380283 - RNA, 19 nt, Homo sapiens
gcaccuaauaccacucuca

SEQ ID NO: 380284 - RNA, 19 nt, Homo sapiens
gcucccagggccagguuua

SEQ ID NO: 380285 - RNA, 19 nt, Homo sapiens
uggaguaccugacggacau

SEQ ID NO: 380286 - RNA, 19 nt, Homo sapiens
cagaugaauacuuccauug

SEQ ID NO: 380287 - RNA, 19 nt, Homo sapiens
ggcugucacuggcccugua

SEQ ID NO: 380288 - RNA, 19 nt, Homo sapiens
caagccggauccaccaaca

SEQ ID NO: 380289 - RNA, 19 nt, Homo sapiens
gagaaacugcucaccaacu

SEQ ID NO: 380290 - RNA, 19 nt, Homo sapiens
guaccugacggacaucaug

SEQ ID NO: 380291 - RNA, 19 nt, Homo sapiens
cagccugccugucgcuaug

SEQ ID NO: 380292 - RNA, 19 nt, Homo sapiens
caacaccgcagcgccuuau

SEQ ID NO: 380293 - RNA, 19 nt, Homo sapiens
gagcagggccaggucacuu

SEQ ID NO: 380294 - RNA, 19 nt, Homo sapiens
gccaaggccauuccggaaa

SEQ ID NO: 380295 - RNA, 19 nt, Homo sapiens
auaccacucucaaccacuu

SEQ ID NO: 380296 - RNA, 19 nt, Homo sapiens
gcagcugaacugagcguau

SEQ ID NO: 380297 - RNA, 19 nt, Homo sapiens
cgagcuaccaggagaugaa

SEQ ID NO: 380298 - RNA, 19 nt, Homo sapiens
cgacuucuccgacuacaac

SEQ ID NO: 380299 - RNA, 19 nt, Homo sapiens
caguggcagucaccucuau

SEQ ID NO: 380300 - RNA, 19 nt, Homo sapiens
guaccuguuugaccuucug

SEQ ID NO: 380301 - RNA, 19 nt, Homo sapiens
agggcacgcugcagaaguu

SEQ ID NO: 380302 - RNA, 19 nt, Homo sapiens
cacccaugcucuuuaugug

SEQ ID NO: 380303 - RNA, 19 nt, Homo sapiens
gcagggccaggucacuuug

SEQ ID NO: 380304 - RNA, 19 nt, Homo sapiens
gcaguggcagucaccucua

SEQ ID NO: 380305 - RNA, 19 nt, Homo sapiens
ggcagaugggcacaugaua

SEQ ID NO: 380306 - RNA, 19 nt, Homo sapiens
ccaacaccgcagcgccuua

SEQ ID NO: 380307 - RNA, 19 nt, Homo sapiens
uguaccaccucggagcaua

SEQ ID NO: 380308 - RNA, 19 nt, Homo sapiens
caauguggacgccauccuu

SEQ ID NO: 380309 - RNA, 19 nt, Homo sapiens
ggacccugcacaucuggaa

SEQ ID NO: 380310 - RNA, 19 nt, Homo sapiens
gccaaacggacccugaaug

SEQ ID NO: 380311 - RNA, 19 nt, Homo sapiens
ugaagggcacgcugcagaa

SEQ ID NO: 380312 - RNA, 19 nt, Homo sapiens
cuacaaggucccagaugga

SEQ ID NO: 380313 - RNA, 19 nt, Homo sapiens
gugaaccacuguacaugcu

SEQ ID NO: 380314 - RNA, 19 nt, Homo sapiens
cagcgguccuuguggucuu

SEQ ID NO: 380315 - RNA, 19 nt, Homo sapiens
ucacuggcccuguaaucga

SEQ ID NO: 380316 - RNA, 19 nt, Homo sapiens
cccaugcucuuuaugugau

SEQ ID NO: 380317 - RNA, 19 nt, Homo sapiens
ccacauccacagguacuau

SEQ ID NO: 380318 - RNA, 19 nt, Homo sapiens
gaagaaagacugcauugua

SEQ ID NO: 380319 - RNA, 19 nt, Homo sapiens
ggaagacccuugaaaauaa

SEQ ID NO: 380320 - RNA, 19 nt, Homo sapiens
aagaaagacugcauuguaa

SEQ ID NO: 380321 - RNA, 19 nt, Homo sapiens
caacucagcacauuguaua

SEQ ID NO: 380322 - RNA, 19 nt, Homo sapiens
gaaagacugcauuguaauu

SEQ ID NO: 380323 - RNA, 19 nt, Homo sapiens
caaauuguauugcuucugu

SEQ ID NO: 380324 - RNA, 19 nt, Homo sapiens
ggaaacggaagauggaaua

SEQ ID NO: 380325 - RNA, 19 nt, Homo sapiens
gaaauguuauacucagugu

SEQ ID NO: 380326 - RNA, 19 nt, Homo sapiens
cuaaagaguuucuaaaggu

SEQ ID NO: 380327 - RNA, 19 nt, Homo sapiens
gaaccugacugcaucaaaa

SEQ ID NO: 380328 - RNA, 19 nt, Homo sapiens
uuaguagggucucaaguaa

SEQ ID NO: 380329 - RNA, 19 nt, Homo sapiens
gcacucaccguguguaguu

SEQ ID NO: 380330 - RNA, 19 nt, Homo sapiens
gggaugagagaacauuaua

SEQ ID NO: 380331 - RNA, 19 nt, Homo sapiens
gugcacguuucaucaauuu

SEQ ID NO: 380332 - RNA, 19 nt, Homo sapiens
gagaaacaguucagugcau

SEQ ID NO: 380333 - RNA, 19 nt, Homo sapiens
gaauggaagacccuugaaa

SEQ ID NO: 380334 - RNA, 19 nt, Homo sapiens
guauaaccagggauaauaa

SEQ ID NO: 380335 - RNA, 19 nt, Homo sapiens
ggagaugccugggaagaag

SEQ ID NO: 380336 - RNA, 19 nt, Homo sapiens
uggaauacaucaaagugaa

SEQ ID NO: 380337 - RNA, 19 nt, Homo sapiens
cuacucaacucaggagauu

SEQ ID NO: 380338 - RNA, 19 nt, Homo sapiens
gcacacauauaaaaguuga

SEQ ID NO: 380339 - RNA, 19 nt, Homo sapiens
aaaauuaccucacaucugu

SEQ ID NO: 380340 - RNA, 19 nt, Homo sapiens
acaguuaguucucaucuag

SEQ ID NO: 380341 - RNA, 19 nt, Homo sapiens
gggcguuacuagaaacuau

SEQ ID NO: 380342 - RNA, 19 nt, Homo sapiens
acacugaaauguuauacuc

SEQ ID NO: 380343 - RNA, 19 nt, Homo sapiens
gauuaccgcuggccuacug

SEQ ID NO: 380344 - RNA, 19 nt, Homo sapiens
gcauuguaauugagaggaa

SEQ ID NO: 380345 - RNA, 19 nt, Homo sapiens
guaauugagaggaauguga

SEQ ID NO: 380346 - RNA, 19 nt, Homo sapiens
uaucugggcuauauacagu

SEQ ID NO: 380347 - RNA, 19 nt, Homo sapiens
acaguucagugcauuguug

SEQ ID NO: 380348 - RNA, 19 nt, Homo sapiens
gaagacccuugaaaauaaa

SEQ ID NO: 380349 - RNA, 19 nt, Homo sapiens
ggaugagagaacauuauaa

SEQ ID NO: 380350 - RNA, 19 nt, Homo sapiens
ggugcacguuucaucaauu

SEQ ID NO: 380351 - RNA, 19 nt, Homo sapiens
aaacucuucugcucaggaa

SEQ ID NO: 380352 - RNA, 19 nt, Homo sapiens
gaaaugcuccuugucacau

SEQ ID NO: 380353 - RNA, 19 nt, Homo sapiens
agaaacaguucagugcauu

SEQ ID NO: 380354 - RNA, 19 nt, Homo sapiens
uguagucacuuuagaugga

SEQ ID NO: 380355 - RNA, 19 nt, Homo sapiens
gaaaguuccauauaugcau

SEQ ID NO: 380356 - RNA, 19 nt, Homo sapiens
uguauaaccagggauaaua

SEQ ID NO: 380357 - RNA, 19 nt, Homo sapiens
ggucucaaguaaguucauu

SEQ ID NO: 380358 - RNA, 19 nt, Homo sapiens
gaaacaguucagugcauug

SEQ ID NO: 380359 - RNA, 19 nt, Homo sapiens
ggaggugcacguuucauca

SEQ ID NO: 380360 - RNA, 19 nt, Homo sapiens
aaucugauauccaaacucu

SEQ ID NO: 380361 - RNA, 19 nt, Homo sapiens
cuuaguagggucucaagua

SEQ ID NO: 380362 - RNA, 19 nt, Homo sapiens
aagacugcauuguaauuga

SEQ ID NO: 380363 - RNA, 19 nt, Homo sapiens
ucuaaagaguuucuaaagg

SEQ ID NO: 380364 - RNA, 19 nt, Homo sapiens
gaacauggggauuuuguau

SEQ ID NO: 380365 - RNA, 19 nt, Homo sapiens
ggaauacaucaaagugaau

SEQ ID NO: 380366 - RNA, 19 nt, Homo sapiens
gcaggacuguucguguuca

SEQ ID NO: 380367 - RNA, 19 nt, Homo sapiens
gcuauauacaguccucaaa

SEQ ID NO: 380368 - RNA, 19 nt, Homo sapiens
gaaacuucugaaucugaua

SEQ ID NO: 380369 - RNA, 19 nt, Homo sapiens
uauacucaguguugauuuc

SEQ ID NO: 380370 - RNA, 19 nt, Homo sapiens
cucagcacauuguauauga

SEQ ID NO: 380371 - RNA, 19 nt, Homo sapiens
ucagugcauuguuguuguu

SEQ ID NO: 380372 - RNA, 19 nt, Homo sapiens
gaacuuccggcagaaacuu

SEQ ID NO: 380373 - RNA, 19 nt, Homo sapiens
guagucacuuuagauggaa

SEQ ID NO: 380374 - RNA, 19 nt, Homo sapiens
uaaaagaacauggggauuu

SEQ ID NO: 380375 - RNA, 19 nt, Homo sapiens
ggaaccugacugcaucaaa

SEQ ID NO: 380376 - RNA, 19 nt, Homo sapiens
cugcaggacuguucguguu

SEQ ID NO: 380377 - RNA, 19 nt, Homo sapiens
cuguggcaguaaacuauua

SEQ ID NO: 380378 - RNA, 19 nt, Homo sapiens
guagguuguagucacuuua

SEQ ID NO: 380379 - RNA, 19 nt, Homo sapiens
aguagggucucaaguaagu

SEQ ID NO: 380380 - RNA, 19 nt, Homo sapiens
ucaaagugaauuucuguuc

SEQ ID NO: 380381 - RNA, 19 nt, Homo sapiens
uguccgaggugcuccaguu

SEQ ID NO: 380382 - RNA, 19 nt, Homo sapiens
uaauugagaggaaugugaa

SEQ ID NO: 380383 - RNA, 19 nt, Homo sapiens
acauggggauuuuguauaa

SEQ ID NO: 380384 - RNA, 19 nt, Homo sapiens
cagcacauuguauaugauu

SEQ ID NO: 380385 - RNA, 19 nt, Homo sapiens
caucaaagugaauuucugu

SEQ ID NO: 380386 - RNA, 19 nt, Homo sapiens
ugacucaaauuguauugcu

SEQ ID NO: 380387 - RNA, 19 nt, Homo sapiens
aauguuauacucaguguug

SEQ ID NO: 380388 - RNA, 19 nt, Homo sapiens
gauggaaaauuaccucaca

SEQ ID NO: 380389 - RNA, 19 nt, Homo sapiens
ccucacaucuguuuucuuc

SEQ ID NO: 380390 - RNA, 19 nt, Homo sapiens
gaggugcacguuucaucaa

SEQ ID NO: 380391 - RNA, 19 nt, Homo sapiens
gaaaauuaccucacaucug

SEQ ID NO: 380392 - RNA, 19 nt, Homo sapiens
ucugauauccaaacucuuc

SEQ ID NO: 380393 - RNA, 19 nt, Homo sapiens
ugaggggacuccuucaaaa

SEQ ID NO: 380394 - RNA, 19 nt, Homo sapiens
aacggaagauggaauacau

SEQ ID NO: 380395 - RNA, 19 nt, Homo sapiens
aaagacugcauuguaauug

SEQ ID NO: 380396 - RNA, 19 nt, Homo sapiens
uguagguuguagucacuuu

SEQ ID NO: 380397 - RNA, 19 nt, Homo sapiens
cgaaaugcuccuugucaca

SEQ ID NO: 380398 - RNA, 19 nt, Homo sapiens
ccauauaugcauuggugaa

SEQ ID NO: 380399 - RNA, 19 nt, Homo sapiens
acucaguguugauuucuuc

SEQ ID NO: 380400 - RNA, 19 nt, Homo sapiens
ccuagaggcagcuauuuua

SEQ ID NO: 380401 - RNA, 19 nt, Homo sapiens
gacucaaauuguauugcuu

SEQ ID NO: 380402 - RNA, 19 nt, Homo sapiens
guuauacucaguguugauu

SEQ ID NO: 380403 - RNA, 19 nt, Homo sapiens
gcacauuguauaugauucg

SEQ ID NO: 380404 - RNA, 19 nt, Homo sapiens
guucagugcauuguuguug

SEQ ID NO: 380405 - RNA, 19 nt, Homo sapiens
uggaagacccuugaaaaua

SEQ ID NO: 380406 - RNA, 19 nt, Homo sapiens
aagaauggaagacccuuga

SEQ ID NO: 380407 - RNA, 19 nt, Homo sapiens
acucaacucaggagauuug

SEQ ID NO: 380408 - RNA, 19 nt, Homo sapiens
gguucgaaaugcuccuugu

SEQ ID NO: 380409 - RNA, 19 nt, Homo sapiens
ccaguuggaggcugagguu

SEQ ID NO: 380410 - RNA, 19 nt, Homo sapiens
cuagaaugaaaguuccaua

SEQ ID NO: 380411 - RNA, 19 nt, Homo sapiens
gagagaacauuauaaaacc

SEQ ID NO: 380412 - RNA, 19 nt, Homo sapiens
ucccagauuaucauucuuu

SEQ ID NO: 380413 - RNA, 19 nt, Homo sapiens
ucugguauuuauggucuaa

SEQ ID NO: 380414 - RNA, 19 nt, Homo sapiens
guuguagucacuuuagaug

SEQ ID NO: 380415 - RNA, 19 nt, Homo sapiens
cuauauacaguccucaaau

SEQ ID NO: 380416 - RNA, 19 nt, Homo sapiens
gcauuggugaauauauaug

SEQ ID NO: 380417 - RNA, 19 nt, Homo sapiens
aacaguuaguucucaucua

SEQ ID NO: 380418 - RNA, 19 nt, Homo sapiens
gaaucucucuuccuauaua

SEQ ID NO: 380419 - RNA, 19 nt, Homo sapiens
gagaauggaguucagaaua

SEQ ID NO: 380420 - RNA, 19 nt, Homo sapiens
gcaaacaucaaacuaagaa

SEQ ID NO: 380421 - RNA, 19 nt, Homo sapiens
gaagaaaacucagcuaaau

SEQ ID NO: 380422 - RNA, 19 nt, Homo sapiens
gaacacaggcuccaaacau

SEQ ID NO: 380423 - RNA, 19 nt, Homo sapiens
gaaggaagacacugcagaa

SEQ ID NO: 380424 - RNA, 19 nt, Homo sapiens
gaugaugacaugguauuua

SEQ ID NO: 380425 - RNA, 19 nt, Homo sapiens
ccaaguccauaagaaauuu

SEQ ID NO: 380426 - RNA, 19 nt, Homo sapiens
gaacgaagaggaaaauaaa

SEQ ID NO: 380427 - RNA, 19 nt, Homo sapiens
gcaguuucaugaacgaaga

SEQ ID NO: 380428 - RNA, 19 nt, Homo sapiens
ggagaagcccauacugcua

SEQ ID NO: 380429 - RNA, 19 nt, Homo sapiens
ucagcuaaauuuccuauag

SEQ ID NO: 380430 - RNA, 19 nt, Homo sapiens
aacacaggcuccaaacaua

SEQ ID NO: 380431 - RNA, 19 nt, Homo sapiens
gcauccaaguccauaagaa

SEQ ID NO: 380432 - RNA, 19 nt, Homo sapiens
augaaucucucuuccuaua

SEQ ID NO: 380433 - RNA, 19 nt, Homo sapiens
gcaagucugauaccuguug

SEQ ID NO: 380434 - RNA, 19 nt, Homo sapiens
gcccauacugcuacuauaa

SEQ ID NO: 380435 - RNA, 19 nt, Homo sapiens
agaauggaguucagaauac

SEQ ID NO: 380436 - RNA, 19 nt, Homo sapiens
aaaaggauaucaagcacua

SEQ ID NO: 380437 - RNA, 19 nt, Homo sapiens
aaacuaagaauggcaaaga

SEQ ID NO: 380438 - RNA, 19 nt, Homo sapiens
gaauggaguucagaauacu

SEQ ID NO: 380439 - RNA, 19 nt, Homo sapiens
cuaagaauggcaaagauga

SEQ ID NO: 380440 - RNA, 19 nt, Homo sapiens
cacucaaucuggcuauaaa

SEQ ID NO: 380441 - RNA, 19 nt, Homo sapiens
acacaggcuccaaacauaa

SEQ ID NO: 380442 - RNA, 19 nt, Homo sapiens
cauccaaguccauaagaaa

SEQ ID NO: 380443 - RNA, 19 nt, Homo sapiens
aaagaacacaggcuccaaa

SEQ ID NO: 380444 - RNA, 19 nt, Homo sapiens
gcuacuauaacuuguguau

SEQ ID NO: 380445 - RNA, 19 nt, Homo sapiens
gauguaugcucggaagagu

SEQ ID NO: 380446 - RNA, 19 nt, Homo sapiens
aaacucagcuaaauuuccu

SEQ ID NO: 380447 - RNA, 19 nt, Homo sapiens
ccacucaaucuggcuauaa

SEQ ID NO: 380448 - RNA, 19 nt, Homo sapiens
gcuccaaacauaauuucuu

SEQ ID NO: 380449 - RNA, 19 nt, Homo sapiens
uuuagaugaugacauggua

SEQ ID NO: 380450 - RNA, 19 nt, Homo sapiens
cagcuaaauuuccuauagg

SEQ ID NO: 380451 - RNA, 19 nt, Homo sapiens
ugagagcaguuucaugaac

SEQ ID NO: 380452 - RNA, 19 nt, Homo sapiens
uaagaauggcaaagaugaa

SEQ ID NO: 380453 - RNA, 19 nt, Homo sapiens
guaugcaaacaucaaacua

SEQ ID NO: 380454 - RNA, 19 nt, Homo sapiens
gaauacugaaucaacacaa

SEQ ID NO: 380455 - RNA, 19 nt, Homo sapiens
aaugauaugcuuucucugu

SEQ ID NO: 380456 - RNA, 19 nt, Homo sapiens
auacugcuacuauaacuug

SEQ ID NO: 380457 - RNA, 19 nt, Homo sapiens
ccuguuggcaagucugaua

SEQ ID NO: 380458 - RNA, 19 nt, Homo sapiens
uagaugaugacaugguauu

SEQ ID NO: 380459 - RNA, 19 nt, Homo sapiens
aaggagagauuuugacaug

SEQ ID NO: 380460 - RNA, 19 nt, Homo sapiens
ccuauaggaaggagagauu

SEQ ID NO: 380461 - RNA, 19 nt, Homo sapiens
ccauacugcuacuauaacu

SEQ ID NO: 380462 - RNA, 19 nt, Homo sapiens
guagauuucccagcugaga

SEQ ID NO: 380463 - RNA, 19 nt, Homo sapiens
ucucugugcauuaaauuug

SEQ ID NO: 380464 - RNA, 19 nt, Homo sapiens
aaggauaucaagcacuaaa

SEQ ID NO: 380465 - RNA, 19 nt, Homo sapiens
caaagaacacaggcuccaa

SEQ ID NO: 380466 - RNA, 19 nt, Homo sapiens
gaugaaucucucuuccuau

SEQ ID NO: 380467 - RNA, 19 nt, Homo sapiens
augcaaacaucaaacuaag

SEQ ID NO: 380468 - RNA, 19 nt, Homo sapiens
caagaaaagagagaaauug

SEQ ID NO: 380469 - RNA, 19 nt, Homo sapiens
gcacuaaaaggaucuguag

SEQ ID NO: 380470 - RNA, 19 nt, Homo sapiens
ggaggagaagcccauacug

SEQ ID NO: 380471 - RNA, 19 nt, Homo sapiens
caaucuggcuauaaaagga

SEQ ID NO: 380472 - RNA, 19 nt, Homo sapiens
aauacugaaucaacacaag

SEQ ID NO: 380473 - RNA, 19 nt, Homo sapiens
guugguccacaucaucuuu

SEQ ID NO: 380474 - RNA, 19 nt, Homo sapiens
gagagaaauuggggaugaa

SEQ ID NO: 380475 - RNA, 19 nt, Homo sapiens
aaucauggucugccacuca

SEQ ID NO: 380476 - RNA, 19 nt, Homo sapiens
uccaaguccauaagaaauu

SEQ ID NO: 380477 - RNA, 19 nt, Homo sapiens
cugcuacuauaacuugugu

SEQ ID NO: 380478 - RNA, 19 nt, Homo sapiens
gaaauuggggaugaagaaa

SEQ ID NO: 380479 - RNA, 19 nt, Homo sapiens
agagagaaauuggggauga

SEQ ID NO: 380480 - RNA, 19 nt, Homo sapiens
ugagaauggaguucagaau

SEQ ID NO: 380481 - RNA, 19 nt, Homo sapiens
ugaacgaagaggaaaauaa

SEQ ID NO: 380482 - RNA, 19 nt, Homo sapiens
aaacaacgauuucuccauu

SEQ ID NO: 380483 - RNA, 19 nt, Homo sapiens
ggaggaggcuggugagaug

SEQ ID NO: 380484 - RNA, 19 nt, Homo sapiens
ugccauaacuuguuuguaa

SEQ ID NO: 380485 - RNA, 19 nt, Homo sapiens
gaaaggaauaggaaauuga

SEQ ID NO: 380486 - RNA, 19 nt, Homo sapiens
ccacugccauaacuuguuu

SEQ ID NO: 380487 - RNA, 19 nt, Homo sapiens
ccaggaaguuggccaauca

SEQ ID NO: 380488 - RNA, 19 nt, Homo sapiens
acaacgauuucuccauuaa

SEQ ID NO: 380489 - RNA, 19 nt, Homo sapiens
ugaaaggaauaggaaauug

SEQ ID NO: 380490 - RNA, 19 nt, Homo sapiens
gcacugagcgccugcagau

SEQ ID NO: 380491 - RNA, 19 nt, Homo sapiens
gccauaacuuguuuguaaa

SEQ ID NO: 380492 - RNA, 19 nt, Homo sapiens
gaaccuucccgucugauug

SEQ ID NO: 380493 - RNA, 19 nt, Homo sapiens
gaaguuggccaaucagaag

SEQ ID NO: 380494 - RNA, 19 nt, Homo sapiens
cagaagcgguucagugagu

SEQ ID NO: 380495 - RNA, 19 nt, Homo sapiens
ggaaguuggccaaucagaa

SEQ ID NO: 380496 - RNA, 19 nt, Homo sapiens
agaagcagcugcagaagag

SEQ ID NO: 380497 - RNA, 19 nt, Homo sapiens
gagaugaggauauauaugc

SEQ ID NO: 380498 - RNA, 19 nt, Homo sapiens
ggaagucggccaggaaguu

SEQ ID NO: 380499 - RNA, 19 nt, Homo sapiens
aacaacgauuucuccauua

SEQ ID NO: 380500 - RNA, 19 nt, Homo sapiens
ccagaaugguaauguguag

SEQ ID NO: 380501 - RNA, 19 nt, Homo sapiens
caacgauuucuccauuaaa

SEQ ID NO: 380502 - RNA, 19 nt, Homo sapiens
gugaguuuaugaggcaaua

SEQ ID NO: 380503 - RNA, 19 nt, Homo sapiens
gaagucggccaggaaguug

SEQ ID NO: 380504 - RNA, 19 nt, Homo sapiens
ggagaugaggauauauaug

SEQ ID NO: 380505 - RNA, 19 nt, Homo sapiens
gugaaaggaauaggaaauu

SEQ ID NO: 380506 - RNA, 19 nt, Homo sapiens
gggagaugaggauauauau

SEQ ID NO: 380507 - RNA, 19 nt, Homo sapiens
aaacuucuacugagcaaau

SEQ ID NO: 380508 - RNA, 19 nt, Homo sapiens
cagagggacugucucacau

SEQ ID NO: 380509 - RNA, 19 nt, Homo sapiens
ggugaaaggaauaggaaau

SEQ ID NO: 380510 - RNA, 19 nt, Homo sapiens
gcaggugaaaggaauagga

SEQ ID NO: 380511 - RNA, 19 nt, Homo sapiens
gaagcgguucagugaguuu

SEQ ID NO: 380512 - RNA, 19 nt, Homo sapiens
cuggugagauggagcagaa

SEQ ID NO: 380513 - RNA, 19 nt, Homo sapiens
cagaagcagcugcagaaga

SEQ ID NO: 380514 - RNA, 19 nt, Homo sapiens
ugacuugccacugccauaa

SEQ ID NO: 380515 - RNA, 19 nt, Homo sapiens
gcgguucagugaguuuaug

SEQ ID NO: 380516 - RNA, 19 nt, Homo sapiens
uccauuaaacuucuacuga

SEQ ID NO: 380517 - RNA, 19 nt, Homo sapiens
cuagcuaccauuucaauag

SEQ ID NO: 380518 - RNA, 19 nt, Homo sapiens
uuaaacuucuacugagcaa

SEQ ID NO: 380519 - RNA, 19 nt, Homo sapiens
cgauuucuccauuaaacuu

SEQ ID NO: 380520 - RNA, 19 nt, Homo sapiens
ucagagggacugucucaca

SEQ ID NO: 380521 - RNA, 19 nt, Homo sapiens
ccaguguguucagcaguug

SEQ ID NO: 380522 - RNA, 19 nt, Homo sapiens
caggugaaaggaauaggaa

SEQ ID NO: 380523 - RNA, 19 nt, Homo sapiens
ggggagaugaggauauaua

SEQ ID NO: 380524 - RNA, 19 nt, Homo sapiens
ggaauaggaaauugaaccu

SEQ ID NO: 380525 - RNA, 19 nt, Homo sapiens
uaaacaacgauuucuccau

SEQ ID NO: 380526 - RNA, 19 nt, Homo sapiens
uccaguguguucagcaguu

SEQ ID NO: 380527 - RNA, 19 nt, Homo sapiens
aacgauuucuccauuaaac

SEQ ID NO: 380528 - RNA, 19 nt, Homo sapiens
gaaaguagcguuaagauag

SEQ ID NO: 380529 - RNA, 19 nt, Homo sapiens
gaacaaugcuuaacauacu

SEQ ID NO: 380530 - RNA, 19 nt, Homo sapiens
gacaauaugcugaacauua

SEQ ID NO: 380531 - RNA, 19 nt, Homo sapiens
guaaagagaagguugauuu

SEQ ID NO: 380532 - RNA, 19 nt, Homo sapiens
ggagaagcccauaauguua

SEQ ID NO: 380533 - RNA, 19 nt, Homo sapiens
ggaacuacuuggcauguaa

SEQ ID NO: 380534 - RNA, 19 nt, Homo sapiens
uaacugaucugauaauguc

SEQ ID NO: 380535 - RNA, 19 nt, Homo sapiens
cucaauaacugaucugaua

SEQ ID NO: 380536 - RNA, 19 nt, Homo sapiens
cagccuauauucuuguuua

SEQ ID NO: 380537 - RNA, 19 nt, Homo sapiens
ggaaagcccauccguacua

SEQ ID NO: 380538 - RNA, 19 nt, Homo sapiens
gcauauacuucuguuugua

SEQ ID NO: 380539 - RNA, 19 nt, Homo sapiens
gaagaaaacucagcuaaau

SEQ ID NO: 380540 - RNA, 19 nt, Homo sapiens
caccaugccuggcuaguuu

SEQ ID NO: 380541 - RNA, 19 nt, Homo sapiens
ugguuuaccuccaucauua

SEQ ID NO: 380542 - RNA, 19 nt, Homo sapiens
gaguggaacuauaauacaa

SEQ ID NO: 380543 - RNA, 19 nt, Homo sapiens
gagaccaccuucacuuguu

SEQ ID NO: 380544 - RNA, 19 nt, Homo sapiens
gcagucaaccaguaaauug

SEQ ID NO: 380545 - RNA, 19 nt, Homo sapiens
gcguuaagauagaucagua

SEQ ID NO: 380546 - RNA, 19 nt, Homo sapiens
guugagaaaugguacgauu

SEQ ID NO: 380547 - RNA, 19 nt, Homo sapiens
uacuguaacuuggguauua

SEQ ID NO: 380548 - RNA, 19 nt, Homo sapiens
acaauaugcugaacauuag

SEQ ID NO: 380549 - RNA, 19 nt, Homo sapiens
ucagaggauuuguaagaaa

SEQ ID NO: 380550 - RNA, 19 nt, Homo sapiens
uaagauagaucaguaacca

SEQ ID NO: 380551 - RNA, 19 nt, Homo sapiens
cagaauguuuauugacgua

SEQ ID NO: 380552 - RNA, 19 nt, Homo sapiens
gaggagaagcccauaaugu

SEQ ID NO: 380553 - RNA, 19 nt, Homo sapiens
gggauuaugcugucacaaa

SEQ ID NO: 380554 - RNA, 19 nt, Homo sapiens
cacugaaucugguuauaaa

SEQ ID NO: 380555 - RNA, 19 nt, Homo sapiens
ucagaccacuucuaccaaa

SEQ ID NO: 380556 - RNA, 19 nt, Homo sapiens
guuggucuaugucaucuuu

SEQ ID NO: 380557 - RNA, 19 nt, Homo sapiens
uauugugacuguuugcaua

SEQ ID NO: 380558 - RNA, 19 nt, Homo sapiens
aaaguagcguuaagauaga

SEQ ID NO: 380559 - RNA, 19 nt, Homo sapiens
caccuucacuuguugagaa

SEQ ID NO: 380560 - RNA, 19 nt, Homo sapiens
gaucugauaaugucaacuu

SEQ ID NO: 380561 - RNA, 19 nt, Homo sapiens
gaucucggcucacugaaac

SEQ ID NO: 380562 - RNA, 19 nt, Homo sapiens
guagaacaaugggauuaug

SEQ ID NO: 380563 - RNA, 19 nt, Homo sapiens
cuacuuggcauguaagaaa

SEQ ID NO: 380564 - RNA, 19 nt, Homo sapiens
ccaaagugcugggauuaca

SEQ ID NO: 380565 - RNA, 19 nt, Homo sapiens
uaucguauuuggaguggaa

SEQ ID NO: 380566 - RNA, 19 nt, Homo sapiens
gagccuguguucuguaaag

SEQ ID NO: 380567 - RNA, 19 nt, Homo sapiens
agagugcagucaaccagua

SEQ ID NO: 380568 - RNA, 19 nt, Homo sapiens
agaaaguagcguuaagaua

SEQ ID NO: 380569 - RNA, 19 nt, Homo sapiens
ucacugaaucugguuauaa

SEQ ID NO: 380570 - RNA, 19 nt, Homo sapiens
gggaagagucuaccaaucu

SEQ ID NO: 380571 - RNA, 19 nt, Homo sapiens
agaaggaucuguagcuuuu

SEQ ID NO: 380572 - RNA, 19 nt, Homo sapiens
uaaugcauauugugacugu

SEQ ID NO: 380573 - RNA, 19 nt, Homo sapiens
uagcgucaguguccuaaug

SEQ ID NO: 380574 - RNA, 19 nt, Homo sapiens
uaaagagaagguugauuug

SEQ ID NO: 380575 - RNA, 19 nt, Homo sapiens
ggauuaugcugucacaaaa

SEQ ID NO: 380576 - RNA, 19 nt, Homo sapiens
aaccuuaucuugcacuaga

SEQ ID NO: 380577 - RNA, 19 nt, Homo sapiens
aagagaagguugauuuguc

SEQ ID NO: 380578 - RNA, 19 nt, Homo sapiens
ucagcuaaauuuccuguag

SEQ ID NO: 380579 - RNA, 19 nt, Homo sapiens
uaagaaauagcgucagugu

SEQ ID NO: 380580 - RNA, 19 nt, Homo sapiens
gaaagcccauccguacuac

SEQ ID NO: 380581 - RNA, 19 nt, Homo sapiens
ccaguaaauugcagauucu

SEQ ID NO: 380582 - RNA, 19 nt, Homo sapiens
aaaauguucugcucuguuu

SEQ ID NO: 380583 - RNA, 19 nt, Homo sapiens
cagacaauaugcugaacau

SEQ ID NO: 380584 - RNA, 19 nt, Homo sapiens
gaaaacagauaguuaugac

SEQ ID NO: 380585 - RNA, 19 nt, Homo sapiens
ggaguggaacuauaauaca

SEQ ID NO: 380586 - RNA, 19 nt, Homo sapiens
gcacuagaaggaucuguag

SEQ ID NO: 380587 - RNA, 19 nt, Homo sapiens
ugucuuuggugaaugguuu

SEQ ID NO: 380588 - RNA, 19 nt, Homo sapiens
gcaugucuuuggugaaugg

SEQ ID NO: 380589 - RNA, 19 nt, Homo sapiens
caaugacaacgacaacaaa

SEQ ID NO: 380590 - RNA, 19 nt, Homo sapiens
aaagagaccaccuucacuu

SEQ ID NO: 380591 - RNA, 19 nt, Homo sapiens
ccacugaguccagccuaua

SEQ ID NO: 380592 - RNA, 19 nt, Homo sapiens
uauuuggaguggaacuaua

SEQ ID NO: 380593 - RNA, 19 nt, Homo sapiens
aagcaugucuuuggugaau

SEQ ID NO: 380594 - RNA, 19 nt, Homo sapiens
uacauacacucuagaccaa

SEQ ID NO: 380595 - RNA, 19 nt, Homo sapiens
gagacuggauccgcaaagu

SEQ ID NO: 380596 - RNA, 19 nt, Homo sapiens
gguacgauuucacguuauc

SEQ ID NO: 380597 - RNA, 19 nt, Homo sapiens
augguacgauuucacguua

SEQ ID NO: 380598 - RNA, 19 nt, Homo sapiens
aguuaugacucaaggcuuu

SEQ ID NO: 380599 - RNA, 19 nt, Homo sapiens
ucaguguccuaaugcauau

SEQ ID NO: 380600 - RNA, 19 nt, Homo sapiens
ugccucagccucaugaaua

SEQ ID NO: 380601 - RNA, 19 nt, Homo sapiens
gaagguugauuugucuuuu

SEQ ID NO: 380602 - RNA, 19 nt, Homo sapiens
ccuaaagcauauaagacaa

SEQ ID NO: 380603 - RNA, 19 nt, Homo sapiens
ggaggagaagcccauaaug

SEQ ID NO: 380604 - RNA, 19 nt, Homo sapiens
gucaguguccuaaugcaua

SEQ ID NO: 380605 - RNA, 19 nt, Homo sapiens
cagaauggaggaacuacuu

SEQ ID NO: 380606 - RNA, 19 nt, Homo sapiens
auacuaaccuuacauacac

SEQ ID NO: 380607 - RNA, 19 nt, Homo sapiens
gagagaaacuggggaugaa

SEQ ID NO: 380608 - RNA, 19 nt, Homo sapiens
cauacuaaccuuacauaca

SEQ ID NO: 380609 - RNA, 19 nt, Homo sapiens
gagaagcccauaauguuac

SEQ ID NO: 380610 - RNA, 19 nt, Homo sapiens
aggagaagcccauaauguu

SEQ ID NO: 380611 - RNA, 19 nt, Homo sapiens
guaaagagaccaccuucac

SEQ ID NO: 380612 - RNA, 19 nt, Homo sapiens
agagaagguugauuugucu

SEQ ID NO: 380613 - RNA, 19 nt, Homo sapiens
aaacucagcuaaauuuccu

SEQ ID NO: 380614 - RNA, 19 nt, Homo sapiens
caaggagagugcagucaac

SEQ ID NO: 380615 - RNA, 19 nt, Homo sapiens
cagaggauuuguaagaaac

SEQ ID NO: 380616 - RNA, 19 nt, Homo sapiens
agauagaucaguaaccaaa

SEQ ID NO: 380617 - RNA, 19 nt, Homo sapiens
cuagaaggaucuguagcuu

SEQ ID NO: 380618 - RNA, 19 nt, Homo sapiens
gggaggagaagcccauaau

SEQ ID NO: 380619 - RNA, 19 nt, Homo sapiens
uuucagaggauuuguaaga

SEQ ID NO: 380620 - RNA, 19 nt, Homo sapiens
uguaagaaauagcgucagu

SEQ ID NO: 380621 - RNA, 19 nt, Homo sapiens
augaauagcugggauuaca

SEQ ID NO: 380622 - RNA, 19 nt, Homo sapiens
uggagccuguguucuguaa

SEQ ID NO: 380623 - RNA, 19 nt, Homo sapiens
aaagaaaguagcguuaaga

SEQ ID NO: 380624 - RNA, 19 nt, Homo sapiens
gauaccgaaucaacacaag

SEQ ID NO: 380625 - RNA, 19 nt, Homo sapiens
ggcaagguuucaccaucuu

SEQ ID NO: 380626 - RNA, 19 nt, Homo sapiens
aaauuaagcaugucuuugg

SEQ ID NO: 380627 - RNA, 19 nt, Homo sapiens
augcugaacauuagacaua

SEQ ID NO: 380628 - RNA, 19 nt, Homo sapiens
gaagacagaugaaaugauu

SEQ ID NO: 380629 - RNA, 19 nt, Homo sapiens
gaaaguagcguuaagauag

SEQ ID NO: 380630 - RNA, 19 nt, Homo sapiens
gaacaaugcuuaacauacu

SEQ ID NO: 380631 - RNA, 19 nt, Homo sapiens
guaaagagaagguugauuu

SEQ ID NO: 380632 - RNA, 19 nt, Homo sapiens
ggagaagcccauaauguua

SEQ ID NO: 380633 - RNA, 19 nt, Homo sapiens
gauuacauguguucaauug

SEQ ID NO: 380634 - RNA, 19 nt, Homo sapiens
uaacugaucugauaauguc

SEQ ID NO: 380635 - RNA, 19 nt, Homo sapiens
cucaauaacugaucugaua

SEQ ID NO: 380636 - RNA, 19 nt, Homo sapiens
cagccuauauucuuguuua

SEQ ID NO: 380637 - RNA, 19 nt, Homo sapiens
ggaagagucuaccaacguu

SEQ ID NO: 380638 - RNA, 19 nt, Homo sapiens
ggaaagaagugugaaacug

SEQ ID NO: 380639 - RNA, 19 nt, Homo sapiens
gcauauacuucuguuugua

SEQ ID NO: 380640 - RNA, 19 nt, Homo sapiens
gaagaaaacucagcuaaau

SEQ ID NO: 380641 - RNA, 19 nt, Homo sapiens
gaaagaagugugaaacugu

SEQ ID NO: 380642 - RNA, 19 nt, Homo sapiens
gaguggaacuauaauacaa

SEQ ID NO: 380643 - RNA, 19 nt, Homo sapiens
gcguuaagauagaucagua

SEQ ID NO: 380644 - RNA, 19 nt, Homo sapiens
gguauuauguuaacugucu

SEQ ID NO: 380645 - RNA, 19 nt, Homo sapiens
guugagaaaugguacgauu

SEQ ID NO: 380646 - RNA, 19 nt, Homo sapiens
gagacgcccuucacauguu

SEQ ID NO: 380647 - RNA, 19 nt, Homo sapiens
cgacuuggcauguaagaaa

SEQ ID NO: 380648 - RNA, 19 nt, Homo sapiens
ggaauucuuaggauaauga

SEQ ID NO: 380649 - RNA, 19 nt, Homo sapiens
uacuguaacuuggguauua

SEQ ID NO: 380650 - RNA, 19 nt, Homo sapiens
ccacguacaacaugaaauu

SEQ ID NO: 380651 - RNA, 19 nt, Homo sapiens
ucagaggauuuguaagaaa

SEQ ID NO: 380652 - RNA, 19 nt, Homo sapiens
uaagauagaucaguaacca

SEQ ID NO: 380653 - RNA, 19 nt, Homo sapiens
cagaauguuuauugacgua

SEQ ID NO: 380654 - RNA, 19 nt, Homo sapiens
gaggagaagcccauaaugu

SEQ ID NO: 380655 - RNA, 19 nt, Homo sapiens
ucagaccacuucuaccaaa

SEQ ID NO: 380656 - RNA, 19 nt, Homo sapiens
cacugaaucugguuauaaa

SEQ ID NO: 380657 - RNA, 19 nt, Homo sapiens
gggauuaugcugucacaaa

SEQ ID NO: 380658 - RNA, 19 nt, Homo sapiens
ucagcuaaauuuccuauag

SEQ ID NO: 380659 - RNA, 19 nt, Homo sapiens
uauugugacuguuugcaua

SEQ ID NO: 380660 - RNA, 19 nt, Homo sapiens
gaagaacgacuuggcaugu

SEQ ID NO: 380661 - RNA, 19 nt, Homo sapiens
aaaguagcguuaagauaga

SEQ ID NO: 380662 - RNA, 19 nt, Homo sapiens
gaucugauaaugucaacuu

SEQ ID NO: 380663 - RNA, 19 nt, Homo sapiens
agaacgacuuggcauguaa

SEQ ID NO: 380664 - RNA, 19 nt, Homo sapiens
aaaaugcucugcacuguuu

SEQ ID NO: 380665 - RNA, 19 nt, Homo sapiens
gaucucggcucacugaaac

SEQ ID NO: 380666 - RNA, 19 nt, Homo sapiens
guagaacaaugggauuaug

SEQ ID NO: 380667 - RNA, 19 nt, Homo sapiens
ccaaagugcugggauuaca

SEQ ID NO: 380668 - RNA, 19 nt, Homo sapiens
cuucacauguugagaaaug

SEQ ID NO: 380669 - RNA, 19 nt, Homo sapiens
uaucguauuuggaguggaa

SEQ ID NO: 380670 - RNA, 19 nt, Homo sapiens
gagccuguguucuguaaag

SEQ ID NO: 380671 - RNA, 19 nt, Homo sapiens
agagugcagucaaccagua

SEQ ID NO: 380672 - RNA, 19 nt, Homo sapiens
agaaggaucuguagcuuuu

SEQ ID NO: 380673 - RNA, 19 nt, Homo sapiens
ucacugaaucugguuauaa

SEQ ID NO: 380674 - RNA, 19 nt, Homo sapiens
agaaaguagcguuaagaua

SEQ ID NO: 380675 - RNA, 19 nt, Homo sapiens
cauauucaccuuucuggaa

SEQ ID NO: 380676 - RNA, 19 nt, Homo sapiens
uaaugcauauugugacugu

SEQ ID NO: 380677 - RNA, 19 nt, Homo sapiens
uagcgucaguguccuaaug

SEQ ID NO: 380678 - RNA, 19 nt, Homo sapiens
uaaagagaagguugauuug

SEQ ID NO: 380679 - RNA, 19 nt, Homo sapiens
ggauuaugcugucacaaaa

SEQ ID NO: 380680 - RNA, 19 nt, Homo sapiens
aagagaagguugauuuguc

SEQ ID NO: 380681 - RNA, 19 nt, Homo sapiens
aaccuuaucuugcacuaga

SEQ ID NO: 380682 - RNA, 19 nt, Homo sapiens
uaagaaauagcgucagugu

SEQ ID NO: 380683 - RNA, 19 nt, Homo sapiens
guugguccauaucaucuuu

SEQ ID NO: 380684 - RNA, 19 nt, Homo sapiens
gaaaacagauaguuaugac

SEQ ID NO: 380685 - RNA, 19 nt, Homo sapiens
aagaacgacuuggcaugua

SEQ ID NO: 380686 - RNA, 19 nt, Homo sapiens
ggaguggaacuauaauaca

SEQ ID NO: 380687 - RNA, 19 nt, Homo sapiens
gcacuagaaggaucuguag

SEQ ID NO: 380688 - RNA, 19 nt, Homo sapiens
ugucuuuggugaaugguuu

SEQ ID NO: 380689 - RNA, 19 nt, Homo sapiens
gcaugucuuuggugaaugg

SEQ ID NO: 380690 - RNA, 19 nt, Homo sapiens
gauaccgaaucaacacuag

SEQ ID NO: 380691 - RNA, 19 nt, Homo sapiens
ccacugaguccagccuaua

SEQ ID NO: 380692 - RNA, 19 nt, Homo sapiens
uauuuggaguggaacuaua

SEQ ID NO: 380693 - RNA, 19 nt, Homo sapiens
aagcaugucuuuggugaau

SEQ ID NO: 380694 - RNA, 19 nt, Homo sapiens
uacauacacucuagaccaa

SEQ ID NO: 380695 - RNA, 19 nt, Homo sapiens
gguacgauuucacguuauc

SEQ ID NO: 380696 - RNA, 19 nt, Homo sapiens
augguacgauuucacguua

SEQ ID NO: 380697 - RNA, 19 nt, Homo sapiens
aguuaugacucaaggcuuu

SEQ ID NO: 380698 - RNA, 19 nt, Homo sapiens
ucaguguccuaaugcauau

SEQ ID NO: 380699 - RNA, 19 nt, Homo sapiens
ugccucagccucaugaaua

SEQ ID NO: 380700 - RNA, 19 nt, Homo sapiens
gaagguugauuugucuuuu

SEQ ID NO: 380701 - RNA, 19 nt, Homo sapiens
ggauaccgaaucaacacua

SEQ ID NO: 380702 - RNA, 19 nt, Homo sapiens
ggaggagaagcccauaaug

SEQ ID NO: 380703 - RNA, 19 nt, Homo sapiens
ggaagacagaugaaaugau

SEQ ID NO: 380704 - RNA, 19 nt, Homo sapiens
caggaagacagaugaaaug

SEQ ID NO: 380705 - RNA, 19 nt, Homo sapiens
gucaguguccuaaugcaua

SEQ ID NO: 380706 - RNA, 19 nt, Homo sapiens
auacuaaccuuacauacac

SEQ ID NO: 380707 - RNA, 19 nt, Homo sapiens
gagagaaacuggggaugaa

SEQ ID NO: 380708 - RNA, 19 nt, Homo sapiens
cauacuaaccuuacauaca

SEQ ID NO: 380709 - RNA, 19 nt, Homo sapiens
gagaagcccauaauguuac

SEQ ID NO: 380710 - RNA, 19 nt, Homo sapiens
aggagaagcccauaauguu

SEQ ID NO: 380711 - RNA, 19 nt, Homo sapiens
agagaagguugauuugucu

SEQ ID NO: 380712 - RNA, 19 nt, Homo sapiens
gauguaugcugggaagagu

SEQ ID NO: 380713 - RNA, 19 nt, Homo sapiens
aaacucagcuaaauuuccu

SEQ ID NO: 380714 - RNA, 19 nt, Homo sapiens
ucaccuuucuggaauucuu

SEQ ID NO: 380715 - RNA, 19 nt, Homo sapiens
cuagaaggaucuguagcuu

SEQ ID NO: 380716 - RNA, 19 nt, Homo sapiens
caaggagagugcagucaac

SEQ ID NO: 380717 - RNA, 19 nt, Homo sapiens
cagaggauuuguaagaaac

SEQ ID NO: 380718 - RNA, 19 nt, Homo sapiens
agauagaucaguaaccaaa

SEQ ID NO: 380719 - RNA, 19 nt, Homo sapiens
gggaggagaagcccauaau

SEQ ID NO: 380720 - RNA, 19 nt, Homo sapiens
cagcuaaauuuccuauagg

SEQ ID NO: 380721 - RNA, 19 nt, Homo sapiens
uuucagaggauuuguaaga

SEQ ID NO: 380722 - RNA, 19 nt, Homo sapiens
uguaagaaauagcgucagu

SEQ ID NO: 380723 - RNA, 19 nt, Homo sapiens
gacuuggcauguaagaaau

SEQ ID NO: 380724 - RNA, 19 nt, Homo sapiens
augaauagcugggauuaca

SEQ ID NO: 380725 - RNA, 19 nt, Homo sapiens
uggagccuguguucuguaa

SEQ ID NO: 380726 - RNA, 19 nt, Homo sapiens
aaagaaaguagcguuaaga

SEQ ID NO: 380727 - RNA, 19 nt, Homo sapiens
guaaagagacgcccuucac

SEQ ID NO: 380728 - RNA, 19 nt, Homo sapiens
gaggaugucuccaauacaa

SEQ ID NO: 380729 - RNA, 19 nt, Homo sapiens
gaccucagcucuugcauca

SEQ ID NO: 380730 - RNA, 19 nt, Homo sapiens
ccaggaaggucaucaagau

SEQ ID NO: 380731 - RNA, 19 nt, Homo sapiens
ggagcaggauagugccuuu

SEQ ID NO: 380732 - RNA, 19 nt, Homo sapiens
ggaggaggaguuccaguuu

SEQ ID NO: 380733 - RNA, 19 nt, Homo sapiens
gaggaggaguuccaguuuc

SEQ ID NO: 380734 - RNA, 19 nt, Homo sapiens
ggaaagaugcagcuguauc

SEQ ID NO: 380735 - RNA, 19 nt, Homo sapiens
gcagcuguauccaagaaag

SEQ ID NO: 380736 - RNA, 19 nt, Homo sapiens
ggggaaagaugcagcugua

SEQ ID NO: 380737 - RNA, 19 nt, Homo sapiens
gagcucaagugcgacauca

SEQ ID NO: 380738 - RNA, 19 nt, Homo sapiens
aaccgagaaucgaaacuaa

SEQ ID NO: 380739 - RNA, 19 nt, Homo sapiens
cgacagcccagaagaggaa

SEQ ID NO: 380740 - RNA, 19 nt, Homo sapiens
gaugacagcagcagugagu

SEQ ID NO: 380741 - RNA, 19 nt, Homo sapiens
gaaagaugcagcuguaucc

SEQ ID NO: 380742 - RNA, 19 nt, Homo sapiens
gucauuugcuggcuugaau

SEQ ID NO: 380743 - RNA, 19 nt, Homo sapiens
ucugagcucuggccaacaa

SEQ ID NO: 380744 - RNA, 19 nt, Homo sapiens
gaucuaaaccgagaaucga

SEQ ID NO: 380745 - RNA, 19 nt, Homo sapiens
gcuccuggcgugucauuug

SEQ ID NO: 380746 - RNA, 19 nt, Homo sapiens
cgaagcugcugccuugucu

SEQ ID NO: 380747 - RNA, 19 nt, Homo sapiens
ggaacgcguuguggugauc

SEQ ID NO: 380748 - RNA, 19 nt, Homo sapiens
ugcagaggaugaagugcua

SEQ ID NO: 380749 - RNA, 19 nt, Homo sapiens
aaaccgagaaucgaaacua

SEQ ID NO: 380750 - RNA, 19 nt, Homo sapiens
cgacaucagcgcagagauc

SEQ ID NO: 380751 - RNA, 19 nt, Homo sapiens
cagcagcucggaagacuca

SEQ ID NO: 380752 - RNA, 19 nt, Homo sapiens
ggacagcucaagggacuca

SEQ ID NO: 380753 - RNA, 19 nt, Homo sapiens
gggacccuauugacguuga

SEQ ID NO: 380754 - RNA, 19 nt, Homo sapiens
caacgacagcccagaagag

SEQ ID NO: 380755 - RNA, 19 nt, Homo sapiens
guacgccuucuccaucaaa

SEQ ID NO: 380756 - RNA, 19 nt, Homo sapiens
guguacgccuucuccauca

SEQ ID NO: 380757 - RNA, 19 nt, Homo sapiens
ugcaggaccucagcucuug

SEQ ID NO: 380758 - RNA, 19 nt, Homo sapiens
gagagugaaggcccagguu

SEQ ID NO: 380759 - RNA, 19 nt, Homo sapiens
caagaucuaaaccgagaau

SEQ ID NO: 380760 - RNA, 19 nt, Homo sapiens
cauuugcuggcuugaauaa

SEQ ID NO: 380761 - RNA, 19 nt, Homo sapiens
gcagcagugaguccaguga

SEQ ID NO: 380762 - RNA, 19 nt, Homo sapiens
cgcccuggauaacgucuuu

SEQ ID NO: 380763 - RNA, 19 nt, Homo sapiens
ccccaccccuuucuaauuu

SEQ ID NO: 380764 - RNA, 19 nt, Homo sapiens
gaggaggcagagagaguga

SEQ ID NO: 380765 - RNA, 19 nt, Homo sapiens
gccgacuucuggugcuuug

SEQ ID NO: 380766 - RNA, 19 nt, Homo sapiens
uugcuggcuugaauaaaga

SEQ ID NO: 380767 - RNA, 19 nt, Homo sapiens
uuugcuggcuugaauaaag

SEQ ID NO: 380768 - RNA, 19 nt, Homo sapiens
ucacgcacuccaagaucua

SEQ ID NO: 380769 - RNA, 19 nt, Homo sapiens
ucaagggacucagccaacu

SEQ ID NO: 380770 - RNA, 19 nt, Homo sapiens
cggaggaggaguuccaguu

SEQ ID NO: 380771 - RNA, 19 nt, Homo sapiens
ccgauggcuucgacgaguu

SEQ ID NO: 380772 - RNA, 19 nt, Homo sapiens
gcgcuggugcagaggauga

SEQ ID NO: 380773 - RNA, 19 nt, Homo sapiens
augcagcuguauccaagaa

SEQ ID NO: 380774 - RNA, 19 nt, Homo sapiens
aggaggaguuccaguuucu

SEQ ID NO: 380775 - RNA, 19 nt, Homo sapiens
auacaacgacagcccagaa

SEQ ID NO: 380776 - RNA, 19 nt, Homo sapiens
gguaccagcgcgacuacga

SEQ ID NO: 380777 - RNA, 19 nt, Homo sapiens
aaacuaagcugggguccau

SEQ ID NO: 380778 - RNA, 19 nt, Homo sapiens
gaggaugucuccaauacaa

SEQ ID NO: 380779 - RNA, 19 nt, Homo sapiens
ggccacagcuuugcucuuu

SEQ ID NO: 380780 - RNA, 19 nt, Homo sapiens
gaccucagcucuugcauca

SEQ ID NO: 380781 - RNA, 19 nt, Homo sapiens
ccaaauuucccuucucuaa

SEQ ID NO: 380782 - RNA, 19 nt, Homo sapiens
ugaagucuguguacccaua

SEQ ID NO: 380783 - RNA, 19 nt, Homo sapiens
ccaggaaggucaucaagau

SEQ ID NO: 380784 - RNA, 19 nt, Homo sapiens
ccacaggccucuggaauca

SEQ ID NO: 380785 - RNA, 19 nt, Homo sapiens
caaagugccuuccaaacca

SEQ ID NO: 380786 - RNA, 19 nt, Homo sapiens
gaacaggucccuuccuaag

SEQ ID NO: 380787 - RNA, 19 nt, Homo sapiens
gccagcagcuucaaacuca

SEQ ID NO: 380788 - RNA, 19 nt, Homo sapiens
agaccuaccuggcgagaaa

SEQ ID NO: 380789 - RNA, 19 nt, Homo sapiens
aaugaaacccagaagauua

SEQ ID NO: 380790 - RNA, 19 nt, Homo sapiens
gaaacagauugaugcagau

SEQ ID NO: 380791 - RNA, 19 nt, Homo sapiens
gaagacccacugaggaauu

SEQ ID NO: 380792 - RNA, 19 nt, Homo sapiens
ggagcaggauagugccuuu

SEQ ID NO: 380793 - RNA, 19 nt, Homo sapiens
gcugugccauccugcauuu

SEQ ID NO: 380794 - RNA, 19 nt, Homo sapiens
gagaaagucccgucccuau

SEQ ID NO: 380795 - RNA, 19 nt, Homo sapiens
gcaaagacagaaacugaug

SEQ ID NO: 380796 - RNA, 19 nt, Homo sapiens
cagcaaagacagaaacuga

SEQ ID NO: 380797 - RNA, 19 nt, Homo sapiens
gaaguacagccgcuaucua

SEQ ID NO: 380798 - RNA, 19 nt, Homo sapiens
ggaggaggaguuccaguuu

SEQ ID NO: 380799 - RNA, 19 nt, Homo sapiens
agacugggcccacugauuu

SEQ ID NO: 380800 - RNA, 19 nt, Homo sapiens
gaaagucccgucccuaucu

SEQ ID NO: 380801 - RNA, 19 nt, Homo sapiens
gcauguuccugcuuccaaa

SEQ ID NO: 380802 - RNA, 19 nt, Homo sapiens
gacagaaacugauguucca

SEQ ID NO: 380803 - RNA, 19 nt, Homo sapiens
caaauuucccuucucuaaa

SEQ ID NO: 380804 - RNA, 19 nt, Homo sapiens
cuaaacauccuacagagaa

SEQ ID NO: 380805 - RNA, 19 nt, Homo sapiens
ggaauuccguagggucuug

SEQ ID NO: 380806 - RNA, 19 nt, Homo sapiens
gaccaaauuucccuucucu

SEQ ID NO: 380807 - RNA, 19 nt, Homo sapiens
gaggaggaguuccaguuuc

SEQ ID NO: 380808 - RNA, 19 nt, Homo sapiens
aaacugauguuccaugcau

SEQ ID NO: 380809 - RNA, 19 nt, Homo sapiens
gcuggugcaugcucaaguu

SEQ ID NO: 380810 - RNA, 19 nt, Homo sapiens
cuacagagaagguuccaaa

SEQ ID NO: 380811 - RNA, 19 nt, Homo sapiens
gaaccgcugcucucauaga

SEQ ID NO: 380812 - RNA, 19 nt, Homo sapiens
ugacagcucccacacagaa

SEQ ID NO: 380813 - RNA, 19 nt, Homo sapiens
gaagaaguacagccgcuau

SEQ ID NO: 380814 - RNA, 19 nt, Homo sapiens
cagagaagguuccaaagcu

SEQ ID NO: 380815 - RNA, 19 nt, Homo sapiens
caaugaaacccagaagauu

SEQ ID NO: 380816 - RNA, 19 nt, Homo sapiens
ggaaagaugcagcuguauc

SEQ ID NO: 380817 - RNA, 19 nt, Homo sapiens
gcaccagacuccuauuagc

SEQ ID NO: 380818 - RNA, 19 nt, Homo sapiens
aaccgagaaucgaaacuaa

SEQ ID NO: 380819 - RNA, 19 nt, Homo sapiens
gcagcuguauccaagaaag

SEQ ID NO: 380820 - RNA, 19 nt, Homo sapiens
ggggaaagaugcagcugua

SEQ ID NO: 380821 - RNA, 19 nt, Homo sapiens
gagcucaagugcgacauca

SEQ ID NO: 380822 - RNA, 19 nt, Homo sapiens
ccacagcuuugcucuuugg

SEQ ID NO: 380823 - RNA, 19 nt, Homo sapiens
gugcaccagacuccuauua

SEQ ID NO: 380824 - RNA, 19 nt, Homo sapiens
aaauuucccuucucuaaac

SEQ ID NO: 380825 - RNA, 19 nt, Homo sapiens
ucaguagccugcagugcuu

SEQ ID NO: 380826 - RNA, 19 nt, Homo sapiens
cgacagcccagaagaggaa

SEQ ID NO: 380827 - RNA, 19 nt, Homo sapiens
gagacugggcccacugauu

SEQ ID NO: 380828 - RNA, 19 nt, Homo sapiens
aagcaccgauggaaacaga

SEQ ID NO: 380829 - RNA, 19 nt, Homo sapiens
gcauggcccuuggcucuuc

SEQ ID NO: 380830 - RNA, 19 nt, Homo sapiens
ggaccaaauuucccuucuc

SEQ ID NO: 380831 - RNA, 19 nt, Homo sapiens
aaguacagccgcuaucuaa

SEQ ID NO: 380832 - RNA, 19 nt, Homo sapiens
gcaccgauggaaacagauu

SEQ ID NO: 380833 - RNA, 19 nt, Homo sapiens
gucauuugguucagaauca

SEQ ID NO: 380834 - RNA, 19 nt, Homo sapiens
gaugacagcagcagugagu

SEQ ID NO: 380835 - RNA, 19 nt, Homo sapiens
gaaagaugcagcuguaucc

SEQ ID NO: 380836 - RNA, 19 nt, Homo sapiens
cagcacuacucagcaugua

SEQ ID NO: 380837 - RNA, 19 nt, Homo sapiens
gaucuaaaccgagaaucga

SEQ ID NO: 380838 - RNA, 19 nt, Homo sapiens
gcucugggcaccuacuuug

SEQ ID NO: 380839 - RNA, 19 nt, Homo sapiens
acagauugaugcagaugga

SEQ ID NO: 380840 - RNA, 19 nt, Homo sapiens
ccucaguugucauuugguu

SEQ ID NO: 380841 - RNA, 19 nt, Homo sapiens
cgaagcugcugccuugucu

SEQ ID NO: 380842 - RNA, 19 nt, Homo sapiens
gcaguggacaggaagacuu

SEQ ID NO: 380843 - RNA, 19 nt, Homo sapiens
acaaugaaacccagaagau

SEQ ID NO: 380844 - RNA, 19 nt, Homo sapiens
guacccagcccucaguugu

SEQ ID NO: 380845 - RNA, 19 nt, Homo sapiens
gacaaugaaacccagaaga

SEQ ID NO: 380846 - RNA, 19 nt, Homo sapiens
aaaccgagaaucgaaacua

SEQ ID NO: 380847 - RNA, 19 nt, Homo sapiens
ggaacgcguuguggugauc

SEQ ID NO: 380848 - RNA, 19 nt, Homo sapiens
ugcagaggaugaagugcua

SEQ ID NO: 380849 - RNA, 19 nt, Homo sapiens
ucucauccuugaauucuag

SEQ ID NO: 380850 - RNA, 19 nt, Homo sapiens
uaaacauccuacagagaag

SEQ ID NO: 380851 - RNA, 19 nt, Homo sapiens
guugucauuugguucagaa

SEQ ID NO: 380852 - RNA, 19 nt, Homo sapiens
cgacaucagcgcagagauc

SEQ ID NO: 380853 - RNA, 19 nt, Homo sapiens
ccuccuggcugcacagaca

SEQ ID NO: 380854 - RNA, 19 nt, Homo sapiens
aaagugccuuccaaaccaa

SEQ ID NO: 380855 - RNA, 19 nt, Homo sapiens
ucucuaaacauccuacaga

SEQ ID NO: 380856 - RNA, 19 nt, Homo sapiens
cagcagcucggaagacuca

SEQ ID NO: 380857 - RNA, 19 nt, Homo sapiens
gggacccuauugacguuga

SEQ ID NO: 380858 - RNA, 19 nt, Homo sapiens
ggacagcucaagggacuca

SEQ ID NO: 380859 - RNA, 19 nt, Homo sapiens
aaagacagaaacugauguu

SEQ ID NO: 380860 - RNA, 19 nt, Homo sapiens
agaacagucugaggugaug

SEQ ID NO: 380861 - RNA, 19 nt, Homo sapiens
gcccucaguugucauuugg

SEQ ID NO: 380862 - RNA, 19 nt, Homo sapiens
gcccagcacuacucagcau

SEQ ID NO: 380863 - RNA, 19 nt, Homo sapiens
caaagacagaaacugaugu

SEQ ID NO: 380864 - RNA, 19 nt, Homo sapiens
uaccuuggguguccuuaca

SEQ ID NO: 380865 - RNA, 19 nt, Homo sapiens
guacagccgcuaucuaagc

SEQ ID NO: 380866 - RNA, 19 nt, Homo sapiens
cuacacaacgugagcuuca

SEQ ID NO: 380867 - RNA, 19 nt, Homo sapiens
gcagcacuuccucagcuuu

SEQ ID NO: 380868 - RNA, 19 nt, Homo sapiens
caacgacagcccagaagag

SEQ ID NO: 380869 - RNA, 19 nt, Homo sapiens
guacgccuucuccaucaaa

SEQ ID NO: 380870 - RNA, 19 nt, Homo sapiens
guguacgccuucuccauca

SEQ ID NO: 380871 - RNA, 19 nt, Homo sapiens
ugcaggaccucagcucuug

SEQ ID NO: 380872 - RNA, 19 nt, Homo sapiens
ggguuguccgcucugauua

SEQ ID NO: 380873 - RNA, 19 nt, Homo sapiens
agacuucucauccuugaau

SEQ ID NO: 380874 - RNA, 19 nt, Homo sapiens
caagaucuaaaccgagaau

SEQ ID NO: 380875 - RNA, 19 nt, Homo sapiens
gcagaccugugggcucuac

SEQ ID NO: 380876 - RNA, 19 nt, Homo sapiens
gagagugaaggcccagguu

SEQ ID NO: 380877 - RNA, 19 nt, Homo sapiens
cgcccuggauaacgucuuu

SEQ ID NO: 380878 - RNA, 19 nt, Homo sapiens
gaggaugucuccaauacaa

SEQ ID NO: 380879 - RNA, 19 nt, Homo sapiens
agauguggcugcucaauaa

SEQ ID NO: 380880 - RNA, 19 nt, Homo sapiens
gaccucagcucuugcauca

SEQ ID NO: 380881 - RNA, 19 nt, Homo sapiens
ggaaugaaucaacgaauga

SEQ ID NO: 380882 - RNA, 19 nt, Homo sapiens
gugcuacccuucucuugua

SEQ ID NO: 380883 - RNA, 19 nt, Homo sapiens
ccaggaaggucaucaagau

SEQ ID NO: 380884 - RNA, 19 nt, Homo sapiens
ggagcaggauagugccuuu

SEQ ID NO: 380885 - RNA, 19 nt, Homo sapiens
ggaggaggaguuccaguuu

SEQ ID NO: 380886 - RNA, 19 nt, Homo sapiens
ggaggccucucaaguccaa

SEQ ID NO: 380887 - RNA, 19 nt, Homo sapiens
gaggaggaguuccaguuuc

SEQ ID NO: 380888 - RNA, 19 nt, Homo sapiens
cccaagaccuggcagaugu

SEQ ID NO: 380889 - RNA, 19 nt, Homo sapiens
gcuaaggcauggcugagau

SEQ ID NO: 380890 - RNA, 19 nt, Homo sapiens
ggaaagaugcagcuguauc

SEQ ID NO: 380891 - RNA, 19 nt, Homo sapiens
cccaguggcucaacaacuu

SEQ ID NO: 380892 - RNA, 19 nt, Homo sapiens
gcagcuguauccaagaaag

SEQ ID NO: 380893 - RNA, 19 nt, Homo sapiens
ggggaaagaugcagcugua

SEQ ID NO: 380894 - RNA, 19 nt, Homo sapiens
gagcucaagugcgacauca

SEQ ID NO: 380895 - RNA, 19 nt, Homo sapiens
aaccgagaaucgaaacuaa

SEQ ID NO: 380896 - RNA, 19 nt, Homo sapiens
cgacagcccagaagaggaa

SEQ ID NO: 380897 - RNA, 19 nt, Homo sapiens
cagauguggcugcucaaua

SEQ ID NO: 380898 - RNA, 19 nt, Homo sapiens
uagcacucauuaauucuug

SEQ ID NO: 380899 - RNA, 19 nt, Homo sapiens
gaaagaugcagcuguaucc

SEQ ID NO: 380900 - RNA, 19 nt, Homo sapiens
gaaugaaucaacgaaugaa

SEQ ID NO: 380901 - RNA, 19 nt, Homo sapiens
aggaaugaaucaacgaaug

SEQ ID NO: 380902 - RNA, 19 nt, Homo sapiens
gaucuaaaccgagaaucga

SEQ ID NO: 380903 - RNA, 19 nt, Homo sapiens
gggauccgcuaccuguugu

SEQ ID NO: 380904 - RNA, 19 nt, Homo sapiens
cgaagcugcugccuugucu

SEQ ID NO: 380905 - RNA, 19 nt, Homo sapiens
gagauucaagccaccauuc

SEQ ID NO: 380906 - RNA, 19 nt, Homo sapiens
ggaacgcguuguggugauc

SEQ ID NO: 380907 - RNA, 19 nt, Homo sapiens
ugcagaggaugaagugcua

SEQ ID NO: 380908 - RNA, 19 nt, Homo sapiens
aaaccgagaaucgaaacua

SEQ ID NO: 380909 - RNA, 19 nt, Homo sapiens
ccucaaccauccugccaau

SEQ ID NO: 380910 - RNA, 19 nt, Homo sapiens
gagcacagggacuggcuau

SEQ ID NO: 380911 - RNA, 19 nt, Homo sapiens
aggcauggcugagauucaa

SEQ ID NO: 380912 - RNA, 19 nt, Homo sapiens
cuccauggcuucccagcuu

SEQ ID NO: 380913 - RNA, 19 nt, Homo sapiens
cgacaucagcgcagagauc

SEQ ID NO: 380914 - RNA, 19 nt, Homo sapiens
uaaggaaugaaucaacgaa

SEQ ID NO: 380915 - RNA, 19 nt, Homo sapiens
cagcagcucggaagacuca

SEQ ID NO: 380916 - RNA, 19 nt, Homo sapiens
gggacccuauugacguuga

SEQ ID NO: 380917 - RNA, 19 nt, Homo sapiens
ggacagcucaagggacuca

SEQ ID NO: 380918 - RNA, 19 nt, Homo sapiens
cagcacuccugccaucaca

SEQ ID NO: 380919 - RNA, 19 nt, Homo sapiens
acagcgagccuccugauca

SEQ ID NO: 380920 - RNA, 19 nt, Homo sapiens
caacgacagcccagaagag

SEQ ID NO: 380921 - RNA, 19 nt, Homo sapiens
guacgccuucuccaucaaa

SEQ ID NO: 380922 - RNA, 19 nt, Homo sapiens
guguacgccuucuccauca

SEQ ID NO: 380923 - RNA, 19 nt, Homo sapiens
ugcaggaccucagcucuug

SEQ ID NO: 380924 - RNA, 19 nt, Homo sapiens
caagaucuaaaccgagaau

SEQ ID NO: 380925 - RNA, 19 nt, Homo sapiens
gagagugaaggcccagguu

SEQ ID NO: 380926 - RNA, 19 nt, Homo sapiens
gcacagggacuggcuaucc

SEQ ID NO: 380927 - RNA, 19 nt, Homo sapiens
cgcccuggauaacgucuuu

SEQ ID NO: 380928 - RNA, 19 nt, Homo sapiens
gauguggcugcucaauaaa

SEQ ID NO: 380929 - RNA, 19 nt, Homo sapiens
ugaaucaacgaaugaaugg

SEQ ID NO: 380930 - RNA, 19 nt, Homo sapiens
guagcacucauuaauucuu

SEQ ID NO: 380931 - RNA, 19 nt, Homo sapiens
cauggaggccucucaaguc

SEQ ID NO: 380932 - RNA, 19 nt, Homo sapiens
ggaaagcagagcccagacu

SEQ ID NO: 380933 - RNA, 19 nt, Homo sapiens
ccgcuugcacccucaauug

SEQ ID NO: 380934 - RNA, 19 nt, Homo sapiens
gaggaggcagagagaguga

SEQ ID NO: 380935 - RNA, 19 nt, Homo sapiens
gccgacuucuggugcuuug

SEQ ID NO: 380936 - RNA, 19 nt, Homo sapiens
caccauuccaggccucuuu

SEQ ID NO: 380937 - RNA, 19 nt, Homo sapiens
ucaagggacucagccaacu

SEQ ID NO: 380938 - RNA, 19 nt, Homo sapiens
ucacgcacuccaagaucua

SEQ ID NO: 380939 - RNA, 19 nt, Homo sapiens
ccaguggcucaacaacuuu

SEQ ID NO: 380940 - RNA, 19 nt, Homo sapiens
cggaggaggaguuccaguu

SEQ ID NO: 380941 - RNA, 19 nt, Homo sapiens
ccgauggcuucgacgaguu

SEQ ID NO: 380942 - RNA, 19 nt, Homo sapiens
gcgcuggugcagaggauga

SEQ ID NO: 380943 - RNA, 19 nt, Homo sapiens
acccuucucuuguaaccuu

SEQ ID NO: 380944 - RNA, 19 nt, Homo sapiens
ccauggaggccucucaagu

SEQ ID NO: 380945 - RNA, 19 nt, Homo sapiens
aggaggaguuccaguuucu

SEQ ID NO: 380946 - RNA, 19 nt, Homo sapiens
augcagcuguauccaagaa

SEQ ID NO: 380947 - RNA, 19 nt, Homo sapiens
acgaaugaauggcuaugca

SEQ ID NO: 380948 - RNA, 19 nt, Homo sapiens
auacaacgacagcccagaa

SEQ ID NO: 380949 - RNA, 19 nt, Homo sapiens
gguaccagcgcgacuacga

SEQ ID NO: 380950 - RNA, 19 nt, Homo sapiens
caauagcacagccuuccau

SEQ ID NO: 380951 - RNA, 19 nt, Homo sapiens
cuucccagcuugacauguc

SEQ ID NO: 380952 - RNA, 19 nt, Homo sapiens
aaacuaagcugggguccau

SEQ ID NO: 380953 - RNA, 19 nt, Homo sapiens
gaggagggcuggacaagaa

SEQ ID NO: 380954 - RNA, 19 nt, Homo sapiens
gccaggagcucuucugaaa

SEQ ID NO: 380955 - RNA, 19 nt, Homo sapiens
gaggaugucuccaauacaa

SEQ ID NO: 380956 - RNA, 19 nt, Homo sapiens
agauguggcugcucaauaa

SEQ ID NO: 380957 - RNA, 19 nt, Homo sapiens
ggagcuuccuuaugcauuu

SEQ ID NO: 380958 - RNA, 19 nt, Homo sapiens
gaccucagcucuugcauca

SEQ ID NO: 380959 - RNA, 19 nt, Homo sapiens
gcaggugacucucagacuu

SEQ ID NO: 380960 - RNA, 19 nt, Homo sapiens
ggaaugaaucaacgaauga

SEQ ID NO: 380961 - RNA, 19 nt, Homo sapiens
gugcuacccuucucuugua

SEQ ID NO: 380962 - RNA, 19 nt, Homo sapiens
caggagcucuucugaaaug

SEQ ID NO: 380963 - RNA, 19 nt, Homo sapiens
ccaggaaggucaucaagau

SEQ ID NO: 380964 - RNA, 19 nt, Homo sapiens
agucugagguucuguauug

SEQ ID NO: 380965 - RNA, 19 nt, Homo sapiens
ccacagggcagcuauauag

SEQ ID NO: 380966 - RNA, 19 nt, Homo sapiens
gaggacagucuccaaauga

SEQ ID NO: 380967 - RNA, 19 nt, Homo sapiens
ggagcaggauagugccuuu

SEQ ID NO: 380968 - RNA, 19 nt, Homo sapiens
ggaggaggaguuccaguuu

SEQ ID NO: 380969 - RNA, 19 nt, Homo sapiens
cccuagagguuuauuacua

SEQ ID NO: 380970 - RNA, 19 nt, Homo sapiens
ggaggccucucaaguccaa

SEQ ID NO: 380971 - RNA, 19 nt, Homo sapiens
uaaauccauuccacaguga

SEQ ID NO: 380972 - RNA, 19 nt, Homo sapiens
uccauuccuugguuuauua

SEQ ID NO: 380973 - RNA, 19 nt, Homo sapiens
gaggaggaguuccaguuuc

SEQ ID NO: 380974 - RNA, 19 nt, Homo sapiens
acuagaggcuggacuauca

SEQ ID NO: 380975 - RNA, 19 nt, Homo sapiens
cccaagaccuggcagaugu

SEQ ID NO: 380976 - RNA, 19 nt, Homo sapiens
gcuaaggcauggcugagau

SEQ ID NO: 380977 - RNA, 19 nt, Homo sapiens
ugaggacagucuccaaaug

SEQ ID NO: 380978 - RNA, 19 nt, Homo sapiens
ggaucugaauagagugaaa

SEQ ID NO: 380979 - RNA, 19 nt, Homo sapiens
ggaaagaugcagcuguauc

SEQ ID NO: 380980 - RNA, 19 nt, Homo sapiens
cccaguggcucaacaacuu

SEQ ID NO: 380981 - RNA, 19 nt, Homo sapiens
gaaaaggggaucugaauag

SEQ ID NO: 380982 - RNA, 19 nt, Homo sapiens
gcagcuguauccaagaaag

SEQ ID NO: 380983 - RNA, 19 nt, Homo sapiens
ggggaaagaugcagcugua

SEQ ID NO: 380984 - RNA, 19 nt, Homo sapiens
gagcucaagugcgacauca

SEQ ID NO: 380985 - RNA, 19 nt, Homo sapiens
aaccgagaaucgaaacuaa

SEQ ID NO: 380986 - RNA, 19 nt, Homo sapiens
cgacagcccagaagaggaa

SEQ ID NO: 380987 - RNA, 19 nt, Homo sapiens
cagauguggcugcucaaua

SEQ ID NO: 380988 - RNA, 19 nt, Homo sapiens
uagcacucauuaauucuug

SEQ ID NO: 380989 - RNA, 19 nt, Homo sapiens
ggaaaaggggaucugaaua

SEQ ID NO: 380990 - RNA, 19 nt, Homo sapiens
ccauccauguagaaagaua

SEQ ID NO: 380991 - RNA, 19 nt, Homo sapiens
gaaagaugcagcuguaucc

SEQ ID NO: 380992 - RNA, 19 nt, Homo sapiens
gaaugaaucaacgaaugaa

SEQ ID NO: 380993 - RNA, 19 nt, Homo sapiens
aggaaugaaucaacgaaug

SEQ ID NO: 380994 - RNA, 19 nt, Homo sapiens
gaucuaaaccgagaaucga

SEQ ID NO: 380995 - RNA, 19 nt, Homo sapiens
gggauccgcuaccuguugu

SEQ ID NO: 380996 - RNA, 19 nt, Homo sapiens
gagguucuguauuggaaag

SEQ ID NO: 380997 - RNA, 19 nt, Homo sapiens
cgaagcugcugccuugucu

SEQ ID NO: 380998 - RNA, 19 nt, Homo sapiens
cuccauccauguagaaaga

SEQ ID NO: 380999 - RNA, 19 nt, Homo sapiens
gagauucaagccaccauuc

SEQ ID NO: 381000 - RNA, 19 nt, Homo sapiens
gcugaggacagucuccaaa

SEQ ID NO: 381001 - RNA, 19 nt, Homo sapiens
ggaacgcguuguggugauc

SEQ ID NO: 381002 - RNA, 19 nt, Homo sapiens
aaaccgagaaucgaaacua

SEQ ID NO: 381003 - RNA, 19 nt, Homo sapiens
ugcagaggaugaagugcua

SEQ ID NO: 381004 - RNA, 19 nt, Homo sapiens
ccucaaccauccugccaau

SEQ ID NO: 381005 - RNA, 19 nt, Homo sapiens
cugaauagagugaaagguu

SEQ ID NO: 381006 - RNA, 19 nt, Homo sapiens
gagcacagggacuggcuau

SEQ ID NO: 381007 - RNA, 19 nt, Homo sapiens
aggcauggcugagauucaa

SEQ ID NO: 381008 - RNA, 19 nt, Homo sapiens
cuccauggcuucccagcuu

SEQ ID NO: 381009 - RNA, 19 nt, Homo sapiens
gaauguccaagaccuuugu

SEQ ID NO: 381010 - RNA, 19 nt, Homo sapiens
ggaauguccaagaccuuug

SEQ ID NO: 381011 - RNA, 19 nt, Homo sapiens
cgacaucagcgcagagauc

SEQ ID NO: 381012 - RNA, 19 nt, Homo sapiens
uaaggaaugaaucaacgaa

SEQ ID NO: 381013 - RNA, 19 nt, Homo sapiens
gucuggagcuuccuuaugc

SEQ ID NO: 381014 - RNA, 19 nt, Homo sapiens
ggacagucuccaaaugaca

SEQ ID NO: 381015 - RNA, 19 nt, Homo sapiens
ggugaguggcccagaaguu

SEQ ID NO: 381016 - RNA, 19 nt, Homo sapiens
cagcagcucggaagacuca

SEQ ID NO: 381017 - RNA, 19 nt, Homo sapiens
ggacagcucaagggacuca

SEQ ID NO: 381018 - RNA, 19 nt, Homo sapiens
gggacccuauugacguuga

SEQ ID NO: 381019 - RNA, 19 nt, Homo sapiens
cugagguucuguauuggaa

SEQ ID NO: 381020 - RNA, 19 nt, Homo sapiens
ccacagcaggugacucuca

SEQ ID NO: 381021 - RNA, 19 nt, Homo sapiens
cagcacuccugccaucaca

SEQ ID NO: 381022 - RNA, 19 nt, Homo sapiens
acagcgagccuccugauca

SEQ ID NO: 381023 - RNA, 19 nt, Homo sapiens
caacgacagcccagaagag

SEQ ID NO: 381024 - RNA, 19 nt, Homo sapiens
guacgccuucuccaucaaa

SEQ ID NO: 381025 - RNA, 19 nt, Homo sapiens
guguacgccuucuccauca

SEQ ID NO: 381026 - RNA, 19 nt, Homo sapiens
ugcaggaccucagcucuug

SEQ ID NO: 381027 - RNA, 19 nt, Homo sapiens
caagaucuaaaccgagaau

SEQ ID NO: 381028 - RNA, 19 nt, Homo sapiens
gagagugaaggcccagguu

SEQ ID NO: 381029 - RNA, 19 nt, Homo sapiens
gcacagggacuggcuaucc

SEQ ID NO: 381030 - RNA, 19 nt, Homo sapiens
cgcccuggauaacgucuuu

SEQ ID NO: 381031 - RNA, 19 nt, Homo sapiens
gauguggcugcucaauaaa

SEQ ID NO: 381032 - RNA, 19 nt, Homo sapiens
ugaaucaacgaaugaaugg

SEQ ID NO: 381033 - RNA, 19 nt, Homo sapiens
guagcacucauuaauucuu

SEQ ID NO: 381034 - RNA, 19 nt, Homo sapiens
cauggaggccucucaaguc

SEQ ID NO: 381035 - RNA, 19 nt, Homo sapiens
ccgcuugcacccucaauug

SEQ ID NO: 381036 - RNA, 19 nt, Homo sapiens
gccacagggcagcuauaua

SEQ ID NO: 381037 - RNA, 19 nt, Homo sapiens
gccgacuucuggugcuuug

SEQ ID NO: 381038 - RNA, 19 nt, Homo sapiens
gaggaggcagagagaguga

SEQ ID NO: 381039 - RNA, 19 nt, Homo sapiens
caccauuccaggccucuuu

SEQ ID NO: 381040 - RNA, 19 nt, Homo sapiens
ucaagggacucagccaacu

SEQ ID NO: 381041 - RNA, 19 nt, Homo sapiens
ucacgcacuccaagaucua

SEQ ID NO: 381042 - RNA, 19 nt, Homo sapiens
gggccaggagcucuucuga

SEQ ID NO: 381043 - RNA, 19 nt, Homo sapiens
caggugacucucagacuug

SEQ ID NO: 381044 - RNA, 19 nt, Homo sapiens
cggaggaggaguuccaguu

SEQ ID NO: 381045 - RNA, 19 nt, Homo sapiens
ccaguggcucaacaacuuu

SEQ ID NO: 381046 - RNA, 19 nt, Homo sapiens
gggccaaacaagugagguu

SEQ ID NO: 381047 - RNA, 19 nt, Homo sapiens
gugaguggcccagaaguuc

SEQ ID NO: 381048 - RNA, 19 nt, Homo sapiens
ccgauggcuucgacgaguu

SEQ ID NO: 381049 - RNA, 19 nt, Homo sapiens
gcgcuggugcagaggauga

SEQ ID NO: 381050 - RNA, 19 nt, Homo sapiens
acccuucucuuguaaccuu

SEQ ID NO: 381051 - RNA, 19 nt, Homo sapiens
ccauggaggccucucaagu

SEQ ID NO: 381052 - RNA, 19 nt, Homo sapiens
aggaggaguuccaguuucu

SEQ ID NO: 381053 - RNA, 19 nt, Homo sapiens
gaggaugucuccaauacaa

SEQ ID NO: 381054 - RNA, 19 nt, Homo sapiens
agauguggcugcucaauaa

SEQ ID NO: 381055 - RNA, 19 nt, Homo sapiens
gaccucagcucuugcauca

SEQ ID NO: 381056 - RNA, 19 nt, Homo sapiens
ggaaugaaucaacgaauga

SEQ ID NO: 381057 - RNA, 19 nt, Homo sapiens
gugcuacccuucucuugua

SEQ ID NO: 381058 - RNA, 19 nt, Homo sapiens
ccaggaaggucaucaagau

SEQ ID NO: 381059 - RNA, 19 nt, Homo sapiens
ggagcaggauagugccuuu

SEQ ID NO: 381060 - RNA, 19 nt, Homo sapiens
ggaggaggaguuccaguuu

SEQ ID NO: 381061 - RNA, 19 nt, Homo sapiens
ggaggccucucaaguccaa

SEQ ID NO: 381062 - RNA, 19 nt, Homo sapiens
gaggaggaguuccaguuuc

SEQ ID NO: 381063 - RNA, 19 nt, Homo sapiens
cccaagaccuggcagaugu

SEQ ID NO: 381064 - RNA, 19 nt, Homo sapiens
gcuaaggcauggcugagau

SEQ ID NO: 381065 - RNA, 19 nt, Homo sapiens
ggaaagaugcagcuguauc

SEQ ID NO: 381066 - RNA, 19 nt, Homo sapiens
cccaguggcucaacaacuu

SEQ ID NO: 381067 - RNA, 19 nt, Homo sapiens
gcagcuguauccaagaaag

SEQ ID NO: 381068 - RNA, 19 nt, Homo sapiens
ggggaaagaugcagcugua

SEQ ID NO: 381069 - RNA, 19 nt, Homo sapiens
gagcucaagugcgacauca

SEQ ID NO: 381070 - RNA, 19 nt, Homo sapiens
aaccgagaaucgaaacuaa

SEQ ID NO: 381071 - RNA, 19 nt, Homo sapiens
cgacagcccagaagaggaa

SEQ ID NO: 381072 - RNA, 19 nt, Homo sapiens
cagauguggcugcucaaua

SEQ ID NO: 381073 - RNA, 19 nt, Homo sapiens
uagcacucauuaauucuug

SEQ ID NO: 381074 - RNA, 19 nt, Homo sapiens
gaaagaugcagcuguaucc

SEQ ID NO: 381075 - RNA, 19 nt, Homo sapiens
gaaugaaucaacgaaugaa

SEQ ID NO: 381076 - RNA, 19 nt, Homo sapiens
aggaaugaaucaacgaaug

SEQ ID NO: 381077 - RNA, 19 nt, Homo sapiens
gaucuaaaccgagaaucga

SEQ ID NO: 381078 - RNA, 19 nt, Homo sapiens
gggauccgcuaccuguugu

SEQ ID NO: 381079 - RNA, 19 nt, Homo sapiens
cgaagcugcugccuugucu

SEQ ID NO: 381080 - RNA, 19 nt, Homo sapiens
gagauucaagccaccauuc

SEQ ID NO: 381081 - RNA, 19 nt, Homo sapiens
ggaacgcguuguggugauc

SEQ ID NO: 381082 - RNA, 19 nt, Homo sapiens
ugcagaggaugaagugcua

SEQ ID NO: 381083 - RNA, 19 nt, Homo sapiens
aaaccgagaaucgaaacua

SEQ ID NO: 381084 - RNA, 19 nt, Homo sapiens
ccucaaccauccugccaau

SEQ ID NO: 381085 - RNA, 19 nt, Homo sapiens
gagcacagggacuggcuau

SEQ ID NO: 381086 - RNA, 19 nt, Homo sapiens
aggcauggcugagauucaa

SEQ ID NO: 381087 - RNA, 19 nt, Homo sapiens
cuccauggcuucccagcuu

SEQ ID NO: 381088 - RNA, 19 nt, Homo sapiens
cgacaucagcgcagagauc

SEQ ID NO: 381089 - RNA, 19 nt, Homo sapiens
uaaggaaugaaucaacgaa

SEQ ID NO: 381090 - RNA, 19 nt, Homo sapiens
cagcagcucggaagacuca

SEQ ID NO: 381091 - RNA, 19 nt, Homo sapiens
gggacccuauugacguuga

SEQ ID NO: 381092 - RNA, 19 nt, Homo sapiens
ggacagcucaagggacuca

SEQ ID NO: 381093 - RNA, 19 nt, Homo sapiens
cagcacuccugccaucaca

SEQ ID NO: 381094 - RNA, 19 nt, Homo sapiens
acagcgagccuccugauca

SEQ ID NO: 381095 - RNA, 19 nt, Homo sapiens
caacgacagcccagaagag

SEQ ID NO: 381096 - RNA, 19 nt, Homo sapiens
guacgccuucuccaucaaa

SEQ ID NO: 381097 - RNA, 19 nt, Homo sapiens
guguacgccuucuccauca

SEQ ID NO: 381098 - RNA, 19 nt, Homo sapiens
ugcaggaccucagcucuug

SEQ ID NO: 381099 - RNA, 19 nt, Homo sapiens
caagaucuaaaccgagaau

SEQ ID NO: 381100 - RNA, 19 nt, Homo sapiens
gagagugaaggcccagguu

SEQ ID NO: 381101 - RNA, 19 nt, Homo sapiens
gcacagggacuggcuaucc

SEQ ID NO: 381102 - RNA, 19 nt, Homo sapiens
cgcccuggauaacgucuuu

SEQ ID NO: 381103 - RNA, 19 nt, Homo sapiens
gauguggcugcucaauaaa

SEQ ID NO: 381104 - RNA, 19 nt, Homo sapiens
ugaaucaacgaaugaaugg

SEQ ID NO: 381105 - RNA, 19 nt, Homo sapiens
guagcacucauuaauucuu

SEQ ID NO: 381106 - RNA, 19 nt, Homo sapiens
cauggaggccucucaaguc

SEQ ID NO: 381107 - RNA, 19 nt, Homo sapiens
ccgcuugcacccucaauug

SEQ ID NO: 381108 - RNA, 19 nt, Homo sapiens
gaggaggcagagagaguga

SEQ ID NO: 381109 - RNA, 19 nt, Homo sapiens
gccgacuucuggugcuuug

SEQ ID NO: 381110 - RNA, 19 nt, Homo sapiens
caccauuccaggccucuuu

SEQ ID NO: 381111 - RNA, 19 nt, Homo sapiens
ucaagggacucagccaacu

SEQ ID NO: 381112 - RNA, 19 nt, Homo sapiens
ucacgcacuccaagaucua

SEQ ID NO: 381113 - RNA, 19 nt, Homo sapiens
ccaguggcucaacaacuuu

SEQ ID NO: 381114 - RNA, 19 nt, Homo sapiens
cggaggaggaguuccaguu

SEQ ID NO: 381115 - RNA, 19 nt, Homo sapiens
ccgauggcuucgacgaguu

SEQ ID NO: 381116 - RNA, 19 nt, Homo sapiens
gcgcuggugcagaggauga

SEQ ID NO: 381117 - RNA, 19 nt, Homo sapiens
acccuucucuuguaaccuu

SEQ ID NO: 381118 - RNA, 19 nt, Homo sapiens
ccauggaggccucucaagu

SEQ ID NO: 381119 - RNA, 19 nt, Homo sapiens
ccagacucuuggagcaguu

SEQ ID NO: 381120 - RNA, 19 nt, Homo sapiens
aggaggaguuccaguuucu

SEQ ID NO: 381121 - RNA, 19 nt, Homo sapiens
augcagcuguauccaagaa

SEQ ID NO: 381122 - RNA, 19 nt, Homo sapiens
acgaaugaauggcuaugca

SEQ ID NO: 381123 - RNA, 19 nt, Homo sapiens
auacaacgacagcccagaa

SEQ ID NO: 381124 - RNA, 19 nt, Homo sapiens
gguaccagcgcgacuacga

SEQ ID NO: 381125 - RNA, 19 nt, Homo sapiens
caauagcacagccuuccau

SEQ ID NO: 381126 - RNA, 19 nt, Homo sapiens
cuucccagcuugacauguc

SEQ ID NO: 381127 - RNA, 19 nt, Homo sapiens
aaacuaagcugggguccau

SEQ ID NO: 381128 - RNA, 19 nt, Homo sapiens
gaggaugucuccaauacaa

SEQ ID NO: 381129 - RNA, 19 nt, Homo sapiens
agauguggcugcucaauaa

SEQ ID NO: 381130 - RNA, 19 nt, Homo sapiens
gaccucagcucuugcauca

SEQ ID NO: 381131 - RNA, 19 nt, Homo sapiens
ggaaugaaucaacgaauga

SEQ ID NO: 381132 - RNA, 19 nt, Homo sapiens
gugcuacccuucucuugua

SEQ ID NO: 381133 - RNA, 19 nt, Homo sapiens
ccaggaaggucaucaagau

SEQ ID NO: 381134 - RNA, 19 nt, Homo sapiens
ggagcaggauagugccuuu

SEQ ID NO: 381135 - RNA, 19 nt, Homo sapiens
ggaggaggaguuccaguuu

SEQ ID NO: 381136 - RNA, 19 nt, Homo sapiens
ggaggccucucaaguccaa

SEQ ID NO: 381137 - RNA, 19 nt, Homo sapiens
gaggaggaguuccaguuuc

SEQ ID NO: 381138 - RNA, 19 nt, Homo sapiens
cccaagaccuggcagaugu

SEQ ID NO: 381139 - RNA, 19 nt, Homo sapiens
gcuaaggcauggcugagau

SEQ ID NO: 381140 - RNA, 19 nt, Homo sapiens
ggaaagaugcagcuguauc

SEQ ID NO: 381141 - RNA, 19 nt, Homo sapiens
cccaguggcucaacaacuu

SEQ ID NO: 381142 - RNA, 19 nt, Homo sapiens
gcagcuguauccaagaaag

SEQ ID NO: 381143 - RNA, 19 nt, Homo sapiens
ggggaaagaugcagcugua

SEQ ID NO: 381144 - RNA, 19 nt, Homo sapiens
gagcucaagugcgacauca

SEQ ID NO: 381145 - RNA, 19 nt, Homo sapiens
aaccgagaaucgaaacuaa

SEQ ID NO: 381146 - RNA, 19 nt, Homo sapiens
cgacagcccagaagaggaa

SEQ ID NO: 381147 - RNA, 19 nt, Homo sapiens
cagauguggcugcucaaua

SEQ ID NO: 381148 - RNA, 19 nt, Homo sapiens
uagcacucauuaauucuug

SEQ ID NO: 381149 - RNA, 19 nt, Homo sapiens
gaaagaugcagcuguaucc

SEQ ID NO: 381150 - RNA, 19 nt, Homo sapiens
gaaugaaucaacgaaugaa

SEQ ID NO: 381151 - RNA, 19 nt, Homo sapiens
aggaaugaaucaacgaaug

SEQ ID NO: 381152 - RNA, 19 nt, Homo sapiens
gaucuaaaccgagaaucga

SEQ ID NO: 381153 - RNA, 19 nt, Homo sapiens
gggauccgcuaccuguugu

SEQ ID NO: 381154 - RNA, 19 nt, Homo sapiens
cgaagcugcugccuugucu

SEQ ID NO: 381155 - RNA, 19 nt, Homo sapiens
gagauucaagccaccauuc

SEQ ID NO: 381156 - RNA, 19 nt, Homo sapiens
ggaacgcguuguggugauc

SEQ ID NO: 381157 - RNA, 19 nt, Homo sapiens
ugcagaggaugaagugcua

SEQ ID NO: 381158 - RNA, 19 nt, Homo sapiens
aaaccgagaaucgaaacua

SEQ ID NO: 381159 - RNA, 19 nt, Homo sapiens
ccucaaccauccugccaau

SEQ ID NO: 381160 - RNA, 19 nt, Homo sapiens
gagcacagggacuggcuau

SEQ ID NO: 381161 - RNA, 19 nt, Homo sapiens
aggcauggcugagauucaa

SEQ ID NO: 381162 - RNA, 19 nt, Homo sapiens
cuccauggcuucccagcuu

SEQ ID NO: 381163 - RNA, 19 nt, Homo sapiens
cgacaucagcgcagagauc

SEQ ID NO: 381164 - RNA, 19 nt, Homo sapiens
uaaggaaugaaucaacgaa

SEQ ID NO: 381165 - RNA, 19 nt, Homo sapiens
cagcagcucggaagacuca

SEQ ID NO: 381166 - RNA, 19 nt, Homo sapiens
gggacccuauugacguuga

SEQ ID NO: 381167 - RNA, 19 nt, Homo sapiens
ggacagcucaagggacuca

SEQ ID NO: 381168 - RNA, 19 nt, Homo sapiens
cagcacuccugccaucaca

SEQ ID NO: 381169 - RNA, 19 nt, Homo sapiens
acagcgagccuccugauca

SEQ ID NO: 381170 - RNA, 19 nt, Homo sapiens
caacgacagcccagaagag

SEQ ID NO: 381171 - RNA, 19 nt, Homo sapiens
guacgccuucuccaucaaa

SEQ ID NO: 381172 - RNA, 19 nt, Homo sapiens
guguacgccuucuccauca

SEQ ID NO: 381173 - RNA, 19 nt, Homo sapiens
ugcaggaccucagcucuug

SEQ ID NO: 381174 - RNA, 19 nt, Homo sapiens
caagaucuaaaccgagaau

SEQ ID NO: 381175 - RNA, 19 nt, Homo sapiens
gagagugaaggcccagguu

SEQ ID NO: 381176 - RNA, 19 nt, Homo sapiens
gcacagggacuggcuaucc

SEQ ID NO: 381177 - RNA, 19 nt, Homo sapiens
cgcccuggauaacgucuuu

SEQ ID NO: 381178 - RNA, 19 nt, Homo sapiens
gauguggcugcucaauaaa

SEQ ID NO: 381179 - RNA, 19 nt, Homo sapiens
ugaaucaacgaaugaaugg

SEQ ID NO: 381180 - RNA, 19 nt, Homo sapiens
guagcacucauuaauucuu

SEQ ID NO: 381181 - RNA, 19 nt, Homo sapiens
cauggaggccucucaaguc

SEQ ID NO: 381182 - RNA, 19 nt, Homo sapiens
ccgcuugcacccucaauug

SEQ ID NO: 381183 - RNA, 19 nt, Homo sapiens
gaggaggcagagagaguga

SEQ ID NO: 381184 - RNA, 19 nt, Homo sapiens
gccgacuucuggugcuuug

SEQ ID NO: 381185 - RNA, 19 nt, Homo sapiens
caccauuccaggccucuuu

SEQ ID NO: 381186 - RNA, 19 nt, Homo sapiens
ucaagggacucagccaacu

SEQ ID NO: 381187 - RNA, 19 nt, Homo sapiens
ucacgcacuccaagaucua

SEQ ID NO: 381188 - RNA, 19 nt, Homo sapiens
ccaguggcucaacaacuuu

SEQ ID NO: 381189 - RNA, 19 nt, Homo sapiens
cggaggaggaguuccaguu

SEQ ID NO: 381190 - RNA, 19 nt, Homo sapiens
ccgauggcuucgacgaguu

SEQ ID NO: 381191 - RNA, 19 nt, Homo sapiens
gcgcuggugcagaggauga

SEQ ID NO: 381192 - RNA, 19 nt, Homo sapiens
acccuucucuuguaaccuu

SEQ ID NO: 381193 - RNA, 19 nt, Homo sapiens
ccauggaggccucucaagu

SEQ ID NO: 381194 - RNA, 19 nt, Homo sapiens
ccagacucuuggagcaguu

SEQ ID NO: 381195 - RNA, 19 nt, Homo sapiens
aggaggaguuccaguuucu

SEQ ID NO: 381196 - RNA, 19 nt, Homo sapiens
augcagcuguauccaagaa

SEQ ID NO: 381197 - RNA, 19 nt, Homo sapiens
acgaaugaauggcuaugca

SEQ ID NO: 381198 - RNA, 19 nt, Homo sapiens
auacaacgacagcccagaa

SEQ ID NO: 381199 - RNA, 19 nt, Homo sapiens
gguaccagcgcgacuacga

SEQ ID NO: 381200 - RNA, 19 nt, Homo sapiens
caauagcacagccuuccau

SEQ ID NO: 381201 - RNA, 19 nt, Homo sapiens
cuucccagcuugacauguc

SEQ ID NO: 381202 - RNA, 19 nt, Homo sapiens
aaacuaagcugggguccau

SEQ ID NO: 381203 - RNA, 19 nt, Homo sapiens
gaggagggcuggacaagaa

SEQ ID NO: 381204 - RNA, 19 nt, Homo sapiens
gccaggagcucuucugaaa

SEQ ID NO: 381205 - RNA, 19 nt, Homo sapiens
gaggaugucuccaauacaa

SEQ ID NO: 381206 - RNA, 19 nt, Homo sapiens
agauguggcugcucaauaa

SEQ ID NO: 381207 - RNA, 19 nt, Homo sapiens
ggagcuuccuuaugcauuu

SEQ ID NO: 381208 - RNA, 19 nt, Homo sapiens
gaccucagcucuugcauca

SEQ ID NO: 381209 - RNA, 19 nt, Homo sapiens
gcaggugacucucagacuu

SEQ ID NO: 381210 - RNA, 19 nt, Homo sapiens
ggaaugaaucaacgaauga

SEQ ID NO: 381211 - RNA, 19 nt, Homo sapiens
gugcuacccuucucuugua

SEQ ID NO: 381212 - RNA, 19 nt, Homo sapiens
caggagcucuucugaaaug

SEQ ID NO: 381213 - RNA, 19 nt, Homo sapiens
ccaggaaggucaucaagau

SEQ ID NO: 381214 - RNA, 19 nt, Homo sapiens
agucugagguucuguauug

SEQ ID NO: 381215 - RNA, 19 nt, Homo sapiens
ccacagggcagcuauauag

SEQ ID NO: 381216 - RNA, 19 nt, Homo sapiens
gaggacagucuccaaauga

SEQ ID NO: 381217 - RNA, 19 nt, Homo sapiens
ggagcaggauagugccuuu

SEQ ID NO: 381218 - RNA, 19 nt, Homo sapiens
ggaggaggaguuccaguuu

SEQ ID NO: 381219 - RNA, 19 nt, Homo sapiens
cccuagagguuuauuacua

SEQ ID NO: 381220 - RNA, 19 nt, Homo sapiens
ggaggccucucaaguccaa

SEQ ID NO: 381221 - RNA, 19 nt, Homo sapiens
uaaauccauuccacaguga

SEQ ID NO: 381222 - RNA, 19 nt, Homo sapiens
uccauuccuugguuuauua

SEQ ID NO: 381223 - RNA, 19 nt, Homo sapiens
gaggaggaguuccaguuuc

SEQ ID NO: 381224 - RNA, 19 nt, Homo sapiens
acuagaggcuggacuauca

SEQ ID NO: 381225 - RNA, 19 nt, Homo sapiens
cccaagaccuggcagaugu

SEQ ID NO: 381226 - RNA, 19 nt, Homo sapiens
gcuaaggcauggcugagau

SEQ ID NO: 381227 - RNA, 19 nt, Homo sapiens
ugaggacagucuccaaaug

SEQ ID NO: 381228 - RNA, 19 nt, Homo sapiens
ggaucugaauagagugaaa

SEQ ID NO: 381229 - RNA, 19 nt, Homo sapiens
ggaaagaugcagcuguauc

SEQ ID NO: 381230 - RNA, 19 nt, Homo sapiens
cccaguggcucaacaacuu

SEQ ID NO: 381231 - RNA, 19 nt, Homo sapiens
gaaaaggggaucugaauag

SEQ ID NO: 381232 - RNA, 19 nt, Homo sapiens
gcagcuguauccaagaaag

SEQ ID NO: 381233 - RNA, 19 nt, Homo sapiens
ggggaaagaugcagcugua

SEQ ID NO: 381234 - RNA, 19 nt, Homo sapiens
gagcucaagugcgacauca

SEQ ID NO: 381235 - RNA, 19 nt, Homo sapiens
aaccgagaaucgaaacuaa

SEQ ID NO: 381236 - RNA, 19 nt, Homo sapiens
cgacagcccagaagaggaa

SEQ ID NO: 381237 - RNA, 19 nt, Homo sapiens
cagauguggcugcucaaua

SEQ ID NO: 381238 - RNA, 19 nt, Homo sapiens
uagcacucauuaauucuug

SEQ ID NO: 381239 - RNA, 19 nt, Homo sapiens
ggaaaaggggaucugaaua

SEQ ID NO: 381240 - RNA, 19 nt, Homo sapiens
ccauccauguagaaagaua

SEQ ID NO: 381241 - RNA, 19 nt, Homo sapiens
gaaagaugcagcuguaucc

SEQ ID NO: 381242 - RNA, 19 nt, Homo sapiens
gaaugaaucaacgaaugaa

SEQ ID NO: 381243 - RNA, 19 nt, Homo sapiens
aggaaugaaucaacgaaug

SEQ ID NO: 381244 - RNA, 19 nt, Homo sapiens
gaucuaaaccgagaaucga

SEQ ID NO: 381245 - RNA, 19 nt, Homo sapiens
gggauccgcuaccuguugu

SEQ ID NO: 381246 - RNA, 19 nt, Homo sapiens
gagguucuguauuggaaag

SEQ ID NO: 381247 - RNA, 19 nt, Homo sapiens
cgaagcugcugccuugucu

SEQ ID NO: 381248 - RNA, 19 nt, Homo sapiens
cuccauccauguagaaaga

SEQ ID NO: 381249 - RNA, 19 nt, Homo sapiens
gagauucaagccaccauuc

SEQ ID NO: 381250 - RNA, 19 nt, Homo sapiens
gcugaggacagucuccaaa

SEQ ID NO: 381251 - RNA, 19 nt, Homo sapiens
ggaacgcguuguggugauc

SEQ ID NO: 381252 - RNA, 19 nt, Homo sapiens
aaaccgagaaucgaaacua

SEQ ID NO: 381253 - RNA, 19 nt, Homo sapiens
ugcagaggaugaagugcua

SEQ ID NO: 381254 - RNA, 19 nt, Homo sapiens
ccucaaccauccugccaau

SEQ ID NO: 381255 - RNA, 19 nt, Homo sapiens
cugaauagagugaaagguu

SEQ ID NO: 381256 - RNA, 19 nt, Homo sapiens
gagcacagggacuggcuau

SEQ ID NO: 381257 - RNA, 19 nt, Homo sapiens
aggcauggcugagauucaa

SEQ ID NO: 381258 - RNA, 19 nt, Homo sapiens
cuccauggcuucccagcuu

SEQ ID NO: 381259 - RNA, 19 nt, Homo sapiens
gaauguccaagaccuuugu

SEQ ID NO: 381260 - RNA, 19 nt, Homo sapiens
ggaauguccaagaccuuug

SEQ ID NO: 381261 - RNA, 19 nt, Homo sapiens
cgacaucagcgcagagauc

SEQ ID NO: 381262 - RNA, 19 nt, Homo sapiens
uaaggaaugaaucaacgaa

SEQ ID NO: 381263 - RNA, 19 nt, Homo sapiens
gucuggagcuuccuuaugc

SEQ ID NO: 381264 - RNA, 19 nt, Homo sapiens
ggacagucuccaaaugaca

SEQ ID NO: 381265 - RNA, 19 nt, Homo sapiens
ggugaguggcccagaaguu

SEQ ID NO: 381266 - RNA, 19 nt, Homo sapiens
cagcagcucggaagacuca

SEQ ID NO: 381267 - RNA, 19 nt, Homo sapiens
ggacagcucaagggacuca

SEQ ID NO: 381268 - RNA, 19 nt, Homo sapiens
gggacccuauugacguuga

SEQ ID NO: 381269 - RNA, 19 nt, Homo sapiens
cugagguucuguauuggaa

SEQ ID NO: 381270 - RNA, 19 nt, Homo sapiens
ccacagcaggugacucuca

SEQ ID NO: 381271 - RNA, 19 nt, Homo sapiens
cagcacuccugccaucaca

SEQ ID NO: 381272 - RNA, 19 nt, Homo sapiens
acagcgagccuccugauca

SEQ ID NO: 381273 - RNA, 19 nt, Homo sapiens
caacgacagcccagaagag

SEQ ID NO: 381274 - RNA, 19 nt, Homo sapiens
guacgccuucuccaucaaa

SEQ ID NO: 381275 - RNA, 19 nt, Homo sapiens
guguacgccuucuccauca

SEQ ID NO: 381276 - RNA, 19 nt, Homo sapiens
ugcaggaccucagcucuug

SEQ ID NO: 381277 - RNA, 19 nt, Homo sapiens
caagaucuaaaccgagaau

SEQ ID NO: 381278 - RNA, 19 nt, Homo sapiens
gagagugaaggcccagguu

SEQ ID NO: 381279 - RNA, 19 nt, Homo sapiens
gcacagggacuggcuaucc

SEQ ID NO: 381280 - RNA, 19 nt, Homo sapiens
cgcccuggauaacgucuuu

SEQ ID NO: 381281 - RNA, 19 nt, Homo sapiens
gauguggcugcucaauaaa

SEQ ID NO: 381282 - RNA, 19 nt, Homo sapiens
ugaaucaacgaaugaaugg

SEQ ID NO: 381283 - RNA, 19 nt, Homo sapiens
guagcacucauuaauucuu

SEQ ID NO: 381284 - RNA, 19 nt, Homo sapiens
cauggaggccucucaaguc

SEQ ID NO: 381285 - RNA, 19 nt, Homo sapiens
ccgcuugcacccucaauug

SEQ ID NO: 381286 - RNA, 19 nt, Homo sapiens
gccacagggcagcuauaua

SEQ ID NO: 381287 - RNA, 19 nt, Homo sapiens
gccgacuucuggugcuuug

SEQ ID NO: 381288 - RNA, 19 nt, Homo sapiens
gaggaggcagagagaguga

SEQ ID NO: 381289 - RNA, 19 nt, Homo sapiens
caccauuccaggccucuuu

SEQ ID NO: 381290 - RNA, 19 nt, Homo sapiens
ucaagggacucagccaacu

SEQ ID NO: 381291 - RNA, 19 nt, Homo sapiens
ucacgcacuccaagaucua

SEQ ID NO: 381292 - RNA, 19 nt, Homo sapiens
gggccaggagcucuucuga

SEQ ID NO: 381293 - RNA, 19 nt, Homo sapiens
caggugacucucagacuug

SEQ ID NO: 381294 - RNA, 19 nt, Homo sapiens
cggaggaggaguuccaguu

SEQ ID NO: 381295 - RNA, 19 nt, Homo sapiens
ccaguggcucaacaacuuu

SEQ ID NO: 381296 - RNA, 19 nt, Homo sapiens
gggccaaacaagugagguu

SEQ ID NO: 381297 - RNA, 19 nt, Homo sapiens
gugaguggcccagaaguuc

SEQ ID NO: 381298 - RNA, 19 nt, Homo sapiens
ccgauggcuucgacgaguu

SEQ ID NO: 381299 - RNA, 19 nt, Homo sapiens
gcgcuggugcagaggauga

SEQ ID NO: 381300 - RNA, 19 nt, Homo sapiens
acccuucucuuguaaccuu

SEQ ID NO: 381301 - RNA, 19 nt, Homo sapiens
ccauggaggccucucaagu

SEQ ID NO: 381302 - RNA, 19 nt, Homo sapiens
ccagacucuuggagcaguu

SEQ ID NO: 381303 - RNA, 19 nt, Homo sapiens
gaccucagcucuugcauca

SEQ ID NO: 381304 - RNA, 19 nt, Homo sapiens
ggagcaggauagugccuuu

SEQ ID NO: 381305 - RNA, 19 nt, Homo sapiens
ggaggaggaguuccaguuu

SEQ ID NO: 381306 - RNA, 19 nt, Homo sapiens
gaggaggaguuccaguuuc

SEQ ID NO: 381307 - RNA, 19 nt, Homo sapiens
auaaagauguccgccuuaa

SEQ ID NO: 381308 - RNA, 19 nt, Homo sapiens
ggaaagaugcagcuguauc

SEQ ID NO: 381309 - RNA, 19 nt, Homo sapiens
gcagcuguauccaagaaag

SEQ ID NO: 381310 - RNA, 19 nt, Homo sapiens
ggggaaagaugcagcugua

SEQ ID NO: 381311 - RNA, 19 nt, Homo sapiens
gagcucaagugcgacauca

SEQ ID NO: 381312 - RNA, 19 nt, Homo sapiens
aaccgagaaucgaaacuaa

SEQ ID NO: 381313 - RNA, 19 nt, Homo sapiens
gaugacagcagcagugagu

SEQ ID NO: 381314 - RNA, 19 nt, Homo sapiens
gaaagaugcagcuguaucc

SEQ ID NO: 381315 - RNA, 19 nt, Homo sapiens
gucauuugcuggcuugaau

SEQ ID NO: 381316 - RNA, 19 nt, Homo sapiens
ucugagcucuggccaacaa

SEQ ID NO: 381317 - RNA, 19 nt, Homo sapiens
gaucuaaaccgagaaucga

SEQ ID NO: 381318 - RNA, 19 nt, Homo sapiens
uaaagauguccgccuuaaa

SEQ ID NO: 381319 - RNA, 19 nt, Homo sapiens
gcuccuggcgugucauuug

SEQ ID NO: 381320 - RNA, 19 nt, Homo sapiens
cgaagcugcugccuugucu

SEQ ID NO: 381321 - RNA, 19 nt, Homo sapiens
ggaacgcguuguggugauc

SEQ ID NO: 381322 - RNA, 19 nt, Homo sapiens
ugcagaggaugaagugcua

SEQ ID NO: 381323 - RNA, 19 nt, Homo sapiens
aaaccgagaaucgaaacua

SEQ ID NO: 381324 - RNA, 19 nt, Homo sapiens
aaagauguccgccuuaaaa

SEQ ID NO: 381325 - RNA, 19 nt, Homo sapiens
cgacaucagcgcagagauc

SEQ ID NO: 381326 - RNA, 19 nt, Homo sapiens
cagcagcucggaagacuca

SEQ ID NO: 381327 - RNA, 19 nt, Homo sapiens
gggacccuauugacguuga

SEQ ID NO: 381328 - RNA, 19 nt, Homo sapiens
ggacagcucaagggacuca

SEQ ID NO: 381329 - RNA, 19 nt, Homo sapiens
aauaaagauguccgccuua

SEQ ID NO: 381330 - RNA, 19 nt, Homo sapiens
ugcaggaccucagcucuug

SEQ ID NO: 381331 - RNA, 19 nt, Homo sapiens
caagaucuaaaccgagaau

SEQ ID NO: 381332 - RNA, 19 nt, Homo sapiens
cauuugcuggcuugaauaa

SEQ ID NO: 381333 - RNA, 19 nt, Homo sapiens
gcagcagugaguccaguga

SEQ ID NO: 381334 - RNA, 19 nt, Homo sapiens
cgcccuggauaacgucuuu

SEQ ID NO: 381335 - RNA, 19 nt, Homo sapiens
ccccaccccuuucuaauuu

SEQ ID NO: 381336 - RNA, 19 nt, Homo sapiens
gccgacuucuggugcuuug

SEQ ID NO: 381337 - RNA, 19 nt, Homo sapiens
uugcuggcuugaauaaaga

SEQ ID NO: 381338 - RNA, 19 nt, Homo sapiens
uuugcuggcuugaauaaag

SEQ ID NO: 381339 - RNA, 19 nt, Homo sapiens
ucacgcacuccaagaucua

SEQ ID NO: 381340 - RNA, 19 nt, Homo sapiens
ucaagggacucagccaacu

SEQ ID NO: 381341 - RNA, 19 nt, Homo sapiens
ccgauggcuucgacgaguu

SEQ ID NO: 381342 - RNA, 19 nt, Homo sapiens
gcgcuggugcagaggauga

SEQ ID NO: 381343 - RNA, 19 nt, Homo sapiens
cggaggaggaguuccaguu

SEQ ID NO: 381344 - RNA, 19 nt, Homo sapiens
augcagcuguauccaagaa

SEQ ID NO: 381345 - RNA, 19 nt, Homo sapiens
aggaggaguuccaguuucu

SEQ ID NO: 381346 - RNA, 19 nt, Homo sapiens
gguaccagcgcgacuacga

SEQ ID NO: 381347 - RNA, 19 nt, Homo sapiens
aaacuaagcugggguccau

SEQ ID NO: 381348 - RNA, 19 nt, Homo sapiens
agauguggcugcucaauaa

SEQ ID NO: 381349 - RNA, 19 nt, Homo sapiens
gaccucagcucuugcauca

SEQ ID NO: 381350 - RNA, 19 nt, Homo sapiens
ggaaugaaucaacgaauga

SEQ ID NO: 381351 - RNA, 19 nt, Homo sapiens
ggagcaggauagugccuuu

SEQ ID NO: 381352 - RNA, 19 nt, Homo sapiens
ggaggaggaguuccaguuu

SEQ ID NO: 381353 - RNA, 19 nt, Homo sapiens
gaggaggaguuccaguuuc

SEQ ID NO: 381354 - RNA, 19 nt, Homo sapiens
cccaagaccuggcagaugu

SEQ ID NO: 381355 - RNA, 19 nt, Homo sapiens
gcuaaggcauggcugagau

SEQ ID NO: 381356 - RNA, 19 nt, Homo sapiens
ggaaagaugcagcuguauc

SEQ ID NO: 381357 - RNA, 19 nt, Homo sapiens
gcagcuguauccaagaaag

SEQ ID NO: 381358 - RNA, 19 nt, Homo sapiens
ggggaaagaugcagcugua

SEQ ID NO: 381359 - RNA, 19 nt, Homo sapiens
gagcucaagugcgacauca

SEQ ID NO: 381360 - RNA, 19 nt, Homo sapiens
aaccgagaaucgaaacuaa

SEQ ID NO: 381361 - RNA, 19 nt, Homo sapiens
cagauguggcugcucaaua

SEQ ID NO: 381362 - RNA, 19 nt, Homo sapiens
uagcacucauuaauucuug

SEQ ID NO: 381363 - RNA, 19 nt, Homo sapiens
gaaagaugcagcuguaucc

SEQ ID NO: 381364 - RNA, 19 nt, Homo sapiens
gaaugaaucaacgaaugaa

SEQ ID NO: 381365 - RNA, 19 nt, Homo sapiens
aggaaugaaucaacgaaug

SEQ ID NO: 381366 - RNA, 19 nt, Homo sapiens
gaucuaaaccgagaaucga

SEQ ID NO: 381367 - RNA, 19 nt, Homo sapiens
cgaagcugcugccuugucu

SEQ ID NO: 381368 - RNA, 19 nt, Homo sapiens
gagauucaagccaccauuc

SEQ ID NO: 381369 - RNA, 19 nt, Homo sapiens
ugcagaggaugaagugcua

SEQ ID NO: 381370 - RNA, 19 nt, Homo sapiens
aaaccgagaaucgaaacua

SEQ ID NO: 381371 - RNA, 19 nt, Homo sapiens
gagcacagggacuggcuau

SEQ ID NO: 381372 - RNA, 19 nt, Homo sapiens
aggcauggcugagauucaa

SEQ ID NO: 381373 - RNA, 19 nt, Homo sapiens
cgacaucagcgcagagauc

SEQ ID NO: 381374 - RNA, 19 nt, Homo sapiens
ggacagcucaagggacuca

SEQ ID NO: 381375 - RNA, 19 nt, Homo sapiens
uaaggaaugaaucaacgaa

SEQ ID NO: 381376 - RNA, 19 nt, Homo sapiens
gggacccuauugacguuga

SEQ ID NO: 381377 - RNA, 19 nt, Homo sapiens
ugcaggaccucagcucuug

SEQ ID NO: 381378 - RNA, 19 nt, Homo sapiens
caagaucuaaaccgagaau

SEQ ID NO: 381379 - RNA, 19 nt, Homo sapiens
gcacagggacuggcuaucc

SEQ ID NO: 381380 - RNA, 19 nt, Homo sapiens
cgcccuggauaacgucuuu

SEQ ID NO: 381381 - RNA, 19 nt, Homo sapiens
gauguggcugcucaauaaa

SEQ ID NO: 381382 - RNA, 19 nt, Homo sapiens
ugaaucaacgaaugaaugg

SEQ ID NO: 381383 - RNA, 19 nt, Homo sapiens
guagcacucauuaauucuu

SEQ ID NO: 381384 - RNA, 19 nt, Homo sapiens
gccgacuucuggugcuuug

SEQ ID NO: 381385 - RNA, 19 nt, Homo sapiens
caccauuccaggccucuuu

SEQ ID NO: 381386 - RNA, 19 nt, Homo sapiens
ucacgcacuccaagaucua

SEQ ID NO: 381387 - RNA, 19 nt, Homo sapiens
ucaagggacucagccaacu

SEQ ID NO: 381388 - RNA, 19 nt, Homo sapiens
ccgauggcuucgacgaguu

SEQ ID NO: 381389 - RNA, 19 nt, Homo sapiens
cggaggaggaguuccaguu

SEQ ID NO: 381390 - RNA, 19 nt, Homo sapiens
gcgcuggugcagaggauga

SEQ ID NO: 381391 - RNA, 19 nt, Homo sapiens
augcagcuguauccaagaa

SEQ ID NO: 381392 - RNA, 19 nt, Homo sapiens
aggaggaguuccaguuucu

SEQ ID NO: 381393 - RNA, 19 nt, Homo sapiens
acgaaugaauggcuaugca

SEQ ID NO: 381394 - RNA, 19 nt, Homo sapiens
gguaccagcgcgacuacga

SEQ ID NO: 381395 - RNA, 19 nt, Homo sapiens
caauagcacagccuuccau

SEQ ID NO: 381396 - RNA, 19 nt, Homo sapiens
aaacuaagcugggguccau

SEQ ID NO: 381397 - RNA, 19 nt, Homo sapiens
gaccucagcucuugcauca

SEQ ID NO: 381398 - RNA, 19 nt, Homo sapiens
ccaggaaggucaucaagau

SEQ ID NO: 381399 - RNA, 19 nt, Homo sapiens
ggagcaggauagugccuuu

SEQ ID NO: 381400 - RNA, 19 nt, Homo sapiens
ggaggaggaguuccaguuu

SEQ ID NO: 381401 - RNA, 19 nt, Homo sapiens
gaggaggaguuccaguuuc

SEQ ID NO: 381402 - RNA, 19 nt, Homo sapiens
auaaagauguccgccuuaa

SEQ ID NO: 381403 - RNA, 19 nt, Homo sapiens
ggaaagaugcagcuguauc

SEQ ID NO: 381404 - RNA, 19 nt, Homo sapiens
gcagcuguauccaagaaag

SEQ ID NO: 381405 - RNA, 19 nt, Homo sapiens
ggggaaagaugcagcugua

SEQ ID NO: 381406 - RNA, 19 nt, Homo sapiens
gagcucaagugcgacauca

SEQ ID NO: 381407 - RNA, 19 nt, Homo sapiens
aaccgagaaucgaaacuaa

SEQ ID NO: 381408 - RNA, 19 nt, Homo sapiens
cgacagcccagaagaggaa

SEQ ID NO: 381409 - RNA, 19 nt, Homo sapiens
gaugacagcagcagugagu

SEQ ID NO: 381410 - RNA, 19 nt, Homo sapiens
gaaagaugcagcuguaucc

SEQ ID NO: 381411 - RNA, 19 nt, Homo sapiens
gucauuugcuggcuugaau

SEQ ID NO: 381412 - RNA, 19 nt, Homo sapiens
ucugagcucuggccaacaa

SEQ ID NO: 381413 - RNA, 19 nt, Homo sapiens
gaucuaaaccgagaaucga

SEQ ID NO: 381414 - RNA, 19 nt, Homo sapiens
uaaagauguccgccuuaaa

SEQ ID NO: 381415 - RNA, 19 nt, Homo sapiens
gcuccuggcgugucauuug

SEQ ID NO: 381416 - RNA, 19 nt, Homo sapiens
cgaagcugcugccuugucu

SEQ ID NO: 381417 - RNA, 19 nt, Homo sapiens
ggaacgcguuguggugauc

SEQ ID NO: 381418 - RNA, 19 nt, Homo sapiens
ugcagaggaugaagugcua

SEQ ID NO: 381419 - RNA, 19 nt, Homo sapiens
aaaccgagaaucgaaacua

SEQ ID NO: 381420 - RNA, 19 nt, Homo sapiens
aaagauguccgccuuaaaa

SEQ ID NO: 381421 - RNA, 19 nt, Homo sapiens
cgacaucagcgcagagauc

SEQ ID NO: 381422 - RNA, 19 nt, Homo sapiens
cagcagcucggaagacuca

SEQ ID NO: 381423 - RNA, 19 nt, Homo sapiens
gggacccuauugacguuga

SEQ ID NO: 381424 - RNA, 19 nt, Homo sapiens
ggacagcucaagggacuca

SEQ ID NO: 381425 - RNA, 19 nt, Homo sapiens
aauaaagauguccgccuua

SEQ ID NO: 381426 - RNA, 19 nt, Homo sapiens
caacgacagcccagaagag

SEQ ID NO: 381427 - RNA, 19 nt, Homo sapiens
ugcaggaccucagcucuug

SEQ ID NO: 381428 - RNA, 19 nt, Homo sapiens
caagaucuaaaccgagaau

SEQ ID NO: 381429 - RNA, 19 nt, Homo sapiens
cauuugcuggcuugaauaa

SEQ ID NO: 381430 - RNA, 19 nt, Homo sapiens
gcagcagugaguccaguga

SEQ ID NO: 381431 - RNA, 19 nt, Homo sapiens
cgcccuggauaacgucuuu

SEQ ID NO: 381432 - RNA, 19 nt, Homo sapiens
ccccaccccuuucuaauuu

SEQ ID NO: 381433 - RNA, 19 nt, Homo sapiens
gccgacuucuggugcuuug

SEQ ID NO: 381434 - RNA, 19 nt, Homo sapiens
uugcuggcuugaauaaaga

SEQ ID NO: 381435 - RNA, 19 nt, Homo sapiens
uuugcuggcuugaauaaag

SEQ ID NO: 381436 - RNA, 19 nt, Homo sapiens
ucacgcacuccaagaucua

SEQ ID NO: 381437 - RNA, 19 nt, Homo sapiens
ucaagggacucagccaacu

SEQ ID NO: 381438 - RNA, 19 nt, Homo sapiens
ccgauggcuucgacgaguu

SEQ ID NO: 381439 - RNA, 19 nt, Homo sapiens
cggaggaggaguuccaguu

SEQ ID NO: 381440 - RNA, 19 nt, Homo sapiens
gcgcuggugcagaggauga

SEQ ID NO: 381441 - RNA, 19 nt, Homo sapiens
augcagcuguauccaagaa

SEQ ID NO: 381442 - RNA, 19 nt, Homo sapiens
aggaggaguuccaguuucu

SEQ ID NO: 381443 - RNA, 19 nt, Homo sapiens
auacaacgacagcccagaa

SEQ ID NO: 381444 - RNA, 19 nt, Homo sapiens
gguaccagcgcgacuacga

SEQ ID NO: 381445 - RNA, 19 nt, Homo sapiens
aaacuaagcugggguccau

SEQ ID NO: 381446 - RNA, 19 nt, Homo sapiens
agauguggcugcucaauaa

SEQ ID NO: 381447 - RNA, 19 nt, Homo sapiens
gaccucagcucuugcauca

SEQ ID NO: 381448 - RNA, 19 nt, Homo sapiens
ggaaugaaucaacgaauga

SEQ ID NO: 381449 - RNA, 19 nt, Homo sapiens
gugcuacccuucucuugua

SEQ ID NO: 381450 - RNA, 19 nt, Homo sapiens
ccaggaaggucaucaagau

SEQ ID NO: 381451 - RNA, 19 nt, Homo sapiens
ggagcaggauagugccuuu

SEQ ID NO: 381452 - RNA, 19 nt, Homo sapiens
ggaggaggaguuccaguuu

SEQ ID NO: 381453 - RNA, 19 nt, Homo sapiens
ggaggccucucaaguccaa

SEQ ID NO: 381454 - RNA, 19 nt, Homo sapiens
gaggaggaguuccaguuuc

SEQ ID NO: 381455 - RNA, 19 nt, Homo sapiens
cccaagaccuggcagaugu

SEQ ID NO: 381456 - RNA, 19 nt, Homo sapiens
gcuaaggcauggcugagau

SEQ ID NO: 381457 - RNA, 19 nt, Homo sapiens
ggaaagaugcagcuguauc

SEQ ID NO: 381458 - RNA, 19 nt, Homo sapiens
cccaguggcucaacaacuu

SEQ ID NO: 381459 - RNA, 19 nt, Homo sapiens
gcagcuguauccaagaaag

SEQ ID NO: 381460 - RNA, 19 nt, Homo sapiens
ggggaaagaugcagcugua

SEQ ID NO: 381461 - RNA, 19 nt, Homo sapiens
gagcucaagugcgacauca

SEQ ID NO: 381462 - RNA, 19 nt, Homo sapiens
aaccgagaaucgaaacuaa

SEQ ID NO: 381463 - RNA, 19 nt, Homo sapiens
cgacagcccagaagaggaa

SEQ ID NO: 381464 - RNA, 19 nt, Homo sapiens
cagauguggcugcucaaua

SEQ ID NO: 381465 - RNA, 19 nt, Homo sapiens
uagcacucauuaauucuug

SEQ ID NO: 381466 - RNA, 19 nt, Homo sapiens
gaaagaugcagcuguaucc

SEQ ID NO: 381467 - RNA, 19 nt, Homo sapiens
gaaugaaucaacgaaugaa

SEQ ID NO: 381468 - RNA, 19 nt, Homo sapiens
aggaaugaaucaacgaaug

SEQ ID NO: 381469 - RNA, 19 nt, Homo sapiens
gaucuaaaccgagaaucga

SEQ ID NO: 381470 - RNA, 19 nt, Homo sapiens
gggauccgcuaccuguugu

SEQ ID NO: 381471 - RNA, 19 nt, Homo sapiens
cgaagcugcugccuugucu

SEQ ID NO: 381472 - RNA, 19 nt, Homo sapiens
gagauucaagccaccauuc

SEQ ID NO: 381473 - RNA, 19 nt, Homo sapiens
ggaacgcguuguggugauc

SEQ ID NO: 381474 - RNA, 19 nt, Homo sapiens
ugcagaggaugaagugcua

SEQ ID NO: 381475 - RNA, 19 nt, Homo sapiens
aaaccgagaaucgaaacua

SEQ ID NO: 381476 - RNA, 19 nt, Homo sapiens
ccucaaccauccugccaau

SEQ ID NO: 381477 - RNA, 19 nt, Homo sapiens
gagcacagggacuggcuau

SEQ ID NO: 381478 - RNA, 19 nt, Homo sapiens
aggcauggcugagauucaa

SEQ ID NO: 381479 - RNA, 19 nt, Homo sapiens
cuccauggcuucccagcuu

SEQ ID NO: 381480 - RNA, 19 nt, Homo sapiens
cgacaucagcgcagagauc

SEQ ID NO: 381481 - RNA, 19 nt, Homo sapiens
ggacagcucaagggacuca

SEQ ID NO: 381482 - RNA, 19 nt, Homo sapiens
uaaggaaugaaucaacgaa

SEQ ID NO: 381483 - RNA, 19 nt, Homo sapiens
cagcagcucggaagacuca

SEQ ID NO: 381484 - RNA, 19 nt, Homo sapiens
gggacccuauugacguuga

SEQ ID NO: 381485 - RNA, 19 nt, Homo sapiens
cagcacuccugccaucaca

SEQ ID NO: 381486 - RNA, 19 nt, Homo sapiens
acagcgagccuccugauca

SEQ ID NO: 381487 - RNA, 19 nt, Homo sapiens
caacgacagcccagaagag

SEQ ID NO: 381488 - RNA, 19 nt, Homo sapiens
ugcaggaccucagcucuug

SEQ ID NO: 381489 - RNA, 19 nt, Homo sapiens
caagaucuaaaccgagaau

SEQ ID NO: 381490 - RNA, 19 nt, Homo sapiens
gcacagggacuggcuaucc

SEQ ID NO: 381491 - RNA, 19 nt, Homo sapiens
cgcccuggauaacgucuuu

SEQ ID NO: 381492 - RNA, 19 nt, Homo sapiens
gauguggcugcucaauaaa

SEQ ID NO: 381493 - RNA, 19 nt, Homo sapiens
ugaaucaacgaaugaaugg

SEQ ID NO: 381494 - RNA, 19 nt, Homo sapiens
guagcacucauuaauucuu

SEQ ID NO: 381495 - RNA, 19 nt, Homo sapiens
cauggaggccucucaaguc

SEQ ID NO: 381496 - RNA, 19 nt, Homo sapiens
ccgcuugcacccucaauug

SEQ ID NO: 381497 - RNA, 19 nt, Homo sapiens
gccgacuucuggugcuuug

SEQ ID NO: 381498 - RNA, 19 nt, Homo sapiens
caccauuccaggccucuuu

SEQ ID NO: 381499 - RNA, 19 nt, Homo sapiens
ucacgcacuccaagaucua

SEQ ID NO: 381500 - RNA, 19 nt, Homo sapiens
ucaagggacucagccaacu

SEQ ID NO: 381501 - RNA, 19 nt, Homo sapiens
ccaguggcucaacaacuuu

SEQ ID NO: 381502 - RNA, 19 nt, Homo sapiens
cggaggaggaguuccaguu

SEQ ID NO: 381503 - RNA, 19 nt, Homo sapiens
ccgauggcuucgacgaguu

SEQ ID NO: 381504 - RNA, 19 nt, Homo sapiens
gcgcuggugcagaggauga

SEQ ID NO: 381505 - RNA, 19 nt, Homo sapiens
aggaggaguuccaguuucu

SEQ ID NO: 381506 - RNA, 19 nt, Homo sapiens
acccuucucuuguaaccuu

SEQ ID NO: 381507 - RNA, 19 nt, Homo sapiens
ccauggaggccucucaagu

SEQ ID NO: 381508 - RNA, 19 nt, Homo sapiens
ccagacucuuggagcaguu

SEQ ID NO: 381509 - RNA, 19 nt, Homo sapiens
augcagcuguauccaagaa

SEQ ID NO: 381510 - RNA, 19 nt, Homo sapiens
acgaaugaauggcuaugca

SEQ ID NO: 381511 - RNA, 19 nt, Homo sapiens
auacaacgacagcccagaa

SEQ ID NO: 381512 - RNA, 19 nt, Homo sapiens
gguaccagcgcgacuacga

SEQ ID NO: 381513 - RNA, 19 nt, Homo sapiens
caauagcacagccuuccau

SEQ ID NO: 381514 - RNA, 19 nt, Homo sapiens
aaacuaagcugggguccau

SEQ ID NO: 381515 - RNA, 19 nt, Homo sapiens
cuucccagcuugacauguc

SEQ ID NO: 381516 - RNA, 19 nt, Homo sapiens
gaacuuugucacaguauua

SEQ ID NO: 381517 - RNA, 19 nt, Homo sapiens
gaacgacuuugagaucuuu

SEQ ID NO: 381518 - RNA, 19 nt, Homo sapiens
gaggaggcgugcucaagua

SEQ ID NO: 381519 - RNA, 19 nt, Homo sapiens
aaagagagguccugguguu

SEQ ID NO: 381520 - RNA, 19 nt, Homo sapiens
gggagaaguucguggaaga

SEQ ID NO: 381521 - RNA, 19 nt, Homo sapiens
gaucagcuuugacgucuuc

SEQ ID NO: 381522 - RNA, 19 nt, Homo sapiens
ggaauggcaugcugaacau

SEQ ID NO: 381523 - RNA, 19 nt, Homo sapiens
gcaaagggcugagguucuc

SEQ ID NO: 381524 - RNA, 19 nt, Homo sapiens
ggaacgacuuugagaucuu

SEQ ID NO: 381525 - RNA, 19 nt, Homo sapiens
gaacuggacaagaaagaga

SEQ ID NO: 381526 - RNA, 19 nt, Homo sapiens
agagaacuuugucacagua

SEQ ID NO: 381527 - RNA, 19 nt, Homo sapiens
gaggaggcaugaucagcuu

SEQ ID NO: 381528 - RNA, 19 nt, Homo sapiens
ucuccgaacuggacaagaa

SEQ ID NO: 381529 - RNA, 19 nt, Homo sapiens
gagagguccugguguugga

SEQ ID NO: 381530 - RNA, 19 nt, Homo sapiens
ugaagucauugagaaguuu

SEQ ID NO: 381531 - RNA, 19 nt, Homo sapiens
gaacgggacggugcaguau

SEQ ID NO: 381532 - RNA, 19 nt, Homo sapiens
gagaagauccgggagaagu

SEQ ID NO: 381533 - RNA, 19 nt, Homo sapiens
ccaagcagaccauccagaa

SEQ ID NO: 381534 - RNA, 19 nt, Homo sapiens
cugcagaagcuacgaagua

SEQ ID NO: 381535 - RNA, 19 nt, Homo sapiens
acgggacggugcaguauaa

SEQ ID NO: 381536 - RNA, 19 nt, Homo sapiens
ugagaaguuugauuaugug

SEQ ID NO: 381537 - RNA, 19 nt, Homo sapiens
ggacggugcaguauaagca

SEQ ID NO: 381538 - RNA, 19 nt, Homo sapiens
cgacaccauccacuucuuu

SEQ ID NO: 381539 - RNA, 19 nt, Homo sapiens
aagagaagauccgggagaa

SEQ ID NO: 381540 - RNA, 19 nt, Homo sapiens
ggaggaggcgugcucaagu

SEQ ID NO: 381541 - RNA, 19 nt, Homo sapiens
uagagaacuuugucacagu

SEQ ID NO: 381542 - RNA, 19 nt, Homo sapiens
ucaaguaucgguacgagau

SEQ ID NO: 381543 - RNA, 19 nt, Homo sapiens
gggaacgacuuugagaucu

SEQ ID NO: 381544 - RNA, 19 nt, Homo sapiens
gaaggugccuauuuuagag

SEQ ID NO: 381545 - RNA, 19 nt, Homo sapiens
gaagauccgggagaaguuc

SEQ ID NO: 381546 - RNA, 19 nt, Homo sapiens
ccaagaagcguggaaccuu

SEQ ID NO: 381547 - RNA, 19 nt, Homo sapiens
guauuucgguacagaagag

SEQ ID NO: 381548 - RNA, 19 nt, Homo sapiens
gagauuuucuucccagaga

SEQ ID NO: 381549 - RNA, 19 nt, Homo sapiens
uggaagaccugaaaacaga

SEQ ID NO: 381550 - RNA, 19 nt, Homo sapiens
ggaaggugccuauuuuaga

SEQ ID NO: 381551 - RNA, 19 nt, Homo sapiens
gaggcgugcucaaguaucg

SEQ ID NO: 381552 - RNA, 19 nt, Homo sapiens
gaggcaugaucagcuuuga

SEQ ID NO: 381553 - RNA, 19 nt, Homo sapiens
ggacaagaaagagaagauc

SEQ ID NO: 381554 - RNA, 19 nt, Homo sapiens
guggaaccuucaucgaguu

SEQ ID NO: 381555 - RNA, 19 nt, Homo sapiens
ggaggcaugaucagcuuug

SEQ ID NO: 381556 - RNA, 19 nt, Homo sapiens
gaagucauugagaaguuug

SEQ ID NO: 381557 - RNA, 19 nt, Homo sapiens
aagcgcuacugccuggaua

SEQ ID NO: 381558 - RNA, 19 nt, Homo sapiens
guucguggaagaccugaaa

SEQ ID NO: 381559 - RNA, 19 nt, Homo sapiens
agaacuuugucacaguauu

SEQ ID NO: 381560 - RNA, 19 nt, Homo sapiens
gcgcguccucugccuguuu

SEQ ID NO: 381561 - RNA, 19 nt, Homo sapiens
agaacgggacggugcagua

SEQ ID NO: 381562 - RNA, 19 nt, Homo sapiens
cagcgaugccgggagauuu

SEQ ID NO: 381563 - RNA, 19 nt, Homo sapiens
gcugcaagcccacccagau

SEQ ID NO: 381564 - RNA, 19 nt, Homo sapiens
gcagcgaugccgggagauu

SEQ ID NO: 381565 - RNA, 19 nt, Homo sapiens
ggugggaacgacuuugaga

SEQ ID NO: 381566 - RNA, 19 nt, Homo sapiens
cugcaggacuugaucaacu

SEQ ID NO: 381567 - RNA, 19 nt, Homo sapiens
cggaauggcaugcugaaca

SEQ ID NO: 381568 - RNA, 19 nt, Homo sapiens
uggggaaggugccuauuuu

SEQ ID NO: 381569 - RNA, 19 nt, Homo sapiens
cagccagucugcuccuagu

SEQ ID NO: 381570 - RNA, 19 nt, Homo sapiens
gagguccugguguuggaua

SEQ ID NO: 381571 - RNA, 19 nt, Homo sapiens
ucccagagacagcucauga

SEQ ID NO: 381572 - RNA, 19 nt, Homo sapiens
ugcaggacuugaucaacuu

SEQ ID NO: 381573 - RNA, 19 nt, Homo sapiens
ggcucugacuacuguaaga

SEQ ID NO: 381574 - RNA, 19 nt, Homo sapiens
gacaccauccacuucuuug

SEQ ID NO: 381575 - RNA, 19 nt, Homo sapiens
agaagauccgggagaaguu

SEQ ID NO: 381576 - RNA, 19 nt, Homo sapiens
ugucacaguauuaaaguuc

SEQ ID NO: 381577 - RNA, 19 nt, Homo sapiens
gagaacuuugucacaguau

SEQ ID NO: 381578 - RNA, 19 nt, Homo sapiens
ggaggagaggaucgaguuc

SEQ ID NO: 381579 - RNA, 19 nt, Homo sapiens
uggaggagaggaucgaguu

SEQ ID NO: 381580 - RNA, 19 nt, Homo sapiens
gaagagaacuuuccuagga

SEQ ID NO: 381581 - RNA, 19 nt, Homo sapiens
ggaaagaguuugcuggaaa

SEQ ID NO: 381582 - RNA, 19 nt, Homo sapiens
guaaugaccuuccaaagug

SEQ ID NO: 381583 - RNA, 19 nt, Homo sapiens
gaaaugggauguuaaacgu

SEQ ID NO: 381584 - RNA, 19 nt, Homo sapiens
gaaaugaugugguugaaaa

SEQ ID NO: 381585 - RNA, 19 nt, Homo sapiens
ccaaagaaauggaugacuu

SEQ ID NO: 381586 - RNA, 19 nt, Homo sapiens
aaauuaaacucccgaagaa

SEQ ID NO: 381587 - RNA, 19 nt, Homo sapiens
agaaauggaugacuuccua

SEQ ID NO: 381588 - RNA, 19 nt, Homo sapiens
gacagaauauucaaaguca

SEQ ID NO: 381589 - RNA, 19 nt, Homo sapiens
ggaaacgguucauguguca

SEQ ID NO: 381590 - RNA, 19 nt, Homo sapiens
gcaaugaccaugagaucuu

SEQ ID NO: 381591 - RNA, 19 nt, Homo sapiens
gaaaaugacgguuauaaga

SEQ ID NO: 381592 - RNA, 19 nt, Homo sapiens
gaagagggguacuuucauu

SEQ ID NO: 381593 - RNA, 19 nt, Homo sapiens
gagaguuggugcuggcaaa

SEQ ID NO: 381594 - RNA, 19 nt, Homo sapiens
uuaaucaacuacugucuga

SEQ ID NO: 381595 - RNA, 19 nt, Homo sapiens
gugccaacgugucuuguaa

SEQ ID NO: 381596 - RNA, 19 nt, Homo sapiens
gcagugugauacccaguga

SEQ ID NO: 381597 - RNA, 19 nt, Homo sapiens
gggaaacucuuguguagac

SEQ ID NO: 381598 - RNA, 19 nt, Homo sapiens
uagcagaucuacggaaaga

SEQ ID NO: 381599 - RNA, 19 nt, Homo sapiens
gaaagaguuugcuggaaaa

SEQ ID NO: 381600 - RNA, 19 nt, Homo sapiens
gugaagaguagcacauuaa

SEQ ID NO: 381601 - RNA, 19 nt, Homo sapiens
gagcagacccuagggaguu

SEQ ID NO: 381602 - RNA, 19 nt, Homo sapiens
gugggucuguggaaacaua

SEQ ID NO: 381603 - RNA, 19 nt, Homo sapiens
ucuaauacccacccugaua

SEQ ID NO: 381604 - RNA, 19 nt, Homo sapiens
gaugggaaacucuugugua

SEQ ID NO: 381605 - RNA, 19 nt, Homo sapiens
gaccauuuauuucuuugga

SEQ ID NO: 381606 - RNA, 19 nt, Homo sapiens
ggaaggaucccgggucuca

SEQ ID NO: 381607 - RNA, 19 nt, Homo sapiens
gaaaauggcuugguagcau

SEQ ID NO: 381608 - RNA, 19 nt, Homo sapiens
gaguagcacauuaaaguga

SEQ ID NO: 381609 - RNA, 19 nt, Homo sapiens
caucuuuccuugucgaaug

SEQ ID NO: 381610 - RNA, 19 nt, Homo sapiens
gcagaaaauuaccaaagaa

SEQ ID NO: 381611 - RNA, 19 nt, Homo sapiens
gaugucagacuucaccaaa

SEQ ID NO: 381612 - RNA, 19 nt, Homo sapiens
gggaaaugaugugguugaa

SEQ ID NO: 381613 - RNA, 19 nt, Homo sapiens
agugaagaguagcacauua

SEQ ID NO: 381614 - RNA, 19 nt, Homo sapiens
gaaggagaaacucuuguca

SEQ ID NO: 381615 - RNA, 19 nt, Homo sapiens
caaagaaauggaugacuuc

SEQ ID NO: 381616 - RNA, 19 nt, Homo sapiens
uaaugaccuuccaaaguga

SEQ ID NO: 381617 - RNA, 19 nt, Homo sapiens
guggaaacacugagccaua

SEQ ID NO: 381618 - RNA, 19 nt, Homo sapiens
uuacccagguccagagaaa

SEQ ID NO: 381619 - RNA, 19 nt, Homo sapiens
agaacacgguggaagagaa

SEQ ID NO: 381620 - RNA, 19 nt, Homo sapiens
gcuagaacacgguggaaga

SEQ ID NO: 381621 - RNA, 19 nt, Homo sapiens
gaggccagaucagcuuuga

SEQ ID NO: 381622 - RNA, 19 nt, Homo sapiens
gcagaucuacggaaagagu

SEQ ID NO: 381623 - RNA, 19 nt, Homo sapiens
ggaaaugaugugguugaaa

SEQ ID NO: 381624 - RNA, 19 nt, Homo sapiens
gagcaacugggaaaugaug

SEQ ID NO: 381625 - RNA, 19 nt, Homo sapiens
gugcuuucaucacagcuaa

SEQ ID NO: 381626 - RNA, 19 nt, Homo sapiens
uuacaaacaccuccuggaa

SEQ ID NO: 381627 - RNA, 19 nt, Homo sapiens
aagaagaacgcauugaguu

SEQ ID NO: 381628 - RNA, 19 nt, Homo sapiens
gugaggcccuaauccaaga

SEQ ID NO: 381629 - RNA, 19 nt, Homo sapiens
aagaguagcacauuaaagu

SEQ ID NO: 381630 - RNA, 19 nt, Homo sapiens
gaagaguagcacauuaaag

SEQ ID NO: 381631 - RNA, 19 nt, Homo sapiens
gccaggugcuuucaucaca

SEQ ID NO: 381632 - RNA, 19 nt, Homo sapiens
cauacacccuccauugcuu

SEQ ID NO: 381633 - RNA, 19 nt, Homo sapiens
caagaauggcccagaggaa

SEQ ID NO: 381634 - RNA, 19 nt, Homo sapiens
guagacagaauauucaaag

SEQ ID NO: 381635 - RNA, 19 nt, Homo sapiens
ccaggacgaaguuuacaaa

SEQ ID NO: 381636 - RNA, 19 nt, Homo sapiens
gacaggccaucugcaguga

SEQ ID NO: 381637 - RNA, 19 nt, Homo sapiens
guagcacauuaaagugauu

SEQ ID NO: 381638 - RNA, 19 nt, Homo sapiens
auggaugacuuccuacaaa

SEQ ID NO: 381639 - RNA, 19 nt, Homo sapiens
accaugagaucuucacaga

SEQ ID NO: 381640 - RNA, 19 nt, Homo sapiens
caagaagaacgcauugagu

SEQ ID NO: 381641 - RNA, 19 nt, Homo sapiens
ugaagaguagcacauuaaa

SEQ ID NO: 381642 - RNA, 19 nt, Homo sapiens
cuaggaugauacagaaaga

SEQ ID NO: 381643 - RNA, 19 nt, Homo sapiens
uuugaugucuuuccugaug

SEQ ID NO: 381644 - RNA, 19 nt, Homo sapiens
auacaaagaugggaaacuc

SEQ ID NO: 381645 - RNA, 19 nt, Homo sapiens
aggagcaacugggaaauga

SEQ ID NO: 381646 - RNA, 19 nt, Homo sapiens
ggcagaaaauuaccaaaga

SEQ ID NO: 381647 - RNA, 19 nt, Homo sapiens
aaacucuuguguagacaga

SEQ ID NO: 381648 - RNA, 19 nt, Homo sapiens
gaucaaaaucggaguggua

SEQ ID NO: 381649 - RNA, 19 nt, Homo sapiens
ggccuucacccagacuuua

SEQ ID NO: 381650 - RNA, 19 nt, Homo sapiens
caaugaccaugagaucuuc

SEQ ID NO: 381651 - RNA, 19 nt, Homo sapiens
guucacuacacucagaaua

SEQ ID NO: 381652 - RNA, 19 nt, Homo sapiens
uguaaugaccuuccaaagu

SEQ ID NO: 381653 - RNA, 19 nt, Homo sapiens
gaagcucccgccugcaugu

SEQ ID NO: 381654 - RNA, 19 nt, Homo sapiens
uacgugcaaucauguaguu

SEQ ID NO: 381655 - RNA, 19 nt, Homo sapiens
cggaaagaguuugcuggaa

SEQ ID NO: 381656 - RNA, 19 nt, Homo sapiens
guucgccucuaguuucuca

SEQ ID NO: 381657 - RNA, 19 nt, Homo sapiens
gaggccugcuggacagaug

SEQ ID NO: 381658 - RNA, 19 nt, Homo sapiens
gcggaucggacuuugagaa

SEQ ID NO: 381659 - RNA, 19 nt, Homo sapiens
gaagcugcagccaagaaga

SEQ ID NO: 381660 - RNA, 19 nt, Homo sapiens
gucgaaugauacuguaaug

SEQ ID NO: 381661 - RNA, 19 nt, Homo sapiens
cgagagcccagccagagaa

SEQ ID NO: 381662 - RNA, 19 nt, Homo sapiens
cagcccaggacgaaguuua

SEQ ID NO: 381663 - RNA, 19 nt, Homo sapiens
acgguuauaagaccauuua

SEQ ID NO: 381664 - RNA, 19 nt, Homo sapiens
ccugauggaugggacaaga

SEQ ID NO: 381665 - RNA, 19 nt, Homo sapiens
guaggcggaucggacuuug

SEQ ID NO: 381666 - RNA, 19 nt, Homo sapiens
gaacacgguggaagagaac

SEQ ID NO: 381667 - RNA, 19 nt, Homo sapiens
acugggaaaugaugugguu

SEQ ID NO: 381668 - RNA, 19 nt, Homo sapiens
ccaagaagaacgcauugag

SEQ ID NO: 381669 - RNA, 19 nt, Homo sapiens
auuccgaaaugggauguua

SEQ ID NO: 381670 - RNA, 19 nt, Homo sapiens
aaaauggcuugguagcaua

SEQ ID NO: 381671 - RNA, 19 nt, Homo sapiens
cgaaugauacuguaaugac

SEQ ID NO: 381672 - RNA, 19 nt, Homo sapiens
ggaaacucuuguguagaca

SEQ ID NO: 381673 - RNA, 19 nt, Homo sapiens
cgaaaugggauguuaaacg

SEQ ID NO: 381674 - RNA, 19 nt, Homo sapiens
aaauugaggcagaagauca

SEQ ID NO: 381675 - RNA, 19 nt, Homo sapiens
gaaagugcaggagcaacug

SEQ ID NO: 381676 - RNA, 19 nt, Homo sapiens
aaacaccuccuggaacgaa

SEQ ID NO: 381677 - RNA, 19 nt, Homo sapiens
gccaacgugucuuguaagg

SEQ ID NO: 381678 - RNA, 19 nt, Homo sapiens
cagaauauucaaagucauc

SEQ ID NO: 381679 - RNA, 19 nt, Homo sapiens
gcuagaaacuggggacaug

SEQ ID NO: 381680 - RNA, 19 nt, Homo sapiens
gaauaaagcugcuacaaau

SEQ ID NO: 381681 - RNA, 19 nt, Homo sapiens
gcaaaggccuaaacugaga

SEQ ID NO: 381682 - RNA, 19 nt, Homo sapiens
gcaaagagacaaccauaaa

SEQ ID NO: 381683 - RNA, 19 nt, Homo sapiens
gcgagaacuuugacgauua

SEQ ID NO: 381684 - RNA, 19 nt, Homo sapiens
gcauauaugugugugauaa

SEQ ID NO: 381685 - RNA, 19 nt, Homo sapiens
ggaaggagcaucagaaaug

SEQ ID NO: 381686 - RNA, 19 nt, Homo sapiens
gaaaucaauugcuuccauu

SEQ ID NO: 381687 - RNA, 19 nt, Homo sapiens
guaaagaauuguagucuca

SEQ ID NO: 381688 - RNA, 19 nt, Homo sapiens
ccauguauauguacguuua

SEQ ID NO: 381689 - RNA, 19 nt, Homo sapiens
gaaagaaccauguggaaau

SEQ ID NO: 381690 - RNA, 19 nt, Homo sapiens
gaaggagcaucagaaauga

SEQ ID NO: 381691 - RNA, 19 nt, Homo sapiens
aaacauaggagucccuuua

SEQ ID NO: 381692 - RNA, 19 nt, Homo sapiens
gcaugcagcuguaguuugu

SEQ ID NO: 381693 - RNA, 19 nt, Homo sapiens
ggccuaaacugagaauuaa

SEQ ID NO: 381694 - RNA, 19 nt, Homo sapiens
gcauugugcccaaguaaua

SEQ ID NO: 381695 - RNA, 19 nt, Homo sapiens
agaaugggcuauuauaaug

SEQ ID NO: 381696 - RNA, 19 nt, Homo sapiens
ggagaaugggcuauuauaa

SEQ ID NO: 381697 - RNA, 19 nt, Homo sapiens
gaauuguagucucaguuaa

SEQ ID NO: 381698 - RNA, 19 nt, Homo sapiens
gcaccagaaucuaugagaa

SEQ ID NO: 381699 - RNA, 19 nt, Homo sapiens
gaggaucacugaaucaagu

SEQ ID NO: 381700 - RNA, 19 nt, Homo sapiens
aagaugagcuugaaauauc

SEQ ID NO: 381701 - RNA, 19 nt, Homo sapiens
gcaaguagugguuugguuu

SEQ ID NO: 381702 - RNA, 19 nt, Homo sapiens
gagaaugggcuauuauaau

SEQ ID NO: 381703 - RNA, 19 nt, Homo sapiens
gaacuuugacgauuacaug

SEQ ID NO: 381704 - RNA, 19 nt, Homo sapiens
agagaaagcuagugaaugg

SEQ ID NO: 381705 - RNA, 19 nt, Homo sapiens
cauaggagucccuuuauuu

SEQ ID NO: 381706 - RNA, 19 nt, Homo sapiens
gaaauggaauagaauuggu

SEQ ID NO: 381707 - RNA, 19 nt, Homo sapiens
gugcaugcaugucauuauu

SEQ ID NO: 381708 - RNA, 19 nt, Homo sapiens
gaagggaauuguacaucau

SEQ ID NO: 381709 - RNA, 19 nt, Homo sapiens
gagccaaucugagagcaaa

SEQ ID NO: 381710 - RNA, 19 nt, Homo sapiens
gaucuucgugucuaauaua

SEQ ID NO: 381711 - RNA, 19 nt, Homo sapiens
gccagaaaguaauguuaaa

SEQ ID NO: 381712 - RNA, 19 nt, Homo sapiens
gcagagaggaucacugaau

SEQ ID NO: 381713 - RNA, 19 nt, Homo sapiens
agacaaccauaaagagaaa

SEQ ID NO: 381714 - RNA, 19 nt, Homo sapiens
gagaugggauggcaaagag

SEQ ID NO: 381715 - RNA, 19 nt, Homo sapiens
gcagaaaugaauauaccua

SEQ ID NO: 381716 - RNA, 19 nt, Homo sapiens
ugaauaaagcugcuacaaa

SEQ ID NO: 381717 - RNA, 19 nt, Homo sapiens
uaucacaguuuauccauuc

SEQ ID NO: 381718 - RNA, 19 nt, Homo sapiens
cuaggagaaugggcuauua

SEQ ID NO: 381719 - RNA, 19 nt, Homo sapiens
gaaaugaggcaagcuagga

SEQ ID NO: 381720 - RNA, 19 nt, Homo sapiens
aaacauagagccagcuuga

SEQ ID NO: 381721 - RNA, 19 nt, Homo sapiens
gcaagaaaggagauauuau

SEQ ID NO: 381722 - RNA, 19 nt, Homo sapiens
ugaagggaauuguacauca

SEQ ID NO: 381723 - RNA, 19 nt, Homo sapiens
aaccacagcugacaauaga

SEQ ID NO: 381724 - RNA, 19 nt, Homo sapiens
gaaaugaauauaccuagca

SEQ ID NO: 381725 - RNA, 19 nt, Homo sapiens
guagugguuugguuucuau

SEQ ID NO: 381726 - RNA, 19 nt, Homo sapiens
gcagagaugggauggcaaa

SEQ ID NO: 381727 - RNA, 19 nt, Homo sapiens
ugaaucaagugcagagaug

SEQ ID NO: 381728 - RNA, 19 nt, Homo sapiens
gagacaaccauaaagagaa

SEQ ID NO: 381729 - RNA, 19 nt, Homo sapiens
caagcuaggccaggaauuu

SEQ ID NO: 381730 - RNA, 19 nt, Homo sapiens
gaagaaaccacagcugaca

SEQ ID NO: 381731 - RNA, 19 nt, Homo sapiens
aaagaaccauguggaaaug

SEQ ID NO: 381732 - RNA, 19 nt, Homo sapiens
agaauuguagucucaguua

SEQ ID NO: 381733 - RNA, 19 nt, Homo sapiens
guugaacuuuguauacuug

SEQ ID NO: 381734 - RNA, 19 nt, Homo sapiens
aaagagacaaccauaaaga

SEQ ID NO: 381735 - RNA, 19 nt, Homo sapiens
caagguaggaacaagauga

SEQ ID NO: 381736 - RNA, 19 nt, Homo sapiens
caaaauggcuuagacacaa

SEQ ID NO: 381737 - RNA, 19 nt, Homo sapiens
gaaaugagggaaggcaaga

SEQ ID NO: 381738 - RNA, 19 nt, Homo sapiens
gagucaggauguucacuau

SEQ ID NO: 381739 - RNA, 19 nt, Homo sapiens
ggagucaggauguucacua

SEQ ID NO: 381740 - RNA, 19 nt, Homo sapiens
ccuggaaacuugucucuag

SEQ ID NO: 381741 - RNA, 19 nt, Homo sapiens
gcaugcaugucauuauuac

SEQ ID NO: 381742 - RNA, 19 nt, Homo sapiens
cagagaggaucacugaauc

SEQ ID NO: 381743 - RNA, 19 nt, Homo sapiens
gaaaccacagcugacaaua

SEQ ID NO: 381744 - RNA, 19 nt, Homo sapiens
uaacucacaucccacucaa

SEQ ID NO: 381745 - RNA, 19 nt, Homo sapiens
acagguaaaugugaguuaa

SEQ ID NO: 381746 - RNA, 19 nt, Homo sapiens
cacaaacaguugaugaugu

SEQ ID NO: 381747 - RNA, 19 nt, Homo sapiens
gacaauagaaagaccaaga

SEQ ID NO: 381748 - RNA, 19 nt, Homo sapiens
ggccaggaauuugaagaaa

SEQ ID NO: 381749 - RNA, 19 nt, Homo sapiens
gaggcaagcuaggagaaug

SEQ ID NO: 381750 - RNA, 19 nt, Homo sapiens
ccacagcugacaauagaaa

SEQ ID NO: 381751 - RNA, 19 nt, Homo sapiens
ccaaagcaagggcaaggua

SEQ ID NO: 381752 - RNA, 19 nt, Homo sapiens
acauaggagucccuuuauu

SEQ ID NO: 381753 - RNA, 19 nt, Homo sapiens
cugaauacacugcaaauau

SEQ ID NO: 381754 - RNA, 19 nt, Homo sapiens
cuucgugucuaauauaguu

SEQ ID NO: 381755 - RNA, 19 nt, Homo sapiens
acaaacaguugaugauguc

SEQ ID NO: 381756 - RNA, 19 nt, Homo sapiens
uauauuggccagacacaaa

SEQ ID NO: 381757 - RNA, 19 nt, Homo sapiens
ggaaauggaauagaauugg

SEQ ID NO: 381758 - RNA, 19 nt, Homo sapiens
aggccuaaacugagaauua

SEQ ID NO: 381759 - RNA, 19 nt, Homo sapiens
gagcuugaaauaucuuguu

SEQ ID NO: 381760 - RNA, 19 nt, Homo sapiens
aaacaccucagcagaaaug

SEQ ID NO: 381761 - RNA, 19 nt, Homo sapiens
gacaauugagcuauuucua

SEQ ID NO: 381762 - RNA, 19 nt, Homo sapiens
gaauuguacaucaugcauu

SEQ ID NO: 381763 - RNA, 19 nt, Homo sapiens
gacagguaaaugugaguua

SEQ ID NO: 381764 - RNA, 19 nt, Homo sapiens
acucagaucuucgugucua

SEQ ID NO: 381765 - RNA, 19 nt, Homo sapiens
gaucaggguagcaaacuca

SEQ ID NO: 381766 - RNA, 19 nt, Homo sapiens
ggcaaagagacaaccauaa

SEQ ID NO: 381767 - RNA, 19 nt, Homo sapiens
gucaggauguucacuaugg

SEQ ID NO: 381768 - RNA, 19 nt, Homo sapiens
ugauugagcaaaugagaaa

SEQ ID NO: 381769 - RNA, 19 nt, Homo sapiens
caguuuauccauucuacua

SEQ ID NO: 381770 - RNA, 19 nt, Homo sapiens
ugguuugguuucuaucaua

SEQ ID NO: 381771 - RNA, 19 nt, Homo sapiens
aaagagaaagcuagugaau

SEQ ID NO: 381772 - RNA, 19 nt, Homo sapiens
caaagagacaaccauaaag

SEQ ID NO: 381773 - RNA, 19 nt, Homo sapiens
cgagaacuuugacgauuac

SEQ ID NO: 381774 - RNA, 19 nt, Homo sapiens
gguuugguuucuaucauau

SEQ ID NO: 381775 - RNA, 19 nt, Homo sapiens
ucagaaaugaggcaagcua

SEQ ID NO: 381776 - RNA, 19 nt, Homo sapiens
ugacaaaacugaauacacu

SEQ ID NO: 381777 - RNA, 19 nt, Homo sapiens
auaaagagaaagcuaguga

SEQ ID NO: 381778 - RNA, 19 nt, Homo sapiens
cagaucuucgugucuaaua

SEQ ID NO: 381779 - RNA, 19 nt, Homo sapiens
cagcagaaaugaauauacc

SEQ ID NO: 381780 - RNA, 19 nt, Homo sapiens
caacaagucuuugaaaugg

SEQ ID NO: 381781 - RNA, 19 nt, Homo sapiens
gcaaagaaaucugcuugga

SEQ ID NO: 381782 - RNA, 19 nt, Homo sapiens
cuaaacaacucacuggaaa

SEQ ID NO: 381783 - RNA, 19 nt, Homo sapiens
aaacacggcuuguggcauu

SEQ ID NO: 381784 - RNA, 19 nt, Homo sapiens
uaacaucccuugcauuugg

SEQ ID NO: 381785 - RNA, 19 nt, Homo sapiens
ucacacaucuaaaugagaa

SEQ ID NO: 381786 - RNA, 19 nt, Homo sapiens
gaaauguccaccacuguuu

SEQ ID NO: 381787 - RNA, 19 nt, Homo sapiens
gacaacaagucuuugaaau

SEQ ID NO: 381788 - RNA, 19 nt, Homo sapiens
uuacaucacuggaaucuuc

SEQ ID NO: 381789 - RNA, 19 nt, Homo sapiens
cuucaucacucccacauuu

SEQ ID NO: 381790 - RNA, 19 nt, Homo sapiens
ggauuuaccauuccuuauu

SEQ ID NO: 381791 - RNA, 19 nt, Homo sapiens
gcaauggacacgcaacuga

SEQ ID NO: 381792 - RNA, 19 nt, Homo sapiens
acagaaagcagacaaagaa

SEQ ID NO: 381793 - RNA, 19 nt, Homo sapiens
uuaaagaaguagcuaagga

SEQ ID NO: 381794 - RNA, 19 nt, Homo sapiens
gaaaucugcuuggaagaag

SEQ ID NO: 381795 - RNA, 19 nt, Homo sapiens
gccaccaacuguagaugua

SEQ ID NO: 381796 - RNA, 19 nt, Homo sapiens
ggaaauguccaccacuguu

SEQ ID NO: 381797 - RNA, 19 nt, Homo sapiens
ccagaaugcuccuccuguu

SEQ ID NO: 381798 - RNA, 19 nt, Homo sapiens
ccaacuguguggacuaaga

SEQ ID NO: 381799 - RNA, 19 nt, Homo sapiens
caaagaaaucugcuuggaa

SEQ ID NO: 381800 - RNA, 19 nt, Homo sapiens
ggucggagcaucagaacaa

SEQ ID NO: 381801 - RNA, 19 nt, Homo sapiens
gcuguugauugaagaugua

SEQ ID NO: 381802 - RNA, 19 nt, Homo sapiens
ucucagcggugucaucuau

SEQ ID NO: 381803 - RNA, 19 nt, Homo sapiens
caccaacuguagauguaua

SEQ ID NO: 381804 - RNA, 19 nt, Homo sapiens
uaaagaaguagcuaaggaa

SEQ ID NO: 381805 - RNA, 19 nt, Homo sapiens
gaauggagaccugaauaau

SEQ ID NO: 381806 - RNA, 19 nt, Homo sapiens
gaaacuccgcugagcagaa

SEQ ID NO: 381807 - RNA, 19 nt, Homo sapiens
agaaaucagugacaacaag

SEQ ID NO: 381808 - RNA, 19 nt, Homo sapiens
acgaauggcugcagucugu

SEQ ID NO: 381809 - RNA, 19 nt, Homo sapiens
gaacuugccgccagaaugc

SEQ ID NO: 381810 - RNA, 19 nt, Homo sapiens
cuuaacaucccuugcauuu

SEQ ID NO: 381811 - RNA, 19 nt, Homo sapiens
ugacaacaagucuuugaaa

SEQ ID NO: 381812 - RNA, 19 nt, Homo sapiens
guugagccuuaaagaagua

SEQ ID NO: 381813 - RNA, 19 nt, Homo sapiens
ucgaucaucuucagcauuc

SEQ ID NO: 381814 - RNA, 19 nt, Homo sapiens
ccaccacuguuucucauca

SEQ ID NO: 381815 - RNA, 19 nt, Homo sapiens
caacauaagauagaaugga

SEQ ID NO: 381816 - RNA, 19 nt, Homo sapiens
uagaauggagaccugaaua

SEQ ID NO: 381817 - RNA, 19 nt, Homo sapiens
ucagugacaacaagucuuu

SEQ ID NO: 381818 - RNA, 19 nt, Homo sapiens
agaauggagaccugaauaa

SEQ ID NO: 381819 - RNA, 19 nt, Homo sapiens
cuaaucaucuaaacaacuc

SEQ ID NO: 381820 - RNA, 19 nt, Homo sapiens
gaccaucagccucguguug

SEQ ID NO: 381821 - RNA, 19 nt, Homo sapiens
uaccaacuguguggacuaa

SEQ ID NO: 381822 - RNA, 19 nt, Homo sapiens
gggagggucuugccuuaac

SEQ ID NO: 381823 - RNA, 19 nt, Homo sapiens
caaggacugucuggcaaug

SEQ ID NO: 381824 - RNA, 19 nt, Homo sapiens
acaacaagucuuugaaaug

SEQ ID NO: 381825 - RNA, 19 nt, Homo sapiens
caguccaccucauuuagaa

SEQ ID NO: 381826 - RNA, 19 nt, Homo sapiens
gaacuuuacauccuaacag

SEQ ID NO: 381827 - RNA, 19 nt, Homo sapiens
caucaucaccaaacgaaug

SEQ ID NO: 381828 - RNA, 19 nt, Homo sapiens
aauggagaccugaauaauu

SEQ ID NO: 381829 - RNA, 19 nt, Homo sapiens
gaaaucagugacaacaagu

SEQ ID NO: 381830 - RNA, 19 nt, Homo sapiens
gggaagggaggaagggaaa

SEQ ID NO: 381831 - RNA, 19 nt, Homo sapiens
uaugugaucuugcggaaac

SEQ ID NO: 381832 - RNA, 19 nt, Homo sapiens
ugucaucuaugugaucuug

SEQ ID NO: 381833 - RNA, 19 nt, Homo sapiens
ggauuacuccuacgguuuc

SEQ ID NO: 381834 - RNA, 19 nt, Homo sapiens
ucauaaagccuucaucacu

SEQ ID NO: 381835 - RNA, 19 nt, Homo sapiens
ggagggucuugccuuaaca

SEQ ID NO: 381836 - RNA, 19 nt, Homo sapiens
gcuaagacuccagaccuuu

SEQ ID NO: 381837 - RNA, 19 nt, Homo sapiens
ugaaauggugcuauggauu

SEQ ID NO: 381838 - RNA, 19 nt, Homo sapiens
gagaaaucagugacaacaa

SEQ ID NO: 381839 - RNA, 19 nt, Homo sapiens
caucagaacaagcgucuag

SEQ ID NO: 381840 - RNA, 19 nt, Homo sapiens
ggaguaucuucgucacaca

SEQ ID NO: 381841 - RNA, 19 nt, Homo sapiens
aaaccaaaguguggguaga

SEQ ID NO: 381842 - RNA, 19 nt, Homo sapiens
aguauaauccagcucagua

SEQ ID NO: 381843 - RNA, 19 nt, Homo sapiens
ucagcggugucaucuaugu

SEQ ID NO: 381844 - RNA, 19 nt, Homo sapiens
aaacaacucacuggaaauc

SEQ ID NO: 381845 - RNA, 19 nt, Homo sapiens
gcuggucugugcgugauga

SEQ ID NO: 381846 - RNA, 19 nt, Homo sapiens
aaucauaaagccuucauca

SEQ ID NO: 381847 - RNA, 19 nt, Homo sapiens
aaugagaaaucagugacaa

SEQ ID NO: 381848 - RNA, 19 nt, Homo sapiens
cuaaaugagaaaucaguga

SEQ ID NO: 381849 - RNA, 19 nt, Homo sapiens
cgucacacaucuaaaugag

SEQ ID NO: 381850 - RNA, 19 nt, Homo sapiens
gauagaauggagaccugaa

SEQ ID NO: 381851 - RNA, 19 nt, Homo sapiens
agaaaucugcuuggaagaa

SEQ ID NO: 381852 - RNA, 19 nt, Homo sapiens
ccuuacagguggaguaucu

SEQ ID NO: 381853 - RNA, 19 nt, Homo sapiens
auaauccagcucaguauuu

SEQ ID NO: 381854 - RNA, 19 nt, Homo sapiens
ccaguccaccucauuuaga

SEQ ID NO: 381855 - RNA, 19 nt, Homo sapiens
guauaauccagcucaguau

SEQ ID NO: 381856 - RNA, 19 nt, Homo sapiens
cagaaugcuccuccuguug

SEQ ID NO: 381857 - RNA, 19 nt, Homo sapiens
cagaaagcagacaaagaaa

SEQ ID NO: 381858 - RNA, 19 nt, Homo sapiens
ccaccaugauccugucgau

SEQ ID NO: 381859 - RNA, 19 nt, Homo sapiens
uauaauccagcucaguauu

SEQ ID NO: 381860 - RNA, 19 nt, Homo sapiens
guguugagccuuaaagaag

SEQ ID NO: 381861 - RNA, 19 nt, Homo sapiens
gaaaacagaaagcagacaa

SEQ ID NO: 381862 - RNA, 19 nt, Homo sapiens
acaagcgucuagacuccuu

SEQ ID NO: 381863 - RNA, 19 nt, Homo sapiens
aaacuccgcugagcagaac

SEQ ID NO: 381864 - RNA, 19 nt, Homo sapiens
ucuaaacaacucacuggaa

SEQ ID NO: 381865 - RNA, 19 nt, Homo sapiens
ccagugcauccaacagaaa

SEQ ID NO: 381866 - RNA, 19 nt, Homo sapiens
cggauuacuccuacgguuu

SEQ ID NO: 381867 - RNA, 19 nt, Homo sapiens
ucaacucggauuacuccua

SEQ ID NO: 381868 - RNA, 19 nt, Homo sapiens
ugagaaaucagugacaaca

SEQ ID NO: 381869 - RNA, 19 nt, Homo sapiens
cccagugcauccaacagaa

SEQ ID NO: 381870 - RNA, 19 nt, Homo sapiens
uaauccagcucaguauuuu

SEQ ID NO: 381871 - RNA, 19 nt, Homo sapiens
caucucaacucggauuacu

SEQ ID NO: 381872 - RNA, 19 nt, Homo sapiens
ucagcauucugucucuguu

SEQ ID NO: 381873 - RNA, 19 nt, Homo sapiens
uauauauggugcccuucug

SEQ ID NO: 381874 - RNA, 19 nt, Homo sapiens
ggguugcuguugauugaag

SEQ ID NO: 381875 - RNA, 19 nt, Homo sapiens
caacuguguggacuaagau

SEQ ID NO: 381876 - RNA, 19 nt, Homo sapiens
uaaacaacucacuggaaau

SEQ ID NO: 381877 - RNA, 19 nt, Homo sapiens
ccacgaucgucagccaaug

SEQ ID NO: 381878 - RNA, 19 nt, Homo sapiens
ggaacuuuacauccuaaca

SEQ ID NO: 381879 - RNA, 19 nt, Homo sapiens
aaacagaaagcagacaaag

SEQ ID NO: 381880 - RNA, 19 nt, Homo sapiens
caacaagucuuugaaaugg

SEQ ID NO: 381881 - RNA, 19 nt, Homo sapiens
cuaaacaacucacuggaaa

SEQ ID NO: 381882 - RNA, 19 nt, Homo sapiens
aaacacggcuuguggcauu

SEQ ID NO: 381883 - RNA, 19 nt, Homo sapiens
ucacacaucuaaaugagaa

SEQ ID NO: 381884 - RNA, 19 nt, Homo sapiens
gaaauguccaccacuguuu

SEQ ID NO: 381885 - RNA, 19 nt, Homo sapiens
gacaacaagucuuugaaau

SEQ ID NO: 381886 - RNA, 19 nt, Homo sapiens
uuacaucacuggaaucuuc

SEQ ID NO: 381887 - RNA, 19 nt, Homo sapiens
cuucaucacucccacauuu

SEQ ID NO: 381888 - RNA, 19 nt, Homo sapiens
ggauuuaccauuccuuauu

SEQ ID NO: 381889 - RNA, 19 nt, Homo sapiens
gcaauggacacgcaacuga

SEQ ID NO: 381890 - RNA, 19 nt, Homo sapiens
acagaaagcagacaaagaa

SEQ ID NO: 381891 - RNA, 19 nt, Homo sapiens
uuaaagaaguagcuaagga

SEQ ID NO: 381892 - RNA, 19 nt, Homo sapiens
gccaccaacuguagaugua

SEQ ID NO: 381893 - RNA, 19 nt, Homo sapiens
ggaaauguccaccacuguu

SEQ ID NO: 381894 - RNA, 19 nt, Homo sapiens
ccagaaugcuccuccuguu

SEQ ID NO: 381895 - RNA, 19 nt, Homo sapiens
ccaacuguguggacuaaga

SEQ ID NO: 381896 - RNA, 19 nt, Homo sapiens
ggucggagcaucagaacaa

SEQ ID NO: 381897 - RNA, 19 nt, Homo sapiens
gcuguugauugaagaugua

SEQ ID NO: 381898 - RNA, 19 nt, Homo sapiens
cgggacagcuguuccuuug

SEQ ID NO: 381899 - RNA, 19 nt, Homo sapiens
ucucagcggugucaucuau

SEQ ID NO: 381900 - RNA, 19 nt, Homo sapiens
caccaacuguagauguaua

SEQ ID NO: 381901 - RNA, 19 nt, Homo sapiens
uaaagaaguagcuaaggaa

SEQ ID NO: 381902 - RNA, 19 nt, Homo sapiens
gaauggagaccugaauaau

SEQ ID NO: 381903 - RNA, 19 nt, Homo sapiens
gaaacuccgcugagcagaa

SEQ ID NO: 381904 - RNA, 19 nt, Homo sapiens
agaaaucagugacaacaag

SEQ ID NO: 381905 - RNA, 19 nt, Homo sapiens
acgaauggcugcagucugu

SEQ ID NO: 381906 - RNA, 19 nt, Homo sapiens
gaacuugccgccagaaugc

SEQ ID NO: 381907 - RNA, 19 nt, Homo sapiens
ugacaacaagucuuugaaa

SEQ ID NO: 381908 - RNA, 19 nt, Homo sapiens
guugagccuuaaagaagua

SEQ ID NO: 381909 - RNA, 19 nt, Homo sapiens
ucgaucaucuucagcauuc

SEQ ID NO: 381910 - RNA, 19 nt, Homo sapiens
ccaccacuguuucucauca

SEQ ID NO: 381911 - RNA, 19 nt, Homo sapiens
caacauaagauagaaugga

SEQ ID NO: 381912 - RNA, 19 nt, Homo sapiens
cacccgaguuuguguuuga

SEQ ID NO: 381913 - RNA, 19 nt, Homo sapiens
uagaauggagaccugaaua

SEQ ID NO: 381914 - RNA, 19 nt, Homo sapiens
ucagugacaacaagucuuu

SEQ ID NO: 381915 - RNA, 19 nt, Homo sapiens
agaauggagaccugaauaa

SEQ ID NO: 381916 - RNA, 19 nt, Homo sapiens
cuaaucaucuaaacaacuc

SEQ ID NO: 381917 - RNA, 19 nt, Homo sapiens
gaccaucagccucguguug

SEQ ID NO: 381918 - RNA, 19 nt, Homo sapiens
uaccaacuguguggacuaa

SEQ ID NO: 381919 - RNA, 19 nt, Homo sapiens
caaggacugucuggcaaug

SEQ ID NO: 381920 - RNA, 19 nt, Homo sapiens
acaacaagucuuugaaaug

SEQ ID NO: 381921 - RNA, 19 nt, Homo sapiens
caguccaccucauuuagaa

SEQ ID NO: 381922 - RNA, 19 nt, Homo sapiens
gaacuuuacauccuaacag

SEQ ID NO: 381923 - RNA, 19 nt, Homo sapiens
caucaucaccaaacgaaug

SEQ ID NO: 381924 - RNA, 19 nt, Homo sapiens
aauggagaccugaauaauu

SEQ ID NO: 381925 - RNA, 19 nt, Homo sapiens
gaaaucagugacaacaagu

SEQ ID NO: 381926 - RNA, 19 nt, Homo sapiens
gggaagggaggaagggaaa

SEQ ID NO: 381927 - RNA, 19 nt, Homo sapiens
uaugugaucuugcggaaac

SEQ ID NO: 381928 - RNA, 19 nt, Homo sapiens
ugucaucuaugugaucuug

SEQ ID NO: 381929 - RNA, 19 nt, Homo sapiens
ggauuacuccuacgguuuc

SEQ ID NO: 381930 - RNA, 19 nt, Homo sapiens
ucauaaagccuucaucacu

SEQ ID NO: 381931 - RNA, 19 nt, Homo sapiens
gcuaagacuccagaccuuu

SEQ ID NO: 381932 - RNA, 19 nt, Homo sapiens
ugaaauggugcuauggauu

SEQ ID NO: 381933 - RNA, 19 nt, Homo sapiens
gagaaaucagugacaacaa

SEQ ID NO: 381934 - RNA, 19 nt, Homo sapiens
caucagaacaagcgucuag

SEQ ID NO: 381935 - RNA, 19 nt, Homo sapiens
gcacccgaguuuguguuug

SEQ ID NO: 381936 - RNA, 19 nt, Homo sapiens
ggaguaucuucgucacaca

SEQ ID NO: 381937 - RNA, 19 nt, Homo sapiens
aaaccaaaguguggguaga

SEQ ID NO: 381938 - RNA, 19 nt, Homo sapiens
aguauaauccagcucagua

SEQ ID NO: 381939 - RNA, 19 nt, Homo sapiens
ucagcggugucaucuaugu

SEQ ID NO: 381940 - RNA, 19 nt, Homo sapiens
aaacaacucacuggaaauc

SEQ ID NO: 381941 - RNA, 19 nt, Homo sapiens
gcuggucugugcgugauga

SEQ ID NO: 381942 - RNA, 19 nt, Homo sapiens
aaucauaaagccuucauca

SEQ ID NO: 381943 - RNA, 19 nt, Homo sapiens
aaugagaaaucagugacaa

SEQ ID NO: 381944 - RNA, 19 nt, Homo sapiens
cuaaaugagaaaucaguga

SEQ ID NO: 381945 - RNA, 19 nt, Homo sapiens
cgucacacaucuaaaugag

SEQ ID NO: 381946 - RNA, 19 nt, Homo sapiens
gauagaauggagaccugaa

SEQ ID NO: 381947 - RNA, 19 nt, Homo sapiens
ccuuacagguggaguaucu

SEQ ID NO: 381948 - RNA, 19 nt, Homo sapiens
auaauccagcucaguauuu

SEQ ID NO: 381949 - RNA, 19 nt, Homo sapiens
cagaaugcuccuccuguug

SEQ ID NO: 381950 - RNA, 19 nt, Homo sapiens
ccaguccaccucauuuaga

SEQ ID NO: 381951 - RNA, 19 nt, Homo sapiens
guauaauccagcucaguau

SEQ ID NO: 381952 - RNA, 19 nt, Homo sapiens
cagaaagcagacaaagaaa

SEQ ID NO: 381953 - RNA, 19 nt, Homo sapiens
ccaccaugauccugucgau

SEQ ID NO: 381954 - RNA, 19 nt, Homo sapiens
caacgcacccgaguuugug

SEQ ID NO: 381955 - RNA, 19 nt, Homo sapiens
ccaacgcacccgaguuugu

SEQ ID NO: 381956 - RNA, 19 nt, Homo sapiens
uauaauccagcucaguauu

SEQ ID NO: 381957 - RNA, 19 nt, Homo sapiens
guguugagccuuaaagaag

SEQ ID NO: 381958 - RNA, 19 nt, Homo sapiens
gaaaacagaaagcagacaa

SEQ ID NO: 381959 - RNA, 19 nt, Homo sapiens
acaagcgucuagacuccuu

SEQ ID NO: 381960 - RNA, 19 nt, Homo sapiens
ucuaaacaacucacuggaa

SEQ ID NO: 381961 - RNA, 19 nt, Homo sapiens
ccagugcauccaacagaaa

SEQ ID NO: 381962 - RNA, 19 nt, Homo sapiens
cggauuacuccuacgguuu

SEQ ID NO: 381963 - RNA, 19 nt, Homo sapiens
ucaacucggauuacuccua

SEQ ID NO: 381964 - RNA, 19 nt, Homo sapiens
aaacuccgcugagcagaac

SEQ ID NO: 381965 - RNA, 19 nt, Homo sapiens
ugagaaaucagugacaaca

SEQ ID NO: 381966 - RNA, 19 nt, Homo sapiens
cccagugcauccaacagaa

SEQ ID NO: 381967 - RNA, 19 nt, Homo sapiens
uaauccagcucaguauuuu

SEQ ID NO: 381968 - RNA, 19 nt, Homo sapiens
caucucaacucggauuacu

SEQ ID NO: 381969 - RNA, 19 nt, Homo sapiens
ucagcauucugucucuguu

SEQ ID NO: 381970 - RNA, 19 nt, Homo sapiens
uauauauggugcccuucug

SEQ ID NO: 381971 - RNA, 19 nt, Homo sapiens
ggguugcuguugauugaag

SEQ ID NO: 381972 - RNA, 19 nt, Homo sapiens
caacuguguggacuaagau

SEQ ID NO: 381973 - RNA, 19 nt, Homo sapiens
ccuuugggcugcagaaacu

SEQ ID NO: 381974 - RNA, 19 nt, Homo sapiens
uaaacaacucacuggaaau

SEQ ID NO: 381975 - RNA, 19 nt, Homo sapiens
ggaacuuuacauccuaaca

SEQ ID NO: 381976 - RNA, 19 nt, Homo sapiens
aaacagaaagcagacaaag

SEQ ID NO: 381977 - RNA, 19 nt, Homo sapiens
ccacgaucgucagccaaug

SEQ ID NO: 381978 - RNA, 19 nt, Homo sapiens
caauggaucgugggcaaug

SEQ ID NO: 381979 - RNA, 19 nt, Homo sapiens
gagccaacgcacccgaguu

SEQ ID NO: 381980 - RNA, 19 nt, Homo sapiens
caacaagucuuugaaaugg

SEQ ID NO: 381981 - RNA, 19 nt, Homo sapiens
cuaaacaacucacuggaaa

SEQ ID NO: 381982 - RNA, 19 nt, Homo sapiens
aaacacggcuuguggcauu

SEQ ID NO: 381983 - RNA, 19 nt, Homo sapiens
ucacacaucuaaaugagaa

SEQ ID NO: 381984 - RNA, 19 nt, Homo sapiens
gaaauguccaccacuguuu

SEQ ID NO: 381985 - RNA, 19 nt, Homo sapiens
gacaacaagucuuugaaau

SEQ ID NO: 381986 - RNA, 19 nt, Homo sapiens
uuacaucacuggaaucuuc

SEQ ID NO: 381987 - RNA, 19 nt, Homo sapiens
cuucaucacucccacauuu

SEQ ID NO: 381988 - RNA, 19 nt, Homo sapiens
ggauuuaccauuccuuauu

SEQ ID NO: 381989 - RNA, 19 nt, Homo sapiens
gcaauggacacgcaacuga

SEQ ID NO: 381990 - RNA, 19 nt, Homo sapiens
acagaaagcagacaaagaa

SEQ ID NO: 381991 - RNA, 19 nt, Homo sapiens
uuaaagaaguagcuaagga

SEQ ID NO: 381992 - RNA, 19 nt, Homo sapiens
gccaccaacuguagaugua

SEQ ID NO: 381993 - RNA, 19 nt, Homo sapiens
ggaaauguccaccacuguu

SEQ ID NO: 381994 - RNA, 19 nt, Homo sapiens
ccagaaugcuccuccuguu

SEQ ID NO: 381995 - RNA, 19 nt, Homo sapiens
ccaacuguguggacuaaga

SEQ ID NO: 381996 - RNA, 19 nt, Homo sapiens
ggucggagcaucagaacaa

SEQ ID NO: 381997 - RNA, 19 nt, Homo sapiens
gcuguugauugaagaugua

SEQ ID NO: 381998 - RNA, 19 nt, Homo sapiens
ucucagcggugucaucuau

SEQ ID NO: 381999 - RNA, 19 nt, Homo sapiens
caccaacuguagauguaua

SEQ ID NO: 382000 - RNA, 19 nt, Homo sapiens
uaaagaaguagcuaaggaa

SEQ ID NO: 382001 - RNA, 19 nt, Homo sapiens
gaauggagaccugaauaau

SEQ ID NO: 382002 - RNA, 19 nt, Homo sapiens
gaaacuccgcugagcagaa

SEQ ID NO: 382003 - RNA, 19 nt, Homo sapiens
agaaaucagugacaacaag

SEQ ID NO: 382004 - RNA, 19 nt, Homo sapiens
acgaauggcugcagucugu

SEQ ID NO: 382005 - RNA, 19 nt, Homo sapiens
gaacuugccgccagaaugc

SEQ ID NO: 382006 - RNA, 19 nt, Homo sapiens
ugacaacaagucuuugaaa

SEQ ID NO: 382007 - RNA, 19 nt, Homo sapiens
guugagccuuaaagaagua

SEQ ID NO: 382008 - RNA, 19 nt, Homo sapiens
ucgaucaucuucagcauuc

SEQ ID NO: 382009 - RNA, 19 nt, Homo sapiens
ccaccacuguuucucauca

SEQ ID NO: 382010 - RNA, 19 nt, Homo sapiens
caacauaagauagaaugga

SEQ ID NO: 382011 - RNA, 19 nt, Homo sapiens
uagaauggagaccugaaua

SEQ ID NO: 382012 - RNA, 19 nt, Homo sapiens
ucagugacaacaagucuuu

SEQ ID NO: 382013 - RNA, 19 nt, Homo sapiens
agaauggagaccugaauaa

SEQ ID NO: 382014 - RNA, 19 nt, Homo sapiens
cuaaucaucuaaacaacuc

SEQ ID NO: 382015 - RNA, 19 nt, Homo sapiens
gaccaucagccucguguug

SEQ ID NO: 382016 - RNA, 19 nt, Homo sapiens
uaccaacuguguggacuaa

SEQ ID NO: 382017 - RNA, 19 nt, Homo sapiens
caaggacugucuggcaaug

SEQ ID NO: 382018 - RNA, 19 nt, Homo sapiens
acaacaagucuuugaaaug

SEQ ID NO: 382019 - RNA, 19 nt, Homo sapiens
caguccaccucauuuagaa

SEQ ID NO: 382020 - RNA, 19 nt, Homo sapiens
gaacuuuacauccuaacag

SEQ ID NO: 382021 - RNA, 19 nt, Homo sapiens
caucaucaccaaacgaaug

SEQ ID NO: 382022 - RNA, 19 nt, Homo sapiens
aauggagaccugaauaauu

SEQ ID NO: 382023 - RNA, 19 nt, Homo sapiens
gaaaucagugacaacaagu

SEQ ID NO: 382024 - RNA, 19 nt, Homo sapiens
gggaagggaggaagggaaa

SEQ ID NO: 382025 - RNA, 19 nt, Homo sapiens
uaugugaucuugcggaaac

SEQ ID NO: 382026 - RNA, 19 nt, Homo sapiens
ugucaucuaugugaucuug

SEQ ID NO: 382027 - RNA, 19 nt, Homo sapiens
ggauuacuccuacgguuuc

SEQ ID NO: 382028 - RNA, 19 nt, Homo sapiens
ucauaaagccuucaucacu

SEQ ID NO: 382029 - RNA, 19 nt, Homo sapiens
gcuaagacuccagaccuuu

SEQ ID NO: 382030 - RNA, 19 nt, Homo sapiens
ugaaauggugcuauggauu

SEQ ID NO: 382031 - RNA, 19 nt, Homo sapiens
gagaaaucagugacaacaa

SEQ ID NO: 382032 - RNA, 19 nt, Homo sapiens
caucagaacaagcgucuag

SEQ ID NO: 382033 - RNA, 19 nt, Homo sapiens
ggaguaucuucgucacaca

SEQ ID NO: 382034 - RNA, 19 nt, Homo sapiens
aaaccaaaguguggguaga

SEQ ID NO: 382035 - RNA, 19 nt, Homo sapiens
aguauaauccagcucagua

SEQ ID NO: 382036 - RNA, 19 nt, Homo sapiens
ucagcggugucaucuaugu

SEQ ID NO: 382037 - RNA, 19 nt, Homo sapiens
aaacaacucacuggaaauc

SEQ ID NO: 382038 - RNA, 19 nt, Homo sapiens
gcuggucugugcgugauga

SEQ ID NO: 382039 - RNA, 19 nt, Homo sapiens
aaucauaaagccuucauca

SEQ ID NO: 382040 - RNA, 19 nt, Homo sapiens
aaugagaaaucagugacaa

SEQ ID NO: 382041 - RNA, 19 nt, Homo sapiens
cuaaaugagaaaucaguga

SEQ ID NO: 382042 - RNA, 19 nt, Homo sapiens
cgucacacaucuaaaugag

SEQ ID NO: 382043 - RNA, 19 nt, Homo sapiens
gauagaauggagaccugaa

SEQ ID NO: 382044 - RNA, 19 nt, Homo sapiens
ccuuacagguggaguaucu

SEQ ID NO: 382045 - RNA, 19 nt, Homo sapiens
auaauccagcucaguauuu

SEQ ID NO: 382046 - RNA, 19 nt, Homo sapiens
cagaaugcuccuccuguug

SEQ ID NO: 382047 - RNA, 19 nt, Homo sapiens
ccaguccaccucauuuaga

SEQ ID NO: 382048 - RNA, 19 nt, Homo sapiens
guauaauccagcucaguau

SEQ ID NO: 382049 - RNA, 19 nt, Homo sapiens
cagaaagcagacaaagaaa

SEQ ID NO: 382050 - RNA, 19 nt, Homo sapiens
ccaccaugauccugucgau

SEQ ID NO: 382051 - RNA, 19 nt, Homo sapiens
uauaauccagcucaguauu

SEQ ID NO: 382052 - RNA, 19 nt, Homo sapiens
guguugagccuuaaagaag

SEQ ID NO: 382053 - RNA, 19 nt, Homo sapiens
gaaaacagaaagcagacaa

SEQ ID NO: 382054 - RNA, 19 nt, Homo sapiens
acaagcgucuagacuccuu

SEQ ID NO: 382055 - RNA, 19 nt, Homo sapiens
ucuaaacaacucacuggaa

SEQ ID NO: 382056 - RNA, 19 nt, Homo sapiens
ccagugcauccaacagaaa

SEQ ID NO: 382057 - RNA, 19 nt, Homo sapiens
cggauuacuccuacgguuu

SEQ ID NO: 382058 - RNA, 19 nt, Homo sapiens
ucaacucggauuacuccua

SEQ ID NO: 382059 - RNA, 19 nt, Homo sapiens
aaacuccgcugagcagaac

SEQ ID NO: 382060 - RNA, 19 nt, Homo sapiens
ugagaaaucagugacaaca

SEQ ID NO: 382061 - RNA, 19 nt, Homo sapiens
cccagugcauccaacagaa

SEQ ID NO: 382062 - RNA, 19 nt, Homo sapiens
uaauccagcucaguauuuu

SEQ ID NO: 382063 - RNA, 19 nt, Homo sapiens
caucucaacucggauuacu

SEQ ID NO: 382064 - RNA, 19 nt, Homo sapiens
ucagcauucugucucuguu

SEQ ID NO: 382065 - RNA, 19 nt, Homo sapiens
uauauauggugcccuucug

SEQ ID NO: 382066 - RNA, 19 nt, Homo sapiens
ggguugcuguugauugaag

SEQ ID NO: 382067 - RNA, 19 nt, Homo sapiens
caacuguguggacuaagau

SEQ ID NO: 382068 - RNA, 19 nt, Homo sapiens
ccacgaucgucagccaaug

SEQ ID NO: 382069 - RNA, 19 nt, Homo sapiens
uaaacaacucacuggaaau

SEQ ID NO: 382070 - RNA, 19 nt, Homo sapiens
ggaacuuuacauccuaaca

SEQ ID NO: 382071 - RNA, 19 nt, Homo sapiens
aaacagaaagcagacaaag

SEQ ID NO: 382072 - RNA, 19 nt, Homo sapiens
caauggaucgugggcaaug

SEQ ID NO: 382073 - RNA, 19 nt, Homo sapiens
ucccaguccaccucauuua

SEQ ID NO: 382074 - RNA, 19 nt, Homo sapiens
ggugucaucuaugugaucu

SEQ ID NO: 382075 - RNA, 19 nt, Homo sapiens
guucuucugccaacucuuc

SEQ ID NO: 382076 - RNA, 19 nt, Homo sapiens
ucuuugaaauggugcuaug

SEQ ID NO: 382077 - RNA, 19 nt, Homo sapiens
aucccaaacucaaaccaaa

SEQ ID NO: 382078 - RNA, 19 nt, Homo sapiens
uugaaauggugcuauggau

SEQ ID NO: 382079 - RNA, 19 nt, Homo sapiens
cuuuacauccuaacaguau

SEQ ID NO: 382080 - RNA, 19 nt, Homo sapiens
gaagaagcccugcuauuua

SEQ ID NO: 382081 - RNA, 19 nt, Homo sapiens
gaacaggagucacaaaugu

SEQ ID NO: 382082 - RNA, 19 nt, Homo sapiens
gaaauugguucugucauaa

SEQ ID NO: 382083 - RNA, 19 nt, Homo sapiens
ggaaucaucuggaaagaau

SEQ ID NO: 382084 - RNA, 19 nt, Homo sapiens
gaagauuaguuaccauuga

SEQ ID NO: 382085 - RNA, 19 nt, Homo sapiens
caaaggaaguuuaugaaug

SEQ ID NO: 382086 - RNA, 19 nt, Homo sapiens
caagauggcucucauguca

SEQ ID NO: 382087 - RNA, 19 nt, Homo sapiens
gcgaaugguuucaagauaa

SEQ ID NO: 382088 - RNA, 19 nt, Homo sapiens
ugaaauugguucugucaua

SEQ ID NO: 382089 - RNA, 19 nt, Homo sapiens
aaacagaaaugcaaaggaa

SEQ ID NO: 382090 - RNA, 19 nt, Homo sapiens
gaaaugcaaaggaaguuua

SEQ ID NO: 382091 - RNA, 19 nt, Homo sapiens
ccaauuauguuaacagaga

SEQ ID NO: 382092 - RNA, 19 nt, Homo sapiens
gcagaccacucuuucacua

SEQ ID NO: 382093 - RNA, 19 nt, Homo sapiens
aagaagcccugcuauuuaa

SEQ ID NO: 382094 - RNA, 19 nt, Homo sapiens
cuaaagacuuggaacgaua

SEQ ID NO: 382095 - RNA, 19 nt, Homo sapiens
ggaaucuacucguuuguau

SEQ ID NO: 382096 - RNA, 19 nt, Homo sapiens
cauaaacagucgaccagua

SEQ ID NO: 382097 - RNA, 19 nt, Homo sapiens
gaaucuaccuguaagaaag

SEQ ID NO: 382098 - RNA, 19 nt, Homo sapiens
ucagaaaccuucacaucuu

SEQ ID NO: 382099 - RNA, 19 nt, Homo sapiens
gacagcagaugaccaaaga

SEQ ID NO: 382100 - RNA, 19 nt, Homo sapiens
ggaugaaccuugcuugauc

SEQ ID NO: 382101 - RNA, 19 nt, Homo sapiens
uagaaggaauggcuaauug

SEQ ID NO: 382102 - RNA, 19 nt, Homo sapiens
ugacaucguucuuaguaaa

SEQ ID NO: 382103 - RNA, 19 nt, Homo sapiens
ggagaacuauggauuugau

SEQ ID NO: 382104 - RNA, 19 nt, Homo sapiens
uccagaaacuacaugauua

SEQ ID NO: 382105 - RNA, 19 nt, Homo sapiens
cuaauugucucccauucua

SEQ ID NO: 382106 - RNA, 19 nt, Homo sapiens
gaagaacuguggaagacau

SEQ ID NO: 382107 - RNA, 19 nt, Homo sapiens
aaaccugacuuaaggauug

SEQ ID NO: 382108 - RNA, 19 nt, Homo sapiens
gcaaucgaguaaucaagaa

SEQ ID NO: 382109 - RNA, 19 nt, Homo sapiens
ggaaauuucugcagaugag

SEQ ID NO: 382110 - RNA, 19 nt, Homo sapiens
ccacaagcguagauguuaa

SEQ ID NO: 382111 - RNA, 19 nt, Homo sapiens
gaagagagccauugaacag

SEQ ID NO: 382112 - RNA, 19 nt, Homo sapiens
ggaaguuuaugaauguaga

SEQ ID NO: 382113 - RNA, 19 nt, Homo sapiens
cgaaugguuucaagauaaa

SEQ ID NO: 382114 - RNA, 19 nt, Homo sapiens
agaagaagcccugcuauuu

SEQ ID NO: 382115 - RNA, 19 nt, Homo sapiens
gcaauaaagaccauauaga

SEQ ID NO: 382116 - RNA, 19 nt, Homo sapiens
cagcugauguugauguaaa

SEQ ID NO: 382117 - RNA, 19 nt, Homo sapiens
gaaauuaaagaguguguuc

SEQ ID NO: 382118 - RNA, 19 nt, Homo sapiens
gaccaaagauacaguggau

SEQ ID NO: 382119 - RNA, 19 nt, Homo sapiens
gauccacaaucucagguuu

SEQ ID NO: 382120 - RNA, 19 nt, Homo sapiens
gaagagaaggcuacuaaag

SEQ ID NO: 382121 - RNA, 19 nt, Homo sapiens
gaaggcuacuaaagacuug

SEQ ID NO: 382122 - RNA, 19 nt, Homo sapiens
aaaggaaucuacucguuug

SEQ ID NO: 382123 - RNA, 19 nt, Homo sapiens
gagcuuugguauccuuaaa

SEQ ID NO: 382124 - RNA, 19 nt, Homo sapiens
gaugacgacuuguuaugga

SEQ ID NO: 382125 - RNA, 19 nt, Homo sapiens
cuaaaggaaucuacucguu

SEQ ID NO: 382126 - RNA, 19 nt, Homo sapiens
cgacaucauuacaaucuga

SEQ ID NO: 382127 - RNA, 19 nt, Homo sapiens
guaccacucugaagaaucu

SEQ ID NO: 382128 - RNA, 19 nt, Homo sapiens
uaauggcaaugaaguacua

SEQ ID NO: 382129 - RNA, 19 nt, Homo sapiens
aaauugaggugcgagauaa

SEQ ID NO: 382130 - RNA, 19 nt, Homo sapiens
uaaccuaucuuccagaaac

SEQ ID NO: 382131 - RNA, 19 nt, Homo sapiens
uaaccuaucuuccagaaac

SEQ ID NO: 382132 - RNA, 19 nt, Homo sapiens
gcaaaggaaguuuaugaau

SEQ ID NO: 382133 - RNA, 19 nt, Homo sapiens
gcugacaucguucuuagua

SEQ ID NO: 382134 - RNA, 19 nt, Homo sapiens
gaaaaucgauguuccuaca

SEQ ID NO: 382135 - RNA, 19 nt, Homo sapiens
ugaaaugccuaaaggaauc

SEQ ID NO: 382136 - RNA, 19 nt, Homo sapiens
gaggacauccaagacauua

SEQ ID NO: 382137 - RNA, 19 nt, Homo sapiens
cagcagaugaccaaagaua

SEQ ID NO: 382138 - RNA, 19 nt, Homo sapiens
aggauucacugacuuguuu

SEQ ID NO: 382139 - RNA, 19 nt, Homo sapiens
gcaccaguuuggaaaugaa

SEQ ID NO: 382140 - RNA, 19 nt, Homo sapiens
ggaaaagccaauuauguua

SEQ ID NO: 382141 - RNA, 19 nt, Homo sapiens
gacauugagugaagaggaa

SEQ ID NO: 382142 - RNA, 19 nt, Homo sapiens
uaaaggaaucuacucguuu

SEQ ID NO: 382143 - RNA, 19 nt, Homo sapiens
gaacaauauggaauccuuu

SEQ ID NO: 382144 - RNA, 19 nt, Homo sapiens
ggauugucuuuguacauaa

SEQ ID NO: 382145 - RNA, 19 nt, Homo sapiens
cagaaaccuucacaucuug

SEQ ID NO: 382146 - RNA, 19 nt, Homo sapiens
acaauuacccauguacuua

SEQ ID NO: 382147 - RNA, 19 nt, Homo sapiens
ggaugcaacacuacaaauu

SEQ ID NO: 382148 - RNA, 19 nt, Homo sapiens
gaauauugaaccugugaaa

SEQ ID NO: 382149 - RNA, 19 nt, Homo sapiens
guucucagaucaucacuuc

SEQ ID NO: 382150 - RNA, 19 nt, Homo sapiens
gaaugaagcaccaguuugg

SEQ ID NO: 382151 - RNA, 19 nt, Homo sapiens
gaugcaacacuacaaauug

SEQ ID NO: 382152 - RNA, 19 nt, Homo sapiens
ccugaugcauggcuaauga

SEQ ID NO: 382153 - RNA, 19 nt, Homo sapiens
ggaagacauugagugaaga

SEQ ID NO: 382154 - RNA, 19 nt, Homo sapiens
ccagaaacuacaugauuaa

SEQ ID NO: 382155 - RNA, 19 nt, Homo sapiens
gaauguagaccucgcaaag

SEQ ID NO: 382156 - RNA, 19 nt, Homo sapiens
ugaacaauauggaauccuu

SEQ ID NO: 382157 - RNA, 19 nt, Homo sapiens
aagcguagauguuaaacug

SEQ ID NO: 382158 - RNA, 19 nt, Homo sapiens
ccagacaauuacccaugua

SEQ ID NO: 382159 - RNA, 19 nt, Homo sapiens
aaaguggaaucaucuggaa

SEQ ID NO: 382160 - RNA, 19 nt, Homo sapiens
uccaaucccugaacaaaug

SEQ ID NO: 382161 - RNA, 19 nt, Homo sapiens
gaacuguggaagacauuga

SEQ ID NO: 382162 - RNA, 19 nt, Homo sapiens
aggauugucuuuguacaua

SEQ ID NO: 382163 - RNA, 19 nt, Homo sapiens
ccaaagauacaguggauca

SEQ ID NO: 382164 - RNA, 19 nt, Homo sapiens
gcagaugaccaaagauaca

SEQ ID NO: 382165 - RNA, 19 nt, Homo sapiens
gagaauauugaaccuguga

SEQ ID NO: 382166 - RNA, 19 nt, Homo sapiens
gcaguuauuuggcagaaaa

SEQ ID NO: 382167 - RNA, 19 nt, Homo sapiens
gcaugagucugguuuuaaa

SEQ ID NO: 382168 - RNA, 19 nt, Homo sapiens
uaaagaguguguucauggu

SEQ ID NO: 382169 - RNA, 19 nt, Homo sapiens
ggacauccaagacauuauc

SEQ ID NO: 382170 - RNA, 19 nt, Homo sapiens
gccacaagcguagauguua

SEQ ID NO: 382171 - RNA, 19 nt, Homo sapiens
guacagauccccuuuucua

SEQ ID NO: 382172 - RNA, 19 nt, Homo sapiens
aagagaaggcuacuaaaga

SEQ ID NO: 382173 - RNA, 19 nt, Homo sapiens
cagcugacaucguucuuag

SEQ ID NO: 382174 - RNA, 19 nt, Homo sapiens
gcagcugacaucguucuua

SEQ ID NO: 382175 - RNA, 19 nt, Homo sapiens
gcuaguggaugguaauugc

SEQ ID NO: 382176 - RNA, 19 nt, Homo sapiens
ugaaaacucuucggaaauu

SEQ ID NO: 382177 - RNA, 19 nt, Homo sapiens
cuuaaggauugucuuugua

SEQ ID NO: 382178 - RNA, 19 nt, Homo sapiens
ccaagacauuaucuacaga

SEQ ID NO: 382179 - RNA, 19 nt, Homo sapiens
gacaauuacccauguacuu

SEQ ID NO: 382180 - RNA, 19 nt, Homo sapiens
ggacucgacugguguuuga

SEQ ID NO: 382181 - RNA, 19 nt, Homo sapiens
cauaaggaauuucaaagga

SEQ ID NO: 382182 - RNA, 19 nt, Homo sapiens
aaacugacuccuagaagua

SEQ ID NO: 382183 - RNA, 19 nt, Homo sapiens
guauucagcucugucaaga

SEQ ID NO: 382184 - RNA, 19 nt, Homo sapiens
ggacaacgugaucacugua

SEQ ID NO: 382185 - RNA, 19 nt, Homo sapiens
aaacuucgaaggcuuaaug

SEQ ID NO: 382186 - RNA, 19 nt, Homo sapiens
gguccagguucuucuagau

SEQ ID NO: 382187 - RNA, 19 nt, Homo sapiens
gggaaaaucauccagaaaa

SEQ ID NO: 382188 - RNA, 19 nt, Homo sapiens
caacgugaucacuguauuc

SEQ ID NO: 382189 - RNA, 19 nt, Homo sapiens
acaacgugaucacuguauu

SEQ ID NO: 382190 - RNA, 19 nt, Homo sapiens
uucgaaggcuuaaugaugu

SEQ ID NO: 382191 - RNA, 19 nt, Homo sapiens
ggaaaaucauccagaaaac

SEQ ID NO: 382192 - RNA, 19 nt, Homo sapiens
uccagguucuucuagauga

SEQ ID NO: 382193 - RNA, 19 nt, Homo sapiens
gcaaaacugacuccuagaa

SEQ ID NO: 382194 - RNA, 19 nt, Homo sapiens
agaagaaacgugccugcuu

SEQ ID NO: 382195 - RNA, 19 nt, Homo sapiens
cuucgaaggcuuaaugaug

SEQ ID NO: 382196 - RNA, 19 nt, Homo sapiens
ucagcucugucaagaaugg

SEQ ID NO: 382197 - RNA, 19 nt, Homo sapiens
gacaacgugaucacuguau

SEQ ID NO: 382198 - RNA, 19 nt, Homo sapiens
ccauaaggaauuucaaagg

SEQ ID NO: 382199 - RNA, 19 nt, Homo sapiens
aggacaacgugaucacugu

SEQ ID NO: 382200 - RNA, 19 nt, Homo sapiens
ggaauauuaagaagaaacg

SEQ ID NO: 382201 - RNA, 19 nt, Homo sapiens
gaacugacuccuagaagua

SEQ ID NO: 382202 - RNA, 19 nt, Homo sapiens
ggacucgacugguguuuga

SEQ ID NO: 382203 - RNA, 19 nt, Homo sapiens
ggagagacgggaaguauuu

SEQ ID NO: 382204 - RNA, 19 nt, Homo sapiens
cauguaagauucaagaguu

SEQ ID NO: 382205 - RNA, 19 nt, Homo sapiens
gcgacuaccucccuucuga

SEQ ID NO: 382206 - RNA, 19 nt, Homo sapiens
gaagucaguccaucagauu

SEQ ID NO: 382207 - RNA, 19 nt, Homo sapiens
ggaagucaguccaucagau

SEQ ID NO: 382208 - RNA, 19 nt, Homo sapiens
caucacacauguaagauuc

SEQ ID NO: 382209 - RNA, 19 nt, Homo sapiens
gcugagaacucgaguacag

SEQ ID NO: 382210 - RNA, 19 nt, Homo sapiens
guauucagcucugucaaga

SEQ ID NO: 382211 - RNA, 19 nt, Homo sapiens
gcuuuacucugaaacauca

SEQ ID NO: 382212 - RNA, 19 nt, Homo sapiens
ggacucgaccuuugacaga

SEQ ID NO: 382213 - RNA, 19 nt, Homo sapiens
ggaaaccgccagacaccaa

SEQ ID NO: 382214 - RNA, 19 nt, Homo sapiens
gcuaaggccaucaaaccua

SEQ ID NO: 382215 - RNA, 19 nt, Homo sapiens
ggaaaccgccagacaccaa

SEQ ID NO: 382216 - RNA, 19 nt, Homo sapiens
ggaaaccgccagacaccaa

SEQ ID NO: 382217 - RNA, 19 nt, Homo sapiens
cgaaggcuuuacucugaaa

SEQ ID NO: 382218 - RNA, 19 nt, Homo sapiens
gcaguccggugugcucuga

SEQ ID NO: 382219 - RNA, 19 nt, Homo sapiens
ggacaacgugaucacugua

SEQ ID NO: 382220 - RNA, 19 nt, Homo sapiens
gguggaaacuuuuggcuuu

SEQ ID NO: 382221 - RNA, 19 nt, Homo sapiens
cuaaggccaucaaaccuau

SEQ ID NO: 382222 - RNA, 19 nt, Homo sapiens
ucaagaguuugccgaccua

SEQ ID NO: 382223 - RNA, 19 nt, Homo sapiens
cggaaaggguggagcacaa

SEQ ID NO: 382224 - RNA, 19 nt, Homo sapiens
guagaacugacuccuagaa

SEQ ID NO: 382225 - RNA, 19 nt, Homo sapiens
uucgaaggcuuuacucuga

SEQ ID NO: 382226 - RNA, 19 nt, Homo sapiens
gauccgguguugcauccuu

SEQ ID NO: 382227 - RNA, 19 nt, Homo sapiens
gguccagguucuucuagau

SEQ ID NO: 382228 - RNA, 19 nt, Homo sapiens
gagcugagaacucgaguac

SEQ ID NO: 382229 - RNA, 19 nt, Homo sapiens
agaacugacuccuagaagu

SEQ ID NO: 382230 - RNA, 19 nt, Homo sapiens
gggaaaaucauccagaaaa

SEQ ID NO: 382231 - RNA, 19 nt, Homo sapiens
ccauaaagaauuucaaagg

SEQ ID NO: 382232 - RNA, 19 nt, Homo sapiens
caacgugaucacuguauuc

SEQ ID NO: 382233 - RNA, 19 nt, Homo sapiens
acaacgugaucacuguauu

SEQ ID NO: 382234 - RNA, 19 nt, Homo sapiens
ucacacauguaagauucaa

SEQ ID NO: 382235 - RNA, 19 nt, Homo sapiens
ucacggacucgaccuuuga

SEQ ID NO: 382236 - RNA, 19 nt, Homo sapiens
acacauguaagauucaaga

SEQ ID NO: 382237 - RNA, 19 nt, Homo sapiens
gaacucgaguacagaaccu

SEQ ID NO: 382238 - RNA, 19 nt, Homo sapiens
ggaaaaucauccagaaaac

SEQ ID NO: 382239 - RNA, 19 nt, Homo sapiens
uccagguucuucuagauga

SEQ ID NO: 382240 - RNA, 19 nt, Homo sapiens
ugugcaccauaaagaauuu

SEQ ID NO: 382241 - RNA, 19 nt, Homo sapiens
agaagaaacgugccugcuu

SEQ ID NO: 382242 - RNA, 19 nt, Homo sapiens
ucagcucugucaagaaugg

SEQ ID NO: 382243 - RNA, 19 nt, Homo sapiens
gacugguguuugaucacua

SEQ ID NO: 382244 - RNA, 19 nt, Homo sapiens
gagcacaacgucgaaagca

SEQ ID NO: 382245 - RNA, 19 nt, Homo sapiens
gacaacgugaucacuguau

SEQ ID NO: 382246 - RNA, 19 nt, Homo sapiens
gcucggaaaccgccagaca

SEQ ID NO: 382247 - RNA, 19 nt, Homo sapiens
gucacggacucgaccuuug

SEQ ID NO: 382248 - RNA, 19 nt, Homo sapiens
gcucggaaaccgccagaca

SEQ ID NO: 382249 - RNA, 19 nt, Homo sapiens
ucgaaggcuuuacucugaa

SEQ ID NO: 382250 - RNA, 19 nt, Homo sapiens
ggucggaaaccgccagaca

SEQ ID NO: 382251 - RNA, 19 nt, Homo sapiens
ugagaacucgaguacagaa

SEQ ID NO: 382252 - RNA, 19 nt, Homo sapiens
ggaugcuggugccacuaau

SEQ ID NO: 382253 - RNA, 19 nt, Homo sapiens
gcaccauaaagaauuucaa

SEQ ID NO: 382254 - RNA, 19 nt, Homo sapiens
cgacugguguuugaucacu

SEQ ID NO: 382255 - RNA, 19 nt, Homo sapiens
gaugugggguagaagaaga

SEQ ID NO: 382256 - RNA, 19 nt, Homo sapiens
gaaaccgccaagacaccaa

SEQ ID NO: 382257 - RNA, 19 nt, Homo sapiens
caccaaggcucggaaucca

SEQ ID NO: 382258 - RNA, 19 nt, Homo sapiens
aggacaacgugaucacugu

SEQ ID NO: 382259 - RNA, 19 nt, Homo sapiens
aaggagagacgggaaguau

SEQ ID NO: 382260 - RNA, 19 nt, Homo sapiens
ggaauauuaagaagaaacg

SEQ ID NO: 382261 - RNA, 19 nt, Homo sapiens
gcgcaaccaaagcaagaga

SEQ ID NO: 382262 - RNA, 19 nt, Homo sapiens
agacaccaacgcucggaaa

SEQ ID NO: 382263 - RNA, 19 nt, Homo sapiens
agacaccaacggucggaaa

SEQ ID NO: 382264 - RNA, 19 nt, Homo sapiens
agacaccaacggucggaaa

SEQ ID NO: 382265 - RNA, 19 nt, Homo sapiens
agacaccaacgcucggaaa

SEQ ID NO: 382266 - RNA, 19 nt, Homo sapiens
gauaauggaaggugaauuu

SEQ ID NO: 382267 - RNA, 19 nt, Homo sapiens
gaagucaguccaucagauu

SEQ ID NO: 382268 - RNA, 19 nt, Homo sapiens
ggaagucaguccaucagau

SEQ ID NO: 382269 - RNA, 19 nt, Homo sapiens
gaaggugaauuuccauguc

SEQ ID NO: 382270 - RNA, 19 nt, Homo sapiens
ggagaggagccguggauaa

SEQ ID NO: 382271 - RNA, 19 nt, Homo sapiens
gaggagccguggauaaugg

SEQ ID NO: 382272 - RNA, 19 nt, Homo sapiens
gggaugugauguuggagaa

SEQ ID NO: 382273 - RNA, 19 nt, Homo sapiens
ggacccugaugagaagaua

SEQ ID NO: 382274 - RNA, 19 nt, Homo sapiens
gagaggagccguggauaau

SEQ ID NO: 382275 - RNA, 19 nt, Homo sapiens
gaguggaggugaaggaagu

SEQ ID NO: 382276 - RNA, 19 nt, Homo sapiens
gcuaaggccaucaaaccua

SEQ ID NO: 382277 - RNA, 19 nt, Homo sapiens
cuaaggccaucaaaccuau

SEQ ID NO: 382278 - RNA, 19 nt, Homo sapiens
ggagaacuacagccaucua

SEQ ID NO: 382279 - RNA, 19 nt, Homo sapiens
gaaggacacccgccuggau

SEQ ID NO: 382280 - RNA, 19 nt, Homo sapiens
cuacagccaucuaguuucu

SEQ ID NO: 382281 - RNA, 19 nt, Homo sapiens
agacuaggccgucgcugua

SEQ ID NO: 382282 - RNA, 19 nt, Homo sapiens
caacuggacccugaugaga

SEQ ID NO: 382283 - RNA, 19 nt, Homo sapiens
cacagucucugcauguuuc

SEQ ID NO: 382284 - RNA, 19 nt, Homo sapiens
agaaaacuuugaaggcuua

SEQ ID NO: 382285 - RNA, 19 nt, Homo sapiens
ccagugucauucaaagaug

SEQ ID NO: 382286 - RNA, 19 nt, Homo sapiens
caagagcaacaggaaauga

SEQ ID NO: 382287 - RNA, 19 nt, Homo sapiens
ccacagucucugcauguuu

SEQ ID NO: 382288 - RNA, 19 nt, Homo sapiens
gguagaagaagaaaacuuu

SEQ ID NO: 382289 - RNA, 19 nt, Homo sapiens
uuugaaggcuuaaucucuu

SEQ ID NO: 382290 - RNA, 19 nt, Homo sapiens
cugaugagaagauagcaua

SEQ ID NO: 382291 - RNA, 19 nt, Homo sapiens
ggacacccgccuggauuug

SEQ ID NO: 382292 - RNA, 19 nt, Homo sapiens
gaugugauguuggagaacu

SEQ ID NO: 382293 - RNA, 19 nt, Homo sapiens
caacaggaaaugaacacau

SEQ ID NO: 382294 - RNA, 19 nt, Homo sapiens
uugaaggcuuaaucucuuu

SEQ ID NO: 382295 - RNA, 19 nt, Homo sapiens
aaggugaauuuccauguca

SEQ ID NO: 382296 - RNA, 19 nt, Homo sapiens
agccaaacaucaucaugga

SEQ ID NO: 382297 - RNA, 19 nt, Homo sapiens
agauguggcuguggauuuc

SEQ ID NO: 382298 - RNA, 19 nt, Homo sapiens
gggccagugucauucaaag

SEQ ID NO: 382299 - RNA, 19 nt, Homo sapiens
aaacuuugaaggcuuaauc

SEQ ID NO: 382300 - RNA, 19 nt, Homo sapiens
gcaacuggacccugaugag

SEQ ID NO: 382301 - RNA, 19 nt, Homo sapiens
gagcaacaggaaaugaaca

SEQ ID NO: 382302 - RNA, 19 nt, Homo sapiens
gagaacuacagccaucuag

SEQ ID NO: 382303 - RNA, 19 nt, Homo sapiens
aagauguggcuguggauuu

SEQ ID NO: 382304 - RNA, 19 nt, Homo sapiens
ggaugcuggugccacuaau

SEQ ID NO: 382305 - RNA, 19 nt, Homo sapiens
gccacagucucugcauguu

SEQ ID NO: 382306 - RNA, 19 nt, Homo sapiens
gaaggcuuaaucucuuuca

SEQ ID NO: 382307 - RNA, 19 nt, Homo sapiens
ucaccaagccaaacaucau

SEQ ID NO: 382308 - RNA, 19 nt, Homo sapiens
gccagugucauucaaagau

SEQ ID NO: 382309 - RNA, 19 nt, Homo sapiens
gaugugggguagaagaaga

SEQ ID NO: 382310 - RNA, 19 nt, Homo sapiens
gggagaggagccguggaua

SEQ ID NO: 382311 - RNA, 19 nt, Homo sapiens
aagagcaacaggaaaugaa

SEQ ID NO: 382312 - RNA, 19 nt, Homo sapiens
cagugucauucaaagaugu

SEQ ID NO: 382313 - RNA, 19 nt, Homo sapiens
gcucugaaacaucacacau

SEQ ID NO: 382314 - RNA, 19 nt, Homo sapiens
uccaagagcaacaggaaau

SEQ ID NO: 382315 - RNA, 19 nt, Homo sapiens
ccaagagcaacaggaaaug

SEQ ID NO: 382316 - RNA, 19 nt, Homo sapiens
caagccaaacaucaucaug

SEQ ID NO: 382317 - RNA, 19 nt, Homo sapiens
gaagagagcugccaauuaa

SEQ ID NO: 382318 - RNA, 19 nt, Homo sapiens
gaaagaagguggaaaguuu

SEQ ID NO: 382319 - RNA, 19 nt, Homo sapiens
gaacaaacaucgagagauu

SEQ ID NO: 382320 - RNA, 19 nt, Homo sapiens
gcaaauacguguagaccua

SEQ ID NO: 382321 - RNA, 19 nt, Homo sapiens
ggaaagaugucuaagaaau

SEQ ID NO: 382322 - RNA, 19 nt, Homo sapiens
ccaagaugcucccauaaua

SEQ ID NO: 382323 - RNA, 19 nt, Homo sapiens
gcaaggaacauauuuauug

SEQ ID NO: 382324 - RNA, 19 nt, Homo sapiens
gcagacaaaccuaugauua

SEQ ID NO: 382325 - RNA, 19 nt, Homo sapiens
gaaaguagcagaaauuaca

SEQ ID NO: 382326 - RNA, 19 nt, Homo sapiens
guagaagucucugauauug

SEQ ID NO: 382327 - RNA, 19 nt, Homo sapiens
ccaaggagaugaaguaaca

SEQ ID NO: 382328 - RNA, 19 nt, Homo sapiens
gaaguugaaucgacucaug

SEQ ID NO: 382329 - RNA, 19 nt, Homo sapiens
caaaggaucacagcauuua

SEQ ID NO: 382330 - RNA, 19 nt, Homo sapiens
gagaugaaguaacacugua

SEQ ID NO: 382331 - RNA, 19 nt, Homo sapiens
gaguagaagucucugauau

SEQ ID NO: 382332 - RNA, 19 nt, Homo sapiens
gaaaaggccccuauugaua

SEQ ID NO: 382333 - RNA, 19 nt, Homo sapiens
gaacaucaggaucucauuu

SEQ ID NO: 382334 - RNA, 19 nt, Homo sapiens
ugaaagcuuuggagaauga

SEQ ID NO: 382335 - RNA, 19 nt, Homo sapiens
uaaaaucgcuggugugaaa

SEQ ID NO: 382336 - RNA, 19 nt, Homo sapiens
agacaagaauccaaagaaa

SEQ ID NO: 382337 - RNA, 19 nt, Homo sapiens
ccucaggcuuuauuuauuu

SEQ ID NO: 382338 - RNA, 19 nt, Homo sapiens
agaaauacuuguugaagga

SEQ ID NO: 382339 - RNA, 19 nt, Homo sapiens
cuaagaaauucgaagugua

SEQ ID NO: 382340 - RNA, 19 nt, Homo sapiens
gcgugauccuguaccauua

SEQ ID NO: 382341 - RNA, 19 nt, Homo sapiens
agaagagagcugccaauua

SEQ ID NO: 382342 - RNA, 19 nt, Homo sapiens
ggaaagaagguggaaaguu

SEQ ID NO: 382343 - RNA, 19 nt, Homo sapiens
gagaagaacgugugaugga

SEQ ID NO: 382344 - RNA, 19 nt, Homo sapiens
ggaguagaagucucugaua

SEQ ID NO: 382345 - RNA, 19 nt, Homo sapiens
caaggaacauauuuauugg

SEQ ID NO: 382346 - RNA, 19 nt, Homo sapiens
gauccuguaccauuaagua

SEQ ID NO: 382347 - RNA, 19 nt, Homo sapiens
gaaauucgaaguguauaga

SEQ ID NO: 382348 - RNA, 19 nt, Homo sapiens
agaagucucugauauugga

SEQ ID NO: 382349 - RNA, 19 nt, Homo sapiens
gaagaaaucauugcugaag

SEQ ID NO: 382350 - RNA, 19 nt, Homo sapiens
gcuaacaguuguauaucug

SEQ ID NO: 382351 - RNA, 19 nt, Homo sapiens
caauuaaagcuaacaguug

SEQ ID NO: 382352 - RNA, 19 nt, Homo sapiens
aagccaagaugcucccaua

SEQ ID NO: 382353 - RNA, 19 nt, Homo sapiens
ugaagagcgugauccugua

SEQ ID NO: 382354 - RNA, 19 nt, Homo sapiens
gaugaaguaacacuguaua

SEQ ID NO: 382355 - RNA, 19 nt, Homo sapiens
agucagaucucuuggugaa

SEQ ID NO: 382356 - RNA, 19 nt, Homo sapiens
gaagaagaagaaaugauca

SEQ ID NO: 382357 - RNA, 19 nt, Homo sapiens
ugaagacucugagaaggaa

SEQ ID NO: 382358 - RNA, 19 nt, Homo sapiens
guucugagaugcaguaaaa

SEQ ID NO: 382359 - RNA, 19 nt, Homo sapiens
aaacaucgagagauuugua

SEQ ID NO: 382360 - RNA, 19 nt, Homo sapiens
gaacgagaagaacguguga

SEQ ID NO: 382361 - RNA, 19 nt, Homo sapiens
auggaaagaugucuaagaa

SEQ ID NO: 382362 - RNA, 19 nt, Homo sapiens
cagacaaaccuaugauuau

SEQ ID NO: 382363 - RNA, 19 nt, Homo sapiens
ccaauuaaagcuaacaguu

SEQ ID NO: 382364 - RNA, 19 nt, Homo sapiens
ccauaauacucucagauag

SEQ ID NO: 382365 - RNA, 19 nt, Homo sapiens
gaaugaauuugugcuuaca

SEQ ID NO: 382366 - RNA, 19 nt, Homo sapiens
ugaaggcgguggugaucaa

SEQ ID NO: 382367 - RNA, 19 nt, Homo sapiens
gugaaaguagcagaaauua

SEQ ID NO: 382368 - RNA, 19 nt, Homo sapiens
ccagcaaggaacauauuua

SEQ ID NO: 382369 - RNA, 19 nt, Homo sapiens
cagagucuauagcaaauca

SEQ ID NO: 382370 - RNA, 19 nt, Homo sapiens
gauggccgcuccagcuuuc

SEQ ID NO: 382371 - RNA, 19 nt, Homo sapiens
aauggacacuggaguagaa

SEQ ID NO: 382372 - RNA, 19 nt, Homo sapiens
cagcaaggaacauauuuau

SEQ ID NO: 382373 - RNA, 19 nt, Homo sapiens
gaagguggaaaguuugguu

SEQ ID NO: 382374 - RNA, 19 nt, Homo sapiens
ggauaaugcuacuaaaaga

SEQ ID NO: 382375 - RNA, 19 nt, Homo sapiens
aagcagaaccuccuucaga

SEQ ID NO: 382376 - RNA, 19 nt, Homo sapiens
gcagaaauuacagagcuaa

SEQ ID NO: 382377 - RNA, 19 nt, Homo sapiens
ggugggauaaugcuacuaa

SEQ ID NO: 382378 - RNA, 19 nt, Homo sapiens
gaaguaacacuguauacac

SEQ ID NO: 382379 - RNA, 19 nt, Homo sapiens
ggagaugaaguaacacugu

SEQ ID NO: 382380 - RNA, 19 nt, Homo sapiens
ccaguccaguggugggaua

SEQ ID NO: 382381 - RNA, 19 nt, Homo sapiens
ugaugucucuguccaagga

SEQ ID NO: 382382 - RNA, 19 nt, Homo sapiens
ugaaucgacucauggaaag

SEQ ID NO: 382383 - RNA, 19 nt, Homo sapiens
ugaaugaauuugugcuuac

SEQ ID NO: 382384 - RNA, 19 nt, Homo sapiens
ugaagaagaagaaaugauc

SEQ ID NO: 382385 - RNA, 19 nt, Homo sapiens
cccauaauacucucagaua

SEQ ID NO: 382386 - RNA, 19 nt, Homo sapiens
gcuauggacuccuggaacu

SEQ ID NO: 382387 - RNA, 19 nt, Homo sapiens
caaguucugagaugcagua

SEQ ID NO: 382388 - RNA, 19 nt, Homo sapiens
cgagagauuuguacuaucc

SEQ ID NO: 382389 - RNA, 19 nt, Homo sapiens
ucuaagaaauucgaagugu

SEQ ID NO: 382390 - RNA, 19 nt, Homo sapiens
gaacuugugucuccaaaac

SEQ ID NO: 382391 - RNA, 19 nt, Homo sapiens
cagacaagaauccaaagaa

SEQ ID NO: 382392 - RNA, 19 nt, Homo sapiens
gaaccagacaagaauccaa

SEQ ID NO: 382393 - RNA, 19 nt, Homo sapiens
ggaaaaggccccuauugau

SEQ ID NO: 382394 - RNA, 19 nt, Homo sapiens
aagaucaaguucugagaug

SEQ ID NO: 382395 - RNA, 19 nt, Homo sapiens
gaaauacuuguugaaggaa

SEQ ID NO: 382396 - RNA, 19 nt, Homo sapiens
ucagaucucuuggugaagu

SEQ ID NO: 382397 - RNA, 19 nt, Homo sapiens
auaauacucucagauagug

SEQ ID NO: 382398 - RNA, 19 nt, Homo sapiens
uaccucggauguagaagaa

SEQ ID NO: 382399 - RNA, 19 nt, Homo sapiens
ucaaaggaucacagcauuu

SEQ ID NO: 382400 - RNA, 19 nt, Homo sapiens
acucucagauagugaagaa

SEQ ID NO: 382401 - RNA, 19 nt, Homo sapiens
gccaagaugcucccauaau

SEQ ID NO: 382402 - RNA, 19 nt, Homo sapiens
agcagaaccuccuucagaa

SEQ ID NO: 382403 - RNA, 19 nt, Homo sapiens
gagucucucuguguuguug

SEQ ID NO: 382404 - RNA, 19 nt, Homo sapiens
ugagaaggaagaugaugaa

SEQ ID NO: 382405 - RNA, 19 nt, Homo sapiens
uccuggaacugcccaaauu

SEQ ID NO: 382406 - RNA, 19 nt, Homo sapiens
acacagaccaccagugcaa

SEQ ID NO: 382407 - RNA, 19 nt, Homo sapiens
caagaugcucccauaauac

SEQ ID NO: 382408 - RNA, 19 nt, Homo sapiens
auugaaagcuuuggagaau

SEQ ID NO: 382409 - RNA, 19 nt, Homo sapiens
ugauugccaugaacaaaca

SEQ ID NO: 382410 - RNA, 19 nt, Homo sapiens
cauaauacucucagauagu

SEQ ID NO: 382411 - RNA, 19 nt, Homo sapiens
gcuaauauugaaagcuuug

SEQ ID NO: 382412 - RNA, 19 nt, Homo sapiens
ugugaaaguagcagaaauu

SEQ ID NO: 382413 - RNA, 19 nt, Homo sapiens
caucgagagauuuguacua

SEQ ID NO: 382414 - RNA, 19 nt, Homo sapiens
ggaucccaaugaacgagaa

SEQ ID NO: 382415 - RNA, 19 nt, Homo sapiens
cauggaaagaugucuaaga

SEQ ID NO: 382416 - RNA, 19 nt, Homo sapiens
gagucuauagcaaaucaaa

SEQ ID NO: 382417 - RNA, 19 nt, Homo sapiens
gaaaauagcugaagaacug

SEQ ID NO: 382418 - RNA, 19 nt, Homo sapiens
caaaguuucuucucaguuu

SEQ ID NO: 382419 - RNA, 19 nt, Homo sapiens
uaaagaagcugucaagaag

SEQ ID NO: 382420 - RNA, 19 nt, Homo sapiens
ggaagacaaguuugauuua

SEQ ID NO: 382421 - RNA, 19 nt, Homo sapiens
gaagugacauguacauucu

SEQ ID NO: 382422 - RNA, 19 nt, Homo sapiens
ugacugagcuggaagacaa

SEQ ID NO: 382423 - RNA, 19 nt, Homo sapiens
gaaggcagcugagcaaaca

SEQ ID NO: 382424 - RNA, 19 nt, Homo sapiens
gcagggaagaugaaaguua

SEQ ID NO: 382425 - RNA, 19 nt, Homo sapiens
gaugaagccucagguguaa

SEQ ID NO: 382426 - RNA, 19 nt, Homo sapiens
uagaauggcuacagaaaga

SEQ ID NO: 382427 - RNA, 19 nt, Homo sapiens
gaagagacaccaugccauu

SEQ ID NO: 382428 - RNA, 19 nt, Homo sapiens
ggacaucugccucaagaaa

SEQ ID NO: 382429 - RNA, 19 nt, Homo sapiens
ggagacagguugcuucagu

SEQ ID NO: 382430 - RNA, 19 nt, Homo sapiens
gcacauccuuaucaauaug

SEQ ID NO: 382431 - RNA, 19 nt, Homo sapiens
ggaugaagccucaggugua

SEQ ID NO: 382432 - RNA, 19 nt, Homo sapiens
cccauuaccugcuauauau

SEQ ID NO: 382433 - RNA, 19 nt, Homo sapiens
gaagacaaguuugauuuac

SEQ ID NO: 382434 - RNA, 19 nt, Homo sapiens
gaagaaggcagcugagcaa

SEQ ID NO: 382435 - RNA, 19 nt, Homo sapiens
gaacagaaacaagagaaga

SEQ ID NO: 382436 - RNA, 19 nt, Homo sapiens
ccacagaacagaaacaaga

SEQ ID NO: 382437 - RNA, 19 nt, Homo sapiens
ccacagcugucaucacguu

SEQ ID NO: 382438 - RNA, 19 nt, Homo sapiens
ggaauuugcaguugacuug

SEQ ID NO: 382439 - RNA, 19 nt, Homo sapiens
caagcucucucuaaggaaa

SEQ ID NO: 382440 - RNA, 19 nt, Homo sapiens
gaagagagagcgagcaaca

SEQ ID NO: 382441 - RNA, 19 nt, Homo sapiens
gaaaagcucuugaauuguc

SEQ ID NO: 382442 - RNA, 19 nt, Homo sapiens
gcugagagauuggagaaug

SEQ ID NO: 382443 - RNA, 19 nt, Homo sapiens
uaaagugacugagcuggaa

SEQ ID NO: 382444 - RNA, 19 nt, Homo sapiens
cuaaagaagcugucaagaa

SEQ ID NO: 382445 - RNA, 19 nt, Homo sapiens
gcugucaucacguuauuua

SEQ ID NO: 382446 - RNA, 19 nt, Homo sapiens
gcucaagucugaaguugca

SEQ ID NO: 382447 - RNA, 19 nt, Homo sapiens
cugaagaacugccuaagga

SEQ ID NO: 382448 - RNA, 19 nt, Homo sapiens
gcucuugaauugucaggaa

SEQ ID NO: 382449 - RNA, 19 nt, Homo sapiens
cgacagcuuugugaaguuu

SEQ ID NO: 382450 - RNA, 19 nt, Homo sapiens
ucagaaaccucucccucaa

SEQ ID NO: 382451 - RNA, 19 nt, Homo sapiens
gaagaagcaccuuaacaca

SEQ ID NO: 382452 - RNA, 19 nt, Homo sapiens
ccgaggagaugcucagcua

SEQ ID NO: 382453 - RNA, 19 nt, Homo sapiens
gacauagaauggcuacaga

SEQ ID NO: 382454 - RNA, 19 nt, Homo sapiens
ggaaacagcaaauccaaag

SEQ ID NO: 382455 - RNA, 19 nt, Homo sapiens
aagaagcugucaagaagaa

SEQ ID NO: 382456 - RNA, 19 nt, Homo sapiens
caaacccaaugcucagaaa

SEQ ID NO: 382457 - RNA, 19 nt, Homo sapiens
cauuaaggaucgaaguaaa

SEQ ID NO: 382458 - RNA, 19 nt, Homo sapiens
gacagaggcuucagguaca

SEQ ID NO: 382459 - RNA, 19 nt, Homo sapiens
gaagaaacgacucaaaauu

SEQ ID NO: 382460 - RNA, 19 nt, Homo sapiens
gaugaaaguuacggauaug

SEQ ID NO: 382461 - RNA, 19 nt, Homo sapiens
gaucaucuccugaaacucu

SEQ ID NO: 382462 - RNA, 19 nt, Homo sapiens
acgaaaagcucuugaauug

SEQ ID NO: 382463 - RNA, 19 nt, Homo sapiens
caaaccacaugaugcugaa

SEQ ID NO: 382464 - RNA, 19 nt, Homo sapiens
ugacacccauuaccugcua

SEQ ID NO: 382465 - RNA, 19 nt, Homo sapiens
gcagaugcagugcuucaaa

SEQ ID NO: 382466 - RNA, 19 nt, Homo sapiens
uaaugaaccuagugcugaa

SEQ ID NO: 382467 - RNA, 19 nt, Homo sapiens
gcaacaagcgacccaagga

SEQ ID NO: 382468 - RNA, 19 nt, Homo sapiens
agaagcaccuuaacacaca

SEQ ID NO: 382469 - RNA, 19 nt, Homo sapiens
gagacaccaugccauuuca

SEQ ID NO: 382470 - RNA, 19 nt, Homo sapiens
gaccucagcucaaguuucg

SEQ ID NO: 382471 - RNA, 19 nt, Homo sapiens
ggcagcagaucaacgaaau

SEQ ID NO: 382472 - RNA, 19 nt, Homo sapiens
gauauguacugccaaacca

SEQ ID NO: 382473 - RNA, 19 nt, Homo sapiens
gggugucgcagcaacauua

SEQ ID NO: 382474 - RNA, 19 nt, Homo sapiens
gcaaauccaaaguuucuuc

SEQ ID NO: 382475 - RNA, 19 nt, Homo sapiens
gaacaucauggaguccuuu

SEQ ID NO: 382476 - RNA, 19 nt, Homo sapiens
gucaucacguuauuuaaug

SEQ ID NO: 382477 - RNA, 19 nt, Homo sapiens
gguaccacaugccugauug

SEQ ID NO: 382478 - RNA, 19 nt, Homo sapiens
gaaaguuacggauauguac

SEQ ID NO: 382479 - RNA, 19 nt, Homo sapiens
agaugaaaguuacggauau

SEQ ID NO: 382480 - RNA, 19 nt, Homo sapiens
auacagaccuauagaagag

SEQ ID NO: 382481 - RNA, 19 nt, Homo sapiens
cagcucaaguuucgagaga

SEQ ID NO: 382482 - RNA, 19 nt, Homo sapiens
aaacagcaaauccaaaguu

SEQ ID NO: 382483 - RNA, 19 nt, Homo sapiens
gcccagugcugagagauug

SEQ ID NO: 382484 - RNA, 19 nt, Homo sapiens
aaaugaggcuggagaugug

SEQ ID NO: 382485 - RNA, 19 nt, Homo sapiens
ugaccugccugaugcaaau

SEQ ID NO: 382486 - RNA, 19 nt, Homo sapiens
uugcacauccuuaucaaua

SEQ ID NO: 382487 - RNA, 19 nt, Homo sapiens
acacaccauuucuuccuaa

SEQ ID NO: 382488 - RNA, 19 nt, Homo sapiens
ccucagguguaaacaagaa

SEQ ID NO: 382489 - RNA, 19 nt, Homo sapiens
aacagcaaauccaaaguuu

SEQ ID NO: 382490 - RNA, 19 nt, Homo sapiens
gcgagccucuucccugaug

SEQ ID NO: 382491 - RNA, 19 nt, Homo sapiens
ugaaaguuacggauaugua

SEQ ID NO: 382492 - RNA, 19 nt, Homo sapiens
ggaugaguccuaccuugaa

SEQ ID NO: 382493 - RNA, 19 nt, Homo sapiens
caaaugcuggugcugcuuu

SEQ ID NO: 382494 - RNA, 19 nt, Homo sapiens
gcagaguaaugcaguacca

SEQ ID NO: 382495 - RNA, 19 nt, Homo sapiens
acaucugccucaagaaauu

SEQ ID NO: 382496 - RNA, 19 nt, Homo sapiens
caacguggacucaaacaag

SEQ ID NO: 382497 - RNA, 19 nt, Homo sapiens
gagaagaaacgacucaaaa

SEQ ID NO: 382498 - RNA, 19 nt, Homo sapiens
cagggaagaugaaaguuac

SEQ ID NO: 382499 - RNA, 19 nt, Homo sapiens
ggacucaaacaagcaauau

SEQ ID NO: 382500 - RNA, 19 nt, Homo sapiens
uggaagacaaguuugauuu

SEQ ID NO: 382501 - RNA, 19 nt, Homo sapiens
cagcugucaucacguuauu

SEQ ID NO: 382502 - RNA, 19 nt, Homo sapiens
gacuuuggguuguauguag

SEQ ID NO: 382503 - RNA, 19 nt, Homo sapiens
cauagaauggcuacagaaa

SEQ ID NO: 382504 - RNA, 19 nt, Homo sapiens
cgaagugacauguacauuc

SEQ ID NO: 382505 - RNA, 19 nt, Homo sapiens
gacaccaugccauuucaua

SEQ ID NO: 382506 - RNA, 19 nt, Homo sapiens
gcucaaguuucgagagaag

SEQ ID NO: 382507 - RNA, 19 nt, Homo sapiens
ugaugccaaugauguaauu

SEQ ID NO: 382508 - RNA, 19 nt, Homo sapiens
acaacuggccacagagaua

SEQ ID NO: 382509 - RNA, 19 nt, Homo sapiens
aauccaaaguuucuucuca

SEQ ID NO: 382510 - RNA, 19 nt, Homo sapiens
guacaacuggccacagaga

SEQ ID NO: 382511 - RNA, 19 nt, Homo sapiens
cagcaaauccaaaguuucu

SEQ ID NO: 382512 - RNA, 19 nt, Homo sapiens
caucauggaguccuuugaa

SEQ ID NO: 382513 - RNA, 19 nt, Homo sapiens
caagagaagaaacgacuca

SEQ ID NO: 382514 - RNA, 19 nt, Homo sapiens
gaaacaagagaagaaacga

SEQ ID NO: 382515 - RNA, 19 nt, Homo sapiens
cauuuaggaugaucagcaa

SEQ ID NO: 382516 - RNA, 19 nt, Homo sapiens
caacgaaaugcaccuuuua

SEQ ID NO: 382517 - RNA, 19 nt, Homo sapiens
uaaugaagcuguucugaua

SEQ ID NO: 382518 - RNA, 19 nt, Homo sapiens
gaacucgacugauguuuga

SEQ ID NO: 382519 - RNA, 19 nt, Homo sapiens
ggaaaucauuggucaguuu

SEQ ID NO: 382520 - RNA, 19 nt, Homo sapiens
ggauguaaauuucgaguuu

SEQ ID NO: 382521 - RNA, 19 nt, Homo sapiens
gaagauaccggauguaaau

SEQ ID NO: 382522 - RNA, 19 nt, Homo sapiens
ugaaagggcuaaacugauu

SEQ ID NO: 382523 - RNA, 19 nt, Homo sapiens
gaauaaagcaguuacauca

SEQ ID NO: 382524 - RNA, 19 nt, Homo sapiens
gcacuuccguggauucuga

SEQ ID NO: 382525 - RNA, 19 nt, Homo sapiens
gaacagaauuacaggaagu

SEQ ID NO: 382526 - RNA, 19 nt, Homo sapiens
ggaaggaguucaacagaca

SEQ ID NO: 382527 - RNA, 19 nt, Homo sapiens
gagcggagguggagaagga

SEQ ID NO: 382528 - RNA, 19 nt, Homo sapiens
ggacgucgaugaacugauc

SEQ ID NO: 382529 - RNA, 19 nt, Homo sapiens
gggcuaaacugauuuccuu

SEQ ID NO: 382530 - RNA, 19 nt, Homo sapiens
gaaaucauuggucaguuua

SEQ ID NO: 382531 - RNA, 19 nt, Homo sapiens
gcaguuacaucaugaagca

SEQ ID NO: 382532 - RNA, 19 nt, Homo sapiens
ggaagucggugaugauugg

SEQ ID NO: 382533 - RNA, 19 nt, Homo sapiens
uaaagcaguuacaucauga

SEQ ID NO: 382534 - RNA, 19 nt, Homo sapiens
cauaaggaauuucaaagga

SEQ ID NO: 382535 - RNA, 19 nt, Homo sapiens
ggucuuacaugcauacugu

SEQ ID NO: 382536 - RNA, 19 nt, Homo sapiens
gaagucaguccaucagauu

SEQ ID NO: 382537 - RNA, 19 nt, Homo sapiens
ggaagucaguccaucagau

SEQ ID NO: 382538 - RNA, 19 nt, Homo sapiens
gcugagagcucgaguacag

SEQ ID NO: 382539 - RNA, 19 nt, Homo sapiens
caauguuacuccagauaaa

SEQ ID NO: 382540 - RNA, 19 nt, Homo sapiens
caucucagguuucauuuca

SEQ ID NO: 382541 - RNA, 19 nt, Homo sapiens
gcuuaacucugaaacauca

SEQ ID NO: 382542 - RNA, 19 nt, Homo sapiens
ccacggacgagaaguauaa

SEQ ID NO: 382543 - RNA, 19 nt, Homo sapiens
gauguggacugccauucaa

SEQ ID NO: 382544 - RNA, 19 nt, Homo sapiens
caagcgagaugaagaaacu

SEQ ID NO: 382545 - RNA, 19 nt, Homo sapiens
gauaccggauguaaauuuc

SEQ ID NO: 382546 - RNA, 19 nt, Homo sapiens
ugacaaaggcguccugaga

SEQ ID NO: 382547 - RNA, 19 nt, Homo sapiens
ggaagauaccggauguaaa

SEQ ID NO: 382548 - RNA, 19 nt, Homo sapiens
ugaaugaggucuaccacau

SEQ ID NO: 382549 - RNA, 19 nt, Homo sapiens
acacaucacacccauuuaa

SEQ ID NO: 382550 - RNA, 19 nt, Homo sapiens
gguuggaacucgacugaug

SEQ ID NO: 382551 - RNA, 19 nt, Homo sapiens
ggauguugaagguaacuua

SEQ ID NO: 382552 - RNA, 19 nt, Homo sapiens
gaaagggcuaaacugauuu

SEQ ID NO: 382553 - RNA, 19 nt, Homo sapiens
cagaauuacaggaaguuua

SEQ ID NO: 382554 - RNA, 19 nt, Homo sapiens
ccaggaagauaccggaugu

SEQ ID NO: 382555 - RNA, 19 nt, Homo sapiens
gaaaauaucggcucugugu

SEQ ID NO: 382556 - RNA, 19 nt, Homo sapiens
ggaauauuaagaaggagua

SEQ ID NO: 382557 - RNA, 19 nt, Homo sapiens
ggaacucgacugauguuug

SEQ ID NO: 382558 - RNA, 19 nt, Homo sapiens
ucaagcagccgaagaugaa

SEQ ID NO: 382559 - RNA, 19 nt, Homo sapiens
cgacaccaguauccauuug

SEQ ID NO: 382560 - RNA, 19 nt, Homo sapiens
aaauaucggcucuguguuu

SEQ ID NO: 382561 - RNA, 19 nt, Homo sapiens
gaaggaguaugccaaaaug

SEQ ID NO: 382562 - RNA, 19 nt, Homo sapiens
auaaagcaguuacaucaug

SEQ ID NO: 382563 - RNA, 19 nt, Homo sapiens
gcuaaggccaucaaaccua

SEQ ID NO: 382564 - RNA, 19 nt, Homo sapiens
aaagauuuguccuggagaa

SEQ ID NO: 382565 - RNA, 19 nt, Homo sapiens
gggaacagaauuacaggaa

SEQ ID NO: 382566 - RNA, 19 nt, Homo sapiens
auuaaggacuggagaagaa

SEQ ID NO: 382567 - RNA, 19 nt, Homo sapiens
uaagaaggaguaugccaaa

SEQ ID NO: 382568 - RNA, 19 nt, Homo sapiens
cuaaggccaucaaaccuau

SEQ ID NO: 382569 - RNA, 19 nt, Homo sapiens
caguuuaaccugggauuua

SEQ ID NO: 382570 - RNA, 19 nt, Homo sapiens
ugauaggaauguuugauag

SEQ ID NO: 382571 - RNA, 19 nt, Homo sapiens
aaagugaucuugagaaccu

SEQ ID NO: 382572 - RNA, 19 nt, Homo sapiens
agccgaagaugaacuaaga

SEQ ID NO: 382573 - RNA, 19 nt, Homo sapiens
gaaguuuagggcaaagauu

SEQ ID NO: 382574 - RNA, 19 nt, Homo sapiens
gcaggaacauguggacucu

SEQ ID NO: 382575 - RNA, 19 nt, Homo sapiens
gcaugcagcggauuuggaa

SEQ ID NO: 382576 - RNA, 19 nt, Homo sapiens
uaggaauguuugauaguga

SEQ ID NO: 382577 - RNA, 19 nt, Homo sapiens
uuacaucucagguuucauu

SEQ ID NO: 382578 - RNA, 19 nt, Homo sapiens
gcaggcauccguguaaguu

SEQ ID NO: 382579 - RNA, 19 nt, Homo sapiens
gcaguuauuuuccacacua

SEQ ID NO: 382580 - RNA, 19 nt, Homo sapiens
ucaagaguuugccgaccua

SEQ ID NO: 382581 - RNA, 19 nt, Homo sapiens
gucacuguauggaauaauu

SEQ ID NO: 382582 - RNA, 19 nt, Homo sapiens
auacacaucacacccauuu

SEQ ID NO: 382583 - RNA, 19 nt, Homo sapiens
cguagucacuguauggaau

SEQ ID NO: 382584 - RNA, 19 nt, Homo sapiens
cuaaacgaauaaagcaguu

SEQ ID NO: 382585 - RNA, 19 nt, Homo sapiens
gauguugaagguaacuuaa

SEQ ID NO: 382586 - RNA, 19 nt, Homo sapiens
gaaugaggucuaccacaug

SEQ ID NO: 382587 - RNA, 19 nt, Homo sapiens
gaucacaaugggaaaauua

SEQ ID NO: 382588 - RNA, 19 nt, Homo sapiens
gcucauagcaccucagacu

SEQ ID NO: 382589 - RNA, 19 nt, Homo sapiens
gaucggguguugcauccau

SEQ ID NO: 382590 - RNA, 19 nt, Homo sapiens
agaaagaggcagugaguuc

SEQ ID NO: 382591 - RNA, 19 nt, Homo sapiens
ucaauguuacuccagauaa

SEQ ID NO: 382592 - RNA, 19 nt, Homo sapiens
uucgaaggcuuaacucuga

SEQ ID NO: 382593 - RNA, 19 nt, Homo sapiens
gauguuugcagaaauggaa

SEQ ID NO: 382594 - RNA, 19 nt, Homo sapiens
gggcagaagcaguugcaaa

SEQ ID NO: 382595 - RNA, 19 nt, Homo sapiens
ugagcgaugucaccauuuc

SEQ ID NO: 382596 - RNA, 19 nt, Homo sapiens
guagucacuguauggaaua

SEQ ID NO: 382597 - RNA, 19 nt, Homo sapiens
cugauuuccuugccaacua

SEQ ID NO: 382598 - RNA, 19 nt, Homo sapiens
gguugaaacuuuuggcuuu

SEQ ID NO: 382599 - RNA, 19 nt, Homo sapiens
gagaugaagaaacugauca

SEQ ID NO: 382600 - RNA, 19 nt, Homo sapiens
ccucagacucucaacuuaa

SEQ ID NO: 382601 - RNA, 19 nt, Homo sapiens
caaacugaaugaggauauc

SEQ ID NO: 382602 - RNA, 19 nt, Homo sapiens
ugauguagcugugaaaauu

SEQ ID NO: 382603 - RNA, 19 nt, Homo sapiens
ccaagaaggagcccucuag

SEQ ID NO: 382604 - RNA, 19 nt, Homo sapiens
gaucaauccccuucauuaa

SEQ ID NO: 382605 - RNA, 19 nt, Homo sapiens
gaugucaacaagcuaaaug

SEQ ID NO: 382606 - RNA, 19 nt, Homo sapiens
acaccaguauccauuuguu

SEQ ID NO: 382607 - RNA, 19 nt, Homo sapiens
ucugcagacucgugaauga

SEQ ID NO: 382608 - RNA, 19 nt, Homo sapiens
ggaguuggaaggaguucaa

SEQ ID NO: 382609 - RNA, 19 nt, Homo sapiens
gacagagucuucacuaacc

SEQ ID NO: 382610 - RNA, 19 nt, Homo sapiens
cgaauaaagcaguuacauc

SEQ ID NO: 382611 - RNA, 19 nt, Homo sapiens
caugucagccucucagguu

SEQ ID NO: 382612 - RNA, 19 nt, Homo sapiens
gaaaagcccaugguagaaa

SEQ ID NO: 382613 - RNA, 19 nt, Homo sapiens
ccagauaaaaggcaaauuu

SEQ ID NO: 382614 - RNA, 19 nt, Homo sapiens
caaaaugguccaggucuua

SEQ ID NO: 382615 - RNA, 19 nt, Homo sapiens
gaagaugaacuaagaaaag

SEQ ID NO: 382616 - RNA, 19 nt, Homo sapiens
acaggaaguuuagggcaaa

SEQ ID NO: 382617 - RNA, 19 nt, Homo sapiens
gcacuaaagucuacaucua

SEQ ID NO: 382618 - RNA, 19 nt, Homo sapiens
ggacugaucuuccauuucu

SEQ ID NO: 382619 - RNA, 19 nt, Homo sapiens
gaaagaaaggcacauguuu

SEQ ID NO: 382620 - RNA, 19 nt, Homo sapiens
guucuuaucucuauaguga

SEQ ID NO: 382621 - RNA, 19 nt, Homo sapiens
gaaaggcacauguuuaaga

SEQ ID NO: 382622 - RNA, 19 nt, Homo sapiens
gaaacuauuugaggcuaua

SEQ ID NO: 382623 - RNA, 19 nt, Homo sapiens
ucacuuagcaggaauauga

SEQ ID NO: 382624 - RNA, 19 nt, Homo sapiens
ggaauaccauuuagucauc

SEQ ID NO: 382625 - RNA, 19 nt, Homo sapiens
gcaggaauaugaaagaaag

SEQ ID NO: 382626 - RNA, 19 nt, Homo sapiens
gagccaugcuagccaauaa

SEQ ID NO: 382627 - RNA, 19 nt, Homo sapiens
ggaacaagccuucuucugu

SEQ ID NO: 382628 - RNA, 19 nt, Homo sapiens
aaagaaaggcacauguuua

SEQ ID NO: 382629 - RNA, 19 nt, Homo sapiens
cauuaaagccacagaauaa

SEQ ID NO: 382630 - RNA, 19 nt, Homo sapiens
gaaaugcugauacaucuga

SEQ ID NO: 382631 - RNA, 19 nt, Homo sapiens
gaguaaggaauaccauuua

SEQ ID NO: 382632 - RNA, 19 nt, Homo sapiens
ccacuguucuuaucucuau

SEQ ID NO: 382633 - RNA, 19 nt, Homo sapiens
caacauggccaacagcauu

SEQ ID NO: 382634 - RNA, 19 nt, Homo sapiens
ggacuugaccaacuacauu

SEQ ID NO: 382635 - RNA, 19 nt, Homo sapiens
gagaugcacacuuauauau

SEQ ID NO: 382636 - RNA, 19 nt, Homo sapiens
uuagggaucuugcugcuuu

SEQ ID NO: 382637 - RNA, 19 nt, Homo sapiens
uaaacaggccuaagaagaa

SEQ ID NO: 382638 - RNA, 19 nt, Homo sapiens
agaaggagauugugaugga

SEQ ID NO: 382639 - RNA, 19 nt, Homo sapiens
auaauucccuuucucauug

SEQ ID NO: 382640 - RNA, 19 nt, Homo sapiens
caccuauccugcucuguua

SEQ ID NO: 382641 - RNA, 19 nt, Homo sapiens
aaacaggccuaagaagaaa

SEQ ID NO: 382642 - RNA, 19 nt, Homo sapiens
gcugauacaucugaucuau

SEQ ID NO: 382643 - RNA, 19 nt, Homo sapiens
aaagcgccauggcuacuua

SEQ ID NO: 382644 - RNA, 19 nt, Homo sapiens
uuagagagaguaaggaaua

SEQ ID NO: 382645 - RNA, 19 nt, Homo sapiens
aagaaaggcacauguuuaa

SEQ ID NO: 382646 - RNA, 19 nt, Homo sapiens
ggccaaggaauauaguuua

SEQ ID NO: 382647 - RNA, 19 nt, Homo sapiens
gaagaaggagauugugaug

SEQ ID NO: 382648 - RNA, 19 nt, Homo sapiens
gcuauagauuuaagcuuga

SEQ ID NO: 382649 - RNA, 19 nt, Homo sapiens
ggaaccaggugccaacagu

SEQ ID NO: 382650 - RNA, 19 nt, Homo sapiens
gagagaggaagagaaauuu

SEQ ID NO: 382651 - RNA, 19 nt, Homo sapiens
gugaaaugcugauacaucu

SEQ ID NO: 382652 - RNA, 19 nt, Homo sapiens
ccugagcucuggugaaaug

SEQ ID NO: 382653 - RNA, 19 nt, Homo sapiens
uagggcagcuguuugagaa

SEQ ID NO: 382654 - RNA, 19 nt, Homo sapiens
uaaagccacagaauaauug

SEQ ID NO: 382655 - RNA, 19 nt, Homo sapiens
acacaaagagugaguucua

SEQ ID NO: 382656 - RNA, 19 nt, Homo sapiens
agaaagcagcgaaggaaua

SEQ ID NO: 382657 - RNA, 19 nt, Homo sapiens
ucuauccguucuucacuua

SEQ ID NO: 382658 - RNA, 19 nt, Homo sapiens
gaaagcagcgaaggaauag

SEQ ID NO: 382659 - RNA, 19 nt, Homo sapiens
ggaggaagaaggagauugu

SEQ ID NO: 382660 - RNA, 19 nt, Homo sapiens
cacaaagagugaguucuaa

SEQ ID NO: 382661 - RNA, 19 nt, Homo sapiens
gacugaaggccaaggaaua

SEQ ID NO: 382662 - RNA, 19 nt, Homo sapiens
uaauacaucugcaagacau

SEQ ID NO: 382663 - RNA, 19 nt, Homo sapiens
caggacugaucuuccauuu

SEQ ID NO: 382664 - RNA, 19 nt, Homo sapiens
cauaauucccuuucucauu

SEQ ID NO: 382665 - RNA, 19 nt, Homo sapiens
ggaagaaggagauugugau

SEQ ID NO: 382666 - RNA, 19 nt, Homo sapiens
ggaauugcaguuagagaga

SEQ ID NO: 382667 - RNA, 19 nt, Homo sapiens
ucauuaaagccacagaaua

SEQ ID NO: 382668 - RNA, 19 nt, Homo sapiens
ugagagaggaagagaaauu

SEQ ID NO: 382669 - RNA, 19 nt, Homo sapiens
ugaaugauuugcugucaca

SEQ ID NO: 382670 - RNA, 19 nt, Homo sapiens
gaagcuacagauuauauca

SEQ ID NO: 382671 - RNA, 19 nt, Homo sapiens
guaauuacaggcuccuauu

SEQ ID NO: 382672 - RNA, 19 nt, Homo sapiens
uaauuaaacaggccuaaga

SEQ ID NO: 382673 - RNA, 19 nt, Homo sapiens
caaggaauauaguuuacag

SEQ ID NO: 382674 - RNA, 19 nt, Homo sapiens
ccacaugugccaacaauag

SEQ ID NO: 382675 - RNA, 19 nt, Homo sapiens
gugcaggugugguuucaga

SEQ ID NO: 382676 - RNA, 19 nt, Homo sapiens
ccacagcguuugguguuga

SEQ ID NO: 382677 - RNA, 19 nt, Homo sapiens
gaauccugcucucuaauac

SEQ ID NO: 382678 - RNA, 19 nt, Homo sapiens
gagaacaggucccauuuuc

SEQ ID NO: 382679 - RNA, 19 nt, Homo sapiens
gcaaucaaucaaucaauca

SEQ ID NO: 382680 - RNA, 19 nt, Homo sapiens
ggccuaagaagaaaucaaa

SEQ ID NO: 382681 - RNA, 19 nt, Homo sapiens
ggaauaggacaaccuucaa

SEQ ID NO: 382682 - RNA, 19 nt, Homo sapiens
gacuugaccaacuacauua

SEQ ID NO: 382683 - RNA, 19 nt, Homo sapiens
ugucacagacuauuuggua

SEQ ID NO: 382684 - RNA, 19 nt, Homo sapiens
ugaaagaaaggcacauguu

SEQ ID NO: 382685 - RNA, 19 nt, Homo sapiens
ugagaugcacacuuauaua

SEQ ID NO: 382686 - RNA, 19 nt, Homo sapiens
ccucuacuguccucauuga

SEQ ID NO: 382687 - RNA, 19 nt, Homo sapiens
cagacuauuugguagaaga

SEQ ID NO: 382688 - RNA, 19 nt, Homo sapiens
ugucugauccaauguaauu

SEQ ID NO: 382689 - RNA, 19 nt, Homo sapiens
caaacaaagcagaacuaaa

SEQ ID NO: 382690 - RNA, 19 nt, Homo sapiens
gaauaggacaaccuucaau

SEQ ID NO: 382691 - RNA, 19 nt, Homo sapiens
uaagaggaauaccuaaagg

SEQ ID NO: 382692 - RNA, 19 nt, Homo sapiens
guucuucacuuagcaggaa

SEQ ID NO: 382693 - RNA, 19 nt, Homo sapiens
gcaauuucccaaacaauac

SEQ ID NO: 382694 - RNA, 19 nt, Homo sapiens
ccagaaugauugccucuac

SEQ ID NO: 382695 - RNA, 19 nt, Homo sapiens
uuaaacaggccuaagaaga

SEQ ID NO: 382696 - RNA, 19 nt, Homo sapiens
agaauccugcucucuaaua

SEQ ID NO: 382697 - RNA, 19 nt, Homo sapiens
gcacauguuuaagaggaau

SEQ ID NO: 382698 - RNA, 19 nt, Homo sapiens
uaaggaauaccauuuaguc

SEQ ID NO: 382699 - RNA, 19 nt, Homo sapiens
caugggaauugcaguuaga

SEQ ID NO: 382700 - RNA, 19 nt, Homo sapiens
caccaccacuuguuucugu

SEQ ID NO: 382701 - RNA, 19 nt, Homo sapiens
aauaggacaaccuucaaua

SEQ ID NO: 382702 - RNA, 19 nt, Homo sapiens
gaacucuugccugggaaua

SEQ ID NO: 382703 - RNA, 19 nt, Homo sapiens
gagaguaaggaauaccauu

SEQ ID NO: 382704 - RNA, 19 nt, Homo sapiens
ggugaaaugcugauacauc

SEQ ID NO: 382705 - RNA, 19 nt, Homo sapiens
cacuaaagucuacaucuaa

SEQ ID NO: 382706 - RNA, 19 nt, Homo sapiens
gugcuggacagacauaauu

SEQ ID NO: 382707 - RNA, 19 nt, Homo sapiens
cuacuguccucauugacuu

SEQ ID NO: 382708 - RNA, 19 nt, Homo sapiens
gcucuguuauuucuucauc

SEQ ID NO: 382709 - RNA, 19 nt, Homo sapiens
ccucgucccucccaagaug

SEQ ID NO: 382710 - RNA, 19 nt, Homo sapiens
aaaggcacauguuuaagag

SEQ ID NO: 382711 - RNA, 19 nt, Homo sapiens
uagcaggaauaugaaagaa

SEQ ID NO: 382712 - RNA, 19 nt, Homo sapiens
ccucaccacuguucuuauc

SEQ ID NO: 382713 - RNA, 19 nt, Homo sapiens
cuucccaguucucuuuaua

SEQ ID NO: 382714 - RNA, 19 nt, Homo sapiens
agaguaaggaauaccauuu

SEQ ID NO: 382715 - RNA, 19 nt, Homo sapiens
ugauagggcagcuguuuga

SEQ ID NO: 382716 - RNA, 19 nt, Homo sapiens
gacauaauucccuuucuca

SEQ ID NO: 382717 - RNA, 19 nt, Homo sapiens
gcacuaaagucuacaucua

SEQ ID NO: 382718 - RNA, 19 nt, Homo sapiens
ggacugaucuuccauuucu

SEQ ID NO: 382719 - RNA, 19 nt, Homo sapiens
gaaagaaaggcacauguuu

SEQ ID NO: 382720 - RNA, 19 nt, Homo sapiens
guucuuaucucuauaguga

SEQ ID NO: 382721 - RNA, 19 nt, Homo sapiens
gaaaggcacauguuuaaga

SEQ ID NO: 382722 - RNA, 19 nt, Homo sapiens
gaaacuauuugaggcuaua

SEQ ID NO: 382723 - RNA, 19 nt, Homo sapiens
ucacuuagcaggaauauga

SEQ ID NO: 382724 - RNA, 19 nt, Homo sapiens
ggaauaccauuuagucauc

SEQ ID NO: 382725 - RNA, 19 nt, Homo sapiens
gcaggaauaugaaagaaag

SEQ ID NO: 382726 - RNA, 19 nt, Homo sapiens
gagccaugcuagccaauaa

SEQ ID NO: 382727 - RNA, 19 nt, Homo sapiens
ggaacaagccuucuucugu

SEQ ID NO: 382728 - RNA, 19 nt, Homo sapiens
aaagaaaggcacauguuua

SEQ ID NO: 382729 - RNA, 19 nt, Homo sapiens
cauuaaagccacagaauaa

SEQ ID NO: 382730 - RNA, 19 nt, Homo sapiens
gaaaugcugauacaucuga

SEQ ID NO: 382731 - RNA, 19 nt, Homo sapiens
gaguaaggaauaccauuua

SEQ ID NO: 382732 - RNA, 19 nt, Homo sapiens
ccacuguucuuaucucuau

SEQ ID NO: 382733 - RNA, 19 nt, Homo sapiens
caacauggccaacagcauu

SEQ ID NO: 382734 - RNA, 19 nt, Homo sapiens
ggacuugaccaacuacauu

SEQ ID NO: 382735 - RNA, 19 nt, Homo sapiens
gagaugcacacuuauauau

SEQ ID NO: 382736 - RNA, 19 nt, Homo sapiens
uuagggaucuugcugcuuu

SEQ ID NO: 382737 - RNA, 19 nt, Homo sapiens
uaaacaggccuaagaagaa

SEQ ID NO: 382738 - RNA, 19 nt, Homo sapiens
agaaggagauugugaugga

SEQ ID NO: 382739 - RNA, 19 nt, Homo sapiens
auaauucccuuucucauug

SEQ ID NO: 382740 - RNA, 19 nt, Homo sapiens
caccuauccugcucuguua

SEQ ID NO: 382741 - RNA, 19 nt, Homo sapiens
aaacaggccuaagaagaaa

SEQ ID NO: 382742 - RNA, 19 nt, Homo sapiens
gcugauacaucugaucuau

SEQ ID NO: 382743 - RNA, 19 nt, Homo sapiens
uuagagagaguaaggaaua

SEQ ID NO: 382744 - RNA, 19 nt, Homo sapiens
aagaaaggcacauguuuaa

SEQ ID NO: 382745 - RNA, 19 nt, Homo sapiens
ggccaaggaauauaguuua

SEQ ID NO: 382746 - RNA, 19 nt, Homo sapiens
gaagaaggagauugugaug

SEQ ID NO: 382747 - RNA, 19 nt, Homo sapiens
gcuauagauuuaagcuuga

SEQ ID NO: 382748 - RNA, 19 nt, Homo sapiens
ggaaccaggugccaacagu

SEQ ID NO: 382749 - RNA, 19 nt, Homo sapiens
gagagaggaagagaaauuu

SEQ ID NO: 382750 - RNA, 19 nt, Homo sapiens
gugaaaugcugauacaucu

SEQ ID NO: 382751 - RNA, 19 nt, Homo sapiens
ccugagcucuggugaaaug

SEQ ID NO: 382752 - RNA, 19 nt, Homo sapiens
uagggcagcuguuugagaa

SEQ ID NO: 382753 - RNA, 19 nt, Homo sapiens
uaaagccacagaauaauug

SEQ ID NO: 382754 - RNA, 19 nt, Homo sapiens
acacaaagagugaguucua

SEQ ID NO: 382755 - RNA, 19 nt, Homo sapiens
agaaagcagcgaaggaaua

SEQ ID NO: 382756 - RNA, 19 nt, Homo sapiens
ucuauccguucuucacuua

SEQ ID NO: 382757 - RNA, 19 nt, Homo sapiens
gaaagcagcgaaggaauag

SEQ ID NO: 382758 - RNA, 19 nt, Homo sapiens
ggaggaagaaggagauugu

SEQ ID NO: 382759 - RNA, 19 nt, Homo sapiens
cacaaagagugaguucuaa

SEQ ID NO: 382760 - RNA, 19 nt, Homo sapiens
gacugaaggccaaggaaua

SEQ ID NO: 382761 - RNA, 19 nt, Homo sapiens
uaauacaucugcaagacau

SEQ ID NO: 382762 - RNA, 19 nt, Homo sapiens
caggacugaucuuccauuu

SEQ ID NO: 382763 - RNA, 19 nt, Homo sapiens
cauaauucccuuucucauu

SEQ ID NO: 382764 - RNA, 19 nt, Homo sapiens
ggaagaaggagauugugau

SEQ ID NO: 382765 - RNA, 19 nt, Homo sapiens
ggaauugcaguuagagaga

SEQ ID NO: 382766 - RNA, 19 nt, Homo sapiens
ucauuaaagccacagaaua

SEQ ID NO: 382767 - RNA, 19 nt, Homo sapiens
ugagagaggaagagaaauu

SEQ ID NO: 382768 - RNA, 19 nt, Homo sapiens
ugaaugauuugcugucaca

SEQ ID NO: 382769 - RNA, 19 nt, Homo sapiens
gaagcuacagauuauauca

SEQ ID NO: 382770 - RNA, 19 nt, Homo sapiens
guaauuacaggcuccuauu

SEQ ID NO: 382771 - RNA, 19 nt, Homo sapiens
uaauuaaacaggccuaaga

SEQ ID NO: 382772 - RNA, 19 nt, Homo sapiens
caaggaauauaguuuacag

SEQ ID NO: 382773 - RNA, 19 nt, Homo sapiens
ccacaugugccaacaauag

SEQ ID NO: 382774 - RNA, 19 nt, Homo sapiens
gugcaggugugguuucaga

SEQ ID NO: 382775 - RNA, 19 nt, Homo sapiens
ccacagcguuugguguuga

SEQ ID NO: 382776 - RNA, 19 nt, Homo sapiens
gaauccugcucucuaauac

SEQ ID NO: 382777 - RNA, 19 nt, Homo sapiens
gagaacaggucccauuuuc

SEQ ID NO: 382778 - RNA, 19 nt, Homo sapiens
gcaaucaaucaaucaauca

SEQ ID NO: 382779 - RNA, 19 nt, Homo sapiens
ggccuaagaagaaaucaaa

SEQ ID NO: 382780 - RNA, 19 nt, Homo sapiens
ggaauaggacaaccuucaa

SEQ ID NO: 382781 - RNA, 19 nt, Homo sapiens
gacuugaccaacuacauua

SEQ ID NO: 382782 - RNA, 19 nt, Homo sapiens
ugucacagacuauuuggua

SEQ ID NO: 382783 - RNA, 19 nt, Homo sapiens
acagcgccauggcuacuua

SEQ ID NO: 382784 - RNA, 19 nt, Homo sapiens
ugaaagaaaggcacauguu

SEQ ID NO: 382785 - RNA, 19 nt, Homo sapiens
ugagaugcacacuuauaua

SEQ ID NO: 382786 - RNA, 19 nt, Homo sapiens
ccucuacuguccucauuga

SEQ ID NO: 382787 - RNA, 19 nt, Homo sapiens
cagacuauuugguagaaga

SEQ ID NO: 382788 - RNA, 19 nt, Homo sapiens
ugucugauccaauguaauu

SEQ ID NO: 382789 - RNA, 19 nt, Homo sapiens
caaacaaagcagaacuaaa

SEQ ID NO: 382790 - RNA, 19 nt, Homo sapiens
gaauaggacaaccuucaau

SEQ ID NO: 382791 - RNA, 19 nt, Homo sapiens
uaagaggaauaccuaaagg

SEQ ID NO: 382792 - RNA, 19 nt, Homo sapiens
guucuucacuuagcaggaa

SEQ ID NO: 382793 - RNA, 19 nt, Homo sapiens
gcaauuucccaaacaauac

SEQ ID NO: 382794 - RNA, 19 nt, Homo sapiens
ccagaaugauugccucuac

SEQ ID NO: 382795 - RNA, 19 nt, Homo sapiens
uuaaacaggccuaagaaga

SEQ ID NO: 382796 - RNA, 19 nt, Homo sapiens
agaauccugcucucuaaua

SEQ ID NO: 382797 - RNA, 19 nt, Homo sapiens
gcacauguuuaagaggaau

SEQ ID NO: 382798 - RNA, 19 nt, Homo sapiens
uaaggaauaccauuuaguc

SEQ ID NO: 382799 - RNA, 19 nt, Homo sapiens
caugggaauugcaguuaga

SEQ ID NO: 382800 - RNA, 19 nt, Homo sapiens
caccaccacuuguuucugu

SEQ ID NO: 382801 - RNA, 19 nt, Homo sapiens
aauaggacaaccuucaaua

SEQ ID NO: 382802 - RNA, 19 nt, Homo sapiens
gaacucuugccugggaaua

SEQ ID NO: 382803 - RNA, 19 nt, Homo sapiens
gagaguaaggaauaccauu

SEQ ID NO: 382804 - RNA, 19 nt, Homo sapiens
ggugaaaugcugauacauc

SEQ ID NO: 382805 - RNA, 19 nt, Homo sapiens
cacuaaagucuacaucuaa

SEQ ID NO: 382806 - RNA, 19 nt, Homo sapiens
gugcuggacagacauaauu

SEQ ID NO: 382807 - RNA, 19 nt, Homo sapiens
cuacuguccucauugacuu

SEQ ID NO: 382808 - RNA, 19 nt, Homo sapiens
gcucuguuauuucuucauc

SEQ ID NO: 382809 - RNA, 19 nt, Homo sapiens
aaaggcacauguuuaagag

SEQ ID NO: 382810 - RNA, 19 nt, Homo sapiens
uagcaggaauaugaaagaa

SEQ ID NO: 382811 - RNA, 19 nt, Homo sapiens
ccucaccacuguucuuauc

SEQ ID NO: 382812 - RNA, 19 nt, Homo sapiens
cuucccaguucucuuuaua

SEQ ID NO: 382813 - RNA, 19 nt, Homo sapiens
agaguaaggaauaccauuu

SEQ ID NO: 382814 - RNA, 19 nt, Homo sapiens
ugauagggcagcuguuuga

SEQ ID NO: 382815 - RNA, 19 nt, Homo sapiens
gacauaauucccuuucuca

SEQ ID NO: 382816 - RNA, 19 nt, Homo sapiens
ggagcaaaaugaaaauuag

SEQ ID NO: 382817 - RNA, 19 nt, Homo sapiens
gagcagaaguggcauauuu

SEQ ID NO: 382818 - RNA, 19 nt, Homo sapiens
ggaaaugccuggauguaaa

SEQ ID NO: 382819 - RNA, 19 nt, Homo sapiens
ggaagggacucgagacuuu

SEQ ID NO: 382820 - RNA, 19 nt, Homo sapiens
gcaagaaucuguucaaggu

SEQ ID NO: 382821 - RNA, 19 nt, Homo sapiens
ggagacuacuguuauuuga

SEQ ID NO: 382822 - RNA, 19 nt, Homo sapiens
ccaaacaacuuucaagaag

SEQ ID NO: 382823 - RNA, 19 nt, Homo sapiens
ggaaauaaaggaaacucua

SEQ ID NO: 382824 - RNA, 19 nt, Homo sapiens
ggaaagaccccuccauaua

SEQ ID NO: 382825 - RNA, 19 nt, Homo sapiens
ccaaugaauuugacucaga

SEQ ID NO: 382826 - RNA, 19 nt, Homo sapiens
caacccaacuuuaccuaga

SEQ ID NO: 382827 - RNA, 19 nt, Homo sapiens
gggcacaccugaauuaguc

SEQ ID NO: 382828 - RNA, 19 nt, Homo sapiens
gaaacucuaagcaguauga

SEQ ID NO: 382829 - RNA, 19 nt, Homo sapiens
caaaugaugugggccagaa

SEQ ID NO: 382830 - RNA, 19 nt, Homo sapiens
gcagauucaucaagcauca

SEQ ID NO: 382831 - RNA, 19 nt, Homo sapiens
gaacauucucucucagauu

SEQ ID NO: 382832 - RNA, 19 nt, Homo sapiens
gugggagcauccaagauua

SEQ ID NO: 382833 - RNA, 19 nt, Homo sapiens
ccacgaugcugccacuuug

SEQ ID NO: 382834 - RNA, 19 nt, Homo sapiens
cauacuaguuucuuuguuc

SEQ ID NO: 382835 - RNA, 19 nt, Homo sapiens
ggagacaaauguuggaaaa

SEQ ID NO: 382836 - RNA, 19 nt, Homo sapiens
gaaagaccccuccauauau

SEQ ID NO: 382837 - RNA, 19 nt, Homo sapiens
gaaaagaaguuugcuacga

SEQ ID NO: 382838 - RNA, 19 nt, Homo sapiens
gacacauacuaguuucuuu

SEQ ID NO: 382839 - RNA, 19 nt, Homo sapiens
gaaagacucggcugcuuca

SEQ ID NO: 382840 - RNA, 19 nt, Homo sapiens
aaagaaguuugcuacgaaa

SEQ ID NO: 382841 - RNA, 19 nt, Homo sapiens
acacaagccucgcagaaca

SEQ ID NO: 382842 - RNA, 19 nt, Homo sapiens
ggucaggaauuacggaaag

SEQ ID NO: 382843 - RNA, 19 nt, Homo sapiens
ccaaauuuguggauguaau

SEQ ID NO: 382844 - RNA, 19 nt, Homo sapiens
aaagguggcucccgaacug

SEQ ID NO: 382845 - RNA, 19 nt, Homo sapiens
caagggcacucucaaacca

SEQ ID NO: 382846 - RNA, 19 nt, Homo sapiens
ucaagaaguugccgcagau

SEQ ID NO: 382847 - RNA, 19 nt, Homo sapiens
uggaaagugugaacuguau

SEQ ID NO: 382848 - RNA, 19 nt, Homo sapiens
aacauucucucucagauug

SEQ ID NO: 382849 - RNA, 19 nt, Homo sapiens
ugacucagauguggauguu

SEQ ID NO: 382850 - RNA, 19 nt, Homo sapiens
caaugaauuugacucagau

SEQ ID NO: 382851 - RNA, 19 nt, Homo sapiens
ccaccuagauuucuuucca

SEQ ID NO: 382852 - RNA, 19 nt, Homo sapiens
uuaggagacuacuguuauu

SEQ ID NO: 382853 - RNA, 19 nt, Homo sapiens
ggagguauaagguaucugu

SEQ ID NO: 382854 - RNA, 19 nt, Homo sapiens
guuaggagacuacuguuau

SEQ ID NO: 382855 - RNA, 19 nt, Homo sapiens
ggacacauacuaguuucuu

SEQ ID NO: 382856 - RNA, 19 nt, Homo sapiens
gaaguggcauauuuuguug

SEQ ID NO: 382857 - RNA, 19 nt, Homo sapiens
gccaaugugugcaagaauc

SEQ ID NO: 382858 - RNA, 19 nt, Homo sapiens
cuaaugagaacccaaacaa

SEQ ID NO: 382859 - RNA, 19 nt, Homo sapiens
acuguuauuugaccaauga

SEQ ID NO: 382860 - RNA, 19 nt, Homo sapiens
ggccuguaaucacuuaaga

SEQ ID NO: 382861 - RNA, 19 nt, Homo sapiens
gaaguuugcuacgaaagac

SEQ ID NO: 382862 - RNA, 19 nt, Homo sapiens
aaaagaaguuugcuacgaa

SEQ ID NO: 382863 - RNA, 19 nt, Homo sapiens
gaaagugugaacuguaucu

SEQ ID NO: 382864 - RNA, 19 nt, Homo sapiens
ugagaacccaaacaacuuu

SEQ ID NO: 382865 - RNA, 19 nt, Homo sapiens
caacacccgcuuccuccua

SEQ ID NO: 382866 - RNA, 19 nt, Homo sapiens
gggagcauccaagauuaua

SEQ ID NO: 382867 - RNA, 19 nt, Homo sapiens
guaaucacuuaagaagcua

SEQ ID NO: 382868 - RNA, 19 nt, Homo sapiens
uguaaucacuuaagaagcu

SEQ ID NO: 382869 - RNA, 19 nt, Homo sapiens
cgucuucacugcaaacaag

SEQ ID NO: 382870 - RNA, 19 nt, Homo sapiens
gaacccaaacaacuuucaa

SEQ ID NO: 382871 - RNA, 19 nt, Homo sapiens
gguggaaagugugaacugu

SEQ ID NO: 382872 - RNA, 19 nt, Homo sapiens
gguauaacaaugugaucaa

SEQ ID NO: 382873 - RNA, 19 nt, Homo sapiens
acuugcagaugguuaaauu

SEQ ID NO: 382874 - RNA, 19 nt, Homo sapiens
acaggacacauacuaguuu

SEQ ID NO: 382875 - RNA, 19 nt, Homo sapiens
gguuacaggacacauacua

SEQ ID NO: 382876 - RNA, 19 nt, Homo sapiens
aaagguuacaggacacaua

SEQ ID NO: 382877 - RNA, 19 nt, Homo sapiens
ccacagaugggucacuaug

SEQ ID NO: 382878 - RNA, 19 nt, Homo sapiens
ucacuuaagaagcuacaaa

SEQ ID NO: 382879 - RNA, 19 nt, Homo sapiens
gagcauccaagauuauagu

SEQ ID NO: 382880 - RNA, 19 nt, Homo sapiens
gaagggacucgagacuuug

SEQ ID NO: 382881 - RNA, 19 nt, Homo sapiens
gaucgugggagcagaagug

SEQ ID NO: 382882 - RNA, 19 nt, Homo sapiens
ugugaucaacccaacuuua

SEQ ID NO: 382883 - RNA, 19 nt, Homo sapiens
caaaccagauaguacucau

SEQ ID NO: 382884 - RNA, 19 nt, Homo sapiens
uacaacgucuucacugcaa

SEQ ID NO: 382885 - RNA, 19 nt, Homo sapiens
cgaacuggauacacacaag

SEQ ID NO: 382886 - RNA, 19 nt, Homo sapiens
gcaucaguggcuccaauuu

SEQ ID NO: 382887 - RNA, 19 nt, Homo sapiens
ggccagaaauuuuaucuag

SEQ ID NO: 382888 - RNA, 19 nt, Homo sapiens
acacauacuaguuucuuug

SEQ ID NO: 382889 - RNA, 19 nt, Homo sapiens
aaagaccccuccauauauu

SEQ ID NO: 382890 - RNA, 19 nt, Homo sapiens
gcuacaaauauuacacuga

SEQ ID NO: 382891 - RNA, 19 nt, Homo sapiens
ccaaauggaggaguggaaa

SEQ ID NO: 382892 - RNA, 19 nt, Homo sapiens
gcuggaaggagaaccaaug

SEQ ID NO: 382893 - RNA, 19 nt, Homo sapiens
guaucuguguggacuggaa

SEQ ID NO: 382894 - RNA, 19 nt, Homo sapiens
acucuaagcaguaugaaau

SEQ ID NO: 382895 - RNA, 19 nt, Homo sapiens
aaggaaacucuaagcagua

SEQ ID NO: 382896 - RNA, 19 nt, Homo sapiens
caggacacauacuaguuuc

SEQ ID NO: 382897 - RNA, 19 nt, Homo sapiens
gaaaugccuggauguaaaa

SEQ ID NO: 382898 - RNA, 19 nt, Homo sapiens
ugccaaauuuguggaugua

SEQ ID NO: 382899 - RNA, 19 nt, Homo sapiens
gaaagguggcucccgaacu

SEQ ID NO: 382900 - RNA, 19 nt, Homo sapiens
guggaaagugugaacugua

SEQ ID NO: 382901 - RNA, 19 nt, Homo sapiens
auucauggauucauagaca

SEQ ID NO: 382902 - RNA, 19 nt, Homo sapiens
agauaguacucauuccaau

SEQ ID NO: 382903 - RNA, 19 nt, Homo sapiens
guucggaaauaaaggaaac

SEQ ID NO: 382904 - RNA, 19 nt, Homo sapiens
gagacuuugcggccuguaa

SEQ ID NO: 382905 - RNA, 19 nt, Homo sapiens
gccacgaugcugccacuuu

SEQ ID NO: 382906 - RNA, 19 nt, Homo sapiens
uggaaaugccuggauguaa

SEQ ID NO: 382907 - RNA, 19 nt, Homo sapiens
ccccagcgaugccaaauuu

SEQ ID NO: 382908 - RNA, 19 nt, Homo sapiens
caucaguggcuccaauuuc

SEQ ID NO: 382909 - RNA, 19 nt, Homo sapiens
aagcaucaguggcuccaau

SEQ ID NO: 382910 - RNA, 19 nt, Homo sapiens
gggacuugcagaugguuaa

SEQ ID NO: 382911 - RNA, 19 nt, Homo sapiens
caccugaauuaguccgauu

SEQ ID NO: 382912 - RNA, 19 nt, Homo sapiens
acacacaagccucgcagaa

SEQ ID NO: 382913 - RNA, 19 nt, Homo sapiens
gcuccaauuucaaaacaaa

SEQ ID NO: 382914 - RNA, 19 nt, Homo sapiens
agaaguugccgcagauuca

SEQ ID NO: 382915 - RNA, 19 nt, Homo sapiens
cccaaacaacuuucaagaa

SEQ ID NO: 382916 - RNA, 19 nt, Homo sapiens
agauuauaguggagacaaa

SEQ ID NO: 382917 - RNA, 19 nt, Homo sapiens
ccaaacaacuuucaaauuc

SEQ ID NO: 382918 - RNA, 19 nt, Homo sapiens
gaucaaggaugcccacaga

SEQ ID NO: 382919 - RNA, 19 nt, Homo sapiens
gaaaagaaguuugcuauga

SEQ ID NO: 382920 - RNA, 19 nt, Homo sapiens
caucauccauggcuucaua

SEQ ID NO: 382921 - RNA, 19 nt, Homo sapiens
cuaagaagcuacaaguauu

SEQ ID NO: 382922 - RNA, 19 nt, Homo sapiens
gaagcaaguuucgagagua

SEQ ID NO: 382923 - RNA, 19 nt, Homo sapiens
gagaagagaagacagugua

SEQ ID NO: 382924 - RNA, 19 nt, Homo sapiens
gugaagagcagcagaaauu

SEQ ID NO: 382925 - RNA, 19 nt, Homo sapiens
gaaauaagggaaacacuca

SEQ ID NO: 382926 - RNA, 19 nt, Homo sapiens
gcaaucaccuaagaagcua

SEQ ID NO: 382927 - RNA, 19 nt, Homo sapiens
ugacagacaugugcaagaa

SEQ ID NO: 382928 - RNA, 19 nt, Homo sapiens
aaaccaggcucaacccauu

SEQ ID NO: 382929 - RNA, 19 nt, Homo sapiens
gggaaacacucaccaguac

SEQ ID NO: 382930 - RNA, 19 nt, Homo sapiens
gcucaacccauuccuauga

SEQ ID NO: 382931 - RNA, 19 nt, Homo sapiens
caagaagaaugcccugucu

SEQ ID NO: 382932 - RNA, 19 nt, Homo sapiens
ugacuuuguugaugugauu

SEQ ID NO: 382933 - RNA, 19 nt, Homo sapiens
agaaagacccgguucauca

SEQ ID NO: 382934 - RNA, 19 nt, Homo sapiens
caggagaggcuagcaauuu

SEQ ID NO: 382935 - RNA, 19 nt, Homo sapiens
gaagaggugcgacuugauc

SEQ ID NO: 382936 - RNA, 19 nt, Homo sapiens
agaagacaguguacaacuu

SEQ ID NO: 382937 - RNA, 19 nt, Homo sapiens
gcugcugcguucacacuaa

SEQ ID NO: 382938 - RNA, 19 nt, Homo sapiens
ccgauggguuugcugcaua

SEQ ID NO: 382939 - RNA, 19 nt, Homo sapiens
ccuaagaagcuacaaguau

SEQ ID NO: 382940 - RNA, 19 nt, Homo sapiens
acaaguccuuugagucuga

SEQ ID NO: 382941 - RNA, 19 nt, Homo sapiens
gaaagacccgguucaucau

SEQ ID NO: 382942 - RNA, 19 nt, Homo sapiens
agaaugcccugucucagau

SEQ ID NO: 382943 - RNA, 19 nt, Homo sapiens
gaugcugacuuuguugaug

SEQ ID NO: 382944 - RNA, 19 nt, Homo sapiens
cgagaguacuccugaagag

SEQ ID NO: 382945 - RNA, 19 nt, Homo sapiens
gaacagccacuggucagau

SEQ ID NO: 382946 - RNA, 19 nt, Homo sapiens
uuccaaaguucaccucauu

SEQ ID NO: 382947 - RNA, 19 nt, Homo sapiens
caagugaagagcagcagaa

SEQ ID NO: 382948 - RNA, 19 nt, Homo sapiens
ggagaggcaggaagcaaga

SEQ ID NO: 382949 - RNA, 19 nt, Homo sapiens
gaaauucuucuugaacaca

SEQ ID NO: 382950 - RNA, 19 nt, Homo sapiens
cugaagaggugcgacuuga

SEQ ID NO: 382951 - RNA, 19 nt, Homo sapiens
acacacaggcugccaacaa

SEQ ID NO: 382952 - RNA, 19 nt, Homo sapiens
gcaucugcguggacuggaa

SEQ ID NO: 382953 - RNA, 19 nt, Homo sapiens
cccaaacaacuuucaaauu

SEQ ID NO: 382954 - RNA, 19 nt, Homo sapiens
ccacagaugggucacuaug

SEQ ID NO: 382955 - RNA, 19 nt, Homo sapiens
ucaaggaugcccacagaug

SEQ ID NO: 382956 - RNA, 19 nt, Homo sapiens
gcacccgcuuccugcugua

SEQ ID NO: 382957 - RNA, 19 nt, Homo sapiens
gagaagacaguguacaacu

SEQ ID NO: 382958 - RNA, 19 nt, Homo sapiens
cuacaaguccuuugagucu

SEQ ID NO: 382959 - RNA, 19 nt, Homo sapiens
gcauaucccugcacuuccu

SEQ ID NO: 382960 - RNA, 19 nt, Homo sapiens
agaagcaaguuucgagagu

SEQ ID NO: 382961 - RNA, 19 nt, Homo sapiens
gaagagaagacaguguaca

SEQ ID NO: 382962 - RNA, 19 nt, Homo sapiens
gaaacacucaccaguacag

SEQ ID NO: 382963 - RNA, 19 nt, Homo sapiens
ccacuggucagaucaaagu

SEQ ID NO: 382964 - RNA, 19 nt, Homo sapiens
aggagaggcuagcaauuuc

SEQ ID NO: 382965 - RNA, 19 nt, Homo sapiens
gucacuaugcugauaaauu

SEQ ID NO: 382966 - RNA, 19 nt, Homo sapiens
gggucacuaugcugauaaa

SEQ ID NO: 382967 - RNA, 19 nt, Homo sapiens
aagaaugcccugucucaga

SEQ ID NO: 382968 - RNA, 19 nt, Homo sapiens
agaagaaugcccugucuca

SEQ ID NO: 382969 - RNA, 19 nt, Homo sapiens
uagacaggaugcugaucuu

SEQ ID NO: 382970 - RNA, 19 nt, Homo sapiens
aggguuggauccuguagaa

SEQ ID NO: 382971 - RNA, 19 nt, Homo sapiens
aaauucuccuccucucuga

SEQ ID NO: 382972 - RNA, 19 nt, Homo sapiens
cgauggguuugcugcauau

SEQ ID NO: 382973 - RNA, 19 nt, Homo sapiens
augcugaucuucuggacaa

SEQ ID NO: 382974 - RNA, 19 nt, Homo sapiens
ggcuugcaaucaccuaaga

SEQ ID NO: 382975 - RNA, 19 nt, Homo sapiens
ggagaagagaagacagugu

SEQ ID NO: 382976 - RNA, 19 nt, Homo sapiens
caagaucacugugcaaaag

SEQ ID NO: 382977 - RNA, 19 nt, Homo sapiens
guugcuuuguuuggaaaua

SEQ ID NO: 382978 - RNA, 19 nt, Homo sapiens
ccucaaucccgauggguuu

SEQ ID NO: 382979 - RNA, 19 nt, Homo sapiens
uggaggaggugaacugcau

SEQ ID NO: 382980 - RNA, 19 nt, Homo sapiens
gcugcguucacacuaauaa

SEQ ID NO: 382981 - RNA, 19 nt, Homo sapiens
aagagaagacaguguacaa

SEQ ID NO: 382982 - RNA, 19 nt, Homo sapiens
gcaaagcuggauguuggaa

SEQ ID NO: 382983 - RNA, 19 nt, Homo sapiens
caacccauuccuaugaguu

SEQ ID NO: 382984 - RNA, 19 nt, Homo sapiens
acaggaugcugaucuucug

SEQ ID NO: 382985 - RNA, 19 nt, Homo sapiens
cacacugucuggaagaaca

SEQ ID NO: 382986 - RNA, 19 nt, Homo sapiens
acagacaugugcaagaaac

SEQ ID NO: 382987 - RNA, 19 nt, Homo sapiens
gaugcaaagcuggauguug

SEQ ID NO: 382988 - RNA, 19 nt, Homo sapiens
agggaaacacucaccagua

SEQ ID NO: 382989 - RNA, 19 nt, Homo sapiens
ggaugcagcuccccugauc

SEQ ID NO: 382990 - RNA, 19 nt, Homo sapiens
auccauggcuucauagaca

SEQ ID NO: 382991 - RNA, 19 nt, Homo sapiens
gucaaguuucuuuggaaua

SEQ ID NO: 382992 - RNA, 19 nt, Homo sapiens
ggaaacacucaccaguaca

SEQ ID NO: 382993 - RNA, 19 nt, Homo sapiens
ggucagaucaaaguugcuu

SEQ ID NO: 382994 - RNA, 19 nt, Homo sapiens
acagaugggucacuaugcu

SEQ ID NO: 382995 - RNA, 19 nt, Homo sapiens
aagucaaguuucuuuggaa

SEQ ID NO: 382996 - RNA, 19 nt, Homo sapiens
ccucugaugcugacuuugu

SEQ ID NO: 382997 - RNA, 19 nt, Homo sapiens
cgacuugaucccucugaug

SEQ ID NO: 382998 - RNA, 19 nt, Homo sapiens
aagcaaguuucgagaguac

SEQ ID NO: 382999 - RNA, 19 nt, Homo sapiens
guuggauccuguagaagca

SEQ ID NO: 383000 - RNA, 19 nt, Homo sapiens
gacagacaugugcaagaaa

SEQ ID NO: 383001 - RNA, 19 nt, Homo sapiens
agucaaguuucuuuggaau

SEQ ID NO: 383002 - RNA, 19 nt, Homo sapiens
gacaggaugcugaucuucu

SEQ ID NO: 383003 - RNA, 19 nt, Homo sapiens
cacacaggcugccaacaac

SEQ ID NO: 383004 - RNA, 19 nt, Homo sapiens
aaaagaaguuugcuaugag

SEQ ID NO: 383005 - RNA, 19 nt, Homo sapiens
gacagaaagacccgguuca

SEQ ID NO: 383006 - RNA, 19 nt, Homo sapiens
ugaaaacccaaacaacuuu

SEQ ID NO: 383007 - RNA, 19 nt, Homo sapiens
ggacuuuguggcuugcaau

SEQ ID NO: 383008 - RNA, 19 nt, Homo sapiens
gggacuuuguggcuugcaa

SEQ ID NO: 383009 - RNA, 19 nt, Homo sapiens
cagaaagacccgguucauc

SEQ ID NO: 383010 - RNA, 19 nt, Homo sapiens
ucccucugaugcugacuuu

SEQ ID NO: 383011 - RNA, 19 nt, Homo sapiens
ggaaaagaaguuugcuaug

SEQ ID NO: 383012 - RNA, 19 nt, Homo sapiens
ucgacauccucuugacaga

SEQ ID NO: 383013 - RNA, 19 nt, Homo sapiens
gacaugugcaagaaacugu

SEQ ID NO: 383014 - RNA, 19 nt, Homo sapiens
cuucauagacaaaggagau

SEQ ID NO: 383015 - RNA, 19 nt, Homo sapiens
gcaaaagggagaagagaag

SEQ ID NO: 383016 - RNA, 19 nt, Homo sapiens
uggaaagcauccucaaucc

SEQ ID NO: 383017 - RNA, 19 nt, Homo sapiens
ggagacagcuuucuuaaua

SEQ ID NO: 383018 - RNA, 19 nt, Homo sapiens
gcacuaugcugaccaauuu

SEQ ID NO: 383019 - RNA, 19 nt, Homo sapiens
ccaaacaacuuccaacuaa

SEQ ID NO: 383020 - RNA, 19 nt, Homo sapiens
gaacaaacgugggauaaau

SEQ ID NO: 383021 - RNA, 19 nt, Homo sapiens
uaagaagcuucgaguauua

SEQ ID NO: 383022 - RNA, 19 nt, Homo sapiens
caucauccauggcuucuua

SEQ ID NO: 383023 - RNA, 19 nt, Homo sapiens
ggaaggaauugguggcuuu

SEQ ID NO: 383024 - RNA, 19 nt, Homo sapiens
ggagagagugguaacuuua

SEQ ID NO: 383025 - RNA, 19 nt, Homo sapiens
gaaaugcccggauguaaga

SEQ ID NO: 383026 - RNA, 19 nt, Homo sapiens
cuaagaagcuucgaguauu

SEQ ID NO: 383027 - RNA, 19 nt, Homo sapiens
gaaagugaauggguacauc

SEQ ID NO: 383028 - RNA, 19 nt, Homo sapiens
gaaaacaagugcuguggaa

SEQ ID NO: 383029 - RNA, 19 nt, Homo sapiens
gaagaugggacugaguaua

SEQ ID NO: 383030 - RNA, 19 nt, Homo sapiens
ucagcgaccuguaaaauua

SEQ ID NO: 383031 - RNA, 19 nt, Homo sapiens
caucaggauugcuuuguau

SEQ ID NO: 383032 - RNA, 19 nt, Homo sapiens
gcaaucaccuaagaagcuu

SEQ ID NO: 383033 - RNA, 19 nt, Homo sapiens
gauggaauaugggaaggaa

SEQ ID NO: 383034 - RNA, 19 nt, Homo sapiens
caaacaacuuccaacuaau

SEQ ID NO: 383035 - RNA, 19 nt, Homo sapiens
caaaggaucccucaaacca

SEQ ID NO: 383036 - RNA, 19 nt, Homo sapiens
ggaaaugcccggauguaag

SEQ ID NO: 383037 - RNA, 19 nt, Homo sapiens
ggacauugacacccgcuuu

SEQ ID NO: 383038 - RNA, 19 nt, Homo sapiens
ggaacaaacgugggauaaa

SEQ ID NO: 383039 - RNA, 19 nt, Homo sapiens
ccaaauggaggaaaggaaa

SEQ ID NO: 383040 - RNA, 19 nt, Homo sapiens
gcaagaaaauguuugaagu

SEQ ID NO: 383041 - RNA, 19 nt, Homo sapiens
aagaugggacugaguauaa

SEQ ID NO: 383042 - RNA, 19 nt, Homo sapiens
cacagauucuucucccaua

SEQ ID NO: 383043 - RNA, 19 nt, Homo sapiens
gaaggugaacugcaucugu

SEQ ID NO: 383044 - RNA, 19 nt, Homo sapiens
caucggacaugugcaagaa

SEQ ID NO: 383045 - RNA, 19 nt, Homo sapiens
cagcgacacuguggaagaa

SEQ ID NO: 383046 - RNA, 19 nt, Homo sapiens
gacacccgcuuucuucugu

SEQ ID NO: 383047 - RNA, 19 nt, Homo sapiens
gugaagaugggacugagua

SEQ ID NO: 383048 - RNA, 19 nt, Homo sapiens
aaacgugggauaaaucuau

SEQ ID NO: 383049 - RNA, 19 nt, Homo sapiens
gaguaaguguuucccuugu

SEQ ID NO: 383050 - RNA, 19 nt, Homo sapiens
gagacagcuuucuuaauac

SEQ ID NO: 383051 - RNA, 19 nt, Homo sapiens
ccuaagaagcuucgaguau

SEQ ID NO: 383052 - RNA, 19 nt, Homo sapiens
gcggagacagcuuucuuaa

SEQ ID NO: 383053 - RNA, 19 nt, Homo sapiens
agacagcuuucuuaauaca

SEQ ID NO: 383054 - RNA, 19 nt, Homo sapiens
gaaaagagaaagugaaugg

SEQ ID NO: 383055 - RNA, 19 nt, Homo sapiens
uaagguaucagucacacuu

SEQ ID NO: 383056 - RNA, 19 nt, Homo sapiens
aggagagagugguaacuuu

SEQ ID NO: 383057 - RNA, 19 nt, Homo sapiens
ggaauugguggcuuugugu

SEQ ID NO: 383058 - RNA, 19 nt, Homo sapiens
gaaaacgucuugcaaucuc

SEQ ID NO: 383059 - RNA, 19 nt, Homo sapiens
caaaucacagugcaaagug

SEQ ID NO: 383060 - RNA, 19 nt, Homo sapiens
acaucaggauugcuuugua

SEQ ID NO: 383061 - RNA, 19 nt, Homo sapiens
caacuuggcugcuuuucug

SEQ ID NO: 383062 - RNA, 19 nt, Homo sapiens
gcacggaaccagacaccau

SEQ ID NO: 383063 - RNA, 19 nt, Homo sapiens
gcagcgacacuguggaaga

SEQ ID NO: 383064 - RNA, 19 nt, Homo sapiens
caagugcuguggaacaaac

SEQ ID NO: 383065 - RNA, 19 nt, Homo sapiens
caaccauuacugauauuga

SEQ ID NO: 383066 - RNA, 19 nt, Homo sapiens
ggcggagacagcuuucuua

SEQ ID NO: 383067 - RNA, 19 nt, Homo sapiens
aaacaacuuccaacuaauc

SEQ ID NO: 383068 - RNA, 19 nt, Homo sapiens
caagacacgcuucaucauc

SEQ ID NO: 383069 - RNA, 19 nt, Homo sapiens
aaaucuaucugagcccaaa

SEQ ID NO: 383070 - RNA, 19 nt, Homo sapiens
caggauugcuuuguaugga

SEQ ID NO: 383071 - RNA, 19 nt, Homo sapiens
gcuuucuucuguacacaaa

SEQ ID NO: 383072 - RNA, 19 nt, Homo sapiens
gcaagacacgcuucaucau

SEQ ID NO: 383073 - RNA, 19 nt, Homo sapiens
gcugaaggaugccccaaaa

SEQ ID NO: 383074 - RNA, 19 nt, Homo sapiens
gaugggacugaguauaauu

SEQ ID NO: 383075 - RNA, 19 nt, Homo sapiens
gaauggguacaucaggauu

SEQ ID NO: 383076 - RNA, 19 nt, Homo sapiens
aaacaagugcuguggaaca

SEQ ID NO: 383077 - RNA, 19 nt, Homo sapiens
cauaguuccuucccuaggu

SEQ ID NO: 383078 - RNA, 19 nt, Homo sapiens
guacaucaggauugcuuug

SEQ ID NO: 383079 - RNA, 19 nt, Homo sapiens
uggaauaugggaaggaauu

SEQ ID NO: 383080 - RNA, 19 nt, Homo sapiens
gcaaucucuuuacccuugu

SEQ ID NO: 383081 - RNA, 19 nt, Homo sapiens
cggacaacuuggcugcuuu

SEQ ID NO: 383082 - RNA, 19 nt, Homo sapiens
ggaauaugggaaggaauug

SEQ ID NO: 383083 - RNA, 19 nt, Homo sapiens
ggccgugcuuccaggauga

SEQ ID NO: 383084 - RNA, 19 nt, Homo sapiens
uggagaaggugaacugcau

SEQ ID NO: 383085 - RNA, 19 nt, Homo sapiens
ccaaaucacagugcaaagu

SEQ ID NO: 383086 - RNA, 19 nt, Homo sapiens
uuucaaaggaucccucaaa

SEQ ID NO: 383087 - RNA, 19 nt, Homo sapiens
gaaggaauugguggcuuug

SEQ ID NO: 383088 - RNA, 19 nt, Homo sapiens
gauguggauuuuaauguug

SEQ ID NO: 383089 - RNA, 19 nt, Homo sapiens
ggcacuaugcugaccaauu

SEQ ID NO: 383090 - RNA, 19 nt, Homo sapiens
ggucugcuacggacaacuu

SEQ ID NO: 383091 - RNA, 19 nt, Homo sapiens
caucugacgccguguuugu

SEQ ID NO: 383092 - RNA, 19 nt, Homo sapiens
ccucaaaccagaugcaagu

SEQ ID NO: 383093 - RNA, 19 nt, Homo sapiens
caaauggaggaaaggaaau

SEQ ID NO: 383094 - RNA, 19 nt, Homo sapiens
gggcggagacagcuuucuu

SEQ ID NO: 383095 - RNA, 19 nt, Homo sapiens
gugcggcuauugcgguaau

SEQ ID NO: 383096 - RNA, 19 nt, Homo sapiens
aacaagugcuguggaacaa

SEQ ID NO: 383097 - RNA, 19 nt, Homo sapiens
gagguucgguuggauccau

SEQ ID NO: 383098 - RNA, 19 nt, Homo sapiens
auccauggcuucuuagaca

SEQ ID NO: 383099 - RNA, 19 nt, Homo sapiens
ucagucacacuuucuggaa

SEQ ID NO: 383100 - RNA, 19 nt, Homo sapiens
uccaaacaacuuccaacua

SEQ ID NO: 383101 - RNA, 19 nt, Homo sapiens
agauucuucucccauaguu

SEQ ID NO: 383102 - RNA, 19 nt, Homo sapiens
cgacgcagcuaggguacag

SEQ ID NO: 383103 - RNA, 19 nt, Homo sapiens
uagcagcgacacuguggaa

SEQ ID NO: 383104 - RNA, 19 nt, Homo sapiens
uuucuucuguacacaaaug

SEQ ID NO: 383105 - RNA, 19 nt, Homo sapiens
guacacaaaugaaaaucca

SEQ ID NO: 383106 - RNA, 19 nt, Homo sapiens
acacgugugcuauugaugu

SEQ ID NO: 383107 - RNA, 19 nt, Homo sapiens
gacauugacacccgcuuuc

SEQ ID NO: 383108 - RNA, 19 nt, Homo sapiens
gaaggaugccccaaaaugg

SEQ ID NO: 383109 - RNA, 19 nt, Homo sapiens
ggugggccaucuggauuuc

SEQ ID NO: 383110 - RNA, 19 nt, Homo sapiens
cgcaagacacgcuucauca

SEQ ID NO: 383111 - RNA, 19 nt, Homo sapiens
agaugggacugaguauaau

SEQ ID NO: 383112 - RNA, 19 nt, Homo sapiens
caaacgugggauaaaucua

SEQ ID NO: 383113 - RNA, 19 nt, Homo sapiens
uggaacaaacgugggauaa

SEQ ID NO: 383114 - RNA, 19 nt, Homo sapiens
caacuuccaacuaaucacu

SEQ ID NO: 383115 - RNA, 19 nt, Homo sapiens
gaaguaaugaaaacucgaa

SEQ ID NO: 383116 - RNA, 19 nt, Homo sapiens
aggauugcuuuguauggaa

SEQ ID NO: 383117 - RNA, 19 nt, Homo sapiens
caacaugccugccucauug

SEQ ID NO: 383118 - RNA, 19 nt, Homo sapiens
gcccagaucuugccagcuu

SEQ ID NO: 383119 - RNA, 19 nt, Homo sapiens
ugaaguggcaccuaauaaa

SEQ ID NO: 383120 - RNA, 19 nt, Homo sapiens
uggauucccuguucuuuga

SEQ ID NO: 383121 - RNA, 19 nt, Homo sapiens
gaaguggcaccuaauaaag

SEQ ID NO: 383122 - RNA, 19 nt, Homo sapiens
ccaccuggauucccuguuc

SEQ ID NO: 383123 - RNA, 19 nt, Homo sapiens
uaucaugccugcccaccuu

SEQ ID NO: 383124 - RNA, 19 nt, Homo sapiens
gacaucaccaugacagauu

SEQ ID NO: 383125 - RNA, 19 nt, Homo sapiens
gcgccuaccuccgcaacaa

SEQ ID NO: 383126 - RNA, 19 nt, Homo sapiens
ucagaagguugggcuguga

SEQ ID NO: 383127 - RNA, 19 nt, Homo sapiens
agacaggcguagaugaugu

SEQ ID NO: 383128 - RNA, 19 nt, Homo sapiens
ccaacaugccugccucauu

SEQ ID NO: 383129 - RNA, 19 nt, Homo sapiens
ggacaucaccaugacagau

SEQ ID NO: 383130 - RNA, 19 nt, Homo sapiens
gggaaugcuggcaggauaa

SEQ ID NO: 383131 - RNA, 19 nt, Homo sapiens
ggggaaugcuggcaggaua

SEQ ID NO: 383132 - RNA, 19 nt, Homo sapiens
ucuuugaaguggcaccuaa

SEQ ID NO: 383133 - RNA, 19 nt, Homo sapiens
aggcguagaugaugucaag

SEQ ID NO: 383134 - RNA, 19 nt, Homo sapiens
acaucaccaugacagauuu

SEQ ID NO: 383135 - RNA, 19 nt, Homo sapiens
ggcaccuaauaaagaaaua

SEQ ID NO: 383136 - RNA, 19 nt, Homo sapiens
cagauuuccuggaggucaa

SEQ ID NO: 383137 - RNA, 19 nt, Homo sapiens
aguggcaccuaauaaagaa

SEQ ID NO: 383138 - RNA, 19 nt, Homo sapiens
gccuucaacuggagcaugu

SEQ ID NO: 383139 - RNA, 19 nt, Homo sapiens
ucagacaggcguagaugau

SEQ ID NO: 383140 - RNA, 19 nt, Homo sapiens
gaccuucgccaccggugaa

SEQ ID NO: 383141 - RNA, 19 nt, Homo sapiens
ugucaagggcgucuucuuc

SEQ ID NO: 383142 - RNA, 19 nt, Homo sapiens
gcagccacuuugaggacau

SEQ ID NO: 383143 - RNA, 19 nt, Homo sapiens
gcacccucaucgacauugg

SEQ ID NO: 383144 - RNA, 19 nt, Homo sapiens
uugaaguggcaccuaauaa

SEQ ID NO: 383145 - RNA, 19 nt, Homo sapiens
uuugaaguggcaccuaaua

SEQ ID NO: 383146 - RNA, 19 nt, Homo sapiens
gacgcacccucaucgacau

SEQ ID NO: 383147 - RNA, 19 nt, Homo sapiens
aaguggcaccuaauaaaga

SEQ ID NO: 383148 - RNA, 19 nt, Homo sapiens
ggagagaacuguuugaaga

SEQ ID NO: 383149 - RNA, 19 nt, Homo sapiens
uaaagaggaugcugccuua

SEQ ID NO: 383150 - RNA, 19 nt, Homo sapiens
ggaagaauguguccagcua

SEQ ID NO: 383151 - RNA, 19 nt, Homo sapiens
gaacguggaugagaacauu

SEQ ID NO: 383152 - RNA, 19 nt, Homo sapiens
gaaagcagguugaaaauga

SEQ ID NO: 383153 - RNA, 19 nt, Homo sapiens
gaucaaaggauaagaauuc

SEQ ID NO: 383154 - RNA, 19 nt, Homo sapiens
uaacaucccuugucaucuu

SEQ ID NO: 383155 - RNA, 19 nt, Homo sapiens
gaaauagggauuguucaua

SEQ ID NO: 383156 - RNA, 19 nt, Homo sapiens
ggaggaugaugauguuaaa

SEQ ID NO: 383157 - RNA, 19 nt, Homo sapiens
gaaugaacauaaugccaaa

SEQ ID NO: 383158 - RNA, 19 nt, Homo sapiens
gaugcugccuuaagaauug

SEQ ID NO: 383159 - RNA, 19 nt, Homo sapiens
aaaugaagcuagcaaagaa

SEQ ID NO: 383160 - RNA, 19 nt, Homo sapiens
uagaggacgugguaguuua

SEQ ID NO: 383161 - RNA, 19 nt, Homo sapiens
gaaagaggucuauaucaga

SEQ ID NO: 383162 - RNA, 19 nt, Homo sapiens
gaguagaggucgaacuaga

SEQ ID NO: 383163 - RNA, 19 nt, Homo sapiens
ggaaauggagguuaagaug

SEQ ID NO: 383164 - RNA, 19 nt, Homo sapiens
gaaaggagagaacuguuug

SEQ ID NO: 383165 - RNA, 19 nt, Homo sapiens
gagaguagaagucggagua

SEQ ID NO: 383166 - RNA, 19 nt, Homo sapiens
gcauugcagucuucaguug

SEQ ID NO: 383167 - RNA, 19 nt, Homo sapiens
ggagguagaggacguggua

SEQ ID NO: 383168 - RNA, 19 nt, Homo sapiens
gaaagaaagcagguugaaa

SEQ ID NO: 383169 - RNA, 19 nt, Homo sapiens
ggaggaaacugagguaagg

SEQ ID NO: 383170 - RNA, 19 nt, Homo sapiens
aaauagggauuguucauag

SEQ ID NO: 383171 - RNA, 19 nt, Homo sapiens
uuaagaacguggaugagaa

SEQ ID NO: 383172 - RNA, 19 nt, Homo sapiens
gaucggaagagaagggaua

SEQ ID NO: 383173 - RNA, 19 nt, Homo sapiens
ggacauaauagagauagaa

SEQ ID NO: 383174 - RNA, 19 nt, Homo sapiens
gauagcagcagcagcacua

SEQ ID NO: 383175 - RNA, 19 nt, Homo sapiens
gcaagaagaauggaaugaa

SEQ ID NO: 383176 - RNA, 19 nt, Homo sapiens
gaaauagaaccaccaagag

SEQ ID NO: 383177 - RNA, 19 nt, Homo sapiens
caucgaauuugcagaacaa

SEQ ID NO: 383178 - RNA, 19 nt, Homo sapiens
caagaagaauggaaugaac

SEQ ID NO: 383179 - RNA, 19 nt, Homo sapiens
uaugugagguuccaaaaua

SEQ ID NO: 383180 - RNA, 19 nt, Homo sapiens
agaaagaggucuauaucag

SEQ ID NO: 383181 - RNA, 19 nt, Homo sapiens
uaaucgaguugaaagugua

SEQ ID NO: 383182 - RNA, 19 nt, Homo sapiens
aaauggagguuaagaugga

SEQ ID NO: 383183 - RNA, 19 nt, Homo sapiens
gagcguggaucggaagaga

SEQ ID NO: 383184 - RNA, 19 nt, Homo sapiens
gaagagaggcgugcuaaac

SEQ ID NO: 383185 - RNA, 19 nt, Homo sapiens
aggcguggauucucagaua

SEQ ID NO: 383186 - RNA, 19 nt, Homo sapiens
agaggaugcugccuuaaga

SEQ ID NO: 383187 - RNA, 19 nt, Homo sapiens
acaaaaggaucaaaggaua

SEQ ID NO: 383188 - RNA, 19 nt, Homo sapiens
aaauugagccagauaaaga

SEQ ID NO: 383189 - RNA, 19 nt, Homo sapiens
gaagaauggaaugaacaua

SEQ ID NO: 383190 - RNA, 19 nt, Homo sapiens
agaaauagaaccaccaaga

SEQ ID NO: 383191 - RNA, 19 nt, Homo sapiens
ucauagugaugcagagaaa

SEQ ID NO: 383192 - RNA, 19 nt, Homo sapiens
ggaaauagggauuguucau

SEQ ID NO: 383193 - RNA, 19 nt, Homo sapiens
gcaaaucuuuaagucuguu

SEQ ID NO: 383194 - RNA, 19 nt, Homo sapiens
gaagugaaagagaccgaaa

SEQ ID NO: 383195 - RNA, 19 nt, Homo sapiens
gacagaaagaggucuauau

SEQ ID NO: 383196 - RNA, 19 nt, Homo sapiens
gaaauugagccagauaaag

SEQ ID NO: 383197 - RNA, 19 nt, Homo sapiens
cugaagaaguuauggaugu

SEQ ID NO: 383198 - RNA, 19 nt, Homo sapiens
gaagacaaucaaugaagga

SEQ ID NO: 383199 - RNA, 19 nt, Homo sapiens
ccuagaagacaaucaauga

SEQ ID NO: 383200 - RNA, 19 nt, Homo sapiens
ugaaaggagagaacuguuu

SEQ ID NO: 383201 - RNA, 19 nt, Homo sapiens
gaaugucagugcuuuagac

SEQ ID NO: 383202 - RNA, 19 nt, Homo sapiens
cgugagaacuuugcaggaa

SEQ ID NO: 383203 - RNA, 19 nt, Homo sapiens
gauagaaagcacagaagga

SEQ ID NO: 383204 - RNA, 19 nt, Homo sapiens
ggcagcagcagcagagaua

SEQ ID NO: 383205 - RNA, 19 nt, Homo sapiens
gaaacugagguaagggaaa

SEQ ID NO: 383206 - RNA, 19 nt, Homo sapiens
aacaggaaauggagguuaa

SEQ ID NO: 383207 - RNA, 19 nt, Homo sapiens
aguagcagcuccaguacaa

SEQ ID NO: 383208 - RNA, 19 nt, Homo sapiens
agaggucgaacuagaaaua

SEQ ID NO: 383209 - RNA, 19 nt, Homo sapiens
caaagaauuggaaccagaa

SEQ ID NO: 383210 - RNA, 19 nt, Homo sapiens
uagagaugguugagaaugu

SEQ ID NO: 383211 - RNA, 19 nt, Homo sapiens
gacaaucaaugaaggaaaa

SEQ ID NO: 383212 - RNA, 19 nt, Homo sapiens
guagaggucgaacuagaaa

SEQ ID NO: 383213 - RNA, 19 nt, Homo sapiens
ccagagagcgagagcgaaa

SEQ ID NO: 383214 - RNA, 19 nt, Homo sapiens
guagaggacgugguaguuu

SEQ ID NO: 383215 - RNA, 19 nt, Homo sapiens
aauagaaccaccaagagua

SEQ ID NO: 383216 - RNA, 19 nt, Homo sapiens
aaccucagcuucagucuca

SEQ ID NO: 383217 - RNA, 19 nt, Homo sapiens
aagagaaugucagugcuuu

SEQ ID NO: 383218 - RNA, 19 nt, Homo sapiens
ugaaauugagccagauaaa

SEQ ID NO: 383219 - RNA, 19 nt, Homo sapiens
ggaggaggaaacugaggua

SEQ ID NO: 383220 - RNA, 19 nt, Homo sapiens
gguggugcguaaugaagaa

SEQ ID NO: 383221 - RNA, 19 nt, Homo sapiens
ccuuaagaauugcauguug

SEQ ID NO: 383222 - RNA, 19 nt, Homo sapiens
ggaugcugccuuaagaauu

SEQ ID NO: 383223 - RNA, 19 nt, Homo sapiens
aaacaggaaauggagguua

SEQ ID NO: 383224 - RNA, 19 nt, Homo sapiens
uagaagagucacagagaaa

SEQ ID NO: 383225 - RNA, 19 nt, Homo sapiens
agauuaacaucccuuguca

SEQ ID NO: 383226 - RNA, 19 nt, Homo sapiens
gagaaucacgccaggaaag

SEQ ID NO: 383227 - RNA, 19 nt, Homo sapiens
gaauggaaugaacauaaug

SEQ ID NO: 383228 - RNA, 19 nt, Homo sapiens
aguagcaguucaaccagua

SEQ ID NO: 383229 - RNA, 19 nt, Homo sapiens
ggucgaacuagaaauagaa

SEQ ID NO: 383230 - RNA, 19 nt, Homo sapiens
gacccagucuugacaguac

SEQ ID NO: 383231 - RNA, 19 nt, Homo sapiens
gauuugucauuagcuguuu

SEQ ID NO: 383232 - RNA, 19 nt, Homo sapiens
ugagccagauaaagaaugu

SEQ ID NO: 383233 - RNA, 19 nt, Homo sapiens
aaacugagguaagggaaag

SEQ ID NO: 383234 - RNA, 19 nt, Homo sapiens
gcaucgaauuugcagaaca

SEQ ID NO: 383235 - RNA, 19 nt, Homo sapiens
auagaagagucacagagaa

SEQ ID NO: 383236 - RNA, 19 nt, Homo sapiens
aaagaaagcagguugaaaa

SEQ ID NO: 383237 - RNA, 19 nt, Homo sapiens
ugaaagagaccgaaaauca

SEQ ID NO: 383238 - RNA, 19 nt, Homo sapiens
cagaaagaggucuauauca

SEQ ID NO: 383239 - RNA, 19 nt, Homo sapiens
aguaguagcagucgcagua

SEQ ID NO: 383240 - RNA, 19 nt, Homo sapiens
agucgaagcaguagcagua

SEQ ID NO: 383241 - RNA, 19 nt, Homo sapiens
cuaaucgaguugaaagugu

SEQ ID NO: 383242 - RNA, 19 nt, Homo sapiens
gugagaagcagcaggauag

SEQ ID NO: 383243 - RNA, 19 nt, Homo sapiens
aaacaggcgccaggaaauu

SEQ ID NO: 383244 - RNA, 19 nt, Homo sapiens
gcgcacacguagagaccuu

SEQ ID NO: 383245 - RNA, 19 nt, Homo sapiens
uuaagucuguucccuucaa

SEQ ID NO: 383246 - RNA, 19 nt, Homo sapiens
aaagcgacccggaggauga

SEQ ID NO: 383247 - RNA, 19 nt, Homo sapiens
ccaaacagagagaccuuga

SEQ ID NO: 383248 - RNA, 19 nt, Homo sapiens
gaaauaaacugguucacua

SEQ ID NO: 383249 - RNA, 19 nt, Homo sapiens
ggaagacacucagcaauua

SEQ ID NO: 383250 - RNA, 19 nt, Homo sapiens
gaucugaacuauuugcuuu

SEQ ID NO: 383251 - RNA, 19 nt, Homo sapiens
gcacagcacuaaagcauga

SEQ ID NO: 383252 - RNA, 19 nt, Homo sapiens
gaaguuuccucauaacauu

SEQ ID NO: 383253 - RNA, 19 nt, Homo sapiens
gagaguaauuguuguguaa

SEQ ID NO: 383254 - RNA, 19 nt, Homo sapiens
gaacugaauuaccacauga

SEQ ID NO: 383255 - RNA, 19 nt, Homo sapiens
aaacaacagugaugcauuu

SEQ ID NO: 383256 - RNA, 19 nt, Homo sapiens
guaaacaucuggguguaua

SEQ ID NO: 383257 - RNA, 19 nt, Homo sapiens
cauaaagccugaaugauga

SEQ ID NO: 383258 - RNA, 19 nt, Homo sapiens
guaaauagcacuaaacguu

SEQ ID NO: 383259 - RNA, 19 nt, Homo sapiens
ccaaauauucuacgacuua

SEQ ID NO: 383260 - RNA, 19 nt, Homo sapiens
gaaagaauuacgucgcuua

SEQ ID NO: 383261 - RNA, 19 nt, Homo sapiens
guaacugaguguuuguuua

SEQ ID NO: 383262 - RNA, 19 nt, Homo sapiens
caacagcccuuacaaacau

SEQ ID NO: 383263 - RNA, 19 nt, Homo sapiens
caaguuaucuuucguagca

SEQ ID NO: 383264 - RNA, 19 nt, Homo sapiens
ggugagagcugcauagauc

SEQ ID NO: 383265 - RNA, 19 nt, Homo sapiens
cggcggauaugauaaauuu

SEQ ID NO: 383266 - RNA, 19 nt, Homo sapiens
auacucagcugucccuuua

SEQ ID NO: 383267 - RNA, 19 nt, Homo sapiens
gagcagaguuuuaaaauga

SEQ ID NO: 383268 - RNA, 19 nt, Homo sapiens
guacauaaagccugaauga

SEQ ID NO: 383269 - RNA, 19 nt, Homo sapiens
ggucagcguuguuuaaaug

SEQ ID NO: 383270 - RNA, 19 nt, Homo sapiens
gcauagauccaguaaugua

SEQ ID NO: 383271 - RNA, 19 nt, Homo sapiens
ggucagcaguccaaauauu

SEQ ID NO: 383272 - RNA, 19 nt, Homo sapiens
uuacgucgcuuaauaccua

SEQ ID NO: 383273 - RNA, 19 nt, Homo sapiens
guaaacacauggaacugaa

SEQ ID NO: 383274 - RNA, 19 nt, Homo sapiens
caaggacgauuucuacaug

SEQ ID NO: 383275 - RNA, 19 nt, Homo sapiens
ucccugaucugaacuauuu

SEQ ID NO: 383276 - RNA, 19 nt, Homo sapiens
guagagggcugaugaaacu

SEQ ID NO: 383277 - RNA, 19 nt, Homo sapiens
ggcaagauguccaguaaug

SEQ ID NO: 383278 - RNA, 19 nt, Homo sapiens
gcugaaaugugaauucugu

SEQ ID NO: 383279 - RNA, 19 nt, Homo sapiens
gcacagaauacuaaacuga

SEQ ID NO: 383280 - RNA, 19 nt, Homo sapiens
ggaacugaauuaccacaug

SEQ ID NO: 383281 - RNA, 19 nt, Homo sapiens
cugcauagauccaguaaug

SEQ ID NO: 383282 - RNA, 19 nt, Homo sapiens
ucacaacaauggauagaau

SEQ ID NO: 383283 - RNA, 19 nt, Homo sapiens
aaacugagugugacuauuu

SEQ ID NO: 383284 - RNA, 19 nt, Homo sapiens
guaaaugguuucaaauggu

SEQ ID NO: 383285 - RNA, 19 nt, Homo sapiens
gaagacacucagcaauuaa

SEQ ID NO: 383286 - RNA, 19 nt, Homo sapiens
gauauagucuuugucuuuc

SEQ ID NO: 383287 - RNA, 19 nt, Homo sapiens
gauauuagugcuugcaauu

SEQ ID NO: 383288 - RNA, 19 nt, Homo sapiens
gcauguauaugacaauugg

SEQ ID NO: 383289 - RNA, 19 nt, Homo sapiens
uaaauuguccugaacuuug

SEQ ID NO: 383290 - RNA, 19 nt, Homo sapiens
gaugugauauagucuuugu

SEQ ID NO: 383291 - RNA, 19 nt, Homo sapiens
cagcguuguuuaaauguaa

SEQ ID NO: 383292 - RNA, 19 nt, Homo sapiens
caaagcauguauaugacaa

SEQ ID NO: 383293 - RNA, 19 nt, Homo sapiens
uuaaaggucuugauuaggu

SEQ ID NO: 383294 - RNA, 19 nt, Homo sapiens
gauucuuccuguaaacuaa

SEQ ID NO: 383295 - RNA, 19 nt, Homo sapiens
ugugugguaucuagaaaua

SEQ ID NO: 383296 - RNA, 19 nt, Homo sapiens
caacagugaugcauuuggu

SEQ ID NO: 383297 - RNA, 19 nt, Homo sapiens
uugacuagcugaaauguga

SEQ ID NO: 383298 - RNA, 19 nt, Homo sapiens
cagcagaauuuauaacagu

SEQ ID NO: 383299 - RNA, 19 nt, Homo sapiens
gaagaucccucugccaaaa

SEQ ID NO: 383300 - RNA, 19 nt, Homo sapiens
auaaacugguucacuagua

SEQ ID NO: 383301 - RNA, 19 nt, Homo sapiens
caggucagcaguccaaaua

SEQ ID NO: 383302 - RNA, 19 nt, Homo sapiens
uugcaaagcauguauauga

SEQ ID NO: 383303 - RNA, 19 nt, Homo sapiens
ucugguaguugcuuaauug

SEQ ID NO: 383304 - RNA, 19 nt, Homo sapiens
gcacuggcacagaauacua

SEQ ID NO: 383305 - RNA, 19 nt, Homo sapiens
gccaagcuuuucuuuauua

SEQ ID NO: 383306 - RNA, 19 nt, Homo sapiens
gugaugugauauagucuuu

SEQ ID NO: 383307 - RNA, 19 nt, Homo sapiens
cagcaugucucccugaucu

SEQ ID NO: 383308 - RNA, 19 nt, Homo sapiens
acauaaagccugaaugaug

SEQ ID NO: 383309 - RNA, 19 nt, Homo sapiens
uaaacugguucacuaguag

SEQ ID NO: 383310 - RNA, 19 nt, Homo sapiens
gaaguugcaggcugacauu

SEQ ID NO: 383311 - RNA, 19 nt, Homo sapiens
gggcugaugaaacuaauuu

SEQ ID NO: 383312 - RNA, 19 nt, Homo sapiens
ugagaagacuggagagagu

SEQ ID NO: 383313 - RNA, 19 nt, Homo sapiens
caaauggucagcguuguuu

SEQ ID NO: 383314 - RNA, 19 nt, Homo sapiens
guaaccacauccaguguca

SEQ ID NO: 383315 - RNA, 19 nt, Homo sapiens
gacccgacauugcuucaga

SEQ ID NO: 383316 - RNA, 19 nt, Homo sapiens
gaaaugugaauucuguuag

SEQ ID NO: 383317 - RNA, 19 nt, Homo sapiens
gagcuacuuucaucuaaac

SEQ ID NO: 383318 - RNA, 19 nt, Homo sapiens
gaguaauuguuguguaauc

SEQ ID NO: 383319 - RNA, 19 nt, Homo sapiens
aaacuuucuucaucuguug

SEQ ID NO: 383320 - RNA, 19 nt, Homo sapiens
gccuaacgcuggugucuca

SEQ ID NO: 383321 - RNA, 19 nt, Homo sapiens
gauccaguaauguacauaa

SEQ ID NO: 383322 - RNA, 19 nt, Homo sapiens
uagaaaaccucauugauca

SEQ ID NO: 383323 - RNA, 19 nt, Homo sapiens
aaucaaguguuccaaauac

SEQ ID NO: 383324 - RNA, 19 nt, Homo sapiens
cgacauugcuucagaaacc

SEQ ID NO: 383325 - RNA, 19 nt, Homo sapiens
ugaauucuguuaguguuga

SEQ ID NO: 383326 - RNA, 19 nt, Homo sapiens
uagauuggcgcguaguaua

SEQ ID NO: 383327 - RNA, 19 nt, Homo sapiens
uaacugaguguuuguuuag

SEQ ID NO: 383328 - RNA, 19 nt, Homo sapiens
ggggaaaaguuaacaaguu

SEQ ID NO: 383329 - RNA, 19 nt, Homo sapiens
cgauucugcuucugacauu

SEQ ID NO: 383330 - RNA, 19 nt, Homo sapiens
uaacauuaccauucacguu

SEQ ID NO: 383331 - RNA, 19 nt, Homo sapiens
agaaucugguaguugcuua

SEQ ID NO: 383332 - RNA, 19 nt, Homo sapiens
gaggguaguuucagucacu

SEQ ID NO: 383333 - RNA, 19 nt, Homo sapiens
agagaguaauuguugugua

SEQ ID NO: 383334 - RNA, 19 nt, Homo sapiens
aacauuaccauucacguua

SEQ ID NO: 383335 - RNA, 19 nt, Homo sapiens
guuaauuuguggacaguca

SEQ ID NO: 383336 - RNA, 19 nt, Homo sapiens
gaaauucuuccuggaugaa

SEQ ID NO: 383337 - RNA, 19 nt, Homo sapiens
gugucaugcuuacuccuua

SEQ ID NO: 383338 - RNA, 19 nt, Homo sapiens
guaauccuguaaacacugu

SEQ ID NO: 383339 - RNA, 19 nt, Homo sapiens
cgugaccaauguuacagua

SEQ ID NO: 383340 - RNA, 19 nt, Homo sapiens
acucagcugucccuuuaaa

SEQ ID NO: 383341 - RNA, 19 nt, Homo sapiens
uguaaaugguuucaaaugg

SEQ ID NO: 383342 - RNA, 19 nt, Homo sapiens
uauuagugcuugcaauugu

SEQ ID NO: 383343 - RNA, 19 nt, Homo sapiens
ucacucaucggcuuucauu

SEQ ID NO: 383344 - RNA, 19 nt, Homo sapiens
acauuaccauucacguuaa

SEQ ID NO: 383345 - RNA, 19 nt, Homo sapiens
uuaccuaaauuguccugaa

SEQ ID NO: 383346 - RNA, 19 nt, Homo sapiens
gugucucacucaucucuuu

SEQ ID NO: 383347 - RNA, 19 nt, Homo sapiens
gcuggugucucacucaucu

SEQ ID NO: 383348 - RNA, 19 nt, Homo sapiens
gaaagaacauccaagacaa

SEQ ID NO: 383349 - RNA, 19 nt, Homo sapiens
gggaggagauugacaaguu

SEQ ID NO: 383350 - RNA, 19 nt, Homo sapiens
ggaggagauugacaaguuu

SEQ ID NO: 383351 - RNA, 19 nt, Homo sapiens
gcacaggccugcgguacaa

SEQ ID NO: 383352 - RNA, 19 nt, Homo sapiens
gcaagucggugaagaaagg

SEQ ID NO: 383353 - RNA, 19 nt, Homo sapiens
gagcaguacuuccgugaug

SEQ ID NO: 383354 - RNA, 19 nt, Homo sapiens
ggacgaggaugaggacuuc

SEQ ID NO: 383355 - RNA, 19 nt, Homo sapiens
cagcugacccuaauuuauu

SEQ ID NO: 383356 - RNA, 19 nt, Homo sapiens
ggaagcccaucaccgacua

SEQ ID NO: 383357 - RNA, 19 nt, Homo sapiens
ggauguggguuucaugaag

SEQ ID NO: 383358 - RNA, 19 nt, Homo sapiens
cgaaagaacauccaagaca

SEQ ID NO: 383359 - RNA, 19 nt, Homo sapiens
ggguugggcugaaucaaau

SEQ ID NO: 383360 - RNA, 19 nt, Homo sapiens
cgagugcacugcugccuau

SEQ ID NO: 383361 - RNA, 19 nt, Homo sapiens
gaugaaggaugaggaacug

SEQ ID NO: 383362 - RNA, 19 nt, Homo sapiens
cgccaaagcugacugucuu

SEQ ID NO: 383363 - RNA, 19 nt, Homo sapiens
gcacugcugccuauacuuc

SEQ ID NO: 383364 - RNA, 19 nt, Homo sapiens
cagaugaccagcaaacuga

SEQ ID NO: 383365 - RNA, 19 nt, Homo sapiens
gcagaugcaggaccaguga

SEQ ID NO: 383366 - RNA, 19 nt, Homo sapiens
ugaaggcauugcaugagaa

SEQ ID NO: 383367 - RNA, 19 nt, Homo sapiens
gccacacgaugcuccguuu

SEQ ID NO: 383368 - RNA, 19 nt, Homo sapiens
gagaagcuuaucaggauga

SEQ ID NO: 383369 - RNA, 19 nt, Homo sapiens
gcagaugaccagcaaacug

SEQ ID NO: 383370 - RNA, 19 nt, Homo sapiens
agaagaggauucccaggau

SEQ ID NO: 383371 - RNA, 19 nt, Homo sapiens
ggccgagucuucccuuauc

SEQ ID NO: 383372 - RNA, 19 nt, Homo sapiens
gcaaagcuaggcagaagag

SEQ ID NO: 383373 - RNA, 19 nt, Homo sapiens
gauguucccacccgcauga

SEQ ID NO: 383374 - RNA, 19 nt, Homo sapiens
ggugacaggagaacaaugu

SEQ ID NO: 383375 - RNA, 19 nt, Homo sapiens
ggaugaagcagcagaugca

SEQ ID NO: 383376 - RNA, 19 nt, Homo sapiens
gagaugcugcagaggauga

SEQ ID NO: 383377 - RNA, 19 nt, Homo sapiens
agaagggagucaagcugaa

SEQ ID NO: 383378 - RNA, 19 nt, Homo sapiens
ggauccauguauaccaguu

SEQ ID NO: 383379 - RNA, 19 nt, Homo sapiens
ccagcugacccuaauuuau

SEQ ID NO: 383380 - RNA, 19 nt, Homo sapiens
ggcuuugacuucacacuca

SEQ ID NO: 383381 - RNA, 19 nt, Homo sapiens
caacaucgugccucucauc

SEQ ID NO: 383382 - RNA, 19 nt, Homo sapiens
gccuaggccucccgauguu

SEQ ID NO: 383383 - RNA, 19 nt, Homo sapiens
gggcaggguugggcugaau

SEQ ID NO: 383384 - RNA, 19 nt, Homo sapiens
uuaucaggaugaaggauga

SEQ ID NO: 383385 - RNA, 19 nt, Homo sapiens
aguuugggauccauguaua

SEQ ID NO: 383386 - RNA, 19 nt, Homo sapiens
cagcaggaccgggaacuga

SEQ ID NO: 383387 - RNA, 19 nt, Homo sapiens
agagcggccucaaccgaaa

SEQ ID NO: 383388 - RNA, 19 nt, Homo sapiens
guauaccaguucccugagu

SEQ ID NO: 383389 - RNA, 19 nt, Homo sapiens
gcccaucaccgacuaugug

SEQ ID NO: 383390 - RNA, 19 nt, Homo sapiens
gcauaugcacgaccucaag

SEQ ID NO: 383391 - RNA, 19 nt, Homo sapiens
caaguuugggauccaugua

SEQ ID NO: 383392 - RNA, 19 nt, Homo sapiens
aacacacgguggacauuga

SEQ ID NO: 383393 - RNA, 19 nt, Homo sapiens
gaggagauugacaaguuug

SEQ ID NO: 383394 - RNA, 19 nt, Homo sapiens
ccagugagauccggaagcu

SEQ ID NO: 383395 - RNA, 19 nt, Homo sapiens
cgguggacauugaggagaa

SEQ ID NO: 383396 - RNA, 19 nt, Homo sapiens
aggcaaagcuaggcagaag

SEQ ID NO: 383397 - RNA, 19 nt, Homo sapiens
augaaggcauugcaugaga

SEQ ID NO: 383398 - RNA, 19 nt, Homo sapiens
accagcaguuugagcagua

SEQ ID NO: 383399 - RNA, 19 nt, Homo sapiens
gccagacgguagagauucu

SEQ ID NO: 383400 - RNA, 19 nt, Homo sapiens
ugacccuaauuuauucuca

SEQ ID NO: 383401 - RNA, 19 nt, Homo sapiens
ggacaagcaggacauugac

SEQ ID NO: 383402 - RNA, 19 nt, Homo sapiens
ggaugaaggaugaggaacu

SEQ ID NO: 383403 - RNA, 19 nt, Homo sapiens
uggagaaccaggcgcauug

SEQ ID NO: 383404 - RNA, 19 nt, Homo sapiens
gaaggcauugcaugagaag

SEQ ID NO: 383405 - RNA, 19 nt, Homo sapiens
gccaguggauguggguuuc

SEQ ID NO: 383406 - RNA, 19 nt, Homo sapiens
gugcacugcugccuauacu

SEQ ID NO: 383407 - RNA, 19 nt, Homo sapiens
gaagggagucaagcugaag

SEQ ID NO: 383408 - RNA, 19 nt, Homo sapiens
aaacacacgguggacauug

SEQ ID NO: 383409 - RNA, 19 nt, Homo sapiens
gggccgagucuucccuuau

SEQ ID NO: 383410 - RNA, 19 nt, Homo sapiens
aggacaagcaggacauuga

SEQ ID NO: 383411 - RNA, 19 nt, Homo sapiens
caaccgaaagaacauccaa

SEQ ID NO: 383412 - RNA, 19 nt, Homo sapiens
ggccucaaccgaaagaaca

SEQ ID NO: 383413 - RNA, 19 nt, Homo sapiens
ggacauugacaagcaguac

SEQ ID NO: 383414 - RNA, 19 nt, Homo sapiens
gcaggguugggcugaauca

SEQ ID NO: 383415 - RNA, 19 nt, Homo sapiens
cagccagacgguagagauu

SEQ ID NO: 383416 - RNA, 19 nt, Homo sapiens
guggauguggguuucauga

SEQ ID NO: 383417 - RNA, 19 nt, Homo sapiens
gaggacaagcaggacauug

SEQ ID NO: 383418 - RNA, 19 nt, Homo sapiens
gccgagacugagaagcuua

SEQ ID NO: 383419 - RNA, 19 nt, Homo sapiens
ccacagccucuuccugaca

SEQ ID NO: 383420 - RNA, 19 nt, Homo sapiens
gacggucacagcacccaaa

SEQ ID NO: 383421 - RNA, 19 nt, Homo sapiens
gggaucaggagcgaaguug

SEQ ID NO: 383422 - RNA, 19 nt, Homo sapiens
gagacugagaagcuuauca

SEQ ID NO: 383423 - RNA, 19 nt, Homo sapiens
uccagcagaugaccagcaa

SEQ ID NO: 383424 - RNA, 19 nt, Homo sapiens
ggccaguggauguggguuu

SEQ ID NO: 383425 - RNA, 19 nt, Homo sapiens
acaagcaggacauugacaa

SEQ ID NO: 383426 - RNA, 19 nt, Homo sapiens
ccgcaagucggugaagaaa

SEQ ID NO: 383427 - RNA, 19 nt, Homo sapiens
aggagaugcugcagaggau

SEQ ID NO: 383428 - RNA, 19 nt, Homo sapiens
caggaugaaggaugaggaa

SEQ ID NO: 383429 - RNA, 19 nt, Homo sapiens
ugacaaguuugggauccau

SEQ ID NO: 383430 - RNA, 19 nt, Homo sapiens
gucaacaucgugccucuca

SEQ ID NO: 383431 - RNA, 19 nt, Homo sapiens
gaaagaacauccaagacaa

SEQ ID NO: 383432 - RNA, 19 nt, Homo sapiens
gggaggagauugagcauuu

SEQ ID NO: 383433 - RNA, 19 nt, Homo sapiens
ggacagauccagaaacuga

SEQ ID NO: 383434 - RNA, 19 nt, Homo sapiens
ggaagccuguggcagaaua

SEQ ID NO: 383435 - RNA, 19 nt, Homo sapiens
gcaaguucgugaaggauuu

SEQ ID NO: 383436 - RNA, 19 nt, Homo sapiens
gaagagaggaucaugcaaa

SEQ ID NO: 383437 - RNA, 19 nt, Homo sapiens
gaacuuugccugggagaua

SEQ ID NO: 383438 - RNA, 19 nt, Homo sapiens
ggaccaagcccuaaaggaa

SEQ ID NO: 383439 - RNA, 19 nt, Homo sapiens
gaaaguccgugaagaaagg

SEQ ID NO: 383440 - RNA, 19 nt, Homo sapiens
uuucagcccuggauauuua

SEQ ID NO: 383441 - RNA, 19 nt, Homo sapiens
ggaacggaaucgcaacaaa

SEQ ID NO: 383442 - RNA, 19 nt, Homo sapiens
gccauuggauguugaauuc

SEQ ID NO: 383443 - RNA, 19 nt, Homo sapiens
ggaugaggacuucaaauug

SEQ ID NO: 383444 - RNA, 19 nt, Homo sapiens
gaugaggacuucaaauugc

SEQ ID NO: 383445 - RNA, 19 nt, Homo sapiens
ggagacacauuaugagaac

SEQ ID NO: 383446 - RNA, 19 nt, Homo sapiens
gaugaaggagaacuauuaa

SEQ ID NO: 383447 - RNA, 19 nt, Homo sapiens
agaugaaggagaacuauua

SEQ ID NO: 383448 - RNA, 19 nt, Homo sapiens
cagcaacacuguaguagag

SEQ ID NO: 383449 - RNA, 19 nt, Homo sapiens
gaccaagcccuaaaggaaa

SEQ ID NO: 383450 - RNA, 19 nt, Homo sapiens
cgaaagaacauccaagaca

SEQ ID NO: 383451 - RNA, 19 nt, Homo sapiens
gaaggagaacuauuaacug

SEQ ID NO: 383452 - RNA, 19 nt, Homo sapiens
caaggaguaugugggcuuu

SEQ ID NO: 383453 - RNA, 19 nt, Homo sapiens
aagcugggaucaagcguuu

SEQ ID NO: 383454 - RNA, 19 nt, Homo sapiens
gcacugcgacuuugugaag

SEQ ID NO: 383455 - RNA, 19 nt, Homo sapiens
ggaaucaagaucuaucaau

SEQ ID NO: 383456 - RNA, 19 nt, Homo sapiens
caaacugacucgggaaagu

SEQ ID NO: 383457 - RNA, 19 nt, Homo sapiens
gagaggaucaugcaaacug

SEQ ID NO: 383458 - RNA, 19 nt, Homo sapiens
gcccagagacucagaggaa

SEQ ID NO: 383459 - RNA, 19 nt, Homo sapiens
uaaaggaaagcaucccauu

SEQ ID NO: 383460 - RNA, 19 nt, Homo sapiens
gggcaagcuugaucccuau

SEQ ID NO: 383461 - RNA, 19 nt, Homo sapiens
ccaggaagccagacaacaa

SEQ ID NO: 383462 - RNA, 19 nt, Homo sapiens
caucccauuugcaguaauu

SEQ ID NO: 383463 - RNA, 19 nt, Homo sapiens
auacauugaucagcaguuu

SEQ ID NO: 383464 - RNA, 19 nt, Homo sapiens
gaaacuucuuggugcugaa

SEQ ID NO: 383465 - RNA, 19 nt, Homo sapiens
gugaaggauuucucaggaa

SEQ ID NO: 383466 - RNA, 19 nt, Homo sapiens
uaaaucuccuccucuucuu

SEQ ID NO: 383467 - RNA, 19 nt, Homo sapiens
gaacggaaucgcaacaaac

SEQ ID NO: 383468 - RNA, 19 nt, Homo sapiens
aaggaaagcaucccauuug

SEQ ID NO: 383469 - RNA, 19 nt, Homo sapiens
agaguggccugaaccgaaa

SEQ ID NO: 383470 - RNA, 19 nt, Homo sapiens
ccaaccaaguccaccgaaa

SEQ ID NO: 383471 - RNA, 19 nt, Homo sapiens
aaaggaaagcaucccauuu

SEQ ID NO: 383472 - RNA, 19 nt, Homo sapiens
ggagaucacuaagcaugca

SEQ ID NO: 383473 - RNA, 19 nt, Homo sapiens
aauccacacuugucaauag

SEQ ID NO: 383474 - RNA, 19 nt, Homo sapiens
ugagcaaguucgugaagga

SEQ ID NO: 383475 - RNA, 19 nt, Homo sapiens
cagagacucagaggaaaua

SEQ ID NO: 383476 - RNA, 19 nt, Homo sapiens
cuacugccacuucgccuua

SEQ ID NO: 383477 - RNA, 19 nt, Homo sapiens
ccagaaacugagaagcuua

SEQ ID NO: 383478 - RNA, 19 nt, Homo sapiens
caccacggaugauggagaa

SEQ ID NO: 383479 - RNA, 19 nt, Homo sapiens
ggacaccacggaugaugga

SEQ ID NO: 383480 - RNA, 19 nt, Homo sapiens
gggagacacauuaugagaa

SEQ ID NO: 383481 - RNA, 19 nt, Homo sapiens
aaacuguggagaucacuaa

SEQ ID NO: 383482 - RNA, 19 nt, Homo sapiens
gcaaauccacacuugucaa

SEQ ID NO: 383483 - RNA, 19 nt, Homo sapiens
gcuaagaccugggcaucca

SEQ ID NO: 383484 - RNA, 19 nt, Homo sapiens
gaaccgaaagaacauccaa

SEQ ID NO: 383485 - RNA, 19 nt, Homo sapiens
caaauccacacuugucaau

SEQ ID NO: 383486 - RNA, 19 nt, Homo sapiens
gcagcaacacuguaguaga

SEQ ID NO: 383487 - RNA, 19 nt, Homo sapiens
aagcaucccauuugcagua

SEQ ID NO: 383488 - RNA, 19 nt, Homo sapiens
ggacugaagcugggaucaa

SEQ ID NO: 383489 - RNA, 19 nt, Homo sapiens
ggaccucuaugaugaugac

SEQ ID NO: 383490 - RNA, 19 nt, Homo sapiens
ugaaggagaacuauuaacu

SEQ ID NO: 383491 - RNA, 19 nt, Homo sapiens
cggaaucgcaacaaacuga

SEQ ID NO: 383492 - RNA, 19 nt, Homo sapiens
ggagauaaaauuagaccua

SEQ ID NO: 383493 - RNA, 19 nt, Homo sapiens
ccagggcacugcgacuuug

SEQ ID NO: 383494 - RNA, 19 nt, Homo sapiens
ggaaagcaucccauuugca

SEQ ID NO: 383495 - RNA, 19 nt, Homo sapiens
gggcaaauccacacuuguc

SEQ ID NO: 383496 - RNA, 19 nt, Homo sapiens
gacugaagcugggaucaag

SEQ ID NO: 383497 - RNA, 19 nt, Homo sapiens
gagacucagaggaaauaaa

SEQ ID NO: 383498 - RNA, 19 nt, Homo sapiens
agacaacaacagcaucaaa

SEQ ID NO: 383499 - RNA, 19 nt, Homo sapiens
caagcuugaucccuaugau

SEQ ID NO: 383500 - RNA, 19 nt, Homo sapiens
gcaagcuugaucccuauga

SEQ ID NO: 383501 - RNA, 19 nt, Homo sapiens
gcaggagaugcuacacaaa

SEQ ID NO: 383502 - RNA, 19 nt, Homo sapiens
ugcaggagaugcuacacaa

SEQ ID NO: 383503 - RNA, 19 nt, Homo sapiens
aggaugaggacuucaaauu

SEQ ID NO: 383504 - RNA, 19 nt, Homo sapiens
ggccugaaccgaaagaaca

SEQ ID NO: 383505 - RNA, 19 nt, Homo sapiens
ggagaugcuacacaaaaua

SEQ ID NO: 383506 - RNA, 19 nt, Homo sapiens
gagaagcuuauccgagaga

SEQ ID NO: 383507 - RNA, 19 nt, Homo sapiens
agacacauuaugagaacua

SEQ ID NO: 383508 - RNA, 19 nt, Homo sapiens
aauuagaccuagagcuuuc

SEQ ID NO: 383509 - RNA, 19 nt, Homo sapiens
gcaguggacauagaagaga

SEQ ID NO: 383510 - RNA, 19 nt, Homo sapiens
gcaugcaguggacauagaa

SEQ ID NO: 383511 - RNA, 19 nt, Homo sapiens
gcacugcugccuguacuuc

SEQ ID NO: 383512 - RNA, 19 nt, Homo sapiens
caguggacauagaagagaa

SEQ ID NO: 383513 - RNA, 19 nt, Homo sapiens
caaccaaguccaccgaaag

SEQ ID NO: 383514 - RNA, 19 nt, Homo sapiens
gaagcuuauccgagagaaa

SEQ ID NO: 383515 - RNA, 19 nt, Homo sapiens
caaggcuguuucugugugu

SEQ ID NO: 383516 - RNA, 19 nt, Homo sapiens
acauugaucagcaguuuga

SEQ ID NO: 383517 - RNA, 19 nt, Homo sapiens
ccgaaaguccgugaagaaa

SEQ ID NO: 383518 - RNA, 19 nt, Homo sapiens
gaugaugaccuggaguuca

SEQ ID NO: 383519 - RNA, 19 nt, Homo sapiens
acugacaccucccgaagug

SEQ ID NO: 383520 - RNA, 19 nt, Homo sapiens
caccgaaaguccgugaaga

SEQ ID NO: 383521 - RNA, 19 nt, Homo sapiens
acucagaggaaauaaaguu

SEQ ID NO: 383522 - RNA, 19 nt, Homo sapiens
gggcaucguggaaguggaa

SEQ ID NO: 383523 - RNA, 19 nt, Homo sapiens
gcaguaauuggcagcaaca

SEQ ID NO: 383524 - RNA, 19 nt, Homo sapiens
gcuaaggcagacacacuga

SEQ ID NO: 383525 - RNA, 19 nt, Homo sapiens
gggucaacaucgugccuau

SEQ ID NO: 383526 - RNA, 19 nt, Homo sapiens
cauuggauguugaauucau

SEQ ID NO: 383527 - RNA, 19 nt, Homo sapiens
ggccauuggauguugaauu

SEQ ID NO: 383528 - RNA, 19 nt, Homo sapiens
ccagacaacaacagcauca

SEQ ID NO: 383529 - RNA, 19 nt, Homo sapiens
acuauuaacuggcuuucag

SEQ ID NO: 383530 - RNA, 19 nt, Homo sapiens
cagaaacugagaagcuuau

SEQ ID NO: 383531 - RNA, 19 nt, Homo sapiens
gaaagaacauccaagacaa

SEQ ID NO: 383532 - RNA, 19 nt, Homo sapiens
gggaggagauugagcauuu

SEQ ID NO: 383533 - RNA, 19 nt, Homo sapiens
ggacagauccagaaacuga

SEQ ID NO: 383534 - RNA, 19 nt, Homo sapiens
ggaagccuguggcagaaua

SEQ ID NO: 383535 - RNA, 19 nt, Homo sapiens
gcaaguucgugaaggauuu

SEQ ID NO: 383536 - RNA, 19 nt, Homo sapiens
gaagagaggaucaugcaaa

SEQ ID NO: 383537 - RNA, 19 nt, Homo sapiens
ggaccaagcccuaaaggaa

SEQ ID NO: 383538 - RNA, 19 nt, Homo sapiens
gaaaguccgugaagaaagg

SEQ ID NO: 383539 - RNA, 19 nt, Homo sapiens
uuucagcccuggauauuua

SEQ ID NO: 383540 - RNA, 19 nt, Homo sapiens
ggaacggaaucgcaaguau

SEQ ID NO: 383541 - RNA, 19 nt, Homo sapiens
gccauuggauguugaauuc

SEQ ID NO: 383542 - RNA, 19 nt, Homo sapiens
ggaugaggacuucaaauug

SEQ ID NO: 383543 - RNA, 19 nt, Homo sapiens
gaugaggacuucaaauugc

SEQ ID NO: 383544 - RNA, 19 nt, Homo sapiens
ggagacacauuaugagaac

SEQ ID NO: 383545 - RNA, 19 nt, Homo sapiens
gaugaaggagaacuauuaa

SEQ ID NO: 383546 - RNA, 19 nt, Homo sapiens
agaugaaggagaacuauua

SEQ ID NO: 383547 - RNA, 19 nt, Homo sapiens
cagcaacacuguaguagag

SEQ ID NO: 383548 - RNA, 19 nt, Homo sapiens
gaacggaaucgcaaguaug

SEQ ID NO: 383549 - RNA, 19 nt, Homo sapiens
gaccaagcccuaaaggaaa

SEQ ID NO: 383550 - RNA, 19 nt, Homo sapiens
cgaaagaacauccaagaca

SEQ ID NO: 383551 - RNA, 19 nt, Homo sapiens
gaaggagaacuauuaacug

SEQ ID NO: 383552 - RNA, 19 nt, Homo sapiens
caaggaguaugugggcuuu

SEQ ID NO: 383553 - RNA, 19 nt, Homo sapiens
gcacugcgacuuugugaag

SEQ ID NO: 383554 - RNA, 19 nt, Homo sapiens
ggaaucaagaucuaucaau

SEQ ID NO: 383555 - RNA, 19 nt, Homo sapiens
caaacugacucgggaaagu

SEQ ID NO: 383556 - RNA, 19 nt, Homo sapiens
gagaggaucaugcaaacug

SEQ ID NO: 383557 - RNA, 19 nt, Homo sapiens
gcccagagacucagaggaa

SEQ ID NO: 383558 - RNA, 19 nt, Homo sapiens
uaaaggaaagcaucccauu

SEQ ID NO: 383559 - RNA, 19 nt, Homo sapiens
gggcaagcuugaucccuau

SEQ ID NO: 383560 - RNA, 19 nt, Homo sapiens
gugaaggauuucucaggaa

SEQ ID NO: 383561 - RNA, 19 nt, Homo sapiens
caucccauuugcaguaauu

SEQ ID NO: 383562 - RNA, 19 nt, Homo sapiens
auacauugaucagcaguuu

SEQ ID NO: 383563 - RNA, 19 nt, Homo sapiens
gaaacuucuuggugcugaa

SEQ ID NO: 383564 - RNA, 19 nt, Homo sapiens
uaaaucuccuccucuucuu

SEQ ID NO: 383565 - RNA, 19 nt, Homo sapiens
aaggaaagcaucccauuug

SEQ ID NO: 383566 - RNA, 19 nt, Homo sapiens
agaguggccugaaccgaaa

SEQ ID NO: 383567 - RNA, 19 nt, Homo sapiens
ccaaccaaguccaccgaaa

SEQ ID NO: 383568 - RNA, 19 nt, Homo sapiens
aaaggaaagcaucccauuu

SEQ ID NO: 383569 - RNA, 19 nt, Homo sapiens
ggagaucacuaagcaugca

SEQ ID NO: 383570 - RNA, 19 nt, Homo sapiens
aauccacacuugucaauag

SEQ ID NO: 383571 - RNA, 19 nt, Homo sapiens
ugagcaaguucgugaagga

SEQ ID NO: 383572 - RNA, 19 nt, Homo sapiens
cagagacucagaggaaaua

SEQ ID NO: 383573 - RNA, 19 nt, Homo sapiens
cuacugccacuucgccuua

SEQ ID NO: 383574 - RNA, 19 nt, Homo sapiens
caccacggaugauggagaa

SEQ ID NO: 383575 - RNA, 19 nt, Homo sapiens
ccagaaacugagaagcuua

SEQ ID NO: 383576 - RNA, 19 nt, Homo sapiens
ggacaccacggaugaugga

SEQ ID NO: 383577 - RNA, 19 nt, Homo sapiens
gcuaagaccugggcaucca

SEQ ID NO: 383578 - RNA, 19 nt, Homo sapiens
gaccagaagccaggacaaa

SEQ ID NO: 383579 - RNA, 19 nt, Homo sapiens
gggagacacauuaugagaa

SEQ ID NO: 383580 - RNA, 19 nt, Homo sapiens
cagccaugaucaagcguuu

SEQ ID NO: 383581 - RNA, 19 nt, Homo sapiens
aaacuguggagaucacuaa

SEQ ID NO: 383582 - RNA, 19 nt, Homo sapiens
gcaaauccacacuugucaa

SEQ ID NO: 383583 - RNA, 19 nt, Homo sapiens
gaaccgaaagaacauccaa

SEQ ID NO: 383584 - RNA, 19 nt, Homo sapiens
caaauccacacuugucaau

SEQ ID NO: 383585 - RNA, 19 nt, Homo sapiens
gcagcaacacuguaguaga

SEQ ID NO: 383586 - RNA, 19 nt, Homo sapiens
aagcaucccauuugcagua

SEQ ID NO: 383587 - RNA, 19 nt, Homo sapiens
ggaccucuaugaugaugac

SEQ ID NO: 383588 - RNA, 19 nt, Homo sapiens
ugaaggagaacuauuaacu

SEQ ID NO: 383589 - RNA, 19 nt, Homo sapiens
ccagggcacugcgacuuug

SEQ ID NO: 383590 - RNA, 19 nt, Homo sapiens
ggaaagcaucccauuugca

SEQ ID NO: 383591 - RNA, 19 nt, Homo sapiens
gggcaaauccacacuuguc

SEQ ID NO: 383592 - RNA, 19 nt, Homo sapiens
gagacucagaggaaauaaa

SEQ ID NO: 383593 - RNA, 19 nt, Homo sapiens
caagcuugaucccuaugau

SEQ ID NO: 383594 - RNA, 19 nt, Homo sapiens
gcaagcuugaucccuauga

SEQ ID NO: 383595 - RNA, 19 nt, Homo sapiens
gcaggagaugcuacacaaa

SEQ ID NO: 383596 - RNA, 19 nt, Homo sapiens
ugcaggagaugcuacacaa

SEQ ID NO: 383597 - RNA, 19 nt, Homo sapiens
aggaugaggacuucaaauu

SEQ ID NO: 383598 - RNA, 19 nt, Homo sapiens
ggccugaaccgaaagaaca

SEQ ID NO: 383599 - RNA, 19 nt, Homo sapiens
ggagaugcuacacaaaaua

SEQ ID NO: 383600 - RNA, 19 nt, Homo sapiens
gagaagcuuauccgagaga

SEQ ID NO: 383601 - RNA, 19 nt, Homo sapiens
agacacauuaugagaacua

SEQ ID NO: 383602 - RNA, 19 nt, Homo sapiens
caagggaacaggccaagag

SEQ ID NO: 383603 - RNA, 19 nt, Homo sapiens
gcaguggacauagaagaga

SEQ ID NO: 383604 - RNA, 19 nt, Homo sapiens
gcaugcaguggacauagaa

SEQ ID NO: 383605 - RNA, 19 nt, Homo sapiens
gcacugcugccuguacuuc

SEQ ID NO: 383606 - RNA, 19 nt, Homo sapiens
caguggacauagaagagaa

SEQ ID NO: 383607 - RNA, 19 nt, Homo sapiens
caaccaaguccaccgaaag

SEQ ID NO: 383608 - RNA, 19 nt, Homo sapiens
gaagcuuauccgagagaaa

SEQ ID NO: 383609 - RNA, 19 nt, Homo sapiens
gaugaugaccuggaguuca

SEQ ID NO: 383610 - RNA, 19 nt, Homo sapiens
acauugaucagcaguuuga

SEQ ID NO: 383611 - RNA, 19 nt, Homo sapiens
ccgaaaguccgugaagaaa

SEQ ID NO: 383612 - RNA, 19 nt, Homo sapiens
acugacaccucccgaagug

SEQ ID NO: 383613 - RNA, 19 nt, Homo sapiens
caccgaaaguccgugaaga

SEQ ID NO: 383614 - RNA, 19 nt, Homo sapiens
acucagaggaaauaaaguu

SEQ ID NO: 383615 - RNA, 19 nt, Homo sapiens
ucgcaaguaugaccagaag

SEQ ID NO: 383616 - RNA, 19 nt, Homo sapiens
gggcaucguggaaguggaa

SEQ ID NO: 383617 - RNA, 19 nt, Homo sapiens
gcaguaauuggcagcaaca

SEQ ID NO: 383618 - RNA, 19 nt, Homo sapiens
gcuaaggcagacacacuga

SEQ ID NO: 383619 - RNA, 19 nt, Homo sapiens
gggucaacaucgugccuau

SEQ ID NO: 383620 - RNA, 19 nt, Homo sapiens
cauuggauguugaauucau

SEQ ID NO: 383621 - RNA, 19 nt, Homo sapiens
ggccauuggauguugaauu

SEQ ID NO: 383622 - RNA, 19 nt, Homo sapiens
ccucugacaaccagcagua

SEQ ID NO: 383623 - RNA, 19 nt, Homo sapiens
acuauuaacuggcuuucag

SEQ ID NO: 383624 - RNA, 19 nt, Homo sapiens
cagaaacugagaagcuuau

SEQ ID NO: 383625 - RNA, 19 nt, Homo sapiens
caugcaaacuguggagauc

SEQ ID NO: 383626 - RNA, 19 nt, Homo sapiens
aagagaggaucaugcaaac

SEQ ID NO: 383627 - RNA, 19 nt, Homo sapiens
agacucagaggaaauaaag

SEQ ID NO: 383628 - RNA, 19 nt, Homo sapiens
gcuuucagcccuggauauu

SEQ ID NO: 383629 - RNA, 19 nt, Homo sapiens
uggcagcaacacuguagua

SEQ ID NO: 383630 - RNA, 19 nt, Homo sapiens
ucaugaaggcccugcauca

SEQ ID NO: 383631 - RNA, 19 nt, Homo sapiens
gaaagaacauccaagacaa

SEQ ID NO: 383632 - RNA, 19 nt, Homo sapiens
gggaggagauugagcauuu

SEQ ID NO: 383633 - RNA, 19 nt, Homo sapiens
ggacagauccagaaacuga

SEQ ID NO: 383634 - RNA, 19 nt, Homo sapiens
ggaagccuguggcagaaua

SEQ ID NO: 383635 - RNA, 19 nt, Homo sapiens
gcaaguucgugaaggauuu

SEQ ID NO: 383636 - RNA, 19 nt, Homo sapiens
gaagagaggaucaugcaaa

SEQ ID NO: 383637 - RNA, 19 nt, Homo sapiens
ggaccaagcccuaaaggaa

SEQ ID NO: 383638 - RNA, 19 nt, Homo sapiens
gaaaguccgugaagaaagg

SEQ ID NO: 383639 - RNA, 19 nt, Homo sapiens
uuucagcccuggauauuua

SEQ ID NO: 383640 - RNA, 19 nt, Homo sapiens
ggaacggaaucgcaacaaa

SEQ ID NO: 383641 - RNA, 19 nt, Homo sapiens
gccauuggauguugaauuc

SEQ ID NO: 383642 - RNA, 19 nt, Homo sapiens
ggaugaggacuucaaauug

SEQ ID NO: 383643 - RNA, 19 nt, Homo sapiens
gaugaggacuucaaauugc

SEQ ID NO: 383644 - RNA, 19 nt, Homo sapiens
ggagacacauuaugagaac

SEQ ID NO: 383645 - RNA, 19 nt, Homo sapiens
gaugaaggagaacuauuaa

SEQ ID NO: 383646 - RNA, 19 nt, Homo sapiens
agaugaaggagaacuauua

SEQ ID NO: 383647 - RNA, 19 nt, Homo sapiens
cagcaacacuguaguagag

SEQ ID NO: 383648 - RNA, 19 nt, Homo sapiens
gaccaagcccuaaaggaaa

SEQ ID NO: 383649 - RNA, 19 nt, Homo sapiens
cgaaagaacauccaagaca

SEQ ID NO: 383650 - RNA, 19 nt, Homo sapiens
gaaggagaacuauuaacug

SEQ ID NO: 383651 - RNA, 19 nt, Homo sapiens
caaggaguaugugggcuuu

SEQ ID NO: 383652 - RNA, 19 nt, Homo sapiens
gcacugcgacuuugugaag

SEQ ID NO: 383653 - RNA, 19 nt, Homo sapiens
ggaaucaagaucuaucaau

SEQ ID NO: 383654 - RNA, 19 nt, Homo sapiens
caaacugacucgggaaagu

SEQ ID NO: 383655 - RNA, 19 nt, Homo sapiens
gagaggaucaugcaaacug

SEQ ID NO: 383656 - RNA, 19 nt, Homo sapiens
gcccagagacucagaggaa

SEQ ID NO: 383657 - RNA, 19 nt, Homo sapiens
uaaaggaaagcaucccauu

SEQ ID NO: 383658 - RNA, 19 nt, Homo sapiens
gggcaagcuugaucccuau

SEQ ID NO: 383659 - RNA, 19 nt, Homo sapiens
caucccauuugcaguaauu

SEQ ID NO: 383660 - RNA, 19 nt, Homo sapiens
auacauugaucagcaguuu

SEQ ID NO: 383661 - RNA, 19 nt, Homo sapiens
gugaaggauuucucaggaa

SEQ ID NO: 383662 - RNA, 19 nt, Homo sapiens
gaaacuucuuggugcugaa

SEQ ID NO: 383663 - RNA, 19 nt, Homo sapiens
uaaaucuccuccucuucuu

SEQ ID NO: 383664 - RNA, 19 nt, Homo sapiens
gaacggaaucgcaacaaac

SEQ ID NO: 383665 - RNA, 19 nt, Homo sapiens
aaggaaagcaucccauuug

SEQ ID NO: 383666 - RNA, 19 nt, Homo sapiens
agaguggccugaaccgaaa

SEQ ID NO: 383667 - RNA, 19 nt, Homo sapiens
ccaaccaaguccaccgaaa

SEQ ID NO: 383668 - RNA, 19 nt, Homo sapiens
aaaggaaagcaucccauuu

SEQ ID NO: 383669 - RNA, 19 nt, Homo sapiens
ggagaucacuaagcaugca

SEQ ID NO: 383670 - RNA, 19 nt, Homo sapiens
aauccacacuugucaauag

SEQ ID NO: 383671 - RNA, 19 nt, Homo sapiens
ugagcaaguucgugaagga

SEQ ID NO: 383672 - RNA, 19 nt, Homo sapiens
cagagacucagaggaaaua

SEQ ID NO: 383673 - RNA, 19 nt, Homo sapiens
cuacugccacuucgccuua

SEQ ID NO: 383674 - RNA, 19 nt, Homo sapiens
caccacggaugauggagaa

SEQ ID NO: 383675 - RNA, 19 nt, Homo sapiens
ccagaaacugagaagcuua

SEQ ID NO: 383676 - RNA, 19 nt, Homo sapiens
ggacaccacggaugaugga

SEQ ID NO: 383677 - RNA, 19 nt, Homo sapiens
gggagacacauuaugagaa

SEQ ID NO: 383678 - RNA, 19 nt, Homo sapiens
cagccaugaucaagcguuu

SEQ ID NO: 383679 - RNA, 19 nt, Homo sapiens
gcuaagaccugggcaucca

SEQ ID NO: 383680 - RNA, 19 nt, Homo sapiens
aaacuguggagaucacuaa

SEQ ID NO: 383681 - RNA, 19 nt, Homo sapiens
gcaaauccacacuugucaa

SEQ ID NO: 383682 - RNA, 19 nt, Homo sapiens
gaaccgaaagaacauccaa

SEQ ID NO: 383683 - RNA, 19 nt, Homo sapiens
caaauccacacuugucaau

SEQ ID NO: 383684 - RNA, 19 nt, Homo sapiens
gcagcaacacuguaguaga

SEQ ID NO: 383685 - RNA, 19 nt, Homo sapiens
aagcaucccauuugcagua

SEQ ID NO: 383686 - RNA, 19 nt, Homo sapiens
ggaccucuaugaugaugac

SEQ ID NO: 383687 - RNA, 19 nt, Homo sapiens
ugaaggagaacuauuaacu

SEQ ID NO: 383688 - RNA, 19 nt, Homo sapiens
cggaaucgcaacaaacuga

SEQ ID NO: 383689 - RNA, 19 nt, Homo sapiens
ccagggcacugcgacuuug

SEQ ID NO: 383690 - RNA, 19 nt, Homo sapiens
ggaaagcaucccauuugca

SEQ ID NO: 383691 - RNA, 19 nt, Homo sapiens
gggcaaauccacacuuguc

SEQ ID NO: 383692 - RNA, 19 nt, Homo sapiens
gagacucagaggaaauaaa

SEQ ID NO: 383693 - RNA, 19 nt, Homo sapiens
gcaagcuugaucccuauga

SEQ ID NO: 383694 - RNA, 19 nt, Homo sapiens
caagcuugaucccuaugau

SEQ ID NO: 383695 - RNA, 19 nt, Homo sapiens
gcaggagaugcuacacaaa

SEQ ID NO: 383696 - RNA, 19 nt, Homo sapiens
ugcaggagaugcuacacaa

SEQ ID NO: 383697 - RNA, 19 nt, Homo sapiens
aggaugaggacuucaaauu

SEQ ID NO: 383698 - RNA, 19 nt, Homo sapiens
ggccugaaccgaaagaaca

SEQ ID NO: 383699 - RNA, 19 nt, Homo sapiens
ggagaugcuacacaaaaua

SEQ ID NO: 383700 - RNA, 19 nt, Homo sapiens
gagaagcuuauccgagaga

SEQ ID NO: 383701 - RNA, 19 nt, Homo sapiens
agacacauuaugagaacua

SEQ ID NO: 383702 - RNA, 19 nt, Homo sapiens
gcaguggacauagaagaga

SEQ ID NO: 383703 - RNA, 19 nt, Homo sapiens
gcaugcaguggacauagaa

SEQ ID NO: 383704 - RNA, 19 nt, Homo sapiens
gcacugcugccuguacuuc

SEQ ID NO: 383705 - RNA, 19 nt, Homo sapiens
caguggacauagaagagaa

SEQ ID NO: 383706 - RNA, 19 nt, Homo sapiens
caaccaaguccaccgaaag

SEQ ID NO: 383707 - RNA, 19 nt, Homo sapiens
gaagcuuauccgagagaaa

SEQ ID NO: 383708 - RNA, 19 nt, Homo sapiens
gaugaugaccuggaguuca

SEQ ID NO: 383709 - RNA, 19 nt, Homo sapiens
acauugaucagcaguuuga

SEQ ID NO: 383710 - RNA, 19 nt, Homo sapiens
ccgaaaguccgugaagaaa

SEQ ID NO: 383711 - RNA, 19 nt, Homo sapiens
acugacaccucccgaagug

SEQ ID NO: 383712 - RNA, 19 nt, Homo sapiens
caccgaaaguccgugaaga

SEQ ID NO: 383713 - RNA, 19 nt, Homo sapiens
acucagaggaaauaaaguu

SEQ ID NO: 383714 - RNA, 19 nt, Homo sapiens
gggcaucguggaaguggaa

SEQ ID NO: 383715 - RNA, 19 nt, Homo sapiens
gcaguaauuggcagcaaca

SEQ ID NO: 383716 - RNA, 19 nt, Homo sapiens
gcuaaggcagacacacuga

SEQ ID NO: 383717 - RNA, 19 nt, Homo sapiens
gggucaacaucgugccuau

SEQ ID NO: 383718 - RNA, 19 nt, Homo sapiens
cauuggauguugaauucau

SEQ ID NO: 383719 - RNA, 19 nt, Homo sapiens
ggccauuggauguugaauu

SEQ ID NO: 383720 - RNA, 19 nt, Homo sapiens
ccucugacaaccagcagua

SEQ ID NO: 383721 - RNA, 19 nt, Homo sapiens
acuauuaacuggcuuucag

SEQ ID NO: 383722 - RNA, 19 nt, Homo sapiens
cagaaacugagaagcuuau

SEQ ID NO: 383723 - RNA, 19 nt, Homo sapiens
caugcaaacuguggagauc

SEQ ID NO: 383724 - RNA, 19 nt, Homo sapiens
aagagaggaucaugcaaac

SEQ ID NO: 383725 - RNA, 19 nt, Homo sapiens
agacucagaggaaauaaag

SEQ ID NO: 383726 - RNA, 19 nt, Homo sapiens
gcuuucagcccuggauauu

SEQ ID NO: 383727 - RNA, 19 nt, Homo sapiens
uggcagcaacacuguagua

SEQ ID NO: 383728 - RNA, 19 nt, Homo sapiens
ucaugaaggcccugcauca

SEQ ID NO: 383729 - RNA, 19 nt, Homo sapiens
ugaugaggaugaggacuuc

SEQ ID NO: 383730 - RNA, 19 nt, Homo sapiens
cgaaaguccgugaagaaag

SEQ ID NO: 383731 - RNA, 19 nt, Homo sapiens
gaaagaacauccaagacaa

SEQ ID NO: 383732 - RNA, 19 nt, Homo sapiens
gggaggagauugagcauuu

SEQ ID NO: 383733 - RNA, 19 nt, Homo sapiens
ggacagauccagaaacuga

SEQ ID NO: 383734 - RNA, 19 nt, Homo sapiens
ggaagccuguggcagaaua

SEQ ID NO: 383735 - RNA, 19 nt, Homo sapiens
gcaaguucgugaaggauuu

SEQ ID NO: 383736 - RNA, 19 nt, Homo sapiens
gaagagaggaucaugcaaa

SEQ ID NO: 383737 - RNA, 19 nt, Homo sapiens
caagggcacuggaaauuug

SEQ ID NO: 383738 - RNA, 19 nt, Homo sapiens
gaacuuugccugggagaua

SEQ ID NO: 383739 - RNA, 19 nt, Homo sapiens
ggaccaagcccuaaaggaa

SEQ ID NO: 383740 - RNA, 19 nt, Homo sapiens
gaaaguccgugaagaaagg

SEQ ID NO: 383741 - RNA, 19 nt, Homo sapiens
uuucagcccuggauauuua

SEQ ID NO: 383742 - RNA, 19 nt, Homo sapiens
ggaacggaaucgcaaguau

SEQ ID NO: 383743 - RNA, 19 nt, Homo sapiens
gaugggaacucacagaagu

SEQ ID NO: 383744 - RNA, 19 nt, Homo sapiens
gccauuggauguugaauuc

SEQ ID NO: 383745 - RNA, 19 nt, Homo sapiens
ggaugaggacuucaaauug

SEQ ID NO: 383746 - RNA, 19 nt, Homo sapiens
gaugaggacuucaaauugc

SEQ ID NO: 383747 - RNA, 19 nt, Homo sapiens
ggagacacauuaugagaac

SEQ ID NO: 383748 - RNA, 19 nt, Homo sapiens
gaugaaggagaacuauuaa

SEQ ID NO: 383749 - RNA, 19 nt, Homo sapiens
agaugaaggagaacuauua

SEQ ID NO: 383750 - RNA, 19 nt, Homo sapiens
cagcaacacuguaguagag

SEQ ID NO: 383751 - RNA, 19 nt, Homo sapiens
gaacggaaucgcaaguaug

SEQ ID NO: 383752 - RNA, 19 nt, Homo sapiens
gaccaagcccuaaaggaaa

SEQ ID NO: 383753 - RNA, 19 nt, Homo sapiens
cgaaagaacauccaagaca

SEQ ID NO: 383754 - RNA, 19 nt, Homo sapiens
gaaggagaacuauuaacug

SEQ ID NO: 383755 - RNA, 19 nt, Homo sapiens
caaggaguaugugggcuuu

SEQ ID NO: 383756 - RNA, 19 nt, Homo sapiens
aagcugggaucaagcguuu

SEQ ID NO: 383757 - RNA, 19 nt, Homo sapiens
gcacugcgacuuugugaag

SEQ ID NO: 383758 - RNA, 19 nt, Homo sapiens
ggaaucaagaucuaucaau

SEQ ID NO: 383759 - RNA, 19 nt, Homo sapiens
caaacugacucgggaaagu

SEQ ID NO: 383760 - RNA, 19 nt, Homo sapiens
gagaggaucaugcaaacug

SEQ ID NO: 383761 - RNA, 19 nt, Homo sapiens
gcccagagacucagaggaa

SEQ ID NO: 383762 - RNA, 19 nt, Homo sapiens
uaaaggaaagcaucccauu

SEQ ID NO: 383763 - RNA, 19 nt, Homo sapiens
gagcagagugugugugugu

SEQ ID NO: 383764 - RNA, 19 nt, Homo sapiens
gggcaagcuugaucccuau

SEQ ID NO: 383765 - RNA, 19 nt, Homo sapiens
ccaggaagccagacaacaa

SEQ ID NO: 383766 - RNA, 19 nt, Homo sapiens
caucccauuugcaguaauu

SEQ ID NO: 383767 - RNA, 19 nt, Homo sapiens
auacauugaucagcaguuu

SEQ ID NO: 383768 - RNA, 19 nt, Homo sapiens
gaaacuucuuggugcugaa

SEQ ID NO: 383769 - RNA, 19 nt, Homo sapiens
gugaaggauuucucaggaa

SEQ ID NO: 383770 - RNA, 19 nt, Homo sapiens
uaaaucuccuccucuucuu

SEQ ID NO: 383771 - RNA, 19 nt, Homo sapiens
aaggaaagcaucccauuug

SEQ ID NO: 383772 - RNA, 19 nt, Homo sapiens
agaguggccugaaccgaaa

SEQ ID NO: 383773 - RNA, 19 nt, Homo sapiens
ccaaccaaguccaccgaaa

SEQ ID NO: 383774 - RNA, 19 nt, Homo sapiens
aaaggaaagcaucccauuu

SEQ ID NO: 383775 - RNA, 19 nt, Homo sapiens
ggagaucacuaagcaugca

SEQ ID NO: 383776 - RNA, 19 nt, Homo sapiens
aauccacacuugucaauag

SEQ ID NO: 383777 - RNA, 19 nt, Homo sapiens
ccaagggcacuggaaauuu

SEQ ID NO: 383778 - RNA, 19 nt, Homo sapiens
ugagcaaguucgugaagga

SEQ ID NO: 383779 - RNA, 19 nt, Homo sapiens
cagagacucagaggaaaua

SEQ ID NO: 383780 - RNA, 19 nt, Homo sapiens
cuacugccacuucgccuua

SEQ ID NO: 383781 - RNA, 19 nt, Homo sapiens
ccagaaacugagaagcuua

SEQ ID NO: 383782 - RNA, 19 nt, Homo sapiens
gaaagggagagaagauugg

SEQ ID NO: 383783 - RNA, 19 nt, Homo sapiens
caccacggaugauggagaa

SEQ ID NO: 383784 - RNA, 19 nt, Homo sapiens
ggacaccacggaugaugga

SEQ ID NO: 383785 - RNA, 19 nt, Homo sapiens
gaccagaagccaggacaaa

SEQ ID NO: 383786 - RNA, 19 nt, Homo sapiens
gggagacacauuaugagaa

SEQ ID NO: 383787 - RNA, 19 nt, Homo sapiens
aaacuguggagaucacuaa

SEQ ID NO: 383788 - RNA, 19 nt, Homo sapiens
gcaaauccacacuugucaa

SEQ ID NO: 383789 - RNA, 19 nt, Homo sapiens
gcuaagaccugggcaucca

SEQ ID NO: 383790 - RNA, 19 nt, Homo sapiens
gaaccgaaagaacauccaa

SEQ ID NO: 383791 - RNA, 19 nt, Homo sapiens
caaauccacacuugucaau

SEQ ID NO: 383792 - RNA, 19 nt, Homo sapiens
ugaaagggagagaagauug

SEQ ID NO: 383793 - RNA, 19 nt, Homo sapiens
gcagcaacacuguaguaga

SEQ ID NO: 383794 - RNA, 19 nt, Homo sapiens
aagcaucccauuugcagua

SEQ ID NO: 383795 - RNA, 19 nt, Homo sapiens
ggacugaagcugggaucaa

SEQ ID NO: 383796 - RNA, 19 nt, Homo sapiens
agcccuagcuccaagauau

SEQ ID NO: 383797 - RNA, 19 nt, Homo sapiens
ggaccucuaugaugaugac

SEQ ID NO: 383798 - RNA, 19 nt, Homo sapiens
ugaaggagaacuauuaacu

SEQ ID NO: 383799 - RNA, 19 nt, Homo sapiens
ccagggcacugcgacuuug

SEQ ID NO: 383800 - RNA, 19 nt, Homo sapiens
gacugaagcugggaucaag

SEQ ID NO: 383801 - RNA, 19 nt, Homo sapiens
ggaaagcaucccauuugca

SEQ ID NO: 383802 - RNA, 19 nt, Homo sapiens
ggagauaaaauuagaccua

SEQ ID NO: 383803 - RNA, 19 nt, Homo sapiens
gggcaaauccacacuuguc

SEQ ID NO: 383804 - RNA, 19 nt, Homo sapiens
gagacucagaggaaauaaa

SEQ ID NO: 383805 - RNA, 19 nt, Homo sapiens
agacaacaacagcaucaaa

SEQ ID NO: 383806 - RNA, 19 nt, Homo sapiens
caagcuugaucccuaugau

SEQ ID NO: 383807 - RNA, 19 nt, Homo sapiens
gcaagcuugaucccuauga

SEQ ID NO: 383808 - RNA, 19 nt, Homo sapiens
gcaggagaugcuacacaaa

SEQ ID NO: 383809 - RNA, 19 nt, Homo sapiens
ugcaggagaugcuacacaa

SEQ ID NO: 383810 - RNA, 19 nt, Homo sapiens
aggaugaggacuucaaauu

SEQ ID NO: 383811 - RNA, 19 nt, Homo sapiens
ggccugaaccgaaagaaca

SEQ ID NO: 383812 - RNA, 19 nt, Homo sapiens
ggagaugcuacacaaaaua

SEQ ID NO: 383813 - RNA, 19 nt, Homo sapiens
gagaagcuuauccgagaga

SEQ ID NO: 383814 - RNA, 19 nt, Homo sapiens
agacacauuaugagaacua

SEQ ID NO: 383815 - RNA, 19 nt, Homo sapiens
aauuagaccuagagcuuuc

SEQ ID NO: 383816 - RNA, 19 nt, Homo sapiens
gcaguggacauagaagaga

SEQ ID NO: 383817 - RNA, 19 nt, Homo sapiens
gcaugcaguggacauagaa

SEQ ID NO: 383818 - RNA, 19 nt, Homo sapiens
gcacugcugccuguacuuc

SEQ ID NO: 383819 - RNA, 19 nt, Homo sapiens
caguggacauagaagagaa

SEQ ID NO: 383820 - RNA, 19 nt, Homo sapiens
caaccaaguccaccgaaag

SEQ ID NO: 383821 - RNA, 19 nt, Homo sapiens
caaggcuguuucugugugu

SEQ ID NO: 383822 - RNA, 19 nt, Homo sapiens
gaagcuuauccgagagaaa

SEQ ID NO: 383823 - RNA, 19 nt, Homo sapiens
acauugaucagcaguuuga

SEQ ID NO: 383824 - RNA, 19 nt, Homo sapiens
ccgaaaguccgugaagaaa

SEQ ID NO: 383825 - RNA, 19 nt, Homo sapiens
ggccucagaugggaacuca

SEQ ID NO: 383826 - RNA, 19 nt, Homo sapiens
gaugaugaccuggaguuca

SEQ ID NO: 383827 - RNA, 19 nt, Homo sapiens
acugacaccucccgaagug

SEQ ID NO: 383828 - RNA, 19 nt, Homo sapiens
caccgaaaguccgugaaga

SEQ ID NO: 383829 - RNA, 19 nt, Homo sapiens
acucagaggaaauaaaguu

SEQ ID NO: 383830 - RNA, 19 nt, Homo sapiens
ucgcaaguaugaccagaag

SEQ ID NO: 383831 - RNA, 19 nt, Homo sapiens
caacagaccuccagucaga

SEQ ID NO: 383832 - RNA, 19 nt, Homo sapiens
gaucauauaugucuuagug

SEQ ID NO: 383833 - RNA, 19 nt, Homo sapiens
ggacacagaugacucuuug

SEQ ID NO: 383834 - RNA, 19 nt, Homo sapiens
cagcaaagcuuaugaagga

SEQ ID NO: 383835 - RNA, 19 nt, Homo sapiens
ccacagagcuccagaccaa

SEQ ID NO: 383836 - RNA, 19 nt, Homo sapiens
gaacaauucuuucuuucug

SEQ ID NO: 383837 - RNA, 19 nt, Homo sapiens
gcaaauaggccucugcaaa

SEQ ID NO: 383838 - RNA, 19 nt, Homo sapiens
ggacaugaccaucuuauga

SEQ ID NO: 383839 - RNA, 19 nt, Homo sapiens
gaaguacacuggaauuuac

SEQ ID NO: 383840 - RNA, 19 nt, Homo sapiens
guaagggacuuuauagaug

SEQ ID NO: 383841 - RNA, 19 nt, Homo sapiens
gaaauugaucucacugaua

SEQ ID NO: 383842 - RNA, 19 nt, Homo sapiens
aaacagccaugcaucuaua

SEQ ID NO: 383843 - RNA, 19 nt, Homo sapiens
caaaugggaugaacuaaag

SEQ ID NO: 383844 - RNA, 19 nt, Homo sapiens
ggacaaaugggaugaacua

SEQ ID NO: 383845 - RNA, 19 nt, Homo sapiens
ugaaggagguacagaauau

SEQ ID NO: 383846 - RNA, 19 nt, Homo sapiens
caaagacaguuuaucauca

SEQ ID NO: 383847 - RNA, 19 nt, Homo sapiens
uaguagcucugaugaaaua

SEQ ID NO: 383848 - RNA, 19 nt, Homo sapiens
gaacuggucuucucacacu

SEQ ID NO: 383849 - RNA, 19 nt, Homo sapiens
gaauacggguuuaaucuag

SEQ ID NO: 383850 - RNA, 19 nt, Homo sapiens
gcucagugcugcuggauga

SEQ ID NO: 383851 - RNA, 19 nt, Homo sapiens
ggagaaacuuugaagaaca

SEQ ID NO: 383852 - RNA, 19 nt, Homo sapiens
ucuaaaugcucucugauaa

SEQ ID NO: 383853 - RNA, 19 nt, Homo sapiens
gagaaacuuugaagaacaa

SEQ ID NO: 383854 - RNA, 19 nt, Homo sapiens
ggagaccucuucugagaug

SEQ ID NO: 383855 - RNA, 19 nt, Homo sapiens
caagagagggcaaagagua

SEQ ID NO: 383856 - RNA, 19 nt, Homo sapiens
gaauauucuuugcguugua

SEQ ID NO: 383857 - RNA, 19 nt, Homo sapiens
uaagggacuuuauagauga

SEQ ID NO: 383858 - RNA, 19 nt, Homo sapiens
ccagaaaccacaaguauga

SEQ ID NO: 383859 - RNA, 19 nt, Homo sapiens
uaaauacagugaccauguu

SEQ ID NO: 383860 - RNA, 19 nt, Homo sapiens
uuaaacagguuguagcaaa

SEQ ID NO: 383861 - RNA, 19 nt, Homo sapiens
ggaauuuacugagaaacuu

SEQ ID NO: 383862 - RNA, 19 nt, Homo sapiens
ccacaaguaugaugacuag

SEQ ID NO: 383863 - RNA, 19 nt, Homo sapiens
caaauaggccucugcaaau

SEQ ID NO: 383864 - RNA, 19 nt, Homo sapiens
gagaguaacugggcaaagu

SEQ ID NO: 383865 - RNA, 19 nt, Homo sapiens
gagcagaagauacaacaaa

SEQ ID NO: 383866 - RNA, 19 nt, Homo sapiens
caaagucacagcuccauuu

SEQ ID NO: 383867 - RNA, 19 nt, Homo sapiens
gcauacggcuggcaucugu

SEQ ID NO: 383868 - RNA, 19 nt, Homo sapiens
ggacagaaacaagauuaaa

SEQ ID NO: 383869 - RNA, 19 nt, Homo sapiens
guauuugucuuguagauca

SEQ ID NO: 383870 - RNA, 19 nt, Homo sapiens
aaagcuagcagaaaguuua

SEQ ID NO: 383871 - RNA, 19 nt, Homo sapiens
gcaaagacaguuuaucauc

SEQ ID NO: 383872 - RNA, 19 nt, Homo sapiens
ucagggacauuucaaguug

SEQ ID NO: 383873 - RNA, 19 nt, Homo sapiens
caaguaugaugacuaggaa

SEQ ID NO: 383874 - RNA, 19 nt, Homo sapiens
gguguuugcuuccuucuug

SEQ ID NO: 383875 - RNA, 19 nt, Homo sapiens
guagccaucugauauccua

SEQ ID NO: 383876 - RNA, 19 nt, Homo sapiens
uguaguagcucugaugaaa

SEQ ID NO: 383877 - RNA, 19 nt, Homo sapiens
cagaggagcugcagacagu

SEQ ID NO: 383878 - RNA, 19 nt, Homo sapiens
ccaguuagcucaucucacu

SEQ ID NO: 383879 - RNA, 19 nt, Homo sapiens
ugaaguacacuggaauuua

SEQ ID NO: 383880 - RNA, 19 nt, Homo sapiens
cagaaggaauaaucgguaa

SEQ ID NO: 383881 - RNA, 19 nt, Homo sapiens
caucauggcuacagauaca

SEQ ID NO: 383882 - RNA, 19 nt, Homo sapiens
gagagcagcguguuccuuu

SEQ ID NO: 383883 - RNA, 19 nt, Homo sapiens
caggaacacuggcccauug

SEQ ID NO: 383884 - RNA, 19 nt, Homo sapiens
ccacguaagggacuuuaua

SEQ ID NO: 383885 - RNA, 19 nt, Homo sapiens
gcagacaccacuacaguug

SEQ ID NO: 383886 - RNA, 19 nt, Homo sapiens
gguuuaagauguaagugaa

SEQ ID NO: 383887 - RNA, 19 nt, Homo sapiens
gggagggcaugaacacaaa

SEQ ID NO: 383888 - RNA, 19 nt, Homo sapiens
gaauggagcagaagauaca

SEQ ID NO: 383889 - RNA, 19 nt, Homo sapiens
ggcaugaacacaaacauaa

SEQ ID NO: 383890 - RNA, 19 nt, Homo sapiens
cagaauuccuuucccaguu

SEQ ID NO: 383891 - RNA, 19 nt, Homo sapiens
uaggacagcuucagaaucu

SEQ ID NO: 383892 - RNA, 19 nt, Homo sapiens
ccaacaagcucgggacaug

SEQ ID NO: 383893 - RNA, 19 nt, Homo sapiens
gaaaccacaaguaugauga

SEQ ID NO: 383894 - RNA, 19 nt, Homo sapiens
cuauaaaggucaucaucuu

SEQ ID NO: 383895 - RNA, 19 nt, Homo sapiens
cuucagagacaauccauua

SEQ ID NO: 383896 - RNA, 19 nt, Homo sapiens
gaaaucacuauucacacua

SEQ ID NO: 383897 - RNA, 19 nt, Homo sapiens
gugaggaucuugagacaca

SEQ ID NO: 383898 - RNA, 19 nt, Homo sapiens
ggucugaaguacacuggaa

SEQ ID NO: 383899 - RNA, 19 nt, Homo sapiens
guaaauacagugaccaugu

SEQ ID NO: 383900 - RNA, 19 nt, Homo sapiens
auucagagguuacugcuuu

SEQ ID NO: 383901 - RNA, 19 nt, Homo sapiens
gagaacaaagauuccauuu

SEQ ID NO: 383902 - RNA, 19 nt, Homo sapiens
agaagcagcucguccugaa

SEQ ID NO: 383903 - RNA, 19 nt, Homo sapiens
ucgguuaucucgcaaagaa

SEQ ID NO: 383904 - RNA, 19 nt, Homo sapiens
ucacagcuccauuucagua

SEQ ID NO: 383905 - RNA, 19 nt, Homo sapiens
gcugagugauggccaaguu

SEQ ID NO: 383906 - RNA, 19 nt, Homo sapiens
gguuucaucugauugagaa

SEQ ID NO: 383907 - RNA, 19 nt, Homo sapiens
ggugagguuucaucugauu

SEQ ID NO: 383908 - RNA, 19 nt, Homo sapiens
gagccaggaugagaacaaa

SEQ ID NO: 383909 - RNA, 19 nt, Homo sapiens
gggcaugaacacaaacaua

SEQ ID NO: 383910 - RNA, 19 nt, Homo sapiens
gcuagcagaaaguuuauuu

SEQ ID NO: 383911 - RNA, 19 nt, Homo sapiens
gguaagaggaacacuagaa

SEQ ID NO: 383912 - RNA, 19 nt, Homo sapiens
agagguuacugcuuuauau

SEQ ID NO: 383913 - RNA, 19 nt, Homo sapiens
gcaacccuauggccucuug

SEQ ID NO: 383914 - RNA, 19 nt, Homo sapiens
cacuuucucugaaucauuu

SEQ ID NO: 383915 - RNA, 19 nt, Homo sapiens
gaucagguguuuuguuuug

SEQ ID NO: 383916 - RNA, 19 nt, Homo sapiens
uaagacagaauacggguuu

SEQ ID NO: 383917 - RNA, 19 nt, Homo sapiens
gaagccuacugucaugaga

SEQ ID NO: 383918 - RNA, 19 nt, Homo sapiens
uagcaaagacaguuuauca

SEQ ID NO: 383919 - RNA, 19 nt, Homo sapiens
acacuggaauuuacugaga

SEQ ID NO: 383920 - RNA, 19 nt, Homo sapiens
agauguaagugaacaauuc

SEQ ID NO: 383921 - RNA, 19 nt, Homo sapiens
gaaggaauaaucgguaaau

SEQ ID NO: 383922 - RNA, 19 nt, Homo sapiens
gaaaucuuguuaggcuuga

SEQ ID NO: 383923 - RNA, 19 nt, Homo sapiens
ggaauccuguguggaaugu

SEQ ID NO: 383924 - RNA, 19 nt, Homo sapiens
uuuaugggcucggcaguua

SEQ ID NO: 383925 - RNA, 19 nt, Homo sapiens
caagauaagugcggcauac

SEQ ID NO: 383926 - RNA, 19 nt, Homo sapiens
gacaugaccaucuuaugaa

SEQ ID NO: 383927 - RNA, 19 nt, Homo sapiens
gcauggaggacacagauga

SEQ ID NO: 383928 - RNA, 19 nt, Homo sapiens
gauccugggucacacuuca

SEQ ID NO: 383929 - RNA, 19 nt, Homo sapiens
gaugcgaggcuaacaaguu

SEQ ID NO: 383930 - RNA, 19 nt, Homo sapiens
gggauuagcacagguuauu

SEQ ID NO: 383931 - RNA, 19 nt, Homo sapiens
gagaguagcuggaauguaa

SEQ ID NO: 383932 - RNA, 19 nt, Homo sapiens
gaacacaccuggaaagaug

SEQ ID NO: 383933 - RNA, 19 nt, Homo sapiens
ggagagggaugcuuaauug

SEQ ID NO: 383934 - RNA, 19 nt, Homo sapiens
gcaguaacaucgauuguaa

SEQ ID NO: 383935 - RNA, 19 nt, Homo sapiens
gaaguacgcugcucugguu

SEQ ID NO: 383936 - RNA, 19 nt, Homo sapiens
ggaauuaugucaccaaaca

SEQ ID NO: 383937 - RNA, 19 nt, Homo sapiens
gacauuagacguuucauua

SEQ ID NO: 383938 - RNA, 19 nt, Homo sapiens
ggaaauugcuacuuggauu

SEQ ID NO: 383939 - RNA, 19 nt, Homo sapiens
ggagauacagauucaauua

SEQ ID NO: 383940 - RNA, 19 nt, Homo sapiens
gaacuaugcuuuugagaua

SEQ ID NO: 383941 - RNA, 19 nt, Homo sapiens
ggagggaaauugcuacuug

SEQ ID NO: 383942 - RNA, 19 nt, Homo sapiens
uaacaucgcugggaacauu

SEQ ID NO: 383943 - RNA, 19 nt, Homo sapiens
cagcacagcucacugauga

SEQ ID NO: 383944 - RNA, 19 nt, Homo sapiens
gaagauggccgagagauuu

SEQ ID NO: 383945 - RNA, 19 nt, Homo sapiens
guacaauuaugcuguguuu

SEQ ID NO: 383946 - RNA, 19 nt, Homo sapiens
gcucaaaggauuagauaua

SEQ ID NO: 383947 - RNA, 19 nt, Homo sapiens
agaaauuccugucuucaua

SEQ ID NO: 383948 - RNA, 19 nt, Homo sapiens
agauaaagcuguagacuug

SEQ ID NO: 383949 - RNA, 19 nt, Homo sapiens
gauaaugucuuugaugguu

SEQ ID NO: 383950 - RNA, 19 nt, Homo sapiens
aaagaacacugcuagguuu

SEQ ID NO: 383951 - RNA, 19 nt, Homo sapiens
gaaacaggaacuccaauuu

SEQ ID NO: 383952 - RNA, 19 nt, Homo sapiens
ugaagaaguugaugaagaa

SEQ ID NO: 383953 - RNA, 19 nt, Homo sapiens
guacaaacugcuugaaaua

SEQ ID NO: 383954 - RNA, 19 nt, Homo sapiens
ucaaacagcuaaugaaaca

SEQ ID NO: 383955 - RNA, 19 nt, Homo sapiens
caacacaucuagccuggaa

SEQ ID NO: 383956 - RNA, 19 nt, Homo sapiens
gcaagaaguucaaguggau

SEQ ID NO: 383957 - RNA, 19 nt, Homo sapiens
ccaagaagcccuagaaaga

SEQ ID NO: 383958 - RNA, 19 nt, Homo sapiens
caagauaggucgacugaag

SEQ ID NO: 383959 - RNA, 19 nt, Homo sapiens
gaaagaacacugcuagguu

SEQ ID NO: 383960 - RNA, 19 nt, Homo sapiens
gcaccaaucuggaagaagu

SEQ ID NO: 383961 - RNA, 19 nt, Homo sapiens
gaacacagcagagcaauuc

SEQ ID NO: 383962 - RNA, 19 nt, Homo sapiens
ugaaucuucucaacuguua

SEQ ID NO: 383963 - RNA, 19 nt, Homo sapiens
gagauacugugucauaugu

SEQ ID NO: 383964 - RNA, 19 nt, Homo sapiens
caacugagcaacaaauuga

SEQ ID NO: 383965 - RNA, 19 nt, Homo sapiens
ggaagaaguauuuaaguug

SEQ ID NO: 383966 - RNA, 19 nt, Homo sapiens
gaaaggacguaagaaagga

SEQ ID NO: 383967 - RNA, 19 nt, Homo sapiens
ggacauugaucaagaaggu

SEQ ID NO: 383968 - RNA, 19 nt, Homo sapiens
uaugauggcugguugauau

SEQ ID NO: 383969 - RNA, 19 nt, Homo sapiens
gagcccagcuuguaucguu

SEQ ID NO: 383970 - RNA, 19 nt, Homo sapiens
caagaaaggacguaagaaa

SEQ ID NO: 383971 - RNA, 19 nt, Homo sapiens
ccaaaguucugcaggacua

SEQ ID NO: 383972 - RNA, 19 nt, Homo sapiens
gaucaaagccgggacacua

SEQ ID NO: 383973 - RNA, 19 nt, Homo sapiens
gauccaagcuuagaaaugg

SEQ ID NO: 383974 - RNA, 19 nt, Homo sapiens
guacuacugcagagaauua

SEQ ID NO: 383975 - RNA, 19 nt, Homo sapiens
gaacagaaagaucaaagga

SEQ ID NO: 383976 - RNA, 19 nt, Homo sapiens
caugugagcuguuguguca

SEQ ID NO: 383977 - RNA, 19 nt, Homo sapiens
cgaaagagaugguacaaaa

SEQ ID NO: 383978 - RNA, 19 nt, Homo sapiens
gaaggauguuuaugaggaa

SEQ ID NO: 383979 - RNA, 19 nt, Homo sapiens
agaagaggcugauagaaau

SEQ ID NO: 383980 - RNA, 19 nt, Homo sapiens
guaaagcacgcaauaaaga

SEQ ID NO: 383981 - RNA, 19 nt, Homo sapiens
gaaauuaacaaggcauuga

SEQ ID NO: 383982 - RNA, 19 nt, Homo sapiens
cagaagaggcugauagaaa

SEQ ID NO: 383983 - RNA, 19 nt, Homo sapiens
ucacagguguuuaugaaga

SEQ ID NO: 383984 - RNA, 19 nt, Homo sapiens
uacaggaucuuaacacuga

SEQ ID NO: 383985 - RNA, 19 nt, Homo sapiens
gcagaaacaggauaaucua

SEQ ID NO: 383986 - RNA, 19 nt, Homo sapiens
ggugaaagcuggagauacu

SEQ ID NO: 383987 - RNA, 19 nt, Homo sapiens
gaucaugugugagcuaaau

SEQ ID NO: 383988 - RNA, 19 nt, Homo sapiens
gaaagaaaacugcagauaa

SEQ ID NO: 383989 - RNA, 19 nt, Homo sapiens
gaucauguguuguauucga

SEQ ID NO: 383990 - RNA, 19 nt, Homo sapiens
gccuugcacucacuaaaua

SEQ ID NO: 383991 - RNA, 19 nt, Homo sapiens
gcaacaaauugaucaugga

SEQ ID NO: 383992 - RNA, 19 nt, Homo sapiens
gaucugugauguggaaauu

SEQ ID NO: 383993 - RNA, 19 nt, Homo sapiens
guuugaagauggugacuuu

SEQ ID NO: 383994 - RNA, 19 nt, Homo sapiens
gagcaggcuuguuuguuga

SEQ ID NO: 383995 - RNA, 19 nt, Homo sapiens
caacgucggaugggaauua

SEQ ID NO: 383996 - RNA, 19 nt, Homo sapiens
ggugagaaguauaaauaug

SEQ ID NO: 383997 - RNA, 19 nt, Homo sapiens
caaagaagucauugagaaa

SEQ ID NO: 383998 - RNA, 19 nt, Homo sapiens
guaaugauacugaagaaga

SEQ ID NO: 383999 - RNA, 19 nt, Homo sapiens
cgaacaacauuaagucaau

SEQ ID NO: 384000 - RNA, 19 nt, Homo sapiens
caaugaaggauguuuauga

SEQ ID NO: 384001 - RNA, 19 nt, Homo sapiens
cagaggaagugaaacaaga

SEQ ID NO: 384002 - RNA, 19 nt, Homo sapiens
gcaauggaguuugaagaug

SEQ ID NO: 384003 - RNA, 19 nt, Homo sapiens
uaacuccuguuccucuuaa

SEQ ID NO: 384004 - RNA, 19 nt, Homo sapiens
gagcuucaccgaauccuuu

SEQ ID NO: 384005 - RNA, 19 nt, Homo sapiens
caagaggaauguaaagaag

SEQ ID NO: 384006 - RNA, 19 nt, Homo sapiens
gcaauaaagacaagaggaa

SEQ ID NO: 384007 - RNA, 19 nt, Homo sapiens
gagccaaccugucgcaauc

SEQ ID NO: 384008 - RNA, 19 nt, Homo sapiens
ggacuucacagguguuuau

SEQ ID NO: 384009 - RNA, 19 nt, Homo sapiens
ucuuaaacgugcugaauuu

SEQ ID NO: 384010 - RNA, 19 nt, Homo sapiens
ggcagucuuuccucucuua

SEQ ID NO: 384011 - RNA, 19 nt, Homo sapiens
gcucacugaugaagagaaa

SEQ ID NO: 384012 - RNA, 19 nt, Homo sapiens
acaaacugcuugaaauaga

SEQ ID NO: 384013 - RNA, 19 nt, Homo sapiens
ugaggaauuugaugagaaa

SEQ ID NO: 384014 - RNA, 19 nt, Homo sapiens
caacaagaaagcacauuga

SEQ ID NO: 384015 - RNA, 19 nt, Homo sapiens
gcacucacuaaauagauua

SEQ ID NO: 384016 - RNA, 19 nt, Homo sapiens
gagcucaaaggauuagaua

SEQ ID NO: 384017 - RNA, 19 nt, Homo sapiens
ggaaauuucagcaaaggaa

SEQ ID NO: 384018 - RNA, 19 nt, Homo sapiens
gggacugugucucauguuu

SEQ ID NO: 384019 - RNA, 19 nt, Homo sapiens
gauacugugucauauguca

SEQ ID NO: 384020 - RNA, 19 nt, Homo sapiens
ccagugagccaguuugaaa

SEQ ID NO: 384021 - RNA, 19 nt, Homo sapiens
aacaggagcucaaaggauu

SEQ ID NO: 384022 - RNA, 19 nt, Homo sapiens
gaugguaaagcacgcaaua

SEQ ID NO: 384023 - RNA, 19 nt, Homo sapiens
gaaagugcagguaaagguu

SEQ ID NO: 384024 - RNA, 19 nt, Homo sapiens
gaaauugcuacuuggauug

SEQ ID NO: 384025 - RNA, 19 nt, Homo sapiens
gaaauuccugucuucauau

SEQ ID NO: 384026 - RNA, 19 nt, Homo sapiens
gaaugaugcucuacuuggu

SEQ ID NO: 384027 - RNA, 19 nt, Homo sapiens
ugauggagauaccaauaaa

SEQ ID NO: 384028 - RNA, 19 nt, Homo sapiens
gaagaaauugauggagaua

SEQ ID NO: 384029 - RNA, 19 nt, Homo sapiens
ggauguuuaugaggaauuu

SEQ ID NO: 384030 - RNA, 19 nt, Homo sapiens
ugucauaugucaucuguca

SEQ ID NO: 384031 - RNA, 19 nt, Homo sapiens
gaauugggcugaaauauuu

SEQ ID NO: 384032 - RNA, 19 nt, Homo sapiens
gaaauugccuggaguagga

SEQ ID NO: 384033 - RNA, 19 nt, Homo sapiens
gaagagauguuacaaaugc

SEQ ID NO: 384034 - RNA, 19 nt, Homo sapiens
caaggaaguuuguagauga

SEQ ID NO: 384035 - RNA, 19 nt, Homo sapiens
ucacagaacucgcaaacuu

SEQ ID NO: 384036 - RNA, 19 nt, Homo sapiens
gugaagagauguuacaaau

SEQ ID NO: 384037 - RNA, 19 nt, Homo sapiens
guaagggucuuugguguuu

SEQ ID NO: 384038 - RNA, 19 nt, Homo sapiens
gcaaggaaguuuguagaug

SEQ ID NO: 384039 - RNA, 19 nt, Homo sapiens
ccacacagaagaauugaua

SEQ ID NO: 384040 - RNA, 19 nt, Homo sapiens
gccaagcuauccacaagua

SEQ ID NO: 384041 - RNA, 19 nt, Homo sapiens
ccaauaggagucuuaauuu

SEQ ID NO: 384042 - RNA, 19 nt, Homo sapiens
cagcuucacuucagaauca

SEQ ID NO: 384043 - RNA, 19 nt, Homo sapiens
gauacgaguucauccauca

SEQ ID NO: 384044 - RNA, 19 nt, Homo sapiens
caaguacaaugcuuacaga

SEQ ID NO: 384045 - RNA, 19 nt, Homo sapiens
guacaaugcuuacagaaaa

SEQ ID NO: 384046 - RNA, 19 nt, Homo sapiens
cagcaucuguuauagcaaa

SEQ ID NO: 384047 - RNA, 19 nt, Homo sapiens
guuuguagaugaaggaauu

SEQ ID NO: 384048 - RNA, 19 nt, Homo sapiens
gagccaagcuauccacaag

SEQ ID NO: 384049 - RNA, 19 nt, Homo sapiens
cgaauugggcugaaauauu

SEQ ID NO: 384050 - RNA, 19 nt, Homo sapiens
gaauauccacacagaagaa

SEQ ID NO: 384051 - RNA, 19 nt, Homo sapiens
gaaccaucaucagcgaauu

SEQ ID NO: 384052 - RNA, 19 nt, Homo sapiens
gaagaauugauaucagguu

SEQ ID NO: 384053 - RNA, 19 nt, Homo sapiens
uaagaaauugccuggagua

SEQ ID NO: 384054 - RNA, 19 nt, Homo sapiens
ucaccgacaugcucacaga

SEQ ID NO: 384055 - RNA, 19 nt, Homo sapiens
cccaauaggagucuuaauu

SEQ ID NO: 384056 - RNA, 19 nt, Homo sapiens
caaagggugagacaaaguu

SEQ ID NO: 384057 - RNA, 19 nt, Homo sapiens
cgaguucauccaucaauuu

SEQ ID NO: 384058 - RNA, 19 nt, Homo sapiens
caaaauacccacacaaaau

SEQ ID NO: 384059 - RNA, 19 nt, Homo sapiens
caacccaauaggagucuua

SEQ ID NO: 384060 - RNA, 19 nt, Homo sapiens
agacaucuuugauuacauc

SEQ ID NO: 384061 - RNA, 19 nt, Homo sapiens
uuacugugguguucucuau

SEQ ID NO: 384062 - RNA, 19 nt, Homo sapiens
gagcgaaugaggccuguau

SEQ ID NO: 384063 - RNA, 19 nt, Homo sapiens
gggagucacuggaguugca

SEQ ID NO: 384064 - RNA, 19 nt, Homo sapiens
gaacgugagccaagcuauc

SEQ ID NO: 384065 - RNA, 19 nt, Homo sapiens
acugugguguucucuauuu

SEQ ID NO: 384066 - RNA, 19 nt, Homo sapiens
gcaaaauacccacacaaaa

SEQ ID NO: 384067 - RNA, 19 nt, Homo sapiens
aaaagaauauccacacaga

SEQ ID NO: 384068 - RNA, 19 nt, Homo sapiens
cugaauacauugcuacagu

SEQ ID NO: 384069 - RNA, 19 nt, Homo sapiens
aauaaagaguggagcugaa

SEQ ID NO: 384070 - RNA, 19 nt, Homo sapiens
uacccaaagaucaguauua

SEQ ID NO: 384071 - RNA, 19 nt, Homo sapiens
cuuaaccuuugcuauguaa

SEQ ID NO: 384072 - RNA, 19 nt, Homo sapiens
cuugcaauguagucaauaa

SEQ ID NO: 384073 - RNA, 19 nt, Homo sapiens
ucagguugauacccaaaga

SEQ ID NO: 384074 - RNA, 19 nt, Homo sapiens
gaaguuuguagaugaagga

SEQ ID NO: 384075 - RNA, 19 nt, Homo sapiens
aaaagcagcaucuguuaua

SEQ ID NO: 384076 - RNA, 19 nt, Homo sapiens
uggcagacacaacccaaua

SEQ ID NO: 384077 - RNA, 19 nt, Homo sapiens
ucuagucccugguucugaa

SEQ ID NO: 384078 - RNA, 19 nt, Homo sapiens
uuugccagcuucccaguaa

SEQ ID NO: 384079 - RNA, 19 nt, Homo sapiens
gaaauauuuuggggacuuu

SEQ ID NO: 384080 - RNA, 19 nt, Homo sapiens
guuucacaaucaaugagua

SEQ ID NO: 384081 - RNA, 19 nt, Homo sapiens
cacagaacucgcaaacuuu

SEQ ID NO: 384082 - RNA, 19 nt, Homo sapiens
aagaauuccucgugaagag

SEQ ID NO: 384083 - RNA, 19 nt, Homo sapiens
aaggaaguuuguagaugaa

SEQ ID NO: 384084 - RNA, 19 nt, Homo sapiens
cugaaaagauugaugaguu

SEQ ID NO: 384085 - RNA, 19 nt, Homo sapiens
ucuuaaccuuugcuaugua

SEQ ID NO: 384086 - RNA, 19 nt, Homo sapiens
uauccacacagaagaauug

SEQ ID NO: 384087 - RNA, 19 nt, Homo sapiens
acuagaagaucucagaaaa

SEQ ID NO: 384088 - RNA, 19 nt, Homo sapiens
gaaaagcagcaucuguuau

SEQ ID NO: 384089 - RNA, 19 nt, Homo sapiens
gaguucauccaucaauuuc

SEQ ID NO: 384090 - RNA, 19 nt, Homo sapiens
aagaauauccacacagaag

SEQ ID NO: 384091 - RNA, 19 nt, Homo sapiens
caucccagcuucacuucag

SEQ ID NO: 384092 - RNA, 19 nt, Homo sapiens
gcgaauugggcugaaauau

SEQ ID NO: 384093 - RNA, 19 nt, Homo sapiens
aaagcagcaucuguuauag

SEQ ID NO: 384094 - RNA, 19 nt, Homo sapiens
acagaagaauugauaucag

SEQ ID NO: 384095 - RNA, 19 nt, Homo sapiens
ugaagagauguuacaaaug

SEQ ID NO: 384096 - RNA, 19 nt, Homo sapiens
gaauuccucgugaagagau

SEQ ID NO: 384097 - RNA, 19 nt, Homo sapiens
gcaggaugauacgaguuca

SEQ ID NO: 384098 - RNA, 19 nt, Homo sapiens
gcaauguagucaauaaaac

SEQ ID NO: 384099 - RNA, 19 nt, Homo sapiens
caaggaccggagcgaauga

SEQ ID NO: 384100 - RNA, 19 nt, Homo sapiens
ccaaggaccggagcgaaug

SEQ ID NO: 384101 - RNA, 19 nt, Homo sapiens
cacagaagaauugauauca

SEQ ID NO: 384102 - RNA, 19 nt, Homo sapiens
acaaaguucauggguguuu

SEQ ID NO: 384103 - RNA, 19 nt, Homo sapiens
gaauacauugcuacagucu

SEQ ID NO: 384104 - RNA, 19 nt, Homo sapiens
cacuggaguugcaggagaa

SEQ ID NO: 384105 - RNA, 19 nt, Homo sapiens
caagcuauccacaaguaca

SEQ ID NO: 384106 - RNA, 19 nt, Homo sapiens
caaaugcaagauauuguac

SEQ ID NO: 384107 - RNA, 19 nt, Homo sapiens
gucaaagggugagacaaag

SEQ ID NO: 384108 - RNA, 19 nt, Homo sapiens
acgaguucauccaucaauu

SEQ ID NO: 384109 - RNA, 19 nt, Homo sapiens
uuucuuaaccuuugcuaug

SEQ ID NO: 384110 - RNA, 19 nt, Homo sapiens
guauuacugugguguucuc

SEQ ID NO: 384111 - RNA, 19 nt, Homo sapiens
acacagaagaauugauauc

SEQ ID NO: 384112 - RNA, 19 nt, Homo sapiens
agaaaagcagcaucuguua

SEQ ID NO: 384113 - RNA, 19 nt, Homo sapiens
aaagaauuccucgugaaga

SEQ ID NO: 384114 - RNA, 19 nt, Homo sapiens
gcagacacaacccaauagg

SEQ ID NO: 384115 - RNA, 19 nt, Homo sapiens
acccaaagaucaguauuac

SEQ ID NO: 384116 - RNA, 19 nt, Homo sapiens
cgugaagagauguuacaaa

SEQ ID NO: 384117 - RNA, 19 nt, Homo sapiens
uaaauugaaccaucaucag

SEQ ID NO: 384118 - RNA, 19 nt, Homo sapiens
gacucgaguuaguggcauu

SEQ ID NO: 384119 - RNA, 19 nt, Homo sapiens
guucauccaucaauuuccu

SEQ ID NO: 384120 - RNA, 19 nt, Homo sapiens
gcucacagaacucgcaaac

SEQ ID NO: 384121 - RNA, 19 nt, Homo sapiens
aguacaaugcuuacagaaa

SEQ ID NO: 384122 - RNA, 19 nt, Homo sapiens
agaguccaguggugacaug

SEQ ID NO: 384123 - RNA, 19 nt, Homo sapiens
ggaauuaaaacacuagaag

SEQ ID NO: 384124 - RNA, 19 nt, Homo sapiens
ggcaggaugauacgaguuc

SEQ ID NO: 384125 - RNA, 19 nt, Homo sapiens
ccacaaguacaaugcuuac

SEQ ID NO: 384126 - RNA, 19 nt, Homo sapiens
agaauauccacacagaaga

SEQ ID NO: 384127 - RNA, 19 nt, Homo sapiens
aaagaauauccacacagaa

SEQ ID NO: 384128 - RNA, 19 nt, Homo sapiens
gauaaauugaaccaucauc

SEQ ID NO: 384129 - RNA, 19 nt, Homo sapiens
agcagcaucuguuauagca

SEQ ID NO: 384130 - RNA, 19 nt, Homo sapiens
cacuagaagaucucagaaa

SEQ ID NO: 384131 - RNA, 19 nt, Homo sapiens
gaacugugcucccgagaga

SEQ ID NO: 384132 - RNA, 19 nt, Homo sapiens
gcacaugggugaccugcaa

SEQ ID NO: 384133 - RNA, 19 nt, Homo sapiens
gcaagaaggugcggaagga

SEQ ID NO: 384134 - RNA, 19 nt, Homo sapiens
ggaccagggagaauuaaua

SEQ ID NO: 384135 - RNA, 19 nt, Homo sapiens
gagcacagccugcccauug

SEQ ID NO: 384136 - RNA, 19 nt, Homo sapiens
gagcugaacuuggccauca

SEQ ID NO: 384137 - RNA, 19 nt, Homo sapiens
ggagguaucccaucugaau

SEQ ID NO: 384138 - RNA, 19 nt, Homo sapiens
gaucaccgguuacaacauc

SEQ ID NO: 384139 - RNA, 19 nt, Homo sapiens
gaccagggagaauuaauaa

SEQ ID NO: 384140 - RNA, 19 nt, Homo sapiens
aguuggagauugaccauua

SEQ ID NO: 384141 - RNA, 19 nt, Homo sapiens
guacaaacauucccuuucc

SEQ ID NO: 384142 - RNA, 19 nt, Homo sapiens
gacgucagaugaucgagaa

SEQ ID NO: 384143 - RNA, 19 nt, Homo sapiens
gugccaaggugcagagcua

SEQ ID NO: 384144 - RNA, 19 nt, Homo sapiens
cggcuucgcucccuacuuc

SEQ ID NO: 384145 - RNA, 19 nt, Homo sapiens
guuacaacauccagaacuu

SEQ ID NO: 384146 - RNA, 19 nt, Homo sapiens
caacgucgacuuugagauc

SEQ ID NO: 384147 - RNA, 19 nt, Homo sapiens
ggagauugaccauuaugug

SEQ ID NO: 384148 - RNA, 19 nt, Homo sapiens
cagggagaauuaauaaagu

SEQ ID NO: 384149 - RNA, 19 nt, Homo sapiens
gcgggaccagggagaauua

SEQ ID NO: 384150 - RNA, 19 nt, Homo sapiens
gugccaaggugguguaugg

SEQ ID NO: 384151 - RNA, 19 nt, Homo sapiens
ccagggagaauuaauaaag

SEQ ID NO: 384152 - RNA, 19 nt, Homo sapiens
aaggagguaucccaucuga

SEQ ID NO: 384153 - RNA, 19 nt, Homo sapiens
agaaggagguaucccaucu

SEQ ID NO: 384154 - RNA, 19 nt, Homo sapiens
ucucggaccugcugugcaa

SEQ ID NO: 384155 - RNA, 19 nt, Homo sapiens
ccauugacacgcaguacua

SEQ ID NO: 384156 - RNA, 19 nt, Homo sapiens
ccauccggcuggaguuuga

SEQ ID NO: 384157 - RNA, 19 nt, Homo sapiens
aggaggagcugcagucagu

SEQ ID NO: 384158 - RNA, 19 nt, Homo sapiens
gaggaggaccuggcacuga

SEQ ID NO: 384159 - RNA, 19 nt, Homo sapiens
cgccgcaacugcugcauug

SEQ ID NO: 384160 - RNA, 19 nt, Homo sapiens
ccucugggaugaugaugau

SEQ ID NO: 384161 - RNA, 19 nt, Homo sapiens
acaccaagguugucagcau

SEQ ID NO: 384162 - RNA, 19 nt, Homo sapiens
gagcuggccgagaggauga

SEQ ID NO: 384163 - RNA, 19 nt, Homo sapiens
caacauccgggacucuuca

SEQ ID NO: 384164 - RNA, 19 nt, Homo sapiens
ccugaggccuggugaccuu

SEQ ID NO: 384165 - RNA, 19 nt, Homo sapiens
gggacgaguuugugaagac

SEQ ID NO: 384166 - RNA, 19 nt, Homo sapiens
ggacuucuccucgcuguac

SEQ ID NO: 384167 - RNA, 19 nt, Homo sapiens
gugcucagcuucgauaucg

SEQ ID NO: 384168 - RNA, 19 nt, Homo sapiens
guuggagauugaccauuau

SEQ ID NO: 384169 - RNA, 19 nt, Homo sapiens
gaccacacgcgcugcaaga

SEQ ID NO: 384170 - RNA, 19 nt, Homo sapiens
gguacaaacauucccuuuc

SEQ ID NO: 384171 - RNA, 19 nt, Homo sapiens
ggucccaccaucagccaua

SEQ ID NO: 384172 - RNA, 19 nt, Homo sapiens
ggugaacgccguggagaug

SEQ ID NO: 384173 - RNA, 19 nt, Homo sapiens
cuaaguacacaguggagaa

SEQ ID NO: 384174 - RNA, 19 nt, Homo sapiens
cguaggcuguggcgggaaa

SEQ ID NO: 384175 - RNA, 19 nt, Homo sapiens
gcaacgggagcugaacuug

SEQ ID NO: 384176 - RNA, 19 nt, Homo sapiens
aggccaacgucgacuuuga

SEQ ID NO: 384177 - RNA, 19 nt, Homo sapiens
guucggacgucagaugauc

SEQ ID NO: 384178 - RNA, 19 nt, Homo sapiens
gguccaccuucauccguau

SEQ ID NO: 384179 - RNA, 19 nt, Homo sapiens
gggagucugagcuguauca

SEQ ID NO: 384180 - RNA, 19 nt, Homo sapiens
gcaaccgcaucgauaucuc

SEQ ID NO: 384181 - RNA, 19 nt, Homo sapiens
ggcccagacccucaaggua

SEQ ID NO: 384182 - RNA, 19 nt, Homo sapiens
gaaggagguaucccaucug

SEQ ID NO: 384183 - RNA, 19 nt, Homo sapiens
ucccauaccugcuuaucag

SEQ ID NO: 384184 - RNA, 19 nt, Homo sapiens
gaccuuccguaccucaucu

SEQ ID NO: 384185 - RNA, 19 nt, Homo sapiens
cgaggccaacgucgacuuu

SEQ ID NO: 384186 - RNA, 19 nt, Homo sapiens
gggagaauuaauaaaguuc

SEQ ID NO: 384187 - RNA, 19 nt, Homo sapiens
cccugaggcugaaggagaa

SEQ ID NO: 384188 - RNA, 19 nt, Homo sapiens
gaugagggguucucugucu

SEQ ID NO: 384189 - RNA, 19 nt, Homo sapiens
ccgggagucugagcuguau

SEQ ID NO: 384190 - RNA, 19 nt, Homo sapiens
gguggagucuaaguacaca

SEQ ID NO: 384191 - RNA, 19 nt, Homo sapiens
gagguaucccaucugaaug

SEQ ID NO: 384192 - RNA, 19 nt, Homo sapiens
ggagauggaggcagaacac

SEQ ID NO: 384193 - RNA, 19 nt, Homo sapiens
gcuguacccguccaucaug

SEQ ID NO: 384194 - RNA, 19 nt, Homo sapiens
cauccgggacucuucauuc

SEQ ID NO: 384195 - RNA, 19 nt, Homo sapiens
aggaggaccuggcacugau

SEQ ID NO: 384196 - RNA, 19 nt, Homo sapiens
ggcuggaguuugagaaggu

SEQ ID NO: 384197 - RNA, 19 nt, Homo sapiens
gagcgccaacuccguauac

SEQ ID NO: 384198 - RNA, 19 nt, Homo sapiens
agacagagccccucaucuu

SEQ ID NO: 384199 - RNA, 19 nt, Homo sapiens
cuacuucccauaccugcuu

SEQ ID NO: 384200 - RNA, 19 nt, Homo sapiens
ccucaagguacaaacauuc

SEQ ID NO: 384201 - RNA, 19 nt, Homo sapiens
ggaggaggagcugcaguca

SEQ ID NO: 384202 - RNA, 19 nt, Homo sapiens
cggacgugcuguggucuga

SEQ ID NO: 384203 - RNA, 19 nt, Homo sapiens
cuggugaccuugcaagcau

SEQ ID NO: 384204 - RNA, 19 nt, Homo sapiens
uaaguacacaguggagaau

SEQ ID NO: 384205 - RNA, 19 nt, Homo sapiens
ccaaauaccucaccaagaa

SEQ ID NO: 384206 - RNA, 19 nt, Homo sapiens
gagcagggauucuaucaau

SEQ ID NO: 384207 - RNA, 19 nt, Homo sapiens
gcagggauucuaucaauaa

SEQ ID NO: 384208 - RNA, 19 nt, Homo sapiens
ggacagaacgugagugaca

SEQ ID NO: 384209 - RNA, 19 nt, Homo sapiens
gcaguaugcccacauuuau

SEQ ID NO: 384210 - RNA, 19 nt, Homo sapiens
aagaugaacugcagcguau

SEQ ID NO: 384211 - RNA, 19 nt, Homo sapiens
gaacgugagugacauuuuc

SEQ ID NO: 384212 - RNA, 19 nt, Homo sapiens
ugaagaagcugugugaacu

SEQ ID NO: 384213 - RNA, 19 nt, Homo sapiens
aaauaaagccuggcacuug

SEQ ID NO: 384214 - RNA, 19 nt, Homo sapiens
aaacugacccguucaucuu

SEQ ID NO: 384215 - RNA, 19 nt, Homo sapiens
cguggaggcuguuaagaug

SEQ ID NO: 384216 - RNA, 19 nt, Homo sapiens
gagagacgacgggaaguuu

SEQ ID NO: 384217 - RNA, 19 nt, Homo sapiens
gcuaggagagcgcagcuuu

SEQ ID NO: 384218 - RNA, 19 nt, Homo sapiens
aguuugaucccaccaauua

SEQ ID NO: 384219 - RNA, 19 nt, Homo sapiens
gauggaggcuguucauucc

SEQ ID NO: 384220 - RNA, 19 nt, Homo sapiens
guggaggacuauugcuuug

SEQ ID NO: 384221 - RNA, 19 nt, Homo sapiens
gaacugcagcguaucaaac

SEQ ID NO: 384222 - RNA, 19 nt, Homo sapiens
gaccagagaggcccagaug

SEQ ID NO: 384223 - RNA, 19 nt, Homo sapiens
uuaagaugcuggaugagau

SEQ ID NO: 384224 - RNA, 19 nt, Homo sapiens
gguggaggacuauugcuuu

SEQ ID NO: 384225 - RNA, 19 nt, Homo sapiens
gagugaagaagcuguguga

SEQ ID NO: 384226 - RNA, 19 nt, Homo sapiens
ccagagaggcccagaugga

SEQ ID NO: 384227 - RNA, 19 nt, Homo sapiens
gugucggcauuguaaauaa

SEQ ID NO: 384228 - RNA, 19 nt, Homo sapiens
cagcauggaggaucacuug

SEQ ID NO: 384229 - RNA, 19 nt, Homo sapiens
cggacacucuagguuguua

SEQ ID NO: 384230 - RNA, 19 nt, Homo sapiens
cuguuaagaugcuggauga

SEQ ID NO: 384231 - RNA, 19 nt, Homo sapiens
caaauaccucaccaagaaa

SEQ ID NO: 384232 - RNA, 19 nt, Homo sapiens
ugagugacauuuuccgaua

SEQ ID NO: 384233 - RNA, 19 nt, Homo sapiens
ucaggaguguggccauguu

SEQ ID NO: 384234 - RNA, 19 nt, Homo sapiens
ugucggcauuguaaauaaa

SEQ ID NO: 384235 - RNA, 19 nt, Homo sapiens
ggaggacuauugcuuugcu

SEQ ID NO: 384236 - RNA, 19 nt, Homo sapiens
gaugaacugcagcguauca

SEQ ID NO: 384237 - RNA, 19 nt, Homo sapiens
gcaguggagugggagugaa

SEQ ID NO: 384238 - RNA, 19 nt, Homo sapiens
ccacccgccucauccaaau

SEQ ID NO: 384239 - RNA, 19 nt, Homo sapiens
cagaccgccugccuuguga

SEQ ID NO: 384240 - RNA, 19 nt, Homo sapiens
ccaagcaagucaggagugu

SEQ ID NO: 384241 - RNA, 19 nt, Homo sapiens
gaagaagcugugugaacug

SEQ ID NO: 384242 - RNA, 19 nt, Homo sapiens
gcauggaggaucacuugga

SEQ ID NO: 384243 - RNA, 19 nt, Homo sapiens
cgaguuugaucccaccaau

SEQ ID NO: 384244 - RNA, 19 nt, Homo sapiens
gcgaagcuguguggaccaa

SEQ ID NO: 384245 - RNA, 19 nt, Homo sapiens
uaaauaaagccuggcacuu

SEQ ID NO: 384246 - RNA, 19 nt, Homo sapiens
gugcccgcaugucuacuuu

SEQ ID NO: 384247 - RNA, 19 nt, Homo sapiens
caggacagaacgugaguga

SEQ ID NO: 384248 - RNA, 19 nt, Homo sapiens
cuaggagagcgcagcuuua

SEQ ID NO: 384249 - RNA, 19 nt, Homo sapiens
gccaaauaccucaccaaga

SEQ ID NO: 384250 - RNA, 19 nt, Homo sapiens
guuaagaugcuggaugaga

SEQ ID NO: 384251 - RNA, 19 nt, Homo sapiens
cuaucaauaaggccaaaua

SEQ ID NO: 384252 - RNA, 19 nt, Homo sapiens
gacagaacgugagugacau

SEQ ID NO: 384253 - RNA, 19 nt, Homo sapiens
agccaacaaugccaccuuu

SEQ ID NO: 384254 - RNA, 19 nt, Homo sapiens
cagagugcccgcaugucua

SEQ ID NO: 384255 - RNA, 19 nt, Homo sapiens
ucaauaaggccaaauaccu

SEQ ID NO: 384256 - RNA, 19 nt, Homo sapiens
agcagggauucuaucaaua

SEQ ID NO: 384257 - RNA, 19 nt, Homo sapiens
cgugaugccaggcgaguuu

SEQ ID NO: 384258 - RNA, 19 nt, Homo sapiens
gcguggaggcuguuaagau

SEQ ID NO: 384259 - RNA, 19 nt, Homo sapiens
ugagacccuuccuggagaa

SEQ ID NO: 384260 - RNA, 19 nt, Homo sapiens
ggugggcacucuguucaag

SEQ ID NO: 384261 - RNA, 19 nt, Homo sapiens
agauggaggcuguucauuc

SEQ ID NO: 384262 - RNA, 19 nt, Homo sapiens
augacgagcuggucuugga

SEQ ID NO: 384263 - RNA, 19 nt, Homo sapiens
gcagugucggcauuguaaa

SEQ ID NO: 384264 - RNA, 19 nt, Homo sapiens
ccagagugcccgcaugucu

SEQ ID NO: 384265 - RNA, 19 nt, Homo sapiens
gaguuugaucccaccaauu

SEQ ID NO: 384266 - RNA, 19 nt, Homo sapiens
cugcagcguaucaaacuaa

SEQ ID NO: 384267 - RNA, 19 nt, Homo sapiens
gugaagaagcugugugaac

SEQ ID NO: 384268 - RNA, 19 nt, Homo sapiens
cagagcagggauucuauca

SEQ ID NO: 384269 - RNA, 19 nt, Homo sapiens
cagauagguuugugcuacu

SEQ ID NO: 384270 - RNA, 19 nt, Homo sapiens
ggacaucaggacagaacgu

SEQ ID NO: 384271 - RNA, 19 nt, Homo sapiens
cagggauucuaucaauaag

SEQ ID NO: 384272 - RNA, 19 nt, Homo sapiens
ugaacugcagcguaucaaa

SEQ ID NO: 384273 - RNA, 19 nt, Homo sapiens
acagcagcauggaggauca

SEQ ID NO: 384274 - RNA, 19 nt, Homo sapiens
uaggagagcgcagcuuuag

SEQ ID NO: 384275 - RNA, 19 nt, Homo sapiens
gagugggagugaagaagcu

SEQ ID NO: 384276 - RNA, 19 nt, Homo sapiens
caguaugcccacauuuaug

SEQ ID NO: 384277 - RNA, 19 nt, Homo sapiens
gcacccagagcagggauuc

SEQ ID NO: 384278 - RNA, 19 nt, Homo sapiens
ugagagacgacgggaaguu

SEQ ID NO: 384279 - RNA, 19 nt, Homo sapiens
gaagauagcugaccaguug

SEQ ID NO: 384280 - RNA, 19 nt, Homo sapiens
gaaaacaacuggaacauuu

SEQ ID NO: 384281 - RNA, 19 nt, Homo sapiens
ggacacagaugguauaugg

SEQ ID NO: 384282 - RNA, 19 nt, Homo sapiens
agagaaggcuggcggauua

SEQ ID NO: 384283 - RNA, 19 nt, Homo sapiens
ugaaggagaucacccagua

SEQ ID NO: 384284 - RNA, 19 nt, Homo sapiens
gaagagguaugcuguguuc

SEQ ID NO: 384285 - RNA, 19 nt, Homo sapiens
ggaaaccucuaagaagaua

SEQ ID NO: 384286 - RNA, 19 nt, Homo sapiens
gaagaaggcaagaaauuga

SEQ ID NO: 384287 - RNA, 19 nt, Homo sapiens
gaaaggaggcugaugacaa

SEQ ID NO: 384288 - RNA, 19 nt, Homo sapiens
ggacaggcguuacgaguuc

SEQ ID NO: 384289 - RNA, 19 nt, Homo sapiens
gcagugcaguggauuacua

SEQ ID NO: 384290 - RNA, 19 nt, Homo sapiens
gaagaaugaugucuacaag

SEQ ID NO: 384291 - RNA, 19 nt, Homo sapiens
ugaagaggcuggccaguga

SEQ ID NO: 384292 - RNA, 19 nt, Homo sapiens
gaucaacgcugagcuguca

SEQ ID NO: 384293 - RNA, 19 nt, Homo sapiens
gaucuggacuugccaaauc

SEQ ID NO: 384294 - RNA, 19 nt, Homo sapiens
gaacugcagcugauuaaga

SEQ ID NO: 384295 - RNA, 19 nt, Homo sapiens
gguaugcuguguucaauga

SEQ ID NO: 384296 - RNA, 19 nt, Homo sapiens
ggacggauaagauggauuu

SEQ ID NO: 384297 - RNA, 19 nt, Homo sapiens
gcaagaaauugaagaagag

SEQ ID NO: 384298 - RNA, 19 nt, Homo sapiens
ggcaagaaauugaagaaga

SEQ ID NO: 384299 - RNA, 19 nt, Homo sapiens
gaaagugccuguggagcaa

SEQ ID NO: 384300 - RNA, 19 nt, Homo sapiens
cagaugcugucgccacuua

SEQ ID NO: 384301 - RNA, 19 nt, Homo sapiens
gcaguggauuacuacuuua

SEQ ID NO: 384302 - RNA, 19 nt, Homo sapiens
aagacaggcuggcucauua

SEQ ID NO: 384303 - RNA, 19 nt, Homo sapiens
gcgaggaacaggcgaaaua

SEQ ID NO: 384304 - RNA, 19 nt, Homo sapiens
gaagaggugugugaugaga

SEQ ID NO: 384305 - RNA, 19 nt, Homo sapiens
caaagaggaucuggacuug

SEQ ID NO: 384306 - RNA, 19 nt, Homo sapiens
gaaggagccuggugagaag

SEQ ID NO: 384307 - RNA, 19 nt, Homo sapiens
gcagagccauccagcgauu

SEQ ID NO: 384308 - RNA, 19 nt, Homo sapiens
caaaucacuugguggguuu

SEQ ID NO: 384309 - RNA, 19 nt, Homo sapiens
uaagauggauuugcgguuu

SEQ ID NO: 384310 - RNA, 19 nt, Homo sapiens
ggagaagaaugaugucuac

SEQ ID NO: 384311 - RNA, 19 nt, Homo sapiens
ucaaagggcuccacaaggu

SEQ ID NO: 384312 - RNA, 19 nt, Homo sapiens
gaugaauccugccgccuuu

SEQ ID NO: 384313 - RNA, 19 nt, Homo sapiens
gagauuguuucagaagaua

SEQ ID NO: 384314 - RNA, 19 nt, Homo sapiens
gaacuacuuccucaugauu

SEQ ID NO: 384315 - RNA, 19 nt, Homo sapiens
ggaggagggugcuucguau

SEQ ID NO: 384316 - RNA, 19 nt, Homo sapiens
cucggaagcuggaagauua

SEQ ID NO: 384317 - RNA, 19 nt, Homo sapiens
ggaagaaggcaagaaauug

SEQ ID NO: 384318 - RNA, 19 nt, Homo sapiens
cagaggacaucuccacauu

SEQ ID NO: 384319 - RNA, 19 nt, Homo sapiens
ucuacaaucucuaugagua

SEQ ID NO: 384320 - RNA, 19 nt, Homo sapiens
gugaugagauuaagagcaa

SEQ ID NO: 384321 - RNA, 19 nt, Homo sapiens
cgauaucccuugccgguuu

SEQ ID NO: 384322 - RNA, 19 nt, Homo sapiens
ggagauuguuucagaagau

SEQ ID NO: 384323 - RNA, 19 nt, Homo sapiens
cccaacagcuucccagaaa

SEQ ID NO: 384324 - RNA, 19 nt, Homo sapiens
gagcagguacuuucacauu

SEQ ID NO: 384325 - RNA, 19 nt, Homo sapiens
aaacacaccuucgaaguuc

SEQ ID NO: 384326 - RNA, 19 nt, Homo sapiens
gugaagcgcugcaagaaca

SEQ ID NO: 384327 - RNA, 19 nt, Homo sapiens
gauaucccuugccgguuua

SEQ ID NO: 384328 - RNA, 19 nt, Homo sapiens
ugaaguacguccacccauu

SEQ ID NO: 384329 - RNA, 19 nt, Homo sapiens
caacaucuaugcagacaac

SEQ ID NO: 384330 - RNA, 19 nt, Homo sapiens
aaacugaccugaagaccau

SEQ ID NO: 384331 - RNA, 19 nt, Homo sapiens
acauggaggugcuguauga

SEQ ID NO: 384332 - RNA, 19 nt, Homo sapiens
gaacauggaggugcuguau

SEQ ID NO: 384333 - RNA, 19 nt, Homo sapiens
gaagacaggcuggcucauu

SEQ ID NO: 384334 - RNA, 19 nt, Homo sapiens
acagggagauuguuucaga

SEQ ID NO: 384335 - RNA, 19 nt, Homo sapiens
gaugacggaagcagauuua

SEQ ID NO: 384336 - RNA, 19 nt, Homo sapiens
gcgcagggcauccgucuuu

SEQ ID NO: 384337 - RNA, 19 nt, Homo sapiens
gagcagaagucuacaucca

SEQ ID NO: 384338 - RNA, 19 nt, Homo sapiens
caaggaagaaggcaagaaa

SEQ ID NO: 384339 - RNA, 19 nt, Homo sapiens
gagaugagcagguacuuuc

SEQ ID NO: 384340 - RNA, 19 nt, Homo sapiens
caaagcgccuggccgaguu

SEQ ID NO: 384341 - RNA, 19 nt, Homo sapiens
ccuuagagcuggacacaga

SEQ ID NO: 384342 - RNA, 19 nt, Homo sapiens
aggauuaugucgcaaauga

SEQ ID NO: 384343 - RNA, 19 nt, Homo sapiens
cauccucucugcuucauga

SEQ ID NO: 384344 - RNA, 19 nt, Homo sapiens
caaacacaccuucgaaguu

SEQ ID NO: 384345 - RNA, 19 nt, Homo sapiens
gaacaucauggucaaggaa

SEQ ID NO: 384346 - RNA, 19 nt, Homo sapiens
cagaacuacuuccucauga

SEQ ID NO: 384347 - RNA, 19 nt, Homo sapiens
gaagcgccauccagaagau

SEQ ID NO: 384348 - RNA, 19 nt, Homo sapiens
gauugggacuacuacauug

SEQ ID NO: 384349 - RNA, 19 nt, Homo sapiens
gaccagauuaugaugauuu

SEQ ID NO: 384350 - RNA, 19 nt, Homo sapiens
gggaauuucuucucuggau

SEQ ID NO: 384351 - RNA, 19 nt, Homo sapiens
gcuccaacauggucuacaa

SEQ ID NO: 384352 - RNA, 19 nt, Homo sapiens
gccaagugcuccugacaug

SEQ ID NO: 384353 - RNA, 19 nt, Homo sapiens
gaccuuccguggcagauug

SEQ ID NO: 384354 - RNA, 19 nt, Homo sapiens
ggauugggacuacuacauu

SEQ ID NO: 384355 - RNA, 19 nt, Homo sapiens
uauucgagcucaucucuga

SEQ ID NO: 384356 - RNA, 19 nt, Homo sapiens
gagcaggaguucaauaagc

SEQ ID NO: 384357 - RNA, 19 nt, Homo sapiens
gaagagggacaguuaccuu

SEQ ID NO: 384358 - RNA, 19 nt, Homo sapiens
ccuauaaaccguauuucua

SEQ ID NO: 384359 - RNA, 19 nt, Homo sapiens
uaagguggcuuugcccuau

SEQ ID NO: 384360 - RNA, 19 nt, Homo sapiens
ggcagaaacugaccugaag

SEQ ID NO: 384361 - RNA, 19 nt, Homo sapiens
ggacuucggccucguaaag

SEQ ID NO: 384362 - RNA, 19 nt, Homo sapiens
agaaugaugucuacaagca

SEQ ID NO: 384363 - RNA, 19 nt, Homo sapiens
gacacgugcuggacucuga

SEQ ID NO: 384364 - RNA, 19 nt, Homo sapiens
ggccagggcuaccucauca

SEQ ID NO: 384365 - RNA, 19 nt, Homo sapiens
uggaggaucuugucaaagu

SEQ ID NO: 384366 - RNA, 19 nt, Homo sapiens
ggacuugccaaaucacuug

SEQ ID NO: 384367 - RNA, 19 nt, Homo sapiens
caccaucacucagaagauu

SEQ ID NO: 384368 - RNA, 19 nt, Homo sapiens
gaggacaucuccacauucg

SEQ ID NO: 384369 - RNA, 19 nt, Homo sapiens
ucaauaagccuggagcaaa

SEQ ID NO: 384370 - RNA, 19 nt, Homo sapiens
gagacagaccagauuauga

SEQ ID NO: 384371 - RNA, 19 nt, Homo sapiens
gcugagacagaccagauua

SEQ ID NO: 384372 - RNA, 19 nt, Homo sapiens
gaacauugcccagcacuac

SEQ ID NO: 384373 - RNA, 19 nt, Homo sapiens
cucagaagauucagaagaa

SEQ ID NO: 384374 - RNA, 19 nt, Homo sapiens
gugaagaagcccaaaguga

SEQ ID NO: 384375 - RNA, 19 nt, Homo sapiens
gagcugaucgagcagauug

SEQ ID NO: 384376 - RNA, 19 nt, Homo sapiens
gaaguacguccacccauuc

SEQ ID NO: 384377 - RNA, 19 nt, Homo sapiens
ugcaguggauuacuacuuu

SEQ ID NO: 384378 - RNA, 19 nt, Homo sapiens
uaacuauggcggaaucaaa

SEQ ID NO: 384379 - RNA, 19 nt, Homo sapiens
ccacaggcaugaauuauuu

SEQ ID NO: 384380 - RNA, 19 nt, Homo sapiens
gaucaaguguuucauguca

SEQ ID NO: 384381 - RNA, 19 nt, Homo sapiens
gcauaauguuugcugguua

SEQ ID NO: 384382 - RNA, 19 nt, Homo sapiens
cgugaagacuuaguaaaua

SEQ ID NO: 384383 - RNA, 19 nt, Homo sapiens
gaaagcaucacuaaugaau

SEQ ID NO: 384384 - RNA, 19 nt, Homo sapiens
gcugaaagcaucacuaaug

SEQ ID NO: 384385 - RNA, 19 nt, Homo sapiens
agacaaauaugauccuuuc

SEQ ID NO: 384386 - RNA, 19 nt, Homo sapiens
gcaauuuggcuauuccuaa

SEQ ID NO: 384387 - RNA, 19 nt, Homo sapiens
gaugaaagcggaagcaaau

SEQ ID NO: 384388 - RNA, 19 nt, Homo sapiens
gcauaaacccuggcucuuu

SEQ ID NO: 384389 - RNA, 19 nt, Homo sapiens
cauaggagcauuugauauu

SEQ ID NO: 384390 - RNA, 19 nt, Homo sapiens
uagcaaacuucaaggcuuu

SEQ ID NO: 384391 - RNA, 19 nt, Homo sapiens
gcagaagguugguuugaag

SEQ ID NO: 384392 - RNA, 19 nt, Homo sapiens
gaagaucaaguguuucaug

SEQ ID NO: 384393 - RNA, 19 nt, Homo sapiens
caaccacccugcaccaaau

SEQ ID NO: 384394 - RNA, 19 nt, Homo sapiens
ggaagcagcaguccaggaa

SEQ ID NO: 384395 - RNA, 19 nt, Homo sapiens
aagcaucacuaaugaauuc

SEQ ID NO: 384396 - RNA, 19 nt, Homo sapiens
gaaaccuuauuggguagua

SEQ ID NO: 384397 - RNA, 19 nt, Homo sapiens
cugaaagcaucacuaauga

SEQ ID NO: 384398 - RNA, 19 nt, Homo sapiens
ccuccaaccugcuuuauuc

SEQ ID NO: 384399 - RNA, 19 nt, Homo sapiens
caauuuggcuauuccuaau

SEQ ID NO: 384400 - RNA, 19 nt, Homo sapiens
uagaagaggagaauaaaga

SEQ ID NO: 384401 - RNA, 19 nt, Homo sapiens
ucaguuccauagugguuua

SEQ ID NO: 384402 - RNA, 19 nt, Homo sapiens
gaauuagagcuugaagaua

SEQ ID NO: 384403 - RNA, 19 nt, Homo sapiens
cgugagcgauauaccauuu

SEQ ID NO: 384404 - RNA, 19 nt, Homo sapiens
ggaagauccuacuggaaca

SEQ ID NO: 384405 - RNA, 19 nt, Homo sapiens
gcagucagucuguugauga

SEQ ID NO: 384406 - RNA, 19 nt, Homo sapiens
caaauaugauccuuucacu

SEQ ID NO: 384407 - RNA, 19 nt, Homo sapiens
ccacugagcccucuaguac

SEQ ID NO: 384408 - RNA, 19 nt, Homo sapiens
guaaagcucaguuccauag

SEQ ID NO: 384409 - RNA, 19 nt, Homo sapiens
gcuugaagauaaacuggaa

SEQ ID NO: 384410 - RNA, 19 nt, Homo sapiens
gaagguugguuugaagauc

SEQ ID NO: 384411 - RNA, 19 nt, Homo sapiens
ggaaugcagucagucuguu

SEQ ID NO: 384412 - RNA, 19 nt, Homo sapiens
gacaguagaagauagcaaa

SEQ ID NO: 384413 - RNA, 19 nt, Homo sapiens
gauauucaccaaagucguu

SEQ ID NO: 384414 - RNA, 19 nt, Homo sapiens
gauaauuaaugcaguugag

SEQ ID NO: 384415 - RNA, 19 nt, Homo sapiens
gauuguucuuggaaugaua

SEQ ID NO: 384416 - RNA, 19 nt, Homo sapiens
aagcaacccuugucaucaa

SEQ ID NO: 384417 - RNA, 19 nt, Homo sapiens
gaagcaacccuugucauca

SEQ ID NO: 384418 - RNA, 19 nt, Homo sapiens
guggugaagcuauuaagua

SEQ ID NO: 384419 - RNA, 19 nt, Homo sapiens
gcaccuccaaccugcuuua

SEQ ID NO: 384420 - RNA, 19 nt, Homo sapiens
gaagaggagaauaaagaug

SEQ ID NO: 384421 - RNA, 19 nt, Homo sapiens
ugucaaugccuuuggauuu

SEQ ID NO: 384422 - RNA, 19 nt, Homo sapiens
gagauaaagcagagauguu

SEQ ID NO: 384423 - RNA, 19 nt, Homo sapiens
ugaacgaucugugguggaa

SEQ ID NO: 384424 - RNA, 19 nt, Homo sapiens
aaacaugauugaacgaucu

SEQ ID NO: 384425 - RNA, 19 nt, Homo sapiens
gcagacaaauaugauccuu

SEQ ID NO: 384426 - RNA, 19 nt, Homo sapiens
ggagguccuucuaauacau

SEQ ID NO: 384427 - RNA, 19 nt, Homo sapiens
guacuacuagggcauacua

SEQ ID NO: 384428 - RNA, 19 nt, Homo sapiens
acugagcccucuaguacua

SEQ ID NO: 384429 - RNA, 19 nt, Homo sapiens
ugaauuagagcuugaagau

SEQ ID NO: 384430 - RNA, 19 nt, Homo sapiens
cuaauaagacaguagaaga

SEQ ID NO: 384431 - RNA, 19 nt, Homo sapiens
ucuaauacaucugugaaga

SEQ ID NO: 384432 - RNA, 19 nt, Homo sapiens
ucaaguguuucaugucaau

SEQ ID NO: 384433 - RNA, 19 nt, Homo sapiens
cauaaacccuggcucuuuu

SEQ ID NO: 384434 - RNA, 19 nt, Homo sapiens
ccaaccugcuuuauucugu

SEQ ID NO: 384435 - RNA, 19 nt, Homo sapiens
ggaccagguggaaguauug

SEQ ID NO: 384436 - RNA, 19 nt, Homo sapiens
gacccacaggcaugaauua

SEQ ID NO: 384437 - RNA, 19 nt, Homo sapiens
guauugggcauaugacuau

SEQ ID NO: 384438 - RNA, 19 nt, Homo sapiens
uaaagaugcuauguuugug

SEQ ID NO: 384439 - RNA, 19 nt, Homo sapiens
gcuagaagaggagaauaaa

SEQ ID NO: 384440 - RNA, 19 nt, Homo sapiens
agaggcaugcuuugucuua

SEQ ID NO: 384441 - RNA, 19 nt, Homo sapiens
gauagguucucacccugau

SEQ ID NO: 384442 - RNA, 19 nt, Homo sapiens
agauaaagcagagauguuu

SEQ ID NO: 384443 - RNA, 19 nt, Homo sapiens
aguagaagauagcaaacuu

SEQ ID NO: 384444 - RNA, 19 nt, Homo sapiens
caucacuaaugaauucaga

SEQ ID NO: 384445 - RNA, 19 nt, Homo sapiens
aaaucaaguucaagcuuug

SEQ ID NO: 384446 - RNA, 19 nt, Homo sapiens
gauauuccacgcuuugugu

SEQ ID NO: 384447 - RNA, 19 nt, Homo sapiens
gaagauaaacuggaaaaga

SEQ ID NO: 384448 - RNA, 19 nt, Homo sapiens
ggcuauuccuaaucacuuu

SEQ ID NO: 384449 - RNA, 19 nt, Homo sapiens
ccauagugguuuauacaca

SEQ ID NO: 384450 - RNA, 19 nt, Homo sapiens
aauguuugcugguuauuca

SEQ ID NO: 384451 - RNA, 19 nt, Homo sapiens
gagaauaaagaugcuaugu

SEQ ID NO: 384452 - RNA, 19 nt, Homo sapiens
ggauuugguuccaucuuac

SEQ ID NO: 384453 - RNA, 19 nt, Homo sapiens
gucaaugccuuuggauuuc

SEQ ID NO: 384454 - RNA, 19 nt, Homo sapiens
ucagugaauuagagcuuga

SEQ ID NO: 384455 - RNA, 19 nt, Homo sapiens
aagaucaaguguuucaugu

SEQ ID NO: 384456 - RNA, 19 nt, Homo sapiens
ccacccugcaccaaauuua

SEQ ID NO: 384457 - RNA, 19 nt, Homo sapiens
uguguacaauucagaaaga

SEQ ID NO: 384458 - RNA, 19 nt, Homo sapiens
caauaucauaggagcauuu

SEQ ID NO: 384459 - RNA, 19 nt, Homo sapiens
gaaugcagucagucuguug

SEQ ID NO: 384460 - RNA, 19 nt, Homo sapiens
aagcagcaguccaggaaug

SEQ ID NO: 384461 - RNA, 19 nt, Homo sapiens
ugaaagcggaagcaaauuc

SEQ ID NO: 384462 - RNA, 19 nt, Homo sapiens
ggacccacaggcaugaauu

SEQ ID NO: 384463 - RNA, 19 nt, Homo sapiens
gcuccguggugaagcuauu

SEQ ID NO: 384464 - RNA, 19 nt, Homo sapiens
acuaauccuugcagaauuc

SEQ ID NO: 384465 - RNA, 19 nt, Homo sapiens
ggccaccacuugcugaaag

SEQ ID NO: 384466 - RNA, 19 nt, Homo sapiens
aaagcucaguuccauagug

SEQ ID NO: 384467 - RNA, 19 nt, Homo sapiens
ggagaugcgauuguucuug

SEQ ID NO: 384468 - RNA, 19 nt, Homo sapiens
uuaaugcaguugagaagca

SEQ ID NO: 384469 - RNA, 19 nt, Homo sapiens
cuacuaauccuugcagaau

SEQ ID NO: 384470 - RNA, 19 nt, Homo sapiens
cagacaaaggguaccauuu

SEQ ID NO: 384471 - RNA, 19 nt, Homo sapiens
uaucugauguuugguugga

SEQ ID NO: 384472 - RNA, 19 nt, Homo sapiens
aagaugcuauguuuguguu

SEQ ID NO: 384473 - RNA, 19 nt, Homo sapiens
gaaguggauuuucauucaa

SEQ ID NO: 384474 - RNA, 19 nt, Homo sapiens
aauaugauccuuucacuac

SEQ ID NO: 384475 - RNA, 19 nt, Homo sapiens
gcuuuauucugugugguaa

SEQ ID NO: 384476 - RNA, 19 nt, Homo sapiens
uaauacaucugugaagacu

SEQ ID NO: 384477 - RNA, 19 nt, Homo sapiens
uaguaaagcucaguuccau

SEQ ID NO: 384478 - RNA, 19 nt, Homo sapiens
uacuaauccuugcagaauu

SEQ ID NO: 384479 - RNA, 19 nt, Homo sapiens
gugaagcgcuggauauuua

SEQ ID NO: 384480 - RNA, 19 nt, Homo sapiens
ggaaagaauuaaugcucua

SEQ ID NO: 384481 - RNA, 19 nt, Homo sapiens
uagaagaacuggauuacuu

SEQ ID NO: 384482 - RNA, 19 nt, Homo sapiens
gaaaggagauacgggauuc

SEQ ID NO: 384483 - RNA, 19 nt, Homo sapiens
ugaaguggcuguuugaaga

SEQ ID NO: 384484 - RNA, 19 nt, Homo sapiens
ggaaggaagugaccaugga

SEQ ID NO: 384485 - RNA, 19 nt, Homo sapiens
ggagagagguacaaagaag

SEQ ID NO: 384486 - RNA, 19 nt, Homo sapiens
gaaggagccucgagaacug

SEQ ID NO: 384487 - RNA, 19 nt, Homo sapiens
cuaagaaggugaagaagga

SEQ ID NO: 384488 - RNA, 19 nt, Homo sapiens
ugauggaucuggccaauga

SEQ ID NO: 384489 - RNA, 19 nt, Homo sapiens
ccaaggcaguggaaauaaa

SEQ ID NO: 384490 - RNA, 19 nt, Homo sapiens
uuaaugcucuaacgugaua

SEQ ID NO: 384491 - RNA, 19 nt, Homo sapiens
gguaucggcugucggauga

SEQ ID NO: 384492 - RNA, 19 nt, Homo sapiens
gaagugaccauggauugua

SEQ ID NO: 384493 - RNA, 19 nt, Homo sapiens
cacauuaacucaggcauuu

SEQ ID NO: 384494 - RNA, 19 nt, Homo sapiens
gcacagagucagaaauguu

SEQ ID NO: 384495 - RNA, 19 nt, Homo sapiens
ggucacaccuaaacucaug

SEQ ID NO: 384496 - RNA, 19 nt, Homo sapiens
gcugagcgcuuacuaaugc

SEQ ID NO: 384497 - RNA, 19 nt, Homo sapiens
uaacucaggcauuucauuu

SEQ ID NO: 384498 - RNA, 19 nt, Homo sapiens
agaacuggauuacuuagaa

SEQ ID NO: 384499 - RNA, 19 nt, Homo sapiens
gcagaucaccaaccucuug

SEQ ID NO: 384500 - RNA, 19 nt, Homo sapiens
gcaauggaccuuacaacga

SEQ ID NO: 384501 - RNA, 19 nt, Homo sapiens
uaauugaacucaccaaagg

SEQ ID NO: 384502 - RNA, 19 nt, Homo sapiens
gaacuggauuacuuagaag

SEQ ID NO: 384503 - RNA, 19 nt, Homo sapiens
ggaggaguuucaacaagau

SEQ ID NO: 384504 - RNA, 19 nt, Homo sapiens
ggacauucgugagaacuuc

SEQ ID NO: 384505 - RNA, 19 nt, Homo sapiens
ggcacaauguuuccuuuga

SEQ ID NO: 384506 - RNA, 19 nt, Homo sapiens
gcucugcuguugacuacuu

SEQ ID NO: 384507 - RNA, 19 nt, Homo sapiens
gugcugggcugcugcauca

SEQ ID NO: 384508 - RNA, 19 nt, Homo sapiens
gcagaggugcacagacuuu

SEQ ID NO: 384509 - RNA, 19 nt, Homo sapiens
ggaaaggagauacgggauu

SEQ ID NO: 384510 - RNA, 19 nt, Homo sapiens
ucagugcagucgauauuga

SEQ ID NO: 384511 - RNA, 19 nt, Homo sapiens
ucagaaauguucaauaagc

SEQ ID NO: 384512 - RNA, 19 nt, Homo sapiens
gaggaggaguuucaacaag

SEQ ID NO: 384513 - RNA, 19 nt, Homo sapiens
agaagaacuggauuacuua

SEQ ID NO: 384514 - RNA, 19 nt, Homo sapiens
caaaagggcuugccuaagg

SEQ ID NO: 384515 - RNA, 19 nt, Homo sapiens
ggauuucccugcaggaucu

SEQ ID NO: 384516 - RNA, 19 nt, Homo sapiens
gcccuuugcugagcgcuua

SEQ ID NO: 384517 - RNA, 19 nt, Homo sapiens
ugaaggacauucgugagaa

SEQ ID NO: 384518 - RNA, 19 nt, Homo sapiens
gauaauugaacucaccaaa

SEQ ID NO: 384519 - RNA, 19 nt, Homo sapiens
gcagugaggaggaggaguu

SEQ ID NO: 384520 - RNA, 19 nt, Homo sapiens
gcagcuaccgcucuucuug

SEQ ID NO: 384521 - RNA, 19 nt, Homo sapiens
cuucuuggcugguucuuug

SEQ ID NO: 384522 - RNA, 19 nt, Homo sapiens
ggaagucacaguggaagaa

SEQ ID NO: 384523 - RNA, 19 nt, Homo sapiens
gagcucugcuguugacuac

SEQ ID NO: 384524 - RNA, 19 nt, Homo sapiens
gggcacagagucagaaaug

SEQ ID NO: 384525 - RNA, 19 nt, Homo sapiens
gcacaauguuuccuuugac

SEQ ID NO: 384526 - RNA, 19 nt, Homo sapiens
gaacgcccauaaacguauc

SEQ ID NO: 384527 - RNA, 19 nt, Homo sapiens
ucacaaggaugguaauagc

SEQ ID NO: 384528 - RNA, 19 nt, Homo sapiens
ugacaauagugccauaugg

SEQ ID NO: 384529 - RNA, 19 nt, Homo sapiens
ggaggaggaguuucaacaa

SEQ ID NO: 384530 - RNA, 19 nt, Homo sapiens
caggagagagguacaaaga

SEQ ID NO: 384531 - RNA, 19 nt, Homo sapiens
gaaggacauucgugagaac

SEQ ID NO: 384532 - RNA, 19 nt, Homo sapiens
acucaggcauuucauuuau

SEQ ID NO: 384533 - RNA, 19 nt, Homo sapiens
gcccuggccuugcagauca

SEQ ID NO: 384534 - RNA, 19 nt, Homo sapiens
uugaagaguuugccauaga

SEQ ID NO: 384535 - RNA, 19 nt, Homo sapiens
caagcugccucacaaggau

SEQ ID NO: 384536 - RNA, 19 nt, Homo sapiens
gcaagaauuuaagcagaag

SEQ ID NO: 384537 - RNA, 19 nt, Homo sapiens
agugggaccugcaagaauu

SEQ ID NO: 384538 - RNA, 19 nt, Homo sapiens
caucagcagugucaacagu

SEQ ID NO: 384539 - RNA, 19 nt, Homo sapiens
gcuuacuaaugcaguuuaa

SEQ ID NO: 384540 - RNA, 19 nt, Homo sapiens
ugaagaguuugccauagau

SEQ ID NO: 384541 - RNA, 19 nt, Homo sapiens
gagaaggcccagcagaugu

SEQ ID NO: 384542 - RNA, 19 nt, Homo sapiens
gcuuggagacgcccacuuu

SEQ ID NO: 384543 - RNA, 19 nt, Homo sapiens
gaggaacgcccauaaacgu

SEQ ID NO: 384544 - RNA, 19 nt, Homo sapiens
ccuaaacucauggcacuua

SEQ ID NO: 384545 - RNA, 19 nt, Homo sapiens
gaagaagucguugauggau

SEQ ID NO: 384546 - RNA, 19 nt, Homo sapiens
ggaacgcccauaaacguau

SEQ ID NO: 384547 - RNA, 19 nt, Homo sapiens
gaauuuaagcagaagaaag

SEQ ID NO: 384548 - RNA, 19 nt, Homo sapiens
gaaggcaggcauggucaaa

SEQ ID NO: 384549 - RNA, 19 nt, Homo sapiens
gcucuaacgugauaaaccu

SEQ ID NO: 384550 - RNA, 19 nt, Homo sapiens
gcacagccuuuggguggau

SEQ ID NO: 384551 - RNA, 19 nt, Homo sapiens
gauugcagcugugcuugga

SEQ ID NO: 384552 - RNA, 19 nt, Homo sapiens
ugcaagaauuuaagcagaa

SEQ ID NO: 384553 - RNA, 19 nt, Homo sapiens
ggagugggaccugcaagaa

SEQ ID NO: 384554 - RNA, 19 nt, Homo sapiens
gugcacagacuuuauguag

SEQ ID NO: 384555 - RNA, 19 nt, Homo sapiens
ccacaaagcaaggccagaa

SEQ ID NO: 384556 - RNA, 19 nt, Homo sapiens
ccuggaggcucuguauuug

SEQ ID NO: 384557 - RNA, 19 nt, Homo sapiens
ggugaagcgcuggauauuu

SEQ ID NO: 384558 - RNA, 19 nt, Homo sapiens
aggaggaguuucaacaaga

SEQ ID NO: 384559 - RNA, 19 nt, Homo sapiens
gaauucaguggguucagaa

SEQ ID NO: 384560 - RNA, 19 nt, Homo sapiens
ugaaggugcaguugaauuc

SEQ ID NO: 384561 - RNA, 19 nt, Homo sapiens
caaggaagucacaguggaa

SEQ ID NO: 384562 - RNA, 19 nt, Homo sapiens
agagagaaacugcaaggaa

SEQ ID NO: 384563 - RNA, 19 nt, Homo sapiens
gaugguaauagcuguaaug

SEQ ID NO: 384564 - RNA, 19 nt, Homo sapiens
gaagaacuggauuacuuag

SEQ ID NO: 384565 - RNA, 19 nt, Homo sapiens
gcacaacccauuggacauc

SEQ ID NO: 384566 - RNA, 19 nt, Homo sapiens
gguguggacuacaggacaa

SEQ ID NO: 384567 - RNA, 19 nt, Homo sapiens
caauaagcuugagagcauu

SEQ ID NO: 384568 - RNA, 19 nt, Homo sapiens
aagcuaagaaggugaagaa

SEQ ID NO: 384569 - RNA, 19 nt, Homo sapiens
gagagagguacaaagaaga

SEQ ID NO: 384570 - RNA, 19 nt, Homo sapiens
ugaagaagucguugaugga

SEQ ID NO: 384571 - RNA, 19 nt, Homo sapiens
gagaugaagaagucguuga

SEQ ID NO: 384572 - RNA, 19 nt, Homo sapiens
gacugaggguggcuggauu

SEQ ID NO: 384573 - RNA, 19 nt, Homo sapiens
gcaggaggcagcugagaag

SEQ ID NO: 384574 - RNA, 19 nt, Homo sapiens
gggacaaccuggccaagcu

SEQ ID NO: 384575 - RNA, 19 nt, Homo sapiens
gcagaagaaagcuaagaag

SEQ ID NO: 384576 - RNA, 19 nt, Homo sapiens
uuaagcagaagaaagcuaa

SEQ ID NO: 384577 - RNA, 19 nt, Homo sapiens
aagugaccauggauuguaa

SEQ ID NO: 384578 - RNA, 19 nt, Homo sapiens
ggaagugaccauggauugu

SEQ ID NO: 384579 - RNA, 19 nt, Homo sapiens
gaacugagcccuucuuuaa

SEQ ID NO: 384580 - RNA, 19 nt, Homo sapiens
gaauaaaucucgcucgaaa

SEQ ID NO: 384581 - RNA, 19 nt, Homo sapiens
gaauaaaccuugugcaguu

SEQ ID NO: 384582 - RNA, 19 nt, Homo sapiens
gcagaaaggcagaaaguua

SEQ ID NO: 384583 - RNA, 19 nt, Homo sapiens
ccauuuaggugcugaguua

SEQ ID NO: 384584 - RNA, 19 nt, Homo sapiens
gaagggugguggaauaauu

SEQ ID NO: 384585 - RNA, 19 nt, Homo sapiens
aaacuuagcucugguuauu

SEQ ID NO: 384586 - RNA, 19 nt, Homo sapiens
gaaguuauguccagaucuu

SEQ ID NO: 384587 - RNA, 19 nt, Homo sapiens
gaagaauccucuaaagcaa

SEQ ID NO: 384588 - RNA, 19 nt, Homo sapiens
gcaauuagcccaggaacua

SEQ ID NO: 384589 - RNA, 19 nt, Homo sapiens
gaugagccaugaugcauuu

SEQ ID NO: 384590 - RNA, 19 nt, Homo sapiens
ucacaggcauggauucuaa

SEQ ID NO: 384591 - RNA, 19 nt, Homo sapiens
aagcuaaccucaccaagua

SEQ ID NO: 384592 - RNA, 19 nt, Homo sapiens
ccacagcucuucagccaaa

SEQ ID NO: 384593 - RNA, 19 nt, Homo sapiens
uaagagacgugguugcaaa

SEQ ID NO: 384594 - RNA, 19 nt, Homo sapiens
agacgugguugcaaacuua

SEQ ID NO: 384595 - RNA, 19 nt, Homo sapiens
gaaugggucuuggcuauau

SEQ ID NO: 384596 - RNA, 19 nt, Homo sapiens
gcauugagcugagaucaug

SEQ ID NO: 384597 - RNA, 19 nt, Homo sapiens
gcaaaaccaucucuacuaa

SEQ ID NO: 384598 - RNA, 19 nt, Homo sapiens
gcuggaauuucacacaaua

SEQ ID NO: 384599 - RNA, 19 nt, Homo sapiens
uuaugaagcucgugcauuu

SEQ ID NO: 384600 - RNA, 19 nt, Homo sapiens
agaagagacuguucagaaa

SEQ ID NO: 384601 - RNA, 19 nt, Homo sapiens
gaaaagggaccaaguuuaa

SEQ ID NO: 384602 - RNA, 19 nt, Homo sapiens
acaauaagguccuggcaaa

SEQ ID NO: 384603 - RNA, 19 nt, Homo sapiens
gcaaacauuggaaucauuu

SEQ ID NO: 384604 - RNA, 19 nt, Homo sapiens
gccaagcacuuacauugaa

SEQ ID NO: 384605 - RNA, 19 nt, Homo sapiens
gagcugagaucaugcuagu

SEQ ID NO: 384606 - RNA, 19 nt, Homo sapiens
gcucacgccuguaauccua

SEQ ID NO: 384607 - RNA, 19 nt, Homo sapiens
gaggcagugucauaaagua

SEQ ID NO: 384608 - RNA, 19 nt, Homo sapiens
gaacacauggacuaucauu

SEQ ID NO: 384609 - RNA, 19 nt, Homo sapiens
cagaacacauggacuauca

SEQ ID NO: 384610 - RNA, 19 nt, Homo sapiens
aaacuggccuguggacuaa

SEQ ID NO: 384611 - RNA, 19 nt, Homo sapiens
ggaaaugagagcagccaua

SEQ ID NO: 384612 - RNA, 19 nt, Homo sapiens
gcucgauucucuucagauu

SEQ ID NO: 384613 - RNA, 19 nt, Homo sapiens
gaauaauugcagugaguua

SEQ ID NO: 384614 - RNA, 19 nt, Homo sapiens
guccaacuguaaagcauua

SEQ ID NO: 384615 - RNA, 19 nt, Homo sapiens
cuaaagaccgaaaugauaa

SEQ ID NO: 384616 - RNA, 19 nt, Homo sapiens
gcagaagaauugcuuuaac

SEQ ID NO: 384617 - RNA, 19 nt, Homo sapiens
ggaacugagcccuucuuua

SEQ ID NO: 384618 - RNA, 19 nt, Homo sapiens
cagaaaggcagaaaguuaa

SEQ ID NO: 384619 - RNA, 19 nt, Homo sapiens
gauugaacaugauccaguu

SEQ ID NO: 384620 - RNA, 19 nt, Homo sapiens
gaacgugccagcauugaug

SEQ ID NO: 384621 - RNA, 19 nt, Homo sapiens
gcagaaacagcuuaauaau

SEQ ID NO: 384622 - RNA, 19 nt, Homo sapiens
gcagaaaguuaaagaagcu

SEQ ID NO: 384623 - RNA, 19 nt, Homo sapiens
gagcauucguguacaagga

SEQ ID NO: 384624 - RNA, 19 nt, Homo sapiens
cagaagagacuguucagaa

SEQ ID NO: 384625 - RNA, 19 nt, Homo sapiens
ggaagccaguguugaagug

SEQ ID NO: 384626 - RNA, 19 nt, Homo sapiens
caaguucucugccaaaggu

SEQ ID NO: 384627 - RNA, 19 nt, Homo sapiens
gaggagagacugacuaaag

SEQ ID NO: 384628 - RNA, 19 nt, Homo sapiens
gccgagggauugaacauga

SEQ ID NO: 384629 - RNA, 19 nt, Homo sapiens
gagaaagggaauuaugaaa

SEQ ID NO: 384630 - RNA, 19 nt, Homo sapiens
cuacagacaucaccagcuu

SEQ ID NO: 384631 - RNA, 19 nt, Homo sapiens
ucgauucucuucagauuga

SEQ ID NO: 384632 - RNA, 19 nt, Homo sapiens
uuacagauuucccugagaa

SEQ ID NO: 384633 - RNA, 19 nt, Homo sapiens
ccuuuggccugcacuaaua

SEQ ID NO: 384634 - RNA, 19 nt, Homo sapiens
gaaguguggcucccuggua

SEQ ID NO: 384635 - RNA, 19 nt, Homo sapiens
aaugguggcuguugcaauu

SEQ ID NO: 384636 - RNA, 19 nt, Homo sapiens
gaaaugagagcagccauag

SEQ ID NO: 384637 - RNA, 19 nt, Homo sapiens
gaccagugcuguacaagag

SEQ ID NO: 384638 - RNA, 19 nt, Homo sapiens
guacaagagagacuacaaa

SEQ ID NO: 384639 - RNA, 19 nt, Homo sapiens
gauugaacgugccagcauu

SEQ ID NO: 384640 - RNA, 19 nt, Homo sapiens
gaagugauggagauaaugu

SEQ ID NO: 384641 - RNA, 19 nt, Homo sapiens
gcaaugagggccuugaaca

SEQ ID NO: 384642 - RNA, 19 nt, Homo sapiens
gcauuggaguugcagaaau

SEQ ID NO: 384643 - RNA, 19 nt, Homo sapiens
uuaccaaacucuuuaccaa

SEQ ID NO: 384644 - RNA, 19 nt, Homo sapiens
ccuguaauccuaacacuuu

SEQ ID NO: 384645 - RNA, 19 nt, Homo sapiens
gagauaauaccuuacagau

SEQ ID NO: 384646 - RNA, 19 nt, Homo sapiens
ggagauaauaccuuacaga

SEQ ID NO: 384647 - RNA, 19 nt, Homo sapiens
gcaaacuuagcucugguua

SEQ ID NO: 384648 - RNA, 19 nt, Homo sapiens
ggugacagccacuaagaaa

SEQ ID NO: 384649 - RNA, 19 nt, Homo sapiens
caugaugcauuuacuguca

SEQ ID NO: 384650 - RNA, 19 nt, Homo sapiens
acuaaagaccgaaaugaua

SEQ ID NO: 384651 - RNA, 19 nt, Homo sapiens
ugaacaugauccaguuaaa

SEQ ID NO: 384652 - RNA, 19 nt, Homo sapiens
acauaaaguuggcacagaa

SEQ ID NO: 384653 - RNA, 19 nt, Homo sapiens
gaagaauugcuuuaaccuu

SEQ ID NO: 384654 - RNA, 19 nt, Homo sapiens
gaacuagaggagagacuga

SEQ ID NO: 384655 - RNA, 19 nt, Homo sapiens
ugaugaggcuuacguagau

SEQ ID NO: 384656 - RNA, 19 nt, Homo sapiens
gggcagaugaugcuaagaa

SEQ ID NO: 384657 - RNA, 19 nt, Homo sapiens
ggaggugacucagaaagca

SEQ ID NO: 384658 - RNA, 19 nt, Homo sapiens
cagaugaugcuaagaaguu

SEQ ID NO: 384659 - RNA, 19 nt, Homo sapiens
uaauugcagugaguuauga

SEQ ID NO: 384660 - RNA, 19 nt, Homo sapiens
caacagagcgagacuucau

SEQ ID NO: 384661 - RNA, 19 nt, Homo sapiens
gagacgugguugcaaacuu

SEQ ID NO: 384662 - RNA, 19 nt, Homo sapiens
ugucgaagcuagaagaauc

SEQ ID NO: 384663 - RNA, 19 nt, Homo sapiens
uuucaaaccagucaaagua

SEQ ID NO: 384664 - RNA, 19 nt, Homo sapiens
uacgaucccuucucgguuu

SEQ ID NO: 384665 - RNA, 19 nt, Homo sapiens
gcaggagaaucacuugaac

SEQ ID NO: 384666 - RNA, 19 nt, Homo sapiens
gaaaccccaucucuacuaa

SEQ ID NO: 384667 - RNA, 19 nt, Homo sapiens
gggaggcagugucauaaag

SEQ ID NO: 384668 - RNA, 19 nt, Homo sapiens
aggagagacugacuaaaga

SEQ ID NO: 384669 - RNA, 19 nt, Homo sapiens
aagagacuguucagaaaga

SEQ ID NO: 384670 - RNA, 19 nt, Homo sapiens
gaagagacuguucagaaag

SEQ ID NO: 384671 - RNA, 19 nt, Homo sapiens
caacagagcgagacuccau

SEQ ID NO: 384672 - RNA, 19 nt, Homo sapiens
accauuggcuguaguaaga

SEQ ID NO: 384673 - RNA, 19 nt, Homo sapiens
aaaucucgcucgaaacuca

SEQ ID NO: 384674 - RNA, 19 nt, Homo sapiens
guguucagcuggaauuuca

SEQ ID NO: 384675 - RNA, 19 nt, Homo sapiens
ggaaagcuaaccucaccaa

SEQ ID NO: 384676 - RNA, 19 nt, Homo sapiens
gcauuuggagucacuagaa

SEQ ID NO: 384677 - RNA, 19 nt, Homo sapiens
ggauaugccagaacacaug

SEQ ID NO: 384678 - RNA, 19 nt, Homo sapiens
cauuuacugucaucaagaa

SEQ ID NO: 384679 - RNA, 19 nt, Homo sapiens
gcaagaagcuggugauugu

SEQ ID NO: 384680 - RNA, 19 nt, Homo sapiens
gcuaaagguuccaagauua

SEQ ID NO: 384681 - RNA, 19 nt, Homo sapiens
agaaaucccugucugaaua

SEQ ID NO: 384682 - RNA, 19 nt, Homo sapiens
gagaagaaguuccgcuuug

SEQ ID NO: 384683 - RNA, 19 nt, Homo sapiens
gacuugaacugcaucuuua

SEQ ID NO: 384684 - RNA, 19 nt, Homo sapiens
caacaucuccuacuuauuc

SEQ ID NO: 384685 - RNA, 19 nt, Homo sapiens
ugacagagcucccggugaa

SEQ ID NO: 384686 - RNA, 19 nt, Homo sapiens
gcagagaagugcaaguaug

SEQ ID NO: 384687 - RNA, 19 nt, Homo sapiens
ugacagacuucaagaacua

SEQ ID NO: 384688 - RNA, 19 nt, Homo sapiens
uaauagaggucaucgagaa

SEQ ID NO: 384689 - RNA, 19 nt, Homo sapiens
gaacagcgaugagaacaag

SEQ ID NO: 384690 - RNA, 19 nt, Homo sapiens
gaaggugacugccaacaca

SEQ ID NO: 384691 - RNA, 19 nt, Homo sapiens
caacacagccaucuacuau

SEQ ID NO: 384692 - RNA, 19 nt, Homo sapiens
acacagccaucuacuauga

SEQ ID NO: 384693 - RNA, 19 nt, Homo sapiens
caucauaccuggucacauc

SEQ ID NO: 384694 - RNA, 19 nt, Homo sapiens
gugaaugucuacuaugaaa

SEQ ID NO: 384695 - RNA, 19 nt, Homo sapiens
ugacaucacucgccucuuc

SEQ ID NO: 384696 - RNA, 19 nt, Homo sapiens
ccaaagacuccuucgcuua

SEQ ID NO: 384697 - RNA, 19 nt, Homo sapiens
caggugaaccgcauucuua

SEQ ID NO: 384698 - RNA, 19 nt, Homo sapiens
uuaaggagcucaucaacau

SEQ ID NO: 384699 - RNA, 19 nt, Homo sapiens
caagauggaugaugauguc

SEQ ID NO: 384700 - RNA, 19 nt, Homo sapiens
ugaacugcaucuuuaauga

SEQ ID NO: 384701 - RNA, 19 nt, Homo sapiens
gggugaaugucuacuauga

SEQ ID NO: 384702 - RNA, 19 nt, Homo sapiens
ccaacaugcugacagauau

SEQ ID NO: 384703 - RNA, 19 nt, Homo sapiens
gaaguuccgcuuugauuau

SEQ ID NO: 384704 - RNA, 19 nt, Homo sapiens
ggucauugcugucguugga

SEQ ID NO: 384705 - RNA, 19 nt, Homo sapiens
gaaugucuacuaugaaaug

SEQ ID NO: 384706 - RNA, 19 nt, Homo sapiens
gcaagcggauuccauuugg

SEQ ID NO: 384707 - RNA, 19 nt, Homo sapiens
caucgagggucauacuauu

SEQ ID NO: 384708 - RNA, 19 nt, Homo sapiens
gggaugagaugaacuugca

SEQ ID NO: 384709 - RNA, 19 nt, Homo sapiens
caacaucacccagcuauuc

SEQ ID NO: 384710 - RNA, 19 nt, Homo sapiens
gagauugaguccaaguuca

SEQ ID NO: 384711 - RNA, 19 nt, Homo sapiens
gaucaggaaugggugaaug

SEQ ID NO: 384712 - RNA, 19 nt, Homo sapiens
caacaaggcuuuugagaag

SEQ ID NO: 384713 - RNA, 19 nt, Homo sapiens
caaaucuucucccucauca

SEQ ID NO: 384714 - RNA, 19 nt, Homo sapiens
ucacagcagugcgcaaauu

SEQ ID NO: 384715 - RNA, 19 nt, Homo sapiens
caacuauagucccacauca

SEQ ID NO: 384716 - RNA, 19 nt, Homo sapiens
gcuuugaccuccugcuuga

SEQ ID NO: 384717 - RNA, 19 nt, Homo sapiens
ggacacaggaccacucaug

SEQ ID NO: 384718 - RNA, 19 nt, Homo sapiens
gaaccugccacccagauga

SEQ ID NO: 384719 - RNA, 19 nt, Homo sapiens
ugaugaaccuccugauguu

SEQ ID NO: 384720 - RNA, 19 nt, Homo sapiens
gugaagacaaugaaaguuu

SEQ ID NO: 384721 - RNA, 19 nt, Homo sapiens
gauggaugaugaugucuuc

SEQ ID NO: 384722 - RNA, 19 nt, Homo sapiens
cgacuugaacugcaucuuu

SEQ ID NO: 384723 - RNA, 19 nt, Homo sapiens
gcugagagagccaaggaua

SEQ ID NO: 384724 - RNA, 19 nt, Homo sapiens
gaaccgcauucuuaacgau

SEQ ID NO: 384725 - RNA, 19 nt, Homo sapiens
acgaggaucugaccaaaga

SEQ ID NO: 384726 - RNA, 19 nt, Homo sapiens
gacggaggguggcaucaaa

SEQ ID NO: 384727 - RNA, 19 nt, Homo sapiens
ccagcuccguuguacauaa

SEQ ID NO: 384728 - RNA, 19 nt, Homo sapiens
ccacccagaugaccuugaa

SEQ ID NO: 384729 - RNA, 19 nt, Homo sapiens
uaacaucucccaggucauu

SEQ ID NO: 384730 - RNA, 19 nt, Homo sapiens
gacauucagaacacuauua

SEQ ID NO: 384731 - RNA, 19 nt, Homo sapiens
gcaaauucaccaagagaga

SEQ ID NO: 384732 - RNA, 19 nt, Homo sapiens
uggacaagauggaugauga

SEQ ID NO: 384733 - RNA, 19 nt, Homo sapiens
gaaccuggcuacgcuuaag

SEQ ID NO: 384734 - RNA, 19 nt, Homo sapiens
ggagauggacaacaaguuc

SEQ ID NO: 384735 - RNA, 19 nt, Homo sapiens
acccaaagaucaaggauau

SEQ ID NO: 384736 - RNA, 19 nt, Homo sapiens
cagaaaaucuuccacauca

SEQ ID NO: 384737 - RNA, 19 nt, Homo sapiens
agucagugauggugaagua

SEQ ID NO: 384738 - RNA, 19 nt, Homo sapiens
caaccagucccaacuauag

SEQ ID NO: 384739 - RNA, 19 nt, Homo sapiens
gaacugcaucuuuaaugau

SEQ ID NO: 384740 - RNA, 19 nt, Homo sapiens
cggaugaacugaagcgaau

SEQ ID NO: 384741 - RNA, 19 nt, Homo sapiens
ccacuaugcuggugugucu

SEQ ID NO: 384742 - RNA, 19 nt, Homo sapiens
agaagaaguuccgcuuuga

SEQ ID NO: 384743 - RNA, 19 nt, Homo sapiens
ucagaacacuauuaagaag

SEQ ID NO: 384744 - RNA, 19 nt, Homo sapiens
caacuucacccagcuauuc

SEQ ID NO: 384745 - RNA, 19 nt, Homo sapiens
uugaauaccuuccacuaug

SEQ ID NO: 384746 - RNA, 19 nt, Homo sapiens
ggcagacguuugagaauca

SEQ ID NO: 384747 - RNA, 19 nt, Homo sapiens
ccaagguggugguggagaa

SEQ ID NO: 384748 - RNA, 19 nt, Homo sapiens
aaucuucucccucaucaua

SEQ ID NO: 384749 - RNA, 19 nt, Homo sapiens
acacaugucuacgaccuuu

SEQ ID NO: 384750 - RNA, 19 nt, Homo sapiens
ucaucaacauuuccaagaa

SEQ ID NO: 384751 - RNA, 19 nt, Homo sapiens
ccaaacaugugcaggaaac

SEQ ID NO: 384752 - RNA, 19 nt, Homo sapiens
cuaaagguuccaagauuaa

SEQ ID NO: 384753 - RNA, 19 nt, Homo sapiens
accuuucgcuugaaucuua

SEQ ID NO: 384754 - RNA, 19 nt, Homo sapiens
aauggaagcacguuaauga

SEQ ID NO: 384755 - RNA, 19 nt, Homo sapiens
agaagcggcucacacaugu

SEQ ID NO: 384756 - RNA, 19 nt, Homo sapiens
cccaacaucuccuacuuau

SEQ ID NO: 384757 - RNA, 19 nt, Homo sapiens
aagcuacucuccaacauca

SEQ ID NO: 384758 - RNA, 19 nt, Homo sapiens
gcaggaaacaugacagagu

SEQ ID NO: 384759 - RNA, 19 nt, Homo sapiens
agacagacaacaagaagaa

SEQ ID NO: 384760 - RNA, 19 nt, Homo sapiens
gggcuccuuucgcuccuua

SEQ ID NO: 384761 - RNA, 19 nt, Homo sapiens
ggacauuguuaucuucaac

SEQ ID NO: 384762 - RNA, 19 nt, Homo sapiens
cagcuccguuguacauaaa

SEQ ID NO: 384763 - RNA, 19 nt, Homo sapiens
cgacaucacccagcuauuc

SEQ ID NO: 384764 - RNA, 19 nt, Homo sapiens
ccacaucacccagcuauuc

SEQ ID NO: 384765 - RNA, 19 nt, Homo sapiens
gcagauugcugaaaagauc

SEQ ID NO: 384766 - RNA, 19 nt, Homo sapiens
agaaguuccgcuuugauua

SEQ ID NO: 384767 - RNA, 19 nt, Homo sapiens
ucaugggcauccuguguaa

SEQ ID NO: 384768 - RNA, 19 nt, Homo sapiens
ugacgaggaucugaccaaa

SEQ ID NO: 384769 - RNA, 19 nt, Homo sapiens
caacaaguucgguguggaa

SEQ ID NO: 384770 - RNA, 19 nt, Homo sapiens
ccaagaagcggcucacaca

SEQ ID NO: 384771 - RNA, 19 nt, Homo sapiens
caacgucaccugccuacga

SEQ ID NO: 384772 - RNA, 19 nt, Homo sapiens
gcaaguauggcauggagau

SEQ ID NO: 384773 - RNA, 19 nt, Homo sapiens
ucacggugcugggcauuga

SEQ ID NO: 384774 - RNA, 19 nt, Homo sapiens
ugagagagccaaggauauu

SEQ ID NO: 384775 - RNA, 19 nt, Homo sapiens
cagaugaccuugaauaccu

SEQ ID NO: 384776 - RNA, 19 nt, Homo sapiens
gcuuaagccuuccaacaag

SEQ ID NO: 384777 - RNA, 19 nt, Homo sapiens
cgagaaggcacacaacaau

SEQ ID NO: 384778 - RNA, 19 nt, Homo sapiens
ggccaagcaggacguaaua

SEQ ID NO: 384779 - RNA, 19 nt, Homo sapiens
gaaaugagguccuguacaa

SEQ ID NO: 384780 - RNA, 19 nt, Homo sapiens
ggaagacgcuccuccuaua

SEQ ID NO: 384781 - RNA, 19 nt, Homo sapiens
gacaacagcuggauucuuu

SEQ ID NO: 384782 - RNA, 19 nt, Homo sapiens
gaucaugucuugagaauuc

SEQ ID NO: 384783 - RNA, 19 nt, Homo sapiens
gcacagaaauuuauugauc

SEQ ID NO: 384784 - RNA, 19 nt, Homo sapiens
gcaagaaguucccaucauu

SEQ ID NO: 384785 - RNA, 19 nt, Homo sapiens
ggaacgagauugucagauu

SEQ ID NO: 384786 - RNA, 19 nt, Homo sapiens
gaagcaugcuggauuguaa

SEQ ID NO: 384787 - RNA, 19 nt, Homo sapiens
ggaagacucuguuaucaug

SEQ ID NO: 384788 - RNA, 19 nt, Homo sapiens
ccaagacaguugcauaaua

SEQ ID NO: 384789 - RNA, 19 nt, Homo sapiens
uaaagaaggugaagaacaa

SEQ ID NO: 384790 - RNA, 19 nt, Homo sapiens
gauauuugcugaaguuuga

SEQ ID NO: 384791 - RNA, 19 nt, Homo sapiens
gcacuaaauuucauugguu

SEQ ID NO: 384792 - RNA, 19 nt, Homo sapiens
gaacgagauugucagauug

SEQ ID NO: 384793 - RNA, 19 nt, Homo sapiens
gaaaugcucccucauguug

SEQ ID NO: 384794 - RNA, 19 nt, Homo sapiens
ggagucaacaagauaauua

SEQ ID NO: 384795 - RNA, 19 nt, Homo sapiens
ugacaaauauguacugugu

SEQ ID NO: 384796 - RNA, 19 nt, Homo sapiens
ggaugaugaugguuugaua

SEQ ID NO: 384797 - RNA, 19 nt, Homo sapiens
agaaagaaguagcuuauug

SEQ ID NO: 384798 - RNA, 19 nt, Homo sapiens
ugacagagaucacuaugga

SEQ ID NO: 384799 - RNA, 19 nt, Homo sapiens
gaaguucccaucauuauug

SEQ ID NO: 384800 - RNA, 19 nt, Homo sapiens
gcaagaagcaugcuggauu

SEQ ID NO: 384801 - RNA, 19 nt, Homo sapiens
aaacacggaucauaucuga

SEQ ID NO: 384802 - RNA, 19 nt, Homo sapiens
gaguguagaucaugucuug

SEQ ID NO: 384803 - RNA, 19 nt, Homo sapiens
caagaagcaugcuggauug

SEQ ID NO: 384804 - RNA, 19 nt, Homo sapiens
gaggguagaucucgugaug

SEQ ID NO: 384805 - RNA, 19 nt, Homo sapiens
guaguggaguauauugaua

SEQ ID NO: 384806 - RNA, 19 nt, Homo sapiens
acaaauauguacuguguug

SEQ ID NO: 384807 - RNA, 19 nt, Homo sapiens
auacaugguucauagguua

SEQ ID NO: 384808 - RNA, 19 nt, Homo sapiens
ccugguggcuauuucauua

SEQ ID NO: 384809 - RNA, 19 nt, Homo sapiens
gauuauggcuaucaucuca

SEQ ID NO: 384810 - RNA, 19 nt, Homo sapiens
gaaagaaguagcuuauugu

SEQ ID NO: 384811 - RNA, 19 nt, Homo sapiens
gaagaggcauauugaccaa

SEQ ID NO: 384812 - RNA, 19 nt, Homo sapiens
caagacaguugcauaauac

SEQ ID NO: 384813 - RNA, 19 nt, Homo sapiens
caagaaguucccaucauua

SEQ ID NO: 384814 - RNA, 19 nt, Homo sapiens
uggaguaucucagguguua

SEQ ID NO: 384815 - RNA, 19 nt, Homo sapiens
gaagaaccgccacgauauu

SEQ ID NO: 384816 - RNA, 19 nt, Homo sapiens
acaaagaacaggagucuaa

SEQ ID NO: 384817 - RNA, 19 nt, Homo sapiens
ggagaaagaaguagcuuau

SEQ ID NO: 384818 - RNA, 19 nt, Homo sapiens
gaugaguguuuagcuauuu

SEQ ID NO: 384819 - RNA, 19 nt, Homo sapiens
guucauguuugcaaucuuu

SEQ ID NO: 384820 - RNA, 19 nt, Homo sapiens
uaacaagggugaaauuggu

SEQ ID NO: 384821 - RNA, 19 nt, Homo sapiens
gagaugauguuauuauagg

SEQ ID NO: 384822 - RNA, 19 nt, Homo sapiens
caaugaagcuagauuaagg

SEQ ID NO: 384823 - RNA, 19 nt, Homo sapiens
cauaucagguucauguuug

SEQ ID NO: 384824 - RNA, 19 nt, Homo sapiens
ugaagcauaugguggauga

SEQ ID NO: 384825 - RNA, 19 nt, Homo sapiens
gacaagaggauaugccuuu

SEQ ID NO: 384826 - RNA, 19 nt, Homo sapiens
caucauacacuggauauaa

SEQ ID NO: 384827 - RNA, 19 nt, Homo sapiens
guagaccacuucugauugu

SEQ ID NO: 384828 - RNA, 19 nt, Homo sapiens
gcggaucuaugcacagaaa

SEQ ID NO: 384829 - RNA, 19 nt, Homo sapiens
cgagaaccguuuggcaaua

SEQ ID NO: 384830 - RNA, 19 nt, Homo sapiens
ggugaugccacuccauuua

SEQ ID NO: 384831 - RNA, 19 nt, Homo sapiens
gacuauuggucacuuaauu

SEQ ID NO: 384832 - RNA, 19 nt, Homo sapiens
cugcuugcauucuuauuua

SEQ ID NO: 384833 - RNA, 19 nt, Homo sapiens
cgacagagauauuuuagaa

SEQ ID NO: 384834 - RNA, 19 nt, Homo sapiens
acauaaagaucccgaacaa

SEQ ID NO: 384835 - RNA, 19 nt, Homo sapiens
gagaugauggaaaugguua

SEQ ID NO: 384836 - RNA, 19 nt, Homo sapiens
gagaaaggcuugguuagac

SEQ ID NO: 384837 - RNA, 19 nt, Homo sapiens
uauguacuguguugugaua

SEQ ID NO: 384838 - RNA, 19 nt, Homo sapiens
gagaaccguuuggcaauau

SEQ ID NO: 384839 - RNA, 19 nt, Homo sapiens
uaccauauaucaagcaaga

SEQ ID NO: 384840 - RNA, 19 nt, Homo sapiens
aagaacaacuucagacuca

SEQ ID NO: 384841 - RNA, 19 nt, Homo sapiens
ucuauuguguggcuuuaua

SEQ ID NO: 384842 - RNA, 19 nt, Homo sapiens
gcuuauuguuccacauaua

SEQ ID NO: 384843 - RNA, 19 nt, Homo sapiens
ccaauuauguugcggucaa

SEQ ID NO: 384844 - RNA, 19 nt, Homo sapiens
uaugguggaugauaagauu

SEQ ID NO: 384845 - RNA, 19 nt, Homo sapiens
gaagguaucggcuaacaag

SEQ ID NO: 384846 - RNA, 19 nt, Homo sapiens
ggaagaagaaacagugaug

SEQ ID NO: 384847 - RNA, 19 nt, Homo sapiens
aaagaucccgaacaacuua

SEQ ID NO: 384848 - RNA, 19 nt, Homo sapiens
gaagaauggaguauggaaa

SEQ ID NO: 384849 - RNA, 19 nt, Homo sapiens
gaucuaugcacagaaauuu

SEQ ID NO: 384850 - RNA, 19 nt, Homo sapiens
uggcaacucuaccauauau

SEQ ID NO: 384851 - RNA, 19 nt, Homo sapiens
caccaaugaugcccaauga

SEQ ID NO: 384852 - RNA, 19 nt, Homo sapiens
gcuaucaucucagaggaaa

SEQ ID NO: 384853 - RNA, 19 nt, Homo sapiens
gguacgcucuguuaggauu

SEQ ID NO: 384854 - RNA, 19 nt, Homo sapiens
uggcccauguucucuauua

SEQ ID NO: 384855 - RNA, 19 nt, Homo sapiens
ugaagaagaggcauauuga

SEQ ID NO: 384856 - RNA, 19 nt, Homo sapiens
gaugcaggccguauuugua

SEQ ID NO: 384857 - RNA, 19 nt, Homo sapiens
gaaauugagacgucagaug

SEQ ID NO: 384858 - RNA, 19 nt, Homo sapiens
gauacaugguucauagguu

SEQ ID NO: 384859 - RNA, 19 nt, Homo sapiens
ggagaaauggaacgagauu

SEQ ID NO: 384860 - RNA, 19 nt, Homo sapiens
ggagacaaauuugcuaguc

SEQ ID NO: 384861 - RNA, 19 nt, Homo sapiens
acagucaccuugccugaaa

SEQ ID NO: 384862 - RNA, 19 nt, Homo sapiens
acgacaagcuggaugauga

SEQ ID NO: 384863 - RNA, 19 nt, Homo sapiens
gaaaggauuuuaacuugga

SEQ ID NO: 384864 - RNA, 19 nt, Homo sapiens
gcaacucuaccauauauca

SEQ ID NO: 384865 - RNA, 19 nt, Homo sapiens
gguggcuauuucauuauua

SEQ ID NO: 384866 - RNA, 19 nt, Homo sapiens
uaaauaucuuggugucuug

SEQ ID NO: 384867 - RNA, 19 nt, Homo sapiens
aaacagugaugcuugcaau

SEQ ID NO: 384868 - RNA, 19 nt, Homo sapiens
gacgagaaaggcuugguua

SEQ ID NO: 384869 - RNA, 19 nt, Homo sapiens
aagauucacucucgugcua

SEQ ID NO: 384870 - RNA, 19 nt, Homo sapiens
uaccagcguuugaagcaua

SEQ ID NO: 384871 - RNA, 19 nt, Homo sapiens
caaauuugcuagucgacau

SEQ ID NO: 384872 - RNA, 19 nt, Homo sapiens
caggaagacucuguuauca

SEQ ID NO: 384873 - RNA, 19 nt, Homo sapiens
uuaaagaagugcggaucua

SEQ ID NO: 384874 - RNA, 19 nt, Homo sapiens
gaauuugcuuaaagaagug

SEQ ID NO: 384875 - RNA, 19 nt, Homo sapiens
gcauucuuauuuagaggua

SEQ ID NO: 384876 - RNA, 19 nt, Homo sapiens
ggagcaaagccugguguua

SEQ ID NO: 384877 - RNA, 19 nt, Homo sapiens
cagcaggcaucaacucaau

SEQ ID NO: 384878 - RNA, 19 nt, Homo sapiens
caacuuaugaacacccuaa

SEQ ID NO: 384879 - RNA, 19 nt, Homo sapiens
gaaguaaccuuuuggaaua

SEQ ID NO: 384880 - RNA, 19 nt, Homo sapiens
gcacaaagcaguuaauuag

SEQ ID NO: 384881 - RNA, 19 nt, Homo sapiens
gaaacugagugauuuacaa

SEQ ID NO: 384882 - RNA, 19 nt, Homo sapiens
gaagaaacugagugauuua

SEQ ID NO: 384883 - RNA, 19 nt, Homo sapiens
caauaaagagcacaacaua

SEQ ID NO: 384884 - RNA, 19 nt, Homo sapiens
agaagaaacugagugauuu

SEQ ID NO: 384885 - RNA, 19 nt, Homo sapiens
ugacugcuguuaauaauug

SEQ ID NO: 384886 - RNA, 19 nt, Homo sapiens
guacagaaaggaaaggaua

SEQ ID NO: 384887 - RNA, 19 nt, Homo sapiens
guccagcucuuuacucuaa

SEQ ID NO: 384888 - RNA, 19 nt, Homo sapiens
gcaaggagcaugccaagug

SEQ ID NO: 384889 - RNA, 19 nt, Homo sapiens
ggacaucaguaccaacuag

SEQ ID NO: 384890 - RNA, 19 nt, Homo sapiens
ucacaggcuuggauuaauu

SEQ ID NO: 384891 - RNA, 19 nt, Homo sapiens
gaacaugcacaaagcaguu

SEQ ID NO: 384892 - RNA, 19 nt, Homo sapiens
ggucauagauagauuacca

SEQ ID NO: 384893 - RNA, 19 nt, Homo sapiens
ugaauacgauccagacaau

SEQ ID NO: 384894 - RNA, 19 nt, Homo sapiens
ggagcucacugacgagaau

SEQ ID NO: 384895 - RNA, 19 nt, Homo sapiens
ggaggaguauuucauuucu

SEQ ID NO: 384896 - RNA, 19 nt, Homo sapiens
caggaggaguauuucauuu

SEQ ID NO: 384897 - RNA, 19 nt, Homo sapiens
gauccagagugaugugcua

SEQ ID NO: 384898 - RNA, 19 nt, Homo sapiens
gccacgagauccagaguga

SEQ ID NO: 384899 - RNA, 19 nt, Homo sapiens
agaagugggucauagauag

SEQ ID NO: 384900 - RNA, 19 nt, Homo sapiens
gugaugugcuaaccauaaa

SEQ ID NO: 384901 - RNA, 19 nt, Homo sapiens
caagugccauagccuuuau

SEQ ID NO: 384902 - RNA, 19 nt, Homo sapiens
gcucacaggcuuggauuaa

SEQ ID NO: 384903 - RNA, 19 nt, Homo sapiens
ccagagauccaguacagaa

SEQ ID NO: 384904 - RNA, 19 nt, Homo sapiens
gaugugcggugcaaugaag

SEQ ID NO: 384905 - RNA, 19 nt, Homo sapiens
gcaauaaagagcacaacau

SEQ ID NO: 384906 - RNA, 19 nt, Homo sapiens
ucagcacugucuccagaua

SEQ ID NO: 384907 - RNA, 19 nt, Homo sapiens
ucccaggugucccuaauuu

SEQ ID NO: 384908 - RNA, 19 nt, Homo sapiens
ggucccugcuggaguguuu

SEQ ID NO: 384909 - RNA, 19 nt, Homo sapiens
gcugagacuucgagccuau

SEQ ID NO: 384910 - RNA, 19 nt, Homo sapiens
gauaggaacaugcacaaag

SEQ ID NO: 384911 - RNA, 19 nt, Homo sapiens
ccaggugucccuaauuuga

SEQ ID NO: 384912 - RNA, 19 nt, Homo sapiens
gagaaugucaaguucauca

SEQ ID NO: 384913 - RNA, 19 nt, Homo sapiens
aagaagaaacugagugauu

SEQ ID NO: 384914 - RNA, 19 nt, Homo sapiens
ugucagcccucucaggauu

SEQ ID NO: 384915 - RNA, 19 nt, Homo sapiens
gucccuaauuugagaagua

SEQ ID NO: 384916 - RNA, 19 nt, Homo sapiens
gggaugcagugguguuuag

SEQ ID NO: 384917 - RNA, 19 nt, Homo sapiens
gaugugcuaaccauaaauu

SEQ ID NO: 384918 - RNA, 19 nt, Homo sapiens
uauaaacccuuccaguucu

SEQ ID NO: 384919 - RNA, 19 nt, Homo sapiens
ucgcugagguucccauaau

SEQ ID NO: 384920 - RNA, 19 nt, Homo sapiens
gaagugggucauagauaga

SEQ ID NO: 384921 - RNA, 19 nt, Homo sapiens
ucaaguucaucaucgagaa

SEQ ID NO: 384922 - RNA, 19 nt, Homo sapiens
agacuucucuccugguuag

SEQ ID NO: 384923 - RNA, 19 nt, Homo sapiens
gcaccuguaggaacaacua

SEQ ID NO: 384924 - RNA, 19 nt, Homo sapiens
ugaagaagaaacugaguga

SEQ ID NO: 384925 - RNA, 19 nt, Homo sapiens
ccuauaaacccuuccaguu

SEQ ID NO: 384926 - RNA, 19 nt, Homo sapiens
caacuagaagugggucaua

SEQ ID NO: 384927 - RNA, 19 nt, Homo sapiens
agacucuucucguuucuga

SEQ ID NO: 384928 - RNA, 19 nt, Homo sapiens
ucucaggauugaagaagaa

SEQ ID NO: 384929 - RNA, 19 nt, Homo sapiens
gaccagacgcgacauguca

SEQ ID NO: 384930 - RNA, 19 nt, Homo sapiens
ggaguucacccucgaugug

SEQ ID NO: 384931 - RNA, 19 nt, Homo sapiens
gagaaucuagucuacuguu

SEQ ID NO: 384932 - RNA, 19 nt, Homo sapiens
cuauaaacccuuccaguuc

SEQ ID NO: 384933 - RNA, 19 nt, Homo sapiens
uagaagugggucauagaua

SEQ ID NO: 384934 - RNA, 19 nt, Homo sapiens
ugaaaccauuguccuguca

SEQ ID NO: 384935 - RNA, 19 nt, Homo sapiens
cagaaaggaaaggauauuu

SEQ ID NO: 384936 - RNA, 19 nt, Homo sapiens
ggauugaagaagaaacuga

SEQ ID NO: 384937 - RNA, 19 nt, Homo sapiens
ucaagugccauagccuuua

SEQ ID NO: 384938 - RNA, 19 nt, Homo sapiens
gccauugacuggguucaga

SEQ ID NO: 384939 - RNA, 19 nt, Homo sapiens
guaggaacaacuagacuuc

SEQ ID NO: 384940 - RNA, 19 nt, Homo sapiens
ccugacugcuguuaauaau

SEQ ID NO: 384941 - RNA, 19 nt, Homo sapiens
ggcccugacugcuguuaau

SEQ ID NO: 384942 - RNA, 19 nt, Homo sapiens
ucaauuaagccacgagauc

SEQ ID NO: 384943 - RNA, 19 nt, Homo sapiens
ccagaaagguuuuacuaca

SEQ ID NO: 384944 - RNA, 19 nt, Homo sapiens
ccugcuagcgcuucaaauu

SEQ ID NO: 384945 - RNA, 19 nt, Homo sapiens
uuagaugucugguguugag

SEQ ID NO: 384946 - RNA, 19 nt, Homo sapiens
gaagaccagacgcgacaug

SEQ ID NO: 384947 - RNA, 19 nt, Homo sapiens
cuagacuucucuccugguu

SEQ ID NO: 384948 - RNA, 19 nt, Homo sapiens
agaaucuagucuacuguug

SEQ ID NO: 384949 - RNA, 19 nt, Homo sapiens
cugagaaucuagucuacug

SEQ ID NO: 384950 - RNA, 19 nt, Homo sapiens
uggacaagcugcaguacuc

SEQ ID NO: 384951 - RNA, 19 nt, Homo sapiens
gcacaugugaggaguucug

SEQ ID NO: 384952 - RNA, 19 nt, Homo sapiens
aaccagagauccaguacag

SEQ ID NO: 384953 - RNA, 19 nt, Homo sapiens
gaaaaccagagauccagua

SEQ ID NO: 384954 - RNA, 19 nt, Homo sapiens
gaaugucaaguucaucauc

SEQ ID NO: 384955 - RNA, 19 nt, Homo sapiens
cagaaagguuuuacuacaa

SEQ ID NO: 384956 - RNA, 19 nt, Homo sapiens
cggcaagccagaaagguuu

SEQ ID NO: 384957 - RNA, 19 nt, Homo sapiens
cgcugagguucccauaaua

SEQ ID NO: 384958 - RNA, 19 nt, Homo sapiens
cauuagugaugacauugug

SEQ ID NO: 384959 - RNA, 19 nt, Homo sapiens
aggaauggccaaagaguga

SEQ ID NO: 384960 - RNA, 19 nt, Homo sapiens
gagauccaguacagaaagg

SEQ ID NO: 384961 - RNA, 19 nt, Homo sapiens
ugcacaaagcaguuaauua

SEQ ID NO: 384962 - RNA, 19 nt, Homo sapiens
ucccuaauuugagaaguaa

SEQ ID NO: 384963 - RNA, 19 nt, Homo sapiens
ccuuagaugucugguguug

SEQ ID NO: 384964 - RNA, 19 nt, Homo sapiens
cuaaacccuuucuguccaa

SEQ ID NO: 384965 - RNA, 19 nt, Homo sapiens
agagugaugugcuaaccau

SEQ ID NO: 384966 - RNA, 19 nt, Homo sapiens
ugaaggcucuggcccuaac

SEQ ID NO: 384967 - RNA, 19 nt, Homo sapiens
cacauacacaggaggagua

SEQ ID NO: 384968 - RNA, 19 nt, Homo sapiens
ugucugguguugaggauca

SEQ ID NO: 384969 - RNA, 19 nt, Homo sapiens
gaugucugguguugaggau

SEQ ID NO: 384970 - RNA, 19 nt, Homo sapiens
ggcaggacaucaguaccaa

SEQ ID NO: 384971 - RNA, 19 nt, Homo sapiens
cuagucuacuguugguuga

SEQ ID NO: 384972 - RNA, 19 nt, Homo sapiens
gagauaaugaccccaauga

SEQ ID NO: 384973 - RNA, 19 nt, Homo sapiens
acaggaggaguauuucauu

SEQ ID NO: 384974 - RNA, 19 nt, Homo sapiens
uugacuggguucagauuga

SEQ ID NO: 384975 - RNA, 19 nt, Homo sapiens
ucucgggacugcacaugug

SEQ ID NO: 384976 - RNA, 19 nt, Homo sapiens
cccgaggaauggccaaaga

SEQ ID NO: 384977 - RNA, 19 nt, Homo sapiens
gcugagguucccauaauag

SEQ ID NO: 384978 - RNA, 19 nt, Homo sapiens
cagugcaccuguaggaaca

SEQ ID NO: 384979 - RNA, 19 nt, Homo sapiens
gaaguaaccuuuuggaaua

SEQ ID NO: 384980 - RNA, 19 nt, Homo sapiens
gcacaaagcaguuaauuag

SEQ ID NO: 384981 - RNA, 19 nt, Homo sapiens
gaaacugagugauuuacaa

SEQ ID NO: 384982 - RNA, 19 nt, Homo sapiens
gaagaaacugagugauuua

SEQ ID NO: 384983 - RNA, 19 nt, Homo sapiens
caauaaagagcacaacaua

SEQ ID NO: 384984 - RNA, 19 nt, Homo sapiens
agaagaaacugagugauuu

SEQ ID NO: 384985 - RNA, 19 nt, Homo sapiens
ugacugcuguuaauaauug

SEQ ID NO: 384986 - RNA, 19 nt, Homo sapiens
guacagaaaggaaaggaua

SEQ ID NO: 384987 - RNA, 19 nt, Homo sapiens
guccagcucuuuacucuaa

SEQ ID NO: 384988 - RNA, 19 nt, Homo sapiens
gcaaggagcaugccaagug

SEQ ID NO: 384989 - RNA, 19 nt, Homo sapiens
ggacaucaguaccaacuag

SEQ ID NO: 384990 - RNA, 19 nt, Homo sapiens
ucacaggcuuggauuaauu

SEQ ID NO: 384991 - RNA, 19 nt, Homo sapiens
gaacaugcacaaagcaguu

SEQ ID NO: 384992 - RNA, 19 nt, Homo sapiens
ggucauagauagauuacca

SEQ ID NO: 384993 - RNA, 19 nt, Homo sapiens
ugaauacgauccagacaau

SEQ ID NO: 384994 - RNA, 19 nt, Homo sapiens
ggagcucacugacgagaau

SEQ ID NO: 384995 - RNA, 19 nt, Homo sapiens
ggaggaguauuucauuucu

SEQ ID NO: 384996 - RNA, 19 nt, Homo sapiens
caggaggaguauuucauuu

SEQ ID NO: 384997 - RNA, 19 nt, Homo sapiens
gauccagagugaugugcua

SEQ ID NO: 384998 - RNA, 19 nt, Homo sapiens
gccacgagauccagaguga

SEQ ID NO: 384999 - RNA, 19 nt, Homo sapiens
agaagugggucauagauag

SEQ ID NO: 385000 - RNA, 19 nt, Homo sapiens
gugaugugcuaaccauaaa

SEQ ID NO: 385001 - RNA, 19 nt, Homo sapiens
caagugccauagccuuuau

SEQ ID NO: 385002 - RNA, 19 nt, Homo sapiens
gaccugaucauuuaguuug

SEQ ID NO: 385003 - RNA, 19 nt, Homo sapiens
gcucacaggcuuggauuaa

SEQ ID NO: 385004 - RNA, 19 nt, Homo sapiens
ccagagauccaguacagaa

SEQ ID NO: 385005 - RNA, 19 nt, Homo sapiens
gaugugcggugcaaugaag

SEQ ID NO: 385006 - RNA, 19 nt, Homo sapiens
gcaauaaagagcacaacau

SEQ ID NO: 385007 - RNA, 19 nt, Homo sapiens
ucagcacugucuccagaua

SEQ ID NO: 385008 - RNA, 19 nt, Homo sapiens
ucccaggugucccuaauuu

SEQ ID NO: 385009 - RNA, 19 nt, Homo sapiens
ggucccugcuggaguguuu

SEQ ID NO: 385010 - RNA, 19 nt, Homo sapiens
gcugagacuucgagccuau

SEQ ID NO: 385011 - RNA, 19 nt, Homo sapiens
gauaggaacaugcacaaag

SEQ ID NO: 385012 - RNA, 19 nt, Homo sapiens
ccaggugucccuaauuuga

SEQ ID NO: 385013 - RNA, 19 nt, Homo sapiens
gagaaugucaaguucauca

SEQ ID NO: 385014 - RNA, 19 nt, Homo sapiens
aagaagaaacugagugauu

SEQ ID NO: 385015 - RNA, 19 nt, Homo sapiens
ugucagcccucucaggauu

SEQ ID NO: 385016 - RNA, 19 nt, Homo sapiens
gucccuaauuugagaagua

SEQ ID NO: 385017 - RNA, 19 nt, Homo sapiens
gggaugcagugguguuuag

SEQ ID NO: 385018 - RNA, 19 nt, Homo sapiens
gaugugcuaaccauaaauu

SEQ ID NO: 385019 - RNA, 19 nt, Homo sapiens
ucgcugagguucccauaau

SEQ ID NO: 385020 - RNA, 19 nt, Homo sapiens
uauaaacccuuccaguucu

SEQ ID NO: 385021 - RNA, 19 nt, Homo sapiens
gaagugggucauagauaga

SEQ ID NO: 385022 - RNA, 19 nt, Homo sapiens
ucaaguucaucaucgagaa

SEQ ID NO: 385023 - RNA, 19 nt, Homo sapiens
agacuucucuccugguuag

SEQ ID NO: 385024 - RNA, 19 nt, Homo sapiens
gcaccuguaggaacaacua

SEQ ID NO: 385025 - RNA, 19 nt, Homo sapiens
ugaagaagaaacugaguga

SEQ ID NO: 385026 - RNA, 19 nt, Homo sapiens
ccuauaaacccuuccaguu

SEQ ID NO: 385027 - RNA, 19 nt, Homo sapiens
caacuagaagugggucaua

SEQ ID NO: 385028 - RNA, 19 nt, Homo sapiens
agacucuucucguuucuga

SEQ ID NO: 385029 - RNA, 19 nt, Homo sapiens
ucucaggauugaagaagaa

SEQ ID NO: 385030 - RNA, 19 nt, Homo sapiens
gaccagacgcgacauguca

SEQ ID NO: 385031 - RNA, 19 nt, Homo sapiens
ggaguucacccucgaugug

SEQ ID NO: 385032 - RNA, 19 nt, Homo sapiens
gagaaucuagucuacuguu

SEQ ID NO: 385033 - RNA, 19 nt, Homo sapiens
cuauaaacccuuccaguuc

SEQ ID NO: 385034 - RNA, 19 nt, Homo sapiens
uagaagugggucauagaua

SEQ ID NO: 385035 - RNA, 19 nt, Homo sapiens
ugaaaccauuguccuguca

SEQ ID NO: 385036 - RNA, 19 nt, Homo sapiens
cagaaaggaaaggauauuu

SEQ ID NO: 385037 - RNA, 19 nt, Homo sapiens
ggauugaagaagaaacuga

SEQ ID NO: 385038 - RNA, 19 nt, Homo sapiens
gccauugacuggguucaga

SEQ ID NO: 385039 - RNA, 19 nt, Homo sapiens
ucaagugccauagccuuua

SEQ ID NO: 385040 - RNA, 19 nt, Homo sapiens
guaggaacaacuagacuuc

SEQ ID NO: 385041 - RNA, 19 nt, Homo sapiens
ccugacugcuguuaauaau

SEQ ID NO: 385042 - RNA, 19 nt, Homo sapiens
ggcccugacugcuguuaau

SEQ ID NO: 385043 - RNA, 19 nt, Homo sapiens
ucaauuaagccacgagauc

SEQ ID NO: 385044 - RNA, 19 nt, Homo sapiens
ccagaaagguuuuacuaca

SEQ ID NO: 385045 - RNA, 19 nt, Homo sapiens
ccaccaaauaaacaugaua

SEQ ID NO: 385046 - RNA, 19 nt, Homo sapiens
ccugcuagcgcuucaaauu

SEQ ID NO: 385047 - RNA, 19 nt, Homo sapiens
uuagaugucugguguugag

SEQ ID NO: 385048 - RNA, 19 nt, Homo sapiens
gaagaccagacgcgacaug

SEQ ID NO: 385049 - RNA, 19 nt, Homo sapiens
cuagacuucucuccugguu

SEQ ID NO: 385050 - RNA, 19 nt, Homo sapiens
agaaucuagucuacuguug

SEQ ID NO: 385051 - RNA, 19 nt, Homo sapiens
cugagaaucuagucuacug

SEQ ID NO: 385052 - RNA, 19 nt, Homo sapiens
uggacaagcugcaguacuc

SEQ ID NO: 385053 - RNA, 19 nt, Homo sapiens
gcacaugugaggaguucug

SEQ ID NO: 385054 - RNA, 19 nt, Homo sapiens
aaccagagauccaguacag

SEQ ID NO: 385055 - RNA, 19 nt, Homo sapiens
gaaaaccagagauccagua

SEQ ID NO: 385056 - RNA, 19 nt, Homo sapiens
cgcugagguucccauaaua

SEQ ID NO: 385057 - RNA, 19 nt, Homo sapiens
gaaugucaaguucaucauc

SEQ ID NO: 385058 - RNA, 19 nt, Homo sapiens
cagaaagguuuuacuacaa

SEQ ID NO: 385059 - RNA, 19 nt, Homo sapiens
cggcaagccagaaagguuu

SEQ ID NO: 385060 - RNA, 19 nt, Homo sapiens
cauuagugaugacauugug

SEQ ID NO: 385061 - RNA, 19 nt, Homo sapiens
aggaauggccaaagaguga

SEQ ID NO: 385062 - RNA, 19 nt, Homo sapiens
gagauccaguacagaaagg

SEQ ID NO: 385063 - RNA, 19 nt, Homo sapiens
ugcacaaagcaguuaauua

SEQ ID NO: 385064 - RNA, 19 nt, Homo sapiens
ucccuaauuugagaaguaa

SEQ ID NO: 385065 - RNA, 19 nt, Homo sapiens
ccuuagaugucugguguug

SEQ ID NO: 385066 - RNA, 19 nt, Homo sapiens
cuaaacccuuucuguccaa

SEQ ID NO: 385067 - RNA, 19 nt, Homo sapiens
agagugaugugcuaaccau

SEQ ID NO: 385068 - RNA, 19 nt, Homo sapiens
ugaaggcucuggcccuaac

SEQ ID NO: 385069 - RNA, 19 nt, Homo sapiens
cacauacacaggaggagua

SEQ ID NO: 385070 - RNA, 19 nt, Homo sapiens
ugucugguguugaggauca

SEQ ID NO: 385071 - RNA, 19 nt, Homo sapiens
gaugucugguguugaggau

SEQ ID NO: 385072 - RNA, 19 nt, Homo sapiens
ggcaggacaucaguaccaa

SEQ ID NO: 385073 - RNA, 19 nt, Homo sapiens
cuagucuacuguugguuga

SEQ ID NO: 385074 - RNA, 19 nt, Homo sapiens
gagauaaugaccccaauga

SEQ ID NO: 385075 - RNA, 19 nt, Homo sapiens
acaggaggaguauuucauu

SEQ ID NO: 385076 - RNA, 19 nt, Homo sapiens
uugacuggguucagauuga

SEQ ID NO: 385077 - RNA, 19 nt, Homo sapiens
ucucgggacugcacaugug

SEQ ID NO: 385078 - RNA, 19 nt, Homo sapiens
cccgaggaauggccaaaga

SEQ ID NO: 385079 - RNA, 19 nt, Homo sapiens
ugagauagauggcuacuuu

SEQ ID NO: 385080 - RNA, 19 nt, Homo sapiens
gaauugagcucaugaagca

SEQ ID NO: 385081 - RNA, 19 nt, Homo sapiens
gauagggucuuaacucuug

SEQ ID NO: 385082 - RNA, 19 nt, Homo sapiens
ugacaaggcuacuaagaaa

SEQ ID NO: 385083 - RNA, 19 nt, Homo sapiens
gaaacuagaccagaagaua

SEQ ID NO: 385084 - RNA, 19 nt, Homo sapiens
ggacaagugcuaaguauug

SEQ ID NO: 385085 - RNA, 19 nt, Homo sapiens
ccacaacucucagcuaauu

SEQ ID NO: 385086 - RNA, 19 nt, Homo sapiens
gcacaguggugaggaauug

SEQ ID NO: 385087 - RNA, 19 nt, Homo sapiens
caacuggccugaaauucuu

SEQ ID NO: 385088 - RNA, 19 nt, Homo sapiens
gagaauuccuuuggagaaa

SEQ ID NO: 385089 - RNA, 19 nt, Homo sapiens
uaaguggucuugaaggauu

SEQ ID NO: 385090 - RNA, 19 nt, Homo sapiens
ccaaagagguccacaacca

SEQ ID NO: 385091 - RNA, 19 nt, Homo sapiens
uaacaaagaagaagcaaug

SEQ ID NO: 385092 - RNA, 19 nt, Homo sapiens
guauuaaucuccaaacauc

SEQ ID NO: 385093 - RNA, 19 nt, Homo sapiens
gaacugucuugcagaaugu

SEQ ID NO: 385094 - RNA, 19 nt, Homo sapiens
caccacaacucucagcuaa

SEQ ID NO: 385095 - RNA, 19 nt, Homo sapiens
gcugagacacuucuaaauu

SEQ ID NO: 385096 - RNA, 19 nt, Homo sapiens
gagauagggucuuaacucu

SEQ ID NO: 385097 - RNA, 19 nt, Homo sapiens
ugaagacaguugagaauuc

SEQ ID NO: 385098 - RNA, 19 nt, Homo sapiens
gauaguagacuuuauagag

SEQ ID NO: 385099 - RNA, 19 nt, Homo sapiens
gaacgugccucugcgaagu

SEQ ID NO: 385100 - RNA, 19 nt, Homo sapiens
gcaauggucgugccaaaga

SEQ ID NO: 385101 - RNA, 19 nt, Homo sapiens
ugaaacagcugagacacuu

SEQ ID NO: 385102 - RNA, 19 nt, Homo sapiens
gguaaguggucuugaagga

SEQ ID NO: 385103 - RNA, 19 nt, Homo sapiens
caccacaacuggccugaaa

SEQ ID NO: 385104 - RNA, 19 nt, Homo sapiens
ucacauaaccacacuguug

SEQ ID NO: 385105 - RNA, 19 nt, Homo sapiens
aaauggagauagggucuua

SEQ ID NO: 385106 - RNA, 19 nt, Homo sapiens
gaauuaaaccgcuguuagu

SEQ ID NO: 385107 - RNA, 19 nt, Homo sapiens
gggcugacuugcacagaaa

SEQ ID NO: 385108 - RNA, 19 nt, Homo sapiens
ccaaugacaaggcuacuaa

SEQ ID NO: 385109 - RNA, 19 nt, Homo sapiens
caggugacauggaaucuug

SEQ ID NO: 385110 - RNA, 19 nt, Homo sapiens
gagagaccauugccagugu

SEQ ID NO: 385111 - RNA, 19 nt, Homo sapiens
gaacaggagcucucagaag

SEQ ID NO: 385112 - RNA, 19 nt, Homo sapiens
gcgcagcuuucaguauuaa

SEQ ID NO: 385113 - RNA, 19 nt, Homo sapiens
ugaacugucuugcagaaug

SEQ ID NO: 385114 - RNA, 19 nt, Homo sapiens
ggagcggaguuguuaagga

SEQ ID NO: 385115 - RNA, 19 nt, Homo sapiens
uuuagucacccucaaauua

SEQ ID NO: 385116 - RNA, 19 nt, Homo sapiens
uaaccacacuguugacuac

SEQ ID NO: 385117 - RNA, 19 nt, Homo sapiens
ccuccaagauaacaaagaa

SEQ ID NO: 385118 - RNA, 19 nt, Homo sapiens
cugagacacuucuaaauuc

SEQ ID NO: 385119 - RNA, 19 nt, Homo sapiens
ccacaacuggccugaaauu

SEQ ID NO: 385120 - RNA, 19 nt, Homo sapiens
ggagauagggucuuaacuc

SEQ ID NO: 385121 - RNA, 19 nt, Homo sapiens
cagaagauaguagacuuua

SEQ ID NO: 385122 - RNA, 19 nt, Homo sapiens
auaaggagcggaguuguua

SEQ ID NO: 385123 - RNA, 19 nt, Homo sapiens
gcagauucuugaugauauc

SEQ ID NO: 385124 - RNA, 19 nt, Homo sapiens
ugagacacuucuaaauuca

SEQ ID NO: 385125 - RNA, 19 nt, Homo sapiens
gccugcaccuccaagauaa

SEQ ID NO: 385126 - RNA, 19 nt, Homo sapiens
ucacagcucaucuuuccua

SEQ ID NO: 385127 - RNA, 19 nt, Homo sapiens
uuaccuagauacuaaagga

SEQ ID NO: 385128 - RNA, 19 nt, Homo sapiens
ggccugcaccuccaagaua

SEQ ID NO: 385129 - RNA, 19 nt, Homo sapiens
ggccugaaauucuuaaagg

SEQ ID NO: 385130 - RNA, 19 nt, Homo sapiens
uugaugauauccagacaaa

SEQ ID NO: 385131 - RNA, 19 nt, Homo sapiens
caccaaagcccauauaagg

SEQ ID NO: 385132 - RNA, 19 nt, Homo sapiens
acaaggcuacuaagaaauu

SEQ ID NO: 385133 - RNA, 19 nt, Homo sapiens
cagcagauucuugaugaua

SEQ ID NO: 385134 - RNA, 19 nt, Homo sapiens
gagggacgguuugaagaug

SEQ ID NO: 385135 - RNA, 19 nt, Homo sapiens
uuagucacccucaaauuaa

SEQ ID NO: 385136 - RNA, 19 nt, Homo sapiens
gcaccuccaagauaacaaa

SEQ ID NO: 385137 - RNA, 19 nt, Homo sapiens
gcaccacaacucucagcua

SEQ ID NO: 385138 - RNA, 19 nt, Homo sapiens
gccucagccucccaaauaa

SEQ ID NO: 385139 - RNA, 19 nt, Homo sapiens
agucauggcucacugaagu

SEQ ID NO: 385140 - RNA, 19 nt, Homo sapiens
uuagguugcuguuucaaau

SEQ ID NO: 385141 - RNA, 19 nt, Homo sapiens
aacaggagcucucagaagu

SEQ ID NO: 385142 - RNA, 19 nt, Homo sapiens
ugccucagccucccaaaua

SEQ ID NO: 385143 - RNA, 19 nt, Homo sapiens
gaagacaguugagaauucc

SEQ ID NO: 385144 - RNA, 19 nt, Homo sapiens
cuacacagcccguuucagu

SEQ ID NO: 385145 - RNA, 19 nt, Homo sapiens
ugcagcagauucuugauga

SEQ ID NO: 385146 - RNA, 19 nt, Homo sapiens
agacacuucuaaauucaga

SEQ ID NO: 385147 - RNA, 19 nt, Homo sapiens
aagcaauggucgugccaaa

SEQ ID NO: 385148 - RNA, 19 nt, Homo sapiens
cagcugagacacuucuaaa

SEQ ID NO: 385149 - RNA, 19 nt, Homo sapiens
gaugauauccagacaaagc

SEQ ID NO: 385150 - RNA, 19 nt, Homo sapiens
ggagggacgguuugaagau

SEQ ID NO: 385151 - RNA, 19 nt, Homo sapiens
ccaugugaguugugccauu

SEQ ID NO: 385152 - RNA, 19 nt, Homo sapiens
ccagaagauaguagacuuu

SEQ ID NO: 385153 - RNA, 19 nt, Homo sapiens
gaauguggauuugggguaa

SEQ ID NO: 385154 - RNA, 19 nt, Homo sapiens
ccucacagcucaucuuucc

SEQ ID NO: 385155 - RNA, 19 nt, Homo sapiens
gagaugaggggucacauaa

SEQ ID NO: 385156 - RNA, 19 nt, Homo sapiens
cgaaagcagcagaaugaga

SEQ ID NO: 385157 - RNA, 19 nt, Homo sapiens
aaacuagaccagaagauag

SEQ ID NO: 385158 - RNA, 19 nt, Homo sapiens
agguugcuguuucaaauaa

SEQ ID NO: 385159 - RNA, 19 nt, Homo sapiens
ugagaauuccuuuggagaa

SEQ ID NO: 385160 - RNA, 19 nt, Homo sapiens
gcagcagauucuugaugau

SEQ ID NO: 385161 - RNA, 19 nt, Homo sapiens
uacuuugccuuucuucuug

SEQ ID NO: 385162 - RNA, 19 nt, Homo sapiens
gcuguuaguuugaaaugcu

SEQ ID NO: 385163 - RNA, 19 nt, Homo sapiens
caugugaguugugccauuc

SEQ ID NO: 385164 - RNA, 19 nt, Homo sapiens
cucccaaacuggugagauu

SEQ ID NO: 385165 - RNA, 19 nt, Homo sapiens
ccuagauacuaaaggaaga

SEQ ID NO: 385166 - RNA, 19 nt, Homo sapiens
cccaugaccuccaccaaag

SEQ ID NO: 385167 - RNA, 19 nt, Homo sapiens
caaggcuacuaagaaauuc

SEQ ID NO: 385168 - RNA, 19 nt, Homo sapiens
gccugaaauucuuaaagga

SEQ ID NO: 385169 - RNA, 19 nt, Homo sapiens
ggacgaacaggagcucuca

SEQ ID NO: 385170 - RNA, 19 nt, Homo sapiens
uauagagaaagaccaguuu

SEQ ID NO: 385171 - RNA, 19 nt, Homo sapiens
cacauaaccacacuguuga

SEQ ID NO: 385172 - RNA, 19 nt, Homo sapiens
ggguuagguugcuguuuca

SEQ ID NO: 385173 - RNA, 19 nt, Homo sapiens
aguuugaguuggccuguuu

SEQ ID NO: 385174 - RNA, 19 nt, Homo sapiens
gcagcagucagcgauguuu

SEQ ID NO: 385175 - RNA, 19 nt, Homo sapiens
caagauaacaaagaagaag

SEQ ID NO: 385176 - RNA, 19 nt, Homo sapiens
cuacuuugccuuucuucuu

SEQ ID NO: 385177 - RNA, 19 nt, Homo sapiens
uuauagaggugggguuuua

SEQ ID NO: 385178 - RNA, 19 nt, Homo sapiens
cuggaggagugcagucgua

SEQ ID NO: 385179 - RNA, 19 nt, Homo sapiens
gauauaagcuccgagagaa

SEQ ID NO: 385180 - RNA, 19 nt, Homo sapiens
guaaagauguuuugacgaa

SEQ ID NO: 385181 - RNA, 19 nt, Homo sapiens
ggaguucucgguuguugua

SEQ ID NO: 385182 - RNA, 19 nt, Homo sapiens
ggaguucaaagcccaauuu

SEQ ID NO: 385183 - RNA, 19 nt, Homo sapiens
ucaagaccaucaaggugua

SEQ ID NO: 385184 - RNA, 19 nt, Homo sapiens
ccagauguuuguguucuuu

SEQ ID NO: 385185 - RNA, 19 nt, Homo sapiens
uguaggagguuggguguuu

SEQ ID NO: 385186 - RNA, 19 nt, Homo sapiens
gcucuuuacuccauucaca

SEQ ID NO: 385187 - RNA, 19 nt, Homo sapiens
cagagcugcuggcccgaua

SEQ ID NO: 385188 - RNA, 19 nt, Homo sapiens
gagcugcuggcccgauaua

SEQ ID NO: 385189 - RNA, 19 nt, Homo sapiens
gagguuggguguuuucaaa

SEQ ID NO: 385190 - RNA, 19 nt, Homo sapiens
ccaaggaggaggugacaga

SEQ ID NO: 385191 - RNA, 19 nt, Homo sapiens
ccauucaccuguggauuug

SEQ ID NO: 385192 - RNA, 19 nt, Homo sapiens
ccuaccggcuggugcagua

SEQ ID NO: 385193 - RNA, 19 nt, Homo sapiens
gcgcgcuacuuugggauaa

SEQ ID NO: 385194 - RNA, 19 nt, Homo sapiens
gaccagauguuuguguucu

SEQ ID NO: 385195 - RNA, 19 nt, Homo sapiens
gaugcagccucagaaggaa

SEQ ID NO: 385196 - RNA, 19 nt, Homo sapiens
cgauauaagcuccgagaga

SEQ ID NO: 385197 - RNA, 19 nt, Homo sapiens
agaaccagcugcccaggau

SEQ ID NO: 385198 - RNA, 19 nt, Homo sapiens
guucucgguuguuguagga

SEQ ID NO: 385199 - RNA, 19 nt, Homo sapiens
cccauucaccuguggauuu

SEQ ID NO: 385200 - RNA, 19 nt, Homo sapiens
gugggcagguggugaagau

SEQ ID NO: 385201 - RNA, 19 nt, Homo sapiens
gcaucaagaccaucaaggu

SEQ ID NO: 385202 - RNA, 19 nt, Homo sapiens
agacguaccggcucuggaa

SEQ ID NO: 385203 - RNA, 19 nt, Homo sapiens
ccaccgaccagauguuugu

SEQ ID NO: 385204 - RNA, 19 nt, Homo sapiens
guacauccuggagcaguuu

SEQ ID NO: 385205 - RNA, 19 nt, Homo sapiens
ccaugcacgcgcucaagua

SEQ ID NO: 385206 - RNA, 19 nt, Homo sapiens
ccgaccagauguuuguguu

SEQ ID NO: 385207 - RNA, 19 nt, Homo sapiens
ccucggcucuuuacuccau

SEQ ID NO: 385208 - RNA, 19 nt, Homo sapiens
gcgagaugcagccucagaa

SEQ ID NO: 385209 - RNA, 19 nt, Homo sapiens
ucacggagcacgagcuagu

SEQ ID NO: 385210 - RNA, 19 nt, Homo sapiens
gggcagguggugaagauca

SEQ ID NO: 385211 - RNA, 19 nt, Homo sapiens
agaugcagccucagaagga

SEQ ID NO: 385212 - RNA, 19 nt, Homo sapiens
caucacggagcacgagcua

SEQ ID NO: 385213 - RNA, 19 nt, Homo sapiens
gcaggaggagaacaucaca

SEQ ID NO: 385214 - RNA, 19 nt, Homo sapiens
gugagacggcuggcaggua

SEQ ID NO: 385215 - RNA, 19 nt, Homo sapiens
gcaugcaggaggagaacau

SEQ ID NO: 385216 - RNA, 19 nt, Homo sapiens
caccauacaugaccaagua

SEQ ID NO: 385217 - RNA, 19 nt, Homo sapiens
ggagaaugccgaagaggaa

SEQ ID NO: 385218 - RNA, 19 nt, Homo sapiens
gaacucaaggcccgaaaga

SEQ ID NO: 385219 - RNA, 19 nt, Homo sapiens
gcgagggugucaugucaga

SEQ ID NO: 385220 - RNA, 19 nt, Homo sapiens
cuagaugacuuggagaaug

SEQ ID NO: 385221 - RNA, 19 nt, Homo sapiens
gcgacgacuuugaugaugu

SEQ ID NO: 385222 - RNA, 19 nt, Homo sapiens
gaugggagcuaugaagacu

SEQ ID NO: 385223 - RNA, 19 nt, Homo sapiens
cgacgacuuugaugaugug

SEQ ID NO: 385224 - RNA, 19 nt, Homo sapiens
cagacaacgaggacaauuu

SEQ ID NO: 385225 - RNA, 19 nt, Homo sapiens
ccaggagaaugucgagauc

SEQ ID NO: 385226 - RNA, 19 nt, Homo sapiens
cgaaagauccccaucauca

SEQ ID NO: 385227 - RNA, 19 nt, Homo sapiens
gaccgcaggccaaccagaa

SEQ ID NO: 385228 - RNA, 19 nt, Homo sapiens
uagaugacuuggagaaugc

SEQ ID NO: 385229 - RNA, 19 nt, Homo sapiens
gaggaaggccaggagaaug

SEQ ID NO: 385230 - RNA, 19 nt, Homo sapiens
cauucucacuuuauaugug

SEQ ID NO: 385231 - RNA, 19 nt, Homo sapiens
gaggaugaagggcuagaug

SEQ ID NO: 385232 - RNA, 19 nt, Homo sapiens
cgaaucaccacaccauaca

SEQ ID NO: 385233 - RNA, 19 nt, Homo sapiens
gcgaaucaccacaccauac

SEQ ID NO: 385234 - RNA, 19 nt, Homo sapiens
cagaugggagcuaugaaga

SEQ ID NO: 385235 - RNA, 19 nt, Homo sapiens
gcucaucaucaccgacuga

SEQ ID NO: 385236 - RNA, 19 nt, Homo sapiens
caucaucauucgccguuac

SEQ ID NO: 385237 - RNA, 19 nt, Homo sapiens
augaagggcuagaugacuu

SEQ ID NO: 385238 - RNA, 19 nt, Homo sapiens
aggcgagggugucauguca

SEQ ID NO: 385239 - RNA, 19 nt, Homo sapiens
ggcgacgacuuugaugaug

SEQ ID NO: 385240 - RNA, 19 nt, Homo sapiens
cacccgagcgcuccagauu

SEQ ID NO: 385241 - RNA, 19 nt, Homo sapiens
gagcuggagucaucuuccu

SEQ ID NO: 385242 - RNA, 19 nt, Homo sapiens
ccagaugggagcuaugaag

SEQ ID NO: 385243 - RNA, 19 nt, Homo sapiens
acucaaggcccgaaagauc

SEQ ID NO: 385244 - RNA, 19 nt, Homo sapiens
gucguagugucgcuguuug

SEQ ID NO: 385245 - RNA, 19 nt, Homo sapiens
gccaggagaaugucgagau

SEQ ID NO: 385246 - RNA, 19 nt, Homo sapiens
agacaacgaggacaauuuu

SEQ ID NO: 385247 - RNA, 19 nt, Homo sapiens
ccaucaucauucgccguua

SEQ ID NO: 385248 - RNA, 19 nt, Homo sapiens
gggaagauguucuaccaua

SEQ ID NO: 385249 - RNA, 19 nt, Homo sapiens
gagauccgcuuaaagauug

SEQ ID NO: 385250 - RNA, 19 nt, Homo sapiens
gaugagauccgcuuaaaga

SEQ ID NO: 385251 - RNA, 19 nt, Homo sapiens
gaaguauggcuuuguaauu

SEQ ID NO: 385252 - RNA, 19 nt, Homo sapiens
ggaagauguucuaccauau

SEQ ID NO: 385253 - RNA, 19 nt, Homo sapiens
gacaauggaugaggauauu

SEQ ID NO: 385254 - RNA, 19 nt, Homo sapiens
ggaugaggauauugugauu

SEQ ID NO: 385255 - RNA, 19 nt, Homo sapiens
cuucagagauggaguuuga

SEQ ID NO: 385256 - RNA, 19 nt, Homo sapiens
gaaauugggcccaugucuu

SEQ ID NO: 385257 - RNA, 19 nt, Homo sapiens
guuggacucuucacagaaa

SEQ ID NO: 385258 - RNA, 19 nt, Homo sapiens
gagauggaguuugauccua

SEQ ID NO: 385259 - RNA, 19 nt, Homo sapiens
ggacccguguggacaagaa

SEQ ID NO: 385260 - RNA, 19 nt, Homo sapiens
gacauuccaucccuucaga

SEQ ID NO: 385261 - RNA, 19 nt, Homo sapiens
gcccaugucuugcuucauc

SEQ ID NO: 385262 - RNA, 19 nt, Homo sapiens
gcucccugauggacgauua

SEQ ID NO: 385263 - RNA, 19 nt, Homo sapiens
aaguauggcuuuguaauug

SEQ ID NO: 385264 - RNA, 19 nt, Homo sapiens
ggccgaggcuuuguccuuu

SEQ ID NO: 385265 - RNA, 19 nt, Homo sapiens
agauggaguuugauccuaa

SEQ ID NO: 385266 - RNA, 19 nt, Homo sapiens
ggaaguauggcuuuguaau

SEQ ID NO: 385267 - RNA, 19 nt, Homo sapiens
ucaacacggugaagcagaa

SEQ ID NO: 385268 - RNA, 19 nt, Homo sapiens
gaagauguucuaccauauc

SEQ ID NO: 385269 - RNA, 19 nt, Homo sapiens
caguauguguucuaaguau

SEQ ID NO: 385270 - RNA, 19 nt, Homo sapiens
ucacucaggucaacaaggu

SEQ ID NO: 385271 - RNA, 19 nt, Homo sapiens
gccgaggcuuuguccuuua

SEQ ID NO: 385272 - RNA, 19 nt, Homo sapiens
uaacuacugccuccucauu

SEQ ID NO: 385273 - RNA, 19 nt, Homo sapiens
ggacgaugagauccgcuua

SEQ ID NO: 385274 - RNA, 19 nt, Homo sapiens
gcaaggaaggcaacucauc

SEQ ID NO: 385275 - RNA, 19 nt, Homo sapiens
ugagauccgcuuaaagauu

SEQ ID NO: 385276 - RNA, 19 nt, Homo sapiens
ggucguggaugcuguuguc

SEQ ID NO: 385277 - RNA, 19 nt, Homo sapiens
aaauugggcccaugucuug

SEQ ID NO: 385278 - RNA, 19 nt, Homo sapiens
acgaugagauccgcuuaaa

SEQ ID NO: 385279 - RNA, 19 nt, Homo sapiens
agggaaguauggcuuugua

SEQ ID NO: 385280 - RNA, 19 nt, Homo sapiens
ggucugggaagauguucua

SEQ ID NO: 385281 - RNA, 19 nt, Homo sapiens
guuacaagacaauggauga

SEQ ID NO: 385282 - RNA, 19 nt, Homo sapiens
ccugauggacgauuacuug

SEQ ID NO: 385283 - RNA, 19 nt, Homo sapiens
ggacucuucacagaaauug

SEQ ID NO: 385284 - RNA, 19 nt, Homo sapiens
ugucacacuuaucauguug

SEQ ID NO: 385285 - RNA, 19 nt, Homo sapiens
gauugucacacuuaucaug

SEQ ID NO: 385286 - RNA, 19 nt, Homo sapiens
ugauucagcaggacgauga

SEQ ID NO: 385287 - RNA, 19 nt, Homo sapiens
augaggauauugugauuca

SEQ ID NO: 385288 - RNA, 19 nt, Homo sapiens
acuccaacccaccauguua

SEQ ID NO: 385289 - RNA, 19 nt, Homo sapiens
ccgaggcuuuguccuuuau

SEQ ID NO: 385290 - RNA, 19 nt, Homo sapiens
gacgaugagauccgcuuaa

SEQ ID NO: 385291 - RNA, 19 nt, Homo sapiens
uggaugcuguugucacuca

SEQ ID NO: 385292 - RNA, 19 nt, Homo sapiens
gggaaguauggcuuuguaa

SEQ ID NO: 385293 - RNA, 19 nt, Homo sapiens
agacaauggaugaggauau

SEQ ID NO: 385294 - RNA, 19 nt, Homo sapiens
gggcccaugucuugcuuca

SEQ ID NO: 385295 - RNA, 19 nt, Homo sapiens
ucaguauguguucuaagua

SEQ ID NO: 385296 - RNA, 19 nt, Homo sapiens
ucacacuuaucauguuguc

SEQ ID NO: 385297 - RNA, 19 nt, Homo sapiens
caacccaccauguuacaag

SEQ ID NO: 385298 - RNA, 19 nt, Homo sapiens
uucaguauguguucuaagu

SEQ ID NO: 385299 - RNA, 19 nt, Homo sapiens
cagucuggcugcuguugug

SEQ ID NO: 385300 - RNA, 19 nt, Homo sapiens
uaacuccaacccaccaugu

SEQ ID NO: 385301 - RNA, 19 nt, Homo sapiens
uaauugcugucaccaccau

SEQ ID NO: 385302 - RNA, 19 nt, Homo sapiens
cugggaagauguucuacca

SEQ ID NO: 385303 - RNA, 19 nt, Homo sapiens
uaccuggucugggaagaug

SEQ ID NO: 385304 - RNA, 19 nt, Homo sapiens
gauggaguuugauccuaac

SEQ ID NO: 385305 - RNA, 19 nt, Homo sapiens
ugcuucaucucucgacauu

SEQ ID NO: 385306 - RNA, 19 nt, Homo sapiens
ggaggucguggaugcuguu

SEQ ID NO: 385307 - RNA, 19 nt, Homo sapiens
cuaggaagugugauuguca

SEQ ID NO: 385308 - RNA, 19 nt, Homo sapiens
uauuggugcuggugugauc

SEQ ID NO: 385309 - RNA, 19 nt, Homo sapiens
acagggaaguauggcuuug

SEQ ID NO: 385310 - RNA, 19 nt, Homo sapiens
caagacaauggaugaggau

SEQ ID NO: 385311 - RNA, 19 nt, Homo sapiens
ccaccauguuacaagacaa

SEQ ID NO: 385312 - RNA, 19 nt, Homo sapiens
uccuuuauccaguuaagua

SEQ ID NO: 385313 - RNA, 19 nt, Homo sapiens
cauguuacaagacaaugga

SEQ ID NO: 385314 - RNA, 19 nt, Homo sapiens
cuucaucucucgacauucc

SEQ ID NO: 385315 - RNA, 19 nt, Homo sapiens
gaaacugacucgccuguga

SEQ ID NO: 385316 - RNA, 19 nt, Homo sapiens
gaguuuaucuccugaugaa

SEQ ID NO: 385317 - RNA, 19 nt, Homo sapiens
ccaacaaccugcauggauu

SEQ ID NO: 385318 - RNA, 19 nt, Homo sapiens
gcuaguaccuuguaugaag

SEQ ID NO: 385319 - RNA, 19 nt, Homo sapiens
gagaugaaacuucuacuga

SEQ ID NO: 385320 - RNA, 19 nt, Homo sapiens
uaacuggccuccacucaau

SEQ ID NO: 385321 - RNA, 19 nt, Homo sapiens
gggcugaccaguuugagua

SEQ ID NO: 385322 - RNA, 19 nt, Homo sapiens
ccaagucacucaggucaug

SEQ ID NO: 385323 - RNA, 19 nt, Homo sapiens
agaugaaacuucuacugaa

SEQ ID NO: 385324 - RNA, 19 nt, Homo sapiens
ggaaaaguguacaggauug

SEQ ID NO: 385325 - RNA, 19 nt, Homo sapiens
uuccagggcugaccaguuu

SEQ ID NO: 385326 - RNA, 19 nt, Homo sapiens
gaaaaugaaucagaagcuu

SEQ ID NO: 385327 - RNA, 19 nt, Homo sapiens
ugagggagaugaaacuucu

SEQ ID NO: 385328 - RNA, 19 nt, Homo sapiens
gaaucagaagcuuuaugua

SEQ ID NO: 385329 - RNA, 19 nt, Homo sapiens
ugaaucagaagcuuuaugu

SEQ ID NO: 385330 - RNA, 19 nt, Homo sapiens
caccguggcggcaucuuua

SEQ ID NO: 385331 - RNA, 19 nt, Homo sapiens
cagccucucugccaaguca

SEQ ID NO: 385332 - RNA, 19 nt, Homo sapiens
uagcuaguaccuuguauga

SEQ ID NO: 385333 - RNA, 19 nt, Homo sapiens
ugucucgacugcauuguga

SEQ ID NO: 385334 - RNA, 19 nt, Homo sapiens
ggagaugaaacuucuacug

SEQ ID NO: 385335 - RNA, 19 nt, Homo sapiens
aauuuacccuguagacuug

SEQ ID NO: 385336 - RNA, 19 nt, Homo sapiens
gaugguacccuggaugaug

SEQ ID NO: 385337 - RNA, 19 nt, Homo sapiens
cagaguuuaucuccugaug

SEQ ID NO: 385338 - RNA, 19 nt, Homo sapiens
aaauuuacccuguagacuu

SEQ ID NO: 385339 - RNA, 19 nt, Homo sapiens
gaaguuugaccgagugucu

SEQ ID NO: 385340 - RNA, 19 nt, Homo sapiens
caacaaccugcauggauuc

SEQ ID NO: 385341 - RNA, 19 nt, Homo sapiens
ggaugauggugaauacaac

SEQ ID NO: 385342 - RNA, 19 nt, Homo sapiens
guacaggauugagggagau

SEQ ID NO: 385343 - RNA, 19 nt, Homo sapiens
cuaguaccuuguaugaaga

SEQ ID NO: 385344 - RNA, 19 nt, Homo sapiens
ugggagagcugaaaaugaa

SEQ ID NO: 385345 - RNA, 19 nt, Homo sapiens
ggucaugggcauuguucaa

SEQ ID NO: 385346 - RNA, 19 nt, Homo sapiens
gaguauguaauguauggaa

SEQ ID NO: 385347 - RNA, 19 nt, Homo sapiens
gaggauauuuucgauguga

SEQ ID NO: 385348 - RNA, 19 nt, Homo sapiens
ugaccaguuugaguaugua

SEQ ID NO: 385349 - RNA, 19 nt, Homo sapiens
caaguuccgguuggucaua

SEQ ID NO: 385350 - RNA, 19 nt, Homo sapiens
cauucaaauuuacccugua

SEQ ID NO: 385351 - RNA, 19 nt, Homo sapiens
guuuaucuccugaugaaga

SEQ ID NO: 385352 - RNA, 19 nt, Homo sapiens
gaauacaaccccacugaug

SEQ ID NO: 385353 - RNA, 19 nt, Homo sapiens
gccaacaaccugcauggau

SEQ ID NO: 385354 - RNA, 19 nt, Homo sapiens
ccaguuugaguauguaaug

SEQ ID NO: 385355 - RNA, 19 nt, Homo sapiens
ccacucaaugggaaacuga

SEQ ID NO: 385356 - RNA, 19 nt, Homo sapiens
cugcguacguguccuaugg

SEQ ID NO: 385357 - RNA, 19 nt, Homo sapiens
ucauagcuaguaccuugua

SEQ ID NO: 385358 - RNA, 19 nt, Homo sapiens
aaacugacucgccugugaa

SEQ ID NO: 385359 - RNA, 19 nt, Homo sapiens
uugaguauguaauguaugg

SEQ ID NO: 385360 - RNA, 19 nt, Homo sapiens
ugaagaugguacccuggau

SEQ ID NO: 385361 - RNA, 19 nt, Homo sapiens
uuuaucuccugaugaagaa

SEQ ID NO: 385362 - RNA, 19 nt, Homo sapiens
ggaagggcuggcucacugu

SEQ ID NO: 385363 - RNA, 19 nt, Homo sapiens
cugaccaguuugaguaugu

SEQ ID NO: 385364 - RNA, 19 nt, Homo sapiens
ccuggaugauggugaauac

SEQ ID NO: 385365 - RNA, 19 nt, Homo sapiens
cauagcuaguaccuuguau

SEQ ID NO: 385366 - RNA, 19 nt, Homo sapiens
cugacucgccugugaaaga

SEQ ID NO: 385367 - RNA, 19 nt, Homo sapiens
gcugaccaguuugaguaug

SEQ ID NO: 385368 - RNA, 19 nt, Homo sapiens
uacccuggaugauggugaa

SEQ ID NO: 385369 - RNA, 19 nt, Homo sapiens
aagaugguacccuggauga

SEQ ID NO: 385370 - RNA, 19 nt, Homo sapiens
gaccaguuugaguauguaa

SEQ ID NO: 385371 - RNA, 19 nt, Homo sapiens
ccagggcugaccaguuuga

SEQ ID NO: 385372 - RNA, 19 nt, Homo sapiens
gagugucucgacugcauug

SEQ ID NO: 385373 - RNA, 19 nt, Homo sapiens
auugugagagugaaucuuu

SEQ ID NO: 385374 - RNA, 19 nt, Homo sapiens
uggaugauggugaauacaa

SEQ ID NO: 385375 - RNA, 19 nt, Homo sapiens
gacaacagcugcaucuaug

SEQ ID NO: 385376 - RNA, 19 nt, Homo sapiens
caaggaggcuguguucuuc

SEQ ID NO: 385377 - RNA, 19 nt, Homo sapiens
gaacugacccagauuaucg

SEQ ID NO: 385378 - RNA, 19 nt, Homo sapiens
cgacaacagcugcaucuau

SEQ ID NO: 385379 - RNA, 19 nt, Homo sapiens
gacgaacugacccagauua

SEQ ID NO: 385380 - RNA, 19 nt, Homo sapiens
caagaucacgcacgaagug

SEQ ID NO: 385381 - RNA, 19 nt, Homo sapiens
gcacgaaguggacgaacug

SEQ ID NO: 385382 - RNA, 19 nt, Homo sapiens
ccaaggaagacaaggagaa

SEQ ID NO: 385383 - RNA, 19 nt, Homo sapiens
ggacgaacugacccagauu

SEQ ID NO: 385384 - RNA, 19 nt, Homo sapiens
acaaggaggcuguguucuu

SEQ ID NO: 385385 - RNA, 19 nt, Homo sapiens
gaggaccacccgugccaaa

SEQ ID NO: 385386 - RNA, 19 nt, Homo sapiens
guaauaaacaccagauucc

SEQ ID NO: 385387 - RNA, 19 nt, Homo sapiens
gaaccgcauucugcucuac

SEQ ID NO: 385388 - RNA, 19 nt, Homo sapiens
gaggacgccaugcgccuuu

SEQ ID NO: 385389 - RNA, 19 nt, Homo sapiens
uguaauaaacaccagauuc

SEQ ID NO: 385390 - RNA, 19 nt, Homo sapiens
uggacgaacugacccagau

SEQ ID NO: 385391 - RNA, 19 nt, Homo sapiens
caacagcugcaucuauguc

SEQ ID NO: 385392 - RNA, 19 nt, Homo sapiens
cugcaucuaugucaacaag

SEQ ID NO: 385393 - RNA, 19 nt, Homo sapiens
ugccaggaauguaacaaca

SEQ ID NO: 385394 - RNA, 19 nt, Homo sapiens
agacaaggagaaccgcauu

SEQ ID NO: 385395 - RNA, 19 nt, Homo sapiens
gcuucugccaggaauguaa

SEQ ID NO: 385396 - RNA, 19 nt, Homo sapiens
caacaagaucacgcacgaa

SEQ ID NO: 385397 - RNA, 19 nt, Homo sapiens
agaagaagaucaccauuaa

SEQ ID NO: 385398 - RNA, 19 nt, Homo sapiens
gagaagaagaucaccauua

SEQ ID NO: 385399 - RNA, 19 nt, Homo sapiens
uaacaaggacaccaaggua

SEQ ID NO: 385400 - RNA, 19 nt, Homo sapiens
caacaaagaagaccacaca

SEQ ID NO: 385401 - RNA, 19 nt, Homo sapiens
gaagaucaccauuaacaag

SEQ ID NO: 385402 - RNA, 19 nt, Homo sapiens
gguacccaaugccuguuua

SEQ ID NO: 385403 - RNA, 19 nt, Homo sapiens
ugggaaacaucauuaaauc

SEQ ID NO: 385404 - RNA, 19 nt, Homo sapiens
cccaaugccuguuuauuca

SEQ ID NO: 385405 - RNA, 19 nt, Homo sapiens
acacugggaaacaucauua

SEQ ID NO: 385406 - RNA, 19 nt, Homo sapiens
gacguguccuguacauaga

SEQ ID NO: 385407 - RNA, 19 nt, Homo sapiens
cgacguguccuguacauag

SEQ ID NO: 385408 - RNA, 19 nt, Homo sapiens
cauuaaaucacaacuccua

SEQ ID NO: 385409 - RNA, 19 nt, Homo sapiens
gcaggaaggaauugaguag

SEQ ID NO: 385410 - RNA, 19 nt, Homo sapiens
aagaagaucaccauuaaca

SEQ ID NO: 385411 - RNA, 19 nt, Homo sapiens
ggaaacaucauuaaaucac

SEQ ID NO: 385412 - RNA, 19 nt, Homo sapiens
aaucacaacuccuaaaaga

SEQ ID NO: 385413 - RNA, 19 nt, Homo sapiens
gcuuucggguggccauaaa

SEQ ID NO: 385414 - RNA, 19 nt, Homo sapiens
gggaaacaucauuaaauca

SEQ ID NO: 385415 - RNA, 19 nt, Homo sapiens
agacaagcaggaaggaauu

SEQ ID NO: 385416 - RNA, 19 nt, Homo sapiens
uaaaguauagcgggagaga

SEQ ID NO: 385417 - RNA, 19 nt, Homo sapiens
gaagaagaucaccauuaac

SEQ ID NO: 385418 - RNA, 19 nt, Homo sapiens
acaccaagguacccaaugc

SEQ ID NO: 385419 - RNA, 19 nt, Homo sapiens
ggacaccaagguacccaau

SEQ ID NO: 385420 - RNA, 19 nt, Homo sapiens
gcgagaagaagaucaccau

SEQ ID NO: 385421 - RNA, 19 nt, Homo sapiens
uauucaccaucaacaaaga

SEQ ID NO: 385422 - RNA, 19 nt, Homo sapiens
cugggaaacaucauuaaau

SEQ ID NO: 385423 - RNA, 19 nt, Homo sapiens
cgagaagaagaucaccauu

SEQ ID NO: 385424 - RNA, 19 nt, Homo sapiens
agaucaccauuaacaagga

SEQ ID NO: 385425 - RNA, 19 nt, Homo sapiens
gacaagcaggaaggaauug

SEQ ID NO: 385426 - RNA, 19 nt, Homo sapiens
agaagaucaccauuaacaa

SEQ ID NO: 385427 - RNA, 19 nt, Homo sapiens
caucaccgaccucaucagu

SEQ ID NO: 385428 - RNA, 19 nt, Homo sapiens
gaccacacacugggaaaca

SEQ ID NO: 385429 - RNA, 19 nt, Homo sapiens
acccaaugccuguuuauuc

SEQ ID NO: 385430 - RNA, 19 nt, Homo sapiens
gaauguggauacagaauaa

SEQ ID NO: 385431 - RNA, 19 nt, Homo sapiens
agaggaaugucuucacuua

SEQ ID NO: 385432 - RNA, 19 nt, Homo sapiens
gaaaaggacuaaaagauug

SEQ ID NO: 385433 - RNA, 19 nt, Homo sapiens
ccugaaaccucaaacagua

SEQ ID NO: 385434 - RNA, 19 nt, Homo sapiens
aggaaugucuucacuuaua

SEQ ID NO: 385435 - RNA, 19 nt, Homo sapiens
ccaaucagaugcagagaau

SEQ ID NO: 385436 - RNA, 19 nt, Homo sapiens
cagagaauguggauacaga

SEQ ID NO: 385437 - RNA, 19 nt, Homo sapiens
gauuugcucucuucccauu

SEQ ID NO: 385438 - RNA, 19 nt, Homo sapiens
gcauagcaagagauuaaua

SEQ ID NO: 385439 - RNA, 19 nt, Homo sapiens
aagcauagcaagagauuaa

SEQ ID NO: 385440 - RNA, 19 nt, Homo sapiens
aaacaguaccaaaccuuua

SEQ ID NO: 385441 - RNA, 19 nt, Homo sapiens
ggaaugucuucacuuauac

SEQ ID NO: 385442 - RNA, 19 nt, Homo sapiens
ggacuagccggguuguauu

SEQ ID NO: 385443 - RNA, 19 nt, Homo sapiens
cagcaaccaaugauauaua

SEQ ID NO: 385444 - RNA, 19 nt, Homo sapiens
ccaaagcagcaaccaauga

SEQ ID NO: 385445 - RNA, 19 nt, Homo sapiens
uaccaaaccuuuauacacu

SEQ ID NO: 385446 - RNA, 19 nt, Homo sapiens
caaacaguaccaaaccuuu

SEQ ID NO: 385447 - RNA, 19 nt, Homo sapiens
gaacuccugaaaccucaaa

SEQ ID NO: 385448 - RNA, 19 nt, Homo sapiens
ucacuuauacuuggauuug

SEQ ID NO: 385449 - RNA, 19 nt, Homo sapiens
ccagugaacuccugaaacc

SEQ ID NO: 385450 - RNA, 19 nt, Homo sapiens
ccaaaccuuuauacacugu

SEQ ID NO: 385451 - RNA, 19 nt, Homo sapiens
agaauguggauacagaaua

SEQ ID NO: 385452 - RNA, 19 nt, Homo sapiens
uaacaauggacacccagaa

SEQ ID NO: 385453 - RNA, 19 nt, Homo sapiens
caaagcagcaaccaaugau

SEQ ID NO: 385454 - RNA, 19 nt, Homo sapiens
gcagcaaccaaugauauau

SEQ ID NO: 385455 - RNA, 19 nt, Homo sapiens
caauggacacccagaagga

SEQ ID NO: 385456 - RNA, 19 nt, Homo sapiens
guaccaaaccuuuauacac

SEQ ID NO: 385457 - RNA, 19 nt, Homo sapiens
gagaauguggauacagaau

SEQ ID NO: 385458 - RNA, 19 nt, Homo sapiens
ucagaggaaugucuucacu

SEQ ID NO: 385459 - RNA, 19 nt, Homo sapiens
gacuagccggguuguauuu

SEQ ID NO: 385460 - RNA, 19 nt, Homo sapiens
gaggaaugucuucacuuau

SEQ ID NO: 385461 - RNA, 19 nt, Homo sapiens
gcucucuucccauuucuga

SEQ ID NO: 385462 - RNA, 19 nt, Homo sapiens
aaucagaugcagagaaugu

SEQ ID NO: 385463 - RNA, 19 nt, Homo sapiens
aagcagcaaccaaugauau

SEQ ID NO: 385464 - RNA, 19 nt, Homo sapiens
cuagggauccaaucagaug

SEQ ID NO: 385465 - RNA, 19 nt, Homo sapiens
ucaaacaguaccaaaccuu

SEQ ID NO: 385466 - RNA, 19 nt, Homo sapiens
auauauaucuguggagagu

SEQ ID NO: 385467 - RNA, 19 nt, Homo sapiens
aaagcagcaaccaaugaua

SEQ ID NO: 385468 - RNA, 19 nt, Homo sapiens
uuaagcauagcaagagauu

SEQ ID NO: 385469 - RNA, 19 nt, Homo sapiens
ucucuucccauuucugauu

SEQ ID NO: 385470 - RNA, 19 nt, Homo sapiens
guuguauagcuuucgauuu

SEQ ID NO: 385471 - RNA, 19 nt, Homo sapiens
auauaucuguggagagugu

SEQ ID NO: 385472 - RNA, 19 nt, Homo sapiens
ucccauuucugauuguugu

SEQ ID NO: 385473 - RNA, 19 nt, Homo sapiens
acuaaaagauuggucguuu

SEQ ID NO: 385474 - RNA, 19 nt, Homo sapiens
aauuaagcauagcaagaga

SEQ ID NO: 385475 - RNA, 19 nt, Homo sapiens
caagaaaaggacuaaaaga

SEQ ID NO: 385476 - RNA, 19 nt, Homo sapiens
uagccggguuguauuugga

SEQ ID NO: 385477 - RNA, 19 nt, Homo sapiens
acaguaccaaaccuuuaua

SEQ ID NO: 385478 - RNA, 19 nt, Homo sapiens
ucugauuguuguauagcuu

SEQ ID NO: 385479 - RNA, 19 nt, Homo sapiens
auacuuggauuugcucucu

SEQ ID NO: 385480 - RNA, 19 nt, Homo sapiens
aaauuaagcauagcaagag

SEQ ID NO: 385481 - RNA, 19 nt, Homo sapiens
ucgagaagcugcucaauua

SEQ ID NO: 385482 - RNA, 19 nt, Homo sapiens
ggaaggaaccauccaguaa

SEQ ID NO: 385483 - RNA, 19 nt, Homo sapiens
gaaggaaccauccaguaaa

SEQ ID NO: 385484 - RNA, 19 nt, Homo sapiens
gcaacaagugggaggcuua

SEQ ID NO: 385485 - RNA, 19 nt, Homo sapiens
gagaagcugcucaauuaug

SEQ ID NO: 385486 - RNA, 19 nt, Homo sapiens
guacgcugcuucacuugug

SEQ ID NO: 385487 - RNA, 19 nt, Homo sapiens
gcaagaucgucggcaacaa

SEQ ID NO: 385488 - RNA, 19 nt, Homo sapiens
uccgggagcuggcguaaug

SEQ ID NO: 385489 - RNA, 19 nt, Homo sapiens
ccuguacgcugcuucacuu

SEQ ID NO: 385490 - RNA, 19 nt, Homo sapiens
agaagcugcucaauuaugc

SEQ ID NO: 385491 - RNA, 19 nt, Homo sapiens
ggaaccauccaguaaaggu

SEQ ID NO: 385492 - RNA, 19 nt, Homo sapiens
aaggaaccauccaguaaag

SEQ ID NO: 385493 - RNA, 19 nt, Homo sapiens
caagaucgucggcaacaag

SEQ ID NO: 385494 - RNA, 19 nt, Homo sapiens
acguggaccugaucgagaa

SEQ ID NO: 385495 - RNA, 19 nt, Homo sapiens
cgagaagcugcucaauuau

SEQ ID NO: 385496 - RNA, 19 nt, Homo sapiens
gccaugaucaucccuguac

SEQ ID NO: 385497 - RNA, 19 nt, Homo sapiens
gcaacggccugcagcauua

SEQ ID NO: 385498 - RNA, 19 nt, Homo sapiens
ucaaggagcugguauaugu

SEQ ID NO: 385499 - RNA, 19 nt, Homo sapiens
gcaaauaggagguggaauu

SEQ ID NO: 385500 - RNA, 19 nt, Homo sapiens
gggcaaagauacuggagaa

SEQ ID NO: 385501 - RNA, 19 nt, Homo sapiens
caaagauacuggagaagga

SEQ ID NO: 385502 - RNA, 19 nt, Homo sapiens
cggaggaggugauggauga

SEQ ID NO: 385503 - RNA, 19 nt, Homo sapiens
ggacguguaugccaaggau

SEQ ID NO: 385504 - RNA, 19 nt, Homo sapiens
gcugaugucuccgucauga

SEQ ID NO: 385505 - RNA, 19 nt, Homo sapiens
gcugguauauguguuauuc

SEQ ID NO: 385506 - RNA, 19 nt, Homo sapiens
ggagcugguauauguguua

SEQ ID NO: 385507 - RNA, 19 nt, Homo sapiens
gaauucagagcaucaccua

SEQ ID NO: 385508 - RNA, 19 nt, Homo sapiens
gcaagcugcuggcggagau

SEQ ID NO: 385509 - RNA, 19 nt, Homo sapiens
ugaagacccugcagugcuu

SEQ ID NO: 385510 - RNA, 19 nt, Homo sapiens
gaaagcccaacacacguaa

SEQ ID NO: 385511 - RNA, 19 nt, Homo sapiens
ggaaguaccucugcuugcu

SEQ ID NO: 385512 - RNA, 19 nt, Homo sapiens
cacaggugcuggaagguuu

SEQ ID NO: 385513 - RNA, 19 nt, Homo sapiens
ggacuccucccacaugaug

SEQ ID NO: 385514 - RNA, 19 nt, Homo sapiens
ucaccgcccugcacugcua

SEQ ID NO: 385515 - RNA, 19 nt, Homo sapiens
cgaaagcccaacacacgua

SEQ ID NO: 385516 - RNA, 19 nt, Homo sapiens
guacaacgccgugaugcuu

SEQ ID NO: 385517 - RNA, 19 nt, Homo sapiens
cugcagugcuucuuugaga

SEQ ID NO: 385518 - RNA, 19 nt, Homo sapiens
ggacccagcagaugcguau

SEQ ID NO: 385519 - RNA, 19 nt, Homo sapiens
ucaagagucuacaggagau

SEQ ID NO: 385520 - RNA, 19 nt, Homo sapiens
caaauaggagguggaauuc

SEQ ID NO: 385521 - RNA, 19 nt, Homo sapiens
gagcugguauauguguuau

SEQ ID NO: 385522 - RNA, 19 nt, Homo sapiens
caacacacguaagcagaag

SEQ ID NO: 385523 - RNA, 19 nt, Homo sapiens
ugucggaggugguggugaa

SEQ ID NO: 385524 - RNA, 19 nt, Homo sapiens
ggaggccucucacuaucuc

SEQ ID NO: 385525 - RNA, 19 nt, Homo sapiens
gagguggaauucagagcau

SEQ ID NO: 385526 - RNA, 19 nt, Homo sapiens
gaauguggcaguggagaug

SEQ ID NO: 385527 - RNA, 19 nt, Homo sapiens
ccuugucaguguguaaaua

SEQ ID NO: 385528 - RNA, 19 nt, Homo sapiens
ucucugugcacgacuguua

SEQ ID NO: 385529 - RNA, 19 nt, Homo sapiens
cagaaccacuacaggaagu

SEQ ID NO: 385530 - RNA, 19 nt, Homo sapiens
gaggaucgggccacuguuc

SEQ ID NO: 385531 - RNA, 19 nt, Homo sapiens
ggacucacgcagcugaugu

SEQ ID NO: 385532 - RNA, 19 nt, Homo sapiens
ggagcggcgugcguaaugu

SEQ ID NO: 385533 - RNA, 19 nt, Homo sapiens
caaggucaagcaaauagga

SEQ ID NO: 385534 - RNA, 19 nt, Homo sapiens
acuccaaggucaagcaaau

SEQ ID NO: 385535 - RNA, 19 nt, Homo sapiens
ugaaggccgugcacaaggu

SEQ ID NO: 385536 - RNA, 19 nt, Homo sapiens
gugggaggccucucacuau

SEQ ID NO: 385537 - RNA, 19 nt, Homo sapiens
gaucgggccacuguucuga

SEQ ID NO: 385538 - RNA, 19 nt, Homo sapiens
ccaacacacguaagcagaa

SEQ ID NO: 385539 - RNA, 19 nt, Homo sapiens
ggagacaucagccgaaagc

SEQ ID NO: 385540 - RNA, 19 nt, Homo sapiens
aauaggagguggaauucag

SEQ ID NO: 385541 - RNA, 19 nt, Homo sapiens
gccuagagcgcgaggugua

SEQ ID NO: 385542 - RNA, 19 nt, Homo sapiens
guggauguacccaugcuuu

SEQ ID NO: 385543 - RNA, 19 nt, Homo sapiens
cgaaaggugucuggaacag

SEQ ID NO: 385544 - RNA, 19 nt, Homo sapiens
caucgaaaggugucuggaa

SEQ ID NO: 385545 - RNA, 19 nt, Homo sapiens
cagcugaugucuccgucau

SEQ ID NO: 385546 - RNA, 19 nt, Homo sapiens
ggccuggauuggcucaaga

SEQ ID NO: 385547 - RNA, 19 nt, Homo sapiens
gaagcugagccucgaugug

SEQ ID NO: 385548 - RNA, 19 nt, Homo sapiens
gcuggacuccucccacaug

SEQ ID NO: 385549 - RNA, 19 nt, Homo sapiens
gcuccuggccuucuucaag

SEQ ID NO: 385550 - RNA, 19 nt, Homo sapiens
caagauccaccuggucaau

SEQ ID NO: 385551 - RNA, 19 nt, Homo sapiens
gcgcggaagacccugaaga

SEQ ID NO: 385552 - RNA, 19 nt, Homo sapiens
caagcaaggaggucaagca

SEQ ID NO: 385553 - RNA, 19 nt, Homo sapiens
ccgccguucugcugucuga

SEQ ID NO: 385554 - RNA, 19 nt, Homo sapiens
ggacuccaaggucaagcaa

SEQ ID NO: 385555 - RNA, 19 nt, Homo sapiens
gagccuugucaguguguaa

SEQ ID NO: 385556 - RNA, 19 nt, Homo sapiens
acgcuggccugcuguaugg

SEQ ID NO: 385557 - RNA, 19 nt, Homo sapiens
gaccaagaaccgccuagag

SEQ ID NO: 385558 - RNA, 19 nt, Homo sapiens
gacccugcagugcuucuuu

SEQ ID NO: 385559 - RNA, 19 nt, Homo sapiens
acacacguaagcagaagaa

SEQ ID NO: 385560 - RNA, 19 nt, Homo sapiens
gguauauguguuauucaug

SEQ ID NO: 385561 - RNA, 19 nt, Homo sapiens
cgaagcugcagaugccauu

SEQ ID NO: 385562 - RNA, 19 nt, Homo sapiens
ccgugagccuugucagugu

SEQ ID NO: 385563 - RNA, 19 nt, Homo sapiens
ugcguaaugucggcacuuu

SEQ ID NO: 385564 - RNA, 19 nt, Homo sapiens
ggaagcugagccucgaugu

SEQ ID NO: 385565 - RNA, 19 nt, Homo sapiens
ugggaggccucucacuauc

SEQ ID NO: 385566 - RNA, 19 nt, Homo sapiens
ggugcaggcuacgcagaug

SEQ ID NO: 385567 - RNA, 19 nt, Homo sapiens
cuugucaguguguaaauaa

SEQ ID NO: 385568 - RNA, 19 nt, Homo sapiens
gugaagcguuccaccuacu

SEQ ID NO: 385569 - RNA, 19 nt, Homo sapiens
ugugggaggccucucacua

SEQ ID NO: 385570 - RNA, 19 nt, Homo sapiens
ugcucacgcuggacaugua

SEQ ID NO: 385571 - RNA, 19 nt, Homo sapiens
aagcugcaccugcccuuga

SEQ ID NO: 385572 - RNA, 19 nt, Homo sapiens
gcagauaaucagccucuua

SEQ ID NO: 385573 - RNA, 19 nt, Homo sapiens
caagaacgccuacaagaag

SEQ ID NO: 385574 - RNA, 19 nt, Homo sapiens
cagugaagguguacccuaa

SEQ ID NO: 385575 - RNA, 19 nt, Homo sapiens
gcaagccggugggcaagaa

SEQ ID NO: 385576 - RNA, 19 nt, Homo sapiens
gauaaucagccucuuaaag

SEQ ID NO: 385577 - RNA, 19 nt, Homo sapiens
cagauaaucagccucuuaa

SEQ ID NO: 385578 - RNA, 19 nt, Homo sapiens
ucaagaacgccuacaagaa

SEQ ID NO: 385579 - RNA, 19 nt, Homo sapiens
ggccgagacucccauguuc

SEQ ID NO: 385580 - RNA, 19 nt, Homo sapiens
uuaaagcugccuguaguua

SEQ ID NO: 385581 - RNA, 19 nt, Homo sapiens
gccuguaguuaggaaauaa

SEQ ID NO: 385582 - RNA, 19 nt, Homo sapiens
ucuuaaagcugccuguagu

SEQ ID NO: 385583 - RNA, 19 nt, Homo sapiens
gcaaccugcuggagugcau

SEQ ID NO: 385584 - RNA, 19 nt, Homo sapiens
ccuggaagaugccgagauc

SEQ ID NO: 385585 - RNA, 19 nt, Homo sapiens
gcgcuacggcgguuucaug

SEQ ID NO: 385586 - RNA, 19 nt, Homo sapiens
gaagcgcgaggacgucuca

SEQ ID NO: 385587 - RNA, 19 nt, Homo sapiens
cuacaagaagggcgaguga

SEQ ID NO: 385588 - RNA, 19 nt, Homo sapiens
uaaagcugccuguaguuag

SEQ ID NO: 385589 - RNA, 19 nt, Homo sapiens
aaagcugccuguaguuagg

SEQ ID NO: 385590 - RNA, 19 nt, Homo sapiens
uaaucagccucuuaaagcu

SEQ ID NO: 385591 - RNA, 19 nt, Homo sapiens
ccuacaggauggagcacuu

SEQ ID NO: 385592 - RNA, 19 nt, Homo sapiens
caucaagaacgccuacaag

SEQ ID NO: 385593 - RNA, 19 nt, Homo sapiens
ugccuguaguuaggaaaua

SEQ ID NO: 385594 - RNA, 19 nt, Homo sapiens
aaaacgccaucaucaagaa

SEQ ID NO: 385595 - RNA, 19 nt, Homo sapiens
auaaucagccucuuaaagc

SEQ ID NO: 385596 - RNA, 19 nt, Homo sapiens
gcuucaggccuccauggaa

SEQ ID NO: 385597 - RNA, 19 nt, Homo sapiens
gacauaaacuucugccuaa

SEQ ID NO: 385598 - RNA, 19 nt, Homo sapiens
ucaaaucagucuuggaaua

SEQ ID NO: 385599 - RNA, 19 nt, Homo sapiens
ggagauguauuuggguuua

SEQ ID NO: 385600 - RNA, 19 nt, Homo sapiens
gaaugaaucccauaauuga

SEQ ID NO: 385601 - RNA, 19 nt, Homo sapiens
ggucguauguugucuacua

SEQ ID NO: 385602 - RNA, 19 nt, Homo sapiens
cagaaugaaucccauaauu

SEQ ID NO: 385603 - RNA, 19 nt, Homo sapiens
ggagugauaugauguguag

SEQ ID NO: 385604 - RNA, 19 nt, Homo sapiens
uuaauacccucguggauaa

SEQ ID NO: 385605 - RNA, 19 nt, Homo sapiens
gagaauacacuaucaaauc

SEQ ID NO: 385606 - RNA, 19 nt, Homo sapiens
ggaaccaccagucuucuua

SEQ ID NO: 385607 - RNA, 19 nt, Homo sapiens
ucaaagcacuguuuaacug

SEQ ID NO: 385608 - RNA, 19 nt, Homo sapiens
gaaacugaggccauuauuu

SEQ ID NO: 385609 - RNA, 19 nt, Homo sapiens
gaccgaaucucacucuguu

SEQ ID NO: 385610 - RNA, 19 nt, Homo sapiens
uggcaaguaugucuauaua

SEQ ID NO: 385611 - RNA, 19 nt, Homo sapiens
caucagaggugcuucgaau

SEQ ID NO: 385612 - RNA, 19 nt, Homo sapiens
gcaaguaugucuauauagc

SEQ ID NO: 385613 - RNA, 19 nt, Homo sapiens
ggaccugaaugaagaagau

SEQ ID NO: 385614 - RNA, 19 nt, Homo sapiens
caguggaguuguuuaaauu

SEQ ID NO: 385615 - RNA, 19 nt, Homo sapiens
gcagugacuuuagaaacaa

SEQ ID NO: 385616 - RNA, 19 nt, Homo sapiens
aaacugaggccauuauuuc

SEQ ID NO: 385617 - RNA, 19 nt, Homo sapiens
cauagaaacugaggccauu

SEQ ID NO: 385618 - RNA, 19 nt, Homo sapiens
ugauggaccugaaugaaga

SEQ ID NO: 385619 - RNA, 19 nt, Homo sapiens
ggcagugacuuuagaaaca

SEQ ID NO: 385620 - RNA, 19 nt, Homo sapiens
caugaugaauuacuucuuc

SEQ ID NO: 385621 - RNA, 19 nt, Homo sapiens
guugcuggcucauaagauu

SEQ ID NO: 385622 - RNA, 19 nt, Homo sapiens
gaacuuccuaacuguaauu

SEQ ID NO: 385623 - RNA, 19 nt, Homo sapiens
ccagaaaacauaugcauua

SEQ ID NO: 385624 - RNA, 19 nt, Homo sapiens
agaagaaccuaaagugaca

SEQ ID NO: 385625 - RNA, 19 nt, Homo sapiens
agacaugacuaggaagaaa

SEQ ID NO: 385626 - RNA, 19 nt, Homo sapiens
ucuaugaucuuggcacaaa

SEQ ID NO: 385627 - RNA, 19 nt, Homo sapiens
caugcuaauuggacuuuaa

SEQ ID NO: 385628 - RNA, 19 nt, Homo sapiens
gaagaagauccaacagugu

SEQ ID NO: 385629 - RNA, 19 nt, Homo sapiens
ccaccagucuucuuaccaa

SEQ ID NO: 385630 - RNA, 19 nt, Homo sapiens
aaucgaaacuggcucugaa

SEQ ID NO: 385631 - RNA, 19 nt, Homo sapiens
caaaaguacuuacccuaaa

SEQ ID NO: 385632 - RNA, 19 nt, Homo sapiens
gaaaaccucauuuaccaua

SEQ ID NO: 385633 - RNA, 19 nt, Homo sapiens
uaucaaaucagucuuggaa

SEQ ID NO: 385634 - RNA, 19 nt, Homo sapiens
gcacaguguuucacaaagc

SEQ ID NO: 385635 - RNA, 19 nt, Homo sapiens
gacuuuaacuccauugaag

SEQ ID NO: 385636 - RNA, 19 nt, Homo sapiens
gaaugaagaagauccaaca

SEQ ID NO: 385637 - RNA, 19 nt, Homo sapiens
ucacacaccugaaaauuau

SEQ ID NO: 385638 - RNA, 19 nt, Homo sapiens
ucacgugucuuuagaacuc

SEQ ID NO: 385639 - RNA, 19 nt, Homo sapiens
cucauaagauucaugugua

SEQ ID NO: 385640 - RNA, 19 nt, Homo sapiens
cauuagcucuggauuaaag

SEQ ID NO: 385641 - RNA, 19 nt, Homo sapiens
guaaaaguguccccaaaga

SEQ ID NO: 385642 - RNA, 19 nt, Homo sapiens
caaugaaugcugacccuaa

SEQ ID NO: 385643 - RNA, 19 nt, Homo sapiens
gcagaaggauuugauuuug

SEQ ID NO: 385644 - RNA, 19 nt, Homo sapiens
uggcacaaaugaucacuau

SEQ ID NO: 385645 - RNA, 19 nt, Homo sapiens
aaacuucugccuaauuuga

SEQ ID NO: 385646 - RNA, 19 nt, Homo sapiens
uucauuagcucuggauuaa

SEQ ID NO: 385647 - RNA, 19 nt, Homo sapiens
ugacaugggcgacaguaaa

SEQ ID NO: 385648 - RNA, 19 nt, Homo sapiens
agaaugaaucccauaauug

SEQ ID NO: 385649 - RNA, 19 nt, Homo sapiens
aaugaaugcugacccuaaa

SEQ ID NO: 385650 - RNA, 19 nt, Homo sapiens
cauaaacuucugccuaauu

SEQ ID NO: 385651 - RNA, 19 nt, Homo sapiens
aaaguauccuggaauaaag

SEQ ID NO: 385652 - RNA, 19 nt, Homo sapiens
gauuugcacccaugccaua

SEQ ID NO: 385653 - RNA, 19 nt, Homo sapiens
ggacuuuaacuccauugaa

SEQ ID NO: 385654 - RNA, 19 nt, Homo sapiens
gcucauaagauucaugugu

SEQ ID NO: 385655 - RNA, 19 nt, Homo sapiens
acaguggaguuguuuaaau

SEQ ID NO: 385656 - RNA, 19 nt, Homo sapiens
gaucacuggaaguaaauuu

SEQ ID NO: 385657 - RNA, 19 nt, Homo sapiens
gacacagguuuaugcagaa

SEQ ID NO: 385658 - RNA, 19 nt, Homo sapiens
gcaugaaaaucuucuucua

SEQ ID NO: 385659 - RNA, 19 nt, Homo sapiens
uaacauaucuguggauccu

SEQ ID NO: 385660 - RNA, 19 nt, Homo sapiens
gauggcaaguaugucuaua

SEQ ID NO: 385661 - RNA, 19 nt, Homo sapiens
uuaaggcagugacuuuaga

SEQ ID NO: 385662 - RNA, 19 nt, Homo sapiens
cccaaagacuacacuguug

SEQ ID NO: 385663 - RNA, 19 nt, Homo sapiens
ugccaugucuuguucagaa

SEQ ID NO: 385664 - RNA, 19 nt, Homo sapiens
aaagggaaacugcugauug

SEQ ID NO: 385665 - RNA, 19 nt, Homo sapiens
gguacaacccguagaacuu

SEQ ID NO: 385666 - RNA, 19 nt, Homo sapiens
cugccuaauuugaaugaua

SEQ ID NO: 385667 - RNA, 19 nt, Homo sapiens
ggaugggacuggcacucuu

SEQ ID NO: 385668 - RNA, 19 nt, Homo sapiens
gcaucaaagcacuguuuaa

SEQ ID NO: 385669 - RNA, 19 nt, Homo sapiens
ggacuggcuuucauuagcu

SEQ ID NO: 385670 - RNA, 19 nt, Homo sapiens
uagcucacgugucuuuaga

SEQ ID NO: 385671 - RNA, 19 nt, Homo sapiens
gacuggcacucuucaggaa

SEQ ID NO: 385672 - RNA, 19 nt, Homo sapiens
uaacagaagaaccuaaagu

SEQ ID NO: 385673 - RNA, 19 nt, Homo sapiens
guagaacuuccuaacugua

SEQ ID NO: 385674 - RNA, 19 nt, Homo sapiens
ccguagaacuuccuaacug

SEQ ID NO: 385675 - RNA, 19 nt, Homo sapiens
cuaauggacuggcuuucau

SEQ ID NO: 385676 - RNA, 19 nt, Homo sapiens
agagaauccuccugcauca

SEQ ID NO: 385677 - RNA, 19 nt, Homo sapiens
agacuacacuguuguugag

SEQ ID NO: 385678 - RNA, 19 nt, Homo sapiens
caaagacuacacuguuguu

SEQ ID NO: 385679 - RNA, 19 nt, Homo sapiens
gcccaucgaucccuuuguc

SEQ ID NO: 385680 - RNA, 19 nt, Homo sapiens
uaccaaacacgacuuaaug

SEQ ID NO: 385681 - RNA, 19 nt, Homo sapiens
gcaugcuaauuggacuuua

SEQ ID NO: 385682 - RNA, 19 nt, Homo sapiens
uagaacuuccuaacuguaa

SEQ ID NO: 385683 - RNA, 19 nt, Homo sapiens
ugugggaccugagcacuuu

SEQ ID NO: 385684 - RNA, 19 nt, Homo sapiens
gcugauauauaagguuaca

SEQ ID NO: 385685 - RNA, 19 nt, Homo sapiens
acugagacaugacuaggaa

SEQ ID NO: 385686 - RNA, 19 nt, Homo sapiens
gcuaucuacugagacauga

SEQ ID NO: 385687 - RNA, 19 nt, Homo sapiens
cguagaacuuccuaacugu

SEQ ID NO: 385688 - RNA, 19 nt, Homo sapiens
ggagauacugccuaaugga

SEQ ID NO: 385689 - RNA, 19 nt, Homo sapiens
caauucuccuguugcaaug

SEQ ID NO: 385690 - RNA, 19 nt, Homo sapiens
guacuuacccuaaaacaug

SEQ ID NO: 385691 - RNA, 19 nt, Homo sapiens
ccagucuucuuaccaaaca

SEQ ID NO: 385692 - RNA, 19 nt, Homo sapiens
cgaggacccaguguucuua

SEQ ID NO: 385693 - RNA, 19 nt, Homo sapiens
acagaagaaccuaaaguga

SEQ ID NO: 385694 - RNA, 19 nt, Homo sapiens
guacaacccguagaacuuc

SEQ ID NO: 385695 - RNA, 19 nt, Homo sapiens
guggaguuguuuaaauuuc

SEQ ID NO: 385696 - RNA, 19 nt, Homo sapiens
ucacuggaaguaaauuuga

SEQ ID NO: 385697 - RNA, 19 nt, Homo sapiens
cauauuggcucaugaaauu

SEQ ID NO: 385698 - RNA, 19 nt, Homo sapiens
gggcaaauguuguuuacua

SEQ ID NO: 385699 - RNA, 19 nt, Homo sapiens
gaagcuggcucugaagaua

SEQ ID NO: 385700 - RNA, 19 nt, Homo sapiens
ugacacaguuuaucucuuu

SEQ ID NO: 385701 - RNA, 19 nt, Homo sapiens
gcacgggaauuaagaauca

SEQ ID NO: 385702 - RNA, 19 nt, Homo sapiens
ugacuacuauggcuguuua

SEQ ID NO: 385703 - RNA, 19 nt, Homo sapiens
gcacucagaaaucgacuua

SEQ ID NO: 385704 - RNA, 19 nt, Homo sapiens
gaauuuaaccagcaacauu

SEQ ID NO: 385705 - RNA, 19 nt, Homo sapiens
agauaagccuggaggaaua

SEQ ID NO: 385706 - RNA, 19 nt, Homo sapiens
agacaacgaugacacaguu

SEQ ID NO: 385707 - RNA, 19 nt, Homo sapiens
gaaacauacuugaacuuac

SEQ ID NO: 385708 - RNA, 19 nt, Homo sapiens
uggauacacugguggauaa

SEQ ID NO: 385709 - RNA, 19 nt, Homo sapiens
acucagaaaucgacuuaaa

SEQ ID NO: 385710 - RNA, 19 nt, Homo sapiens
uggcauguguaguuaauuu

SEQ ID NO: 385711 - RNA, 19 nt, Homo sapiens
ccacagagccuuguauugu

SEQ ID NO: 385712 - RNA, 19 nt, Homo sapiens
auacacugguggauaauuu

SEQ ID NO: 385713 - RNA, 19 nt, Homo sapiens
gaacuuacacugggcaaau

SEQ ID NO: 385714 - RNA, 19 nt, Homo sapiens
agaaauguauggcaugugu

SEQ ID NO: 385715 - RNA, 19 nt, Homo sapiens
cuacagugacuacaguuua

SEQ ID NO: 385716 - RNA, 19 nt, Homo sapiens
ccacacugccaccugauua

SEQ ID NO: 385717 - RNA, 19 nt, Homo sapiens
cagcaaaugggaucaauau

SEQ ID NO: 385718 - RNA, 19 nt, Homo sapiens
cuacuucucugauccuuuc

SEQ ID NO: 385719 - RNA, 19 nt, Homo sapiens
gaaguucuguagccucagu

SEQ ID NO: 385720 - RNA, 19 nt, Homo sapiens
caaugggucuguucuccaa

SEQ ID NO: 385721 - RNA, 19 nt, Homo sapiens
gcacauuucuaugccacaa

SEQ ID NO: 385722 - RNA, 19 nt, Homo sapiens
caucagcacuuucauagac

SEQ ID NO: 385723 - RNA, 19 nt, Homo sapiens
aagaaucagucguggguuu

SEQ ID NO: 385724 - RNA, 19 nt, Homo sapiens
gcucauaggcacuuuauac

SEQ ID NO: 385725 - RNA, 19 nt, Homo sapiens
gaggaauacuaaugaugga

SEQ ID NO: 385726 - RNA, 19 nt, Homo sapiens
uaaagccuccagagaagua

SEQ ID NO: 385727 - RNA, 19 nt, Homo sapiens
gaagguacuugagcuggau

SEQ ID NO: 385728 - RNA, 19 nt, Homo sapiens
ucucugauccuuucuuaaa

SEQ ID NO: 385729 - RNA, 19 nt, Homo sapiens
ccacaaaugaccacuacuu

SEQ ID NO: 385730 - RNA, 19 nt, Homo sapiens
caguuuaucucuuuguugu

SEQ ID NO: 385731 - RNA, 19 nt, Homo sapiens
ggauuccacugaaauagag

SEQ ID NO: 385732 - RNA, 19 nt, Homo sapiens
uguauggcauguguaguua

SEQ ID NO: 385733 - RNA, 19 nt, Homo sapiens
uuacuacaguccaaaugaa

SEQ ID NO: 385734 - RNA, 19 nt, Homo sapiens
cagcaacauugacccagaa

SEQ ID NO: 385735 - RNA, 19 nt, Homo sapiens
ggacaucuggguagucugu

SEQ ID NO: 385736 - RNA, 19 nt, Homo sapiens
gcacuuucauagacaacga

SEQ ID NO: 385737 - RNA, 19 nt, Homo sapiens
ccacauggcaucagcacuu

SEQ ID NO: 385738 - RNA, 19 nt, Homo sapiens
gaauugaagcuggcucuga

SEQ ID NO: 385739 - RNA, 19 nt, Homo sapiens
acagagccuuguauuguga

SEQ ID NO: 385740 - RNA, 19 nt, Homo sapiens
aguagaaucuguagaccuu

SEQ ID NO: 385741 - RNA, 19 nt, Homo sapiens
gguagucugucauccuaau

SEQ ID NO: 385742 - RNA, 19 nt, Homo sapiens
gcagaaggauuugauucag

SEQ ID NO: 385743 - RNA, 19 nt, Homo sapiens
gguuugauuuggccucauu

SEQ ID NO: 385744 - RNA, 19 nt, Homo sapiens
caaauguuguuuacuacag

SEQ ID NO: 385745 - RNA, 19 nt, Homo sapiens
cuucucugauccuuucuua

SEQ ID NO: 385746 - RNA, 19 nt, Homo sapiens
ugaaaacagucaaacauga

SEQ ID NO: 385747 - RNA, 19 nt, Homo sapiens
gaauacuaaugauggaucu

SEQ ID NO: 385748 - RNA, 19 nt, Homo sapiens
ugacauacuucccaauggu

SEQ ID NO: 385749 - RNA, 19 nt, Homo sapiens
gaacuacugauaauaacgu

SEQ ID NO: 385750 - RNA, 19 nt, Homo sapiens
cuauggcuguuuagaacua

SEQ ID NO: 385751 - RNA, 19 nt, Homo sapiens
ccagaaauguauggcaugu

SEQ ID NO: 385752 - RNA, 19 nt, Homo sapiens
aauugaagcuggcucugaa

SEQ ID NO: 385753 - RNA, 19 nt, Homo sapiens
caagaauacaguggaaauu

SEQ ID NO: 385754 - RNA, 19 nt, Homo sapiens
ccacagcuuugcaccagau

SEQ ID NO: 385755 - RNA, 19 nt, Homo sapiens
gaaauguauggcaugugua

SEQ ID NO: 385756 - RNA, 19 nt, Homo sapiens
gagggaauuuaaccagcaa

SEQ ID NO: 385757 - RNA, 19 nt, Homo sapiens
uacagugacuacaguuuau

SEQ ID NO: 385758 - RNA, 19 nt, Homo sapiens
gaccacuacuucucugauc

SEQ ID NO: 385759 - RNA, 19 nt, Homo sapiens
gagcuucuuccaaguguga

SEQ ID NO: 385760 - RNA, 19 nt, Homo sapiens
aaacaugagcuucuuccaa

SEQ ID NO: 385761 - RNA, 19 nt, Homo sapiens
caacgaugacacaguuuau

SEQ ID NO: 385762 - RNA, 19 nt, Homo sapiens
gcaugaaagugcgauaacu

SEQ ID NO: 385763 - RNA, 19 nt, Homo sapiens
gcugacauauuggcucaug

SEQ ID NO: 385764 - RNA, 19 nt, Homo sapiens
ccaccugauuaaaggaauu

SEQ ID NO: 385765 - RNA, 19 nt, Homo sapiens
caaaugaccacuacuucuc

SEQ ID NO: 385766 - RNA, 19 nt, Homo sapiens
gaugggaagcugcucauag

SEQ ID NO: 385767 - RNA, 19 nt, Homo sapiens
uggguagucugucauccua

SEQ ID NO: 385768 - RNA, 19 nt, Homo sapiens
acaacgaugacacaguuua

SEQ ID NO: 385769 - RNA, 19 nt, Homo sapiens
ugacauauuggcucaugaa

SEQ ID NO: 385770 - RNA, 19 nt, Homo sapiens
gcaaauguuguuuacuaca

SEQ ID NO: 385771 - RNA, 19 nt, Homo sapiens
guaaaccacccagaauuca

SEQ ID NO: 385772 - RNA, 19 nt, Homo sapiens
cuacuauggcuguuuagaa

SEQ ID NO: 385773 - RNA, 19 nt, Homo sapiens
cuuaaagccuccagagaag

SEQ ID NO: 385774 - RNA, 19 nt, Homo sapiens
caccugaugauaaguauau

SEQ ID NO: 385775 - RNA, 19 nt, Homo sapiens
uauggcauguguaguuaau

SEQ ID NO: 385776 - RNA, 19 nt, Homo sapiens
agugguagcagaaggauuu

SEQ ID NO: 385777 - RNA, 19 nt, Homo sapiens
ggcaaauguuguuuacuac

SEQ ID NO: 385778 - RNA, 19 nt, Homo sapiens
ucaagaauacaguggaaau

SEQ ID NO: 385779 - RNA, 19 nt, Homo sapiens
cacauggcaucagcacuuu

SEQ ID NO: 385780 - RNA, 19 nt, Homo sapiens
gcaagggacagaaaagaaa

SEQ ID NO: 385781 - RNA, 19 nt, Homo sapiens
cugaagauauugacauacu

SEQ ID NO: 385782 - RNA, 19 nt, Homo sapiens
cucugaagauauugacaua

SEQ ID NO: 385783 - RNA, 19 nt, Homo sapiens
ugacaucacagcuguugga

SEQ ID NO: 385784 - RNA, 19 nt, Homo sapiens
ugauuuggccucauucaau

SEQ ID NO: 385785 - RNA, 19 nt, Homo sapiens
gugaauacauuuugcacaa

SEQ ID NO: 385786 - RNA, 19 nt, Homo sapiens
uaaagugguagcagaagga

SEQ ID NO: 385787 - RNA, 19 nt, Homo sapiens
caguccaaaugaaguuaaa

SEQ ID NO: 385788 - RNA, 19 nt, Homo sapiens
cagauaagccuggaggaau

SEQ ID NO: 385789 - RNA, 19 nt, Homo sapiens
ccaagggcacgggaauuaa

SEQ ID NO: 385790 - RNA, 19 nt, Homo sapiens
aaaggaaaaugaacagguu

SEQ ID NO: 385791 - RNA, 19 nt, Homo sapiens
cacaguuuaucucuuuguu

SEQ ID NO: 385792 - RNA, 19 nt, Homo sapiens
ggcaucagcacuuucauag

SEQ ID NO: 385793 - RNA, 19 nt, Homo sapiens
ugugaacucuaaauuguac

SEQ ID NO: 385794 - RNA, 19 nt, Homo sapiens
ugagaagccuacagugacu

SEQ ID NO: 385795 - RNA, 19 nt, Homo sapiens
cuuguauugugaacucuaa

SEQ ID NO: 385796 - RNA, 19 nt, Homo sapiens
uauuucaccugaugauaag

SEQ ID NO: 385797 - RNA, 19 nt, Homo sapiens
gcacggcccucaccuacua

SEQ ID NO: 385798 - RNA, 19 nt, Homo sapiens
gggagacgcugcuguacua

SEQ ID NO: 385799 - RNA, 19 nt, Homo sapiens
ucaagaaacugaugaccaa

SEQ ID NO: 385800 - RNA, 19 nt, Homo sapiens
gagagcagcuuuguggaaa

SEQ ID NO: 385801 - RNA, 19 nt, Homo sapiens
gaugaggaguccaacaaga

SEQ ID NO: 385802 - RNA, 19 nt, Homo sapiens
gagagcaccuguggaaguu

SEQ ID NO: 385803 - RNA, 19 nt, Homo sapiens
ggacaucucggacuccaaa

SEQ ID NO: 385804 - RNA, 19 nt, Homo sapiens
ggaauaaaguucuguuuuc

SEQ ID NO: 385805 - RNA, 19 nt, Homo sapiens
gagcaccuguggaaguuga

SEQ ID NO: 385806 - RNA, 19 nt, Homo sapiens
uguacgagcuggcgcagua

SEQ ID NO: 385807 - RNA, 19 nt, Homo sapiens
ugacggacaugauucuguu

SEQ ID NO: 385808 - RNA, 19 nt, Homo sapiens
ccagugaguguaaauaauu

SEQ ID NO: 385809 - RNA, 19 nt, Homo sapiens
cgacgacgaugggaacuug

SEQ ID NO: 385810 - RNA, 19 nt, Homo sapiens
cagcggacccugaggagua

SEQ ID NO: 385811 - RNA, 19 nt, Homo sapiens
caacaagaagcacccauuc

SEQ ID NO: 385812 - RNA, 19 nt, Homo sapiens
gcgguggacuacaucaaga

SEQ ID NO: 385813 - RNA, 19 nt, Homo sapiens
ggcgguggccgaagaagua

SEQ ID NO: 385814 - RNA, 19 nt, Homo sapiens
gugcggugguuguggagua

SEQ ID NO: 385815 - RNA, 19 nt, Homo sapiens
gaacuuggaggaggacuuc

SEQ ID NO: 385816 - RNA, 19 nt, Homo sapiens
gaacaccuucuacgacauc

SEQ ID NO: 385817 - RNA, 19 nt, Homo sapiens
cgacaacgcccuggugguu

SEQ ID NO: 385818 - RNA, 19 nt, Homo sapiens
gcgcaggcccagugacaaa

SEQ ID NO: 385819 - RNA, 19 nt, Homo sapiens
caccacgccugucaucaug

SEQ ID NO: 385820 - RNA, 19 nt, Homo sapiens
gaaccgagcgccaccucau

SEQ ID NO: 385821 - RNA, 19 nt, Homo sapiens
ccaaccgccuguccaagga

SEQ ID NO: 385822 - RNA, 19 nt, Homo sapiens
gggaccacguggcugugua

SEQ ID NO: 385823 - RNA, 19 nt, Homo sapiens
ccaacaagaagcacccauu

SEQ ID NO: 385824 - RNA, 19 nt, Homo sapiens
ucaugcaccuggaauugga

SEQ ID NO: 385825 - RNA, 19 nt, Homo sapiens
ggcgaggaguccagcauuc

SEQ ID NO: 385826 - RNA, 19 nt, Homo sapiens
ucaccaaaauucagacauu

SEQ ID NO: 385827 - RNA, 19 nt, Homo sapiens
ccucuggcccuuggaauaa

SEQ ID NO: 385828 - RNA, 19 nt, Homo sapiens
cgacaaugcccaggacuuc

SEQ ID NO: 385829 - RNA, 19 nt, Homo sapiens
cgagagcaccuguggaagu

SEQ ID NO: 385830 - RNA, 19 nt, Homo sapiens
gcucaucgugggucuccua

SEQ ID NO: 385831 - RNA, 19 nt, Homo sapiens
cgacucugcucucgucaac

SEQ ID NO: 385832 - RNA, 19 nt, Homo sapiens
cacaugauuuccagugagu

SEQ ID NO: 385833 - RNA, 19 nt, Homo sapiens
uagaugcggccaaggugua

SEQ ID NO: 385834 - RNA, 19 nt, Homo sapiens
gcaggagacagacguggau

SEQ ID NO: 385835 - RNA, 19 nt, Homo sapiens
ccaacucugugcacaucug

SEQ ID NO: 385836 - RNA, 19 nt, Homo sapiens
gaccuacgagcacuucaau

SEQ ID NO: 385837 - RNA, 19 nt, Homo sapiens
ggucaaguucgcgguguuu

SEQ ID NO: 385838 - RNA, 19 nt, Homo sapiens
acaaugcccaggacuucua

SEQ ID NO: 385839 - RNA, 19 nt, Homo sapiens
gacuacaucaagaaacuga

SEQ ID NO: 385840 - RNA, 19 nt, Homo sapiens
ccagggaugugcagaacac

SEQ ID NO: 385841 - RNA, 19 nt, Homo sapiens
ugccagcguuucaugauca

SEQ ID NO: 385842 - RNA, 19 nt, Homo sapiens
acaagggcguggccaccaa

SEQ ID NO: 385843 - RNA, 19 nt, Homo sapiens
ccaccaaccggaagcugaa

SEQ ID NO: 385844 - RNA, 19 nt, Homo sapiens
gguccacaccgacauagau

SEQ ID NO: 385845 - RNA, 19 nt, Homo sapiens
gacaacgcccuggugguuu

SEQ ID NO: 385846 - RNA, 19 nt, Homo sapiens
ugucagagagagcagcuuu

SEQ ID NO: 385847 - RNA, 19 nt, Homo sapiens
gcaggcccagugacaaaga

SEQ ID NO: 385848 - RNA, 19 nt, Homo sapiens
gguggacuacaucaagaaa

SEQ ID NO: 385849 - RNA, 19 nt, Homo sapiens
acugguuccucuucagaaa

SEQ ID NO: 385850 - RNA, 19 nt, Homo sapiens
uggaaaagaugaagaaaac

SEQ ID NO: 385851 - RNA, 19 nt, Homo sapiens
agacauugaccuccucugu

SEQ ID NO: 385852 - RNA, 19 nt, Homo sapiens
uccagugaguguaaauaau

SEQ ID NO: 385853 - RNA, 19 nt, Homo sapiens
gauuuccagugaguguaaa

SEQ ID NO: 385854 - RNA, 19 nt, Homo sapiens
ucgugggucuccuaaccua

SEQ ID NO: 385855 - RNA, 19 nt, Homo sapiens
agagagcagcuuuguggaa

SEQ ID NO: 385856 - RNA, 19 nt, Homo sapiens
ugauuuccagugaguguaa

SEQ ID NO: 385857 - RNA, 19 nt, Homo sapiens
uggacuacaucaagaaacu

SEQ ID NO: 385858 - RNA, 19 nt, Homo sapiens
caucgugggucuccuaacc

SEQ ID NO: 385859 - RNA, 19 nt, Homo sapiens
gggaugugcagaacaccuu

SEQ ID NO: 385860 - RNA, 19 nt, Homo sapiens
ccacgccugucaucauggu

SEQ ID NO: 385861 - RNA, 19 nt, Homo sapiens
ccaccacgccugucaucau

SEQ ID NO: 385862 - RNA, 19 nt, Homo sapiens
ucagagagagcagcuuugu

SEQ ID NO: 385863 - RNA, 19 nt, Homo sapiens
ccaucgaccaccuguguga

SEQ ID NO: 385864 - RNA, 19 nt, Homo sapiens
guacccagccaacgacucu

SEQ ID NO: 385865 - RNA, 19 nt, Homo sapiens
ccucaugcaccuggaauug

SEQ ID NO: 385866 - RNA, 19 nt, Homo sapiens
ggaugaggaguccaacaag

SEQ ID NO: 385867 - RNA, 19 nt, Homo sapiens
gggucaaguucgcgguguu

SEQ ID NO: 385868 - RNA, 19 nt, Homo sapiens
aagaagaaguccccgaguu

SEQ ID NO: 385869 - RNA, 19 nt, Homo sapiens
ggccagggaugugcagaac

SEQ ID NO: 385870 - RNA, 19 nt, Homo sapiens
gcgagggcaaggagcugua

SEQ ID NO: 385871 - RNA, 19 nt, Homo sapiens
gagcuacgagaaccagaag

SEQ ID NO: 385872 - RNA, 19 nt, Homo sapiens
ggaacuuggaggaggacuu

SEQ ID NO: 385873 - RNA, 19 nt, Homo sapiens
ggacugcagaggaguuugc

SEQ ID NO: 385874 - RNA, 19 nt, Homo sapiens
caacaggacuucauuauuc

SEQ ID NO: 385875 - RNA, 19 nt, Homo sapiens
ggaggaagcugagcaagua

SEQ ID NO: 385876 - RNA, 19 nt, Homo sapiens
gaagccacauuaucuauuu

SEQ ID NO: 385877 - RNA, 19 nt, Homo sapiens
gaauaaaccuucuucucaa

SEQ ID NO: 385878 - RNA, 19 nt, Homo sapiens
gaaauuacuugguugacuu

SEQ ID NO: 385879 - RNA, 19 nt, Homo sapiens
ggagaaagaaguaguaaga

SEQ ID NO: 385880 - RNA, 19 nt, Homo sapiens
ggaaugaguugccaagcuu

SEQ ID NO: 385881 - RNA, 19 nt, Homo sapiens
gaggauggcugaagaacug

SEQ ID NO: 385882 - RNA, 19 nt, Homo sapiens
gagcagcgguucuccuuau

SEQ ID NO: 385883 - RNA, 19 nt, Homo sapiens
gaaagaaguaguaagaguu

SEQ ID NO: 385884 - RNA, 19 nt, Homo sapiens
gccaaugaauuuaaaguga

SEQ ID NO: 385885 - RNA, 19 nt, Homo sapiens
gaaaucagagaacuugaaa

SEQ ID NO: 385886 - RNA, 19 nt, Homo sapiens
gaaaccagccaucaaccua

SEQ ID NO: 385887 - RNA, 19 nt, Homo sapiens
ggagagacacuuuggagaa

SEQ ID NO: 385888 - RNA, 19 nt, Homo sapiens
gagccuuccugauguauau

SEQ ID NO: 385889 - RNA, 19 nt, Homo sapiens
gcaacaggacuucauuauu

SEQ ID NO: 385890 - RNA, 19 nt, Homo sapiens
ggacuucauuauucuguuc

SEQ ID NO: 385891 - RNA, 19 nt, Homo sapiens
gggagcaaaugaaaggaaa

SEQ ID NO: 385892 - RNA, 19 nt, Homo sapiens
gaacucaggcggaaaagua

SEQ ID NO: 385893 - RNA, 19 nt, Homo sapiens
ucacagugcugccgagugu

SEQ ID NO: 385894 - RNA, 19 nt, Homo sapiens
gcaacucugccucugauaa

SEQ ID NO: 385895 - RNA, 19 nt, Homo sapiens
gugcauggcucugaauuca

SEQ ID NO: 385896 - RNA, 19 nt, Homo sapiens
gaauuuaaagugagacgaa

SEQ ID NO: 385897 - RNA, 19 nt, Homo sapiens
aaaguaaauugguggaaga

SEQ ID NO: 385898 - RNA, 19 nt, Homo sapiens
gaacaacuauaagcauugc

SEQ ID NO: 385899 - RNA, 19 nt, Homo sapiens
gaagaacaacuauaagcau

SEQ ID NO: 385900 - RNA, 19 nt, Homo sapiens
gcaaguaggagcuuuguac

SEQ ID NO: 385901 - RNA, 19 nt, Homo sapiens
agaaagaaguaguaagagu

SEQ ID NO: 385902 - RNA, 19 nt, Homo sapiens
uaggagcuuuguacaauga

SEQ ID NO: 385903 - RNA, 19 nt, Homo sapiens
ugaauucagucaaacaaca

SEQ ID NO: 385904 - RNA, 19 nt, Homo sapiens
ggauacacccagacaaaug

SEQ ID NO: 385905 - RNA, 19 nt, Homo sapiens
agucauggauuuccuccua

SEQ ID NO: 385906 - RNA, 19 nt, Homo sapiens
ucauggauuuccuccuaua

SEQ ID NO: 385907 - RNA, 19 nt, Homo sapiens
gaaucuggagaaagaagua

SEQ ID NO: 385908 - RNA, 19 nt, Homo sapiens
guaggagcuuuguacaaug

SEQ ID NO: 385909 - RNA, 19 nt, Homo sapiens
ccaccaaugugaugucuac

SEQ ID NO: 385910 - RNA, 19 nt, Homo sapiens
uuauaccucugaauucuga

SEQ ID NO: 385911 - RNA, 19 nt, Homo sapiens
caugcaaacugaaagcaau

SEQ ID NO: 385912 - RNA, 19 nt, Homo sapiens
ccagaaaucagagaacuug

SEQ ID NO: 385913 - RNA, 19 nt, Homo sapiens
ggagcuuuguacaaugaaa

SEQ ID NO: 385914 - RNA, 19 nt, Homo sapiens
gcagcgguucuccuuauuu

SEQ ID NO: 385915 - RNA, 19 nt, Homo sapiens
ggaagagccaauagacaug

SEQ ID NO: 385916 - RNA, 19 nt, Homo sapiens
cagcaacaggacuucauua

SEQ ID NO: 385917 - RNA, 19 nt, Homo sapiens
aguaggagcuuuguacaau

SEQ ID NO: 385918 - RNA, 19 nt, Homo sapiens
gaauugaaucggcccuuug

SEQ ID NO: 385919 - RNA, 19 nt, Homo sapiens
gcaaacugaaagcaauauu

SEQ ID NO: 385920 - RNA, 19 nt, Homo sapiens
ucagaagccacauuaucua

SEQ ID NO: 385921 - RNA, 19 nt, Homo sapiens
ucaugaggauggcugaaga

SEQ ID NO: 385922 - RNA, 19 nt, Homo sapiens
gagagacacuuuggagaac

SEQ ID NO: 385923 - RNA, 19 nt, Homo sapiens
gaaaggaaaagaaaacgaa

SEQ ID NO: 385924 - RNA, 19 nt, Homo sapiens
gaauucagucaaacaacaa

SEQ ID NO: 385925 - RNA, 19 nt, Homo sapiens
caacucugccucugauaau

SEQ ID NO: 385926 - RNA, 19 nt, Homo sapiens
gaacugaaucuggagaaag

SEQ ID NO: 385927 - RNA, 19 nt, Homo sapiens
gaaaagaaaacgaagaaca

SEQ ID NO: 385928 - RNA, 19 nt, Homo sapiens
gauacacccagacaaaugu

SEQ ID NO: 385929 - RNA, 19 nt, Homo sapiens
uaggauacacccagacaaa

SEQ ID NO: 385930 - RNA, 19 nt, Homo sapiens
aacugaaucuggagaaaga

SEQ ID NO: 385931 - RNA, 19 nt, Homo sapiens
gggaaugaguugccaagcu

SEQ ID NO: 385932 - RNA, 19 nt, Homo sapiens
agaauugaaucggcccuuu

SEQ ID NO: 385933 - RNA, 19 nt, Homo sapiens
gcagguagugagaauugaa

SEQ ID NO: 385934 - RNA, 19 nt, Homo sapiens
aaagugggagcaaaugaaa

SEQ ID NO: 385935 - RNA, 19 nt, Homo sapiens
uacagaagcuuuacuuuuc

SEQ ID NO: 385936 - RNA, 19 nt, Homo sapiens
gcaaaugaaaggaaaagaa

SEQ ID NO: 385937 - RNA, 19 nt, Homo sapiens
ugauguauauaugcaggua

SEQ ID NO: 385938 - RNA, 19 nt, Homo sapiens
agugauggcagguaguuua

SEQ ID NO: 385939 - RNA, 19 nt, Homo sapiens
cgaagaacaacuauaagca

SEQ ID NO: 385940 - RNA, 19 nt, Homo sapiens
ccuuugagacaguaauaua

SEQ ID NO: 385941 - RNA, 19 nt, Homo sapiens
gaaugaguugccaagcuuu

SEQ ID NO: 385942 - RNA, 19 nt, Homo sapiens
ggagugauggcagguaguu

SEQ ID NO: 385943 - RNA, 19 nt, Homo sapiens
aaugugaugucuacagcaa

SEQ ID NO: 385944 - RNA, 19 nt, Homo sapiens
cagaagccacauuaucuau

SEQ ID NO: 385945 - RNA, 19 nt, Homo sapiens
guuccuuccugucauuaug

SEQ ID NO: 385946 - RNA, 19 nt, Homo sapiens
gaaucggcccuuugagaca

SEQ ID NO: 385947 - RNA, 19 nt, Homo sapiens
agaacugaaucuggagaaa

SEQ ID NO: 385948 - RNA, 19 nt, Homo sapiens
ggagaacagaauaaaccuu

SEQ ID NO: 385949 - RNA, 19 nt, Homo sapiens
agaaaucagagaacuugaa

SEQ ID NO: 385950 - RNA, 19 nt, Homo sapiens
aauaaaccuucuucucaag

SEQ ID NO: 385951 - RNA, 19 nt, Homo sapiens
gcaugcaaacugaaagcaa

SEQ ID NO: 385952 - RNA, 19 nt, Homo sapiens
uugaaaaguuugccaauga

SEQ ID NO: 385953 - RNA, 19 nt, Homo sapiens
guauauaugcagguaguga

SEQ ID NO: 385954 - RNA, 19 nt, Homo sapiens
gugauggcagguaguuuaa

SEQ ID NO: 385955 - RNA, 19 nt, Homo sapiens
cagcgguucuccuuauuuu

SEQ ID NO: 385956 - RNA, 19 nt, Homo sapiens
ccccuugucuuuauaaauu

SEQ ID NO: 385957 - RNA, 19 nt, Homo sapiens
guaguaagaguuugguuuu

SEQ ID NO: 385958 - RNA, 19 nt, Homo sapiens
ggaagcugagcaaguagga

SEQ ID NO: 385959 - RNA, 19 nt, Homo sapiens
gcccuuugagacaguaaua

SEQ ID NO: 385960 - RNA, 19 nt, Homo sapiens
ugaaaaguuugccaaugaa

SEQ ID NO: 385961 - RNA, 19 nt, Homo sapiens
gagccaauagacauggauu

SEQ ID NO: 385962 - RNA, 19 nt, Homo sapiens
ccaaccaugccaccaaugu

SEQ ID NO: 385963 - RNA, 19 nt, Homo sapiens
ugugaugucuacagcaaca

SEQ ID NO: 385964 - RNA, 19 nt, Homo sapiens
agaaauuacuugguugacu

SEQ ID NO: 385965 - RNA, 19 nt, Homo sapiens
acagaaauuacuugguuga

SEQ ID NO: 385966 - RNA, 19 nt, Homo sapiens
caaguaggagcuuuguaca

SEQ ID NO: 385967 - RNA, 19 nt, Homo sapiens
cugcaacucugccucugau

SEQ ID NO: 385968 - RNA, 19 nt, Homo sapiens
uggaagagccaauagacau

SEQ ID NO: 385969 - RNA, 19 nt, Homo sapiens
gauggcagguaguuuaacc

SEQ ID NO: 385970 - RNA, 19 nt, Homo sapiens
ucucagaagccacauuauc

SEQ ID NO: 385971 - RNA, 19 nt, Homo sapiens
gcaaccggaggcagagaga

SEQ ID NO: 385972 - RNA, 19 nt, Homo sapiens
gagacacuuuggagaacag

SEQ ID NO: 385973 - RNA, 19 nt, Homo sapiens
ucuacucucuugugggaau

SEQ ID NO: 385974 - RNA, 19 nt, Homo sapiens
ggaggaagcuugaguuuga

SEQ ID NO: 385975 - RNA, 19 nt, Homo sapiens
ccagauuacuugguuauua

SEQ ID NO: 385976 - RNA, 19 nt, Homo sapiens
gaaguaccauuagguuuaa

SEQ ID NO: 385977 - RNA, 19 nt, Homo sapiens
gaggaaggcugaggaauga

SEQ ID NO: 385978 - RNA, 19 nt, Homo sapiens
guaggagacugaguuguua

SEQ ID NO: 385979 - RNA, 19 nt, Homo sapiens
caccaugccuggcuaauuu

SEQ ID NO: 385980 - RNA, 19 nt, Homo sapiens
cuacucagcugacauguau

SEQ ID NO: 385981 - RNA, 19 nt, Homo sapiens
gacagcaccuccugagaaa

SEQ ID NO: 385982 - RNA, 19 nt, Homo sapiens
gcaccaucgucacuauuaa

SEQ ID NO: 385983 - RNA, 19 nt, Homo sapiens
gcuuagcucuugauaguga

SEQ ID NO: 385984 - RNA, 19 nt, Homo sapiens
gugcuuagcucuugauagu

SEQ ID NO: 385985 - RNA, 19 nt, Homo sapiens
gaaguugggcuguuguaaa

SEQ ID NO: 385986 - RNA, 19 nt, Homo sapiens
ggaaacagccucagcucaa

SEQ ID NO: 385987 - RNA, 19 nt, Homo sapiens
gcagacauuucaguuggua

SEQ ID NO: 385988 - RNA, 19 nt, Homo sapiens
agaaguaccauuagguuua

SEQ ID NO: 385989 - RNA, 19 nt, Homo sapiens
cacaguugcuccuuuguuu

SEQ ID NO: 385990 - RNA, 19 nt, Homo sapiens
ggagguaauuauagggauu

SEQ ID NO: 385991 - RNA, 19 nt, Homo sapiens
guacaauggugcgaucuug

SEQ ID NO: 385992 - RNA, 19 nt, Homo sapiens
ugacuuggcuccagauuac

SEQ ID NO: 385993 - RNA, 19 nt, Homo sapiens
ggaggaaggcugaggaaug

SEQ ID NO: 385994 - RNA, 19 nt, Homo sapiens
acgcacagcuagaauugua

SEQ ID NO: 385995 - RNA, 19 nt, Homo sapiens
gaaacagccucagcucaag

SEQ ID NO: 385996 - RNA, 19 nt, Homo sapiens
cgacagcaccuccugagaa

SEQ ID NO: 385997 - RNA, 19 nt, Homo sapiens
gugcaaagaucaacguuuu

SEQ ID NO: 385998 - RNA, 19 nt, Homo sapiens
gacaguuucuuugacauau

SEQ ID NO: 385999 - RNA, 19 nt, Homo sapiens
ugaaggagccagugaagga

SEQ ID NO: 386000 - RNA, 19 nt, Homo sapiens
uagaauccauguagaaguc

SEQ ID NO: 386001 - RNA, 19 nt, Homo sapiens
ggguuucuuuagugucuua

SEQ ID NO: 386002 - RNA, 19 nt, Homo sapiens
ugucacauuucauuucuug

SEQ ID NO: 386003 - RNA, 19 nt, Homo sapiens
gcaccucugucucccaagu

SEQ ID NO: 386004 - RNA, 19 nt, Homo sapiens
gcuccagauuacuugguua

SEQ ID NO: 386005 - RNA, 19 nt, Homo sapiens
ugucaaauguugccaaguc

SEQ ID NO: 386006 - RNA, 19 nt, Homo sapiens
cauggaagguucugugucu

SEQ ID NO: 386007 - RNA, 19 nt, Homo sapiens
ucacucacacccucuguaa

SEQ ID NO: 386008 - RNA, 19 nt, Homo sapiens
ugacaguuucuuugacaua

SEQ ID NO: 386009 - RNA, 19 nt, Homo sapiens
agaggaggcugcccugugu

SEQ ID NO: 386010 - RNA, 19 nt, Homo sapiens
ccgaguagcugggauuaca

SEQ ID NO: 386011 - RNA, 19 nt, Homo sapiens
caagggaaguugggcuguu

SEQ ID NO: 386012 - RNA, 19 nt, Homo sapiens
cauguggguuucuuuagug

SEQ ID NO: 386013 - RNA, 19 nt, Homo sapiens
ggaaguugggcuguuguaa

SEQ ID NO: 386014 - RNA, 19 nt, Homo sapiens
ccagaaguaccauuagguu

SEQ ID NO: 386015 - RNA, 19 nt, Homo sapiens
aaacuaaaggaaagcauug

SEQ ID NO: 386016 - RNA, 19 nt, Homo sapiens
acucacacccucuguaauu

SEQ ID NO: 386017 - RNA, 19 nt, Homo sapiens
ccucgcuucuucucucuuu

SEQ ID NO: 386018 - RNA, 19 nt, Homo sapiens
ggacaccuuacaccgagua

SEQ ID NO: 386019 - RNA, 19 nt, Homo sapiens
ucagccagaaguaccauua

SEQ ID NO: 386020 - RNA, 19 nt, Homo sapiens
ccauguggguuucuuuagu

SEQ ID NO: 386021 - RNA, 19 nt, Homo sapiens
gcacagcuagaauuguaga

SEQ ID NO: 386022 - RNA, 19 nt, Homo sapiens
gcucacccaccugcuaaua

SEQ ID NO: 386023 - RNA, 19 nt, Homo sapiens
ucauuucugucacauuuca

SEQ ID NO: 386024 - RNA, 19 nt, Homo sapiens
ugaguccuguucccugaaa

SEQ ID NO: 386025 - RNA, 19 nt, Homo sapiens
ccacucaucaccaauguca

SEQ ID NO: 386026 - RNA, 19 nt, Homo sapiens
gaaggagccagugaaggaa

SEQ ID NO: 386027 - RNA, 19 nt, Homo sapiens
cagaaguaccauuagguuu

SEQ ID NO: 386028 - RNA, 19 nt, Homo sapiens
cuauuaagcagacauuuca

SEQ ID NO: 386029 - RNA, 19 nt, Homo sapiens
caggugugcuuagcucuug

SEQ ID NO: 386030 - RNA, 19 nt, Homo sapiens
ccagguucaugcuuguuug

SEQ ID NO: 386031 - RNA, 19 nt, Homo sapiens
uaagcagacauuucaguug

SEQ ID NO: 386032 - RNA, 19 nt, Homo sapiens
aaaccuuccuucccuucuu

SEQ ID NO: 386033 - RNA, 19 nt, Homo sapiens
aaugacaguuucuuugaca

SEQ ID NO: 386034 - RNA, 19 nt, Homo sapiens
ugccugagccucccgagua

SEQ ID NO: 386035 - RNA, 19 nt, Homo sapiens
cacauuucauuucuuggaa

SEQ ID NO: 386036 - RNA, 19 nt, Homo sapiens
gagguaauuauagggauuu

SEQ ID NO: 386037 - RNA, 19 nt, Homo sapiens
ucaauucuguuccauuuug

SEQ ID NO: 386038 - RNA, 19 nt, Homo sapiens
uguaggagacugaguuguu

SEQ ID NO: 386039 - RNA, 19 nt, Homo sapiens
uaccauguggguuucuuua

SEQ ID NO: 386040 - RNA, 19 nt, Homo sapiens
caaauguugccaagucugu

SEQ ID NO: 386041 - RNA, 19 nt, Homo sapiens
cuagaauuguagaccugua

SEQ ID NO: 386042 - RNA, 19 nt, Homo sapiens
ucagagugcugggaucaca

SEQ ID NO: 386043 - RNA, 19 nt, Homo sapiens
cuuccuuccuuccuucuuu

SEQ ID NO: 386044 - RNA, 19 nt, Homo sapiens
ccacaguugcuccuuuguu

SEQ ID NO: 386045 - RNA, 19 nt, Homo sapiens
cuccuucccuucucccuuu

SEQ ID NO: 386046 - RNA, 19 nt, Homo sapiens
cuccuucccuucucccuuu

SEQ ID NO: 386047 - RNA, 19 nt, Homo sapiens
ucacauuucauuucuugga

SEQ ID NO: 386048 - RNA, 19 nt, Homo sapiens
uccaugggcuuucauuucu

SEQ ID NO: 386049 - RNA, 19 nt, Homo sapiens
cuacgcacagcuagaauug

SEQ ID NO: 386050 - RNA, 19 nt, Homo sapiens
gaauugagccccagguuca

SEQ ID NO: 386051 - RNA, 19 nt, Homo sapiens
aaaaugagccuggaauuga

SEQ ID NO: 386052 - RNA, 19 nt, Homo sapiens
gcgggaacccaggccuuua

SEQ ID NO: 386053 - RNA, 19 nt, Homo sapiens
ccaccaugccuggcuaauu

SEQ ID NO: 386054 - RNA, 19 nt, Homo sapiens
gaggaagcuugaguuugau

SEQ ID NO: 386055 - RNA, 19 nt, Homo sapiens
caucuuagggucacucaca

SEQ ID NO: 386056 - RNA, 19 nt, Homo sapiens
ccaaacugucggcuucaaa

SEQ ID NO: 386057 - RNA, 19 nt, Homo sapiens
uuguagaccuguaaaccuu

SEQ ID NO: 386058 - RNA, 19 nt, Homo sapiens
uagaauuguagaccuguaa

SEQ ID NO: 386059 - RNA, 19 nt, Homo sapiens
aaaugagccuggaauugag

SEQ ID NO: 386060 - RNA, 19 nt, Homo sapiens
gcgcuuaaccacacucucu

SEQ ID NO: 386061 - RNA, 19 nt, Homo sapiens
caccuuacaccgaguaugu

SEQ ID NO: 386062 - RNA, 19 nt, Homo sapiens
gggaaguugggcuguugua

SEQ ID NO: 386063 - RNA, 19 nt, Homo sapiens
gaggaggaaggcugaggaa

SEQ ID NO: 386064 - RNA, 19 nt, Homo sapiens
cagcaccuccugagaaagu

SEQ ID NO: 386065 - RNA, 19 nt, Homo sapiens
caugggcuuucauuucugu

SEQ ID NO: 386066 - RNA, 19 nt, Homo sapiens
uaccagggcguccguguga

SEQ ID NO: 386067 - RNA, 19 nt, Homo sapiens
guccaugggcuuucauuuc

SEQ ID NO: 386068 - RNA, 19 nt, Homo sapiens
gaggugggaggaugugaug

SEQ ID NO: 386069 - RNA, 19 nt, Homo sapiens
ccaccuccacccugcagua

SEQ ID NO: 386070 - RNA, 19 nt, Homo sapiens
caaacugucggcuucaaag

SEQ ID NO: 386071 - RNA, 19 nt, Homo sapiens
cgggaacccaggccuuuaa

SEQ ID NO: 386072 - RNA, 19 nt, Homo sapiens
ggugaaggguguguuuggu

SEQ ID NO: 386073 - RNA, 19 nt, Homo sapiens
acugucggcuucaaagaga

SEQ ID NO: 386074 - RNA, 19 nt, Homo sapiens
ggaaaugacuucagccaaa

SEQ ID NO: 386075 - RNA, 19 nt, Homo sapiens
ucaaggagcugcacaguug

SEQ ID NO: 386076 - RNA, 19 nt, Homo sapiens
gccaagaccuucaaacaaa

SEQ ID NO: 386077 - RNA, 19 nt, Homo sapiens
gcagcagacucaagaauga

SEQ ID NO: 386078 - RNA, 19 nt, Homo sapiens
caacauccguguggccuua

SEQ ID NO: 386079 - RNA, 19 nt, Homo sapiens
gaagaaacgcaccagcaua

SEQ ID NO: 386080 - RNA, 19 nt, Homo sapiens
ggauggagacggaacauuu

SEQ ID NO: 386081 - RNA, 19 nt, Homo sapiens
accagcagcucaccuauua

SEQ ID NO: 386082 - RNA, 19 nt, Homo sapiens
ggacagauaacugggcuua

SEQ ID NO: 386083 - RNA, 19 nt, Homo sapiens
ccaauggucuggacuuuca

SEQ ID NO: 386084 - RNA, 19 nt, Homo sapiens
gaaacuauauggaaaugac

SEQ ID NO: 386085 - RNA, 19 nt, Homo sapiens
cggaacauuugccuaauuu

SEQ ID NO: 386086 - RNA, 19 nt, Homo sapiens
gaacauuugccuaauuugu

SEQ ID NO: 386087 - RNA, 19 nt, Homo sapiens
caacacagcaaccgugauu

SEQ ID NO: 386088 - RNA, 19 nt, Homo sapiens
ccagaacucucucuucaca

SEQ ID NO: 386089 - RNA, 19 nt, Homo sapiens
ugacgaaucuuucaguuac

SEQ ID NO: 386090 - RNA, 19 nt, Homo sapiens
gcaacuacccucacaguca

SEQ ID NO: 386091 - RNA, 19 nt, Homo sapiens
ggaggacuuucuaaccaaa

SEQ ID NO: 386092 - RNA, 19 nt, Homo sapiens
caaagacgaaucaaacuug

SEQ ID NO: 386093 - RNA, 19 nt, Homo sapiens
aaacuaccaucucucgauu

SEQ ID NO: 386094 - RNA, 19 nt, Homo sapiens
gagcagcgagucaagauga

SEQ ID NO: 386095 - RNA, 19 nt, Homo sapiens
uaacugggcuuacuuugac

SEQ ID NO: 386096 - RNA, 19 nt, Homo sapiens
gaagcagccugugccugua

SEQ ID NO: 386097 - RNA, 19 nt, Homo sapiens
gauggcacccucacaguuu

SEQ ID NO: 386098 - RNA, 19 nt, Homo sapiens
uaccaucucucgauuugaa

SEQ ID NO: 386099 - RNA, 19 nt, Homo sapiens
ccaacucgcuggaacaagu

SEQ ID NO: 386100 - RNA, 19 nt, Homo sapiens
gaaaugacuucagccaaac

SEQ ID NO: 386101 - RNA, 19 nt, Homo sapiens
caaacaaagacgaaucaaa

SEQ ID NO: 386102 - RNA, 19 nt, Homo sapiens
aaacaaagacgaaucaaac

SEQ ID NO: 386103 - RNA, 19 nt, Homo sapiens
gaguggagauggcaacaca

SEQ ID NO: 386104 - RNA, 19 nt, Homo sapiens
gagaaguggcuaaaugaug

SEQ ID NO: 386105 - RNA, 19 nt, Homo sapiens
uugaggagcuugagcaguu

SEQ ID NO: 386106 - RNA, 19 nt, Homo sapiens
gaucagcucaauauggaaa

SEQ ID NO: 386107 - RNA, 19 nt, Homo sapiens
uuaagaacaugugcaaguu

SEQ ID NO: 386108 - RNA, 19 nt, Homo sapiens
gggaaacuauauggaaaug

SEQ ID NO: 386109 - RNA, 19 nt, Homo sapiens
gcucucagcccagcucuaa

SEQ ID NO: 386110 - RNA, 19 nt, Homo sapiens
aagaacaugugcaaguuga

SEQ ID NO: 386111 - RNA, 19 nt, Homo sapiens
gaauugauacucccagcuu

SEQ ID NO: 386112 - RNA, 19 nt, Homo sapiens
gcaacuaccucagcaaagc

SEQ ID NO: 386113 - RNA, 19 nt, Homo sapiens
agacggaacauuugccuaa

SEQ ID NO: 386114 - RNA, 19 nt, Homo sapiens
gcucaccuauuaaagcaau

SEQ ID NO: 386115 - RNA, 19 nt, Homo sapiens
gaaugaacaauccgucaga

SEQ ID NO: 386116 - RNA, 19 nt, Homo sapiens
acaccaaagcgaauugaua

SEQ ID NO: 386117 - RNA, 19 nt, Homo sapiens
acacacccauacacaauau

SEQ ID NO: 386118 - RNA, 19 nt, Homo sapiens
cagcagcucaccuauuaaa

SEQ ID NO: 386119 - RNA, 19 nt, Homo sapiens
ggacugccagccagguuaa

SEQ ID NO: 386120 - RNA, 19 nt, Homo sapiens
ggaagaaacgcaccagcau

SEQ ID NO: 386121 - RNA, 19 nt, Homo sapiens
caacugggaaccugguauu

SEQ ID NO: 386122 - RNA, 19 nt, Homo sapiens
gugacgaaucuuucaguua

SEQ ID NO: 386123 - RNA, 19 nt, Homo sapiens
cugaucagcucaauaugga

SEQ ID NO: 386124 - RNA, 19 nt, Homo sapiens
gcuaaaugaugcagagaac

SEQ ID NO: 386125 - RNA, 19 nt, Homo sapiens
gccuugaaccucagcuuua

SEQ ID NO: 386126 - RNA, 19 nt, Homo sapiens
gcugcucagucuuuaaaug

SEQ ID NO: 386127 - RNA, 19 nt, Homo sapiens
gauggagacggaacauuug

SEQ ID NO: 386128 - RNA, 19 nt, Homo sapiens
ccuugaaccucagcuuuaa

SEQ ID NO: 386129 - RNA, 19 nt, Homo sapiens
ccagguuaauaaacugaaa

SEQ ID NO: 386130 - RNA, 19 nt, Homo sapiens
ggugacagcaucagguuug

SEQ ID NO: 386131 - RNA, 19 nt, Homo sapiens
cagcucaccuauuaaagca

SEQ ID NO: 386132 - RNA, 19 nt, Homo sapiens
aaagaggugauucguguuu

SEQ ID NO: 386133 - RNA, 19 nt, Homo sapiens
gcaccagcauagagaccaa

SEQ ID NO: 386134 - RNA, 19 nt, Homo sapiens
uagagaaguggcuaaauga

SEQ ID NO: 386135 - RNA, 19 nt, Homo sapiens
ugguggcucucuuccaaua

SEQ ID NO: 386136 - RNA, 19 nt, Homo sapiens
gagaccagcacaacacaga

SEQ ID NO: 386137 - RNA, 19 nt, Homo sapiens
gacaccaccuccaacaaca

SEQ ID NO: 386138 - RNA, 19 nt, Homo sapiens
aaccucagcuuuaagaaca

SEQ ID NO: 386139 - RNA, 19 nt, Homo sapiens
cacaggaucuucaacaacu

SEQ ID NO: 386140 - RNA, 19 nt, Homo sapiens
caaacuaccaucucucgau

SEQ ID NO: 386141 - RNA, 19 nt, Homo sapiens
ccaagaccuucaaacaaag

SEQ ID NO: 386142 - RNA, 19 nt, Homo sapiens
gaaaccaguaaaccaucua

SEQ ID NO: 386143 - RNA, 19 nt, Homo sapiens
gaaacgcaccagcauagag

SEQ ID NO: 386144 - RNA, 19 nt, Homo sapiens
ccagccagguuaauaaacu

SEQ ID NO: 386145 - RNA, 19 nt, Homo sapiens
agaacucucucuucacagu

SEQ ID NO: 386146 - RNA, 19 nt, Homo sapiens
agggaacucugcaccugua

SEQ ID NO: 386147 - RNA, 19 nt, Homo sapiens
gaacaugugcaaguugaag

SEQ ID NO: 386148 - RNA, 19 nt, Homo sapiens
cauacacaauauaccagaa

SEQ ID NO: 386149 - RNA, 19 nt, Homo sapiens
gaccagcagcucaccuauu

SEQ ID NO: 386150 - RNA, 19 nt, Homo sapiens
gaaccucagcuuuaagaac

SEQ ID NO: 386151 - RNA, 19 nt, Homo sapiens
gcucagucuuuaaauguac

SEQ ID NO: 386152 - RNA, 19 nt, Homo sapiens
aaacgcaccagcauagaga

SEQ ID NO: 386153 - RNA, 19 nt, Homo sapiens
acuaccaucucucgauuug

SEQ ID NO: 386154 - RNA, 19 nt, Homo sapiens
cagccaaacuaccaucucu

SEQ ID NO: 386155 - RNA, 19 nt, Homo sapiens
ccacagagccagucaacac

SEQ ID NO: 386156 - RNA, 19 nt, Homo sapiens
acggaacauuugccuaauu

SEQ ID NO: 386157 - RNA, 19 nt, Homo sapiens
ccacacacacccauacaca

SEQ ID NO: 386158 - RNA, 19 nt, Homo sapiens
gaaccugguauuugccaau

SEQ ID NO: 386159 - RNA, 19 nt, Homo sapiens
ucugguggcucucuuccaa

SEQ ID NO: 386160 - RNA, 19 nt, Homo sapiens
cagaccaccuccacuccuu

SEQ ID NO: 386161 - RNA, 19 nt, Homo sapiens
uaagaacaugugcaaguug

SEQ ID NO: 386162 - RNA, 19 nt, Homo sapiens
gcacaggaucuucaacaac

SEQ ID NO: 386163 - RNA, 19 nt, Homo sapiens
caaaggagagaagggagaa

SEQ ID NO: 386164 - RNA, 19 nt, Homo sapiens
gugcugcugugacgaaucu

SEQ ID NO: 386165 - RNA, 19 nt, Homo sapiens
gagucaagaugagaguuca

SEQ ID NO: 386166 - RNA, 19 nt, Homo sapiens
gaaccucucaucugauucg

SEQ ID NO: 386167 - RNA, 19 nt, Homo sapiens
gaacaauccgucagaaacc

SEQ ID NO: 386168 - RNA, 19 nt, Homo sapiens
acagauaacugggcuuacu

SEQ ID NO: 386169 - RNA, 19 nt, Homo sapiens
acacacacccauacacaau

SEQ ID NO: 386170 - RNA, 19 nt, Homo sapiens
gcccaagugcccugaauuc

SEQ ID NO: 386171 - RNA, 19 nt, Homo sapiens
gauaacugggcuuacuuug

SEQ ID NO: 386172 - RNA, 19 nt, Homo sapiens
gacggaacauuugccuaau

SEQ ID NO: 386173 - RNA, 19 nt, Homo sapiens
acacagcaaccgugauuuc

SEQ ID NO: 386174 - RNA, 19 nt, Homo sapiens
gaaagaaacuaaccaacaa

SEQ ID NO: 386175 - RNA, 19 nt, Homo sapiens
gaaauggaccagacacuaa

SEQ ID NO: 386176 - RNA, 19 nt, Homo sapiens
gcacaacaguuacuaccuu

SEQ ID NO: 386177 - RNA, 19 nt, Homo sapiens
ggaaagaaacuaaccaaca

SEQ ID NO: 386178 - RNA, 19 nt, Homo sapiens
ggaccagcaucgagacaaa

SEQ ID NO: 386179 - RNA, 19 nt, Homo sapiens
uggaggagcuggagcaauu

SEQ ID NO: 386180 - RNA, 19 nt, Homo sapiens
gcacacagacaccgaaaga

SEQ ID NO: 386181 - RNA, 19 nt, Homo sapiens
gaaauaagaaugucuaagc

SEQ ID NO: 386182 - RNA, 19 nt, Homo sapiens
cacaacaguuacuaccuua

SEQ ID NO: 386183 - RNA, 19 nt, Homo sapiens
agucugagcacaacaguua

SEQ ID NO: 386184 - RNA, 19 nt, Homo sapiens
gaccagacacuaaucauca

SEQ ID NO: 386185 - RNA, 19 nt, Homo sapiens
acacagacaccgaaagaaa

SEQ ID NO: 386186 - RNA, 19 nt, Homo sapiens
gaacaugugcaaacucaag

SEQ ID NO: 386187 - RNA, 19 nt, Homo sapiens
caaaggaaccagaggugaa

SEQ ID NO: 386188 - RNA, 19 nt, Homo sapiens
gcucaacgaugcagagacu

SEQ ID NO: 386189 - RNA, 19 nt, Homo sapiens
aaccugagcuucaagaaca

SEQ ID NO: 386190 - RNA, 19 nt, Homo sapiens
gaaagaaauggaccagaca

SEQ ID NO: 386191 - RNA, 19 nt, Homo sapiens
gaaacuaaccaacaaaaga

SEQ ID NO: 386192 - RNA, 19 nt, Homo sapiens
aaacguccgcuucgccuua

SEQ ID NO: 386193 - RNA, 19 nt, Homo sapiens
aagaacaugugcaaacuca

SEQ ID NO: 386194 - RNA, 19 nt, Homo sapiens
ccagaaauaagaaugucua

SEQ ID NO: 386195 - RNA, 19 nt, Homo sapiens
gaaaccagcugccccaaag

SEQ ID NO: 386196 - RNA, 19 nt, Homo sapiens
ccgagcagcugcacaugga

SEQ ID NO: 386197 - RNA, 19 nt, Homo sapiens
gcaagaagaggaccagcau

SEQ ID NO: 386198 - RNA, 19 nt, Homo sapiens
ccucgccgcucuucuugaa

SEQ ID NO: 386199 - RNA, 19 nt, Homo sapiens
ccagccaccugcucaguuc

SEQ ID NO: 386200 - RNA, 19 nt, Homo sapiens
caacaguuacuaccuuauc

SEQ ID NO: 386201 - RNA, 19 nt, Homo sapiens
ucaagaacaugugcaaacu

SEQ ID NO: 386202 - RNA, 19 nt, Homo sapiens
gacuaugucuguggacuca

SEQ ID NO: 386203 - RNA, 19 nt, Homo sapiens
ggaccagacacuaaucauc

SEQ ID NO: 386204 - RNA, 19 nt, Homo sapiens
ggccggagacgcaagaaga

SEQ ID NO: 386205 - RNA, 19 nt, Homo sapiens
ccucagagcaggagugaca

SEQ ID NO: 386206 - RNA, 19 nt, Homo sapiens
gcacauggagaaggaagug

SEQ ID NO: 386207 - RNA, 19 nt, Homo sapiens
agaaauggaccagacacua

SEQ ID NO: 386208 - RNA, 19 nt, Homo sapiens
aaaggaaccagaggugaaa

SEQ ID NO: 386209 - RNA, 19 nt, Homo sapiens
cuaccgacaccaaaucuau

SEQ ID NO: 386210 - RNA, 19 nt, Homo sapiens
ggagaaguggcucaacgau

SEQ ID NO: 386211 - RNA, 19 nt, Homo sapiens
gagcacacagacaccgaaa

SEQ ID NO: 386212 - RNA, 19 nt, Homo sapiens
ggagugacaagggaggaaa

SEQ ID NO: 386213 - RNA, 19 nt, Homo sapiens
caaagaucaaggcugaaga

SEQ ID NO: 386214 - RNA, 19 nt, Homo sapiens
caacaaaagagaaaaccaa

SEQ ID NO: 386215 - RNA, 19 nt, Homo sapiens
ccgcucuucuugaaucaug

SEQ ID NO: 386216 - RNA, 19 nt, Homo sapiens
cacagacaccgaaagaaau

SEQ ID NO: 386217 - RNA, 19 nt, Homo sapiens
aaaauaagaccuccccauu

SEQ ID NO: 386218 - RNA, 19 nt, Homo sapiens
gcucuacggcaacgacuuc

SEQ ID NO: 386219 - RNA, 19 nt, Homo sapiens
ugaccucgccgcucuucuu

SEQ ID NO: 386220 - RNA, 19 nt, Homo sapiens
gguggaacccugccccuua

SEQ ID NO: 386221 - RNA, 19 nt, Homo sapiens
gaaggagaaacgcaucaac

SEQ ID NO: 386222 - RNA, 19 nt, Homo sapiens
ucaacgaugcagagacuau

SEQ ID NO: 386223 - RNA, 19 nt, Homo sapiens
acagacaccgaaagaaaug

SEQ ID NO: 386224 - RNA, 19 nt, Homo sapiens
caagggaggaaagaccaaa

SEQ ID NO: 386225 - RNA, 19 nt, Homo sapiens
cagccuccaucuccagcaa

SEQ ID NO: 386226 - RNA, 19 nt, Homo sapiens
accagaagccuaccucaga

SEQ ID NO: 386227 - RNA, 19 nt, Homo sapiens
gcuccagaaauaagaaugu

SEQ ID NO: 386228 - RNA, 19 nt, Homo sapiens
gaccucgccgcucuucuug

SEQ ID NO: 386229 - RNA, 19 nt, Homo sapiens
caacgaugcagagacuaug

SEQ ID NO: 386230 - RNA, 19 nt, Homo sapiens
ucgccgcucuucuugaauc

SEQ ID NO: 386231 - RNA, 19 nt, Homo sapiens
caagcuuccagcagucuga

SEQ ID NO: 386232 - RNA, 19 nt, Homo sapiens
aauaagaccuccccauucu

SEQ ID NO: 386233 - RNA, 19 nt, Homo sapiens
gcaaacccagggagcucuu

SEQ ID NO: 386234 - RNA, 19 nt, Homo sapiens
aaauggaccagacacuaau

SEQ ID NO: 386235 - RNA, 19 nt, Homo sapiens
caagcaacgccgcaucaag

SEQ ID NO: 386236 - RNA, 19 nt, Homo sapiens
ggaaauagccaaagcuuua

SEQ ID NO: 386237 - RNA, 19 nt, Homo sapiens
gcuuuaaucuagccuaauu

SEQ ID NO: 386238 - RNA, 19 nt, Homo sapiens
gaaauagccaaagcuuuaa

SEQ ID NO: 386239 - RNA, 19 nt, Homo sapiens
ccaccaaccuggacaagau

SEQ ID NO: 386240 - RNA, 19 nt, Homo sapiens
agccaaagcuuuaaucuag

SEQ ID NO: 386241 - RNA, 19 nt, Homo sapiens
ucaagccgcugcucaacaa

SEQ ID NO: 386242 - RNA, 19 nt, Homo sapiens
gcaagaagcgcacguccau

SEQ ID NO: 386243 - RNA, 19 nt, Homo sapiens
gagccgcgucuguguauaa

SEQ ID NO: 386244 - RNA, 19 nt, Homo sapiens
gcucuacgguaacguguuc

SEQ ID NO: 386245 - RNA, 19 nt, Homo sapiens
gagcgaagauccggaacuc

SEQ ID NO: 386246 - RNA, 19 nt, Homo sapiens
cagcacagcgcaccacuug

SEQ ID NO: 386247 - RNA, 19 nt, Homo sapiens
acacgccucuucucuccua

SEQ ID NO: 386248 - RNA, 19 nt, Homo sapiens
ggacgaagcgaggagaguu

SEQ ID NO: 386249 - RNA, 19 nt, Homo sapiens
gagagccgcgucuguguau

SEQ ID NO: 386250 - RNA, 19 nt, Homo sapiens
cggacgaccuggagcaguu

SEQ ID NO: 386251 - RNA, 19 nt, Homo sapiens
aagcuuuaaucuagccuaa

SEQ ID NO: 386252 - RNA, 19 nt, Homo sapiens
gccugcagcuggagaagga

SEQ ID NO: 386253 - RNA, 19 nt, Homo sapiens
ggagagaggagcgaagauc

SEQ ID NO: 386254 - RNA, 19 nt, Homo sapiens
ugggcacgcucuacgguaa

SEQ ID NO: 386255 - RNA, 19 nt, Homo sapiens
gcaguucgccaagcaguuc

SEQ ID NO: 386256 - RNA, 19 nt, Homo sapiens
gcccauggacgauguauac

SEQ ID NO: 386257 - RNA, 19 nt, Homo sapiens
gaacaugugcaagcucaag

SEQ ID NO: 386258 - RNA, 19 nt, Homo sapiens
uagccaaagcuuuaaucua

SEQ ID NO: 386259 - RNA, 19 nt, Homo sapiens
cgagagccgcgucugugua

SEQ ID NO: 386260 - RNA, 19 nt, Homo sapiens
ucaagaacaugugcaagcu

SEQ ID NO: 386261 - RNA, 19 nt, Homo sapiens
guucgguugcuuuggauuu

SEQ ID NO: 386262 - RNA, 19 nt, Homo sapiens
caggaaauagccaaagcuu

SEQ ID NO: 386263 - RNA, 19 nt, Homo sapiens
ccaccccgcuuuccccuuu

SEQ ID NO: 386264 - RNA, 19 nt, Homo sapiens
gcgaagugcagaagcugau

SEQ ID NO: 386265 - RNA, 19 nt, Homo sapiens
cagaaggagaagcgcauga

SEQ ID NO: 386266 - RNA, 19 nt, Homo sapiens
ggagagccauuuccucaaa

SEQ ID NO: 386267 - RNA, 19 nt, Homo sapiens
acacuggacuauccuuuaa

SEQ ID NO: 386268 - RNA, 19 nt, Homo sapiens
gguagcagguguaaugaug

SEQ ID NO: 386269 - RNA, 19 nt, Homo sapiens
caacuaagacacuggacua

SEQ ID NO: 386270 - RNA, 19 nt, Homo sapiens
gcuuacagcuggagaagga

SEQ ID NO: 386271 - RNA, 19 nt, Homo sapiens
ugugauagcuagaaagaga

SEQ ID NO: 386272 - RNA, 19 nt, Homo sapiens
gcaauggaguggagugucu

SEQ ID NO: 386273 - RNA, 19 nt, Homo sapiens
gcaagcacugagauaaaua

SEQ ID NO: 386274 - RNA, 19 nt, Homo sapiens
aaagguagcagguguaaug

SEQ ID NO: 386275 - RNA, 19 nt, Homo sapiens
ggcaagcacugagauaaau

SEQ ID NO: 386276 - RNA, 19 nt, Homo sapiens
gugaggagagugugugaua

SEQ ID NO: 386277 - RNA, 19 nt, Homo sapiens
gacacuggacuauccuuua

SEQ ID NO: 386278 - RNA, 19 nt, Homo sapiens
ugugcaagcugaagccuuu

SEQ ID NO: 386279 - RNA, 19 nt, Homo sapiens
gcugcuguguuuauuuauu

SEQ ID NO: 386280 - RNA, 19 nt, Homo sapiens
agaaggagguggugagagu

SEQ ID NO: 386281 - RNA, 19 nt, Homo sapiens
ggagagagaggagacagaa

SEQ ID NO: 386282 - RNA, 19 nt, Homo sapiens
augcugcuguguuuauuua

SEQ ID NO: 386283 - RNA, 19 nt, Homo sapiens
cagguguaaugauguguuu

SEQ ID NO: 386284 - RNA, 19 nt, Homo sapiens
ggaaagcaacuaagacacu

SEQ ID NO: 386285 - RNA, 19 nt, Homo sapiens
gaccuuugcaggcgaguaa

SEQ ID NO: 386286 - RNA, 19 nt, Homo sapiens
ccacgagcauagacaagau

SEQ ID NO: 386287 - RNA, 19 nt, Homo sapiens
ggaucaaacugggauuuac

SEQ ID NO: 386288 - RNA, 19 nt, Homo sapiens
caccaaaccaugauaaaca

SEQ ID NO: 386289 - RNA, 19 nt, Homo sapiens
gagauaaauaccuggcaaa

SEQ ID NO: 386290 - RNA, 19 nt, Homo sapiens
gauggcaagcacugagaua

SEQ ID NO: 386291 - RNA, 19 nt, Homo sapiens
aaaaguaacugucaaaugc

SEQ ID NO: 386292 - RNA, 19 nt, Homo sapiens
gagagaggagacagaaaga

SEQ ID NO: 386293 - RNA, 19 nt, Homo sapiens
gcaaaaggaaagcaacuaa

SEQ ID NO: 386294 - RNA, 19 nt, Homo sapiens
cggacgaccuggagcaguu

SEQ ID NO: 386295 - RNA, 19 nt, Homo sapiens
gcagcuuccugaugcuuag

SEQ ID NO: 386296 - RNA, 19 nt, Homo sapiens
cugcuguguuuauuuauug

SEQ ID NO: 386297 - RNA, 19 nt, Homo sapiens
aaagagagagagacagaga

SEQ ID NO: 386298 - RNA, 19 nt, Homo sapiens
agaaagagagagagacaga

SEQ ID NO: 386299 - RNA, 19 nt, Homo sapiens
cuaagacacuggacuaucc

SEQ ID NO: 386300 - RNA, 19 nt, Homo sapiens
ggagagugugugauagcua

SEQ ID NO: 386301 - RNA, 19 nt, Homo sapiens
ggagaaggagguggugaga

SEQ ID NO: 386302 - RNA, 19 nt, Homo sapiens
gaacaugugcaagcugaag

SEQ ID NO: 386303 - RNA, 19 nt, Homo sapiens
gcaguucgccaagcaguuc

SEQ ID NO: 386304 - RNA, 19 nt, Homo sapiens
agagagagacagagagaug

SEQ ID NO: 386305 - RNA, 19 nt, Homo sapiens
uagcagguguaaugaugug

SEQ ID NO: 386306 - RNA, 19 nt, Homo sapiens
gcugaagccuuuguugaac

SEQ ID NO: 386307 - RNA, 19 nt, Homo sapiens
cgaguaaccaggcaaugga

SEQ ID NO: 386308 - RNA, 19 nt, Homo sapiens
cuuguucccucucuaacuu

SEQ ID NO: 386309 - RNA, 19 nt, Homo sapiens
guaacaggagacagaaaga

SEQ ID NO: 386310 - RNA, 19 nt, Homo sapiens
gagauggcaagcacugaga

SEQ ID NO: 386311 - RNA, 19 nt, Homo sapiens
gcagguguaaugauguguu

SEQ ID NO: 386312 - RNA, 19 nt, Homo sapiens
gagagagaggagacagaaa

SEQ ID NO: 386313 - RNA, 19 nt, Homo sapiens
cggaucaaacugggauuua

SEQ ID NO: 386314 - RNA, 19 nt, Homo sapiens
caaaccaugauaaacacaa

SEQ ID NO: 386315 - RNA, 19 nt, Homo sapiens
uggcaagcacugagauaaa

SEQ ID NO: 386316 - RNA, 19 nt, Homo sapiens
caggagacagaaagagaaa

SEQ ID NO: 386317 - RNA, 19 nt, Homo sapiens
gcaagcugaagccuuuguu

SEQ ID NO: 386318 - RNA, 19 nt, Homo sapiens
ucaagaacaugugcaagcu

SEQ ID NO: 386319 - RNA, 19 nt, Homo sapiens
gcucugggcacccuguaug

SEQ ID NO: 386320 - RNA, 19 nt, Homo sapiens
aagcugaagccuuuguuga

SEQ ID NO: 386321 - RNA, 19 nt, Homo sapiens
auaaauaccuggcaaaacu

SEQ ID NO: 386322 - RNA, 19 nt, Homo sapiens
gcacgacgagccacaccau

SEQ ID NO: 386323 - RNA, 19 nt, Homo sapiens
gagagagugaggagagugu

SEQ ID NO: 386324 - RNA, 19 nt, Homo sapiens
gaaggagguggugagaguu

SEQ ID NO: 386325 - RNA, 19 nt, Homo sapiens
agagagagagacagagaga

SEQ ID NO: 386326 - RNA, 19 nt, Homo sapiens
ucucuaacuucugauuguu

SEQ ID NO: 386327 - RNA, 19 nt, Homo sapiens
caagcugaagccuuuguug

SEQ ID NO: 386328 - RNA, 19 nt, Homo sapiens
ccgcagcgucuaaccacua

SEQ ID NO: 386329 - RNA, 19 nt, Homo sapiens
uuaaagguagcagguguaa

SEQ ID NO: 386330 - RNA, 19 nt, Homo sapiens
gaccaccaucugcagguuu

SEQ ID NO: 386331 - RNA, 19 nt, Homo sapiens
gcggaucaaacugggauuu

SEQ ID NO: 386332 - RNA, 19 nt, Homo sapiens
ugaggagagugugugauag

SEQ ID NO: 386333 - RNA, 19 nt, Homo sapiens
ccucuuguucccucucuaa

SEQ ID NO: 386334 - RNA, 19 nt, Homo sapiens
gguggugagaguuugguuu

SEQ ID NO: 386335 - RNA, 19 nt, Homo sapiens
agagagaggagacagaaag

SEQ ID NO: 386336 - RNA, 19 nt, Homo sapiens
aaggaaagcaacuaagaca

SEQ ID NO: 386337 - RNA, 19 nt, Homo sapiens
cuagaaagagagagagaca

SEQ ID NO: 386338 - RNA, 19 nt, Homo sapiens
gcgaguaaccaggcaaugg

SEQ ID NO: 386339 - RNA, 19 nt, Homo sapiens
acaggagacagaaagagaa

SEQ ID NO: 386340 - RNA, 19 nt, Homo sapiens
acaugcugcuguguuuauu

SEQ ID NO: 386341 - RNA, 19 nt, Homo sapiens
caagcacugagauaaauac

SEQ ID NO: 386342 - RNA, 19 nt, Homo sapiens
gagagauggcaagcacuga

SEQ ID NO: 386343 - RNA, 19 nt, Homo sapiens
gagugaggagaguguguga

SEQ ID NO: 386344 - RNA, 19 nt, Homo sapiens
gggagagagaggagacaga

SEQ ID NO: 386345 - RNA, 19 nt, Homo sapiens
agacacuggacuauccuuu

SEQ ID NO: 386346 - RNA, 19 nt, Homo sapiens
aaaaggaaagcaacuaaga

SEQ ID NO: 386347 - RNA, 19 nt, Homo sapiens
gcaagggcgcaagcggaaa

SEQ ID NO: 386348 - RNA, 19 nt, Homo sapiens
gcaagaagcggaccucuau

SEQ ID NO: 386349 - RNA, 19 nt, Homo sapiens
ccacaagcaucgacaagau

SEQ ID NO: 386350 - RNA, 19 nt, Homo sapiens
ucaagccgcugcugaacaa

SEQ ID NO: 386351 - RNA, 19 nt, Homo sapiens
gcagacgagcguucaguga

SEQ ID NO: 386352 - RNA, 19 nt, Homo sapiens
cggacgaccuggagcaguu

SEQ ID NO: 386353 - RNA, 19 nt, Homo sapiens
gccugcagcucgagaagga

SEQ ID NO: 386354 - RNA, 19 nt, Homo sapiens
ggagagccacuuccucaag

SEQ ID NO: 386355 - RNA, 19 nt, Homo sapiens
gaacaugugcaagcucaag

SEQ ID NO: 386356 - RNA, 19 nt, Homo sapiens
gcaguucgccaagcaguuc

SEQ ID NO: 386357 - RNA, 19 nt, Homo sapiens
ucaagaacaugugcaagcu

SEQ ID NO: 386358 - RNA, 19 nt, Homo sapiens
gacccguccucugucaaga

SEQ ID NO: 386359 - RNA, 19 nt, Homo sapiens
gaacugggcucgcaccauu

SEQ ID NO: 386360 - RNA, 19 nt, Homo sapiens
cauaagagguucuaacuuc

SEQ ID NO: 386361 - RNA, 19 nt, Homo sapiens
gccaaacaauucaaacaaa

SEQ ID NO: 386362 - RNA, 19 nt, Homo sapiens
gcaccgaacccgucuauca

SEQ ID NO: 386363 - RNA, 19 nt, Homo sapiens
agacacaucuugccaugau

SEQ ID NO: 386364 - RNA, 19 nt, Homo sapiens
gugcgugucugguucugua

SEQ ID NO: 386365 - RNA, 19 nt, Homo sapiens
ccaaacaauucaaacaaag

SEQ ID NO: 386366 - RNA, 19 nt, Homo sapiens
uaacuucuguugacaaagg

SEQ ID NO: 386367 - RNA, 19 nt, Homo sapiens
ggccacagcugccucgaau

SEQ ID NO: 386368 - RNA, 19 nt, Homo sapiens
gcaagaagcggaccuccau

SEQ ID NO: 386369 - RNA, 19 nt, Homo sapiens
ggagacgcauuuccucaag

SEQ ID NO: 386370 - RNA, 19 nt, Homo sapiens
acacguagcccaccacuca

SEQ ID NO: 386371 - RNA, 19 nt, Homo sapiens
ggauuuccuuucucucuca

SEQ ID NO: 386372 - RNA, 19 nt, Homo sapiens
ucuaacuucuguugacaaa

SEQ ID NO: 386373 - RNA, 19 nt, Homo sapiens
gggaucagcagccgcauga

SEQ ID NO: 386374 - RNA, 19 nt, Homo sapiens
gaccagcauugacaagauc

SEQ ID NO: 386375 - RNA, 19 nt, Homo sapiens
gcaacugggugcgaucauc

SEQ ID NO: 386376 - RNA, 19 nt, Homo sapiens
ucucuuuccuuucauucua

SEQ ID NO: 386377 - RNA, 19 nt, Homo sapiens
cgaccagcauugacaagau

SEQ ID NO: 386378 - RNA, 19 nt, Homo sapiens
cugaugaguuggaacaguu

SEQ ID NO: 386379 - RNA, 19 nt, Homo sapiens
acaaagaagaaucaaguug

SEQ ID NO: 386380 - RNA, 19 nt, Homo sapiens
ccgcaacccucagaaacuu

SEQ ID NO: 386381 - RNA, 19 nt, Homo sapiens
gagguucuaacuucuguug

SEQ ID NO: 386382 - RNA, 19 nt, Homo sapiens
acaguucgccaaacaauuc

SEQ ID NO: 386383 - RNA, 19 nt, Homo sapiens
ugacaaaggaaacacauac

SEQ ID NO: 386384 - RNA, 19 nt, Homo sapiens
agacgcauuuccucaagug

SEQ ID NO: 386385 - RNA, 19 nt, Homo sapiens
gagacgcauuuccucaagu

SEQ ID NO: 386386 - RNA, 19 nt, Homo sapiens
ugggcacacuguaugguaa

SEQ ID NO: 386387 - RNA, 19 nt, Homo sapiens
guucuguaaucgaagacaa

SEQ ID NO: 386388 - RNA, 19 nt, Homo sapiens
ucucguacucucucucuuu

SEQ ID NO: 386389 - RNA, 19 nt, Homo sapiens
gcgcugggcacacuguaug

SEQ ID NO: 386390 - RNA, 19 nt, Homo sapiens
ccuacagcauucucaguuc

SEQ ID NO: 386391 - RNA, 19 nt, Homo sapiens
gcagccgcaugagguuuau

SEQ ID NO: 386392 - RNA, 19 nt, Homo sapiens
ugggugcgaucauccauca

SEQ ID NO: 386393 - RNA, 19 nt, Homo sapiens
guucuaacuucuguugaca

SEQ ID NO: 386394 - RNA, 19 nt, Homo sapiens
gguucuaacuucuguugac

SEQ ID NO: 386395 - RNA, 19 nt, Homo sapiens
aagagguucuaacuucugu

SEQ ID NO: 386396 - RNA, 19 nt, Homo sapiens
caaacaaagaagaaucaag

SEQ ID NO: 386397 - RNA, 19 nt, Homo sapiens
ucaccgcucgccacacgua

SEQ ID NO: 386398 - RNA, 19 nt, Homo sapiens
agaaucaaguugggcuuca

SEQ ID NO: 386399 - RNA, 19 nt, Homo sapiens
cgccaaacaauucaaacaa

SEQ ID NO: 386400 - RNA, 19 nt, Homo sapiens
gcgcgaagaccugcaacug

SEQ ID NO: 386401 - RNA, 19 nt, Homo sapiens
auaagagguucuaacuucu

SEQ ID NO: 386402 - RNA, 19 nt, Homo sapiens
ggcagacagccuccaguug

SEQ ID NO: 386403 - RNA, 19 nt, Homo sapiens
uaagagguucuaacuucug

SEQ ID NO: 386404 - RNA, 19 nt, Homo sapiens
ucccuuuccuuuccuuuca

SEQ ID NO: 386405 - RNA, 19 nt, Homo sapiens
ucauaagagguucuaacuu

SEQ ID NO: 386406 - RNA, 19 nt, Homo sapiens
gccaaccccucaacgugua

SEQ ID NO: 386407 - RNA, 19 nt, Homo sapiens
ccucgaaucccuacagcau

SEQ ID NO: 386408 - RNA, 19 nt, Homo sapiens
gguagaaccuuucaacaaa

SEQ ID NO: 386409 - RNA, 19 nt, Homo sapiens
uaacaagacugaaaucaug

SEQ ID NO: 386410 - RNA, 19 nt, Homo sapiens
gaacaagccugagcucuuc

SEQ ID NO: 386411 - RNA, 19 nt, Homo sapiens
guaauaaucagguaccuua

SEQ ID NO: 386412 - RNA, 19 nt, Homo sapiens
ugaaaugucucacggauug

SEQ ID NO: 386413 - RNA, 19 nt, Homo sapiens
gaaauucucugccacuuac

SEQ ID NO: 386414 - RNA, 19 nt, Homo sapiens
gaggcuggcugcuugcuua

SEQ ID NO: 386415 - RNA, 19 nt, Homo sapiens
gcaaacauucuaugcauuu

SEQ ID NO: 386416 - RNA, 19 nt, Homo sapiens
gaaagaaacacaauuaggu

SEQ ID NO: 386417 - RNA, 19 nt, Homo sapiens
caacaaacaaccaaacaaa

SEQ ID NO: 386418 - RNA, 19 nt, Homo sapiens
ugaaagguguggaaagaaa

SEQ ID NO: 386419 - RNA, 19 nt, Homo sapiens
ucguagagaugguuuguua

SEQ ID NO: 386420 - RNA, 19 nt, Homo sapiens
uggaggacaugaaauuaua

SEQ ID NO: 386421 - RNA, 19 nt, Homo sapiens
ccaaggaacuauguacaaa

SEQ ID NO: 386422 - RNA, 19 nt, Homo sapiens
cagagacacuuaccuaaau

SEQ ID NO: 386423 - RNA, 19 nt, Homo sapiens
gaagagcaguuuuaugauu

SEQ ID NO: 386424 - RNA, 19 nt, Homo sapiens
ggauugaucuaccugucua

SEQ ID NO: 386425 - RNA, 19 nt, Homo sapiens
ucaaagaggucugcauguu

SEQ ID NO: 386426 - RNA, 19 nt, Homo sapiens
gaacgagacucaucuugcu

SEQ ID NO: 386427 - RNA, 19 nt, Homo sapiens
guggaaagaaacacaauua

SEQ ID NO: 386428 - RNA, 19 nt, Homo sapiens
guugagaaguuccugcuuu

SEQ ID NO: 386429 - RNA, 19 nt, Homo sapiens
ccaguacacuuacaaaaua

SEQ ID NO: 386430 - RNA, 19 nt, Homo sapiens
gaaacacaauuaggucuca

SEQ ID NO: 386431 - RNA, 19 nt, Homo sapiens
gagcacagcugaaaagaga

SEQ ID NO: 386432 - RNA, 19 nt, Homo sapiens
gccauaaucugcaacuuca

SEQ ID NO: 386433 - RNA, 19 nt, Homo sapiens
ggcuagagcugucggagaa

SEQ ID NO: 386434 - RNA, 19 nt, Homo sapiens
ugaucuaccugucuaugua

SEQ ID NO: 386435 - RNA, 19 nt, Homo sapiens
agagagagguuuaaacuac

SEQ ID NO: 386436 - RNA, 19 nt, Homo sapiens
gggcaaacauucuaugcau

SEQ ID NO: 386437 - RNA, 19 nt, Homo sapiens
uaucaaagcuaguuguucu

SEQ ID NO: 386438 - RNA, 19 nt, Homo sapiens
gcacuaaacugggcuagcu

SEQ ID NO: 386439 - RNA, 19 nt, Homo sapiens
gggcauagucuuugagcua

SEQ ID NO: 386440 - RNA, 19 nt, Homo sapiens
agagacacuuaccuaaaua

SEQ ID NO: 386441 - RNA, 19 nt, Homo sapiens
acaagcugcugguggauuu

SEQ ID NO: 386442 - RNA, 19 nt, Homo sapiens
ggacuuggcugugagaaaa

SEQ ID NO: 386443 - RNA, 19 nt, Homo sapiens
gaacaaaagcaaaggaaaa

SEQ ID NO: 386444 - RNA, 19 nt, Homo sapiens
caagagccauccuuucaag

SEQ ID NO: 386445 - RNA, 19 nt, Homo sapiens
ccacgaugauguccaugaa

SEQ ID NO: 386446 - RNA, 19 nt, Homo sapiens
gaccagagacacuuaccua

SEQ ID NO: 386447 - RNA, 19 nt, Homo sapiens
ggauuuggaguguccguua

SEQ ID NO: 386448 - RNA, 19 nt, Homo sapiens
gaacuuuaauuugcacuac

SEQ ID NO: 386449 - RNA, 19 nt, Homo sapiens
ggauaaauguuggguagca

SEQ ID NO: 386450 - RNA, 19 nt, Homo sapiens
caaagaggucugcauguug

SEQ ID NO: 386451 - RNA, 19 nt, Homo sapiens
ugucgaagaucuaguuuua

SEQ ID NO: 386452 - RNA, 19 nt, Homo sapiens
aagagcaccaccauuauua

SEQ ID NO: 386453 - RNA, 19 nt, Homo sapiens
ugagcuuucuccuugguua

SEQ ID NO: 386454 - RNA, 19 nt, Homo sapiens
guaggaaaauggacuguuu

SEQ ID NO: 386455 - RNA, 19 nt, Homo sapiens
gaaaagaggaagacagauu

SEQ ID NO: 386456 - RNA, 19 nt, Homo sapiens
ccagagacacuuaccuaaa

SEQ ID NO: 386457 - RNA, 19 nt, Homo sapiens
ucacucugguuaggcauua

SEQ ID NO: 386458 - RNA, 19 nt, Homo sapiens
ggaaagaaacacaauuagg

SEQ ID NO: 386459 - RNA, 19 nt, Homo sapiens
uaaaaugccugcuuugugu

SEQ ID NO: 386460 - RNA, 19 nt, Homo sapiens
cuaccagucucccaaauag

SEQ ID NO: 386461 - RNA, 19 nt, Homo sapiens
ggaagacagauuuaaagug

SEQ ID NO: 386462 - RNA, 19 nt, Homo sapiens
uuaccuuucuccucccuua

SEQ ID NO: 386463 - RNA, 19 nt, Homo sapiens
ggcaaacauucuaugcauu

SEQ ID NO: 386464 - RNA, 19 nt, Homo sapiens
gaaaacagaacaaaugaga

SEQ ID NO: 386465 - RNA, 19 nt, Homo sapiens
caaacgagcgagaaguuga

SEQ ID NO: 386466 - RNA, 19 nt, Homo sapiens
ggcaagagccauccuuuca

SEQ ID NO: 386467 - RNA, 19 nt, Homo sapiens
aaacugggcuagcuuucug

SEQ ID NO: 386468 - RNA, 19 nt, Homo sapiens
gaacuuuaacuugcccuuu

SEQ ID NO: 386469 - RNA, 19 nt, Homo sapiens
gagaagggcauagucuuug

SEQ ID NO: 386470 - RNA, 19 nt, Homo sapiens
gcaagagccauccuuucaa

SEQ ID NO: 386471 - RNA, 19 nt, Homo sapiens
ugaaauucucugccacuua

SEQ ID NO: 386472 - RNA, 19 nt, Homo sapiens
ucugaaagguguggaaaga

SEQ ID NO: 386473 - RNA, 19 nt, Homo sapiens
ccacguaccacacgaugaa

SEQ ID NO: 386474 - RNA, 19 nt, Homo sapiens
gaggaagacagauuuaaag

SEQ ID NO: 386475 - RNA, 19 nt, Homo sapiens
aaagaggaagacagauuua

SEQ ID NO: 386476 - RNA, 19 nt, Homo sapiens
gcuucgagauaucuuauuc

SEQ ID NO: 386477 - RNA, 19 nt, Homo sapiens
caagagucauuuauuacag

SEQ ID NO: 386478 - RNA, 19 nt, Homo sapiens
aaagagcaccaccauuauu

SEQ ID NO: 386479 - RNA, 19 nt, Homo sapiens
gauaaauguuggguagcaa

SEQ ID NO: 386480 - RNA, 19 nt, Homo sapiens
agaagggcauagucuuuga

SEQ ID NO: 386481 - RNA, 19 nt, Homo sapiens
ccgagaaacuggaccucaa

SEQ ID NO: 386482 - RNA, 19 nt, Homo sapiens
gcacuaccagucucccaaa

SEQ ID NO: 386483 - RNA, 19 nt, Homo sapiens
gauuuggaguguccguuau

SEQ ID NO: 386484 - RNA, 19 nt, Homo sapiens
ugaaagaagagcaguuuua

SEQ ID NO: 386485 - RNA, 19 nt, Homo sapiens
ccaauucuaugcgccaaau

SEQ ID NO: 386486 - RNA, 19 nt, Homo sapiens
ugaaaguuauuaggagaga

SEQ ID NO: 386487 - RNA, 19 nt, Homo sapiens
gagagagguuuaaacuacu

SEQ ID NO: 386488 - RNA, 19 nt, Homo sapiens
gccuauggcugcucuccaa

SEQ ID NO: 386489 - RNA, 19 nt, Homo sapiens
guagaaccuuucaacaaac

SEQ ID NO: 386490 - RNA, 19 nt, Homo sapiens
aguugaaggugguuaggua

SEQ ID NO: 386491 - RNA, 19 nt, Homo sapiens
auaaucagguaccuuacaa

SEQ ID NO: 386492 - RNA, 19 nt, Homo sapiens
agaggaagacagauuuaaa

SEQ ID NO: 386493 - RNA, 19 nt, Homo sapiens
gagauaucuuauucuagga

SEQ ID NO: 386494 - RNA, 19 nt, Homo sapiens
ggagcuucgagauaucuua

SEQ ID NO: 386495 - RNA, 19 nt, Homo sapiens
cauaaucugcaacuucauu

SEQ ID NO: 386496 - RNA, 19 nt, Homo sapiens
ucuaugcauuugaaacuga

SEQ ID NO: 386497 - RNA, 19 nt, Homo sapiens
agagaagggcauagucuuu

SEQ ID NO: 386498 - RNA, 19 nt, Homo sapiens
gagagaagggcauagucuu

SEQ ID NO: 386499 - RNA, 19 nt, Homo sapiens
ggagagaagggcauagucu

SEQ ID NO: 386500 - RNA, 19 nt, Homo sapiens
gaaagaagagcaguuuuau

SEQ ID NO: 386501 - RNA, 19 nt, Homo sapiens
ucuccucccuuacuucuau

SEQ ID NO: 386502 - RNA, 19 nt, Homo sapiens
agacucaucuugcucuucu

SEQ ID NO: 386503 - RNA, 19 nt, Homo sapiens
aaagcuaguuguucugucu

SEQ ID NO: 386504 - RNA, 19 nt, Homo sapiens
gaaguucuggguaucaaag

SEQ ID NO: 386505 - RNA, 19 nt, Homo sapiens
cagcaagcagccucacuuu

SEQ ID NO: 386506 - RNA, 19 nt, Homo sapiens
cgagaaacuggaccucaaa

SEQ ID NO: 386507 - RNA, 19 nt, Homo sapiens
aagaagagcaguuuuauga

SEQ ID NO: 386508 - RNA, 19 nt, Homo sapiens
gaacaacccucuguaaauu

SEQ ID NO: 386509 - RNA, 19 nt, Homo sapiens
ggaaauguauagcuaguaa

SEQ ID NO: 386510 - RNA, 19 nt, Homo sapiens
caugauaacugguaccuua

SEQ ID NO: 386511 - RNA, 19 nt, Homo sapiens
ccacaagaaugaucaagua

SEQ ID NO: 386512 - RNA, 19 nt, Homo sapiens
ucacugaucuugaaagcua

SEQ ID NO: 386513 - RNA, 19 nt, Homo sapiens
gaaauugauucaggacuaa

SEQ ID NO: 386514 - RNA, 19 nt, Homo sapiens
caagaaugaucaaguaaga

SEQ ID NO: 386515 - RNA, 19 nt, Homo sapiens
acacacaccucuaacagaa

SEQ ID NO: 386516 - RNA, 19 nt, Homo sapiens
guaguguucugauuuguga

SEQ ID NO: 386517 - RNA, 19 nt, Homo sapiens
agaaauugauucaggacua

SEQ ID NO: 386518 - RNA, 19 nt, Homo sapiens
uauauggccugguuucuug

SEQ ID NO: 386519 - RNA, 19 nt, Homo sapiens
caugaccgaugcaccauuu

SEQ ID NO: 386520 - RNA, 19 nt, Homo sapiens
uuaaacuucuuccgucuaa

SEQ ID NO: 386521 - RNA, 19 nt, Homo sapiens
ucugaaguguuaaugcuua

SEQ ID NO: 386522 - RNA, 19 nt, Homo sapiens
gugagaaugugaaacaguu

SEQ ID NO: 386523 - RNA, 19 nt, Homo sapiens
gugcacugcuuguaaauuc

SEQ ID NO: 386524 - RNA, 19 nt, Homo sapiens
ggaagaugaugaugauguc

SEQ ID NO: 386525 - RNA, 19 nt, Homo sapiens
cggagaagcuggaccugaa

SEQ ID NO: 386526 - RNA, 19 nt, Homo sapiens
guauugcuguucucuuuga

SEQ ID NO: 386527 - RNA, 19 nt, Homo sapiens
ucacuugaaugaagauugu

SEQ ID NO: 386528 - RNA, 19 nt, Homo sapiens
uuacagcuuuccuccuaua

SEQ ID NO: 386529 - RNA, 19 nt, Homo sapiens
gcgggaagaugaugaugau

SEQ ID NO: 386530 - RNA, 19 nt, Homo sapiens
gaaacaauuccaguaaaug

SEQ ID NO: 386531 - RNA, 19 nt, Homo sapiens
caccaagccugaacucuuc

SEQ ID NO: 386532 - RNA, 19 nt, Homo sapiens
guauuugucuguuguagca

SEQ ID NO: 386533 - RNA, 19 nt, Homo sapiens
gcuuguaaauucacauugu

SEQ ID NO: 386534 - RNA, 19 nt, Homo sapiens
ggagguuuguuuguagaaa

SEQ ID NO: 386535 - RNA, 19 nt, Homo sapiens
aguaauggaugucuuaauc

SEQ ID NO: 386536 - RNA, 19 nt, Homo sapiens
caucacccguguucaaguu

SEQ ID NO: 386537 - RNA, 19 nt, Homo sapiens
gaugguauuugucuguugu

SEQ ID NO: 386538 - RNA, 19 nt, Homo sapiens
cuagaaacaauuccaguaa

SEQ ID NO: 386539 - RNA, 19 nt, Homo sapiens
gaacagcaagcaggcguuu

SEQ ID NO: 386540 - RNA, 19 nt, Homo sapiens
guugaugcuuaaugugaua

SEQ ID NO: 386541 - RNA, 19 nt, Homo sapiens
ucacccguguucaaguuua

SEQ ID NO: 386542 - RNA, 19 nt, Homo sapiens
aaaugugaaucucgacaaa

SEQ ID NO: 386543 - RNA, 19 nt, Homo sapiens
guauuucagucuuccaguu

SEQ ID NO: 386544 - RNA, 19 nt, Homo sapiens
gaguugaugcuuaauguga

SEQ ID NO: 386545 - RNA, 19 nt, Homo sapiens
uagaguugaugcuuaaugu

SEQ ID NO: 386546 - RNA, 19 nt, Homo sapiens
guuguucgauugucuuuca

SEQ ID NO: 386547 - RNA, 19 nt, Homo sapiens
gaugguuuauuuacuaugg

SEQ ID NO: 386548 - RNA, 19 nt, Homo sapiens
ccucggcccuccucugaaa

SEQ ID NO: 386549 - RNA, 19 nt, Homo sapiens
ucacuuacccuuacacaca

SEQ ID NO: 386550 - RNA, 19 nt, Homo sapiens
uugaugaguuuaccgaauu

SEQ ID NO: 386551 - RNA, 19 nt, Homo sapiens
acaacccucuguaaauuau

SEQ ID NO: 386552 - RNA, 19 nt, Homo sapiens
cuguauugcuguucucuuu

SEQ ID NO: 386553 - RNA, 19 nt, Homo sapiens
uuaucucucuagcaacuua

SEQ ID NO: 386554 - RNA, 19 nt, Homo sapiens
cgaacgagcgaacaacuga

SEQ ID NO: 386555 - RNA, 19 nt, Homo sapiens
gaagcuggaccugaagaaa

SEQ ID NO: 386556 - RNA, 19 nt, Homo sapiens
guucgauugucuuucauug

SEQ ID NO: 386557 - RNA, 19 nt, Homo sapiens
agucuugaguucuguauau

SEQ ID NO: 386558 - RNA, 19 nt, Homo sapiens
gggaagaugaugaugaugu

SEQ ID NO: 386559 - RNA, 19 nt, Homo sapiens
uaacagaagggaagaagca

SEQ ID NO: 386560 - RNA, 19 nt, Homo sapiens
agaacaacccucuguaaau

SEQ ID NO: 386561 - RNA, 19 nt, Homo sapiens
gcaccauuuucuaguuuua

SEQ ID NO: 386562 - RNA, 19 nt, Homo sapiens
cagacgagacaguguuuaa

SEQ ID NO: 386563 - RNA, 19 nt, Homo sapiens
gguaccuuaucuacuguaa

SEQ ID NO: 386564 - RNA, 19 nt, Homo sapiens
gcaagcaggcguuuagcau

SEQ ID NO: 386565 - RNA, 19 nt, Homo sapiens
gguguuugcccuucagauu

SEQ ID NO: 386566 - RNA, 19 nt, Homo sapiens
ugaugaguuuaccgaauuu

SEQ ID NO: 386567 - RNA, 19 nt, Homo sapiens
guguggagauggcuguuug

SEQ ID NO: 386568 - RNA, 19 nt, Homo sapiens
cagaggaaguguggagaug

SEQ ID NO: 386569 - RNA, 19 nt, Homo sapiens
ccaccuaccacacuaugaa

SEQ ID NO: 386570 - RNA, 19 nt, Homo sapiens
gcacacauagauauauucu

SEQ ID NO: 386571 - RNA, 19 nt, Homo sapiens
uuuguuggcuacauguuaa

SEQ ID NO: 386572 - RNA, 19 nt, Homo sapiens
ccaagguauuucagucuuc

SEQ ID NO: 386573 - RNA, 19 nt, Homo sapiens
gagaucaggcguacagagu

SEQ ID NO: 386574 - RNA, 19 nt, Homo sapiens
cagcuuuccuccuauacug

SEQ ID NO: 386575 - RNA, 19 nt, Homo sapiens
guacacuuugcaacuauuu

SEQ ID NO: 386576 - RNA, 19 nt, Homo sapiens
gcaaccagaggcagaaaca

SEQ ID NO: 386577 - RNA, 19 nt, Homo sapiens
cggagagccugucuuccaa

SEQ ID NO: 386578 - RNA, 19 nt, Homo sapiens
acaaaucgaggacugaaga

SEQ ID NO: 386579 - RNA, 19 nt, Homo sapiens
ugaugucccugaacagcaa

SEQ ID NO: 386580 - RNA, 19 nt, Homo sapiens
agacaucacccguguucaa

SEQ ID NO: 386581 - RNA, 19 nt, Homo sapiens
gcagacgagacaguguuua

SEQ ID NO: 386582 - RNA, 19 nt, Homo sapiens
gaagccuacuuugccauuc

SEQ ID NO: 386583 - RNA, 19 nt, Homo sapiens
ucaccaagccugaacucuu

SEQ ID NO: 386584 - RNA, 19 nt, Homo sapiens
cagaagggaagaagcaguu

SEQ ID NO: 386585 - RNA, 19 nt, Homo sapiens
ucuccaaagucuugaguuc

SEQ ID NO: 386586 - RNA, 19 nt, Homo sapiens
acugguaccuuaucuacug

SEQ ID NO: 386587 - RNA, 19 nt, Homo sapiens
uaacugguaccuuaucuac

SEQ ID NO: 386588 - RNA, 19 nt, Homo sapiens
uaauggaugucuuaaucgu

SEQ ID NO: 386589 - RNA, 19 nt, Homo sapiens
gcacguggagcccaaguac

SEQ ID NO: 386590 - RNA, 19 nt, Homo sapiens
gaagcaguuggaagcauga

SEQ ID NO: 386591 - RNA, 19 nt, Homo sapiens
auguauagcuaguaacguu

SEQ ID NO: 386592 - RNA, 19 nt, Homo sapiens
gcggagagccugucuucca

SEQ ID NO: 386593 - RNA, 19 nt, Homo sapiens
acaauuccaguaaauguga

SEQ ID NO: 386594 - RNA, 19 nt, Homo sapiens
guauauggccugguuucuu

SEQ ID NO: 386595 - RNA, 19 nt, Homo sapiens
gacgccaccuaccacacua

SEQ ID NO: 386596 - RNA, 19 nt, Homo sapiens
guguuugcccuucagauuu

SEQ ID NO: 386597 - RNA, 19 nt, Homo sapiens
aacaacccucuguaaauua

SEQ ID NO: 386598 - RNA, 19 nt, Homo sapiens
gaccugauucacugucuga

SEQ ID NO: 386599 - RNA, 19 nt, Homo sapiens
gacacucaguaauggaugu

SEQ ID NO: 386600 - RNA, 19 nt, Homo sapiens
gaguugcgccugcuguguu

SEQ ID NO: 386601 - RNA, 19 nt, Homo sapiens
cacaagaaugaucaaguaa

SEQ ID NO: 386602 - RNA, 19 nt, Homo sapiens
ccaccucggcuucuucaga

SEQ ID NO: 386603 - RNA, 19 nt, Homo sapiens
ggagcgaacgagcgaacaa

SEQ ID NO: 386604 - RNA, 19 nt, Homo sapiens
gaugcacacauagauauau

SEQ ID NO: 386605 - RNA, 19 nt, Homo sapiens
aaugaugcacacauagaua

SEQ ID NO: 386606 - RNA, 19 nt, Homo sapiens
gaagaagcaguuggaagca

SEQ ID NO: 386607 - RNA, 19 nt, Homo sapiens
gggaaauguauagcuagua

SEQ ID NO: 386608 - RNA, 19 nt, Homo sapiens
gcugcaggguaauauauuu

SEQ ID NO: 386609 - RNA, 19 nt, Homo sapiens
cugagaaacuggaccuuaa

SEQ ID NO: 386610 - RNA, 19 nt, Homo sapiens
guauucggcuguccacuga

SEQ ID NO: 386611 - RNA, 19 nt, Homo sapiens
aaacagaaacgaaugaagu

SEQ ID NO: 386612 - RNA, 19 nt, Homo sapiens
cagcugcgcucaccucaca

SEQ ID NO: 386613 - RNA, 19 nt, Homo sapiens
gcugagaaacuggaccuua

SEQ ID NO: 386614 - RNA, 19 nt, Homo sapiens
gguaauauauuuggaagcu

SEQ ID NO: 386615 - RNA, 19 nt, Homo sapiens
ccacguccuucaucugaga

SEQ ID NO: 386616 - RNA, 19 nt, Homo sapiens
ggccaucgcugagaaacug

SEQ ID NO: 386617 - RNA, 19 nt, Homo sapiens
cagaaacgaaugaaguauu

SEQ ID NO: 386618 - RNA, 19 nt, Homo sapiens
gcagcugcaggguaauaua

SEQ ID NO: 386619 - RNA, 19 nt, Homo sapiens
gcaggguaauauauuugga

SEQ ID NO: 386620 - RNA, 19 nt, Homo sapiens
gacagaaacagaaacgaau

SEQ ID NO: 386621 - RNA, 19 nt, Homo sapiens
agacagaaacagaaacgaa

SEQ ID NO: 386622 - RNA, 19 nt, Homo sapiens
ccagagacagaaacagaaa

SEQ ID NO: 386623 - RNA, 19 nt, Homo sapiens
gaaacagaaacgaaugaag

SEQ ID NO: 386624 - RNA, 19 nt, Homo sapiens
cagaaacagaaacgaauga

SEQ ID NO: 386625 - RNA, 19 nt, Homo sapiens
ucagcgacguggagucaga

SEQ ID NO: 386626 - RNA, 19 nt, Homo sapiens
ugagaaacuggaccuuaaa

SEQ ID NO: 386627 - RNA, 19 nt, Homo sapiens
uuuggaagcuuugaugaga

SEQ ID NO: 386628 - RNA, 19 nt, Homo sapiens
caacaugaucgcucucaag

SEQ ID NO: 386629 - RNA, 19 nt, Homo sapiens
aacagaaacgaaugaagua

SEQ ID NO: 386630 - RNA, 19 nt, Homo sapiens
gcugcaagaacccaaauuc

SEQ ID NO: 386631 - RNA, 19 nt, Homo sapiens
cagcugcaggguaauauau

SEQ ID NO: 386632 - RNA, 19 nt, Homo sapiens
gcaaccagagacagaaaca

SEQ ID NO: 386633 - RNA, 19 nt, Homo sapiens
ggugaugcccgcacagauc

SEQ ID NO: 386634 - RNA, 19 nt, Homo sapiens
aaccagagacagaaacaga

SEQ ID NO: 386635 - RNA, 19 nt, Homo sapiens
aaaagaacguggugagagu

SEQ ID NO: 386636 - RNA, 19 nt, Homo sapiens
gcaagccagagcucuucaa

SEQ ID NO: 386637 - RNA, 19 nt, Homo sapiens
acagaaacagaaacgaaug

SEQ ID NO: 386638 - RNA, 19 nt, Homo sapiens
caggguaauauauuuggaa

SEQ ID NO: 386639 - RNA, 19 nt, Homo sapiens
gagaaacuggaccuuaaaa

SEQ ID NO: 386640 - RNA, 19 nt, Homo sapiens
cgaggccuauuucgcuauc

SEQ ID NO: 386641 - RNA, 19 nt, Homo sapiens
ccgcagcugcaggguaaua

SEQ ID NO: 386642 - RNA, 19 nt, Homo sapiens
ccagccacguccuucaucu

SEQ ID NO: 386643 - RNA, 19 nt, Homo sapiens
acaacaugaucgcucucaa

SEQ ID NO: 386644 - RNA, 19 nt, Homo sapiens
ggaggaagcugacaacaau

SEQ ID NO: 386645 - RNA, 19 nt, Homo sapiens
agaaagaacucgagcaauu

SEQ ID NO: 386646 - RNA, 19 nt, Homo sapiens
gaggcaaccuggagaauuu

SEQ ID NO: 386647 - RNA, 19 nt, Homo sapiens
caucaaagcucugcagaaa

SEQ ID NO: 386648 - RNA, 19 nt, Homo sapiens
ucaaagcucugcagaaaga

SEQ ID NO: 386649 - RNA, 19 nt, Homo sapiens
gaaagaacucgagcaauuu

SEQ ID NO: 386650 - RNA, 19 nt, Homo sapiens
ggauuaaguucuucauuca

SEQ ID NO: 386651 - RNA, 19 nt, Homo sapiens
uuacaagucuucugccuuu

SEQ ID NO: 386652 - RNA, 19 nt, Homo sapiens
uaaagaagcuugggacaca

SEQ ID NO: 386653 - RNA, 19 nt, Homo sapiens
uaacugguguguuuauguu

SEQ ID NO: 386654 - RNA, 19 nt, Homo sapiens
gaaguucaaugaugcucuu

SEQ ID NO: 386655 - RNA, 19 nt, Homo sapiens
gggaagguauucagccaaa

SEQ ID NO: 386656 - RNA, 19 nt, Homo sapiens
gggaggagcuagggaaaga

SEQ ID NO: 386657 - RNA, 19 nt, Homo sapiens
acacguagguucuugaauc

SEQ ID NO: 386658 - RNA, 19 nt, Homo sapiens
auugauaacugguguguuu

SEQ ID NO: 386659 - RNA, 19 nt, Homo sapiens
ggagauaugcaaagcagaa

SEQ ID NO: 386660 - RNA, 19 nt, Homo sapiens
gcagaaagaacucgagcaa

SEQ ID NO: 386661 - RNA, 19 nt, Homo sapiens
guggguagguuauuucuag

SEQ ID NO: 386662 - RNA, 19 nt, Homo sapiens
gggaaugggugaaugacau

SEQ ID NO: 386663 - RNA, 19 nt, Homo sapiens
gcacuucuacagacuauuc

SEQ ID NO: 386664 - RNA, 19 nt, Homo sapiens
ggaaggaauugggaacaca

SEQ ID NO: 386665 - RNA, 19 nt, Homo sapiens
uggauuaaguucuucauuc

SEQ ID NO: 386666 - RNA, 19 nt, Homo sapiens
ucacuucacugcacuguac

SEQ ID NO: 386667 - RNA, 19 nt, Homo sapiens
gaacagggaaugggugaau

SEQ ID NO: 386668 - RNA, 19 nt, Homo sapiens
gaagcugacaacaaugaaa

SEQ ID NO: 386669 - RNA, 19 nt, Homo sapiens
ggaaaggggagauugauaa

SEQ ID NO: 386670 - RNA, 19 nt, Homo sapiens
caaugaugcucuugauuuu

SEQ ID NO: 386671 - RNA, 19 nt, Homo sapiens
ccaagcuccugaagcagaa

SEQ ID NO: 386672 - RNA, 19 nt, Homo sapiens
gaaggaauugggaacacaa

SEQ ID NO: 386673 - RNA, 19 nt, Homo sapiens
agagaaagcgaaccaguau

SEQ ID NO: 386674 - RNA, 19 nt, Homo sapiens
gcucucccuugcauucaaa

SEQ ID NO: 386675 - RNA, 19 nt, Homo sapiens
gauauacacaggccgaugu

SEQ ID NO: 386676 - RNA, 19 nt, Homo sapiens
guucuucauucacuaagga

SEQ ID NO: 386677 - RNA, 19 nt, Homo sapiens
gaggaucacccugggauau

SEQ ID NO: 386678 - RNA, 19 nt, Homo sapiens
guucuugaaucccgaaugg

SEQ ID NO: 386679 - RNA, 19 nt, Homo sapiens
aagagaaagcgaaccagua

SEQ ID NO: 386680 - RNA, 19 nt, Homo sapiens
gugccugccugcccuucua

SEQ ID NO: 386681 - RNA, 19 nt, Homo sapiens
cagcgacuaugcacaacga

SEQ ID NO: 386682 - RNA, 19 nt, Homo sapiens
gugcaggcccgaaagagaa

SEQ ID NO: 386683 - RNA, 19 nt, Homo sapiens
gguagguuauuucuagaag

SEQ ID NO: 386684 - RNA, 19 nt, Homo sapiens
aaagaacucgagcaauuug

SEQ ID NO: 386685 - RNA, 19 nt, Homo sapiens
gcuucaagaacauguguaa

SEQ ID NO: 386686 - RNA, 19 nt, Homo sapiens
ccacaucgcccagcagcuu

SEQ ID NO: 386687 - RNA, 19 nt, Homo sapiens
ugacauuuguggguagguu

SEQ ID NO: 386688 - RNA, 19 nt, Homo sapiens
caagucuucugccuuuuaa

SEQ ID NO: 386689 - RNA, 19 nt, Homo sapiens
guccgagugugguucugua

SEQ ID NO: 386690 - RNA, 19 nt, Homo sapiens
gacauuuguggguagguua

SEQ ID NO: 386691 - RNA, 19 nt, Homo sapiens
ggaucacccugggauauac

SEQ ID NO: 386692 - RNA, 19 nt, Homo sapiens
guguuuauguucuuacaag

SEQ ID NO: 386693 - RNA, 19 nt, Homo sapiens
ggaauugggaacacaaagg

SEQ ID NO: 386694 - RNA, 19 nt, Homo sapiens
ucccuugcauucaaacuga

SEQ ID NO: 386695 - RNA, 19 nt, Homo sapiens
ggaagcugacaacaaugaa

SEQ ID NO: 386696 - RNA, 19 nt, Homo sapiens
ggcccuugcugcagaagug

SEQ ID NO: 386697 - RNA, 19 nt, Homo sapiens
ucaagaacauguguaagcu

SEQ ID NO: 386698 - RNA, 19 nt, Homo sapiens
uaugggagcccucacuuca

SEQ ID NO: 386699 - RNA, 19 nt, Homo sapiens
gguuauuucuagaaguuag

SEQ ID NO: 386700 - RNA, 19 nt, Homo sapiens
guagguuauuucuagaagu

SEQ ID NO: 386701 - RNA, 19 nt, Homo sapiens
cgaaagagaaagcgaacca

SEQ ID NO: 386702 - RNA, 19 nt, Homo sapiens
gagauaugcaaagcagaaa

SEQ ID NO: 386703 - RNA, 19 nt, Homo sapiens
gaucaagcagcgacuaugc

SEQ ID NO: 386704 - RNA, 19 nt, Homo sapiens
caaccuggagaauuuguuc

SEQ ID NO: 386705 - RNA, 19 nt, Homo sapiens
uugccaagcuccugaagca

SEQ ID NO: 386706 - RNA, 19 nt, Homo sapiens
ggaguuugugccaggguuu

SEQ ID NO: 386707 - RNA, 19 nt, Homo sapiens
ggccacacguagguucuug

SEQ ID NO: 386708 - RNA, 19 nt, Homo sapiens
ccacacguagguucuugaa

SEQ ID NO: 386709 - RNA, 19 nt, Homo sapiens
cagaagggcaagcgaucaa

SEQ ID NO: 386710 - RNA, 19 nt, Homo sapiens
gguucuauuugggaaggua

SEQ ID NO: 386711 - RNA, 19 nt, Homo sapiens
gcugcugggucuccuuucu

SEQ ID NO: 386712 - RNA, 19 nt, Homo sapiens
aagcagcgacuaugcacaa

SEQ ID NO: 386713 - RNA, 19 nt, Homo sapiens
gcagaaguggguggaggaa

SEQ ID NO: 386714 - RNA, 19 nt, Homo sapiens
gcgaucaagcagcgacuau

SEQ ID NO: 386715 - RNA, 19 nt, Homo sapiens
gaagguauucagccaaacg

SEQ ID NO: 386716 - RNA, 19 nt, Homo sapiens
acagggaaugggugaauga

SEQ ID NO: 386717 - RNA, 19 nt, Homo sapiens
gaaagcgaaccaguaucga

SEQ ID NO: 386718 - RNA, 19 nt, Homo sapiens
gcuaugggagcccucacuu

SEQ ID NO: 386719 - RNA, 19 nt, Homo sapiens
gcaaccuggagaauuuguu

SEQ ID NO: 386720 - RNA, 19 nt, Homo sapiens
aggaagcugacaacaauga

SEQ ID NO: 386721 - RNA, 19 nt, Homo sapiens
uggaggaagcugacaacaa

SEQ ID NO: 386722 - RNA, 19 nt, Homo sapiens
gcuugggacacaguagaua

SEQ ID NO: 386723 - RNA, 19 nt, Homo sapiens
guacuccucggucccuuuc

SEQ ID NO: 386724 - RNA, 19 nt, Homo sapiens
gagaggcaaccuggagaau

SEQ ID NO: 386725 - RNA, 19 nt, Homo sapiens
uaucgagaaccgagugaga

SEQ ID NO: 386726 - RNA, 19 nt, Homo sapiens
gcgaaccaguaucgagaac

SEQ ID NO: 386727 - RNA, 19 nt, Homo sapiens
agaaagcgaaccaguaucg

SEQ ID NO: 386728 - RNA, 19 nt, Homo sapiens
acgaccaucugccgcuuug

SEQ ID NO: 386729 - RNA, 19 nt, Homo sapiens
gcagaagguugggaauuua

SEQ ID NO: 386730 - RNA, 19 nt, Homo sapiens
ccaauuaccugcucagaga

SEQ ID NO: 386731 - RNA, 19 nt, Homo sapiens
ccacacaucucacaucaug

SEQ ID NO: 386732 - RNA, 19 nt, Homo sapiens
gaaggucucuuguggaagu

SEQ ID NO: 386733 - RNA, 19 nt, Homo sapiens
cuaaggagcucaacuacga

SEQ ID NO: 386734 - RNA, 19 nt, Homo sapiens
aaauaaggcuguucuuuca

SEQ ID NO: 386735 - RNA, 19 nt, Homo sapiens
gacaacauccugaaauaaa

SEQ ID NO: 386736 - RNA, 19 nt, Homo sapiens
ucacugaaauugcuaagga

SEQ ID NO: 386737 - RNA, 19 nt, Homo sapiens
gaagagauccgggaguuug

SEQ ID NO: 386738 - RNA, 19 nt, Homo sapiens
ggacaacauccugaaauaa

SEQ ID NO: 386739 - RNA, 19 nt, Homo sapiens
gcagucagauccucaccaa

SEQ ID NO: 386740 - RNA, 19 nt, Homo sapiens
caacuacgaccgugaggua

SEQ ID NO: 386741 - RNA, 19 nt, Homo sapiens
cgaagaagaggauuuguga

SEQ ID NO: 386742 - RNA, 19 nt, Homo sapiens
guagugaacucagcuagug

SEQ ID NO: 386743 - RNA, 19 nt, Homo sapiens
auaaggcuguucuuucaua

SEQ ID NO: 386744 - RNA, 19 nt, Homo sapiens
gcaccuugcuagcaugguu

SEQ ID NO: 386745 - RNA, 19 nt, Homo sapiens
gaacaugggaucuccucuu

SEQ ID NO: 386746 - RNA, 19 nt, Homo sapiens
gggaucaacuuagaagaga

SEQ ID NO: 386747 - RNA, 19 nt, Homo sapiens
aggcuguucuuucauauuu

SEQ ID NO: 386748 - RNA, 19 nt, Homo sapiens
gccauuagcucuugcuuuu

SEQ ID NO: 386749 - RNA, 19 nt, Homo sapiens
uagaagagauccgggaguu

SEQ ID NO: 386750 - RNA, 19 nt, Homo sapiens
cacuacagcuccagucauu

SEQ ID NO: 386751 - RNA, 19 nt, Homo sapiens
ccagaaacucccugucuuu

SEQ ID NO: 386752 - RNA, 19 nt, Homo sapiens
gaaugcugacuuucucuuu

SEQ ID NO: 386753 - RNA, 19 nt, Homo sapiens
gaacuugcagacuggauau

SEQ ID NO: 386754 - RNA, 19 nt, Homo sapiens
gaaaauaaggcuguucuuu

SEQ ID NO: 386755 - RNA, 19 nt, Homo sapiens
ugcagaagguugggaauuu

SEQ ID NO: 386756 - RNA, 19 nt, Homo sapiens
gacuggauaugcaagcaaa

SEQ ID NO: 386757 - RNA, 19 nt, Homo sapiens
caccuugucuucuccuuug

SEQ ID NO: 386758 - RNA, 19 nt, Homo sapiens
ggcauucucuuuccaccuu

SEQ ID NO: 386759 - RNA, 19 nt, Homo sapiens
aaacguggguuaagagaac

SEQ ID NO: 386760 - RNA, 19 nt, Homo sapiens
gaaggaagcaacagugaac

SEQ ID NO: 386761 - RNA, 19 nt, Homo sapiens
ggaaggaagcaacagugaa

SEQ ID NO: 386762 - RNA, 19 nt, Homo sapiens
aggaaggucucuuguggaa

SEQ ID NO: 386763 - RNA, 19 nt, Homo sapiens
gaagguugggaauuuagaa

SEQ ID NO: 386764 - RNA, 19 nt, Homo sapiens
gaagcaacagugaacucua

SEQ ID NO: 386765 - RNA, 19 nt, Homo sapiens
ggggaaaauugcacuaaaa

SEQ ID NO: 386766 - RNA, 19 nt, Homo sapiens
caacauccugaaauaaaug

SEQ ID NO: 386767 - RNA, 19 nt, Homo sapiens
ucuagcacuuuguccauuu

SEQ ID NO: 386768 - RNA, 19 nt, Homo sapiens
uaaggaccacuggccauua

SEQ ID NO: 386769 - RNA, 19 nt, Homo sapiens
caagagugcccagaagcua

SEQ ID NO: 386770 - RNA, 19 nt, Homo sapiens
uaaggcuguucuuucauau

SEQ ID NO: 386771 - RNA, 19 nt, Homo sapiens
gggcuaaagcagcuccuaa

SEQ ID NO: 386772 - RNA, 19 nt, Homo sapiens
uggcagguaugacaacuca

SEQ ID NO: 386773 - RNA, 19 nt, Homo sapiens
gugaugugcugcucagaag

SEQ ID NO: 386774 - RNA, 19 nt, Homo sapiens
aggaugggaucaacuuaga

SEQ ID NO: 386775 - RNA, 19 nt, Homo sapiens
gcucagggacagguuauug

SEQ ID NO: 386776 - RNA, 19 nt, Homo sapiens
ccuuugcuccucuguguua

SEQ ID NO: 386777 - RNA, 19 nt, Homo sapiens
agcagaaccugauggaguu

SEQ ID NO: 386778 - RNA, 19 nt, Homo sapiens
ccagggaucagcagucaga

SEQ ID NO: 386779 - RNA, 19 nt, Homo sapiens
acaauaaaccagacagcaa

SEQ ID NO: 386780 - RNA, 19 nt, Homo sapiens
gcacuaaaacagaaccuuu

SEQ ID NO: 386781 - RNA, 19 nt, Homo sapiens
agucagauccucaccaaug

SEQ ID NO: 386782 - RNA, 19 nt, Homo sapiens
gcuaaacgaagcugaacug

SEQ ID NO: 386783 - RNA, 19 nt, Homo sapiens
aagcaacagugaacucuac

SEQ ID NO: 386784 - RNA, 19 nt, Homo sapiens
caugggaucuccucuucca

SEQ ID NO: 386785 - RNA, 19 nt, Homo sapiens
ggccaucccucccacaaaa

SEQ ID NO: 386786 - RNA, 19 nt, Homo sapiens
ccacagaucagugcugcuu

SEQ ID NO: 386787 - RNA, 19 nt, Homo sapiens
gccagacgcucaagaacac

SEQ ID NO: 386788 - RNA, 19 nt, Homo sapiens
uaaagccggugcuggaaaa

SEQ ID NO: 386789 - RNA, 19 nt, Homo sapiens
ggaaugcugacuuucucuu

SEQ ID NO: 386790 - RNA, 19 nt, Homo sapiens
aacaugggaucuccucuuc

SEQ ID NO: 386791 - RNA, 19 nt, Homo sapiens
cagaaacucccugucuuug

SEQ ID NO: 386792 - RNA, 19 nt, Homo sapiens
gaggaugggaucaacuuag

SEQ ID NO: 386793 - RNA, 19 nt, Homo sapiens
uugcuagcaugguuucuga

SEQ ID NO: 386794 - RNA, 19 nt, Homo sapiens
ggaaacacagccucacacu

SEQ ID NO: 386795 - RNA, 19 nt, Homo sapiens
cauuagcucuugcuuuuga

SEQ ID NO: 386796 - RNA, 19 nt, Homo sapiens
ggaucaacuuagaagagau

SEQ ID NO: 386797 - RNA, 19 nt, Homo sapiens
gacuuucucuuucuuucuc

SEQ ID NO: 386798 - RNA, 19 nt, Homo sapiens
gaaaauugcacuaaaacag

SEQ ID NO: 386799 - RNA, 19 nt, Homo sapiens
gcccuggcccuguguucua

SEQ ID NO: 386800 - RNA, 19 nt, Homo sapiens
cuagacaucacacccaaga

SEQ ID NO: 386801 - RNA, 19 nt, Homo sapiens
gaugggaucaacuuagaag

SEQ ID NO: 386802 - RNA, 19 nt, Homo sapiens
ggaagcaacagugaacucu

SEQ ID NO: 386803 - RNA, 19 nt, Homo sapiens
gggcuggucacuccgaaga

SEQ ID NO: 386804 - RNA, 19 nt, Homo sapiens
ucccacacaucucacauca

SEQ ID NO: 386805 - RNA, 19 nt, Homo sapiens
ggcgagcccuccaagaaac

SEQ ID NO: 386806 - RNA, 19 nt, Homo sapiens
ugaggaugggaucaacuua

SEQ ID NO: 386807 - RNA, 19 nt, Homo sapiens
ggaugaggaugggaucaac

SEQ ID NO: 386808 - RNA, 19 nt, Homo sapiens
agaacuugcagacuggaua

SEQ ID NO: 386809 - RNA, 19 nt, Homo sapiens
ggccauuagcucuugcuuu

SEQ ID NO: 386810 - RNA, 19 nt, Homo sapiens
aaggaccacuggccauuag

SEQ ID NO: 386811 - RNA, 19 nt, Homo sapiens
ucgcugggccuuacacaga

SEQ ID NO: 386812 - RNA, 19 nt, Homo sapiens
uccgggaguuugccaagaa

SEQ ID NO: 386813 - RNA, 19 nt, Homo sapiens
gaaggucagacuccauguc

SEQ ID NO: 386814 - RNA, 19 nt, Homo sapiens
gcuggucacuccgaagaag

SEQ ID NO: 386815 - RNA, 19 nt, Homo sapiens
ggaaaaguggcuaaacgaa

SEQ ID NO: 386816 - RNA, 19 nt, Homo sapiens
gcuaaagccggugcuggaa

SEQ ID NO: 386817 - RNA, 19 nt, Homo sapiens
caagccacauacuccaagu

SEQ ID NO: 386818 - RNA, 19 nt, Homo sapiens
aaugcugacuuucucuuuc

SEQ ID NO: 386819 - RNA, 19 nt, Homo sapiens
caagcaaacgggcaacucu

SEQ ID NO: 386820 - RNA, 19 nt, Homo sapiens
ggaugggaucaacuuagaa

SEQ ID NO: 386821 - RNA, 19 nt, Homo sapiens
cuacagcuccagucauuac

SEQ ID NO: 386822 - RNA, 19 nt, Homo sapiens
ggucagaagguucccaaac

SEQ ID NO: 386823 - RNA, 19 nt, Homo sapiens
uugcuaaggagcucaacua

SEQ ID NO: 386824 - RNA, 19 nt, Homo sapiens
gcagaaccugauggaguuu

SEQ ID NO: 386825 - RNA, 19 nt, Homo sapiens
cuaaagccggugcuggaaa

SEQ ID NO: 386826 - RNA, 19 nt, Homo sapiens
agacaucacacccaagagu

SEQ ID NO: 386827 - RNA, 19 nt, Homo sapiens
aaggaaugcugacuuucuc

SEQ ID NO: 386828 - RNA, 19 nt, Homo sapiens
aaaauaaggcuguucuuuc

SEQ ID NO: 386829 - RNA, 19 nt, Homo sapiens
gcugaaaccuggcuacuua

SEQ ID NO: 386830 - RNA, 19 nt, Homo sapiens
ggaaucaguugcaugaaua

SEQ ID NO: 386831 - RNA, 19 nt, Homo sapiens
ggaaagucauugccauuaa

SEQ ID NO: 386832 - RNA, 19 nt, Homo sapiens
gaacucaucuaacuaaagu

SEQ ID NO: 386833 - RNA, 19 nt, Homo sapiens
caacagacguggauaagug

SEQ ID NO: 386834 - RNA, 19 nt, Homo sapiens
ggauauaucuggaacuaug

SEQ ID NO: 386835 - RNA, 19 nt, Homo sapiens
gauaaggacuuugccauug

SEQ ID NO: 386836 - RNA, 19 nt, Homo sapiens
gaaagucauugccauuaau

SEQ ID NO: 386837 - RNA, 19 nt, Homo sapiens
ugaaauaauuggcgugaaa

SEQ ID NO: 386838 - RNA, 19 nt, Homo sapiens
cgaauuuguucccguauaa

SEQ ID NO: 386839 - RNA, 19 nt, Homo sapiens
gaaaaugaguuugcguuua

SEQ ID NO: 386840 - RNA, 19 nt, Homo sapiens
aaauggagauugcuacaaa

SEQ ID NO: 386841 - RNA, 19 nt, Homo sapiens
uaucaaagcaguugucauu

SEQ ID NO: 386842 - RNA, 19 nt, Homo sapiens
gaaauuggaagcaagguau

SEQ ID NO: 386843 - RNA, 19 nt, Homo sapiens
gcacaugcuuaaauaucaa

SEQ ID NO: 386844 - RNA, 19 nt, Homo sapiens
cgugaaaguucuaggcaua

SEQ ID NO: 386845 - RNA, 19 nt, Homo sapiens
gcgaauuuguucccguaua

SEQ ID NO: 386846 - RNA, 19 nt, Homo sapiens
uaaauucugcugugacuaa

SEQ ID NO: 386847 - RNA, 19 nt, Homo sapiens
ggacuuugccauugauauu

SEQ ID NO: 386848 - RNA, 19 nt, Homo sapiens
gcagccaauuauaaugaua

SEQ ID NO: 386849 - RNA, 19 nt, Homo sapiens
gcacaaugauaaacauacu

SEQ ID NO: 386850 - RNA, 19 nt, Homo sapiens
gaaaacgaauggaaaagga

SEQ ID NO: 386851 - RNA, 19 nt, Homo sapiens
ggacugguuuagaagguau

SEQ ID NO: 386852 - RNA, 19 nt, Homo sapiens
ucacaugguaguugaagua

SEQ ID NO: 386853 - RNA, 19 nt, Homo sapiens
aaaggaaucaguugcauga

SEQ ID NO: 386854 - RNA, 19 nt, Homo sapiens
ccaauauacucagaauguu

SEQ ID NO: 386855 - RNA, 19 nt, Homo sapiens
gaaucugccugcacaguac

SEQ ID NO: 386856 - RNA, 19 nt, Homo sapiens
gaaaguucuaggcauauug

SEQ ID NO: 386857 - RNA, 19 nt, Homo sapiens
guaccgagucuuccucaaa

SEQ ID NO: 386858 - RNA, 19 nt, Homo sapiens
aaggauauaucuggaacua

SEQ ID NO: 386859 - RNA, 19 nt, Homo sapiens
aaaguaaauucugcuguga

SEQ ID NO: 386860 - RNA, 19 nt, Homo sapiens
guauaagguuccugaugga

SEQ ID NO: 386861 - RNA, 19 nt, Homo sapiens
gaaaccuggcuacuuagaa

SEQ ID NO: 386862 - RNA, 19 nt, Homo sapiens
caauugaugugugugaaau

SEQ ID NO: 386863 - RNA, 19 nt, Homo sapiens
gagccauuguggaugcuuu

SEQ ID NO: 386864 - RNA, 19 nt, Homo sapiens
auaaggacuuugccauuga

SEQ ID NO: 386865 - RNA, 19 nt, Homo sapiens
ugaaaguucuaggcauauu

SEQ ID NO: 386866 - RNA, 19 nt, Homo sapiens
agauuucucuggaauacaa

SEQ ID NO: 386867 - RNA, 19 nt, Homo sapiens
gcacucaugaccauuggaa

SEQ ID NO: 386868 - RNA, 19 nt, Homo sapiens
aaaccuggcuacuuagaag

SEQ ID NO: 386869 - RNA, 19 nt, Homo sapiens
guuaccauauguuaggaaa

SEQ ID NO: 386870 - RNA, 19 nt, Homo sapiens
aagcugauauugcuacauc

SEQ ID NO: 386871 - RNA, 19 nt, Homo sapiens
cagauaaggauguguuuca

SEQ ID NO: 386872 - RNA, 19 nt, Homo sapiens
gacuuugccauugauauua

SEQ ID NO: 386873 - RNA, 19 nt, Homo sapiens
cagaauguuauccaucuaa

SEQ ID NO: 386874 - RNA, 19 nt, Homo sapiens
gcaguugucauuuggaagu

SEQ ID NO: 386875 - RNA, 19 nt, Homo sapiens
ucagaauguuauccaucua

SEQ ID NO: 386876 - RNA, 19 nt, Homo sapiens
ugaaucugccugcacagua

SEQ ID NO: 386877 - RNA, 19 nt, Homo sapiens
gcaggacuccggcacuaug

SEQ ID NO: 386878 - RNA, 19 nt, Homo sapiens
acuguggacugguuuagaa

SEQ ID NO: 386879 - RNA, 19 nt, Homo sapiens
uggaaagucauugccauua

SEQ ID NO: 386880 - RNA, 19 nt, Homo sapiens
ggaagcaagguaugugcaa

SEQ ID NO: 386881 - RNA, 19 nt, Homo sapiens
gggcacaaugauaaacaua

SEQ ID NO: 386882 - RNA, 19 nt, Homo sapiens
aagcaguugucauuuggaa

SEQ ID NO: 386883 - RNA, 19 nt, Homo sapiens
ugacuaauccaauauacuc

SEQ ID NO: 386884 - RNA, 19 nt, Homo sapiens
cuggauguauuagaaguaa

SEQ ID NO: 386885 - RNA, 19 nt, Homo sapiens
gaagacccagggcacaaug

SEQ ID NO: 386886 - RNA, 19 nt, Homo sapiens
cuaauccaauauacucaga

SEQ ID NO: 386887 - RNA, 19 nt, Homo sapiens
aggaaucaguugcaugaau

SEQ ID NO: 386888 - RNA, 19 nt, Homo sapiens
uaaaagcacucaugaccau

SEQ ID NO: 386889 - RNA, 19 nt, Homo sapiens
uaaggacuuugccauugau

SEQ ID NO: 386890 - RNA, 19 nt, Homo sapiens
gaaauaauuggcgugaaag

SEQ ID NO: 386891 - RNA, 19 nt, Homo sapiens
gacccagggcacaaugaua

SEQ ID NO: 386892 - RNA, 19 nt, Homo sapiens
gaauuuguucccguauaaa

SEQ ID NO: 386893 - RNA, 19 nt, Homo sapiens
ccacgcuggucuaaugcaa

SEQ ID NO: 386894 - RNA, 19 nt, Homo sapiens
cugaugcagccaauuauaa

SEQ ID NO: 386895 - RNA, 19 nt, Homo sapiens
gcaaggggagcacauauug

SEQ ID NO: 386896 - RNA, 19 nt, Homo sapiens
aagcuacuguggacugguu

SEQ ID NO: 386897 - RNA, 19 nt, Homo sapiens
ugaaauuggaagcaaggua

SEQ ID NO: 386898 - RNA, 19 nt, Homo sapiens
ccaauugaugugugugaaa

SEQ ID NO: 386899 - RNA, 19 nt, Homo sapiens
uccaauauacucagaaugu

SEQ ID NO: 386900 - RNA, 19 nt, Homo sapiens
gaaaaggaaucaguugcau

SEQ ID NO: 386901 - RNA, 19 nt, Homo sapiens
auaauuggcgugaaaguuc

SEQ ID NO: 386902 - RNA, 19 nt, Homo sapiens
ggaaaacuucgcuauguug

SEQ ID NO: 386903 - RNA, 19 nt, Homo sapiens
ugaugugugugaaauugga

SEQ ID NO: 386904 - RNA, 19 nt, Homo sapiens
ccugaugcagccaauuaua

SEQ ID NO: 386905 - RNA, 19 nt, Homo sapiens
ugacccaauugaugugugu

SEQ ID NO: 386906 - RNA, 19 nt, Homo sapiens
ggaagacccagggcacaau

SEQ ID NO: 386907 - RNA, 19 nt, Homo sapiens
agauaaggacuuugccauu

SEQ ID NO: 386908 - RNA, 19 nt, Homo sapiens
ugcguuuaaugcagaauuu

SEQ ID NO: 386909 - RNA, 19 nt, Homo sapiens
acccagggcacaaugauaa

SEQ ID NO: 386910 - RNA, 19 nt, Homo sapiens
gaugcagccaauuauaaug

SEQ ID NO: 386911 - RNA, 19 nt, Homo sapiens
gcuauguugcgaauuuguu

SEQ ID NO: 386912 - RNA, 19 nt, Homo sapiens
ugcugugacuaauccaaua

SEQ ID NO: 386913 - RNA, 19 nt, Homo sapiens
gacccuuuaaacccuauua

SEQ ID NO: 386914 - RNA, 19 nt, Homo sapiens
caagugugauccugaugcu

SEQ ID NO: 386915 - RNA, 19 nt, Homo sapiens
uugcaugaauacaacuuug

SEQ ID NO: 386916 - RNA, 19 nt, Homo sapiens
gcguuuaaugcagaauuua

SEQ ID NO: 386917 - RNA, 19 nt, Homo sapiens
gaauguuauccaucuaaag

SEQ ID NO: 386918 - RNA, 19 nt, Homo sapiens
gcagauaaggauguguuuc

SEQ ID NO: 386919 - RNA, 19 nt, Homo sapiens
uaccaacagacguggauaa

SEQ ID NO: 386920 - RNA, 19 nt, Homo sapiens
aaagcacucaugaccauug

SEQ ID NO: 386921 - RNA, 19 nt, Homo sapiens
ugaugcagccaauuauaau

SEQ ID NO: 386922 - RNA, 19 nt, Homo sapiens
uaauuggcgugaaaguucu

SEQ ID NO: 386923 - RNA, 19 nt, Homo sapiens
cauuguggaugcuuuacca

SEQ ID NO: 386924 - RNA, 19 nt, Homo sapiens
cauuggaaagcauuaguga

SEQ ID NO: 386925 - RNA, 19 nt, Homo sapiens
guuuagaagguauaagguu

SEQ ID NO: 386926 - RNA, 19 nt, Homo sapiens
gggaagacccagggcacaa

SEQ ID NO: 386927 - RNA, 19 nt, Homo sapiens
gcugugacuaauccaauau

SEQ ID NO: 386928 - RNA, 19 nt, Homo sapiens
gauauugcuacaucguguu

SEQ ID NO: 386929 - RNA, 19 nt, Homo sapiens
guagguaaccggcauauua

SEQ ID NO: 386930 - RNA, 19 nt, Homo sapiens
gcacaaauauccaccacuu

SEQ ID NO: 386931 - RNA, 19 nt, Homo sapiens
ucacggagcucacggaauu

SEQ ID NO: 386932 - RNA, 19 nt, Homo sapiens
ggaaauggguuuauaacuc

SEQ ID NO: 386933 - RNA, 19 nt, Homo sapiens
gaaguucaaugcacuggaa

SEQ ID NO: 386934 - RNA, 19 nt, Homo sapiens
gaacaugacauagaagauu

SEQ ID NO: 386935 - RNA, 19 nt, Homo sapiens
ggauaguucuggaagcuuu

SEQ ID NO: 386936 - RNA, 19 nt, Homo sapiens
acaaauauccaccacuuua

SEQ ID NO: 386937 - RNA, 19 nt, Homo sapiens
gaagaguuccugcaagaaa

SEQ ID NO: 386938 - RNA, 19 nt, Homo sapiens
guuuauaacucgugaauuc

SEQ ID NO: 386939 - RNA, 19 nt, Homo sapiens
gacucaagcugguguauga

SEQ ID NO: 386940 - RNA, 19 nt, Homo sapiens
ggaaacauccaagagauuu

SEQ ID NO: 386941 - RNA, 19 nt, Homo sapiens
guauggaaauggguuuaua

SEQ ID NO: 386942 - RNA, 19 nt, Homo sapiens
uaaggaaaccguucuguga

SEQ ID NO: 386943 - RNA, 19 nt, Homo sapiens
gaaacaaaugccaguauug

SEQ ID NO: 386944 - RNA, 19 nt, Homo sapiens
ggaaaccguucugugauau

SEQ ID NO: 386945 - RNA, 19 nt, Homo sapiens
agaaacaaaugccaguauu

SEQ ID NO: 386946 - RNA, 19 nt, Homo sapiens
caaauauccaccacuuuaa

SEQ ID NO: 386947 - RNA, 19 nt, Homo sapiens
cagauucagugucauguga

SEQ ID NO: 386948 - RNA, 19 nt, Homo sapiens
ccaauggcauccagaacaa

SEQ ID NO: 386949 - RNA, 19 nt, Homo sapiens
ggaaaggccaguaacaauc

SEQ ID NO: 386950 - RNA, 19 nt, Homo sapiens
gcugggaaguucaagauca

SEQ ID NO: 386951 - RNA, 19 nt, Homo sapiens
aggaaaccguucugugaua

SEQ ID NO: 386952 - RNA, 19 nt, Homo sapiens
gcaggaggguauuguacau

SEQ ID NO: 386953 - RNA, 19 nt, Homo sapiens
gcaaccacccggacgauau

SEQ ID NO: 386954 - RNA, 19 nt, Homo sapiens
gccaagaucugagaaagca

SEQ ID NO: 386955 - RNA, 19 nt, Homo sapiens
gccaugcugucuucuguga

SEQ ID NO: 386956 - RNA, 19 nt, Homo sapiens
ggacgugcuuccugcuuca

SEQ ID NO: 386957 - RNA, 19 nt, Homo sapiens
gccagcagauucaguguca

SEQ ID NO: 386958 - RNA, 19 nt, Homo sapiens
gugcagaucaucaagaaga

SEQ ID NO: 386959 - RNA, 19 nt, Homo sapiens
uaucauggaacccaaguuu

SEQ ID NO: 386960 - RNA, 19 nt, Homo sapiens
caagugacauugcuaaaau

SEQ ID NO: 386961 - RNA, 19 nt, Homo sapiens
gcuuuggcuuuacggaaua

SEQ ID NO: 386962 - RNA, 19 nt, Homo sapiens
cugaagaguuccugcaaga

SEQ ID NO: 386963 - RNA, 19 nt, Homo sapiens
ggacgaaugccaagaucug

SEQ ID NO: 386964 - RNA, 19 nt, Homo sapiens
caaagugccagcagauuca

SEQ ID NO: 386965 - RNA, 19 nt, Homo sapiens
gcugguagcguauggaaau

SEQ ID NO: 386966 - RNA, 19 nt, Homo sapiens
ucauggaacccaaguuuga

SEQ ID NO: 386967 - RNA, 19 nt, Homo sapiens
caagaucugagaaagcaaa

SEQ ID NO: 386968 - RNA, 19 nt, Homo sapiens
gcuuccugcuucauagaua

SEQ ID NO: 386969 - RNA, 19 nt, Homo sapiens
gaucaaagugccagcagau

SEQ ID NO: 386970 - RNA, 19 nt, Homo sapiens
caacaugaacaaggucaaa

SEQ ID NO: 386971 - RNA, 19 nt, Homo sapiens
gggaaacauccaagagauu

SEQ ID NO: 386972 - RNA, 19 nt, Homo sapiens
gcaagaaaugggaaacauc

SEQ ID NO: 386973 - RNA, 19 nt, Homo sapiens
cccguuaucugaagaguuc

SEQ ID NO: 386974 - RNA, 19 nt, Homo sapiens
gguaaccggcauauuauuc

SEQ ID NO: 386975 - RNA, 19 nt, Homo sapiens
gaaguucaagaucaaagug

SEQ ID NO: 386976 - RNA, 19 nt, Homo sapiens
caauccaccuuuugucaua

SEQ ID NO: 386977 - RNA, 19 nt, Homo sapiens
ccaguaacaauccaccuuu

SEQ ID NO: 386978 - RNA, 19 nt, Homo sapiens
ugaaacugcagaucucaaa

SEQ ID NO: 386979 - RNA, 19 nt, Homo sapiens
caugcugucuucugugaug

SEQ ID NO: 386980 - RNA, 19 nt, Homo sapiens
uagagagcccguuaucuga

SEQ ID NO: 386981 - RNA, 19 nt, Homo sapiens
cuagagagcccguuaucug

SEQ ID NO: 386982 - RNA, 19 nt, Homo sapiens
uauaacucgugaauuccua

SEQ ID NO: 386983 - RNA, 19 nt, Homo sapiens
caagacaagcucagaacug

SEQ ID NO: 386984 - RNA, 19 nt, Homo sapiens
gaggauaguucuggaagcu

SEQ ID NO: 386985 - RNA, 19 nt, Homo sapiens
gagagcccguuaucugaag

SEQ ID NO: 386986 - RNA, 19 nt, Homo sapiens
auccaccacuuuaaccuua

SEQ ID NO: 386987 - RNA, 19 nt, Homo sapiens
ucagaucagccacaccuuu

SEQ ID NO: 386988 - RNA, 19 nt, Homo sapiens
gaacccaaguuugauuuug

SEQ ID NO: 386989 - RNA, 19 nt, Homo sapiens
aaaccguucugugauauca

SEQ ID NO: 386990 - RNA, 19 nt, Homo sapiens
cuucugugaugaacaaaga

SEQ ID NO: 386991 - RNA, 19 nt, Homo sapiens
ugucuucugugaugaacaa

SEQ ID NO: 386992 - RNA, 19 nt, Homo sapiens
uaagagcauagaacucaaa

SEQ ID NO: 386993 - RNA, 19 nt, Homo sapiens
ucccaaaacuucuucaaaa

SEQ ID NO: 386994 - RNA, 19 nt, Homo sapiens
ccacccggacgauaucuuu

SEQ ID NO: 386995 - RNA, 19 nt, Homo sapiens
gaucguccuggccuucuaa

SEQ ID NO: 386996 - RNA, 19 nt, Homo sapiens
guucugugauaucauggaa

SEQ ID NO: 386997 - RNA, 19 nt, Homo sapiens
ucaaagugccagcagauuc

SEQ ID NO: 386998 - RNA, 19 nt, Homo sapiens
acagggacauguacugagu

SEQ ID NO: 386999 - RNA, 19 nt, Homo sapiens
ggaggguauuguacaugug

SEQ ID NO: 387000 - RNA, 19 nt, Homo sapiens
aaacugaaagcagaaauuc

SEQ ID NO: 387001 - RNA, 19 nt, Homo sapiens
cagaaacaaaugccaguau

SEQ ID NO: 387002 - RNA, 19 nt, Homo sapiens
ggacgauaucuuucucuuc

SEQ ID NO: 387003 - RNA, 19 nt, Homo sapiens
gaaacugcagaucucaaau

SEQ ID NO: 387004 - RNA, 19 nt, Homo sapiens
gaagcuguccuggcucaga

SEQ ID NO: 387005 - RNA, 19 nt, Homo sapiens
ugggaaacauccaagagau

SEQ ID NO: 387006 - RNA, 19 nt, Homo sapiens
aagaguuccugcaagaaau

SEQ ID NO: 387007 - RNA, 19 nt, Homo sapiens
uagguaaccggcauauuau

SEQ ID NO: 387008 - RNA, 19 nt, Homo sapiens
ggaaguucaagaucaaagu

SEQ ID NO: 387009 - RNA, 19 nt, Homo sapiens
gaaaggccaguaacaaucc

SEQ ID NO: 387010 - RNA, 19 nt, Homo sapiens
cuacgaggccuacuugaag

SEQ ID NO: 387011 - RNA, 19 nt, Homo sapiens
ucaagcugguguaugacaa

SEQ ID NO: 387012 - RNA, 19 nt, Homo sapiens
gacauguacugaguuccuu

SEQ ID NO: 387013 - RNA, 19 nt, Homo sapiens
uggugcagaucaucaagaa

SEQ ID NO: 387014 - RNA, 19 nt, Homo sapiens
gcacaaccagcaccaucug

SEQ ID NO: 387015 - RNA, 19 nt, Homo sapiens
caggaaaggccaguaacaa

SEQ ID NO: 387016 - RNA, 19 nt, Homo sapiens
gaaucuacgaggccuacuu

SEQ ID NO: 387017 - RNA, 19 nt, Homo sapiens
aacaugacauagaagauuc

SEQ ID NO: 387018 - RNA, 19 nt, Homo sapiens
cugugaacaugacauagaa

SEQ ID NO: 387019 - RNA, 19 nt, Homo sapiens
agucugagcuguagguaac

SEQ ID NO: 387020 - RNA, 19 nt, Homo sapiens
ccaagcugguggccaaugg

SEQ ID NO: 387021 - RNA, 19 nt, Homo sapiens
uacgaggccuacuugaaga

SEQ ID NO: 387022 - RNA, 19 nt, Homo sapiens
gaaauucuuaccugugaac

SEQ ID NO: 387023 - RNA, 19 nt, Homo sapiens
ccaccacuuuaaccuuaga

SEQ ID NO: 387024 - RNA, 19 nt, Homo sapiens
caaagacgggaugcuggua

SEQ ID NO: 387025 - RNA, 19 nt, Homo sapiens
gugaacaugacauagaaga

SEQ ID NO: 387026 - RNA, 19 nt, Homo sapiens
cgaaugccaagaucugaga

SEQ ID NO: 387027 - RNA, 19 nt, Homo sapiens
gaucuagagagcccguuau

SEQ ID NO: 387028 - RNA, 19 nt, Homo sapiens
cuaagagcauagaacucaa

SEQ ID NO: 387029 - RNA, 19 nt, Homo sapiens
gagcgcagcugcaagauuc

SEQ ID NO: 387030 - RNA, 19 nt, Homo sapiens
gcaugaagcuggaguacga

SEQ ID NO: 387031 - RNA, 19 nt, Homo sapiens
ggauacagcucuucucagu

SEQ ID NO: 387032 - RNA, 19 nt, Homo sapiens
aaacugagccuguucauuc

SEQ ID NO: 387033 - RNA, 19 nt, Homo sapiens
ggaagcaguuggugaaugg

SEQ ID NO: 387034 - RNA, 19 nt, Homo sapiens
cgcaaacccuucagugaua

SEQ ID NO: 387035 - RNA, 19 nt, Homo sapiens
gcugcaagauucagaagaa

SEQ ID NO: 387036 - RNA, 19 nt, Homo sapiens
ggacaguguuguacagugu

SEQ ID NO: 387037 - RNA, 19 nt, Homo sapiens
ugaauuugcugucaaguuc

SEQ ID NO: 387038 - RNA, 19 nt, Homo sapiens
cgucuguccuccuuucuua

SEQ ID NO: 387039 - RNA, 19 nt, Homo sapiens
gagccuaaguuugaauuug

SEQ ID NO: 387040 - RNA, 19 nt, Homo sapiens
gggaagaggaggagaaaga

SEQ ID NO: 387041 - RNA, 19 nt, Homo sapiens
gaacaggaccucugcuuuu

SEQ ID NO: 387042 - RNA, 19 nt, Homo sapiens
ccacaugacuuuuccauug

SEQ ID NO: 387043 - RNA, 19 nt, Homo sapiens
ucauugagccuaaguuuga

SEQ ID NO: 387044 - RNA, 19 nt, Homo sapiens
gcaagauucagaagaagaa

SEQ ID NO: 387045 - RNA, 19 nt, Homo sapiens
gggauaaacugagccuguu

SEQ ID NO: 387046 - RNA, 19 nt, Homo sapiens
gcacagagguaggagaacu

SEQ ID NO: 387047 - RNA, 19 nt, Homo sapiens
cauaagcacugaaaucacu

SEQ ID NO: 387048 - RNA, 19 nt, Homo sapiens
acagugaccuggcccuauu

SEQ ID NO: 387049 - RNA, 19 nt, Homo sapiens
gcaaacccuucagugauau

SEQ ID NO: 387050 - RNA, 19 nt, Homo sapiens
cuacaaugccuaccugaaa

SEQ ID NO: 387051 - RNA, 19 nt, Homo sapiens
auacagcucuucucagugu

SEQ ID NO: 387052 - RNA, 19 nt, Homo sapiens
gcacugaaaucacuuuacc

SEQ ID NO: 387053 - RNA, 19 nt, Homo sapiens
gaagaagaaccgcaacaag

SEQ ID NO: 387054 - RNA, 19 nt, Homo sapiens
caacgagggucuggaaugg

SEQ ID NO: 387055 - RNA, 19 nt, Homo sapiens
gagcacagagguaggagaa

SEQ ID NO: 387056 - RNA, 19 nt, Homo sapiens
gcacugggcaugucacaca

SEQ ID NO: 387057 - RNA, 19 nt, Homo sapiens
ggucuggaguggucuggaa

SEQ ID NO: 387058 - RNA, 19 nt, Homo sapiens
gaccuggcccuauucauug

SEQ ID NO: 387059 - RNA, 19 nt, Homo sapiens
ccacuacgguguucaugca

SEQ ID NO: 387060 - RNA, 19 nt, Homo sapiens
caacagaugaagacagaug

SEQ ID NO: 387061 - RNA, 19 nt, Homo sapiens
ugaccuggcccuauucauu

SEQ ID NO: 387062 - RNA, 19 nt, Homo sapiens
ucacugaguucgccaagag

SEQ ID NO: 387063 - RNA, 19 nt, Homo sapiens
ccaagcacaucuacaaugc

SEQ ID NO: 387064 - RNA, 19 nt, Homo sapiens
ccaguguccuuccaucuuc

SEQ ID NO: 387065 - RNA, 19 nt, Homo sapiens
gugauaucauugagccuaa

SEQ ID NO: 387066 - RNA, 19 nt, Homo sapiens
caacggcaguggcuuuguc

SEQ ID NO: 387067 - RNA, 19 nt, Homo sapiens
ggaaguggcagaggcagaa

SEQ ID NO: 387068 - RNA, 19 nt, Homo sapiens
gaggauacagcucuucuca

SEQ ID NO: 387069 - RNA, 19 nt, Homo sapiens
ggcaggagcgggagaauuc

SEQ ID NO: 387070 - RNA, 19 nt, Homo sapiens
ccacgucuguccuccuuuc

SEQ ID NO: 387071 - RNA, 19 nt, Homo sapiens
guacacagacugacgaaac

SEQ ID NO: 387072 - RNA, 19 nt, Homo sapiens
gacuugagccauccaaaga

SEQ ID NO: 387073 - RNA, 19 nt, Homo sapiens
aggcuuagguccucacuuc

SEQ ID NO: 387074 - RNA, 19 nt, Homo sapiens
uccaggagaucuacaagga

SEQ ID NO: 387075 - RNA, 19 nt, Homo sapiens
uaucauugagccuaaguuu

SEQ ID NO: 387076 - RNA, 19 nt, Homo sapiens
ggaaagcagggucagauac

SEQ ID NO: 387077 - RNA, 19 nt, Homo sapiens
acacacacauaagcacuga

SEQ ID NO: 387078 - RNA, 19 nt, Homo sapiens
ucucaguuccucuuucuuu

SEQ ID NO: 387079 - RNA, 19 nt, Homo sapiens
agguuacccuucucaagua

SEQ ID NO: 387080 - RNA, 19 nt, Homo sapiens
uaaauaguguacacagacu

SEQ ID NO: 387081 - RNA, 19 nt, Homo sapiens
acacauaagcacugaaauc

SEQ ID NO: 387082 - RNA, 19 nt, Homo sapiens
cuugagccauccaaagaaa

SEQ ID NO: 387083 - RNA, 19 nt, Homo sapiens
ucacuucugucuccugucu

SEQ ID NO: 387084 - RNA, 19 nt, Homo sapiens
acaaggacauguacuaacg

SEQ ID NO: 387085 - RNA, 19 nt, Homo sapiens
agaagaaccgcaacaagug

SEQ ID NO: 387086 - RNA, 19 nt, Homo sapiens
gauaaacugagccuguuca

SEQ ID NO: 387087 - RNA, 19 nt, Homo sapiens
acacacauaagcacugaaa

SEQ ID NO: 387088 - RNA, 19 nt, Homo sapiens
accaacagaugaagacaga

SEQ ID NO: 387089 - RNA, 19 nt, Homo sapiens
gaucagcgugcacgucuuc

SEQ ID NO: 387090 - RNA, 19 nt, Homo sapiens
aagaagaaccgcaacaagu

SEQ ID NO: 387091 - RNA, 19 nt, Homo sapiens
gaugggaaccacccuguag

SEQ ID NO: 387092 - RNA, 19 nt, Homo sapiens
cacauaagcacugaaauca

SEQ ID NO: 387093 - RNA, 19 nt, Homo sapiens
cuuauucugugagauguuu

SEQ ID NO: 387094 - RNA, 19 nt, Homo sapiens
caaguucaacgcccuggaa

SEQ ID NO: 387095 - RNA, 19 nt, Homo sapiens
acagacugacgaaacuuua

SEQ ID NO: 387096 - RNA, 19 nt, Homo sapiens
gcaacaagugccaguacug

SEQ ID NO: 387097 - RNA, 19 nt, Homo sapiens
gcaugucacacaacgcuau

SEQ ID NO: 387098 - RNA, 19 nt, Homo sapiens
acaguguuguacaguguuu

SEQ ID NO: 387099 - RNA, 19 nt, Homo sapiens
ccagcucucuuccugucuu

SEQ ID NO: 387100 - RNA, 19 nt, Homo sapiens
ccaacgagggucuggaaug

SEQ ID NO: 387101 - RNA, 19 nt, Homo sapiens
gcggcagccucaacaugga

SEQ ID NO: 387102 - RNA, 19 nt, Homo sapiens
gacgaugccagagcuauga

SEQ ID NO: 387103 - RNA, 19 nt, Homo sapiens
agacugacgaaacuuuaaa

SEQ ID NO: 387104 - RNA, 19 nt, Homo sapiens
ucauucugauguccauuug

SEQ ID NO: 387105 - RNA, 19 nt, Homo sapiens
agaacaggaccucugcuuu

SEQ ID NO: 387106 - RNA, 19 nt, Homo sapiens
gguuacccuucucaaguau

SEQ ID NO: 387107 - RNA, 19 nt, Homo sapiens
cagguuacccuucucaagu

SEQ ID NO: 387108 - RNA, 19 nt, Homo sapiens
gaagcuggaguacgagaag

SEQ ID NO: 387109 - RNA, 19 nt, Homo sapiens
cuacgguguucaugcaugu

SEQ ID NO: 387110 - RNA, 19 nt, Homo sapiens
cagacugacgaaacuuuaa

SEQ ID NO: 387111 - RNA, 19 nt, Homo sapiens
gagcuucccgggauaaacu

SEQ ID NO: 387112 - RNA, 19 nt, Homo sapiens
uggaaagcagggucagaua

SEQ ID NO: 387113 - RNA, 19 nt, Homo sapiens
guggagcagugaucucuac

SEQ ID NO: 387114 - RNA, 19 nt, Homo sapiens
uaauuccuguugcucuguu

SEQ ID NO: 387115 - RNA, 19 nt, Homo sapiens
cagcucucuuccugucuuu

SEQ ID NO: 387116 - RNA, 19 nt, Homo sapiens
ccauugaccagcucucuuc

SEQ ID NO: 387117 - RNA, 19 nt, Homo sapiens
ggagaucuacaaggacaug

SEQ ID NO: 387118 - RNA, 19 nt, Homo sapiens
cauccugcgugcccucgaa

SEQ ID NO: 387119 - RNA, 19 nt, Homo sapiens
ccgcaaacccuucagugau

SEQ ID NO: 387120 - RNA, 19 nt, Homo sapiens
agaaggggcugguguggaa

SEQ ID NO: 387121 - RNA, 19 nt, Homo sapiens
gauguccauuugucccaau

SEQ ID NO: 387122 - RNA, 19 nt, Homo sapiens
acccuucagugauaucauu

SEQ ID NO: 387123 - RNA, 19 nt, Homo sapiens
ccucuaucgucaacaagga

SEQ ID NO: 387124 - RNA, 19 nt, Homo sapiens
uccacgacaucgagacauu

SEQ ID NO: 387125 - RNA, 19 nt, Homo sapiens
uaaacugagccuguucauu

SEQ ID NO: 387126 - RNA, 19 nt, Homo sapiens
ucuccugucuucagagcaa

SEQ ID NO: 387127 - RNA, 19 nt, Homo sapiens
ucuguagguuucucucuuc

SEQ ID NO: 387128 - RNA, 19 nt, Homo sapiens
caaggacgggcugcuggua

SEQ ID NO: 387129 - RNA, 19 nt, Homo sapiens
gauugaagcuuaucuauga

SEQ ID NO: 387130 - RNA, 19 nt, Homo sapiens
agacucagcucuacaauaa

SEQ ID NO: 387131 - RNA, 19 nt, Homo sapiens
ccaaguaacucuccucaaa

SEQ ID NO: 387132 - RNA, 19 nt, Homo sapiens
agauaaagcuucuggauuu

SEQ ID NO: 387133 - RNA, 19 nt, Homo sapiens
gaaguucaaugcacuggaa

SEQ ID NO: 387134 - RNA, 19 nt, Homo sapiens
gacaugaauuccuuaauga

SEQ ID NO: 387135 - RNA, 19 nt, Homo sapiens
ccuaagaaauuuacuguga

SEQ ID NO: 387136 - RNA, 19 nt, Homo sapiens
guaccaaagugcaaucaaa

SEQ ID NO: 387137 - RNA, 19 nt, Homo sapiens
ugacaugaauuccuuaaug

SEQ ID NO: 387138 - RNA, 19 nt, Homo sapiens
ucaaugcacuggaauuaga

SEQ ID NO: 387139 - RNA, 19 nt, Homo sapiens
aaguaacucuccucaaaua

SEQ ID NO: 387140 - RNA, 19 nt, Homo sapiens
gacauuccauucacaagaa

SEQ ID NO: 387141 - RNA, 19 nt, Homo sapiens
gcauuucuacuccacauua

SEQ ID NO: 387142 - RNA, 19 nt, Homo sapiens
gggaaaaucugacaccuaa

SEQ ID NO: 387143 - RNA, 19 nt, Homo sapiens
ggccaaggcuucaugacaa

SEQ ID NO: 387144 - RNA, 19 nt, Homo sapiens
gcaauugaaugucgugucu

SEQ ID NO: 387145 - RNA, 19 nt, Homo sapiens
uuacaaguaugaccugaaa

SEQ ID NO: 387146 - RNA, 19 nt, Homo sapiens
acaauaagccucaugaaga

SEQ ID NO: 387147 - RNA, 19 nt, Homo sapiens
caagggaguuucuaaagag

SEQ ID NO: 387148 - RNA, 19 nt, Homo sapiens
gagauaaagcuucuggauu

SEQ ID NO: 387149 - RNA, 19 nt, Homo sapiens
caauaagccucaugaagag

SEQ ID NO: 387150 - RNA, 19 nt, Homo sapiens
acaagggaguuucuaaaga

SEQ ID NO: 387151 - RNA, 19 nt, Homo sapiens
gaucacagaguaugccaaa

SEQ ID NO: 387152 - RNA, 19 nt, Homo sapiens
gaaagacaacagacaaauc

SEQ ID NO: 387153 - RNA, 19 nt, Homo sapiens
gaaauaaaugucaguacug

SEQ ID NO: 387154 - RNA, 19 nt, Homo sapiens
ugacagaccucagacagau

SEQ ID NO: 387155 - RNA, 19 nt, Homo sapiens
gaaaugaccaugguugaca

SEQ ID NO: 387156 - RNA, 19 nt, Homo sapiens
gguugcagauuacaaguau

SEQ ID NO: 387157 - RNA, 19 nt, Homo sapiens
aagaacagauccagugguu

SEQ ID NO: 387158 - RNA, 19 nt, Homo sapiens
gcacuggaauuagaugaca

SEQ ID NO: 387159 - RNA, 19 nt, Homo sapiens
guucaaugcacuggaauua

SEQ ID NO: 387160 - RNA, 19 nt, Homo sapiens
caccauucguuaucuauga

SEQ ID NO: 387161 - RNA, 19 nt, Homo sapiens
gacaaaucaccauucguua

SEQ ID NO: 387162 - RNA, 19 nt, Homo sapiens
gaagcccauugaagacauu

SEQ ID NO: 387163 - RNA, 19 nt, Homo sapiens
ugcaggagaucacagagua

SEQ ID NO: 387164 - RNA, 19 nt, Homo sapiens
gauaaagcuucuggauuuc

SEQ ID NO: 387165 - RNA, 19 nt, Homo sapiens
gaagacauuccauucacaa

SEQ ID NO: 387166 - RNA, 19 nt, Homo sapiens
ucaagaagacggagacaga

SEQ ID NO: 387167 - RNA, 19 nt, Homo sapiens
ugacagcgacuuggcaaua

SEQ ID NO: 387168 - RNA, 19 nt, Homo sapiens
agacaaaucaccauucguu

SEQ ID NO: 387169 - RNA, 19 nt, Homo sapiens
caacagacaaaucaccauu

SEQ ID NO: 387170 - RNA, 19 nt, Homo sapiens
acacaaugcuggccuccuu

SEQ ID NO: 387171 - RNA, 19 nt, Homo sapiens
uaacucuccucaaauaugg

SEQ ID NO: 387172 - RNA, 19 nt, Homo sapiens
ggaaagacaacagacaaau

SEQ ID NO: 387173 - RNA, 19 nt, Homo sapiens
gauaucaagcccuucacua

SEQ ID NO: 387174 - RNA, 19 nt, Homo sapiens
aaagacaacagacaaauca

SEQ ID NO: 387175 - RNA, 19 nt, Homo sapiens
gacagcgacuuggcaauau

SEQ ID NO: 387176 - RNA, 19 nt, Homo sapiens
guaacucuccucaaauaug

SEQ ID NO: 387177 - RNA, 19 nt, Homo sapiens
ggagauaaagcuucuggau

SEQ ID NO: 387178 - RNA, 19 nt, Homo sapiens
guugacuucuccagcauuu

SEQ ID NO: 387179 - RNA, 19 nt, Homo sapiens
ucugacaccuaagaaauuu

SEQ ID NO: 387180 - RNA, 19 nt, Homo sapiens
caagacaaccugcuacaag

SEQ ID NO: 387181 - RNA, 19 nt, Homo sapiens
caaaucaccauucguuauc

SEQ ID NO: 387182 - RNA, 19 nt, Homo sapiens
ugucgugucuguggagaua

SEQ ID NO: 387183 - RNA, 19 nt, Homo sapiens
gaaaaugacagaccucaga

SEQ ID NO: 387184 - RNA, 19 nt, Homo sapiens
cuaaagagccugcgaaagc

SEQ ID NO: 387185 - RNA, 19 nt, Homo sapiens
ugacaagggaguuucuaaa

SEQ ID NO: 387186 - RNA, 19 nt, Homo sapiens
ccaaaagcauuccugguuu

SEQ ID NO: 387187 - RNA, 19 nt, Homo sapiens
ccaacucccucauggcaau

SEQ ID NO: 387188 - RNA, 19 nt, Homo sapiens
cagguuugcugaaugugaa

SEQ ID NO: 387189 - RNA, 19 nt, Homo sapiens
ucuaugacaugaauuccuu

SEQ ID NO: 387190 - RNA, 19 nt, Homo sapiens
ggauuucacuauggaguuc

SEQ ID NO: 387191 - RNA, 19 nt, Homo sapiens
gaaaaucugacaccuaaga

SEQ ID NO: 387192 - RNA, 19 nt, Homo sapiens
gccaacauuucccuucuuc

SEQ ID NO: 387193 - RNA, 19 nt, Homo sapiens
gcccagguuugcugaaugu

SEQ ID NO: 387194 - RNA, 19 nt, Homo sapiens
cgaagacauuccauucaca

SEQ ID NO: 387195 - RNA, 19 nt, Homo sapiens
ugcaggagaucuacaagga

SEQ ID NO: 387196 - RNA, 19 nt, Homo sapiens
uuauggagcccaaguuuga

SEQ ID NO: 387197 - RNA, 19 nt, Homo sapiens
gacaagggaguuucuaaag

SEQ ID NO: 387198 - RNA, 19 nt, Homo sapiens
ggaguccacgagaucauuu

SEQ ID NO: 387199 - RNA, 19 nt, Homo sapiens
caaguaacucuccucaaau

SEQ ID NO: 387200 - RNA, 19 nt, Homo sapiens
cauaaugccaucagguuug

SEQ ID NO: 387201 - RNA, 19 nt, Homo sapiens
ggacuuguacuagcagaga

SEQ ID NO: 387202 - RNA, 19 nt, Homo sapiens
gaagacggagacagacaug

SEQ ID NO: 387203 - RNA, 19 nt, Homo sapiens
uugccaagcugcuccagaa

SEQ ID NO: 387204 - RNA, 19 nt, Homo sapiens
ugaguuugcugugaaguuc

SEQ ID NO: 387205 - RNA, 19 nt, Homo sapiens
ccuccuugaugaauaaaga

SEQ ID NO: 387206 - RNA, 19 nt, Homo sapiens
uuucagggcugccaguuuc

SEQ ID NO: 387207 - RNA, 19 nt, Homo sapiens
acaaaucaccauucguuau

SEQ ID NO: 387208 - RNA, 19 nt, Homo sapiens
ugaccaugguugacacaga

SEQ ID NO: 387209 - RNA, 19 nt, Homo sapiens
gagcccaaguuugaguuug

SEQ ID NO: 387210 - RNA, 19 nt, Homo sapiens
ccaaagugcaaucaaagug

SEQ ID NO: 387211 - RNA, 19 nt, Homo sapiens
gcacuauucugagggaaaa

SEQ ID NO: 387212 - RNA, 19 nt, Homo sapiens
cagaaaugaccaugguuga

SEQ ID NO: 387213 - RNA, 19 nt, Homo sapiens
ggaucucuccguaauggaa

SEQ ID NO: 387214 - RNA, 19 nt, Homo sapiens
ccgcagaaaugaccauggu

SEQ ID NO: 387215 - RNA, 19 nt, Homo sapiens
auccagugguugcagauua

SEQ ID NO: 387216 - RNA, 19 nt, Homo sapiens
uggccuccuugaugaauaa

SEQ ID NO: 387217 - RNA, 19 nt, Homo sapiens
caugaauuccuuaaugaug

SEQ ID NO: 387218 - RNA, 19 nt, Homo sapiens
acucauacauaaaguccuu

SEQ ID NO: 387219 - RNA, 19 nt, Homo sapiens
guggagaccgcccagguuu

SEQ ID NO: 387220 - RNA, 19 nt, Homo sapiens
acagcgacuuggcaauauu

SEQ ID NO: 387221 - RNA, 19 nt, Homo sapiens
uuacgaagacauuccauuc

SEQ ID NO: 387222 - RNA, 19 nt, Homo sapiens
aaucaccauucguuaucua

SEQ ID NO: 387223 - RNA, 19 nt, Homo sapiens
ccucauggcaauugaaugu

SEQ ID NO: 387224 - RNA, 19 nt, Homo sapiens
caacauuucccuucuucca

SEQ ID NO: 387225 - RNA, 19 nt, Homo sapiens
guggaucucuccguaaugg

SEQ ID NO: 387226 - RNA, 19 nt, Homo sapiens
uuaaugaugggagaagaua

SEQ ID NO: 387227 - RNA, 19 nt, Homo sapiens
cguuaucuaugacaugaau

SEQ ID NO: 387228 - RNA, 19 nt, Homo sapiens
caggaaagacaacagacaa

SEQ ID NO: 387229 - RNA, 19 nt, Homo sapiens
gauugaagcuuaucuauga

SEQ ID NO: 387230 - RNA, 19 nt, Homo sapiens
gcaaacauaucacaagaaa

SEQ ID NO: 387231 - RNA, 19 nt, Homo sapiens
agacucagcucuacaauaa

SEQ ID NO: 387232 - RNA, 19 nt, Homo sapiens
ccaaguaacucuccucaaa

SEQ ID NO: 387233 - RNA, 19 nt, Homo sapiens
agauaaagcuucuggauuu

SEQ ID NO: 387234 - RNA, 19 nt, Homo sapiens
gaaguucaaugcacuggaa

SEQ ID NO: 387235 - RNA, 19 nt, Homo sapiens
gacaugaauuccuuaauga

SEQ ID NO: 387236 - RNA, 19 nt, Homo sapiens
ccuaagaaauuuacuguga

SEQ ID NO: 387237 - RNA, 19 nt, Homo sapiens
guaccaaagugcaaucaaa

SEQ ID NO: 387238 - RNA, 19 nt, Homo sapiens
ugacaugaauuccuuaaug

SEQ ID NO: 387239 - RNA, 19 nt, Homo sapiens
ucaaugcacuggaauuaga

SEQ ID NO: 387240 - RNA, 19 nt, Homo sapiens
aaguaacucuccucaaaua

SEQ ID NO: 387241 - RNA, 19 nt, Homo sapiens
gacauuccauucacaagaa

SEQ ID NO: 387242 - RNA, 19 nt, Homo sapiens
gcauuucuacuccacauua

SEQ ID NO: 387243 - RNA, 19 nt, Homo sapiens
gggaaaaucugacaccuaa

SEQ ID NO: 387244 - RNA, 19 nt, Homo sapiens
caaauucuguuacuucaag

SEQ ID NO: 387245 - RNA, 19 nt, Homo sapiens
ggccaaggcuucaugacaa

SEQ ID NO: 387246 - RNA, 19 nt, Homo sapiens
gcaauugaaugucgugucu

SEQ ID NO: 387247 - RNA, 19 nt, Homo sapiens
uuacaaguaugaccugaaa

SEQ ID NO: 387248 - RNA, 19 nt, Homo sapiens
acaauaagccucaugaaga

SEQ ID NO: 387249 - RNA, 19 nt, Homo sapiens
caagggaguuucuaaagag

SEQ ID NO: 387250 - RNA, 19 nt, Homo sapiens
gagauaaagcuucuggauu

SEQ ID NO: 387251 - RNA, 19 nt, Homo sapiens
caauaagccucaugaagag

SEQ ID NO: 387252 - RNA, 19 nt, Homo sapiens
acaagggaguuucuaaaga

SEQ ID NO: 387253 - RNA, 19 nt, Homo sapiens
gaucacagaguaugccaaa

SEQ ID NO: 387254 - RNA, 19 nt, Homo sapiens
gaaagacaacagacaaauc

SEQ ID NO: 387255 - RNA, 19 nt, Homo sapiens
gaaauaaaugucaguacug

SEQ ID NO: 387256 - RNA, 19 nt, Homo sapiens
ugacagaccucagacagau

SEQ ID NO: 387257 - RNA, 19 nt, Homo sapiens
gguugcagauuacaaguau

SEQ ID NO: 387258 - RNA, 19 nt, Homo sapiens
aagaacagauccagugguu

SEQ ID NO: 387259 - RNA, 19 nt, Homo sapiens
gaaaugaccaugguugaca

SEQ ID NO: 387260 - RNA, 19 nt, Homo sapiens
uacacugucugcaaacaua

SEQ ID NO: 387261 - RNA, 19 nt, Homo sapiens
gcacuggaauuagaugaca

SEQ ID NO: 387262 - RNA, 19 nt, Homo sapiens
guucaaugcacuggaauua

SEQ ID NO: 387263 - RNA, 19 nt, Homo sapiens
caccauucguuaucuauga

SEQ ID NO: 387264 - RNA, 19 nt, Homo sapiens
gacaaaucaccauucguua

SEQ ID NO: 387265 - RNA, 19 nt, Homo sapiens
gaagcccauugaagacauu

SEQ ID NO: 387266 - RNA, 19 nt, Homo sapiens
ugcaggagaucacagagua

SEQ ID NO: 387267 - RNA, 19 nt, Homo sapiens
gauaaagcuucuggauuuc

SEQ ID NO: 387268 - RNA, 19 nt, Homo sapiens
gaagacauuccauucacaa

SEQ ID NO: 387269 - RNA, 19 nt, Homo sapiens
ucaagaagacggagacaga

SEQ ID NO: 387270 - RNA, 19 nt, Homo sapiens
ugacagcgacuuggcaaua

SEQ ID NO: 387271 - RNA, 19 nt, Homo sapiens
agacaaaucaccauucguu

SEQ ID NO: 387272 - RNA, 19 nt, Homo sapiens
caacagacaaaucaccauu

SEQ ID NO: 387273 - RNA, 19 nt, Homo sapiens
acacaaugcuggccuccuu

SEQ ID NO: 387274 - RNA, 19 nt, Homo sapiens
uaacucuccucaaauaugg

SEQ ID NO: 387275 - RNA, 19 nt, Homo sapiens
ggaaagacaacagacaaau

SEQ ID NO: 387276 - RNA, 19 nt, Homo sapiens
gauaucaagcccuucacua

SEQ ID NO: 387277 - RNA, 19 nt, Homo sapiens
aaagacaacagacaaauca

SEQ ID NO: 387278 - RNA, 19 nt, Homo sapiens
ucacaaauucuguuacuuc

SEQ ID NO: 387279 - RNA, 19 nt, Homo sapiens
gacagcgacuuggcaauau

SEQ ID NO: 387280 - RNA, 19 nt, Homo sapiens
guaacucuccucaaauaug

SEQ ID NO: 387281 - RNA, 19 nt, Homo sapiens
ggagauaaagcuucuggau

SEQ ID NO: 387282 - RNA, 19 nt, Homo sapiens
guugacuucuccagcauuu

SEQ ID NO: 387283 - RNA, 19 nt, Homo sapiens
gugaaacucugggagauuc

SEQ ID NO: 387284 - RNA, 19 nt, Homo sapiens
ucugacaccuaagaaauuu

SEQ ID NO: 387285 - RNA, 19 nt, Homo sapiens
caagacaaccugcuacaag

SEQ ID NO: 387286 - RNA, 19 nt, Homo sapiens
caaaucaccauucguuauc

SEQ ID NO: 387287 - RNA, 19 nt, Homo sapiens
ugucgugucuguggagaua

SEQ ID NO: 387288 - RNA, 19 nt, Homo sapiens
gaaaaugacagaccucaga

SEQ ID NO: 387289 - RNA, 19 nt, Homo sapiens
cuaaagagccugcgaaagc

SEQ ID NO: 387290 - RNA, 19 nt, Homo sapiens
ugacaagggaguuucuaaa

SEQ ID NO: 387291 - RNA, 19 nt, Homo sapiens
cacaaauucuguuacuuca

SEQ ID NO: 387292 - RNA, 19 nt, Homo sapiens
ccaaaagcauuccugguuu

SEQ ID NO: 387293 - RNA, 19 nt, Homo sapiens
ggauugaucuuuugcuaga

SEQ ID NO: 387294 - RNA, 19 nt, Homo sapiens
ccaacucccucauggcaau

SEQ ID NO: 387295 - RNA, 19 nt, Homo sapiens
agaaagcgauuccuucacu

SEQ ID NO: 387296 - RNA, 19 nt, Homo sapiens
cagguuugcugaaugugaa

SEQ ID NO: 387297 - RNA, 19 nt, Homo sapiens
ucuaugacaugaauuccuu

SEQ ID NO: 387298 - RNA, 19 nt, Homo sapiens
ggauuucacuauggaguuc

SEQ ID NO: 387299 - RNA, 19 nt, Homo sapiens
gaaaaucugacaccuaaga

SEQ ID NO: 387300 - RNA, 19 nt, Homo sapiens
gccaacauuucccuucuuc

SEQ ID NO: 387301 - RNA, 19 nt, Homo sapiens
gcccagguuugcugaaugu

SEQ ID NO: 387302 - RNA, 19 nt, Homo sapiens
cgaagacauuccauucaca

SEQ ID NO: 387303 - RNA, 19 nt, Homo sapiens
cugcaaacauaucacaaga

SEQ ID NO: 387304 - RNA, 19 nt, Homo sapiens
cugauacacugucugcaaa

SEQ ID NO: 387305 - RNA, 19 nt, Homo sapiens
ugcaggagaucuacaagga

SEQ ID NO: 387306 - RNA, 19 nt, Homo sapiens
ccagaaagcgauuccuuca

SEQ ID NO: 387307 - RNA, 19 nt, Homo sapiens
uuauggagcccaaguuuga

SEQ ID NO: 387308 - RNA, 19 nt, Homo sapiens
gacaagggaguuucuaaag

SEQ ID NO: 387309 - RNA, 19 nt, Homo sapiens
ggaguccacgagaucauuu

SEQ ID NO: 387310 - RNA, 19 nt, Homo sapiens
caaguaacucuccucaaau

SEQ ID NO: 387311 - RNA, 19 nt, Homo sapiens
cauaaugccaucagguuug

SEQ ID NO: 387312 - RNA, 19 nt, Homo sapiens
ccuauuccaugcuguuaug

SEQ ID NO: 387313 - RNA, 19 nt, Homo sapiens
cacaagaaaugaccauggu

SEQ ID NO: 387314 - RNA, 19 nt, Homo sapiens
ggacuuguacuagcagaga

SEQ ID NO: 387315 - RNA, 19 nt, Homo sapiens
gaagacggagacagacaug

SEQ ID NO: 387316 - RNA, 19 nt, Homo sapiens
uugccaagcugcuccagaa

SEQ ID NO: 387317 - RNA, 19 nt, Homo sapiens
ugaguuugcugugaaguuc

SEQ ID NO: 387318 - RNA, 19 nt, Homo sapiens
ccuccuugaugaauaaaga

SEQ ID NO: 387319 - RNA, 19 nt, Homo sapiens
uuucagggcugccaguuuc

SEQ ID NO: 387320 - RNA, 19 nt, Homo sapiens
acaaaucaccauucguuau

SEQ ID NO: 387321 - RNA, 19 nt, Homo sapiens
gauacacugucugcaaaca

SEQ ID NO: 387322 - RNA, 19 nt, Homo sapiens
gagcccaaguuugaguuug

SEQ ID NO: 387323 - RNA, 19 nt, Homo sapiens
acucauggguguauucaca

SEQ ID NO: 387324 - RNA, 19 nt, Homo sapiens
ccaaagugcaaucaaagug

SEQ ID NO: 387325 - RNA, 19 nt, Homo sapiens
ugaccaugguugacacaga

SEQ ID NO: 387326 - RNA, 19 nt, Homo sapiens
gcacuauucugagggaaaa

SEQ ID NO: 387327 - RNA, 19 nt, Homo sapiens
auccagugguugcagauua

SEQ ID NO: 387328 - RNA, 19 nt, Homo sapiens
ggaucucuccguaauggaa

SEQ ID NO: 387329 - RNA, 19 nt, Homo sapiens
gauugaagcuuaucuauga

SEQ ID NO: 387330 - RNA, 19 nt, Homo sapiens
agacucagcucuacaauaa

SEQ ID NO: 387331 - RNA, 19 nt, Homo sapiens
ccaaguaacucuccucaaa

SEQ ID NO: 387332 - RNA, 19 nt, Homo sapiens
gaaagaagccaacacuaaa

SEQ ID NO: 387333 - RNA, 19 nt, Homo sapiens
agauaaagcuucuggauuu

SEQ ID NO: 387334 - RNA, 19 nt, Homo sapiens
gaaguucaaugcacuggaa

SEQ ID NO: 387335 - RNA, 19 nt, Homo sapiens
gacaugaauuccuuaauga

SEQ ID NO: 387336 - RNA, 19 nt, Homo sapiens
ccuaagaaauuuacuguga

SEQ ID NO: 387337 - RNA, 19 nt, Homo sapiens
guaccaaagugcaaucaaa

SEQ ID NO: 387338 - RNA, 19 nt, Homo sapiens
ugacaugaauuccuuaaug

SEQ ID NO: 387339 - RNA, 19 nt, Homo sapiens
ugaaagaagccaacacuaa

SEQ ID NO: 387340 - RNA, 19 nt, Homo sapiens
ucaaugcacuggaauuaga

SEQ ID NO: 387341 - RNA, 19 nt, Homo sapiens
aaguaacucuccucaaaua

SEQ ID NO: 387342 - RNA, 19 nt, Homo sapiens
gacauuccauucacaagaa

SEQ ID NO: 387343 - RNA, 19 nt, Homo sapiens
gcauuucuacuccacauua

SEQ ID NO: 387344 - RNA, 19 nt, Homo sapiens
gggaaaaucugacaccuaa

SEQ ID NO: 387345 - RNA, 19 nt, Homo sapiens
ggccaaggcuucaugacaa

SEQ ID NO: 387346 - RNA, 19 nt, Homo sapiens
gcaauugaaugucgugucu

SEQ ID NO: 387347 - RNA, 19 nt, Homo sapiens
uuacaaguaugaccugaaa

SEQ ID NO: 387348 - RNA, 19 nt, Homo sapiens
acaauaagccucaugaaga

SEQ ID NO: 387349 - RNA, 19 nt, Homo sapiens
caagggaguuucuaaagag

SEQ ID NO: 387350 - RNA, 19 nt, Homo sapiens
gagauaaagcuucuggauu

SEQ ID NO: 387351 - RNA, 19 nt, Homo sapiens
caauaagccucaugaagag

SEQ ID NO: 387352 - RNA, 19 nt, Homo sapiens
uuaauucccuuuccuuaga

SEQ ID NO: 387353 - RNA, 19 nt, Homo sapiens
aaacgagagucagccuuua

SEQ ID NO: 387354 - RNA, 19 nt, Homo sapiens
acaagggaguuucuaaaga

SEQ ID NO: 387355 - RNA, 19 nt, Homo sapiens
gaucacagaguaugccaaa

SEQ ID NO: 387356 - RNA, 19 nt, Homo sapiens
gaaagacaacagacaaauc

SEQ ID NO: 387357 - RNA, 19 nt, Homo sapiens
gaaauaaaugucaguacug

SEQ ID NO: 387358 - RNA, 19 nt, Homo sapiens
ugacagaccucagacagau

SEQ ID NO: 387359 - RNA, 19 nt, Homo sapiens
caacacuaaaccacaaaua

SEQ ID NO: 387360 - RNA, 19 nt, Homo sapiens
gguugcagauuacaaguau

SEQ ID NO: 387361 - RNA, 19 nt, Homo sapiens
aagaacagauccagugguu

SEQ ID NO: 387362 - RNA, 19 nt, Homo sapiens
gaaaugaccaugguugaca

SEQ ID NO: 387363 - RNA, 19 nt, Homo sapiens
caaacgagagucagccuuu

SEQ ID NO: 387364 - RNA, 19 nt, Homo sapiens
gcacuggaauuagaugaca

SEQ ID NO: 387365 - RNA, 19 nt, Homo sapiens
guucaaugcacuggaauua

SEQ ID NO: 387366 - RNA, 19 nt, Homo sapiens
caccauucguuaucuauga

SEQ ID NO: 387367 - RNA, 19 nt, Homo sapiens
gacaaaucaccauucguua

SEQ ID NO: 387368 - RNA, 19 nt, Homo sapiens
gaagcccauugaagacauu

SEQ ID NO: 387369 - RNA, 19 nt, Homo sapiens
ugcaggagaucacagagua

SEQ ID NO: 387370 - RNA, 19 nt, Homo sapiens
gauaaagcuucuggauuuc

SEQ ID NO: 387371 - RNA, 19 nt, Homo sapiens
gaagacauuccauucacaa

SEQ ID NO: 387372 - RNA, 19 nt, Homo sapiens
ucaagaagacggagacaga

SEQ ID NO: 387373 - RNA, 19 nt, Homo sapiens
ugacagcgacuuggcaaua

SEQ ID NO: 387374 - RNA, 19 nt, Homo sapiens
agacaaaucaccauucguu

SEQ ID NO: 387375 - RNA, 19 nt, Homo sapiens
caacagacaaaucaccauu

SEQ ID NO: 387376 - RNA, 19 nt, Homo sapiens
acacaaugcuggccuccuu

SEQ ID NO: 387377 - RNA, 19 nt, Homo sapiens
uaacucuccucaaauaugg

SEQ ID NO: 387378 - RNA, 19 nt, Homo sapiens
ggaaagacaacagacaaau

SEQ ID NO: 387379 - RNA, 19 nt, Homo sapiens
gauaucaagcccuucacua

SEQ ID NO: 387380 - RNA, 19 nt, Homo sapiens
aaagacaacagacaaauca

SEQ ID NO: 387381 - RNA, 19 nt, Homo sapiens
gagucagccuuuaacgaaa

SEQ ID NO: 387382 - RNA, 19 nt, Homo sapiens
gacagcgacuuggcaauau

SEQ ID NO: 387383 - RNA, 19 nt, Homo sapiens
guaacucuccucaaauaug

SEQ ID NO: 387384 - RNA, 19 nt, Homo sapiens
gcuuaauucccuuuccuua

SEQ ID NO: 387385 - RNA, 19 nt, Homo sapiens
ggagauaaagcuucuggau

SEQ ID NO: 387386 - RNA, 19 nt, Homo sapiens
guugacuucuccagcauuu

SEQ ID NO: 387387 - RNA, 19 nt, Homo sapiens
ucugacaccuaagaaauuu

SEQ ID NO: 387388 - RNA, 19 nt, Homo sapiens
caagacaaccugcuacaag

SEQ ID NO: 387389 - RNA, 19 nt, Homo sapiens
caaaucaccauucguuauc

SEQ ID NO: 387390 - RNA, 19 nt, Homo sapiens
ugucgugucuguggagaua

SEQ ID NO: 387391 - RNA, 19 nt, Homo sapiens
gaaaaugacagaccucaga

SEQ ID NO: 387392 - RNA, 19 nt, Homo sapiens
cuaaagagccugcgaaagc

SEQ ID NO: 387393 - RNA, 19 nt, Homo sapiens
ugacaagggaguuucuaaa

SEQ ID NO: 387394 - RNA, 19 nt, Homo sapiens
ccaaaagcauuccugguuu

SEQ ID NO: 387395 - RNA, 19 nt, Homo sapiens
ccaacucccucauggcaau

SEQ ID NO: 387396 - RNA, 19 nt, Homo sapiens
cagguuugcugaaugugaa

SEQ ID NO: 387397 - RNA, 19 nt, Homo sapiens
ucuaugacaugaauuccuu

SEQ ID NO: 387398 - RNA, 19 nt, Homo sapiens
ggauuucacuauggaguuc

SEQ ID NO: 387399 - RNA, 19 nt, Homo sapiens
gaaaaucugacaccuaaga

SEQ ID NO: 387400 - RNA, 19 nt, Homo sapiens
gccaacauuucccuucuuc

SEQ ID NO: 387401 - RNA, 19 nt, Homo sapiens
gcccagguuugcugaaugu

SEQ ID NO: 387402 - RNA, 19 nt, Homo sapiens
cgaagacauuccauucaca

SEQ ID NO: 387403 - RNA, 19 nt, Homo sapiens
ugcaggagaucuacaagga

SEQ ID NO: 387404 - RNA, 19 nt, Homo sapiens
uuauggagcccaaguuuga

SEQ ID NO: 387405 - RNA, 19 nt, Homo sapiens
gacaagggaguuucuaaag

SEQ ID NO: 387406 - RNA, 19 nt, Homo sapiens
ggaguccacgagaucauuu

SEQ ID NO: 387407 - RNA, 19 nt, Homo sapiens
agagucagccuuuaacgaa

SEQ ID NO: 387408 - RNA, 19 nt, Homo sapiens
caaguaacucuccucaaau

SEQ ID NO: 387409 - RNA, 19 nt, Homo sapiens
cauaaugccaucagguuug

SEQ ID NO: 387410 - RNA, 19 nt, Homo sapiens
ggacuuguacuagcagaga

SEQ ID NO: 387411 - RNA, 19 nt, Homo sapiens
gaagacggagacagacaug

SEQ ID NO: 387412 - RNA, 19 nt, Homo sapiens
uugccaagcugcuccagaa

SEQ ID NO: 387413 - RNA, 19 nt, Homo sapiens
ugaguuugcugugaaguuc

SEQ ID NO: 387414 - RNA, 19 nt, Homo sapiens
ccuccuugaugaauaaaga

SEQ ID NO: 387415 - RNA, 19 nt, Homo sapiens
uuucagggcugccaguuuc

SEQ ID NO: 387416 - RNA, 19 nt, Homo sapiens
acaaaucaccauucguuau

SEQ ID NO: 387417 - RNA, 19 nt, Homo sapiens
gagcccaaguuugaguuug

SEQ ID NO: 387418 - RNA, 19 nt, Homo sapiens
ugaccaugguugacacaga

SEQ ID NO: 387419 - RNA, 19 nt, Homo sapiens
ccaaagugcaaucaaagug

SEQ ID NO: 387420 - RNA, 19 nt, Homo sapiens
gcacuauucugagggaaaa

SEQ ID NO: 387421 - RNA, 19 nt, Homo sapiens
ggaucucuccguaauggaa

SEQ ID NO: 387422 - RNA, 19 nt, Homo sapiens
gagagucagccuuuaacga

SEQ ID NO: 387423 - RNA, 19 nt, Homo sapiens
auccagugguugcagauua

SEQ ID NO: 387424 - RNA, 19 nt, Homo sapiens
caacaaggccauuuucuca

SEQ ID NO: 387425 - RNA, 19 nt, Homo sapiens
uggccuccuugaugaauaa

SEQ ID NO: 387426 - RNA, 19 nt, Homo sapiens
caugaauuccuuaaugaug

SEQ ID NO: 387427 - RNA, 19 nt, Homo sapiens
acucauacauaaaguccuu

SEQ ID NO: 387428 - RNA, 19 nt, Homo sapiens
guggagaccgcccagguuu

SEQ ID NO: 387429 - RNA, 19 nt, Homo sapiens
gauugaagcuuaucuauga

SEQ ID NO: 387430 - RNA, 19 nt, Homo sapiens
gaaagaagccgacacuaaa

SEQ ID NO: 387431 - RNA, 19 nt, Homo sapiens
agacucagcucuacaauaa

SEQ ID NO: 387432 - RNA, 19 nt, Homo sapiens
ccaaguaacucuccucaaa

SEQ ID NO: 387433 - RNA, 19 nt, Homo sapiens
agauaaagcuucuggauuu

SEQ ID NO: 387434 - RNA, 19 nt, Homo sapiens
gaaguucaaugcacuggaa

SEQ ID NO: 387435 - RNA, 19 nt, Homo sapiens
gacaugaauuccuuaauga

SEQ ID NO: 387436 - RNA, 19 nt, Homo sapiens
ccuaagaaauuuacuguga

SEQ ID NO: 387437 - RNA, 19 nt, Homo sapiens
guaccaaagugcaaucaaa

SEQ ID NO: 387438 - RNA, 19 nt, Homo sapiens
ugacaugaauuccuuaaug

SEQ ID NO: 387439 - RNA, 19 nt, Homo sapiens
ucaaugcacuggaauuaga

SEQ ID NO: 387440 - RNA, 19 nt, Homo sapiens
aaguaacucuccucaaaua

SEQ ID NO: 387441 - RNA, 19 nt, Homo sapiens
ugaaagaagccgacacuaa

SEQ ID NO: 387442 - RNA, 19 nt, Homo sapiens
gacauuccauucacaagaa

SEQ ID NO: 387443 - RNA, 19 nt, Homo sapiens
gcauuucuacuccacauua

SEQ ID NO: 387444 - RNA, 19 nt, Homo sapiens
gggaaaaucugacaccuaa

SEQ ID NO: 387445 - RNA, 19 nt, Homo sapiens
ggccaaggcuucaugacaa

SEQ ID NO: 387446 - RNA, 19 nt, Homo sapiens
gcaauugaaugucgugucu

SEQ ID NO: 387447 - RNA, 19 nt, Homo sapiens
uuacaaguaugaccugaaa

SEQ ID NO: 387448 - RNA, 19 nt, Homo sapiens
acaauaagccucaugaaga

SEQ ID NO: 387449 - RNA, 19 nt, Homo sapiens
acacuaaaccaccaauaua

SEQ ID NO: 387450 - RNA, 19 nt, Homo sapiens
caagggaguuucuaaagag

SEQ ID NO: 387451 - RNA, 19 nt, Homo sapiens
gagauaaagcuucuggauu

SEQ ID NO: 387452 - RNA, 19 nt, Homo sapiens
caauaagccucaugaagag

SEQ ID NO: 387453 - RNA, 19 nt, Homo sapiens
aaacgagagucagccuuua

SEQ ID NO: 387454 - RNA, 19 nt, Homo sapiens
acaagggaguuucuaaaga

SEQ ID NO: 387455 - RNA, 19 nt, Homo sapiens
gaucacagaguaugccaaa

SEQ ID NO: 387456 - RNA, 19 nt, Homo sapiens
gaaagacaacagacaaauc

SEQ ID NO: 387457 - RNA, 19 nt, Homo sapiens
gaaauaaaugucaguacug

SEQ ID NO: 387458 - RNA, 19 nt, Homo sapiens
ugacagaccucagacagau

SEQ ID NO: 387459 - RNA, 19 nt, Homo sapiens
gguugcagauuacaaguau

SEQ ID NO: 387460 - RNA, 19 nt, Homo sapiens
caaacgagagucagccuuu

SEQ ID NO: 387461 - RNA, 19 nt, Homo sapiens
aagaacagauccagugguu

SEQ ID NO: 387462 - RNA, 19 nt, Homo sapiens
gaaaugaccaugguugaca

SEQ ID NO: 387463 - RNA, 19 nt, Homo sapiens
gcacuggaauuagaugaca

SEQ ID NO: 387464 - RNA, 19 nt, Homo sapiens
guucaaugcacuggaauua

SEQ ID NO: 387465 - RNA, 19 nt, Homo sapiens
caccauucguuaucuauga

SEQ ID NO: 387466 - RNA, 19 nt, Homo sapiens
gacaaaucaccauucguua

SEQ ID NO: 387467 - RNA, 19 nt, Homo sapiens
gaagcccauugaagacauu

SEQ ID NO: 387468 - RNA, 19 nt, Homo sapiens
ugcaggagaucacagagua

SEQ ID NO: 387469 - RNA, 19 nt, Homo sapiens
gauaaagcuucuggauuuc

SEQ ID NO: 387470 - RNA, 19 nt, Homo sapiens
gaagacauuccauucacaa

SEQ ID NO: 387471 - RNA, 19 nt, Homo sapiens
ucaagaagacggagacaga

SEQ ID NO: 387472 - RNA, 19 nt, Homo sapiens
ugacagcgacuuggcaaua

SEQ ID NO: 387473 - RNA, 19 nt, Homo sapiens
agacaaaucaccauucguu

SEQ ID NO: 387474 - RNA, 19 nt, Homo sapiens
caacagacaaaucaccauu

SEQ ID NO: 387475 - RNA, 19 nt, Homo sapiens
acacaaugcuggccuccuu

SEQ ID NO: 387476 - RNA, 19 nt, Homo sapiens
uaacucuccucaaauaugg

SEQ ID NO: 387477 - RNA, 19 nt, Homo sapiens
ggaaagacaacagacaaau

SEQ ID NO: 387478 - RNA, 19 nt, Homo sapiens
gauaucaagcccuucacua

SEQ ID NO: 387479 - RNA, 19 nt, Homo sapiens
gagucagccuuuaacgaaa

SEQ ID NO: 387480 - RNA, 19 nt, Homo sapiens
aaagacaacagacaaauca

SEQ ID NO: 387481 - RNA, 19 nt, Homo sapiens
gacagcgacuuggcaauau

SEQ ID NO: 387482 - RNA, 19 nt, Homo sapiens
guaacucuccucaaauaug

SEQ ID NO: 387483 - RNA, 19 nt, Homo sapiens
ggagauaaagcuucuggau

SEQ ID NO: 387484 - RNA, 19 nt, Homo sapiens
gacacuaaaccaccaauau

SEQ ID NO: 387485 - RNA, 19 nt, Homo sapiens
guugacuucuccagcauuu

SEQ ID NO: 387486 - RNA, 19 nt, Homo sapiens
ucugacaccuaagaaauuu

SEQ ID NO: 387487 - RNA, 19 nt, Homo sapiens
caagacaaccugcuacaag

SEQ ID NO: 387488 - RNA, 19 nt, Homo sapiens
ggccgcagauuugaaagaa

SEQ ID NO: 387489 - RNA, 19 nt, Homo sapiens
caaaucaccauucguuauc

SEQ ID NO: 387490 - RNA, 19 nt, Homo sapiens
ugucgugucuguggagaua

SEQ ID NO: 387491 - RNA, 19 nt, Homo sapiens
gaaaaugacagaccucaga

SEQ ID NO: 387492 - RNA, 19 nt, Homo sapiens
cuaaagagccugcgaaagc

SEQ ID NO: 387493 - RNA, 19 nt, Homo sapiens
ugacaagggaguuucuaaa

SEQ ID NO: 387494 - RNA, 19 nt, Homo sapiens
ccaaaagcauuccugguuu

SEQ ID NO: 387495 - RNA, 19 nt, Homo sapiens
ccaacucccucauggcaau

SEQ ID NO: 387496 - RNA, 19 nt, Homo sapiens
cagguuugcugaaugugaa

SEQ ID NO: 387497 - RNA, 19 nt, Homo sapiens
ucuaugacaugaauuccuu

SEQ ID NO: 387498 - RNA, 19 nt, Homo sapiens
ggauuucacuauggaguuc

SEQ ID NO: 387499 - RNA, 19 nt, Homo sapiens
gaaaaucugacaccuaaga

SEQ ID NO: 387500 - RNA, 19 nt, Homo sapiens
gccaacauuucccuucuuc

SEQ ID NO: 387501 - RNA, 19 nt, Homo sapiens
gcccagguuugcugaaugu

SEQ ID NO: 387502 - RNA, 19 nt, Homo sapiens
cgaagacauuccauucaca

SEQ ID NO: 387503 - RNA, 19 nt, Homo sapiens
ugcaggagaucuacaagga

SEQ ID NO: 387504 - RNA, 19 nt, Homo sapiens
uuauggagcccaaguuuga

SEQ ID NO: 387505 - RNA, 19 nt, Homo sapiens
gacaagggaguuucuaaag

SEQ ID NO: 387506 - RNA, 19 nt, Homo sapiens
ggaguccacgagaucauuu

SEQ ID NO: 387507 - RNA, 19 nt, Homo sapiens
caaguaacucuccucaaau

SEQ ID NO: 387508 - RNA, 19 nt, Homo sapiens
agagucagccuuuaacgaa

SEQ ID NO: 387509 - RNA, 19 nt, Homo sapiens
cauaaugccaucagguuug

SEQ ID NO: 387510 - RNA, 19 nt, Homo sapiens
ggacuuguacuagcagaga

SEQ ID NO: 387511 - RNA, 19 nt, Homo sapiens
gaagacggagacagacaug

SEQ ID NO: 387512 - RNA, 19 nt, Homo sapiens
uugccaagcugcuccagaa

SEQ ID NO: 387513 - RNA, 19 nt, Homo sapiens
ugaguuugcugugaaguuc

SEQ ID NO: 387514 - RNA, 19 nt, Homo sapiens
ccuccuugaugaauaaaga

SEQ ID NO: 387515 - RNA, 19 nt, Homo sapiens
uuucagggcugccaguuuc

SEQ ID NO: 387516 - RNA, 19 nt, Homo sapiens
acaaaucaccauucguuau

SEQ ID NO: 387517 - RNA, 19 nt, Homo sapiens
gagcccaaguuugaguuug

SEQ ID NO: 387518 - RNA, 19 nt, Homo sapiens
ugaccaugguugacacaga

SEQ ID NO: 387519 - RNA, 19 nt, Homo sapiens
ccaaagugcaaucaaagug

SEQ ID NO: 387520 - RNA, 19 nt, Homo sapiens
gcacuauucugagggaaaa

SEQ ID NO: 387521 - RNA, 19 nt, Homo sapiens
gagagucagccuuuaacga

SEQ ID NO: 387522 - RNA, 19 nt, Homo sapiens
ggaucucuccguaauggaa

SEQ ID NO: 387523 - RNA, 19 nt, Homo sapiens
auccagugguugcagauua

SEQ ID NO: 387524 - RNA, 19 nt, Homo sapiens
uggccuccuugaugaauaa

SEQ ID NO: 387525 - RNA, 19 nt, Homo sapiens
caugaauuccuuaaugaug

SEQ ID NO: 387526 - RNA, 19 nt, Homo sapiens
acucauacauaaaguccuu

SEQ ID NO: 387527 - RNA, 19 nt, Homo sapiens
guggagaccgcccagguuu

SEQ ID NO: 387528 - RNA, 19 nt, Homo sapiens
acagcgacuuggcaauauu

SEQ ID NO: 387529 - RNA, 19 nt, Homo sapiens
gcagaaggcucucaaagua

SEQ ID NO: 387530 - RNA, 19 nt, Homo sapiens
ggaaagccaucaucacuua

SEQ ID NO: 387531 - RNA, 19 nt, Homo sapiens
gaggaaagcugaaaccauu

SEQ ID NO: 387532 - RNA, 19 nt, Homo sapiens
gcagagaaaucuuaucaga

SEQ ID NO: 387533 - RNA, 19 nt, Homo sapiens
ggaauuccauuguuugaaa

SEQ ID NO: 387534 - RNA, 19 nt, Homo sapiens
ucaaauggcuucuucuaaa

SEQ ID NO: 387535 - RNA, 19 nt, Homo sapiens
ggacugggcucucaucuca

SEQ ID NO: 387536 - RNA, 19 nt, Homo sapiens
gcacaggaauuccauuguu

SEQ ID NO: 387537 - RNA, 19 nt, Homo sapiens
ggaauuaggaaccuuauuu

SEQ ID NO: 387538 - RNA, 19 nt, Homo sapiens
ggaagcagcccuuuagaaa

SEQ ID NO: 387539 - RNA, 19 nt, Homo sapiens
uaaugaaccugaaguacua

SEQ ID NO: 387540 - RNA, 19 nt, Homo sapiens
acaacaaacugaagacuaa

SEQ ID NO: 387541 - RNA, 19 nt, Homo sapiens
caacuuguuuccuccguua

SEQ ID NO: 387542 - RNA, 19 nt, Homo sapiens
gaugaaaccucaaggaaag

SEQ ID NO: 387543 - RNA, 19 nt, Homo sapiens
gcacagagaaacauaagaa

SEQ ID NO: 387544 - RNA, 19 nt, Homo sapiens
ggacagcuuugugauguaa

SEQ ID NO: 387545 - RNA, 19 nt, Homo sapiens
gaccaguccuugucuauga

SEQ ID NO: 387546 - RNA, 19 nt, Homo sapiens
gaacaucugcuguguacaa

SEQ ID NO: 387547 - RNA, 19 nt, Homo sapiens
ggucugauuugguuaagaa

SEQ ID NO: 387548 - RNA, 19 nt, Homo sapiens
gcaauuauguacuggaaag

SEQ ID NO: 387549 - RNA, 19 nt, Homo sapiens
ggacaaagaccgagacaag

SEQ ID NO: 387550 - RNA, 19 nt, Homo sapiens
ucaaguggcucuuccaugu

SEQ ID NO: 387551 - RNA, 19 nt, Homo sapiens
ggaagaaggcagacacuga

SEQ ID NO: 387552 - RNA, 19 nt, Homo sapiens
ggcaauggcaccaguaaua

SEQ ID NO: 387553 - RNA, 19 nt, Homo sapiens
guucagagaucauaggaau

SEQ ID NO: 387554 - RNA, 19 nt, Homo sapiens
uaaauaggguucagagauc

SEQ ID NO: 387555 - RNA, 19 nt, Homo sapiens
caagcugggugaauuagaa

SEQ ID NO: 387556 - RNA, 19 nt, Homo sapiens
gaacuccuccauccucuaa

SEQ ID NO: 387557 - RNA, 19 nt, Homo sapiens
gcaaagauaagccuccaaa

SEQ ID NO: 387558 - RNA, 19 nt, Homo sapiens
cgucagauauguucuaugu

SEQ ID NO: 387559 - RNA, 19 nt, Homo sapiens
gaaggaacaucugcugugu

SEQ ID NO: 387560 - RNA, 19 nt, Homo sapiens
ggaguucaguggauucuuc

SEQ ID NO: 387561 - RNA, 19 nt, Homo sapiens
gaugaaagcagccaaagug

SEQ ID NO: 387562 - RNA, 19 nt, Homo sapiens
ucacagaacccuaucuuug

SEQ ID NO: 387563 - RNA, 19 nt, Homo sapiens
ucagaagguucaucaaguu

SEQ ID NO: 387564 - RNA, 19 nt, Homo sapiens
gaaagucuccaucucauag

SEQ ID NO: 387565 - RNA, 19 nt, Homo sapiens
ucugaugucuuucaaacua

SEQ ID NO: 387566 - RNA, 19 nt, Homo sapiens
gacaccaaguggccuauaa

SEQ ID NO: 387567 - RNA, 19 nt, Homo sapiens
gaugaguucucuccuggaa

SEQ ID NO: 387568 - RNA, 19 nt, Homo sapiens
gaucauaggaauauuagga

SEQ ID NO: 387569 - RNA, 19 nt, Homo sapiens
ugacauccuuucagacauu

SEQ ID NO: 387570 - RNA, 19 nt, Homo sapiens
ggaaagucuccaucucaua

SEQ ID NO: 387571 - RNA, 19 nt, Homo sapiens
caugugagcuguaaacucu

SEQ ID NO: 387572 - RNA, 19 nt, Homo sapiens
aagcuugccucuccaauga

SEQ ID NO: 387573 - RNA, 19 nt, Homo sapiens
uaaccaagccgacacaguu

SEQ ID NO: 387574 - RNA, 19 nt, Homo sapiens
caaaguuguucaaagaugu

SEQ ID NO: 387575 - RNA, 19 nt, Homo sapiens
ccaaaguuguucaaagaug

SEQ ID NO: 387576 - RNA, 19 nt, Homo sapiens
gcauauccagacccuauua

SEQ ID NO: 387577 - RNA, 19 nt, Homo sapiens
gaaaagcaguaaaucagaa

SEQ ID NO: 387578 - RNA, 19 nt, Homo sapiens
cgacacaguugauuucagu

SEQ ID NO: 387579 - RNA, 19 nt, Homo sapiens
uguaugaacugaucacuca

SEQ ID NO: 387580 - RNA, 19 nt, Homo sapiens
ccaaaucacccaucucuuc

SEQ ID NO: 387581 - RNA, 19 nt, Homo sapiens
ucucauaguucuucuaaca

SEQ ID NO: 387582 - RNA, 19 nt, Homo sapiens
cacaggaauuccauuguuu

SEQ ID NO: 387583 - RNA, 19 nt, Homo sapiens
ugaaggacuuuggucauuu

SEQ ID NO: 387584 - RNA, 19 nt, Homo sapiens
caaguuaaguagcaguaug

SEQ ID NO: 387585 - RNA, 19 nt, Homo sapiens
caggauuucucaacccuuu

SEQ ID NO: 387586 - RNA, 19 nt, Homo sapiens
gaaacucaaccaacuuaug

SEQ ID NO: 387587 - RNA, 19 nt, Homo sapiens
cccaguaucuagagcauuu

SEQ ID NO: 387588 - RNA, 19 nt, Homo sapiens
gaagaggguugugaugagu

SEQ ID NO: 387589 - RNA, 19 nt, Homo sapiens
gagaagaggguugugauga

SEQ ID NO: 387590 - RNA, 19 nt, Homo sapiens
gaagagcaaggcuuauaug

SEQ ID NO: 387591 - RNA, 19 nt, Homo sapiens
gcaugggaguucuaaagga

SEQ ID NO: 387592 - RNA, 19 nt, Homo sapiens
guuugacucugaugucuuu

SEQ ID NO: 387593 - RNA, 19 nt, Homo sapiens
ccucuuauccuaaaucuga

SEQ ID NO: 387594 - RNA, 19 nt, Homo sapiens
gcacugcuauuuccucaac

SEQ ID NO: 387595 - RNA, 19 nt, Homo sapiens
aauagacccuggagugaaa

SEQ ID NO: 387596 - RNA, 19 nt, Homo sapiens
gaauaauguuucucgaucu

SEQ ID NO: 387597 - RNA, 19 nt, Homo sapiens
gaaacaagaagccguccuu

SEQ ID NO: 387598 - RNA, 19 nt, Homo sapiens
caugggaguucuaaaggaa

SEQ ID NO: 387599 - RNA, 19 nt, Homo sapiens
ugccaaaguuguucaaaga

SEQ ID NO: 387600 - RNA, 19 nt, Homo sapiens
cacauccaguugacaauaa

SEQ ID NO: 387601 - RNA, 19 nt, Homo sapiens
ggacacuuaaguaauguuu

SEQ ID NO: 387602 - RNA, 19 nt, Homo sapiens
ugagguaguuguccguuug

SEQ ID NO: 387603 - RNA, 19 nt, Homo sapiens
caucaagcugggugaauua

SEQ ID NO: 387604 - RNA, 19 nt, Homo sapiens
gacaaguaacacaaucuua

SEQ ID NO: 387605 - RNA, 19 nt, Homo sapiens
uaagaagaccucagaguca

SEQ ID NO: 387606 - RNA, 19 nt, Homo sapiens
ucucauaugucuggaacua

SEQ ID NO: 387607 - RNA, 19 nt, Homo sapiens
caauggauguugacucaca

SEQ ID NO: 387608 - RNA, 19 nt, Homo sapiens
ucagcaaggugucucagaa

SEQ ID NO: 387609 - RNA, 19 nt, Homo sapiens
gcaucaagcccaagcaaau

SEQ ID NO: 387610 - RNA, 19 nt, Homo sapiens
gaaggacuuuggucauuuu

SEQ ID NO: 387611 - RNA, 19 nt, Homo sapiens
gaauuaggaaccuuauuuc

SEQ ID NO: 387612 - RNA, 19 nt, Homo sapiens
caaaggaugguccgacuau

SEQ ID NO: 387613 - RNA, 19 nt, Homo sapiens
gaguuccucuuauccuaaa

SEQ ID NO: 387614 - RNA, 19 nt, Homo sapiens
gagcauuuguucagaaacu

SEQ ID NO: 387615 - RNA, 19 nt, Homo sapiens
gacugcaucucccaucauu

SEQ ID NO: 387616 - RNA, 19 nt, Homo sapiens
gacaacaaacugaagacua

SEQ ID NO: 387617 - RNA, 19 nt, Homo sapiens
guacagcagcuaagggaaa

SEQ ID NO: 387618 - RNA, 19 nt, Homo sapiens
caggacagcuuugugaugu

SEQ ID NO: 387619 - RNA, 19 nt, Homo sapiens
auacauuccuugaugcauu

SEQ ID NO: 387620 - RNA, 19 nt, Homo sapiens
gcaucaagccagagaguug

SEQ ID NO: 387621 - RNA, 19 nt, Homo sapiens
ccauagcagagaaaucuua

SEQ ID NO: 387622 - RNA, 19 nt, Homo sapiens
caguacagguggaucuaaa

SEQ ID NO: 387623 - RNA, 19 nt, Homo sapiens
ucauaguucuucuaacaga

SEQ ID NO: 387624 - RNA, 19 nt, Homo sapiens
gggaaagucuccaucucau

SEQ ID NO: 387625 - RNA, 19 nt, Homo sapiens
cacagaacccuaucuuuga

SEQ ID NO: 387626 - RNA, 19 nt, Homo sapiens
caaagcaccagacugaaga

SEQ ID NO: 387627 - RNA, 19 nt, Homo sapiens
ugaaguguguccucucuca

SEQ ID NO: 387628 - RNA, 19 nt, Homo sapiens
ggccgaagagcaaggcuua

SEQ ID NO: 387629 - RNA, 19 nt, Homo sapiens
gaacuuagguauaguguuu

SEQ ID NO: 387630 - RNA, 19 nt, Homo sapiens
caacaaagauggccacauu

SEQ ID NO: 387631 - RNA, 19 nt, Homo sapiens
ccaaggaagugaugaauaa

SEQ ID NO: 387632 - RNA, 19 nt, Homo sapiens
gaaaugcagugacuaugaa

SEQ ID NO: 387633 - RNA, 19 nt, Homo sapiens
gaacauacaaucaaguuug

SEQ ID NO: 387634 - RNA, 19 nt, Homo sapiens
gaucacgccugcauguuaa

SEQ ID NO: 387635 - RNA, 19 nt, Homo sapiens
gcaagaagccugaacuuuc

SEQ ID NO: 387636 - RNA, 19 nt, Homo sapiens
ggaggcagguuguagauau

SEQ ID NO: 387637 - RNA, 19 nt, Homo sapiens
cagaaucaccuguguauuu

SEQ ID NO: 387638 - RNA, 19 nt, Homo sapiens
ccaauuggaugacuuaauc

SEQ ID NO: 387639 - RNA, 19 nt, Homo sapiens
gagaggagcaagauaguuu

SEQ ID NO: 387640 - RNA, 19 nt, Homo sapiens
agacuuacauggccaauug

SEQ ID NO: 387641 - RNA, 19 nt, Homo sapiens
gaagaaaugcagugacuau

SEQ ID NO: 387642 - RNA, 19 nt, Homo sapiens
gcauugcgcuuaaacuaug

SEQ ID NO: 387643 - RNA, 19 nt, Homo sapiens
uaagaacccugcaagaugu

SEQ ID NO: 387644 - RNA, 19 nt, Homo sapiens
cuucagaucuucucaguga

SEQ ID NO: 387645 - RNA, 19 nt, Homo sapiens
gcaggagcauugcgcuuaa

SEQ ID NO: 387646 - RNA, 19 nt, Homo sapiens
gaucucggcucaccgcaaa

SEQ ID NO: 387647 - RNA, 19 nt, Homo sapiens
aaagauggccacauugaua

SEQ ID NO: 387648 - RNA, 19 nt, Homo sapiens
guagagauccugaugauuc

SEQ ID NO: 387649 - RNA, 19 nt, Homo sapiens
ggaucacgccugcauguua

SEQ ID NO: 387650 - RNA, 19 nt, Homo sapiens
gagaagcuguuugcucauu

SEQ ID NO: 387651 - RNA, 19 nt, Homo sapiens
gagcauugcgcuuaaacua

SEQ ID NO: 387652 - RNA, 19 nt, Homo sapiens
ucacaaucuucacaaagua

SEQ ID NO: 387653 - RNA, 19 nt, Homo sapiens
uagacuaucucccuuauuc

SEQ ID NO: 387654 - RNA, 19 nt, Homo sapiens
ucacaugaauaucgacauu

SEQ ID NO: 387655 - RNA, 19 nt, Homo sapiens
gaucuucucagugaauuua

SEQ ID NO: 387656 - RNA, 19 nt, Homo sapiens
ccagaacggucauaugugu

SEQ ID NO: 387657 - RNA, 19 nt, Homo sapiens
uaacugaucuggagcuuuu

SEQ ID NO: 387658 - RNA, 19 nt, Homo sapiens
ggaaggaaauacuaagaac

SEQ ID NO: 387659 - RNA, 19 nt, Homo sapiens
gacccaagcauauggauuu

SEQ ID NO: 387660 - RNA, 19 nt, Homo sapiens
ggaggaggcuguuauuuug

SEQ ID NO: 387661 - RNA, 19 nt, Homo sapiens
aagaaccacugacaaugua

SEQ ID NO: 387662 - RNA, 19 nt, Homo sapiens
aagaagacauggcagacua

SEQ ID NO: 387663 - RNA, 19 nt, Homo sapiens
cagacaacaugcuggagua

SEQ ID NO: 387664 - RNA, 19 nt, Homo sapiens
gagaagagccaaccagaag

SEQ ID NO: 387665 - RNA, 19 nt, Homo sapiens
gagaacauacaaucaaguu

SEQ ID NO: 387666 - RNA, 19 nt, Homo sapiens
ccaugcaacugcccuggua

SEQ ID NO: 387667 - RNA, 19 nt, Homo sapiens
ucagcuaucucauggauca

SEQ ID NO: 387668 - RNA, 19 nt, Homo sapiens
caaucaaguuugcuggaaa

SEQ ID NO: 387669 - RNA, 19 nt, Homo sapiens
agaagcagauggaggagaa

SEQ ID NO: 387670 - RNA, 19 nt, Homo sapiens
gauauggcuucaccaagga

SEQ ID NO: 387671 - RNA, 19 nt, Homo sapiens
ugaaggcuaugaauucugu

SEQ ID NO: 387672 - RNA, 19 nt, Homo sapiens
guucaacggugacuuugug

SEQ ID NO: 387673 - RNA, 19 nt, Homo sapiens
agagauuucugccuuguug

SEQ ID NO: 387674 - RNA, 19 nt, Homo sapiens
gcacccagccuauuuuaua

SEQ ID NO: 387675 - RNA, 19 nt, Homo sapiens
cagcagcgguggagucugu

SEQ ID NO: 387676 - RNA, 19 nt, Homo sapiens
ucugauagaugagaaaguu

SEQ ID NO: 387677 - RNA, 19 nt, Homo sapiens
cauagacagugaucauuca

SEQ ID NO: 387678 - RNA, 19 nt, Homo sapiens
gaacagcucagcagacaac

SEQ ID NO: 387679 - RNA, 19 nt, Homo sapiens
ccaaagugcugggauuaca

SEQ ID NO: 387680 - RNA, 19 nt, Homo sapiens
caagaagccugaacuuucc

SEQ ID NO: 387681 - RNA, 19 nt, Homo sapiens
acacaggguuucuccaugu

SEQ ID NO: 387682 - RNA, 19 nt, Homo sapiens
gaauaucgacauuacagau

SEQ ID NO: 387683 - RNA, 19 nt, Homo sapiens
gcuguuugcucauucuuca

SEQ ID NO: 387684 - RNA, 19 nt, Homo sapiens
guacagcugccaaacauca

SEQ ID NO: 387685 - RNA, 19 nt, Homo sapiens
uaagaaccacugacaaugu

SEQ ID NO: 387686 - RNA, 19 nt, Homo sapiens
ucacaaccgcaagguauua

SEQ ID NO: 387687 - RNA, 19 nt, Homo sapiens
cuaagaacccugcaagaug

SEQ ID NO: 387688 - RNA, 19 nt, Homo sapiens
gaaaccaugaggaccauau

SEQ ID NO: 387689 - RNA, 19 nt, Homo sapiens
caguagagauccugaugau

SEQ ID NO: 387690 - RNA, 19 nt, Homo sapiens
gcccaggacuccgagauga

SEQ ID NO: 387691 - RNA, 19 nt, Homo sapiens
cauauucacugaggacaga

SEQ ID NO: 387692 - RNA, 19 nt, Homo sapiens
caccacaccaggcuaauuu

SEQ ID NO: 387693 - RNA, 19 nt, Homo sapiens
guaacucucucauuguuuu

SEQ ID NO: 387694 - RNA, 19 nt, Homo sapiens
gcgagaacauacaaucaag

SEQ ID NO: 387695 - RNA, 19 nt, Homo sapiens
gggaaggaaauacuaagaa

SEQ ID NO: 387696 - RNA, 19 nt, Homo sapiens
caagaaacaucugguacag

SEQ ID NO: 387697 - RNA, 19 nt, Homo sapiens
caagcuccaugacuucuuc

SEQ ID NO: 387698 - RNA, 19 nt, Homo sapiens
agauggaguuucucucuug

SEQ ID NO: 387699 - RNA, 19 nt, Homo sapiens
agaaucaccuguguauuuc

SEQ ID NO: 387700 - RNA, 19 nt, Homo sapiens
gauccaaccuagagaccau

SEQ ID NO: 387701 - RNA, 19 nt, Homo sapiens
gugaacagcucagcagaca

SEQ ID NO: 387702 - RNA, 19 nt, Homo sapiens
ggccacagcuggugaacag

SEQ ID NO: 387703 - RNA, 19 nt, Homo sapiens
aaacgagacagaagaguga

SEQ ID NO: 387704 - RNA, 19 nt, Homo sapiens
gcaagauaguuuccaccau

SEQ ID NO: 387705 - RNA, 19 nt, Homo sapiens
guuaagaaccacugacaau

SEQ ID NO: 387706 - RNA, 19 nt, Homo sapiens
ccacuucaguuaagaacca

SEQ ID NO: 387707 - RNA, 19 nt, Homo sapiens
acaaagauggccacauuga

SEQ ID NO: 387708 - RNA, 19 nt, Homo sapiens
cuggaaacauuguaucgaa

SEQ ID NO: 387709 - RNA, 19 nt, Homo sapiens
acaacaugcuggaguacaa

SEQ ID NO: 387710 - RNA, 19 nt, Homo sapiens
ugagagcucugagggagaa

SEQ ID NO: 387711 - RNA, 19 nt, Homo sapiens
gauauccuguggagugauc

SEQ ID NO: 387712 - RNA, 19 nt, Homo sapiens
agaaaugcagugacuauga

SEQ ID NO: 387713 - RNA, 19 nt, Homo sapiens
ucucauggaucacuucauc

SEQ ID NO: 387714 - RNA, 19 nt, Homo sapiens
gcucucacaugaauaucga

SEQ ID NO: 387715 - RNA, 19 nt, Homo sapiens
ucagugaauuuaagaagca

SEQ ID NO: 387716 - RNA, 19 nt, Homo sapiens
augcaaaccugaaggcuau

SEQ ID NO: 387717 - RNA, 19 nt, Homo sapiens
uagagguacccgacaguua

SEQ ID NO: 387718 - RNA, 19 nt, Homo sapiens
acuccgagaugaagaaaug

SEQ ID NO: 387719 - RNA, 19 nt, Homo sapiens
ucagaaugcccacaagcua

SEQ ID NO: 387720 - RNA, 19 nt, Homo sapiens
gaauuuaagaagcaugaug

SEQ ID NO: 387721 - RNA, 19 nt, Homo sapiens
gaagcuguuugcucauucu

SEQ ID NO: 387722 - RNA, 19 nt, Homo sapiens
agaguuccaucuuaacaga

SEQ ID NO: 387723 - RNA, 19 nt, Homo sapiens
gagauccugaugauucuuu

SEQ ID NO: 387724 - RNA, 19 nt, Homo sapiens
gaacagccuggucuucauc

SEQ ID NO: 387725 - RNA, 19 nt, Homo sapiens
gggcugcaccuucuuuaug

SEQ ID NO: 387726 - RNA, 19 nt, Homo sapiens
gcaagguauuaacaaucuu

SEQ ID NO: 387727 - RNA, 19 nt, Homo sapiens
ggcaagaagccugaacuuu

SEQ ID NO: 387728 - RNA, 19 nt, Homo sapiens
uggaguuucucucuuguug

SEQ ID NO: 387729 - RNA, 19 nt, Homo sapiens
gaacuuagguauaguguuu

SEQ ID NO: 387730 - RNA, 19 nt, Homo sapiens
caacaaagauggccacauu

SEQ ID NO: 387731 - RNA, 19 nt, Homo sapiens
ccaaggaagugaugaauaa

SEQ ID NO: 387732 - RNA, 19 nt, Homo sapiens
gaaaugcagugacuaugaa

SEQ ID NO: 387733 - RNA, 19 nt, Homo sapiens
uaagaaggaugucaggaua

SEQ ID NO: 387734 - RNA, 19 nt, Homo sapiens
gaacauacaaucaaguuug

SEQ ID NO: 387735 - RNA, 19 nt, Homo sapiens
gaucacgccugcauguuaa

SEQ ID NO: 387736 - RNA, 19 nt, Homo sapiens
gcaagaagccugaacuuuc

SEQ ID NO: 387737 - RNA, 19 nt, Homo sapiens
ggaggcagguuguagauau

SEQ ID NO: 387738 - RNA, 19 nt, Homo sapiens
cagaaucaccuguguauuu

SEQ ID NO: 387739 - RNA, 19 nt, Homo sapiens
ccaauuggaugacuuaauc

SEQ ID NO: 387740 - RNA, 19 nt, Homo sapiens
gagaggagcaagauaguuu

SEQ ID NO: 387741 - RNA, 19 nt, Homo sapiens
agacuuacauggccaauug

SEQ ID NO: 387742 - RNA, 19 nt, Homo sapiens
gaagaaaugcagugacuau

SEQ ID NO: 387743 - RNA, 19 nt, Homo sapiens
gcauugcgcuuaaacuaug

SEQ ID NO: 387744 - RNA, 19 nt, Homo sapiens
uaagaacccugcaagaugu

SEQ ID NO: 387745 - RNA, 19 nt, Homo sapiens
cuucagaucuucucaguga

SEQ ID NO: 387746 - RNA, 19 nt, Homo sapiens
gcaggagcauugcgcuuaa

SEQ ID NO: 387747 - RNA, 19 nt, Homo sapiens
gaucucggcucaccgcaaa

SEQ ID NO: 387748 - RNA, 19 nt, Homo sapiens
aaagauggccacauugaua

SEQ ID NO: 387749 - RNA, 19 nt, Homo sapiens
guagagauccugaugauuc

SEQ ID NO: 387750 - RNA, 19 nt, Homo sapiens
ggaucacgccugcauguua

SEQ ID NO: 387751 - RNA, 19 nt, Homo sapiens
gagaagcuguuugcucauu

SEQ ID NO: 387752 - RNA, 19 nt, Homo sapiens
gagcauugcgcuuaaacua

SEQ ID NO: 387753 - RNA, 19 nt, Homo sapiens
ucacaaucuucacaaagua

SEQ ID NO: 387754 - RNA, 19 nt, Homo sapiens
uagacuaucucccuuauuc

SEQ ID NO: 387755 - RNA, 19 nt, Homo sapiens
ucacaugaauaucgacauu

SEQ ID NO: 387756 - RNA, 19 nt, Homo sapiens
gaucuucucagugaauuua

SEQ ID NO: 387757 - RNA, 19 nt, Homo sapiens
ccagaacggucauaugugu

SEQ ID NO: 387758 - RNA, 19 nt, Homo sapiens
uaacugaucuggagcuuuu

SEQ ID NO: 387759 - RNA, 19 nt, Homo sapiens
ggaaggaaauacuaagaac

SEQ ID NO: 387760 - RNA, 19 nt, Homo sapiens
gacccaagcauauggauuu

SEQ ID NO: 387761 - RNA, 19 nt, Homo sapiens
ggaggaggcuguuauuuug

SEQ ID NO: 387762 - RNA, 19 nt, Homo sapiens
aagaagacauggcagacua

SEQ ID NO: 387763 - RNA, 19 nt, Homo sapiens
aagaaccacugacaaugua

SEQ ID NO: 387764 - RNA, 19 nt, Homo sapiens
cagacaacaugcuggagua

SEQ ID NO: 387765 - RNA, 19 nt, Homo sapiens
gagaagagccaaccagaag

SEQ ID NO: 387766 - RNA, 19 nt, Homo sapiens
gagaacauacaaucaaguu

SEQ ID NO: 387767 - RNA, 19 nt, Homo sapiens
ccaugcaacugcccuggua

SEQ ID NO: 387768 - RNA, 19 nt, Homo sapiens
ucagcuaucucauggauca

SEQ ID NO: 387769 - RNA, 19 nt, Homo sapiens
caaucaaguuugcuggaaa

SEQ ID NO: 387770 - RNA, 19 nt, Homo sapiens
agaagcagauggaggagaa

SEQ ID NO: 387771 - RNA, 19 nt, Homo sapiens
gauauggcuucaccaagga

SEQ ID NO: 387772 - RNA, 19 nt, Homo sapiens
ugaaggcuaugaauucugu

SEQ ID NO: 387773 - RNA, 19 nt, Homo sapiens
guucaacggugacuuugug

SEQ ID NO: 387774 - RNA, 19 nt, Homo sapiens
agagauuucugccuuguug

SEQ ID NO: 387775 - RNA, 19 nt, Homo sapiens
gcacccagccuauuuuaua

SEQ ID NO: 387776 - RNA, 19 nt, Homo sapiens
cagcagcgguggagucugu

SEQ ID NO: 387777 - RNA, 19 nt, Homo sapiens
agaaggaugucaggauaaa

SEQ ID NO: 387778 - RNA, 19 nt, Homo sapiens
ucugauagaugagaaaguu

SEQ ID NO: 387779 - RNA, 19 nt, Homo sapiens
cauagacagugaucauuca

SEQ ID NO: 387780 - RNA, 19 nt, Homo sapiens
gaacagcucagcagacaac

SEQ ID NO: 387781 - RNA, 19 nt, Homo sapiens
ccaaagugcugggauuaca

SEQ ID NO: 387782 - RNA, 19 nt, Homo sapiens
caagaagccugaacuuucc

SEQ ID NO: 387783 - RNA, 19 nt, Homo sapiens
acacaggguuucuccaugu

SEQ ID NO: 387784 - RNA, 19 nt, Homo sapiens
gaauaucgacauuacagau

SEQ ID NO: 387785 - RNA, 19 nt, Homo sapiens
gguuagcucucaccuguag

SEQ ID NO: 387786 - RNA, 19 nt, Homo sapiens
ugacagugcccauuauuuc

SEQ ID NO: 387787 - RNA, 19 nt, Homo sapiens
gcuguuugcucauucuuca

SEQ ID NO: 387788 - RNA, 19 nt, Homo sapiens
guacagcugccaaacauca

SEQ ID NO: 387789 - RNA, 19 nt, Homo sapiens
uaagaaccacugacaaugu

SEQ ID NO: 387790 - RNA, 19 nt, Homo sapiens
ucacaaccgcaagguauua

SEQ ID NO: 387791 - RNA, 19 nt, Homo sapiens
cuaagaacccugcaagaug

SEQ ID NO: 387792 - RNA, 19 nt, Homo sapiens
gaaaccaugaggaccauau

SEQ ID NO: 387793 - RNA, 19 nt, Homo sapiens
caguagagauccugaugau

SEQ ID NO: 387794 - RNA, 19 nt, Homo sapiens
gcccaggacuccgagauga

SEQ ID NO: 387795 - RNA, 19 nt, Homo sapiens
cauauucacugaggacaga

SEQ ID NO: 387796 - RNA, 19 nt, Homo sapiens
caccacaccaggcuaauuu

SEQ ID NO: 387797 - RNA, 19 nt, Homo sapiens
guaacucucucauuguuuu

SEQ ID NO: 387798 - RNA, 19 nt, Homo sapiens
gcgagaacauacaaucaag

SEQ ID NO: 387799 - RNA, 19 nt, Homo sapiens
gauaaagucggccuagcuu

SEQ ID NO: 387800 - RNA, 19 nt, Homo sapiens
gggaaggaaauacuaagaa

SEQ ID NO: 387801 - RNA, 19 nt, Homo sapiens
caagaaacaucugguacag

SEQ ID NO: 387802 - RNA, 19 nt, Homo sapiens
caagcuccaugacuucuuc

SEQ ID NO: 387803 - RNA, 19 nt, Homo sapiens
agauggaguuucucucuug

SEQ ID NO: 387804 - RNA, 19 nt, Homo sapiens
agaaucaccuguguauuuc

SEQ ID NO: 387805 - RNA, 19 nt, Homo sapiens
gauccaaccuagagaccau

SEQ ID NO: 387806 - RNA, 19 nt, Homo sapiens
gugaacagcucagcagaca

SEQ ID NO: 387807 - RNA, 19 nt, Homo sapiens
ggccacagcuggugaacag

SEQ ID NO: 387808 - RNA, 19 nt, Homo sapiens
aaacgagacagaagaguga

SEQ ID NO: 387809 - RNA, 19 nt, Homo sapiens
gcaagauaguuuccaccau

SEQ ID NO: 387810 - RNA, 19 nt, Homo sapiens
guuaagaaccacugacaau

SEQ ID NO: 387811 - RNA, 19 nt, Homo sapiens
ccacuucaguuaagaacca

SEQ ID NO: 387812 - RNA, 19 nt, Homo sapiens
acaaagauggccacauuga

SEQ ID NO: 387813 - RNA, 19 nt, Homo sapiens
cuggaaacauuguaucgaa

SEQ ID NO: 387814 - RNA, 19 nt, Homo sapiens
acaacaugcuggaguacaa

SEQ ID NO: 387815 - RNA, 19 nt, Homo sapiens
guaagaaggaugucaggau

SEQ ID NO: 387816 - RNA, 19 nt, Homo sapiens
ugagagcucugagggagaa

SEQ ID NO: 387817 - RNA, 19 nt, Homo sapiens
gauauccuguggagugauc

SEQ ID NO: 387818 - RNA, 19 nt, Homo sapiens
agaaaugcagugacuauga

SEQ ID NO: 387819 - RNA, 19 nt, Homo sapiens
ucucauggaucacuucauc

SEQ ID NO: 387820 - RNA, 19 nt, Homo sapiens
gcucucacaugaauaucga

SEQ ID NO: 387821 - RNA, 19 nt, Homo sapiens
ucagugaauuuaagaagca

SEQ ID NO: 387822 - RNA, 19 nt, Homo sapiens
augcaaaccugaaggcuau

SEQ ID NO: 387823 - RNA, 19 nt, Homo sapiens
uagagguacccgacaguua

SEQ ID NO: 387824 - RNA, 19 nt, Homo sapiens
acuccgagaugaagaaaug

SEQ ID NO: 387825 - RNA, 19 nt, Homo sapiens
ucagaaugcccacaagcua

SEQ ID NO: 387826 - RNA, 19 nt, Homo sapiens
ggcaacagguuagcucuca

SEQ ID NO: 387827 - RNA, 19 nt, Homo sapiens
ccagccaacucugcuacua

SEQ ID NO: 387828 - RNA, 19 nt, Homo sapiens
gaauuuaagaagcaugaug

SEQ ID NO: 387829 - RNA, 19 nt, Homo sapiens
gaacuuagguauaguguuu

SEQ ID NO: 387830 - RNA, 19 nt, Homo sapiens
caacaaagauggccacauu

SEQ ID NO: 387831 - RNA, 19 nt, Homo sapiens
ccaaggaagugaugaauaa

SEQ ID NO: 387832 - RNA, 19 nt, Homo sapiens
gaaaugcagugacuaugaa

SEQ ID NO: 387833 - RNA, 19 nt, Homo sapiens
gaacauacaaucaaguuug

SEQ ID NO: 387834 - RNA, 19 nt, Homo sapiens
gaucacgccugcauguuaa

SEQ ID NO: 387835 - RNA, 19 nt, Homo sapiens
gcaagaagccugaacuuuc

SEQ ID NO: 387836 - RNA, 19 nt, Homo sapiens
ggaggcagguuguagauau

SEQ ID NO: 387837 - RNA, 19 nt, Homo sapiens
cagaaucaccuguguauuu

SEQ ID NO: 387838 - RNA, 19 nt, Homo sapiens
ccaauuggaugacuuaauc

SEQ ID NO: 387839 - RNA, 19 nt, Homo sapiens
gagaggagcaagauaguuu

SEQ ID NO: 387840 - RNA, 19 nt, Homo sapiens
agacuuacauggccaauug

SEQ ID NO: 387841 - RNA, 19 nt, Homo sapiens
gaagaaaugcagugacuau

SEQ ID NO: 387842 - RNA, 19 nt, Homo sapiens
gcauugcgcuuaaacuaug

SEQ ID NO: 387843 - RNA, 19 nt, Homo sapiens
uaagaacccugcaagaugu

SEQ ID NO: 387844 - RNA, 19 nt, Homo sapiens
cuucagaucuucucaguga

SEQ ID NO: 387845 - RNA, 19 nt, Homo sapiens
gcaggagcauugcgcuuaa

SEQ ID NO: 387846 - RNA, 19 nt, Homo sapiens
gaucucggcucaccgcaaa

SEQ ID NO: 387847 - RNA, 19 nt, Homo sapiens
aaagauggccacauugaua

SEQ ID NO: 387848 - RNA, 19 nt, Homo sapiens
guagagauccugaugauuc

SEQ ID NO: 387849 - RNA, 19 nt, Homo sapiens
ggaucacgccugcauguua

SEQ ID NO: 387850 - RNA, 19 nt, Homo sapiens
gagaagcuguuugcucauu

SEQ ID NO: 387851 - RNA, 19 nt, Homo sapiens
gagcauugcgcuuaaacua

SEQ ID NO: 387852 - RNA, 19 nt, Homo sapiens
ucacaaucuucacaaagua

SEQ ID NO: 387853 - RNA, 19 nt, Homo sapiens
uagacuaucucccuuauuc

SEQ ID NO: 387854 - RNA, 19 nt, Homo sapiens
ucacaugaauaucgacauu

SEQ ID NO: 387855 - RNA, 19 nt, Homo sapiens
gaucuucucagugaauuua

SEQ ID NO: 387856 - RNA, 19 nt, Homo sapiens
ccagaacggucauaugugu

SEQ ID NO: 387857 - RNA, 19 nt, Homo sapiens
uaacugaucuggagcuuuu

SEQ ID NO: 387858 - RNA, 19 nt, Homo sapiens
ggaaggaaauacuaagaac

SEQ ID NO: 387859 - RNA, 19 nt, Homo sapiens
gacccaagcauauggauuu

SEQ ID NO: 387860 - RNA, 19 nt, Homo sapiens
ggaggaggcuguuauuuug

SEQ ID NO: 387861 - RNA, 19 nt, Homo sapiens
aagaaccacugacaaugua

SEQ ID NO: 387862 - RNA, 19 nt, Homo sapiens
aagaagacauggcagacua

SEQ ID NO: 387863 - RNA, 19 nt, Homo sapiens
cagacaacaugcuggagua

SEQ ID NO: 387864 - RNA, 19 nt, Homo sapiens
gagaagagccaaccagaag

SEQ ID NO: 387865 - RNA, 19 nt, Homo sapiens
gagaacauacaaucaaguu

SEQ ID NO: 387866 - RNA, 19 nt, Homo sapiens
ccaugcaacugcccuggua

SEQ ID NO: 387867 - RNA, 19 nt, Homo sapiens
ucagcuaucucauggauca

SEQ ID NO: 387868 - RNA, 19 nt, Homo sapiens
caaucaaguuugcuggaaa

SEQ ID NO: 387869 - RNA, 19 nt, Homo sapiens
agaagcagauggaggagaa

SEQ ID NO: 387870 - RNA, 19 nt, Homo sapiens
gauauggcuucaccaagga

SEQ ID NO: 387871 - RNA, 19 nt, Homo sapiens
ugaaggcuaugaauucugu

SEQ ID NO: 387872 - RNA, 19 nt, Homo sapiens
guucaacggugacuuugug

SEQ ID NO: 387873 - RNA, 19 nt, Homo sapiens
agagauuucugccuuguug

SEQ ID NO: 387874 - RNA, 19 nt, Homo sapiens
gcacccagccuauuuuaua

SEQ ID NO: 387875 - RNA, 19 nt, Homo sapiens
cagcagcgguggagucugu

SEQ ID NO: 387876 - RNA, 19 nt, Homo sapiens
ucugauagaugagaaaguu

SEQ ID NO: 387877 - RNA, 19 nt, Homo sapiens
cauagacagugaucauuca

SEQ ID NO: 387878 - RNA, 19 nt, Homo sapiens
gaacagcucagcagacaac

SEQ ID NO: 387879 - RNA, 19 nt, Homo sapiens
ccaaagugcugggauuaca

SEQ ID NO: 387880 - RNA, 19 nt, Homo sapiens
caagaagccugaacuuucc

SEQ ID NO: 387881 - RNA, 19 nt, Homo sapiens
acacaggguuucuccaugu

SEQ ID NO: 387882 - RNA, 19 nt, Homo sapiens
gaauaucgacauuacagau

SEQ ID NO: 387883 - RNA, 19 nt, Homo sapiens
gcuguuugcucauucuuca

SEQ ID NO: 387884 - RNA, 19 nt, Homo sapiens
guacagcugccaaacauca

SEQ ID NO: 387885 - RNA, 19 nt, Homo sapiens
uaagaaccacugacaaugu

SEQ ID NO: 387886 - RNA, 19 nt, Homo sapiens
ucacaaccgcaagguauua

SEQ ID NO: 387887 - RNA, 19 nt, Homo sapiens
cuaagaacccugcaagaug

SEQ ID NO: 387888 - RNA, 19 nt, Homo sapiens
gaaaccaugaggaccauau

SEQ ID NO: 387889 - RNA, 19 nt, Homo sapiens
caguagagauccugaugau

SEQ ID NO: 387890 - RNA, 19 nt, Homo sapiens
gcccaggacuccgagauga

SEQ ID NO: 387891 - RNA, 19 nt, Homo sapiens
cauauucacugaggacaga

SEQ ID NO: 387892 - RNA, 19 nt, Homo sapiens
caccacaccaggcuaauuu

SEQ ID NO: 387893 - RNA, 19 nt, Homo sapiens
guaacucucucauuguuuu

SEQ ID NO: 387894 - RNA, 19 nt, Homo sapiens
gcgagaacauacaaucaag

SEQ ID NO: 387895 - RNA, 19 nt, Homo sapiens
gggaaggaaauacuaagaa

SEQ ID NO: 387896 - RNA, 19 nt, Homo sapiens
caagaaacaucugguacag

SEQ ID NO: 387897 - RNA, 19 nt, Homo sapiens
caagcuccaugacuucuuc

SEQ ID NO: 387898 - RNA, 19 nt, Homo sapiens
agauggaguuucucucuug

SEQ ID NO: 387899 - RNA, 19 nt, Homo sapiens
agaaucaccuguguauuuc

SEQ ID NO: 387900 - RNA, 19 nt, Homo sapiens
gauccaaccuagagaccau

SEQ ID NO: 387901 - RNA, 19 nt, Homo sapiens
gugaacagcucagcagaca

SEQ ID NO: 387902 - RNA, 19 nt, Homo sapiens
ggccacagcuggugaacag

SEQ ID NO: 387903 - RNA, 19 nt, Homo sapiens
aaacgagacagaagaguga

SEQ ID NO: 387904 - RNA, 19 nt, Homo sapiens
gcaagauaguuuccaccau

SEQ ID NO: 387905 - RNA, 19 nt, Homo sapiens
guuaagaaccacugacaau

SEQ ID NO: 387906 - RNA, 19 nt, Homo sapiens
ccacuucaguuaagaacca

SEQ ID NO: 387907 - RNA, 19 nt, Homo sapiens
acaaagauggccacauuga

SEQ ID NO: 387908 - RNA, 19 nt, Homo sapiens
cuggaaacauuguaucgaa

SEQ ID NO: 387909 - RNA, 19 nt, Homo sapiens
acaacaugcuggaguacaa

SEQ ID NO: 387910 - RNA, 19 nt, Homo sapiens
ugagagcucugagggagaa

SEQ ID NO: 387911 - RNA, 19 nt, Homo sapiens
gauauccuguggagugauc

SEQ ID NO: 387912 - RNA, 19 nt, Homo sapiens
agaaaugcagugacuauga

SEQ ID NO: 387913 - RNA, 19 nt, Homo sapiens
ucucauggaucacuucauc

SEQ ID NO: 387914 - RNA, 19 nt, Homo sapiens
gcucucacaugaauaucga

SEQ ID NO: 387915 - RNA, 19 nt, Homo sapiens
ucagugaauuuaagaagca

SEQ ID NO: 387916 - RNA, 19 nt, Homo sapiens
augcaaaccugaaggcuau

SEQ ID NO: 387917 - RNA, 19 nt, Homo sapiens
uagagguacccgacaguua

SEQ ID NO: 387918 - RNA, 19 nt, Homo sapiens
acuccgagaugaagaaaug

SEQ ID NO: 387919 - RNA, 19 nt, Homo sapiens
ucagaaugcccacaagcua

SEQ ID NO: 387920 - RNA, 19 nt, Homo sapiens
gaauuuaagaagcaugaug

SEQ ID NO: 387921 - RNA, 19 nt, Homo sapiens
gaagcuguuugcucauucu

SEQ ID NO: 387922 - RNA, 19 nt, Homo sapiens
agaguuccaucuuaacaga

SEQ ID NO: 387923 - RNA, 19 nt, Homo sapiens
gagauccugaugauucuuu

SEQ ID NO: 387924 - RNA, 19 nt, Homo sapiens
gaacagccuggucuucauc

SEQ ID NO: 387925 - RNA, 19 nt, Homo sapiens
gggcugcaccuucuuuaug

SEQ ID NO: 387926 - RNA, 19 nt, Homo sapiens
gcaagguauuaacaaucuu

SEQ ID NO: 387927 - RNA, 19 nt, Homo sapiens
ggcaagaagccugaacuuu

SEQ ID NO: 387928 - RNA, 19 nt, Homo sapiens
uggaguuucucucuuguug

SEQ ID NO: 387929 - RNA, 19 nt, Homo sapiens
gaaauggucuggaauguuu

SEQ ID NO: 387930 - RNA, 19 nt, Homo sapiens
gcacagagauguuauuuau

SEQ ID NO: 387931 - RNA, 19 nt, Homo sapiens
gcaauuaagugaucaagua

SEQ ID NO: 387932 - RNA, 19 nt, Homo sapiens
caaguaaccugguacauuu

SEQ ID NO: 387933 - RNA, 19 nt, Homo sapiens
gguaaaugcugcucgauua

SEQ ID NO: 387934 - RNA, 19 nt, Homo sapiens
ggucacaccucaucuauuu

SEQ ID NO: 387935 - RNA, 19 nt, Homo sapiens
gcaaugggauacuuauuaa

SEQ ID NO: 387936 - RNA, 19 nt, Homo sapiens
gaaaguuggucaagaaguu

SEQ ID NO: 387937 - RNA, 19 nt, Homo sapiens
ccaaaugguuuauacagua

SEQ ID NO: 387938 - RNA, 19 nt, Homo sapiens
gaaugggucuuguaaauca

SEQ ID NO: 387939 - RNA, 19 nt, Homo sapiens
gaacuggccuuacuuugau

SEQ ID NO: 387940 - RNA, 19 nt, Homo sapiens
caacaagacaggugaguua

SEQ ID NO: 387941 - RNA, 19 nt, Homo sapiens
gaaggcagguggucacuga

SEQ ID NO: 387942 - RNA, 19 nt, Homo sapiens
ccucaucuauuuacuguua

SEQ ID NO: 387943 - RNA, 19 nt, Homo sapiens
gaacauuuccaauugcaua

SEQ ID NO: 387944 - RNA, 19 nt, Homo sapiens
gaauuguucuuguagauga

SEQ ID NO: 387945 - RNA, 19 nt, Homo sapiens
gggaaugggucuuguaaau

SEQ ID NO: 387946 - RNA, 19 nt, Homo sapiens
ucagaaagcuaaugauugu

SEQ ID NO: 387947 - RNA, 19 nt, Homo sapiens
ggaaauauccagacacaau

SEQ ID NO: 387948 - RNA, 19 nt, Homo sapiens
gggaauuaguaucaacuua

SEQ ID NO: 387949 - RNA, 19 nt, Homo sapiens
gcaauaccaucucaccuau

SEQ ID NO: 387950 - RNA, 19 nt, Homo sapiens
ugaaaugauuacccaguua

SEQ ID NO: 387951 - RNA, 19 nt, Homo sapiens
aacaaucccuuuauccuua

SEQ ID NO: 387952 - RNA, 19 nt, Homo sapiens
ggagagugcugguauugug

SEQ ID NO: 387953 - RNA, 19 nt, Homo sapiens
gcaaguaaccugguacauu

SEQ ID NO: 387954 - RNA, 19 nt, Homo sapiens
caaagaaucuggugcaaaa

SEQ ID NO: 387955 - RNA, 19 nt, Homo sapiens
caagacaggugaguuaaau

SEQ ID NO: 387956 - RNA, 19 nt, Homo sapiens
caacaugcguagccucuug

SEQ ID NO: 387957 - RNA, 19 nt, Homo sapiens
guccaaguaucaucuuaua

SEQ ID NO: 387958 - RNA, 19 nt, Homo sapiens
acuauaagcucagcaagua

SEQ ID NO: 387959 - RNA, 19 nt, Homo sapiens
gauagaaaguuggucaaga

SEQ ID NO: 387960 - RNA, 19 nt, Homo sapiens
ccaauaaaccagaauuuga

SEQ ID NO: 387961 - RNA, 19 nt, Homo sapiens
aauaccaucucaccuauaa

SEQ ID NO: 387962 - RNA, 19 nt, Homo sapiens
ugugaugccuuguugauaa

SEQ ID NO: 387963 - RNA, 19 nt, Homo sapiens
gauggaaggagacauaauu

SEQ ID NO: 387964 - RNA, 19 nt, Homo sapiens
gaaccuucauucagccaaa

SEQ ID NO: 387965 - RNA, 19 nt, Homo sapiens
gguuucaucuguacaagaa

SEQ ID NO: 387966 - RNA, 19 nt, Homo sapiens
guagaugauucaauuguca

SEQ ID NO: 387967 - RNA, 19 nt, Homo sapiens
auagaaaguuggucaagaa

SEQ ID NO: 387968 - RNA, 19 nt, Homo sapiens
cagcuugucucacuggaaa

SEQ ID NO: 387969 - RNA, 19 nt, Homo sapiens
cagaauaucuaggagcaaa

SEQ ID NO: 387970 - RNA, 19 nt, Homo sapiens
gagaaauuguggaaauauc

SEQ ID NO: 387971 - RNA, 19 nt, Homo sapiens
gaacuaaacuaagccuacu

SEQ ID NO: 387972 - RNA, 19 nt, Homo sapiens
uuaaugaagugcuugauca

SEQ ID NO: 387973 - RNA, 19 nt, Homo sapiens
gaaaagaguggucauugua

SEQ ID NO: 387974 - RNA, 19 nt, Homo sapiens
uguccaaacucuugauauu

SEQ ID NO: 387975 - RNA, 19 nt, Homo sapiens
gaaauauccagacacaaug

SEQ ID NO: 387976 - RNA, 19 nt, Homo sapiens
gaaaaugugauccauagua

SEQ ID NO: 387977 - RNA, 19 nt, Homo sapiens
ccaaguccaugcuuuaaag

SEQ ID NO: 387978 - RNA, 19 nt, Homo sapiens
gguuagcacuguuccagaa

SEQ ID NO: 387979 - RNA, 19 nt, Homo sapiens
ucuuguagcuucuuaucua

SEQ ID NO: 387980 - RNA, 19 nt, Homo sapiens
gaauuggacacaccaggua

SEQ ID NO: 387981 - RNA, 19 nt, Homo sapiens
ggaaaguacuaaaccaaaa

SEQ ID NO: 387982 - RNA, 19 nt, Homo sapiens
uagaaggacugguuucauc

SEQ ID NO: 387983 - RNA, 19 nt, Homo sapiens
uugaucaccuugcagaaua

SEQ ID NO: 387984 - RNA, 19 nt, Homo sapiens
gccagcagcuagcgauuga

SEQ ID NO: 387985 - RNA, 19 nt, Homo sapiens
aaucgucccuuaugcauug

SEQ ID NO: 387986 - RNA, 19 nt, Homo sapiens
uuauggaaaucgucccuua

SEQ ID NO: 387987 - RNA, 19 nt, Homo sapiens
gcauacucccugcuuauaa

SEQ ID NO: 387988 - RNA, 19 nt, Homo sapiens
gaugccuuguugauaaaua

SEQ ID NO: 387989 - RNA, 19 nt, Homo sapiens
gaccuuggcuucccugucu

SEQ ID NO: 387990 - RNA, 19 nt, Homo sapiens
gugaaaugauuacccaguu

SEQ ID NO: 387991 - RNA, 19 nt, Homo sapiens
acauggagcuggaggaguu

SEQ ID NO: 387992 - RNA, 19 nt, Homo sapiens
ucacugacauuucccaagu

SEQ ID NO: 387993 - RNA, 19 nt, Homo sapiens
ggacugguuucaucuguac

SEQ ID NO: 387994 - RNA, 19 nt, Homo sapiens
uaccaucucaccuauaaua

SEQ ID NO: 387995 - RNA, 19 nt, Homo sapiens
acagagauguuauuuaugc

SEQ ID NO: 387996 - RNA, 19 nt, Homo sapiens
agucuugccuggagaaauu

SEQ ID NO: 387997 - RNA, 19 nt, Homo sapiens
guaaaugcugcucgauuaa

SEQ ID NO: 387998 - RNA, 19 nt, Homo sapiens
cauaauggcgaauugguaa

SEQ ID NO: 387999 - RNA, 19 nt, Homo sapiens
ugaacuggccuuacuuuga

SEQ ID NO: 388000 - RNA, 19 nt, Homo sapiens
aaauggaaauggucuggaa

SEQ ID NO: 388001 - RNA, 19 nt, Homo sapiens
uggagaaauuguggaaaua

SEQ ID NO: 388002 - RNA, 19 nt, Homo sapiens
gguggugucuucagaaucu

SEQ ID NO: 388003 - RNA, 19 nt, Homo sapiens
gggaaaguacuaaaccaaa

SEQ ID NO: 388004 - RNA, 19 nt, Homo sapiens
gcagugacacgggcaaauu

SEQ ID NO: 388005 - RNA, 19 nt, Homo sapiens
ugcaaugggauacuuauua

SEQ ID NO: 388006 - RNA, 19 nt, Homo sapiens
gcaagaaguuaggguuaag

SEQ ID NO: 388007 - RNA, 19 nt, Homo sapiens
ggagaaauuguggaaauau

SEQ ID NO: 388008 - RNA, 19 nt, Homo sapiens
cguagccucuugucuuaaa

SEQ ID NO: 388009 - RNA, 19 nt, Homo sapiens
ugcguagccucuugucuua

SEQ ID NO: 388010 - RNA, 19 nt, Homo sapiens
gauuugagccaucauuuca

SEQ ID NO: 388011 - RNA, 19 nt, Homo sapiens
ggaaauggucuggaauguu

SEQ ID NO: 388012 - RNA, 19 nt, Homo sapiens
ggcaauaccaucucaccua

SEQ ID NO: 388013 - RNA, 19 nt, Homo sapiens
gauggguggugucuucaga

SEQ ID NO: 388014 - RNA, 19 nt, Homo sapiens
cauacucccugcuuauaau

SEQ ID NO: 388015 - RNA, 19 nt, Homo sapiens
ugcgauaacugaacauuuc

SEQ ID NO: 388016 - RNA, 19 nt, Homo sapiens
gguuggauguguguaguuu

SEQ ID NO: 388017 - RNA, 19 nt, Homo sapiens
acaagaagggauaaaguuu

SEQ ID NO: 388018 - RNA, 19 nt, Homo sapiens
guccaaacucuugauauua

SEQ ID NO: 388019 - RNA, 19 nt, Homo sapiens
gauauuaccgugaagucuu

SEQ ID NO: 388020 - RNA, 19 nt, Homo sapiens
gaaaucgucccuuaugcau

SEQ ID NO: 388021 - RNA, 19 nt, Homo sapiens
uuacugagaugcuuuugua

SEQ ID NO: 388022 - RNA, 19 nt, Homo sapiens
agacauaauuggcagaucu

SEQ ID NO: 388023 - RNA, 19 nt, Homo sapiens
ccacaugugcaaugggaua

SEQ ID NO: 388024 - RNA, 19 nt, Homo sapiens
gacaggugaguuaaauaua

SEQ ID NO: 388025 - RNA, 19 nt, Homo sapiens
guauuggucugucuacaag

SEQ ID NO: 388026 - RNA, 19 nt, Homo sapiens
gugaugccuuguugauaaa

SEQ ID NO: 388027 - RNA, 19 nt, Homo sapiens
ccucuugucuuaaauguac

SEQ ID NO: 388028 - RNA, 19 nt, Homo sapiens
guccagauccauuuagaaa

SEQ ID NO: 388029 - RNA, 19 nt, Homo sapiens
gaacuccgcugcaugugua

SEQ ID NO: 388030 - RNA, 19 nt, Homo sapiens
gaagugaucgggaaaggaa

SEQ ID NO: 388031 - RNA, 19 nt, Homo sapiens
caaccaagucgaagugaua

SEQ ID NO: 388032 - RNA, 19 nt, Homo sapiens
cuagaguucucauuuauuc

SEQ ID NO: 388033 - RNA, 19 nt, Homo sapiens
uaaauaagccugguuucaa

SEQ ID NO: 388034 - RNA, 19 nt, Homo sapiens
gauauguguuucauucugu

SEQ ID NO: 388035 - RNA, 19 nt, Homo sapiens
aaagacaaccucuggaauu

SEQ ID NO: 388036 - RNA, 19 nt, Homo sapiens
ggauaccuauucuuacugu

SEQ ID NO: 388037 - RNA, 19 nt, Homo sapiens
ggaaaggaacccauugcaa

SEQ ID NO: 388038 - RNA, 19 nt, Homo sapiens
caacucacccucacucaga

SEQ ID NO: 388039 - RNA, 19 nt, Homo sapiens
ggauauguguuucauucug

SEQ ID NO: 388040 - RNA, 19 nt, Homo sapiens
aaagauggcagaaagaaga

SEQ ID NO: 388041 - RNA, 19 nt, Homo sapiens
gacaaccucuggaauucau

SEQ ID NO: 388042 - RNA, 19 nt, Homo sapiens
aggaaagucuagacaguga

SEQ ID NO: 388043 - RNA, 19 nt, Homo sapiens
gaagguugguuaaaagaug

SEQ ID NO: 388044 - RNA, 19 nt, Homo sapiens
gcaaccaagucgaagugau

SEQ ID NO: 388045 - RNA, 19 nt, Homo sapiens
gcagaaagaagaugaaaau

SEQ ID NO: 388046 - RNA, 19 nt, Homo sapiens
caggauaccuauucuuacu

SEQ ID NO: 388047 - RNA, 19 nt, Homo sapiens
gcaaagaggaaagucuaga

SEQ ID NO: 388048 - RNA, 19 nt, Homo sapiens
caaaggacaaacuaagaga

SEQ ID NO: 388049 - RNA, 19 nt, Homo sapiens
aaauaagccugguuucaac

SEQ ID NO: 388050 - RNA, 19 nt, Homo sapiens
uaagagaaacuuggcgaaa

SEQ ID NO: 388051 - RNA, 19 nt, Homo sapiens
ucuagacagugacuuguau

SEQ ID NO: 388052 - RNA, 19 nt, Homo sapiens
uuggauauguguuucauuc

SEQ ID NO: 388053 - RNA, 19 nt, Homo sapiens
aagacaaccucuggaauuc

SEQ ID NO: 388054 - RNA, 19 nt, Homo sapiens
ugacuuguaugcugaacuc

SEQ ID NO: 388055 - RNA, 19 nt, Homo sapiens
agaggaaagucuagacagu

SEQ ID NO: 388056 - RNA, 19 nt, Homo sapiens
aaacuuggcgaaaggcaaa

SEQ ID NO: 388057 - RNA, 19 nt, Homo sapiens
gcugaacuccgcugcaugu

SEQ ID NO: 388058 - RNA, 19 nt, Homo sapiens
gaaaggcaaagaggaaagu

SEQ ID NO: 388059 - RNA, 19 nt, Homo sapiens
ccaccaaaggacaaacuaa

SEQ ID NO: 388060 - RNA, 19 nt, Homo sapiens
gauggcagaaagaagauga

SEQ ID NO: 388061 - RNA, 19 nt, Homo sapiens
guuaaaagauggcagaaag

SEQ ID NO: 388062 - RNA, 19 nt, Homo sapiens
ggacaaacuaagagaaacu

SEQ ID NO: 388063 - RNA, 19 nt, Homo sapiens
uucaggauaccuauucuua

SEQ ID NO: 388064 - RNA, 19 nt, Homo sapiens
uaaagacaaccucuggaau

SEQ ID NO: 388065 - RNA, 19 nt, Homo sapiens
agagaaacuuggcgaaagg

SEQ ID NO: 388066 - RNA, 19 nt, Homo sapiens
gauaccuauucuuacugua

SEQ ID NO: 388067 - RNA, 19 nt, Homo sapiens
gcugauuaauuuguucugu

SEQ ID NO: 388068 - RNA, 19 nt, Homo sapiens
aagagaaacuuggcgaaag

SEQ ID NO: 388069 - RNA, 19 nt, Homo sapiens
gcauguguauaaagacaac

SEQ ID NO: 388070 - RNA, 19 nt, Homo sapiens
cugccaaacuucuuuaacu

SEQ ID NO: 388071 - RNA, 19 nt, Homo sapiens
ggcgaaaggcaaagaggaa

SEQ ID NO: 388072 - RNA, 19 nt, Homo sapiens
cccaggaaggguagaauuu

SEQ ID NO: 388073 - RNA, 19 nt, Homo sapiens
ccagaugcucccagaauca

SEQ ID NO: 388074 - RNA, 19 nt, Homo sapiens
ccaaaggacaaacuaagag

SEQ ID NO: 388075 - RNA, 19 nt, Homo sapiens
gcgaaaggcaaagaggaaa

SEQ ID NO: 388076 - RNA, 19 nt, Homo sapiens
aaggacaaacuaagagaaa

SEQ ID NO: 388077 - RNA, 19 nt, Homo sapiens
gcucagccuucuccaccau

SEQ ID NO: 388078 - RNA, 19 nt, Homo sapiens
auaaagacaaccucuggaa

SEQ ID NO: 388079 - RNA, 19 nt, Homo sapiens
gaugcucccagaaucaaga

SEQ ID NO: 388080 - RNA, 19 nt, Homo sapiens
ggucuucugguucuggaaa

SEQ ID NO: 388081 - RNA, 19 nt, Homo sapiens
ggaagugaucgggaaagga

SEQ ID NO: 388082 - RNA, 19 nt, Homo sapiens
ucucauuuauucaggauac

SEQ ID NO: 388083 - RNA, 19 nt, Homo sapiens
gguagaauuuugaaaccuu

SEQ ID NO: 388084 - RNA, 19 nt, Homo sapiens
ucagccuucuccaccauga

SEQ ID NO: 388085 - RNA, 19 nt, Homo sapiens
gacaaacuaagagaaacuu

SEQ ID NO: 388086 - RNA, 19 nt, Homo sapiens
aggcaaagaggaaagucua

SEQ ID NO: 388087 - RNA, 19 nt, Homo sapiens
aaaggacaaacuaagagaa

SEQ ID NO: 388088 - RNA, 19 nt, Homo sapiens
auaaauaagccugguuuca

SEQ ID NO: 388089 - RNA, 19 nt, Homo sapiens
caggaaggguagaauuuug

SEQ ID NO: 388090 - RNA, 19 nt, Homo sapiens
gggaaaggaacccauugca

SEQ ID NO: 388091 - RNA, 19 nt, Homo sapiens
cccagaugcucccagaauc

SEQ ID NO: 388092 - RNA, 19 nt, Homo sapiens
gaacccauugcaaccaagu

SEQ ID NO: 388093 - RNA, 19 nt, Homo sapiens
cugcauguguauaaagaca

SEQ ID NO: 388094 - RNA, 19 nt, Homo sapiens
guucucauuuauucaggau

SEQ ID NO: 388095 - RNA, 19 nt, Homo sapiens
ugccaaacuucuuuaacuc

SEQ ID NO: 388096 - RNA, 19 nt, Homo sapiens
caccaaaggacaaacuaag

SEQ ID NO: 388097 - RNA, 19 nt, Homo sapiens
ugagaagguugguuaaaag

SEQ ID NO: 388098 - RNA, 19 nt, Homo sapiens
caaagaggaaagucuagac

SEQ ID NO: 388099 - RNA, 19 nt, Homo sapiens
aaagaggaaagucuagaca

SEQ ID NO: 388100 - RNA, 19 nt, Homo sapiens
cugagaagguugguuaaaa

SEQ ID NO: 388101 - RNA, 19 nt, Homo sapiens
acugaaggaugggaggaaa

SEQ ID NO: 388102 - RNA, 19 nt, Homo sapiens
uaaaagauggcagaaagaa

SEQ ID NO: 388103 - RNA, 19 nt, Homo sapiens
ccauugcaaccaagucgaa

SEQ ID NO: 388104 - RNA, 19 nt, Homo sapiens
cgcugcauguguauaaaga

SEQ ID NO: 388105 - RNA, 19 nt, Homo sapiens
gaacaaagauggaagcauu

SEQ ID NO: 388106 - RNA, 19 nt, Homo sapiens
gggaaacccucuucaauaa

SEQ ID NO: 388107 - RNA, 19 nt, Homo sapiens
gaugaaaucugugcugaua

SEQ ID NO: 388108 - RNA, 19 nt, Homo sapiens
gaucaaaccucgagggaaa

SEQ ID NO: 388109 - RNA, 19 nt, Homo sapiens
ggauuugguuucagcauua

SEQ ID NO: 388110 - RNA, 19 nt, Homo sapiens
gggaacagauuauugauau

SEQ ID NO: 388111 - RNA, 19 nt, Homo sapiens
gaauuucacucacauacaa

SEQ ID NO: 388112 - RNA, 19 nt, Homo sapiens
gaacaggacaugagggaua

SEQ ID NO: 388113 - RNA, 19 nt, Homo sapiens
uaaggaagagcuagaauua

SEQ ID NO: 388114 - RNA, 19 nt, Homo sapiens
ccaaugaccugcacuugaa

SEQ ID NO: 388115 - RNA, 19 nt, Homo sapiens
ggaagguggugacuauauu

SEQ ID NO: 388116 - RNA, 19 nt, Homo sapiens
guacaaucguugacaauga

SEQ ID NO: 388117 - RNA, 19 nt, Homo sapiens
gagaggaacccguauguuu

SEQ ID NO: 388118 - RNA, 19 nt, Homo sapiens
gaagaaacagaaucuauga

SEQ ID NO: 388119 - RNA, 19 nt, Homo sapiens
ucaauaagcuugccaacau

SEQ ID NO: 388120 - RNA, 19 nt, Homo sapiens
acaaacagaugcauaguau

SEQ ID NO: 388121 - RNA, 19 nt, Homo sapiens
gaaguugaauucaugaaca

SEQ ID NO: 388122 - RNA, 19 nt, Homo sapiens
ucgaggagcuuacaucaaa

SEQ ID NO: 388123 - RNA, 19 nt, Homo sapiens
caucaggucucaugaaugu

SEQ ID NO: 388124 - RNA, 19 nt, Homo sapiens
gcaguuauccaccuucuuu

SEQ ID NO: 388125 - RNA, 19 nt, Homo sapiens
aaacagcgccaucaagaua

SEQ ID NO: 388126 - RNA, 19 nt, Homo sapiens
gagcuuacaucaaacuaug

SEQ ID NO: 388127 - RNA, 19 nt, Homo sapiens
cgaauaugcugaugaacaa

SEQ ID NO: 388128 - RNA, 19 nt, Homo sapiens
cagaauauccgcauugaaa

SEQ ID NO: 388129 - RNA, 19 nt, Homo sapiens
gagcuagaauuaagaaauc

SEQ ID NO: 388130 - RNA, 19 nt, Homo sapiens
uuacaaagcucgacugaag

SEQ ID NO: 388131 - RNA, 19 nt, Homo sapiens
caauaagcuugccaacaua

SEQ ID NO: 388132 - RNA, 19 nt, Homo sapiens
gaucugaccuggaaaucau

SEQ ID NO: 388133 - RNA, 19 nt, Homo sapiens
gaacagagggaaccacgaa

SEQ ID NO: 388134 - RNA, 19 nt, Homo sapiens
agaaaucagucucuugaaa

SEQ ID NO: 388135 - RNA, 19 nt, Homo sapiens
ggagaucccucaguucgaa

SEQ ID NO: 388136 - RNA, 19 nt, Homo sapiens
gaccagauguuacuuccaa

SEQ ID NO: 388137 - RNA, 19 nt, Homo sapiens
caggagaucugacacauca

SEQ ID NO: 388138 - RNA, 19 nt, Homo sapiens
auacagaucugaccuggaa

SEQ ID NO: 388139 - RNA, 19 nt, Homo sapiens
gggcugaacuuaccaugga

SEQ ID NO: 388140 - RNA, 19 nt, Homo sapiens
gaacaacagauacuucaug

SEQ ID NO: 388141 - RNA, 19 nt, Homo sapiens
cuacuaagcuugacaucug

SEQ ID NO: 388142 - RNA, 19 nt, Homo sapiens
gauggaagcauugacuuua

SEQ ID NO: 388143 - RNA, 19 nt, Homo sapiens
gaccacagacuugaauuua

SEQ ID NO: 388144 - RNA, 19 nt, Homo sapiens
agaagaggcugaagcuuga

SEQ ID NO: 388145 - RNA, 19 nt, Homo sapiens
guaauaggauuugguuuca

SEQ ID NO: 388146 - RNA, 19 nt, Homo sapiens
aauaagaccugugugauga

SEQ ID NO: 388147 - RNA, 19 nt, Homo sapiens
ccaaagagguaacaaucug

SEQ ID NO: 388148 - RNA, 19 nt, Homo sapiens
cagaaucuaugacugaaga

SEQ ID NO: 388149 - RNA, 19 nt, Homo sapiens
gauguuacuuccaagauuc

SEQ ID NO: 388150 - RNA, 19 nt, Homo sapiens
ccauagagauccuaaugau

SEQ ID NO: 388151 - RNA, 19 nt, Homo sapiens
gaaagaauuccauagagau

SEQ ID NO: 388152 - RNA, 19 nt, Homo sapiens
gaagguggugacuauauuu

SEQ ID NO: 388153 - RNA, 19 nt, Homo sapiens
gagggaaccacgaagauuu

SEQ ID NO: 388154 - RNA, 19 nt, Homo sapiens
guacggauauugauuuacu

SEQ ID NO: 388155 - RNA, 19 nt, Homo sapiens
guucgaaucugguaaacau

SEQ ID NO: 388156 - RNA, 19 nt, Homo sapiens
cuaaugauccuguguguga

SEQ ID NO: 388157 - RNA, 19 nt, Homo sapiens
ccaagaaaguccugaagca

SEQ ID NO: 388158 - RNA, 19 nt, Homo sapiens
gaagagcuagaauuaagaa

SEQ ID NO: 388159 - RNA, 19 nt, Homo sapiens
aaacagaaucuaugacuga

SEQ ID NO: 388160 - RNA, 19 nt, Homo sapiens
gccaaagaguggauacuau

SEQ ID NO: 388161 - RNA, 19 nt, Homo sapiens
gauauucuguggagugauc

SEQ ID NO: 388162 - RNA, 19 nt, Homo sapiens
cagcaguucuucaacgaaa

SEQ ID NO: 388163 - RNA, 19 nt, Homo sapiens
uaauggacuugaacaaaga

SEQ ID NO: 388164 - RNA, 19 nt, Homo sapiens
cgaaggguaugaaaucugu

SEQ ID NO: 388165 - RNA, 19 nt, Homo sapiens
gagcaugaaugggaacaga

SEQ ID NO: 388166 - RNA, 19 nt, Homo sapiens
acaaauggaucuccuacug

SEQ ID NO: 388167 - RNA, 19 nt, Homo sapiens
gaaaucagucucuugaaag

SEQ ID NO: 388168 - RNA, 19 nt, Homo sapiens
uaagaccugugugaugaua

SEQ ID NO: 388169 - RNA, 19 nt, Homo sapiens
acacaagcccucugcauuu

SEQ ID NO: 388170 - RNA, 19 nt, Homo sapiens
cagcauuaguaccuacaua

SEQ ID NO: 388171 - RNA, 19 nt, Homo sapiens
caaacuauguucugguaca

SEQ ID NO: 388172 - RNA, 19 nt, Homo sapiens
ggaaagccagagagcauuu

SEQ ID NO: 388173 - RNA, 19 nt, Homo sapiens
caggaggaauaccagguua

SEQ ID NO: 388174 - RNA, 19 nt, Homo sapiens
gaacucauacagcacaaga

SEQ ID NO: 388175 - RNA, 19 nt, Homo sapiens
ugaaacagcuaggcccaaa

SEQ ID NO: 388176 - RNA, 19 nt, Homo sapiens
ccagcaaagugaagaucua

SEQ ID NO: 388177 - RNA, 19 nt, Homo sapiens
ccauggagaucccucaguu

SEQ ID NO: 388178 - RNA, 19 nt, Homo sapiens
aaauggaucuccuacugaa

SEQ ID NO: 388179 - RNA, 19 nt, Homo sapiens
guagaucgaggaaagaauu

SEQ ID NO: 388180 - RNA, 19 nt, Homo sapiens
caaguacaguccuuuccaa

SEQ ID NO: 388181 - RNA, 19 nt, Homo sapiens
aaacuucucccuccaaaga

SEQ ID NO: 388182 - RNA, 19 nt, Homo sapiens
ucuuagaggugcuauuuga

SEQ ID NO: 388183 - RNA, 19 nt, Homo sapiens
gggauuauguggacucgau

SEQ ID NO: 388184 - RNA, 19 nt, Homo sapiens
ugggaaacccucuucaaua

SEQ ID NO: 388185 - RNA, 19 nt, Homo sapiens
gggaaaggcugggagaaca

SEQ ID NO: 388186 - RNA, 19 nt, Homo sapiens
gcuguuauugguaagauua

SEQ ID NO: 388187 - RNA, 19 nt, Homo sapiens
gauaugaagacuugaugaa

SEQ ID NO: 388188 - RNA, 19 nt, Homo sapiens
guagagaggaacaagauga

SEQ ID NO: 388189 - RNA, 19 nt, Homo sapiens
agaaaguccugaagcaaau

SEQ ID NO: 388190 - RNA, 19 nt, Homo sapiens
gcaaagugaagaucuagga

SEQ ID NO: 388191 - RNA, 19 nt, Homo sapiens
gguuaaaugucaguaauag

SEQ ID NO: 388192 - RNA, 19 nt, Homo sapiens
gaaaacagcgccaucaaga

SEQ ID NO: 388193 - RNA, 19 nt, Homo sapiens
gaaugggaacagauuauug

SEQ ID NO: 388194 - RNA, 19 nt, Homo sapiens
ccacagacuugaauuuacu

SEQ ID NO: 388195 - RNA, 19 nt, Homo sapiens
gguauggcuucacgaaaga

SEQ ID NO: 388196 - RNA, 19 nt, Homo sapiens
ccacgaagauuuuaugaug

SEQ ID NO: 388197 - RNA, 19 nt, Homo sapiens
ucaugcccauuaugucuua

SEQ ID NO: 388198 - RNA, 19 nt, Homo sapiens
acacacauauacauaagga

SEQ ID NO: 388199 - RNA, 19 nt, Homo sapiens
ugaagaggaucggcuaaga

SEQ ID NO: 388200 - RNA, 19 nt, Homo sapiens
gagggagacaggaggaaua

SEQ ID NO: 388201 - RNA, 19 nt, Homo sapiens
gaauuuacuccaccgugua

SEQ ID NO: 388202 - RNA, 19 nt, Homo sapiens
guaccgagguuacaaagcu

SEQ ID NO: 388203 - RNA, 19 nt, Homo sapiens
gguaagauuagguuaaaug

SEQ ID NO: 388204 - RNA, 19 nt, Homo sapiens
gaaccuguguggaccugau

SEQ ID NO: 388205 - RNA, 19 nt, Homo sapiens
gaacaaagauggaagcauu

SEQ ID NO: 388206 - RNA, 19 nt, Homo sapiens
gggaaacccucuucaauaa

SEQ ID NO: 388207 - RNA, 19 nt, Homo sapiens
gaugaaaucugugcugaua

SEQ ID NO: 388208 - RNA, 19 nt, Homo sapiens
gaucaaaccucgagggaaa

SEQ ID NO: 388209 - RNA, 19 nt, Homo sapiens
ggauuugguuucagcauua

SEQ ID NO: 388210 - RNA, 19 nt, Homo sapiens
gggaacagauuauugauau

SEQ ID NO: 388211 - RNA, 19 nt, Homo sapiens
gaauuucacucacauacaa

SEQ ID NO: 388212 - RNA, 19 nt, Homo sapiens
ccaaugaccugcacuugaa

SEQ ID NO: 388213 - RNA, 19 nt, Homo sapiens
ggaagguggugacuauauu

SEQ ID NO: 388214 - RNA, 19 nt, Homo sapiens
guacaaucguugacaauga

SEQ ID NO: 388215 - RNA, 19 nt, Homo sapiens
gagaggaacccguauguuu

SEQ ID NO: 388216 - RNA, 19 nt, Homo sapiens
gaagaaacagaaucuauga

SEQ ID NO: 388217 - RNA, 19 nt, Homo sapiens
ucaauaagcuugccaacau

SEQ ID NO: 388218 - RNA, 19 nt, Homo sapiens
acaaacagaugcauaguau

SEQ ID NO: 388219 - RNA, 19 nt, Homo sapiens
gaaguugaauucaugaaca

SEQ ID NO: 388220 - RNA, 19 nt, Homo sapiens
ucgaggagcuuacaucaaa

SEQ ID NO: 388221 - RNA, 19 nt, Homo sapiens
caucaggucucaugaaugu

SEQ ID NO: 388222 - RNA, 19 nt, Homo sapiens
gcaguuauccaccuucuuu

SEQ ID NO: 388223 - RNA, 19 nt, Homo sapiens
aaacagcgccaucaagaua

SEQ ID NO: 388224 - RNA, 19 nt, Homo sapiens
gagcuuacaucaaacuaug

SEQ ID NO: 388225 - RNA, 19 nt, Homo sapiens
cgaauaugcugaugaacaa

SEQ ID NO: 388226 - RNA, 19 nt, Homo sapiens
cagaauauccgcauugaaa

SEQ ID NO: 388227 - RNA, 19 nt, Homo sapiens
uuacaaagcucgacugaag

SEQ ID NO: 388228 - RNA, 19 nt, Homo sapiens
caauaagcuugccaacaua

SEQ ID NO: 388229 - RNA, 19 nt, Homo sapiens
gaucugaccuggaaaucau

SEQ ID NO: 388230 - RNA, 19 nt, Homo sapiens
gaacagagggaaccacgaa

SEQ ID NO: 388231 - RNA, 19 nt, Homo sapiens
ggagaucccucaguucgaa

SEQ ID NO: 388232 - RNA, 19 nt, Homo sapiens
gaccagauguuacuuccaa

SEQ ID NO: 388233 - RNA, 19 nt, Homo sapiens
caggagaucugacacauca

SEQ ID NO: 388234 - RNA, 19 nt, Homo sapiens
auacagaucugaccuggaa

SEQ ID NO: 388235 - RNA, 19 nt, Homo sapiens
gggcugaacuuaccaugga

SEQ ID NO: 388236 - RNA, 19 nt, Homo sapiens
cuacuaagcuugacaucug

SEQ ID NO: 388237 - RNA, 19 nt, Homo sapiens
gauggaagcauugacuuua

SEQ ID NO: 388238 - RNA, 19 nt, Homo sapiens
gaccacagacuugaauuua

SEQ ID NO: 388239 - RNA, 19 nt, Homo sapiens
agaagaggcugaagcuuga

SEQ ID NO: 388240 - RNA, 19 nt, Homo sapiens
guaauaggauuugguuuca

SEQ ID NO: 388241 - RNA, 19 nt, Homo sapiens
ccaaagagguaacaaucug

SEQ ID NO: 388242 - RNA, 19 nt, Homo sapiens
aauaagaccugugugauga

SEQ ID NO: 388243 - RNA, 19 nt, Homo sapiens
cagaaucuaugacugaaga

SEQ ID NO: 388244 - RNA, 19 nt, Homo sapiens
gauguuacuuccaagauuc

SEQ ID NO: 388245 - RNA, 19 nt, Homo sapiens
ccauagagauccuaaugau

SEQ ID NO: 388246 - RNA, 19 nt, Homo sapiens
gaaagaauuccauagagau

SEQ ID NO: 388247 - RNA, 19 nt, Homo sapiens
gaagguggugacuauauuu

SEQ ID NO: 388248 - RNA, 19 nt, Homo sapiens
gagggaaccacgaagauuu

SEQ ID NO: 388249 - RNA, 19 nt, Homo sapiens
guucgaaucugguaaacau

SEQ ID NO: 388250 - RNA, 19 nt, Homo sapiens
cuaaugauccuguguguga

SEQ ID NO: 388251 - RNA, 19 nt, Homo sapiens
ccaagaaaguccugaagca

SEQ ID NO: 388252 - RNA, 19 nt, Homo sapiens
aaacagaaucuaugacuga

SEQ ID NO: 388253 - RNA, 19 nt, Homo sapiens
gccaaagaguggauacuau

SEQ ID NO: 388254 - RNA, 19 nt, Homo sapiens
gauauucuguggagugauc

SEQ ID NO: 388255 - RNA, 19 nt, Homo sapiens
cagcaguucuucaacgaaa

SEQ ID NO: 388256 - RNA, 19 nt, Homo sapiens
uaauggacuugaacaaaga

SEQ ID NO: 388257 - RNA, 19 nt, Homo sapiens
cgaaggguaugaaaucugu

SEQ ID NO: 388258 - RNA, 19 nt, Homo sapiens
uaagaccugugugaugaua

SEQ ID NO: 388259 - RNA, 19 nt, Homo sapiens
gagcaugaaugggaacaga

SEQ ID NO: 388260 - RNA, 19 nt, Homo sapiens
acaaauggaucuccuacug

SEQ ID NO: 388261 - RNA, 19 nt, Homo sapiens
acacaagcccucugcauuu

SEQ ID NO: 388262 - RNA, 19 nt, Homo sapiens
cagcauuaguaccuacaua

SEQ ID NO: 388263 - RNA, 19 nt, Homo sapiens
caaacuauguucugguaca

SEQ ID NO: 388264 - RNA, 19 nt, Homo sapiens
ggaaagccagagagcauuu

SEQ ID NO: 388265 - RNA, 19 nt, Homo sapiens
caggaggaauaccagguua

SEQ ID NO: 388266 - RNA, 19 nt, Homo sapiens
gaacucauacagcacaaga

SEQ ID NO: 388267 - RNA, 19 nt, Homo sapiens
ugaaacagcuaggcccaaa

SEQ ID NO: 388268 - RNA, 19 nt, Homo sapiens
ccauggagaucccucaguu

SEQ ID NO: 388269 - RNA, 19 nt, Homo sapiens
aaauggaucuccuacugaa

SEQ ID NO: 388270 - RNA, 19 nt, Homo sapiens
ccagcaaagugaagaucua

SEQ ID NO: 388271 - RNA, 19 nt, Homo sapiens
guagaucgaggaaagaauu

SEQ ID NO: 388272 - RNA, 19 nt, Homo sapiens
caaguacaguccuuuccaa

SEQ ID NO: 388273 - RNA, 19 nt, Homo sapiens
gggaaaggcugggagaaca

SEQ ID NO: 388274 - RNA, 19 nt, Homo sapiens
ugggaaacccucuucaaua

SEQ ID NO: 388275 - RNA, 19 nt, Homo sapiens
aaacuucucccuccaaaga

SEQ ID NO: 388276 - RNA, 19 nt, Homo sapiens
ucuuagaggugcuauuuga

SEQ ID NO: 388277 - RNA, 19 nt, Homo sapiens
gcuguuauugguaagauua

SEQ ID NO: 388278 - RNA, 19 nt, Homo sapiens
gauaugaagacuugaugaa

SEQ ID NO: 388279 - RNA, 19 nt, Homo sapiens
guagagaggaacaagauga

SEQ ID NO: 388280 - RNA, 19 nt, Homo sapiens
gcaaagugaagaucuagga

SEQ ID NO: 388281 - RNA, 19 nt, Homo sapiens
agaaaguccugaagcaaau

SEQ ID NO: 388282 - RNA, 19 nt, Homo sapiens
gguuaaaugucaguaauag

SEQ ID NO: 388283 - RNA, 19 nt, Homo sapiens
gaaaacagcgccaucaaga

SEQ ID NO: 388284 - RNA, 19 nt, Homo sapiens
gaaugggaacagauuauug

SEQ ID NO: 388285 - RNA, 19 nt, Homo sapiens
ccacagacuugaauuuacu

SEQ ID NO: 388286 - RNA, 19 nt, Homo sapiens
gguauggcuucacgaaaga

SEQ ID NO: 388287 - RNA, 19 nt, Homo sapiens
ccacgaagauuuuaugaug

SEQ ID NO: 388288 - RNA, 19 nt, Homo sapiens
ucaugcccauuaugucuua

SEQ ID NO: 388289 - RNA, 19 nt, Homo sapiens
acacacauauacauaagga

SEQ ID NO: 388290 - RNA, 19 nt, Homo sapiens
ugaagaggaucggcuaaga

SEQ ID NO: 388291 - RNA, 19 nt, Homo sapiens
gagggagacaggaggaaua

SEQ ID NO: 388292 - RNA, 19 nt, Homo sapiens
gaauuuacuccaccgugua

SEQ ID NO: 388293 - RNA, 19 nt, Homo sapiens
guaccgagguuacaaagcu

SEQ ID NO: 388294 - RNA, 19 nt, Homo sapiens
gguaagauuagguuaaaug

SEQ ID NO: 388295 - RNA, 19 nt, Homo sapiens
caauaagaccugugugaug

SEQ ID NO: 388296 - RNA, 19 nt, Homo sapiens
caacggaaacaaacagaga

SEQ ID NO: 388297 - RNA, 19 nt, Homo sapiens
gaaccuguguggaccugau

SEQ ID NO: 388298 - RNA, 19 nt, Homo sapiens
gcauuaguaccuacauauu

SEQ ID NO: 388299 - RNA, 19 nt, Homo sapiens
ugguacaacuccucgauuu

SEQ ID NO: 388300 - RNA, 19 nt, Homo sapiens
ccagagagcauuugagaag

SEQ ID NO: 388301 - RNA, 19 nt, Homo sapiens
guacaagaggcucauucua

SEQ ID NO: 388302 - RNA, 19 nt, Homo sapiens
ccaucaagauauuaagaga

SEQ ID NO: 388303 - RNA, 19 nt, Homo sapiens
caaauggaucuccuacuga

SEQ ID NO: 388304 - RNA, 19 nt, Homo sapiens
gaagcacaauaaaguaggu

SEQ ID NO: 388305 - RNA, 19 nt, Homo sapiens
gaacaaagauggaagcauu

SEQ ID NO: 388306 - RNA, 19 nt, Homo sapiens
gggaaacccucuucaauaa

SEQ ID NO: 388307 - RNA, 19 nt, Homo sapiens
gaugaaaucugugcugaua

SEQ ID NO: 388308 - RNA, 19 nt, Homo sapiens
gaucaaaccucgagggaaa

SEQ ID NO: 388309 - RNA, 19 nt, Homo sapiens
ggauuugguuucagcauua

SEQ ID NO: 388310 - RNA, 19 nt, Homo sapiens
gaauuucacucacauacaa

SEQ ID NO: 388311 - RNA, 19 nt, Homo sapiens
gaacaggacaugagggaua

SEQ ID NO: 388312 - RNA, 19 nt, Homo sapiens
uaaggaagagcuagaauua

SEQ ID NO: 388313 - RNA, 19 nt, Homo sapiens
ccaaugaccugcacuugaa

SEQ ID NO: 388314 - RNA, 19 nt, Homo sapiens
ggaagguggugacuauauu

SEQ ID NO: 388315 - RNA, 19 nt, Homo sapiens
guacaaucguugacaauga

SEQ ID NO: 388316 - RNA, 19 nt, Homo sapiens
gagaggaacccguauguuu

SEQ ID NO: 388317 - RNA, 19 nt, Homo sapiens
gaagaaacagaaucuauga

SEQ ID NO: 388318 - RNA, 19 nt, Homo sapiens
ucaauaagcuugccaacau

SEQ ID NO: 388319 - RNA, 19 nt, Homo sapiens
acaaacagaugcauaguau

SEQ ID NO: 388320 - RNA, 19 nt, Homo sapiens
gaaguugaauucaugaaca

SEQ ID NO: 388321 - RNA, 19 nt, Homo sapiens
ucgaggagcuuacaucaaa

SEQ ID NO: 388322 - RNA, 19 nt, Homo sapiens
caucaggucucaugaaugu

SEQ ID NO: 388323 - RNA, 19 nt, Homo sapiens
gcaguuauccaccuucuuu

SEQ ID NO: 388324 - RNA, 19 nt, Homo sapiens
aaacagcgccaucaagaua

SEQ ID NO: 388325 - RNA, 19 nt, Homo sapiens
gagcuuacaucaaacuaug

SEQ ID NO: 388326 - RNA, 19 nt, Homo sapiens
cgaauaugcugaugaacaa

SEQ ID NO: 388327 - RNA, 19 nt, Homo sapiens
cagaauauccgcauugaaa

SEQ ID NO: 388328 - RNA, 19 nt, Homo sapiens
gagcuagaauuaagaaauc

SEQ ID NO: 388329 - RNA, 19 nt, Homo sapiens
uuacaaagcucgacugaag

SEQ ID NO: 388330 - RNA, 19 nt, Homo sapiens
caauaagcuugccaacaua

SEQ ID NO: 388331 - RNA, 19 nt, Homo sapiens
gaucugaccuggaaaucau

SEQ ID NO: 388332 - RNA, 19 nt, Homo sapiens
gaacagagggaaccacgaa

SEQ ID NO: 388333 - RNA, 19 nt, Homo sapiens
agaaaucagucucuugaaa

SEQ ID NO: 388334 - RNA, 19 nt, Homo sapiens
ggagaucccucaguucgaa

SEQ ID NO: 388335 - RNA, 19 nt, Homo sapiens
gaccagauguuacuuccaa

SEQ ID NO: 388336 - RNA, 19 nt, Homo sapiens
caggagaucugacacauca

SEQ ID NO: 388337 - RNA, 19 nt, Homo sapiens
auacagaucugaccuggaa

SEQ ID NO: 388338 - RNA, 19 nt, Homo sapiens
gggcugaacuuaccaugga

SEQ ID NO: 388339 - RNA, 19 nt, Homo sapiens
gaacaacagauacuucaug

SEQ ID NO: 388340 - RNA, 19 nt, Homo sapiens
cuacuaagcuugacaucug

SEQ ID NO: 388341 - RNA, 19 nt, Homo sapiens
gauggaagcauugacuuua

SEQ ID NO: 388342 - RNA, 19 nt, Homo sapiens
gaccacagacuugaauuua

SEQ ID NO: 388343 - RNA, 19 nt, Homo sapiens
agaagaggcugaagcuuga

SEQ ID NO: 388344 - RNA, 19 nt, Homo sapiens
guaauaggauuugguuuca

SEQ ID NO: 388345 - RNA, 19 nt, Homo sapiens
aauaagaccugugugauga

SEQ ID NO: 388346 - RNA, 19 nt, Homo sapiens
ccaaagagguaacaaucug

SEQ ID NO: 388347 - RNA, 19 nt, Homo sapiens
cagaaucuaugacugaaga

SEQ ID NO: 388348 - RNA, 19 nt, Homo sapiens
gauguuacuuccaagauuc

SEQ ID NO: 388349 - RNA, 19 nt, Homo sapiens
ccauagagauccuaaugau

SEQ ID NO: 388350 - RNA, 19 nt, Homo sapiens
gaaagaauuccauagagau

SEQ ID NO: 388351 - RNA, 19 nt, Homo sapiens
gaagguggugacuauauuu

SEQ ID NO: 388352 - RNA, 19 nt, Homo sapiens
gagggaaccacgaagauuu

SEQ ID NO: 388353 - RNA, 19 nt, Homo sapiens
guacggauauugauuuacu

SEQ ID NO: 388354 - RNA, 19 nt, Homo sapiens
guucgaaucugguaaacau

SEQ ID NO: 388355 - RNA, 19 nt, Homo sapiens
cuaaugauccuguguguga

SEQ ID NO: 388356 - RNA, 19 nt, Homo sapiens
ccaagaaaguccugaagca

SEQ ID NO: 388357 - RNA, 19 nt, Homo sapiens
gaagagcuagaauuaagaa

SEQ ID NO: 388358 - RNA, 19 nt, Homo sapiens
aaacagaaucuaugacuga

SEQ ID NO: 388359 - RNA, 19 nt, Homo sapiens
gccaaagaguggauacuau

SEQ ID NO: 388360 - RNA, 19 nt, Homo sapiens
gauauucuguggagugauc

SEQ ID NO: 388361 - RNA, 19 nt, Homo sapiens
cagcaguucuucaacgaaa

SEQ ID NO: 388362 - RNA, 19 nt, Homo sapiens
uaauggacuugaacaaaga

SEQ ID NO: 388363 - RNA, 19 nt, Homo sapiens
uaagaccugugugaugaua

SEQ ID NO: 388364 - RNA, 19 nt, Homo sapiens
cgaaggguaugaaaucugu

SEQ ID NO: 388365 - RNA, 19 nt, Homo sapiens
gaaaucagucucuugaaag

SEQ ID NO: 388366 - RNA, 19 nt, Homo sapiens
acacaagcccucugcauuu

SEQ ID NO: 388367 - RNA, 19 nt, Homo sapiens
cagcauuaguaccuacaua

SEQ ID NO: 388368 - RNA, 19 nt, Homo sapiens
caaacuauguucugguaca

SEQ ID NO: 388369 - RNA, 19 nt, Homo sapiens
ggaaagccagagagcauuu

SEQ ID NO: 388370 - RNA, 19 nt, Homo sapiens
caggaggaauaccagguua

SEQ ID NO: 388371 - RNA, 19 nt, Homo sapiens
gaacucauacagcacaaga

SEQ ID NO: 388372 - RNA, 19 nt, Homo sapiens
ugaaacagcuaggcccaaa

SEQ ID NO: 388373 - RNA, 19 nt, Homo sapiens
ccauggagaucccucaguu

SEQ ID NO: 388374 - RNA, 19 nt, Homo sapiens
guagaucgaggaaagaauu

SEQ ID NO: 388375 - RNA, 19 nt, Homo sapiens
ccagcaaagugaagaucua

SEQ ID NO: 388376 - RNA, 19 nt, Homo sapiens
caaguacaguccuuuccaa

SEQ ID NO: 388377 - RNA, 19 nt, Homo sapiens
gggaaaggcugggagaaca

SEQ ID NO: 388378 - RNA, 19 nt, Homo sapiens
ugggaaacccucuucaaua

SEQ ID NO: 388379 - RNA, 19 nt, Homo sapiens
aaacuucucccuccaaaga

SEQ ID NO: 388380 - RNA, 19 nt, Homo sapiens
ucuuagaggugcuauuuga

SEQ ID NO: 388381 - RNA, 19 nt, Homo sapiens
gggauuauguggacucgau

SEQ ID NO: 388382 - RNA, 19 nt, Homo sapiens
gcuguuauugguaagauua

SEQ ID NO: 388383 - RNA, 19 nt, Homo sapiens
gauaugaagacuugaugaa

SEQ ID NO: 388384 - RNA, 19 nt, Homo sapiens
gcaaagugaagaucuagga

SEQ ID NO: 388385 - RNA, 19 nt, Homo sapiens
guagagaggaacaagauga

SEQ ID NO: 388386 - RNA, 19 nt, Homo sapiens
agaaaguccugaagcaaau

SEQ ID NO: 388387 - RNA, 19 nt, Homo sapiens
gguuaaaugucaguaauag

SEQ ID NO: 388388 - RNA, 19 nt, Homo sapiens
gaaaacagcgccaucaaga

SEQ ID NO: 388389 - RNA, 19 nt, Homo sapiens
ccacagacuugaauuuacu

SEQ ID NO: 388390 - RNA, 19 nt, Homo sapiens
gguauggcuucacgaaaga

SEQ ID NO: 388391 - RNA, 19 nt, Homo sapiens
ccacgaagauuuuaugaug

SEQ ID NO: 388392 - RNA, 19 nt, Homo sapiens
ucaugcccauuaugucuua

SEQ ID NO: 388393 - RNA, 19 nt, Homo sapiens
acacacauauacauaagga

SEQ ID NO: 388394 - RNA, 19 nt, Homo sapiens
ugaagaggaucggcuaaga

SEQ ID NO: 388395 - RNA, 19 nt, Homo sapiens
gagggagacaggaggaaua

SEQ ID NO: 388396 - RNA, 19 nt, Homo sapiens
gaauuuacuccaccgugua

SEQ ID NO: 388397 - RNA, 19 nt, Homo sapiens
guaccgagguuacaaagcu

SEQ ID NO: 388398 - RNA, 19 nt, Homo sapiens
gguaagauuagguuaaaug

SEQ ID NO: 388399 - RNA, 19 nt, Homo sapiens
caauaagaccugugugaug

SEQ ID NO: 388400 - RNA, 19 nt, Homo sapiens
caacggaaacaaacagaga

SEQ ID NO: 388401 - RNA, 19 nt, Homo sapiens
gaaccuguguggaccugau

SEQ ID NO: 388402 - RNA, 19 nt, Homo sapiens
gcauuaguaccuacauauu

SEQ ID NO: 388403 - RNA, 19 nt, Homo sapiens
ugguacaacuccucgauuu

SEQ ID NO: 388404 - RNA, 19 nt, Homo sapiens
ccagagagcauuugagaag

SEQ ID NO: 388405 - RNA, 19 nt, Homo sapiens
gaacaaagauggaagcauu

SEQ ID NO: 388406 - RNA, 19 nt, Homo sapiens
gggaaacccucuucaauaa

SEQ ID NO: 388407 - RNA, 19 nt, Homo sapiens
gaugaaaucugugcugaua

SEQ ID NO: 388408 - RNA, 19 nt, Homo sapiens
gaucaaaccucgagggaaa

SEQ ID NO: 388409 - RNA, 19 nt, Homo sapiens
ggauuugguuucagcauua

SEQ ID NO: 388410 - RNA, 19 nt, Homo sapiens
gaauuucacucacauacaa

SEQ ID NO: 388411 - RNA, 19 nt, Homo sapiens
gaacaggacaugagggaua

SEQ ID NO: 388412 - RNA, 19 nt, Homo sapiens
uaaggaagagcuagaauua

SEQ ID NO: 388413 - RNA, 19 nt, Homo sapiens
ccaaugaccugcacuugaa

SEQ ID NO: 388414 - RNA, 19 nt, Homo sapiens
guacaaucguugacaauga

SEQ ID NO: 388415 - RNA, 19 nt, Homo sapiens
gagaggaacccguauguuu

SEQ ID NO: 388416 - RNA, 19 nt, Homo sapiens
gaagaaacagaaucuauga

SEQ ID NO: 388417 - RNA, 19 nt, Homo sapiens
ucaauaagcuugccaacau

SEQ ID NO: 388418 - RNA, 19 nt, Homo sapiens
acaaacagaugcauaguau

SEQ ID NO: 388419 - RNA, 19 nt, Homo sapiens
gaaguugaauucaugaaca

SEQ ID NO: 388420 - RNA, 19 nt, Homo sapiens
gcaguuauccaccuucuuu

SEQ ID NO: 388421 - RNA, 19 nt, Homo sapiens
aaacagcgccaucaagaua

SEQ ID NO: 388422 - RNA, 19 nt, Homo sapiens
cgaauaugcugaugaacaa

SEQ ID NO: 388423 - RNA, 19 nt, Homo sapiens
cagaauauccgcauugaaa

SEQ ID NO: 388424 - RNA, 19 nt, Homo sapiens
gagcuagaauuaagaaauc

SEQ ID NO: 388425 - RNA, 19 nt, Homo sapiens
uuacaaagcucgacugaag

SEQ ID NO: 388426 - RNA, 19 nt, Homo sapiens
caauaagcuugccaacaua

SEQ ID NO: 388427 - RNA, 19 nt, Homo sapiens
gaucugaccuggaaaucau

SEQ ID NO: 388428 - RNA, 19 nt, Homo sapiens
ggaacagaguggauacuau

SEQ ID NO: 388429 - RNA, 19 nt, Homo sapiens
gaacagagggaaccacgaa

SEQ ID NO: 388430 - RNA, 19 nt, Homo sapiens
agaaaucagucucuugaaa

SEQ ID NO: 388431 - RNA, 19 nt, Homo sapiens
ggagaucccucaguucgaa

SEQ ID NO: 388432 - RNA, 19 nt, Homo sapiens
gaacagaguggauacuaug

SEQ ID NO: 388433 - RNA, 19 nt, Homo sapiens
caggagaucugacacauca

SEQ ID NO: 388434 - RNA, 19 nt, Homo sapiens
auacagaucugaccuggaa

SEQ ID NO: 388435 - RNA, 19 nt, Homo sapiens
gggcugaacuuaccaugga

SEQ ID NO: 388436 - RNA, 19 nt, Homo sapiens
gaacaacagauacuucaug

SEQ ID NO: 388437 - RNA, 19 nt, Homo sapiens
cuacuaagcuugacaucug

SEQ ID NO: 388438 - RNA, 19 nt, Homo sapiens
gauggaagcauugacuuua

SEQ ID NO: 388439 - RNA, 19 nt, Homo sapiens
gaccacagacuugaauuua

SEQ ID NO: 388440 - RNA, 19 nt, Homo sapiens
agaagaggcugaagcuuga

SEQ ID NO: 388441 - RNA, 19 nt, Homo sapiens
guaauaggauuugguuuca

SEQ ID NO: 388442 - RNA, 19 nt, Homo sapiens
ccaaagagguaacaaucug

SEQ ID NO: 388443 - RNA, 19 nt, Homo sapiens
aauaagaccugugugauga

SEQ ID NO: 388444 - RNA, 19 nt, Homo sapiens
cagaaucuaugacugaaga

SEQ ID NO: 388445 - RNA, 19 nt, Homo sapiens
ccauagagauccuaaugau

SEQ ID NO: 388446 - RNA, 19 nt, Homo sapiens
gaaagaauuccauagagau

SEQ ID NO: 388447 - RNA, 19 nt, Homo sapiens
gagggaaccacgaagauuu

SEQ ID NO: 388448 - RNA, 19 nt, Homo sapiens
guacggauauugauuuacu

SEQ ID NO: 388449 - RNA, 19 nt, Homo sapiens
guucgaaucugguaaacau

SEQ ID NO: 388450 - RNA, 19 nt, Homo sapiens
cuaaugauccuguguguga

SEQ ID NO: 388451 - RNA, 19 nt, Homo sapiens
ccaagaaaguccugaagca

SEQ ID NO: 388452 - RNA, 19 nt, Homo sapiens
gaagagcuagaauuaagaa

SEQ ID NO: 388453 - RNA, 19 nt, Homo sapiens
aaacagaaucuaugacuga

SEQ ID NO: 388454 - RNA, 19 nt, Homo sapiens
cagcaguucuucaacgaaa

SEQ ID NO: 388455 - RNA, 19 nt, Homo sapiens
uaauggacuugaacaaaga

SEQ ID NO: 388456 - RNA, 19 nt, Homo sapiens
uaagaccugugugaugaua

SEQ ID NO: 388457 - RNA, 19 nt, Homo sapiens
gagcaugaaugggaacaga

SEQ ID NO: 388458 - RNA, 19 nt, Homo sapiens
acaaauggaucuccuacug

SEQ ID NO: 388459 - RNA, 19 nt, Homo sapiens
gaaaucagucucuugaaag

SEQ ID NO: 388460 - RNA, 19 nt, Homo sapiens
acacaagcccucugcauuu

SEQ ID NO: 388461 - RNA, 19 nt, Homo sapiens
cagcauuaguaccuacaua

SEQ ID NO: 388462 - RNA, 19 nt, Homo sapiens
ggaaagccagagagcauuu

SEQ ID NO: 388463 - RNA, 19 nt, Homo sapiens
caggaggaauaccagguua

SEQ ID NO: 388464 - RNA, 19 nt, Homo sapiens
gaacucauacagcacaaga

SEQ ID NO: 388465 - RNA, 19 nt, Homo sapiens
ugaaacagcuaggcccaaa

SEQ ID NO: 388466 - RNA, 19 nt, Homo sapiens
ccauggagaucccucaguu

SEQ ID NO: 388467 - RNA, 19 nt, Homo sapiens
aaauggaucuccuacugaa

SEQ ID NO: 388468 - RNA, 19 nt, Homo sapiens
ccagcaaagugaagaucua

SEQ ID NO: 388469 - RNA, 19 nt, Homo sapiens
guagaucgaggaaagaauu

SEQ ID NO: 388470 - RNA, 19 nt, Homo sapiens
caaguacaguccuuuccaa

SEQ ID NO: 388471 - RNA, 19 nt, Homo sapiens
ugggaaacccucuucaaua

SEQ ID NO: 388472 - RNA, 19 nt, Homo sapiens
gggaaaggcugggagaaca

SEQ ID NO: 388473 - RNA, 19 nt, Homo sapiens
aaacuucucccuccaaaga

SEQ ID NO: 388474 - RNA, 19 nt, Homo sapiens
ucuuagaggugcuauuuga

SEQ ID NO: 388475 - RNA, 19 nt, Homo sapiens
gggauuauguggacucgau

SEQ ID NO: 388476 - RNA, 19 nt, Homo sapiens
gcuguuauugguaagauua

SEQ ID NO: 388477 - RNA, 19 nt, Homo sapiens
gauaugaagacuugaugaa

SEQ ID NO: 388478 - RNA, 19 nt, Homo sapiens
guagagaggaacaagauga

SEQ ID NO: 388479 - RNA, 19 nt, Homo sapiens
agaaaguccugaagcaaau

SEQ ID NO: 388480 - RNA, 19 nt, Homo sapiens
gcaaagugaagaucuagga

SEQ ID NO: 388481 - RNA, 19 nt, Homo sapiens
gguuaaaugucaguaauag

SEQ ID NO: 388482 - RNA, 19 nt, Homo sapiens
gaaaacagcgccaucaaga

SEQ ID NO: 388483 - RNA, 19 nt, Homo sapiens
ccacagacuugaauuuacu

SEQ ID NO: 388484 - RNA, 19 nt, Homo sapiens
gguauggcuucacgaaaga

SEQ ID NO: 388485 - RNA, 19 nt, Homo sapiens
ccacgaagauuuuaugaug

SEQ ID NO: 388486 - RNA, 19 nt, Homo sapiens
ucaugcccauuaugucuua

SEQ ID NO: 388487 - RNA, 19 nt, Homo sapiens
acacacauauacauaagga

SEQ ID NO: 388488 - RNA, 19 nt, Homo sapiens
ugaagaggaucggcuaaga

SEQ ID NO: 388489 - RNA, 19 nt, Homo sapiens
gagggagacaggaggaaua

SEQ ID NO: 388490 - RNA, 19 nt, Homo sapiens
gaauuuacuccaccgugua

SEQ ID NO: 388491 - RNA, 19 nt, Homo sapiens
guaccgagguuacaaagcu

SEQ ID NO: 388492 - RNA, 19 nt, Homo sapiens
gguaagauuagguuaaaug

SEQ ID NO: 388493 - RNA, 19 nt, Homo sapiens
caauaagaccugugugaug

SEQ ID NO: 388494 - RNA, 19 nt, Homo sapiens
gaaccuguguggaccugau

SEQ ID NO: 388495 - RNA, 19 nt, Homo sapiens
cagaguggauacuauggaa

SEQ ID NO: 388496 - RNA, 19 nt, Homo sapiens
caacggaaacaaacagaga

SEQ ID NO: 388497 - RNA, 19 nt, Homo sapiens
ccagagagcauuugagaag

SEQ ID NO: 388498 - RNA, 19 nt, Homo sapiens
gcauuaguaccuacauauu

SEQ ID NO: 388499 - RNA, 19 nt, Homo sapiens
aggaagagcuagaauuaag

SEQ ID NO: 388500 - RNA, 19 nt, Homo sapiens
guacaagaggcucauucua

SEQ ID NO: 388501 - RNA, 19 nt, Homo sapiens
ccaucaagauauuaagaga

SEQ ID NO: 388502 - RNA, 19 nt, Homo sapiens
caaauggaucuccuacuga

SEQ ID NO: 388503 - RNA, 19 nt, Homo sapiens
gaagcacaauaaaguaggu

SEQ ID NO: 388504 - RNA, 19 nt, Homo sapiens
gauacuucaugcccauuau

SEQ ID NO: 388505 - RNA, 19 nt, Homo sapiens
gaacaaagauggaagcauu

SEQ ID NO: 388506 - RNA, 19 nt, Homo sapiens
gggaaacccucuucaauaa

SEQ ID NO: 388507 - RNA, 19 nt, Homo sapiens
gaugaaaucugugcugaua

SEQ ID NO: 388508 - RNA, 19 nt, Homo sapiens
gaucaaaccucgagggaaa

SEQ ID NO: 388509 - RNA, 19 nt, Homo sapiens
ggauuugguuucagcauua

SEQ ID NO: 388510 - RNA, 19 nt, Homo sapiens
gaauuucacucacauacaa

SEQ ID NO: 388511 - RNA, 19 nt, Homo sapiens
gaacaggacaugagggaua

SEQ ID NO: 388512 - RNA, 19 nt, Homo sapiens
uaaggaagagcuagaauua

SEQ ID NO: 388513 - RNA, 19 nt, Homo sapiens
ccaaugaccugcacuugaa

SEQ ID NO: 388514 - RNA, 19 nt, Homo sapiens
guacaaucguugacaauga

SEQ ID NO: 388515 - RNA, 19 nt, Homo sapiens
gagaggaacccguauguuu

SEQ ID NO: 388516 - RNA, 19 nt, Homo sapiens
gaagaaacagaaucuauga

SEQ ID NO: 388517 - RNA, 19 nt, Homo sapiens
ucaauaagcuugccaacau

SEQ ID NO: 388518 - RNA, 19 nt, Homo sapiens
acaaacagaugcauaguau

SEQ ID NO: 388519 - RNA, 19 nt, Homo sapiens
gaacagguggugacuauau

SEQ ID NO: 388520 - RNA, 19 nt, Homo sapiens
gaaguugaauucaugaaca

SEQ ID NO: 388521 - RNA, 19 nt, Homo sapiens
ucgaggagcuuacaucaaa

SEQ ID NO: 388522 - RNA, 19 nt, Homo sapiens
gcaguuauccaccuucuuu

SEQ ID NO: 388523 - RNA, 19 nt, Homo sapiens
aaacagcgccaucaagaua

SEQ ID NO: 388524 - RNA, 19 nt, Homo sapiens
gagcuuacaucaaacuaug

SEQ ID NO: 388525 - RNA, 19 nt, Homo sapiens
gggaacagguggugacuau

SEQ ID NO: 388526 - RNA, 19 nt, Homo sapiens
cgaauaugcugaugaacaa

SEQ ID NO: 388527 - RNA, 19 nt, Homo sapiens
cagaauauccgcauugaaa

SEQ ID NO: 388528 - RNA, 19 nt, Homo sapiens
gagcuagaauuaagaaauc

SEQ ID NO: 388529 - RNA, 19 nt, Homo sapiens
uuacaaagcucgacugaag

SEQ ID NO: 388530 - RNA, 19 nt, Homo sapiens
caauaagcuugccaacaua

SEQ ID NO: 388531 - RNA, 19 nt, Homo sapiens
gaucugaccuggaaaucau

SEQ ID NO: 388532 - RNA, 19 nt, Homo sapiens
gaacagagggaaccacgaa

SEQ ID NO: 388533 - RNA, 19 nt, Homo sapiens
agaaaucagucucuugaaa

SEQ ID NO: 388534 - RNA, 19 nt, Homo sapiens
ggagaucccucaguucgaa

SEQ ID NO: 388535 - RNA, 19 nt, Homo sapiens
caggagaucugacacauca

SEQ ID NO: 388536 - RNA, 19 nt, Homo sapiens
auacagaucugaccuggaa

SEQ ID NO: 388537 - RNA, 19 nt, Homo sapiens
gggcugaacuuaccaugga

SEQ ID NO: 388538 - RNA, 19 nt, Homo sapiens
gaacaacagauacuucaug

SEQ ID NO: 388539 - RNA, 19 nt, Homo sapiens
cuacuaagcuugacaucug

SEQ ID NO: 388540 - RNA, 19 nt, Homo sapiens
gauggaagcauugacuuua

SEQ ID NO: 388541 - RNA, 19 nt, Homo sapiens
gaccacagacuugaauuua

SEQ ID NO: 388542 - RNA, 19 nt, Homo sapiens
agaagaggcugaagcuuga

SEQ ID NO: 388543 - RNA, 19 nt, Homo sapiens
guaauaggauuugguuuca

SEQ ID NO: 388544 - RNA, 19 nt, Homo sapiens
aauaagaccugugugauga

SEQ ID NO: 388545 - RNA, 19 nt, Homo sapiens
ccaaagagguaacaaucug

SEQ ID NO: 388546 - RNA, 19 nt, Homo sapiens
cagaaucuaugacugaaga

SEQ ID NO: 388547 - RNA, 19 nt, Homo sapiens
ccauagagauccuaaugau

SEQ ID NO: 388548 - RNA, 19 nt, Homo sapiens
gaaagaauuccauagagau

SEQ ID NO: 388549 - RNA, 19 nt, Homo sapiens
gagggaaccacgaagauuu

SEQ ID NO: 388550 - RNA, 19 nt, Homo sapiens
guacggauauugauuuacu

SEQ ID NO: 388551 - RNA, 19 nt, Homo sapiens
guucgaaucugguaaacau

SEQ ID NO: 388552 - RNA, 19 nt, Homo sapiens
cuaaugauccuguguguga

SEQ ID NO: 388553 - RNA, 19 nt, Homo sapiens
ccaagaaaguccugaagca

SEQ ID NO: 388554 - RNA, 19 nt, Homo sapiens
gaagagcuagaauuaagaa

SEQ ID NO: 388555 - RNA, 19 nt, Homo sapiens
aaacagaaucuaugacuga

SEQ ID NO: 388556 - RNA, 19 nt, Homo sapiens
gccaaagaguggauacuau

SEQ ID NO: 388557 - RNA, 19 nt, Homo sapiens
cagcaguucuucaacgaaa

SEQ ID NO: 388558 - RNA, 19 nt, Homo sapiens
uaauggacuugaacaaaga

SEQ ID NO: 388559 - RNA, 19 nt, Homo sapiens
uaagaccugugugaugaua

SEQ ID NO: 388560 - RNA, 19 nt, Homo sapiens
acaaauggaucuccuacug

SEQ ID NO: 388561 - RNA, 19 nt, Homo sapiens
gaaaucagucucuugaaag

SEQ ID NO: 388562 - RNA, 19 nt, Homo sapiens
acacaagcccucugcauuu

SEQ ID NO: 388563 - RNA, 19 nt, Homo sapiens
cagcauuaguaccuacaua

SEQ ID NO: 388564 - RNA, 19 nt, Homo sapiens
caaacuauguucugguaca

SEQ ID NO: 388565 - RNA, 19 nt, Homo sapiens
ggaaagccagagagcauuu

SEQ ID NO: 388566 - RNA, 19 nt, Homo sapiens
caggaggaauaccagguua

SEQ ID NO: 388567 - RNA, 19 nt, Homo sapiens
gaacucauacagcacaaga

SEQ ID NO: 388568 - RNA, 19 nt, Homo sapiens
ugaaacagcuaggcccaaa

SEQ ID NO: 388569 - RNA, 19 nt, Homo sapiens
ccauggagaucccucaguu

SEQ ID NO: 388570 - RNA, 19 nt, Homo sapiens
aaauggaucuccuacugaa

SEQ ID NO: 388571 - RNA, 19 nt, Homo sapiens
guagaucgaggaaagaauu

SEQ ID NO: 388572 - RNA, 19 nt, Homo sapiens
ccagcaaagugaagaucua

SEQ ID NO: 388573 - RNA, 19 nt, Homo sapiens
caaguacaguccuuuccaa

SEQ ID NO: 388574 - RNA, 19 nt, Homo sapiens
gggaaaggcugggagaaca

SEQ ID NO: 388575 - RNA, 19 nt, Homo sapiens
ugggaaacccucuucaaua

SEQ ID NO: 388576 - RNA, 19 nt, Homo sapiens
aaacuucucccuccaaaga

SEQ ID NO: 388577 - RNA, 19 nt, Homo sapiens
ucuuagaggugcuauuuga

SEQ ID NO: 388578 - RNA, 19 nt, Homo sapiens
gggauuauguggacucgau

SEQ ID NO: 388579 - RNA, 19 nt, Homo sapiens
gcuguuauugguaagauua

SEQ ID NO: 388580 - RNA, 19 nt, Homo sapiens
gauaugaagacuugaugaa

SEQ ID NO: 388581 - RNA, 19 nt, Homo sapiens
guagagaggaacaagauga

SEQ ID NO: 388582 - RNA, 19 nt, Homo sapiens
gcaaagugaagaucuagga

SEQ ID NO: 388583 - RNA, 19 nt, Homo sapiens
agaaaguccugaagcaaau

SEQ ID NO: 388584 - RNA, 19 nt, Homo sapiens
gguuaaaugucaguaauag

SEQ ID NO: 388585 - RNA, 19 nt, Homo sapiens
gaaaacagcgccaucaaga

SEQ ID NO: 388586 - RNA, 19 nt, Homo sapiens
ccacagacuugaauuuacu

SEQ ID NO: 388587 - RNA, 19 nt, Homo sapiens
gguauggcuucacgaaaga

SEQ ID NO: 388588 - RNA, 19 nt, Homo sapiens
ccacgaagauuuuaugaug

SEQ ID NO: 388589 - RNA, 19 nt, Homo sapiens
ucaugcccauuaugucuua

SEQ ID NO: 388590 - RNA, 19 nt, Homo sapiens
acacacauauacauaagga

SEQ ID NO: 388591 - RNA, 19 nt, Homo sapiens
ugaagaggaucggcuaaga

SEQ ID NO: 388592 - RNA, 19 nt, Homo sapiens
gagggagacaggaggaaua

SEQ ID NO: 388593 - RNA, 19 nt, Homo sapiens
gaauuuacuccaccgugua

SEQ ID NO: 388594 - RNA, 19 nt, Homo sapiens
guaccgagguuacaaagcu

SEQ ID NO: 388595 - RNA, 19 nt, Homo sapiens
gguaagauuagguuaaaug

SEQ ID NO: 388596 - RNA, 19 nt, Homo sapiens
caauaagaccugugugaug

SEQ ID NO: 388597 - RNA, 19 nt, Homo sapiens
caacggaaacaaacagaga

SEQ ID NO: 388598 - RNA, 19 nt, Homo sapiens
gaaccuguguggaccugau

SEQ ID NO: 388599 - RNA, 19 nt, Homo sapiens
gcauuaguaccuacauauu

SEQ ID NO: 388600 - RNA, 19 nt, Homo sapiens
ugguacaacuccucgauuu

SEQ ID NO: 388601 - RNA, 19 nt, Homo sapiens
ccagagagcauuugagaag

SEQ ID NO: 388602 - RNA, 19 nt, Homo sapiens
aggaagagcuagaauuaag

SEQ ID NO: 388603 - RNA, 19 nt, Homo sapiens
guacaagaggcucauucua

SEQ ID NO: 388604 - RNA, 19 nt, Homo sapiens
ccaucaagauauuaagaga

SEQ ID NO: 388605 - RNA, 19 nt, Homo sapiens
gcaauggacucuccuccua

SEQ ID NO: 388606 - RNA, 19 nt, Homo sapiens
ggacuguaauugauagauu

SEQ ID NO: 388607 - RNA, 19 nt, Homo sapiens
gaacaagcagccauacuga

SEQ ID NO: 388608 - RNA, 19 nt, Homo sapiens
ggacggacuguaauugaua

SEQ ID NO: 388609 - RNA, 19 nt, Homo sapiens
gcaacuuucugguaaacuu

SEQ ID NO: 388610 - RNA, 19 nt, Homo sapiens
ggaacaggcuuuggucuuc

SEQ ID NO: 388611 - RNA, 19 nt, Homo sapiens
gacauggccugcaauuuca

SEQ ID NO: 388612 - RNA, 19 nt, Homo sapiens
cuacuccgaugacaaguuu

SEQ ID NO: 388613 - RNA, 19 nt, Homo sapiens
uagaugggcuccucacaga

SEQ ID NO: 388614 - RNA, 19 nt, Homo sapiens
cugcuuagcucacagaaau

SEQ ID NO: 388615 - RNA, 19 nt, Homo sapiens
caacaucuacaaucucuau

SEQ ID NO: 388616 - RNA, 19 nt, Homo sapiens
caacagcugcuuccaccua

SEQ ID NO: 388617 - RNA, 19 nt, Homo sapiens
ccaagcaccuccacuacug

SEQ ID NO: 388618 - RNA, 19 nt, Homo sapiens
agacauggccugcaauuuc

SEQ ID NO: 388619 - RNA, 19 nt, Homo sapiens
gacuguaauugauagauug

SEQ ID NO: 388620 - RNA, 19 nt, Homo sapiens
caacuuucugguaaacuua

SEQ ID NO: 388621 - RNA, 19 nt, Homo sapiens
cggagcagcugccacaaug

SEQ ID NO: 388622 - RNA, 19 nt, Homo sapiens
caacaaagaccuggaaugc

SEQ ID NO: 388623 - RNA, 19 nt, Homo sapiens
gaugagugguuuguggauu

SEQ ID NO: 388624 - RNA, 19 nt, Homo sapiens
guacaagaacaacaaacuu

SEQ ID NO: 388625 - RNA, 19 nt, Homo sapiens
gggcaacucuggccucaac

SEQ ID NO: 388626 - RNA, 19 nt, Homo sapiens
gcaccuccacuacugguuu

SEQ ID NO: 388627 - RNA, 19 nt, Homo sapiens
gaacaggcuuuggucuucu

SEQ ID NO: 388628 - RNA, 19 nt, Homo sapiens
guacuccggcuaccucaaa

SEQ ID NO: 388629 - RNA, 19 nt, Homo sapiens
ggugguggacggacuguaa

SEQ ID NO: 388630 - RNA, 19 nt, Homo sapiens
uggauucccucaaccagaa

SEQ ID NO: 388631 - RNA, 19 nt, Homo sapiens
gcuccaagcaccuccacua

SEQ ID NO: 388632 - RNA, 19 nt, Homo sapiens
acaacucccuggucuacuu

SEQ ID NO: 388633 - RNA, 19 nt, Homo sapiens
ccagaaggaucccgagaac

SEQ ID NO: 388634 - RNA, 19 nt, Homo sapiens
gaagcaugaacucccagua

SEQ ID NO: 388635 - RNA, 19 nt, Homo sapiens
gguaugagaaggacacugu

SEQ ID NO: 388636 - RNA, 19 nt, Homo sapiens
ccgcagcaguuccugaaug

SEQ ID NO: 388637 - RNA, 19 nt, Homo sapiens
gggauaaagugcgcaugga

SEQ ID NO: 388638 - RNA, 19 nt, Homo sapiens
aagaaugcccuuuaugaug

SEQ ID NO: 388639 - RNA, 19 nt, Homo sapiens
guagacauggccugcaauu

SEQ ID NO: 388640 - RNA, 19 nt, Homo sapiens
acucuggccucaacaucua

SEQ ID NO: 388641 - RNA, 19 nt, Homo sapiens
ggaguacaagaacaacaaa

SEQ ID NO: 388642 - RNA, 19 nt, Homo sapiens
ggcugcagcucacuagaug

SEQ ID NO: 388643 - RNA, 19 nt, Homo sapiens
gcggaaggcccucaacauc

SEQ ID NO: 388644 - RNA, 19 nt, Homo sapiens
caagcagccauacugauga

SEQ ID NO: 388645 - RNA, 19 nt, Homo sapiens
ggcccugguuagugaagua

SEQ ID NO: 388646 - RNA, 19 nt, Homo sapiens
ccuaugagcagaaugacaa

SEQ ID NO: 388647 - RNA, 19 nt, Homo sapiens
ggacaugugcaacuuucug

SEQ ID NO: 388648 - RNA, 19 nt, Homo sapiens
acaagcagccauacugaug

SEQ ID NO: 388649 - RNA, 19 nt, Homo sapiens
ugaacaagcagccauacug

SEQ ID NO: 388650 - RNA, 19 nt, Homo sapiens
gggaacaggcuuuggucuu

SEQ ID NO: 388651 - RNA, 19 nt, Homo sapiens
ggucuacuuugccuacuac

SEQ ID NO: 388652 - RNA, 19 nt, Homo sapiens
gaugacaaguuuuaugcaa

SEQ ID NO: 388653 - RNA, 19 nt, Homo sapiens
gacggacuguaauugauag

SEQ ID NO: 388654 - RNA, 19 nt, Homo sapiens
caugugcaacuuucuggua

SEQ ID NO: 388655 - RNA, 19 nt, Homo sapiens
ggauuugggcaacaucuuc

SEQ ID NO: 388656 - RNA, 19 nt, Homo sapiens
uggaaugcgugaccaaucu

SEQ ID NO: 388657 - RNA, 19 nt, Homo sapiens
ugacaacaaagaccuggaa

SEQ ID NO: 388658 - RNA, 19 nt, Homo sapiens
gaacucccaguaucugaag

SEQ ID NO: 388659 - RNA, 19 nt, Homo sapiens
ucacucgccugccacucaa

SEQ ID NO: 388660 - RNA, 19 nt, Homo sapiens
caacucccuggucuacuuu

SEQ ID NO: 388661 - RNA, 19 nt, Homo sapiens
gaaugcccuuuaugaugca

SEQ ID NO: 388662 - RNA, 19 nt, Homo sapiens
uggccaagcagccgucuuu

SEQ ID NO: 388663 - RNA, 19 nt, Homo sapiens
acagaaauaccagauccua

SEQ ID NO: 388664 - RNA, 19 nt, Homo sapiens
guggacggacuguaauuga

SEQ ID NO: 388665 - RNA, 19 nt, Homo sapiens
ccuuuaugaugcacugauu

SEQ ID NO: 388666 - RNA, 19 nt, Homo sapiens
gcaugaacucccaguaucu

SEQ ID NO: 388667 - RNA, 19 nt, Homo sapiens
cgugaccaaucuucaggaa

SEQ ID NO: 388668 - RNA, 19 nt, Homo sapiens
aauggacucuccuccuaug

SEQ ID NO: 388669 - RNA, 19 nt, Homo sapiens
aagcaugaacucccaguau

SEQ ID NO: 388670 - RNA, 19 nt, Homo sapiens
cuacuaccauggccuucug

SEQ ID NO: 388671 - RNA, 19 nt, Homo sapiens
cagaaauaccagauccuau

SEQ ID NO: 388672 - RNA, 19 nt, Homo sapiens
ggaaugcgugaccaaucuu

SEQ ID NO: 388673 - RNA, 19 nt, Homo sapiens
gcucacagaaauaccagau

SEQ ID NO: 388674 - RNA, 19 nt, Homo sapiens
agaaggaucccgagaacag

SEQ ID NO: 388675 - RNA, 19 nt, Homo sapiens
acccacugcugcucucaaa

SEQ ID NO: 388676 - RNA, 19 nt, Homo sapiens
caauggacucuccuccuau

SEQ ID NO: 388677 - RNA, 19 nt, Homo sapiens
gaggucgcccagagcaauu

SEQ ID NO: 388678 - RNA, 19 nt, Homo sapiens
uggacggacuguaauugau

SEQ ID NO: 388679 - RNA, 19 nt, Homo sapiens
ugggacaugugcaacuuuc

SEQ ID NO: 388680 - RNA, 19 nt, Homo sapiens
ccuccuaugagcagaauga

SEQ ID NO: 388681 - RNA, 19 nt, Homo sapiens
caccuccacuacugguuug

SEQ ID NO: 388682 - RNA, 19 nt, Homo sapiens
gcccagggucucccauaga

SEQ ID NO: 388683 - RNA, 19 nt, Homo sapiens
aaugggacaugugcaacuu

SEQ ID NO: 388684 - RNA, 19 nt, Homo sapiens
gaaugcgugaccaaucuuc

SEQ ID NO: 388685 - RNA, 19 nt, Homo sapiens
cggaguacaagaacaacaa

SEQ ID NO: 388686 - RNA, 19 nt, Homo sapiens
gguggacggacuguaauug

SEQ ID NO: 388687 - RNA, 19 nt, Homo sapiens
agcaugaacucccaguauc

SEQ ID NO: 388688 - RNA, 19 nt, Homo sapiens
guggugcuuuggcucaaug

SEQ ID NO: 388689 - RNA, 19 nt, Homo sapiens
ugagaaggacacuguugug

SEQ ID NO: 388690 - RNA, 19 nt, Homo sapiens
uaugagaaggacacuguug

SEQ ID NO: 388691 - RNA, 19 nt, Homo sapiens
gccucaacaucuacaaucu

SEQ ID NO: 388692 - RNA, 19 nt, Homo sapiens
caacucuggccucaacauc

SEQ ID NO: 388693 - RNA, 19 nt, Homo sapiens
gugucacccuggaguacaa

SEQ ID NO: 388694 - RNA, 19 nt, Homo sapiens
ugacaacucccuggucuac

SEQ ID NO: 388695 - RNA, 19 nt, Homo sapiens
augugcaacuuucugguaa

SEQ ID NO: 388696 - RNA, 19 nt, Homo sapiens
aguguaacuucuaugacaa

SEQ ID NO: 388697 - RNA, 19 nt, Homo sapiens
ugaggcccuucaagauuuc

SEQ ID NO: 388698 - RNA, 19 nt, Homo sapiens
ugugcaacuuucugguaaa

SEQ ID NO: 388699 - RNA, 19 nt, Homo sapiens
gauuugggcaacaucuuca

SEQ ID NO: 388700 - RNA, 19 nt, Homo sapiens
cucaacaucuacaaucucu

SEQ ID NO: 388701 - RNA, 19 nt, Homo sapiens
gcaacucuggccucaacau

SEQ ID NO: 388702 - RNA, 19 nt, Homo sapiens
cuacuuugccuacuaccau

SEQ ID NO: 388703 - RNA, 19 nt, Homo sapiens
gagaaaggauuugguuaua

SEQ ID NO: 388704 - RNA, 19 nt, Homo sapiens
gaaaggauuugguuauaag

SEQ ID NO: 388705 - RNA, 19 nt, Homo sapiens
gaaagaaggcaugaauauu

SEQ ID NO: 388706 - RNA, 19 nt, Homo sapiens
aaagaaggcaugaauauug

SEQ ID NO: 388707 - RNA, 19 nt, Homo sapiens
ugaaagaaggcaugaauau

SEQ ID NO: 388708 - RNA, 19 nt, Homo sapiens
gagagaaaggauuugguua

SEQ ID NO: 388709 - RNA, 19 nt, Homo sapiens
uagcuggauugcagaguua

SEQ ID NO: 388710 - RNA, 19 nt, Homo sapiens
ggagagaaaggauuugguu

SEQ ID NO: 388711 - RNA, 19 nt, Homo sapiens
gaucauuccuucuguagcu

SEQ ID NO: 388712 - RNA, 19 nt, Homo sapiens
guggacaacucgaauaagu

SEQ ID NO: 388713 - RNA, 19 nt, Homo sapiens
gauugcagaguuaaguuua

SEQ ID NO: 388714 - RNA, 19 nt, Homo sapiens
ucugagcacuggagagaaa

SEQ ID NO: 388715 - RNA, 19 nt, Homo sapiens
gcagacaaggucccaaaga

SEQ ID NO: 388716 - RNA, 19 nt, Homo sapiens
gaucaccauugcugacugu

SEQ ID NO: 388717 - RNA, 19 nt, Homo sapiens
aagaaggcaugaauauugu

SEQ ID NO: 388718 - RNA, 19 nt, Homo sapiens
gugaaagaaggcaugaaua

SEQ ID NO: 388719 - RNA, 19 nt, Homo sapiens
ggauugcagaguuaaguuu

SEQ ID NO: 388720 - RNA, 19 nt, Homo sapiens
gcacuggagagaaaggauu

SEQ ID NO: 388721 - RNA, 19 nt, Homo sapiens
agagaaaggauuugguuau

SEQ ID NO: 388722 - RNA, 19 nt, Homo sapiens
cuagcuggauugcagaguu

SEQ ID NO: 388723 - RNA, 19 nt, Homo sapiens
cagacaaggucccaaagac

SEQ ID NO: 388724 - RNA, 19 nt, Homo sapiens
caucugcacugccaagacu

SEQ ID NO: 388725 - RNA, 19 nt, Homo sapiens
gguggcaaguccaucuaug

SEQ ID NO: 388726 - RNA, 19 nt, Homo sapiens
caaagacagcagaaaauuu

SEQ ID NO: 388727 - RNA, 19 nt, Homo sapiens
acaaaugguucccaguuuu

SEQ ID NO: 388728 - RNA, 19 nt, Homo sapiens
cccuuuggguuccauguuu

SEQ ID NO: 388729 - RNA, 19 nt, Homo sapiens
gcagaguuaaguuuaugau

SEQ ID NO: 388730 - RNA, 19 nt, Homo sapiens
ucccaugccuagcuggauu

SEQ ID NO: 388731 - RNA, 19 nt, Homo sapiens
agacaaggucccaaagaca

SEQ ID NO: 388732 - RNA, 19 nt, Homo sapiens
gugguuggauggcaagcau

SEQ ID NO: 388733 - RNA, 19 nt, Homo sapiens
uugcagaguuaaguuuaug

SEQ ID NO: 388734 - RNA, 19 nt, Homo sapiens
ccaaagacagcagaaaauu

SEQ ID NO: 388735 - RNA, 19 nt, Homo sapiens
gcacugguggcaaguccau

SEQ ID NO: 388736 - RNA, 19 nt, Homo sapiens
cagcaagaagaucaccauu

SEQ ID NO: 388737 - RNA, 19 nt, Homo sapiens
uuccaggguuuauguguca

SEQ ID NO: 388738 - RNA, 19 nt, Homo sapiens
gaugagaacuucaaacuga

SEQ ID NO: 388739 - RNA, 19 nt, Homo sapiens
uaccaacccugaccaauaa

SEQ ID NO: 388740 - RNA, 19 nt, Homo sapiens
caaauuccaucguguaauc

SEQ ID NO: 388741 - RNA, 19 nt, Homo sapiens
gcaagcaugugguguuugg

SEQ ID NO: 388742 - RNA, 19 nt, Homo sapiens
cuaccaacccugaccaaua

SEQ ID NO: 388743 - RNA, 19 nt, Homo sapiens
aauuggagaugaagaugua

SEQ ID NO: 388744 - RNA, 19 nt, Homo sapiens
gagaaaggauuuggcuaca

SEQ ID NO: 388745 - RNA, 19 nt, Homo sapiens
gcacagggacaucuuucuu

SEQ ID NO: 388746 - RNA, 19 nt, Homo sapiens
ggagauggcacaggaggaa

SEQ ID NO: 388747 - RNA, 19 nt, Homo sapiens
ggugaucuuuggucucuuc

SEQ ID NO: 388748 - RNA, 19 nt, Homo sapiens
cagcaaauuccaucgugua

SEQ ID NO: 388749 - RNA, 19 nt, Homo sapiens
uggcaagcaugugguguuu

SEQ ID NO: 388750 - RNA, 19 nt, Homo sapiens
guaaucaaggacuucauga

SEQ ID NO: 388751 - RNA, 19 nt, Homo sapiens
caacggcucccaguucuuc

SEQ ID NO: 388752 - RNA, 19 nt, Homo sapiens
gaauuggagaugaagaugu

SEQ ID NO: 388753 - RNA, 19 nt, Homo sapiens
agaaaggauuuggcuacaa

SEQ ID NO: 388754 - RNA, 19 nt, Homo sapiens
gauccagggcggagacuuc

SEQ ID NO: 388755 - RNA, 19 nt, Homo sapiens
ccuacgaauuggagaugaa

SEQ ID NO: 388756 - RNA, 19 nt, Homo sapiens
agacagacagccgggauaa

SEQ ID NO: 388757 - RNA, 19 nt, Homo sapiens
ucaaggacuucaugaucca

SEQ ID NO: 388758 - RNA, 19 nt, Homo sapiens
gcaaauuccaucguguaau

SEQ ID NO: 388759 - RNA, 19 nt, Homo sapiens
uacaggagagaaaggauuu

SEQ ID NO: 388760 - RNA, 19 nt, Homo sapiens
cuacaggagagaaaggauu

SEQ ID NO: 388761 - RNA, 19 nt, Homo sapiens
ucuuuggucucuucggaaa

SEQ ID NO: 388762 - RNA, 19 nt, Homo sapiens
caccaacggcucccaguuc

SEQ ID NO: 388763 - RNA, 19 nt, Homo sapiens
ggcccaaagucaccgucaa

SEQ ID NO: 388764 - RNA, 19 nt, Homo sapiens
gggauaaaccccugaagga

SEQ ID NO: 388765 - RNA, 19 nt, Homo sapiens
gagagcaccaagacagaca

SEQ ID NO: 388766 - RNA, 19 nt, Homo sapiens
ccacaggcccauggacuca

SEQ ID NO: 388767 - RNA, 19 nt, Homo sapiens
gcacaggaggaaagagcau

SEQ ID NO: 388768 - RNA, 19 nt, Homo sapiens
cgggugaucuuuggucucu

SEQ ID NO: 388769 - RNA, 19 nt, Homo sapiens
gacagacagccgggauaaa

SEQ ID NO: 388770 - RNA, 19 nt, Homo sapiens
uguaacaaacuccuaccaa

SEQ ID NO: 388771 - RNA, 19 nt, Homo sapiens
gggcacagggacaucuuuc

SEQ ID NO: 388772 - RNA, 19 nt, Homo sapiens
ccaaagucaccgucaaggu

SEQ ID NO: 388773 - RNA, 19 nt, Homo sapiens
ggauaauuuuguggccuua

SEQ ID NO: 388774 - RNA, 19 nt, Homo sapiens
caucaacaguggcaagaua

SEQ ID NO: 388775 - RNA, 19 nt, Homo sapiens
ccagaucacaggaaaguua

SEQ ID NO: 388776 - RNA, 19 nt, Homo sapiens
caaagauguuggcagaauu

SEQ ID NO: 388777 - RNA, 19 nt, Homo sapiens
ggugagacauuuccagaug

SEQ ID NO: 388778 - RNA, 19 nt, Homo sapiens
gccaaggucuucuuugaug

SEQ ID NO: 388779 - RNA, 19 nt, Homo sapiens
gagcaucuauggugagaca

SEQ ID NO: 388780 - RNA, 19 nt, Homo sapiens
caauggcucucaguucuuu

SEQ ID NO: 388781 - RNA, 19 nt, Homo sapiens
caacaggagagaaaggaua

SEQ ID NO: 388782 - RNA, 19 nt, Homo sapiens
ucaaggauuucaugauuca

SEQ ID NO: 388783 - RNA, 19 nt, Homo sapiens
gauguuggcagaauuguga

SEQ ID NO: 388784 - RNA, 19 nt, Homo sapiens
gaucacaggaaaguuauaa

SEQ ID NO: 388785 - RNA, 19 nt, Homo sapiens
cuuagggacuuugaacuua

SEQ ID NO: 388786 - RNA, 19 nt, Homo sapiens
gcucggcgcacuuguguuu

SEQ ID NO: 388787 - RNA, 19 nt, Homo sapiens
gagagaaaggauauggaua

SEQ ID NO: 388788 - RNA, 19 nt, Homo sapiens
ccaagacaguggaaaauuu

SEQ ID NO: 388789 - RNA, 19 nt, Homo sapiens
cggccaaggucuucuuuga

SEQ ID NO: 388790 - RNA, 19 nt, Homo sapiens
acaaagauguuggcagaau

SEQ ID NO: 388791 - RNA, 19 nt, Homo sapiens
ugacacaacuggcagaaaa

SEQ ID NO: 388792 - RNA, 19 nt, Homo sapiens
caucuauggugagacauuu

SEQ ID NO: 388793 - RNA, 19 nt, Homo sapiens
uuagggacuuugaacuuaa

SEQ ID NO: 388794 - RNA, 19 nt, Homo sapiens
ggagagaaaggauauggau

SEQ ID NO: 388795 - RNA, 19 nt, Homo sapiens
uuaguaaaccaccugcuua

SEQ ID NO: 388796 - RNA, 19 nt, Homo sapiens
ugauuggccucuuuggaaa

SEQ ID NO: 388797 - RNA, 19 nt, Homo sapiens
aaucaaaccgucacccuuu

SEQ ID NO: 388798 - RNA, 19 nt, Homo sapiens
gugagacauuuccagauga

SEQ ID NO: 388799 - RNA, 19 nt, Homo sapiens
gugauuggccucuuuggaa

SEQ ID NO: 388800 - RNA, 19 nt, Homo sapiens
gggcaugaccguccacuca

SEQ ID NO: 388801 - RNA, 19 nt, Homo sapiens
gcugcuaccucucgugcuu

SEQ ID NO: 388802 - RNA, 19 nt, Homo sapiens
uaucccagaucacaggaaa

SEQ ID NO: 388803 - RNA, 19 nt, Homo sapiens
aaacaaggauaugcuuugg

SEQ ID NO: 388804 - RNA, 19 nt, Homo sapiens
caaguuucaucgugucauc

SEQ ID NO: 388805 - RNA, 19 nt, Homo sapiens
ggauauaaaggaagcaagu

SEQ ID NO: 388806 - RNA, 19 nt, Homo sapiens
ugguugagaucgcugauug

SEQ ID NO: 388807 - RNA, 19 nt, Homo sapiens
gauuggagacaaagauguu

SEQ ID NO: 388808 - RNA, 19 nt, Homo sapiens
uagggacuuugaacuuaaa

SEQ ID NO: 388809 - RNA, 19 nt, Homo sapiens
guuguguugucuuucaauu

SEQ ID NO: 388810 - RNA, 19 nt, Homo sapiens
uguauucuaucccagauca

SEQ ID NO: 388811 - RNA, 19 nt, Homo sapiens
gaaaacaaggauaugcuuu

SEQ ID NO: 388812 - RNA, 19 nt, Homo sapiens
gcuuagggacuuugaacuu

SEQ ID NO: 388813 - RNA, 19 nt, Homo sapiens
gcaucuauggugagacauu

SEQ ID NO: 388814 - RNA, 19 nt, Homo sapiens
gauauaaaggaagcaaguu

SEQ ID NO: 388815 - RNA, 19 nt, Homo sapiens
ccaaggucuucuuugaugu

SEQ ID NO: 388816 - RNA, 19 nt, Homo sapiens
gcugaagcacuauggcauu

SEQ ID NO: 388817 - RNA, 19 nt, Homo sapiens
aaaggaagcaaguuucauc

SEQ ID NO: 388818 - RNA, 19 nt, Homo sapiens
aaagauguuggcagaauug

SEQ ID NO: 388819 - RNA, 19 nt, Homo sapiens
ggaaaauuuuguugcucua

SEQ ID NO: 388820 - RNA, 19 nt, Homo sapiens
gaauugugauuggccucuu

SEQ ID NO: 388821 - RNA, 19 nt, Homo sapiens
aucaaaccgucacccuuua

SEQ ID NO: 388822 - RNA, 19 nt, Homo sapiens
ugugaggauuggagacaaa

SEQ ID NO: 388823 - RNA, 19 nt, Homo sapiens
caucgugucaucaaggauu

SEQ ID NO: 388824 - RNA, 19 nt, Homo sapiens
aaccgucacccuuuaguuu

SEQ ID NO: 388825 - RNA, 19 nt, Homo sapiens
guguguguguguuguguug

SEQ ID NO: 388826 - RNA, 19 nt, Homo sapiens
gcugauuggugacacaacu

SEQ ID NO: 388827 - RNA, 19 nt, Homo sapiens
uguguguuguguugucuuu

SEQ ID NO: 388828 - RNA, 19 nt, Homo sapiens
gugagcaucuauggugaga

SEQ ID NO: 388829 - RNA, 19 nt, Homo sapiens
uauaaaggaagcaaguuuc

SEQ ID NO: 388830 - RNA, 19 nt, Homo sapiens
gaggauuggagacaaagau

SEQ ID NO: 388831 - RNA, 19 nt, Homo sapiens
cugaagcacuauggcauug

SEQ ID NO: 388832 - RNA, 19 nt, Homo sapiens
ugacaucaccacuggagau

SEQ ID NO: 388833 - RNA, 19 nt, Homo sapiens
agacauuuccagaugagaa

SEQ ID NO: 388834 - RNA, 19 nt, Homo sapiens
caagacaguggaaaauuuu

SEQ ID NO: 388835 - RNA, 19 nt, Homo sapiens
gaaaaguugugcccaagac

SEQ ID NO: 388836 - RNA, 19 nt, Homo sapiens
uguguuguguugucuuuca

SEQ ID NO: 388837 - RNA, 19 nt, Homo sapiens
guggcaagauagacgugaa

SEQ ID NO: 388838 - RNA, 19 nt, Homo sapiens
ugagacauuuccagaugag

SEQ ID NO: 388839 - RNA, 19 nt, Homo sapiens
gggacuuugaacuuaaaua

SEQ ID NO: 388840 - RNA, 19 nt, Homo sapiens
ggauuggagacaaagaugu

SEQ ID NO: 388841 - RNA, 19 nt, Homo sapiens
aauugugauuggccucuuu

SEQ ID NO: 388842 - RNA, 19 nt, Homo sapiens
gcucucaguucuuuaucac

SEQ ID NO: 388843 - RNA, 19 nt, Homo sapiens
caaggucuucuuugaugug

SEQ ID NO: 388844 - RNA, 19 nt, Homo sapiens
accaauggcucucaguucu

SEQ ID NO: 388845 - RNA, 19 nt, Homo sapiens
ucuagcaacaggagagaaa

SEQ ID NO: 388846 - RNA, 19 nt, Homo sapiens
ccaccugcuuagggacuuu

SEQ ID NO: 388847 - RNA, 19 nt, Homo sapiens
ggcucucaguucuuuauca

SEQ ID NO: 388848 - RNA, 19 nt, Homo sapiens
gcaacaggagagaaaggau

SEQ ID NO: 388849 - RNA, 19 nt, Homo sapiens
caaguggugcuauuuuaaa

SEQ ID NO: 388850 - RNA, 19 nt, Homo sapiens
gaugugaggauuggagaca

SEQ ID NO: 388851 - RNA, 19 nt, Homo sapiens
cucaaguggugcuauuuua

SEQ ID NO: 388852 - RNA, 19 nt, Homo sapiens
cagaucacaggaaaguuau

SEQ ID NO: 388853 - RNA, 19 nt, Homo sapiens
caacugcucgaucaucaac

SEQ ID NO: 388854 - RNA, 19 nt, Homo sapiens
gagcuccaagcaacugaug

SEQ ID NO: 388855 - RNA, 19 nt, Homo sapiens
cagaugagaacuucaagcu

SEQ ID NO: 388856 - RNA, 19 nt, Homo sapiens
ggccaaggucuucuuugau

SEQ ID NO: 388857 - RNA, 19 nt, Homo sapiens
accaacugcucgaucauca

SEQ ID NO: 388858 - RNA, 19 nt, Homo sapiens
ccaauggcucucaguucuu

SEQ ID NO: 388859 - RNA, 19 nt, Homo sapiens
auaaaggaagcaaguuuca

SEQ ID NO: 388860 - RNA, 19 nt, Homo sapiens
gaauauuggugcuuguaaa

SEQ ID NO: 388861 - RNA, 19 nt, Homo sapiens
gagccaagcugcaaccuau

SEQ ID NO: 388862 - RNA, 19 nt, Homo sapiens
ggaugcggauauagauuua

SEQ ID NO: 388863 - RNA, 19 nt, Homo sapiens
uaagauacguggacaguuc

SEQ ID NO: 388864 - RNA, 19 nt, Homo sapiens
gcugcaaccuauagcuuua

SEQ ID NO: 388865 - RNA, 19 nt, Homo sapiens
ggagcgaguuggucgaauu

SEQ ID NO: 388866 - RNA, 19 nt, Homo sapiens
ccaaguagcugggauuaca

SEQ ID NO: 388867 - RNA, 19 nt, Homo sapiens
uaaaggcacagaaagauaa

SEQ ID NO: 388868 - RNA, 19 nt, Homo sapiens
uaugaucccuaauguguuu

SEQ ID NO: 388869 - RNA, 19 nt, Homo sapiens
ggauagcaccagaagauaa

SEQ ID NO: 388870 - RNA, 19 nt, Homo sapiens
gcacagaaagauaaagaga

SEQ ID NO: 388871 - RNA, 19 nt, Homo sapiens
ucaaggauggcaaggauua

SEQ ID NO: 388872 - RNA, 19 nt, Homo sapiens
gccacuagguacucugaua

SEQ ID NO: 388873 - RNA, 19 nt, Homo sapiens
gaauaggaguggcaaggau

SEQ ID NO: 388874 - RNA, 19 nt, Homo sapiens
ugaauaugaucccuaaugu

SEQ ID NO: 388875 - RNA, 19 nt, Homo sapiens
uaagaaagcucaggggaua

SEQ ID NO: 388876 - RNA, 19 nt, Homo sapiens
gcucaaggauggcaaggau

SEQ ID NO: 388877 - RNA, 19 nt, Homo sapiens
gauagcaccagaagauaaa

SEQ ID NO: 388878 - RNA, 19 nt, Homo sapiens
agaauaugaucaagcauug

SEQ ID NO: 388879 - RNA, 19 nt, Homo sapiens
gcaauugacaguuguuuag

SEQ ID NO: 388880 - RNA, 19 nt, Homo sapiens
ugccucagcuucccaagua

SEQ ID NO: 388881 - RNA, 19 nt, Homo sapiens
cagaauugcugaaagucaa

SEQ ID NO: 388882 - RNA, 19 nt, Homo sapiens
caucaaauaccaaagcauu

SEQ ID NO: 388883 - RNA, 19 nt, Homo sapiens
gcuaaauugugcguuauug

SEQ ID NO: 388884 - RNA, 19 nt, Homo sapiens
cuuaguuccuuacuguuua

SEQ ID NO: 388885 - RNA, 19 nt, Homo sapiens
acugggagauggcuauuaa

SEQ ID NO: 388886 - RNA, 19 nt, Homo sapiens
auaaugguguccagucuuu

SEQ ID NO: 388887 - RNA, 19 nt, Homo sapiens
acucugauauuccguacua

SEQ ID NO: 388888 - RNA, 19 nt, Homo sapiens
acagaaagauaaagagaag

SEQ ID NO: 388889 - RNA, 19 nt, Homo sapiens
cgacagucauccagauuuc

SEQ ID NO: 388890 - RNA, 19 nt, Homo sapiens
ccugcuaaauugugcguua

SEQ ID NO: 388891 - RNA, 19 nt, Homo sapiens
guacuaaacacgucugcaa

SEQ ID NO: 388892 - RNA, 19 nt, Homo sapiens
auaaagagaaggcaguaua

SEQ ID NO: 388893 - RNA, 19 nt, Homo sapiens
aaagauaaaggcacagaaa

SEQ ID NO: 388894 - RNA, 19 nt, Homo sapiens
aaacacgucugcaagucaa

SEQ ID NO: 388895 - RNA, 19 nt, Homo sapiens
ccaaagugcugggauuaca

SEQ ID NO: 388896 - RNA, 19 nt, Homo sapiens
gauaaaggcacagaaagau

SEQ ID NO: 388897 - RNA, 19 nt, Homo sapiens
gcaaggauauuggaaaaug

SEQ ID NO: 388898 - RNA, 19 nt, Homo sapiens
uaaagagaaggcaguauau

SEQ ID NO: 388899 - RNA, 19 nt, Homo sapiens
uaagcuguguacugaauau

SEQ ID NO: 388900 - RNA, 19 nt, Homo sapiens
ugcagaauguggagaauug

SEQ ID NO: 388901 - RNA, 19 nt, Homo sapiens
caccuuaguuccuuacugu

SEQ ID NO: 388902 - RNA, 19 nt, Homo sapiens
aacugaagaugucaaauug

SEQ ID NO: 388903 - RNA, 19 nt, Homo sapiens
caaauaccaaagcauugua

SEQ ID NO: 388904 - RNA, 19 nt, Homo sapiens
ggacagguggagaaaguau

SEQ ID NO: 388905 - RNA, 19 nt, Homo sapiens
gcagauaucguacccaaaa

SEQ ID NO: 388906 - RNA, 19 nt, Homo sapiens
caguaacccucgagucuuc

SEQ ID NO: 388907 - RNA, 19 nt, Homo sapiens
guaaacugaagaugucaaa

SEQ ID NO: 388908 - RNA, 19 nt, Homo sapiens
ucuuugagauggagucuug

SEQ ID NO: 388909 - RNA, 19 nt, Homo sapiens
gcagaauugcugaaaguca

SEQ ID NO: 388910 - RNA, 19 nt, Homo sapiens
gcagggagcaauugacagu

SEQ ID NO: 388911 - RNA, 19 nt, Homo sapiens
gaaugggacagguggagaa

SEQ ID NO: 388912 - RNA, 19 nt, Homo sapiens
aaacaugucacaauacagu

SEQ ID NO: 388913 - RNA, 19 nt, Homo sapiens
gauagggguucaugcuuaa

SEQ ID NO: 388914 - RNA, 19 nt, Homo sapiens
aauaugaucccuaaugugu

SEQ ID NO: 388915 - RNA, 19 nt, Homo sapiens
uagaaaggauucaguuuug

SEQ ID NO: 388916 - RNA, 19 nt, Homo sapiens
guaaagugguuuuguuugu

SEQ ID NO: 388917 - RNA, 19 nt, Homo sapiens
gguucaugcuuaauaaaca

SEQ ID NO: 388918 - RNA, 19 nt, Homo sapiens
gaauaugaucccuaaugug

SEQ ID NO: 388919 - RNA, 19 nt, Homo sapiens
agaaggcaguauaugcaaa

SEQ ID NO: 388920 - RNA, 19 nt, Homo sapiens
ccaaaacugcggaaaauuu

SEQ ID NO: 388921 - RNA, 19 nt, Homo sapiens
ugauagggguucaugcuua

SEQ ID NO: 388922 - RNA, 19 nt, Homo sapiens
gagaaggcaguauaugcaa

SEQ ID NO: 388923 - RNA, 19 nt, Homo sapiens
gcgacagucauccagauuu

SEQ ID NO: 388924 - RNA, 19 nt, Homo sapiens
gaucgggaggguuuacuga

SEQ ID NO: 388925 - RNA, 19 nt, Homo sapiens
gauucaggguggagacuuc

SEQ ID NO: 388926 - RNA, 19 nt, Homo sapiens
uacaguaaguaaagugguu

SEQ ID NO: 388927 - RNA, 19 nt, Homo sapiens
uggcugaucuuaagaaagc

SEQ ID NO: 388928 - RNA, 19 nt, Homo sapiens
gccaaguaauuaaaggaau

SEQ ID NO: 388929 - RNA, 19 nt, Homo sapiens
gguguuuggccaaguaauu

SEQ ID NO: 388930 - RNA, 19 nt, Homo sapiens
gcaaaugcaggccgcaaca

SEQ ID NO: 388931 - RNA, 19 nt, Homo sapiens
auaaaggcacagaaagaua

SEQ ID NO: 388932 - RNA, 19 nt, Homo sapiens
gggauagcaccagaagaua

SEQ ID NO: 388933 - RNA, 19 nt, Homo sapiens
gcuguguacugaauauugg

SEQ ID NO: 388934 - RNA, 19 nt, Homo sapiens
ggaauaggaguggcaagga

SEQ ID NO: 388935 - RNA, 19 nt, Homo sapiens
guguuuggccaaguaauua

SEQ ID NO: 388936 - RNA, 19 nt, Homo sapiens
acacaaacgguucucaguu

SEQ ID NO: 388937 - RNA, 19 nt, Homo sapiens
agauaaaggcacagaaaga

SEQ ID NO: 388938 - RNA, 19 nt, Homo sapiens
gaacugggagauggcuauu

SEQ ID NO: 388939 - RNA, 19 nt, Homo sapiens
agaauuguuugcagauauc

SEQ ID NO: 388940 - RNA, 19 nt, Homo sapiens
gagcgaguuggucgaauug

SEQ ID NO: 388941 - RNA, 19 nt, Homo sapiens
uuacugagcauggcaaaug

SEQ ID NO: 388942 - RNA, 19 nt, Homo sapiens
cugggaaaccucuccauuu

SEQ ID NO: 388943 - RNA, 19 nt, Homo sapiens
gagcaauugacaguuguuu

SEQ ID NO: 388944 - RNA, 19 nt, Homo sapiens
gggagcaauugacaguugu

SEQ ID NO: 388945 - RNA, 19 nt, Homo sapiens
ccacuagguacucugauau

SEQ ID NO: 388946 - RNA, 19 nt, Homo sapiens
gcgaguuggucgaauuguc

SEQ ID NO: 388947 - RNA, 19 nt, Homo sapiens
uguuuacaguuuaggagua

SEQ ID NO: 388948 - RNA, 19 nt, Homo sapiens
aggcagaauugcugaaagu

SEQ ID NO: 388949 - RNA, 19 nt, Homo sapiens
ugaauauuggugcuuguaa

SEQ ID NO: 388950 - RNA, 19 nt, Homo sapiens
uuuaagcuguguacugaau

SEQ ID NO: 388951 - RNA, 19 nt, Homo sapiens
gaggaugcggauauagauu

SEQ ID NO: 388952 - RNA, 19 nt, Homo sapiens
gauauuccguacuaaacac

SEQ ID NO: 388953 - RNA, 19 nt, Homo sapiens
ugggacagguggagaaagu

SEQ ID NO: 388954 - RNA, 19 nt, Homo sapiens
aaauaaugguguccagucu

SEQ ID NO: 388955 - RNA, 19 nt, Homo sapiens
ucacguuggucuugaacuc

SEQ ID NO: 388956 - RNA, 19 nt, Homo sapiens
cacaauacaguaaguaaag

SEQ ID NO: 388957 - RNA, 19 nt, Homo sapiens
ccuaauguguuucuuuuga

SEQ ID NO: 388958 - RNA, 19 nt, Homo sapiens
cuuauuguguguugauugu

SEQ ID NO: 388959 - RNA, 19 nt, Homo sapiens
gcuuagaaaggauucaguu

SEQ ID NO: 388960 - RNA, 19 nt, Homo sapiens
gaagaaaucuggaccuuga

SEQ ID NO: 388961 - RNA, 19 nt, Homo sapiens
uuacaagucucgcuuauua

SEQ ID NO: 388962 - RNA, 19 nt, Homo sapiens
ggaaggaggugcucaagaa

SEQ ID NO: 388963 - RNA, 19 nt, Homo sapiens
gaacuaauagggaacuuua

SEQ ID NO: 388964 - RNA, 19 nt, Homo sapiens
ggaagagaaccacaaauua

SEQ ID NO: 388965 - RNA, 19 nt, Homo sapiens
cuaaggaagucauuaagua

SEQ ID NO: 388966 - RNA, 19 nt, Homo sapiens
ucaaagaggugacuaagga

SEQ ID NO: 388967 - RNA, 19 nt, Homo sapiens
gaacagaaaccacaagugu

SEQ ID NO: 388968 - RNA, 19 nt, Homo sapiens
caacaaacuccucaugaua

SEQ ID NO: 388969 - RNA, 19 nt, Homo sapiens
ucacaguucuggcauuuaa

SEQ ID NO: 388970 - RNA, 19 nt, Homo sapiens
caggaaaggugaacagaaa

SEQ ID NO: 388971 - RNA, 19 nt, Homo sapiens
gcacagcucuugcaacucu

SEQ ID NO: 388972 - RNA, 19 nt, Homo sapiens
agaagaaccugcuagauga

SEQ ID NO: 388973 - RNA, 19 nt, Homo sapiens
gcaacaaacuccucaugau

SEQ ID NO: 388974 - RNA, 19 nt, Homo sapiens
gaucgaaaggugugauuua

SEQ ID NO: 388975 - RNA, 19 nt, Homo sapiens
gaacaucaccaacgagcua

SEQ ID NO: 388976 - RNA, 19 nt, Homo sapiens
gaaggcagcugggagcaaa

SEQ ID NO: 388977 - RNA, 19 nt, Homo sapiens
cauaacaucuuccacaaug

SEQ ID NO: 388978 - RNA, 19 nt, Homo sapiens
caugauaacugcacacaau

SEQ ID NO: 388979 - RNA, 19 nt, Homo sapiens
ggacaaagaccucgagauc

SEQ ID NO: 388980 - RNA, 19 nt, Homo sapiens
agaaggugcuggacaagua

SEQ ID NO: 388981 - RNA, 19 nt, Homo sapiens
gaagagaaacaaaggcaaa

SEQ ID NO: 388982 - RNA, 19 nt, Homo sapiens
gggaagagaaccacaaauu

SEQ ID NO: 388983 - RNA, 19 nt, Homo sapiens
gaagagaaccacaaauuac

SEQ ID NO: 388984 - RNA, 19 nt, Homo sapiens
ccaaggaccucaagaacau

SEQ ID NO: 388985 - RNA, 19 nt, Homo sapiens
ggacagcgcugggaacaag

SEQ ID NO: 388986 - RNA, 19 nt, Homo sapiens
ucaaguacauggaggacua

SEQ ID NO: 388987 - RNA, 19 nt, Homo sapiens
ggacaacugcgaugccuuu

SEQ ID NO: 388988 - RNA, 19 nt, Homo sapiens
gggaggagaucucagugaa

SEQ ID NO: 388989 - RNA, 19 nt, Homo sapiens
cagagaauguuucacaguu

SEQ ID NO: 388990 - RNA, 19 nt, Homo sapiens
gacagaggcugcagaaucu

SEQ ID NO: 388991 - RNA, 19 nt, Homo sapiens
uguaaaggacuaugaguua

SEQ ID NO: 388992 - RNA, 19 nt, Homo sapiens
ugaguucgcugcaggacua

SEQ ID NO: 388993 - RNA, 19 nt, Homo sapiens
gaagccuccucaguaguua

SEQ ID NO: 388994 - RNA, 19 nt, Homo sapiens
gggaggagaucguggacaa

SEQ ID NO: 388995 - RNA, 19 nt, Homo sapiens
ucaagaggcuagagaagga

SEQ ID NO: 388996 - RNA, 19 nt, Homo sapiens
agaaagagguggugaaacu

SEQ ID NO: 388997 - RNA, 19 nt, Homo sapiens
cugagaagcugcucuaugu

SEQ ID NO: 388998 - RNA, 19 nt, Homo sapiens
cgagaagccuccucaguag

SEQ ID NO: 388999 - RNA, 19 nt, Homo sapiens
gcuacacccugcagaagaa

SEQ ID NO: 389000 - RNA, 19 nt, Homo sapiens
gcuguuagccuuaguuuca

SEQ ID NO: 389001 - RNA, 19 nt, Homo sapiens
gacaggcacuggcugaaga

SEQ ID NO: 389002 - RNA, 19 nt, Homo sapiens
ggaacuggaugaccucaag

SEQ ID NO: 389003 - RNA, 19 nt, Homo sapiens
ccaaggaacuagacuuucu

SEQ ID NO: 389004 - RNA, 19 nt, Homo sapiens
cgaaaggugugauuuagag

SEQ ID NO: 389005 - RNA, 19 nt, Homo sapiens
ccaccaaagugaaggaaga

SEQ ID NO: 389006 - RNA, 19 nt, Homo sapiens
ggaaacacaagcagaucua

SEQ ID NO: 389007 - RNA, 19 nt, Homo sapiens
uaaggucucuucucgacuu

SEQ ID NO: 389008 - RNA, 19 nt, Homo sapiens
cagaagaaccugcuagaug

SEQ ID NO: 389009 - RNA, 19 nt, Homo sapiens
ucaagaacaucaccaacga

SEQ ID NO: 389010 - RNA, 19 nt, Homo sapiens
gaguggacguuaauuguca

SEQ ID NO: 389011 - RNA, 19 nt, Homo sapiens
gaaaaccacugaaggacaa

SEQ ID NO: 389012 - RNA, 19 nt, Homo sapiens
ggacacagaggccaagaug

SEQ ID NO: 389013 - RNA, 19 nt, Homo sapiens
ucaaggaggugcucaaggu

SEQ ID NO: 389014 - RNA, 19 nt, Homo sapiens
ucgagcagcugcagaagaa

SEQ ID NO: 389015 - RNA, 19 nt, Homo sapiens
ccgagaagccuccucagua

SEQ ID NO: 389016 - RNA, 19 nt, Homo sapiens
gaggaggcguggaagauca

SEQ ID NO: 389017 - RNA, 19 nt, Homo sapiens
ggaggacuaccaccaguuu

SEQ ID NO: 389018 - RNA, 19 nt, Homo sapiens
gaaguaggcacagcucuug

SEQ ID NO: 389019 - RNA, 19 nt, Homo sapiens
gaagaucugugccaauucc

SEQ ID NO: 389020 - RNA, 19 nt, Homo sapiens
ggaggagcauaacaucuuc

SEQ ID NO: 389021 - RNA, 19 nt, Homo sapiens
cagaggagcagcacaagaa

SEQ ID NO: 389022 - RNA, 19 nt, Homo sapiens
gaaccugcuagaugagaua

SEQ ID NO: 389023 - RNA, 19 nt, Homo sapiens
gguaugaggugcugaagac

SEQ ID NO: 389024 - RNA, 19 nt, Homo sapiens
ggacaagaccagacugauc

SEQ ID NO: 389025 - RNA, 19 nt, Homo sapiens
uggugaaacugcagaauga

SEQ ID NO: 389026 - RNA, 19 nt, Homo sapiens
guaaaggacuaugaguuag

SEQ ID NO: 389027 - RNA, 19 nt, Homo sapiens
uagaugagauagcaaguag

SEQ ID NO: 389028 - RNA, 19 nt, Homo sapiens
gcaccuacagagaauguuu

SEQ ID NO: 389029 - RNA, 19 nt, Homo sapiens
ggaagucuggcaagaaguu

SEQ ID NO: 389030 - RNA, 19 nt, Homo sapiens
agacagaucugggcuccaa

SEQ ID NO: 389031 - RNA, 19 nt, Homo sapiens
gaucucacccgccaauaug

SEQ ID NO: 389032 - RNA, 19 nt, Homo sapiens
ggagaaggucacagagaaa

SEQ ID NO: 389033 - RNA, 19 nt, Homo sapiens
ggagcuggcggucuuggua

SEQ ID NO: 389034 - RNA, 19 nt, Homo sapiens
agaccaagcugaagaacca

SEQ ID NO: 389035 - RNA, 19 nt, Homo sapiens
gugcuggaguggacguuaa

SEQ ID NO: 389036 - RNA, 19 nt, Homo sapiens
aacaaacuccucaugauaa

SEQ ID NO: 389037 - RNA, 19 nt, Homo sapiens
cagaggagcagaagaaaca

SEQ ID NO: 389038 - RNA, 19 nt, Homo sapiens
caagagcacccaggaagaa

SEQ ID NO: 389039 - RNA, 19 nt, Homo sapiens
caugagacccugcaaagga

SEQ ID NO: 389040 - RNA, 19 nt, Homo sapiens
guaguuacucugcucauga

SEQ ID NO: 389041 - RNA, 19 nt, Homo sapiens
gacaggaagucuggcaaga

SEQ ID NO: 389042 - RNA, 19 nt, Homo sapiens
aggagaaggucacagagaa

SEQ ID NO: 389043 - RNA, 19 nt, Homo sapiens
aaaggacuaugaguuagaa

SEQ ID NO: 389044 - RNA, 19 nt, Homo sapiens
ggaggcacucugugacuuu

SEQ ID NO: 389045 - RNA, 19 nt, Homo sapiens
caggaagucuggcaagaag

SEQ ID NO: 389046 - RNA, 19 nt, Homo sapiens
aaguagaagugacccauga

SEQ ID NO: 389047 - RNA, 19 nt, Homo sapiens
gggaguugcuggccacaca

SEQ ID NO: 389048 - RNA, 19 nt, Homo sapiens
acucggaccugaaccagaa

SEQ ID NO: 389049 - RNA, 19 nt, Homo sapiens
gagaaacaaaggcaaauac

SEQ ID NO: 389050 - RNA, 19 nt, Homo sapiens
ugaaggagcgugugaccaa

SEQ ID NO: 389051 - RNA, 19 nt, Homo sapiens
gaaguucuccaucgaagag

SEQ ID NO: 389052 - RNA, 19 nt, Homo sapiens
ccaaucuccugccaccaaa

SEQ ID NO: 389053 - RNA, 19 nt, Homo sapiens
gagcaggaaguacagaaga

SEQ ID NO: 389054 - RNA, 19 nt, Homo sapiens
cuacagagaauguuucaca

SEQ ID NO: 389055 - RNA, 19 nt, Homo sapiens
gagggaagagaaccacaaa

SEQ ID NO: 389056 - RNA, 19 nt, Homo sapiens
gaagaggaagcagcacuug

SEQ ID NO: 389057 - RNA, 19 nt, Homo sapiens
ggaagaggaagcagcacuu

SEQ ID NO: 389058 - RNA, 19 nt, Homo sapiens
gaaacaaaggcaaauacag

SEQ ID NO: 389059 - RNA, 19 nt, Homo sapiens
gugagaagguaacccauac

SEQ ID NO: 389060 - RNA, 19 nt, Homo sapiens
guaggaaacugccacauuu

SEQ ID NO: 389061 - RNA, 19 nt, Homo sapiens
gaugguaucugggauguua

SEQ ID NO: 389062 - RNA, 19 nt, Homo sapiens
cuaaaugccuuguuucuuu

SEQ ID NO: 389063 - RNA, 19 nt, Homo sapiens
ucagagaacuucagcagua

SEQ ID NO: 389064 - RNA, 19 nt, Homo sapiens
gaagaaacauggugcagau

SEQ ID NO: 389065 - RNA, 19 nt, Homo sapiens
acaauagacugaauccuua

SEQ ID NO: 389066 - RNA, 19 nt, Homo sapiens
gcagguggcucuguaauga

SEQ ID NO: 389067 - RNA, 19 nt, Homo sapiens
guaauccgcuggagaaaga

SEQ ID NO: 389068 - RNA, 19 nt, Homo sapiens
guucucagguugccaaaua

SEQ ID NO: 389069 - RNA, 19 nt, Homo sapiens
ugaagaagaugaucaguuc

SEQ ID NO: 389070 - RNA, 19 nt, Homo sapiens
gaugaacacaugagaguua

SEQ ID NO: 389071 - RNA, 19 nt, Homo sapiens
gaacugcuuuaaaucacua

SEQ ID NO: 389072 - RNA, 19 nt, Homo sapiens
caagaggaauguuauugaa

SEQ ID NO: 389073 - RNA, 19 nt, Homo sapiens
gaaaugaagagcucuguga

SEQ ID NO: 389074 - RNA, 19 nt, Homo sapiens
caacagaugauauguggua

SEQ ID NO: 389075 - RNA, 19 nt, Homo sapiens
gaaugcagguggcucugua

SEQ ID NO: 389076 - RNA, 19 nt, Homo sapiens
ggagauugaugaacacaug

SEQ ID NO: 389077 - RNA, 19 nt, Homo sapiens
uaacauccauccucaacuu

SEQ ID NO: 389078 - RNA, 19 nt, Homo sapiens
gaguacagcucaacuuugu

SEQ ID NO: 389079 - RNA, 19 nt, Homo sapiens
gcaagcaagaggaauguua

SEQ ID NO: 389080 - RNA, 19 nt, Homo sapiens
gaaacauggugcagauaga

SEQ ID NO: 389081 - RNA, 19 nt, Homo sapiens
gguaauggguugcgauaug

SEQ ID NO: 389082 - RNA, 19 nt, Homo sapiens
ugagaaaguuugcaaugaa

SEQ ID NO: 389083 - RNA, 19 nt, Homo sapiens
ucaagagguuuacuuugua

SEQ ID NO: 389084 - RNA, 19 nt, Homo sapiens
uagaucacaucaccaauaa

SEQ ID NO: 389085 - RNA, 19 nt, Homo sapiens
ccuagaggaucaagacaua

SEQ ID NO: 389086 - RNA, 19 nt, Homo sapiens
caagaaauguuuggcuuau

SEQ ID NO: 389087 - RNA, 19 nt, Homo sapiens
gcaagaggaauguuauuga

SEQ ID NO: 389088 - RNA, 19 nt, Homo sapiens
gaagaaggaggcagaguug

SEQ ID NO: 389089 - RNA, 19 nt, Homo sapiens
agaaauguuuggcuuauug

SEQ ID NO: 389090 - RNA, 19 nt, Homo sapiens
gaaaguuugcaaugaagua

SEQ ID NO: 389091 - RNA, 19 nt, Homo sapiens
gaguuggcauuguugauaa

SEQ ID NO: 389092 - RNA, 19 nt, Homo sapiens
gcucaaaugugcagaugau

SEQ ID NO: 389093 - RNA, 19 nt, Homo sapiens
cagaguagaagaaaucaua

SEQ ID NO: 389094 - RNA, 19 nt, Homo sapiens
ggaguuggcauuguugaua

SEQ ID NO: 389095 - RNA, 19 nt, Homo sapiens
ucaaaugugcagaugauua

SEQ ID NO: 389096 - RNA, 19 nt, Homo sapiens
gauaugacaugggugagaa

SEQ ID NO: 389097 - RNA, 19 nt, Homo sapiens
uuacaaagcugaacaucca

SEQ ID NO: 389098 - RNA, 19 nt, Homo sapiens
gagaguacagcucaacuuu

SEQ ID NO: 389099 - RNA, 19 nt, Homo sapiens
aggcagaguuggacaagua

SEQ ID NO: 389100 - RNA, 19 nt, Homo sapiens
caagaucacaaaccaagua

SEQ ID NO: 389101 - RNA, 19 nt, Homo sapiens
gaauggcucucuggcugua

SEQ ID NO: 389102 - RNA, 19 nt, Homo sapiens
caaguaauccgcuggagaa

SEQ ID NO: 389103 - RNA, 19 nt, Homo sapiens
ugaaguccaugauauugaa

SEQ ID NO: 389104 - RNA, 19 nt, Homo sapiens
acaaauguguccauggaaa

SEQ ID NO: 389105 - RNA, 19 nt, Homo sapiens
uaaaugccuuguuucuuug

SEQ ID NO: 389106 - RNA, 19 nt, Homo sapiens
augaagagcucugugauuu

SEQ ID NO: 389107 - RNA, 19 nt, Homo sapiens
gagaaagaacgaauucaga

SEQ ID NO: 389108 - RNA, 19 nt, Homo sapiens
uaaagccagucccuucauu

SEQ ID NO: 389109 - RNA, 19 nt, Homo sapiens
gucgacaccuguuuguaua

SEQ ID NO: 389110 - RNA, 19 nt, Homo sapiens
gagaaaguuugcaaugaag

SEQ ID NO: 389111 - RNA, 19 nt, Homo sapiens
uuacaaauguguccaugga

SEQ ID NO: 389112 - RNA, 19 nt, Homo sapiens
caaaugugcagaugauuau

SEQ ID NO: 389113 - RNA, 19 nt, Homo sapiens
cagaagcagugaagaagga

SEQ ID NO: 389114 - RNA, 19 nt, Homo sapiens
gaagagcucugugauuuug

SEQ ID NO: 389115 - RNA, 19 nt, Homo sapiens
gaucacaaaccaaguaauc

SEQ ID NO: 389116 - RNA, 19 nt, Homo sapiens
ggauguuccuucguuguuu

SEQ ID NO: 389117 - RNA, 19 nt, Homo sapiens
cauccauccucaacuuuaa

SEQ ID NO: 389118 - RNA, 19 nt, Homo sapiens
ggaaugcagaguagaagaa

SEQ ID NO: 389119 - RNA, 19 nt, Homo sapiens
agcagcagcuuccuacaua

SEQ ID NO: 389120 - RNA, 19 nt, Homo sapiens
guaaagaauggaaucagaa

SEQ ID NO: 389121 - RNA, 19 nt, Homo sapiens
aaccauaauucguguugua

SEQ ID NO: 389122 - RNA, 19 nt, Homo sapiens
ccaaaugcacccaaaguau

SEQ ID NO: 389123 - RNA, 19 nt, Homo sapiens
ggaagucgagacaacauga

SEQ ID NO: 389124 - RNA, 19 nt, Homo sapiens
caaaguaucgccagaagca

SEQ ID NO: 389125 - RNA, 19 nt, Homo sapiens
gcugugagcauuuguuaga

SEQ ID NO: 389126 - RNA, 19 nt, Homo sapiens
ccaugaguauugcagguaa

SEQ ID NO: 389127 - RNA, 19 nt, Homo sapiens
caagucauguuguguuugg

SEQ ID NO: 389128 - RNA, 19 nt, Homo sapiens
uguaaagaauggaaucaga

SEQ ID NO: 389129 - RNA, 19 nt, Homo sapiens
uacaacagcuagcccagaa

SEQ ID NO: 389130 - RNA, 19 nt, Homo sapiens
gacacugacucuacaucaa

SEQ ID NO: 389131 - RNA, 19 nt, Homo sapiens
gaaauggaggaugcacaua

SEQ ID NO: 389132 - RNA, 19 nt, Homo sapiens
caagagguuuacuuuguag

SEQ ID NO: 389133 - RNA, 19 nt, Homo sapiens
guaggugucuuaauuucuc

SEQ ID NO: 389134 - RNA, 19 nt, Homo sapiens
gcagcagcuuccuacauau

SEQ ID NO: 389135 - RNA, 19 nt, Homo sapiens
cgagacaacaugaguguga

SEQ ID NO: 389136 - RNA, 19 nt, Homo sapiens
ggacuugaaucguggucau

SEQ ID NO: 389137 - RNA, 19 nt, Homo sapiens
ggucauucuuugcugugua

SEQ ID NO: 389138 - RNA, 19 nt, Homo sapiens
cugaugaccuugagaaagu

SEQ ID NO: 389139 - RNA, 19 nt, Homo sapiens
uuagaucacaucaccaaua

SEQ ID NO: 389140 - RNA, 19 nt, Homo sapiens
gagagcagcagccauguca

SEQ ID NO: 389141 - RNA, 19 nt, Homo sapiens
aaaucagacuccagcaauu

SEQ ID NO: 389142 - RNA, 19 nt, Homo sapiens
cucaagagguuuacuuugu

SEQ ID NO: 389143 - RNA, 19 nt, Homo sapiens
cagcagcuuccuacauaua

SEQ ID NO: 389144 - RNA, 19 nt, Homo sapiens
gaacuucagcaguacaaca

SEQ ID NO: 389145 - RNA, 19 nt, Homo sapiens
ugacgacacugacucuaca

SEQ ID NO: 389146 - RNA, 19 nt, Homo sapiens
uagacugaauccuuacaaa

SEQ ID NO: 389147 - RNA, 19 nt, Homo sapiens
ugaagccguuuacaauaga

SEQ ID NO: 389148 - RNA, 19 nt, Homo sapiens
caaaugcacccaaaguauc

SEQ ID NO: 389149 - RNA, 19 nt, Homo sapiens
agaaagaacgaauucagaa

SEQ ID NO: 389150 - RNA, 19 nt, Homo sapiens
guucauuucuucacacaag

SEQ ID NO: 389151 - RNA, 19 nt, Homo sapiens
gagguuuacuuuguaggaa

SEQ ID NO: 389152 - RNA, 19 nt, Homo sapiens
gauaaagccagucccuuca

SEQ ID NO: 389153 - RNA, 19 nt, Homo sapiens
acaagaaauguuuggcuua

SEQ ID NO: 389154 - RNA, 19 nt, Homo sapiens
ugacaugggugagaaugau

SEQ ID NO: 389155 - RNA, 19 nt, Homo sapiens
uuuguaagauccagacuug

SEQ ID NO: 389156 - RNA, 19 nt, Homo sapiens
gggauguuaugggaaauga

SEQ ID NO: 389157 - RNA, 19 nt, Homo sapiens
ucauuauccuugcauguga

SEQ ID NO: 389158 - RNA, 19 nt, Homo sapiens
ugagaguuaugucagagaa

SEQ ID NO: 389159 - RNA, 19 nt, Homo sapiens
augcaaggcuggcguguug

SEQ ID NO: 389160 - RNA, 19 nt, Homo sapiens
gaugggaucugggauguua

SEQ ID NO: 389161 - RNA, 19 nt, Homo sapiens
gaugauaauuuguguguug

SEQ ID NO: 389162 - RNA, 19 nt, Homo sapiens
ggaaagccauacugaauca

SEQ ID NO: 389163 - RNA, 19 nt, Homo sapiens
ggagaagucuggcgaggaa

SEQ ID NO: 389164 - RNA, 19 nt, Homo sapiens
ggaagaugcuccagagaga

SEQ ID NO: 389165 - RNA, 19 nt, Homo sapiens
ggacuaugauuacaagugu

SEQ ID NO: 389166 - RNA, 19 nt, Homo sapiens
gaucccgaguggcaaauua

SEQ ID NO: 389167 - RNA, 19 nt, Homo sapiens
uagaacacaucacuacuaa

SEQ ID NO: 389168 - RNA, 19 nt, Homo sapiens
cgagauaacaugaguauug

SEQ ID NO: 389169 - RNA, 19 nt, Homo sapiens
gaacagugaugcuggaaac

SEQ ID NO: 389170 - RNA, 19 nt, Homo sapiens
aaaguggucuugcugaauu

SEQ ID NO: 389171 - RNA, 19 nt, Homo sapiens
ggacaagucugcuuuucua

SEQ ID NO: 389172 - RNA, 19 nt, Homo sapiens
uaaagcaugugauguggaa

SEQ ID NO: 389173 - RNA, 19 nt, Homo sapiens
gaucugggauguuaugagu

SEQ ID NO: 389174 - RNA, 19 nt, Homo sapiens
gggaaugguuuacguuaug

SEQ ID NO: 389175 - RNA, 19 nt, Homo sapiens
uaaaguagagggagaagaa

SEQ ID NO: 389176 - RNA, 19 nt, Homo sapiens
gagauaacaugaguauugu

SEQ ID NO: 389177 - RNA, 19 nt, Homo sapiens
gcagugggaguuaugauuu

SEQ ID NO: 389178 - RNA, 19 nt, Homo sapiens
acacacagcuguuguaggu

SEQ ID NO: 389179 - RNA, 19 nt, Homo sapiens
aggagaugcugacuaguua

SEQ ID NO: 389180 - RNA, 19 nt, Homo sapiens
gagcagaagaggaugaauu

SEQ ID NO: 389181 - RNA, 19 nt, Homo sapiens
gaagaugcagggacaaaga

SEQ ID NO: 389182 - RNA, 19 nt, Homo sapiens
guaaugaggagcucuguga

SEQ ID NO: 389183 - RNA, 19 nt, Homo sapiens
ucacaaaccuugcaaucca

SEQ ID NO: 389184 - RNA, 19 nt, Homo sapiens
acacaucacuacuaacgaa

SEQ ID NO: 389185 - RNA, 19 nt, Homo sapiens
gaggagaugcugacuaguu

SEQ ID NO: 389186 - RNA, 19 nt, Homo sapiens
gaagcucucaggcaaauga

SEQ ID NO: 389187 - RNA, 19 nt, Homo sapiens
ccuaggaaguguaauguau

SEQ ID NO: 389188 - RNA, 19 nt, Homo sapiens
uugaagagauuauggagaa

SEQ ID NO: 389189 - RNA, 19 nt, Homo sapiens
gaggagcucugugaauaug

SEQ ID NO: 389190 - RNA, 19 nt, Homo sapiens
gaguuaugauuucaccuaa

SEQ ID NO: 389191 - RNA, 19 nt, Homo sapiens
ggacaggagugguucaacu

SEQ ID NO: 389192 - RNA, 19 nt, Homo sapiens
gcaaauuacugcucaacac

SEQ ID NO: 389193 - RNA, 19 nt, Homo sapiens
gaagaaagcccugcugaac

SEQ ID NO: 389194 - RNA, 19 nt, Homo sapiens
cagaagaggaugaauuuau

SEQ ID NO: 389195 - RNA, 19 nt, Homo sapiens
gaaggaaugccugaucuug

SEQ ID NO: 389196 - RNA, 19 nt, Homo sapiens
ggagcucugugaauauguu

SEQ ID NO: 389197 - RNA, 19 nt, Homo sapiens
ggaguuaugauuucaccua

SEQ ID NO: 389198 - RNA, 19 nt, Homo sapiens
aaccaaguguuuagaauga

SEQ ID NO: 389199 - RNA, 19 nt, Homo sapiens
agacagcucuaaugaagau

SEQ ID NO: 389200 - RNA, 19 nt, Homo sapiens
ggaagucgagauaacauga

SEQ ID NO: 389201 - RNA, 19 nt, Homo sapiens
gaacacaucacuacuaacg

SEQ ID NO: 389202 - RNA, 19 nt, Homo sapiens
caugugauguggaauaauc

SEQ ID NO: 389203 - RNA, 19 nt, Homo sapiens
ccaaauaaagcaugugaug

SEQ ID NO: 389204 - RNA, 19 nt, Homo sapiens
ccaaguguuuagaaugaaa

SEQ ID NO: 389205 - RNA, 19 nt, Homo sapiens
ucugggauguuaugaguaa

SEQ ID NO: 389206 - RNA, 19 nt, Homo sapiens
agaagaggaugaauuuauc

SEQ ID NO: 389207 - RNA, 19 nt, Homo sapiens
gugaugauacaacguguua

SEQ ID NO: 389208 - RNA, 19 nt, Homo sapiens
gaauggacaagucugcuuu

SEQ ID NO: 389209 - RNA, 19 nt, Homo sapiens
gcucaacacauuuauuaga

SEQ ID NO: 389210 - RNA, 19 nt, Homo sapiens
acucauaguuagcuuugua

SEQ ID NO: 389211 - RNA, 19 nt, Homo sapiens
acacagcuguuguagguau

SEQ ID NO: 389212 - RNA, 19 nt, Homo sapiens
gcuggcaagcguaauguua

SEQ ID NO: 389213 - RNA, 19 nt, Homo sapiens
augaggagcucugugaaua

SEQ ID NO: 389214 - RNA, 19 nt, Homo sapiens
cuccagagccugagguuua

SEQ ID NO: 389215 - RNA, 19 nt, Homo sapiens
gauacaacguguuaauggu

SEQ ID NO: 389216 - RNA, 19 nt, Homo sapiens
caaggaugauaauuugugu

SEQ ID NO: 389217 - RNA, 19 nt, Homo sapiens
ggaaacuaccgacaacuuc

SEQ ID NO: 389218 - RNA, 19 nt, Homo sapiens
ucaggcaaaugagaauuaa

SEQ ID NO: 389219 - RNA, 19 nt, Homo sapiens
ccacauagagaaagugaug

SEQ ID NO: 389220 - RNA, 19 nt, Homo sapiens
gcagaagaggaugaauuua

SEQ ID NO: 389221 - RNA, 19 nt, Homo sapiens
cugcucaacacauuuauua

SEQ ID NO: 389222 - RNA, 19 nt, Homo sapiens
gcaggaaagccauacugaa

SEQ ID NO: 389223 - RNA, 19 nt, Homo sapiens
caagggaagucgagauaac

SEQ ID NO: 389224 - RNA, 19 nt, Homo sapiens
ucauacagcuuugguuugu

SEQ ID NO: 389225 - RNA, 19 nt, Homo sapiens
gggauguuaugaguaauga

SEQ ID NO: 389226 - RNA, 19 nt, Homo sapiens
gaagaggaugaauuuauca

SEQ ID NO: 389227 - RNA, 19 nt, Homo sapiens
gaugauacaacguguuaau

SEQ ID NO: 389228 - RNA, 19 nt, Homo sapiens
gauggagaguggaaaugga

SEQ ID NO: 389229 - RNA, 19 nt, Homo sapiens
guugugagauauuggaugu

SEQ ID NO: 389230 - RNA, 19 nt, Homo sapiens
gauuagagagauuaugcua

SEQ ID NO: 389231 - RNA, 19 nt, Homo sapiens
caggaaagccauacugaau

SEQ ID NO: 389232 - RNA, 19 nt, Homo sapiens
ccacagcuacuucuucgaa

SEQ ID NO: 389233 - RNA, 19 nt, Homo sapiens
gcaagcguaauguuauuga

SEQ ID NO: 389234 - RNA, 19 nt, Homo sapiens
gaucacaaaccuugcaauc

SEQ ID NO: 389235 - RNA, 19 nt, Homo sapiens
guauaggaauggacaaguc

SEQ ID NO: 389236 - RNA, 19 nt, Homo sapiens
aaauaaagcaugugaugug

SEQ ID NO: 389237 - RNA, 19 nt, Homo sapiens
caaaauguaugucaaccaa

SEQ ID NO: 389238 - RNA, 19 nt, Homo sapiens
gaaaguggucuugcugaau

SEQ ID NO: 389239 - RNA, 19 nt, Homo sapiens
agaaaguggucuugcugaa

SEQ ID NO: 389240 - RNA, 19 nt, Homo sapiens
gugcuguucuguauaggaa

SEQ ID NO: 389241 - RNA, 19 nt, Homo sapiens
ucaaccaaguguuuagaau

SEQ ID NO: 389242 - RNA, 19 nt, Homo sapiens
cauuguaugccagaaauua

SEQ ID NO: 389243 - RNA, 19 nt, Homo sapiens
gaaacccagugacaaugca

SEQ ID NO: 389244 - RNA, 19 nt, Homo sapiens
agaaagcccugcugaacca

SEQ ID NO: 389245 - RNA, 19 nt, Homo sapiens
uggaggagaugcugacuag

SEQ ID NO: 389246 - RNA, 19 nt, Homo sapiens
caaccaaguguuuagaaug

SEQ ID NO: 389247 - RNA, 19 nt, Homo sapiens
cagcuuugguuuguauauu

SEQ ID NO: 389248 - RNA, 19 nt, Homo sapiens
gaaguugugagauauugga

SEQ ID NO: 389249 - RNA, 19 nt, Homo sapiens
uagaaguugugagauauug

SEQ ID NO: 389250 - RNA, 19 nt, Homo sapiens
gaauccacauagagaaagu

SEQ ID NO: 389251 - RNA, 19 nt, Homo sapiens
caagcguaauguuauugaa

SEQ ID NO: 389252 - RNA, 19 nt, Homo sapiens
gccugagguuuaugaaauu

SEQ ID NO: 389253 - RNA, 19 nt, Homo sapiens
gauuacaaguguguugaug

SEQ ID NO: 389254 - RNA, 19 nt, Homo sapiens
gcgcuaggguggagagaag

SEQ ID NO: 389255 - RNA, 19 nt, Homo sapiens
caccuaagcauaucuacuu

SEQ ID NO: 389256 - RNA, 19 nt, Homo sapiens
uuacugcucaacacauuua

SEQ ID NO: 389257 - RNA, 19 nt, Homo sapiens
guaugucaaccaaguguuu

SEQ ID NO: 389258 - RNA, 19 nt, Homo sapiens
aaauguaugucaaccaagu

SEQ ID NO: 389259 - RNA, 19 nt, Homo sapiens
cacaagggaagucgagaua

SEQ ID NO: 389260 - RNA, 19 nt, Homo sapiens
ggaaacuccuucacaagaa

SEQ ID NO: 389261 - RNA, 19 nt, Homo sapiens
gaaacuccuucacaagaaa

SEQ ID NO: 389262 - RNA, 19 nt, Homo sapiens
uggcaaagcuuuagacaug

SEQ ID NO: 389263 - RNA, 19 nt, Homo sapiens
gggaggaaguugccuugua

SEQ ID NO: 389264 - RNA, 19 nt, Homo sapiens
gccaggaaguuguagauuu

SEQ ID NO: 389265 - RNA, 19 nt, Homo sapiens
uuaaagagcuggcacagau

SEQ ID NO: 389266 - RNA, 19 nt, Homo sapiens
uggaagagcugcuggauca

SEQ ID NO: 389267 - RNA, 19 nt, Homo sapiens
acagaaggcuuuagaagau

SEQ ID NO: 389268 - RNA, 19 nt, Homo sapiens
ggaggaugcucacaacugu

SEQ ID NO: 389269 - RNA, 19 nt, Homo sapiens
aagaugauguggacaauga

SEQ ID NO: 389270 - RNA, 19 nt, Homo sapiens
gaacuagcacgcaucaaga

SEQ ID NO: 389271 - RNA, 19 nt, Homo sapiens
cugaagaagucauuaaaga

SEQ ID NO: 389272 - RNA, 19 nt, Homo sapiens
ccaggaaguuguagauuuc

SEQ ID NO: 389273 - RNA, 19 nt, Homo sapiens
ggaggaaguugccuuguac

SEQ ID NO: 389274 - RNA, 19 nt, Homo sapiens
caaauugaccacugaagaa

SEQ ID NO: 389275 - RNA, 19 nt, Homo sapiens
gggaagcaguugauuguag

SEQ ID NO: 389276 - RNA, 19 nt, Homo sapiens
caaaccagaggaugaagua

SEQ ID NO: 389277 - RNA, 19 nt, Homo sapiens
aaaaguagcugaugaagau

SEQ ID NO: 389278 - RNA, 19 nt, Homo sapiens
ccacugaggaugaagauga

SEQ ID NO: 389279 - RNA, 19 nt, Homo sapiens
agaggacgaugaagaagaa

SEQ ID NO: 389280 - RNA, 19 nt, Homo sapiens
gggaaacuccuucacaaga

SEQ ID NO: 389281 - RNA, 19 nt, Homo sapiens
ggaagaagaggaagacagu

SEQ ID NO: 389282 - RNA, 19 nt, Homo sapiens
gagggaagcaguugauugu

SEQ ID NO: 389283 - RNA, 19 nt, Homo sapiens
ucagaaggccuacaaggaa

SEQ ID NO: 389284 - RNA, 19 nt, Homo sapiens
ggacgaugaagaagaagaa

SEQ ID NO: 389285 - RNA, 19 nt, Homo sapiens
gagcuucgguuauugucau

SEQ ID NO: 389286 - RNA, 19 nt, Homo sapiens
gagcagccaggaaguugua

SEQ ID NO: 389287 - RNA, 19 nt, Homo sapiens
gcaaagcuuuagacauguc

SEQ ID NO: 389288 - RNA, 19 nt, Homo sapiens
ugaagaggacgaugaagaa

SEQ ID NO: 389289 - RNA, 19 nt, Homo sapiens
gcagugaggaggcagagaa

SEQ ID NO: 389290 - RNA, 19 nt, Homo sapiens
uagggaaacuccuucacaa

SEQ ID NO: 389291 - RNA, 19 nt, Homo sapiens
gaggcuaccaugacuauug

SEQ ID NO: 389292 - RNA, 19 nt, Homo sapiens
ugaccugcaucaucauuug

SEQ ID NO: 389293 - RNA, 19 nt, Homo sapiens
guuguacacuuucaaucaa

SEQ ID NO: 389294 - RNA, 19 nt, Homo sapiens
gcucucuguuguacacuuu

SEQ ID NO: 389295 - RNA, 19 nt, Homo sapiens
gaaccugccaccugaggaa

SEQ ID NO: 389296 - RNA, 19 nt, Homo sapiens
cuuuagacauguccuauga

SEQ ID NO: 389297 - RNA, 19 nt, Homo sapiens
ccacugaagaagucauuaa

SEQ ID NO: 389298 - RNA, 19 nt, Homo sapiens
gcuauugacgccaaauuga

SEQ ID NO: 389299 - RNA, 19 nt, Homo sapiens
ggaaguuguagauuucauu

SEQ ID NO: 389300 - RNA, 19 nt, Homo sapiens
gaagaggcuaccaugacua

SEQ ID NO: 389301 - RNA, 19 nt, Homo sapiens
ccaaauugaccacugaaga

SEQ ID NO: 389302 - RNA, 19 nt, Homo sapiens
ggacuggcgguucugguuu

SEQ ID NO: 389303 - RNA, 19 nt, Homo sapiens
ccugugcucuguuguguug

SEQ ID NO: 389304 - RNA, 19 nt, Homo sapiens
gcagagcuccagccagaga

SEQ ID NO: 389305 - RNA, 19 nt, Homo sapiens
uuccugagcuggacaguga

SEQ ID NO: 389306 - RNA, 19 nt, Homo sapiens
ggacagugaggaugaguca

SEQ ID NO: 389307 - RNA, 19 nt, Homo sapiens
ggacucaacuagggaaacu

SEQ ID NO: 389308 - RNA, 19 nt, Homo sapiens
gggaaggacuggcgguucu

SEQ ID NO: 389309 - RNA, 19 nt, Homo sapiens
ggaagacagugaggaaugc

SEQ ID NO: 389310 - RNA, 19 nt, Homo sapiens
gaaguuguagauuucauuc

SEQ ID NO: 389311 - RNA, 19 nt, Homo sapiens
gugaggaggcagagaauga

SEQ ID NO: 389312 - RNA, 19 nt, Homo sapiens
ggaaguugccuuguacugu

SEQ ID NO: 389313 - RNA, 19 nt, Homo sapiens
gaagaagaagaagagauga

SEQ ID NO: 389314 - RNA, 19 nt, Homo sapiens
cgaugaagaagaagaagaa

SEQ ID NO: 389315 - RNA, 19 nt, Homo sapiens
caucaucauuugcuucaag

SEQ ID NO: 389316 - RNA, 19 nt, Homo sapiens
cauguccuaugaucacaaa

SEQ ID NO: 389317 - RNA, 19 nt, Homo sapiens
cagaugaggcggaggaaga

SEQ ID NO: 389318 - RNA, 19 nt, Homo sapiens
gacaagcugccucgaguug

SEQ ID NO: 389319 - RNA, 19 nt, Homo sapiens
cacuuucaaucaacacuuu

SEQ ID NO: 389320 - RNA, 19 nt, Homo sapiens
gcaacagcgacaagaagaa

SEQ ID NO: 389321 - RNA, 19 nt, Homo sapiens
ucacugacgaccaugaauu

SEQ ID NO: 389322 - RNA, 19 nt, Homo sapiens
agaagaagaagaagagaug

SEQ ID NO: 389323 - RNA, 19 nt, Homo sapiens
ugaagaggcuaccaugacu

SEQ ID NO: 389324 - RNA, 19 nt, Homo sapiens
ucacaaaccagaggaugaa

SEQ ID NO: 389325 - RNA, 19 nt, Homo sapiens
cagagaaugaggaagauga

SEQ ID NO: 389326 - RNA, 19 nt, Homo sapiens
gccaaaaccuaaucguaaa

SEQ ID NO: 389327 - RNA, 19 nt, Homo sapiens
gggagccucugcuguccuu

SEQ ID NO: 389328 - RNA, 19 nt, Homo sapiens
ucacuccgcccauuccaaa

SEQ ID NO: 389329 - RNA, 19 nt, Homo sapiens
aggaggugcucucuacuga

SEQ ID NO: 389330 - RNA, 19 nt, Homo sapiens
cuacaaggaaggcaagcua

SEQ ID NO: 389331 - RNA, 19 nt, Homo sapiens
ggaccacuucuauaagaga

SEQ ID NO: 389332 - RNA, 19 nt, Homo sapiens
uuagacauguccuaugauc

SEQ ID NO: 389333 - RNA, 19 nt, Homo sapiens
guacugugccaaauaucuu

SEQ ID NO: 389334 - RNA, 19 nt, Homo sapiens
ugaagaagaagaagaagag

SEQ ID NO: 389335 - RNA, 19 nt, Homo sapiens
uacagaaggcuuuagaaga

SEQ ID NO: 389336 - RNA, 19 nt, Homo sapiens
gaagaagaagaagaagaga

SEQ ID NO: 389337 - RNA, 19 nt, Homo sapiens
gaaugaggaagaugaggau

SEQ ID NO: 389338 - RNA, 19 nt, Homo sapiens
aggcuaccaugacuauuga

SEQ ID NO: 389339 - RNA, 19 nt, Homo sapiens
ggccaaaaccuaaucguaa

SEQ ID NO: 389340 - RNA, 19 nt, Homo sapiens
ggagcuggguggcuucacu

SEQ ID NO: 389341 - RNA, 19 nt, Homo sapiens
cuuguacugugccaaauau

SEQ ID NO: 389342 - RNA, 19 nt, Homo sapiens
accagaggaugaaguagaa

SEQ ID NO: 389343 - RNA, 19 nt, Homo sapiens
cagaaggcuuuagaagaug

SEQ ID NO: 389344 - RNA, 19 nt, Homo sapiens
uaccaugacuauugaagag

SEQ ID NO: 389345 - RNA, 19 nt, Homo sapiens
ugaagaugauguggacaau

SEQ ID NO: 389346 - RNA, 19 nt, Homo sapiens
gaagagcugcuggaucagu

SEQ ID NO: 389347 - RNA, 19 nt, Homo sapiens
cgagggaagcaguugauug

SEQ ID NO: 389348 - RNA, 19 nt, Homo sapiens
ggaggcagagaaugaggaa

SEQ ID NO: 389349 - RNA, 19 nt, Homo sapiens
aagaagaggaagacaguga

SEQ ID NO: 389350 - RNA, 19 nt, Homo sapiens
ggcaacagcgacaagaaga

SEQ ID NO: 389351 - RNA, 19 nt, Homo sapiens
guagaacuagcacgcauca

SEQ ID NO: 389352 - RNA, 19 nt, Homo sapiens
gugaggaugagucagauga

SEQ ID NO: 389353 - RNA, 19 nt, Homo sapiens
gaagaugauguggacaaug

SEQ ID NO: 389354 - RNA, 19 nt, Homo sapiens
gaugagcagccaggaaguu

SEQ ID NO: 389355 - RNA, 19 nt, Homo sapiens
ggggaccacuucuauaaga

SEQ ID NO: 389356 - RNA, 19 nt, Homo sapiens
guggcaaggucaccaugga

SEQ ID NO: 389357 - RNA, 19 nt, Homo sapiens
ggaaggcaagcuacagaag

SEQ ID NO: 389358 - RNA, 19 nt, Homo sapiens
gaugccuucuuggcuauug

SEQ ID NO: 389359 - RNA, 19 nt, Homo sapiens
aaagagcuggcacagauug

SEQ ID NO: 389360 - RNA, 19 nt, Homo sapiens
gaagggcgcuggaagguau

SEQ ID NO: 389361 - RNA, 19 nt, Homo sapiens
gcaaacccaucguuccaua

SEQ ID NO: 389362 - RNA, 19 nt, Homo sapiens
gcugggagguuccugguua

SEQ ID NO: 389363 - RNA, 19 nt, Homo sapiens
guuaaugacuguauagaga

SEQ ID NO: 389364 - RNA, 19 nt, Homo sapiens
gaaacccaccugacuagua

SEQ ID NO: 389365 - RNA, 19 nt, Homo sapiens
ggagguuccugguuacaga

SEQ ID NO: 389366 - RNA, 19 nt, Homo sapiens
caaagagccugaugagacu

SEQ ID NO: 389367 - RNA, 19 nt, Homo sapiens
ggaccuugcuccugguuuc

SEQ ID NO: 389368 - RNA, 19 nt, Homo sapiens
gcuaguggcugugucuuau

SEQ ID NO: 389369 - RNA, 19 nt, Homo sapiens
ccagggauuuggacauuug

SEQ ID NO: 389370 - RNA, 19 nt, Homo sapiens
cagcuucagugcucaguga

SEQ ID NO: 389371 - RNA, 19 nt, Homo sapiens
ugagggaguugcuguuaau

SEQ ID NO: 389372 - RNA, 19 nt, Homo sapiens
aaacccaccugacuaguag

SEQ ID NO: 389373 - RNA, 19 nt, Homo sapiens
gacauuuggugccaucuuc

SEQ ID NO: 389374 - RNA, 19 nt, Homo sapiens
gcaagcagagcaccucaga

SEQ ID NO: 389375 - RNA, 19 nt, Homo sapiens
ggacggagaguaggagaga

SEQ ID NO: 389376 - RNA, 19 nt, Homo sapiens
ggaccucgaucuccuucuc

SEQ ID NO: 389377 - RNA, 19 nt, Homo sapiens
gcagagcaccucagaacuc

SEQ ID NO: 389378 - RNA, 19 nt, Homo sapiens
gggaguagcggauuugaag

SEQ ID NO: 389379 - RNA, 19 nt, Homo sapiens
guggaggucuagagauguu

SEQ ID NO: 389380 - RNA, 19 nt, Homo sapiens
gaggcugaccacguuauua

SEQ ID NO: 389381 - RNA, 19 nt, Homo sapiens
ucucugccguggaguguuu

SEQ ID NO: 389382 - RNA, 19 nt, Homo sapiens
gcuacacaauuaggacuga

SEQ ID NO: 389383 - RNA, 19 nt, Homo sapiens
uggcuuggauucagaagug

SEQ ID NO: 389384 - RNA, 19 nt, Homo sapiens
gagcuuggcuuggauucag

SEQ ID NO: 389385 - RNA, 19 nt, Homo sapiens
aaucguguaugacucaguu

SEQ ID NO: 389386 - RNA, 19 nt, Homo sapiens
cuaauggugcuaucuuuga

SEQ ID NO: 389387 - RNA, 19 nt, Homo sapiens
ucucaucccuaccuauugu

SEQ ID NO: 389388 - RNA, 19 nt, Homo sapiens
cagagcaccucagaacuca

SEQ ID NO: 389389 - RNA, 19 nt, Homo sapiens
gggaguugcuguuaaugac

SEQ ID NO: 389390 - RNA, 19 nt, Homo sapiens
agagucagcuaggcaauuc

SEQ ID NO: 389391 - RNA, 19 nt, Homo sapiens
ucuggaggcugaccacguu

SEQ ID NO: 389392 - RNA, 19 nt, Homo sapiens
gcuggaagguaucucuaag

SEQ ID NO: 389393 - RNA, 19 nt, Homo sapiens
aacccaucguuccauauua

SEQ ID NO: 389394 - RNA, 19 nt, Homo sapiens
ggauuugaagcacuuguug

SEQ ID NO: 389395 - RNA, 19 nt, Homo sapiens
aaacccaucguuccauauu

SEQ ID NO: 389396 - RNA, 19 nt, Homo sapiens
uagcggauuugaagcacuu

SEQ ID NO: 389397 - RNA, 19 nt, Homo sapiens
gagcaaacccaucguucca

SEQ ID NO: 389398 - RNA, 19 nt, Homo sapiens
uaugagggaguugcuguua

SEQ ID NO: 389399 - RNA, 19 nt, Homo sapiens
gggaaucguguaugacuca

SEQ ID NO: 389400 - RNA, 19 nt, Homo sapiens
ggaggcugaccacguuauu

SEQ ID NO: 389401 - RNA, 19 nt, Homo sapiens
gcacuuguuggccuacaga

SEQ ID NO: 389402 - RNA, 19 nt, Homo sapiens
ggcuaguggcugugucuua

SEQ ID NO: 389403 - RNA, 19 nt, Homo sapiens
ggacauuuggugccaucuu

SEQ ID NO: 389404 - RNA, 19 nt, Homo sapiens
gggugggaguagcggauuu

SEQ ID NO: 389405 - RNA, 19 nt, Homo sapiens
cccuaauggugcuaucuuu

SEQ ID NO: 389406 - RNA, 19 nt, Homo sapiens
aauuaggacugaaggagau

SEQ ID NO: 389407 - RNA, 19 nt, Homo sapiens
gggcaaagagccugaugag

SEQ ID NO: 389408 - RNA, 19 nt, Homo sapiens
uuucugagcuuggcuugga

SEQ ID NO: 389409 - RNA, 19 nt, Homo sapiens
ucguggaggucuagagaug

SEQ ID NO: 389410 - RNA, 19 nt, Homo sapiens
gccagacucagcacucauu

SEQ ID NO: 389411 - RNA, 19 nt, Homo sapiens
gaucuccuucucccucauu

SEQ ID NO: 389412 - RNA, 19 nt, Homo sapiens
uaaugacuguauagagagu

SEQ ID NO: 389413 - RNA, 19 nt, Homo sapiens
ccacguuauuagugccauu

SEQ ID NO: 389414 - RNA, 19 nt, Homo sapiens
cagaguggacggagaguag

SEQ ID NO: 389415 - RNA, 19 nt, Homo sapiens
ggccucagagugacuguga

SEQ ID NO: 389416 - RNA, 19 nt, Homo sapiens
gcugaccacguuauuagug

SEQ ID NO: 389417 - RNA, 19 nt, Homo sapiens
cauauuacugggccuguug

SEQ ID NO: 389418 - RNA, 19 nt, Homo sapiens
gucuguagcuguggugaau

SEQ ID NO: 389419 - RNA, 19 nt, Homo sapiens
cagccagacucagcacuca

SEQ ID NO: 389420 - RNA, 19 nt, Homo sapiens
uaauggugcuaucuuugag

SEQ ID NO: 389421 - RNA, 19 nt, Homo sapiens
guguaugacucaguugcuu

SEQ ID NO: 389422 - RNA, 19 nt, Homo sapiens
gaaucugcaguaccaagga

SEQ ID NO: 389423 - RNA, 19 nt, Homo sapiens
ucucucaucccuaccuauu

SEQ ID NO: 389424 - RNA, 19 nt, Homo sapiens
augagggaguugcuguuaa

SEQ ID NO: 389425 - RNA, 19 nt, Homo sapiens
gaguagcggauuugaagca

SEQ ID NO: 389426 - RNA, 19 nt, Homo sapiens
ccauauuacugggccuguu

SEQ ID NO: 389427 - RNA, 19 nt, Homo sapiens
aagcagagcaccucagaac

SEQ ID NO: 389428 - RNA, 19 nt, Homo sapiens
guggcugugucuuaucuca

SEQ ID NO: 389429 - RNA, 19 nt, Homo sapiens
cuugaaacccaccugacua

SEQ ID NO: 389430 - RNA, 19 nt, Homo sapiens
cagcugcccagaacagguu

SEQ ID NO: 389431 - RNA, 19 nt, Homo sapiens
ucagaacucaggcguacug

SEQ ID NO: 389432 - RNA, 19 nt, Homo sapiens
caaacccaucguuccauau

SEQ ID NO: 389433 - RNA, 19 nt, Homo sapiens
gcugagcaaacccaucguu

SEQ ID NO: 389434 - RNA, 19 nt, Homo sapiens
ccuaauggugcuaucuuug

SEQ ID NO: 389435 - RNA, 19 nt, Homo sapiens
ucaguguccugggcacaga

SEQ ID NO: 389436 - RNA, 19 nt, Homo sapiens
uaucucaggagcuguuuca

SEQ ID NO: 389437 - RNA, 19 nt, Homo sapiens
guaugacucaguugcuuuc

SEQ ID NO: 389438 - RNA, 19 nt, Homo sapiens
guaccaaggagcccaucug

SEQ ID NO: 389439 - RNA, 19 nt, Homo sapiens
ccacugcuugguccaucua

SEQ ID NO: 389440 - RNA, 19 nt, Homo sapiens
cuacacaauuaggacugaa

SEQ ID NO: 389441 - RNA, 19 nt, Homo sapiens
gcgcuggaagguaucucua

SEQ ID NO: 389442 - RNA, 19 nt, Homo sapiens
caucuggucucuugaauaa

SEQ ID NO: 389443 - RNA, 19 nt, Homo sapiens
caacccaucuggucucuug

SEQ ID NO: 389444 - RNA, 19 nt, Homo sapiens
gaugauggauugauuguac

SEQ ID NO: 389445 - RNA, 19 nt, Homo sapiens
caagaucugcggugacaua

SEQ ID NO: 389446 - RNA, 19 nt, Homo sapiens
gaacgaccguggcgucucu

SEQ ID NO: 389447 - RNA, 19 nt, Homo sapiens
caagagacgcuacaacauc

SEQ ID NO: 389448 - RNA, 19 nt, Homo sapiens
aagagacgcuacaacauca

SEQ ID NO: 389449 - RNA, 19 nt, Homo sapiens
ccaaguuccuccacaagca

SEQ ID NO: 389450 - RNA, 19 nt, Homo sapiens
gagcagauucggcggauca

SEQ ID NO: 389451 - RNA, 19 nt, Homo sapiens
gcaagagacgcuacaacau

SEQ ID NO: 389452 - RNA, 19 nt, Homo sapiens
gaucugcggugacauacac

SEQ ID NO: 389453 - RNA, 19 nt, Homo sapiens
ccgccaaagccaagaaaua

SEQ ID NO: 389454 - RNA, 19 nt, Homo sapiens
caugugcucuuuccagauc

SEQ ID NO: 389455 - RNA, 19 nt, Homo sapiens
caucuaugguuucuacgau

SEQ ID NO: 389456 - RNA, 19 nt, Homo sapiens
uggauugauuguacagaaa

SEQ ID NO: 389457 - RNA, 19 nt, Homo sapiens
cagcaucaaccgcaucuau

SEQ ID NO: 389458 - RNA, 19 nt, Homo sapiens
gaccuucugcgacuauuug

SEQ ID NO: 389459 - RNA, 19 nt, Homo sapiens
caacaucaaacuguggaaa

SEQ ID NO: 389460 - RNA, 19 nt, Homo sapiens
gccugcugcuggccuauaa

SEQ ID NO: 389461 - RNA, 19 nt, Homo sapiens
ucuggucucuugaauaaag

SEQ ID NO: 389462 - RNA, 19 nt, Homo sapiens
ucuaugguuucuacgauga

SEQ ID NO: 389463 - RNA, 19 nt, Homo sapiens
ccgcaucuaugguuucuac

SEQ ID NO: 389464 - RNA, 19 nt, Homo sapiens
gagcaacuaccucuuucug

SEQ ID NO: 389465 - RNA, 19 nt, Homo sapiens
ugacauacacggccaguac

SEQ ID NO: 389466 - RNA, 19 nt, Homo sapiens
cauggagccuugguguauu

SEQ ID NO: 389467 - RNA, 19 nt, Homo sapiens
cccagaugauggauugauu

SEQ ID NO: 389468 - RNA, 19 nt, Homo sapiens
gaccguggcgucucuuuua

SEQ ID NO: 389469 - RNA, 19 nt, Homo sapiens
ggauugauuguacagaaau

SEQ ID NO: 389470 - RNA, 19 nt, Homo sapiens
ccgaggugguggccaaguu

SEQ ID NO: 389471 - RNA, 19 nt, Homo sapiens
gagacgcuacaacaucaaa

SEQ ID NO: 389472 - RNA, 19 nt, Homo sapiens
gcaucaaccgcaucuaugg

SEQ ID NO: 389473 - RNA, 19 nt, Homo sapiens
ccagaugauggauugauug

SEQ ID NO: 389474 - RNA, 19 nt, Homo sapiens
uuucucagcucccaacuac

SEQ ID NO: 389475 - RNA, 19 nt, Homo sapiens
ccaucuggucucuugaaua

SEQ ID NO: 389476 - RNA, 19 nt, Homo sapiens
auguacagcugacagagaa

SEQ ID NO: 389477 - RNA, 19 nt, Homo sapiens
auggagccuugguguauuu

SEQ ID NO: 389478 - RNA, 19 nt, Homo sapiens
cugcuggccuauaagauca

SEQ ID NO: 389479 - RNA, 19 nt, Homo sapiens
cgccaaagccaagaaauag

SEQ ID NO: 389480 - RNA, 19 nt, Homo sapiens
gaaguacgggcaguucagu

SEQ ID NO: 389481 - RNA, 19 nt, Homo sapiens
cggcagcuggugacacuuu

SEQ ID NO: 389482 - RNA, 19 nt, Homo sapiens
uggccuauaagaucaagua

SEQ ID NO: 389483 - RNA, 19 nt, Homo sapiens
gcugcuggccuauaagauc

SEQ ID NO: 389484 - RNA, 19 nt, Homo sapiens
acauggagccuugguguau

SEQ ID NO: 389485 - RNA, 19 nt, Homo sapiens
ggaaguacgggcaguucag

SEQ ID NO: 389486 - RNA, 19 nt, Homo sapiens
gcaucuaugguuucuacga

SEQ ID NO: 389487 - RNA, 19 nt, Homo sapiens
cuacgaccuucugcgacua

SEQ ID NO: 389488 - RNA, 19 nt, Homo sapiens
gcacgacuuggaccucauc

SEQ ID NO: 389489 - RNA, 19 nt, Homo sapiens
uggccaaguuccuccacaa

SEQ ID NO: 389490 - RNA, 19 nt, Homo sapiens
uggcgucucuuuuaccuuu

SEQ ID NO: 389491 - RNA, 19 nt, Homo sapiens
cucaagaucugcggugaca

SEQ ID NO: 389492 - RNA, 19 nt, Homo sapiens
auggauugauuguacagaa

SEQ ID NO: 389493 - RNA, 19 nt, Homo sapiens
cagaugauggauugauugu

SEQ ID NO: 389494 - RNA, 19 nt, Homo sapiens
guggcgaguuugacaaugc

SEQ ID NO: 389495 - RNA, 19 nt, Homo sapiens
ucucagcucccaacuacug

SEQ ID NO: 389496 - RNA, 19 nt, Homo sapiens
ugcaagagacgcuacaaca

SEQ ID NO: 389497 - RNA, 19 nt, Homo sapiens
caaccuggacucgaucauc

SEQ ID NO: 389498 - RNA, 19 nt, Homo sapiens
ugagaaaccuguuaacuua

SEQ ID NO: 389499 - RNA, 19 nt, Homo sapiens
caacacgacuugaaauaaa

SEQ ID NO: 389500 - RNA, 19 nt, Homo sapiens
gcugagcgauuucuaauaa

SEQ ID NO: 389501 - RNA, 19 nt, Homo sapiens
gcaguagcauuucauuuaa

SEQ ID NO: 389502 - RNA, 19 nt, Homo sapiens
gaaaccaucagauuuguua

SEQ ID NO: 389503 - RNA, 19 nt, Homo sapiens
gggaagagcuuuacagaca

SEQ ID NO: 389504 - RNA, 19 nt, Homo sapiens
gcagaugacugaagcagaa

SEQ ID NO: 389505 - RNA, 19 nt, Homo sapiens
gaaaggaauucuguaaaga

SEQ ID NO: 389506 - RNA, 19 nt, Homo sapiens
gugcuuaacugucuaauau

SEQ ID NO: 389507 - RNA, 19 nt, Homo sapiens
agauaaggcucauauagua

SEQ ID NO: 389508 - RNA, 19 nt, Homo sapiens
uaaacagccuccagucaua

SEQ ID NO: 389509 - RNA, 19 nt, Homo sapiens
gggccucucuuguuuauuu

SEQ ID NO: 389510 - RNA, 19 nt, Homo sapiens
guaaagaaaccaucagauu

SEQ ID NO: 389511 - RNA, 19 nt, Homo sapiens
gaaugcaaacgaagauuua

SEQ ID NO: 389512 - RNA, 19 nt, Homo sapiens
gaagagcuuuacagacauu

SEQ ID NO: 389513 - RNA, 19 nt, Homo sapiens
cgaaggauguauuuaaaug

SEQ ID NO: 389514 - RNA, 19 nt, Homo sapiens
guucgaggcuuauguauca

SEQ ID NO: 389515 - RNA, 19 nt, Homo sapiens
ggauggaaauuuaucaugu

SEQ ID NO: 389516 - RNA, 19 nt, Homo sapiens
uaugaagccugacugauuu

SEQ ID NO: 389517 - RNA, 19 nt, Homo sapiens
uaacaaauggcaaugagua

SEQ ID NO: 389518 - RNA, 19 nt, Homo sapiens
ggaagauggauaugaauuu

SEQ ID NO: 389519 - RNA, 19 nt, Homo sapiens
caccagaccugcaaucuau

SEQ ID NO: 389520 - RNA, 19 nt, Homo sapiens
gguggaagauggauaugaa

SEQ ID NO: 389521 - RNA, 19 nt, Homo sapiens
gaaaccaucugaaaagaaa

SEQ ID NO: 389522 - RNA, 19 nt, Homo sapiens
gaaguucgaggcuuaugua

SEQ ID NO: 389523 - RNA, 19 nt, Homo sapiens
aaagggcaauguugauuaa

SEQ ID NO: 389524 - RNA, 19 nt, Homo sapiens
gcuuaacugucuaauauug

SEQ ID NO: 389525 - RNA, 19 nt, Homo sapiens
gaugaaacuuugauguguu

SEQ ID NO: 389526 - RNA, 19 nt, Homo sapiens
ggaaagauugugcagauga

SEQ ID NO: 389527 - RNA, 19 nt, Homo sapiens
gcaacacgacuugaaauaa

SEQ ID NO: 389528 - RNA, 19 nt, Homo sapiens
ucacaaagguuuuaucuga

SEQ ID NO: 389529 - RNA, 19 nt, Homo sapiens
ggaugaaacuuugaugugu

SEQ ID NO: 389530 - RNA, 19 nt, Homo sapiens
agacauucaccaacuauua

SEQ ID NO: 389531 - RNA, 19 nt, Homo sapiens
guuaaggacauacuucaua

SEQ ID NO: 389532 - RNA, 19 nt, Homo sapiens
aaagaaaccaucagauuug

SEQ ID NO: 389533 - RNA, 19 nt, Homo sapiens
caggaaagauugugcagau

SEQ ID NO: 389534 - RNA, 19 nt, Homo sapiens
gaucuucuguugucaugga

SEQ ID NO: 389535 - RNA, 19 nt, Homo sapiens
uagcaucaaucgcauuuau

SEQ ID NO: 389536 - RNA, 19 nt, Homo sapiens
gacuaaguauguugguuaa

SEQ ID NO: 389537 - RNA, 19 nt, Homo sapiens
uaaauaacuuccugauugg

SEQ ID NO: 389538 - RNA, 19 nt, Homo sapiens
ggacaucauaucuauaaug

SEQ ID NO: 389539 - RNA, 19 nt, Homo sapiens
gaugcucuauugugcagua

SEQ ID NO: 389540 - RNA, 19 nt, Homo sapiens
cagcugauagugaauauuu

SEQ ID NO: 389541 - RNA, 19 nt, Homo sapiens
ccauuaaaguuacaucuuc

SEQ ID NO: 389542 - RNA, 19 nt, Homo sapiens
ucaaauauccagagaacuu

SEQ ID NO: 389543 - RNA, 19 nt, Homo sapiens
gcaaugaguagaaaaguua

SEQ ID NO: 389544 - RNA, 19 nt, Homo sapiens
uguguaagcugagcgauuu

SEQ ID NO: 389545 - RNA, 19 nt, Homo sapiens
auaaugcccuucuauaugu

SEQ ID NO: 389546 - RNA, 19 nt, Homo sapiens
gaacuuacaggacacagau

SEQ ID NO: 389547 - RNA, 19 nt, Homo sapiens
gguauugggugcuuaacug

SEQ ID NO: 389548 - RNA, 19 nt, Homo sapiens
ugcaguagcauuucauuua

SEQ ID NO: 389549 - RNA, 19 nt, Homo sapiens
ggguaaaggaucuuaaauu

SEQ ID NO: 389550 - RNA, 19 nt, Homo sapiens
gaguguggaugaaacuuug

SEQ ID NO: 389551 - RNA, 19 nt, Homo sapiens
uagcagccauuguggauga

SEQ ID NO: 389552 - RNA, 19 nt, Homo sapiens
auacaggaauugacacuga

SEQ ID NO: 389553 - RNA, 19 nt, Homo sapiens
gaucgugguguuuccuuua

SEQ ID NO: 389554 - RNA, 19 nt, Homo sapiens
ggucaagacuaaguauguu

SEQ ID NO: 389555 - RNA, 19 nt, Homo sapiens
agacuaaguauguugguua

SEQ ID NO: 389556 - RNA, 19 nt, Homo sapiens
uaagauaaggcucauauag

SEQ ID NO: 389557 - RNA, 19 nt, Homo sapiens
gaauugacacugauuugga

SEQ ID NO: 389558 - RNA, 19 nt, Homo sapiens
cagcuaauccgccgaagaa

SEQ ID NO: 389559 - RNA, 19 nt, Homo sapiens
aaauuacuguggcgaguuu

SEQ ID NO: 389560 - RNA, 19 nt, Homo sapiens
gcuaaacgacaguugguaa

SEQ ID NO: 389561 - RNA, 19 nt, Homo sapiens
gauuugugcacucuaauuu

SEQ ID NO: 389562 - RNA, 19 nt, Homo sapiens
gcuauuggcuuauaaaauc

SEQ ID NO: 389563 - RNA, 19 nt, Homo sapiens
gacaucauaucuauaaugc

SEQ ID NO: 389564 - RNA, 19 nt, Homo sapiens
guagugaaguauaguagca

SEQ ID NO: 389565 - RNA, 19 nt, Homo sapiens
gauguguucauuucagaua

SEQ ID NO: 389566 - RNA, 19 nt, Homo sapiens
ugauaaugcugguggaaug

SEQ ID NO: 389567 - RNA, 19 nt, Homo sapiens
ggcaacacgacuugaaaua

SEQ ID NO: 389568 - RNA, 19 nt, Homo sapiens
guauguugguuaauaggaa

SEQ ID NO: 389569 - RNA, 19 nt, Homo sapiens
guaaauucauccaggucaa

SEQ ID NO: 389570 - RNA, 19 nt, Homo sapiens
gggcaauguugauuaaucu

SEQ ID NO: 389571 - RNA, 19 nt, Homo sapiens
caaauggcaaugaguagaa

SEQ ID NO: 389572 - RNA, 19 nt, Homo sapiens
augcuuaacuuccugguaa

SEQ ID NO: 389573 - RNA, 19 nt, Homo sapiens
ucacuagaauaauggcaaa

SEQ ID NO: 389574 - RNA, 19 nt, Homo sapiens
gacaguugguaaccuuauu

SEQ ID NO: 389575 - RNA, 19 nt, Homo sapiens
uaugaugaaugcaaacgaa

SEQ ID NO: 389576 - RNA, 19 nt, Homo sapiens
gcauuuauggauucuauga

SEQ ID NO: 389577 - RNA, 19 nt, Homo sapiens
caaguuuauugcagccuuu

SEQ ID NO: 389578 - RNA, 19 nt, Homo sapiens
aggcuuaugucacuaaaga

SEQ ID NO: 389579 - RNA, 19 nt, Homo sapiens
ggaagagcuuuacagacau

SEQ ID NO: 389580 - RNA, 19 nt, Homo sapiens
cagguuugcucugugauuu

SEQ ID NO: 389581 - RNA, 19 nt, Homo sapiens
ucauccaggucaagacuaa

SEQ ID NO: 389582 - RNA, 19 nt, Homo sapiens
gagcauugucaaauuugua

SEQ ID NO: 389583 - RNA, 19 nt, Homo sapiens
caagcuuuguagugaagua

SEQ ID NO: 389584 - RNA, 19 nt, Homo sapiens
gaacguggacagccucauc

SEQ ID NO: 389585 - RNA, 19 nt, Homo sapiens
gaauaauggcaaauacuuc

SEQ ID NO: 389586 - RNA, 19 nt, Homo sapiens
uuuaugaugucacaccuuu

SEQ ID NO: 389587 - RNA, 19 nt, Homo sapiens
gaaagauugugcagaugac

SEQ ID NO: 389588 - RNA, 19 nt, Homo sapiens
gauccacaguacaugagaa

SEQ ID NO: 389589 - RNA, 19 nt, Homo sapiens
gagagucugugccgacaag

SEQ ID NO: 389590 - RNA, 19 nt, Homo sapiens
ggagacggguaaaggaucu

SEQ ID NO: 389591 - RNA, 19 nt, Homo sapiens
cuacugaugucccugauac

SEQ ID NO: 389592 - RNA, 19 nt, Homo sapiens
ccagaagccaacuaucuuu

SEQ ID NO: 389593 - RNA, 19 nt, Homo sapiens
gacauucaccaacuauuau

SEQ ID NO: 389594 - RNA, 19 nt, Homo sapiens
uaugaugucacaccuuuaa

SEQ ID NO: 389595 - RNA, 19 nt, Homo sapiens
gauguagucaguaaauuuc

SEQ ID NO: 389596 - RNA, 19 nt, Homo sapiens
gaccuucacugauuguuuu

SEQ ID NO: 389597 - RNA, 19 nt, Homo sapiens
uagguuaggucacaaaggu

SEQ ID NO: 389598 - RNA, 19 nt, Homo sapiens
ggaaggcgauggcggauuu

SEQ ID NO: 389599 - RNA, 19 nt, Homo sapiens
caaaggaacuaacuuacug

SEQ ID NO: 389600 - RNA, 19 nt, Homo sapiens
gcggugaaguugaggcuua

SEQ ID NO: 389601 - RNA, 19 nt, Homo sapiens
gaacucacaguaccuauga

SEQ ID NO: 389602 - RNA, 19 nt, Homo sapiens
ggaguguccuucacauuug

SEQ ID NO: 389603 - RNA, 19 nt, Homo sapiens
ucacugguaugauguauau

SEQ ID NO: 389604 - RNA, 19 nt, Homo sapiens
caaagcaagcaaagaaaua

SEQ ID NO: 389605 - RNA, 19 nt, Homo sapiens
guaagaauguccagcuuca

SEQ ID NO: 389606 - RNA, 19 nt, Homo sapiens
ucacaaagcaagcaaagaa

SEQ ID NO: 389607 - RNA, 19 nt, Homo sapiens
cagaugaccguguacaaua

SEQ ID NO: 389608 - RNA, 19 nt, Homo sapiens
aguugaggcuuauaaguua

SEQ ID NO: 389609 - RNA, 19 nt, Homo sapiens
ggacuuguaacauagagua

SEQ ID NO: 389610 - RNA, 19 nt, Homo sapiens
gguugaagauggauaugaa

SEQ ID NO: 389611 - RNA, 19 nt, Homo sapiens
ggaguaaguguacaauuga

SEQ ID NO: 389612 - RNA, 19 nt, Homo sapiens
gaccgauuaugcuuucuuu

SEQ ID NO: 389613 - RNA, 19 nt, Homo sapiens
ucacaguaccuaugacuuu

SEQ ID NO: 389614 - RNA, 19 nt, Homo sapiens
uagauaaacucaacaucga

SEQ ID NO: 389615 - RNA, 19 nt, Homo sapiens
ugacauccauggacaauac

SEQ ID NO: 389616 - RNA, 19 nt, Homo sapiens
agaaauagaugucguuuug

SEQ ID NO: 389617 - RNA, 19 nt, Homo sapiens
ucagaggacugugcuuaaa

SEQ ID NO: 389618 - RNA, 19 nt, Homo sapiens
guacaacccauaaucaugu

SEQ ID NO: 389619 - RNA, 19 nt, Homo sapiens
aggaguaaguguacaauug

SEQ ID NO: 389620 - RNA, 19 nt, Homo sapiens
ggagacgaucugccucuua

SEQ ID NO: 389621 - RNA, 19 nt, Homo sapiens
gcuaucaacauuaggagua

SEQ ID NO: 389622 - RNA, 19 nt, Homo sapiens
cuauacgagugaccgauua

SEQ ID NO: 389623 - RNA, 19 nt, Homo sapiens
gugauauagugcuguuuaa

SEQ ID NO: 389624 - RNA, 19 nt, Homo sapiens
uuuaaagccugcagagaaa

SEQ ID NO: 389625 - RNA, 19 nt, Homo sapiens
caaugcaggugccaugaug

SEQ ID NO: 389626 - RNA, 19 nt, Homo sapiens
gagacgaucugccucuuac

SEQ ID NO: 389627 - RNA, 19 nt, Homo sapiens
aagcaugauuuggaucuua

SEQ ID NO: 389628 - RNA, 19 nt, Homo sapiens
agaaagcaacuaccuguuu

SEQ ID NO: 389629 - RNA, 19 nt, Homo sapiens
gaacuugaagcaccacuca

SEQ ID NO: 389630 - RNA, 19 nt, Homo sapiens
cuuaaagucucgugaaauc

SEQ ID NO: 389631 - RNA, 19 nt, Homo sapiens
acaaaccacugugaacauu

SEQ ID NO: 389632 - RNA, 19 nt, Homo sapiens
gcggagaguuugacaaugc

SEQ ID NO: 389633 - RNA, 19 nt, Homo sapiens
guacauguucuugucauaa

SEQ ID NO: 389634 - RNA, 19 nt, Homo sapiens
ggucuucuuugugaucuuu

SEQ ID NO: 389635 - RNA, 19 nt, Homo sapiens
gaacccguccauucagaaa

SEQ ID NO: 389636 - RNA, 19 nt, Homo sapiens
ucaggagaaugaaaucaga

SEQ ID NO: 389637 - RNA, 19 nt, Homo sapiens
cucauugucuuguuaugua

SEQ ID NO: 389638 - RNA, 19 nt, Homo sapiens
caacaucgacagcauuauc

SEQ ID NO: 389639 - RNA, 19 nt, Homo sapiens
gcaguuggucacucuguuu

SEQ ID NO: 389640 - RNA, 19 nt, Homo sapiens
guccaagccugguaagaau

SEQ ID NO: 389641 - RNA, 19 nt, Homo sapiens
gaaguugaggcuuauaagu

SEQ ID NO: 389642 - RNA, 19 nt, Homo sapiens
acaauacuguucuauacga

SEQ ID NO: 389643 - RNA, 19 nt, Homo sapiens
caaagaaauagaugucguu

SEQ ID NO: 389644 - RNA, 19 nt, Homo sapiens
gaucaaggucuucuuugug

SEQ ID NO: 389645 - RNA, 19 nt, Homo sapiens
aggaguaacuuucaaccuu

SEQ ID NO: 389646 - RNA, 19 nt, Homo sapiens
caacauuaggaguaacuuu

SEQ ID NO: 389647 - RNA, 19 nt, Homo sapiens
gguuauaacagcaaaugaa

SEQ ID NO: 389648 - RNA, 19 nt, Homo sapiens
ccagaucaaggucuucuuu

SEQ ID NO: 389649 - RNA, 19 nt, Homo sapiens
gguccaagccugguaagaa

SEQ ID NO: 389650 - RNA, 19 nt, Homo sapiens
ggagguuuaucaccagauc

SEQ ID NO: 389651 - RNA, 19 nt, Homo sapiens
uggccuacauucuuuauuc

SEQ ID NO: 389652 - RNA, 19 nt, Homo sapiens
gaauuaugcgaccaacuga

SEQ ID NO: 389653 - RNA, 19 nt, Homo sapiens
gaagauauucugcugucau

SEQ ID NO: 389654 - RNA, 19 nt, Homo sapiens
ggacaauacuaugauuugc

SEQ ID NO: 389655 - RNA, 19 nt, Homo sapiens
cauggacaauacuaugauu

SEQ ID NO: 389656 - RNA, 19 nt, Homo sapiens
gcccuagggugcucugaau

SEQ ID NO: 389657 - RNA, 19 nt, Homo sapiens
ccauaagcaugauuuggau

SEQ ID NO: 389658 - RNA, 19 nt, Homo sapiens
caaaauuucuccauaagca

SEQ ID NO: 389659 - RNA, 19 nt, Homo sapiens
uaaagucucgugaaaucuu

SEQ ID NO: 389660 - RNA, 19 nt, Homo sapiens
agaagugguugcaaaauuu

SEQ ID NO: 389661 - RNA, 19 nt, Homo sapiens
aagccaaaguuucuguuga

SEQ ID NO: 389662 - RNA, 19 nt, Homo sapiens
gcaagcaaagaaauagaug

SEQ ID NO: 389663 - RNA, 19 nt, Homo sapiens
cgaauuaugcgaccaacug

SEQ ID NO: 389664 - RNA, 19 nt, Homo sapiens
acaauaccguguggugaaa

SEQ ID NO: 389665 - RNA, 19 nt, Homo sapiens
guugaggcuuauaaguuaa

SEQ ID NO: 389666 - RNA, 19 nt, Homo sapiens
aaucagaggacugugcuua

SEQ ID NO: 389667 - RNA, 19 nt, Homo sapiens
ccaaaguuucuguugaauu

SEQ ID NO: 389668 - RNA, 19 nt, Homo sapiens
agccaaaguuucuguugaa

SEQ ID NO: 389669 - RNA, 19 nt, Homo sapiens
gaguaaguguacaauugau

SEQ ID NO: 389670 - RNA, 19 nt, Homo sapiens
cagaagugguugcaaaauu

SEQ ID NO: 389671 - RNA, 19 nt, Homo sapiens
gauauucugcugucaugga

SEQ ID NO: 389672 - RNA, 19 nt, Homo sapiens
gauagcagccaucguggau

SEQ ID NO: 389673 - RNA, 19 nt, Homo sapiens
aagauauucugcugucaug

SEQ ID NO: 389674 - RNA, 19 nt, Homo sapiens
gccagcaucaacagaauuu

SEQ ID NO: 389675 - RNA, 19 nt, Homo sapiens
uuacuggccuacaaaauaa

SEQ ID NO: 389676 - RNA, 19 nt, Homo sapiens
aguacaaggugguaugguu

SEQ ID NO: 389677 - RNA, 19 nt, Homo sapiens
caaaccacugugaacauuu

SEQ ID NO: 389678 - RNA, 19 nt, Homo sapiens
ugcauacuguugauacaaa

SEQ ID NO: 389679 - RNA, 19 nt, Homo sapiens
aucaaggucuucuuuguga

SEQ ID NO: 389680 - RNA, 19 nt, Homo sapiens
gugaaguugaggcuuauaa

SEQ ID NO: 389681 - RNA, 19 nt, Homo sapiens
ggccugaacccguccauuc

SEQ ID NO: 389682 - RNA, 19 nt, Homo sapiens
cuaucaacauuaggaguaa

SEQ ID NO: 389683 - RNA, 19 nt, Homo sapiens
ggcauuugcugguuauaac

SEQ ID NO: 389684 - RNA, 19 nt, Homo sapiens
caagggguaugaucacaaa

SEQ ID NO: 389685 - RNA, 19 nt, Homo sapiens
cgauggcggauuuagauaa

SEQ ID NO: 389686 - RNA, 19 nt, Homo sapiens
agaucaaggucuucuuugu

SEQ ID NO: 389687 - RNA, 19 nt, Homo sapiens
gcgaccaacugauguacca

SEQ ID NO: 389688 - RNA, 19 nt, Homo sapiens
cagcaucaacagaauuuau

SEQ ID NO: 389689 - RNA, 19 nt, Homo sapiens
gaaugugccagcaucaaca

SEQ ID NO: 389690 - RNA, 19 nt, Homo sapiens
gaccguauacuuaaaauga

SEQ ID NO: 389691 - RNA, 19 nt, Homo sapiens
uguacauguucuugucaua

SEQ ID NO: 389692 - RNA, 19 nt, Homo sapiens
gcucugaaucuguacaugu

SEQ ID NO: 389693 - RNA, 19 nt, Homo sapiens
caacccauaaucauguaaa

SEQ ID NO: 389694 - RNA, 19 nt, Homo sapiens
gaucacaaagcaagcaaag

SEQ ID NO: 389695 - RNA, 19 nt, Homo sapiens
caugaugaguguggaugaa

SEQ ID NO: 389696 - RNA, 19 nt, Homo sapiens
ucaggugguugaagaugga

SEQ ID NO: 389697 - RNA, 19 nt, Homo sapiens
cccaucaggugguugaaga

SEQ ID NO: 389698 - RNA, 19 nt, Homo sapiens
ccagauacauaccuaaaua

SEQ ID NO: 389699 - RNA, 19 nt, Homo sapiens
ggaagaagaugacaaggau

SEQ ID NO: 389700 - RNA, 19 nt, Homo sapiens
ugaaagagcuccagaugau

SEQ ID NO: 389701 - RNA, 19 nt, Homo sapiens
aaagaacccucaacccaua

SEQ ID NO: 389702 - RNA, 19 nt, Homo sapiens
gaagaugcuuggucaacuu

SEQ ID NO: 389703 - RNA, 19 nt, Homo sapiens
ggaaagaguguauguaugu

SEQ ID NO: 389704 - RNA, 19 nt, Homo sapiens
gaucaagacugcaguuugg

SEQ ID NO: 389705 - RNA, 19 nt, Homo sapiens
gaaacugucucagaucuca

SEQ ID NO: 389706 - RNA, 19 nt, Homo sapiens
gcacuuggcccaugggaaa

SEQ ID NO: 389707 - RNA, 19 nt, Homo sapiens
ggagguaucuugggaucaa

SEQ ID NO: 389708 - RNA, 19 nt, Homo sapiens
gaacgccucacccagauuu

SEQ ID NO: 389709 - RNA, 19 nt, Homo sapiens
gaacacaguggcuauuaau

SEQ ID NO: 389710 - RNA, 19 nt, Homo sapiens
gagaacacaguggcuauua

SEQ ID NO: 389711 - RNA, 19 nt, Homo sapiens
gaucacacccacaaugaaa

SEQ ID NO: 389712 - RNA, 19 nt, Homo sapiens
agaagaaacugucucagau

SEQ ID NO: 389713 - RNA, 19 nt, Homo sapiens
gagaggaggagguaucuug

SEQ ID NO: 389714 - RNA, 19 nt, Homo sapiens
guaaggaacccagcacaaa

SEQ ID NO: 389715 - RNA, 19 nt, Homo sapiens
cgaaagaggcaguaaggaa

SEQ ID NO: 389716 - RNA, 19 nt, Homo sapiens
gaaagaguguauguaugug

SEQ ID NO: 389717 - RNA, 19 nt, Homo sapiens
gagaacgccucacccagau

SEQ ID NO: 389718 - RNA, 19 nt, Homo sapiens
uagcaacaauggauagaga

SEQ ID NO: 389719 - RNA, 19 nt, Homo sapiens
acaccggauuuguuucuua

SEQ ID NO: 389720 - RNA, 19 nt, Homo sapiens
gaugcuuggucaacuugua

SEQ ID NO: 389721 - RNA, 19 nt, Homo sapiens
cacaguggcuauuaaugaa

SEQ ID NO: 389722 - RNA, 19 nt, Homo sapiens
agaacacaguggcuauuaa

SEQ ID NO: 389723 - RNA, 19 nt, Homo sapiens
acacagaaguggagucaag

SEQ ID NO: 389724 - RNA, 19 nt, Homo sapiens
gaagaaacugucucagauc

SEQ ID NO: 389725 - RNA, 19 nt, Homo sapiens
acacaguggcuauuaauga

SEQ ID NO: 389726 - RNA, 19 nt, Homo sapiens
ggaagacucggcgcucuaa

SEQ ID NO: 389727 - RNA, 19 nt, Homo sapiens
gagagaugagggucagaua

SEQ ID NO: 389728 - RNA, 19 nt, Homo sapiens
cagcuugcccagauacaua

SEQ ID NO: 389729 - RNA, 19 nt, Homo sapiens
gaaaggagggaaggcaaga

SEQ ID NO: 389730 - RNA, 19 nt, Homo sapiens
ggccucagcuugcccagau

SEQ ID NO: 389731 - RNA, 19 nt, Homo sapiens
caggauguguucccucuuc

SEQ ID NO: 389732 - RNA, 19 nt, Homo sapiens
ggaucaagacugcaguuug

SEQ ID NO: 389733 - RNA, 19 nt, Homo sapiens
guuagguccuuggcacuuu

SEQ ID NO: 389734 - RNA, 19 nt, Homo sapiens
aaaccaagcauaagagaag

SEQ ID NO: 389735 - RNA, 19 nt, Homo sapiens
caccggauuuguuucuuau

SEQ ID NO: 389736 - RNA, 19 nt, Homo sapiens
uggaaagaguguauguaug

SEQ ID NO: 389737 - RNA, 19 nt, Homo sapiens
ccggauuuguuucuuauuc

SEQ ID NO: 389738 - RNA, 19 nt, Homo sapiens
gaacugcaccauggcacuu

SEQ ID NO: 389739 - RNA, 19 nt, Homo sapiens
ggacaccggauuuguuucu

SEQ ID NO: 389740 - RNA, 19 nt, Homo sapiens
gcagaaugcaucccuaaaa

SEQ ID NO: 389741 - RNA, 19 nt, Homo sapiens
gaaagagcuccagaugaug

SEQ ID NO: 389742 - RNA, 19 nt, Homo sapiens
gaguguauguaugugaaga

SEQ ID NO: 389743 - RNA, 19 nt, Homo sapiens
aagaguguauguaugugaa

SEQ ID NO: 389744 - RNA, 19 nt, Homo sapiens
gcccagauacauaccuaaa

SEQ ID NO: 389745 - RNA, 19 nt, Homo sapiens
aagaaacugucucagaucu

SEQ ID NO: 389746 - RNA, 19 nt, Homo sapiens
caguggcuauuaaugaaga

SEQ ID NO: 389747 - RNA, 19 nt, Homo sapiens
ucccuuagcccugacuuua

SEQ ID NO: 389748 - RNA, 19 nt, Homo sapiens
ggaucacacccacaaugaa

SEQ ID NO: 389749 - RNA, 19 nt, Homo sapiens
caagagcagagccugagaa

SEQ ID NO: 389750 - RNA, 19 nt, Homo sapiens
ccaacugggagaauccuuu

SEQ ID NO: 389751 - RNA, 19 nt, Homo sapiens
gaagaugacaaggaucaca

SEQ ID NO: 389752 - RNA, 19 nt, Homo sapiens
cagguucucuuuucuuauu

SEQ ID NO: 389753 - RNA, 19 nt, Homo sapiens
gagaugagggucagauagg

SEQ ID NO: 389754 - RNA, 19 nt, Homo sapiens
caacggaagaagaugacaa

SEQ ID NO: 389755 - RNA, 19 nt, Homo sapiens
guauguaugugaagaugcu

SEQ ID NO: 389756 - RNA, 19 nt, Homo sapiens
ccacggcaacggaagaaga

SEQ ID NO: 389757 - RNA, 19 nt, Homo sapiens
ugauaaauuugguguuagg

SEQ ID NO: 389758 - RNA, 19 nt, Homo sapiens
ggagggaaggcaagauucu

SEQ ID NO: 389759 - RNA, 19 nt, Homo sapiens
acaaggaucacacccacaa

SEQ ID NO: 389760 - RNA, 19 nt, Homo sapiens
cauauaccaccacuggauu

SEQ ID NO: 389761 - RNA, 19 nt, Homo sapiens
gcaagagcagagccugaga

SEQ ID NO: 389762 - RNA, 19 nt, Homo sapiens
cggaagaagaugacaagga

SEQ ID NO: 389763 - RNA, 19 nt, Homo sapiens
caacugggagaauccuuuc

SEQ ID NO: 389764 - RNA, 19 nt, Homo sapiens
cauggacaccggauuuguu

SEQ ID NO: 389765 - RNA, 19 nt, Homo sapiens
agacugcaguuugggaaug

SEQ ID NO: 389766 - RNA, 19 nt, Homo sapiens
ccauauaccaccacuggau

SEQ ID NO: 389767 - RNA, 19 nt, Homo sapiens
gcaccucugggacagcaaa

SEQ ID NO: 389768 - RNA, 19 nt, Homo sapiens
caacuuguacccagugaac

SEQ ID NO: 389769 - RNA, 19 nt, Homo sapiens
aagaagaugacaaggauca

SEQ ID NO: 389770 - RNA, 19 nt, Homo sapiens
aaagaguguauguauguga

SEQ ID NO: 389771 - RNA, 19 nt, Homo sapiens
cuggaaagaguguauguau

SEQ ID NO: 389772 - RNA, 19 nt, Homo sapiens
ucacacccacaaugaaaga

SEQ ID NO: 389773 - RNA, 19 nt, Homo sapiens
aaugaaagagcuccagaug

SEQ ID NO: 389774 - RNA, 19 nt, Homo sapiens
gugauaaauuugguguuag

SEQ ID NO: 389775 - RNA, 19 nt, Homo sapiens
gagccaacucggucugaga

SEQ ID NO: 389776 - RNA, 19 nt, Homo sapiens
gaucccagacacagaagug

SEQ ID NO: 389777 - RNA, 19 nt, Homo sapiens
ugaagaugcuuggucaacu

SEQ ID NO: 389778 - RNA, 19 nt, Homo sapiens
ccaagcauaagagaagaaa

SEQ ID NO: 389779 - RNA, 19 nt, Homo sapiens
uucccaagcuucaggaugu

SEQ ID NO: 389780 - RNA, 19 nt, Homo sapiens
aaacaggagcuaggcagaa

SEQ ID NO: 389781 - RNA, 19 nt, Homo sapiens
gcuggaaagaguguaugua

SEQ ID NO: 389782 - RNA, 19 nt, Homo sapiens
gcauaagagaagaaacugu

SEQ ID NO: 389783 - RNA, 19 nt, Homo sapiens
gggcccagauaagaccaaa

SEQ ID NO: 389784 - RNA, 19 nt, Homo sapiens
cuuggcacuuuccuucuuu

SEQ ID NO: 389785 - RNA, 19 nt, Homo sapiens
caacaauggauagagaaca

SEQ ID NO: 389786 - RNA, 19 nt, Homo sapiens
guguauguaugugaagaug

SEQ ID NO: 389787 - RNA, 19 nt, Homo sapiens
ucacccagauuuuaucaug

SEQ ID NO: 389788 - RNA, 19 nt, Homo sapiens
ccagucauccccagagaua

SEQ ID NO: 389789 - RNA, 19 nt, Homo sapiens
cccagguucucuuuucuua

SEQ ID NO: 389790 - RNA, 19 nt, Homo sapiens
gggaucaagacugcaguuu

SEQ ID NO: 389791 - RNA, 19 nt, Homo sapiens
ccuuggcacuuuccuucuu

SEQ ID NO: 389792 - RNA, 19 nt, Homo sapiens
gcauggacaccggauuugu

SEQ ID NO: 389793 - RNA, 19 nt, Homo sapiens
ugagagaggaggagguauc

SEQ ID NO: 389794 - RNA, 19 nt, Homo sapiens
cggcaacggaagaagauga

SEQ ID NO: 389795 - RNA, 19 nt, Homo sapiens
uggggaaaaucucuuguuu

SEQ ID NO: 389796 - RNA, 19 nt, Homo sapiens
caaugaaagagcuccagau

SEQ ID NO: 389797 - RNA, 19 nt, Homo sapiens
gugugguggugugccaaua

SEQ ID NO: 389798 - RNA, 19 nt, Homo sapiens
caaacuagccagacaauua

SEQ ID NO: 389799 - RNA, 19 nt, Homo sapiens
gaauaccacugauuuagaa

SEQ ID NO: 389800 - RNA, 19 nt, Homo sapiens
caguuuagcugcugaauuu

SEQ ID NO: 389801 - RNA, 19 nt, Homo sapiens
gguguuaccuugucuguuu

SEQ ID NO: 389802 - RNA, 19 nt, Homo sapiens
gaagaugccuguagugaca

SEQ ID NO: 389803 - RNA, 19 nt, Homo sapiens
ugacaaacgugcuuuauuc

SEQ ID NO: 389804 - RNA, 19 nt, Homo sapiens
aaaggaagcuucacuacaa

SEQ ID NO: 389805 - RNA, 19 nt, Homo sapiens
caaagacuaugguuuaaug

SEQ ID NO: 389806 - RNA, 19 nt, Homo sapiens
ggaaacagcaguauuugaa

SEQ ID NO: 389807 - RNA, 19 nt, Homo sapiens
caacuugauuugucuguuu

SEQ ID NO: 389808 - RNA, 19 nt, Homo sapiens
agacaaagacuaugguuua

SEQ ID NO: 389809 - RNA, 19 nt, Homo sapiens
guaaauggauuguuaaggu

SEQ ID NO: 389810 - RNA, 19 nt, Homo sapiens
acacugcaauuguuuguua

SEQ ID NO: 389811 - RNA, 19 nt, Homo sapiens
gaaguaagccuggacauug

SEQ ID NO: 389812 - RNA, 19 nt, Homo sapiens
caggauauauagacugaua

SEQ ID NO: 389813 - RNA, 19 nt, Homo sapiens
ggauaagacuuuaaacagu

SEQ ID NO: 389814 - RNA, 19 nt, Homo sapiens
gaaaaugccuaaucgauau

SEQ ID NO: 389815 - RNA, 19 nt, Homo sapiens
caucuuagccaggaaauua

SEQ ID NO: 389816 - RNA, 19 nt, Homo sapiens
caaacgugcuuuauucuuc

SEQ ID NO: 389817 - RNA, 19 nt, Homo sapiens
gaaaauaguuugaguagca

SEQ ID NO: 389818 - RNA, 19 nt, Homo sapiens
gcaauuguuuguuagaugu

SEQ ID NO: 389819 - RNA, 19 nt, Homo sapiens
gacaaagacuaugguuuaa

SEQ ID NO: 389820 - RNA, 19 nt, Homo sapiens
caaaagaccuacaugauga

SEQ ID NO: 389821 - RNA, 19 nt, Homo sapiens
agaaguagcugucauagag

SEQ ID NO: 389822 - RNA, 19 nt, Homo sapiens
gaagugggaugaaaugaac

SEQ ID NO: 389823 - RNA, 19 nt, Homo sapiens
ugaugaagaugaagaaaug

SEQ ID NO: 389824 - RNA, 19 nt, Homo sapiens
ggagaauuccuugcuguua

SEQ ID NO: 389825 - RNA, 19 nt, Homo sapiens
gccuggacauuguuaaaua

SEQ ID NO: 389826 - RNA, 19 nt, Homo sapiens
gagauuaagucuguacaug

SEQ ID NO: 389827 - RNA, 19 nt, Homo sapiens
ccacugauuuagaaacaaa

SEQ ID NO: 389828 - RNA, 19 nt, Homo sapiens
ggacuacgauaauguguac

SEQ ID NO: 389829 - RNA, 19 nt, Homo sapiens
gaccaucaaugccuaugaa

SEQ ID NO: 389830 - RNA, 19 nt, Homo sapiens
uauaguacguugcuucuug

SEQ ID NO: 389831 - RNA, 19 nt, Homo sapiens
gauuaagucuguacaugug

SEQ ID NO: 389832 - RNA, 19 nt, Homo sapiens
gagaauuccuugcuguuag

SEQ ID NO: 389833 - RNA, 19 nt, Homo sapiens
ggaagaaucaaaucaagga

SEQ ID NO: 389834 - RNA, 19 nt, Homo sapiens
gcaguauucuaaacauuuc

SEQ ID NO: 389835 - RNA, 19 nt, Homo sapiens
gauaauguguacuaugaca

SEQ ID NO: 389836 - RNA, 19 nt, Homo sapiens
cacacaaucuucuaccuuu

SEQ ID NO: 389837 - RNA, 19 nt, Homo sapiens
ggaaagcccugugugucuu

SEQ ID NO: 389838 - RNA, 19 nt, Homo sapiens
gaacaacaggauauauaga

SEQ ID NO: 389839 - RNA, 19 nt, Homo sapiens
cuucacaauucaugacuua

SEQ ID NO: 389840 - RNA, 19 nt, Homo sapiens
ggaauaccacugauuuaga

SEQ ID NO: 389841 - RNA, 19 nt, Homo sapiens
gaaacagcaguauuugaaa

SEQ ID NO: 389842 - RNA, 19 nt, Homo sapiens
acgauaauguguacuauga

SEQ ID NO: 389843 - RNA, 19 nt, Homo sapiens
gauaggguaugaacuaguc

SEQ ID NO: 389844 - RNA, 19 nt, Homo sapiens
gaauguacagacagaagua

SEQ ID NO: 389845 - RNA, 19 nt, Homo sapiens
ugguguaaauggauuguua

SEQ ID NO: 389846 - RNA, 19 nt, Homo sapiens
gaaccauuaugauucaagu

SEQ ID NO: 389847 - RNA, 19 nt, Homo sapiens
gaaaagguauguucaaguc

SEQ ID NO: 389848 - RNA, 19 nt, Homo sapiens
aaacuagccagacaauuaa

SEQ ID NO: 389849 - RNA, 19 nt, Homo sapiens
caucaaugccuaugaauuc

SEQ ID NO: 389850 - RNA, 19 nt, Homo sapiens
gguaauugauaggguauga

SEQ ID NO: 389851 - RNA, 19 nt, Homo sapiens
aagaguuacuguugcauuu

SEQ ID NO: 389852 - RNA, 19 nt, Homo sapiens
guuaaacuuucaccaaugu

SEQ ID NO: 389853 - RNA, 19 nt, Homo sapiens
ucaaggaucuacuccaagu

SEQ ID NO: 389854 - RNA, 19 nt, Homo sapiens
ucaaaguacugcugaacug

SEQ ID NO: 389855 - RNA, 19 nt, Homo sapiens
uauggaaacagcaguauuu

SEQ ID NO: 389856 - RNA, 19 nt, Homo sapiens
gaaaugugguagcucuuac

SEQ ID NO: 389857 - RNA, 19 nt, Homo sapiens
guacguugcuucuuguucu

SEQ ID NO: 389858 - RNA, 19 nt, Homo sapiens
uguaaacccugugacuaua

SEQ ID NO: 389859 - RNA, 19 nt, Homo sapiens
gcagagaugacuaaaauuu

SEQ ID NO: 389860 - RNA, 19 nt, Homo sapiens
guuaaauagucccugcuuu

SEQ ID NO: 389861 - RNA, 19 nt, Homo sapiens
uaacacuugucuucaacuu

SEQ ID NO: 389862 - RNA, 19 nt, Homo sapiens
gagccaaaguaucggauuc

SEQ ID NO: 389863 - RNA, 19 nt, Homo sapiens
cuuagaaaguacccacaua

SEQ ID NO: 389864 - RNA, 19 nt, Homo sapiens
gucauuugcugcuauguug

SEQ ID NO: 389865 - RNA, 19 nt, Homo sapiens
uuaagacugucaccacauu

SEQ ID NO: 389866 - RNA, 19 nt, Homo sapiens
accaaugucugcucuguuu

SEQ ID NO: 389867 - RNA, 19 nt, Homo sapiens
gguuaaacuuucaccaaug

SEQ ID NO: 389868 - RNA, 19 nt, Homo sapiens
aaucaaggaucuacuccaa

SEQ ID NO: 389869 - RNA, 19 nt, Homo sapiens
ggaagcuucacuacaauga

SEQ ID NO: 389870 - RNA, 19 nt, Homo sapiens
aacaagaccucuacgacuu

SEQ ID NO: 389871 - RNA, 19 nt, Homo sapiens
gauguaaacccugugacua

SEQ ID NO: 389872 - RNA, 19 nt, Homo sapiens
caagguagauuuuacuuuc

SEQ ID NO: 389873 - RNA, 19 nt, Homo sapiens
cuaggaauaccacugauuu

SEQ ID NO: 389874 - RNA, 19 nt, Homo sapiens
gcacacaaucuucuaccuu

SEQ ID NO: 389875 - RNA, 19 nt, Homo sapiens
ugauaaacuuagagacuga

SEQ ID NO: 389876 - RNA, 19 nt, Homo sapiens
guuugucucugguuucuga

SEQ ID NO: 389877 - RNA, 19 nt, Homo sapiens
guaaccagugauaugauua

SEQ ID NO: 389878 - RNA, 19 nt, Homo sapiens
cuacuccuuuccacacaua

SEQ ID NO: 389879 - RNA, 19 nt, Homo sapiens
ugugguagcucuuacaaag

SEQ ID NO: 389880 - RNA, 19 nt, Homo sapiens
ugaaaugugguagcucuua

SEQ ID NO: 389881 - RNA, 19 nt, Homo sapiens
gaaguucauagacgagauu

SEQ ID NO: 389882 - RNA, 19 nt, Homo sapiens
gguaugaacuagucaaaau

SEQ ID NO: 389883 - RNA, 19 nt, Homo sapiens
gagacugauuagacugaaa

SEQ ID NO: 389884 - RNA, 19 nt, Homo sapiens
gaauacggaagaaucaaau

SEQ ID NO: 389885 - RNA, 19 nt, Homo sapiens
gccagacaauuaauuucaa

SEQ ID NO: 389886 - RNA, 19 nt, Homo sapiens
ggagagacagaucugaaug

SEQ ID NO: 389887 - RNA, 19 nt, Homo sapiens
gugcaguauucuaaacauu

SEQ ID NO: 389888 - RNA, 19 nt, Homo sapiens
uguaaccagugauaugauu

SEQ ID NO: 389889 - RNA, 19 nt, Homo sapiens
ggugggaaauacaguuuag

SEQ ID NO: 389890 - RNA, 19 nt, Homo sapiens
ccaauugaacaacaggaua

SEQ ID NO: 389891 - RNA, 19 nt, Homo sapiens
ugguagcucuuacaaaguu

SEQ ID NO: 389892 - RNA, 19 nt, Homo sapiens
guaauaucaucaguccaaa

SEQ ID NO: 389893 - RNA, 19 nt, Homo sapiens
ccaaaaugcauaccaguua

SEQ ID NO: 389894 - RNA, 19 nt, Homo sapiens
agagacagaucugaauguu

SEQ ID NO: 389895 - RNA, 19 nt, Homo sapiens
gguuucauuucuagccaua

SEQ ID NO: 389896 - RNA, 19 nt, Homo sapiens
uucuauaccucucugauuu

SEQ ID NO: 389897 - RNA, 19 nt, Homo sapiens
ugucuuaaccuccugcuuu

SEQ ID NO: 389898 - RNA, 19 nt, Homo sapiens
uaacacagcugaacuauuu

SEQ ID NO: 389899 - RNA, 19 nt, Homo sapiens
gcaaauccauggugaaaua

SEQ ID NO: 389900 - RNA, 19 nt, Homo sapiens
gcacuacuauucucucuua

SEQ ID NO: 389901 - RNA, 19 nt, Homo sapiens
gcaaagaaguccuggauga

SEQ ID NO: 389902 - RNA, 19 nt, Homo sapiens
gaaagaaguuccuaacaga

SEQ ID NO: 389903 - RNA, 19 nt, Homo sapiens
gcaaauagguaauguggaa

SEQ ID NO: 389904 - RNA, 19 nt, Homo sapiens
caacaaaccucuugagaau

SEQ ID NO: 389905 - RNA, 19 nt, Homo sapiens
gauaauagcccacagcaua

SEQ ID NO: 389906 - RNA, 19 nt, Homo sapiens
gcaggucuaucuuuaauuu

SEQ ID NO: 389907 - RNA, 19 nt, Homo sapiens
caacagauccagucaauuu

SEQ ID NO: 389908 - RNA, 19 nt, Homo sapiens
gaaauuagguacagcuguu

SEQ ID NO: 389909 - RNA, 19 nt, Homo sapiens
gaagagauuuccauucaga

SEQ ID NO: 389910 - RNA, 19 nt, Homo sapiens
guacagcuguugcuccuua

SEQ ID NO: 389911 - RNA, 19 nt, Homo sapiens
gaagacauauaccuggaua

SEQ ID NO: 389912 - RNA, 19 nt, Homo sapiens
acacauaccuucuuuauag

SEQ ID NO: 389913 - RNA, 19 nt, Homo sapiens
ugacaagacugaaacaauu

SEQ ID NO: 389914 - RNA, 19 nt, Homo sapiens
gguacagccuauauaauua

SEQ ID NO: 389915 - RNA, 19 nt, Homo sapiens
gcagacacauuaugacauu

SEQ ID NO: 389916 - RNA, 19 nt, Homo sapiens
gaagaaguuuccagaaguu

SEQ ID NO: 389917 - RNA, 19 nt, Homo sapiens
guacguaacuauuuccaaa

SEQ ID NO: 389918 - RNA, 19 nt, Homo sapiens
gaagaaaccaugucuaugu

SEQ ID NO: 389919 - RNA, 19 nt, Homo sapiens
gcagauuccucuacugauu

SEQ ID NO: 389920 - RNA, 19 nt, Homo sapiens
uaauagagcuccucagaau

SEQ ID NO: 389921 - RNA, 19 nt, Homo sapiens
gagcuuagggcaaauauuu

SEQ ID NO: 389922 - RNA, 19 nt, Homo sapiens
gcauagaacuuccuuugau

SEQ ID NO: 389923 - RNA, 19 nt, Homo sapiens
gaacugagaaauaagauug

SEQ ID NO: 389924 - RNA, 19 nt, Homo sapiens
cugcugagcuccaguauuu

SEQ ID NO: 389925 - RNA, 19 nt, Homo sapiens
gaaguuaagguuaggauuu

SEQ ID NO: 389926 - RNA, 19 nt, Homo sapiens
guggaaaucugaagaagaa

SEQ ID NO: 389927 - RNA, 19 nt, Homo sapiens
ggaaucacguuuagguauu

SEQ ID NO: 389928 - RNA, 19 nt, Homo sapiens
gaacuagugcaauuacaua

SEQ ID NO: 389929 - RNA, 19 nt, Homo sapiens
gaaacuacuucaaauaugg

SEQ ID NO: 389930 - RNA, 19 nt, Homo sapiens
ggaaacuacuucaaauaug

SEQ ID NO: 389931 - RNA, 19 nt, Homo sapiens
caauagauuucucaaggua

SEQ ID NO: 389932 - RNA, 19 nt, Homo sapiens
caagagaaauccaggguau

SEQ ID NO: 389933 - RNA, 19 nt, Homo sapiens
gcagaaagcuccguaaagg

SEQ ID NO: 389934 - RNA, 19 nt, Homo sapiens
uuaagcaggucuaucuuua

SEQ ID NO: 389935 - RNA, 19 nt, Homo sapiens
cauagaacuuccuuugaua

SEQ ID NO: 389936 - RNA, 19 nt, Homo sapiens
ucacaucucuucacuacuu

SEQ ID NO: 389937 - RNA, 19 nt, Homo sapiens
ugaaauauguacugacuug

SEQ ID NO: 389938 - RNA, 19 nt, Homo sapiens
ugaaguaccuagucagauu

SEQ ID NO: 389939 - RNA, 19 nt, Homo sapiens
ggaauguucuggaaaguca

SEQ ID NO: 389940 - RNA, 19 nt, Homo sapiens
gguaguagaugauuuccuu

SEQ ID NO: 389941 - RNA, 19 nt, Homo sapiens
gaaagcuacuacagaagaa

SEQ ID NO: 389942 - RNA, 19 nt, Homo sapiens
caagagagaauaagacaaa

SEQ ID NO: 389943 - RNA, 19 nt, Homo sapiens
acaaaccucuugagaauau

SEQ ID NO: 389944 - RNA, 19 nt, Homo sapiens
ucacugaaauuauggaaga

SEQ ID NO: 389945 - RNA, 19 nt, Homo sapiens
uaaguuugcuccuucauau

SEQ ID NO: 389946 - RNA, 19 nt, Homo sapiens
uaaacuagcagaagaacua

SEQ ID NO: 389947 - RNA, 19 nt, Homo sapiens
gaaguaaccucagcacuac

SEQ ID NO: 389948 - RNA, 19 nt, Homo sapiens
gaccaguucuccuuuaaga

SEQ ID NO: 389949 - RNA, 19 nt, Homo sapiens
caacaugccauaucucauu

SEQ ID NO: 389950 - RNA, 19 nt, Homo sapiens
ugacaggucuaaauuacaa

SEQ ID NO: 389951 - RNA, 19 nt, Homo sapiens
ugaaacaauugggagauua

SEQ ID NO: 389952 - RNA, 19 nt, Homo sapiens
gcacacacacacacacaua

SEQ ID NO: 389953 - RNA, 19 nt, Homo sapiens
gauuggagcuaguaacaga

SEQ ID NO: 389954 - RNA, 19 nt, Homo sapiens
gcaugaaaaugaaggauua

SEQ ID NO: 389955 - RNA, 19 nt, Homo sapiens
gaggaaacuacuucaaaua

SEQ ID NO: 389956 - RNA, 19 nt, Homo sapiens
ugucugagcuagaauuauu

SEQ ID NO: 389957 - RNA, 19 nt, Homo sapiens
gaaucacguuuagguauuu

SEQ ID NO: 389958 - RNA, 19 nt, Homo sapiens
gaucauggcauuacugaga

SEQ ID NO: 389959 - RNA, 19 nt, Homo sapiens
gugaugaacuagugcaauu

SEQ ID NO: 389960 - RNA, 19 nt, Homo sapiens
acaauaaacuagcagaaga

SEQ ID NO: 389961 - RNA, 19 nt, Homo sapiens
ggccaucaauaucacaaua

SEQ ID NO: 389962 - RNA, 19 nt, Homo sapiens
ugucuaccauuaugacuua

SEQ ID NO: 389963 - RNA, 19 nt, Homo sapiens
uaacaucuguggaagaauc

SEQ ID NO: 389964 - RNA, 19 nt, Homo sapiens
gauaauacgaggaguuuga

SEQ ID NO: 389965 - RNA, 19 nt, Homo sapiens
cagcagaugugucucauuc

SEQ ID NO: 389966 - RNA, 19 nt, Homo sapiens
gaaguaccuagucagauua

SEQ ID NO: 389967 - RNA, 19 nt, Homo sapiens
ggacaaggaagauuuggaa

SEQ ID NO: 389968 - RNA, 19 nt, Homo sapiens
uaacagagcauaucaaagg

SEQ ID NO: 389969 - RNA, 19 nt, Homo sapiens
caaagaaucaacagaagaa

SEQ ID NO: 389970 - RNA, 19 nt, Homo sapiens
ccaaauacagaaagcaaua

SEQ ID NO: 389971 - RNA, 19 nt, Homo sapiens
cugguuaaauggaaacuua

SEQ ID NO: 389972 - RNA, 19 nt, Homo sapiens
ggaacaugaugaacauaau

SEQ ID NO: 389973 - RNA, 19 nt, Homo sapiens
gaagaagcaaggcaugaaa

SEQ ID NO: 389974 - RNA, 19 nt, Homo sapiens
ggaagaagcuguguuaacc

SEQ ID NO: 389975 - RNA, 19 nt, Homo sapiens
caacaacuccaaauacaga

SEQ ID NO: 389976 - RNA, 19 nt, Homo sapiens
caacauaauucacuuucca

SEQ ID NO: 389977 - RNA, 19 nt, Homo sapiens
aaaauaagcucaugagaug

SEQ ID NO: 389978 - RNA, 19 nt, Homo sapiens
aaacauuacucaugaccuu

SEQ ID NO: 389979 - RNA, 19 nt, Homo sapiens
acacacacauaccuucuuu

SEQ ID NO: 389980 - RNA, 19 nt, Homo sapiens
cuacuagucuuccuguuga

SEQ ID NO: 389981 - RNA, 19 nt, Homo sapiens
uauaacaucuguggaagaa

SEQ ID NO: 389982 - RNA, 19 nt, Homo sapiens
gaaaccaugucuauguaca

SEQ ID NO: 389983 - RNA, 19 nt, Homo sapiens
aagaaaccaugucuaugua

SEQ ID NO: 389984 - RNA, 19 nt, Homo sapiens
caaguuuguucaucaagaa

SEQ ID NO: 389985 - RNA, 19 nt, Homo sapiens
aagaaguccuggaugauaa

SEQ ID NO: 389986 - RNA, 19 nt, Homo sapiens
uggcaagcuuuguauauaa

SEQ ID NO: 389987 - RNA, 19 nt, Homo sapiens
gaaaaugaaugcuugacuu

SEQ ID NO: 389988 - RNA, 19 nt, Homo sapiens
ugacugcuguuauuaccua

SEQ ID NO: 389989 - RNA, 19 nt, Homo sapiens
gaaauuucagugucaacua

SEQ ID NO: 389990 - RNA, 19 nt, Homo sapiens
gaaaaggaaucacguuuag

SEQ ID NO: 389991 - RNA, 19 nt, Homo sapiens
gauuugggauguuuacgaa

SEQ ID NO: 389992 - RNA, 19 nt, Homo sapiens
gagaugaaaggaauacauu

SEQ ID NO: 389993 - RNA, 19 nt, Homo sapiens
gaauaaguuugcuccuuca

SEQ ID NO: 389994 - RNA, 19 nt, Homo sapiens
ggcaauugcuguagagaau

SEQ ID NO: 389995 - RNA, 19 nt, Homo sapiens
uaauguacguguagaugaa

SEQ ID NO: 389996 - RNA, 19 nt, Homo sapiens
gagaaaugaugauucacau

SEQ ID NO: 389997 - RNA, 19 nt, Homo sapiens
caggugggauuaauucuga

SEQ ID NO: 389998 - RNA, 19 nt, Homo sapiens
gaaagacacuugagaauuu

SEQ ID NO: 389999 - RNA, 19 nt, Homo sapiens
ggagaaagaagaugaauua

SEQ ID NO: 390000 - RNA, 19 nt, Homo sapiens
gaaucaagaucuuaaguga

SEQ ID NO: 390001 - RNA, 19 nt, Homo sapiens
gaucuuaagugaagccuuu

SEQ ID NO: 390002 - RNA, 19 nt, Homo sapiens
cuaaugagcugcaccagaa

SEQ ID NO: 390003 - RNA, 19 nt, Homo sapiens
gaauaacucugcagugaca

SEQ ID NO: 390004 - RNA, 19 nt, Homo sapiens
guacacaacucacauccuu

SEQ ID NO: 390005 - RNA, 19 nt, Homo sapiens
caacucacauccuucauau

SEQ ID NO: 390006 - RNA, 19 nt, Homo sapiens
gaaaaguacuaucggaaua

SEQ ID NO: 390007 - RNA, 19 nt, Homo sapiens
caacaaugauggucagaau

SEQ ID NO: 390008 - RNA, 19 nt, Homo sapiens
ugacagaauuugaaguuug

SEQ ID NO: 390009 - RNA, 19 nt, Homo sapiens
gaacuuggccucuuaucga

SEQ ID NO: 390010 - RNA, 19 nt, Homo sapiens
gugcauaaauucauucugu

SEQ ID NO: 390011 - RNA, 19 nt, Homo sapiens
aaauggaugugacuuguuu

SEQ ID NO: 390012 - RNA, 19 nt, Homo sapiens
ggaaagcuguguuaauggu

SEQ ID NO: 390013 - RNA, 19 nt, Homo sapiens
acaaugauggucagaauua

SEQ ID NO: 390014 - RNA, 19 nt, Homo sapiens
gaaugugggugguauugga

SEQ ID NO: 390015 - RNA, 19 nt, Homo sapiens
uauugaaggugacucauuu

SEQ ID NO: 390016 - RNA, 19 nt, Homo sapiens
cggaauaacucugcaguga

SEQ ID NO: 390017 - RNA, 19 nt, Homo sapiens
caccagacgucuccuaaga

SEQ ID NO: 390018 - RNA, 19 nt, Homo sapiens
agugauaccuucucauuug

SEQ ID NO: 390019 - RNA, 19 nt, Homo sapiens
gcacagauagugauaccuu

SEQ ID NO: 390020 - RNA, 19 nt, Homo sapiens
caagaagcgcguuguguuu

SEQ ID NO: 390021 - RNA, 19 nt, Homo sapiens
aaagauccauucuacguau

SEQ ID NO: 390022 - RNA, 19 nt, Homo sapiens
uaacuggucuugacuuguc

SEQ ID NO: 390023 - RNA, 19 nt, Homo sapiens
guccugauguuauaaguga

SEQ ID NO: 390024 - RNA, 19 nt, Homo sapiens
uggagaacuuggccucuua

SEQ ID NO: 390025 - RNA, 19 nt, Homo sapiens
cgugggaucugcaguuuga

SEQ ID NO: 390026 - RNA, 19 nt, Homo sapiens
ucugguaacucauggguuu

SEQ ID NO: 390027 - RNA, 19 nt, Homo sapiens
uagaaugcuugguauagaa

SEQ ID NO: 390028 - RNA, 19 nt, Homo sapiens
gaauuucaacgacgacauu

SEQ ID NO: 390029 - RNA, 19 nt, Homo sapiens
acccaucccuugccuauuu

SEQ ID NO: 390030 - RNA, 19 nt, Homo sapiens
ccacguccuuugacaaguu

SEQ ID NO: 390031 - RNA, 19 nt, Homo sapiens
ugauaucuccucugccuua

SEQ ID NO: 390032 - RNA, 19 nt, Homo sapiens
caucauuaauggcuaacaa

SEQ ID NO: 390033 - RNA, 19 nt, Homo sapiens
uccacuagcuuucauguug

SEQ ID NO: 390034 - RNA, 19 nt, Homo sapiens
aaagaaagacacuugagaa

SEQ ID NO: 390035 - RNA, 19 nt, Homo sapiens
ggagccacuuucagaagaa

SEQ ID NO: 390036 - RNA, 19 nt, Homo sapiens
ccagaaaacugucaucguu

SEQ ID NO: 390037 - RNA, 19 nt, Homo sapiens
aggcauuccuccugcaaua

SEQ ID NO: 390038 - RNA, 19 nt, Homo sapiens
caacugagcagaaaauuga

SEQ ID NO: 390039 - RNA, 19 nt, Homo sapiens
caaccgauuacuuaaguuu

SEQ ID NO: 390040 - RNA, 19 nt, Homo sapiens
ccaagaagcgcguuguguu

SEQ ID NO: 390041 - RNA, 19 nt, Homo sapiens
cugaaaucaugucucaaua

SEQ ID NO: 390042 - RNA, 19 nt, Homo sapiens
gacagaauuugaaguuugg

SEQ ID NO: 390043 - RNA, 19 nt, Homo sapiens
ugagagguguuacgagaau

SEQ ID NO: 390044 - RNA, 19 nt, Homo sapiens
ucuguaggaucuuaagaaa

SEQ ID NO: 390045 - RNA, 19 nt, Homo sapiens
guuauagaaugcuugguau

SEQ ID NO: 390046 - RNA, 19 nt, Homo sapiens
caauuuggcuuugaaggau

SEQ ID NO: 390047 - RNA, 19 nt, Homo sapiens
agaugaugcuacccaauuu

SEQ ID NO: 390048 - RNA, 19 nt, Homo sapiens
guucagauccguaucacuu

SEQ ID NO: 390049 - RNA, 19 nt, Homo sapiens
gaagugcucacacaaccaa

SEQ ID NO: 390050 - RNA, 19 nt, Homo sapiens
uggcuagcauccauacuuu

SEQ ID NO: 390051 - RNA, 19 nt, Homo sapiens
caccaccugugaagaguuu

SEQ ID NO: 390052 - RNA, 19 nt, Homo sapiens
ccgccucucugccuaauga

SEQ ID NO: 390053 - RNA, 19 nt, Homo sapiens
gaaagcuguguuaauggua

SEQ ID NO: 390054 - RNA, 19 nt, Homo sapiens
uaacccaaauaucugaaug

SEQ ID NO: 390055 - RNA, 19 nt, Homo sapiens
ugucaucguuuaacccaaa

SEQ ID NO: 390056 - RNA, 19 nt, Homo sapiens
cagaugaugcuacccaauu

SEQ ID NO: 390057 - RNA, 19 nt, Homo sapiens
caauguaacuggucuugac

SEQ ID NO: 390058 - RNA, 19 nt, Homo sapiens
gauaucuccucugccuuaa

SEQ ID NO: 390059 - RNA, 19 nt, Homo sapiens
ucuuggaccuuaaugauau

SEQ ID NO: 390060 - RNA, 19 nt, Homo sapiens
acacuaggauucucaaugc

SEQ ID NO: 390061 - RNA, 19 nt, Homo sapiens
uaagaugguccacucugua

SEQ ID NO: 390062 - RNA, 19 nt, Homo sapiens
gauggaaagcuguguuaau

SEQ ID NO: 390063 - RNA, 19 nt, Homo sapiens
acucacauccuucauauug

SEQ ID NO: 390064 - RNA, 19 nt, Homo sapiens
ggcuuggguucuuguuaua

SEQ ID NO: 390065 - RNA, 19 nt, Homo sapiens
uaagacagaguuagaguca

SEQ ID NO: 390066 - RNA, 19 nt, Homo sapiens
gccuucaaccgauuacuua

SEQ ID NO: 390067 - RNA, 19 nt, Homo sapiens
ucacugcgauccaugucuu

SEQ ID NO: 390068 - RNA, 19 nt, Homo sapiens
ugagaccguugucagugua

SEQ ID NO: 390069 - RNA, 19 nt, Homo sapiens
agaaagacacuugagaauu

SEQ ID NO: 390070 - RNA, 19 nt, Homo sapiens
ucaguagguuuagauuuga

SEQ ID NO: 390071 - RNA, 19 nt, Homo sapiens
gaguuagagucaacaaucu

SEQ ID NO: 390072 - RNA, 19 nt, Homo sapiens
uuacgagaaugcaguuaau

SEQ ID NO: 390073 - RNA, 19 nt, Homo sapiens
ucugaauggucaucuggua

SEQ ID NO: 390074 - RNA, 19 nt, Homo sapiens
gagaaaagcuaaauaaccu

SEQ ID NO: 390075 - RNA, 19 nt, Homo sapiens
ggaggucugaucauuguug

SEQ ID NO: 390076 - RNA, 19 nt, Homo sapiens
auggaaagcuguguuaaug

SEQ ID NO: 390077 - RNA, 19 nt, Homo sapiens
aauuauagcuccggagaau

SEQ ID NO: 390078 - RNA, 19 nt, Homo sapiens
aaagggcucugaagcucaa

SEQ ID NO: 390079 - RNA, 19 nt, Homo sapiens
gugauggaaagcuguguua

SEQ ID NO: 390080 - RNA, 19 nt, Homo sapiens
gacgacauuuugugaauaa

SEQ ID NO: 390081 - RNA, 19 nt, Homo sapiens
uuugaucucuuggaccuua

SEQ ID NO: 390082 - RNA, 19 nt, Homo sapiens
gugacagaauuugaaguuu

SEQ ID NO: 390083 - RNA, 19 nt, Homo sapiens
ggaugugacuuguuuugaa

SEQ ID NO: 390084 - RNA, 19 nt, Homo sapiens
caacccaucccuugccuau

SEQ ID NO: 390085 - RNA, 19 nt, Homo sapiens
gaucauuguugguggaaaa

SEQ ID NO: 390086 - RNA, 19 nt, Homo sapiens
gauguggccaugaggcuuu

SEQ ID NO: 390087 - RNA, 19 nt, Homo sapiens
caaugauggucagaauuau

SEQ ID NO: 390088 - RNA, 19 nt, Homo sapiens
gcauaaauucauucuguag

SEQ ID NO: 390089 - RNA, 19 nt, Homo sapiens
ccaguaccuugcacauaga

SEQ ID NO: 390090 - RNA, 19 nt, Homo sapiens
uccaguaccuugcacauag

SEQ ID NO: 390091 - RNA, 19 nt, Homo sapiens
acaacucacauccuucaua

SEQ ID NO: 390092 - RNA, 19 nt, Homo sapiens
uaagugaagccuuucuguu

SEQ ID NO: 390093 - RNA, 19 nt, Homo sapiens
aaagcuguguuaaugguau

SEQ ID NO: 390094 - RNA, 19 nt, Homo sapiens
aaagccaaaucacagaaug

SEQ ID NO: 390095 - RNA, 19 nt, Homo sapiens
ugggaggucugaucauugu

SEQ ID NO: 390096 - RNA, 19 nt, Homo sapiens
ggagugggaggucugauca

SEQ ID NO: 390097 - RNA, 19 nt, Homo sapiens
aucaguagguuuagauuug

SEQ ID NO: 390098 - RNA, 19 nt, Homo sapiens
ucaggaauauucucgauuu

SEQ ID NO: 390099 - RNA, 19 nt, Homo sapiens
caaguccucugaccuaauu

SEQ ID NO: 390100 - RNA, 19 nt, Homo sapiens
gaaugugucucuguaaaca

SEQ ID NO: 390101 - RNA, 19 nt, Homo sapiens
caggaauauucucgauuua

SEQ ID NO: 390102 - RNA, 19 nt, Homo sapiens
gcugggcucucacaucuau

SEQ ID NO: 390103 - RNA, 19 nt, Homo sapiens
cauccugucuucuacuuga

SEQ ID NO: 390104 - RNA, 19 nt, Homo sapiens
cggaggaccuggacaagga

SEQ ID NO: 390105 - RNA, 19 nt, Homo sapiens
cgaguuguguaaugaguug

SEQ ID NO: 390106 - RNA, 19 nt, Homo sapiens
ucacaucuaucugguuguu

SEQ ID NO: 390107 - RNA, 19 nt, Homo sapiens
ggagcaagguggcgaacca

SEQ ID NO: 390108 - RNA, 19 nt, Homo sapiens
gcauguguccugaaugugu

SEQ ID NO: 390109 - RNA, 19 nt, Homo sapiens
cugaaugugucucuguaaa

SEQ ID NO: 390110 - RNA, 19 nt, Homo sapiens
ugaaacgucugagucacuu

SEQ ID NO: 390111 - RNA, 19 nt, Homo sapiens
cagauacgguggacucucu

SEQ ID NO: 390112 - RNA, 19 nt, Homo sapiens
gcugugcgcuacacuuucu

SEQ ID NO: 390113 - RNA, 19 nt, Homo sapiens
uggcacaggucaagguguu

SEQ ID NO: 390114 - RNA, 19 nt, Homo sapiens
ucucaucccugccucaucu

SEQ ID NO: 390115 - RNA, 19 nt, Homo sapiens
uugcauguguccugaaugu

SEQ ID NO: 390116 - RNA, 19 nt, Homo sapiens
ccagaaggccgaguugugu

SEQ ID NO: 390117 - RNA, 19 nt, Homo sapiens
caccuucggcuuuccagua

SEQ ID NO: 390118 - RNA, 19 nt, Homo sapiens
gcaacguggccuucgagaa

SEQ ID NO: 390119 - RNA, 19 nt, Homo sapiens
gucgggaggucgucucuca

SEQ ID NO: 390120 - RNA, 19 nt, Homo sapiens
gagacuacagccucacaug

SEQ ID NO: 390121 - RNA, 19 nt, Homo sapiens
ccucaggaauauucucgau

SEQ ID NO: 390122 - RNA, 19 nt, Homo sapiens
agaaggccgaguuguguaa

SEQ ID NO: 390123 - RNA, 19 nt, Homo sapiens
cagaaggccgaguugugua

SEQ ID NO: 390124 - RNA, 19 nt, Homo sapiens
cugcugggcucucacaucu

SEQ ID NO: 390125 - RNA, 19 nt, Homo sapiens
caacgaccaccgagacuac

SEQ ID NO: 390126 - RNA, 19 nt, Homo sapiens
ugucgcggcucgcaaucaa

SEQ ID NO: 390127 - RNA, 19 nt, Homo sapiens
gccagaaggccgaguugug

SEQ ID NO: 390128 - RNA, 19 nt, Homo sapiens
cugagucacuugucuaaaa

SEQ ID NO: 390129 - RNA, 19 nt, Homo sapiens
ccacucuuacaauuucuuu

SEQ ID NO: 390130 - RNA, 19 nt, Homo sapiens
gcucggaccuuggcaucag

SEQ ID NO: 390131 - RNA, 19 nt, Homo sapiens
gcacaggucaagguguuca

SEQ ID NO: 390132 - RNA, 19 nt, Homo sapiens
guacggugcgcgugugcaa

SEQ ID NO: 390133 - RNA, 19 nt, Homo sapiens
gccuggagcgugucacuug

SEQ ID NO: 390134 - RNA, 19 nt, Homo sapiens
aggccgaguuguguaauga

SEQ ID NO: 390135 - RNA, 19 nt, Homo sapiens
gacuacagccucacauguc

SEQ ID NO: 390136 - RNA, 19 nt, Homo sapiens
gcaguggcccauccugucu

SEQ ID NO: 390137 - RNA, 19 nt, Homo sapiens
caaccacgcgcugcacaug

SEQ ID NO: 390138 - RNA, 19 nt, Homo sapiens
acaucuaucugguuguucu

SEQ ID NO: 390139 - RNA, 19 nt, Homo sapiens
gagcuggauccacuucauc

SEQ ID NO: 390140 - RNA, 19 nt, Homo sapiens
uccaaguccucugaccuaa

SEQ ID NO: 390141 - RNA, 19 nt, Homo sapiens
uggcugugcgcuacacuuu

SEQ ID NO: 390142 - RNA, 19 nt, Homo sapiens
gccgaguuguguaaugagu

SEQ ID NO: 390143 - RNA, 19 nt, Homo sapiens
agacuacagccucacaugu

SEQ ID NO: 390144 - RNA, 19 nt, Homo sapiens
uccugaaugugucucugua

SEQ ID NO: 390145 - RNA, 19 nt, Homo sapiens
uaacagagcugcaagaguu

SEQ ID NO: 390146 - RNA, 19 nt, Homo sapiens
uaacagagcuggagauucu

SEQ ID NO: 390147 - RNA, 19 nt, Homo sapiens
ggacagagaugcagaggau

SEQ ID NO: 390148 - RNA, 19 nt, Homo sapiens
uaaccaaccuggagaguuu

SEQ ID NO: 390149 - RNA, 19 nt, Homo sapiens
gaaaauaucagccaucuaa

SEQ ID NO: 390150 - RNA, 19 nt, Homo sapiens
gacauugcaucaaauagaa

SEQ ID NO: 390151 - RNA, 19 nt, Homo sapiens
ggacauugcaucaaauaga

SEQ ID NO: 390152 - RNA, 19 nt, Homo sapiens
gauuugagguacugaagaa

SEQ ID NO: 390153 - RNA, 19 nt, Homo sapiens
caacuuacaucaacuacag

SEQ ID NO: 390154 - RNA, 19 nt, Homo sapiens
cagaugccguugcaauuaa

SEQ ID NO: 390155 - RNA, 19 nt, Homo sapiens
gaacgacaaucuccuugag

SEQ ID NO: 390156 - RNA, 19 nt, Homo sapiens
cagaggauguugauuugaa

SEQ ID NO: 390157 - RNA, 19 nt, Homo sapiens
gcaaccggcugaccaagau

SEQ ID NO: 390158 - RNA, 19 nt, Homo sapiens
uucgagagcuggaucuuua

SEQ ID NO: 390159 - RNA, 19 nt, Homo sapiens
gaaaauaucgacaccuuaa

SEQ ID NO: 390160 - RNA, 19 nt, Homo sapiens
caaacccaauggcaauaaa

SEQ ID NO: 390161 - RNA, 19 nt, Homo sapiens
uagggaagauugaaggauu

SEQ ID NO: 390162 - RNA, 19 nt, Homo sapiens
ggaggaggacccagaagaa

SEQ ID NO: 390163 - RNA, 19 nt, Homo sapiens
ggagaacaauaacaaacuc

SEQ ID NO: 390164 - RNA, 19 nt, Homo sapiens
gagcuggagauucuagaua

SEQ ID NO: 390165 - RNA, 19 nt, Homo sapiens
ugaagaaagugaagacucu

SEQ ID NO: 390166 - RNA, 19 nt, Homo sapiens
ucagaugccguugcaauua

SEQ ID NO: 390167 - RNA, 19 nt, Homo sapiens
ugaagaauccggcgaugaa

SEQ ID NO: 390168 - RNA, 19 nt, Homo sapiens
gauugaaggauuugaggua

SEQ ID NO: 390169 - RNA, 19 nt, Homo sapiens
ggaggacccagaagaagaa

SEQ ID NO: 390170 - RNA, 19 nt, Homo sapiens
ggucgucacuauaucaaca

SEQ ID NO: 390171 - RNA, 19 nt, Homo sapiens
caaguugacacgacugaaa

SEQ ID NO: 390172 - RNA, 19 nt, Homo sapiens
gcuggagauucuagauauu

SEQ ID NO: 390173 - RNA, 19 nt, Homo sapiens
ccaucaaccuggacagaga

SEQ ID NO: 390174 - RNA, 19 nt, Homo sapiens
gaagaagggaagaaacaca

SEQ ID NO: 390175 - RNA, 19 nt, Homo sapiens
uaaaggcacugacgauagc

SEQ ID NO: 390176 - RNA, 19 nt, Homo sapiens
acaaccagaucaagaagau

SEQ ID NO: 390177 - RNA, 19 nt, Homo sapiens
cugcaagaguucuggauga

SEQ ID NO: 390178 - RNA, 19 nt, Homo sapiens
ucacaaacccaauggcaau

SEQ ID NO: 390179 - RNA, 19 nt, Homo sapiens
ggucgagucugaagaaucc

SEQ ID NO: 390180 - RNA, 19 nt, Homo sapiens
uuacuaaacuucagaaccu

SEQ ID NO: 390181 - RNA, 19 nt, Homo sapiens
caaccuggagaguuuguuu

SEQ ID NO: 390182 - RNA, 19 nt, Homo sapiens
ugcagaggauguugauuug

SEQ ID NO: 390183 - RNA, 19 nt, Homo sapiens
caauaaaggcacugacgau

SEQ ID NO: 390184 - RNA, 19 nt, Homo sapiens
gucacuauaucaacaguca

SEQ ID NO: 390185 - RNA, 19 nt, Homo sapiens
cuucuuggcuccucaugug

SEQ ID NO: 390186 - RNA, 19 nt, Homo sapiens
gaugaacgacaaucuccuu

SEQ ID NO: 390187 - RNA, 19 nt, Homo sapiens
gaagauugaaggauuugag

SEQ ID NO: 390188 - RNA, 19 nt, Homo sapiens
aauaaaggcacugacgaua

SEQ ID NO: 390189 - RNA, 19 nt, Homo sapiens
gggaggaggacccagaaga

SEQ ID NO: 390190 - RNA, 19 nt, Homo sapiens
cuccugaggucgucacuau

SEQ ID NO: 390191 - RNA, 19 nt, Homo sapiens
uguuggacauugcaucaaa

SEQ ID NO: 390192 - RNA, 19 nt, Homo sapiens
ucgagggccuggagaacaa

SEQ ID NO: 390193 - RNA, 19 nt, Homo sapiens
uggaggagcuacagagucu

SEQ ID NO: 390194 - RNA, 19 nt, Homo sapiens
gcuaacagagcuggagauu

SEQ ID NO: 390195 - RNA, 19 nt, Homo sapiens
agggaagauugaaggauuu

SEQ ID NO: 390196 - RNA, 19 nt, Homo sapiens
aauuaaaucuugccacacu

SEQ ID NO: 390197 - RNA, 19 nt, Homo sapiens
gagaugcagaggauguuga

SEQ ID NO: 390198 - RNA, 19 nt, Homo sapiens
ccguugcaauuaaaucuug

SEQ ID NO: 390199 - RNA, 19 nt, Homo sapiens
gaucgagggucugcagaac

SEQ ID NO: 390200 - RNA, 19 nt, Homo sapiens
acaggcgggucgagucuga

SEQ ID NO: 390201 - RNA, 19 nt, Homo sapiens
ugaaggauuugagguacug

SEQ ID NO: 390202 - RNA, 19 nt, Homo sapiens
augcagaggauguugauuu

SEQ ID NO: 390203 - RNA, 19 nt, Homo sapiens
ccugaggucgucacuauau

SEQ ID NO: 390204 - RNA, 19 nt, Homo sapiens
ggacccagaagaagaacau

SEQ ID NO: 390205 - RNA, 19 nt, Homo sapiens
gcagaggauguugauuuga

SEQ ID NO: 390206 - RNA, 19 nt, Homo sapiens
gugaacagagccugaagga

SEQ ID NO: 390207 - RNA, 19 nt, Homo sapiens
gagaacaauaacaaacuca

SEQ ID NO: 390208 - RNA, 19 nt, Homo sapiens
cgaagggguugacaaguug

SEQ ID NO: 390209 - RNA, 19 nt, Homo sapiens
ggauuugagguacugaaga

SEQ ID NO: 390210 - RNA, 19 nt, Homo sapiens
agaauccggcgaugaagaa

SEQ ID NO: 390211 - RNA, 19 nt, Homo sapiens
aaauaucagccaucuaaca

SEQ ID NO: 390212 - RNA, 19 nt, Homo sapiens
ucuucuuggucaacaauaa

SEQ ID NO: 390213 - RNA, 19 nt, Homo sapiens
gaggagcuacagagucuuc

SEQ ID NO: 390214 - RNA, 19 nt, Homo sapiens
uaaaugcauugagaaucug

SEQ ID NO: 390215 - RNA, 19 nt, Homo sapiens
gcgggucgagucugaagaa

SEQ ID NO: 390216 - RNA, 19 nt, Homo sapiens
caucguggccgaccucagu

SEQ ID NO: 390217 - RNA, 19 nt, Homo sapiens
ugcaagaguucuggaugaa

SEQ ID NO: 390218 - RNA, 19 nt, Homo sapiens
aauaacaaacucacgaugu

SEQ ID NO: 390219 - RNA, 19 nt, Homo sapiens
uggagauucuagauauuuc

SEQ ID NO: 390220 - RNA, 19 nt, Homo sapiens
agaggauguugauuugaau

SEQ ID NO: 390221 - RNA, 19 nt, Homo sapiens
agaugccguugcaauuaaa

SEQ ID NO: 390222 - RNA, 19 nt, Homo sapiens
guuggacauugcaucaaau

SEQ ID NO: 390223 - RNA, 19 nt, Homo sapiens
ugcgggagcuguaccuuag

SEQ ID NO: 390224 - RNA, 19 nt, Homo sapiens
ugacaguccucaguaugca

SEQ ID NO: 390225 - RNA, 19 nt, Homo sapiens
gacaaguugacacgacuga

SEQ ID NO: 390226 - RNA, 19 nt, Homo sapiens
aaccagaucaagaagauug

SEQ ID NO: 390227 - RNA, 19 nt, Homo sapiens
gagguacugaagaaaguga

SEQ ID NO: 390228 - RNA, 19 nt, Homo sapiens
acaaacccaauggcaauaa

SEQ ID NO: 390229 - RNA, 19 nt, Homo sapiens
ugaacgacaaucuccuuga

SEQ ID NO: 390230 - RNA, 19 nt, Homo sapiens
auugagaacuuaagcaacu

SEQ ID NO: 390231 - RNA, 19 nt, Homo sapiens
cgaugaagaagggaagaaa

SEQ ID NO: 390232 - RNA, 19 nt, Homo sapiens
agcuggagauucuagauau

SEQ ID NO: 390233 - RNA, 19 nt, Homo sapiens
gcaacagucgcaggagaug

SEQ ID NO: 390234 - RNA, 19 nt, Homo sapiens
gacaaccagaucaagaaga

SEQ ID NO: 390235 - RNA, 19 nt, Homo sapiens
guacugaagaaagugaaga

SEQ ID NO: 390236 - RNA, 19 nt, Homo sapiens
gaagaauccggcgaugaag

SEQ ID NO: 390237 - RNA, 19 nt, Homo sapiens
caacagucacaaacccaau

SEQ ID NO: 390238 - RNA, 19 nt, Homo sapiens
aaacucuucuuggucaaca

SEQ ID NO: 390239 - RNA, 19 nt, Homo sapiens
ucgaagggguugacaaguu

SEQ ID NO: 390240 - RNA, 19 nt, Homo sapiens
cacaaacccaauggcaaua

SEQ ID NO: 390241 - RNA, 19 nt, Homo sapiens
gaggaggacccagaagaag

SEQ ID NO: 390242 - RNA, 19 nt, Homo sapiens
gcaacuuacaucaacuaca

SEQ ID NO: 390243 - RNA, 19 nt, Homo sapiens
aagcaacuuacaucaacua

SEQ ID NO: 390244 - RNA, 19 nt, Homo sapiens
aggagaugauggagguuga

SEQ ID NO: 390245 - RNA, 19 nt, Homo sapiens
caaaggauaugaccaguug

SEQ ID NO: 390246 - RNA, 19 nt, Homo sapiens
ugauagaucucaacaguaa

SEQ ID NO: 390247 - RNA, 19 nt, Homo sapiens
agacacagguuuauaguuu

SEQ ID NO: 390248 - RNA, 19 nt, Homo sapiens
gaagagaguuuuccugaua

SEQ ID NO: 390249 - RNA, 19 nt, Homo sapiens
gcucaaaggcgcucacuua

SEQ ID NO: 390250 - RNA, 19 nt, Homo sapiens
ggaaguaacuggugucucu

SEQ ID NO: 390251 - RNA, 19 nt, Homo sapiens
gagaaacccugauuugugu

SEQ ID NO: 390252 - RNA, 19 nt, Homo sapiens
gcagaaggguugccauaga

SEQ ID NO: 390253 - RNA, 19 nt, Homo sapiens
guacuguccucuacucuaa

SEQ ID NO: 390254 - RNA, 19 nt, Homo sapiens
aagcugagguuuaaacuaa

SEQ ID NO: 390255 - RNA, 19 nt, Homo sapiens
uaaaugaacccaagaagaa

SEQ ID NO: 390256 - RNA, 19 nt, Homo sapiens
caaaggagacaaacuaauu

SEQ ID NO: 390257 - RNA, 19 nt, Homo sapiens
gcaguuaagcugagguuua

SEQ ID NO: 390258 - RNA, 19 nt, Homo sapiens
guccagagccuaauuuaua

SEQ ID NO: 390259 - RNA, 19 nt, Homo sapiens
ggacuugacuccuguugug

SEQ ID NO: 390260 - RNA, 19 nt, Homo sapiens
gagacaaacuaauugagaa

SEQ ID NO: 390261 - RNA, 19 nt, Homo sapiens
caauugagagcucuuguua

SEQ ID NO: 390262 - RNA, 19 nt, Homo sapiens
ggagaaacccugauuugug

SEQ ID NO: 390263 - RNA, 19 nt, Homo sapiens
aaacauaggagacaaaguu

SEQ ID NO: 390264 - RNA, 19 nt, Homo sapiens
cugcugaaguuucuuauuu

SEQ ID NO: 390265 - RNA, 19 nt, Homo sapiens
ggagggaaaucuggacauu

SEQ ID NO: 390266 - RNA, 19 nt, Homo sapiens
ugagagcucuuguuauuca

SEQ ID NO: 390267 - RNA, 19 nt, Homo sapiens
gacuagaccuggcuaacaa

SEQ ID NO: 390268 - RNA, 19 nt, Homo sapiens
gcuuagaauucugcaguua

SEQ ID NO: 390269 - RNA, 19 nt, Homo sapiens
caguaaaccugacagaguu

SEQ ID NO: 390270 - RNA, 19 nt, Homo sapiens
acagagauuuguacauuug

SEQ ID NO: 390271 - RNA, 19 nt, Homo sapiens
auucagagcuccaagacua

SEQ ID NO: 390272 - RNA, 19 nt, Homo sapiens
ggagacaaacuaauugaga

SEQ ID NO: 390273 - RNA, 19 nt, Homo sapiens
auugagagcucuuguuauu

SEQ ID NO: 390274 - RNA, 19 nt, Homo sapiens
gaagaaauaugcaaaagag

SEQ ID NO: 390275 - RNA, 19 nt, Homo sapiens
ugaaauagcccauaaagac

SEQ ID NO: 390276 - RNA, 19 nt, Homo sapiens
gguaucgucuuucagaaug

SEQ ID NO: 390277 - RNA, 19 nt, Homo sapiens
guaaaugaacccaagaaga

SEQ ID NO: 390278 - RNA, 19 nt, Homo sapiens
gaacuuacgcccaacucuu

SEQ ID NO: 390279 - RNA, 19 nt, Homo sapiens
caaauaaagaugcccuaaa

SEQ ID NO: 390280 - RNA, 19 nt, Homo sapiens
cuaaugaacuagggagaaa

SEQ ID NO: 390281 - RNA, 19 nt, Homo sapiens
ggaaaucuggacauucaaa

SEQ ID NO: 390282 - RNA, 19 nt, Homo sapiens
aagcggauuucuacccuua

SEQ ID NO: 390283 - RNA, 19 nt, Homo sapiens
auaaagaugcccuaaauga

SEQ ID NO: 390284 - RNA, 19 nt, Homo sapiens
uaacaaacauaggagacaa

SEQ ID NO: 390285 - RNA, 19 nt, Homo sapiens
cuauaacccugaagcugua

SEQ ID NO: 390286 - RNA, 19 nt, Homo sapiens
ccucuacucuaaggcauua

SEQ ID NO: 390287 - RNA, 19 nt, Homo sapiens
ggguugaaauagcccauaa

SEQ ID NO: 390288 - RNA, 19 nt, Homo sapiens
gaccaaagaggaagaggaa

SEQ ID NO: 390289 - RNA, 19 nt, Homo sapiens
gagacaaaguuaggaaaca

SEQ ID NO: 390290 - RNA, 19 nt, Homo sapiens
ugccauagaucucaguuug

SEQ ID NO: 390291 - RNA, 19 nt, Homo sapiens
ccacaagcaucugaagaga

SEQ ID NO: 390292 - RNA, 19 nt, Homo sapiens
ggaaaagauuuguuuggaa

SEQ ID NO: 390293 - RNA, 19 nt, Homo sapiens
cagaaggguugccauagau

SEQ ID NO: 390294 - RNA, 19 nt, Homo sapiens
acacuugcauuguagagaa

SEQ ID NO: 390295 - RNA, 19 nt, Homo sapiens
ccugauagaucucaacagu

SEQ ID NO: 390296 - RNA, 19 nt, Homo sapiens
gagaaacugauuauugaug

SEQ ID NO: 390297 - RNA, 19 nt, Homo sapiens
gcugugaauuugucucuca

SEQ ID NO: 390298 - RNA, 19 nt, Homo sapiens
uaggaaacauugauacaag

SEQ ID NO: 390299 - RNA, 19 nt, Homo sapiens
gcucuagccucccgcuguu

SEQ ID NO: 390300 - RNA, 19 nt, Homo sapiens
uagcuaggcuuuucucuuu

SEQ ID NO: 390301 - RNA, 19 nt, Homo sapiens
ccauagaucucaguuugau

SEQ ID NO: 390302 - RNA, 19 nt, Homo sapiens
uccacuaccuccuuucuuu

SEQ ID NO: 390303 - RNA, 19 nt, Homo sapiens
cuuccuugcugauuugaua

SEQ ID NO: 390304 - RNA, 19 nt, Homo sapiens
acaccuuccuugcugauuu

SEQ ID NO: 390305 - RNA, 19 nt, Homo sapiens
cauguaauaugacaauugg

SEQ ID NO: 390306 - RNA, 19 nt, Homo sapiens
agggaaaucuggacauuca

SEQ ID NO: 390307 - RNA, 19 nt, Homo sapiens
acaagcaucugaagagagu

SEQ ID NO: 390308 - RNA, 19 nt, Homo sapiens
cgucagcagugaacaugaa

SEQ ID NO: 390309 - RNA, 19 nt, Homo sapiens
gcaggcgcaugcagaacuu

SEQ ID NO: 390310 - RNA, 19 nt, Homo sapiens
ccaaagaggaagaggaaga

SEQ ID NO: 390311 - RNA, 19 nt, Homo sapiens
ccacugccaucuggaaaug

SEQ ID NO: 390312 - RNA, 19 nt, Homo sapiens
gaaggcaguuuucaaagga

SEQ ID NO: 390313 - RNA, 19 nt, Homo sapiens
ggugcaggcugugaauuug

SEQ ID NO: 390314 - RNA, 19 nt, Homo sapiens
uuucuacccuuaccauuga

SEQ ID NO: 390315 - RNA, 19 nt, Homo sapiens
ccaagaagaagaaauaugc

SEQ ID NO: 390316 - RNA, 19 nt, Homo sapiens
cccugaagcuguaaaugaa

SEQ ID NO: 390317 - RNA, 19 nt, Homo sapiens
caaacuaauugagaaacug

SEQ ID NO: 390318 - RNA, 19 nt, Homo sapiens
auccagagcuguagagguu

SEQ ID NO: 390319 - RNA, 19 nt, Homo sapiens
gaaacccugauuuguguga

SEQ ID NO: 390320 - RNA, 19 nt, Homo sapiens
gaaacugauuauugaugag

SEQ ID NO: 390321 - RNA, 19 nt, Homo sapiens
gggugcaggcugugaauuu

SEQ ID NO: 390322 - RNA, 19 nt, Homo sapiens
uagcagaaggguugccaua

SEQ ID NO: 390323 - RNA, 19 nt, Homo sapiens
agacugcccuggcucuuuc

SEQ ID NO: 390324 - RNA, 19 nt, Homo sapiens
caaagaggaagaggaagaa

SEQ ID NO: 390325 - RNA, 19 nt, Homo sapiens
guucaacacugcccacaac

SEQ ID NO: 390326 - RNA, 19 nt, Homo sapiens
agucaaaggagacaaacua

SEQ ID NO: 390327 - RNA, 19 nt, Homo sapiens
uccagagccuaauuuauau

SEQ ID NO: 390328 - RNA, 19 nt, Homo sapiens
caccaaacccugcagucua

SEQ ID NO: 390329 - RNA, 19 nt, Homo sapiens
gaucaucaacccagaggau

SEQ ID NO: 390330 - RNA, 19 nt, Homo sapiens
aaagaugcccuaaaugagu

SEQ ID NO: 390331 - RNA, 19 nt, Homo sapiens
ugccauagacacagguuua

SEQ ID NO: 390332 - RNA, 19 nt, Homo sapiens
cauagacacagguuuauag

SEQ ID NO: 390333 - RNA, 19 nt, Homo sapiens
aaaggagacaaacuaauug

SEQ ID NO: 390334 - RNA, 19 nt, Homo sapiens
caaacccugcagucuauaa

SEQ ID NO: 390335 - RNA, 19 nt, Homo sapiens
ggagcaggcgcaugcagaa

SEQ ID NO: 390336 - RNA, 19 nt, Homo sapiens
caacacugcccacaacaag

SEQ ID NO: 390337 - RNA, 19 nt, Homo sapiens
gacaaaguuaggaaacauu

SEQ ID NO: 390338 - RNA, 19 nt, Homo sapiens
gcacuccuccugcugaagu

SEQ ID NO: 390339 - RNA, 19 nt, Homo sapiens
accaaacccugcagucuau

SEQ ID NO: 390340 - RNA, 19 nt, Homo sapiens
caugaacccugcaccaaac

SEQ ID NO: 390341 - RNA, 19 nt, Homo sapiens
gggagaaacccugauuugu

SEQ ID NO: 390342 - RNA, 19 nt, Homo sapiens
ugugugacuuuaccauuga

SEQ ID NO: 390343 - RNA, 19 nt, Homo sapiens
caagcuuuguacagagauu

SEQ ID NO: 390344 - RNA, 19 nt, Homo sapiens
aaaagaaggcuuagaauuc

SEQ ID NO: 390345 - RNA, 19 nt, Homo sapiens
gaaaggagaugagaagaug

SEQ ID NO: 390346 - RNA, 19 nt, Homo sapiens
caaaggauaugaccaguug

SEQ ID NO: 390347 - RNA, 19 nt, Homo sapiens
agacacagguuuauaguuu

SEQ ID NO: 390348 - RNA, 19 nt, Homo sapiens
gaagagaguuuuccugaua

SEQ ID NO: 390349 - RNA, 19 nt, Homo sapiens
ggaaguaacuggugucucu

SEQ ID NO: 390350 - RNA, 19 nt, Homo sapiens
gagaaacccugauuugugu

SEQ ID NO: 390351 - RNA, 19 nt, Homo sapiens
gcagaaggguugccauaga

SEQ ID NO: 390352 - RNA, 19 nt, Homo sapiens
guacuguccucuacucuaa

SEQ ID NO: 390353 - RNA, 19 nt, Homo sapiens
aagcugagguuuaaacuaa

SEQ ID NO: 390354 - RNA, 19 nt, Homo sapiens
uaaaugaacccaagaagaa

SEQ ID NO: 390355 - RNA, 19 nt, Homo sapiens
gaagauggguggagaggau

SEQ ID NO: 390356 - RNA, 19 nt, Homo sapiens
caaaggagacaaacuaauu

SEQ ID NO: 390357 - RNA, 19 nt, Homo sapiens
gcaguuaagcugagguuua

SEQ ID NO: 390358 - RNA, 19 nt, Homo sapiens
guccagagccuaauuuaua

SEQ ID NO: 390359 - RNA, 19 nt, Homo sapiens
ggacuugacuccuguugug

SEQ ID NO: 390360 - RNA, 19 nt, Homo sapiens
gagacaaacuaauugagaa

SEQ ID NO: 390361 - RNA, 19 nt, Homo sapiens
ucacaagccucagcaaauu

SEQ ID NO: 390362 - RNA, 19 nt, Homo sapiens
caauugagagcucuuguua

SEQ ID NO: 390363 - RNA, 19 nt, Homo sapiens
gcgagaagccucagacauu

SEQ ID NO: 390364 - RNA, 19 nt, Homo sapiens
ggagaaacccugauuugug

SEQ ID NO: 390365 - RNA, 19 nt, Homo sapiens
aaacauaggagacaaaguu

SEQ ID NO: 390366 - RNA, 19 nt, Homo sapiens
cugcugaaguuucuuauuu

SEQ ID NO: 390367 - RNA, 19 nt, Homo sapiens
ggagggaaaucuggacauu

SEQ ID NO: 390368 - RNA, 19 nt, Homo sapiens
ugagagcucuuguuauuca

SEQ ID NO: 390369 - RNA, 19 nt, Homo sapiens
gacuagaccuggcuaacaa

SEQ ID NO: 390370 - RNA, 19 nt, Homo sapiens
aaacugagcuugauaaccu

SEQ ID NO: 390371 - RNA, 19 nt, Homo sapiens
gcuuagaauucugcaguua

SEQ ID NO: 390372 - RNA, 19 nt, Homo sapiens
acagagauuuguacauuug

SEQ ID NO: 390373 - RNA, 19 nt, Homo sapiens
auucagagcuccaagacua

SEQ ID NO: 390374 - RNA, 19 nt, Homo sapiens
ggagacaaacuaauugaga

SEQ ID NO: 390375 - RNA, 19 nt, Homo sapiens
ggaggaaacugagcuugau

SEQ ID NO: 390376 - RNA, 19 nt, Homo sapiens
auugagagcucuuguuauu

SEQ ID NO: 390377 - RNA, 19 nt, Homo sapiens
gaagaaauaugcaaaagag

SEQ ID NO: 390378 - RNA, 19 nt, Homo sapiens
ugaaauagcccauaaagac

SEQ ID NO: 390379 - RNA, 19 nt, Homo sapiens
gguaucgucuuucagaaug

SEQ ID NO: 390380 - RNA, 19 nt, Homo sapiens
cgagaagccucagacauug

SEQ ID NO: 390381 - RNA, 19 nt, Homo sapiens
guaaaugaacccaagaaga

SEQ ID NO: 390382 - RNA, 19 nt, Homo sapiens
ugauagaucucaacaguac

SEQ ID NO: 390383 - RNA, 19 nt, Homo sapiens
caaauaaagaugcccuaaa

SEQ ID NO: 390384 - RNA, 19 nt, Homo sapiens
cuaaugaacuagggagaaa

SEQ ID NO: 390385 - RNA, 19 nt, Homo sapiens
ggaaaucuggacauucaaa

SEQ ID NO: 390386 - RNA, 19 nt, Homo sapiens
aagcggauuucuacccuua

SEQ ID NO: 390387 - RNA, 19 nt, Homo sapiens
auaaagaugcccuaaauga

SEQ ID NO: 390388 - RNA, 19 nt, Homo sapiens
uaacaaacauaggagacaa

SEQ ID NO: 390389 - RNA, 19 nt, Homo sapiens
cuauaacccugaagcugua

SEQ ID NO: 390390 - RNA, 19 nt, Homo sapiens
ccucuacucuaaggcauua

SEQ ID NO: 390391 - RNA, 19 nt, Homo sapiens
ggguugaaauagcccauaa

SEQ ID NO: 390392 - RNA, 19 nt, Homo sapiens
gaccaaagaggaagaggaa

SEQ ID NO: 390393 - RNA, 19 nt, Homo sapiens
gagacaaaguuaggaaaca

SEQ ID NO: 390394 - RNA, 19 nt, Homo sapiens
ugccauagaucucaguuug

SEQ ID NO: 390395 - RNA, 19 nt, Homo sapiens
ccacaagcaucugaagaga

SEQ ID NO: 390396 - RNA, 19 nt, Homo sapiens
ggaaaagauuuguuuggaa

SEQ ID NO: 390397 - RNA, 19 nt, Homo sapiens
cagaaggguugccauagau

SEQ ID NO: 390398 - RNA, 19 nt, Homo sapiens
acacuugcauuguagagaa

SEQ ID NO: 390399 - RNA, 19 nt, Homo sapiens
gagaaacugauuauugaug

SEQ ID NO: 390400 - RNA, 19 nt, Homo sapiens
ccugauagaucucaacagu

SEQ ID NO: 390401 - RNA, 19 nt, Homo sapiens
gcugugaauuugucucuca

SEQ ID NO: 390402 - RNA, 19 nt, Homo sapiens
uaggaaacauugauacaag

SEQ ID NO: 390403 - RNA, 19 nt, Homo sapiens
uagcuaggcuuuucucuuu

SEQ ID NO: 390404 - RNA, 19 nt, Homo sapiens
ccauagaucucaguuugau

SEQ ID NO: 390405 - RNA, 19 nt, Homo sapiens
uccacuaccuccuuucuuu

SEQ ID NO: 390406 - RNA, 19 nt, Homo sapiens
cuuccuugcugauuugaua

SEQ ID NO: 390407 - RNA, 19 nt, Homo sapiens
acaccuuccuugcugauuu

SEQ ID NO: 390408 - RNA, 19 nt, Homo sapiens
gcucuagccucccgcuguu

SEQ ID NO: 390409 - RNA, 19 nt, Homo sapiens
cauguaauaugacaauugg

SEQ ID NO: 390410 - RNA, 19 nt, Homo sapiens
agggaaaucuggacauuca

SEQ ID NO: 390411 - RNA, 19 nt, Homo sapiens
uugauaaccugacagaguu

SEQ ID NO: 390412 - RNA, 19 nt, Homo sapiens
acaagcaucugaagagagu

SEQ ID NO: 390413 - RNA, 19 nt, Homo sapiens
cgucagcagugaacaugaa

SEQ ID NO: 390414 - RNA, 19 nt, Homo sapiens
gcaggcgcaugcagaacuu

SEQ ID NO: 390415 - RNA, 19 nt, Homo sapiens
ccaaagaggaagaggaaga

SEQ ID NO: 390416 - RNA, 19 nt, Homo sapiens
ccacugccaucuggaaaug

SEQ ID NO: 390417 - RNA, 19 nt, Homo sapiens
gaaggcaguuuucaaagga

SEQ ID NO: 390418 - RNA, 19 nt, Homo sapiens
gaggaaacugagcuugaua

SEQ ID NO: 390419 - RNA, 19 nt, Homo sapiens
ggugcaggcugugaauuug

SEQ ID NO: 390420 - RNA, 19 nt, Homo sapiens
uuucuacccuuaccauuga

SEQ ID NO: 390421 - RNA, 19 nt, Homo sapiens
caaacuaauugagaaacug

SEQ ID NO: 390422 - RNA, 19 nt, Homo sapiens
ccaagaagaagaaauaugc

SEQ ID NO: 390423 - RNA, 19 nt, Homo sapiens
cccugaagcuguaaaugaa

SEQ ID NO: 390424 - RNA, 19 nt, Homo sapiens
gaaacugauuauugaugag

SEQ ID NO: 390425 - RNA, 19 nt, Homo sapiens
auccagagcuguagagguu

SEQ ID NO: 390426 - RNA, 19 nt, Homo sapiens
gaaacccugauuuguguga

SEQ ID NO: 390427 - RNA, 19 nt, Homo sapiens
gggugcaggcugugaauuu

SEQ ID NO: 390428 - RNA, 19 nt, Homo sapiens
uagcagaaggguugccaua

SEQ ID NO: 390429 - RNA, 19 nt, Homo sapiens
agacugcccuggcucuuuc

SEQ ID NO: 390430 - RNA, 19 nt, Homo sapiens
caaagaggaagaggaagaa

SEQ ID NO: 390431 - RNA, 19 nt, Homo sapiens
guucaacacugcccacaac

SEQ ID NO: 390432 - RNA, 19 nt, Homo sapiens
uccagagccuaauuuauau

SEQ ID NO: 390433 - RNA, 19 nt, Homo sapiens
caccaaacccugcagucua

SEQ ID NO: 390434 - RNA, 19 nt, Homo sapiens
agucaaaggagacaaacua

SEQ ID NO: 390435 - RNA, 19 nt, Homo sapiens
gaucaucaacccagaggau

SEQ ID NO: 390436 - RNA, 19 nt, Homo sapiens
aaagaugcccuaaaugagu

SEQ ID NO: 390437 - RNA, 19 nt, Homo sapiens
ugccauagacacagguuua

SEQ ID NO: 390438 - RNA, 19 nt, Homo sapiens
cagcaaauucccaucgauu

SEQ ID NO: 390439 - RNA, 19 nt, Homo sapiens
cauagacacagguuuauag

SEQ ID NO: 390440 - RNA, 19 nt, Homo sapiens
caaacccugcagucuauaa

SEQ ID NO: 390441 - RNA, 19 nt, Homo sapiens
ggagcaggcgcaugcagaa

SEQ ID NO: 390442 - RNA, 19 nt, Homo sapiens
caacacugcccacaacaag

SEQ ID NO: 390443 - RNA, 19 nt, Homo sapiens
aaaggagacaaacuaauug

SEQ ID NO: 390444 - RNA, 19 nt, Homo sapiens
gacaaaguuaggaaacauu

SEQ ID NO: 390445 - RNA, 19 nt, Homo sapiens
gaaaggagaugagaagaug

SEQ ID NO: 390446 - RNA, 19 nt, Homo sapiens
caaaggauaugaccaguug

SEQ ID NO: 390447 - RNA, 19 nt, Homo sapiens
agacacagguuuauaguuu

SEQ ID NO: 390448 - RNA, 19 nt, Homo sapiens
gaagagaguuuuccugaua

SEQ ID NO: 390449 - RNA, 19 nt, Homo sapiens
gcucaaaggcgcucacuua

SEQ ID NO: 390450 - RNA, 19 nt, Homo sapiens
ggaaguaacuggugucucu

SEQ ID NO: 390451 - RNA, 19 nt, Homo sapiens
gagaaacccugauuugugu

SEQ ID NO: 390452 - RNA, 19 nt, Homo sapiens
gcagaaggguugccauaga

SEQ ID NO: 390453 - RNA, 19 nt, Homo sapiens
guacuguccucuacucuaa

SEQ ID NO: 390454 - RNA, 19 nt, Homo sapiens
aagcugagguuuaaacuaa

SEQ ID NO: 390455 - RNA, 19 nt, Homo sapiens
uaaaugaacccaagaagaa

SEQ ID NO: 390456 - RNA, 19 nt, Homo sapiens
gaagauggguggagaggau

SEQ ID NO: 390457 - RNA, 19 nt, Homo sapiens
caaaggagacaaacuaauu

SEQ ID NO: 390458 - RNA, 19 nt, Homo sapiens
gcaguuaagcugagguuua

SEQ ID NO: 390459 - RNA, 19 nt, Homo sapiens
guccagagccuaauuuaua

SEQ ID NO: 390460 - RNA, 19 nt, Homo sapiens
ggacuugacuccuguugug

SEQ ID NO: 390461 - RNA, 19 nt, Homo sapiens
gagacaaacuaauugagaa

SEQ ID NO: 390462 - RNA, 19 nt, Homo sapiens
ucacaagccucagcaaauu

SEQ ID NO: 390463 - RNA, 19 nt, Homo sapiens
caauugagagcucuuguua

SEQ ID NO: 390464 - RNA, 19 nt, Homo sapiens
gcgagaagccucagacauu

SEQ ID NO: 390465 - RNA, 19 nt, Homo sapiens
ggagaaacccugauuugug

SEQ ID NO: 390466 - RNA, 19 nt, Homo sapiens
aaacauaggagacaaaguu

SEQ ID NO: 390467 - RNA, 19 nt, Homo sapiens
cugcugaaguuucuuauuu

SEQ ID NO: 390468 - RNA, 19 nt, Homo sapiens
ggagggaaaucuggacauu

SEQ ID NO: 390469 - RNA, 19 nt, Homo sapiens
ugagagcucuuguuauuca

SEQ ID NO: 390470 - RNA, 19 nt, Homo sapiens
gacuagaccuggcuaacaa

SEQ ID NO: 390471 - RNA, 19 nt, Homo sapiens
aaacugagcuugauaaccu

SEQ ID NO: 390472 - RNA, 19 nt, Homo sapiens
gcuuagaauucugcaguua

SEQ ID NO: 390473 - RNA, 19 nt, Homo sapiens
acagagauuuguacauuug

SEQ ID NO: 390474 - RNA, 19 nt, Homo sapiens
auucagagcuccaagacua

SEQ ID NO: 390475 - RNA, 19 nt, Homo sapiens
ggaggaaacugagcuugau

SEQ ID NO: 390476 - RNA, 19 nt, Homo sapiens
ggagacaaacuaauugaga

SEQ ID NO: 390477 - RNA, 19 nt, Homo sapiens
auugagagcucuuguuauu

SEQ ID NO: 390478 - RNA, 19 nt, Homo sapiens
gaagaaauaugcaaaagag

SEQ ID NO: 390479 - RNA, 19 nt, Homo sapiens
ugaaauagcccauaaagac

SEQ ID NO: 390480 - RNA, 19 nt, Homo sapiens
gguaucgucuuucagaaug

SEQ ID NO: 390481 - RNA, 19 nt, Homo sapiens
cgagaagccucagacauug

SEQ ID NO: 390482 - RNA, 19 nt, Homo sapiens
guaaaugaacccaagaaga

SEQ ID NO: 390483 - RNA, 19 nt, Homo sapiens
ugauagaucucaacaguac

SEQ ID NO: 390484 - RNA, 19 nt, Homo sapiens
gaacuuacgcccaacucuu

SEQ ID NO: 390485 - RNA, 19 nt, Homo sapiens
caaauaaagaugcccuaaa

SEQ ID NO: 390486 - RNA, 19 nt, Homo sapiens
cuaaugaacuagggagaaa

SEQ ID NO: 390487 - RNA, 19 nt, Homo sapiens
ggaaaucuggacauucaaa

SEQ ID NO: 390488 - RNA, 19 nt, Homo sapiens
aagcggauuucuacccuua

SEQ ID NO: 390489 - RNA, 19 nt, Homo sapiens
auaaagaugcccuaaauga

SEQ ID NO: 390490 - RNA, 19 nt, Homo sapiens
uaacaaacauaggagacaa

SEQ ID NO: 390491 - RNA, 19 nt, Homo sapiens
cuauaacccugaagcugua

SEQ ID NO: 390492 - RNA, 19 nt, Homo sapiens
ccucuacucuaaggcauua

SEQ ID NO: 390493 - RNA, 19 nt, Homo sapiens
ggguugaaauagcccauaa

SEQ ID NO: 390494 - RNA, 19 nt, Homo sapiens
gaccaaagaggaagaggaa

SEQ ID NO: 390495 - RNA, 19 nt, Homo sapiens
gagacaaaguuaggaaaca

SEQ ID NO: 390496 - RNA, 19 nt, Homo sapiens
ugccauagaucucaguuug

SEQ ID NO: 390497 - RNA, 19 nt, Homo sapiens
ccacaagcaucugaagaga

SEQ ID NO: 390498 - RNA, 19 nt, Homo sapiens
ggaaaagauuuguuuggaa

SEQ ID NO: 390499 - RNA, 19 nt, Homo sapiens
cagaaggguugccauagau

SEQ ID NO: 390500 - RNA, 19 nt, Homo sapiens
acacuugcauuguagagaa

SEQ ID NO: 390501 - RNA, 19 nt, Homo sapiens
ccugauagaucucaacagu

SEQ ID NO: 390502 - RNA, 19 nt, Homo sapiens
gagaaacugauuauugaug

SEQ ID NO: 390503 - RNA, 19 nt, Homo sapiens
gcugugaauuugucucuca

SEQ ID NO: 390504 - RNA, 19 nt, Homo sapiens
uaggaaacauugauacaag

SEQ ID NO: 390505 - RNA, 19 nt, Homo sapiens
uagcuaggcuuuucucuuu

SEQ ID NO: 390506 - RNA, 19 nt, Homo sapiens
ccauagaucucaguuugau

SEQ ID NO: 390507 - RNA, 19 nt, Homo sapiens
uccacuaccuccuuucuuu

SEQ ID NO: 390508 - RNA, 19 nt, Homo sapiens
cuuccuugcugauuugaua

SEQ ID NO: 390509 - RNA, 19 nt, Homo sapiens
acaccuuccuugcugauuu

SEQ ID NO: 390510 - RNA, 19 nt, Homo sapiens
gcucuagccucccgcuguu

SEQ ID NO: 390511 - RNA, 19 nt, Homo sapiens
cauguaauaugacaauugg

SEQ ID NO: 390512 - RNA, 19 nt, Homo sapiens
agggaaaucuggacauuca

SEQ ID NO: 390513 - RNA, 19 nt, Homo sapiens
uugauaaccugacagaguu

SEQ ID NO: 390514 - RNA, 19 nt, Homo sapiens
acaagcaucugaagagagu

SEQ ID NO: 390515 - RNA, 19 nt, Homo sapiens
cgucagcagugaacaugaa

SEQ ID NO: 390516 - RNA, 19 nt, Homo sapiens
gcaggcgcaugcagaacuu

SEQ ID NO: 390517 - RNA, 19 nt, Homo sapiens
ccaaagaggaagaggaaga

SEQ ID NO: 390518 - RNA, 19 nt, Homo sapiens
ccacugccaucuggaaaug

SEQ ID NO: 390519 - RNA, 19 nt, Homo sapiens
gaaggcaguuuucaaagga

SEQ ID NO: 390520 - RNA, 19 nt, Homo sapiens
gaggaaacugagcuugaua

SEQ ID NO: 390521 - RNA, 19 nt, Homo sapiens
ggugcaggcugugaauuug

SEQ ID NO: 390522 - RNA, 19 nt, Homo sapiens
uuucuacccuuaccauuga

SEQ ID NO: 390523 - RNA, 19 nt, Homo sapiens
ccaagaagaagaaauaugc

SEQ ID NO: 390524 - RNA, 19 nt, Homo sapiens
cccugaagcuguaaaugaa

SEQ ID NO: 390525 - RNA, 19 nt, Homo sapiens
caaacuaauugagaaacug

SEQ ID NO: 390526 - RNA, 19 nt, Homo sapiens
auccagagcuguagagguu

SEQ ID NO: 390527 - RNA, 19 nt, Homo sapiens
gaaacugauuauugaugag

SEQ ID NO: 390528 - RNA, 19 nt, Homo sapiens
gaaacccugauuuguguga

SEQ ID NO: 390529 - RNA, 19 nt, Homo sapiens
gggugcaggcugugaauuu

SEQ ID NO: 390530 - RNA, 19 nt, Homo sapiens
uagcagaaggguugccaua

SEQ ID NO: 390531 - RNA, 19 nt, Homo sapiens
agacugcccuggcucuuuc

SEQ ID NO: 390532 - RNA, 19 nt, Homo sapiens
caaagaggaagaggaagaa

SEQ ID NO: 390533 - RNA, 19 nt, Homo sapiens
guucaacacugcccacaac

SEQ ID NO: 390534 - RNA, 19 nt, Homo sapiens
uccagagccuaauuuauau

SEQ ID NO: 390535 - RNA, 19 nt, Homo sapiens
caccaaacccugcagucua

SEQ ID NO: 390536 - RNA, 19 nt, Homo sapiens
gaucaucaacccagaggau

SEQ ID NO: 390537 - RNA, 19 nt, Homo sapiens
agucaaaggagacaaacua

SEQ ID NO: 390538 - RNA, 19 nt, Homo sapiens
aaagaugcccuaaaugagu

SEQ ID NO: 390539 - RNA, 19 nt, Homo sapiens
ugccauagacacagguuua

SEQ ID NO: 390540 - RNA, 19 nt, Homo sapiens
cagcaaauucccaucgauu

SEQ ID NO: 390541 - RNA, 19 nt, Homo sapiens
cauagacacagguuuauag

SEQ ID NO: 390542 - RNA, 19 nt, Homo sapiens
aaaggagacaaacuaauug

SEQ ID NO: 390543 - RNA, 19 nt, Homo sapiens
caaacccugcagucuauaa

SEQ ID NO: 390544 - RNA, 19 nt, Homo sapiens
ggagcaggcgcaugcagaa

SEQ ID NO: 390545 - RNA, 19 nt, Homo sapiens
ggaugaaacugaacgagua

SEQ ID NO: 390546 - RNA, 19 nt, Homo sapiens
gaagaaacguaaagaugaa

SEQ ID NO: 390547 - RNA, 19 nt, Homo sapiens
gaaggaccgucacuacaua

SEQ ID NO: 390548 - RNA, 19 nt, Homo sapiens
ccaaagagaucaaagugaa

SEQ ID NO: 390549 - RNA, 19 nt, Homo sapiens
ggaaaugaauacugaguug

SEQ ID NO: 390550 - RNA, 19 nt, Homo sapiens
gcacaguggugguuucuga

SEQ ID NO: 390551 - RNA, 19 nt, Homo sapiens
gaacaacugugccuucuac

SEQ ID NO: 390552 - RNA, 19 nt, Homo sapiens
gaaauuggccucaguccuu

SEQ ID NO: 390553 - RNA, 19 nt, Homo sapiens
gcuacaaacuucuuaacaa

SEQ ID NO: 390554 - RNA, 19 nt, Homo sapiens
gaaggaagcacgaaagaug

SEQ ID NO: 390555 - RNA, 19 nt, Homo sapiens
gagagagacuggaaacguu

SEQ ID NO: 390556 - RNA, 19 nt, Homo sapiens
acaauuggcugacguauuc

SEQ ID NO: 390557 - RNA, 19 nt, Homo sapiens
ugaauaagaucaaggacuu

SEQ ID NO: 390558 - RNA, 19 nt, Homo sapiens
gcgcauugauguacauauu

SEQ ID NO: 390559 - RNA, 19 nt, Homo sapiens
gaaacaagccgcagcaaca

SEQ ID NO: 390560 - RNA, 19 nt, Homo sapiens
gaacaacacagcuaaacug

SEQ ID NO: 390561 - RNA, 19 nt, Homo sapiens
gcaauagucaggagcgaua

SEQ ID NO: 390562 - RNA, 19 nt, Homo sapiens
gcacuuacuugaacauucu

SEQ ID NO: 390563 - RNA, 19 nt, Homo sapiens
uccaagaucuucaguuuga

SEQ ID NO: 390564 - RNA, 19 nt, Homo sapiens
gauuugaggaugaguauuu

SEQ ID NO: 390565 - RNA, 19 nt, Homo sapiens
ugaauuggaugaaacugaa

SEQ ID NO: 390566 - RNA, 19 nt, Homo sapiens
cagcugcacuuaagaaauc

SEQ ID NO: 390567 - RNA, 19 nt, Homo sapiens
gcauuaauguccaagagau

SEQ ID NO: 390568 - RNA, 19 nt, Homo sapiens
cagcuaaacuggugaagca

SEQ ID NO: 390569 - RNA, 19 nt, Homo sapiens
cagaggaacuacugaaaca

SEQ ID NO: 390570 - RNA, 19 nt, Homo sapiens
gaagagcuccggaaauugg

SEQ ID NO: 390571 - RNA, 19 nt, Homo sapiens
gcaaacugagagaauauuu

SEQ ID NO: 390572 - RNA, 19 nt, Homo sapiens
ccagaaauauuggucaaau

SEQ ID NO: 390573 - RNA, 19 nt, Homo sapiens
gcagacccguucaccagaa

SEQ ID NO: 390574 - RNA, 19 nt, Homo sapiens
ugaauccacucagaacuuu

SEQ ID NO: 390575 - RNA, 19 nt, Homo sapiens
guucugcccucaccucuug

SEQ ID NO: 390576 - RNA, 19 nt, Homo sapiens
agaagaaacguaaagauga

SEQ ID NO: 390577 - RNA, 19 nt, Homo sapiens
gaccgucacuacauaacuu

SEQ ID NO: 390578 - RNA, 19 nt, Homo sapiens
gaacgaguaaaugugaaua

SEQ ID NO: 390579 - RNA, 19 nt, Homo sapiens
augaagagcuccggaaauu

SEQ ID NO: 390580 - RNA, 19 nt, Homo sapiens
ccaguucucuccuucacuu

SEQ ID NO: 390581 - RNA, 19 nt, Homo sapiens
gcaagucaagugaggauga

SEQ ID NO: 390582 - RNA, 19 nt, Homo sapiens
aauaaacaguggaaagaga

SEQ ID NO: 390583 - RNA, 19 nt, Homo sapiens
ggucugccuuugccaacua

SEQ ID NO: 390584 - RNA, 19 nt, Homo sapiens
ugaaacaaccagacuauuc

SEQ ID NO: 390585 - RNA, 19 nt, Homo sapiens
gaaggcaaacugagagaau

SEQ ID NO: 390586 - RNA, 19 nt, Homo sapiens
uuuccaagaucuucaguuu

SEQ ID NO: 390587 - RNA, 19 nt, Homo sapiens
gaaagucacacuacaugca

SEQ ID NO: 390588 - RNA, 19 nt, Homo sapiens
gaucagcugcacuuaagaa

SEQ ID NO: 390589 - RNA, 19 nt, Homo sapiens
caaguugccuccaguucug

SEQ ID NO: 390590 - RNA, 19 nt, Homo sapiens
gaugagacuccguauguug

SEQ ID NO: 390591 - RNA, 19 nt, Homo sapiens
ggaaaggcaggaagaggaa

SEQ ID NO: 390592 - RNA, 19 nt, Homo sapiens
auacugaguuggccuuuau

SEQ ID NO: 390593 - RNA, 19 nt, Homo sapiens
ggaugagacuccguauguu

SEQ ID NO: 390594 - RNA, 19 nt, Homo sapiens
ggauucaacaagaugauuu

SEQ ID NO: 390595 - RNA, 19 nt, Homo sapiens
gaacaccccuacccuucua

SEQ ID NO: 390596 - RNA, 19 nt, Homo sapiens
ggaggaggaggcauuaaug

SEQ ID NO: 390597 - RNA, 19 nt, Homo sapiens
gaaacugaacgaguaaaug

SEQ ID NO: 390598 - RNA, 19 nt, Homo sapiens
aaagacaaccaacaacauu

SEQ ID NO: 390599 - RNA, 19 nt, Homo sapiens
aaacugaacgaguaaaugu

SEQ ID NO: 390600 - RNA, 19 nt, Homo sapiens
caacaucuaagcccuugaa

SEQ ID NO: 390601 - RNA, 19 nt, Homo sapiens
ucaagggccuggacagcuu

SEQ ID NO: 390602 - RNA, 19 nt, Homo sapiens
gaucacuggugcgcauuga

SEQ ID NO: 390603 - RNA, 19 nt, Homo sapiens
gaaacaaccagacuauucg

SEQ ID NO: 390604 - RNA, 19 nt, Homo sapiens
gauaagaagaaacguaaag

SEQ ID NO: 390605 - RNA, 19 nt, Homo sapiens
caacagcaguggacaucgu

SEQ ID NO: 390606 - RNA, 19 nt, Homo sapiens
gaugaaacugaacgaguaa

SEQ ID NO: 390607 - RNA, 19 nt, Homo sapiens
aaggcaaacugagagaaua

SEQ ID NO: 390608 - RNA, 19 nt, Homo sapiens
ucugacaaguacaaccuua

SEQ ID NO: 390609 - RNA, 19 nt, Homo sapiens
caagucaagugaggaugaa

SEQ ID NO: 390610 - RNA, 19 nt, Homo sapiens
ugaagcagcugagcaaguc

SEQ ID NO: 390611 - RNA, 19 nt, Homo sapiens
gcagaacaacacagcuaaa

SEQ ID NO: 390612 - RNA, 19 nt, Homo sapiens
gaugggauuuccaagaucu

SEQ ID NO: 390613 - RNA, 19 nt, Homo sapiens
ugaaagggguauuguauau

SEQ ID NO: 390614 - RNA, 19 nt, Homo sapiens
ugagaagauucgcccugua

SEQ ID NO: 390615 - RNA, 19 nt, Homo sapiens
uagaccaucucaagcagaa

SEQ ID NO: 390616 - RNA, 19 nt, Homo sapiens
gaccuucaacuuucuguga

SEQ ID NO: 390617 - RNA, 19 nt, Homo sapiens
ccauuugccugcccuguuc

SEQ ID NO: 390618 - RNA, 19 nt, Homo sapiens
gcaacugccgcuaugagaa

SEQ ID NO: 390619 - RNA, 19 nt, Homo sapiens
ccaagggcaugcagcacuu

SEQ ID NO: 390620 - RNA, 19 nt, Homo sapiens
ccacucaacacaacaccua

SEQ ID NO: 390621 - RNA, 19 nt, Homo sapiens
ugacaaguacaaccuuaaa

SEQ ID NO: 390622 - RNA, 19 nt, Homo sapiens
ggaugaagagcuccggaaa

SEQ ID NO: 390623 - RNA, 19 nt, Homo sapiens
gcacugccuuugggaguca

SEQ ID NO: 390624 - RNA, 19 nt, Homo sapiens
gaugauggcgaacucguau

SEQ ID NO: 390625 - RNA, 19 nt, Homo sapiens
caaacagucauccuucaga

SEQ ID NO: 390626 - RNA, 19 nt, Homo sapiens
uugaaaggauccugagaga

SEQ ID NO: 390627 - RNA, 19 nt, Homo sapiens
aagaagaaacguaaagaug

SEQ ID NO: 390628 - RNA, 19 nt, Homo sapiens
uggcugacguauucaaaga

SEQ ID NO: 390629 - RNA, 19 nt, Homo sapiens
gauccucaccuccaucaug

SEQ ID NO: 390630 - RNA, 19 nt, Homo sapiens
caaagacaaccaacaacau

SEQ ID NO: 390631 - RNA, 19 nt, Homo sapiens
ccacccaaauucacucauc

SEQ ID NO: 390632 - RNA, 19 nt, Homo sapiens
gaauaagaucaaggacuuu

SEQ ID NO: 390633 - RNA, 19 nt, Homo sapiens
ccaaaccccuuuccaguau

SEQ ID NO: 390634 - RNA, 19 nt, Homo sapiens
gagaagauucgcccuguac

SEQ ID NO: 390635 - RNA, 19 nt, Homo sapiens
caugaaggcccugguggua

SEQ ID NO: 390636 - RNA, 19 nt, Homo sapiens
cgaguaaaugugaauaaga

SEQ ID NO: 390637 - RNA, 19 nt, Homo sapiens
gcacagccaaaccuucuuc

SEQ ID NO: 390638 - RNA, 19 nt, Homo sapiens
gaaauacaagccacucaac

SEQ ID NO: 390639 - RNA, 19 nt, Homo sapiens
gaugaagagcuccggaaau

SEQ ID NO: 390640 - RNA, 19 nt, Homo sapiens
gucacuacauaacuucaaa

SEQ ID NO: 390641 - RNA, 19 nt, Homo sapiens
gcaucuaccgcucacugua

SEQ ID NO: 390642 - RNA, 19 nt, Homo sapiens
gcugacguauucaaagaca

SEQ ID NO: 390643 - RNA, 19 nt, Homo sapiens
ggccuggacagcuuccuua

SEQ ID NO: 390644 - RNA, 19 nt, Homo sapiens
ccacgcugcuugggacuug

SEQ ID NO: 390645 - RNA, 19 nt, Homo sapiens
cagauuaacuucaggauuu

SEQ ID NO: 390646 - RNA, 19 nt, Homo sapiens
gagguucgauguccaguua

SEQ ID NO: 390647 - RNA, 19 nt, Homo sapiens
caacagccgugaccacuuu

SEQ ID NO: 390648 - RNA, 19 nt, Homo sapiens
caaaagaugugccauauaa

SEQ ID NO: 390649 - RNA, 19 nt, Homo sapiens
uaaccaagcugcaaucaug

SEQ ID NO: 390650 - RNA, 19 nt, Homo sapiens
cuaaagaaauccugacaaa

SEQ ID NO: 390651 - RNA, 19 nt, Homo sapiens
gcaaaucaccagauacaaa

SEQ ID NO: 390652 - RNA, 19 nt, Homo sapiens
gaacuugacgauacucuaa

SEQ ID NO: 390653 - RNA, 19 nt, Homo sapiens
ucacacaaguuuaugguuu

SEQ ID NO: 390654 - RNA, 19 nt, Homo sapiens
ggaaaucugugcugcuuca

SEQ ID NO: 390655 - RNA, 19 nt, Homo sapiens
gcagacagaucacacaagu

SEQ ID NO: 390656 - RNA, 19 nt, Homo sapiens
cuacauaaccucucuggua

SEQ ID NO: 390657 - RNA, 19 nt, Homo sapiens
gcuuguagcucuuaagguu

SEQ ID NO: 390658 - RNA, 19 nt, Homo sapiens
cgagaaggcuaaagaaauc

SEQ ID NO: 390659 - RNA, 19 nt, Homo sapiens
cagaggauauuauucaguu

SEQ ID NO: 390660 - RNA, 19 nt, Homo sapiens
uacauaaccucucugguaa

SEQ ID NO: 390661 - RNA, 19 nt, Homo sapiens
gagcaacaguaacuccaaa

SEQ ID NO: 390662 - RNA, 19 nt, Homo sapiens
agacagaucacacaaguuu

SEQ ID NO: 390663 - RNA, 19 nt, Homo sapiens
cgacauuguuggucaagaa

SEQ ID NO: 390664 - RNA, 19 nt, Homo sapiens
uagauacacuggaucauau

SEQ ID NO: 390665 - RNA, 19 nt, Homo sapiens
gaacgcaucaccauucuuc

SEQ ID NO: 390666 - RNA, 19 nt, Homo sapiens
gcaagacuggugcuguuua

SEQ ID NO: 390667 - RNA, 19 nt, Homo sapiens
caaagccucuugucaucaa

SEQ ID NO: 390668 - RNA, 19 nt, Homo sapiens
gacuggugcuguuuauuaa

SEQ ID NO: 390669 - RNA, 19 nt, Homo sapiens
agacuggugcuguuuauua

SEQ ID NO: 390670 - RNA, 19 nt, Homo sapiens
gggcaagacuggugcuguu

SEQ ID NO: 390671 - RNA, 19 nt, Homo sapiens
gagagacugcagauaauaa

SEQ ID NO: 390672 - RNA, 19 nt, Homo sapiens
gaucauaucagagcacuug

SEQ ID NO: 390673 - RNA, 19 nt, Homo sapiens
gucagaaccuggugaguug

SEQ ID NO: 390674 - RNA, 19 nt, Homo sapiens
cagcaugacuguagauaag

SEQ ID NO: 390675 - RNA, 19 nt, Homo sapiens
ucauggaacuguuuagaau

SEQ ID NO: 390676 - RNA, 19 nt, Homo sapiens
caagacuggugcuguuuau

SEQ ID NO: 390677 - RNA, 19 nt, Homo sapiens
cgugaccacuuuagaauga

SEQ ID NO: 390678 - RNA, 19 nt, Homo sapiens
aaucugugcugcuucagua

SEQ ID NO: 390679 - RNA, 19 nt, Homo sapiens
ugacagaggauauuauuca

SEQ ID NO: 390680 - RNA, 19 nt, Homo sapiens
uagaauugguggcaaauca

SEQ ID NO: 390681 - RNA, 19 nt, Homo sapiens
gguggucucucgccaucua

SEQ ID NO: 390682 - RNA, 19 nt, Homo sapiens
caaaucaccagauacaaau

SEQ ID NO: 390683 - RNA, 19 nt, Homo sapiens
gcgagaaggcuaaagaaau

SEQ ID NO: 390684 - RNA, 19 nt, Homo sapiens
agggauaccguuuaauuua

SEQ ID NO: 390685 - RNA, 19 nt, Homo sapiens
guauugccaugaaccauau

SEQ ID NO: 390686 - RNA, 19 nt, Homo sapiens
ucagggauaccguuuaauu

SEQ ID NO: 390687 - RNA, 19 nt, Homo sapiens
ccucgugaauacaauuuaa

SEQ ID NO: 390688 - RNA, 19 nt, Homo sapiens
ucugagacauuuaaucaug

SEQ ID NO: 390689 - RNA, 19 nt, Homo sapiens
cugagaaggucaaauuuua

SEQ ID NO: 390690 - RNA, 19 nt, Homo sapiens
gcaagauauuucugagaca

SEQ ID NO: 390691 - RNA, 19 nt, Homo sapiens
gcaugacuguagauaagga

SEQ ID NO: 390692 - RNA, 19 nt, Homo sapiens
aacaguaacuccaaagugu

SEQ ID NO: 390693 - RNA, 19 nt, Homo sapiens
gaucuucugucuacauggu

SEQ ID NO: 390694 - RNA, 19 nt, Homo sapiens
caugagagcagacagauca

SEQ ID NO: 390695 - RNA, 19 nt, Homo sapiens
gaucucauggaacuguuua

SEQ ID NO: 390696 - RNA, 19 nt, Homo sapiens
cccauguuguucuuuguua

SEQ ID NO: 390697 - RNA, 19 nt, Homo sapiens
uuucagggauaccguuuaa

SEQ ID NO: 390698 - RNA, 19 nt, Homo sapiens
cagacuacuuccuguaaug

SEQ ID NO: 390699 - RNA, 19 nt, Homo sapiens
uaacaccucgugaauacaa

SEQ ID NO: 390700 - RNA, 19 nt, Homo sapiens
ucauggaacuugacgauac

SEQ ID NO: 390701 - RNA, 19 nt, Homo sapiens
gggagauuauguugacaga

SEQ ID NO: 390702 - RNA, 19 nt, Homo sapiens
caacaguaacuccaaagug

SEQ ID NO: 390703 - RNA, 19 nt, Homo sapiens
gaggauauuauucaguuga

SEQ ID NO: 390704 - RNA, 19 nt, Homo sapiens
gguucuuccugcauauuaa

SEQ ID NO: 390705 - RNA, 19 nt, Homo sapiens
cagggauaccguuuaauuu

SEQ ID NO: 390706 - RNA, 19 nt, Homo sapiens
caagauauuucugagacau

SEQ ID NO: 390707 - RNA, 19 nt, Homo sapiens
ggaaaugggaagagcaaca

SEQ ID NO: 390708 - RNA, 19 nt, Homo sapiens
ccaaacuauuguuaucguu

SEQ ID NO: 390709 - RNA, 19 nt, Homo sapiens
aaucaagggcacuacauaa

SEQ ID NO: 390710 - RNA, 19 nt, Homo sapiens
ccaugaggguccaaugugu

SEQ ID NO: 390711 - RNA, 19 nt, Homo sapiens
guuuaugguuucuaugaug

SEQ ID NO: 390712 - RNA, 19 nt, Homo sapiens
gguaacuccuugacauucu

SEQ ID NO: 390713 - RNA, 19 nt, Homo sapiens
uuuguagacuuguagguaa

SEQ ID NO: 390714 - RNA, 19 nt, Homo sapiens
ggauagcagcaaacaauca

SEQ ID NO: 390715 - RNA, 19 nt, Homo sapiens
gggaagagcaacaguaacu

SEQ ID NO: 390716 - RNA, 19 nt, Homo sapiens
ggaauguaguaacgauuuu

SEQ ID NO: 390717 - RNA, 19 nt, Homo sapiens
ggagcugguuacaccuuug

SEQ ID NO: 390718 - RNA, 19 nt, Homo sapiens
guuuagaauugguggcaaa

SEQ ID NO: 390719 - RNA, 19 nt, Homo sapiens
guaacuccuugacauucuu

SEQ ID NO: 390720 - RNA, 19 nt, Homo sapiens
ugucugcacucaguuuauu

SEQ ID NO: 390721 - RNA, 19 nt, Homo sapiens
agauaaggauagcagcaaa

SEQ ID NO: 390722 - RNA, 19 nt, Homo sapiens
aaccauauaucgaccuaau

SEQ ID NO: 390723 - RNA, 19 nt, Homo sapiens
ugaaccauauaucgaccua

SEQ ID NO: 390724 - RNA, 19 nt, Homo sapiens
ggaacuugacgauacucua

SEQ ID NO: 390725 - RNA, 19 nt, Homo sapiens
ggguucuuccugcauauua

SEQ ID NO: 390726 - RNA, 19 nt, Homo sapiens
aaaucaagggcacuacaua

SEQ ID NO: 390727 - RNA, 19 nt, Homo sapiens
gacugcagauaauaagaug

SEQ ID NO: 390728 - RNA, 19 nt, Homo sapiens
ugagagacugcagauaaua

SEQ ID NO: 390729 - RNA, 19 nt, Homo sapiens
ccacauguuacucgucgua

SEQ ID NO: 390730 - RNA, 19 nt, Homo sapiens
cggaauguaguaacgauuu

SEQ ID NO: 390731 - RNA, 19 nt, Homo sapiens
gacauuuaaucaugccaau

SEQ ID NO: 390732 - RNA, 19 nt, Homo sapiens
guugacagaggauauuauu

SEQ ID NO: 390733 - RNA, 19 nt, Homo sapiens
aaggauagcagcaaacaau

SEQ ID NO: 390734 - RNA, 19 nt, Homo sapiens
cauuaacaccucgugaaua

SEQ ID NO: 390735 - RNA, 19 nt, Homo sapiens
ccagacuacuuccuguaau

SEQ ID NO: 390736 - RNA, 19 nt, Homo sapiens
ucaacagccgccagaagua

SEQ ID NO: 390737 - RNA, 19 nt, Homo sapiens
acagaucacacaaguuuau

SEQ ID NO: 390738 - RNA, 19 nt, Homo sapiens
aaggaaaucugugcugcuu

SEQ ID NO: 390739 - RNA, 19 nt, Homo sapiens
cugcagauaauaagaugua

SEQ ID NO: 390740 - RNA, 19 nt, Homo sapiens
cugagagacugcagauaau

SEQ ID NO: 390741 - RNA, 19 nt, Homo sapiens
auggaacuguuuagaauug

SEQ ID NO: 390742 - RNA, 19 nt, Homo sapiens
gagcagacagaucacacaa

SEQ ID NO: 390743 - RNA, 19 nt, Homo sapiens
ugauuugucugcacucagu

SEQ ID NO: 390744 - RNA, 19 nt, Homo sapiens
auuaacaccucgugaauac

SEQ ID NO: 390745 - RNA, 19 nt, Homo sapiens
ggaauuagaugacacuuua

SEQ ID NO: 390746 - RNA, 19 nt, Homo sapiens
uaacuggcauggauuaaua

SEQ ID NO: 390747 - RNA, 19 nt, Homo sapiens
gaaccaggcugcuaucaug

SEQ ID NO: 390748 - RNA, 19 nt, Homo sapiens
gaccaaaugugccauacua

SEQ ID NO: 390749 - RNA, 19 nt, Homo sapiens
guaagcagcugaacgagaa

SEQ ID NO: 390750 - RNA, 19 nt, Homo sapiens
cacgaaagccgacaaauua

SEQ ID NO: 390751 - RNA, 19 nt, Homo sapiens
uaagagcccuggaucguuu

SEQ ID NO: 390752 - RNA, 19 nt, Homo sapiens
gagguucguugcccuguua

SEQ ID NO: 390753 - RNA, 19 nt, Homo sapiens
ugacagugcuugcauccua

SEQ ID NO: 390754 - RNA, 19 nt, Homo sapiens
aaagagauuucccuucauu

SEQ ID NO: 390755 - RNA, 19 nt, Homo sapiens
uuaaagagauuucccuuca

SEQ ID NO: 390756 - RNA, 19 nt, Homo sapiens
guaacuaacugcuucaucu

SEQ ID NO: 390757 - RNA, 19 nt, Homo sapiens
uuuaguagauggacagaua

SEQ ID NO: 390758 - RNA, 19 nt, Homo sapiens
gagauuucccuucauuuaa

SEQ ID NO: 390759 - RNA, 19 nt, Homo sapiens
cccaaugugugaucuguua

SEQ ID NO: 390760 - RNA, 19 nt, Homo sapiens
ccagaacgcauuacaauau

SEQ ID NO: 390761 - RNA, 19 nt, Homo sapiens
caagcuaacuuccacuaau

SEQ ID NO: 390762 - RNA, 19 nt, Homo sapiens
ugggaaaccugccuuugua

SEQ ID NO: 390763 - RNA, 19 nt, Homo sapiens
gaaaaucaccggauacaaa

SEQ ID NO: 390764 - RNA, 19 nt, Homo sapiens
caguuugccugcuguauuu

SEQ ID NO: 390765 - RNA, 19 nt, Homo sapiens
gaucuuauggaacucuuua

SEQ ID NO: 390766 - RNA, 19 nt, Homo sapiens
gaacgcauuacaauauuga

SEQ ID NO: 390767 - RNA, 19 nt, Homo sapiens
cagaacgcauuacaauauu

SEQ ID NO: 390768 - RNA, 19 nt, Homo sapiens
ccagacuacuuccuauaaa

SEQ ID NO: 390769 - RNA, 19 nt, Homo sapiens
gacugugacucuucuugua

SEQ ID NO: 390770 - RNA, 19 nt, Homo sapiens
ggauacaaacuacuuauuc

SEQ ID NO: 390771 - RNA, 19 nt, Homo sapiens
guagacagaggauauuauu

SEQ ID NO: 390772 - RNA, 19 nt, Homo sapiens
agagauuucccuucauuua

SEQ ID NO: 390773 - RNA, 19 nt, Homo sapiens
caaaugugccauacuaaug

SEQ ID NO: 390774 - RNA, 19 nt, Homo sapiens
caaauugggaucugucuug

SEQ ID NO: 390775 - RNA, 19 nt, Homo sapiens
ggauacaauuggugucaug

SEQ ID NO: 390776 - RNA, 19 nt, Homo sapiens
ucacgaaagccgacaaauu

SEQ ID NO: 390777 - RNA, 19 nt, Homo sapiens
gaaaccugccuuuguaugu

SEQ ID NO: 390778 - RNA, 19 nt, Homo sapiens
gagaggaaaucacgaaagc

SEQ ID NO: 390779 - RNA, 19 nt, Homo sapiens
caaauuacccaaguauaug

SEQ ID NO: 390780 - RNA, 19 nt, Homo sapiens
agaugugcauggucaauuu

SEQ ID NO: 390781 - RNA, 19 nt, Homo sapiens
uagacacacuggaucauau

SEQ ID NO: 390782 - RNA, 19 nt, Homo sapiens
guauauggcuuuuaugaug

SEQ ID NO: 390783 - RNA, 19 nt, Homo sapiens
agacagaggauauuauuca

SEQ ID NO: 390784 - RNA, 19 nt, Homo sapiens
cagacuacuuccuauaaau

SEQ ID NO: 390785 - RNA, 19 nt, Homo sapiens
ggugcuggcuacacauuug

SEQ ID NO: 390786 - RNA, 19 nt, Homo sapiens
cacacuggaucauauaaga

SEQ ID NO: 390787 - RNA, 19 nt, Homo sapiens
uaacuuccacuaauccauu

SEQ ID NO: 390788 - RNA, 19 nt, Homo sapiens
ccaaguauauggcuuuuau

SEQ ID NO: 390789 - RNA, 19 nt, Homo sapiens
gacaaauuacccaaguaua

SEQ ID NO: 390790 - RNA, 19 nt, Homo sapiens
aaaggugcguuauccagaa

SEQ ID NO: 390791 - RNA, 19 nt, Homo sapiens
auucaugggugacuaugua

SEQ ID NO: 390792 - RNA, 19 nt, Homo sapiens
auggaacucuuuagaauug

SEQ ID NO: 390793 - RNA, 19 nt, Homo sapiens
cgacaaauuacccaaguau

SEQ ID NO: 390794 - RNA, 19 nt, Homo sapiens
gaaggcaaaggaaauuuua

SEQ ID NO: 390795 - RNA, 19 nt, Homo sapiens
caauuacuguuaucguugu

SEQ ID NO: 390796 - RNA, 19 nt, Homo sapiens
guaauggagggauacaauu

SEQ ID NO: 390797 - RNA, 19 nt, Homo sapiens
uggcauggauuaauagagu

SEQ ID NO: 390798 - RNA, 19 nt, Homo sapiens
ugacucuucuuguagcauu

SEQ ID NO: 390799 - RNA, 19 nt, Homo sapiens
ccugcuguauuuauaguaa

SEQ ID NO: 390800 - RNA, 19 nt, Homo sapiens
aagcaacaguaaucuaugu

SEQ ID NO: 390801 - RNA, 19 nt, Homo sapiens
ggaaaccugccuuuguaug

SEQ ID NO: 390802 - RNA, 19 nt, Homo sapiens
guaugggaaugccaacguu

SEQ ID NO: 390803 - RNA, 19 nt, Homo sapiens
augaaugucugcgaaagua

SEQ ID NO: 390804 - RNA, 19 nt, Homo sapiens
gagaaggcaaaggaaauuu

SEQ ID NO: 390805 - RNA, 19 nt, Homo sapiens
acaaggcguucaccaagga

SEQ ID NO: 390806 - RNA, 19 nt, Homo sapiens
cccaauuacuguuaucguu

SEQ ID NO: 390807 - RNA, 19 nt, Homo sapiens
acagaucucuuugauuauc

SEQ ID NO: 390808 - RNA, 19 nt, Homo sapiens
ccaaaugugccauacuaau

SEQ ID NO: 390809 - RNA, 19 nt, Homo sapiens
guaacaaauugggaucugu

SEQ ID NO: 390810 - RNA, 19 nt, Homo sapiens
uaauggagggauacaauug

SEQ ID NO: 390811 - RNA, 19 nt, Homo sapiens
uggccucucuccauccaua

SEQ ID NO: 390812 - RNA, 19 nt, Homo sapiens
acuuacagcuuuaguagau

SEQ ID NO: 390813 - RNA, 19 nt, Homo sapiens
gacagugcuugcauccuau

SEQ ID NO: 390814 - RNA, 19 nt, Homo sapiens
uaaagagauuucccuucau

SEQ ID NO: 390815 - RNA, 19 nt, Homo sapiens
aagcuaacuuccacuaauc

SEQ ID NO: 390816 - RNA, 19 nt, Homo sapiens
aaaugugccauacuaauga

SEQ ID NO: 390817 - RNA, 19 nt, Homo sapiens
gcgagaaggcaaaggaaau

SEQ ID NO: 390818 - RNA, 19 nt, Homo sapiens
gugcacccaauuacuguua

SEQ ID NO: 390819 - RNA, 19 nt, Homo sapiens
cgagaaggcaaaggaaauu

SEQ ID NO: 390820 - RNA, 19 nt, Homo sapiens
ccacuuacagcuuuaguag

SEQ ID NO: 390821 - RNA, 19 nt, Homo sapiens
ccgacaaauuacccaagua

SEQ ID NO: 390822 - RNA, 19 nt, Homo sapiens
guguuuaacuggcauggau

SEQ ID NO: 390823 - RNA, 19 nt, Homo sapiens
agacugaaauuuaguacac

SEQ ID NO: 390824 - RNA, 19 nt, Homo sapiens
cuuuguauguggaaguaua

SEQ ID NO: 390825 - RNA, 19 nt, Homo sapiens
gaaugucugcgaaaguaug

SEQ ID NO: 390826 - RNA, 19 nt, Homo sapiens
gcacccaauuacuguuauc

SEQ ID NO: 390827 - RNA, 19 nt, Homo sapiens
agacacacuggaucauaua

SEQ ID NO: 390828 - RNA, 19 nt, Homo sapiens
gaucugcauauuucuguau

SEQ ID NO: 390829 - RNA, 19 nt, Homo sapiens
guacacuauguucuagaua

SEQ ID NO: 390830 - RNA, 19 nt, Homo sapiens
gcaacaguaaucuaugugu

SEQ ID NO: 390831 - RNA, 19 nt, Homo sapiens
gagaugugcauggucaauu

SEQ ID NO: 390832 - RNA, 19 nt, Homo sapiens
agaacgcauuacaauauug

SEQ ID NO: 390833 - RNA, 19 nt, Homo sapiens
gggugacuauguagacaga

SEQ ID NO: 390834 - RNA, 19 nt, Homo sapiens
guuuaacuggcauggauua

SEQ ID NO: 390835 - RNA, 19 nt, Homo sapiens
ccacaucauggaccaaaug

SEQ ID NO: 390836 - RNA, 19 nt, Homo sapiens
acaguaaucuauguguuuc

SEQ ID NO: 390837 - RNA, 19 nt, Homo sapiens
aaaccugccuuuguaugug

SEQ ID NO: 390838 - RNA, 19 nt, Homo sapiens
aggcugcuaucauggaauu

SEQ ID NO: 390839 - RNA, 19 nt, Homo sapiens
ccaggcugcuaucauggaa

SEQ ID NO: 390840 - RNA, 19 nt, Homo sapiens
uacaauuggugucaugauc

SEQ ID NO: 390841 - RNA, 19 nt, Homo sapiens
guagauggacagauauucu

SEQ ID NO: 390842 - RNA, 19 nt, Homo sapiens
uugauuaucuuccacuuac

SEQ ID NO: 390843 - RNA, 19 nt, Homo sapiens
gccgacaaauuacccaagu

SEQ ID NO: 390844 - RNA, 19 nt, Homo sapiens
gugcuugcauccuauuugg

SEQ ID NO: 390845 - RNA, 19 nt, Homo sapiens
ucacagagcuccagaaagc

SEQ ID NO: 390846 - RNA, 19 nt, Homo sapiens
gaguggaguucuuugauga

SEQ ID NO: 390847 - RNA, 19 nt, Homo sapiens
ccaagucucugcagaagau

SEQ ID NO: 390848 - RNA, 19 nt, Homo sapiens
ggaguggaguucuuugaug

SEQ ID NO: 390849 - RNA, 19 nt, Homo sapiens
ucaagaagcuguccaccau

SEQ ID NO: 390850 - RNA, 19 nt, Homo sapiens
gaaauaaaggucuagaagu

SEQ ID NO: 390851 - RNA, 19 nt, Homo sapiens
gcaucaaugugcugucuga

SEQ ID NO: 390852 - RNA, 19 nt, Homo sapiens
gagcuucugccuuuccuua

SEQ ID NO: 390853 - RNA, 19 nt, Homo sapiens
gcuuguggaucauguauau

SEQ ID NO: 390854 - RNA, 19 nt, Homo sapiens
uggcucagcugaaggauga

SEQ ID NO: 390855 - RNA, 19 nt, Homo sapiens
caaccaacaugucaagucu

SEQ ID NO: 390856 - RNA, 19 nt, Homo sapiens
caugguggcugacaaguuc

SEQ ID NO: 390857 - RNA, 19 nt, Homo sapiens
gaacaucgcccagcuucug

SEQ ID NO: 390858 - RNA, 19 nt, Homo sapiens
gucaaagaguucugugaaa

SEQ ID NO: 390859 - RNA, 19 nt, Homo sapiens
ugacuacgcucuucugcau

SEQ ID NO: 390860 - RNA, 19 nt, Homo sapiens
ugaagaagcuaguggaaaa

SEQ ID NO: 390861 - RNA, 19 nt, Homo sapiens
ggcugaacaucaucucuaa

SEQ ID NO: 390862 - RNA, 19 nt, Homo sapiens
uccagaaccugaugaaaga

SEQ ID NO: 390863 - RNA, 19 nt, Homo sapiens
ggucaaagaguucugugaa

SEQ ID NO: 390864 - RNA, 19 nt, Homo sapiens
uagacgaacuccgcaauga

SEQ ID NO: 390865 - RNA, 19 nt, Homo sapiens
cagaacagcugggaaccuu

SEQ ID NO: 390866 - RNA, 19 nt, Homo sapiens
acagagaaauaaaggucua

SEQ ID NO: 390867 - RNA, 19 nt, Homo sapiens
ucucuaaccuggacugugu

SEQ ID NO: 390868 - RNA, 19 nt, Homo sapiens
gggagaaugugaucauguc

SEQ ID NO: 390869 - RNA, 19 nt, Homo sapiens
gaacagcugggaaccuuca

SEQ ID NO: 390870 - RNA, 19 nt, Homo sapiens
gcaaagacaacaccaucga

SEQ ID NO: 390871 - RNA, 19 nt, Homo sapiens
gagaaauaaaggucuagaa

SEQ ID NO: 390872 - RNA, 19 nt, Homo sapiens
ggauccugcugcuguaaug

SEQ ID NO: 390873 - RNA, 19 nt, Homo sapiens
ucuccaaccuggccucuga

SEQ ID NO: 390874 - RNA, 19 nt, Homo sapiens
gaaagggacggagccaaga

SEQ ID NO: 390875 - RNA, 19 nt, Homo sapiens
ccaggaggcucugacuguu

SEQ ID NO: 390876 - RNA, 19 nt, Homo sapiens
ggcaggacaucaccaccaa

SEQ ID NO: 390877 - RNA, 19 nt, Homo sapiens
acagugaccuugggaggaa

SEQ ID NO: 390878 - RNA, 19 nt, Homo sapiens
ucaagcccauccuagagaa

SEQ ID NO: 390879 - RNA, 19 nt, Homo sapiens
gccaauguccgcuucaaug

SEQ ID NO: 390880 - RNA, 19 nt, Homo sapiens
aggcggaacuucgacagua

SEQ ID NO: 390881 - RNA, 19 nt, Homo sapiens
ggauguggacgucaaauac

SEQ ID NO: 390882 - RNA, 19 nt, Homo sapiens
gagguacggcugaacauca

SEQ ID NO: 390883 - RNA, 19 nt, Homo sapiens
ggaugagugcccugaggua

SEQ ID NO: 390884 - RNA, 19 nt, Homo sapiens
ucaaagaguucugugaaaa

SEQ ID NO: 390885 - RNA, 19 nt, Homo sapiens
ggccugagaucaccaagac

SEQ ID NO: 390886 - RNA, 19 nt, Homo sapiens
guucacagagcuccagaaa

SEQ ID NO: 390887 - RNA, 19 nt, Homo sapiens
ccaggccgcugaagacaag

SEQ ID NO: 390888 - RNA, 19 nt, Homo sapiens
uggacaacgucaagaguga

SEQ ID NO: 390889 - RNA, 19 nt, Homo sapiens
caacagcaccuugcagagu

SEQ ID NO: 390890 - RNA, 19 nt, Homo sapiens
ccagcaaccugaagaagcu

SEQ ID NO: 390891 - RNA, 19 nt, Homo sapiens
augagaaacuuaacuccuu

SEQ ID NO: 390892 - RNA, 19 nt, Homo sapiens
gggucucucucccaucuug

SEQ ID NO: 390893 - RNA, 19 nt, Homo sapiens
cccacaaggucaaagaguu

SEQ ID NO: 390894 - RNA, 19 nt, Homo sapiens
gggacccgguugccaaugu

SEQ ID NO: 390895 - RNA, 19 nt, Homo sapiens
ccacaaggucaaagaguuc

SEQ ID NO: 390896 - RNA, 19 nt, Homo sapiens
uggccuggcuuguggauca

SEQ ID NO: 390897 - RNA, 19 nt, Homo sapiens
agaaauaaaggucuagaag

SEQ ID NO: 390898 - RNA, 19 nt, Homo sapiens
gaagcuaguggaaaaguuu

SEQ ID NO: 390899 - RNA, 19 nt, Homo sapiens
ggcuggccaucauugagua

SEQ ID NO: 390900 - RNA, 19 nt, Homo sapiens
ggccaagucucugcagaag

SEQ ID NO: 390901 - RNA, 19 nt, Homo sapiens
gguguccgaugccaaccaa

SEQ ID NO: 390902 - RNA, 19 nt, Homo sapiens
uggagucgcuggccacagu

SEQ ID NO: 390903 - RNA, 19 nt, Homo sapiens
ccaauguccgcuucaaugu

SEQ ID NO: 390904 - RNA, 19 nt, Homo sapiens
guggaguucuuugaugaga

SEQ ID NO: 390905 - RNA, 19 nt, Homo sapiens
gccgcagucugacaggaaa

SEQ ID NO: 390906 - RNA, 19 nt, Homo sapiens
ccaucgcggugcucauaga

SEQ ID NO: 390907 - RNA, 19 nt, Homo sapiens
gcuacaugguggcugacaa

SEQ ID NO: 390908 - RNA, 19 nt, Homo sapiens
gcccuggccucagucauca

SEQ ID NO: 390909 - RNA, 19 nt, Homo sapiens
guugaaaggacccgaagug

SEQ ID NO: 390910 - RNA, 19 nt, Homo sapiens
cggaaccugugcucagaug

SEQ ID NO: 390911 - RNA, 19 nt, Homo sapiens
caaugaggacguucagcuu

SEQ ID NO: 390912 - RNA, 19 nt, Homo sapiens
ggacccgguugccaauguc

SEQ ID NO: 390913 - RNA, 19 nt, Homo sapiens
ggccaucauugaguacaug

SEQ ID NO: 390914 - RNA, 19 nt, Homo sapiens
cggcugaacaucaucucua

SEQ ID NO: 390915 - RNA, 19 nt, Homo sapiens
cagcugggaaccuucacua

SEQ ID NO: 390916 - RNA, 19 nt, Homo sapiens
ugugucaacugugccguuu

SEQ ID NO: 390917 - RNA, 19 nt, Homo sapiens
ccgcaugacuacgcucuuc

SEQ ID NO: 390918 - RNA, 19 nt, Homo sapiens
caccaucgagcaccucuug

SEQ ID NO: 390919 - RNA, 19 nt, Homo sapiens
gcuucugccuuuccuuaca

SEQ ID NO: 390920 - RNA, 19 nt, Homo sapiens
ugaagucaagcccauccua

SEQ ID NO: 390921 - RNA, 19 nt, Homo sapiens
gcuucaauguggccaaguc

SEQ ID NO: 390922 - RNA, 19 nt, Homo sapiens
acuacgcucuucugcauca

SEQ ID NO: 390923 - RNA, 19 nt, Homo sapiens
gaaaaccucucagcugacu

SEQ ID NO: 390924 - RNA, 19 nt, Homo sapiens
cgucaagagugagaucauc

SEQ ID NO: 390925 - RNA, 19 nt, Homo sapiens
gggaguggaguucuuugau

SEQ ID NO: 390926 - RNA, 19 nt, Homo sapiens
gcugggaguggaguucuuu

SEQ ID NO: 390927 - RNA, 19 nt, Homo sapiens
gaugccaaccaacauguca

SEQ ID NO: 390928 - RNA, 19 nt, Homo sapiens
ucaacagcaucaagaagcu

SEQ ID NO: 390929 - RNA, 19 nt, Homo sapiens
gcccugagguacggcugaa

SEQ ID NO: 390930 - RNA, 19 nt, Homo sapiens
gaaccugaugaaagacugu

SEQ ID NO: 390931 - RNA, 19 nt, Homo sapiens
gacaacgucaagagugaga

SEQ ID NO: 390932 - RNA, 19 nt, Homo sapiens
gaaccugugcucagaugac

SEQ ID NO: 390933 - RNA, 19 nt, Homo sapiens
uaccugcaccgcaugacua

SEQ ID NO: 390934 - RNA, 19 nt, Homo sapiens
ccaccagcaaccugaagaa

SEQ ID NO: 390935 - RNA, 19 nt, Homo sapiens
agacaguggugcgggacaa

SEQ ID NO: 390936 - RNA, 19 nt, Homo sapiens
ccaaccaacaugucaaguc

SEQ ID NO: 390937 - RNA, 19 nt, Homo sapiens
gucaagcccauccuagaga

SEQ ID NO: 390938 - RNA, 19 nt, Homo sapiens
acagcaccuugcagaguga

SEQ ID NO: 390939 - RNA, 19 nt, Homo sapiens
gugcauggccuggcuugug

SEQ ID NO: 390940 - RNA, 19 nt, Homo sapiens
aaaccucucagcugacugu

SEQ ID NO: 390941 - RNA, 19 nt, Homo sapiens
ggguuggacaggacaguga

SEQ ID NO: 390942 - RNA, 19 nt, Homo sapiens
gauguggacgucaaauacu

SEQ ID NO: 390943 - RNA, 19 nt, Homo sapiens
aggauguggacgucaaaua

SEQ ID NO: 390944 - RNA, 19 nt, Homo sapiens
caauguccgcuucaaugug

SEQ ID NO: 390945 - RNA, 19 nt, Homo sapiens
cauaauaggugcucaauaa

SEQ ID NO: 390946 - RNA, 19 nt, Homo sapiens
gaaguuaggucaagaugaa

SEQ ID NO: 390947 - RNA, 19 nt, Homo sapiens
ggaaauaacuacuaagcaa

SEQ ID NO: 390948 - RNA, 19 nt, Homo sapiens
gaguuaagcugaagaguuu

SEQ ID NO: 390949 - RNA, 19 nt, Homo sapiens
ggaugcaucuuguuucaua

SEQ ID NO: 390950 - RNA, 19 nt, Homo sapiens
gugaauaugugguuucuaa

SEQ ID NO: 390951 - RNA, 19 nt, Homo sapiens
gaagauagagagaccauaa

SEQ ID NO: 390952 - RNA, 19 nt, Homo sapiens
ggagacauguugagauuug

SEQ ID NO: 390953 - RNA, 19 nt, Homo sapiens
ggccaagaauuaaguauuu

SEQ ID NO: 390954 - RNA, 19 nt, Homo sapiens
gaacaucuucuaccucuuu

SEQ ID NO: 390955 - RNA, 19 nt, Homo sapiens
ggugagaacuugcccauug

SEQ ID NO: 390956 - RNA, 19 nt, Homo sapiens
gaagugaauuguugccauu

SEQ ID NO: 390957 - RNA, 19 nt, Homo sapiens
gagguuaucugucugcauu

SEQ ID NO: 390958 - RNA, 19 nt, Homo sapiens
gcauuagucucaugugaaa

SEQ ID NO: 390959 - RNA, 19 nt, Homo sapiens
gaaaggacccgaagugaau

SEQ ID NO: 390960 - RNA, 19 nt, Homo sapiens
gugauucucuugacguuua

SEQ ID NO: 390961 - RNA, 19 nt, Homo sapiens
gcagauuuccuguucuuua

SEQ ID NO: 390962 - RNA, 19 nt, Homo sapiens
ggaauuagacagugugaaa

SEQ ID NO: 390963 - RNA, 19 nt, Homo sapiens
gaaggcaggugaauaugug

SEQ ID NO: 390964 - RNA, 19 nt, Homo sapiens
gauaaugaguuaagcugaa

SEQ ID NO: 390965 - RNA, 19 nt, Homo sapiens
gauagagagaccauaauua

SEQ ID NO: 390966 - RNA, 19 nt, Homo sapiens
gcuaugagguuugcuugua

SEQ ID NO: 390967 - RNA, 19 nt, Homo sapiens
gaaaaguucuccuaucuug

SEQ ID NO: 390968 - RNA, 19 nt, Homo sapiens
caaguuauguucuucuuca

SEQ ID NO: 390969 - RNA, 19 nt, Homo sapiens
gcaaauuaauagugaggaa

SEQ ID NO: 390970 - RNA, 19 nt, Homo sapiens
guacucaugucauucagaa

SEQ ID NO: 390971 - RNA, 19 nt, Homo sapiens
uaugguggcugacagauuu

SEQ ID NO: 390972 - RNA, 19 nt, Homo sapiens
gcaguauguuuguuucauu

SEQ ID NO: 390973 - RNA, 19 nt, Homo sapiens
gcucuagcuucuguaauua

SEQ ID NO: 390974 - RNA, 19 nt, Homo sapiens
ggacgaauagaguuuaauu

SEQ ID NO: 390975 - RNA, 19 nt, Homo sapiens
gcucauaacuuggccaugu

SEQ ID NO: 390976 - RNA, 19 nt, Homo sapiens
aaacucaccuugucucaug

SEQ ID NO: 390977 - RNA, 19 nt, Homo sapiens
gauaauacugugcagauuu

SEQ ID NO: 390978 - RNA, 19 nt, Homo sapiens
gaaauuacauaacguucag

SEQ ID NO: 390979 - RNA, 19 nt, Homo sapiens
gaaggaaggcaggugaaua

SEQ ID NO: 390980 - RNA, 19 nt, Homo sapiens
caccuugucucaugacuuu

SEQ ID NO: 390981 - RNA, 19 nt, Homo sapiens
gaaccuacuuaaagacugu

SEQ ID NO: 390982 - RNA, 19 nt, Homo sapiens
gaauuguugccauuucuua

SEQ ID NO: 390983 - RNA, 19 nt, Homo sapiens
gaggaugcaucuuguuuca

SEQ ID NO: 390984 - RNA, 19 nt, Homo sapiens
gauccuaauuacuugcaua

SEQ ID NO: 390985 - RNA, 19 nt, Homo sapiens
aggaugaccuugagacuuu

SEQ ID NO: 390986 - RNA, 19 nt, Homo sapiens
cagcuuacaucaguuguuu

SEQ ID NO: 390987 - RNA, 19 nt, Homo sapiens
ccacugugccuacauuuaa

SEQ ID NO: 390988 - RNA, 19 nt, Homo sapiens
uuacucguauuccuuguua

SEQ ID NO: 390989 - RNA, 19 nt, Homo sapiens
ggcaacaacuuagaagaaa

SEQ ID NO: 390990 - RNA, 19 nt, Homo sapiens
ccuaauuacuugcauagaa

SEQ ID NO: 390991 - RNA, 19 nt, Homo sapiens
gaggacgaauagaguuuaa

SEQ ID NO: 390992 - RNA, 19 nt, Homo sapiens
uggcaaaugauccuaauua

SEQ ID NO: 390993 - RNA, 19 nt, Homo sapiens
ggcucuagcuucuguaauu

SEQ ID NO: 390994 - RNA, 19 nt, Homo sapiens
gaacuugcccauugaagau

SEQ ID NO: 390995 - RNA, 19 nt, Homo sapiens
gcacuggaaccauugcuuu

SEQ ID NO: 390996 - RNA, 19 nt, Homo sapiens
gggugauacuggagucuua

SEQ ID NO: 390997 - RNA, 19 nt, Homo sapiens
ggauaauacugugcagauu

SEQ ID NO: 390998 - RNA, 19 nt, Homo sapiens
ggaagagacuguuguucgu

SEQ ID NO: 390999 - RNA, 19 nt, Homo sapiens
ugaagaugagguacuauua

SEQ ID NO: 391000 - RNA, 19 nt, Homo sapiens
gacccgaagugaauuguug

SEQ ID NO: 391001 - RNA, 19 nt, Homo sapiens
cuaacgaggucuuguugaa

SEQ ID NO: 391002 - RNA, 19 nt, Homo sapiens
gauuugcacuggaaccauu

SEQ ID NO: 391003 - RNA, 19 nt, Homo sapiens
guuauguucuucuucauug

SEQ ID NO: 391004 - RNA, 19 nt, Homo sapiens
gcaccuauuugggaucauu

SEQ ID NO: 391005 - RNA, 19 nt, Homo sapiens
gcaacaacuuagaagaaau

SEQ ID NO: 391006 - RNA, 19 nt, Homo sapiens
ccaacaaccucaugaaacu

SEQ ID NO: 391007 - RNA, 19 nt, Homo sapiens
uaaagacugugaagcugaa

SEQ ID NO: 391008 - RNA, 19 nt, Homo sapiens
gcccucagcucacagaaau

SEQ ID NO: 391009 - RNA, 19 nt, Homo sapiens
ccucuaagacuuuguauau

SEQ ID NO: 391010 - RNA, 19 nt, Homo sapiens
cuaauaagcaguauguuug

SEQ ID NO: 391011 - RNA, 19 nt, Homo sapiens
uaacuguagugccuccuaa

SEQ ID NO: 391012 - RNA, 19 nt, Homo sapiens
gaauaucaucuccaauuug

SEQ ID NO: 391013 - RNA, 19 nt, Homo sapiens
gugaaacgcuuagcaagug

SEQ ID NO: 391014 - RNA, 19 nt, Homo sapiens
gcuuggauaugaaacugua

SEQ ID NO: 391015 - RNA, 19 nt, Homo sapiens
gucaggaaauaacuacuaa

SEQ ID NO: 391016 - RNA, 19 nt, Homo sapiens
caaaucggcucuagcuucu

SEQ ID NO: 391017 - RNA, 19 nt, Homo sapiens
ugauuucacuggaauauag

SEQ ID NO: 391018 - RNA, 19 nt, Homo sapiens
cccaaagacuccucuaaga

SEQ ID NO: 391019 - RNA, 19 nt, Homo sapiens
cgggagacauguugagauu

SEQ ID NO: 391020 - RNA, 19 nt, Homo sapiens
gcaaauggcaacaacuuag

SEQ ID NO: 391021 - RNA, 19 nt, Homo sapiens
acaggaagcuauaaguguu

SEQ ID NO: 391022 - RNA, 19 nt, Homo sapiens
gcaaauguucgcuucaaug

SEQ ID NO: 391023 - RNA, 19 nt, Homo sapiens
gcugaauucuuuauguaug

SEQ ID NO: 391024 - RNA, 19 nt, Homo sapiens
gacguucguuugaauauca

SEQ ID NO: 391025 - RNA, 19 nt, Homo sapiens
gaagaugagguacuauuag

SEQ ID NO: 391026 - RNA, 19 nt, Homo sapiens
gcagucugaugugauguaa

SEQ ID NO: 391027 - RNA, 19 nt, Homo sapiens
caacuccuguucuguuuag

SEQ ID NO: 391028 - RNA, 19 nt, Homo sapiens
agauugcaguucuguauuu

SEQ ID NO: 391029 - RNA, 19 nt, Homo sapiens
gaaguguggcugcaucuug

SEQ ID NO: 391030 - RNA, 19 nt, Homo sapiens
gaugugauguaacuguuuc

SEQ ID NO: 391031 - RNA, 19 nt, Homo sapiens
ucacuggaauauaggcuuu

SEQ ID NO: 391032 - RNA, 19 nt, Homo sapiens
ucagaggaauugugcuuug

SEQ ID NO: 391033 - RNA, 19 nt, Homo sapiens
gagagaauuuguuuuggua

SEQ ID NO: 391034 - RNA, 19 nt, Homo sapiens
gaggagcccuaagcauuga

SEQ ID NO: 391035 - RNA, 19 nt, Homo sapiens
gcacaggaagcuauaagug

SEQ ID NO: 391036 - RNA, 19 nt, Homo sapiens
cgacucaacaguauuaaga

SEQ ID NO: 391037 - RNA, 19 nt, Homo sapiens
ugaugaagaugagguacua

SEQ ID NO: 391038 - RNA, 19 nt, Homo sapiens
uaaaagaacuuggugagaa

SEQ ID NO: 391039 - RNA, 19 nt, Homo sapiens
cugagcagcugggaaauuu

SEQ ID NO: 391040 - RNA, 19 nt, Homo sapiens
ggaaauuacauaacguuca

SEQ ID NO: 391041 - RNA, 19 nt, Homo sapiens
gcucaggguuaauguagug

SEQ ID NO: 391042 - RNA, 19 nt, Homo sapiens
uauaaguguucuugcauug

SEQ ID NO: 391043 - RNA, 19 nt, Homo sapiens
gcaaaugcugcccaucgua

SEQ ID NO: 391044 - RNA, 19 nt, Homo sapiens
guaaaugaagugauuggaa

SEQ ID NO: 391045 - RNA, 19 nt, Homo sapiens
gcagaugauuugcggauua

SEQ ID NO: 391046 - RNA, 19 nt, Homo sapiens
ggagaaagcucuguggauu

SEQ ID NO: 391047 - RNA, 19 nt, Homo sapiens
gaauggaucugacaguguu

SEQ ID NO: 391048 - RNA, 19 nt, Homo sapiens
gaaaggagcaguagaugau

SEQ ID NO: 391049 - RNA, 19 nt, Homo sapiens
aaacagcuguaacacauuu

SEQ ID NO: 391050 - RNA, 19 nt, Homo sapiens
ccaaacagcuguaacacau

SEQ ID NO: 391051 - RNA, 19 nt, Homo sapiens
ggacuagauuggacuguau

SEQ ID NO: 391052 - RNA, 19 nt, Homo sapiens
gauuacagcagcagaauuu

SEQ ID NO: 391053 - RNA, 19 nt, Homo sapiens
ccucauuacuguaucauuu

SEQ ID NO: 391054 - RNA, 19 nt, Homo sapiens
gcucauacauaucacauca

SEQ ID NO: 391055 - RNA, 19 nt, Homo sapiens
guagggcacuuuuaauuua

SEQ ID NO: 391056 - RNA, 19 nt, Homo sapiens
gcgaaagaaagaugaaaua

SEQ ID NO: 391057 - RNA, 19 nt, Homo sapiens
caauaagccucgcacaguu

SEQ ID NO: 391058 - RNA, 19 nt, Homo sapiens
gaaguaaacucuguucacu

SEQ ID NO: 391059 - RNA, 19 nt, Homo sapiens
cauaccaggugcaugaaua

SEQ ID NO: 391060 - RNA, 19 nt, Homo sapiens
aaacauaccaggugcauga

SEQ ID NO: 391061 - RNA, 19 nt, Homo sapiens
gaacuauucggcuauguga

SEQ ID NO: 391062 - RNA, 19 nt, Homo sapiens
cagcagaauuucauccaaa

SEQ ID NO: 391063 - RNA, 19 nt, Homo sapiens
gcagaagcagauauaauuu

SEQ ID NO: 391064 - RNA, 19 nt, Homo sapiens
gcuaugggauuuaauugug

SEQ ID NO: 391065 - RNA, 19 nt, Homo sapiens
uaucaagccugccaauaug

SEQ ID NO: 391066 - RNA, 19 nt, Homo sapiens
guauagagauccuacuaca

SEQ ID NO: 391067 - RNA, 19 nt, Homo sapiens
uaaacucuguucacuguau

SEQ ID NO: 391068 - RNA, 19 nt, Homo sapiens
cacaucaacucaauuucua

SEQ ID NO: 391069 - RNA, 19 nt, Homo sapiens
ccagaaggguauaacuuga

SEQ ID NO: 391070 - RNA, 19 nt, Homo sapiens
gacuggaucuuacaauaau

SEQ ID NO: 391071 - RNA, 19 nt, Homo sapiens
cgaagaauauuugccaaug

SEQ ID NO: 391072 - RNA, 19 nt, Homo sapiens
gauggaagguauagagauc

SEQ ID NO: 391073 - RNA, 19 nt, Homo sapiens
agauaaaggugguagaguu

SEQ ID NO: 391074 - RNA, 19 nt, Homo sapiens
gcaaguggcaagcgaaaga

SEQ ID NO: 391075 - RNA, 19 nt, Homo sapiens
aaacacaaagcgagacaua

SEQ ID NO: 391076 - RNA, 19 nt, Homo sapiens
caucuugccuaauggacua

SEQ ID NO: 391077 - RNA, 19 nt, Homo sapiens
ggauuaaucuuuggcaucu

SEQ ID NO: 391078 - RNA, 19 nt, Homo sapiens
gaagaauauuugccaaugc

SEQ ID NO: 391079 - RNA, 19 nt, Homo sapiens
aaauacagcucauucuuac

SEQ ID NO: 391080 - RNA, 19 nt, Homo sapiens
ucagaauguuugacagaaa

SEQ ID NO: 391081 - RNA, 19 nt, Homo sapiens
gauguaaaauucagccaua

SEQ ID NO: 391082 - RNA, 19 nt, Homo sapiens
caugucugcuagccauuua

SEQ ID NO: 391083 - RNA, 19 nt, Homo sapiens
agaacccacuuccugcuua

SEQ ID NO: 391084 - RNA, 19 nt, Homo sapiens
augaauaccucagaaguaa

SEQ ID NO: 391085 - RNA, 19 nt, Homo sapiens
cagaugauuugcggauuaa

SEQ ID NO: 391086 - RNA, 19 nt, Homo sapiens
guagaguugucaucuuuca

SEQ ID NO: 391087 - RNA, 19 nt, Homo sapiens
gauaaaggugguagaguug

SEQ ID NO: 391088 - RNA, 19 nt, Homo sapiens
cauaucacaucaacucaau

SEQ ID NO: 391089 - RNA, 19 nt, Homo sapiens
uagcauucguuccuauaaa

SEQ ID NO: 391090 - RNA, 19 nt, Homo sapiens
ugacuggaucuuacaauaa

SEQ ID NO: 391091 - RNA, 19 nt, Homo sapiens
gcagcagaauuucauccaa

SEQ ID NO: 391092 - RNA, 19 nt, Homo sapiens
ccaaugcucauacauauca

SEQ ID NO: 391093 - RNA, 19 nt, Homo sapiens
agcaguagaugaugaugua

SEQ ID NO: 391094 - RNA, 19 nt, Homo sapiens
ugguagaguugucaucuuu

SEQ ID NO: 391095 - RNA, 19 nt, Homo sapiens
agaaagcucuguggauuca

SEQ ID NO: 391096 - RNA, 19 nt, Homo sapiens
caugaauaccucagaagua

SEQ ID NO: 391097 - RNA, 19 nt, Homo sapiens
gcaucugcccucugugaua

SEQ ID NO: 391098 - RNA, 19 nt, Homo sapiens
agaaggguauaacuugaaa

SEQ ID NO: 391099 - RNA, 19 nt, Homo sapiens
agacauaacccuagaagca

SEQ ID NO: 391100 - RNA, 19 nt, Homo sapiens
gauaucaagccugccaaua

SEQ ID NO: 391101 - RNA, 19 nt, Homo sapiens
gaacccacuuccugcuuag

SEQ ID NO: 391102 - RNA, 19 nt, Homo sapiens
gccuagacuucaauaagaa

SEQ ID NO: 391103 - RNA, 19 nt, Homo sapiens
ccagcagggucaccauuug

SEQ ID NO: 391104 - RNA, 19 nt, Homo sapiens
aguaaacucuguucacugu

SEQ ID NO: 391105 - RNA, 19 nt, Homo sapiens
gagcuaacagaggugauua

SEQ ID NO: 391106 - RNA, 19 nt, Homo sapiens
ucuugguggugguauauua

SEQ ID NO: 391107 - RNA, 19 nt, Homo sapiens
gacuagagacuauuuguca

SEQ ID NO: 391108 - RNA, 19 nt, Homo sapiens
ugccaaugcucauacauau

SEQ ID NO: 391109 - RNA, 19 nt, Homo sapiens
aaccagaguuugacuacuu

SEQ ID NO: 391110 - RNA, 19 nt, Homo sapiens
ccauugugaugacgucaaa

SEQ ID NO: 391111 - RNA, 19 nt, Homo sapiens
gcagauauaauuucuacag

SEQ ID NO: 391112 - RNA, 19 nt, Homo sapiens
gaauguuguuggaauggau

SEQ ID NO: 391113 - RNA, 19 nt, Homo sapiens
gcuguaacacauuuguaua

SEQ ID NO: 391114 - RNA, 19 nt, Homo sapiens
cuauggaucuaaugguuga

SEQ ID NO: 391115 - RNA, 19 nt, Homo sapiens
gccuauggaucuaaugguu

SEQ ID NO: 391116 - RNA, 19 nt, Homo sapiens
cagaggagaauauaauguu

SEQ ID NO: 391117 - RNA, 19 nt, Homo sapiens
gcaagcgaaagaaagauga

SEQ ID NO: 391118 - RNA, 19 nt, Homo sapiens
gugcaugaauaccucagaa

SEQ ID NO: 391119 - RNA, 19 nt, Homo sapiens
gaccagaaggguauaacuu

SEQ ID NO: 391120 - RNA, 19 nt, Homo sapiens
cuagaagcaucgcgggaaa

SEQ ID NO: 391121 - RNA, 19 nt, Homo sapiens
gaaccugaagaucccagua

SEQ ID NO: 391122 - RNA, 19 nt, Homo sapiens
aaagagagagguccauugu

SEQ ID NO: 391123 - RNA, 19 nt, Homo sapiens
gccaugaaccagaguuuga

SEQ ID NO: 391124 - RNA, 19 nt, Homo sapiens
gcagaggagaauauaaugu

SEQ ID NO: 391125 - RNA, 19 nt, Homo sapiens
uagcagaggagaauauaau

SEQ ID NO: 391126 - RNA, 19 nt, Homo sapiens
gagaaagcucuguggauuc

SEQ ID NO: 391127 - RNA, 19 nt, Homo sapiens
cgaaaucaucuccucuauu

SEQ ID NO: 391128 - RNA, 19 nt, Homo sapiens
guauacagcagcaguaaag

SEQ ID NO: 391129 - RNA, 19 nt, Homo sapiens
gcuggaggagggaaugaua

SEQ ID NO: 391130 - RNA, 19 nt, Homo sapiens
agaggaggauggaagguau

SEQ ID NO: 391131 - RNA, 19 nt, Homo sapiens
ggaauggaucugacagugu

SEQ ID NO: 391132 - RNA, 19 nt, Homo sapiens
ccgaaaucaucuccucuau

SEQ ID NO: 391133 - RNA, 19 nt, Homo sapiens
ggugaaaggagcaguagau

SEQ ID NO: 391134 - RNA, 19 nt, Homo sapiens
gcacugaaaauaaggaaaa

SEQ ID NO: 391135 - RNA, 19 nt, Homo sapiens
gauaguugaaucuagcauu

SEQ ID NO: 391136 - RNA, 19 nt, Homo sapiens
agccuagacuucaauaaga

SEQ ID NO: 391137 - RNA, 19 nt, Homo sapiens
augacuggaucuuacaaua

SEQ ID NO: 391138 - RNA, 19 nt, Homo sapiens
ugaaaggagcaguagauga

SEQ ID NO: 391139 - RNA, 19 nt, Homo sapiens
agcagaagcagauauaauu

SEQ ID NO: 391140 - RNA, 19 nt, Homo sapiens
gucaugcuaugggauuuaa

SEQ ID NO: 391141 - RNA, 19 nt, Homo sapiens
gaauaccucagaaguaaac

SEQ ID NO: 391142 - RNA, 19 nt, Homo sapiens
gcaugaauaccucagaagu

SEQ ID NO: 391143 - RNA, 19 nt, Homo sapiens
caucugcccucugugauag

SEQ ID NO: 391144 - RNA, 19 nt, Homo sapiens
cauagcagaggagaauaua

SEQ ID NO: 391145 - RNA, 19 nt, Homo sapiens
gagguugucuguaguauuu

SEQ ID NO: 391146 - RNA, 19 nt, Homo sapiens
gagaaaggcuggucuguuc

SEQ ID NO: 391147 - RNA, 19 nt, Homo sapiens
ggaaaugauuggaauagaa

SEQ ID NO: 391148 - RNA, 19 nt, Homo sapiens
gaaugcagcuuacuuucuu

SEQ ID NO: 391149 - RNA, 19 nt, Homo sapiens
agaaacagccugagaauuu

SEQ ID NO: 391150 - RNA, 19 nt, Homo sapiens
gaaacagccugagaauuug

SEQ ID NO: 391151 - RNA, 19 nt, Homo sapiens
gaccgaagcugacauuauc

SEQ ID NO: 391152 - RNA, 19 nt, Homo sapiens
gcacacacauaucacauca

SEQ ID NO: 391153 - RNA, 19 nt, Homo sapiens
ucgauuaccugaagaguuu

SEQ ID NO: 391154 - RNA, 19 nt, Homo sapiens
ccugaagaguuuagaaaua

SEQ ID NO: 391155 - RNA, 19 nt, Homo sapiens
agaagaggaugcagaauga

SEQ ID NO: 391156 - RNA, 19 nt, Homo sapiens
gcugaugaccugaggauua

SEQ ID NO: 391157 - RNA, 19 nt, Homo sapiens
caaccacacgggagaauua

SEQ ID NO: 391158 - RNA, 19 nt, Homo sapiens
gcagaaugcagcuuacuuu

SEQ ID NO: 391159 - RNA, 19 nt, Homo sapiens
ggacauugauacccgcaaa

SEQ ID NO: 391160 - RNA, 19 nt, Homo sapiens
guuaauaucucuacaucug

SEQ ID NO: 391161 - RNA, 19 nt, Homo sapiens
gaaaacugguucuggguua

SEQ ID NO: 391162 - RNA, 19 nt, Homo sapiens
ucaagcagcugugacauga

SEQ ID NO: 391163 - RNA, 19 nt, Homo sapiens
uaucugguguucuaaauga

SEQ ID NO: 391164 - RNA, 19 nt, Homo sapiens
ccagagauuuauugcauga

SEQ ID NO: 391165 - RNA, 19 nt, Homo sapiens
cauuuaagccagagauuua

SEQ ID NO: 391166 - RNA, 19 nt, Homo sapiens
ggauccagauuuauaacuu

SEQ ID NO: 391167 - RNA, 19 nt, Homo sapiens
gaaaugaacuguggggaaa

SEQ ID NO: 391168 - RNA, 19 nt, Homo sapiens
cuuauuaucugguguucua

SEQ ID NO: 391169 - RNA, 19 nt, Homo sapiens
gagaagaggaugcagaaug

SEQ ID NO: 391170 - RNA, 19 nt, Homo sapiens
gaauuuggcuagggaacuu

SEQ ID NO: 391171 - RNA, 19 nt, Homo sapiens
gguaaaugguuugagauga

SEQ ID NO: 391172 - RNA, 19 nt, Homo sapiens
uuuguaagcuccauagaaa

SEQ ID NO: 391173 - RNA, 19 nt, Homo sapiens
guaaaugguuugagaugag

SEQ ID NO: 391174 - RNA, 19 nt, Homo sapiens
gacaugaagugaaugaagu

SEQ ID NO: 391175 - RNA, 19 nt, Homo sapiens
caucgagacuuaccagguu

SEQ ID NO: 391176 - RNA, 19 nt, Homo sapiens
cuaggugucugcugcgaua

SEQ ID NO: 391177 - RNA, 19 nt, Homo sapiens
gcaguggcggcuacaaaua

SEQ ID NO: 391178 - RNA, 19 nt, Homo sapiens
gcaugcaaaggauuuauaa

SEQ ID NO: 391179 - RNA, 19 nt, Homo sapiens
gaucacagcagccgaguuc

SEQ ID NO: 391180 - RNA, 19 nt, Homo sapiens
ggauuaaccuauggaacuu

SEQ ID NO: 391181 - RNA, 19 nt, Homo sapiens
gcugugacaugaagugaau

SEQ ID NO: 391182 - RNA, 19 nt, Homo sapiens
uaaaugaagcaguaaguug

SEQ ID NO: 391183 - RNA, 19 nt, Homo sapiens
cuagggaacuugaaugcuu

SEQ ID NO: 391184 - RNA, 19 nt, Homo sapiens
caaguaagccugcugucaa

SEQ ID NO: 391185 - RNA, 19 nt, Homo sapiens
cagcuuauuuauuccauug

SEQ ID NO: 391186 - RNA, 19 nt, Homo sapiens
ggacaauccggcuguguga

SEQ ID NO: 391187 - RNA, 19 nt, Homo sapiens
caggguaaaugguuugaga

SEQ ID NO: 391188 - RNA, 19 nt, Homo sapiens
gcagcuuacuuucuucugu

SEQ ID NO: 391189 - RNA, 19 nt, Homo sapiens
gauccagauuuauaacuuc

SEQ ID NO: 391190 - RNA, 19 nt, Homo sapiens
aaccagaacuagucaguau

SEQ ID NO: 391191 - RNA, 19 nt, Homo sapiens
ccuauggaacuuugaaaua

SEQ ID NO: 391192 - RNA, 19 nt, Homo sapiens
gcacaucaacccugcuaug

SEQ ID NO: 391193 - RNA, 19 nt, Homo sapiens
caguaauucuuccauaguu

SEQ ID NO: 391194 - RNA, 19 nt, Homo sapiens
ggucuucauuugaugcauu

SEQ ID NO: 391195 - RNA, 19 nt, Homo sapiens
ucucugaaauuaucucuuc

SEQ ID NO: 391196 - RNA, 19 nt, Homo sapiens
ugacaggcacaccaaauuu

SEQ ID NO: 391197 - RNA, 19 nt, Homo sapiens
cugaugaccugaggauuaa

SEQ ID NO: 391198 - RNA, 19 nt, Homo sapiens
cuaaaugcaugcaaaggau

SEQ ID NO: 391199 - RNA, 19 nt, Homo sapiens
caagcuguguucccucuau

SEQ ID NO: 391200 - RNA, 19 nt, Homo sapiens
gugaagcuguggaaaguca

SEQ ID NO: 391201 - RNA, 19 nt, Homo sapiens
gagggaucauggauacuug

SEQ ID NO: 391202 - RNA, 19 nt, Homo sapiens
ggcacuaaaugcaugcaaa

SEQ ID NO: 391203 - RNA, 19 nt, Homo sapiens
gaugcagaaugacaaggaa

SEQ ID NO: 391204 - RNA, 19 nt, Homo sapiens
gguugucuguaguauuuaa

SEQ ID NO: 391205 - RNA, 19 nt, Homo sapiens
agacuuaccagguucauga

SEQ ID NO: 391206 - RNA, 19 nt, Homo sapiens
cgaguucgauuaccugaag

SEQ ID NO: 391207 - RNA, 19 nt, Homo sapiens
gggucggguuguaauauuu

SEQ ID NO: 391208 - RNA, 19 nt, Homo sapiens
gaagcugacauuaucucua

SEQ ID NO: 391209 - RNA, 19 nt, Homo sapiens
ggaaaggcacuaaaugcau

SEQ ID NO: 391210 - RNA, 19 nt, Homo sapiens
ggaaaucaagcagcuguga

SEQ ID NO: 391211 - RNA, 19 nt, Homo sapiens
acacagugcuucccagagu

SEQ ID NO: 391212 - RNA, 19 nt, Homo sapiens
agagagcacuuucgacaca

SEQ ID NO: 391213 - RNA, 19 nt, Homo sapiens
gaauacuagucaaacaagu

SEQ ID NO: 391214 - RNA, 19 nt, Homo sapiens
aguugaggauccagauuua

SEQ ID NO: 391215 - RNA, 19 nt, Homo sapiens
ggacagaaagagagcacuu

SEQ ID NO: 391216 - RNA, 19 nt, Homo sapiens
ggagaaaagagauaaguuu

SEQ ID NO: 391217 - RNA, 19 nt, Homo sapiens
ccacacgggagaauuacua

SEQ ID NO: 391218 - RNA, 19 nt, Homo sapiens
uaaaugguuugagaugaga

SEQ ID NO: 391219 - RNA, 19 nt, Homo sapiens
ggguuaauaucucuacauc

SEQ ID NO: 391220 - RNA, 19 nt, Homo sapiens
gaaaggcuggucuguucuu

SEQ ID NO: 391221 - RNA, 19 nt, Homo sapiens
gcaaguaagccugcuguca

SEQ ID NO: 391222 - RNA, 19 nt, Homo sapiens
gaagauccaagcaacagau

SEQ ID NO: 391223 - RNA, 19 nt, Homo sapiens
uccaucugcugccuuguua

SEQ ID NO: 391224 - RNA, 19 nt, Homo sapiens
cauagaaacagccugagaa

SEQ ID NO: 391225 - RNA, 19 nt, Homo sapiens
aaaaugagguugucuguag

SEQ ID NO: 391226 - RNA, 19 nt, Homo sapiens
cgagaucagugucgacagu

SEQ ID NO: 391227 - RNA, 19 nt, Homo sapiens
aaagucagcgagcgugaua

SEQ ID NO: 391228 - RNA, 19 nt, Homo sapiens
cugaagaguuuagaaauag

SEQ ID NO: 391229 - RNA, 19 nt, Homo sapiens
guaauucuuccauaguuga

SEQ ID NO: 391230 - RNA, 19 nt, Homo sapiens
gaccugaggauuaaccuau

SEQ ID NO: 391231 - RNA, 19 nt, Homo sapiens
ugaggauccagauuuauaa

SEQ ID NO: 391232 - RNA, 19 nt, Homo sapiens
caacccugcuaugcucuuu

SEQ ID NO: 391233 - RNA, 19 nt, Homo sapiens
uaaaaggaguccaacauuc

SEQ ID NO: 391234 - RNA, 19 nt, Homo sapiens
ggcuacaaauaaccuauau

SEQ ID NO: 391235 - RNA, 19 nt, Homo sapiens
ggagggaucauggauacuu

SEQ ID NO: 391236 - RNA, 19 nt, Homo sapiens
gcacauuccagagccauga

SEQ ID NO: 391237 - RNA, 19 nt, Homo sapiens
ccagauuuauaacuucuag

SEQ ID NO: 391238 - RNA, 19 nt, Homo sapiens
ucucuucgauuucggaugu

SEQ ID NO: 391239 - RNA, 19 nt, Homo sapiens
acacacauaucacaucaac

SEQ ID NO: 391240 - RNA, 19 nt, Homo sapiens
aagcugacauuaucucuac

SEQ ID NO: 391241 - RNA, 19 nt, Homo sapiens
ccaucaaccuccauuguac

SEQ ID NO: 391242 - RNA, 19 nt, Homo sapiens
cgaccgaagcugacauuau

SEQ ID NO: 391243 - RNA, 19 nt, Homo sapiens
gacuuuaauuucccuauac

SEQ ID NO: 391244 - RNA, 19 nt, Homo sapiens
ucucacauacugaauacua

SEQ ID NO: 391245 - RNA, 19 nt, Homo sapiens
gaccaaaccucaaauauaa

SEQ ID NO: 391246 - RNA, 19 nt, Homo sapiens
ggagaaaguugcugaauaa

SEQ ID NO: 391247 - RNA, 19 nt, Homo sapiens
gaaagaugcuccagaauuc

SEQ ID NO: 391248 - RNA, 19 nt, Homo sapiens
gaaccugacuuccauguuu

SEQ ID NO: 391249 - RNA, 19 nt, Homo sapiens
gaaggaaaguuaagucuga

SEQ ID NO: 391250 - RNA, 19 nt, Homo sapiens
ccaaacaacuccacaaauu

SEQ ID NO: 391251 - RNA, 19 nt, Homo sapiens
uaaugaggcucuagauuua

SEQ ID NO: 391252 - RNA, 19 nt, Homo sapiens
ugacuuagcccuaguaaua

SEQ ID NO: 391253 - RNA, 19 nt, Homo sapiens
ggaaagaaagcauuagaua

SEQ ID NO: 391254 - RNA, 19 nt, Homo sapiens
uaacuuaccuggcuuaugu

SEQ ID NO: 391255 - RNA, 19 nt, Homo sapiens
gauauucucuggugcagua

SEQ ID NO: 391256 - RNA, 19 nt, Homo sapiens
ggaagaagaggaagauaua

SEQ ID NO: 391257 - RNA, 19 nt, Homo sapiens
uaaagucucuucacccaua

SEQ ID NO: 391258 - RNA, 19 nt, Homo sapiens
gaaacucacuggauacgaa

SEQ ID NO: 391259 - RNA, 19 nt, Homo sapiens
cauagaaacucacuggaua

SEQ ID NO: 391260 - RNA, 19 nt, Homo sapiens
gaaacaaguucuagaaagu

SEQ ID NO: 391261 - RNA, 19 nt, Homo sapiens
ggacucaguuaucacaaua

SEQ ID NO: 391262 - RNA, 19 nt, Homo sapiens
guaagggccuccagaauug

SEQ ID NO: 391263 - RNA, 19 nt, Homo sapiens
cagaauaccuacaacuuaa

SEQ ID NO: 391264 - RNA, 19 nt, Homo sapiens
gaucugaacucuauguuuc

SEQ ID NO: 391265 - RNA, 19 nt, Homo sapiens
gaacaugcuacucaucuua

SEQ ID NO: 391266 - RNA, 19 nt, Homo sapiens
gaaacgaagauguguauuu

SEQ ID NO: 391267 - RNA, 19 nt, Homo sapiens
ccagauaccuguaguaauc

SEQ ID NO: 391268 - RNA, 19 nt, Homo sapiens
gaaacugucuauaugaaug

SEQ ID NO: 391269 - RNA, 19 nt, Homo sapiens
ggaucuacauuucagaaua

SEQ ID NO: 391270 - RNA, 19 nt, Homo sapiens
guaaaggccucaacguuau

SEQ ID NO: 391271 - RNA, 19 nt, Homo sapiens
gaaaguugcugaauaacca

SEQ ID NO: 391272 - RNA, 19 nt, Homo sapiens
gaaggaagugguaaugaua

SEQ ID NO: 391273 - RNA, 19 nt, Homo sapiens
gaugaugccucuaaauuca

SEQ ID NO: 391274 - RNA, 19 nt, Homo sapiens
gaacaaacucuaagcagaa

SEQ ID NO: 391275 - RNA, 19 nt, Homo sapiens
gaacagaaagcagacauuu

SEQ ID NO: 391276 - RNA, 19 nt, Homo sapiens
gagcaaauuuccauguuau

SEQ ID NO: 391277 - RNA, 19 nt, Homo sapiens
ucacaauacuucucuacua

SEQ ID NO: 391278 - RNA, 19 nt, Homo sapiens
cagaauggcucacaucuuc

SEQ ID NO: 391279 - RNA, 19 nt, Homo sapiens
caagagaggaucuacauuu

SEQ ID NO: 391280 - RNA, 19 nt, Homo sapiens
gaauugagcccuugccauu

SEQ ID NO: 391281 - RNA, 19 nt, Homo sapiens
gacuguggaucuuauauaa

SEQ ID NO: 391282 - RNA, 19 nt, Homo sapiens
ggaaggcuuugaagauuau

SEQ ID NO: 391283 - RNA, 19 nt, Homo sapiens
gaacauagagcagaauuuc

SEQ ID NO: 391284 - RNA, 19 nt, Homo sapiens
gaacagagagaucccuuug

SEQ ID NO: 391285 - RNA, 19 nt, Homo sapiens
caggaaaccuugacaacuu

SEQ ID NO: 391286 - RNA, 19 nt, Homo sapiens
gaagaagagucagauggaa

SEQ ID NO: 391287 - RNA, 19 nt, Homo sapiens
gaaagcagacauuuaugaa

SEQ ID NO: 391288 - RNA, 19 nt, Homo sapiens
ccagccaaauccuauaaua

SEQ ID NO: 391289 - RNA, 19 nt, Homo sapiens
gcucacaucuucuaugaca

SEQ ID NO: 391290 - RNA, 19 nt, Homo sapiens
cagauuacuucuccuauga

SEQ ID NO: 391291 - RNA, 19 nt, Homo sapiens
agacuuugcucaagaacua

SEQ ID NO: 391292 - RNA, 19 nt, Homo sapiens
gcagaaaacuugagucaga

SEQ ID NO: 391293 - RNA, 19 nt, Homo sapiens
ugaccaaaccucaaauaua

SEQ ID NO: 391294 - RNA, 19 nt, Homo sapiens
gagagcaaauuuccauguu

SEQ ID NO: 391295 - RNA, 19 nt, Homo sapiens
guggaaagcuucaaucagu

SEQ ID NO: 391296 - RNA, 19 nt, Homo sapiens
gagcagaauuuccagaaca

SEQ ID NO: 391297 - RNA, 19 nt, Homo sapiens
gaagaagacuugguuacuc

SEQ ID NO: 391298 - RNA, 19 nt, Homo sapiens
gaaagggaaggaaaguuaa

SEQ ID NO: 391299 - RNA, 19 nt, Homo sapiens
uggagaaaguugcugaaua

SEQ ID NO: 391300 - RNA, 19 nt, Homo sapiens
gaaguccuguuggugauaa

SEQ ID NO: 391301 - RNA, 19 nt, Homo sapiens
cagaaggccugcuugaaga

SEQ ID NO: 391302 - RNA, 19 nt, Homo sapiens
uguaugagcuggaguacuu

SEQ ID NO: 391303 - RNA, 19 nt, Homo sapiens
gagaagacaggauuuguga

SEQ ID NO: 391304 - RNA, 19 nt, Homo sapiens
uaaggaagacuguaaauca

SEQ ID NO: 391305 - RNA, 19 nt, Homo sapiens
gcacagacaucauaaaaca

SEQ ID NO: 391306 - RNA, 19 nt, Homo sapiens
caacgagguuucucuguca

SEQ ID NO: 391307 - RNA, 19 nt, Homo sapiens
gaagauggacacuguacaa

SEQ ID NO: 391308 - RNA, 19 nt, Homo sapiens
agaaagggaaggaaaguua

SEQ ID NO: 391309 - RNA, 19 nt, Homo sapiens
ucagaauaccuacaacuua

SEQ ID NO: 391310 - RNA, 19 nt, Homo sapiens
caggaaggcuuugaagauu

SEQ ID NO: 391311 - RNA, 19 nt, Homo sapiens
agaaugagcuaugcagauu

SEQ ID NO: 391312 - RNA, 19 nt, Homo sapiens
ggauacacauuuaacuuag

SEQ ID NO: 391313 - RNA, 19 nt, Homo sapiens
caauaggucuggauacaca

SEQ ID NO: 391314 - RNA, 19 nt, Homo sapiens
ugaaagaugcuccagaauu

SEQ ID NO: 391315 - RNA, 19 nt, Homo sapiens
ccagccaccucuccaagua

SEQ ID NO: 391316 - RNA, 19 nt, Homo sapiens
ugaaaccaauggacacaaa

SEQ ID NO: 391317 - RNA, 19 nt, Homo sapiens
gggaaaagccauuauauuu

SEQ ID NO: 391318 - RNA, 19 nt, Homo sapiens
agagcaaauuuccauguua

SEQ ID NO: 391319 - RNA, 19 nt, Homo sapiens
gugcaagccuuccagagaa

SEQ ID NO: 391320 - RNA, 19 nt, Homo sapiens
agaaauacuuagaccauga

SEQ ID NO: 391321 - RNA, 19 nt, Homo sapiens
ggugauaaagccaaagaua

SEQ ID NO: 391322 - RNA, 19 nt, Homo sapiens
gaaaugaugcaaauucuac

SEQ ID NO: 391323 - RNA, 19 nt, Homo sapiens
gagaauggaccuagucaug

SEQ ID NO: 391324 - RNA, 19 nt, Homo sapiens
gcucugaaacugucuauau

SEQ ID NO: 391325 - RNA, 19 nt, Homo sapiens
ccugaaagaugcuccagaa

SEQ ID NO: 391326 - RNA, 19 nt, Homo sapiens
ugaauaauguugugaaugc

SEQ ID NO: 391327 - RNA, 19 nt, Homo sapiens
gaagaagaggaagauauaa

SEQ ID NO: 391328 - RNA, 19 nt, Homo sapiens
gauacuacuucagcaguuu

SEQ ID NO: 391329 - RNA, 19 nt, Homo sapiens
agagucagauggaaagaaa

SEQ ID NO: 391330 - RNA, 19 nt, Homo sapiens
uaauaugccuagcuuacaa

SEQ ID NO: 391331 - RNA, 19 nt, Homo sapiens
ggaggucaguugauuugga

SEQ ID NO: 391332 - RNA, 19 nt, Homo sapiens
gaucuacauuucagaauac

SEQ ID NO: 391333 - RNA, 19 nt, Homo sapiens
ugacugaaguugccucugu

SEQ ID NO: 391334 - RNA, 19 nt, Homo sapiens
acagaaagcagacauuuau

SEQ ID NO: 391335 - RNA, 19 nt, Homo sapiens
ggaagagauagauaaauug

SEQ ID NO: 391336 - RNA, 19 nt, Homo sapiens
ugaaacaaguucuagaaag

SEQ ID NO: 391337 - RNA, 19 nt, Homo sapiens
gaaaagccauuauauuugg

SEQ ID NO: 391338 - RNA, 19 nt, Homo sapiens
ggaaaaugauacagcuaua

SEQ ID NO: 391339 - RNA, 19 nt, Homo sapiens
aguaaaggccucaacguua

SEQ ID NO: 391340 - RNA, 19 nt, Homo sapiens
gaagacaggauuugugaca

SEQ ID NO: 391341 - RNA, 19 nt, Homo sapiens
ggaaaugaugcaaauucua

SEQ ID NO: 391342 - RNA, 19 nt, Homo sapiens
gagccuaaaucuaaagucu

SEQ ID NO: 391343 - RNA, 19 nt, Homo sapiens
gaauggaccuagucaugag

SEQ ID NO: 391344 - RNA, 19 nt, Homo sapiens
uaacugucauuuaggagaa

SEQ ID NO: 391345 - RNA, 19 nt, Homo sapiens
gaugaagacuggcccauuu

SEQ ID NO: 391346 - RNA, 19 nt, Homo sapiens
gaguguauccuguuuauua

SEQ ID NO: 391347 - RNA, 19 nt, Homo sapiens
ccucauugcuguucagauu

SEQ ID NO: 391348 - RNA, 19 nt, Homo sapiens
gaccagcccucucgguuug

SEQ ID NO: 391349 - RNA, 19 nt, Homo sapiens
ccacacaguuccagacaug

SEQ ID NO: 391350 - RNA, 19 nt, Homo sapiens
acucagaacuucaucauuc

SEQ ID NO: 391351 - RNA, 19 nt, Homo sapiens
ccggguggaugaccaaaua

SEQ ID NO: 391352 - RNA, 19 nt, Homo sapiens
ggucucauccgcauguaua

SEQ ID NO: 391353 - RNA, 19 nt, Homo sapiens
ccagacacuuuguggauga

SEQ ID NO: 391354 - RNA, 19 nt, Homo sapiens
gagaagugaccaaagugua

SEQ ID NO: 391355 - RNA, 19 nt, Homo sapiens
gaugagaggcuguuuacug

SEQ ID NO: 391356 - RNA, 19 nt, Homo sapiens
ccacaaggacuacauguuc

SEQ ID NO: 391357 - RNA, 19 nt, Homo sapiens
ugccugagguggcuguuua

SEQ ID NO: 391358 - RNA, 19 nt, Homo sapiens
ucauugcuguucagauuaa

SEQ ID NO: 391359 - RNA, 19 nt, Homo sapiens
ggcauacgcugacuacauc

SEQ ID NO: 391360 - RNA, 19 nt, Homo sapiens
gcaguucgcagcugauaga

SEQ ID NO: 391361 - RNA, 19 nt, Homo sapiens
gagaaggccgugaaugaga

SEQ ID NO: 391362 - RNA, 19 nt, Homo sapiens
ggaccagcccucucgguuu

SEQ ID NO: 391363 - RNA, 19 nt, Homo sapiens
gaccugguaugccaaacuu

SEQ ID NO: 391364 - RNA, 19 nt, Homo sapiens
gauaccugcugcuuccauu

SEQ ID NO: 391365 - RNA, 19 nt, Homo sapiens
ccgagugccuggagaaguu

SEQ ID NO: 391366 - RNA, 19 nt, Homo sapiens
gcaugucuuuccagaacuu

SEQ ID NO: 391367 - RNA, 19 nt, Homo sapiens
cggccacucucuccuguuu

SEQ ID NO: 391368 - RNA, 19 nt, Homo sapiens
ggucaggagucccaaaggu

SEQ ID NO: 391369 - RNA, 19 nt, Homo sapiens
gcaaauggaagcguucuca

SEQ ID NO: 391370 - RNA, 19 nt, Homo sapiens
gauuaaagccucuguuuug

SEQ ID NO: 391371 - RNA, 19 nt, Homo sapiens
ugaaugagaaccacaagga

SEQ ID NO: 391372 - RNA, 19 nt, Homo sapiens
agaaggccgugaaugagaa

SEQ ID NO: 391373 - RNA, 19 nt, Homo sapiens
uggagucgaugccuuucua

SEQ ID NO: 391374 - RNA, 19 nt, Homo sapiens
cuggagaaguucccuguga

SEQ ID NO: 391375 - RNA, 19 nt, Homo sapiens
gaaccacaaggacuacaug

SEQ ID NO: 391376 - RNA, 19 nt, Homo sapiens
ggaagcguucucaggcaua

SEQ ID NO: 391377 - RNA, 19 nt, Homo sapiens
ggagaagugaccaaagugu

SEQ ID NO: 391378 - RNA, 19 nt, Homo sapiens
gcucacuugucuucaggaa

SEQ ID NO: 391379 - RNA, 19 nt, Homo sapiens
gcugauagaccacccauac

SEQ ID NO: 391380 - RNA, 19 nt, Homo sapiens
uggaguguauccuguuuau

SEQ ID NO: 391381 - RNA, 19 nt, Homo sapiens
ggagagauaccugcugcuu

SEQ ID NO: 391382 - RNA, 19 nt, Homo sapiens
ccaaccagcuguggaacau

SEQ ID NO: 391383 - RNA, 19 nt, Homo sapiens
gugcuagacuggccagaag

SEQ ID NO: 391384 - RNA, 19 nt, Homo sapiens
ugggagaagugaccaaagu

SEQ ID NO: 391385 - RNA, 19 nt, Homo sapiens
gaacuguccauugcuuuua

SEQ ID NO: 391386 - RNA, 19 nt, Homo sapiens
ugccaaacuugaugaggaa

SEQ ID NO: 391387 - RNA, 19 nt, Homo sapiens
ccucucgguuugggaauaa

SEQ ID NO: 391388 - RNA, 19 nt, Homo sapiens
ggagaaguucccugugauc

SEQ ID NO: 391389 - RNA, 19 nt, Homo sapiens
ccuggaguguauccuguuu

SEQ ID NO: 391390 - RNA, 19 nt, Homo sapiens
gacacuuuguggaugagaa

SEQ ID NO: 391391 - RNA, 19 nt, Homo sapiens
ggaaacuccagaaaacaua

SEQ ID NO: 391392 - RNA, 19 nt, Homo sapiens
cuggacagguggauugaug

SEQ ID NO: 391393 - RNA, 19 nt, Homo sapiens
gaagcguucucaggcauac

SEQ ID NO: 391394 - RNA, 19 nt, Homo sapiens
aaaaggagauccacacagu

SEQ ID NO: 391395 - RNA, 19 nt, Homo sapiens
caaacuugaugaggaagca

SEQ ID NO: 391396 - RNA, 19 nt, Homo sapiens
ccugaacuguccauugcuu

SEQ ID NO: 391397 - RNA, 19 nt, Homo sapiens
agaacuucaucauuccaaa

SEQ ID NO: 391398 - RNA, 19 nt, Homo sapiens
ggagucgaugccuuucuaa

SEQ ID NO: 391399 - RNA, 19 nt, Homo sapiens
guggaugaccaaauagcua

SEQ ID NO: 391400 - RNA, 19 nt, Homo sapiens
aaccagcuguggaacauca

SEQ ID NO: 391401 - RNA, 19 nt, Homo sapiens
acauguuccuggaguguau

SEQ ID NO: 391402 - RNA, 19 nt, Homo sapiens
gggcaguucgcagcugaua

SEQ ID NO: 391403 - RNA, 19 nt, Homo sapiens
gguuugggaauaaggcaua

SEQ ID NO: 391404 - RNA, 19 nt, Homo sapiens
accaaaguguagccaguuu

SEQ ID NO: 391405 - RNA, 19 nt, Homo sapiens
gaagacuggcccauuugca

SEQ ID NO: 391406 - RNA, 19 nt, Homo sapiens
gcccagacacuuuguggau

SEQ ID NO: 391407 - RNA, 19 nt, Homo sapiens
ggaacuccacgcgcauuga

SEQ ID NO: 391408 - RNA, 19 nt, Homo sapiens
gcacccucauugcuguuca

SEQ ID NO: 391409 - RNA, 19 nt, Homo sapiens
ggugaggcaugucuuucca

SEQ ID NO: 391410 - RNA, 19 nt, Homo sapiens
gccacucucuccuguuucu

SEQ ID NO: 391411 - RNA, 19 nt, Homo sapiens
gaccaaaguguagccaguu

SEQ ID NO: 391412 - RNA, 19 nt, Homo sapiens
augagaaggccgugaauga

SEQ ID NO: 391413 - RNA, 19 nt, Homo sapiens
aggcaugucuuuccagaac

SEQ ID NO: 391414 - RNA, 19 nt, Homo sapiens
gaugagaaggccgugaaug

SEQ ID NO: 391415 - RNA, 19 nt, Homo sapiens
gaacuucaucauuccaaaa

SEQ ID NO: 391416 - RNA, 19 nt, Homo sapiens
gguaugccaaacuugauga

SEQ ID NO: 391417 - RNA, 19 nt, Homo sapiens
ggauuccucuuggcagucu

SEQ ID NO: 391418 - RNA, 19 nt, Homo sapiens
gguaaccuagccaauggaa

SEQ ID NO: 391419 - RNA, 19 nt, Homo sapiens
aaggagauccacacaguuc

SEQ ID NO: 391420 - RNA, 19 nt, Homo sapiens
gaagggugggugcaagagu

SEQ ID NO: 391421 - RNA, 19 nt, Homo sapiens
agaagugaccaaaguguag

SEQ ID NO: 391422 - RNA, 19 nt, Homo sapiens
cgaggccauugagaaacua

SEQ ID NO: 391423 - RNA, 19 nt, Homo sapiens
aagcugaccuucgaguaca

SEQ ID NO: 391424 - RNA, 19 nt, Homo sapiens
gcagggaagggaggagaga

SEQ ID NO: 391425 - RNA, 19 nt, Homo sapiens
uggagaaguucccugugau

SEQ ID NO: 391426 - RNA, 19 nt, Homo sapiens
gguguucaaucgguaccuu

SEQ ID NO: 391427 - RNA, 19 nt, Homo sapiens
gggagaagugaccaaagug

SEQ ID NO: 391428 - RNA, 19 nt, Homo sapiens
uagcuauugucuucaaggu

SEQ ID NO: 391429 - RNA, 19 nt, Homo sapiens
gaacuccacgcgcauugac

SEQ ID NO: 391430 - RNA, 19 nt, Homo sapiens
ugaggaagcagaaaacuug

SEQ ID NO: 391431 - RNA, 19 nt, Homo sapiens
ucccugaacuguccauugc

SEQ ID NO: 391432 - RNA, 19 nt, Homo sapiens
aggguaaccuagccaaugg

SEQ ID NO: 391433 - RNA, 19 nt, Homo sapiens
ccacucagaacuucaucau

SEQ ID NO: 391434 - RNA, 19 nt, Homo sapiens
ccugguaugccaaacuuga

SEQ ID NO: 391435 - RNA, 19 nt, Homo sapiens
ggacagguggauugaugag

SEQ ID NO: 391436 - RNA, 19 nt, Homo sapiens
gauucauccuuacccucaa

SEQ ID NO: 391437 - RNA, 19 nt, Homo sapiens
ccgaggccauugagaaacu

SEQ ID NO: 391438 - RNA, 19 nt, Homo sapiens
ugcugucucugcaagauug

SEQ ID NO: 391439 - RNA, 19 nt, Homo sapiens
gcuuuccucugcugucucu

SEQ ID NO: 391440 - RNA, 19 nt, Homo sapiens
agggaagggaggagagaua

SEQ ID NO: 391441 - RNA, 19 nt, Homo sapiens
aaagugaaccagggucuca

SEQ ID NO: 391442 - RNA, 19 nt, Homo sapiens
uuccagacaugggcaaaug

SEQ ID NO: 391443 - RNA, 19 nt, Homo sapiens
ggaguguauccuguuuauu

SEQ ID NO: 391444 - RNA, 19 nt, Homo sapiens
ccagacaugggcaaaugga

SEQ ID NO: 391445 - RNA, 19 nt, Homo sapiens
aaacaaaccucaucaguau

SEQ ID NO: 391446 - RNA, 19 nt, Homo sapiens
ggagaaagauacaacacua

SEQ ID NO: 391447 - RNA, 19 nt, Homo sapiens
ugaaugaacugguugagua

SEQ ID NO: 391448 - RNA, 19 nt, Homo sapiens
gcaguaggcuuccucugua

SEQ ID NO: 391449 - RNA, 19 nt, Homo sapiens
gaauagugcuuacaacaug

SEQ ID NO: 391450 - RNA, 19 nt, Homo sapiens
caauacaagugccgaauaa

SEQ ID NO: 391451 - RNA, 19 nt, Homo sapiens
ggaaaugaauggcaagcuu

SEQ ID NO: 391452 - RNA, 19 nt, Homo sapiens
gcauuguacuucuggaaua

SEQ ID NO: 391453 - RNA, 19 nt, Homo sapiens
gcucaaagaugccacuuca

SEQ ID NO: 391454 - RNA, 19 nt, Homo sapiens
gaucagugcuaacaucuuc

SEQ ID NO: 391455 - RNA, 19 nt, Homo sapiens
gcuagcauauuguguugua

SEQ ID NO: 391456 - RNA, 19 nt, Homo sapiens
gaaagcagaacauaaacaa

SEQ ID NO: 391457 - RNA, 19 nt, Homo sapiens
gaaaugaauggcaagcuuu

SEQ ID NO: 391458 - RNA, 19 nt, Homo sapiens
gcaccgaauuuaugggaaa

SEQ ID NO: 391459 - RNA, 19 nt, Homo sapiens
auagaggucuuguauguuu

SEQ ID NO: 391460 - RNA, 19 nt, Homo sapiens
ugggaaauuucuuggauua

SEQ ID NO: 391461 - RNA, 19 nt, Homo sapiens
gcaauucuccagaguggua

SEQ ID NO: 391462 - RNA, 19 nt, Homo sapiens
gcaauacaagugccgaaua

SEQ ID NO: 391463 - RNA, 19 nt, Homo sapiens
uaagagcauucaucagaaa

SEQ ID NO: 391464 - RNA, 19 nt, Homo sapiens
gagcaacacugaaugaacu

SEQ ID NO: 391465 - RNA, 19 nt, Homo sapiens
ggaauuaccugcccuaacc

SEQ ID NO: 391466 - RNA, 19 nt, Homo sapiens
gaaagggcauuguacuucu

SEQ ID NO: 391467 - RNA, 19 nt, Homo sapiens
ggaauuggaacgugaagaa

SEQ ID NO: 391468 - RNA, 19 nt, Homo sapiens
ggaaauuucuuggauuaag

SEQ ID NO: 391469 - RNA, 19 nt, Homo sapiens
ucaaagaugccacuucaaa

SEQ ID NO: 391470 - RNA, 19 nt, Homo sapiens
gauuguuccucaugaauau

SEQ ID NO: 391471 - RNA, 19 nt, Homo sapiens
ccuuaaaucuccaggcuuu

SEQ ID NO: 391472 - RNA, 19 nt, Homo sapiens
ugacuugaauucuucuuug

SEQ ID NO: 391473 - RNA, 19 nt, Homo sapiens
ccaauuauguuugccaguu

SEQ ID NO: 391474 - RNA, 19 nt, Homo sapiens
ggauugagcagcauuuaau

SEQ ID NO: 391475 - RNA, 19 nt, Homo sapiens
uaucauggccauaguauau

SEQ ID NO: 391476 - RNA, 19 nt, Homo sapiens
caauuauguuugccaguuu

SEQ ID NO: 391477 - RNA, 19 nt, Homo sapiens
gcagauauccaagugugua

SEQ ID NO: 391478 - RNA, 19 nt, Homo sapiens
cagcuugccucucaauuca

SEQ ID NO: 391479 - RNA, 19 nt, Homo sapiens
ggagugguaagaauuauga

SEQ ID NO: 391480 - RNA, 19 nt, Homo sapiens
auuggaacgugaagaauua

SEQ ID NO: 391481 - RNA, 19 nt, Homo sapiens
gagaaagauacaacacuaa

SEQ ID NO: 391482 - RNA, 19 nt, Homo sapiens
cauauuguguuguacaguu

SEQ ID NO: 391483 - RNA, 19 nt, Homo sapiens
ugaagguucuuauuccuau

SEQ ID NO: 391484 - RNA, 19 nt, Homo sapiens
gaucagaaauucguacaac

SEQ ID NO: 391485 - RNA, 19 nt, Homo sapiens
auauagaggucuuguaugu

SEQ ID NO: 391486 - RNA, 19 nt, Homo sapiens
aauaaaagcugggaaagua

SEQ ID NO: 391487 - RNA, 19 nt, Homo sapiens
acaaaccucaucaguauaa

SEQ ID NO: 391488 - RNA, 19 nt, Homo sapiens
guugguauaugaauucuuc

SEQ ID NO: 391489 - RNA, 19 nt, Homo sapiens
cuaaagaaagcucuagaaa

SEQ ID NO: 391490 - RNA, 19 nt, Homo sapiens
gguauacaaugugcugaaa

SEQ ID NO: 391491 - RNA, 19 nt, Homo sapiens
gaacugguugaguauguuu

SEQ ID NO: 391492 - RNA, 19 nt, Homo sapiens
uuacuguacucuggaauuu

SEQ ID NO: 391493 - RNA, 19 nt, Homo sapiens
gcacaguauucucagcaau

SEQ ID NO: 391494 - RNA, 19 nt, Homo sapiens
ucaagcagauauccaagug

SEQ ID NO: 391495 - RNA, 19 nt, Homo sapiens
guaccauuccaaucucuua

SEQ ID NO: 391496 - RNA, 19 nt, Homo sapiens
ggucaaguauuucucacau

SEQ ID NO: 391497 - RNA, 19 nt, Homo sapiens
uuaguuacauccuaggaaa

SEQ ID NO: 391498 - RNA, 19 nt, Homo sapiens
gacuugaauucuucuuuga

SEQ ID NO: 391499 - RNA, 19 nt, Homo sapiens
ggauuagcuuuguuucaug

SEQ ID NO: 391500 - RNA, 19 nt, Homo sapiens
ggauuaagagcauucauca

SEQ ID NO: 391501 - RNA, 19 nt, Homo sapiens
gaguauguuucaacuaauc

SEQ ID NO: 391502 - RNA, 19 nt, Homo sapiens
gauugagcagcauuuaaua

SEQ ID NO: 391503 - RNA, 19 nt, Homo sapiens
gaauuuaggcaaaaccuua

SEQ ID NO: 391504 - RNA, 19 nt, Homo sapiens
ucacacugcugcaaaccuu

SEQ ID NO: 391505 - RNA, 19 nt, Homo sapiens
gguaagaauuaugacuuga

SEQ ID NO: 391506 - RNA, 19 nt, Homo sapiens
uuaagagcauucaucagaa

SEQ ID NO: 391507 - RNA, 19 nt, Homo sapiens
gcuaacaucuuccguacac

SEQ ID NO: 391508 - RNA, 19 nt, Homo sapiens
ucaaguauuucucacaucu

SEQ ID NO: 391509 - RNA, 19 nt, Homo sapiens
guagucugcucuguauauu

SEQ ID NO: 391510 - RNA, 19 nt, Homo sapiens
gaaagauacaacacuaaca

SEQ ID NO: 391511 - RNA, 19 nt, Homo sapiens
gcaaaacgauacauugauc

SEQ ID NO: 391512 - RNA, 19 nt, Homo sapiens
aggcagcucaggugaauua

SEQ ID NO: 391513 - RNA, 19 nt, Homo sapiens
gguagucugcucuguauau

SEQ ID NO: 391514 - RNA, 19 nt, Homo sapiens
gcuaaagaaagcucuagaa

SEQ ID NO: 391515 - RNA, 19 nt, Homo sapiens
ccaaguguguauccaguuc

SEQ ID NO: 391516 - RNA, 19 nt, Homo sapiens
ucagaaagaggugauguuu

SEQ ID NO: 391517 - RNA, 19 nt, Homo sapiens
cagcuagcauauuguguug

SEQ ID NO: 391518 - RNA, 19 nt, Homo sapiens
uugcugaacuucuugaaau

SEQ ID NO: 391519 - RNA, 19 nt, Homo sapiens
aaagaugccacuucaaaug

SEQ ID NO: 391520 - RNA, 19 nt, Homo sapiens
gcuugccucucaauucauu

SEQ ID NO: 391521 - RNA, 19 nt, Homo sapiens
caaagaugccacuucaaau

SEQ ID NO: 391522 - RNA, 19 nt, Homo sapiens
ccacugaaagcagaacaua

SEQ ID NO: 391523 - RNA, 19 nt, Homo sapiens
uaggaaguauuaucaaugg

SEQ ID NO: 391524 - RNA, 19 nt, Homo sapiens
guagagcucugaaaagguu

SEQ ID NO: 391525 - RNA, 19 nt, Homo sapiens
uuacccagcuugccucuca

SEQ ID NO: 391526 - RNA, 19 nt, Homo sapiens
gcugaaagacagagagaga

SEQ ID NO: 391527 - RNA, 19 nt, Homo sapiens
cauuguacuucuggaauaa

SEQ ID NO: 391528 - RNA, 19 nt, Homo sapiens
guucuuauuccuaugcaua

SEQ ID NO: 391529 - RNA, 19 nt, Homo sapiens
uagugaagaucccagagaa

SEQ ID NO: 391530 - RNA, 19 nt, Homo sapiens
gaaugaacugguugaguau

SEQ ID NO: 391531 - RNA, 19 nt, Homo sapiens
ucagauuguuccucaugaa

SEQ ID NO: 391532 - RNA, 19 nt, Homo sapiens
ugaaagacagagagagaaa

SEQ ID NO: 391533 - RNA, 19 nt, Homo sapiens
cuuacuagcucauacaaag

SEQ ID NO: 391534 - RNA, 19 nt, Homo sapiens
cuaaugaagguucuuauuc

SEQ ID NO: 391535 - RNA, 19 nt, Homo sapiens
aacgauacauugaucagaa

SEQ ID NO: 391536 - RNA, 19 nt, Homo sapiens
cugaaaagguugacuauau

SEQ ID NO: 391537 - RNA, 19 nt, Homo sapiens
aaagagcaacacugaauga

SEQ ID NO: 391538 - RNA, 19 nt, Homo sapiens
aaaccuuaguuacauccua

SEQ ID NO: 391539 - RNA, 19 nt, Homo sapiens
gaacgugaagaauuaugga

SEQ ID NO: 391540 - RNA, 19 nt, Homo sapiens
gaaggaauuggaacgugaa

SEQ ID NO: 391541 - RNA, 19 nt, Homo sapiens
uaacagagccagugaucag

SEQ ID NO: 391542 - RNA, 19 nt, Homo sapiens
acugaaagcagaacauaaa

SEQ ID NO: 391543 - RNA, 19 nt, Homo sapiens
auuccaaucucuuaacuug

SEQ ID NO: 391544 - RNA, 19 nt, Homo sapiens
gcaaggcgcagaggcagaa

SEQ ID NO: 391545 - RNA, 19 nt, Homo sapiens
gaacaaugaguauauccua

SEQ ID NO: 391546 - RNA, 19 nt, Homo sapiens
gaaccaaaccaucguauca

SEQ ID NO: 391547 - RNA, 19 nt, Homo sapiens
gcagguggcucgcuguguu

SEQ ID NO: 391548 - RNA, 19 nt, Homo sapiens
aagaagagauucacagugu

SEQ ID NO: 391549 - RNA, 19 nt, Homo sapiens
caagagauauguggaucaa

SEQ ID NO: 391550 - RNA, 19 nt, Homo sapiens
gcacaggcaagaagagauu

SEQ ID NO: 391551 - RNA, 19 nt, Homo sapiens
ucaagucgcugucugucuu

SEQ ID NO: 391552 - RNA, 19 nt, Homo sapiens
cgcaugaucucagugaaua

SEQ ID NO: 391553 - RNA, 19 nt, Homo sapiens
gugagaacccugaauuuga

SEQ ID NO: 391554 - RNA, 19 nt, Homo sapiens
ggugauguuugacuucuug

SEQ ID NO: 391555 - RNA, 19 nt, Homo sapiens
aaugcgagguccuuccuua

SEQ ID NO: 391556 - RNA, 19 nt, Homo sapiens
ccaggagcgucaggaguua

SEQ ID NO: 391557 - RNA, 19 nt, Homo sapiens
gguccauggucuauuuauu

SEQ ID NO: 391558 - RNA, 19 nt, Homo sapiens
ccacagcuccucucaguuc

SEQ ID NO: 391559 - RNA, 19 nt, Homo sapiens
caaaccaucguaucacuga

SEQ ID NO: 391560 - RNA, 19 nt, Homo sapiens
gcacaagcaguuccugguu

SEQ ID NO: 391561 - RNA, 19 nt, Homo sapiens
ucacaguaaucauggucua

SEQ ID NO: 391562 - RNA, 19 nt, Homo sapiens
gggcaagcuugaccaggaa

SEQ ID NO: 391563 - RNA, 19 nt, Homo sapiens
augggaagcuguuugauga

SEQ ID NO: 391564 - RNA, 19 nt, Homo sapiens
acaaugugcucaagaccuu

SEQ ID NO: 391565 - RNA, 19 nt, Homo sapiens
gcaagaagagauucacagu

SEQ ID NO: 391566 - RNA, 19 nt, Homo sapiens
gcucacagccuccuacaag

SEQ ID NO: 391567 - RNA, 19 nt, Homo sapiens
gaggaugagcccaaucuug

SEQ ID NO: 391568 - RNA, 19 nt, Homo sapiens
aaggagcacuggaaccaaa

SEQ ID NO: 391569 - RNA, 19 nt, Homo sapiens
caucgagcccucccaguuu

SEQ ID NO: 391570 - RNA, 19 nt, Homo sapiens
uggcugagcugcuggagau

SEQ ID NO: 391571 - RNA, 19 nt, Homo sapiens
ccagugagaacccugaauu

SEQ ID NO: 391572 - RNA, 19 nt, Homo sapiens
gagaggcaaugguggucuu

SEQ ID NO: 391573 - RNA, 19 nt, Homo sapiens
agacggagcacaagcaguu

SEQ ID NO: 391574 - RNA, 19 nt, Homo sapiens
cuaggaagcaucaucaaug

SEQ ID NO: 391575 - RNA, 19 nt, Homo sapiens
ccagagagaaacacaccua

SEQ ID NO: 391576 - RNA, 19 nt, Homo sapiens
gcagcugguauaugaguuu

SEQ ID NO: 391577 - RNA, 19 nt, Homo sapiens
guuagucuguccagucuca

SEQ ID NO: 391578 - RNA, 19 nt, Homo sapiens
ugaaugggaagcuguuuga

SEQ ID NO: 391579 - RNA, 19 nt, Homo sapiens
gaucuacaaugugcucaag

SEQ ID NO: 391580 - RNA, 19 nt, Homo sapiens
gggguagacuuaauaaaga

SEQ ID NO: 391581 - RNA, 19 nt, Homo sapiens
gaaggaugccacucugaca

SEQ ID NO: 391582 - RNA, 19 nt, Homo sapiens
uaggaagcaucaucaaugg

SEQ ID NO: 391583 - RNA, 19 nt, Homo sapiens
agagauauguggaucaaaa

SEQ ID NO: 391584 - RNA, 19 nt, Homo sapiens
ugagaacccugaauuugac

SEQ ID NO: 391585 - RNA, 19 nt, Homo sapiens
gagaaggaugccacucuga

SEQ ID NO: 391586 - RNA, 19 nt, Homo sapiens
gagccauccuccuuucuac

SEQ ID NO: 391587 - RNA, 19 nt, Homo sapiens
gacaggaugggaccaaguu

SEQ ID NO: 391588 - RNA, 19 nt, Homo sapiens
ccagaaggaggugauguuu

SEQ ID NO: 391589 - RNA, 19 nt, Homo sapiens
aggaugagcccaaucuuga

SEQ ID NO: 391590 - RNA, 19 nt, Homo sapiens
gcaaacagugcaaccacau

SEQ ID NO: 391591 - RNA, 19 nt, Homo sapiens
ugugcugccugcuguguuu

SEQ ID NO: 391592 - RNA, 19 nt, Homo sapiens
aacccuaacuggacucuuc

SEQ ID NO: 391593 - RNA, 19 nt, Homo sapiens
ugaccgccauggagacgaa

SEQ ID NO: 391594 - RNA, 19 nt, Homo sapiens
ugaagaggaugagcccaau

SEQ ID NO: 391595 - RNA, 19 nt, Homo sapiens
guccauggucuauuuauuc

SEQ ID NO: 391596 - RNA, 19 nt, Homo sapiens
ucaagaccuucauggagau

SEQ ID NO: 391597 - RNA, 19 nt, Homo sapiens
ucccacagcuccucucagu

SEQ ID NO: 391598 - RNA, 19 nt, Homo sapiens
gcccaggacugugguugug

SEQ ID NO: 391599 - RNA, 19 nt, Homo sapiens
cgaccgaagucuagguuuu

SEQ ID NO: 391600 - RNA, 19 nt, Homo sapiens
ucuaugaauucgagcacuu

SEQ ID NO: 391601 - RNA, 19 nt, Homo sapiens
gggccuacauccgcaaaca

SEQ ID NO: 391602 - RNA, 19 nt, Homo sapiens
accugcagcugguauauga

SEQ ID NO: 391603 - RNA, 19 nt, Homo sapiens
cagugagaacccugaauuu

SEQ ID NO: 391604 - RNA, 19 nt, Homo sapiens
ggguagacuuaauaaagag

SEQ ID NO: 391605 - RNA, 19 nt, Homo sapiens
ucccuucccucgcugugua

SEQ ID NO: 391606 - RNA, 19 nt, Homo sapiens
gaucucagugaauaucuuc

SEQ ID NO: 391607 - RNA, 19 nt, Homo sapiens
ucgcccagcucacccucua

SEQ ID NO: 391608 - RNA, 19 nt, Homo sapiens
guacuuccuuguccccuuu

SEQ ID NO: 391609 - RNA, 19 nt, Homo sapiens
ggaaccaaaccaucguauc

SEQ ID NO: 391610 - RNA, 19 nt, Homo sapiens
ggccugagccauccuccuu

SEQ ID NO: 391611 - RNA, 19 nt, Homo sapiens
ggagggcacaggcaagaag

SEQ ID NO: 391612 - RNA, 19 nt, Homo sapiens
gcgagguccuuccuuaucc

SEQ ID NO: 391613 - RNA, 19 nt, Homo sapiens
gcucuguauuucuggaaca

SEQ ID NO: 391614 - RNA, 19 nt, Homo sapiens
ggacaggaugggaccaagu

SEQ ID NO: 391615 - RNA, 19 nt, Homo sapiens
gcuaaacccagagcuguca

SEQ ID NO: 391616 - RNA, 19 nt, Homo sapiens
ugagccauccuccuuucua

SEQ ID NO: 391617 - RNA, 19 nt, Homo sapiens
ucaucgagcccucccaguu

SEQ ID NO: 391618 - RNA, 19 nt, Homo sapiens
ccucucaguuccgcuauca

SEQ ID NO: 391619 - RNA, 19 nt, Homo sapiens
ccugagccauccuccuuuc

SEQ ID NO: 391620 - RNA, 19 nt, Homo sapiens
caaugaguauauccuaagc

SEQ ID NO: 391621 - RNA, 19 nt, Homo sapiens
gauccuaggaagcaucauc

SEQ ID NO: 391622 - RNA, 19 nt, Homo sapiens
gaauucgagcacuucaaug

SEQ ID NO: 391623 - RNA, 19 nt, Homo sapiens
gaugggaccaaguuagucu

SEQ ID NO: 391624 - RNA, 19 nt, Homo sapiens
cuagacagcaccucagaag

SEQ ID NO: 391625 - RNA, 19 nt, Homo sapiens
ccucccaguuugugaagau

SEQ ID NO: 391626 - RNA, 19 nt, Homo sapiens
ccgggucuauggcaaguuc

SEQ ID NO: 391627 - RNA, 19 nt, Homo sapiens
gaugaaugggaagcuguuu

SEQ ID NO: 391628 - RNA, 19 nt, Homo sapiens
ccaaggagcacuggaacca

SEQ ID NO: 391629 - RNA, 19 nt, Homo sapiens
ucuggaacaaugaguauau

SEQ ID NO: 391630 - RNA, 19 nt, Homo sapiens
gagauccuaggaagcauca

SEQ ID NO: 391631 - RNA, 19 nt, Homo sapiens
gaagaggaugagcccaauc

SEQ ID NO: 391632 - RNA, 19 nt, Homo sapiens
gggcacaggcaagaagaga

SEQ ID NO: 391633 - RNA, 19 nt, Homo sapiens
ggucuuggcaacagaaugc

SEQ ID NO: 391634 - RNA, 19 nt, Homo sapiens
gagacgaggagaggcaaug

SEQ ID NO: 391635 - RNA, 19 nt, Homo sapiens
gagcugucagucccucuau

SEQ ID NO: 391636 - RNA, 19 nt, Homo sapiens
gcuagacagcaccucagaa

SEQ ID NO: 391637 - RNA, 19 nt, Homo sapiens
cccaggagcgucaggaguu

SEQ ID NO: 391638 - RNA, 19 nt, Homo sapiens
ugaucucagugaauaucuu

SEQ ID NO: 391639 - RNA, 19 nt, Homo sapiens
ucuaccaagucuccaagga

SEQ ID NO: 391640 - RNA, 19 nt, Homo sapiens
cuguauuucuggaacaaug

SEQ ID NO: 391641 - RNA, 19 nt, Homo sapiens
agugagaacccugaauuug

SEQ ID NO: 391642 - RNA, 19 nt, Homo sapiens
gagggcacaggcaagaaga

SEQ ID NO: 391643 - RNA, 19 nt, Homo sapiens
ccaagagauauguggauca

SEQ ID NO: 391644 - RNA, 19 nt, Homo sapiens
ucucaguuccgcuaucaga

SEQ ID NO: 391645 - RNA, 19 nt, Homo sapiens
gcugauagauucucaaaua

SEQ ID NO: 391646 - RNA, 19 nt, Homo sapiens
guacugagcuuuuguuuua

SEQ ID NO: 391647 - RNA, 19 nt, Homo sapiens
gacaauacauggcuugaua

SEQ ID NO: 391648 - RNA, 19 nt, Homo sapiens
ugaaauggcucuuugcuuu

SEQ ID NO: 391649 - RNA, 19 nt, Homo sapiens
guaccaaacugauuucaaa

SEQ ID NO: 391650 - RNA, 19 nt, Homo sapiens
gaaaagagcucacguuauc

SEQ ID NO: 391651 - RNA, 19 nt, Homo sapiens
ggagacagaugggccuuua

SEQ ID NO: 391652 - RNA, 19 nt, Homo sapiens
ggaguaagccuguagaaga

SEQ ID NO: 391653 - RNA, 19 nt, Homo sapiens
ggagagagauuuucuuaaa

SEQ ID NO: 391654 - RNA, 19 nt, Homo sapiens
ggaaauauugggaaguaua

SEQ ID NO: 391655 - RNA, 19 nt, Homo sapiens
gaaguaauguucuuaaacg

SEQ ID NO: 391656 - RNA, 19 nt, Homo sapiens
ugauggcacuucucaaaua

SEQ ID NO: 391657 - RNA, 19 nt, Homo sapiens
gaauauaucacccauaauc

SEQ ID NO: 391658 - RNA, 19 nt, Homo sapiens
ggaagaagcauggguuaaa

SEQ ID NO: 391659 - RNA, 19 nt, Homo sapiens
ccuaaaguuucccuaguua

SEQ ID NO: 391660 - RNA, 19 nt, Homo sapiens
gaugaauacuuccugagaa

SEQ ID NO: 391661 - RNA, 19 nt, Homo sapiens
uaagugaccuaaaguggaa

SEQ ID NO: 391662 - RNA, 19 nt, Homo sapiens
uaaagcagcgucuuaugua

SEQ ID NO: 391663 - RNA, 19 nt, Homo sapiens
uuaagugucuugaggcaua

SEQ ID NO: 391664 - RNA, 19 nt, Homo sapiens
guccauauguuugcaguua

SEQ ID NO: 391665 - RNA, 19 nt, Homo sapiens
guauagagacuguuuauuc

SEQ ID NO: 391666 - RNA, 19 nt, Homo sapiens
cuaaacacgugaucuaguu

SEQ ID NO: 391667 - RNA, 19 nt, Homo sapiens
gagauugcucugaaauuua

SEQ ID NO: 391668 - RNA, 19 nt, Homo sapiens
caucuucacucuuuccaaa

SEQ ID NO: 391669 - RNA, 19 nt, Homo sapiens
gaaagcuacuugagaugug

SEQ ID NO: 391670 - RNA, 19 nt, Homo sapiens
aaacagagcaucauaaugg

SEQ ID NO: 391671 - RNA, 19 nt, Homo sapiens
ugacaaguaucucuccauu

SEQ ID NO: 391672 - RNA, 19 nt, Homo sapiens
cauaggugguucugugaua

SEQ ID NO: 391673 - RNA, 19 nt, Homo sapiens
gcgaagaaauauauugauc

SEQ ID NO: 391674 - RNA, 19 nt, Homo sapiens
gcaguuaacauguuucgaa

SEQ ID NO: 391675 - RNA, 19 nt, Homo sapiens
gguaugaaaugcgaagauu

SEQ ID NO: 391676 - RNA, 19 nt, Homo sapiens
gauguguacugcuauucua

SEQ ID NO: 391677 - RNA, 19 nt, Homo sapiens
cuugagagcuuacaucaga

SEQ ID NO: 391678 - RNA, 19 nt, Homo sapiens
ggaagaugaaccaacguua

SEQ ID NO: 391679 - RNA, 19 nt, Homo sapiens
auacauggcuugauauaca

SEQ ID NO: 391680 - RNA, 19 nt, Homo sapiens
caucagaauuugugaagau

SEQ ID NO: 391681 - RNA, 19 nt, Homo sapiens
ccaaucaguuacacucaaa

SEQ ID NO: 391682 - RNA, 19 nt, Homo sapiens
cagaguuacuggaaauauu

SEQ ID NO: 391683 - RNA, 19 nt, Homo sapiens
gaaguaguccauauguuug

SEQ ID NO: 391684 - RNA, 19 nt, Homo sapiens
cacgugaucuaguuucuuu

SEQ ID NO: 391685 - RNA, 19 nt, Homo sapiens
gcagcgccuuuaagcauaa

SEQ ID NO: 391686 - RNA, 19 nt, Homo sapiens
gcugaagucuagauguuga

SEQ ID NO: 391687 - RNA, 19 nt, Homo sapiens
ggacuccugugcuaauugu

SEQ ID NO: 391688 - RNA, 19 nt, Homo sapiens
gaaagcacccugcccuuca

SEQ ID NO: 391689 - RNA, 19 nt, Homo sapiens
agaaagauccgaagaagga

SEQ ID NO: 391690 - RNA, 19 nt, Homo sapiens
cagaugggccuuuauuuga

SEQ ID NO: 391691 - RNA, 19 nt, Homo sapiens
ugaaaucucugagugucua

SEQ ID NO: 391692 - RNA, 19 nt, Homo sapiens
gauuaggaguucaaacaau

SEQ ID NO: 391693 - RNA, 19 nt, Homo sapiens
gagauuaggaguucaaaca

SEQ ID NO: 391694 - RNA, 19 nt, Homo sapiens
gaagcagccuggccucauc

SEQ ID NO: 391695 - RNA, 19 nt, Homo sapiens
agaaguaguccauauguuu

SEQ ID NO: 391696 - RNA, 19 nt, Homo sapiens
guguaaagcucagugugua

SEQ ID NO: 391697 - RNA, 19 nt, Homo sapiens
acaaguaucucuccauuuu

SEQ ID NO: 391698 - RNA, 19 nt, Homo sapiens
ccagauuuccaaccuaaua

SEQ ID NO: 391699 - RNA, 19 nt, Homo sapiens
cuaauugucagcuuacaua

SEQ ID NO: 391700 - RNA, 19 nt, Homo sapiens
guggagcucuuucuguuga

SEQ ID NO: 391701 - RNA, 19 nt, Homo sapiens
gacagaaauuggaguuuua

SEQ ID NO: 391702 - RNA, 19 nt, Homo sapiens
ucagugaaauggcucuuug

SEQ ID NO: 391703 - RNA, 19 nt, Homo sapiens
gaagaagcauggguuaaaa

SEQ ID NO: 391704 - RNA, 19 nt, Homo sapiens
gaaagaacgggaagaagca

SEQ ID NO: 391705 - RNA, 19 nt, Homo sapiens
guucaaagcagagaaacua

SEQ ID NO: 391706 - RNA, 19 nt, Homo sapiens
gaucagaaguuuguauugc

SEQ ID NO: 391707 - RNA, 19 nt, Homo sapiens
uguuugaacuuccgucuuu

SEQ ID NO: 391708 - RNA, 19 nt, Homo sapiens
gauauaccauuguuugaac

SEQ ID NO: 391709 - RNA, 19 nt, Homo sapiens
gcacagaaagauccgaaga

SEQ ID NO: 391710 - RNA, 19 nt, Homo sapiens
caucaugaguuuaaucagu

SEQ ID NO: 391711 - RNA, 19 nt, Homo sapiens
gaagaugaaccaacguuag

SEQ ID NO: 391712 - RNA, 19 nt, Homo sapiens
uuucaucucuggcauaaga

SEQ ID NO: 391713 - RNA, 19 nt, Homo sapiens
gaguaagccuguagaagag

SEQ ID NO: 391714 - RNA, 19 nt, Homo sapiens
caacguacugggcaaauga

SEQ ID NO: 391715 - RNA, 19 nt, Homo sapiens
ucacaaagucagagcgaua

SEQ ID NO: 391716 - RNA, 19 nt, Homo sapiens
caguuacacucaaagcuuu

SEQ ID NO: 391717 - RNA, 19 nt, Homo sapiens
caauacauggcuugauaua

SEQ ID NO: 391718 - RNA, 19 nt, Homo sapiens
ggugauggcacuucucaaa

SEQ ID NO: 391719 - RNA, 19 nt, Homo sapiens
gaaacagagcaucauaaug

SEQ ID NO: 391720 - RNA, 19 nt, Homo sapiens
aaaccacccuucacagaau

SEQ ID NO: 391721 - RNA, 19 nt, Homo sapiens
gucuuuagcugauagauuc

SEQ ID NO: 391722 - RNA, 19 nt, Homo sapiens
gaucuaguuucuuucaucu

SEQ ID NO: 391723 - RNA, 19 nt, Homo sapiens
gcaaacugcagcgccuuua

SEQ ID NO: 391724 - RNA, 19 nt, Homo sapiens
guguguaccuaaagccaua

SEQ ID NO: 391725 - RNA, 19 nt, Homo sapiens
gcaacguacugggcaaaug

SEQ ID NO: 391726 - RNA, 19 nt, Homo sapiens
cauugaaccaucagaauuu

SEQ ID NO: 391727 - RNA, 19 nt, Homo sapiens
uagcagaguuacuggaaau

SEQ ID NO: 391728 - RNA, 19 nt, Homo sapiens
cagcgaggaugacguuuag

SEQ ID NO: 391729 - RNA, 19 nt, Homo sapiens
gugcagaugcugagaaaga

SEQ ID NO: 391730 - RNA, 19 nt, Homo sapiens
ccgcugaagucuagauguu

SEQ ID NO: 391731 - RNA, 19 nt, Homo sapiens
gaagacaaacacucaccaa

SEQ ID NO: 391732 - RNA, 19 nt, Homo sapiens
uaguggagcucuuucuguu

SEQ ID NO: 391733 - RNA, 19 nt, Homo sapiens
cagaaguaguccauauguu

SEQ ID NO: 391734 - RNA, 19 nt, Homo sapiens
uaaaguggaaggaaguaaa

SEQ ID NO: 391735 - RNA, 19 nt, Homo sapiens
gcaguucuuuuguuuguuu

SEQ ID NO: 391736 - RNA, 19 nt, Homo sapiens
cuggaaauauugggaagua

SEQ ID NO: 391737 - RNA, 19 nt, Homo sapiens
gaaauuccuaggcuugaga

SEQ ID NO: 391738 - RNA, 19 nt, Homo sapiens
ucacagaaucuaugggaaa

SEQ ID NO: 391739 - RNA, 19 nt, Homo sapiens
ccaccuuccuccaauccua

SEQ ID NO: 391740 - RNA, 19 nt, Homo sapiens
uagagacuguuuauucugu

SEQ ID NO: 391741 - RNA, 19 nt, Homo sapiens
uggaauagcacaaggagaa

SEQ ID NO: 391742 - RNA, 19 nt, Homo sapiens
ugagauguguacugcuauu

SEQ ID NO: 391743 - RNA, 19 nt, Homo sapiens
cuugagauguguacugcua

SEQ ID NO: 391744 - RNA, 19 nt, Homo sapiens
ucaaagacccauuggaaca

SEQ ID NO: 391745 - RNA, 19 nt, Homo sapiens
guacagaacugaauaaagu

SEQ ID NO: 391746 - RNA, 19 nt, Homo sapiens
ggacaauaacugaugaaua

SEQ ID NO: 391747 - RNA, 19 nt, Homo sapiens
gagaugcccuauaaacuga

SEQ ID NO: 391748 - RNA, 19 nt, Homo sapiens
guacauagggugcuuuauu

SEQ ID NO: 391749 - RNA, 19 nt, Homo sapiens
ggccuucucuugucccuua

SEQ ID NO: 391750 - RNA, 19 nt, Homo sapiens
cagauaggguuguauuauu

SEQ ID NO: 391751 - RNA, 19 nt, Homo sapiens
ugaaugagcuggaggagau

SEQ ID NO: 391752 - RNA, 19 nt, Homo sapiens
ucaacgagaugguggagua

SEQ ID NO: 391753 - RNA, 19 nt, Homo sapiens
ccaaggaggugauguucuu

SEQ ID NO: 391754 - RNA, 19 nt, Homo sapiens
gagcgggacuuccucaaga

SEQ ID NO: 391755 - RNA, 19 nt, Homo sapiens
gaggugauguucuugaaug

SEQ ID NO: 391756 - RNA, 19 nt, Homo sapiens
uauaggcuguggacaauaa

SEQ ID NO: 391757 - RNA, 19 nt, Homo sapiens
guacacacaggaauacaua

SEQ ID NO: 391758 - RNA, 19 nt, Homo sapiens
gaagcuuccugcccugaaa

SEQ ID NO: 391759 - RNA, 19 nt, Homo sapiens
ucagugaccucaaauucaa

SEQ ID NO: 391760 - RNA, 19 nt, Homo sapiens
guacaucgaccagaaguuu

SEQ ID NO: 391761 - RNA, 19 nt, Homo sapiens
gaacagcaggagauuauuc

SEQ ID NO: 391762 - RNA, 19 nt, Homo sapiens
caacaagcgucccagcaau

SEQ ID NO: 391763 - RNA, 19 nt, Homo sapiens
uacauacgcuccucuauuc

SEQ ID NO: 391764 - RNA, 19 nt, Homo sapiens
uccauggacugaucuauaa

SEQ ID NO: 391765 - RNA, 19 nt, Homo sapiens
ccagugcuguguccucuuu

SEQ ID NO: 391766 - RNA, 19 nt, Homo sapiens
gggaggagcuguuuaucca

SEQ ID NO: 391767 - RNA, 19 nt, Homo sapiens
gccaacaccuauuuauuuc

SEQ ID NO: 391768 - RNA, 19 nt, Homo sapiens
gcagauaggguuguauuau

SEQ ID NO: 391769 - RNA, 19 nt, Homo sapiens
gaacaagacaauccaugga

SEQ ID NO: 391770 - RNA, 19 nt, Homo sapiens
agaaguacaucgaccagaa

SEQ ID NO: 391771 - RNA, 19 nt, Homo sapiens
ugacugagccgguaauugu

SEQ ID NO: 391772 - RNA, 19 nt, Homo sapiens
gggcaggacucaacgagau

SEQ ID NO: 391773 - RNA, 19 nt, Homo sapiens
gggaacagcaggagauuau

SEQ ID NO: 391774 - RNA, 19 nt, Homo sapiens
uaaaagacaucaagaagga

SEQ ID NO: 391775 - RNA, 19 nt, Homo sapiens
aagcuaauaucuccuauag

SEQ ID NO: 391776 - RNA, 19 nt, Homo sapiens
uaaagaagagcacaagaug

SEQ ID NO: 391777 - RNA, 19 nt, Homo sapiens
ucgcaucuauggcaaguuu

SEQ ID NO: 391778 - RNA, 19 nt, Homo sapiens
gaagaggacuguggagacu

SEQ ID NO: 391779 - RNA, 19 nt, Homo sapiens
gaaggaaagggaagagaug

SEQ ID NO: 391780 - RNA, 19 nt, Homo sapiens
gaagcuaauaucuccuaua

SEQ ID NO: 391781 - RNA, 19 nt, Homo sapiens
gaaguuguuuauggaaaug

SEQ ID NO: 391782 - RNA, 19 nt, Homo sapiens
ucaugagccugauaaguga

SEQ ID NO: 391783 - RNA, 19 nt, Homo sapiens
gacaauccauggacugauc

SEQ ID NO: 391784 - RNA, 19 nt, Homo sapiens
uacauagggugcuuuauuc

SEQ ID NO: 391785 - RNA, 19 nt, Homo sapiens
gaauacauacgcuccucua

SEQ ID NO: 391786 - RNA, 19 nt, Homo sapiens
gggcaggccuucucuuguc

SEQ ID NO: 391787 - RNA, 19 nt, Homo sapiens
ugccaacaccuauuuauuu

SEQ ID NO: 391788 - RNA, 19 nt, Homo sapiens
gaggacauccagcuucuga

SEQ ID NO: 391789 - RNA, 19 nt, Homo sapiens
cauacugugugguacaauu

SEQ ID NO: 391790 - RNA, 19 nt, Homo sapiens
aagaagagcacaagauguu

SEQ ID NO: 391791 - RNA, 19 nt, Homo sapiens
agaaguacacacaggaaua

SEQ ID NO: 391792 - RNA, 19 nt, Homo sapiens
uaugaguucuucuuacguu

SEQ ID NO: 391793 - RNA, 19 nt, Homo sapiens
gagaaggagagcagucuga

SEQ ID NO: 391794 - RNA, 19 nt, Homo sapiens
caaacauagccaagaagua

SEQ ID NO: 391795 - RNA, 19 nt, Homo sapiens
ucaccaaaguuaugucaag

SEQ ID NO: 391796 - RNA, 19 nt, Homo sapiens
acagagugauacaugcuaa

SEQ ID NO: 391797 - RNA, 19 nt, Homo sapiens
gcagggacacccacagaau

SEQ ID NO: 391798 - RNA, 19 nt, Homo sapiens
guaggcagaucaaccacau

SEQ ID NO: 391799 - RNA, 19 nt, Homo sapiens
gggaagagauguggcaaaa

SEQ ID NO: 391800 - RNA, 19 nt, Homo sapiens
ugaaucagaagcuguuuga

SEQ ID NO: 391801 - RNA, 19 nt, Homo sapiens
ggacgucauugaaccuucu

SEQ ID NO: 391802 - RNA, 19 nt, Homo sapiens
ucaagucccugagugucua

SEQ ID NO: 391803 - RNA, 19 nt, Homo sapiens
ccucauccguguccuacuu

SEQ ID NO: 391804 - RNA, 19 nt, Homo sapiens
aaacauagccaagaaguac

SEQ ID NO: 391805 - RNA, 19 nt, Homo sapiens
cgagaugcccuauaaacug

SEQ ID NO: 391806 - RNA, 19 nt, Homo sapiens
agaggacuguggagacuga

SEQ ID NO: 391807 - RNA, 19 nt, Homo sapiens
gaaguacacacaggaauac

SEQ ID NO: 391808 - RNA, 19 nt, Homo sapiens
ggcagcgccucucuagcua

SEQ ID NO: 391809 - RNA, 19 nt, Homo sapiens
ucauugaaccuucugaguu

SEQ ID NO: 391810 - RNA, 19 nt, Homo sapiens
gcucguguaugaguucuuc

SEQ ID NO: 391811 - RNA, 19 nt, Homo sapiens
gcuucaaccucagcaagaa

SEQ ID NO: 391812 - RNA, 19 nt, Homo sapiens
caacaccuauuuauuuccu

SEQ ID NO: 391813 - RNA, 19 nt, Homo sapiens
uggaguacaucacccauag

SEQ ID NO: 391814 - RNA, 19 nt, Homo sapiens
ggcagauaggguuguauua

SEQ ID NO: 391815 - RNA, 19 nt, Homo sapiens
gcuggcagauaggguugua

SEQ ID NO: 391816 - RNA, 19 nt, Homo sapiens
acaccacgauggcggagaa

SEQ ID NO: 391817 - RNA, 19 nt, Homo sapiens
gcgccucucuagcuacuca

SEQ ID NO: 391818 - RNA, 19 nt, Homo sapiens
ccaacaagcgucccagcaa

SEQ ID NO: 391819 - RNA, 19 nt, Homo sapiens
gcuguguccucuuugacuu

SEQ ID NO: 391820 - RNA, 19 nt, Homo sapiens
auacauacgcuccucuauu

SEQ ID NO: 391821 - RNA, 19 nt, Homo sapiens
gcucugagaaguacacaca

SEQ ID NO: 391822 - RNA, 19 nt, Homo sapiens
gaugcccuauaaacugaaa

SEQ ID NO: 391823 - RNA, 19 nt, Homo sapiens
cauguucccugcacucuac

SEQ ID NO: 391824 - RNA, 19 nt, Homo sapiens
aguacaggcugagcacuaa

SEQ ID NO: 391825 - RNA, 19 nt, Homo sapiens
aagagccacuggaacaaga

SEQ ID NO: 391826 - RNA, 19 nt, Homo sapiens
guaauugugggacuucuca

SEQ ID NO: 391827 - RNA, 19 nt, Homo sapiens
gagcgggaggagcuguuua

SEQ ID NO: 391828 - RNA, 19 nt, Homo sapiens
gaugugggcacuugaagca

SEQ ID NO: 391829 - RNA, 19 nt, Homo sapiens
gcuggcauacuguguggua

SEQ ID NO: 391830 - RNA, 19 nt, Homo sapiens
gggcccagauggaccaagu

SEQ ID NO: 391831 - RNA, 19 nt, Homo sapiens
gauaggguuguauuauuuc

SEQ ID NO: 391832 - RNA, 19 nt, Homo sapiens
gagaaguacacacaggaau

SEQ ID NO: 391833 - RNA, 19 nt, Homo sapiens
uuaaagaagagcacaagau

SEQ ID NO: 391834 - RNA, 19 nt, Homo sapiens
gaucaaccacaucuucuac

SEQ ID NO: 391835 - RNA, 19 nt, Homo sapiens
gaaguacaucgaccagaag

SEQ ID NO: 391836 - RNA, 19 nt, Homo sapiens
agccaaacauagccaagaa

SEQ ID NO: 391837 - RNA, 19 nt, Homo sapiens
gcugccaccuucaucgaau

SEQ ID NO: 391838 - RNA, 19 nt, Homo sapiens
gugaagcuaauaucuccua

SEQ ID NO: 391839 - RNA, 19 nt, Homo sapiens
guagggaacagcaggagau

SEQ ID NO: 391840 - RNA, 19 nt, Homo sapiens
gaaugaaggaaagggaaga

SEQ ID NO: 391841 - RNA, 19 nt, Homo sapiens
gagcaucacaacgggauug

SEQ ID NO: 391842 - RNA, 19 nt, Homo sapiens
guuuguacuugcucuccua

SEQ ID NO: 391843 - RNA, 19 nt, Homo sapiens
gcuuuuggcuguguacaua

SEQ ID NO: 391844 - RNA, 19 nt, Homo sapiens
gccgugugcuggcagauag

SEQ ID NO: 391845 - RNA, 19 nt, Homo sapiens
gaagaaauauuggauguga

SEQ ID NO: 391846 - RNA, 19 nt, Homo sapiens
caaaguuccucacaguuua

SEQ ID NO: 391847 - RNA, 19 nt, Homo sapiens
gagaagaggugauaaacau

SEQ ID NO: 391848 - RNA, 19 nt, Homo sapiens
ggaauggggucaugaauua

SEQ ID NO: 391849 - RNA, 19 nt, Homo sapiens
gugaacaucuuuccaguaa

SEQ ID NO: 391850 - RNA, 19 nt, Homo sapiens
uacaagcgcuccacucuua

SEQ ID NO: 391851 - RNA, 19 nt, Homo sapiens
cagaagaggucgcaaaguu

SEQ ID NO: 391852 - RNA, 19 nt, Homo sapiens
ccaagaaccuuuguuuaaa

SEQ ID NO: 391853 - RNA, 19 nt, Homo sapiens
gaagauggagcaacaguuu

SEQ ID NO: 391854 - RNA, 19 nt, Homo sapiens
gcaaaguuccucacaguuu

SEQ ID NO: 391855 - RNA, 19 nt, Homo sapiens
gcuaagcuguuaaauguau

SEQ ID NO: 391856 - RNA, 19 nt, Homo sapiens
gaaagauccuucacucaca

SEQ ID NO: 391857 - RNA, 19 nt, Homo sapiens
cggaaaggauucaggauaa

SEQ ID NO: 391858 - RNA, 19 nt, Homo sapiens
gaaaugaacagcaccaugu

SEQ ID NO: 391859 - RNA, 19 nt, Homo sapiens
gaacacacauaccagagau

SEQ ID NO: 391860 - RNA, 19 nt, Homo sapiens
ggaugcauauuccuaacua

SEQ ID NO: 391861 - RNA, 19 nt, Homo sapiens
agaaugguaucuugcaaua

SEQ ID NO: 391862 - RNA, 19 nt, Homo sapiens
ugaaguaguuagaauggua

SEQ ID NO: 391863 - RNA, 19 nt, Homo sapiens
gaacugguggacuacauua

SEQ ID NO: 391864 - RNA, 19 nt, Homo sapiens
uuaaugaacugguggacua

SEQ ID NO: 391865 - RNA, 19 nt, Homo sapiens
ggaaaggauucaggauaaa

SEQ ID NO: 391866 - RNA, 19 nt, Homo sapiens
cuggauaacuugacuguaa

SEQ ID NO: 391867 - RNA, 19 nt, Homo sapiens
gaauacaucaugaguuuga

SEQ ID NO: 391868 - RNA, 19 nt, Homo sapiens
gcuggcauauuguauagua

SEQ ID NO: 391869 - RNA, 19 nt, Homo sapiens
ggauucaggauaaacauua

SEQ ID NO: 391870 - RNA, 19 nt, Homo sapiens
cugcuaagcuguuaaaugu

SEQ ID NO: 391871 - RNA, 19 nt, Homo sapiens
ucagaacuuugcaaacaua

SEQ ID NO: 391872 - RNA, 19 nt, Homo sapiens
gacaaacacuaaacaauac

SEQ ID NO: 391873 - RNA, 19 nt, Homo sapiens
uaucgggaguuccuuauuu

SEQ ID NO: 391874 - RNA, 19 nt, Homo sapiens
uacaguagauuucaccuuu

SEQ ID NO: 391875 - RNA, 19 nt, Homo sapiens
cagaauuuauggcaaguuu

SEQ ID NO: 391876 - RNA, 19 nt, Homo sapiens
gggaguuccuuauuuauca

SEQ ID NO: 391877 - RNA, 19 nt, Homo sapiens
ggauguagccucugggaaa

SEQ ID NO: 391878 - RNA, 19 nt, Homo sapiens
gcacagcuggcauauugua

SEQ ID NO: 391879 - RNA, 19 nt, Homo sapiens
ugaauuugauccagaagaa

SEQ ID NO: 391880 - RNA, 19 nt, Homo sapiens
ggauaaaguagacggauuu

SEQ ID NO: 391881 - RNA, 19 nt, Homo sapiens
uggaggaucuggaguuaaa

SEQ ID NO: 391882 - RNA, 19 nt, Homo sapiens
ggaacuggaagaaauauug

SEQ ID NO: 391883 - RNA, 19 nt, Homo sapiens
guauauaccugucucuaag

SEQ ID NO: 391884 - RNA, 19 nt, Homo sapiens
aaaggagcgugaagaauug

SEQ ID NO: 391885 - RNA, 19 nt, Homo sapiens
uagcugaacugcuggaaau

SEQ ID NO: 391886 - RNA, 19 nt, Homo sapiens
gaaagacaaacacuaaaca

SEQ ID NO: 391887 - RNA, 19 nt, Homo sapiens
gaaaagaguugagcaaaca

SEQ ID NO: 391888 - RNA, 19 nt, Homo sapiens
uaagagagaagaggugaua

SEQ ID NO: 391889 - RNA, 19 nt, Homo sapiens
gaacuuugcaaacauaauc

SEQ ID NO: 391890 - RNA, 19 nt, Homo sapiens
ggagucacacguuuaugua

SEQ ID NO: 391891 - RNA, 19 nt, Homo sapiens
caaugaauuugauccagaa

SEQ ID NO: 391892 - RNA, 19 nt, Homo sapiens
agacugucauuuccuuaua

SEQ ID NO: 391893 - RNA, 19 nt, Homo sapiens
guuuggaguuguugccuua

SEQ ID NO: 391894 - RNA, 19 nt, Homo sapiens
gaacaucuuuccaguaacc

SEQ ID NO: 391895 - RNA, 19 nt, Homo sapiens
aauaaggacuucaauccaa

SEQ ID NO: 391896 - RNA, 19 nt, Homo sapiens
aaacagaacacuucaaugg

SEQ ID NO: 391897 - RNA, 19 nt, Homo sapiens
ugacagcaaugaauuugau

SEQ ID NO: 391898 - RNA, 19 nt, Homo sapiens
gaagaggugauaaacauag

SEQ ID NO: 391899 - RNA, 19 nt, Homo sapiens
ucuuagacgugauggaaua

SEQ ID NO: 391900 - RNA, 19 nt, Homo sapiens
gaacucucccuccuaguga

SEQ ID NO: 391901 - RNA, 19 nt, Homo sapiens
gcgcuccacucuuaaugaa

SEQ ID NO: 391902 - RNA, 19 nt, Homo sapiens
gacacgcuaucugaucuua

SEQ ID NO: 391903 - RNA, 19 nt, Homo sapiens
gcauauuccuaacuacugu

SEQ ID NO: 391904 - RNA, 19 nt, Homo sapiens
gacugucauuuccuuauaa

SEQ ID NO: 391905 - RNA, 19 nt, Homo sapiens
guagauuucaccuuuguuu

SEQ ID NO: 391906 - RNA, 19 nt, Homo sapiens
caagaaccuuuguuuaaac

SEQ ID NO: 391907 - RNA, 19 nt, Homo sapiens
uccaagaaccuuuguuuaa

SEQ ID NO: 391908 - RNA, 19 nt, Homo sapiens
uuaaacaaaucgccaagug

SEQ ID NO: 391909 - RNA, 19 nt, Homo sapiens
ucacagaaccaguuauuag

SEQ ID NO: 391910 - RNA, 19 nt, Homo sapiens
uaucaauggcuuugcuuua

SEQ ID NO: 391911 - RNA, 19 nt, Homo sapiens
cacgcuaucugaucuuaaa

SEQ ID NO: 391912 - RNA, 19 nt, Homo sapiens
ucucagaacuuugcaaaca

SEQ ID NO: 391913 - RNA, 19 nt, Homo sapiens
gucaggagcuuaucacucu

SEQ ID NO: 391914 - RNA, 19 nt, Homo sapiens
ggacaucacaggcuucagu

SEQ ID NO: 391915 - RNA, 19 nt, Homo sapiens
gacaguagauggacuucuc

SEQ ID NO: 391916 - RNA, 19 nt, Homo sapiens
cuggaaauauuaggaagua

SEQ ID NO: 391917 - RNA, 19 nt, Homo sapiens
caucgugaccaaauuguuu

SEQ ID NO: 391918 - RNA, 19 nt, Homo sapiens
ggauucaugcaucaguuua

SEQ ID NO: 391919 - RNA, 19 nt, Homo sapiens
acacguuuauguaguagaa

SEQ ID NO: 391920 - RNA, 19 nt, Homo sapiens
uuacuaaccuguggaguca

SEQ ID NO: 391921 - RNA, 19 nt, Homo sapiens
uagacgugauggaauaauu

SEQ ID NO: 391922 - RNA, 19 nt, Homo sapiens
gagcagacuuacccugaag

SEQ ID NO: 391923 - RNA, 19 nt, Homo sapiens
gaauccaaaucaaugucuu

SEQ ID NO: 391924 - RNA, 19 nt, Homo sapiens
caacuacuccuccaucagu

SEQ ID NO: 391925 - RNA, 19 nt, Homo sapiens
gaaacagaacacuucaaug

SEQ ID NO: 391926 - RNA, 19 nt, Homo sapiens
gcaagccuauugaguuaac

SEQ ID NO: 391927 - RNA, 19 nt, Homo sapiens
gaccaguauuaguugcaua

SEQ ID NO: 391928 - RNA, 19 nt, Homo sapiens
gucacacguuuauguagua

SEQ ID NO: 391929 - RNA, 19 nt, Homo sapiens
uggaagaaauauuggaugu

SEQ ID NO: 391930 - RNA, 19 nt, Homo sapiens
uaggaaguauuaucaaugg

SEQ ID NO: 391931 - RNA, 19 nt, Homo sapiens
caaaagugguucuacaaau

SEQ ID NO: 391932 - RNA, 19 nt, Homo sapiens
gaucaucuucggauucuuc

SEQ ID NO: 391933 - RNA, 19 nt, Homo sapiens
gaaauugaucaccgggauu

SEQ ID NO: 391934 - RNA, 19 nt, Homo sapiens
gaacugcuggaaauauuag

SEQ ID NO: 391935 - RNA, 19 nt, Homo sapiens
cugaacugcuggaaauauu

SEQ ID NO: 391936 - RNA, 19 nt, Homo sapiens
ccuaacuacuguauuuguu

SEQ ID NO: 391937 - RNA, 19 nt, Homo sapiens
ggaguuguugccuuacuuu

SEQ ID NO: 391938 - RNA, 19 nt, Homo sapiens
auaaggacuucaauccaaa

SEQ ID NO: 391939 - RNA, 19 nt, Homo sapiens
caacuuuacaguagauuuc

SEQ ID NO: 391940 - RNA, 19 nt, Homo sapiens
gagaaagauccuucacuca

SEQ ID NO: 391941 - RNA, 19 nt, Homo sapiens
ggcuuugcuuuaccucuua

SEQ ID NO: 391942 - RNA, 19 nt, Homo sapiens
uaccagagauguuuuagaa

SEQ ID NO: 391943 - RNA, 19 nt, Homo sapiens
gggaagggaauaucggauu

SEQ ID NO: 391944 - RNA, 19 nt, Homo sapiens
uugcacaucuuccugaguu

SEQ ID NO: 391945 - RNA, 19 nt, Homo sapiens
uaacaaagcugcaguauug

SEQ ID NO: 391946 - RNA, 19 nt, Homo sapiens
ggaaagaggugauaaggaa

SEQ ID NO: 391947 - RNA, 19 nt, Homo sapiens
ggagagagauaauaaacua

SEQ ID NO: 391948 - RNA, 19 nt, Homo sapiens
ggugaaagcuguuccauuu

SEQ ID NO: 391949 - RNA, 19 nt, Homo sapiens
gaacaagacaccauauuaa

SEQ ID NO: 391950 - RNA, 19 nt, Homo sapiens
uagcaaaccuugugaaauu

SEQ ID NO: 391951 - RNA, 19 nt, Homo sapiens
gaaaagaguugcauuugua

SEQ ID NO: 391952 - RNA, 19 nt, Homo sapiens
guucauacuucuacaguua

SEQ ID NO: 391953 - RNA, 19 nt, Homo sapiens
gauaagagaagccuguuua

SEQ ID NO: 391954 - RNA, 19 nt, Homo sapiens
gacaauggcuauaaacuga

SEQ ID NO: 391955 - RNA, 19 nt, Homo sapiens
gaacguugcaaauuuguua

SEQ ID NO: 391956 - RNA, 19 nt, Homo sapiens
cauacuggcuuccaaauuu

SEQ ID NO: 391957 - RNA, 19 nt, Homo sapiens
ggacaauucuuugauuuga

SEQ ID NO: 391958 - RNA, 19 nt, Homo sapiens
gaacaagauccgagcaaua

SEQ ID NO: 391959 - RNA, 19 nt, Homo sapiens
caacaaaaguccauucaua

SEQ ID NO: 391960 - RNA, 19 nt, Homo sapiens
ggaagagaguguugcauug

SEQ ID NO: 391961 - RNA, 19 nt, Homo sapiens
gaaagcuaaugcuaguaua

SEQ ID NO: 391962 - RNA, 19 nt, Homo sapiens
ggacauucauggacaauuc

SEQ ID NO: 391963 - RNA, 19 nt, Homo sapiens
guaauucacuacagccuaa

SEQ ID NO: 391964 - RNA, 19 nt, Homo sapiens
guauaucaguuacggguua

SEQ ID NO: 391965 - RNA, 19 nt, Homo sapiens
caagacaccauauuaagua

SEQ ID NO: 391966 - RNA, 19 nt, Homo sapiens
gagaaaauauccugacuaa

SEQ ID NO: 391967 - RNA, 19 nt, Homo sapiens
ugacugagaugcugguaaa

SEQ ID NO: 391968 - RNA, 19 nt, Homo sapiens
guagaugguuagcauguuu

SEQ ID NO: 391969 - RNA, 19 nt, Homo sapiens
gcaaagcgcuacuguugag

SEQ ID NO: 391970 - RNA, 19 nt, Homo sapiens
ugaacaagacaccauauua

SEQ ID NO: 391971 - RNA, 19 nt, Homo sapiens
ggacagcaauggcaguaau

SEQ ID NO: 391972 - RNA, 19 nt, Homo sapiens
caaagacuaucccaagguu

SEQ ID NO: 391973 - RNA, 19 nt, Homo sapiens
agagaagccuguuuaaaga

SEQ ID NO: 391974 - RNA, 19 nt, Homo sapiens
aaagaacguugcaaauuug

SEQ ID NO: 391975 - RNA, 19 nt, Homo sapiens
ggcuguaugugaauucuua

SEQ ID NO: 391976 - RNA, 19 nt, Homo sapiens
gaacuagggucagaagaag

SEQ ID NO: 391977 - RNA, 19 nt, Homo sapiens
cuagauagguuaaugaaag

SEQ ID NO: 391978 - RNA, 19 nt, Homo sapiens
aaagaaagcuaaugcuagu

SEQ ID NO: 391979 - RNA, 19 nt, Homo sapiens
gagaugccaugcccucuga

SEQ ID NO: 391980 - RNA, 19 nt, Homo sapiens
caaagaaccaccugcauau

SEQ ID NO: 391981 - RNA, 19 nt, Homo sapiens
ucaaagaaccaccugcaua

SEQ ID NO: 391982 - RNA, 19 nt, Homo sapiens
gagauuaacacuuuagaug

SEQ ID NO: 391983 - RNA, 19 nt, Homo sapiens
cuccagagauuaacacuuu

SEQ ID NO: 391984 - RNA, 19 nt, Homo sapiens
gguuguggcuugcugaauu

SEQ ID NO: 391985 - RNA, 19 nt, Homo sapiens
agaagaagauggauuugau

SEQ ID NO: 391986 - RNA, 19 nt, Homo sapiens
uaauuugacuucugacaug

SEQ ID NO: 391987 - RNA, 19 nt, Homo sapiens
ucuuauaacugcagagaaa

SEQ ID NO: 391988 - RNA, 19 nt, Homo sapiens
guuguggcuugcugaauua

SEQ ID NO: 391989 - RNA, 19 nt, Homo sapiens
gagaagagagugagagugu

SEQ ID NO: 391990 - RNA, 19 nt, Homo sapiens
gcaccaaauuacuuagaug

SEQ ID NO: 391991 - RNA, 19 nt, Homo sapiens
gaagagaguguugcauuga

SEQ ID NO: 391992 - RNA, 19 nt, Homo sapiens
gugaugaugugaaagaaau

SEQ ID NO: 391993 - RNA, 19 nt, Homo sapiens
acaaagauguucucgauac

SEQ ID NO: 391994 - RNA, 19 nt, Homo sapiens
ugcaugaacuuacagaauu

SEQ ID NO: 391995 - RNA, 19 nt, Homo sapiens
uauaagugcccaaguaauu

SEQ ID NO: 391996 - RNA, 19 nt, Homo sapiens
gguuacaacugguucauuc

SEQ ID NO: 391997 - RNA, 19 nt, Homo sapiens
ggucugacauauacuggaa

SEQ ID NO: 391998 - RNA, 19 nt, Homo sapiens
ugaugaagcucuuugaagu

SEQ ID NO: 391999 - RNA, 19 nt, Homo sapiens
gcaugaacuuacagaauuc

SEQ ID NO: 392000 - RNA, 19 nt, Homo sapiens
gaaugcccuucuuuccaua

SEQ ID NO: 392001 - RNA, 19 nt, Homo sapiens
ggaacaagauccgagcaau

SEQ ID NO: 392002 - RNA, 19 nt, Homo sapiens
gaacauuucacucacaaca

SEQ ID NO: 392003 - RNA, 19 nt, Homo sapiens
uugaaugugugcuguauuu

SEQ ID NO: 392004 - RNA, 19 nt, Homo sapiens
uaacagagggugcaucaau

SEQ ID NO: 392005 - RNA, 19 nt, Homo sapiens
cuagagugaugaugugaaa

SEQ ID NO: 392006 - RNA, 19 nt, Homo sapiens
gauauagcauacccaaaca

SEQ ID NO: 392007 - RNA, 19 nt, Homo sapiens
ggagaguauucuuuaaagu

SEQ ID NO: 392008 - RNA, 19 nt, Homo sapiens
gggagaguauucuuuaaag

SEQ ID NO: 392009 - RNA, 19 nt, Homo sapiens
ggcaauugaucccaaguug

SEQ ID NO: 392010 - RNA, 19 nt, Homo sapiens
uaaaggcgcaucuuaugaa

SEQ ID NO: 392011 - RNA, 19 nt, Homo sapiens
gguaucaugguguuuauuu

SEQ ID NO: 392012 - RNA, 19 nt, Homo sapiens
gaaauggugauucugguau

SEQ ID NO: 392013 - RNA, 19 nt, Homo sapiens
ugaauuaggcagucuuaaa

SEQ ID NO: 392014 - RNA, 19 nt, Homo sapiens
gaaugaacauguuuuccua

SEQ ID NO: 392015 - RNA, 19 nt, Homo sapiens
gcaacuuacuagagugaug

SEQ ID NO: 392016 - RNA, 19 nt, Homo sapiens
gcaauuagcgauauagcau

SEQ ID NO: 392017 - RNA, 19 nt, Homo sapiens
cuaaaugcauggcaacugu

SEQ ID NO: 392018 - RNA, 19 nt, Homo sapiens
gcuuaaugccuuugaaauu

SEQ ID NO: 392019 - RNA, 19 nt, Homo sapiens
cauggacaauucuuugauu

SEQ ID NO: 392020 - RNA, 19 nt, Homo sapiens
gagggugcaucaauucuuc

SEQ ID NO: 392021 - RNA, 19 nt, Homo sapiens
uagcauacccaaacaaaga

SEQ ID NO: 392022 - RNA, 19 nt, Homo sapiens
acaaggcucucaccucaga

SEQ ID NO: 392023 - RNA, 19 nt, Homo sapiens
ggauuuaugugcacaacca

SEQ ID NO: 392024 - RNA, 19 nt, Homo sapiens
uaacauaagcuugucaaug

SEQ ID NO: 392025 - RNA, 19 nt, Homo sapiens
uagcagcaauauucaguga

SEQ ID NO: 392026 - RNA, 19 nt, Homo sapiens
gggcuuagaccgaauuaau

SEQ ID NO: 392027 - RNA, 19 nt, Homo sapiens
aggcuucccuucucuaauu

SEQ ID NO: 392028 - RNA, 19 nt, Homo sapiens
uaaguacagugauaaagca

SEQ ID NO: 392029 - RNA, 19 nt, Homo sapiens
guucuugccucugacagua

SEQ ID NO: 392030 - RNA, 19 nt, Homo sapiens
caaagauguucucgauaca

SEQ ID NO: 392031 - RNA, 19 nt, Homo sapiens
uaagagaagccuguuuaaa

SEQ ID NO: 392032 - RNA, 19 nt, Homo sapiens
uuacagaauucucauccuu

SEQ ID NO: 392033 - RNA, 19 nt, Homo sapiens
aacauaagcuugucaaugc

SEQ ID NO: 392034 - RNA, 19 nt, Homo sapiens
guacagugauaaagcaucu

SEQ ID NO: 392035 - RNA, 19 nt, Homo sapiens
gaagaagauggauuugaug

SEQ ID NO: 392036 - RNA, 19 nt, Homo sapiens
cugcucagaugaugaacua

SEQ ID NO: 392037 - RNA, 19 nt, Homo sapiens
ugaguccgcugaagggauu

SEQ ID NO: 392038 - RNA, 19 nt, Homo sapiens
gcuugucaaugcacaugua

SEQ ID NO: 392039 - RNA, 19 nt, Homo sapiens
caacaggcuucccuucucu

SEQ ID NO: 392040 - RNA, 19 nt, Homo sapiens
guuaucagguuguuucagu

SEQ ID NO: 392041 - RNA, 19 nt, Homo sapiens
gugccuacuuccacuguaa

SEQ ID NO: 392042 - RNA, 19 nt, Homo sapiens
ggacuucuagauagguuaa

SEQ ID NO: 392043 - RNA, 19 nt, Homo sapiens
gcaguaauagcagcaauau

SEQ ID NO: 392044 - RNA, 19 nt, Homo sapiens
gcuuagaccgaauuaauga

SEQ ID NO: 392045 - RNA, 19 nt, Homo sapiens
gcacugagaucuuugacua

SEQ ID NO: 392046 - RNA, 19 nt, Homo sapiens
ucaaagagcuguucagagu

SEQ ID NO: 392047 - RNA, 19 nt, Homo sapiens
ggagaggccuggagaccua

SEQ ID NO: 392048 - RNA, 19 nt, Homo sapiens
ggacgagcaucuccagaaa

SEQ ID NO: 392049 - RNA, 19 nt, Homo sapiens
cgacauccauggacaauuc

SEQ ID NO: 392050 - RNA, 19 nt, Homo sapiens
ccagagagaucuugguaga

SEQ ID NO: 392051 - RNA, 19 nt, Homo sapiens
gcugcgagcucaucaagga

SEQ ID NO: 392052 - RNA, 19 nt, Homo sapiens
acaauucuaugaccucaaa

SEQ ID NO: 392053 - RNA, 19 nt, Homo sapiens
cuacugcacugagaucuuu

SEQ ID NO: 392054 - RNA, 19 nt, Homo sapiens
accaugaaguuuccaauaa

SEQ ID NO: 392055 - RNA, 19 nt, Homo sapiens
ggagccggcuaccuauuug

SEQ ID NO: 392056 - RNA, 19 nt, Homo sapiens
ccaugaaguuuccaauaau

SEQ ID NO: 392057 - RNA, 19 nt, Homo sapiens
aaagagcuguucagaguag

SEQ ID NO: 392058 - RNA, 19 nt, Homo sapiens
gcaggucuauggcuucuac

SEQ ID NO: 392059 - RNA, 19 nt, Homo sapiens
ucaaggcccugugcgcuaa

SEQ ID NO: 392060 - RNA, 19 nt, Homo sapiens
gaucugccgugcccaccaa

SEQ ID NO: 392061 - RNA, 19 nt, Homo sapiens
gagaccaacuaccucuuca

SEQ ID NO: 392062 - RNA, 19 nt, Homo sapiens
acgagcaucuccagaaaga

SEQ ID NO: 392063 - RNA, 19 nt, Homo sapiens
gacaaucgaccgaaagcaa

SEQ ID NO: 392064 - RNA, 19 nt, Homo sapiens
caaagagcuguucagagua

SEQ ID NO: 392065 - RNA, 19 nt, Homo sapiens
ggccagagagaucuuggua

SEQ ID NO: 392066 - RNA, 19 nt, Homo sapiens
gcacuuaagguucgcuauc

SEQ ID NO: 392067 - RNA, 19 nt, Homo sapiens
gaccaacuaccucuucaug

SEQ ID NO: 392068 - RNA, 19 nt, Homo sapiens
gaaccaugaaguuuccaau

SEQ ID NO: 392069 - RNA, 19 nt, Homo sapiens
gaugagugccugcgcaagu

SEQ ID NO: 392070 - RNA, 19 nt, Homo sapiens
ucuauagcgucgaaacguu

SEQ ID NO: 392071 - RNA, 19 nt, Homo sapiens
ucuauggcuucuacgauga

SEQ ID NO: 392072 - RNA, 19 nt, Homo sapiens
caugagagucgccagauca

SEQ ID NO: 392073 - RNA, 19 nt, Homo sapiens
aaccaugaaguuuccaaua

SEQ ID NO: 392074 - RNA, 19 nt, Homo sapiens
ggucggcacccaacuacug

SEQ ID NO: 392075 - RNA, 19 nt, Homo sapiens
ucaaggagagcgaagucaa

SEQ ID NO: 392076 - RNA, 19 nt, Homo sapiens
agaagcccguggccgacua

SEQ ID NO: 392077 - RNA, 19 nt, Homo sapiens
aagguucgcuauccugauc

SEQ ID NO: 392078 - RNA, 19 nt, Homo sapiens
gaggagccggcuaccuauu

SEQ ID NO: 392079 - RNA, 19 nt, Homo sapiens
ggccgacuacuuccuguga

SEQ ID NO: 392080 - RNA, 19 nt, Homo sapiens
ccagaucacgcaggucuau

SEQ ID NO: 392081 - RNA, 19 nt, Homo sapiens
uggaucagauucggacaau

SEQ ID NO: 392082 - RNA, 19 nt, Homo sapiens
augagugccugcgcaagua

SEQ ID NO: 392083 - RNA, 19 nt, Homo sapiens
ccaugagagucgccagauc

SEQ ID NO: 392084 - RNA, 19 nt, Homo sapiens
ccucaaagagcuguucaga

SEQ ID NO: 392085 - RNA, 19 nt, Homo sapiens
caaggagagcgaagucaag

SEQ ID NO: 392086 - RNA, 19 nt, Homo sapiens
gcugcuggcacuuaagguu

SEQ ID NO: 392087 - RNA, 19 nt, Homo sapiens
gagacggugcucacugugu

SEQ ID NO: 392088 - RNA, 19 nt, Homo sapiens
gcgcuaaggccagagagau

SEQ ID NO: 392089 - RNA, 19 nt, Homo sapiens
uguggaccguggcuucuau

SEQ ID NO: 392090 - RNA, 19 nt, Homo sapiens
uggcuucuauagcgucgaa

SEQ ID NO: 392091 - RNA, 19 nt, Homo sapiens
aggagccggcuaccuauuu

SEQ ID NO: 392092 - RNA, 19 nt, Homo sapiens
caaucgaccgaaagcaaga

SEQ ID NO: 392093 - RNA, 19 nt, Homo sapiens
ggucuauggcuucuacgau

SEQ ID NO: 392094 - RNA, 19 nt, Homo sapiens
gugacgugguggcccaguu

SEQ ID NO: 392095 - RNA, 19 nt, Homo sapiens
cgaggagccggcuaccuau

SEQ ID NO: 392096 - RNA, 19 nt, Homo sapiens
ugagaccaacuaccucuuc

SEQ ID NO: 392097 - RNA, 19 nt, Homo sapiens
gcagacaccuuacugaaua

SEQ ID NO: 392098 - RNA, 19 nt, Homo sapiens
gaaagaaggucgaguagau

SEQ ID NO: 392099 - RNA, 19 nt, Homo sapiens
uuacugaacugcuugguua

SEQ ID NO: 392100 - RNA, 19 nt, Homo sapiens
ugacauccauggccaauuu

SEQ ID NO: 392101 - RNA, 19 nt, Homo sapiens
gaauuagcauggucuuaaa

SEQ ID NO: 392102 - RNA, 19 nt, Homo sapiens
ugacagaaauguugguaaa

SEQ ID NO: 392103 - RNA, 19 nt, Homo sapiens
gaaacccaguuggcauuua

SEQ ID NO: 392104 - RNA, 19 nt, Homo sapiens
ucgaguagaugaagaaauu

SEQ ID NO: 392105 - RNA, 19 nt, Homo sapiens
gcggaaccaucuauuguuu

SEQ ID NO: 392106 - RNA, 19 nt, Homo sapiens
gcuauagaauguacagaaa

SEQ ID NO: 392107 - RNA, 19 nt, Homo sapiens
gaagaaauugcgcuuagaa

SEQ ID NO: 392108 - RNA, 19 nt, Homo sapiens
gaaagagucuaugaagcuu

SEQ ID NO: 392109 - RNA, 19 nt, Homo sapiens
gcuaauacacgauaccuuu

SEQ ID NO: 392110 - RNA, 19 nt, Homo sapiens
cuaugaagcuuguauggaa

SEQ ID NO: 392111 - RNA, 19 nt, Homo sapiens
gaagaaguauuugauuugg

SEQ ID NO: 392112 - RNA, 19 nt, Homo sapiens
ggacagagguuauuuuagu

SEQ ID NO: 392113 - RNA, 19 nt, Homo sapiens
gugcaggacuauucgagua

SEQ ID NO: 392114 - RNA, 19 nt, Homo sapiens
caagcugacuguaaauuuc

SEQ ID NO: 392115 - RNA, 19 nt, Homo sapiens
gaugaauauucgacaguuu

SEQ ID NO: 392116 - RNA, 19 nt, Homo sapiens
ccaagcacauuauuucuuc

SEQ ID NO: 392117 - RNA, 19 nt, Homo sapiens
guaggaggaucaccugcua

SEQ ID NO: 392118 - RNA, 19 nt, Homo sapiens
cuugacaucugaagaagua

SEQ ID NO: 392119 - RNA, 19 nt, Homo sapiens
gcaagaugguuucaauucu

SEQ ID NO: 392120 - RNA, 19 nt, Homo sapiens
uaaagcugcuguauuaaag

SEQ ID NO: 392121 - RNA, 19 nt, Homo sapiens
caaagagccaccugcauuu

SEQ ID NO: 392122 - RNA, 19 nt, Homo sapiens
uguauggucuccugucuaa

SEQ ID NO: 392123 - RNA, 19 nt, Homo sapiens
gaacugcuugguuaaacua

SEQ ID NO: 392124 - RNA, 19 nt, Homo sapiens
gaugcaggcuauagaaugu

SEQ ID NO: 392125 - RNA, 19 nt, Homo sapiens
ccacauagaaucugcaguu

SEQ ID NO: 392126 - RNA, 19 nt, Homo sapiens
ucaaagagccaccugcauu

SEQ ID NO: 392127 - RNA, 19 nt, Homo sapiens
acacaucgcuugacaucug

SEQ ID NO: 392128 - RNA, 19 nt, Homo sapiens
gugauuugcugcuggcuuu

SEQ ID NO: 392129 - RNA, 19 nt, Homo sapiens
uuaccuagauguuaugaga

SEQ ID NO: 392130 - RNA, 19 nt, Homo sapiens
gauguuaguggaagcauaa

SEQ ID NO: 392131 - RNA, 19 nt, Homo sapiens
caaugguucuguucaauca

SEQ ID NO: 392132 - RNA, 19 nt, Homo sapiens
gguacgacauguauagguu

SEQ ID NO: 392133 - RNA, 19 nt, Homo sapiens
aaauguggcuaauucugua

SEQ ID NO: 392134 - RNA, 19 nt, Homo sapiens
ggucuauaguucuuaaaug

SEQ ID NO: 392135 - RNA, 19 nt, Homo sapiens
ccacuguaguuugguauuu

SEQ ID NO: 392136 - RNA, 19 nt, Homo sapiens
ggugaaagaaggucgagua

SEQ ID NO: 392137 - RNA, 19 nt, Homo sapiens
caugaaaugucuuuaaagg

SEQ ID NO: 392138 - RNA, 19 nt, Homo sapiens
cggccaagcugacuguaaa

SEQ ID NO: 392139 - RNA, 19 nt, Homo sapiens
gaaagugcacccuguaugg

SEQ ID NO: 392140 - RNA, 19 nt, Homo sapiens
cagaaauguugguaaaugu

SEQ ID NO: 392141 - RNA, 19 nt, Homo sapiens
acagaaauguugguaaaug

SEQ ID NO: 392142 - RNA, 19 nt, Homo sapiens
caauacaguucgaggaugu

SEQ ID NO: 392143 - RNA, 19 nt, Homo sapiens
ggaaagagucuaugaagcu

SEQ ID NO: 392144 - RNA, 19 nt, Homo sapiens
uaguauagagugugucuua

SEQ ID NO: 392145 - RNA, 19 nt, Homo sapiens
ugaauuagcauggucuuaa

SEQ ID NO: 392146 - RNA, 19 nt, Homo sapiens
accaaugugugacuuguua

SEQ ID NO: 392147 - RNA, 19 nt, Homo sapiens
cagaauuacucauuuaagg

SEQ ID NO: 392148 - RNA, 19 nt, Homo sapiens
ggcaggcucucuuacuuga

SEQ ID NO: 392149 - RNA, 19 nt, Homo sapiens
gagaaacccaguuggcauu

SEQ ID NO: 392150 - RNA, 19 nt, Homo sapiens
gaaguagaagcuccaauca

SEQ ID NO: 392151 - RNA, 19 nt, Homo sapiens
gcaggacuauucgaguauu

SEQ ID NO: 392152 - RNA, 19 nt, Homo sapiens
gagguuacuagcuguauuu

SEQ ID NO: 392153 - RNA, 19 nt, Homo sapiens
gcgcuuagaauuaucaaug

SEQ ID NO: 392154 - RNA, 19 nt, Homo sapiens
gagaaugccaccucggaaa

SEQ ID NO: 392155 - RNA, 19 nt, Homo sapiens
aguagaagcuccaaucaca

SEQ ID NO: 392156 - RNA, 19 nt, Homo sapiens
guauuucccuuuacuuugg

SEQ ID NO: 392157 - RNA, 19 nt, Homo sapiens
ggaaccaugugcuaauuuu

SEQ ID NO: 392158 - RNA, 19 nt, Homo sapiens
ccagagauuuaagaagaaa

SEQ ID NO: 392159 - RNA, 19 nt, Homo sapiens
aaacccaguuggcauuuau

SEQ ID NO: 392160 - RNA, 19 nt, Homo sapiens
caacacaucgcuugacauc

SEQ ID NO: 392161 - RNA, 19 nt, Homo sapiens
ccaagcugacuguaaauuu

SEQ ID NO: 392162 - RNA, 19 nt, Homo sapiens
caagaugguuucaauucuc

SEQ ID NO: 392163 - RNA, 19 nt, Homo sapiens
cauagaaucugcaguuuug

SEQ ID NO: 392164 - RNA, 19 nt, Homo sapiens
gaaauguugguaaauguuc

SEQ ID NO: 392165 - RNA, 19 nt, Homo sapiens
aagcugcuguauuaaagua

SEQ ID NO: 392166 - RNA, 19 nt, Homo sapiens
ucaugaagcucaagaugca

SEQ ID NO: 392167 - RNA, 19 nt, Homo sapiens
gaggaucaccugcuaauac

SEQ ID NO: 392168 - RNA, 19 nt, Homo sapiens
guacgacauguauagguua

SEQ ID NO: 392169 - RNA, 19 nt, Homo sapiens
ucucuuacuugaacacaaa

SEQ ID NO: 392170 - RNA, 19 nt, Homo sapiens
guuacuagcuguauuuuga

SEQ ID NO: 392171 - RNA, 19 nt, Homo sapiens
ucaggucuauaguucuuaa

SEQ ID NO: 392172 - RNA, 19 nt, Homo sapiens
caagaugcaggcuauagaa

SEQ ID NO: 392173 - RNA, 19 nt, Homo sapiens
ggaccaaugugugacuugu

SEQ ID NO: 392174 - RNA, 19 nt, Homo sapiens
caugaaugcagacaccuua

SEQ ID NO: 392175 - RNA, 19 nt, Homo sapiens
cacauuauuucuucugaga

SEQ ID NO: 392176 - RNA, 19 nt, Homo sapiens
guucaaucauucagauguu

SEQ ID NO: 392177 - RNA, 19 nt, Homo sapiens
guaacauagucuugguauu

SEQ ID NO: 392178 - RNA, 19 nt, Homo sapiens
ucuuaaauguggcuaauuc

SEQ ID NO: 392179 - RNA, 19 nt, Homo sapiens
ccaguuggcauuuauacaa

SEQ ID NO: 392180 - RNA, 19 nt, Homo sapiens
acagcaagaugguuucaau

SEQ ID NO: 392181 - RNA, 19 nt, Homo sapiens
cacguggucuuuaccguuu

SEQ ID NO: 392182 - RNA, 19 nt, Homo sapiens
ggaaccaucuauuguuuug

SEQ ID NO: 392183 - RNA, 19 nt, Homo sapiens
gcagcggaaccaucuauug

SEQ ID NO: 392184 - RNA, 19 nt, Homo sapiens
caggcaggcucucuuacuu

SEQ ID NO: 392185 - RNA, 19 nt, Homo sapiens
caguuggcauuuauacaaa

SEQ ID NO: 392186 - RNA, 19 nt, Homo sapiens
gaaaccauugugcuucuga

SEQ ID NO: 392187 - RNA, 19 nt, Homo sapiens
acuaaugacugaaggugaa

SEQ ID NO: 392188 - RNA, 19 nt, Homo sapiens
gagcuaauguggacuuuuc

SEQ ID NO: 392189 - RNA, 19 nt, Homo sapiens
cacagucucucugaagaaa

SEQ ID NO: 392190 - RNA, 19 nt, Homo sapiens
gguaaauguucugaguauu

SEQ ID NO: 392191 - RNA, 19 nt, Homo sapiens
ugguaaauguucugaguau

SEQ ID NO: 392192 - RNA, 19 nt, Homo sapiens
uuugauaguuugccucuug

SEQ ID NO: 392193 - RNA, 19 nt, Homo sapiens
gaugaagaaauugcgcuua

SEQ ID NO: 392194 - RNA, 19 nt, Homo sapiens
ccucaggucuauaguucuu

SEQ ID NO: 392195 - RNA, 19 nt, Homo sapiens
ugaagaaauugcgcuuaga

SEQ ID NO: 392196 - RNA, 19 nt, Homo sapiens
acagggauguugccuagug

SEQ ID NO: 392197 - RNA, 19 nt, Homo sapiens
gaaguagccuuaaagauaa

SEQ ID NO: 392198 - RNA, 19 nt, Homo sapiens
ggaaguagccuuaaagaua

SEQ ID NO: 392199 - RNA, 19 nt, Homo sapiens
gaagaaagcccauucauga

SEQ ID NO: 392200 - RNA, 19 nt, Homo sapiens
caauaaagcugcuguguug

SEQ ID NO: 392201 - RNA, 19 nt, Homo sapiens
gcucuuauuucuacaguua

SEQ ID NO: 392202 - RNA, 19 nt, Homo sapiens
guaaggagaucaucaggaa

SEQ ID NO: 392203 - RNA, 19 nt, Homo sapiens
ggaggaaugucaccugaaa

SEQ ID NO: 392204 - RNA, 19 nt, Homo sapiens
ucacagagaugcugguaaa

SEQ ID NO: 392205 - RNA, 19 nt, Homo sapiens
gcaggcaucuuacagacua

SEQ ID NO: 392206 - RNA, 19 nt, Homo sapiens
ggacaauucuuugaccuaa

SEQ ID NO: 392207 - RNA, 19 nt, Homo sapiens
ggaggugcauuuauaauuc

SEQ ID NO: 392208 - RNA, 19 nt, Homo sapiens
gacagaggcuauuucagua

SEQ ID NO: 392209 - RNA, 19 nt, Homo sapiens
gaaguuauuugaaguugga

SEQ ID NO: 392210 - RNA, 19 nt, Homo sapiens
gaaggaagcacuacaguuc

SEQ ID NO: 392211 - RNA, 19 nt, Homo sapiens
gaacugauuucugaugaug

SEQ ID NO: 392212 - RNA, 19 nt, Homo sapiens
aaacaggaaugucgaauca

SEQ ID NO: 392213 - RNA, 19 nt, Homo sapiens
ggaagaggaaguagccuua

SEQ ID NO: 392214 - RNA, 19 nt, Homo sapiens
ggacagaggcuauuucagu

SEQ ID NO: 392215 - RNA, 19 nt, Homo sapiens
caccugaaauuacuucuuu

SEQ ID NO: 392216 - RNA, 19 nt, Homo sapiens
gaaagcccauucaugacuu

SEQ ID NO: 392217 - RNA, 19 nt, Homo sapiens
uagagugugugcuguauuu

SEQ ID NO: 392218 - RNA, 19 nt, Homo sapiens
ggaagaaagcccauucaug

SEQ ID NO: 392219 - RNA, 19 nt, Homo sapiens
aagcugcuguguugaaaua

SEQ ID NO: 392220 - RNA, 19 nt, Homo sapiens
ggaaugucaccugaaauua

SEQ ID NO: 392221 - RNA, 19 nt, Homo sapiens
cagaggcuauuucaguaua

SEQ ID NO: 392222 - RNA, 19 nt, Homo sapiens
uaacacacgcuaccucuuu

SEQ ID NO: 392223 - RNA, 19 nt, Homo sapiens
cauaugcucugaugacgaa

SEQ ID NO: 392224 - RNA, 19 nt, Homo sapiens
ggcuuuccaucacuuauua

SEQ ID NO: 392225 - RNA, 19 nt, Homo sapiens
cagagaugcugguaaaugu

SEQ ID NO: 392226 - RNA, 19 nt, Homo sapiens
guuggaggaucaccuagua

SEQ ID NO: 392227 - RNA, 19 nt, Homo sapiens
ugugaagucuugugcuaua

SEQ ID NO: 392228 - RNA, 19 nt, Homo sapiens
gcacgggucuuuucaauuc

SEQ ID NO: 392229 - RNA, 19 nt, Homo sapiens
gcacuacaguucguaagga

SEQ ID NO: 392230 - RNA, 19 nt, Homo sapiens
acaggaaugucgaaucaaa

SEQ ID NO: 392231 - RNA, 19 nt, Homo sapiens
agaaguagaugcuccaauc

SEQ ID NO: 392232 - RNA, 19 nt, Homo sapiens
gagaucaucaggaauaaga

SEQ ID NO: 392233 - RNA, 19 nt, Homo sapiens
gaaguuggaggaucaccua

SEQ ID NO: 392234 - RNA, 19 nt, Homo sapiens
gcaagagaagacuaugaua

SEQ ID NO: 392235 - RNA, 19 nt, Homo sapiens
gcaaugagaagaccuugga

SEQ ID NO: 392236 - RNA, 19 nt, Homo sapiens
uaaagcugcuguguugaaa

SEQ ID NO: 392237 - RNA, 19 nt, Homo sapiens
cuacuggcuuccaaacuuu

SEQ ID NO: 392238 - RNA, 19 nt, Homo sapiens
gaagucuugugcuauaaag

SEQ ID NO: 392239 - RNA, 19 nt, Homo sapiens
gaggugcauuuauaauuca

SEQ ID NO: 392240 - RNA, 19 nt, Homo sapiens
cgagacagccacaguagaa

SEQ ID NO: 392241 - RNA, 19 nt, Homo sapiens
caacccaacggcuuacuuu

SEQ ID NO: 392242 - RNA, 19 nt, Homo sapiens
aaggagaucaucaggaaua

SEQ ID NO: 392243 - RNA, 19 nt, Homo sapiens
acaauucuuugaccuaaug

SEQ ID NO: 392244 - RNA, 19 nt, Homo sapiens
ucacauggucuuugccuuu

SEQ ID NO: 392245 - RNA, 19 nt, Homo sapiens
gaaugucaccugaaauuac

SEQ ID NO: 392246 - RNA, 19 nt, Homo sapiens
gaagaggaaguagccuuaa

SEQ ID NO: 392247 - RNA, 19 nt, Homo sapiens
gaaaagcaacucaaaacaa

SEQ ID NO: 392248 - RNA, 19 nt, Homo sapiens
ccuacuggcuuccaaacuu

SEQ ID NO: 392249 - RNA, 19 nt, Homo sapiens
gguaucgaauguacaggaa

SEQ ID NO: 392250 - RNA, 19 nt, Homo sapiens
uaucgaauguacaggaaga

SEQ ID NO: 392251 - RNA, 19 nt, Homo sapiens
gaaugggaaaccuaaaguu

SEQ ID NO: 392252 - RNA, 19 nt, Homo sapiens
gaugcuggguaucgaaugu

SEQ ID NO: 392253 - RNA, 19 nt, Homo sapiens
aagaggaaguagccuuaaa

SEQ ID NO: 392254 - RNA, 19 nt, Homo sapiens
aaagcccauucaugacuua

SEQ ID NO: 392255 - RNA, 19 nt, Homo sapiens
gaggaaguagccuuaaaga

SEQ ID NO: 392256 - RNA, 19 nt, Homo sapiens
gaacuuccccuaauaaaag

SEQ ID NO: 392257 - RNA, 19 nt, Homo sapiens
gaagcacuacaguucguaa

SEQ ID NO: 392258 - RNA, 19 nt, Homo sapiens
cgagggugcucuuauuucu

SEQ ID NO: 392259 - RNA, 19 nt, Homo sapiens
guccgagggugcucuuauu

SEQ ID NO: 392260 - RNA, 19 nt, Homo sapiens
uacggaaccucccgccuuu

SEQ ID NO: 392261 - RNA, 19 nt, Homo sapiens
caaggaaguauuugagaau

SEQ ID NO: 392262 - RNA, 19 nt, Homo sapiens
gaaguagaugcuccaauca

SEQ ID NO: 392263 - RNA, 19 nt, Homo sapiens
caacauaugcucugaugac

SEQ ID NO: 392264 - RNA, 19 nt, Homo sapiens
ugauauucauggacaauuc

SEQ ID NO: 392265 - RNA, 19 nt, Homo sapiens
gugaagucuugugcuauaa

SEQ ID NO: 392266 - RNA, 19 nt, Homo sapiens
augaauaucaggcaguuua

SEQ ID NO: 392267 - RNA, 19 nt, Homo sapiens
uggcucagguggaucuaaa

SEQ ID NO: 392268 - RNA, 19 nt, Homo sapiens
guauagagugugugcugua

SEQ ID NO: 392269 - RNA, 19 nt, Homo sapiens
gagaaugggaaaccuaaag

SEQ ID NO: 392270 - RNA, 19 nt, Homo sapiens
caagcagacuaucgagaca

SEQ ID NO: 392271 - RNA, 19 nt, Homo sapiens
augacgaacugauuucuga

SEQ ID NO: 392272 - RNA, 19 nt, Homo sapiens
cccaacggcuuacuuucaa

SEQ ID NO: 392273 - RNA, 19 nt, Homo sapiens
ggaaugucgaaucaaauau

SEQ ID NO: 392274 - RNA, 19 nt, Homo sapiens
aggaaugucgaaucaaaua

SEQ ID NO: 392275 - RNA, 19 nt, Homo sapiens
ucuuugaccuaaugaaguu

SEQ ID NO: 392276 - RNA, 19 nt, Homo sapiens
ucagaggguucucgcuuca

SEQ ID NO: 392277 - RNA, 19 nt, Homo sapiens
gaagcagaaggaagcacua

SEQ ID NO: 392278 - RNA, 19 nt, Homo sapiens
agaagaccuuggagcacua

SEQ ID NO: 392279 - RNA, 19 nt, Homo sapiens
gaccuaaugaaguuauuug

SEQ ID NO: 392280 - RNA, 19 nt, Homo sapiens
gaauaagaucagagccauu

SEQ ID NO: 392281 - RNA, 19 nt, Homo sapiens
caucaggaauaagaucaga

SEQ ID NO: 392282 - RNA, 19 nt, Homo sapiens
ugggaaaccuaaaguugau

SEQ ID NO: 392283 - RNA, 19 nt, Homo sapiens
gcugcuguguugaaauaug

SEQ ID NO: 392284 - RNA, 19 nt, Homo sapiens
acaguuacccugcaguuug

SEQ ID NO: 392285 - RNA, 19 nt, Homo sapiens
gguucucgcuucagcacaa

SEQ ID NO: 392286 - RNA, 19 nt, Homo sapiens
cagacuauuucaccuucaa

SEQ ID NO: 392287 - RNA, 19 nt, Homo sapiens
gacaauucuuugaccuaau

SEQ ID NO: 392288 - RNA, 19 nt, Homo sapiens
aaaggaaggacgacuggaa

SEQ ID NO: 392289 - RNA, 19 nt, Homo sapiens
cugcuguguugaaauauga

SEQ ID NO: 392290 - RNA, 19 nt, Homo sapiens
caguuacccugcaguuugu

SEQ ID NO: 392291 - RNA, 19 nt, Homo sapiens
gaaauuagacagguuuacg

SEQ ID NO: 392292 - RNA, 19 nt, Homo sapiens
gguguaugaugccuguaug

SEQ ID NO: 392293 - RNA, 19 nt, Homo sapiens
ggcaagagaagacuaugau

SEQ ID NO: 392294 - RNA, 19 nt, Homo sapiens
acgaacugauuucugauga

SEQ ID NO: 392295 - RNA, 19 nt, Homo sapiens
ggaaaccuaaaguugaugu

SEQ ID NO: 392296 - RNA, 19 nt, Homo sapiens
ccaagaugcuggguaucga

SEQ ID NO: 392297 - RNA, 19 nt, Homo sapiens
ggauaaagauggcuauauu

SEQ ID NO: 392298 - RNA, 19 nt, Homo sapiens
ggauggagauggaagaaua

SEQ ID NO: 392299 - RNA, 19 nt, Homo sapiens
gagaaagucuaguucauug

SEQ ID NO: 392300 - RNA, 19 nt, Homo sapiens
gagcagaaauugagguuug

SEQ ID NO: 392301 - RNA, 19 nt, Homo sapiens
ggaagaauauccuuugaag

SEQ ID NO: 392302 - RNA, 19 nt, Homo sapiens
gcuuauagcugcuucauuc

SEQ ID NO: 392303 - RNA, 19 nt, Homo sapiens
gauagaagacuguacaauu

SEQ ID NO: 392304 - RNA, 19 nt, Homo sapiens
gaagaauucugugcuguug

SEQ ID NO: 392305 - RNA, 19 nt, Homo sapiens
ugagaaaucuugcuaaucu

SEQ ID NO: 392306 - RNA, 19 nt, Homo sapiens
ucugaaagauacacaguua

SEQ ID NO: 392307 - RNA, 19 nt, Homo sapiens
guacagcgaguaauagaua

SEQ ID NO: 392308 - RNA, 19 nt, Homo sapiens
gaaucucgaccuuaauuua

SEQ ID NO: 392309 - RNA, 19 nt, Homo sapiens
gaaaagagcauaucaaugu

SEQ ID NO: 392310 - RNA, 19 nt, Homo sapiens
uuaagaagcuugauuugga

SEQ ID NO: 392311 - RNA, 19 nt, Homo sapiens
gcaaugcucucuguguauu

SEQ ID NO: 392312 - RNA, 19 nt, Homo sapiens
gagauaaggagcagaaauu

SEQ ID NO: 392313 - RNA, 19 nt, Homo sapiens
gaaucaaggugaaucaauc

SEQ ID NO: 392314 - RNA, 19 nt, Homo sapiens
acaguagucuuucccuuua

SEQ ID NO: 392315 - RNA, 19 nt, Homo sapiens
ccaaauuuaugccacuuaa

SEQ ID NO: 392316 - RNA, 19 nt, Homo sapiens
uaagggauauccauuuguu

SEQ ID NO: 392317 - RNA, 19 nt, Homo sapiens
gaucuuaucccuucccauu

SEQ ID NO: 392318 - RNA, 19 nt, Homo sapiens
gugaucauguaacuacuua

SEQ ID NO: 392319 - RNA, 19 nt, Homo sapiens
ccaacuaaguguuauugaa

SEQ ID NO: 392320 - RNA, 19 nt, Homo sapiens
ucaguggcauggcuuauaa

SEQ ID NO: 392321 - RNA, 19 nt, Homo sapiens
caaguuauccuuuggaaau

SEQ ID NO: 392322 - RNA, 19 nt, Homo sapiens
gaacuagccuuuugugaau

SEQ ID NO: 392323 - RNA, 19 nt, Homo sapiens
guagguuggcuuuaauuua

SEQ ID NO: 392324 - RNA, 19 nt, Homo sapiens
guagaugugugacucuuau

SEQ ID NO: 392325 - RNA, 19 nt, Homo sapiens
guucuacuguuugaucuua

SEQ ID NO: 392326 - RNA, 19 nt, Homo sapiens
uauaagggauauccauuug

SEQ ID NO: 392327 - RNA, 19 nt, Homo sapiens
aagaauaccugaagugauc

SEQ ID NO: 392328 - RNA, 19 nt, Homo sapiens
ucaguaacguuaagugcua

SEQ ID NO: 392329 - RNA, 19 nt, Homo sapiens
gagaaaucuugcuaaucua

SEQ ID NO: 392330 - RNA, 19 nt, Homo sapiens
gcauguauguaucuaaaca

SEQ ID NO: 392331 - RNA, 19 nt, Homo sapiens
gaagugaucauguaacuac

SEQ ID NO: 392332 - RNA, 19 nt, Homo sapiens
ggagaaagucuaguucauu

SEQ ID NO: 392333 - RNA, 19 nt, Homo sapiens
gaaagagauuuaagaagcu

SEQ ID NO: 392334 - RNA, 19 nt, Homo sapiens
uauuaaaugucccucagua

SEQ ID NO: 392335 - RNA, 19 nt, Homo sapiens
agaauucugugcuguugua

SEQ ID NO: 392336 - RNA, 19 nt, Homo sapiens
acaacagaauccuuuagua

SEQ ID NO: 392337 - RNA, 19 nt, Homo sapiens
gauacacaguuacagcaaa

SEQ ID NO: 392338 - RNA, 19 nt, Homo sapiens
ucuaugacauggauaaaga

SEQ ID NO: 392339 - RNA, 19 nt, Homo sapiens
guugugggaucuuuagaaa

SEQ ID NO: 392340 - RNA, 19 nt, Homo sapiens
caaggugaaucaaucugaa

SEQ ID NO: 392341 - RNA, 19 nt, Homo sapiens
ggauagagcaugcauacug

SEQ ID NO: 392342 - RNA, 19 nt, Homo sapiens
gauaauguugccaaacuuu

SEQ ID NO: 392343 - RNA, 19 nt, Homo sapiens
uaccugaagugaucaugua

SEQ ID NO: 392344 - RNA, 19 nt, Homo sapiens
uguaguagguuggcuuuaa

SEQ ID NO: 392345 - RNA, 19 nt, Homo sapiens
gaugguuuauguugaaugu

SEQ ID NO: 392346 - RNA, 19 nt, Homo sapiens
ggagccauugcauuuauua

SEQ ID NO: 392347 - RNA, 19 nt, Homo sapiens
guaguagguuggcuuuaau

SEQ ID NO: 392348 - RNA, 19 nt, Homo sapiens
gauaaggagcagaaauuga

SEQ ID NO: 392349 - RNA, 19 nt, Homo sapiens
aaauguaccucuuguuuac

SEQ ID NO: 392350 - RNA, 19 nt, Homo sapiens
gacaguagucuuucccuuu

SEQ ID NO: 392351 - RNA, 19 nt, Homo sapiens
ucaaaagacuugcagcuaa

SEQ ID NO: 392352 - RNA, 19 nt, Homo sapiens
gaaggacagcaacaugaaa

SEQ ID NO: 392353 - RNA, 19 nt, Homo sapiens
uaucuuggcuggcguuaca

SEQ ID NO: 392354 - RNA, 19 nt, Homo sapiens
gagcaaaauuguauccaaa

SEQ ID NO: 392355 - RNA, 19 nt, Homo sapiens
gguguuaggccagcuauuu

SEQ ID NO: 392356 - RNA, 19 nt, Homo sapiens
gaagccaacuaaguguuau

SEQ ID NO: 392357 - RNA, 19 nt, Homo sapiens
ugaagccaacuaaguguua

SEQ ID NO: 392358 - RNA, 19 nt, Homo sapiens
gauggaagaauauccuuug

SEQ ID NO: 392359 - RNA, 19 nt, Homo sapiens
cgacacagaugggaaugga

SEQ ID NO: 392360 - RNA, 19 nt, Homo sapiens
caacagaauccuuuaguac

SEQ ID NO: 392361 - RNA, 19 nt, Homo sapiens
uaaucuauaugccacagaa

SEQ ID NO: 392362 - RNA, 19 nt, Homo sapiens
cuaaacacccacauauauu

SEQ ID NO: 392363 - RNA, 19 nt, Homo sapiens
ucuaaacacccacauauau

SEQ ID NO: 392364 - RNA, 19 nt, Homo sapiens
aaucaugaauucccuuguu

SEQ ID NO: 392365 - RNA, 19 nt, Homo sapiens
agaagacuguacaauuuga

SEQ ID NO: 392366 - RNA, 19 nt, Homo sapiens
gaagaauauccuuugaaga

SEQ ID NO: 392367 - RNA, 19 nt, Homo sapiens
gaagaauaccugaagugau

SEQ ID NO: 392368 - RNA, 19 nt, Homo sapiens
gaagcugucugaggcaauc

SEQ ID NO: 392369 - RNA, 19 nt, Homo sapiens
aaagauggcuauauuucca

SEQ ID NO: 392370 - RNA, 19 nt, Homo sapiens
gucuuucccuuuauaguuu

SEQ ID NO: 392371 - RNA, 19 nt, Homo sapiens
ggaaaugaggcaaguuauc

SEQ ID NO: 392372 - RNA, 19 nt, Homo sapiens
uaggagccauugcauuuau

SEQ ID NO: 392373 - RNA, 19 nt, Homo sapiens
gagguuugcuuuccguauc

SEQ ID NO: 392374 - RNA, 19 nt, Homo sapiens
gaguaccacccaacacuuu

SEQ ID NO: 392375 - RNA, 19 nt, Homo sapiens
ggauauccauuuguuugau

SEQ ID NO: 392376 - RNA, 19 nt, Homo sapiens
uaacugcacagggcuuaua

SEQ ID NO: 392377 - RNA, 19 nt, Homo sapiens
ugaugcggaugaaauuaaa

SEQ ID NO: 392378 - RNA, 19 nt, Homo sapiens
ucaguucagugucaaagga

SEQ ID NO: 392379 - RNA, 19 nt, Homo sapiens
agaugggaauggagaagua

SEQ ID NO: 392380 - RNA, 19 nt, Homo sapiens
uaucuaaacacccacauau

SEQ ID NO: 392381 - RNA, 19 nt, Homo sapiens
ugaggcaaguuauccuuug

SEQ ID NO: 392382 - RNA, 19 nt, Homo sapiens
aaugcucucuguguauuua

SEQ ID NO: 392383 - RNA, 19 nt, Homo sapiens
guaacaaaggagucuguaa

SEQ ID NO: 392384 - RNA, 19 nt, Homo sapiens
gugccaagcagaacauaaa

SEQ ID NO: 392385 - RNA, 19 nt, Homo sapiens
ggcaaguuauccuuuggaa

SEQ ID NO: 392386 - RNA, 19 nt, Homo sapiens
ggagauaaggagcagaaau

SEQ ID NO: 392387 - RNA, 19 nt, Homo sapiens
gaaaaucuccacuacaugu

SEQ ID NO: 392388 - RNA, 19 nt, Homo sapiens
gaaaagggcagguugaauc

SEQ ID NO: 392389 - RNA, 19 nt, Homo sapiens
ucccauuucugcaaaggua

SEQ ID NO: 392390 - RNA, 19 nt, Homo sapiens
guaucauguucuacuguuu

SEQ ID NO: 392391 - RNA, 19 nt, Homo sapiens
aaaguaguguaucauguuc

SEQ ID NO: 392392 - RNA, 19 nt, Homo sapiens
acuaggagccauugcauuu

SEQ ID NO: 392393 - RNA, 19 nt, Homo sapiens
ucauucugcuacuuuguaa

SEQ ID NO: 392394 - RNA, 19 nt, Homo sapiens
acaaaggagucuguaacuu

SEQ ID NO: 392395 - RNA, 19 nt, Homo sapiens
ucaugucucugccugaguu

SEQ ID NO: 392396 - RNA, 19 nt, Homo sapiens
gaaauuaaaaggcuaggaa

SEQ ID NO: 392397 - RNA, 19 nt, Homo sapiens
uaacagaucuccaccauug

SEQ ID NO: 392398 - RNA, 19 nt, Homo sapiens
ggauaaagauggcuacauu

SEQ ID NO: 392399 - RNA, 19 nt, Homo sapiens
gagaaccacuucccauaua

SEQ ID NO: 392400 - RNA, 19 nt, Homo sapiens
ugaaagaucuaacuggaua

SEQ ID NO: 392401 - RNA, 19 nt, Homo sapiens
gaacccaucuaucaaggua

SEQ ID NO: 392402 - RNA, 19 nt, Homo sapiens
gguguuaggugaacuguuu

SEQ ID NO: 392403 - RNA, 19 nt, Homo sapiens
gagcagaaguugagguuug

SEQ ID NO: 392404 - RNA, 19 nt, Homo sapiens
ucaaggagauuuacugcua

SEQ ID NO: 392405 - RNA, 19 nt, Homo sapiens
gagaauuuguuuaccagua

SEQ ID NO: 392406 - RNA, 19 nt, Homo sapiens
ggacauggaagaucuguuu

SEQ ID NO: 392407 - RNA, 19 nt, Homo sapiens
caacacaccuggagcacaa

SEQ ID NO: 392408 - RNA, 19 nt, Homo sapiens
gcaggagguuuaagaaguu

SEQ ID NO: 392409 - RNA, 19 nt, Homo sapiens
ccacaaauuuaaucacuug

SEQ ID NO: 392410 - RNA, 19 nt, Homo sapiens
agaccaaacuagaacuuua

SEQ ID NO: 392411 - RNA, 19 nt, Homo sapiens
ggauuuagcacuugaaaga

SEQ ID NO: 392412 - RNA, 19 nt, Homo sapiens
guucaaagauucagacaca

SEQ ID NO: 392413 - RNA, 19 nt, Homo sapiens
gcagaacaaugaaacauac

SEQ ID NO: 392414 - RNA, 19 nt, Homo sapiens
ggaaauggcuuuuauaaac

SEQ ID NO: 392415 - RNA, 19 nt, Homo sapiens
gagaugugcucccacuuug

SEQ ID NO: 392416 - RNA, 19 nt, Homo sapiens
caacagggacaaauauauu

SEQ ID NO: 392417 - RNA, 19 nt, Homo sapiens
gaacugagagccuguaucu

SEQ ID NO: 392418 - RNA, 19 nt, Homo sapiens
gauuacaugcucacauuua

SEQ ID NO: 392419 - RNA, 19 nt, Homo sapiens
gagccuguaucuggauuua

SEQ ID NO: 392420 - RNA, 19 nt, Homo sapiens
guauaugggaggaaauuua

SEQ ID NO: 392421 - RNA, 19 nt, Homo sapiens
cagcaucugugccuccaua

SEQ ID NO: 392422 - RNA, 19 nt, Homo sapiens
gaagccauauguccuaaca

SEQ ID NO: 392423 - RNA, 19 nt, Homo sapiens
ggauggcgaugggaagaua

SEQ ID NO: 392424 - RNA, 19 nt, Homo sapiens
gcacaauuccacuuucauu

SEQ ID NO: 392425 - RNA, 19 nt, Homo sapiens
gagcacaauuccacuuuca

SEQ ID NO: 392426 - RNA, 19 nt, Homo sapiens
gcuguuauuucucaucauu

SEQ ID NO: 392427 - RNA, 19 nt, Homo sapiens
gccaacaaaucuaguucua

SEQ ID NO: 392428 - RNA, 19 nt, Homo sapiens
ccucaccacuccuucauuu

SEQ ID NO: 392429 - RNA, 19 nt, Homo sapiens
ggaagagcaagucaaauga

SEQ ID NO: 392430 - RNA, 19 nt, Homo sapiens
guagggaacccaucuauca

SEQ ID NO: 392431 - RNA, 19 nt, Homo sapiens
agaaaucgcugugcauguu

SEQ ID NO: 392432 - RNA, 19 nt, Homo sapiens
gggaagagcaagucaaaug

SEQ ID NO: 392433 - RNA, 19 nt, Homo sapiens
caacucagugcuauuaauu

SEQ ID NO: 392434 - RNA, 19 nt, Homo sapiens
cagaaguccucacacacua

SEQ ID NO: 392435 - RNA, 19 nt, Homo sapiens
gcaacagggacaaauauau

SEQ ID NO: 392436 - RNA, 19 nt, Homo sapiens
gaaacauacucucccuaca

SEQ ID NO: 392437 - RNA, 19 nt, Homo sapiens
ucagggcucuuauaggaaa

SEQ ID NO: 392438 - RNA, 19 nt, Homo sapiens
cuucagggcucuuauagga

SEQ ID NO: 392439 - RNA, 19 nt, Homo sapiens
gauaaagauggcuacauuu

SEQ ID NO: 392440 - RNA, 19 nt, Homo sapiens
gcauuuacgacauggauaa

SEQ ID NO: 392441 - RNA, 19 nt, Homo sapiens
gauaguuaccuaaggcuuu

SEQ ID NO: 392442 - RNA, 19 nt, Homo sapiens
aaagagaggaaauguguuu

SEQ ID NO: 392443 - RNA, 19 nt, Homo sapiens
gaucaggguuauguaaugu

SEQ ID NO: 392444 - RNA, 19 nt, Homo sapiens
caaaacagcagaacaauga

SEQ ID NO: 392445 - RNA, 19 nt, Homo sapiens
gaccaaacuagaacuuuaa

SEQ ID NO: 392446 - RNA, 19 nt, Homo sapiens
uggauuacaugcucacauu

SEQ ID NO: 392447 - RNA, 19 nt, Homo sapiens
gugugagcaugaauaauuu

SEQ ID NO: 392448 - RNA, 19 nt, Homo sapiens
gcauuuaugucauguuggu

SEQ ID NO: 392449 - RNA, 19 nt, Homo sapiens
ggcaggagguuuaagaagu

SEQ ID NO: 392450 - RNA, 19 nt, Homo sapiens
agaucuaacuggauauuug

SEQ ID NO: 392451 - RNA, 19 nt, Homo sapiens
gacaugaggcuuacugguu

SEQ ID NO: 392452 - RNA, 19 nt, Homo sapiens
guagcaacagggacaaaua

SEQ ID NO: 392453 - RNA, 19 nt, Homo sapiens
caacugucucucugacuua

SEQ ID NO: 392454 - RNA, 19 nt, Homo sapiens
gcuggaauuuacaagcuaa

SEQ ID NO: 392455 - RNA, 19 nt, Homo sapiens
caaggagauuuacugcuau

SEQ ID NO: 392456 - RNA, 19 nt, Homo sapiens
agaaccacuucccauauaa

SEQ ID NO: 392457 - RNA, 19 nt, Homo sapiens
cagagaaccacuucccaua

SEQ ID NO: 392458 - RNA, 19 nt, Homo sapiens
ccaacugucucucugacuu

SEQ ID NO: 392459 - RNA, 19 nt, Homo sapiens
gaagcugguccucaucgua

SEQ ID NO: 392460 - RNA, 19 nt, Homo sapiens
gaggcuuacugguugcuuu

SEQ ID NO: 392461 - RNA, 19 nt, Homo sapiens
caauuccacuuucauucaa

SEQ ID NO: 392462 - RNA, 19 nt, Homo sapiens
uuacuuagccucucugugu

SEQ ID NO: 392463 - RNA, 19 nt, Homo sapiens
gagcagggcuaggacuugu

SEQ ID NO: 392464 - RNA, 19 nt, Homo sapiens
gugcagaaguccucacaca

SEQ ID NO: 392465 - RNA, 19 nt, Homo sapiens
gaaaucgcugugcauguuu

SEQ ID NO: 392466 - RNA, 19 nt, Homo sapiens
acaagaagcugguccucau

SEQ ID NO: 392467 - RNA, 19 nt, Homo sapiens
agagaggcauuauuuauac

SEQ ID NO: 392468 - RNA, 19 nt, Homo sapiens
gaucugaggccuagaagag

SEQ ID NO: 392469 - RNA, 19 nt, Homo sapiens
gcucacagaugcagagacu

SEQ ID NO: 392470 - RNA, 19 nt, Homo sapiens
gagucaggcugcaguggaa

SEQ ID NO: 392471 - RNA, 19 nt, Homo sapiens
gcucccacuuugacaauga

SEQ ID NO: 392472 - RNA, 19 nt, Homo sapiens
aaaggagacaugaggcuua

SEQ ID NO: 392473 - RNA, 19 nt, Homo sapiens
cgacggugauggagaagug

SEQ ID NO: 392474 - RNA, 19 nt, Homo sapiens
ccaacucagugcuauuaau

SEQ ID NO: 392475 - RNA, 19 nt, Homo sapiens
gguuugcguucagcauuua

SEQ ID NO: 392476 - RNA, 19 nt, Homo sapiens
acaaagagaggaaaugugu

SEQ ID NO: 392477 - RNA, 19 nt, Homo sapiens
ggagcacaauuccacuuuc

SEQ ID NO: 392478 - RNA, 19 nt, Homo sapiens
ugugugagcaugaauaauu

SEQ ID NO: 392479 - RNA, 19 nt, Homo sapiens
ucacagaugcagagacuga

SEQ ID NO: 392480 - RNA, 19 nt, Homo sapiens
aaaguggcauuaugucugu

SEQ ID NO: 392481 - RNA, 19 nt, Homo sapiens
ugagacauuuaguuaguug

SEQ ID NO: 392482 - RNA, 19 nt, Homo sapiens
gcccacaccagcauuaauu

SEQ ID NO: 392483 - RNA, 19 nt, Homo sapiens
gcucuuauaggaaaugcua

SEQ ID NO: 392484 - RNA, 19 nt, Homo sapiens
cacaaugcauccagaaauc

SEQ ID NO: 392485 - RNA, 19 nt, Homo sapiens
caccaacucagugcuauua

SEQ ID NO: 392486 - RNA, 19 nt, Homo sapiens
aaaucggaaugcuuuguuu

SEQ ID NO: 392487 - RNA, 19 nt, Homo sapiens
uaacaaagagaggaaaugu

SEQ ID NO: 392488 - RNA, 19 nt, Homo sapiens
aaagauggcuacauuucca

SEQ ID NO: 392489 - RNA, 19 nt, Homo sapiens
guucagcauuuacgacaug

SEQ ID NO: 392490 - RNA, 19 nt, Homo sapiens
gcagcccacaccagcauua

SEQ ID NO: 392491 - RNA, 19 nt, Homo sapiens
ccagauuguuaacuuccua

SEQ ID NO: 392492 - RNA, 19 nt, Homo sapiens
uuaucacacucacuucuuu

SEQ ID NO: 392493 - RNA, 19 nt, Homo sapiens
ggugaucaggguuauguaa

SEQ ID NO: 392494 - RNA, 19 nt, Homo sapiens
gaacaaugaaacauacucu

SEQ ID NO: 392495 - RNA, 19 nt, Homo sapiens
ugaggugucccacauacua

SEQ ID NO: 392496 - RNA, 19 nt, Homo sapiens
guugguagcuuuagaucag

SEQ ID NO: 392497 - RNA, 19 nt, Homo sapiens
gaacaaagccuccuacauc

SEQ ID NO: 392498 - RNA, 19 nt, Homo sapiens
gaaaugugccuaccagauu

SEQ ID NO: 392499 - RNA, 19 nt, Homo sapiens
agaaguacaucaaggguua

SEQ ID NO: 392500 - RNA, 19 nt, Homo sapiens
ccauugagcuggacaagaa

SEQ ID NO: 392501 - RNA, 19 nt, Homo sapiens
gcaaagugcugaucaugca

SEQ ID NO: 392502 - RNA, 19 nt, Homo sapiens
gcaacaagaucgugaagca

SEQ ID NO: 392503 - RNA, 19 nt, Homo sapiens
cagaggagcucaagacuca

SEQ ID NO: 392504 - RNA, 19 nt, Homo sapiens
agaacaaccuggacuauau

SEQ ID NO: 392505 - RNA, 19 nt, Homo sapiens
gcaaagugacaaucaguuu

SEQ ID NO: 392506 - RNA, 19 nt, Homo sapiens
cagagaagauuacaguaug

SEQ ID NO: 392507 - RNA, 19 nt, Homo sapiens
gcaugaccauugaggauga

SEQ ID NO: 392508 - RNA, 19 nt, Homo sapiens
gagaacaaccuggacuaua

SEQ ID NO: 392509 - RNA, 19 nt, Homo sapiens
ggacacccauggccaguuc

SEQ ID NO: 392510 - RNA, 19 nt, Homo sapiens
ggcgugagcugucaguuug

SEQ ID NO: 392511 - RNA, 19 nt, Homo sapiens
aaagagacagagaagauua

SEQ ID NO: 392512 - RNA, 19 nt, Homo sapiens
gacaaucaguuucaugaag

SEQ ID NO: 392513 - RNA, 19 nt, Homo sapiens
gaaaccacacucaaagaga

SEQ ID NO: 392514 - RNA, 19 nt, Homo sapiens
gaagaaacugcaccggaaa

SEQ ID NO: 392515 - RNA, 19 nt, Homo sapiens
guacaaggaccagaagaaa

SEQ ID NO: 392516 - RNA, 19 nt, Homo sapiens
uauucgagcucaacgguuu

SEQ ID NO: 392517 - RNA, 19 nt, Homo sapiens
ggaaaugugccuaccagau

SEQ ID NO: 392518 - RNA, 19 nt, Homo sapiens
ucaaagagacagagaagau

SEQ ID NO: 392519 - RNA, 19 nt, Homo sapiens
ugaaauaccaggagugcaa

SEQ ID NO: 392520 - RNA, 19 nt, Homo sapiens
gaacaaccuggacuauauc

SEQ ID NO: 392521 - RNA, 19 nt, Homo sapiens
gaccaaccccuauauauuu

SEQ ID NO: 392522 - RNA, 19 nt, Homo sapiens
ucaagacucaggccaauga

SEQ ID NO: 392523 - RNA, 19 nt, Homo sapiens
gccaaugacuacuucaaag

SEQ ID NO: 392524 - RNA, 19 nt, Homo sapiens
caaagagacagagaagauu

SEQ ID NO: 392525 - RNA, 19 nt, Homo sapiens
gcucaagacucaggccaau

SEQ ID NO: 392526 - RNA, 19 nt, Homo sapiens
ugacaaggaugccaaaaug

SEQ ID NO: 392527 - RNA, 19 nt, Homo sapiens
ggacaagaaguacaucaag

SEQ ID NO: 392528 - RNA, 19 nt, Homo sapiens
ucuaugaccuccucaacau

SEQ ID NO: 392529 - RNA, 19 nt, Homo sapiens
caacuacugcgaccagaug

SEQ ID NO: 392530 - RNA, 19 nt, Homo sapiens
ggaaaccacacucaaagag

SEQ ID NO: 392531 - RNA, 19 nt, Homo sapiens
ggaacaaagccuccuacau

SEQ ID NO: 392532 - RNA, 19 nt, Homo sapiens
gggcgugagcugucaguuu

SEQ ID NO: 392533 - RNA, 19 nt, Homo sapiens
gguacaaggaccagaagaa

SEQ ID NO: 392534 - RNA, 19 nt, Homo sapiens
gagcaugaccauugaggau

SEQ ID NO: 392535 - RNA, 19 nt, Homo sapiens
caaccuggacuauaucauc

SEQ ID NO: 392536 - RNA, 19 nt, Homo sapiens
ggaccgaggcuccuucucu

SEQ ID NO: 392537 - RNA, 19 nt, Homo sapiens
cagacaacaugaaccagau

SEQ ID NO: 392538 - RNA, 19 nt, Homo sapiens
gaaacugcaccggaaaugu

SEQ ID NO: 392539 - RNA, 19 nt, Homo sapiens
gugacaaucaguuucauga

SEQ ID NO: 392540 - RNA, 19 nt, Homo sapiens
ggccaaugacuacuucaaa

SEQ ID NO: 392541 - RNA, 19 nt, Homo sapiens
cagcaaugccaucuacuau

SEQ ID NO: 392542 - RNA, 19 nt, Homo sapiens
ccagcaaugccaucuacua

SEQ ID NO: 392543 - RNA, 19 nt, Homo sapiens
acggaggccuguucaguga

SEQ ID NO: 392544 - RNA, 19 nt, Homo sapiens
gcacggaggccuguucagu

SEQ ID NO: 392545 - RNA, 19 nt, Homo sapiens
agacagagaagauuacagu

SEQ ID NO: 392546 - RNA, 19 nt, Homo sapiens
ucgagagcaugaccauuga

SEQ ID NO: 392547 - RNA, 19 nt, Homo sapiens
uaccaggagugcaacaaga

SEQ ID NO: 392548 - RNA, 19 nt, Homo sapiens
ggccucaguuccaccaguu

SEQ ID NO: 392549 - RNA, 19 nt, Homo sapiens
acagagaagauuacaguau

SEQ ID NO: 392550 - RNA, 19 nt, Homo sapiens
aaaugugccuaccagauuc

SEQ ID NO: 392551 - RNA, 19 nt, Homo sapiens
agacucaggccaaugacua

SEQ ID NO: 392552 - RNA, 19 nt, Homo sapiens
ugaagcagaaggccuuuga

SEQ ID NO: 392553 - RNA, 19 nt, Homo sapiens
ccagauguacgagcucuuu

SEQ ID NO: 392554 - RNA, 19 nt, Homo sapiens
caaguacacagcccagaug

SEQ ID NO: 392555 - RNA, 19 nt, Homo sapiens
ccacgagacagacaacaug

SEQ ID NO: 392556 - RNA, 19 nt, Homo sapiens
agagaagauuacaguaugu

SEQ ID NO: 392557 - RNA, 19 nt, Homo sapiens
aaacugcaccggaaaugug

SEQ ID NO: 392558 - RNA, 19 nt, Homo sapiens
caaagugacaaucaguuuc

SEQ ID NO: 392559 - RNA, 19 nt, Homo sapiens
guacagcggacccaagcuu

SEQ ID NO: 392560 - RNA, 19 nt, Homo sapiens
guacaucaaggguuauuac

SEQ ID NO: 392561 - RNA, 19 nt, Homo sapiens
acaagaucgugaagcagaa

SEQ ID NO: 392562 - RNA, 19 nt, Homo sapiens
caaucaguuucaugaagga

SEQ ID NO: 392563 - RNA, 19 nt, Homo sapiens
caacaugaaccagaucuac

SEQ ID NO: 392564 - RNA, 19 nt, Homo sapiens
aaagugacaaucaguuuca

SEQ ID NO: 392565 - RNA, 19 nt, Homo sapiens
gcuugaagacggcaaagug

SEQ ID NO: 392566 - RNA, 19 nt, Homo sapiens
gaggcaaccacgagacaga

SEQ ID NO: 392567 - RNA, 19 nt, Homo sapiens
ucaggccaaugacuacuuc

SEQ ID NO: 392568 - RNA, 19 nt, Homo sapiens
gacagagaagauuacagua

SEQ ID NO: 392569 - RNA, 19 nt, Homo sapiens
gaagacggcaaagugacaa

SEQ ID NO: 392570 - RNA, 19 nt, Homo sapiens
agacgguggucaaggugaa

SEQ ID NO: 392571 - RNA, 19 nt, Homo sapiens
gcagcuaggaaugauguga

SEQ ID NO: 392572 - RNA, 19 nt, Homo sapiens
auucagggcccauguguga

SEQ ID NO: 392573 - RNA, 19 nt, Homo sapiens
gugcaucaacggcaaagug

SEQ ID NO: 392574 - RNA, 19 nt, Homo sapiens
cagauguacgagcucuuua

SEQ ID NO: 392575 - RNA, 19 nt, Homo sapiens
guacccagaucacuuucac

SEQ ID NO: 392576 - RNA, 19 nt, Homo sapiens
cgaggcuccuucucuguag

SEQ ID NO: 392577 - RNA, 19 nt, Homo sapiens
ccgaggcuccuucucugua

SEQ ID NO: 392578 - RNA, 19 nt, Homo sapiens
gccaggccaucgagcugaa

SEQ ID NO: 392579 - RNA, 19 nt, Homo sapiens
ggagaccaaccccuauaua

SEQ ID NO: 392580 - RNA, 19 nt, Homo sapiens
gagaagauuacaguaugug

SEQ ID NO: 392581 - RNA, 19 nt, Homo sapiens
uggccuaccugcgcacuga

SEQ ID NO: 392582 - RNA, 19 nt, Homo sapiens
ugacaaucaguuucaugaa

SEQ ID NO: 392583 - RNA, 19 nt, Homo sapiens
gggcagaggagcucaagac

SEQ ID NO: 392584 - RNA, 19 nt, Homo sapiens
ccuguacccagaucacuuu

SEQ ID NO: 392585 - RNA, 19 nt, Homo sapiens
caacauauucgagcucaac

SEQ ID NO: 392586 - RNA, 19 nt, Homo sapiens
acaaggaccagaagaaacu

SEQ ID NO: 392587 - RNA, 19 nt, Homo sapiens
ggcaaagugacaaucaguu

SEQ ID NO: 392588 - RNA, 19 nt, Homo sapiens
acacagcccagauguacga

SEQ ID NO: 392589 - RNA, 19 nt, Homo sapiens
gugaggugaaggccaagua

SEQ ID NO: 392590 - RNA, 19 nt, Homo sapiens
gaggcuccuucucuguaga

SEQ ID NO: 392591 - RNA, 19 nt, Homo sapiens
gagaccaaccccuauauau

SEQ ID NO: 392592 - RNA, 19 nt, Homo sapiens
acauggcacugggcaaguu

SEQ ID NO: 392593 - RNA, 19 nt, Homo sapiens
ccaaguacacagcccagau

SEQ ID NO: 392594 - RNA, 19 nt, Homo sapiens
gcaaccacgagacagacaa

SEQ ID NO: 392595 - RNA, 19 nt, Homo sapiens
ucaagcccauggccuaugc

SEQ ID NO: 392596 - RNA, 19 nt, Homo sapiens
ucaaagccaaggacuacga

SEQ ID NO: 392597 - RNA, 19 nt, Homo sapiens
gagcaaaggucacaaauga

SEQ ID NO: 392598 - RNA, 19 nt, Homo sapiens
gcacgaaggcuauaaauuu

SEQ ID NO: 392599 - RNA, 19 nt, Homo sapiens
ggacaaguauguggaaaua

SEQ ID NO: 392600 - RNA, 19 nt, Homo sapiens
gcaaguaccugccagagaa

SEQ ID NO: 392601 - RNA, 19 nt, Homo sapiens
gcacuuugcugcugaaaug

SEQ ID NO: 392602 - RNA, 19 nt, Homo sapiens
gcauguagcucuugcuuau

SEQ ID NO: 392603 - RNA, 19 nt, Homo sapiens
gaacgacaacgccauauuu

SEQ ID NO: 392604 - RNA, 19 nt, Homo sapiens
uaacacaggucuauggauu

SEQ ID NO: 392605 - RNA, 19 nt, Homo sapiens
cacgaaggcuauaaauuua

SEQ ID NO: 392606 - RNA, 19 nt, Homo sapiens
ccaaaugccucaaguuaug

SEQ ID NO: 392607 - RNA, 19 nt, Homo sapiens
ucacuuaccuucuugcauu

SEQ ID NO: 392608 - RNA, 19 nt, Homo sapiens
uaaauggccugaucguauu

SEQ ID NO: 392609 - RNA, 19 nt, Homo sapiens
ugagaagacuugagaaaug

SEQ ID NO: 392610 - RNA, 19 nt, Homo sapiens
caagagaaccaaaguuauu

SEQ ID NO: 392611 - RNA, 19 nt, Homo sapiens
gcagcaaaguuguuauuca

SEQ ID NO: 392612 - RNA, 19 nt, Homo sapiens
cacaguagcagcuuuaaua

SEQ ID NO: 392613 - RNA, 19 nt, Homo sapiens
gagaagacuugagaaaugu

SEQ ID NO: 392614 - RNA, 19 nt, Homo sapiens
agacagagguuacuauagu

SEQ ID NO: 392615 - RNA, 19 nt, Homo sapiens
gagauacuguaccaaaguu

SEQ ID NO: 392616 - RNA, 19 nt, Homo sapiens
uacaagagaaccaaaguua

SEQ ID NO: 392617 - RNA, 19 nt, Homo sapiens
ggaaauauugcuucgauca

SEQ ID NO: 392618 - RNA, 19 nt, Homo sapiens
guagacagagguuacuaua

SEQ ID NO: 392619 - RNA, 19 nt, Homo sapiens
aaagccaauugacagauua

SEQ ID NO: 392620 - RNA, 19 nt, Homo sapiens
gaccuucacuuaccuucuu

SEQ ID NO: 392621 - RNA, 19 nt, Homo sapiens
guaacaguguguggagaua

SEQ ID NO: 392622 - RNA, 19 nt, Homo sapiens
gcaaaggucacaaaugagu

SEQ ID NO: 392623 - RNA, 19 nt, Homo sapiens
ccaaauauggaaaugcuaa

SEQ ID NO: 392624 - RNA, 19 nt, Homo sapiens
gaggaaaucaugagaguag

SEQ ID NO: 392625 - RNA, 19 nt, Homo sapiens
cuaaauggccugaucguau

SEQ ID NO: 392626 - RNA, 19 nt, Homo sapiens
cgcuagaccuggacaagua

SEQ ID NO: 392627 - RNA, 19 nt, Homo sapiens
gcgaggaaaucaugagagu

SEQ ID NO: 392628 - RNA, 19 nt, Homo sapiens
gacagagguuacuauaguu

SEQ ID NO: 392629 - RNA, 19 nt, Homo sapiens
gcuaaugccuggagauacu

SEQ ID NO: 392630 - RNA, 19 nt, Homo sapiens
agauauccauggacaguuu

SEQ ID NO: 392631 - RNA, 19 nt, Homo sapiens
ccuaauuacugcuaucguu

SEQ ID NO: 392632 - RNA, 19 nt, Homo sapiens
guuuggagaccuucacuua

SEQ ID NO: 392633 - RNA, 19 nt, Homo sapiens
aguagcagcuuuaauagau

SEQ ID NO: 392634 - RNA, 19 nt, Homo sapiens
gcucacaguagcagcuuua

SEQ ID NO: 392635 - RNA, 19 nt, Homo sapiens
gcugaaaugcugccucuug

SEQ ID NO: 392636 - RNA, 19 nt, Homo sapiens
guggaaauauugcuucgau

SEQ ID NO: 392637 - RNA, 19 nt, Homo sapiens
uauggucugcuccuaauua

SEQ ID NO: 392638 - RNA, 19 nt, Homo sapiens
caugagaguagacagauaa

SEQ ID NO: 392639 - RNA, 19 nt, Homo sapiens
aaacuucauuguccuuugu

SEQ ID NO: 392640 - RNA, 19 nt, Homo sapiens
uaagaaauuucagcagcaa

SEQ ID NO: 392641 - RNA, 19 nt, Homo sapiens
cugcagagcacaucaacua

SEQ ID NO: 392642 - RNA, 19 nt, Homo sapiens
cgaacggaaucaggaaauu

SEQ ID NO: 392643 - RNA, 19 nt, Homo sapiens
uuagaagagucaaauguuc

SEQ ID NO: 392644 - RNA, 19 nt, Homo sapiens
cagcaaaguuguuauucag

SEQ ID NO: 392645 - RNA, 19 nt, Homo sapiens
cagagcacaucaacuagug

SEQ ID NO: 392646 - RNA, 19 nt, Homo sapiens
gagaagcuggugacaguau

SEQ ID NO: 392647 - RNA, 19 nt, Homo sapiens
uagcagcuuuaauagauga

SEQ ID NO: 392648 - RNA, 19 nt, Homo sapiens
caaaccaaauauggaaaug

SEQ ID NO: 392649 - RNA, 19 nt, Homo sapiens
uaaacuucauuguccuuug

SEQ ID NO: 392650 - RNA, 19 nt, Homo sapiens
ccagaacgacaacgccaua

SEQ ID NO: 392651 - RNA, 19 nt, Homo sapiens
aaauauugcuucgaucaug

SEQ ID NO: 392652 - RNA, 19 nt, Homo sapiens
ggagauacuguaccaaagu

SEQ ID NO: 392653 - RNA, 19 nt, Homo sapiens
ucaugagaguagacagaua

SEQ ID NO: 392654 - RNA, 19 nt, Homo sapiens
cuccaaaugccucaaguua

SEQ ID NO: 392655 - RNA, 19 nt, Homo sapiens
auguagcucuugcuuauuu

SEQ ID NO: 392656 - RNA, 19 nt, Homo sapiens
ucaaaacacuggaucaaau

SEQ ID NO: 392657 - RNA, 19 nt, Homo sapiens
gacagauuacaccuaaaua

SEQ ID NO: 392658 - RNA, 19 nt, Homo sapiens
ggagcaaaggucacaaaug

SEQ ID NO: 392659 - RNA, 19 nt, Homo sapiens
gcggcuaugugacuacguu

SEQ ID NO: 392660 - RNA, 19 nt, Homo sapiens
ugacagauuacaccuaaau

SEQ ID NO: 392661 - RNA, 19 nt, Homo sapiens
guguguccauggugguuua

SEQ ID NO: 392662 - RNA, 19 nt, Homo sapiens
auugacagauuacaccuaa

SEQ ID NO: 392663 - RNA, 19 nt, Homo sapiens
guaaauacaagagaaccaa

SEQ ID NO: 392664 - RNA, 19 nt, Homo sapiens
gaaauauugcuucgaucau

SEQ ID NO: 392665 - RNA, 19 nt, Homo sapiens
ggagauauccauggacagu

SEQ ID NO: 392666 - RNA, 19 nt, Homo sapiens
guagcagcuuuaauagaug

SEQ ID NO: 392667 - RNA, 19 nt, Homo sapiens
gaugagugccaaaccaaau

SEQ ID NO: 392668 - RNA, 19 nt, Homo sapiens
gauaacacaggucuaugga

SEQ ID NO: 392669 - RNA, 19 nt, Homo sapiens
ugaagcggcuaugugacua

SEQ ID NO: 392670 - RNA, 19 nt, Homo sapiens
cacuuaccuucuugcauua

SEQ ID NO: 392671 - RNA, 19 nt, Homo sapiens
ggucugcuccuaauuacug

SEQ ID NO: 392672 - RNA, 19 nt, Homo sapiens
aaaggucacaaaugaguuu

SEQ ID NO: 392673 - RNA, 19 nt, Homo sapiens
aaauuggucuaaaggacaa

SEQ ID NO: 392674 - RNA, 19 nt, Homo sapiens
guauaccugucccagaugu

SEQ ID NO: 392675 - RNA, 19 nt, Homo sapiens
cagcagcaaaguuguuauu

SEQ ID NO: 392676 - RNA, 19 nt, Homo sapiens
gcagagcacaucaacuagu

SEQ ID NO: 392677 - RNA, 19 nt, Homo sapiens
gccaguaucaacaccagua

SEQ ID NO: 392678 - RNA, 19 nt, Homo sapiens
uuugugaccuccucuuaga

SEQ ID NO: 392679 - RNA, 19 nt, Homo sapiens
ccauccugcugacccauuu

SEQ ID NO: 392680 - RNA, 19 nt, Homo sapiens
acaacgccauauuuccuuu

SEQ ID NO: 392681 - RNA, 19 nt, Homo sapiens
gcuaaauggccugaucgua

SEQ ID NO: 392682 - RNA, 19 nt, Homo sapiens
acaaguauguggaaauagc

SEQ ID NO: 392683 - RNA, 19 nt, Homo sapiens
gaaaucaugagaguagaca

SEQ ID NO: 392684 - RNA, 19 nt, Homo sapiens
ccagauucagaacguguua

SEQ ID NO: 392685 - RNA, 19 nt, Homo sapiens
augagaagcuggugacagu

SEQ ID NO: 392686 - RNA, 19 nt, Homo sapiens
ugucccagauguaaacuuc

SEQ ID NO: 392687 - RNA, 19 nt, Homo sapiens
gagaaaugucuuaauacuc

SEQ ID NO: 392688 - RNA, 19 nt, Homo sapiens
aaugcugccucuugccuuu

SEQ ID NO: 392689 - RNA, 19 nt, Homo sapiens
uguagcucuugcuuauuua

SEQ ID NO: 392690 - RNA, 19 nt, Homo sapiens
guaaacuucauuguccuuu

SEQ ID NO: 392691 - RNA, 19 nt, Homo sapiens
ccagauguaaacuucauug

SEQ ID NO: 392692 - RNA, 19 nt, Homo sapiens
cauucagccuuuuguuuua

SEQ ID NO: 392693 - RNA, 19 nt, Homo sapiens
guuguggugucuauagcaa

SEQ ID NO: 392694 - RNA, 19 nt, Homo sapiens
ccaaaccaaauauggaaau

SEQ ID NO: 392695 - RNA, 19 nt, Homo sapiens
acagauaacacaggucuau

SEQ ID NO: 392696 - RNA, 19 nt, Homo sapiens
gcuaugugacuacguuugu

SEQ ID NO: 392697 - RNA, 19 nt, Homo sapiens
ggaaguagcacccaaauua

SEQ ID NO: 392698 - RNA, 19 nt, Homo sapiens
ggagacagcuguugcaauc

SEQ ID NO: 392699 - RNA, 19 nt, Homo sapiens
gagaauaggaggaaccaua

SEQ ID NO: 392700 - RNA, 19 nt, Homo sapiens
ggagacaacuaacuaaagu

SEQ ID NO: 392701 - RNA, 19 nt, Homo sapiens
gaaguagcacccaaauuaa

SEQ ID NO: 392702 - RNA, 19 nt, Homo sapiens
ggagacaguuuccuucaug

SEQ ID NO: 392703 - RNA, 19 nt, Homo sapiens
caaaggagacaacuaacua

SEQ ID NO: 392704 - RNA, 19 nt, Homo sapiens
gagaggaaauguacaucuu

SEQ ID NO: 392705 - RNA, 19 nt, Homo sapiens
gguguugaaugcaaguuua

SEQ ID NO: 392706 - RNA, 19 nt, Homo sapiens
guacucacauaaaugcuuu

SEQ ID NO: 392707 - RNA, 19 nt, Homo sapiens
gaugaaacccguauaguuc

SEQ ID NO: 392708 - RNA, 19 nt, Homo sapiens
gcagcuaguucuuccuauu

SEQ ID NO: 392709 - RNA, 19 nt, Homo sapiens
ugaaauuccucaaugauuc

SEQ ID NO: 392710 - RNA, 19 nt, Homo sapiens
ggaugaaacccguauaguu

SEQ ID NO: 392711 - RNA, 19 nt, Homo sapiens
aaccugcccuuucuuaaua

SEQ ID NO: 392712 - RNA, 19 nt, Homo sapiens
uaaaggaaauggacaaugc

SEQ ID NO: 392713 - RNA, 19 nt, Homo sapiens
caucuaacaugcacuacuu

SEQ ID NO: 392714 - RNA, 19 nt, Homo sapiens
gaacagcuucuucuugaau

SEQ ID NO: 392715 - RNA, 19 nt, Homo sapiens
aaacacauuuaccagcaua

SEQ ID NO: 392716 - RNA, 19 nt, Homo sapiens
ggacaaugcaggacagcua

SEQ ID NO: 392717 - RNA, 19 nt, Homo sapiens
gaucugaaucuuauccuuu

SEQ ID NO: 392718 - RNA, 19 nt, Homo sapiens
ggauuaagagcaagaaguu

SEQ ID NO: 392719 - RNA, 19 nt, Homo sapiens
ggaagacauuucuguagca

SEQ ID NO: 392720 - RNA, 19 nt, Homo sapiens
gaggaaauguacaucuugu

SEQ ID NO: 392721 - RNA, 19 nt, Homo sapiens
ugaauuaguugcugucaca

SEQ ID NO: 392722 - RNA, 19 nt, Homo sapiens
caacuaauccuucuaucau

SEQ ID NO: 392723 - RNA, 19 nt, Homo sapiens
gagaucaacccacauuaga

SEQ ID NO: 392724 - RNA, 19 nt, Homo sapiens
gcccaaaggagacaacuaa

SEQ ID NO: 392725 - RNA, 19 nt, Homo sapiens
gagcuacgccuugaugaaa

SEQ ID NO: 392726 - RNA, 19 nt, Homo sapiens
gcaacuaauccuucuauca

SEQ ID NO: 392727 - RNA, 19 nt, Homo sapiens
uaacaugcacuacuuggaa

SEQ ID NO: 392728 - RNA, 19 nt, Homo sapiens
ucaaugaguccuacaagaa

SEQ ID NO: 392729 - RNA, 19 nt, Homo sapiens
agauccagcuugcaacuaa

SEQ ID NO: 392730 - RNA, 19 nt, Homo sapiens
ggcuauuucugcaucauuu

SEQ ID NO: 392731 - RNA, 19 nt, Homo sapiens
caucuucuguuaccauaug

SEQ ID NO: 392732 - RNA, 19 nt, Homo sapiens
caaugaguccuacaagaaa

SEQ ID NO: 392733 - RNA, 19 nt, Homo sapiens
gcaugucaguuuggagaaa

SEQ ID NO: 392734 - RNA, 19 nt, Homo sapiens
uaacuuagggagcgaagaa

SEQ ID NO: 392735 - RNA, 19 nt, Homo sapiens
ggagaucaacccacauuag

SEQ ID NO: 392736 - RNA, 19 nt, Homo sapiens
cgaccaaccugcccuuucu

SEQ ID NO: 392737 - RNA, 19 nt, Homo sapiens
ugaagaaguuugugauggu

SEQ ID NO: 392738 - RNA, 19 nt, Homo sapiens
ugauggcccugaagaaguu

SEQ ID NO: 392739 - RNA, 19 nt, Homo sapiens
uaacguaaucuaccauuuc

SEQ ID NO: 392740 - RNA, 19 nt, Homo sapiens
caaguuuaauuaccaugga

SEQ ID NO: 392741 - RNA, 19 nt, Homo sapiens
ccuuugccaucuucuguua

SEQ ID NO: 392742 - RNA, 19 nt, Homo sapiens
cauaugguguugaaugcaa

SEQ ID NO: 392743 - RNA, 19 nt, Homo sapiens
gccaucuucuguuaccaua

SEQ ID NO: 392744 - RNA, 19 nt, Homo sapiens
gaagacauuucuguagcau

SEQ ID NO: 392745 - RNA, 19 nt, Homo sapiens
cuaacguaaucuaccauuu

SEQ ID NO: 392746 - RNA, 19 nt, Homo sapiens
aaacuaacguaaucuacca

SEQ ID NO: 392747 - RNA, 19 nt, Homo sapiens
gaucaacccacauuagagu

SEQ ID NO: 392748 - RNA, 19 nt, Homo sapiens
gugaaauuccucaaugauu

SEQ ID NO: 392749 - RNA, 19 nt, Homo sapiens
cauaaaggaggauguguau

SEQ ID NO: 392750 - RNA, 19 nt, Homo sapiens
uuucugauguguuccauga

SEQ ID NO: 392751 - RNA, 19 nt, Homo sapiens
caaccugcccuuucuuaau

SEQ ID NO: 392752 - RNA, 19 nt, Homo sapiens
uaauuaccauggagauugu

SEQ ID NO: 392753 - RNA, 19 nt, Homo sapiens
ggaauuuacgucuuaucuu

SEQ ID NO: 392754 - RNA, 19 nt, Homo sapiens
gcucagauccagcuugcaa

SEQ ID NO: 392755 - RNA, 19 nt, Homo sapiens
ccguauaguucacaauaga

SEQ ID NO: 392756 - RNA, 19 nt, Homo sapiens
caucauaccauuccuugga

SEQ ID NO: 392757 - RNA, 19 nt, Homo sapiens
ccauaaaggaggaugugua

SEQ ID NO: 392758 - RNA, 19 nt, Homo sapiens
uaauaugacuaguggucuu

SEQ ID NO: 392759 - RNA, 19 nt, Homo sapiens
caggacagcuaguguuucu

SEQ ID NO: 392760 - RNA, 19 nt, Homo sapiens
gcucagagaugcccuucac

SEQ ID NO: 392761 - RNA, 19 nt, Homo sapiens
gcuacgccuugaugaaaga

SEQ ID NO: 392762 - RNA, 19 nt, Homo sapiens
gucaggcacuugcuaagga

SEQ ID NO: 392763 - RNA, 19 nt, Homo sapiens
gcgcgaaagugaaaaguga

SEQ ID NO: 392764 - RNA, 19 nt, Homo sapiens
cucagguagugaugaauua

SEQ ID NO: 392765 - RNA, 19 nt, Homo sapiens
uuggagaaaugaugagcua

SEQ ID NO: 392766 - RNA, 19 nt, Homo sapiens
cacuuugucuccucaggua

SEQ ID NO: 392767 - RNA, 19 nt, Homo sapiens
gagacaacuaacuaaagua

SEQ ID NO: 392768 - RNA, 19 nt, Homo sapiens
cuacaaugcuaugggauuc

SEQ ID NO: 392769 - RNA, 19 nt, Homo sapiens
gaugagcuacgccuugaug

SEQ ID NO: 392770 - RNA, 19 nt, Homo sapiens
ugcuaaggauccuaaauug

SEQ ID NO: 392771 - RNA, 19 nt, Homo sapiens
aaugucaauucccaaguaa

SEQ ID NO: 392772 - RNA, 19 nt, Homo sapiens
aaaggagacaacuaacuaa

SEQ ID NO: 392773 - RNA, 19 nt, Homo sapiens
ccaaguaacaacagugugu

SEQ ID NO: 392774 - RNA, 19 nt, Homo sapiens
uaaaggaggauguguaucg

SEQ ID NO: 392775 - RNA, 19 nt, Homo sapiens
cuccaaaguuguucaggaa

SEQ ID NO: 392776 - RNA, 19 nt, Homo sapiens
cuaaggauccuaaauugca

SEQ ID NO: 392777 - RNA, 19 nt, Homo sapiens
uguuggugcugcuaaguuu

SEQ ID NO: 392778 - RNA, 19 nt, Homo sapiens
cguaaucuaccauuuccua

SEQ ID NO: 392779 - RNA, 19 nt, Homo sapiens
gaagaaaauaccuggaauu

SEQ ID NO: 392780 - RNA, 19 nt, Homo sapiens
gaaugcaaguuuaauuacc

SEQ ID NO: 392781 - RNA, 19 nt, Homo sapiens
gggaccaucuucaguuguc

SEQ ID NO: 392782 - RNA, 19 nt, Homo sapiens
gcuacaaugcuaugggauu

SEQ ID NO: 392783 - RNA, 19 nt, Homo sapiens
gagcauggaaaucauaguc

SEQ ID NO: 392784 - RNA, 19 nt, Homo sapiens
uaagagaggaaauguacau

SEQ ID NO: 392785 - RNA, 19 nt, Homo sapiens
cuccugagaauuccuguua

SEQ ID NO: 392786 - RNA, 19 nt, Homo sapiens
ucugauguguuccaugaga

SEQ ID NO: 392787 - RNA, 19 nt, Homo sapiens
gggagacaguuuccuucau

SEQ ID NO: 392788 - RNA, 19 nt, Homo sapiens
ccacaugggagacaguuuc

SEQ ID NO: 392789 - RNA, 19 nt, Homo sapiens
gcaaggcuacaaugcuaug

SEQ ID NO: 392790 - RNA, 19 nt, Homo sapiens
uaccauuccuuggaugaaa

SEQ ID NO: 392791 - RNA, 19 nt, Homo sapiens
agaugaggauuaagagcaa

SEQ ID NO: 392792 - RNA, 19 nt, Homo sapiens
ccagcauacuccaaacugu

SEQ ID NO: 392793 - RNA, 19 nt, Homo sapiens
aauaggaggaaccauauga

SEQ ID NO: 392794 - RNA, 19 nt, Homo sapiens
gaauaggaggaaccauaug

SEQ ID NO: 392795 - RNA, 19 nt, Homo sapiens
agaauaggaggaaccauau

SEQ ID NO: 392796 - RNA, 19 nt, Homo sapiens
gauccagcuugcaacuaau

SEQ ID NO: 392797 - RNA, 19 nt, Homo sapiens
cagagcagauggcccagua

SEQ ID NO: 392798 - RNA, 19 nt, Homo sapiens
ccacacaggcucaauaaag

SEQ ID NO: 392799 - RNA, 19 nt, Homo sapiens
guagauacaucaacaugcu

SEQ ID NO: 392800 - RNA, 19 nt, Homo sapiens
ggacuuauaaugccaccuu

SEQ ID NO: 392801 - RNA, 19 nt, Homo sapiens
cugcguggcucuguuacua

SEQ ID NO: 392802 - RNA, 19 nt, Homo sapiens
gagcagauggcccaguaug

SEQ ID NO: 392803 - RNA, 19 nt, Homo sapiens
gcagauggcccaguaugca

SEQ ID NO: 392804 - RNA, 19 nt, Homo sapiens
caauaaagcaagucaaagc

SEQ ID NO: 392805 - RNA, 19 nt, Homo sapiens
cacacaggcucaauaaagc

SEQ ID NO: 392806 - RNA, 19 nt, Homo sapiens
gcguggcucuguuacuaca

SEQ ID NO: 392807 - RNA, 19 nt, Homo sapiens
caccuucugucuccuacga

SEQ ID NO: 392808 - RNA, 19 nt, Homo sapiens
caccugcguggcucuguua

SEQ ID NO: 392809 - RNA, 19 nt, Homo sapiens
cucaauaaagcaagucaaa

SEQ ID NO: 392810 - RNA, 19 nt, Homo sapiens
ucccacacaggcucaauaa

SEQ ID NO: 392811 - RNA, 19 nt, Homo sapiens
cuccguagauacaucaaca

SEQ ID NO: 392812 - RNA, 19 nt, Homo sapiens
caacuucucugaacauugc

SEQ ID NO: 392813 - RNA, 19 nt, Homo sapiens
gcagguccaaucccauuua

SEQ ID NO: 392814 - RNA, 19 nt, Homo sapiens
ggcaucagcucaucaucaa

SEQ ID NO: 392815 - RNA, 19 nt, Homo sapiens
gguaaccucugccugaugu

SEQ ID NO: 392816 - RNA, 19 nt, Homo sapiens
gagacccucugcaagaugu

SEQ ID NO: 392817 - RNA, 19 nt, Homo sapiens
cagguccaaucccauuuaa

SEQ ID NO: 392818 - RNA, 19 nt, Homo sapiens
gaaccucaucuucuuagug

SEQ ID NO: 392819 - RNA, 19 nt, Homo sapiens
ccaacagcauccuggagaa

SEQ ID NO: 392820 - RNA, 19 nt, Homo sapiens
ggagaggcaucagcucauc

SEQ ID NO: 392821 - RNA, 19 nt, Homo sapiens
gugcucaucugggucauug

SEQ ID NO: 392822 - RNA, 19 nt, Homo sapiens
ccauacaacuucucugaac

SEQ ID NO: 392823 - RNA, 19 nt, Homo sapiens
ccaccugcgucaacccauu

SEQ ID NO: 392824 - RNA, 19 nt, Homo sapiens
gagcugggcacaugaagca

SEQ ID NO: 392825 - RNA, 19 nt, Homo sapiens
aaccucaucuucuuagugu

SEQ ID NO: 392826 - RNA, 19 nt, Homo sapiens
caacgugaccaaccugcuu

SEQ ID NO: 392827 - RNA, 19 nt, Homo sapiens
cgucaacccauucaucuau

SEQ ID NO: 392828 - RNA, 19 nt, Homo sapiens
cauacaacuucucugaaca

SEQ ID NO: 392829 - RNA, 19 nt, Homo sapiens
gcacaugaagcaggucaau

SEQ ID NO: 392830 - RNA, 19 nt, Homo sapiens
auacggaagucuccaaagg

SEQ ID NO: 392831 - RNA, 19 nt, Homo sapiens
ggaaccucaucuucuuagu

SEQ ID NO: 392832 - RNA, 19 nt, Homo sapiens
ccacgggaaccucaucuuc

SEQ ID NO: 392833 - RNA, 19 nt, Homo sapiens
acgggaaccucaucuucuu

SEQ ID NO: 392834 - RNA, 19 nt, Homo sapiens
ggagaaugucuuccacaag

SEQ ID NO: 392835 - RNA, 19 nt, Homo sapiens
ccaaggcucuggaguuccu

SEQ ID NO: 392836 - RNA, 19 nt, Homo sapiens
ggacuacuggaucuuugga

SEQ ID NO: 392837 - RNA, 19 nt, Homo sapiens
cuaaguggcagguccaauc

SEQ ID NO: 392838 - RNA, 19 nt, Homo sapiens
acagcauccuggagaaugu

SEQ ID NO: 392839 - RNA, 19 nt, Homo sapiens
uacaacuucucugaacauu

SEQ ID NO: 392840 - RNA, 19 nt, Homo sapiens
gucaacccauucaucuaug

SEQ ID NO: 392841 - RNA, 19 nt, Homo sapiens
caacagcauccuggagaau

SEQ ID NO: 392842 - RNA, 19 nt, Homo sapiens
ccacaguacauacggaagu

SEQ ID NO: 392843 - RNA, 19 nt, Homo sapiens
ccaccuuccugcuccucuu

SEQ ID NO: 392844 - RNA, 19 nt, Homo sapiens
ucucugacuuccucaugug

SEQ ID NO: 392845 - RNA, 19 nt, Homo sapiens
ucugaacauugccaggauu

SEQ ID NO: 392846 - RNA, 19 nt, Homo sapiens
uggccuugcugcucccaaa

SEQ ID NO: 392847 - RNA, 19 nt, Homo sapiens
ucaacaccaacuucaagaa

SEQ ID NO: 392848 - RNA, 19 nt, Homo sapiens
gggaaccucaucuucuuag

SEQ ID NO: 392849 - RNA, 19 nt, Homo sapiens
cgggaaccucaucuucuua

SEQ ID NO: 392850 - RNA, 19 nt, Homo sapiens
gcucaccaccgcaccaucu

SEQ ID NO: 392851 - RNA, 19 nt, Homo sapiens
uacuggaucuuuggagaga

SEQ ID NO: 392852 - RNA, 19 nt, Homo sapiens
ggaagacuggcaccaugag

SEQ ID NO: 392853 - RNA, 19 nt, Homo sapiens
cauggacuacuggaucuuu

SEQ ID NO: 392854 - RNA, 19 nt, Homo sapiens
gcgucaacccauucaucua

SEQ ID NO: 392855 - RNA, 19 nt, Homo sapiens
ggaagcccagcaucucaca

SEQ ID NO: 392856 - RNA, 19 nt, Homo sapiens
gagcuuaagugaagaggua

SEQ ID NO: 392857 - RNA, 19 nt, Homo sapiens
gagaagaaaucaacuuugu

SEQ ID NO: 392858 - RNA, 19 nt, Homo sapiens
ggaaagagcccgugaagau

SEQ ID NO: 392859 - RNA, 19 nt, Homo sapiens
ggaaacaccagaucacaua

SEQ ID NO: 392860 - RNA, 19 nt, Homo sapiens
ccaugucgcugguugcuua

SEQ ID NO: 392861 - RNA, 19 nt, Homo sapiens
gaagaugaacccacaaaga

SEQ ID NO: 392862 - RNA, 19 nt, Homo sapiens
ggaugucuguugaaauaaa

SEQ ID NO: 392863 - RNA, 19 nt, Homo sapiens
agggaugucuguugaaaua

SEQ ID NO: 392864 - RNA, 19 nt, Homo sapiens
gagagaagaaaucaacuuu

SEQ ID NO: 392865 - RNA, 19 nt, Homo sapiens
cgacagugaugaggaagua

SEQ ID NO: 392866 - RNA, 19 nt, Homo sapiens
ugaaagagacuaacagguu

SEQ ID NO: 392867 - RNA, 19 nt, Homo sapiens
gaguugagccauacccuua

SEQ ID NO: 392868 - RNA, 19 nt, Homo sapiens
ggacuaggagcuuaaguga

SEQ ID NO: 392869 - RNA, 19 nt, Homo sapiens
gaagagguacgccuuguuc

SEQ ID NO: 392870 - RNA, 19 nt, Homo sapiens
aaauucagcuccuuucugu

SEQ ID NO: 392871 - RNA, 19 nt, Homo sapiens
gaaccgagggagagaagaa

SEQ ID NO: 392872 - RNA, 19 nt, Homo sapiens
ggaagaagacgacagugau

SEQ ID NO: 392873 - RNA, 19 nt, Homo sapiens
aagaacaccuggucagaga

SEQ ID NO: 392874 - RNA, 19 nt, Homo sapiens
gaagaagacgacagugaug

SEQ ID NO: 392875 - RNA, 19 nt, Homo sapiens
gcccagcaauggaugacua

SEQ ID NO: 392876 - RNA, 19 nt, Homo sapiens
ccagggaugucuguugaaa

SEQ ID NO: 392877 - RNA, 19 nt, Homo sapiens
uuacagugguggcuacuau

SEQ ID NO: 392878 - RNA, 19 nt, Homo sapiens
caaugccgcuggugcuuau

SEQ ID NO: 392879 - RNA, 19 nt, Homo sapiens
acuaggagcuuaagugaag

SEQ ID NO: 392880 - RNA, 19 nt, Homo sapiens
ggagagaagaaaucaacuu

SEQ ID NO: 392881 - RNA, 19 nt, Homo sapiens
gugcuuauuaucaggauua

SEQ ID NO: 392882 - RNA, 19 nt, Homo sapiens
gaugaacccacaaagaaga

SEQ ID NO: 392883 - RNA, 19 nt, Homo sapiens
aagaugaacccacaaagaa

SEQ ID NO: 392884 - RNA, 19 nt, Homo sapiens
gaaagagcccgugaagauc

SEQ ID NO: 392885 - RNA, 19 nt, Homo sapiens
guacggagcaggcggacuu

SEQ ID NO: 392886 - RNA, 19 nt, Homo sapiens
caagauggcagcagguuca

SEQ ID NO: 392887 - RNA, 19 nt, Homo sapiens
gcagaucacgcaggaagaa

SEQ ID NO: 392888 - RNA, 19 nt, Homo sapiens
gacuacagcuacaaucagu

SEQ ID NO: 392889 - RNA, 19 nt, Homo sapiens
caccuggaguugagccaua

SEQ ID NO: 392890 - RNA, 19 nt, Homo sapiens
agacgacagugaugaggaa

SEQ ID NO: 392891 - RNA, 19 nt, Homo sapiens
cuacagcuacaaucaguuu

SEQ ID NO: 392892 - RNA, 19 nt, Homo sapiens
aaccagggaugucuguuga

SEQ ID NO: 392893 - RNA, 19 nt, Homo sapiens
cgagaaugaacauauuuga

SEQ ID NO: 392894 - RNA, 19 nt, Homo sapiens
gaaacaccagaucacauau

SEQ ID NO: 392895 - RNA, 19 nt, Homo sapiens
ccaggacgaugcagccaau

SEQ ID NO: 392896 - RNA, 19 nt, Homo sapiens
gcaggaagaagacgacagu

SEQ ID NO: 392897 - RNA, 19 nt, Homo sapiens
caucgaugacgaagcauuu

SEQ ID NO: 392898 - RNA, 19 nt, Homo sapiens
acaaucaguuuuccacaua

SEQ ID NO: 392899 - RNA, 19 nt, Homo sapiens
cugcgagaaugaacauauu

SEQ ID NO: 392900 - RNA, 19 nt, Homo sapiens
ggacgacuacagcuacaau

SEQ ID NO: 392901 - RNA, 19 nt, Homo sapiens
caaggcugcugccaagagu

SEQ ID NO: 392902 - RNA, 19 nt, Homo sapiens
agcaaagacuugugugaug

SEQ ID NO: 392903 - RNA, 19 nt, Homo sapiens
gcgagaaugaacauauuug

SEQ ID NO: 392904 - RNA, 19 nt, Homo sapiens
ccacaaagaagaaaacuau

SEQ ID NO: 392905 - RNA, 19 nt, Homo sapiens
gaggaaagagcccgugaag

SEQ ID NO: 392906 - RNA, 19 nt, Homo sapiens
agccaaauauggauucuag

SEQ ID NO: 392907 - RNA, 19 nt, Homo sapiens
gacccaagccaaauaugga

SEQ ID NO: 392908 - RNA, 19 nt, Homo sapiens
ccaaugccgcuggugcuua

SEQ ID NO: 392909 - RNA, 19 nt, Homo sapiens
gagcuggaacugaagaaca

SEQ ID NO: 392910 - RNA, 19 nt, Homo sapiens
ggcgguggcuccuacaucu

SEQ ID NO: 392911 - RNA, 19 nt, Homo sapiens
gauggcagcagguucaagu

SEQ ID NO: 392912 - RNA, 19 nt, Homo sapiens
ucggauggcuccccugaua

SEQ ID NO: 392913 - RNA, 19 nt, Homo sapiens
gugaagagguacgccuugu

SEQ ID NO: 392914 - RNA, 19 nt, Homo sapiens
gggacuaggagcuuaagug

SEQ ID NO: 392915 - RNA, 19 nt, Homo sapiens
aaaccugacugugaaagag

SEQ ID NO: 392916 - RNA, 19 nt, Homo sapiens
gaacaccuggucagagaac

SEQ ID NO: 392917 - RNA, 19 nt, Homo sapiens
cuucuaagaccaagacuuc

SEQ ID NO: 392918 - RNA, 19 nt, Homo sapiens
ggaagaugaacccacaaag

SEQ ID NO: 392919 - RNA, 19 nt, Homo sapiens
aaaccagggaugucuguug

SEQ ID NO: 392920 - RNA, 19 nt, Homo sapiens
cuagggcucuggaacugau

SEQ ID NO: 392921 - RNA, 19 nt, Homo sapiens
gucagacccaagccaaaua

SEQ ID NO: 392922 - RNA, 19 nt, Homo sapiens
ugacugugaaagagacuaa

SEQ ID NO: 392923 - RNA, 19 nt, Homo sapiens
ugaagaacaccuggucaga

SEQ ID NO: 392924 - RNA, 19 nt, Homo sapiens
gagcgggagcuggaacuga

SEQ ID NO: 392925 - RNA, 19 nt, Homo sapiens
gaagagaaaaccaugaagu

SEQ ID NO: 392926 - RNA, 19 nt, Homo sapiens
ucaacuuuguggagaucaa

SEQ ID NO: 392927 - RNA, 19 nt, Homo sapiens
agcgggagcuggaacugaa

SEQ ID NO: 392928 - RNA, 19 nt, Homo sapiens
agagaagaaaucaacuuug

SEQ ID NO: 392929 - RNA, 19 nt, Homo sapiens
ccgcuggugcuuauuauca

SEQ ID NO: 392930 - RNA, 19 nt, Homo sapiens
auacuaagcccuccagacu

SEQ ID NO: 392931 - RNA, 19 nt, Homo sapiens
ucagacccaagccaaauau

SEQ ID NO: 392932 - RNA, 19 nt, Homo sapiens
aaaucaacuuuguggagau

SEQ ID NO: 392933 - RNA, 19 nt, Homo sapiens
aggaagaagacgacaguga

SEQ ID NO: 392934 - RNA, 19 nt, Homo sapiens
uagcaaagacuugugugau

SEQ ID NO: 392935 - RNA, 19 nt, Homo sapiens
cagcaauggaugacuaagu

SEQ ID NO: 392936 - RNA, 19 nt, Homo sapiens
ucgaugacgaagcauuuaa

SEQ ID NO: 392937 - RNA, 19 nt, Homo sapiens
ugucaggugugauaaaaug

SEQ ID NO: 392938 - RNA, 19 nt, Homo sapiens
ggagcuagcaaagacuugu

SEQ ID NO: 392939 - RNA, 19 nt, Homo sapiens
ccaagccaaauauggauuc

SEQ ID NO: 392940 - RNA, 19 nt, Homo sapiens
cgagggagagaagaaauca

SEQ ID NO: 392941 - RNA, 19 nt, Homo sapiens
agaccaagacuuccucucu

SEQ ID NO: 392942 - RNA, 19 nt, Homo sapiens
cuagcaaagacuuguguga

SEQ ID NO: 392943 - RNA, 19 nt, Homo sapiens
ugaagagguacgccuuguu

SEQ ID NO: 392944 - RNA, 19 nt, Homo sapiens
aagaagacgacagugauga

SEQ ID NO: 392945 - RNA, 19 nt, Homo sapiens
gaacugugcuguaaauaaa

SEQ ID NO: 392946 - RNA, 19 nt, Homo sapiens
gagaguuacuuucuuugua

SEQ ID NO: 392947 - RNA, 19 nt, Homo sapiens
gaaguuagacauaugaaga

SEQ ID NO: 392948 - RNA, 19 nt, Homo sapiens
gaucagagauuucuaugac

SEQ ID NO: 392949 - RNA, 19 nt, Homo sapiens
ccuaguagcugauaaauac

SEQ ID NO: 392950 - RNA, 19 nt, Homo sapiens
gcaagugucccaugaaugu

SEQ ID NO: 392951 - RNA, 19 nt, Homo sapiens
gagcaagugucccaugaau

SEQ ID NO: 392952 - RNA, 19 nt, Homo sapiens
ggacauccaacauuugaaa

SEQ ID NO: 392953 - RNA, 19 nt, Homo sapiens
aacagaagguugaucauuu

SEQ ID NO: 392954 - RNA, 19 nt, Homo sapiens
gaucguaacuacagauuuu

SEQ ID NO: 392955 - RNA, 19 nt, Homo sapiens
gaaaagcgguccacauugu

SEQ ID NO: 392956 - RNA, 19 nt, Homo sapiens
gaaccucacucauggaacu

SEQ ID NO: 392957 - RNA, 19 nt, Homo sapiens
gacauuaucugguuuugua

SEQ ID NO: 392958 - RNA, 19 nt, Homo sapiens
agaauuggaucagagauuu

SEQ ID NO: 392959 - RNA, 19 nt, Homo sapiens
ggaacuuucugaugacugu

SEQ ID NO: 392960 - RNA, 19 nt, Homo sapiens
gcugauaaauacuggaaga

SEQ ID NO: 392961 - RNA, 19 nt, Homo sapiens
gaagugagagccauuucuu

SEQ ID NO: 392962 - RNA, 19 nt, Homo sapiens
uaacuaaggauaucacaga

SEQ ID NO: 392963 - RNA, 19 nt, Homo sapiens
aacaagcucuggcugauuu

SEQ ID NO: 392964 - RNA, 19 nt, Homo sapiens
ccucauaacuggaguagag

SEQ ID NO: 392965 - RNA, 19 nt, Homo sapiens
ggccaaaguugagauagaa

SEQ ID NO: 392966 - RNA, 19 nt, Homo sapiens
ggaaagcagcacugagaaa

SEQ ID NO: 392967 - RNA, 19 nt, Homo sapiens
ccaaggcccuccuggauca

SEQ ID NO: 392968 - RNA, 19 nt, Homo sapiens
ucacuuaugcagcccauua

SEQ ID NO: 392969 - RNA, 19 nt, Homo sapiens
uccaagcucugaauguaua

SEQ ID NO: 392970 - RNA, 19 nt, Homo sapiens
gcaguuugaggauuuagua

SEQ ID NO: 392971 - RNA, 19 nt, Homo sapiens
ugaaagcuauguugguguu

SEQ ID NO: 392972 - RNA, 19 nt, Homo sapiens
aaugguggaucaauacuuu

SEQ ID NO: 392973 - RNA, 19 nt, Homo sapiens
guacuaauggugucgauga

SEQ ID NO: 392974 - RNA, 19 nt, Homo sapiens
guacuggauuuaaugacuu

SEQ ID NO: 392975 - RNA, 19 nt, Homo sapiens
gggccaaaguugagauaga

SEQ ID NO: 392976 - RNA, 19 nt, Homo sapiens
uuuaguaccuuguggugua

SEQ ID NO: 392977 - RNA, 19 nt, Homo sapiens
gaacaagcucuggcugauu

SEQ ID NO: 392978 - RNA, 19 nt, Homo sapiens
ccaaaguugagauagaaua

SEQ ID NO: 392979 - RNA, 19 nt, Homo sapiens
ccacauucccauucacuuu

SEQ ID NO: 392980 - RNA, 19 nt, Homo sapiens
ugaacugugcuguaaauaa

SEQ ID NO: 392981 - RNA, 19 nt, Homo sapiens
gagggagaguuacuuucuu

SEQ ID NO: 392982 - RNA, 19 nt, Homo sapiens
uaagagggagaguuacuuu

SEQ ID NO: 392983 - RNA, 19 nt, Homo sapiens
uagaguuccugguugcuuu

SEQ ID NO: 392984 - RNA, 19 nt, Homo sapiens
aaacauuaguucacacaca

SEQ ID NO: 392985 - RNA, 19 nt, Homo sapiens
caggaaagcagcacugaga

SEQ ID NO: 392986 - RNA, 19 nt, Homo sapiens
uacuggagcccuucacuua

SEQ ID NO: 392987 - RNA, 19 nt, Homo sapiens
aagaaugccuuggauccua

SEQ ID NO: 392988 - RNA, 19 nt, Homo sapiens
uaucaggccugcacagaag

SEQ ID NO: 392989 - RNA, 19 nt, Homo sapiens
agggagaguuacuuucuuu

SEQ ID NO: 392990 - RNA, 19 nt, Homo sapiens
gagguggaguaacuaagga

SEQ ID NO: 392991 - RNA, 19 nt, Homo sapiens
uuaaucgacucucaaauac

SEQ ID NO: 392992 - RNA, 19 nt, Homo sapiens
guaccuaguagcugauaaa

SEQ ID NO: 392993 - RNA, 19 nt, Homo sapiens
cucaggacauccaacauuu

SEQ ID NO: 392994 - RNA, 19 nt, Homo sapiens
aaucgacucucaaauacug

SEQ ID NO: 392995 - RNA, 19 nt, Homo sapiens
gacaacucauucaaggauu

SEQ ID NO: 392996 - RNA, 19 nt, Homo sapiens
ggagaguuacuuucuuugu

SEQ ID NO: 392997 - RNA, 19 nt, Homo sapiens
uuuccaagcucugaaugua

SEQ ID NO: 392998 - RNA, 19 nt, Homo sapiens
caagguagugugccaguau

SEQ ID NO: 392999 - RNA, 19 nt, Homo sapiens
ugaaagacuggaucucuga

SEQ ID NO: 393000 - RNA, 19 nt, Homo sapiens
aagagcaagugucccauga

SEQ ID NO: 393001 - RNA, 19 nt, Homo sapiens
gaccaaggcccuccuggau

SEQ ID NO: 393002 - RNA, 19 nt, Homo sapiens
ggugaaaugccugaauauu

SEQ ID NO: 393003 - RNA, 19 nt, Homo sapiens
guagugugccaguauuuga

SEQ ID NO: 393004 - RNA, 19 nt, Homo sapiens
acacuugaauuuccugaca

SEQ ID NO: 393005 - RNA, 19 nt, Homo sapiens
gaucuccgcaccaagaaug

SEQ ID NO: 393006 - RNA, 19 nt, Homo sapiens
ccuccuggaucacuacuau

SEQ ID NO: 393007 - RNA, 19 nt, Homo sapiens
uuucuacacugguaaugaa

SEQ ID NO: 393008 - RNA, 19 nt, Homo sapiens
gaaagacuggaucucugaa

SEQ ID NO: 393009 - RNA, 19 nt, Homo sapiens
acuauucgguucucuacuu

SEQ ID NO: 393010 - RNA, 19 nt, Homo sapiens
ucuggcaguuugaggauuu

SEQ ID NO: 393011 - RNA, 19 nt, Homo sapiens
gaagguugaucauuuugga

SEQ ID NO: 393012 - RNA, 19 nt, Homo sapiens
caggacauccaacauuuga

SEQ ID NO: 393013 - RNA, 19 nt, Homo sapiens
uuaugaagaucguaacuac

SEQ ID NO: 393014 - RNA, 19 nt, Homo sapiens
aaucagcgguaccuaguag

SEQ ID NO: 393015 - RNA, 19 nt, Homo sapiens
cuggaucacuacuauguau

SEQ ID NO: 393016 - RNA, 19 nt, Homo sapiens
gaagaucguaacuacagau

SEQ ID NO: 393017 - RNA, 19 nt, Homo sapiens
gaaaaucaaccugucauug

SEQ ID NO: 393018 - RNA, 19 nt, Homo sapiens
caaaguugagauagaauag

SEQ ID NO: 393019 - RNA, 19 nt, Homo sapiens
gcccgcuccuuggaaguua

SEQ ID NO: 393020 - RNA, 19 nt, Homo sapiens
aacauuaguucacacacaa

SEQ ID NO: 393021 - RNA, 19 nt, Homo sapiens
caaugguggacuauccuua

SEQ ID NO: 393022 - RNA, 19 nt, Homo sapiens
gggugaaucuggcaauggu

SEQ ID NO: 393023 - RNA, 19 nt, Homo sapiens
guccugggaugccauuaau

SEQ ID NO: 393024 - RNA, 19 nt, Homo sapiens
cagaguuaaucaaacacuu

SEQ ID NO: 393025 - RNA, 19 nt, Homo sapiens
ugacaacucauucaaggau

SEQ ID NO: 393026 - RNA, 19 nt, Homo sapiens
guucucuacuuccaacaga

SEQ ID NO: 393027 - RNA, 19 nt, Homo sapiens
ggaucagagauuucuauga

SEQ ID NO: 393028 - RNA, 19 nt, Homo sapiens
uaugaagaauuggaucaga

SEQ ID NO: 393029 - RNA, 19 nt, Homo sapiens
uccuaugucugugcuguua

SEQ ID NO: 393030 - RNA, 19 nt, Homo sapiens
gucaggagguggaguaacu

SEQ ID NO: 393031 - RNA, 19 nt, Homo sapiens
ccauuaaucgacucucaaa

SEQ ID NO: 393032 - RNA, 19 nt, Homo sapiens
gguccacauuguucagaga

SEQ ID NO: 393033 - RNA, 19 nt, Homo sapiens
uugcagaguuaaucaaaca

SEQ ID NO: 393034 - RNA, 19 nt, Homo sapiens
aaagcuauguugguguuug

SEQ ID NO: 393035 - RNA, 19 nt, Homo sapiens
acuuugaacugugcuguaa

SEQ ID NO: 393036 - RNA, 19 nt, Homo sapiens
agaaugccuuggauccuau

SEQ ID NO: 393037 - RNA, 19 nt, Homo sapiens
cagcaauggugaacuagac

SEQ ID NO: 393038 - RNA, 19 nt, Homo sapiens
gaucacuacuauguaugga

SEQ ID NO: 393039 - RNA, 19 nt, Homo sapiens
ccucacucauggaacuuaa

SEQ ID NO: 393040 - RNA, 19 nt, Homo sapiens
gaacacuggguuggagcua

SEQ ID NO: 393041 - RNA, 19 nt, Homo sapiens
ucaagguagugugccagua

SEQ ID NO: 393042 - RNA, 19 nt, Homo sapiens
cuggagcccuucacuuaug

SEQ ID NO: 393043 - RNA, 19 nt, Homo sapiens
gguccugggaugccauuaa

SEQ ID NO: 393044 - RNA, 19 nt, Homo sapiens
ugaagaucguaacuacaga

SEQ ID NO: 393045 - RNA, 19 nt, Homo sapiens
cccaagaacuccuuuaaua

SEQ ID NO: 393046 - RNA, 19 nt, Homo sapiens
ggauuaaccuggacaacaa

SEQ ID NO: 393047 - RNA, 19 nt, Homo sapiens
gaggaggacuaaacucaga

SEQ ID NO: 393048 - RNA, 19 nt, Homo sapiens
caucugcccucuacuguga

SEQ ID NO: 393049 - RNA, 19 nt, Homo sapiens
gaacaccuguaccucaaca

SEQ ID NO: 393050 - RNA, 19 nt, Homo sapiens
guaacaagauugagaccau

SEQ ID NO: 393051 - RNA, 19 nt, Homo sapiens
caagaacuccuuuaauauc

SEQ ID NO: 393052 - RNA, 19 nt, Homo sapiens
ccaagaacuccuuuaauau

SEQ ID NO: 393053 - RNA, 19 nt, Homo sapiens
ccgcauccauuaccucuau

SEQ ID NO: 393054 - RNA, 19 nt, Homo sapiens
agaacaacuucaucacuga

SEQ ID NO: 393055 - RNA, 19 nt, Homo sapiens
ucauucggcuuaacuacaa

SEQ ID NO: 393056 - RNA, 19 nt, Homo sapiens
cacaacauccugagaaaga

SEQ ID NO: 393057 - RNA, 19 nt, Homo sapiens
caacaauagcaucgagaaa

SEQ ID NO: 393058 - RNA, 19 nt, Homo sapiens
uucaagagcuuucccaauc

SEQ ID NO: 393059 - RNA, 19 nt, Homo sapiens
caaccuggcccacaacauc

SEQ ID NO: 393060 - RNA, 19 nt, Homo sapiens
ccacaggccugcgauggau

SEQ ID NO: 393061 - RNA, 19 nt, Homo sapiens
gacaguaacaagauugaga

SEQ ID NO: 393062 - RNA, 19 nt, Homo sapiens
ccacccaguugaaagacaa

SEQ ID NO: 393063 - RNA, 19 nt, Homo sapiens
ggaagaggaggacuaaacu

SEQ ID NO: 393064 - RNA, 19 nt, Homo sapiens
ugcaucaccuggaucauga

SEQ ID NO: 393065 - RNA, 19 nt, Homo sapiens
agaagaaccaguuggaaga

SEQ ID NO: 393066 - RNA, 19 nt, Homo sapiens
ccuaacggauacuucaaga

SEQ ID NO: 393067 - RNA, 19 nt, Homo sapiens
ggagaagaaccaguuggaa

SEQ ID NO: 393068 - RNA, 19 nt, Homo sapiens
ggauggaaacuacuugaag

SEQ ID NO: 393069 - RNA, 19 nt, Homo sapiens
uggaacaccuguaccucaa

SEQ ID NO: 393070 - RNA, 19 nt, Homo sapiens
ucaagagcuuucccaaucu

SEQ ID NO: 393071 - RNA, 19 nt, Homo sapiens
agauugagaccaucccuaa

SEQ ID NO: 393072 - RNA, 19 nt, Homo sapiens
cccacaacauccugagaaa

SEQ ID NO: 393073 - RNA, 19 nt, Homo sapiens
gaaccacaucuccagaauc

SEQ ID NO: 393074 - RNA, 19 nt, Homo sapiens
gguggaagaggaggacuaa

SEQ ID NO: 393075 - RNA, 19 nt, Homo sapiens
ccaaacuccuggccuucug

SEQ ID NO: 393076 - RNA, 19 nt, Homo sapiens
gcccaaggccagccaacaa

SEQ ID NO: 393077 - RNA, 19 nt, Homo sapiens
caacggaacccagauuugc

SEQ ID NO: 393078 - RNA, 19 nt, Homo sapiens
gcccacaacauccugagaa

SEQ ID NO: 393079 - RNA, 19 nt, Homo sapiens
agaaccacaucuccagaau

SEQ ID NO: 393080 - RNA, 19 nt, Homo sapiens
gcucugaccgcacuugaag

SEQ ID NO: 393081 - RNA, 19 nt, Homo sapiens
ccaucuaucuucccugacu

SEQ ID NO: 393082 - RNA, 19 nt, Homo sapiens
ccuggacaguaacaagauu

SEQ ID NO: 393083 - RNA, 19 nt, Homo sapiens
gcgaaaggucccugucauc

SEQ ID NO: 393084 - RNA, 19 nt, Homo sapiens
gcggcuggauggaaacuac

SEQ ID NO: 393085 - RNA, 19 nt, Homo sapiens
gaagaggaggacuaaacuc

SEQ ID NO: 393086 - RNA, 19 nt, Homo sapiens
cagaaccacaucuccagaa

SEQ ID NO: 393087 - RNA, 19 nt, Homo sapiens
gaagaaccaguuggaagag

SEQ ID NO: 393088 - RNA, 19 nt, Homo sapiens
ucccuuugcuccagaaaca

SEQ ID NO: 393089 - RNA, 19 nt, Homo sapiens
agagggugcuggagaaacu

SEQ ID NO: 393090 - RNA, 19 nt, Homo sapiens
acaggccugcgauggauua

SEQ ID NO: 393091 - RNA, 19 nt, Homo sapiens
ccaacaagacgaccaagac

SEQ ID NO: 393092 - RNA, 19 nt, Homo sapiens
aaagccaucuauucuucug

SEQ ID NO: 393093 - RNA, 19 nt, Homo sapiens
ucaacggaacccagauuug

SEQ ID NO: 393094 - RNA, 19 nt, Homo sapiens
aagaggaggacuaaacuca

SEQ ID NO: 393095 - RNA, 19 nt, Homo sapiens
acaacaggaucagcagugu

SEQ ID NO: 393096 - RNA, 19 nt, Homo sapiens
gugcaucaccuggaucaug

SEQ ID NO: 393097 - RNA, 19 nt, Homo sapiens
cuucugugguuucccuuug

SEQ ID NO: 393098 - RNA, 19 nt, Homo sapiens
ucaaggacucaguuugguu

SEQ ID NO: 393099 - RNA, 19 nt, Homo sapiens
acaauagcaucgagaaaau

SEQ ID NO: 393100 - RNA, 19 nt, Homo sapiens
ccaaggccagccaacaaga

SEQ ID NO: 393101 - RNA, 19 nt, Homo sapiens
caaccagugcacacccaaa

SEQ ID NO: 393102 - RNA, 19 nt, Homo sapiens
acaacaauagcaucgagaa

SEQ ID NO: 393103 - RNA, 19 nt, Homo sapiens
ccuccaggcccuccaucua

SEQ ID NO: 393104 - RNA, 19 nt, Homo sapiens
aaccacaucuccagaaucc

SEQ ID NO: 393105 - RNA, 19 nt, Homo sapiens
ccucccacuucucaucuug

SEQ ID NO: 393106 - RNA, 19 nt, Homo sapiens
cuccuggccuucugugguu

SEQ ID NO: 393107 - RNA, 19 nt, Homo sapiens
guuccacccaguugaaaga

SEQ ID NO: 393108 - RNA, 19 nt, Homo sapiens
acggauacuucaagagcuu

SEQ ID NO: 393109 - RNA, 19 nt, Homo sapiens
agcucuaccuggacaguaa

SEQ ID NO: 393110 - RNA, 19 nt, Homo sapiens
ucugcccucuacugugaua

SEQ ID NO: 393111 - RNA, 19 nt, Homo sapiens
ugcaguccguggucaucua

SEQ ID NO: 393112 - RNA, 19 nt, Homo sapiens
ccgcuggaccucaugaugu

SEQ ID NO: 393113 - RNA, 19 nt, Homo sapiens
accuguaccucaacaacaa

SEQ ID NO: 393114 - RNA, 19 nt, Homo sapiens
gccaacaagacgaccaaga

SEQ ID NO: 393115 - RNA, 19 nt, Homo sapiens
ccagaacaacuucaucacu

SEQ ID NO: 393116 - RNA, 19 nt, Homo sapiens
acaacauccugagaaagau

SEQ ID NO: 393117 - RNA, 19 nt, Homo sapiens
caccuuccauggccucaag

SEQ ID NO: 393118 - RNA, 19 nt, Homo sapiens
ggccugcgauggauuaacc

SEQ ID NO: 393119 - RNA, 19 nt, Homo sapiens
gagaaugacugaacuauau

SEQ ID NO: 393120 - RNA, 19 nt, Homo sapiens
ccaagaggcugacuauuaa

SEQ ID NO: 393121 - RNA, 19 nt, Homo sapiens
ccaaagagcuuccagaugu

SEQ ID NO: 393122 - RNA, 19 nt, Homo sapiens
gcauaaaggugguaucuug

SEQ ID NO: 393123 - RNA, 19 nt, Homo sapiens
caucagagguuuauacaaa

SEQ ID NO: 393124 - RNA, 19 nt, Homo sapiens
gaauugaugcuucugauua

SEQ ID NO: 393125 - RNA, 19 nt, Homo sapiens
guacgaagauuccaauguu

SEQ ID NO: 393126 - RNA, 19 nt, Homo sapiens
gaaaguugauggugccaaa

SEQ ID NO: 393127 - RNA, 19 nt, Homo sapiens
gcaguuaagucauagaaug

SEQ ID NO: 393128 - RNA, 19 nt, Homo sapiens
cagcgaagauggugaauau

SEQ ID NO: 393129 - RNA, 19 nt, Homo sapiens
ggagagacguggcauaaag

SEQ ID NO: 393130 - RNA, 19 nt, Homo sapiens
ggaagggaauguucuacaa

SEQ ID NO: 393131 - RNA, 19 nt, Homo sapiens
gcagaaccagcgaguauua

SEQ ID NO: 393132 - RNA, 19 nt, Homo sapiens
gaauaaagcauuucaccuu

SEQ ID NO: 393133 - RNA, 19 nt, Homo sapiens
gagcugaguuaucugauga

SEQ ID NO: 393134 - RNA, 19 nt, Homo sapiens
cagaggagguggcgaauau

SEQ ID NO: 393135 - RNA, 19 nt, Homo sapiens
gcgaagauggugaauauuu

SEQ ID NO: 393136 - RNA, 19 nt, Homo sapiens
ggacagcaaacaacacuuu

SEQ ID NO: 393137 - RNA, 19 nt, Homo sapiens
acacugaaaucuucuauca

SEQ ID NO: 393138 - RNA, 19 nt, Homo sapiens
cccaagaggcugacuauua

SEQ ID NO: 393139 - RNA, 19 nt, Homo sapiens
caaggaagguuacacaucu

SEQ ID NO: 393140 - RNA, 19 nt, Homo sapiens
caaauacucuccauugcau

SEQ ID NO: 393141 - RNA, 19 nt, Homo sapiens
aaacugcuuugaugacuuu

SEQ ID NO: 393142 - RNA, 19 nt, Homo sapiens
uaagauuacugugccauuu

SEQ ID NO: 393143 - RNA, 19 nt, Homo sapiens
gaaccgaucagucagaaga

SEQ ID NO: 393144 - RNA, 19 nt, Homo sapiens
gcacagagacaucuaccaa

SEQ ID NO: 393145 - RNA, 19 nt, Homo sapiens
uaauggacaugcugaaguu

SEQ ID NO: 393146 - RNA, 19 nt, Homo sapiens
gaagaaggacacugaaauc

SEQ ID NO: 393147 - RNA, 19 nt, Homo sapiens
agacuucuuugcaacaaua

SEQ ID NO: 393148 - RNA, 19 nt, Homo sapiens
gugcugaguuuccugauga

SEQ ID NO: 393149 - RNA, 19 nt, Homo sapiens
ucauccagcuuucuuauau

SEQ ID NO: 393150 - RNA, 19 nt, Homo sapiens
uaauggagguucaaaugga

SEQ ID NO: 393151 - RNA, 19 nt, Homo sapiens
gaaguuaccagaagcagau

SEQ ID NO: 393152 - RNA, 19 nt, Homo sapiens
gcccacagccaaagugaua

SEQ ID NO: 393153 - RNA, 19 nt, Homo sapiens
gaaccagcgaguauuauau

SEQ ID NO: 393154 - RNA, 19 nt, Homo sapiens
caagaaaccacugggcaua

SEQ ID NO: 393155 - RNA, 19 nt, Homo sapiens
ggagcugaguuaucugaug

SEQ ID NO: 393156 - RNA, 19 nt, Homo sapiens
gaaguggaguuuucuguga

SEQ ID NO: 393157 - RNA, 19 nt, Homo sapiens
uuaagggcauguugggaua

SEQ ID NO: 393158 - RNA, 19 nt, Homo sapiens
cugaguaucugaucaagga

SEQ ID NO: 393159 - RNA, 19 nt, Homo sapiens
gagcuggagccaagaguuu

SEQ ID NO: 393160 - RNA, 19 nt, Homo sapiens
gggcauguugggauaaaua

SEQ ID NO: 393161 - RNA, 19 nt, Homo sapiens
caaucaaguucaugaaagu

SEQ ID NO: 393162 - RNA, 19 nt, Homo sapiens
gggcauacuuaucuauauc

SEQ ID NO: 393163 - RNA, 19 nt, Homo sapiens
gcaaggaugguacgaagau

SEQ ID NO: 393164 - RNA, 19 nt, Homo sapiens
guacagcggucagaagaag

SEQ ID NO: 393165 - RNA, 19 nt, Homo sapiens
gaauguuuguuagcuguga

SEQ ID NO: 393166 - RNA, 19 nt, Homo sapiens
uagaauggauagcuugugu

SEQ ID NO: 393167 - RNA, 19 nt, Homo sapiens
acagagacaucuaccaauc

SEQ ID NO: 393168 - RNA, 19 nt, Homo sapiens
caaagagcuuccagaugug

SEQ ID NO: 393169 - RNA, 19 nt, Homo sapiens
gacaaucaaguucaugaaa

SEQ ID NO: 393170 - RNA, 19 nt, Homo sapiens
gaacugccgugggaauuuu

SEQ ID NO: 393171 - RNA, 19 nt, Homo sapiens
ggaauugaugcuucugauu

SEQ ID NO: 393172 - RNA, 19 nt, Homo sapiens
gaugauggccgcuaugucu

SEQ ID NO: 393173 - RNA, 19 nt, Homo sapiens
cagaugugcuugaaagagu

SEQ ID NO: 393174 - RNA, 19 nt, Homo sapiens
acaaagagagaaugacuga

SEQ ID NO: 393175 - RNA, 19 nt, Homo sapiens
ugggauaaauagcuaaaug

SEQ ID NO: 393176 - RNA, 19 nt, Homo sapiens
ccucuuugguuguguuauu

SEQ ID NO: 393177 - RNA, 19 nt, Homo sapiens
gaauggauagcuuguguca

SEQ ID NO: 393178 - RNA, 19 nt, Homo sapiens
gaaugacugaacuauauga

SEQ ID NO: 393179 - RNA, 19 nt, Homo sapiens
ucagagguuuauacaaaga

SEQ ID NO: 393180 - RNA, 19 nt, Homo sapiens
gggauuuacuuccgguuuc

SEQ ID NO: 393181 - RNA, 19 nt, Homo sapiens
uuagauugcugaauuaagg

SEQ ID NO: 393182 - RNA, 19 nt, Homo sapiens
gaucaaggaagguuacaca

SEQ ID NO: 393183 - RNA, 19 nt, Homo sapiens
uggccgcuaugucuuguua

SEQ ID NO: 393184 - RNA, 19 nt, Homo sapiens
uucaagcaguuaagucaua

SEQ ID NO: 393185 - RNA, 19 nt, Homo sapiens
ccaaagugauagaggaagu

SEQ ID NO: 393186 - RNA, 19 nt, Homo sapiens
gguuacacaucucccaaga

SEQ ID NO: 393187 - RNA, 19 nt, Homo sapiens
agaccgccguacaggauua

SEQ ID NO: 393188 - RNA, 19 nt, Homo sapiens
gggaaccgaucagucagaa

SEQ ID NO: 393189 - RNA, 19 nt, Homo sapiens
cgaagauggugaauauuuu

SEQ ID NO: 393190 - RNA, 19 nt, Homo sapiens
uaagaaugacagggauuua

SEQ ID NO: 393191 - RNA, 19 nt, Homo sapiens
uccauaaccucuauaucuu

SEQ ID NO: 393192 - RNA, 19 nt, Homo sapiens
ugucaaauacucuccauug

SEQ ID NO: 393193 - RNA, 19 nt, Homo sapiens
ugaagagucuaaguggaaa

SEQ ID NO: 393194 - RNA, 19 nt, Homo sapiens
gauggguggagcugaguua

SEQ ID NO: 393195 - RNA, 19 nt, Homo sapiens
gcauuucaccuuucugcaa

SEQ ID NO: 393196 - RNA, 19 nt, Homo sapiens
ugaauggcuugucaaauac

SEQ ID NO: 393197 - RNA, 19 nt, Homo sapiens
ggguggagcugaguuaucu

SEQ ID NO: 393198 - RNA, 19 nt, Homo sapiens
ggaauguucuacaacucau

SEQ ID NO: 393199 - RNA, 19 nt, Homo sapiens
agagucaaguucagcugua

SEQ ID NO: 393200 - RNA, 19 nt, Homo sapiens
acaaucaaguucaugaaag

SEQ ID NO: 393201 - RNA, 19 nt, Homo sapiens
cagcgaguauuauauguac

SEQ ID NO: 393202 - RNA, 19 nt, Homo sapiens
gaggcugacuauuaaugga

SEQ ID NO: 393203 - RNA, 19 nt, Homo sapiens
ggugguaucuuggccaaca

SEQ ID NO: 393204 - RNA, 19 nt, Homo sapiens
uacaguguuuccaggcuua

SEQ ID NO: 393205 - RNA, 19 nt, Homo sapiens
gcucuacuaccaugucuug

SEQ ID NO: 393206 - RNA, 19 nt, Homo sapiens
ccauaaccucuauaucuuu

SEQ ID NO: 393207 - RNA, 19 nt, Homo sapiens
auagcuaaauggcaacaaa

SEQ ID NO: 393208 - RNA, 19 nt, Homo sapiens
agagaaugacugaacuaua

SEQ ID NO: 393209 - RNA, 19 nt, Homo sapiens
gaaugacagggauuuacuu

SEQ ID NO: 393210 - RNA, 19 nt, Homo sapiens
gaaaccacugggcauaaug

SEQ ID NO: 393211 - RNA, 19 nt, Homo sapiens
caacauacugucugacgau

SEQ ID NO: 393212 - RNA, 19 nt, Homo sapiens
gauuaucccaaguauaguu

SEQ ID NO: 393213 - RNA, 19 nt, Homo sapiens
gagagaaugacugaacuau

SEQ ID NO: 393214 - RNA, 19 nt, Homo sapiens
caaggaugguacgaagauu

SEQ ID NO: 393215 - RNA, 19 nt, Homo sapiens
gaauguucuacaacucaua

SEQ ID NO: 393216 - RNA, 19 nt, Homo sapiens
cagacugggugacaaucaa

SEQ ID NO: 393217 - RNA, 19 nt, Homo sapiens
agaaccagcgaguauuaua

SEQ ID NO: 393218 - RNA, 19 nt, Homo sapiens
cuauauccauaaccucuau

SEQ ID NO: 393219 - RNA, 19 nt, Homo sapiens
gcaccugccuggacuaugu

SEQ ID NO: 393220 - RNA, 19 nt, Homo sapiens
ggccaucacaccuccauua

SEQ ID NO: 393221 - RNA, 19 nt, Homo sapiens
gaagaagaagcacaagaug

SEQ ID NO: 393222 - RNA, 19 nt, Homo sapiens
gagugccgcuucuacaguu

SEQ ID NO: 393223 - RNA, 19 nt, Homo sapiens
ggucagugcggcuggauuu

SEQ ID NO: 393224 - RNA, 19 nt, Homo sapiens
gcaaugugcaugugucugu

SEQ ID NO: 393225 - RNA, 19 nt, Homo sapiens
uggaagggcucacggacaa

SEQ ID NO: 393226 - RNA, 19 nt, Homo sapiens
caucacaccuccauuaacg

SEQ ID NO: 393227 - RNA, 19 nt, Homo sapiens
gugaggagaagaagaagaa

SEQ ID NO: 393228 - RNA, 19 nt, Homo sapiens
gcaccugcacccucuguga

SEQ ID NO: 393229 - RNA, 19 nt, Homo sapiens
gcaccgugugggacaauaa

SEQ ID NO: 393230 - RNA, 19 nt, Homo sapiens
ccacggaugccuaugugaa

SEQ ID NO: 393231 - RNA, 19 nt, Homo sapiens
caacuacggcacccacuuc

SEQ ID NO: 393232 - RNA, 19 nt, Homo sapiens
gccaucacaccuccauuaa

SEQ ID NO: 393233 - RNA, 19 nt, Homo sapiens
ggcuggacgugacuccuaa

SEQ ID NO: 393234 - RNA, 19 nt, Homo sapiens
aagaagaagcacaagauga

SEQ ID NO: 393235 - RNA, 19 nt, Homo sapiens
agaagaagaagcacaagau

SEQ ID NO: 393236 - RNA, 19 nt, Homo sapiens
ccaagucugguucccauga

SEQ ID NO: 393237 - RNA, 19 nt, Homo sapiens
cagggacgaugaccuccuu

SEQ ID NO: 393238 - RNA, 19 nt, Homo sapiens
agaagaagaagaagcacaa

SEQ ID NO: 393239 - RNA, 19 nt, Homo sapiens
guacucagccuggguaaac

SEQ ID NO: 393240 - RNA, 19 nt, Homo sapiens
ucaggcuuaucuccaacua

SEQ ID NO: 393241 - RNA, 19 nt, Homo sapiens
gggcuggacgugacuccua

SEQ ID NO: 393242 - RNA, 19 nt, Homo sapiens
caacuuugcagcccagaag

SEQ ID NO: 393243 - RNA, 19 nt, Homo sapiens
ggugagaugcaaccugaau

SEQ ID NO: 393244 - RNA, 19 nt, Homo sapiens
ggucugggaucaggacucu

SEQ ID NO: 393245 - RNA, 19 nt, Homo sapiens
gcugcacccugacuucaag

SEQ ID NO: 393246 - RNA, 19 nt, Homo sapiens
ugagaugcaaccugaauca

SEQ ID NO: 393247 - RNA, 19 nt, Homo sapiens
ccugugaggagaagaagaa

SEQ ID NO: 393248 - RNA, 19 nt, Homo sapiens
gagcuggguggccgcauau

SEQ ID NO: 393249 - RNA, 19 nt, Homo sapiens
ggagugccgcuucuacagu

SEQ ID NO: 393250 - RNA, 19 nt, Homo sapiens
guaaccagggccaaaguca

SEQ ID NO: 393251 - RNA, 19 nt, Homo sapiens
ccugaaucauggccaccua

SEQ ID NO: 393252 - RNA, 19 nt, Homo sapiens
cuacaguuuccauguggua

SEQ ID NO: 393253 - RNA, 19 nt, Homo sapiens
ucacaggcagccaacuuug

SEQ ID NO: 393254 - RNA, 19 nt, Homo sapiens
ugaucaggcucccaagucu

SEQ ID NO: 393255 - RNA, 19 nt, Homo sapiens
ugaaucauggccaccuaaa

SEQ ID NO: 393256 - RNA, 19 nt, Homo sapiens
cccaugaggugagaugcaa

SEQ ID NO: 393257 - RNA, 19 nt, Homo sapiens
agaagaagcacaagaugac

SEQ ID NO: 393258 - RNA, 19 nt, Homo sapiens
cuacggcacccacuucauc

SEQ ID NO: 393259 - RNA, 19 nt, Homo sapiens
caagucugguucccaugag

SEQ ID NO: 393260 - RNA, 19 nt, Homo sapiens
gguugcaggucugggauca

SEQ ID NO: 393261 - RNA, 19 nt, Homo sapiens
cuucuacaguuuccaugug

SEQ ID NO: 393262 - RNA, 19 nt, Homo sapiens
ccuaagcccaccagcaaug

SEQ ID NO: 393263 - RNA, 19 nt, Homo sapiens
cgaggcccaggucaacaua

SEQ ID NO: 393264 - RNA, 19 nt, Homo sapiens
ugaggagggcccugaguca

SEQ ID NO: 393265 - RNA, 19 nt, Homo sapiens
gaagaagaagaagcacaag

SEQ ID NO: 393266 - RNA, 19 nt, Homo sapiens
agacccaccaggaccagua

SEQ ID NO: 393267 - RNA, 19 nt, Homo sapiens
agaugcaaccugaaucaug

SEQ ID NO: 393268 - RNA, 19 nt, Homo sapiens
aagaagaagaagcacaaga

SEQ ID NO: 393269 - RNA, 19 nt, Homo sapiens
caccagcaaugugcaugug

SEQ ID NO: 393270 - RNA, 19 nt, Homo sapiens
ugacuuggauugugaauua

SEQ ID NO: 393271 - RNA, 19 nt, Homo sapiens
gaaacacagugaauuugua

SEQ ID NO: 393272 - RNA, 19 nt, Homo sapiens
ggaacaggauuaccaacua

SEQ ID NO: 393273 - RNA, 19 nt, Homo sapiens
ggacuugaaucguaucuuc

SEQ ID NO: 393274 - RNA, 19 nt, Homo sapiens
gaagcaaauuggcagguaa

SEQ ID NO: 393275 - RNA, 19 nt, Homo sapiens
aaucguaucuucccacuuu

SEQ ID NO: 393276 - RNA, 19 nt, Homo sapiens
ggacuugggucaacaugga

SEQ ID NO: 393277 - RNA, 19 nt, Homo sapiens
caaauuggcagguaauauu

SEQ ID NO: 393278 - RNA, 19 nt, Homo sapiens
gaacaggauuaccaacuag

SEQ ID NO: 393279 - RNA, 19 nt, Homo sapiens
ggaguguacuauauacuau

SEQ ID NO: 393280 - RNA, 19 nt, Homo sapiens
guaccaugguuauaugauu

SEQ ID NO: 393281 - RNA, 19 nt, Homo sapiens
gaauguguuugcagagcua

SEQ ID NO: 393282 - RNA, 19 nt, Homo sapiens
gcaauguaguuagcauauu

SEQ ID NO: 393283 - RNA, 19 nt, Homo sapiens
ugauuaaucuugggacaaa

SEQ ID NO: 393284 - RNA, 19 nt, Homo sapiens
gcaaacugccuugaagaaa

SEQ ID NO: 393285 - RNA, 19 nt, Homo sapiens
ugcagaagcuacucaaaug

SEQ ID NO: 393286 - RNA, 19 nt, Homo sapiens
ccaggugaauccaacaaga

SEQ ID NO: 393287 - RNA, 19 nt, Homo sapiens
gcaaauuggcagguaauau

SEQ ID NO: 393288 - RNA, 19 nt, Homo sapiens
agacuaaguuggucaugau

SEQ ID NO: 393289 - RNA, 19 nt, Homo sapiens
caaacugccuugaagaaaa

SEQ ID NO: 393290 - RNA, 19 nt, Homo sapiens
ggaccaauguucgaacuac

SEQ ID NO: 393291 - RNA, 19 nt, Homo sapiens
aauccucaguucaagguua

SEQ ID NO: 393292 - RNA, 19 nt, Homo sapiens
gggucaacauggauuagaa

SEQ ID NO: 393293 - RNA, 19 nt, Homo sapiens
uuaggucucuugacaggaa

SEQ ID NO: 393294 - RNA, 19 nt, Homo sapiens
agaagcaaauuggcaggua

SEQ ID NO: 393295 - RNA, 19 nt, Homo sapiens
guucuggaauccucaguuc

SEQ ID NO: 393296 - RNA, 19 nt, Homo sapiens
gagaauccaggacuugaau

SEQ ID NO: 393297 - RNA, 19 nt, Homo sapiens
cgaacuacuuccaggugaa

SEQ ID NO: 393298 - RNA, 19 nt, Homo sapiens
gcugcaauccagacaguaa

SEQ ID NO: 393299 - RNA, 19 nt, Homo sapiens
caauaccucauacugcuuu

SEQ ID NO: 393300 - RNA, 19 nt, Homo sapiens
uagacuaaguuggucauga

SEQ ID NO: 393301 - RNA, 19 nt, Homo sapiens
uauguaccaugguuauaug

SEQ ID NO: 393302 - RNA, 19 nt, Homo sapiens
ggauaucuguguauuuuca

SEQ ID NO: 393303 - RNA, 19 nt, Homo sapiens
gcuuuaaugcuguuaucua

SEQ ID NO: 393304 - RNA, 19 nt, Homo sapiens
ucucaugaauucuuaaagg

SEQ ID NO: 393305 - RNA, 19 nt, Homo sapiens
ggaaauggaacaggauuac

SEQ ID NO: 393306 - RNA, 19 nt, Homo sapiens
ggguggaguguacuauaua

SEQ ID NO: 393307 - RNA, 19 nt, Homo sapiens
uggcagguaauauuucaua

SEQ ID NO: 393308 - RNA, 19 nt, Homo sapiens
auccaggacuugaaucgua

SEQ ID NO: 393309 - RNA, 19 nt, Homo sapiens
gcgcugcaauccagacagu

SEQ ID NO: 393310 - RNA, 19 nt, Homo sapiens
agacgagaauccaggacuu

SEQ ID NO: 393311 - RNA, 19 nt, Homo sapiens
gaacuacuuccaggugaau

SEQ ID NO: 393312 - RNA, 19 nt, Homo sapiens
ugaaacacagugaauuugu

SEQ ID NO: 393313 - RNA, 19 nt, Homo sapiens
acuauuaccuuugaaugug

SEQ ID NO: 393314 - RNA, 19 nt, Homo sapiens
gguggaguguacuauauac

SEQ ID NO: 393315 - RNA, 19 nt, Homo sapiens
ggaauccucaguucaaggu

SEQ ID NO: 393316 - RNA, 19 nt, Homo sapiens
guucaaccaacaucauuau

SEQ ID NO: 393317 - RNA, 19 nt, Homo sapiens
ggcaauguaguuagcauau

SEQ ID NO: 393318 - RNA, 19 nt, Homo sapiens
caaaugcagucggcuuguc

SEQ ID NO: 393319 - RNA, 19 nt, Homo sapiens
cggaaauggaacaggauua

SEQ ID NO: 393320 - RNA, 19 nt, Homo sapiens
uggaguguacuauauacua

SEQ ID NO: 393321 - RNA, 19 nt, Homo sapiens
ugauaugccccuuuucuua

SEQ ID NO: 393322 - RNA, 19 nt, Homo sapiens
gacaguaauucugcaaacu

SEQ ID NO: 393323 - RNA, 19 nt, Homo sapiens
caggguggaguguacuaua

SEQ ID NO: 393324 - RNA, 19 nt, Homo sapiens
cuaaguuggucaugaugca

SEQ ID NO: 393325 - RNA, 19 nt, Homo sapiens
gugaugcuuuccaugacaa

SEQ ID NO: 393326 - RNA, 19 nt, Homo sapiens
aggguggaguguacuauau

SEQ ID NO: 393327 - RNA, 19 nt, Homo sapiens
aaacacagugaauuuguag

SEQ ID NO: 393328 - RNA, 19 nt, Homo sapiens
cucaugaauucuuaaagga

SEQ ID NO: 393329 - RNA, 19 nt, Homo sapiens
acaccaggcaauguaguua

SEQ ID NO: 393330 - RNA, 19 nt, Homo sapiens
agacaguaauucugcaaac

SEQ ID NO: 393331 - RNA, 19 nt, Homo sapiens
gcaauccagacaguaauuc

SEQ ID NO: 393332 - RNA, 19 nt, Homo sapiens
auaaugauaugccccuuuu

SEQ ID NO: 393333 - RNA, 19 nt, Homo sapiens
gacaccaggcaauguaguu

SEQ ID NO: 393334 - RNA, 19 nt, Homo sapiens
ccaacuaguagacgaaagu

SEQ ID NO: 393335 - RNA, 19 nt, Homo sapiens
acaggauuaccaacuagua

SEQ ID NO: 393336 - RNA, 19 nt, Homo sapiens
cgagaauccaggacuugaa

SEQ ID NO: 393337 - RNA, 19 nt, Homo sapiens
gaugcagaagcuacucaaa

SEQ ID NO: 393338 - RNA, 19 nt, Homo sapiens
cuggauaucuguguauuuu

SEQ ID NO: 393339 - RNA, 19 nt, Homo sapiens
gauaugccccuuuucuuau

SEQ ID NO: 393340 - RNA, 19 nt, Homo sapiens
uagauucccauggccauaa

SEQ ID NO: 393341 - RNA, 19 nt, Homo sapiens
ucugcaaacugccuugaag

SEQ ID NO: 393342 - RNA, 19 nt, Homo sapiens
cuauuaccuuugaaugugu

SEQ ID NO: 393343 - RNA, 19 nt, Homo sapiens
gcagaagcuacucaaaugc

SEQ ID NO: 393344 - RNA, 19 nt, Homo sapiens
agauucccauggccauaaa

SEQ ID NO: 393345 - RNA, 19 nt, Homo sapiens
ucaguucaagguuauccua

SEQ ID NO: 393346 - RNA, 19 nt, Homo sapiens
gaccaauguucgaacuacu

SEQ ID NO: 393347 - RNA, 19 nt, Homo sapiens
gacgagaauccaggacuug

SEQ ID NO: 393348 - RNA, 19 nt, Homo sapiens
cagaagcuacucaaaugca

SEQ ID NO: 393349 - RNA, 19 nt, Homo sapiens
ucauacugcuuuaccuuuu

SEQ ID NO: 393350 - RNA, 19 nt, Homo sapiens
gugcugucaauaccucaua

SEQ ID NO: 393351 - RNA, 19 nt, Homo sapiens
ucugaggacuacucuggau

SEQ ID NO: 393352 - RNA, 19 nt, Homo sapiens
uccaggacuugaaucguau

SEQ ID NO: 393353 - RNA, 19 nt, Homo sapiens
ccaauguucgaacuacuuc

SEQ ID NO: 393354 - RNA, 19 nt, Homo sapiens
gacuuggauugugaauuau

SEQ ID NO: 393355 - RNA, 19 nt, Homo sapiens
ugaggacuacucuggauca

SEQ ID NO: 393356 - RNA, 19 nt, Homo sapiens
ucuggaauccucaguucaa

SEQ ID NO: 393357 - RNA, 19 nt, Homo sapiens
ugcaaacugccuugaagaa

SEQ ID NO: 393358 - RNA, 19 nt, Homo sapiens
cuugacaccaggcaaugua

SEQ ID NO: 393359 - RNA, 19 nt, Homo sapiens
gaauccaggacuugaaucg

SEQ ID NO: 393360 - RNA, 19 nt, Homo sapiens
gcagggagcuggaggaaga

SEQ ID NO: 393361 - RNA, 19 nt, Homo sapiens
gaagaugccuccaagaaag

SEQ ID NO: 393362 - RNA, 19 nt, Homo sapiens
ggauaaagccaagaugaaa

SEQ ID NO: 393363 - RNA, 19 nt, Homo sapiens
ugaagaugccuccaagaaa

SEQ ID NO: 393364 - RNA, 19 nt, Homo sapiens
gugaagaugccuccaagaa

SEQ ID NO: 393365 - RNA, 19 nt, Homo sapiens
gaagugaagaugccuccaa

SEQ ID NO: 393366 - RNA, 19 nt, Homo sapiens
gggauaaagccaagaugaa

SEQ ID NO: 393367 - RNA, 19 nt, Homo sapiens
cgaauccaguguucuguca

SEQ ID NO: 393368 - RNA, 19 nt, Homo sapiens
ugaggaagaggacacagua

SEQ ID NO: 393369 - RNA, 19 nt, Homo sapiens
uuucaucuguuccuacuga

SEQ ID NO: 393370 - RNA, 19 nt, Homo sapiens
acuucuggcucuucuauuu

SEQ ID NO: 393371 - RNA, 19 nt, Homo sapiens
ccaccucccugcaauaaaa

SEQ ID NO: 393372 - RNA, 19 nt, Homo sapiens
cuucagacguuuagucaag

SEQ ID NO: 393373 - RNA, 19 nt, Homo sapiens
gaggaagaggacacaguaa

SEQ ID NO: 393374 - RNA, 19 nt, Homo sapiens
ggaagaggacacaguaaaa

SEQ ID NO: 393375 - RNA, 19 nt, Homo sapiens
gcuggaacuuugcguacug

SEQ ID NO: 393376 - RNA, 19 nt, Homo sapiens
caccagagcaggagaugga

SEQ ID NO: 393377 - RNA, 19 nt, Homo sapiens
agacuuccuuucaucuguu

SEQ ID NO: 393378 - RNA, 19 nt, Homo sapiens
ugccagauaugguggacaa

SEQ ID NO: 393379 - RNA, 19 nt, Homo sapiens
caagaaagauggggcuguu

SEQ ID NO: 393380 - RNA, 19 nt, Homo sapiens
ucugagacuuccaccuuug

SEQ ID NO: 393381 - RNA, 19 nt, Homo sapiens
gauaaagccaagaugaaac

SEQ ID NO: 393382 - RNA, 19 nt, Homo sapiens
cgagcccacugccucagaa

SEQ ID NO: 393383 - RNA, 19 nt, Homo sapiens
cauccacaacuucaauauu

SEQ ID NO: 393384 - RNA, 19 nt, Homo sapiens
agucaagcuugguuuacuu

SEQ ID NO: 393385 - RNA, 19 nt, Homo sapiens
ggucccagccgacaguuca

SEQ ID NO: 393386 - RNA, 19 nt, Homo sapiens
aggaagaggacacaguaaa

SEQ ID NO: 393387 - RNA, 19 nt, Homo sapiens
ccacgugggaagaucuaaa

SEQ ID NO: 393388 - RNA, 19 nt, Homo sapiens
caagaugaaacuccccuua

SEQ ID NO: 393389 - RNA, 19 nt, Homo sapiens
aagacuuccuuucaucugu

SEQ ID NO: 393390 - RNA, 19 nt, Homo sapiens
ugggauaaagccaagauga

SEQ ID NO: 393391 - RNA, 19 nt, Homo sapiens
agacgcugccugaggauga

SEQ ID NO: 393392 - RNA, 19 nt, Homo sapiens
gagacuuccaccuuugaga

SEQ ID NO: 393393 - RNA, 19 nt, Homo sapiens
gcucaaccagggucaaguc

SEQ ID NO: 393394 - RNA, 19 nt, Homo sapiens
uaucgaauccaguguucug

SEQ ID NO: 393395 - RNA, 19 nt, Homo sapiens
uuacuucuggcucuucuau

SEQ ID NO: 393396 - RNA, 19 nt, Homo sapiens
uuucugcucuucaucuaag

SEQ ID NO: 393397 - RNA, 19 nt, Homo sapiens
gacaggaagugaauaagaa

SEQ ID NO: 393398 - RNA, 19 nt, Homo sapiens
gcaagaugcuucugauucu

SEQ ID NO: 393399 - RNA, 19 nt, Homo sapiens
ggauuuaaaugaagauguc

SEQ ID NO: 393400 - RNA, 19 nt, Homo sapiens
gcucagcucaggauuuaaa

SEQ ID NO: 393401 - RNA, 19 nt, Homo sapiens
gcucaggauuuaaaugaag

SEQ ID NO: 393402 - RNA, 19 nt, Homo sapiens
cagcucaggauuuaaauga

SEQ ID NO: 393403 - RNA, 19 nt, Homo sapiens
ugacaggaagugaauaaga

SEQ ID NO: 393404 - RNA, 19 nt, Homo sapiens
gaggagacucugagcaguu

SEQ ID NO: 393405 - RNA, 19 nt, Homo sapiens
ucaaugacaggaagugaau

SEQ ID NO: 393406 - RNA, 19 nt, Homo sapiens
ucugagcaguucauagaug

SEQ ID NO: 393407 - RNA, 19 nt, Homo sapiens
aaugacaggaagugaauaa

SEQ ID NO: 393408 - RNA, 19 nt, Homo sapiens
ggcagucuccucaguaauc

SEQ ID NO: 393409 - RNA, 19 nt, Homo sapiens
ucaaggaaggccacaagga

SEQ ID NO: 393410 - RNA, 19 nt, Homo sapiens
acucugagcaguucauaga

SEQ ID NO: 393411 - RNA, 19 nt, Homo sapiens
gaugggaaccaggaugaug

SEQ ID NO: 393412 - RNA, 19 nt, Homo sapiens
gugaugggaaccaggauga

SEQ ID NO: 393413 - RNA, 19 nt, Homo sapiens
ggggcagucuccucaguaa

SEQ ID NO: 393414 - RNA, 19 nt, Homo sapiens
acagggaggccaucagcaa

SEQ ID NO: 393415 - RNA, 19 nt, Homo sapiens
ugcaagaugcuucugauuc

SEQ ID NO: 393416 - RNA, 19 nt, Homo sapiens
ccugcaagaugcuucugau

SEQ ID NO: 393417 - RNA, 19 nt, Homo sapiens
ucagggaaagccacaagga

SEQ ID NO: 393418 - RNA, 19 nt, Homo sapiens
cagagccuccugcaagaug

SEQ ID NO: 393419 - RNA, 19 nt, Homo sapiens
caccaccuccucagggaaa

SEQ ID NO: 393420 - RNA, 19 nt, Homo sapiens
accagagccuccugcaaga

SEQ ID NO: 393421 - RNA, 19 nt, Homo sapiens
gggaggccaucagcaaggu

SEQ ID NO: 393422 - RNA, 19 nt, Homo sapiens
ucaacccucugcuggugau

SEQ ID NO: 393423 - RNA, 19 nt, Homo sapiens
gggaggacagcaaucucaa

SEQ ID NO: 393424 - RNA, 19 nt, Homo sapiens
caaaugccuugaaacauaa

SEQ ID NO: 393425 - RNA, 19 nt, Homo sapiens
gacaggaagugaauaagaa

SEQ ID NO: 393426 - RNA, 19 nt, Homo sapiens
auaagaagaugacaguguu

SEQ ID NO: 393427 - RNA, 19 nt, Homo sapiens
ggaagugaauaagaagaug

SEQ ID NO: 393428 - RNA, 19 nt, Homo sapiens
gaagugaauaagaagauga

SEQ ID NO: 393429 - RNA, 19 nt, Homo sapiens
gaagaugacaguguuucaa

SEQ ID NO: 393430 - RNA, 19 nt, Homo sapiens
gaugacaguguuucaaaug

SEQ ID NO: 393431 - RNA, 19 nt, Homo sapiens
gaugggaaccagaaugaug

SEQ ID NO: 393432 - RNA, 19 nt, Homo sapiens
ugacaggaagugaauaaga

SEQ ID NO: 393433 - RNA, 19 nt, Homo sapiens
gaucaugcucuaacuucaa

SEQ ID NO: 393434 - RNA, 19 nt, Homo sapiens
gaggagacucugagcaguu

SEQ ID NO: 393435 - RNA, 19 nt, Homo sapiens
ugaauaagaagaugacagu

SEQ ID NO: 393436 - RNA, 19 nt, Homo sapiens
gugaugggaaccagaauga

SEQ ID NO: 393437 - RNA, 19 nt, Homo sapiens
auaaugugaucaugcucua

SEQ ID NO: 393438 - RNA, 19 nt, Homo sapiens
ucaaugacaggaagugaau

SEQ ID NO: 393439 - RNA, 19 nt, Homo sapiens
ucugagcaguucauagaug

SEQ ID NO: 393440 - RNA, 19 nt, Homo sapiens
uaagaagaugacaguguuu

SEQ ID NO: 393441 - RNA, 19 nt, Homo sapiens
aaugacaggaagugaauaa

SEQ ID NO: 393442 - RNA, 19 nt, Homo sapiens
aagaugacaguguuucaaa

SEQ ID NO: 393443 - RNA, 19 nt, Homo sapiens
gcagucuccucaguaaucu

SEQ ID NO: 393444 - RNA, 19 nt, Homo sapiens
ggcagucuccucaguaauc

SEQ ID NO: 393445 - RNA, 19 nt, Homo sapiens
agaugacaguguuucaaau

SEQ ID NO: 393446 - RNA, 19 nt, Homo sapiens
acucugagcaguucauaga

SEQ ID NO: 393447 - RNA, 19 nt, Homo sapiens
ucaaggaaggccacaagga

SEQ ID NO: 393448 - RNA, 19 nt, Homo sapiens
aauaagaagaugacagugu

SEQ ID NO: 393449 - RNA, 19 nt, Homo sapiens
gcucuaacuucaauauacc

SEQ ID NO: 393450 - RNA, 19 nt, Homo sapiens
ugaucaugcucuaacuuca

SEQ ID NO: 393451 - RNA, 19 nt, Homo sapiens
gugaucaugcucuaacuuc

SEQ ID NO: 393452 - RNA, 19 nt, Homo sapiens
ggggaaaaguugggaguga

SEQ ID NO: 393453 - RNA, 19 nt, Homo sapiens
ggggcagucuccucaguaa

SEQ ID NO: 393454 - RNA, 19 nt, Homo sapiens
acagggaggccaucagcaa

SEQ ID NO: 393455 - RNA, 19 nt, Homo sapiens
ucagggaaagccacaagga

SEQ ID NO: 393456 - RNA, 19 nt, Homo sapiens
ggugaugggaaccagaaug

SEQ ID NO: 393457 - RNA, 19 nt, Homo sapiens
caccaccuccucagggaaa

SEQ ID NO: 393458 - RNA, 19 nt, Homo sapiens
gggaggacagcaaucucaa

SEQ ID NO: 393459 - RNA, 19 nt, Homo sapiens
ucaacccucugcuggugau

SEQ ID NO: 393460 - RNA, 19 nt, Homo sapiens
gggaggccaucagcaaggu

SEQ ID NO: 393461 - RNA, 19 nt, Homo sapiens
caacuacgguggagugaua

SEQ ID NO: 393462 - RNA, 19 nt, Homo sapiens
gaaaguagccagcagauau

SEQ ID NO: 393463 - RNA, 19 nt, Homo sapiens
gaaugaagcugaaucugau

SEQ ID NO: 393464 - RNA, 19 nt, Homo sapiens
aaagaaagcugggauaaga

SEQ ID NO: 393465 - RNA, 19 nt, Homo sapiens
ggagagguguucauuguug

SEQ ID NO: 393466 - RNA, 19 nt, Homo sapiens
gaacugguauuugacauug

SEQ ID NO: 393467 - RNA, 19 nt, Homo sapiens
gaaggaggacuuuggauuu

SEQ ID NO: 393468 - RNA, 19 nt, Homo sapiens
caacaaagcuuccaaaagu

SEQ ID NO: 393469 - RNA, 19 nt, Homo sapiens
gcaaaggaaucaaucaucu

SEQ ID NO: 393470 - RNA, 19 nt, Homo sapiens
gaauaugccuugguuaauc

SEQ ID NO: 393471 - RNA, 19 nt, Homo sapiens
gugaggagauguuguaguu

SEQ ID NO: 393472 - RNA, 19 nt, Homo sapiens
gaagacagagcuccucaaa

SEQ ID NO: 393473 - RNA, 19 nt, Homo sapiens
ggaccaguuugauccauuu

SEQ ID NO: 393474 - RNA, 19 nt, Homo sapiens
ggauaucaaugucagcaaa

SEQ ID NO: 393475 - RNA, 19 nt, Homo sapiens
guggagugauaaagaauua

SEQ ID NO: 393476 - RNA, 19 nt, Homo sapiens
gcagaaaguggaccaguuu

SEQ ID NO: 393477 - RNA, 19 nt, Homo sapiens
aaagaaaguucaccuaagu

SEQ ID NO: 393478 - RNA, 19 nt, Homo sapiens
aaacauagaaccagagauu

SEQ ID NO: 393479 - RNA, 19 nt, Homo sapiens
ugaagaauaugccuugguu

SEQ ID NO: 393480 - RNA, 19 nt, Homo sapiens
gcagauaucagaauaacau

SEQ ID NO: 393481 - RNA, 19 nt, Homo sapiens
gccagcagauaucagaaua

SEQ ID NO: 393482 - RNA, 19 nt, Homo sapiens
aaggaggacuuuggauuua

SEQ ID NO: 393483 - RNA, 19 nt, Homo sapiens
gaaccagagauuauaagaa

SEQ ID NO: 393484 - RNA, 19 nt, Homo sapiens
gaugugaggagauguugua

SEQ ID NO: 393485 - RNA, 19 nt, Homo sapiens
gaagagcccuuuuaguguu

SEQ ID NO: 393486 - RNA, 19 nt, Homo sapiens
gaaaaugaauccauacaag

SEQ ID NO: 393487 - RNA, 19 nt, Homo sapiens
ucuagcaccuuaugugaaa

SEQ ID NO: 393488 - RNA, 19 nt, Homo sapiens
gaagaauaugccuugguua

SEQ ID NO: 393489 - RNA, 19 nt, Homo sapiens
guucugggauaguugagua

SEQ ID NO: 393490 - RNA, 19 nt, Homo sapiens
ggaaggagagguguucauu

SEQ ID NO: 393491 - RNA, 19 nt, Homo sapiens
gaggagauguuguaguucu

SEQ ID NO: 393492 - RNA, 19 nt, Homo sapiens
agacagagcuccucaaacc

SEQ ID NO: 393493 - RNA, 19 nt, Homo sapiens
aaggagagguguucauugu

SEQ ID NO: 393494 - RNA, 19 nt, Homo sapiens
gaaggagagguguucauug

SEQ ID NO: 393495 - RNA, 19 nt, Homo sapiens
caucgucucuggguauauu

SEQ ID NO: 393496 - RNA, 19 nt, Homo sapiens
aaaaggagaugcagaaaau

SEQ ID NO: 393497 - RNA, 19 nt, Homo sapiens
cauagaaccagagauuaua

SEQ ID NO: 393498 - RNA, 19 nt, Homo sapiens
aaccagagauuauaagaag

SEQ ID NO: 393499 - RNA, 19 nt, Homo sapiens
gaagcugaaucugauguca

SEQ ID NO: 393500 - RNA, 19 nt, Homo sapiens
ccaaaagucucacaauuca

SEQ ID NO: 393501 - RNA, 19 nt, Homo sapiens
gcuggacccucaugacaau

SEQ ID NO: 393502 - RNA, 19 nt, Homo sapiens
cuucaagagccauuuaaua

SEQ ID NO: 393503 - RNA, 19 nt, Homo sapiens
aaccacagaucaaauacuu

SEQ ID NO: 393504 - RNA, 19 nt, Homo sapiens
agaaugaagcugaaucuga

SEQ ID NO: 393505 - RNA, 19 nt, Homo sapiens
caaaggaaucaaucaucua

SEQ ID NO: 393506 - RNA, 19 nt, Homo sapiens
gaaagcugggauaagauuu

SEQ ID NO: 393507 - RNA, 19 nt, Homo sapiens
aagaauaugccuugguuaa

SEQ ID NO: 393508 - RNA, 19 nt, Homo sapiens
gaaaguggaccaguuugau

SEQ ID NO: 393509 - RNA, 19 nt, Homo sapiens
gaaucaaucaucuacugaa

SEQ ID NO: 393510 - RNA, 19 nt, Homo sapiens
ggaaucaaucaucuacuga

SEQ ID NO: 393511 - RNA, 19 nt, Homo sapiens
cauacaagauugauauagg

SEQ ID NO: 393512 - RNA, 19 nt, Homo sapiens
cagaucaaauacuucaaga

SEQ ID NO: 393513 - RNA, 19 nt, Homo sapiens
ucaaucaucuacugaagag

SEQ ID NO: 393514 - RNA, 19 nt, Homo sapiens
ggaggacuuuggauuuaag

SEQ ID NO: 393515 - RNA, 19 nt, Homo sapiens
ccacagaucaaauacuuca

SEQ ID NO: 393516 - RNA, 19 nt, Homo sapiens
acauugacaugacagacua

SEQ ID NO: 393517 - RNA, 19 nt, Homo sapiens
guugggagcacuugaagaa

SEQ ID NO: 393518 - RNA, 19 nt, Homo sapiens
gcaguacguucugggauag

SEQ ID NO: 393519 - RNA, 19 nt, Homo sapiens
ugaaggaggacuuuggauu

SEQ ID NO: 393520 - RNA, 19 nt, Homo sapiens
ugcaguacguucugggaua

SEQ ID NO: 393521 - RNA, 19 nt, Homo sapiens
cgcaguauauucucacaga

SEQ ID NO: 393522 - RNA, 19 nt, Homo sapiens
gaaaaggagaugcagaaaa

SEQ ID NO: 393523 - RNA, 19 nt, Homo sapiens
aaaggguggucaagacguu

SEQ ID NO: 393524 - RNA, 19 nt, Homo sapiens
ccucaaaccauuguggaua

SEQ ID NO: 393525 - RNA, 19 nt, Homo sapiens
ugggauaguugaguauuug

SEQ ID NO: 393526 - RNA, 19 nt, Homo sapiens
uggcuggagugggagauua

SEQ ID NO: 393527 - RNA, 19 nt, Homo sapiens
cagcagauaucagaauaac

SEQ ID NO: 393528 - RNA, 19 nt, Homo sapiens
aauaugccuugguuaauca

SEQ ID NO: 393529 - RNA, 19 nt, Homo sapiens
ggagaaugaagcugaaucu

SEQ ID NO: 393530 - RNA, 19 nt, Homo sapiens
gauaucuucugccuucaac

SEQ ID NO: 393531 - RNA, 19 nt, Homo sapiens
acauagaaccagagauuau

SEQ ID NO: 393532 - RNA, 19 nt, Homo sapiens
caucugccgugaauuggau

SEQ ID NO: 393533 - RNA, 19 nt, Homo sapiens
agaaagcugggauaagauu

SEQ ID NO: 393534 - RNA, 19 nt, Homo sapiens
cagagcuccucaaaccauu

SEQ ID NO: 393535 - RNA, 19 nt, Homo sapiens
ugaauuggaugccauuucc

SEQ ID NO: 393536 - RNA, 19 nt, Homo sapiens
guagccagcagauaucaga

SEQ ID NO: 393537 - RNA, 19 nt, Homo sapiens
ccaaucaacacaauacagu

SEQ ID NO: 393538 - RNA, 19 nt, Homo sapiens
cucaaaccauuguggauau

SEQ ID NO: 393539 - RNA, 19 nt, Homo sapiens
cuauugauuugcagaaagu

SEQ ID NO: 393540 - RNA, 19 nt, Homo sapiens
aauaaagaaagcugggaua

SEQ ID NO: 393541 - RNA, 19 nt, Homo sapiens
gcaccuuaugugaaaguuu

SEQ ID NO: 393542 - RNA, 19 nt, Homo sapiens
agaggagaaugaagcugaa

SEQ ID NO: 393543 - RNA, 19 nt, Homo sapiens
aggaaucaaucaucuacug

SEQ ID NO: 393544 - RNA, 19 nt, Homo sapiens
ugggagcacuugaagaaag

SEQ ID NO: 393545 - RNA, 19 nt, Homo sapiens
auaaagaaagcugggauaa

SEQ ID NO: 393546 - RNA, 19 nt, Homo sapiens
cugggauaguugaguauuu

SEQ ID NO: 393547 - RNA, 19 nt, Homo sapiens
caucauugacagagcauug

SEQ ID NO: 393548 - RNA, 19 nt, Homo sapiens
uuguaguucugcagacaua

SEQ ID NO: 393549 - RNA, 19 nt, Homo sapiens
caccuuaugugaaaguuuu

SEQ ID NO: 393550 - RNA, 19 nt, Homo sapiens
agcugaaucugaugucaaa

SEQ ID NO: 393551 - RNA, 19 nt, Homo sapiens
ccaguuugauccauuuacu

SEQ ID NO: 393552 - RNA, 19 nt, Homo sapiens
ugcagaaaguggaccaguu

SEQ ID NO: 393553 - RNA, 19 nt, Homo sapiens
uguaaaggguggucaagac

SEQ ID NO: 393554 - RNA, 19 nt, Homo sapiens
gaguauuugagccuuguaa

SEQ ID NO: 393555 - RNA, 19 nt, Homo sapiens
aggaggacuuuggauuuaa

SEQ ID NO: 393556 - RNA, 19 nt, Homo sapiens
gagcauugaaggaggacuu

SEQ ID NO: 393557 - RNA, 19 nt, Homo sapiens
aaucaacacaauacaguga

SEQ ID NO: 393558 - RNA, 19 nt, Homo sapiens
aaaccauuguggauaucuu

SEQ ID NO: 393559 - RNA, 19 nt, Homo sapiens
gaccaguuugauccauuua

SEQ ID NO: 393560 - RNA, 19 nt, Homo sapiens
agaaaguggaccaguuuga

SEQ ID NO: 393561 - RNA, 19 nt, Homo sapiens
gaaaggaacugaacaauac

SEQ ID NO: 393562 - RNA, 19 nt, Homo sapiens
gaaaggagguuugagguaa

SEQ ID NO: 393563 - RNA, 19 nt, Homo sapiens
gagagaagcuagaagauga

SEQ ID NO: 393564 - RNA, 19 nt, Homo sapiens
caacagagacuuucacuau

SEQ ID NO: 393565 - RNA, 19 nt, Homo sapiens
gaaggaaagucuauuugga

SEQ ID NO: 393566 - RNA, 19 nt, Homo sapiens
gcuagaagaugaauaugaa

SEQ ID NO: 393567 - RNA, 19 nt, Homo sapiens
gaggaggaguuucuauuaa

SEQ ID NO: 393568 - RNA, 19 nt, Homo sapiens
gcucuggccucuuuaaauu

SEQ ID NO: 393569 - RNA, 19 nt, Homo sapiens
caacauccgucacagcuuu

SEQ ID NO: 393570 - RNA, 19 nt, Homo sapiens
guaaagacauaaagaagga

SEQ ID NO: 393571 - RNA, 19 nt, Homo sapiens
cuacaggcaugcacacuua

SEQ ID NO: 393572 - RNA, 19 nt, Homo sapiens
gaagauuacuuuagugaag

SEQ ID NO: 393573 - RNA, 19 nt, Homo sapiens
gcaagaauuuaucaaagga

SEQ ID NO: 393574 - RNA, 19 nt, Homo sapiens
gaaccuauccaaccagaaa

SEQ ID NO: 393575 - RNA, 19 nt, Homo sapiens
gaaagucuauuuggaagau

SEQ ID NO: 393576 - RNA, 19 nt, Homo sapiens
gaagcuagaagaugaauau

SEQ ID NO: 393577 - RNA, 19 nt, Homo sapiens
caucugcucuggccucuuu

SEQ ID NO: 393578 - RNA, 19 nt, Homo sapiens
gaaggaaccuauccaacca

SEQ ID NO: 393579 - RNA, 19 nt, Homo sapiens
cauaaagccuugcgggaaa

SEQ ID NO: 393580 - RNA, 19 nt, Homo sapiens
cgaagaagagaucauauuu

SEQ ID NO: 393581 - RNA, 19 nt, Homo sapiens
caggauuucuuaaaggaua

SEQ ID NO: 393582 - RNA, 19 nt, Homo sapiens
caaaccaaguguccagaaa

SEQ ID NO: 393583 - RNA, 19 nt, Homo sapiens
ugaaaggaacugaacaaua

SEQ ID NO: 393584 - RNA, 19 nt, Homo sapiens
ggaaaggagguuugaggua

SEQ ID NO: 393585 - RNA, 19 nt, Homo sapiens
gaauaugaaccacgaagaa

SEQ ID NO: 393586 - RNA, 19 nt, Homo sapiens
acagagacuuucacuauau

SEQ ID NO: 393587 - RNA, 19 nt, Homo sapiens
ggacagacuauacaccuuu

SEQ ID NO: 393588 - RNA, 19 nt, Homo sapiens
gaaugaauuuagagccaaa

SEQ ID NO: 393589 - RNA, 19 nt, Homo sapiens
gggcauugguuuaacuuug

SEQ ID NO: 393590 - RNA, 19 nt, Homo sapiens
ggacuagaagauuacuuua

SEQ ID NO: 393591 - RNA, 19 nt, Homo sapiens
aaauggaucuccuucgauu

SEQ ID NO: 393592 - RNA, 19 nt, Homo sapiens
gagccaacguauucuaaau

SEQ ID NO: 393593 - RNA, 19 nt, Homo sapiens
gauaaagguuacucuuaca

SEQ ID NO: 393594 - RNA, 19 nt, Homo sapiens
gaagauggcuuugcuuacg

SEQ ID NO: 393595 - RNA, 19 nt, Homo sapiens
gaagaagagaucauauuuc

SEQ ID NO: 393596 - RNA, 19 nt, Homo sapiens
gaacaauaccagaguaagu

SEQ ID NO: 393597 - RNA, 19 nt, Homo sapiens
ggagugagcuaugugaaag

SEQ ID NO: 393598 - RNA, 19 nt, Homo sapiens
ggagggauaagccagauuu

SEQ ID NO: 393599 - RNA, 19 nt, Homo sapiens
ggagauuguugccucauca

SEQ ID NO: 393600 - RNA, 19 nt, Homo sapiens
cuccuucgauuuagauuua

SEQ ID NO: 393601 - RNA, 19 nt, Homo sapiens
gaggaaggaaagucuauuu

SEQ ID NO: 393602 - RNA, 19 nt, Homo sapiens
gaauuuagagccaaacugu

SEQ ID NO: 393603 - RNA, 19 nt, Homo sapiens
agaguaaguuggagaguga

SEQ ID NO: 393604 - RNA, 19 nt, Homo sapiens
gauagccaauugcaguuug

SEQ ID NO: 393605 - RNA, 19 nt, Homo sapiens
agaggaggaguuucuauua

SEQ ID NO: 393606 - RNA, 19 nt, Homo sapiens
gaaggaaagaggaggaguu

SEQ ID NO: 393607 - RNA, 19 nt, Homo sapiens
aacagagacuuucacuaua

SEQ ID NO: 393608 - RNA, 19 nt, Homo sapiens
aaagauggauccagacaag

SEQ ID NO: 393609 - RNA, 19 nt, Homo sapiens
cuuaaaggauagccaauug

SEQ ID NO: 393610 - RNA, 19 nt, Homo sapiens
ccacgaagaagagaucaua

SEQ ID NO: 393611 - RNA, 19 nt, Homo sapiens
gaagggcauugguuuaacu

SEQ ID NO: 393612 - RNA, 19 nt, Homo sapiens
cagagacuuucacuauauu

SEQ ID NO: 393613 - RNA, 19 nt, Homo sapiens
aggaggaguuucuauuaaa

SEQ ID NO: 393614 - RNA, 19 nt, Homo sapiens
ugaaucauccuaaucaguu

SEQ ID NO: 393615 - RNA, 19 nt, Homo sapiens
ugauaaagguuacucuuac

SEQ ID NO: 393616 - RNA, 19 nt, Homo sapiens
agaaauggaucuccuucga

SEQ ID NO: 393617 - RNA, 19 nt, Homo sapiens
gagagccaacguauucuaa

SEQ ID NO: 393618 - RNA, 19 nt, Homo sapiens
cagauugauuugcuuucua

SEQ ID NO: 393619 - RNA, 19 nt, Homo sapiens
gguuugagguaacaacaga

SEQ ID NO: 393620 - RNA, 19 nt, Homo sapiens
caguauggccuauuucuga

SEQ ID NO: 393621 - RNA, 19 nt, Homo sapiens
gcaagaggacagacuauac

SEQ ID NO: 393622 - RNA, 19 nt, Homo sapiens
gauccagacaaguuugaua

SEQ ID NO: 393623 - RNA, 19 nt, Homo sapiens
ggaaggaaagucuauuugg

SEQ ID NO: 393624 - RNA, 19 nt, Homo sapiens
cuuagacgcugguucauuc

SEQ ID NO: 393625 - RNA, 19 nt, Homo sapiens
ggaggaguuucuauuaaaa

SEQ ID NO: 393626 - RNA, 19 nt, Homo sapiens
caugcacacuuauuaggaa

SEQ ID NO: 393627 - RNA, 19 nt, Homo sapiens
aaauggugguaaagacaua

SEQ ID NO: 393628 - RNA, 19 nt, Homo sapiens
gaaucauccuaaucaguuc

SEQ ID NO: 393629 - RNA, 19 nt, Homo sapiens
gauuguggcuuuucuuuga

SEQ ID NO: 393630 - RNA, 19 nt, Homo sapiens
gaagaaagcggaggaagcu

SEQ ID NO: 393631 - RNA, 19 nt, Homo sapiens
ccagaaacuacaauaaaga

SEQ ID NO: 393632 - RNA, 19 nt, Homo sapiens
gaaagauggauccagacaa

SEQ ID NO: 393633 - RNA, 19 nt, Homo sapiens
cauccugaaugaauuuaga

SEQ ID NO: 393634 - RNA, 19 nt, Homo sapiens
uaccucagccucccaagua

SEQ ID NO: 393635 - RNA, 19 nt, Homo sapiens
agaaacuccucaacccaaa

SEQ ID NO: 393636 - RNA, 19 nt, Homo sapiens
ccagacaaguuugauaaag

SEQ ID NO: 393637 - RNA, 19 nt, Homo sapiens
ggaaagauggauccagaca

SEQ ID NO: 393638 - RNA, 19 nt, Homo sapiens
gggaaauguugggaagauu

SEQ ID NO: 393639 - RNA, 19 nt, Homo sapiens
ggguucgaguccauuuaua

SEQ ID NO: 393640 - RNA, 19 nt, Homo sapiens
gaaauggaucuccuucgau

SEQ ID NO: 393641 - RNA, 19 nt, Homo sapiens
gaagauuauucuguccaau

SEQ ID NO: 393642 - RNA, 19 nt, Homo sapiens
aaagguuacucuuacaaca

SEQ ID NO: 393643 - RNA, 19 nt, Homo sapiens
gcaugcgucaguuacauaa

SEQ ID NO: 393644 - RNA, 19 nt, Homo sapiens
uggaagauggcuuugcuua

SEQ ID NO: 393645 - RNA, 19 nt, Homo sapiens
uauaagugaugaagagaag

SEQ ID NO: 393646 - RNA, 19 nt, Homo sapiens
gaaccacgaagaagagauc

SEQ ID NO: 393647 - RNA, 19 nt, Homo sapiens
uuagugcagugacacaauu

SEQ ID NO: 393648 - RNA, 19 nt, Homo sapiens
aauagccuguuuccuguuu

SEQ ID NO: 393649 - RNA, 19 nt, Homo sapiens
cagacaaguuugauaaagg

SEQ ID NO: 393650 - RNA, 19 nt, Homo sapiens
gguucgaguccauuuauaa

SEQ ID NO: 393651 - RNA, 19 nt, Homo sapiens
cccagaaacuacaauaaag

SEQ ID NO: 393652 - RNA, 19 nt, Homo sapiens
caggcaugcacacuuauua

SEQ ID NO: 393653 - RNA, 19 nt, Homo sapiens
gugcugggauuacaguugu

SEQ ID NO: 393654 - RNA, 19 nt, Homo sapiens
gccaacguauucuaaaugg

SEQ ID NO: 393655 - RNA, 19 nt, Homo sapiens
caagaggacagacuauaca

SEQ ID NO: 393656 - RNA, 19 nt, Homo sapiens
agacaaguuugauaaaggu

SEQ ID NO: 393657 - RNA, 19 nt, Homo sapiens
uaagccagauuuuggauuu

SEQ ID NO: 393658 - RNA, 19 nt, Homo sapiens
ugaagauuauucuguccaa

SEQ ID NO: 393659 - RNA, 19 nt, Homo sapiens
gauggauccagacaaguuu

SEQ ID NO: 393660 - RNA, 19 nt, Homo sapiens
aaugcaguauggccuauuu

SEQ ID NO: 393661 - RNA, 19 nt, Homo sapiens
gaacuuaucuacuggauuu

SEQ ID NO: 393662 - RNA, 19 nt, Homo sapiens
gaggagagcuauuugauua

SEQ ID NO: 393663 - RNA, 19 nt, Homo sapiens
gcaauaagcaugcauaaua

SEQ ID NO: 393664 - RNA, 19 nt, Homo sapiens
uaaaguagcugugaagaua

SEQ ID NO: 393665 - RNA, 19 nt, Homo sapiens
gaugucagauggugaauuu

SEQ ID NO: 393666 - RNA, 19 nt, Homo sapiens
gaacaugaaugguuuaaac

SEQ ID NO: 393667 - RNA, 19 nt, Homo sapiens
ggagagcuauuugauuaua

SEQ ID NO: 393668 - RNA, 19 nt, Homo sapiens
caaagucgaccaaaugaua

SEQ ID NO: 393669 - RNA, 19 nt, Homo sapiens
acacaugaaugcaaagaua

SEQ ID NO: 393670 - RNA, 19 nt, Homo sapiens
caaaaugagucuacaguua

SEQ ID NO: 393671 - RNA, 19 nt, Homo sapiens
guagagcaaucaaacaauu

SEQ ID NO: 393672 - RNA, 19 nt, Homo sapiens
caacagaaaucaccaggau

SEQ ID NO: 393673 - RNA, 19 nt, Homo sapiens
gaagaucggccacuacauu

SEQ ID NO: 393674 - RNA, 19 nt, Homo sapiens
gacaagcacuuacuccaaa

SEQ ID NO: 393675 - RNA, 19 nt, Homo sapiens
gauaacaggagaauaauga

SEQ ID NO: 393676 - RNA, 19 nt, Homo sapiens
gaggauccaucauauaguu

SEQ ID NO: 393677 - RNA, 19 nt, Homo sapiens
caacuaugcugcaccagaa

SEQ ID NO: 393678 - RNA, 19 nt, Homo sapiens
gaaaucaccaggauccuuu

SEQ ID NO: 393679 - RNA, 19 nt, Homo sapiens
gaaguucucagcugucuuu

SEQ ID NO: 393680 - RNA, 19 nt, Homo sapiens
gcagaaguauguagagcaa

SEQ ID NO: 393681 - RNA, 19 nt, Homo sapiens
gaaugaagccaaagauuuc

SEQ ID NO: 393682 - RNA, 19 nt, Homo sapiens
caaccaugauugaugauga

SEQ ID NO: 393683 - RNA, 19 nt, Homo sapiens
gauugaugaugaagccuua

SEQ ID NO: 393684 - RNA, 19 nt, Homo sapiens
gggauuggaacaugauuua

SEQ ID NO: 393685 - RNA, 19 nt, Homo sapiens
ucucuuaccucaucuguga

SEQ ID NO: 393686 - RNA, 19 nt, Homo sapiens
ggaagaauccugugacaag

SEQ ID NO: 393687 - RNA, 19 nt, Homo sapiens
ccauacccuugaugaauua

SEQ ID NO: 393688 - RNA, 19 nt, Homo sapiens
gccauacccuugaugaauu

SEQ ID NO: 393689 - RNA, 19 nt, Homo sapiens
gaaguaauuucaggaagau

SEQ ID NO: 393690 - RNA, 19 nt, Homo sapiens
ugaaugaagccaaagauuu

SEQ ID NO: 393691 - RNA, 19 nt, Homo sapiens
ggaauuagaagucaaaguc

SEQ ID NO: 393692 - RNA, 19 nt, Homo sapiens
gcaguugccuaccaucuca

SEQ ID NO: 393693 - RNA, 19 nt, Homo sapiens
gcccagagguagauauaug

SEQ ID NO: 393694 - RNA, 19 nt, Homo sapiens
acaauuggauuaugaaugg

SEQ ID NO: 393695 - RNA, 19 nt, Homo sapiens
cagggaacaugaaugguuu

SEQ ID NO: 393696 - RNA, 19 nt, Homo sapiens
gcagagaaauucagaaccu

SEQ ID NO: 393697 - RNA, 19 nt, Homo sapiens
ugaauugacugggcauaaa

SEQ ID NO: 393698 - RNA, 19 nt, Homo sapiens
gaagucacacaauagaauu

SEQ ID NO: 393699 - RNA, 19 nt, Homo sapiens
ccaaaggagugauucagau

SEQ ID NO: 393700 - RNA, 19 nt, Homo sapiens
cgacagggauuggaacaug

SEQ ID NO: 393701 - RNA, 19 nt, Homo sapiens
ggaagucacacaauagaau

SEQ ID NO: 393702 - RNA, 19 nt, Homo sapiens
guucucagcugucuuuaca

SEQ ID NO: 393703 - RNA, 19 nt, Homo sapiens
gcagguggaucccaugaag

SEQ ID NO: 393704 - RNA, 19 nt, Homo sapiens
gcgacaagcccaccugauu

SEQ ID NO: 393705 - RNA, 19 nt, Homo sapiens
agaaguaauuucaggaaga

SEQ ID NO: 393706 - RNA, 19 nt, Homo sapiens
ggaaaauccucagaaguuu

SEQ ID NO: 393707 - RNA, 19 nt, Homo sapiens
gaccaugugccaacucuuu

SEQ ID NO: 393708 - RNA, 19 nt, Homo sapiens
augcaaagauagcugauuu

SEQ ID NO: 393709 - RNA, 19 nt, Homo sapiens
ggaggagagcuauuugauu

SEQ ID NO: 393710 - RNA, 19 nt, Homo sapiens
gaaaauguccugcuugaug

SEQ ID NO: 393711 - RNA, 19 nt, Homo sapiens
ucaaagauaucagggaaca

SEQ ID NO: 393712 - RNA, 19 nt, Homo sapiens
gacagggauuggaacauga

SEQ ID NO: 393713 - RNA, 19 nt, Homo sapiens
ugaccucacuugacucuuc

SEQ ID NO: 393714 - RNA, 19 nt, Homo sapiens
ugccuaccaucucauaaua

SEQ ID NO: 393715 - RNA, 19 nt, Homo sapiens
gugaugggaucuucuauac

SEQ ID NO: 393716 - RNA, 19 nt, Homo sapiens
uuucaggcauccucauaua

SEQ ID NO: 393717 - RNA, 19 nt, Homo sapiens
gcagcaauaagcaugcaua

SEQ ID NO: 393718 - RNA, 19 nt, Homo sapiens
acaggagaauaaugaauga

SEQ ID NO: 393719 - RNA, 19 nt, Homo sapiens
gauaugugaugggaucuuc

SEQ ID NO: 393720 - RNA, 19 nt, Homo sapiens
ccuaccaucucauaauaga

SEQ ID NO: 393721 - RNA, 19 nt, Homo sapiens
caggcauccucauauaauu

SEQ ID NO: 393722 - RNA, 19 nt, Homo sapiens
gaugugugcaaaucuaauu

SEQ ID NO: 393723 - RNA, 19 nt, Homo sapiens
agacucaguuccuggagaa

SEQ ID NO: 393724 - RNA, 19 nt, Homo sapiens
gauacucaaucgacagaag

SEQ ID NO: 393725 - RNA, 19 nt, Homo sapiens
gaaauuacagaagccaaau

SEQ ID NO: 393726 - RNA, 19 nt, Homo sapiens
aacaggaccuuccaaaaua

SEQ ID NO: 393727 - RNA, 19 nt, Homo sapiens
aaagauagcugauuuuggu

SEQ ID NO: 393728 - RNA, 19 nt, Homo sapiens
agaaguauguagagcaauc

SEQ ID NO: 393729 - RNA, 19 nt, Homo sapiens
gauauuauggcagaaguau

SEQ ID NO: 393730 - RNA, 19 nt, Homo sapiens
gaagguuggcaaacaugaa

SEQ ID NO: 393731 - RNA, 19 nt, Homo sapiens
guuagcaacuaucgaucuu

SEQ ID NO: 393732 - RNA, 19 nt, Homo sapiens
caagcccaccugauucuuu

SEQ ID NO: 393733 - RNA, 19 nt, Homo sapiens
caaagugaagguuggcaaa

SEQ ID NO: 393734 - RNA, 19 nt, Homo sapiens
ggugguccauagagauuug

SEQ ID NO: 393735 - RNA, 19 nt, Homo sapiens
ggcauaaaguagcugugaa

SEQ ID NO: 393736 - RNA, 19 nt, Homo sapiens
caaaggagugauucagaug

SEQ ID NO: 393737 - RNA, 19 nt, Homo sapiens
guaaacccauauuauuugc

SEQ ID NO: 393738 - RNA, 19 nt, Homo sapiens
cgacaagcccaccugauuc

SEQ ID NO: 393739 - RNA, 19 nt, Homo sapiens
gaacccuuccauuugauga

SEQ ID NO: 393740 - RNA, 19 nt, Homo sapiens
ccuaauaucgagaaaugaa

SEQ ID NO: 393741 - RNA, 19 nt, Homo sapiens
aagcaugcauaauaaguca

SEQ ID NO: 393742 - RNA, 19 nt, Homo sapiens
ccaaguggauaguagaacu

SEQ ID NO: 393743 - RNA, 19 nt, Homo sapiens
gcagugggguuauucucua

SEQ ID NO: 393744 - RNA, 19 nt, Homo sapiens
uuucugguguggauuauug

SEQ ID NO: 393745 - RNA, 19 nt, Homo sapiens
aaagaaagucggcgucugu

SEQ ID NO: 393746 - RNA, 19 nt, Homo sapiens
ggucaucaguacaccaucu

SEQ ID NO: 393747 - RNA, 19 nt, Homo sapiens
ugaaauuacagaagccaaa

SEQ ID NO: 393748 - RNA, 19 nt, Homo sapiens
ggauuuccguaguauugau

SEQ ID NO: 393749 - RNA, 19 nt, Homo sapiens
gggugaagaucggccacua

SEQ ID NO: 393750 - RNA, 19 nt, Homo sapiens
gaugaagccuuaaaagaag

SEQ ID NO: 393751 - RNA, 19 nt, Homo sapiens
gggcauaaaguagcuguga

SEQ ID NO: 393752 - RNA, 19 nt, Homo sapiens
cuauaccccucaauauuua

SEQ ID NO: 393753 - RNA, 19 nt, Homo sapiens
ggcauccucauauaauuaa

SEQ ID NO: 393754 - RNA, 19 nt, Homo sapiens
agccuaauaucgagaaaug

SEQ ID NO: 393755 - RNA, 19 nt, Homo sapiens
ggucggcaccuucggcaaa

SEQ ID NO: 393756 - RNA, 19 nt, Homo sapiens
auucagaaccucaagcuuu

SEQ ID NO: 393757 - RNA, 19 nt, Homo sapiens
ucagggaacaugaaugguu

SEQ ID NO: 393758 - RNA, 19 nt, Homo sapiens
guaugcaggcccagaggua

SEQ ID NO: 393759 - RNA, 19 nt, Homo sapiens
gcacacaugaaugcaaaga

SEQ ID NO: 393760 - RNA, 19 nt, Homo sapiens
ucauggugauggaauaugu

SEQ ID NO: 393761 - RNA, 19 nt, Homo sapiens
gaaaggaugccaccucuua

SEQ ID NO: 393762 - RNA, 19 nt, Homo sapiens
gaugucagauggugaauuu

SEQ ID NO: 393763 - RNA, 19 nt, Homo sapiens
gcagagagccauucacuuu

SEQ ID NO: 393764 - RNA, 19 nt, Homo sapiens
cgacuaagcccaaaucuuu

SEQ ID NO: 393765 - RNA, 19 nt, Homo sapiens
guaccuacguuauuuaaga

SEQ ID NO: 393766 - RNA, 19 nt, Homo sapiens
gcauguaccuacguuauuu

SEQ ID NO: 393767 - RNA, 19 nt, Homo sapiens
gaaacgagcaacuaucaaa

SEQ ID NO: 393768 - RNA, 19 nt, Homo sapiens
acacaugaaugccaagaua

SEQ ID NO: 393769 - RNA, 19 nt, Homo sapiens
ggaagguagugaaugcaua

SEQ ID NO: 393770 - RNA, 19 nt, Homo sapiens
gagcaaaccguaugacauu

SEQ ID NO: 393771 - RNA, 19 nt, Homo sapiens
gacagaagauucgcaguuu

SEQ ID NO: 393772 - RNA, 19 nt, Homo sapiens
ggcaauaucuuuaauaggu

SEQ ID NO: 393773 - RNA, 19 nt, Homo sapiens
gcaguggcuuaucaucuua

SEQ ID NO: 393774 - RNA, 19 nt, Homo sapiens
gaucagcacuccaacagau

SEQ ID NO: 393775 - RNA, 19 nt, Homo sapiens
ucacauaggcaauaucuuu

SEQ ID NO: 393776 - RNA, 19 nt, Homo sapiens
aaaccugccuccaagauuu

SEQ ID NO: 393777 - RNA, 19 nt, Homo sapiens
guaauucuauugugccuau

SEQ ID NO: 393778 - RNA, 19 nt, Homo sapiens
uaacagguaaccacaauuu

SEQ ID NO: 393779 - RNA, 19 nt, Homo sapiens
uaagagagcaugaaugguu

SEQ ID NO: 393780 - RNA, 19 nt, Homo sapiens
gagcugugguguuaucuug

SEQ ID NO: 393781 - RNA, 19 nt, Homo sapiens
aagcauugaugaugaagua

SEQ ID NO: 393782 - RNA, 19 nt, Homo sapiens
cagaaguaaugaacaguuu

SEQ ID NO: 393783 - RNA, 19 nt, Homo sapiens
gagcaugaaugguuuaaac

SEQ ID NO: 393784 - RNA, 19 nt, Homo sapiens
uaaagaaccacgaguaaga

SEQ ID NO: 393785 - RNA, 19 nt, Homo sapiens
guacaaauacugccuagug

SEQ ID NO: 393786 - RNA, 19 nt, Homo sapiens
gaaccacgaguaagauauu

SEQ ID NO: 393787 - RNA, 19 nt, Homo sapiens
guugaucugucucuaguuu

SEQ ID NO: 393788 - RNA, 19 nt, Homo sapiens
ccugaaaccucauccagaa

SEQ ID NO: 393789 - RNA, 19 nt, Homo sapiens
gacaaucggagaauaauga

SEQ ID NO: 393790 - RNA, 19 nt, Homo sapiens
caaggaauccgaagucaga

SEQ ID NO: 393791 - RNA, 19 nt, Homo sapiens
gaugauagugccaugcaua

SEQ ID NO: 393792 - RNA, 19 nt, Homo sapiens
gagcaacuaucaaagacau

SEQ ID NO: 393793 - RNA, 19 nt, Homo sapiens
gcugugguguuaucuugua

SEQ ID NO: 393794 - RNA, 19 nt, Homo sapiens
gucuggaggugaauuauuu

SEQ ID NO: 393795 - RNA, 19 nt, Homo sapiens
gcagucacaccauggauuu

SEQ ID NO: 393796 - RNA, 19 nt, Homo sapiens
ucaauuaacaggccauaaa

SEQ ID NO: 393797 - RNA, 19 nt, Homo sapiens
gaggugaauuauuugacua

SEQ ID NO: 393798 - RNA, 19 nt, Homo sapiens
acagaagauucgcaguuua

SEQ ID NO: 393799 - RNA, 19 nt, Homo sapiens
agaagacuguggucaugua

SEQ ID NO: 393800 - RNA, 19 nt, Homo sapiens
ccagucugauuacuacuuu

SEQ ID NO: 393801 - RNA, 19 nt, Homo sapiens
gaaguuuaccgagcuauga

SEQ ID NO: 393802 - RNA, 19 nt, Homo sapiens
ggcgaaccaucucaaugua

SEQ ID NO: 393803 - RNA, 19 nt, Homo sapiens
aauauccacugcaauacua

SEQ ID NO: 393804 - RNA, 19 nt, Homo sapiens
gauagugccaugcauauuc

SEQ ID NO: 393805 - RNA, 19 nt, Homo sapiens
gcaacuaucaaagacauaa

SEQ ID NO: 393806 - RNA, 19 nt, Homo sapiens
auaaugaguucacuacaga

SEQ ID NO: 393807 - RNA, 19 nt, Homo sapiens
guuuagauguuguuggaaa

SEQ ID NO: 393808 - RNA, 19 nt, Homo sapiens
cacauugucuucaguuuca

SEQ ID NO: 393809 - RNA, 19 nt, Homo sapiens
cauuauggcugaaguuuac

SEQ ID NO: 393810 - RNA, 19 nt, Homo sapiens
gcauaugguuguucaucga

SEQ ID NO: 393811 - RNA, 19 nt, Homo sapiens
gcuguuugguguaguaaau

SEQ ID NO: 393812 - RNA, 19 nt, Homo sapiens
gaauacgacuaagcccaaa

SEQ ID NO: 393813 - RNA, 19 nt, Homo sapiens
cagagaauguccuguugga

SEQ ID NO: 393814 - RNA, 19 nt, Homo sapiens
ggaggugaauuauuugacu

SEQ ID NO: 393815 - RNA, 19 nt, Homo sapiens
aacuuuaccugguugauaa

SEQ ID NO: 393816 - RNA, 19 nt, Homo sapiens
ugaagcagcuggauuuuga

SEQ ID NO: 393817 - RNA, 19 nt, Homo sapiens
caaaccguaugacauuaug

SEQ ID NO: 393818 - RNA, 19 nt, Homo sapiens
gcaaaccguaugacauuau

SEQ ID NO: 393819 - RNA, 19 nt, Homo sapiens
aacaagguuugcccaguua

SEQ ID NO: 393820 - RNA, 19 nt, Homo sapiens
gagcauguaccuacguuau

SEQ ID NO: 393821 - RNA, 19 nt, Homo sapiens
uugcggaucuccaaauuau

SEQ ID NO: 393822 - RNA, 19 nt, Homo sapiens
gaaaugugugccagucuga

SEQ ID NO: 393823 - RNA, 19 nt, Homo sapiens
uggagaacaucaauuaaca

SEQ ID NO: 393824 - RNA, 19 nt, Homo sapiens
ccacucuccugaugcauau

SEQ ID NO: 393825 - RNA, 19 nt, Homo sapiens
gaagacuguggucauguaa

SEQ ID NO: 393826 - RNA, 19 nt, Homo sapiens
guuuaucgcccaauuuauu

SEQ ID NO: 393827 - RNA, 19 nt, Homo sapiens
guguuuaucgcccaauuua

SEQ ID NO: 393828 - RNA, 19 nt, Homo sapiens
gaagauuggagaacaucaa

SEQ ID NO: 393829 - RNA, 19 nt, Homo sapiens
caguuuagauguuguugga

SEQ ID NO: 393830 - RNA, 19 nt, Homo sapiens
ugaugaggcugugaaagaa

SEQ ID NO: 393831 - RNA, 19 nt, Homo sapiens
gaaaaugagcuuacaacuu

SEQ ID NO: 393832 - RNA, 19 nt, Homo sapiens
caaguggcgucaaggaauc

SEQ ID NO: 393833 - RNA, 19 nt, Homo sapiens
gacuaagcccaaaucuuua

SEQ ID NO: 393834 - RNA, 19 nt, Homo sapiens
caaagcaagauguccauug

SEQ ID NO: 393835 - RNA, 19 nt, Homo sapiens
gaugccaccucuuauagca

SEQ ID NO: 393836 - RNA, 19 nt, Homo sapiens
aagagagcaugaaugguuu

SEQ ID NO: 393837 - RNA, 19 nt, Homo sapiens
cauaagagagcaugaaugg

SEQ ID NO: 393838 - RNA, 19 nt, Homo sapiens
gcuguggauuacugucaua

SEQ ID NO: 393839 - RNA, 19 nt, Homo sapiens
ccuaguguauucaacagaa

SEQ ID NO: 393840 - RNA, 19 nt, Homo sapiens
cuaugaagcagcuggauuu

SEQ ID NO: 393841 - RNA, 19 nt, Homo sapiens
ccaaaucuuuagcugugaa

SEQ ID NO: 393842 - RNA, 19 nt, Homo sapiens
aaagcaagauguccauugg

SEQ ID NO: 393843 - RNA, 19 nt, Homo sapiens
gcaugaaugguuuaaacaa

SEQ ID NO: 393844 - RNA, 19 nt, Homo sapiens
gcagguugacccacugaaa

SEQ ID NO: 393845 - RNA, 19 nt, Homo sapiens
cacauaggcaauaucuuua

SEQ ID NO: 393846 - RNA, 19 nt, Homo sapiens
gcacauugucuucaguuuc

SEQ ID NO: 393847 - RNA, 19 nt, Homo sapiens
gauuucagaagccaaguuu

SEQ ID NO: 393848 - RNA, 19 nt, Homo sapiens
cgaaccaucucaauguaag

SEQ ID NO: 393849 - RNA, 19 nt, Homo sapiens
gacuggcaauuacgugaaa

SEQ ID NO: 393850 - RNA, 19 nt, Homo sapiens
gugaaugcauaccaucuuc

SEQ ID NO: 393851 - RNA, 19 nt, Homo sapiens
ccacugaaacgagcaacua

SEQ ID NO: 393852 - RNA, 19 nt, Homo sapiens
ccacgaguaagauauuauu

SEQ ID NO: 393853 - RNA, 19 nt, Homo sapiens
caugaaugguuuaaacaag

SEQ ID NO: 393854 - RNA, 19 nt, Homo sapiens
cgccgaagauggcugagaa

SEQ ID NO: 393855 - RNA, 19 nt, Homo sapiens
aaacagcuguaacuaacuc

SEQ ID NO: 393856 - RNA, 19 nt, Homo sapiens
agacuguggucauguaaca

SEQ ID NO: 393857 - RNA, 19 nt, Homo sapiens
gggugaagaucggacacua

SEQ ID NO: 393858 - RNA, 19 nt, Homo sapiens
ccauaaaguggcaguuaaa

SEQ ID NO: 393859 - RNA, 19 nt, Homo sapiens
uguaacagguaaccacaau

SEQ ID NO: 393860 - RNA, 19 nt, Homo sapiens
cuaaauuucaguaggcuuu

SEQ ID NO: 393861 - RNA, 19 nt, Homo sapiens
gaagaaaacugacuuugaa

SEQ ID NO: 393862 - RNA, 19 nt, Homo sapiens
ggaacuaaauacaguguug

SEQ ID NO: 393863 - RNA, 19 nt, Homo sapiens
guacauugcucauuucaca

SEQ ID NO: 393864 - RNA, 19 nt, Homo sapiens
aaaccuacauucucgauuu

SEQ ID NO: 393865 - RNA, 19 nt, Homo sapiens
cauaauaggugacaguguu

SEQ ID NO: 393866 - RNA, 19 nt, Homo sapiens
guacgucaccaccuuguua

SEQ ID NO: 393867 - RNA, 19 nt, Homo sapiens
ugaaaggaauguagaacuu

SEQ ID NO: 393868 - RNA, 19 nt, Homo sapiens
ggacugaggccacacauca

SEQ ID NO: 393869 - RNA, 19 nt, Homo sapiens
gaagcuuucugauuucuag

SEQ ID NO: 393870 - RNA, 19 nt, Homo sapiens
gacuguacauugcucauuu

SEQ ID NO: 393871 - RNA, 19 nt, Homo sapiens
gaaagugucgguuuaucuu

SEQ ID NO: 393872 - RNA, 19 nt, Homo sapiens
ccacagauguacccacuag

SEQ ID NO: 393873 - RNA, 19 nt, Homo sapiens
ugucugagcuguccaguuc

SEQ ID NO: 393874 - RNA, 19 nt, Homo sapiens
ggaagugaaugauaaagcu

SEQ ID NO: 393875 - RNA, 19 nt, Homo sapiens
gaucuggaagugaaugaua

SEQ ID NO: 393876 - RNA, 19 nt, Homo sapiens
gaauuacugucaccuugau

SEQ ID NO: 393877 - RNA, 19 nt, Homo sapiens
gauggacaaguuucaauaa

SEQ ID NO: 393878 - RNA, 19 nt, Homo sapiens
gcucagcaauaaucuguuc

SEQ ID NO: 393879 - RNA, 19 nt, Homo sapiens
ggucuugccuguccuucaa

SEQ ID NO: 393880 - RNA, 19 nt, Homo sapiens
aaaggaauguagaacuuga

SEQ ID NO: 393881 - RNA, 19 nt, Homo sapiens
gagagcaucaguacaaguu

SEQ ID NO: 393882 - RNA, 19 nt, Homo sapiens
gaaaggaauguagaacuug

SEQ ID NO: 393883 - RNA, 19 nt, Homo sapiens
ggaggugucauuucuauag

SEQ ID NO: 393884 - RNA, 19 nt, Homo sapiens
uaaauacaguguuggucuu

SEQ ID NO: 393885 - RNA, 19 nt, Homo sapiens
ccagggaggugucauuucu

SEQ ID NO: 393886 - RNA, 19 nt, Homo sapiens
ccaaucacgucaugcugaa

SEQ ID NO: 393887 - RNA, 19 nt, Homo sapiens
ggaaggagagcaucaguac

SEQ ID NO: 393888 - RNA, 19 nt, Homo sapiens
gaggcugggugcaguucua

SEQ ID NO: 393889 - RNA, 19 nt, Homo sapiens
gggagucgccacagaugua

SEQ ID NO: 393890 - RNA, 19 nt, Homo sapiens
ucaaccugcugccggauuu

SEQ ID NO: 393891 - RNA, 19 nt, Homo sapiens
gaggugucauuucuauaga

SEQ ID NO: 393892 - RNA, 19 nt, Homo sapiens
gcuaacuccuuugccagua

SEQ ID NO: 393893 - RNA, 19 nt, Homo sapiens
aaugaaugcuaacuccuuu

SEQ ID NO: 393894 - RNA, 19 nt, Homo sapiens
agaaguacgucaccaccuu

SEQ ID NO: 393895 - RNA, 19 nt, Homo sapiens
cgaggaagcgguugggaaa

SEQ ID NO: 393896 - RNA, 19 nt, Homo sapiens
ggaaagugucgguuuaucu

SEQ ID NO: 393897 - RNA, 19 nt, Homo sapiens
uauacgcgcugucuaucaa

SEQ ID NO: 393898 - RNA, 19 nt, Homo sapiens
uaacuccuuugccaguaaa

SEQ ID NO: 393899 - RNA, 19 nt, Homo sapiens
cagaagacauuucauaccu

SEQ ID NO: 393900 - RNA, 19 nt, Homo sapiens
cagaagccacaauaacuuu

SEQ ID NO: 393901 - RNA, 19 nt, Homo sapiens
cuaacuccuuugccaguaa

SEQ ID NO: 393902 - RNA, 19 nt, Homo sapiens
gagcaucaguacaaguucu

SEQ ID NO: 393903 - RNA, 19 nt, Homo sapiens
uugggaaagugucgguuua

SEQ ID NO: 393904 - RNA, 19 nt, Homo sapiens
uaagucaccacgucuagaa

SEQ ID NO: 393905 - RNA, 19 nt, Homo sapiens
caacccaccgguacaagaa

SEQ ID NO: 393906 - RNA, 19 nt, Homo sapiens
guugaggccuggcuaugga

SEQ ID NO: 393907 - RNA, 19 nt, Homo sapiens
ggaagcgguugggaaagug

SEQ ID NO: 393908 - RNA, 19 nt, Homo sapiens
ccagaagccacaauaacuu

SEQ ID NO: 393909 - RNA, 19 nt, Homo sapiens
ggcccaagauccugaugga

SEQ ID NO: 393910 - RNA, 19 nt, Homo sapiens
uuacagucaugugcacuaa

SEQ ID NO: 393911 - RNA, 19 nt, Homo sapiens
caacaacuggaguaaacuu

SEQ ID NO: 393912 - RNA, 19 nt, Homo sapiens
ugauggacaaguuucaaua

SEQ ID NO: 393913 - RNA, 19 nt, Homo sapiens
gcuguugcuuauucugaaa

SEQ ID NO: 393914 - RNA, 19 nt, Homo sapiens
gggaaagugucgguuuauc

SEQ ID NO: 393915 - RNA, 19 nt, Homo sapiens
gggugcaguucuaaaccua

SEQ ID NO: 393916 - RNA, 19 nt, Homo sapiens
gcaacccaccgguacaaga

SEQ ID NO: 393917 - RNA, 19 nt, Homo sapiens
aaggagagcaucaguacaa

SEQ ID NO: 393918 - RNA, 19 nt, Homo sapiens
caguugcuguugcuuauuc

SEQ ID NO: 393919 - RNA, 19 nt, Homo sapiens
ccaacgguguuucgaugga

SEQ ID NO: 393920 - RNA, 19 nt, Homo sapiens
cuauggaacuaaauacagu

SEQ ID NO: 393921 - RNA, 19 nt, Homo sapiens
gcaguucuaaaccuacauu

SEQ ID NO: 393922 - RNA, 19 nt, Homo sapiens
ggacuguacauugcucauu

SEQ ID NO: 393923 - RNA, 19 nt, Homo sapiens
uauacaagcccauaugaag

SEQ ID NO: 393924 - RNA, 19 nt, Homo sapiens
uaacaacaucauucaagug

SEQ ID NO: 393925 - RNA, 19 nt, Homo sapiens
caagagggaauggacugua

SEQ ID NO: 393926 - RNA, 19 nt, Homo sapiens
guuauacaagcccauauga

SEQ ID NO: 393927 - RNA, 19 nt, Homo sapiens
ucaccagaagccacaauaa

SEQ ID NO: 393928 - RNA, 19 nt, Homo sapiens
ucugcccucuucccuauaa

SEQ ID NO: 393929 - RNA, 19 nt, Homo sapiens
acagucaugugcacuaagu

SEQ ID NO: 393930 - RNA, 19 nt, Homo sapiens
cagcaauaaucuguucuca

SEQ ID NO: 393931 - RNA, 19 nt, Homo sapiens
agcaugaucuggaagugaa

SEQ ID NO: 393932 - RNA, 19 nt, Homo sapiens
caaaagugcuccgaugugu

SEQ ID NO: 393933 - RNA, 19 nt, Homo sapiens
gcagcaugaucuggaagug

SEQ ID NO: 393934 - RNA, 19 nt, Homo sapiens
ugacaguguuaaccgugaa

SEQ ID NO: 393935 - RNA, 19 nt, Homo sapiens
guuaacaacaucauucaag

SEQ ID NO: 393936 - RNA, 19 nt, Homo sapiens
gcugccggauuucuccauu

SEQ ID NO: 393937 - RNA, 19 nt, Homo sapiens
agggaggugucauuucuau

SEQ ID NO: 393938 - RNA, 19 nt, Homo sapiens
gguccugcuugaagguuug

SEQ ID NO: 393939 - RNA, 19 nt, Homo sapiens
aacaacaucauucaaguga

SEQ ID NO: 393940 - RNA, 19 nt, Homo sapiens
cauaguaaccagccagcuu

SEQ ID NO: 393941 - RNA, 19 nt, Homo sapiens
ugaauuacugucaccuuga

SEQ ID NO: 393942 - RNA, 19 nt, Homo sapiens
agcggaagcucccguuaug

SEQ ID NO: 393943 - RNA, 19 nt, Homo sapiens
ggaccucugccccuaguua

SEQ ID NO: 393944 - RNA, 19 nt, Homo sapiens
acucugcccucuucccuau

SEQ ID NO: 393945 - RNA, 19 nt, Homo sapiens
guucuaaaccuacauucuc

SEQ ID NO: 393946 - RNA, 19 nt, Homo sapiens
cuccacacgugcaugcuuu

SEQ ID NO: 393947 - RNA, 19 nt, Homo sapiens
auacaagcccauaugaaga

SEQ ID NO: 393948 - RNA, 19 nt, Homo sapiens
auaauaggugacaguguua

SEQ ID NO: 393949 - RNA, 19 nt, Homo sapiens
gcuuucugauuucuagaug

SEQ ID NO: 393950 - RNA, 19 nt, Homo sapiens
cagcggaagcucccguuau

SEQ ID NO: 393951 - RNA, 19 nt, Homo sapiens
gaugagguuuuacaauugu

SEQ ID NO: 393952 - RNA, 19 nt, Homo sapiens
gaaggagagcaucaguaca

SEQ ID NO: 393953 - RNA, 19 nt, Homo sapiens
gugcaguucuaaaccuaca

SEQ ID NO: 393954 - RNA, 19 nt, Homo sapiens
gcucauuucacacucuuca

SEQ ID NO: 393955 - RNA, 19 nt, Homo sapiens
gucaccaccuuguuauaca

SEQ ID NO: 393956 - RNA, 19 nt, Homo sapiens
acacggggauuuccuguga

SEQ ID NO: 393957 - RNA, 19 nt, Homo sapiens
acaguuaacaacaucauuc

SEQ ID NO: 393958 - RNA, 19 nt, Homo sapiens
gcacaguuaacaacaucau

SEQ ID NO: 393959 - RNA, 19 nt, Homo sapiens
cggaaggagagcaucagua

SEQ ID NO: 393960 - RNA, 19 nt, Homo sapiens
aaaugaaugcuaacuccuu

SEQ ID NO: 393961 - RNA, 19 nt, Homo sapiens
guucgaugcuuuaaaguua

SEQ ID NO: 393962 - RNA, 19 nt, Homo sapiens
uaagagccauaaugacuuu

SEQ ID NO: 393963 - RNA, 19 nt, Homo sapiens
gcaaggaggucuucaucuc

SEQ ID NO: 393964 - RNA, 19 nt, Homo sapiens
gcaccaagauuccacugau

SEQ ID NO: 393965 - RNA, 19 nt, Homo sapiens
uuacuacucugcuauacaa

SEQ ID NO: 393966 - RNA, 19 nt, Homo sapiens
ugaaccaucucuaugcauu

SEQ ID NO: 393967 - RNA, 19 nt, Homo sapiens
ggaaggagcacaagaucau

SEQ ID NO: 393968 - RNA, 19 nt, Homo sapiens
ggaaaguucugagacaucu

SEQ ID NO: 393969 - RNA, 19 nt, Homo sapiens
uaucauggcagcaggauuu

SEQ ID NO: 393970 - RNA, 19 nt, Homo sapiens
gguguucgaugcuuuaaag

SEQ ID NO: 393971 - RNA, 19 nt, Homo sapiens
ccagucagcuuggcacaau

SEQ ID NO: 393972 - RNA, 19 nt, Homo sapiens
gcaccaauacaaguucuuu

SEQ ID NO: 393973 - RNA, 19 nt, Homo sapiens
caacccaucgcuacaagaa

SEQ ID NO: 393974 - RNA, 19 nt, Homo sapiens
caucagagccugugguuac

SEQ ID NO: 393975 - RNA, 19 nt, Homo sapiens
ccaagauuccacugauuaa

SEQ ID NO: 393976 - RNA, 19 nt, Homo sapiens
ucuaugcauuguccauuaa

SEQ ID NO: 393977 - RNA, 19 nt, Homo sapiens
gagccauaaugacuuuguu

SEQ ID NO: 393978 - RNA, 19 nt, Homo sapiens
caccaagauuccacugauu

SEQ ID NO: 393979 - RNA, 19 nt, Homo sapiens
gcuacaagaagaaguaugu

SEQ ID NO: 393980 - RNA, 19 nt, Homo sapiens
ccaaccauguuaugcugaa

SEQ ID NO: 393981 - RNA, 19 nt, Homo sapiens
gagagcaccaauacaaguu

SEQ ID NO: 393982 - RNA, 19 nt, Homo sapiens
ggagagcaccaauacaagu

SEQ ID NO: 393983 - RNA, 19 nt, Homo sapiens
guauguuacuacucugcua

SEQ ID NO: 393984 - RNA, 19 nt, Homo sapiens
guuauccgcuggucugaag

SEQ ID NO: 393985 - RNA, 19 nt, Homo sapiens
gaaccaucucuaugcauug

SEQ ID NO: 393986 - RNA, 19 nt, Homo sapiens
ucaagaaauguaugcguuu

SEQ ID NO: 393987 - RNA, 19 nt, Homo sapiens
uauggaaaguucugagaca

SEQ ID NO: 393988 - RNA, 19 nt, Homo sapiens
cagcuuggcacaauuaaca

SEQ ID NO: 393989 - RNA, 19 nt, Homo sapiens
ggacaguggguucaugauc

SEQ ID NO: 393990 - RNA, 19 nt, Homo sapiens
gcugaaccaucucuaugca

SEQ ID NO: 393991 - RNA, 19 nt, Homo sapiens
cucuaugcauuguccauua

SEQ ID NO: 393992 - RNA, 19 nt, Homo sapiens
gcuauacaagcccauuuga

SEQ ID NO: 393993 - RNA, 19 nt, Homo sapiens
gauggacaguggguucaug

SEQ ID NO: 393994 - RNA, 19 nt, Homo sapiens
accaagauuccacugauua

SEQ ID NO: 393995 - RNA, 19 nt, Homo sapiens
acccaucgcuacaagaaga

SEQ ID NO: 393996 - RNA, 19 nt, Homo sapiens
ucugagacaucuuguagag

SEQ ID NO: 393997 - RNA, 19 nt, Homo sapiens
ugagguguucgaugcuuua

SEQ ID NO: 393998 - RNA, 19 nt, Homo sapiens
gagcaccaauacaaguucu

SEQ ID NO: 393999 - RNA, 19 nt, Homo sapiens
ccacugauuaagagccaua

SEQ ID NO: 394000 - RNA, 19 nt, Homo sapiens
ccugagcccaaccauguua

SEQ ID NO: 394001 - RNA, 19 nt, Homo sapiens
guucugagacaucuuguag

SEQ ID NO: 394002 - RNA, 19 nt, Homo sapiens
gccuuauggucaagaaaug

SEQ ID NO: 394003 - RNA, 19 nt, Homo sapiens
aagauuccacugauuaaga

SEQ ID NO: 394004 - RNA, 19 nt, Homo sapiens
agucagcuuggcacaauua

SEQ ID NO: 394005 - RNA, 19 nt, Homo sapiens
caaguucuuuguggaugga

SEQ ID NO: 394006 - RNA, 19 nt, Homo sapiens
gggaaggagcacaagauca

SEQ ID NO: 394007 - RNA, 19 nt, Homo sapiens
gaaggagcacaagaucaug

SEQ ID NO: 394008 - RNA, 19 nt, Homo sapiens
uguaugcguuucgaucuga

SEQ ID NO: 394009 - RNA, 19 nt, Homo sapiens
aaaguucugagacaucuug

SEQ ID NO: 394010 - RNA, 19 nt, Homo sapiens
gacagugugaugguccuua

SEQ ID NO: 394011 - RNA, 19 nt, Homo sapiens
agggagagcaccaauacaa

SEQ ID NO: 394012 - RNA, 19 nt, Homo sapiens
acaagaagaaguauguuac

SEQ ID NO: 394013 - RNA, 19 nt, Homo sapiens
ugauccaugucaagaaauc

SEQ ID NO: 394014 - RNA, 19 nt, Homo sapiens
ugagggagagcaccaauac

SEQ ID NO: 394015 - RNA, 19 nt, Homo sapiens
ggccuuauggucaagaaau

SEQ ID NO: 394016 - RNA, 19 nt, Homo sapiens
caaggaggucuucaucucu

SEQ ID NO: 394017 - RNA, 19 nt, Homo sapiens
gcgcaacccaucgcuacaa

SEQ ID NO: 394018 - RNA, 19 nt, Homo sapiens
ucccugagcccaaccaugu

SEQ ID NO: 394019 - RNA, 19 nt, Homo sapiens
uuaagagccauaaugacuu

SEQ ID NO: 394020 - RNA, 19 nt, Homo sapiens
acagugugaugguccuuag

SEQ ID NO: 394021 - RNA, 19 nt, Homo sapiens
agauuccacugauuaagag

SEQ ID NO: 394022 - RNA, 19 nt, Homo sapiens
cauggcagcaggauuugga

SEQ ID NO: 394023 - RNA, 19 nt, Homo sapiens
gcaacccaucgcuacaaga

SEQ ID NO: 394024 - RNA, 19 nt, Homo sapiens
ucgaugcuuuaaaguuaga

SEQ ID NO: 394025 - RNA, 19 nt, Homo sapiens
gggagagcaccaauacaag

SEQ ID NO: 394026 - RNA, 19 nt, Homo sapiens
aaccaucucuaugcauugu

SEQ ID NO: 394027 - RNA, 19 nt, Homo sapiens
cccagggccuuauggucaa

SEQ ID NO: 394028 - RNA, 19 nt, Homo sapiens
gaacacacccugaaugaaa

SEQ ID NO: 394029 - RNA, 19 nt, Homo sapiens
ggacgagacuuccucuuga

SEQ ID NO: 394030 - RNA, 19 nt, Homo sapiens
gaacacagcccacuuggau

SEQ ID NO: 394031 - RNA, 19 nt, Homo sapiens
caaggacaacucaaacuua

SEQ ID NO: 394032 - RNA, 19 nt, Homo sapiens
gaagcagacugacuuugga

SEQ ID NO: 394033 - RNA, 19 nt, Homo sapiens
cggagaaucugcucauuga

SEQ ID NO: 394034 - RNA, 19 nt, Homo sapiens
caaccuuccuuucggagua

SEQ ID NO: 394035 - RNA, 19 nt, Homo sapiens
ccugcaagcugucaacuuu

SEQ ID NO: 394036 - RNA, 19 nt, Homo sapiens
cagaguuccuugcaucuaa

SEQ ID NO: 394037 - RNA, 19 nt, Homo sapiens
ggaagccuccgcucucuuu

SEQ ID NO: 394038 - RNA, 19 nt, Homo sapiens
gaacagaagaggccaaguc

SEQ ID NO: 394039 - RNA, 19 nt, Homo sapiens
gagcaaaggcuacaacaag

SEQ ID NO: 394040 - RNA, 19 nt, Homo sapiens
gaaccacuaugccaugaag

SEQ ID NO: 394041 - RNA, 19 nt, Homo sapiens
gcaggaagcccagauaauc

SEQ ID NO: 394042 - RNA, 19 nt, Homo sapiens
cgaguaacuuugacgacua

SEQ ID NO: 394043 - RNA, 19 nt, Homo sapiens
gagauuauccugagcaaag

SEQ ID NO: 394044 - RNA, 19 nt, Homo sapiens
gcgcuucccuucccacuuc

SEQ ID NO: 394045 - RNA, 19 nt, Homo sapiens
gcaaggaguuuucugaguu

SEQ ID NO: 394046 - RNA, 19 nt, Homo sapiens
caacucaaacuuauacaug

SEQ ID NO: 394047 - RNA, 19 nt, Homo sapiens
ggacaacucaaacuuauac

SEQ ID NO: 394048 - RNA, 19 nt, Homo sapiens
ccacuuggaucaguuugaa

SEQ ID NO: 394049 - RNA, 19 nt, Homo sapiens
gagcaggaagcccagauaa

SEQ ID NO: 394050 - RNA, 19 nt, Homo sapiens
gacgagacuuccucuugaa

SEQ ID NO: 394051 - RNA, 19 nt, Homo sapiens
gaaagucccgcucagaaca

SEQ ID NO: 394052 - RNA, 19 nt, Homo sapiens
uuaaagagaagcagacuga

SEQ ID NO: 394053 - RNA, 19 nt, Homo sapiens
gaguaacuuugacgacuau

SEQ ID NO: 394054 - RNA, 19 nt, Homo sapiens
ccaugaagauccucgacaa

SEQ ID NO: 394055 - RNA, 19 nt, Homo sapiens
aaggacaacucaaacuuau

SEQ ID NO: 394056 - RNA, 19 nt, Homo sapiens
ugaagauccucgacaaaca

SEQ ID NO: 394057 - RNA, 19 nt, Homo sapiens
ggaauccucucugccaauc

SEQ ID NO: 394058 - RNA, 19 nt, Homo sapiens
gaaauccgggucuccauca

SEQ ID NO: 394059 - RNA, 19 nt, Homo sapiens
ggucaacgauaucaagaac

SEQ ID NO: 394060 - RNA, 19 nt, Homo sapiens
ggagcaggaagcccagaua

SEQ ID NO: 394061 - RNA, 19 nt, Homo sapiens
ugacgacuaugaggaagaa

SEQ ID NO: 394062 - RNA, 19 nt, Homo sapiens
gggauacgaguaacuuuga

SEQ ID NO: 394063 - RNA, 19 nt, Homo sapiens
ccaaagccaaagaagauuu

SEQ ID NO: 394064 - RNA, 19 nt, Homo sapiens
guucuuaucuaugaaaugg

SEQ ID NO: 394065 - RNA, 19 nt, Homo sapiens
caggagagcgugaaagaau

SEQ ID NO: 394066 - RNA, 19 nt, Homo sapiens
gaagguggugaaacugaaa

SEQ ID NO: 394067 - RNA, 19 nt, Homo sapiens
gggaaccacuaugccauga

SEQ ID NO: 394068 - RNA, 19 nt, Homo sapiens
ccauccagaucuaugagaa

SEQ ID NO: 394069 - RNA, 19 nt, Homo sapiens
gggaggggcugccuguuuu

SEQ ID NO: 394070 - RNA, 19 nt, Homo sapiens
ugccacaacugacuggauu

SEQ ID NO: 394071 - RNA, 19 nt, Homo sapiens
ucaacgauaucaagaacca

SEQ ID NO: 394072 - RNA, 19 nt, Homo sapiens
ggagagcgugaaagaauuc

SEQ ID NO: 394073 - RNA, 19 nt, Homo sapiens
guggguugcuugcuagaau

SEQ ID NO: 394074 - RNA, 19 nt, Homo sapiens
gaaguguggcaaggaguuu

SEQ ID NO: 394075 - RNA, 19 nt, Homo sapiens
gggugaugcuggugaaaca

SEQ ID NO: 394076 - RNA, 19 nt, Homo sapiens
gaucgaacacacccugaau

SEQ ID NO: 394077 - RNA, 19 nt, Homo sapiens
gcuaagggcaaaugaacga

SEQ ID NO: 394078 - RNA, 19 nt, Homo sapiens
agaagguggugaaacugaa

SEQ ID NO: 394079 - RNA, 19 nt, Homo sapiens
ucagaacacagcccacuug

SEQ ID NO: 394080 - RNA, 19 nt, Homo sapiens
caaggaguuuucugaguuu

SEQ ID NO: 394081 - RNA, 19 nt, Homo sapiens
cgacuaugaggaagaagaa

SEQ ID NO: 394082 - RNA, 19 nt, Homo sapiens
ggaaagucccgcucagaac

SEQ ID NO: 394083 - RNA, 19 nt, Homo sapiens
ucaaggacaacucaaacuu

SEQ ID NO: 394084 - RNA, 19 nt, Homo sapiens
uuucucaacuccagucaga

SEQ ID NO: 394085 - RNA, 19 nt, Homo sapiens
cagaagguggugaaacuga

SEQ ID NO: 394086 - RNA, 19 nt, Homo sapiens
uuuauucuccgcuagauuu

SEQ ID NO: 394087 - RNA, 19 nt, Homo sapiens
gcaggagagcgugaaagaa

SEQ ID NO: 394088 - RNA, 19 nt, Homo sapiens
aggagagcgugaaagaauu

SEQ ID NO: 394089 - RNA, 19 nt, Homo sapiens
ucgaacacacccugaauga

SEQ ID NO: 394090 - RNA, 19 nt, Homo sapiens
gaaacugaaacagaucgaa

SEQ ID NO: 394091 - RNA, 19 nt, Homo sapiens
gaagauccucgacaaacag

SEQ ID NO: 394092 - RNA, 19 nt, Homo sapiens
gagacuuccucuugaacag

SEQ ID NO: 394093 - RNA, 19 nt, Homo sapiens
caggaagcccagauaauca

SEQ ID NO: 394094 - RNA, 19 nt, Homo sapiens
ggugacagacuucgguuuc

SEQ ID NO: 394095 - RNA, 19 nt, Homo sapiens
gggacaggguauggaaaga

SEQ ID NO: 394096 - RNA, 19 nt, Homo sapiens
aacagaagguggugaaacu

SEQ ID NO: 394097 - RNA, 19 nt, Homo sapiens
aagagaagcagacugacuu

SEQ ID NO: 394098 - RNA, 19 nt, Homo sapiens
gauaaucagagggacagaa

SEQ ID NO: 394099 - RNA, 19 nt, Homo sapiens
gaucucaccaagcgcuuug

SEQ ID NO: 394100 - RNA, 19 nt, Homo sapiens
ggagaccgggaaccacuau

SEQ ID NO: 394101 - RNA, 19 nt, Homo sapiens
guaacuuugacgacuauga

SEQ ID NO: 394102 - RNA, 19 nt, Homo sapiens
ugacuggauugccaucuac

SEQ ID NO: 394103 - RNA, 19 nt, Homo sapiens
uugggaaccucaagaaugg

SEQ ID NO: 394104 - RNA, 19 nt, Homo sapiens
acauucaggugacagacuu

SEQ ID NO: 394105 - RNA, 19 nt, Homo sapiens
acacagcccacuuggauca

SEQ ID NO: 394106 - RNA, 19 nt, Homo sapiens
ggaucaguuugaacgaauc

SEQ ID NO: 394107 - RNA, 19 nt, Homo sapiens
uggugaaacugaaacagau

SEQ ID NO: 394108 - RNA, 19 nt, Homo sapiens
cugacuggauugccaucua

SEQ ID NO: 394109 - RNA, 19 nt, Homo sapiens
acaaacagaagguggugaa

SEQ ID NO: 394110 - RNA, 19 nt, Homo sapiens
guggugaaacugaaacaga

SEQ ID NO: 394111 - RNA, 19 nt, Homo sapiens
agaauggggucaacgauau

SEQ ID NO: 394112 - RNA, 19 nt, Homo sapiens
caugaagauccucgacaaa

SEQ ID NO: 394113 - RNA, 19 nt, Homo sapiens
ccccaacuccuuaauuuua

SEQ ID NO: 394114 - RNA, 19 nt, Homo sapiens
gagaagcagacugacuuug

SEQ ID NO: 394115 - RNA, 19 nt, Homo sapiens
aagaggggcucacgcuuaa

SEQ ID NO: 394116 - RNA, 19 nt, Homo sapiens
auaaucagagggacagaaa

SEQ ID NO: 394117 - RNA, 19 nt, Homo sapiens
ccagaucguccugaccuuu

SEQ ID NO: 394118 - RNA, 19 nt, Homo sapiens
uggaucaguuugaacgaau

SEQ ID NO: 394119 - RNA, 19 nt, Homo sapiens
aaagaggggcucacgcuua

SEQ ID NO: 394120 - RNA, 19 nt, Homo sapiens
ccagggacaggguauggaa

SEQ ID NO: 394121 - RNA, 19 nt, Homo sapiens
gugggaggguuggauugaa

SEQ ID NO: 394122 - RNA, 19 nt, Homo sapiens
gaccagcagggcuacauuc

SEQ ID NO: 394123 - RNA, 19 nt, Homo sapiens
ggaagcccagauaaucaga

SEQ ID NO: 394124 - RNA, 19 nt, Homo sapiens
ccagaguuccuugcaucua

SEQ ID NO: 394125 - RNA, 19 nt, Homo sapiens
guccugaccuuugaguauc

SEQ ID NO: 394126 - RNA, 19 nt, Homo sapiens
cagaucguccugaccuuug

SEQ ID NO: 394127 - RNA, 19 nt, Homo sapiens
ggacaggguauggaaagag

SEQ ID NO: 394128 - RNA, 19 nt, Homo sapiens
cagauuggauugcuauuua

SEQ ID NO: 394129 - RNA, 19 nt, Homo sapiens
gagcauacuuugaaugaga

SEQ ID NO: 394130 - RNA, 19 nt, Homo sapiens
gaagagucauguugguaaa

SEQ ID NO: 394131 - RNA, 19 nt, Homo sapiens
guacuagaccacuuucuua

SEQ ID NO: 394132 - RNA, 19 nt, Homo sapiens
caacacacgagaagaguua

SEQ ID NO: 394133 - RNA, 19 nt, Homo sapiens
cagauucucucacuuggua

SEQ ID NO: 394134 - RNA, 19 nt, Homo sapiens
caacugacuuaacaacauu

SEQ ID NO: 394135 - RNA, 19 nt, Homo sapiens
caacuuugaugacuaugaa

SEQ ID NO: 394136 - RNA, 19 nt, Homo sapiens
ggaaagggaacaaagugua

SEQ ID NO: 394137 - RNA, 19 nt, Homo sapiens
gaagauauccgugucucua

SEQ ID NO: 394138 - RNA, 19 nt, Homo sapiens
aggcagaacuuggacauua

SEQ ID NO: 394139 - RNA, 19 nt, Homo sapiens
gcagaagguuguuaaacug

SEQ ID NO: 394140 - RNA, 19 nt, Homo sapiens
gaagugaccagccugugua

SEQ ID NO: 394141 - RNA, 19 nt, Homo sapiens
ggaagagucauguugguaa

SEQ ID NO: 394142 - RNA, 19 nt, Homo sapiens
ugaaaccuuugaagacaua

SEQ ID NO: 394143 - RNA, 19 nt, Homo sapiens
ggagauaccagcaacuuug

SEQ ID NO: 394144 - RNA, 19 nt, Homo sapiens
gagaauccaacucagaaua

SEQ ID NO: 394145 - RNA, 19 nt, Homo sapiens
gaauaaugccggacuugaa

SEQ ID NO: 394146 - RNA, 19 nt, Homo sapiens
gagauguucuuucuaccaa

SEQ ID NO: 394147 - RNA, 19 nt, Homo sapiens
cuaauaguccucaucauaa

SEQ ID NO: 394148 - RNA, 19 nt, Homo sapiens
gaaagggaacaaaguguau

SEQ ID NO: 394149 - RNA, 19 nt, Homo sapiens
gcagguaggucauuaacac

SEQ ID NO: 394150 - RNA, 19 nt, Homo sapiens
cagcauuucuguagguauu

SEQ ID NO: 394151 - RNA, 19 nt, Homo sapiens
ucuaaacagugcuccauuu

SEQ ID NO: 394152 - RNA, 19 nt, Homo sapiens
gaagcuccauucauaccaa

SEQ ID NO: 394153 - RNA, 19 nt, Homo sapiens
ggucacagacuuuggguuu

SEQ ID NO: 394154 - RNA, 19 nt, Homo sapiens
gaaguuguuuccagcuaau

SEQ ID NO: 394155 - RNA, 19 nt, Homo sapiens
uaggagugcuaaucuauga

SEQ ID NO: 394156 - RNA, 19 nt, Homo sapiens
ucuaauaguccucaucaua

SEQ ID NO: 394157 - RNA, 19 nt, Homo sapiens
gaacaguauuaugccauga

SEQ ID NO: 394158 - RNA, 19 nt, Homo sapiens
ggugaaaccuuugaagaca

SEQ ID NO: 394159 - RNA, 19 nt, Homo sapiens
ucaagcugaucuuaaugua

SEQ ID NO: 394160 - RNA, 19 nt, Homo sapiens
cagcaacuuugaugacuau

SEQ ID NO: 394161 - RNA, 19 nt, Homo sapiens
uaaagaauggugucaguga

SEQ ID NO: 394162 - RNA, 19 nt, Homo sapiens
gcugucagguggaaauuuc

SEQ ID NO: 394163 - RNA, 19 nt, Homo sapiens
uauaaaaccugccacaauu

SEQ ID NO: 394164 - RNA, 19 nt, Homo sapiens
gauaaguguugcuuucagu

SEQ ID NO: 394165 - RNA, 19 nt, Homo sapiens
ccaacugacuuaacaacau

SEQ ID NO: 394166 - RNA, 19 nt, Homo sapiens
gaauccaacucagaauaau

SEQ ID NO: 394167 - RNA, 19 nt, Homo sapiens
uaagaagaauuggaagguu

SEQ ID NO: 394168 - RNA, 19 nt, Homo sapiens
cuauaugucuuucgguuau

SEQ ID NO: 394169 - RNA, 19 nt, Homo sapiens
cuagaccacuuucuuacuu

SEQ ID NO: 394170 - RNA, 19 nt, Homo sapiens
ucacaucuaagaagaauug

SEQ ID NO: 394171 - RNA, 19 nt, Homo sapiens
gauauccgugucucuauaa

SEQ ID NO: 394172 - RNA, 19 nt, Homo sapiens
gaccaaccaauucagauuu

SEQ ID NO: 394173 - RNA, 19 nt, Homo sapiens
acugguccaucuauauuua

SEQ ID NO: 394174 - RNA, 19 nt, Homo sapiens
uggcuuaacccacuuguuu

SEQ ID NO: 394175 - RNA, 19 nt, Homo sapiens
cauaauuucuaaccucugu

SEQ ID NO: 394176 - RNA, 19 nt, Homo sapiens
uggaaacaauauagaggua

SEQ ID NO: 394177 - RNA, 19 nt, Homo sapiens
agauauccgugucucuaua

SEQ ID NO: 394178 - RNA, 19 nt, Homo sapiens
ggcagaacuuggacauuau

SEQ ID NO: 394179 - RNA, 19 nt, Homo sapiens
aaacagugcuccauuuuau

SEQ ID NO: 394180 - RNA, 19 nt, Homo sapiens
gcugagaccguccuuguug

SEQ ID NO: 394181 - RNA, 19 nt, Homo sapiens
ggagugcuaaucuaugaaa

SEQ ID NO: 394182 - RNA, 19 nt, Homo sapiens
gacuaacuuucuuggaauu

SEQ ID NO: 394183 - RNA, 19 nt, Homo sapiens
ugaugacuaugaagaagaa

SEQ ID NO: 394184 - RNA, 19 nt, Homo sapiens
caucuaagaagaauuggaa

SEQ ID NO: 394185 - RNA, 19 nt, Homo sapiens
gauaagcagaagguuguua

SEQ ID NO: 394186 - RNA, 19 nt, Homo sapiens
ggagagcgugaaagaguuu

SEQ ID NO: 394187 - RNA, 19 nt, Homo sapiens
cacauuuaguucaguguuu

SEQ ID NO: 394188 - RNA, 19 nt, Homo sapiens
cagcuagacccagaaauuu

SEQ ID NO: 394189 - RNA, 19 nt, Homo sapiens
ugagugaggucuuuauugc

SEQ ID NO: 394190 - RNA, 19 nt, Homo sapiens
ccagcaacuuugaugacua

SEQ ID NO: 394191 - RNA, 19 nt, Homo sapiens
ugaaauggcagcuggcuau

SEQ ID NO: 394192 - RNA, 19 nt, Homo sapiens
ucagcaagggcuacaauaa

SEQ ID NO: 394193 - RNA, 19 nt, Homo sapiens
gggagaauccaacucagaa

SEQ ID NO: 394194 - RNA, 19 nt, Homo sapiens
guugagaauccauggcuua

SEQ ID NO: 394195 - RNA, 19 nt, Homo sapiens
guucaguguuuguugagaa

SEQ ID NO: 394196 - RNA, 19 nt, Homo sapiens
guugguauuugagagguua

SEQ ID NO: 394197 - RNA, 19 nt, Homo sapiens
agaaguuguuuccagcuaa

SEQ ID NO: 394198 - RNA, 19 nt, Homo sapiens
gaaggauaaguguugcuuu

SEQ ID NO: 394199 - RNA, 19 nt, Homo sapiens
gagcugagaccguccuugu

SEQ ID NO: 394200 - RNA, 19 nt, Homo sapiens
ccauucauaccaaaguuua

SEQ ID NO: 394201 - RNA, 19 nt, Homo sapiens
accaaccaauucagauuua

SEQ ID NO: 394202 - RNA, 19 nt, Homo sapiens
gaauuggaagguucaguga

SEQ ID NO: 394203 - RNA, 19 nt, Homo sapiens
gaagguuguuaaacugaag

SEQ ID NO: 394204 - RNA, 19 nt, Homo sapiens
ucauuaacaccacuucuuu

SEQ ID NO: 394205 - RNA, 19 nt, Homo sapiens
uuaccuaguuccuucauuc

SEQ ID NO: 394206 - RNA, 19 nt, Homo sapiens
uuaaagaggaacaagauga

SEQ ID NO: 394207 - RNA, 19 nt, Homo sapiens
gagauaccagcaacuuuga

SEQ ID NO: 394208 - RNA, 19 nt, Homo sapiens
gauguucuuucuaccaauc

SEQ ID NO: 394209 - RNA, 19 nt, Homo sapiens
ugucugagauguucuuucu

SEQ ID NO: 394210 - RNA, 19 nt, Homo sapiens
gagaauccauggcuuaacc

SEQ ID NO: 394211 - RNA, 19 nt, Homo sapiens
ucaugcagauacaauguug

SEQ ID NO: 394212 - RNA, 19 nt, Homo sapiens
gaucgaucaugcagauaca

SEQ ID NO: 394213 - RNA, 19 nt, Homo sapiens
gaggaaagggaacaaagug

SEQ ID NO: 394214 - RNA, 19 nt, Homo sapiens
agacuaacuuucuuggaau

SEQ ID NO: 394215 - RNA, 19 nt, Homo sapiens
agaauccaacucagaauaa

SEQ ID NO: 394216 - RNA, 19 nt, Homo sapiens
gcagaccaaccaauucaga

SEQ ID NO: 394217 - RNA, 19 nt, Homo sapiens
uagagcauacuuugaauga

SEQ ID NO: 394218 - RNA, 19 nt, Homo sapiens
ucacugguccaucuauauu

SEQ ID NO: 394219 - RNA, 19 nt, Homo sapiens
guggaaauuucaagcacuu

SEQ ID NO: 394220 - RNA, 19 nt, Homo sapiens
ucuaaccucuguucucuca

SEQ ID NO: 394221 - RNA, 19 nt, Homo sapiens
aaggauaaguguugcuuuc

SEQ ID NO: 394222 - RNA, 19 nt, Homo sapiens
ugaagcaguuaccuaguuc

SEQ ID NO: 394223 - RNA, 19 nt, Homo sapiens
gaauggugucagugauaua

SEQ ID NO: 394224 - RNA, 19 nt, Homo sapiens
gugcuaaucuaugaaaugg

SEQ ID NO: 394225 - RNA, 19 nt, Homo sapiens
guucuaugcagcucagaua

SEQ ID NO: 394226 - RNA, 19 nt, Homo sapiens
cuaccaaucuauaugucuu

SEQ ID NO: 394227 - RNA, 19 nt, Homo sapiens
aaaccugucugagauguuc

SEQ ID NO: 394228 - RNA, 19 nt, Homo sapiens
gcaggaagcccagauauuu

SEQ ID NO: 394229 - RNA, 19 nt, Homo sapiens
gaacaggcaccacuuacua

SEQ ID NO: 394230 - RNA, 19 nt, Homo sapiens
cagaguuccuuguaucuaa

SEQ ID NO: 394231 - RNA, 19 nt, Homo sapiens
uaagagaggaugaaugaaa

SEQ ID NO: 394232 - RNA, 19 nt, Homo sapiens
gagauuuccucuacagaug

SEQ ID NO: 394233 - RNA, 19 nt, Homo sapiens
ccaugaagauccucaacaa

SEQ ID NO: 394234 - RNA, 19 nt, Homo sapiens
ccucugugcuucucucuuu

SEQ ID NO: 394235 - RNA, 19 nt, Homo sapiens
gagcaaaggcuacaacaag

SEQ ID NO: 394236 - RNA, 19 nt, Homo sapiens
ggacaacuccuaccuguac

SEQ ID NO: 394237 - RNA, 19 nt, Homo sapiens
ccaguaacuuugacgacua

SEQ ID NO: 394238 - RNA, 19 nt, Homo sapiens
ccagauauuuggaggaaca

SEQ ID NO: 394239 - RNA, 19 nt, Homo sapiens
gaagugugccaaggaguuu

SEQ ID NO: 394240 - RNA, 19 nt, Homo sapiens
gcccagauauuuggaggaa

SEQ ID NO: 394241 - RNA, 19 nt, Homo sapiens
caccuacccuuuggaguaa

SEQ ID NO: 394242 - RNA, 19 nt, Homo sapiens
acaccuacccuuuggagua

SEQ ID NO: 394243 - RNA, 19 nt, Homo sapiens
ggccaggucuugcuguugu

SEQ ID NO: 394244 - RNA, 19 nt, Homo sapiens
acuaagagaggaugaauga

SEQ ID NO: 394245 - RNA, 19 nt, Homo sapiens
ggagcaggaagcccagaua

SEQ ID NO: 394246 - RNA, 19 nt, Homo sapiens
ggagauuuccucuacagau

SEQ ID NO: 394247 - RNA, 19 nt, Homo sapiens
ggaucgccaucuaugagaa

SEQ ID NO: 394248 - RNA, 19 nt, Homo sapiens
ccagcuggaucgccaucua

SEQ ID NO: 394249 - RNA, 19 nt, Homo sapiens
gaaggagagagguuuagug

SEQ ID NO: 394250 - RNA, 19 nt, Homo sapiens
gagaucauccugagcaaag

SEQ ID NO: 394251 - RNA, 19 nt, Homo sapiens
aagcuccaguucuccuuua

SEQ ID NO: 394252 - RNA, 19 nt, Homo sapiens
agaagguggugaagaugaa

SEQ ID NO: 394253 - RNA, 19 nt, Homo sapiens
ugaagauccucaacaagca

SEQ ID NO: 394254 - RNA, 19 nt, Homo sapiens
gagcaggaagcccagauau

SEQ ID NO: 394255 - RNA, 19 nt, Homo sapiens
gaagcaggucgagcacaua

SEQ ID NO: 394256 - RNA, 19 nt, Homo sapiens
gagguuuagugccauguuc

SEQ ID NO: 394257 - RNA, 19 nt, Homo sapiens
ucaccaagcgcuucggaaa

SEQ ID NO: 394258 - RNA, 19 nt, Homo sapiens
ccaaggaguuuucugaguu

SEQ ID NO: 394259 - RNA, 19 nt, Homo sapiens
aaagaggggcucaaacuua

SEQ ID NO: 394260 - RNA, 19 nt, Homo sapiens
ccauccagaucuacgagaa

SEQ ID NO: 394261 - RNA, 19 nt, Homo sapiens
ugaagcaggucgagcacau

SEQ ID NO: 394262 - RNA, 19 nt, Homo sapiens
cauguucagugggcuguuu

SEQ ID NO: 394263 - RNA, 19 nt, Homo sapiens
gauauuuggaggaacagaa

SEQ ID NO: 394264 - RNA, 19 nt, Homo sapiens
caaggaguuuucugaguuu

SEQ ID NO: 394265 - RNA, 19 nt, Homo sapiens
gcuguuugcuagaauaaaa

SEQ ID NO: 394266 - RNA, 19 nt, Homo sapiens
gaguuucucagcucuauuc

SEQ ID NO: 394267 - RNA, 19 nt, Homo sapiens
gaugggaggguuggauuga

SEQ ID NO: 394268 - RNA, 19 nt, Homo sapiens
cuccggaucuccaucaaug

SEQ ID NO: 394269 - RNA, 19 nt, Homo sapiens
cagaagguggugaagauga

SEQ ID NO: 394270 - RNA, 19 nt, Homo sapiens
caggaagcccagauauuug

SEQ ID NO: 394271 - RNA, 19 nt, Homo sapiens
aagaggggcucaaacuuaa

SEQ ID NO: 394272 - RNA, 19 nt, Homo sapiens
ccuuguaucuaauuucauc

SEQ ID NO: 394273 - RNA, 19 nt, Homo sapiens
gggaugccaguaacuuuga

SEQ ID NO: 394274 - RNA, 19 nt, Homo sapiens
gaacgggguuggcgacauc

SEQ ID NO: 394275 - RNA, 19 nt, Homo sapiens
gcacauacugaacgagaag

SEQ ID NO: 394276 - RNA, 19 nt, Homo sapiens
gcaggucgagcacauacug

SEQ ID NO: 394277 - RNA, 19 nt, Homo sapiens
cagcgcgucggaagguuua

SEQ ID NO: 394278 - RNA, 19 nt, Homo sapiens
agcagaagguggugaagau

SEQ ID NO: 394279 - RNA, 19 nt, Homo sapiens
gaaagaggggcucaaacuu

SEQ ID NO: 394280 - RNA, 19 nt, Homo sapiens
aagcacaccuacccuuugg

SEQ ID NO: 394281 - RNA, 19 nt, Homo sapiens
gccaggucuugcuguugua

SEQ ID NO: 394282 - RNA, 19 nt, Homo sapiens
gggaugggaggguuggauu

SEQ ID NO: 394283 - RNA, 19 nt, Homo sapiens
cagcucggaucaguucgaa

SEQ ID NO: 394284 - RNA, 19 nt, Homo sapiens
gggcuguuugcuagaauaa

SEQ ID NO: 394285 - RNA, 19 nt, Homo sapiens
ggaaggagagagguuuagu

SEQ ID NO: 394286 - RNA, 19 nt, Homo sapiens
aagagaggaugaaugaaaa

SEQ ID NO: 394287 - RNA, 19 nt, Homo sapiens
ccagaguuccuuguaucua

SEQ ID NO: 394288 - RNA, 19 nt, Homo sapiens
gcagaagguggugaagaug

SEQ ID NO: 394289 - RNA, 19 nt, Homo sapiens
ggaugggaggguuggauug

SEQ ID NO: 394290 - RNA, 19 nt, Homo sapiens
ccaaagccagaggagauuu

SEQ ID NO: 394291 - RNA, 19 nt, Homo sapiens
caagcuccaguucuccuuu

SEQ ID NO: 394292 - RNA, 19 nt, Homo sapiens
ggaaagaggggcucaaacu

SEQ ID NO: 394293 - RNA, 19 nt, Homo sapiens
gagcuccggaucuccauca

SEQ ID NO: 394294 - RNA, 19 nt, Homo sapiens
caaagccagaggagauuuc

SEQ ID NO: 394295 - RNA, 19 nt, Homo sapiens
gcuggaucgccaucuauga

SEQ ID NO: 394296 - RNA, 19 nt, Homo sapiens
ugggcuguuugcuagaaua

SEQ ID NO: 394297 - RNA, 19 nt, Homo sapiens
caggccaggucuugcuguu

SEQ ID NO: 394298 - RNA, 19 nt, Homo sapiens
agaguuccuuguaucuaau

SEQ ID NO: 394299 - RNA, 19 nt, Homo sapiens
agaagugugccaaggaguu

SEQ ID NO: 394300 - RNA, 19 nt, Homo sapiens
gaggaagagcuccggaucu

SEQ ID NO: 394301 - RNA, 19 nt, Homo sapiens
gaccagcccauccagaucu

SEQ ID NO: 394302 - RNA, 19 nt, Homo sapiens
ccacuacgccaugaagauc

SEQ ID NO: 394303 - RNA, 19 nt, Homo sapiens
gccaaagccagaggagauu

SEQ ID NO: 394304 - RNA, 19 nt, Homo sapiens
aggagagcgugaacgaguu

SEQ ID NO: 394305 - RNA, 19 nt, Homo sapiens
aacaggcaccacuuacuaa

SEQ ID NO: 394306 - RNA, 19 nt, Homo sapiens
aggaagagcuccggaucuc

SEQ ID NO: 394307 - RNA, 19 nt, Homo sapiens
gauguucucccgccuacag

SEQ ID NO: 394308 - RNA, 19 nt, Homo sapiens
ggugcgguuucccuccaaa

SEQ ID NO: 394309 - RNA, 19 nt, Homo sapiens
ugggaaggagagagguuua

SEQ ID NO: 394310 - RNA, 19 nt, Homo sapiens
ggaguuuucugaguuuuag

SEQ ID NO: 394311 - RNA, 19 nt, Homo sapiens
caguaacuuugacgacuac

SEQ ID NO: 394312 - RNA, 19 nt, Homo sapiens
gaacuucucccacauaaua

SEQ ID NO: 394313 - RNA, 19 nt, Homo sapiens
gaaaucauguggcuugugu

SEQ ID NO: 394314 - RNA, 19 nt, Homo sapiens
gaagaaaugcaauacauga

SEQ ID NO: 394315 - RNA, 19 nt, Homo sapiens
gaaauuagcaggucuugau

SEQ ID NO: 394316 - RNA, 19 nt, Homo sapiens
ggaaucaaauuucucacaa

SEQ ID NO: 394317 - RNA, 19 nt, Homo sapiens
gaucuaguauagucaauga

SEQ ID NO: 394318 - RNA, 19 nt, Homo sapiens
acaagaagguuuccaauca

SEQ ID NO: 394319 - RNA, 19 nt, Homo sapiens
gaaacuacauaugcagauu

SEQ ID NO: 394320 - RNA, 19 nt, Homo sapiens
guaaagcccugguguugug

SEQ ID NO: 394321 - RNA, 19 nt, Homo sapiens
gacagaaggugaagaagau

SEQ ID NO: 394322 - RNA, 19 nt, Homo sapiens
gcaaugaauuagccuugaa

SEQ ID NO: 394323 - RNA, 19 nt, Homo sapiens
gcaaucauguggacaccaa

SEQ ID NO: 394324 - RNA, 19 nt, Homo sapiens
ugaagaagaugcacaacga

SEQ ID NO: 394325 - RNA, 19 nt, Homo sapiens
gauggccucugcuguguuu

SEQ ID NO: 394326 - RNA, 19 nt, Homo sapiens
ggaagaacagguagaagaa

SEQ ID NO: 394327 - RNA, 19 nt, Homo sapiens
aaagagaucuaguauaguc

SEQ ID NO: 394328 - RNA, 19 nt, Homo sapiens
aaaguaaucuccuugcaau

SEQ ID NO: 394329 - RNA, 19 nt, Homo sapiens
agacuccauugcuuuauua

SEQ ID NO: 394330 - RNA, 19 nt, Homo sapiens
gaugaugauucuuccugua

SEQ ID NO: 394331 - RNA, 19 nt, Homo sapiens
gaaaguaaucuccuugcaa

SEQ ID NO: 394332 - RNA, 19 nt, Homo sapiens
caucaagacuccauugcuu

SEQ ID NO: 394333 - RNA, 19 nt, Homo sapiens
gauuaagucuaacagauuc

SEQ ID NO: 394334 - RNA, 19 nt, Homo sapiens
gacaacuuaucuucacuaa

SEQ ID NO: 394335 - RNA, 19 nt, Homo sapiens
aaagaaagauccagaaagc

SEQ ID NO: 394336 - RNA, 19 nt, Homo sapiens
gcuccgaccuagaugauga

SEQ ID NO: 394337 - RNA, 19 nt, Homo sapiens
gaagaugcacaacgaaguu

SEQ ID NO: 394338 - RNA, 19 nt, Homo sapiens
acuaaggacuggaaauauu

SEQ ID NO: 394339 - RNA, 19 nt, Homo sapiens
ucuaacagauucaucaaga

SEQ ID NO: 394340 - RNA, 19 nt, Homo sapiens
ugaaucagguggagaaagu

SEQ ID NO: 394341 - RNA, 19 nt, Homo sapiens
cgaccuagaugaugauucu

SEQ ID NO: 394342 - RNA, 19 nt, Homo sapiens
caagacagaaggugaagaa

SEQ ID NO: 394343 - RNA, 19 nt, Homo sapiens
ucaagacuccauugcuuua

SEQ ID NO: 394344 - RNA, 19 nt, Homo sapiens
guauggauccuuucacuug

SEQ ID NO: 394345 - RNA, 19 nt, Homo sapiens
gaaggucaucuccaagaaa

SEQ ID NO: 394346 - RNA, 19 nt, Homo sapiens
ggacaacuuaucuucacua

SEQ ID NO: 394347 - RNA, 19 nt, Homo sapiens
caacaagacagaaggugaa

SEQ ID NO: 394348 - RNA, 19 nt, Homo sapiens
ugacugauguggaaacuac

SEQ ID NO: 394349 - RNA, 19 nt, Homo sapiens
gaagaacagguagaagaaa

SEQ ID NO: 394350 - RNA, 19 nt, Homo sapiens
guguguuacugcuguguua

SEQ ID NO: 394351 - RNA, 19 nt, Homo sapiens
gcaaguggcaacagcaaug

SEQ ID NO: 394352 - RNA, 19 nt, Homo sapiens
ccucucagauccaaauguu

SEQ ID NO: 394353 - RNA, 19 nt, Homo sapiens
uuaaauaucucuggcucaa

SEQ ID NO: 394354 - RNA, 19 nt, Homo sapiens
gacgaaaugcuuauagaga

SEQ ID NO: 394355 - RNA, 19 nt, Homo sapiens
aaauuuggaggacaacuua

SEQ ID NO: 394356 - RNA, 19 nt, Homo sapiens
gccaagaucauacuaagga

SEQ ID NO: 394357 - RNA, 19 nt, Homo sapiens
aaauaucucuggcucaagu

SEQ ID NO: 394358 - RNA, 19 nt, Homo sapiens
gaaaugcuuauagagagua

SEQ ID NO: 394359 - RNA, 19 nt, Homo sapiens
cuaaggacuggaaauauuu

SEQ ID NO: 394360 - RNA, 19 nt, Homo sapiens
guugaugaguugauuaagu

SEQ ID NO: 394361 - RNA, 19 nt, Homo sapiens
cauuguauguugaugaguu

SEQ ID NO: 394362 - RNA, 19 nt, Homo sapiens
uaucuggaaugcauuuguu

SEQ ID NO: 394363 - RNA, 19 nt, Homo sapiens
gaagaagaugcacaacgaa

SEQ ID NO: 394364 - RNA, 19 nt, Homo sapiens
ugaaggucaucuccaagaa

SEQ ID NO: 394365 - RNA, 19 nt, Homo sapiens
gaaaauggcugugcugcau

SEQ ID NO: 394366 - RNA, 19 nt, Homo sapiens
uggcaacagcaaugaauua

SEQ ID NO: 394367 - RNA, 19 nt, Homo sapiens
cuccauugcuuuauuauag

SEQ ID NO: 394368 - RNA, 19 nt, Homo sapiens
aagaacagguagaagaaau

SEQ ID NO: 394369 - RNA, 19 nt, Homo sapiens
gaggacaacuuaucuucac

SEQ ID NO: 394370 - RNA, 19 nt, Homo sapiens
ugauguacauuacugugaa

SEQ ID NO: 394371 - RNA, 19 nt, Homo sapiens
ggaaccugcucauuaucau

SEQ ID NO: 394372 - RNA, 19 nt, Homo sapiens
gcacaacgaaguucuacag

SEQ ID NO: 394373 - RNA, 19 nt, Homo sapiens
caagaagguuuccaaucag

SEQ ID NO: 394374 - RNA, 19 nt, Homo sapiens
gcucuucucucucaaucca

SEQ ID NO: 394375 - RNA, 19 nt, Homo sapiens
ucaccugaauucaaucugu

SEQ ID NO: 394376 - RNA, 19 nt, Homo sapiens
ccucucugauugcuuauga

SEQ ID NO: 394377 - RNA, 19 nt, Homo sapiens
gaauuaaagacaagaaggu

SEQ ID NO: 394378 - RNA, 19 nt, Homo sapiens
gguaauaaauaaggaacca

SEQ ID NO: 394379 - RNA, 19 nt, Homo sapiens
auacuaaggacuggaaaua

SEQ ID NO: 394380 - RNA, 19 nt, Homo sapiens
cgaaaugcuuauagagagu

SEQ ID NO: 394381 - RNA, 19 nt, Homo sapiens
ucauguggcuuguguuugg

SEQ ID NO: 394382 - RNA, 19 nt, Homo sapiens
guauguugaugaguugauu

SEQ ID NO: 394383 - RNA, 19 nt, Homo sapiens
ucauaugacgaaaugcuua

SEQ ID NO: 394384 - RNA, 19 nt, Homo sapiens
ggaggacaacuuaucuuca

SEQ ID NO: 394385 - RNA, 19 nt, Homo sapiens
ucaaauuucucacaaugcu

SEQ ID NO: 394386 - RNA, 19 nt, Homo sapiens
gauguacauuacugugaau

SEQ ID NO: 394387 - RNA, 19 nt, Homo sapiens
gauccagaaagcacuguuu

SEQ ID NO: 394388 - RNA, 19 nt, Homo sapiens
guggauauuugguagcaau

SEQ ID NO: 394389 - RNA, 19 nt, Homo sapiens
gcuauguggauauuuggua

SEQ ID NO: 394390 - RNA, 19 nt, Homo sapiens
ccugcuauguggauauuug

SEQ ID NO: 394391 - RNA, 19 nt, Homo sapiens
ccucuggucaguauuauga

SEQ ID NO: 394392 - RNA, 19 nt, Homo sapiens
ggacaccaaucacaaaagu

SEQ ID NO: 394393 - RNA, 19 nt, Homo sapiens
gaaaagaaaagccaagauc

SEQ ID NO: 394394 - RNA, 19 nt, Homo sapiens
auagaaaucugaaggucau

SEQ ID NO: 394395 - RNA, 19 nt, Homo sapiens
agacagaaggugaagaaga

SEQ ID NO: 394396 - RNA, 19 nt, Homo sapiens
uacaugauauccugguuuc

SEQ ID NO: 394397 - RNA, 19 nt, Homo sapiens
agcaaugacugauguggaa

SEQ ID NO: 394398 - RNA, 19 nt, Homo sapiens
gacaagaagguuuccaauc

SEQ ID NO: 394399 - RNA, 19 nt, Homo sapiens
guaaucuccuugcaaucau

SEQ ID NO: 394400 - RNA, 19 nt, Homo sapiens
aagacuccauugcuuuauu

SEQ ID NO: 394401 - RNA, 19 nt, Homo sapiens
gaaaaucaauccacaaccu

SEQ ID NO: 394402 - RNA, 19 nt, Homo sapiens
uauggauccuuucacuuga

SEQ ID NO: 394403 - RNA, 19 nt, Homo sapiens
uaaucccucuggucaguau

SEQ ID NO: 394404 - RNA, 19 nt, Homo sapiens
ucucagauccaaauguuau

SEQ ID NO: 394405 - RNA, 19 nt, Homo sapiens
uuacugcuguguuauuuac

SEQ ID NO: 394406 - RNA, 19 nt, Homo sapiens
gaguagcuccgaccuagau

SEQ ID NO: 394407 - RNA, 19 nt, Homo sapiens
ggaaacuacauaugcagau

SEQ ID NO: 394408 - RNA, 19 nt, Homo sapiens
gaugauucuuccuguagca

SEQ ID NO: 394409 - RNA, 19 nt, Homo sapiens
uugaucauaugacgaaaug

SEQ ID NO: 394410 - RNA, 19 nt, Homo sapiens
uagcaaugguugaaaucau

SEQ ID NO: 394411 - RNA, 19 nt, Homo sapiens
caaugaauuagccuugaaa

SEQ ID NO: 394412 - RNA, 19 nt, Homo sapiens
gcaaaucauucuugguaaa

SEQ ID NO: 394413 - RNA, 19 nt, Homo sapiens
caagauaacucugggagaa

SEQ ID NO: 394414 - RNA, 19 nt, Homo sapiens
gggcaaaucauucuuggua

SEQ ID NO: 394415 - RNA, 19 nt, Homo sapiens
aaaccugucucagaaauaa

SEQ ID NO: 394416 - RNA, 19 nt, Homo sapiens
ggaaaagccucaaaaugaa

SEQ ID NO: 394417 - RNA, 19 nt, Homo sapiens
ggagaaagaaaguuuauca

SEQ ID NO: 394418 - RNA, 19 nt, Homo sapiens
gcauaccacugucuguaaa

SEQ ID NO: 394419 - RNA, 19 nt, Homo sapiens
uaucaagagugcugaauau

SEQ ID NO: 394420 - RNA, 19 nt, Homo sapiens
gauaggagaaagaaaguuu

SEQ ID NO: 394421 - RNA, 19 nt, Homo sapiens
uauggaacaugccuauuaa

SEQ ID NO: 394422 - RNA, 19 nt, Homo sapiens
ggauagaguguguuuguuu

SEQ ID NO: 394423 - RNA, 19 nt, Homo sapiens
cugaauaucugcauguuga

SEQ ID NO: 394424 - RNA, 19 nt, Homo sapiens
caagagugcugaauaucug

SEQ ID NO: 394425 - RNA, 19 nt, Homo sapiens
ggaaagauaggagaaagaa

SEQ ID NO: 394426 - RNA, 19 nt, Homo sapiens
gaacaauagucaaaacuca

SEQ ID NO: 394427 - RNA, 19 nt, Homo sapiens
ggcaaaucauucuugguaa

SEQ ID NO: 394428 - RNA, 19 nt, Homo sapiens
gaaggaagaugcaaaagag

SEQ ID NO: 394429 - RNA, 19 nt, Homo sapiens
gaggacagauucaucaaaa

SEQ ID NO: 394430 - RNA, 19 nt, Homo sapiens
guaugugccuacugugauu

SEQ ID NO: 394431 - RNA, 19 nt, Homo sapiens
acagaaacaucuuuaggau

SEQ ID NO: 394432 - RNA, 19 nt, Homo sapiens
uguccaagguaagcuauua

SEQ ID NO: 394433 - RNA, 19 nt, Homo sapiens
cuaagcagcauguguauau

SEQ ID NO: 394434 - RNA, 19 nt, Homo sapiens
agacggaaccucagauuug

SEQ ID NO: 394435 - RNA, 19 nt, Homo sapiens
ggauuuauuuagccugaug

SEQ ID NO: 394436 - RNA, 19 nt, Homo sapiens
gcagguuacuuccaaaucg

SEQ ID NO: 394437 - RNA, 19 nt, Homo sapiens
ggugguaacugugguaaca

SEQ ID NO: 394438 - RNA, 19 nt, Homo sapiens
gaaggcucauaaucuauca

SEQ ID NO: 394439 - RNA, 19 nt, Homo sapiens
aaaggcagguuacuuccaa

SEQ ID NO: 394440 - RNA, 19 nt, Homo sapiens
cagcauguguauauuagau

SEQ ID NO: 394441 - RNA, 19 nt, Homo sapiens
ugagaaagaacaauaguca

SEQ ID NO: 394442 - RNA, 19 nt, Homo sapiens
guugaaagacuuagugguu

SEQ ID NO: 394443 - RNA, 19 nt, Homo sapiens
aaagacacuucaucaagau

SEQ ID NO: 394444 - RNA, 19 nt, Homo sapiens
aaacaacacaagaccaauu

SEQ ID NO: 394445 - RNA, 19 nt, Homo sapiens
uaccagacauccagaguuc

SEQ ID NO: 394446 - RNA, 19 nt, Homo sapiens
auauggaacaugccuauua

SEQ ID NO: 394447 - RNA, 19 nt, Homo sapiens
cagaaacaucuuuaggaua

SEQ ID NO: 394448 - RNA, 19 nt, Homo sapiens
gauagaguguguuuguuuu

SEQ ID NO: 394449 - RNA, 19 nt, Homo sapiens
gcccuaagcagcaugugua

SEQ ID NO: 394450 - RNA, 19 nt, Homo sapiens
cggaaugccuuaccagaca

SEQ ID NO: 394451 - RNA, 19 nt, Homo sapiens
gaaagauaggagaaagaaa

SEQ ID NO: 394452 - RNA, 19 nt, Homo sapiens
cggcuggagucaugcuaua

SEQ ID NO: 394453 - RNA, 19 nt, Homo sapiens
agacuuagugguucuguuu

SEQ ID NO: 394454 - RNA, 19 nt, Homo sapiens
ucacuuugauugcaaugau

SEQ ID NO: 394455 - RNA, 19 nt, Homo sapiens
aagcagcauguguauauua

SEQ ID NO: 394456 - RNA, 19 nt, Homo sapiens
gaaaagacacuucaucaag

SEQ ID NO: 394457 - RNA, 19 nt, Homo sapiens
gagucaugcuauacugaaa

SEQ ID NO: 394458 - RNA, 19 nt, Homo sapiens
ccaaaucgcacugaaggaa

SEQ ID NO: 394459 - RNA, 19 nt, Homo sapiens
aaaagacacuucaucaaga

SEQ ID NO: 394460 - RNA, 19 nt, Homo sapiens
gaauaucugcauguugaaa

SEQ ID NO: 394461 - RNA, 19 nt, Homo sapiens
aaagauaggagaaagaaag

SEQ ID NO: 394462 - RNA, 19 nt, Homo sapiens
ggagucaugcuauacugaa

SEQ ID NO: 394463 - RNA, 19 nt, Homo sapiens
caacacaagaccaauugga

SEQ ID NO: 394464 - RNA, 19 nt, Homo sapiens
uuaaaccugucucagaaau

SEQ ID NO: 394465 - RNA, 19 nt, Homo sapiens
uggaaaagccucaaaauga

SEQ ID NO: 394466 - RNA, 19 nt, Homo sapiens
acacaagaccaauuggaaa

SEQ ID NO: 394467 - RNA, 19 nt, Homo sapiens
gccagggacaggaaagaua

SEQ ID NO: 394468 - RNA, 19 nt, Homo sapiens
caaaucgcacugaaggaaa

SEQ ID NO: 394469 - RNA, 19 nt, Homo sapiens
uaagcagcauguguauauu

SEQ ID NO: 394470 - RNA, 19 nt, Homo sapiens
gacauuuagucugguggua

SEQ ID NO: 394471 - RNA, 19 nt, Homo sapiens
gcucauaaucuaucaagag

SEQ ID NO: 394472 - RNA, 19 nt, Homo sapiens
ucagagauuuauguugcua

SEQ ID NO: 394473 - RNA, 19 nt, Homo sapiens
uaacagaaacaucuuuagg

SEQ ID NO: 394474 - RNA, 19 nt, Homo sapiens
augaugauguccaagguaa

SEQ ID NO: 394475 - RNA, 19 nt, Homo sapiens
uaaaccugucucagaaaua

SEQ ID NO: 394476 - RNA, 19 nt, Homo sapiens
gagaaagaacaauagucaa

SEQ ID NO: 394477 - RNA, 19 nt, Homo sapiens
caaugaugauguccaaggu

SEQ ID NO: 394478 - RNA, 19 nt, Homo sapiens
cuacucacuuugauugcaa

SEQ ID NO: 394479 - RNA, 19 nt, Homo sapiens
gaugggcaaaucauucuug

SEQ ID NO: 394480 - RNA, 19 nt, Homo sapiens
gcacugaaggaaaagguua

SEQ ID NO: 394481 - RNA, 19 nt, Homo sapiens
agacacuucaucaagauaa

SEQ ID NO: 394482 - RNA, 19 nt, Homo sapiens
uaacugugguaacauugca

SEQ ID NO: 394483 - RNA, 19 nt, Homo sapiens
ugaaagacuuagugguucu

SEQ ID NO: 394484 - RNA, 19 nt, Homo sapiens
ggaaugccuuaccagacau

SEQ ID NO: 394485 - RNA, 19 nt, Homo sapiens
cagaaaugcauaccacugu

SEQ ID NO: 394486 - RNA, 19 nt, Homo sapiens
caggaaagauaggagaaag

SEQ ID NO: 394487 - RNA, 19 nt, Homo sapiens
agagauuuauguugcuaug

SEQ ID NO: 394488 - RNA, 19 nt, Homo sapiens
gaaaugcauaccacugucu

SEQ ID NO: 394489 - RNA, 19 nt, Homo sapiens
ugguaacugugguaacauu

SEQ ID NO: 394490 - RNA, 19 nt, Homo sapiens
cuucauggaauuuguagaa

SEQ ID NO: 394491 - RNA, 19 nt, Homo sapiens
cuaucaagagugcugaaua

SEQ ID NO: 394492 - RNA, 19 nt, Homo sapiens
ccacagacggaaccucaga

SEQ ID NO: 394493 - RNA, 19 nt, Homo sapiens
agauaauuguguugugaug

SEQ ID NO: 394494 - RNA, 19 nt, Homo sapiens
ucaagagugcugaauaucu

SEQ ID NO: 394495 - RNA, 19 nt, Homo sapiens
gacggaaccucagauuugc

SEQ ID NO: 394496 - RNA, 19 nt, Homo sapiens
cagacggaaccucagauuu

SEQ ID NO: 394497 - RNA, 19 nt, Homo sapiens
gaaggaaaagguuaagaau

SEQ ID NO: 394498 - RNA, 19 nt, Homo sapiens
gcuauuaaaaggcagguua

SEQ ID NO: 394499 - RNA, 19 nt, Homo sapiens
gcuacucacuuugauugca

SEQ ID NO: 394500 - RNA, 19 nt, Homo sapiens
gacaggaaagauaggagaa

SEQ ID NO: 394501 - RNA, 19 nt, Homo sapiens
uaacauugcagcccuaagc

SEQ ID NO: 394502 - RNA, 19 nt, Homo sapiens
agauuuauguugcuaugag

SEQ ID NO: 394503 - RNA, 19 nt, Homo sapiens
gaugcuacucacuuugauu

SEQ ID NO: 394504 - RNA, 19 nt, Homo sapiens
cucauaaucuaucaagagu

SEQ ID NO: 394505 - RNA, 19 nt, Homo sapiens
aacagaaacaucuuuagga

SEQ ID NO: 394506 - RNA, 19 nt, Homo sapiens
uaauuguguugugaugcua

SEQ ID NO: 394507 - RNA, 19 nt, Homo sapiens
gagaaagaaaguuuaucag

SEQ ID NO: 394508 - RNA, 19 nt, Homo sapiens
ugaggacagauucaucaaa

SEQ ID NO: 394509 - RNA, 19 nt, Homo sapiens
ccagggacaggaaagauag

SEQ ID NO: 394510 - RNA, 19 nt, Homo sapiens
uugcaaugaugauguccaa

SEQ ID NO: 394511 - RNA, 19 nt, Homo sapiens
ugaaggcucauaaucuauc

SEQ ID NO: 394512 - RNA, 19 nt, Homo sapiens
gagaauggauuuauagcua

SEQ ID NO: 394513 - RNA, 19 nt, Homo sapiens
ggaaucagaugaaacuuga

SEQ ID NO: 394514 - RNA, 19 nt, Homo sapiens
gacaaauucugaucucuaa

SEQ ID NO: 394515 - RNA, 19 nt, Homo sapiens
ggacaucuacuccaaguuu

SEQ ID NO: 394516 - RNA, 19 nt, Homo sapiens
gaugcugucucuucauuaa

SEQ ID NO: 394517 - RNA, 19 nt, Homo sapiens
gaagaacacaagauagaaa

SEQ ID NO: 394518 - RNA, 19 nt, Homo sapiens
ggaaagagaauggauuuau

SEQ ID NO: 394519 - RNA, 19 nt, Homo sapiens
caacaucgaucacauuacu

SEQ ID NO: 394520 - RNA, 19 nt, Homo sapiens
gcuagaagaacacaagaua

SEQ ID NO: 394521 - RNA, 19 nt, Homo sapiens
gaggaaagagaauggauuu

SEQ ID NO: 394522 - RNA, 19 nt, Homo sapiens
ugacauuucuucccauaau

SEQ ID NO: 394523 - RNA, 19 nt, Homo sapiens
ggauuuauagcuacccuua

SEQ ID NO: 394524 - RNA, 19 nt, Homo sapiens
gaugaaacuugagggaauu

SEQ ID NO: 394525 - RNA, 19 nt, Homo sapiens
ugaaguuccucaaauuguu

SEQ ID NO: 394526 - RNA, 19 nt, Homo sapiens
gaaguuccucaaauuguuu

SEQ ID NO: 394527 - RNA, 19 nt, Homo sapiens
gcucacagguggagagaag

SEQ ID NO: 394528 - RNA, 19 nt, Homo sapiens
gaacacaagauagaaacuu

SEQ ID NO: 394529 - RNA, 19 nt, Homo sapiens
caaauucugaucucuaaga

SEQ ID NO: 394530 - RNA, 19 nt, Homo sapiens
ccaaguccauuuagugaca

SEQ ID NO: 394531 - RNA, 19 nt, Homo sapiens
gcaccgcuacuauaaauca

SEQ ID NO: 394532 - RNA, 19 nt, Homo sapiens
uggaagagcuacagauugg

SEQ ID NO: 394533 - RNA, 19 nt, Homo sapiens
uagaagaacacaagauaga

SEQ ID NO: 394534 - RNA, 19 nt, Homo sapiens
acaauagcguguauacuuc

SEQ ID NO: 394535 - RNA, 19 nt, Homo sapiens
ggaggaaagagaauggauu

SEQ ID NO: 394536 - RNA, 19 nt, Homo sapiens
gauaguaagaagcaaaguu

SEQ ID NO: 394537 - RNA, 19 nt, Homo sapiens
guguauacuuccuucauga

SEQ ID NO: 394538 - RNA, 19 nt, Homo sapiens
ugauucaacccuaagauaa

SEQ ID NO: 394539 - RNA, 19 nt, Homo sapiens
cagaaucaggcaauacuuu

SEQ ID NO: 394540 - RNA, 19 nt, Homo sapiens
gaagucucaucgcugcuau

SEQ ID NO: 394541 - RNA, 19 nt, Homo sapiens
cuauaaaucagccuuggua

SEQ ID NO: 394542 - RNA, 19 nt, Homo sapiens
gaggaggccaaguccauuu

SEQ ID NO: 394543 - RNA, 19 nt, Homo sapiens
gacccagaaucaggcaaua

SEQ ID NO: 394544 - RNA, 19 nt, Homo sapiens
gggaaucagaugaaacuug

SEQ ID NO: 394545 - RNA, 19 nt, Homo sapiens
gacaucuacuccaaguuug

SEQ ID NO: 394546 - RNA, 19 nt, Homo sapiens
agaugaaacuugagggaau

SEQ ID NO: 394547 - RNA, 19 nt, Homo sapiens
acaagcgcauucugaaguu

SEQ ID NO: 394548 - RNA, 19 nt, Homo sapiens
uuaaaccgcuugucugcau

SEQ ID NO: 394549 - RNA, 19 nt, Homo sapiens
aacaauagcguguauacuu

SEQ ID NO: 394550 - RNA, 19 nt, Homo sapiens
ggccaaguccauuuaguga

SEQ ID NO: 394551 - RNA, 19 nt, Homo sapiens
ggucaagggaauuguauca

SEQ ID NO: 394552 - RNA, 19 nt, Homo sapiens
acuaaagccuugcaacauc

SEQ ID NO: 394553 - RNA, 19 nt, Homo sapiens
uggagacggucauuucuuc

SEQ ID NO: 394554 - RNA, 19 nt, Homo sapiens
cugcaccgcuacuauaaau

SEQ ID NO: 394555 - RNA, 19 nt, Homo sapiens
gauucaacccuaagauaau

SEQ ID NO: 394556 - RNA, 19 nt, Homo sapiens
agacaaauucugaucucua

SEQ ID NO: 394557 - RNA, 19 nt, Homo sapiens
ccucacacauacacuugaa

SEQ ID NO: 394558 - RNA, 19 nt, Homo sapiens
ggucauuucuucagauagc

SEQ ID NO: 394559 - RNA, 19 nt, Homo sapiens
gagguucaccgacuuguag

SEQ ID NO: 394560 - RNA, 19 nt, Homo sapiens
aaacuugagggaauuguga

SEQ ID NO: 394561 - RNA, 19 nt, Homo sapiens
aaugccagcuuguuugaug

SEQ ID NO: 394562 - RNA, 19 nt, Homo sapiens
ucgcugcuaugaccugauu

SEQ ID NO: 394563 - RNA, 19 nt, Homo sapiens
ucaagggaauuguaucacu

SEQ ID NO: 394564 - RNA, 19 nt, Homo sapiens
acaacaaccuagauguauc

SEQ ID NO: 394565 - RNA, 19 nt, Homo sapiens
agacggucauuucuucaga

SEQ ID NO: 394566 - RNA, 19 nt, Homo sapiens
gaaacuugagggaauugug

SEQ ID NO: 394567 - RNA, 19 nt, Homo sapiens
ugacuaaagccuugcaaca

SEQ ID NO: 394568 - RNA, 19 nt, Homo sapiens
gcaccuaugccaauauugc

SEQ ID NO: 394569 - RNA, 19 nt, Homo sapiens
gcaauacuuuguacauccu

SEQ ID NO: 394570 - RNA, 19 nt, Homo sapiens
gaaucaggcaauacuuugu

SEQ ID NO: 394571 - RNA, 19 nt, Homo sapiens
ugcugucucuucauuaauu

SEQ ID NO: 394572 - RNA, 19 nt, Homo sapiens
uguacgagcugccccuuua

SEQ ID NO: 394573 - RNA, 19 nt, Homo sapiens
ggaggaggccaaguccauu

SEQ ID NO: 394574 - RNA, 19 nt, Homo sapiens
acccuuacccucacacaua

SEQ ID NO: 394575 - RNA, 19 nt, Homo sapiens
gcagagguucaccgacuug

SEQ ID NO: 394576 - RNA, 19 nt, Homo sapiens
auacgucccugcaggugaa

SEQ ID NO: 394577 - RNA, 19 nt, Homo sapiens
agugacauuucuucccaua

SEQ ID NO: 394578 - RNA, 19 nt, Homo sapiens
ugcaacaucgaucacauua

SEQ ID NO: 394579 - RNA, 19 nt, Homo sapiens
gaggccaaguccauuuagu

SEQ ID NO: 394580 - RNA, 19 nt, Homo sapiens
ccuguccucuuagauauau

SEQ ID NO: 394581 - RNA, 19 nt, Homo sapiens
cguguauacuuccuucaug

SEQ ID NO: 394582 - RNA, 19 nt, Homo sapiens
caggagcggugggaugaug

SEQ ID NO: 394583 - RNA, 19 nt, Homo sapiens
aaucaggcaauacuuugua

SEQ ID NO: 394584 - RNA, 19 nt, Homo sapiens
uugaugcugucucuucauu

SEQ ID NO: 394585 - RNA, 19 nt, Homo sapiens
cugauucaacccuaagaua

SEQ ID NO: 394586 - RNA, 19 nt, Homo sapiens
gcuaguggaagcagagguu

SEQ ID NO: 394587 - RNA, 19 nt, Homo sapiens
gcuacagauuggcaccuau

SEQ ID NO: 394588 - RNA, 19 nt, Homo sapiens
acggucauuucuucagaua

SEQ ID NO: 394589 - RNA, 19 nt, Homo sapiens
uaaaccgcuugucugcauu

SEQ ID NO: 394590 - RNA, 19 nt, Homo sapiens
acaucgaucacauuacuuu

SEQ ID NO: 394591 - RNA, 19 nt, Homo sapiens
gacuaaagccuugcaacau

SEQ ID NO: 394592 - RNA, 19 nt, Homo sapiens
cagaaaagaccuacaacaa

SEQ ID NO: 394593 - RNA, 19 nt, Homo sapiens
acuccaaguuugauguuau

SEQ ID NO: 394594 - RNA, 19 nt, Homo sapiens
ccacaggcugccaguuauu

SEQ ID NO: 394595 - RNA, 19 nt, Homo sapiens
aaacuuggagagaggugua

SEQ ID NO: 394596 - RNA, 19 nt, Homo sapiens
uaaaucagccuugguacag

SEQ ID NO: 394597 - RNA, 19 nt, Homo sapiens
ggcccugauucaacccuaa

SEQ ID NO: 394598 - RNA, 19 nt, Homo sapiens
gugacucuguucccuguuc

SEQ ID NO: 394599 - RNA, 19 nt, Homo sapiens
gacuuguagugguggauga

SEQ ID NO: 394600 - RNA, 19 nt, Homo sapiens
ggcgugugguggacaucua

SEQ ID NO: 394601 - RNA, 19 nt, Homo sapiens
auucugaaguuccucaaau

SEQ ID NO: 394602 - RNA, 19 nt, Homo sapiens
agaaucaggcaauacuuug

SEQ ID NO: 394603 - RNA, 19 nt, Homo sapiens
ccuaaugccagcuuguuug

SEQ ID NO: 394604 - RNA, 19 nt, Homo sapiens
ccaacaauagcguguauac

SEQ ID NO: 394605 - RNA, 19 nt, Homo sapiens
caucaacaggcuaguggaa

SEQ ID NO: 394606 - RNA, 19 nt, Homo sapiens
cuaaugccagcuuguuuga

SEQ ID NO: 394607 - RNA, 19 nt, Homo sapiens
gagcuagaagaacacaaga

SEQ ID NO: 394608 - RNA, 19 nt, Homo sapiens
gacggucauuucuucagau

SEQ ID NO: 394609 - RNA, 19 nt, Homo sapiens
ucacagguggagagaagaa

SEQ ID NO: 394610 - RNA, 19 nt, Homo sapiens
cagaguucauguccaaguc

SEQ ID NO: 394611 - RNA, 19 nt, Homo sapiens
agccagaguucauguccaa

SEQ ID NO: 394612 - RNA, 19 nt, Homo sapiens
uaagaaagccaccuuguua

SEQ ID NO: 394613 - RNA, 19 nt, Homo sapiens
ggccauauaugcuguauuu

SEQ ID NO: 394614 - RNA, 19 nt, Homo sapiens
gagcaaauguccuaacaga

SEQ ID NO: 394615 - RNA, 19 nt, Homo sapiens
gcucaaagauucuauugug

SEQ ID NO: 394616 - RNA, 19 nt, Homo sapiens
gcaacuaacugacucuguu

SEQ ID NO: 394617 - RNA, 19 nt, Homo sapiens
gaacuugcuuugauuuaug

SEQ ID NO: 394618 - RNA, 19 nt, Homo sapiens
caugcaaacugcuuuauuu

SEQ ID NO: 394619 - RNA, 19 nt, Homo sapiens
gaagauguaugaggaauuc

SEQ ID NO: 394620 - RNA, 19 nt, Homo sapiens
cgagacagcuauagaagaa

SEQ ID NO: 394621 - RNA, 19 nt, Homo sapiens
gcaaauguccuaacagaga

SEQ ID NO: 394622 - RNA, 19 nt, Homo sapiens
ccaaauaauugaucagaug

SEQ ID NO: 394623 - RNA, 19 nt, Homo sapiens
gcucauacacaguuaaaua

SEQ ID NO: 394624 - RNA, 19 nt, Homo sapiens
gaaauugcacuacugauga

SEQ ID NO: 394625 - RNA, 19 nt, Homo sapiens
gaucuguacuuuguguuua

SEQ ID NO: 394626 - RNA, 19 nt, Homo sapiens
gaugcugaauugagaauaa

SEQ ID NO: 394627 - RNA, 19 nt, Homo sapiens
ggaccgaccuagauuugaa

SEQ ID NO: 394628 - RNA, 19 nt, Homo sapiens
gcagcuuccugucuguuua

SEQ ID NO: 394629 - RNA, 19 nt, Homo sapiens
uaaucugccugguuuauuu

SEQ ID NO: 394630 - RNA, 19 nt, Homo sapiens
gaaagacaucugccuguaa

SEQ ID NO: 394631 - RNA, 19 nt, Homo sapiens
gagauuggauuugcuguga

SEQ ID NO: 394632 - RNA, 19 nt, Homo sapiens
gaaagcggaagauguauga

SEQ ID NO: 394633 - RNA, 19 nt, Homo sapiens
gauaaugagagaagugaua

SEQ ID NO: 394634 - RNA, 19 nt, Homo sapiens
gauuugcugugacuagaua

SEQ ID NO: 394635 - RNA, 19 nt, Homo sapiens
gaagaugggcagaagauug

SEQ ID NO: 394636 - RNA, 19 nt, Homo sapiens
ucagcugacuccaguauaa

SEQ ID NO: 394637 - RNA, 19 nt, Homo sapiens
ugagaaagcggaagaugua

SEQ ID NO: 394638 - RNA, 19 nt, Homo sapiens
gggaauacuuugagagguu

SEQ ID NO: 394639 - RNA, 19 nt, Homo sapiens
aagcuaaucugccugguuu

SEQ ID NO: 394640 - RNA, 19 nt, Homo sapiens
gguauaaugugucuguguu

SEQ ID NO: 394641 - RNA, 19 nt, Homo sapiens
gcacgcagccuucgagaau

SEQ ID NO: 394642 - RNA, 19 nt, Homo sapiens
gggagugacugcaagcauu

SEQ ID NO: 394643 - RNA, 19 nt, Homo sapiens
caaauguccuaacagagaa

SEQ ID NO: 394644 - RNA, 19 nt, Homo sapiens
gcucacaaauuccgauuag

SEQ ID NO: 394645 - RNA, 19 nt, Homo sapiens
gagaacuugcuuugauuua

SEQ ID NO: 394646 - RNA, 19 nt, Homo sapiens
ggauaugauugguucaguu

SEQ ID NO: 394647 - RNA, 19 nt, Homo sapiens
uccagcaccuauugaauua

SEQ ID NO: 394648 - RNA, 19 nt, Homo sapiens
uauggagacuuugcuguua

SEQ ID NO: 394649 - RNA, 19 nt, Homo sapiens
uacgguagcugaugcauug

SEQ ID NO: 394650 - RNA, 19 nt, Homo sapiens
ggaugucuauguuaacaau

SEQ ID NO: 394651 - RNA, 19 nt, Homo sapiens
gauaugauugguucaguuu

SEQ ID NO: 394652 - RNA, 19 nt, Homo sapiens
aaagacaucugccuguaau

SEQ ID NO: 394653 - RNA, 19 nt, Homo sapiens
gagagcagccacugucaaa

SEQ ID NO: 394654 - RNA, 19 nt, Homo sapiens
ggagggagcuuuggagaac

SEQ ID NO: 394655 - RNA, 19 nt, Homo sapiens
ggggauaacuucuauguga

SEQ ID NO: 394656 - RNA, 19 nt, Homo sapiens
agacaucugccuguaauua

SEQ ID NO: 394657 - RNA, 19 nt, Homo sapiens
agaaagacaucugccugua

SEQ ID NO: 394658 - RNA, 19 nt, Homo sapiens
gcagauccagcaccuauug

SEQ ID NO: 394659 - RNA, 19 nt, Homo sapiens
agaguucuauggagacuuu

SEQ ID NO: 394660 - RNA, 19 nt, Homo sapiens
ggagaacuugcuuugauuu

SEQ ID NO: 394661 - RNA, 19 nt, Homo sapiens
guaagaaagccaccuuguu

SEQ ID NO: 394662 - RNA, 19 nt, Homo sapiens
aaucuccucugcucauuaa

SEQ ID NO: 394663 - RNA, 19 nt, Homo sapiens
cuuccugucuguuuauaua

SEQ ID NO: 394664 - RNA, 19 nt, Homo sapiens
aaugauacccaacaguuua

SEQ ID NO: 394665 - RNA, 19 nt, Homo sapiens
uuuccagccuuauguguua

SEQ ID NO: 394666 - RNA, 19 nt, Homo sapiens
ggaauuccuuaguaaaguc

SEQ ID NO: 394667 - RNA, 19 nt, Homo sapiens
ggagugacugcaagcauuu

SEQ ID NO: 394668 - RNA, 19 nt, Homo sapiens
ccaaugauacccaacaguu

SEQ ID NO: 394669 - RNA, 19 nt, Homo sapiens
gcagugagugccaugcuuu

SEQ ID NO: 394670 - RNA, 19 nt, Homo sapiens
gauaacuucuaugugauug

SEQ ID NO: 394671 - RNA, 19 nt, Homo sapiens
acaagacaauggccgcuuu

SEQ ID NO: 394672 - RNA, 19 nt, Homo sapiens
cuucuccaauucugaaaua

SEQ ID NO: 394673 - RNA, 19 nt, Homo sapiens
gacaucugccuguaauuaa

SEQ ID NO: 394674 - RNA, 19 nt, Homo sapiens
uuagggaaauggauauaga

SEQ ID NO: 394675 - RNA, 19 nt, Homo sapiens
uaaaugcucauacacaguu

SEQ ID NO: 394676 - RNA, 19 nt, Homo sapiens
gcucagacauccucaaacg

SEQ ID NO: 394677 - RNA, 19 nt, Homo sapiens
uaaaugaggguuucugauc

SEQ ID NO: 394678 - RNA, 19 nt, Homo sapiens
gguaauguaggguuauauu

SEQ ID NO: 394679 - RNA, 19 nt, Homo sapiens
cuacauucuugguuguuaa

SEQ ID NO: 394680 - RNA, 19 nt, Homo sapiens
ccaguuauaagcguauuua

SEQ ID NO: 394681 - RNA, 19 nt, Homo sapiens
gauguaacagugcaagauu

SEQ ID NO: 394682 - RNA, 19 nt, Homo sapiens
ggauaacuucuaugugauu

SEQ ID NO: 394683 - RNA, 19 nt, Homo sapiens
auaagguaauguaggguua

SEQ ID NO: 394684 - RNA, 19 nt, Homo sapiens
caauuuggagcauuaacua

SEQ ID NO: 394685 - RNA, 19 nt, Homo sapiens
aacgaaacauccagcagua

SEQ ID NO: 394686 - RNA, 19 nt, Homo sapiens
ccaaagccauugaaaagaa

SEQ ID NO: 394687 - RNA, 19 nt, Homo sapiens
uuucugaucuguacuuugu

SEQ ID NO: 394688 - RNA, 19 nt, Homo sapiens
uuaaauuggucaugguaga

SEQ ID NO: 394689 - RNA, 19 nt, Homo sapiens
guauugagucuuaacugua

SEQ ID NO: 394690 - RNA, 19 nt, Homo sapiens
ugaagaguuuguugaagug

SEQ ID NO: 394691 - RNA, 19 nt, Homo sapiens
caagggaggaugagauuuc

SEQ ID NO: 394692 - RNA, 19 nt, Homo sapiens
gggaagagguuuuauuuac

SEQ ID NO: 394693 - RNA, 19 nt, Homo sapiens
caaugauacccaacaguuu

SEQ ID NO: 394694 - RNA, 19 nt, Homo sapiens
ccagaagcauaacauucaa

SEQ ID NO: 394695 - RNA, 19 nt, Homo sapiens
guaaacuuguguauugagu

SEQ ID NO: 394696 - RNA, 19 nt, Homo sapiens
uucaagcgcugcucaaaga

SEQ ID NO: 394697 - RNA, 19 nt, Homo sapiens
cagcuagugccaaauaauu

SEQ ID NO: 394698 - RNA, 19 nt, Homo sapiens
ucagacauccucaaacgaa

SEQ ID NO: 394699 - RNA, 19 nt, Homo sapiens
caagacaauggccgcuuua

SEQ ID NO: 394700 - RNA, 19 nt, Homo sapiens
gcuuuccuaucuagcauuu

SEQ ID NO: 394701 - RNA, 19 nt, Homo sapiens
agauacagauggagcaaau

SEQ ID NO: 394702 - RNA, 19 nt, Homo sapiens
gggcagauccagcaccuau

SEQ ID NO: 394703 - RNA, 19 nt, Homo sapiens
uggagaacuugcuuugauu

SEQ ID NO: 394704 - RNA, 19 nt, Homo sapiens
caggagagacugugauuca

SEQ ID NO: 394705 - RNA, 19 nt, Homo sapiens
gaaacauccagcaguacaa

SEQ ID NO: 394706 - RNA, 19 nt, Homo sapiens
aaauugcacuacugaugaa

SEQ ID NO: 394707 - RNA, 19 nt, Homo sapiens
ugaaauugcacuacugaug

SEQ ID NO: 394708 - RNA, 19 nt, Homo sapiens
gacaagugggaacgucuua

SEQ ID NO: 394709 - RNA, 19 nt, Homo sapiens
ggaagauguaugaggaauu

SEQ ID NO: 394710 - RNA, 19 nt, Homo sapiens
gggauaacuucuaugugau

SEQ ID NO: 394711 - RNA, 19 nt, Homo sapiens
gaaagguuauaccaaaaga

SEQ ID NO: 394712 - RNA, 19 nt, Homo sapiens
gaacagagaugcagacuuc

SEQ ID NO: 394713 - RNA, 19 nt, Homo sapiens
gaagugagcaucuugauua

SEQ ID NO: 394714 - RNA, 19 nt, Homo sapiens
gaugucaaaugcuuaguua

SEQ ID NO: 394715 - RNA, 19 nt, Homo sapiens
gaaugaagauuguggaugu

SEQ ID NO: 394716 - RNA, 19 nt, Homo sapiens
ggaagauguuugaaucauu

SEQ ID NO: 394717 - RNA, 19 nt, Homo sapiens
gcaugucucuccaacaauu

SEQ ID NO: 394718 - RNA, 19 nt, Homo sapiens
gaagauuguggauguaaua

SEQ ID NO: 394719 - RNA, 19 nt, Homo sapiens
ucaggaagcuugcaaagau

SEQ ID NO: 394720 - RNA, 19 nt, Homo sapiens
gugagcaucuugauuagaa

SEQ ID NO: 394721 - RNA, 19 nt, Homo sapiens
guuccuagcagauuuaaua

SEQ ID NO: 394722 - RNA, 19 nt, Homo sapiens
gaagcaggacuaaaucaaa

SEQ ID NO: 394723 - RNA, 19 nt, Homo sapiens
caagggugauucauccuaa

SEQ ID NO: 394724 - RNA, 19 nt, Homo sapiens
ccacagaacacauacagaa

SEQ ID NO: 394725 - RNA, 19 nt, Homo sapiens
caaagaagaggaagauguu

SEQ ID NO: 394726 - RNA, 19 nt, Homo sapiens
gcaaagaagaggaagaugu

SEQ ID NO: 394727 - RNA, 19 nt, Homo sapiens
ggaacagcuuucucaaguu

SEQ ID NO: 394728 - RNA, 19 nt, Homo sapiens
guauaaacaugcuccuuuc

SEQ ID NO: 394729 - RNA, 19 nt, Homo sapiens
gauuguggauguaauagga

SEQ ID NO: 394730 - RNA, 19 nt, Homo sapiens
gagauugcccgcugccaua

SEQ ID NO: 394731 - RNA, 19 nt, Homo sapiens
gaacagcuggugaagaugu

SEQ ID NO: 394732 - RNA, 19 nt, Homo sapiens
caggaagcuugcaaagaua

SEQ ID NO: 394733 - RNA, 19 nt, Homo sapiens
aaacagacaugacagaacu

SEQ ID NO: 394734 - RNA, 19 nt, Homo sapiens
cggcaugucucuccaacaa

SEQ ID NO: 394735 - RNA, 19 nt, Homo sapiens
gaaagucagcacuaaagga

SEQ ID NO: 394736 - RNA, 19 nt, Homo sapiens
gaaccaggaggucgagauu

SEQ ID NO: 394737 - RNA, 19 nt, Homo sapiens
cauagagucuggcgaagug

SEQ ID NO: 394738 - RNA, 19 nt, Homo sapiens
agaggaagauguuugaauc

SEQ ID NO: 394739 - RNA, 19 nt, Homo sapiens
caauuuaagugccugauac

SEQ ID NO: 394740 - RNA, 19 nt, Homo sapiens
agaggaacaucucacacua

SEQ ID NO: 394741 - RNA, 19 nt, Homo sapiens
cccgagagcugcuaccauu

SEQ ID NO: 394742 - RNA, 19 nt, Homo sapiens
gagaacgcauaaucacuca

SEQ ID NO: 394743 - RNA, 19 nt, Homo sapiens
ggacuaaaucaaacaagga

SEQ ID NO: 394744 - RNA, 19 nt, Homo sapiens
aaucaaacccgcucuguug

SEQ ID NO: 394745 - RNA, 19 nt, Homo sapiens
cuauaacccugaugaggaa

SEQ ID NO: 394746 - RNA, 19 nt, Homo sapiens
aggaacagcuggugaagau

SEQ ID NO: 394747 - RNA, 19 nt, Homo sapiens
cgccugaccucgucgaauu

SEQ ID NO: 394748 - RNA, 19 nt, Homo sapiens
agucaaagcugaugagcau

SEQ ID NO: 394749 - RNA, 19 nt, Homo sapiens
gagagcugcuaccauuguu

SEQ ID NO: 394750 - RNA, 19 nt, Homo sapiens
gcaguacuuuggagagcuu

SEQ ID NO: 394751 - RNA, 19 nt, Homo sapiens
cagaacgaaugaagauugu

SEQ ID NO: 394752 - RNA, 19 nt, Homo sapiens
aggaacagcuuucucaagu

SEQ ID NO: 394753 - RNA, 19 nt, Homo sapiens
uuaagugccugauacaaag

SEQ ID NO: 394754 - RNA, 19 nt, Homo sapiens
caacccacaccuccacuuu

SEQ ID NO: 394755 - RNA, 19 nt, Homo sapiens
ggaagaggaagauacagau

SEQ ID NO: 394756 - RNA, 19 nt, Homo sapiens
uuagaccacuuguaaagau

SEQ ID NO: 394757 - RNA, 19 nt, Homo sapiens
gaaggcccauucauuagac

SEQ ID NO: 394758 - RNA, 19 nt, Homo sapiens
cagauuuaauagacgagua

SEQ ID NO: 394759 - RNA, 19 nt, Homo sapiens
ggauggagaacgcauaauc

SEQ ID NO: 394760 - RNA, 19 nt, Homo sapiens
ucagaacgaaugaagauug

SEQ ID NO: 394761 - RNA, 19 nt, Homo sapiens
gauggagaacgcauaauca

SEQ ID NO: 394762 - RNA, 19 nt, Homo sapiens
agaacuagcucugauguac

SEQ ID NO: 394763 - RNA, 19 nt, Homo sapiens
ucaaaugcuuaguuaugga

SEQ ID NO: 394764 - RNA, 19 nt, Homo sapiens
ugccucagcuuaugcaguu

SEQ ID NO: 394765 - RNA, 19 nt, Homo sapiens
gagaacuagcucugaugua

SEQ ID NO: 394766 - RNA, 19 nt, Homo sapiens
ggagaacuagcucugaugu

SEQ ID NO: 394767 - RNA, 19 nt, Homo sapiens
gggaacuuaugacauuuua

SEQ ID NO: 394768 - RNA, 19 nt, Homo sapiens
uaaaggaugggcagagguu

SEQ ID NO: 394769 - RNA, 19 nt, Homo sapiens
ggaggacgaggacuuggaa

SEQ ID NO: 394770 - RNA, 19 nt, Homo sapiens
aggaacaucucacacuaug

SEQ ID NO: 394771 - RNA, 19 nt, Homo sapiens
gaggaacaucucacacuau

SEQ ID NO: 394772 - RNA, 19 nt, Homo sapiens
gaacuagcucugauguaca

SEQ ID NO: 394773 - RNA, 19 nt, Homo sapiens
uugcaaagauauucuccuu

SEQ ID NO: 394774 - RNA, 19 nt, Homo sapiens
ugauacaaaguccaaagua

SEQ ID NO: 394775 - RNA, 19 nt, Homo sapiens
ugucaaaugcuuaguuaug

SEQ ID NO: 394776 - RNA, 19 nt, Homo sapiens
gaagaggaagauacagauc

SEQ ID NO: 394777 - RNA, 19 nt, Homo sapiens
gucaaaugcuuaguuaugg

SEQ ID NO: 394778 - RNA, 19 nt, Homo sapiens
ggagaugucaaaugcuuag

SEQ ID NO: 394779 - RNA, 19 nt, Homo sapiens
ccaguuccuagcagauuua

SEQ ID NO: 394780 - RNA, 19 nt, Homo sapiens
ggaggaggacgaggacuug

SEQ ID NO: 394781 - RNA, 19 nt, Homo sapiens
agaagaggaagauguuuga

SEQ ID NO: 394782 - RNA, 19 nt, Homo sapiens
ugccauguuugaaaggaua

SEQ ID NO: 394783 - RNA, 19 nt, Homo sapiens
gauccaagggugauucauc

SEQ ID NO: 394784 - RNA, 19 nt, Homo sapiens
gguuaugggcauuuagaaa

SEQ ID NO: 394785 - RNA, 19 nt, Homo sapiens
cgaagugagcaucuugauu

SEQ ID NO: 394786 - RNA, 19 nt, Homo sapiens
ccuagcagauuuaauagac

SEQ ID NO: 394787 - RNA, 19 nt, Homo sapiens
gaggaagauguuugaauca

SEQ ID NO: 394788 - RNA, 19 nt, Homo sapiens
gagaugauggagacaacuu

SEQ ID NO: 394789 - RNA, 19 nt, Homo sapiens
gaaguuccaguuccuagca

SEQ ID NO: 394790 - RNA, 19 nt, Homo sapiens
uagaccacuuguaaagauu

SEQ ID NO: 394791 - RNA, 19 nt, Homo sapiens
ugaagauuguggauguaau

SEQ ID NO: 394792 - RNA, 19 nt, Homo sapiens
aguauaaacaugcuccuuu

SEQ ID NO: 394793 - RNA, 19 nt, Homo sapiens
gaagaggaagauguuugaa

SEQ ID NO: 394794 - RNA, 19 nt, Homo sapiens
gacuggaccgggugacuuu

SEQ ID NO: 394795 - RNA, 19 nt, Homo sapiens
gagaugcagacuucaggaa

SEQ ID NO: 394796 - RNA, 19 nt, Homo sapiens
uuuaagugccugauacaaa

SEQ ID NO: 394797 - RNA, 19 nt, Homo sapiens
uucauuagaccacuuguaa

SEQ ID NO: 394798 - RNA, 19 nt, Homo sapiens
cccagagccuucuuagugu

SEQ ID NO: 394799 - RNA, 19 nt, Homo sapiens
ggacuggaccgggugacuu

SEQ ID NO: 394800 - RNA, 19 nt, Homo sapiens
ugacaaccguggcaguuuu

SEQ ID NO: 394801 - RNA, 19 nt, Homo sapiens
gaugccauguuugaaagga

SEQ ID NO: 394802 - RNA, 19 nt, Homo sapiens
uaaggauggagaacgcaua

SEQ ID NO: 394803 - RNA, 19 nt, Homo sapiens
cuagaggugucagaacgaa

SEQ ID NO: 394804 - RNA, 19 nt, Homo sapiens
ccaagggugauucauccua

SEQ ID NO: 394805 - RNA, 19 nt, Homo sapiens
uaaaacugaugaacagaga

SEQ ID NO: 394806 - RNA, 19 nt, Homo sapiens
cauuagaccacuuguaaag

SEQ ID NO: 394807 - RNA, 19 nt, Homo sapiens
aaagucagcacuaaaggau

SEQ ID NO: 394808 - RNA, 19 nt, Homo sapiens
gcaggacuaaaucaaacaa

SEQ ID NO: 394809 - RNA, 19 nt, Homo sapiens
aagcaggacuaaaucaaac

SEQ ID NO: 394810 - RNA, 19 nt, Homo sapiens
ggaagcuugcaaagauauu

SEQ ID NO: 394811 - RNA, 19 nt, Homo sapiens
gcucuguuggucaauauga

SEQ ID NO: 394812 - RNA, 19 nt, Homo sapiens
gcagaugucucaaguauua

SEQ ID NO: 394813 - RNA, 19 nt, Homo sapiens
gaacaucgcuaccuaugaa

SEQ ID NO: 394814 - RNA, 19 nt, Homo sapiens
gcaauucucuguauucuau

SEQ ID NO: 394815 - RNA, 19 nt, Homo sapiens
gaacucagauguacuagau

SEQ ID NO: 394816 - RNA, 19 nt, Homo sapiens
gcaauauacucuuacauga

SEQ ID NO: 394817 - RNA, 19 nt, Homo sapiens
ccaaagcaauauacucuua

SEQ ID NO: 394818 - RNA, 19 nt, Homo sapiens
gaaaguaguagaugugaua

SEQ ID NO: 394819 - RNA, 19 nt, Homo sapiens
guucaaugcuccaguaaua

SEQ ID NO: 394820 - RNA, 19 nt, Homo sapiens
gagcauaacccuauauaaa

SEQ ID NO: 394821 - RNA, 19 nt, Homo sapiens
gagcagaugucucaaguau

SEQ ID NO: 394822 - RNA, 19 nt, Homo sapiens
gaaaguaucuguguuuaag

SEQ ID NO: 394823 - RNA, 19 nt, Homo sapiens
ggaagagaauggugcagua

SEQ ID NO: 394824 - RNA, 19 nt, Homo sapiens
gcaaagacauccugcuguu

SEQ ID NO: 394825 - RNA, 19 nt, Homo sapiens
gaagauguguugguaacua

SEQ ID NO: 394826 - RNA, 19 nt, Homo sapiens
gcauaacccuauauaaaga

SEQ ID NO: 394827 - RNA, 19 nt, Homo sapiens
gaacuggccuuaauguaca

SEQ ID NO: 394828 - RNA, 19 nt, Homo sapiens
ucaauaggcuuuaacauca

SEQ ID NO: 394829 - RNA, 19 nt, Homo sapiens
ucacuaggccugcauaaua

SEQ ID NO: 394830 - RNA, 19 nt, Homo sapiens
gauagaggcacauuugaua

SEQ ID NO: 394831 - RNA, 19 nt, Homo sapiens
gaaaugugaugguguugga

SEQ ID NO: 394832 - RNA, 19 nt, Homo sapiens
gcccacaguuuauuucuuu

SEQ ID NO: 394833 - RNA, 19 nt, Homo sapiens
gagauucggcugauucuuu

SEQ ID NO: 394834 - RNA, 19 nt, Homo sapiens
gaugcagaguccaggauua

SEQ ID NO: 394835 - RNA, 19 nt, Homo sapiens
acaugaagaugacuuguuu

SEQ ID NO: 394836 - RNA, 19 nt, Homo sapiens
uuucugaccuuaccauaua

SEQ ID NO: 394837 - RNA, 19 nt, Homo sapiens
gaggcacauuugauauuua

SEQ ID NO: 394838 - RNA, 19 nt, Homo sapiens
aguauuagaugccauguuu

SEQ ID NO: 394839 - RNA, 19 nt, Homo sapiens
aaagacauccugcuguuua

SEQ ID NO: 394840 - RNA, 19 nt, Homo sapiens
guaauaaaccgauucacaa

SEQ ID NO: 394841 - RNA, 19 nt, Homo sapiens
gaaauuagugcagaaagaa

SEQ ID NO: 394842 - RNA, 19 nt, Homo sapiens
gacaggcaauuuagucauu

SEQ ID NO: 394843 - RNA, 19 nt, Homo sapiens
gcagaaagaacucagaugu

SEQ ID NO: 394844 - RNA, 19 nt, Homo sapiens
agagggcacuuggcaauua

SEQ ID NO: 394845 - RNA, 19 nt, Homo sapiens
ugacgauggugacaacuuu

SEQ ID NO: 394846 - RNA, 19 nt, Homo sapiens
ugaaauuagugcagaaaga

SEQ ID NO: 394847 - RNA, 19 nt, Homo sapiens
gcuuuaauguagacucaua

SEQ ID NO: 394848 - RNA, 19 nt, Homo sapiens
aaaggaacaucgcuaccua

SEQ ID NO: 394849 - RNA, 19 nt, Homo sapiens
ggaccuugcauggaaauua

SEQ ID NO: 394850 - RNA, 19 nt, Homo sapiens
uaaaggauguuaucauagg

SEQ ID NO: 394851 - RNA, 19 nt, Homo sapiens
gaccuugcauggaaauuau

SEQ ID NO: 394852 - RNA, 19 nt, Homo sapiens
gagagaucauuaaugcauu

SEQ ID NO: 394853 - RNA, 19 nt, Homo sapiens
ugucaaauguuuagcaaug

SEQ ID NO: 394854 - RNA, 19 nt, Homo sapiens
aaucagaaguggaagagaa

SEQ ID NO: 394855 - RNA, 19 nt, Homo sapiens
gcaccaaaguauacaacga

SEQ ID NO: 394856 - RNA, 19 nt, Homo sapiens
gagggcacuuggcaauuaa

SEQ ID NO: 394857 - RNA, 19 nt, Homo sapiens
gcuuuaacaucacuuucua

SEQ ID NO: 394858 - RNA, 19 nt, Homo sapiens
ccuuaaaucuuuggaguuu

SEQ ID NO: 394859 - RNA, 19 nt, Homo sapiens
ucacugccauuccuuaaau

SEQ ID NO: 394860 - RNA, 19 nt, Homo sapiens
ggugacaacuuuuauguaa

SEQ ID NO: 394861 - RNA, 19 nt, Homo sapiens
acucagauguacuagauuu

SEQ ID NO: 394862 - RNA, 19 nt, Homo sapiens
uaauguagacucauaguug

SEQ ID NO: 394863 - RNA, 19 nt, Homo sapiens
gagaauguguuuguguaga

SEQ ID NO: 394864 - RNA, 19 nt, Homo sapiens
uguagaaucuggagaagug

SEQ ID NO: 394865 - RNA, 19 nt, Homo sapiens
auacaacgauggagaacaa

SEQ ID NO: 394866 - RNA, 19 nt, Homo sapiens
agaaagaacucagauguac

SEQ ID NO: 394867 - RNA, 19 nt, Homo sapiens
caagaccuguagugacaaa

SEQ ID NO: 394868 - RNA, 19 nt, Homo sapiens
gaaaagaaaggguaaauca

SEQ ID NO: 394869 - RNA, 19 nt, Homo sapiens
ucauugauaugcucaguau

SEQ ID NO: 394870 - RNA, 19 nt, Homo sapiens
aaagaacucagauguacua

SEQ ID NO: 394871 - RNA, 19 nt, Homo sapiens
gcaaaaguauggagcaaga

SEQ ID NO: 394872 - RNA, 19 nt, Homo sapiens
aaagaaaggguaaaucaga

SEQ ID NO: 394873 - RNA, 19 nt, Homo sapiens
guuggaagauguguuggua

SEQ ID NO: 394874 - RNA, 19 nt, Homo sapiens
uaaaagccaugucuguuaa

SEQ ID NO: 394875 - RNA, 19 nt, Homo sapiens
cagaaagaacucagaugua

SEQ ID NO: 394876 - RNA, 19 nt, Homo sapiens
cuagaggaauagaaacaaa

SEQ ID NO: 394877 - RNA, 19 nt, Homo sapiens
gaauggugcaguagaaaug

SEQ ID NO: 394878 - RNA, 19 nt, Homo sapiens
agagaauggugcaguagaa

SEQ ID NO: 394879 - RNA, 19 nt, Homo sapiens
aagaaaggguaaaucagaa

SEQ ID NO: 394880 - RNA, 19 nt, Homo sapiens
ugccauuccuuaaaucuuu

SEQ ID NO: 394881 - RNA, 19 nt, Homo sapiens
gcauguaauugaucaaggu

SEQ ID NO: 394882 - RNA, 19 nt, Homo sapiens
ugacuuuguuggcauaaug

SEQ ID NO: 394883 - RNA, 19 nt, Homo sapiens
agaggcacauuugauauuu

SEQ ID NO: 394884 - RNA, 19 nt, Homo sapiens
aaacuuaagauccgacauu

SEQ ID NO: 394885 - RNA, 19 nt, Homo sapiens
gcacuuggcaauuaaacau

SEQ ID NO: 394886 - RNA, 19 nt, Homo sapiens
gugguuagaauguuaauug

SEQ ID NO: 394887 - RNA, 19 nt, Homo sapiens
cugagaauguguuugugua

SEQ ID NO: 394888 - RNA, 19 nt, Homo sapiens
aauguagacucauaguuga

SEQ ID NO: 394889 - RNA, 19 nt, Homo sapiens
ucaaugcuccaguaauaaa

SEQ ID NO: 394890 - RNA, 19 nt, Homo sapiens
caacguaucaauaaacagu

SEQ ID NO: 394891 - RNA, 19 nt, Homo sapiens
ccacugagaauguguuugu

SEQ ID NO: 394892 - RNA, 19 nt, Homo sapiens
gagcuugcccugguaacua

SEQ ID NO: 394893 - RNA, 19 nt, Homo sapiens
ucaaagaaauagguugcaa

SEQ ID NO: 394894 - RNA, 19 nt, Homo sapiens
ugaaagcuuuauugaguca

SEQ ID NO: 394895 - RNA, 19 nt, Homo sapiens
acaggcaauuuagucauua

SEQ ID NO: 394896 - RNA, 19 nt, Homo sapiens
caaaguauacaacgaugga

SEQ ID NO: 394897 - RNA, 19 nt, Homo sapiens
gggagcauguaauugauca

SEQ ID NO: 394898 - RNA, 19 nt, Homo sapiens
gcaaaaccuucuuguagga

SEQ ID NO: 394899 - RNA, 19 nt, Homo sapiens
gccuauuggugaaauggua

SEQ ID NO: 394900 - RNA, 19 nt, Homo sapiens
gaauguguuuguguagaug

SEQ ID NO: 394901 - RNA, 19 nt, Homo sapiens
ggagcaagaccuguaguga

SEQ ID NO: 394902 - RNA, 19 nt, Homo sapiens
ggaacaucgcuaccuauga

SEQ ID NO: 394903 - RNA, 19 nt, Homo sapiens
aaagaaauagguugcaaga

SEQ ID NO: 394904 - RNA, 19 nt, Homo sapiens
ggcguucaaugcuccagua

SEQ ID NO: 394905 - RNA, 19 nt, Homo sapiens
gaaaaugugguuagaaugu

SEQ ID NO: 394906 - RNA, 19 nt, Homo sapiens
guaucuguguuuaagaaga

SEQ ID NO: 394907 - RNA, 19 nt, Homo sapiens
ucugggaccuugcauggaa

SEQ ID NO: 394908 - RNA, 19 nt, Homo sapiens
gauaggcaccaaaguauac

SEQ ID NO: 394909 - RNA, 19 nt, Homo sapiens
aagacauccugcuguuuaa

SEQ ID NO: 394910 - RNA, 19 nt, Homo sapiens
acucuuacaugauuucuag

SEQ ID NO: 394911 - RNA, 19 nt, Homo sapiens
ucaaauguuuagcaaugga

SEQ ID NO: 394912 - RNA, 19 nt, Homo sapiens
gcaaaggacugaugaccaa

SEQ ID NO: 394913 - RNA, 19 nt, Homo sapiens
gaagaaggauguggugauu

SEQ ID NO: 394914 - RNA, 19 nt, Homo sapiens
ggauuguucuuucuucaua

SEQ ID NO: 394915 - RNA, 19 nt, Homo sapiens
gaaacaaccuuccaacaac

SEQ ID NO: 394916 - RNA, 19 nt, Homo sapiens
ggacuucaauuuccucaug

SEQ ID NO: 394917 - RNA, 19 nt, Homo sapiens
cagaagaacuguaugcaau

SEQ ID NO: 394918 - RNA, 19 nt, Homo sapiens
gaaggguucucguauguca

SEQ ID NO: 394919 - RNA, 19 nt, Homo sapiens
ggacugggaucgaacaaca

SEQ ID NO: 394920 - RNA, 19 nt, Homo sapiens
caaaugugaucaacuguuc

SEQ ID NO: 394921 - RNA, 19 nt, Homo sapiens
caagaggugccaugaauuu

SEQ ID NO: 394922 - RNA, 19 nt, Homo sapiens
gaagaacuguaugcaauca

SEQ ID NO: 394923 - RNA, 19 nt, Homo sapiens
gccaugaauuuguuacuuu

SEQ ID NO: 394924 - RNA, 19 nt, Homo sapiens
caaaguguguggcaaagga

SEQ ID NO: 394925 - RNA, 19 nt, Homo sapiens
ucacugcucuauggacuua

SEQ ID NO: 394926 - RNA, 19 nt, Homo sapiens
caaggaggcuguuucuauc

SEQ ID NO: 394927 - RNA, 19 nt, Homo sapiens
gcuugugucugauuccaua

SEQ ID NO: 394928 - RNA, 19 nt, Homo sapiens
ggccacggcuugugucuga

SEQ ID NO: 394929 - RNA, 19 nt, Homo sapiens
caguggaagugaauccuua

SEQ ID NO: 394930 - RNA, 19 nt, Homo sapiens
ccaaggaggcuguuucuau

SEQ ID NO: 394931 - RNA, 19 nt, Homo sapiens
gaacaacaaggaaugacuu

SEQ ID NO: 394932 - RNA, 19 nt, Homo sapiens
cacaagaggugccaugaau

SEQ ID NO: 394933 - RNA, 19 nt, Homo sapiens
gcaaggaacacaugaugga

SEQ ID NO: 394934 - RNA, 19 nt, Homo sapiens
gaaauucgagaaagccaaa

SEQ ID NO: 394935 - RNA, 19 nt, Homo sapiens
gaauggaucacacugagaa

SEQ ID NO: 394936 - RNA, 19 nt, Homo sapiens
gaacauuaucuuaguggaa

SEQ ID NO: 394937 - RNA, 19 nt, Homo sapiens
gagcagagaacuuugacaa

SEQ ID NO: 394938 - RNA, 19 nt, Homo sapiens
gcacaacguuuccuaucca

SEQ ID NO: 394939 - RNA, 19 nt, Homo sapiens
uuauagggaucugaaguua

SEQ ID NO: 394940 - RNA, 19 nt, Homo sapiens
uaaggaaccacaagcagua

SEQ ID NO: 394941 - RNA, 19 nt, Homo sapiens
gcaguggaaugaguccuuu

SEQ ID NO: 394942 - RNA, 19 nt, Homo sapiens
guucagggucucucucuua

SEQ ID NO: 394943 - RNA, 19 nt, Homo sapiens
uaugugaagcugaaacuua

SEQ ID NO: 394944 - RNA, 19 nt, Homo sapiens
gaggugccaugaauuuguu

SEQ ID NO: 394945 - RNA, 19 nt, Homo sapiens
agaaggauguggugauuca

SEQ ID NO: 394946 - RNA, 19 nt, Homo sapiens
gaaacucacggacuucaau

SEQ ID NO: 394947 - RNA, 19 nt, Homo sapiens
gaaggaaacauggaacuca

SEQ ID NO: 394948 - RNA, 19 nt, Homo sapiens
gacgagcuauuucagucua

SEQ ID NO: 394949 - RNA, 19 nt, Homo sapiens
cauguuggauucagaagga

SEQ ID NO: 394950 - RNA, 19 nt, Homo sapiens
auagggaucugaaguuaga

SEQ ID NO: 394951 - RNA, 19 nt, Homo sapiens
guuauuaguccaaauguga

SEQ ID NO: 394952 - RNA, 19 nt, Homo sapiens
cagggucucucucuuacaa

SEQ ID NO: 394953 - RNA, 19 nt, Homo sapiens
ggugaaggaccacaaauuc

SEQ ID NO: 394954 - RNA, 19 nt, Homo sapiens
gaucagcugguuauugcua

SEQ ID NO: 394955 - RNA, 19 nt, Homo sapiens
gcaaaggagcagagaacuu

SEQ ID NO: 394956 - RNA, 19 nt, Homo sapiens
uagauaacgucauguugga

SEQ ID NO: 394957 - RNA, 19 nt, Homo sapiens
agaacuguaugcaaucaaa

SEQ ID NO: 394958 - RNA, 19 nt, Homo sapiens
ggacgaggaaggaaacaug

SEQ ID NO: 394959 - RNA, 19 nt, Homo sapiens
uuucggagcugaugaagau

SEQ ID NO: 394960 - RNA, 19 nt, Homo sapiens
cgacgacugucuguagaaa

SEQ ID NO: 394961 - RNA, 19 nt, Homo sapiens
aggcugagguugcugauga

SEQ ID NO: 394962 - RNA, 19 nt, Homo sapiens
gauaacgucauguuggauu

SEQ ID NO: 394963 - RNA, 19 nt, Homo sapiens
ggagcaagcacaaguucaa

SEQ ID NO: 394964 - RNA, 19 nt, Homo sapiens
guaccacauucagcaagua

SEQ ID NO: 394965 - RNA, 19 nt, Homo sapiens
ucaauuuccucaugguguu

SEQ ID NO: 394966 - RNA, 19 nt, Homo sapiens
caugggaucccuuuccuuu

SEQ ID NO: 394967 - RNA, 19 nt, Homo sapiens
aaagcuccaugucacagua

SEQ ID NO: 394968 - RNA, 19 nt, Homo sapiens
guccaaaugugaucaacug

SEQ ID NO: 394969 - RNA, 19 nt, Homo sapiens
gaagacaggaaacaaccuu

SEQ ID NO: 394970 - RNA, 19 nt, Homo sapiens
gaucgaacaacaaggaaug

SEQ ID NO: 394971 - RNA, 19 nt, Homo sapiens
ccuauggcguccuguugua

SEQ ID NO: 394972 - RNA, 19 nt, Homo sapiens
gaccauggcugacguuuuc

SEQ ID NO: 394973 - RNA, 19 nt, Homo sapiens
gacaaagaccgacgacugu

SEQ ID NO: 394974 - RNA, 19 nt, Homo sapiens
gaagggcacagaagaacug

SEQ ID NO: 394975 - RNA, 19 nt, Homo sapiens
gaagacgagcuauuucagu

SEQ ID NO: 394976 - RNA, 19 nt, Homo sapiens
uaaauccgcaguggaauga

SEQ ID NO: 394977 - RNA, 19 nt, Homo sapiens
ugugacaccugcgauauga

SEQ ID NO: 394978 - RNA, 19 nt, Homo sapiens
agaagaaggugaguacuac

SEQ ID NO: 394979 - RNA, 19 nt, Homo sapiens
gaacucaggcagaaauucg

SEQ ID NO: 394980 - RNA, 19 nt, Homo sapiens
aagaagaaggugaguacua

SEQ ID NO: 394981 - RNA, 19 nt, Homo sapiens
gcuuucagauccuuaugug

SEQ ID NO: 394982 - RNA, 19 nt, Homo sapiens
gagcacaacguuuccuauc

SEQ ID NO: 394983 - RNA, 19 nt, Homo sapiens
ggaaccacaagcaguauuc

SEQ ID NO: 394984 - RNA, 19 nt, Homo sapiens
caaccuugaccgagugaaa

SEQ ID NO: 394985 - RNA, 19 nt, Homo sapiens
gccaguggaugguacaagu

SEQ ID NO: 394986 - RNA, 19 nt, Homo sapiens
agugaauccuuaacccuaa

SEQ ID NO: 394987 - RNA, 19 nt, Homo sapiens
gaaggaccacaaauucauc

SEQ ID NO: 394988 - RNA, 19 nt, Homo sapiens
gaggacagcccgucuuaac

SEQ ID NO: 394989 - RNA, 19 nt, Homo sapiens
ggagauccagccaccauuc

SEQ ID NO: 394990 - RNA, 19 nt, Homo sapiens
gugaauccuuaacccuaaa

SEQ ID NO: 394991 - RNA, 19 nt, Homo sapiens
gaugaagacgagcuauuuc

SEQ ID NO: 394992 - RNA, 19 nt, Homo sapiens
ccaagaagaaggugaguac

SEQ ID NO: 394993 - RNA, 19 nt, Homo sapiens
agaugaagacgagcuauuu

SEQ ID NO: 394994 - RNA, 19 nt, Homo sapiens
gagcaagcacaaguucaaa

SEQ ID NO: 394995 - RNA, 19 nt, Homo sapiens
accauccgcuccacacuaa

SEQ ID NO: 394996 - RNA, 19 nt, Homo sapiens
caagcaaugcgucaucaau

SEQ ID NO: 394997 - RNA, 19 nt, Homo sapiens
gugggucacugcucuaugg

SEQ ID NO: 394998 - RNA, 19 nt, Homo sapiens
ccacugcaccgacuucauc

SEQ ID NO: 394999 - RNA, 19 nt, Homo sapiens
ccaaaugugaucaacuguu

SEQ ID NO: 395000 - RNA, 19 nt, Homo sapiens
ggagugcaccaugguagaa

SEQ ID NO: 395001 - RNA, 19 nt, Homo sapiens
gaaaggggaguuuuggaaa

SEQ ID NO: 395002 - RNA, 19 nt, Homo sapiens
aucaagggaugaaauguga

SEQ ID NO: 395003 - RNA, 19 nt, Homo sapiens
ccacaagaggugccaugaa

SEQ ID NO: 395004 - RNA, 19 nt, Homo sapiens
cuuacagagugcaguauga

SEQ ID NO: 395005 - RNA, 19 nt, Homo sapiens
uugaaggguucucguaugu

SEQ ID NO: 395006 - RNA, 19 nt, Homo sapiens
uggaaugaguccuuuacau

SEQ ID NO: 395007 - RNA, 19 nt, Homo sapiens
ccaaacgggcuuucagauc

SEQ ID NO: 395008 - RNA, 19 nt, Homo sapiens
ggaauggaucacacugaga

SEQ ID NO: 395009 - RNA, 19 nt, Homo sapiens
cuuacaaccaagaacauua

SEQ ID NO: 395010 - RNA, 19 nt, Homo sapiens
guaggguuauuaguccaaa

SEQ ID NO: 395011 - RNA, 19 nt, Homo sapiens
ccugaaaauuguaggguua

SEQ ID NO: 395012 - RNA, 19 nt, Homo sapiens
gcaaagggcugaugaccaa

SEQ ID NO: 395013 - RNA, 19 nt, Homo sapiens
ggaugaaacugaccgauuu

SEQ ID NO: 395014 - RNA, 19 nt, Homo sapiens
gaaccaaggucccggaaga

SEQ ID NO: 395015 - RNA, 19 nt, Homo sapiens
ggagaaacuugaacgcaaa

SEQ ID NO: 395016 - RNA, 19 nt, Homo sapiens
gaagucaucaggaauauug

SEQ ID NO: 395017 - RNA, 19 nt, Homo sapiens
gaagugaggccaaugaaga

SEQ ID NO: 395018 - RNA, 19 nt, Homo sapiens
ucaaaguccucuuacaauu

SEQ ID NO: 395019 - RNA, 19 nt, Homo sapiens
gaccaacacugucuccaaa

SEQ ID NO: 395020 - RNA, 19 nt, Homo sapiens
gaaaagaacaugcucaaaa

SEQ ID NO: 395021 - RNA, 19 nt, Homo sapiens
ccaaguguaugguugcuuu

SEQ ID NO: 395022 - RNA, 19 nt, Homo sapiens
gcaaccagcuugggugcua

SEQ ID NO: 395023 - RNA, 19 nt, Homo sapiens
caacagagaccggaugaaa

SEQ ID NO: 395024 - RNA, 19 nt, Homo sapiens
caaaguccucuuacaauuu

SEQ ID NO: 395025 - RNA, 19 nt, Homo sapiens
gagaugggauuaugcagau

SEQ ID NO: 395026 - RNA, 19 nt, Homo sapiens
ggaugaggaugaacucuuc

SEQ ID NO: 395027 - RNA, 19 nt, Homo sapiens
gaagaaggacguugugauc

SEQ ID NO: 395028 - RNA, 19 nt, Homo sapiens
uaucaaagagcaugcauuu

SEQ ID NO: 395029 - RNA, 19 nt, Homo sapiens
ugacaacaauggcaacaga

SEQ ID NO: 395030 - RNA, 19 nt, Homo sapiens
ccaacacugucuccaaauu

SEQ ID NO: 395031 - RNA, 19 nt, Homo sapiens
guugauggcugguuuaagu

SEQ ID NO: 395032 - RNA, 19 nt, Homo sapiens
gcaaggucaugcuuucaga

SEQ ID NO: 395033 - RNA, 19 nt, Homo sapiens
caaguugcauccauguuug

SEQ ID NO: 395034 - RNA, 19 nt, Homo sapiens
gaaagaaucggacaaagac

SEQ ID NO: 395035 - RNA, 19 nt, Homo sapiens
gcaccacucucugaaacaa

SEQ ID NO: 395036 - RNA, 19 nt, Homo sapiens
caaauguccucagguaguu

SEQ ID NO: 395037 - RNA, 19 nt, Homo sapiens
ccaagucuauguccaagga

SEQ ID NO: 395038 - RNA, 19 nt, Homo sapiens
gauguuagcgguacucuuc

SEQ ID NO: 395039 - RNA, 19 nt, Homo sapiens
agaguaagggcaucauuua

SEQ ID NO: 395040 - RNA, 19 nt, Homo sapiens
gaugagcucuaugcuguga

SEQ ID NO: 395041 - RNA, 19 nt, Homo sapiens
caacacugucuccaaauuu

SEQ ID NO: 395042 - RNA, 19 nt, Homo sapiens
gccaugaauuugucacauu

SEQ ID NO: 395043 - RNA, 19 nt, Homo sapiens
ggauuccagugccaaguuu

SEQ ID NO: 395044 - RNA, 19 nt, Homo sapiens
caugggaucuuuguccuuu

SEQ ID NO: 395045 - RNA, 19 nt, Homo sapiens
cgacagggacguccucauu

SEQ ID NO: 395046 - RNA, 19 nt, Homo sapiens
gaugaacucuuccaaucca

SEQ ID NO: 395047 - RNA, 19 nt, Homo sapiens
acaucaagauugccgauuu

SEQ ID NO: 395048 - RNA, 19 nt, Homo sapiens
ccaaguugcauccauguuu

SEQ ID NO: 395049 - RNA, 19 nt, Homo sapiens
gaacgugcaugaggucaag

SEQ ID NO: 395050 - RNA, 19 nt, Homo sapiens
ugaaagaaucggacaaaga

SEQ ID NO: 395051 - RNA, 19 nt, Homo sapiens
cacaagcgcugcgugauga

SEQ ID NO: 395052 - RNA, 19 nt, Homo sapiens
gagagaaaaugccugcuuu

SEQ ID NO: 395053 - RNA, 19 nt, Homo sapiens
ggucaagaaccacaaauuc

SEQ ID NO: 395054 - RNA, 19 nt, Homo sapiens
gaaggacguugugauccaa

SEQ ID NO: 395055 - RNA, 19 nt, Homo sapiens
caguagagauuugggauug

SEQ ID NO: 395056 - RNA, 19 nt, Homo sapiens
gcacaagcgcugcgugaug

SEQ ID NO: 395057 - RNA, 19 nt, Homo sapiens
uugcauccauguuugauuu

SEQ ID NO: 395058 - RNA, 19 nt, Homo sapiens
ugugacaccugcaugauga

SEQ ID NO: 395059 - RNA, 19 nt, Homo sapiens
gcagauggccuauggaaaa

SEQ ID NO: 395060 - RNA, 19 nt, Homo sapiens
cuaaguagauguguagauc

SEQ ID NO: 395061 - RNA, 19 nt, Homo sapiens
gucaagagcuaaguagaug

SEQ ID NO: 395062 - RNA, 19 nt, Homo sapiens
caggaagucaucaggaaua

SEQ ID NO: 395063 - RNA, 19 nt, Homo sapiens
guauauugauugggagaaa

SEQ ID NO: 395064 - RNA, 19 nt, Homo sapiens
caucauggaacacaacgua

SEQ ID NO: 395065 - RNA, 19 nt, Homo sapiens
gugccaaguuugcugcuuu

SEQ ID NO: 395066 - RNA, 19 nt, Homo sapiens
gaccaaacacccaggcaaa

SEQ ID NO: 395067 - RNA, 19 nt, Homo sapiens
gcacagaugagcucuaugc

SEQ ID NO: 395068 - RNA, 19 nt, Homo sapiens
uaucaaaguccucuuacaa

SEQ ID NO: 395069 - RNA, 19 nt, Homo sapiens
gauuugggauugggauuug

SEQ ID NO: 395070 - RNA, 19 nt, Homo sapiens
ccugucagaucccuacgua

SEQ ID NO: 395071 - RNA, 19 nt, Homo sapiens
caagcggugccaugaauuu

SEQ ID NO: 395072 - RNA, 19 nt, Homo sapiens
gaaggugaacgugauauca

SEQ ID NO: 395073 - RNA, 19 nt, Homo sapiens
ggucaugcuuucagaacga

SEQ ID NO: 395074 - RNA, 19 nt, Homo sapiens
cacaagcggugccaugaau

SEQ ID NO: 395075 - RNA, 19 nt, Homo sapiens
aaacaacacagucacucua

SEQ ID NO: 395076 - RNA, 19 nt, Homo sapiens
caccagaccuugaaaagaa

SEQ ID NO: 395077 - RNA, 19 nt, Homo sapiens
gccuggagcuuggcuugua

SEQ ID NO: 395078 - RNA, 19 nt, Homo sapiens
cagaguaagggcaucauuu

SEQ ID NO: 395079 - RNA, 19 nt, Homo sapiens
gaaauugccaucggucugu

SEQ ID NO: 395080 - RNA, 19 nt, Homo sapiens
acccaaauguccucaggua

SEQ ID NO: 395081 - RNA, 19 nt, Homo sapiens
caucaggaauauugaccaa

SEQ ID NO: 395082 - RNA, 19 nt, Homo sapiens
ugucagaucccuacguaaa

SEQ ID NO: 395083 - RNA, 19 nt, Homo sapiens
gagcuaaguagauguguag

SEQ ID NO: 395084 - RNA, 19 nt, Homo sapiens
gaagucaagagcuaaguag

SEQ ID NO: 395085 - RNA, 19 nt, Homo sapiens
gaacacaacguagccuauc

SEQ ID NO: 395086 - RNA, 19 nt, Homo sapiens
aguuuaagauccacacgua

SEQ ID NO: 395087 - RNA, 19 nt, Homo sapiens
gagggacacaucaagauug

SEQ ID NO: 395088 - RNA, 19 nt, Homo sapiens
ccaagaaugugcuuuuaga

SEQ ID NO: 395089 - RNA, 19 nt, Homo sapiens
gcgaaaugcugaaaacuuc

SEQ ID NO: 395090 - RNA, 19 nt, Homo sapiens
aggaugaacucuuccaauc

SEQ ID NO: 395091 - RNA, 19 nt, Homo sapiens
ucagaaagccaguguugau

SEQ ID NO: 395092 - RNA, 19 nt, Homo sapiens
aaagugagagcaaacagaa

SEQ ID NO: 395093 - RNA, 19 nt, Homo sapiens
ccaaagggcccugguuuua

SEQ ID NO: 395094 - RNA, 19 nt, Homo sapiens
gaaacaacacagucacucu

SEQ ID NO: 395095 - RNA, 19 nt, Homo sapiens
guuaagaugaucaaaguuc

SEQ ID NO: 395096 - RNA, 19 nt, Homo sapiens
cauuaucaaaguccucuua

SEQ ID NO: 395097 - RNA, 19 nt, Homo sapiens
ucuaugagaugggauuaug

SEQ ID NO: 395098 - RNA, 19 nt, Homo sapiens
ccaaucagaauucgaagga

SEQ ID NO: 395099 - RNA, 19 nt, Homo sapiens
gaacucuuccaauccauca

SEQ ID NO: 395100 - RNA, 19 nt, Homo sapiens
ggaguccugcuguaugaaa

SEQ ID NO: 395101 - RNA, 19 nt, Homo sapiens
ggaggcaccagaccuugaa

SEQ ID NO: 395102 - RNA, 19 nt, Homo sapiens
uuucugcacugccauauuc

SEQ ID NO: 395103 - RNA, 19 nt, Homo sapiens
gcucuaugcugugaagauc

SEQ ID NO: 395104 - RNA, 19 nt, Homo sapiens
gauuuuaacuuccuaaugg

SEQ ID NO: 395105 - RNA, 19 nt, Homo sapiens
gcugaaagaaucggacaaa

SEQ ID NO: 395106 - RNA, 19 nt, Homo sapiens
guggauaauuggauguuag

SEQ ID NO: 395107 - RNA, 19 nt, Homo sapiens
ccaaauguccucagguagu

SEQ ID NO: 395108 - RNA, 19 nt, Homo sapiens
cgaagucaagagcuaagua

SEQ ID NO: 395109 - RNA, 19 nt, Homo sapiens
ugaccaaucagaauucgaa

SEQ ID NO: 395110 - RNA, 19 nt, Homo sapiens
ggcagaagaacgugcauga

SEQ ID NO: 395111 - RNA, 19 nt, Homo sapiens
aaacuugaacgcaaagaga

SEQ ID NO: 395112 - RNA, 19 nt, Homo sapiens
gcaugaaugugcaccauaa

SEQ ID NO: 395113 - RNA, 19 nt, Homo sapiens
gaaagaacgcuucaacauc

SEQ ID NO: 395114 - RNA, 19 nt, Homo sapiens
agaagaagccgaccaugua

SEQ ID NO: 395115 - RNA, 19 nt, Homo sapiens
ggacugcaguuucuacaca

SEQ ID NO: 395116 - RNA, 19 nt, Homo sapiens
guugaugucuguucaguau

SEQ ID NO: 395117 - RNA, 19 nt, Homo sapiens
gaaagggaaccaaccaaga

SEQ ID NO: 395118 - RNA, 19 nt, Homo sapiens
caucaagauugccgacuuu

SEQ ID NO: 395119 - RNA, 19 nt, Homo sapiens
ggaaaacacuggugcagaa

SEQ ID NO: 395120 - RNA, 19 nt, Homo sapiens
ugaugucuguucaguauuu

SEQ ID NO: 395121 - RNA, 19 nt, Homo sapiens
ucaaggcccucaagaagga

SEQ ID NO: 395122 - RNA, 19 nt, Homo sapiens
gaccaccuguucuuuguga

SEQ ID NO: 395123 - RNA, 19 nt, Homo sapiens
gcuucaagguucacaacua

SEQ ID NO: 395124 - RNA, 19 nt, Homo sapiens
gaagaagccgaccauguau

SEQ ID NO: 395125 - RNA, 19 nt, Homo sapiens
aaacacuggugcagaagaa

SEQ ID NO: 395126 - RNA, 19 nt, Homo sapiens
gccgagcgcugcaagaaga

SEQ ID NO: 395127 - RNA, 19 nt, Homo sapiens
gcaagggcaucauuuacag

SEQ ID NO: 395128 - RNA, 19 nt, Homo sapiens
gggaggacaugcaagacaa

SEQ ID NO: 395129 - RNA, 19 nt, Homo sapiens
caacaagcaaggcuacaaa

SEQ ID NO: 395130 - RNA, 19 nt, Homo sapiens
caucaagaaccaugaguuu

SEQ ID NO: 395131 - RNA, 19 nt, Homo sapiens
ggaaugacgggaaacauca

SEQ ID NO: 395132 - RNA, 19 nt, Homo sapiens
agaaaugcaucgacaagau

SEQ ID NO: 395133 - RNA, 19 nt, Homo sapiens
ucaagaaccaugaguuuau

SEQ ID NO: 395134 - RNA, 19 nt, Homo sapiens
caacagccgggacacuaua

SEQ ID NO: 395135 - RNA, 19 nt, Homo sapiens
aaacuggacucugcuggaa

SEQ ID NO: 395136 - RNA, 19 nt, Homo sapiens
gaaccaagucacccagaga

SEQ ID NO: 395137 - RNA, 19 nt, Homo sapiens
caacccaccuucuguucug

SEQ ID NO: 395138 - RNA, 19 nt, Homo sapiens
caagaaccaugaguuuauc

SEQ ID NO: 395139 - RNA, 19 nt, Homo sapiens
gagacuacaguaacuuuga

SEQ ID NO: 395140 - RNA, 19 nt, Homo sapiens
gaagacugcggcaugaaug

SEQ ID NO: 395141 - RNA, 19 nt, Homo sapiens
gacacuauauuccagaaag

SEQ ID NO: 395142 - RNA, 19 nt, Homo sapiens
gaaaugcaucgacaagauc

SEQ ID NO: 395143 - RNA, 19 nt, Homo sapiens
gcaagugcaacaucaacaa

SEQ ID NO: 395144 - RNA, 19 nt, Homo sapiens
gugcaaagagaacauauuc

SEQ ID NO: 395145 - RNA, 19 nt, Homo sapiens
acaaaugcaggcaauguaa

SEQ ID NO: 395146 - RNA, 19 nt, Homo sapiens
ugaugaggaugaacucuuc

SEQ ID NO: 395147 - RNA, 19 nt, Homo sapiens
acagcaagggcaucauuua

SEQ ID NO: 395148 - RNA, 19 nt, Homo sapiens
gaccaaggaccaccuguuc

SEQ ID NO: 395149 - RNA, 19 nt, Homo sapiens
caucaaggcccucaagaag

SEQ ID NO: 395150 - RNA, 19 nt, Homo sapiens
caacaucaacaacuucauc

SEQ ID NO: 395151 - RNA, 19 nt, Homo sapiens
gaagaagaccggaguugcu

SEQ ID NO: 395152 - RNA, 19 nt, Homo sapiens
gaagcagggauuaaagugu

SEQ ID NO: 395153 - RNA, 19 nt, Homo sapiens
caucaacaacuucaucuuc

SEQ ID NO: 395154 - RNA, 19 nt, Homo sapiens
ccauguauccugaguggaa

SEQ ID NO: 395155 - RNA, 19 nt, Homo sapiens
ggacaugcaagacaacagu

SEQ ID NO: 395156 - RNA, 19 nt, Homo sapiens
gagaagaagaccggaguug

SEQ ID NO: 395157 - RNA, 19 nt, Homo sapiens
ugaaugugcaccauaaaug

SEQ ID NO: 395158 - RNA, 19 nt, Homo sapiens
ccaagguguugaugucugu

SEQ ID NO: 395159 - RNA, 19 nt, Homo sapiens
gagcaccuccuggaagauu

SEQ ID NO: 395160 - RNA, 19 nt, Homo sapiens
agaaagaacgcuucaacau

SEQ ID NO: 395161 - RNA, 19 nt, Homo sapiens
gcuggcuucuccuuuguga

SEQ ID NO: 395162 - RNA, 19 nt, Homo sapiens
cagaagaagccgaccaugu

SEQ ID NO: 395163 - RNA, 19 nt, Homo sapiens
aagcaaggcuacaaaugca

SEQ ID NO: 395164 - RNA, 19 nt, Homo sapiens
guuuaucgccaccuucuuu

SEQ ID NO: 395165 - RNA, 19 nt, Homo sapiens
ccaaggaccaccuguucuu

SEQ ID NO: 395166 - RNA, 19 nt, Homo sapiens
cagagccuguugggauaua

SEQ ID NO: 395167 - RNA, 19 nt, Homo sapiens
acacuauauuccagaaaga

SEQ ID NO: 395168 - RNA, 19 nt, Homo sapiens
caagaaaugcaucgacaag

SEQ ID NO: 395169 - RNA, 19 nt, Homo sapiens
ucgagcaccuccuggaaga

SEQ ID NO: 395170 - RNA, 19 nt, Homo sapiens
uaucaggguuucgagaaga

SEQ ID NO: 395171 - RNA, 19 nt, Homo sapiens
gggacacuauauuccagaa

SEQ ID NO: 395172 - RNA, 19 nt, Homo sapiens
cagagacuacaguaacuuu

SEQ ID NO: 395173 - RNA, 19 nt, Homo sapiens
caaggaccaccuguucuuu

SEQ ID NO: 395174 - RNA, 19 nt, Homo sapiens
cucagagccuguugggaua

SEQ ID NO: 395175 - RNA, 19 nt, Homo sapiens
ggauuaaagugugaagacu

SEQ ID NO: 395176 - RNA, 19 nt, Homo sapiens
caagcaaggcuacaaaugc

SEQ ID NO: 395177 - RNA, 19 nt, Homo sapiens
gccaaguucccaacgauga

SEQ ID NO: 395178 - RNA, 19 nt, Homo sapiens
gggaaugacgggaaacauc

SEQ ID NO: 395179 - RNA, 19 nt, Homo sapiens
gcaucgccuucaacuccua

SEQ ID NO: 395180 - RNA, 19 nt, Homo sapiens
gaaugugcaccauaaaugc

SEQ ID NO: 395181 - RNA, 19 nt, Homo sapiens
ggaggacguggauugcaaa

SEQ ID NO: 395182 - RNA, 19 nt, Homo sapiens
caaccaagaggcugggaau

SEQ ID NO: 395183 - RNA, 19 nt, Homo sapiens
ugaaguacacauucucugu

SEQ ID NO: 395184 - RNA, 19 nt, Homo sapiens
ugugaagacugcggcauga

SEQ ID NO: 395185 - RNA, 19 nt, Homo sapiens
ggacacuauauuccagaaa

SEQ ID NO: 395186 - RNA, 19 nt, Homo sapiens
gccaacagccgggacacua

SEQ ID NO: 395187 - RNA, 19 nt, Homo sapiens
ccaagaggcugggaaugac

SEQ ID NO: 395188 - RNA, 19 nt, Homo sapiens
ccaucaaggcccucaagaa

SEQ ID NO: 395189 - RNA, 19 nt, Homo sapiens
ggcaucaaccagaagcuuu

SEQ ID NO: 395190 - RNA, 19 nt, Homo sapiens
uggaggacguggauugcaa

SEQ ID NO: 395191 - RNA, 19 nt, Homo sapiens
cagcacagagcgugggaaa

SEQ ID NO: 395192 - RNA, 19 nt, Homo sapiens
gggcaacccaccuucuguu

SEQ ID NO: 395193 - RNA, 19 nt, Homo sapiens
gaggccaaguucccaacga

SEQ ID NO: 395194 - RNA, 19 nt, Homo sapiens
uguacgagaugcucauugg

SEQ ID NO: 395195 - RNA, 19 nt, Homo sapiens
ggccugaaguacacauucu

SEQ ID NO: 395196 - RNA, 19 nt, Homo sapiens
acaucaagauugccgacuu

SEQ ID NO: 395197 - RNA, 19 nt, Homo sapiens
acacagcaagggcaucauu

SEQ ID NO: 395198 - RNA, 19 nt, Homo sapiens
ggauauaucaggguuucga

SEQ ID NO: 395199 - RNA, 19 nt, Homo sapiens
cagaaagaacgcuucaaca

SEQ ID NO: 395200 - RNA, 19 nt, Homo sapiens
ccagaaagaacgcuucaac

SEQ ID NO: 395201 - RNA, 19 nt, Homo sapiens
gcaccuccuggaagauuga

SEQ ID NO: 395202 - RNA, 19 nt, Homo sapiens
gaaugacgggaaacaucaa

SEQ ID NO: 395203 - RNA, 19 nt, Homo sapiens
uuacagggaccucaaacug

SEQ ID NO: 395204 - RNA, 19 nt, Homo sapiens
caacuucaucuuccacaag

SEQ ID NO: 395205 - RNA, 19 nt, Homo sapiens
gcagcaagugcaacaucaa

SEQ ID NO: 395206 - RNA, 19 nt, Homo sapiens
acgcugccauccacaagaa

SEQ ID NO: 395207 - RNA, 19 nt, Homo sapiens
ccauggaccagucugcauu

SEQ ID NO: 395208 - RNA, 19 nt, Homo sapiens
cuggagaagcucuuugaaa

SEQ ID NO: 395209 - RNA, 19 nt, Homo sapiens
ucaccaaggaguccaagga

SEQ ID NO: 395210 - RNA, 19 nt, Homo sapiens
uauaucaggguuucgagaa

SEQ ID NO: 395211 - RNA, 19 nt, Homo sapiens
gccaaccucugcggcauca

SEQ ID NO: 395212 - RNA, 19 nt, Homo sapiens
gggcaaagaugaaguauau

SEQ ID NO: 395213 - RNA, 19 nt, Homo sapiens
ggaaagccuugucauuuga

SEQ ID NO: 395214 - RNA, 19 nt, Homo sapiens
cuacauagcuccugagauc

SEQ ID NO: 395215 - RNA, 19 nt, Homo sapiens
caacguggcucccaacugu

SEQ ID NO: 395216 - RNA, 19 nt, Homo sapiens
gaaggaagaguguauguga

SEQ ID NO: 395217 - RNA, 19 nt, Homo sapiens
gacguggacugcacaauga

SEQ ID NO: 395218 - RNA, 19 nt, Homo sapiens
ggagucaucuacagggauu

SEQ ID NO: 395219 - RNA, 19 nt, Homo sapiens
cggaaagccuugucauuug

SEQ ID NO: 395220 - RNA, 19 nt, Homo sapiens
ggacgaagcaauuguaaag

SEQ ID NO: 395221 - RNA, 19 nt, Homo sapiens
ucaauggccuucuuaagau

SEQ ID NO: 395222 - RNA, 19 nt, Homo sapiens
guggagaccucauguuuca

SEQ ID NO: 395223 - RNA, 19 nt, Homo sapiens
gaucaagccacccuucaaa

SEQ ID NO: 395224 - RNA, 19 nt, Homo sapiens
caaugaggacgaccuauuu

SEQ ID NO: 395225 - RNA, 19 nt, Homo sapiens
gaccaaggaccgccucuuu

SEQ ID NO: 395226 - RNA, 19 nt, Homo sapiens
ugaaguauaugcugugaag

SEQ ID NO: 395227 - RNA, 19 nt, Homo sapiens
gaccucauguuucagauuc

SEQ ID NO: 395228 - RNA, 19 nt, Homo sapiens
ucaaagguuucuccuacuu

SEQ ID NO: 395229 - RNA, 19 nt, Homo sapiens
cggaaacacccguaccuua

SEQ ID NO: 395230 - RNA, 19 nt, Homo sapiens
gaacucaagggcaaagaug

SEQ ID NO: 395231 - RNA, 19 nt, Homo sapiens
ggaaacacccguaccuuac

SEQ ID NO: 395232 - RNA, 19 nt, Homo sapiens
gaugaaguauaugcuguga

SEQ ID NO: 395233 - RNA, 19 nt, Homo sapiens
caggaggaauucaaagguu

SEQ ID NO: 395234 - RNA, 19 nt, Homo sapiens
ccagaggaaucgccaaagu

SEQ ID NO: 395235 - RNA, 19 nt, Homo sapiens
ggaagaguguaugugauca

SEQ ID NO: 395236 - RNA, 19 nt, Homo sapiens
gcaaggaagggauucugaa

SEQ ID NO: 395237 - RNA, 19 nt, Homo sapiens
caagggcaaagaugaagua

SEQ ID NO: 395238 - RNA, 19 nt, Homo sapiens
gcaaagaugaaguauaugc

SEQ ID NO: 395239 - RNA, 19 nt, Homo sapiens
gaacuugagaacaacauuc

SEQ ID NO: 395240 - RNA, 19 nt, Homo sapiens
caaccaggaggaauucaaa

SEQ ID NO: 395241 - RNA, 19 nt, Homo sapiens
caaaagagacgucaauaau

SEQ ID NO: 395242 - RNA, 19 nt, Homo sapiens
gaaacuggacaacauccuu

SEQ ID NO: 395243 - RNA, 19 nt, Homo sapiens
ggagaccucauguuucaga

SEQ ID NO: 395244 - RNA, 19 nt, Homo sapiens
gagaacaacauucggaaag

SEQ ID NO: 395245 - RNA, 19 nt, Homo sapiens
cagaggaaucgccaaagua

SEQ ID NO: 395246 - RNA, 19 nt, Homo sapiens
ggcaggguuugcaguguaa

SEQ ID NO: 395247 - RNA, 19 nt, Homo sapiens
ggucaacggccacaaguuc

SEQ ID NO: 395248 - RNA, 19 nt, Homo sapiens
cuacagggauuugaaacug

SEQ ID NO: 395249 - RNA, 19 nt, Homo sapiens
ucggaaagccuugucauuu

SEQ ID NO: 395250 - RNA, 19 nt, Homo sapiens
cggcaggguuugcagugua

SEQ ID NO: 395251 - RNA, 19 nt, Homo sapiens
gcagcacccauucuucaaa

SEQ ID NO: 395252 - RNA, 19 nt, Homo sapiens
uguaaagucugcaaaauga

SEQ ID NO: 395253 - RNA, 19 nt, Homo sapiens
gaguguaugugaucaucga

SEQ ID NO: 395254 - RNA, 19 nt, Homo sapiens
cuucaaaccacgcauuaaa

SEQ ID NO: 395255 - RNA, 19 nt, Homo sapiens
cauggaauauguaaauggu

SEQ ID NO: 395256 - RNA, 19 nt, Homo sapiens
caaagugugcuggguuaaa

SEQ ID NO: 395257 - RNA, 19 nt, Homo sapiens
aggaggaauucaaagguuu

SEQ ID NO: 395258 - RNA, 19 nt, Homo sapiens
gucagcaucuugaaagcuu

SEQ ID NO: 395259 - RNA, 19 nt, Homo sapiens
ccaccaagcagaagaccaa

SEQ ID NO: 395260 - RNA, 19 nt, Homo sapiens
ggauaccagugucaagucu

SEQ ID NO: 395261 - RNA, 19 nt, Homo sapiens
gcaauuguaaagcagauca

SEQ ID NO: 395262 - RNA, 19 nt, Homo sapiens
cgucauggaauauguaaau

SEQ ID NO: 395263 - RNA, 19 nt, Homo sapiens
caaguucgguauccacaac

SEQ ID NO: 395264 - RNA, 19 nt, Homo sapiens
caaugaagagcguguguuc

SEQ ID NO: 395265 - RNA, 19 nt, Homo sapiens
ugggacuccugacuacaua

SEQ ID NO: 395266 - RNA, 19 nt, Homo sapiens
gcacaaugacagagaagag

SEQ ID NO: 395267 - RNA, 19 nt, Homo sapiens
gcagaucaaccaggaggaa

SEQ ID NO: 395268 - RNA, 19 nt, Homo sapiens
acaaugaggacgaccuauu

SEQ ID NO: 395269 - RNA, 19 nt, Homo sapiens
gugcugauguacgagauga

SEQ ID NO: 395270 - RNA, 19 nt, Homo sapiens
ggucacaucggcccucaug

SEQ ID NO: 395271 - RNA, 19 nt, Homo sapiens
ugacguggacugcacaaug

SEQ ID NO: 395272 - RNA, 19 nt, Homo sapiens
ucuggaagcucaccaucug

SEQ ID NO: 395273 - RNA, 19 nt, Homo sapiens
aaagugugcuggguuaaag

SEQ ID NO: 395274 - RNA, 19 nt, Homo sapiens
gcucauaaucacaaagugu

SEQ ID NO: 395275 - RNA, 19 nt, Homo sapiens
gaucgagcuggcugucuuu

SEQ ID NO: 395276 - RNA, 19 nt, Homo sapiens
cgacaaugaggacgaccua

SEQ ID NO: 395277 - RNA, 19 nt, Homo sapiens
ccacuucgaggacuggauu

SEQ ID NO: 395278 - RNA, 19 nt, Homo sapiens
gagcucauaaucacaaagu

SEQ ID NO: 395279 - RNA, 19 nt, Homo sapiens
acaaguucauggccaccua

SEQ ID NO: 395280 - RNA, 19 nt, Homo sapiens
gaucaaccaggaggaauuc

SEQ ID NO: 395281 - RNA, 19 nt, Homo sapiens
cagcacccauucuucaaag

SEQ ID NO: 395282 - RNA, 19 nt, Homo sapiens
aagcuuucaugacgaagaa

SEQ ID NO: 395283 - RNA, 19 nt, Homo sapiens
ucaagcagcacccauucuu

SEQ ID NO: 395284 - RNA, 19 nt, Homo sapiens
gaggacgaccuauuugagu

SEQ ID NO: 395285 - RNA, 19 nt, Homo sapiens
caauggccuucuuaagauc

SEQ ID NO: 395286 - RNA, 19 nt, Homo sapiens
guucauggccaccuaucuu

SEQ ID NO: 395287 - RNA, 19 nt, Homo sapiens
ccaaaagagacgucaauaa

SEQ ID NO: 395288 - RNA, 19 nt, Homo sapiens
uucaauggccuucuuaaga

SEQ ID NO: 395289 - RNA, 19 nt, Homo sapiens
caucuacagggauuugaaa

SEQ ID NO: 395290 - RNA, 19 nt, Homo sapiens
ggaggaauucaaagguuuc

SEQ ID NO: 395291 - RNA, 19 nt, Homo sapiens
acgaagcaauuguaaagca

SEQ ID NO: 395292 - RNA, 19 nt, Homo sapiens
ccuuugaggccgacaauga

SEQ ID NO: 395293 - RNA, 19 nt, Homo sapiens
uauaugcugugaaggucuu

SEQ ID NO: 395294 - RNA, 19 nt, Homo sapiens
ccugauggccagcugauga

SEQ ID NO: 395295 - RNA, 19 nt, Homo sapiens
caacaugccccacaaguuc

SEQ ID NO: 395296 - RNA, 19 nt, Homo sapiens
gcgaggccgugagcuugaa

SEQ ID NO: 395297 - RNA, 19 nt, Homo sapiens
aaacggccaccaagcagaa

SEQ ID NO: 395298 - RNA, 19 nt, Homo sapiens
ggaagaucgauccaaguca

SEQ ID NO: 395299 - RNA, 19 nt, Homo sapiens
cuggacagccucccuuuga

SEQ ID NO: 395300 - RNA, 19 nt, Homo sapiens
gccacgagcucauaaucac

SEQ ID NO: 395301 - RNA, 19 nt, Homo sapiens
uugaguccauccuccauga

SEQ ID NO: 395302 - RNA, 19 nt, Homo sapiens
agaucgagcuggcugucuu

SEQ ID NO: 395303 - RNA, 19 nt, Homo sapiens
gaagaguguaugugaucau

SEQ ID NO: 395304 - RNA, 19 nt, Homo sapiens
gccagaaggaagaguguau

SEQ ID NO: 395305 - RNA, 19 nt, Homo sapiens
ccaucaagcagcacccauu

SEQ ID NO: 395306 - RNA, 19 nt, Homo sapiens
gcgaggacgccaucaagca

SEQ ID NO: 395307 - RNA, 19 nt, Homo sapiens
acugcaagcuggcugacuu

SEQ ID NO: 395308 - RNA, 19 nt, Homo sapiens
gguggagaccucauguuuc

SEQ ID NO: 395309 - RNA, 19 nt, Homo sapiens
gccugggccuggaugaguu

SEQ ID NO: 395310 - RNA, 19 nt, Homo sapiens
ugagaacaacauucggaaa

SEQ ID NO: 395311 - RNA, 19 nt, Homo sapiens
gaauguucaccgucgaugu

SEQ ID NO: 395312 - RNA, 19 nt, Homo sapiens
ggaaugagaccuuuguguu

SEQ ID NO: 395313 - RNA, 19 nt, Homo sapiens
caacagcugggcaaguuua

SEQ ID NO: 395314 - RNA, 19 nt, Homo sapiens
gaaugagaccuuuguguuc

SEQ ID NO: 395315 - RNA, 19 nt, Homo sapiens
gggagcggcuggaacgauu

SEQ ID NO: 395316 - RNA, 19 nt, Homo sapiens
guucaccgcucgcuucuuc

SEQ ID NO: 395317 - RNA, 19 nt, Homo sapiens
gcagaugagauccacguaa

SEQ ID NO: 395318 - RNA, 19 nt, Homo sapiens
ggauggcugguacaaguua

SEQ ID NO: 395319 - RNA, 19 nt, Homo sapiens
ugucaagucugcagcuuug

SEQ ID NO: 395320 - RNA, 19 nt, Homo sapiens
guggauggcugguacaagu

SEQ ID NO: 395321 - RNA, 19 nt, Homo sapiens
gcccguaaccuaauuccua

SEQ ID NO: 395322 - RNA, 19 nt, Homo sapiens
gcuaaacccuguguggaau

SEQ ID NO: 395323 - RNA, 19 nt, Homo sapiens
gaucccgccuccuuucaga

SEQ ID NO: 395324 - RNA, 19 nt, Homo sapiens
ggacgaggaggagcuguuu

SEQ ID NO: 395325 - RNA, 19 nt, Homo sapiens
gggcgaguauuacaaugug

SEQ ID NO: 395326 - RNA, 19 nt, Homo sapiens
ggaguucugcuguaugaga

SEQ ID NO: 395327 - RNA, 19 nt, Homo sapiens
aggaggagggcgaguauua

SEQ ID NO: 395328 - RNA, 19 nt, Homo sapiens
gcagccuccuccagaaguu

SEQ ID NO: 395329 - RNA, 19 nt, Homo sapiens
gagauccacguaacuguug

SEQ ID NO: 395330 - RNA, 19 nt, Homo sapiens
ccuggucccugcuacguuu

SEQ ID NO: 395331 - RNA, 19 nt, Homo sapiens
gaagcuggacaaugugaug

SEQ ID NO: 395332 - RNA, 19 nt, Homo sapiens
ggagggcgaguauuacaau

SEQ ID NO: 395333 - RNA, 19 nt, Homo sapiens
cagaugagauccacguaac

SEQ ID NO: 395334 - RNA, 19 nt, Homo sapiens
uaaacccuguguggaauga

SEQ ID NO: 395335 - RNA, 19 nt, Homo sapiens
aaugagaccuuuguguuca

SEQ ID NO: 395336 - RNA, 19 nt, Homo sapiens
guuugaggcuuguaacuac

SEQ ID NO: 395337 - RNA, 19 nt, Homo sapiens
cgaggcccguaaccuaauu

SEQ ID NO: 395338 - RNA, 19 nt, Homo sapiens
uuggaguucugcuguauga

SEQ ID NO: 395339 - RNA, 19 nt, Homo sapiens
uguauuucgugauggagua

SEQ ID NO: 395340 - RNA, 19 nt, Homo sapiens
caucaagaucacugacuuu

SEQ ID NO: 395341 - RNA, 19 nt, Homo sapiens
gagggacacaucaagauca

SEQ ID NO: 395342 - RNA, 19 nt, Homo sapiens
caccagggcaugaaauguu

SEQ ID NO: 395343 - RNA, 19 nt, Homo sapiens
ccacugcaccgacuucauc

SEQ ID NO: 395344 - RNA, 19 nt, Homo sapiens
gaguucugcuguaugagau

SEQ ID NO: 395345 - RNA, 19 nt, Homo sapiens
gcucuacgccaucaagauc

SEQ ID NO: 395346 - RNA, 19 nt, Homo sapiens
cgacuucagcuuccucaug

SEQ ID NO: 395347 - RNA, 19 nt, Homo sapiens
ggcgaggcccguaaccuaa

SEQ ID NO: 395348 - RNA, 19 nt, Homo sapiens
acaucaagaucacugacuu

SEQ ID NO: 395349 - RNA, 19 nt, Homo sapiens
gucaagagccacaaguuca

SEQ ID NO: 395350 - RNA, 19 nt, Homo sapiens
gagggcgaguauuacaaug

SEQ ID NO: 395351 - RNA, 19 nt, Homo sapiens
gaaccugacgaaacagaag

SEQ ID NO: 395352 - RNA, 19 nt, Homo sapiens
gaagucaagagccacaagu

SEQ ID NO: 395353 - RNA, 19 nt, Homo sapiens
gaggagggcgaguauuaca

SEQ ID NO: 395354 - RNA, 19 nt, Homo sapiens
gaugagauccacguaacug

SEQ ID NO: 395355 - RNA, 19 nt, Homo sapiens
cacaaguuccgccugcaua

SEQ ID NO: 395356 - RNA, 19 nt, Homo sapiens
gcugagggacacaucaaga

SEQ ID NO: 395357 - RNA, 19 nt, Homo sapiens
acaaucagggcaucaucua

SEQ ID NO: 395358 - RNA, 19 nt, Homo sapiens
gguacaaguuacugaacca

SEQ ID NO: 395359 - RNA, 19 nt, Homo sapiens
cccguaaccuaauuccuau

SEQ ID NO: 395360 - RNA, 19 nt, Homo sapiens
ucgacgaugccacgaauuu

SEQ ID NO: 395361 - RNA, 19 nt, Homo sapiens
uaugggaagucugucgauu

SEQ ID NO: 395362 - RNA, 19 nt, Homo sapiens
ucaagcagcccaccuucug

SEQ ID NO: 395363 - RNA, 19 nt, Homo sapiens
accugaagcuggacaaugu

SEQ ID NO: 395364 - RNA, 19 nt, Homo sapiens
uucaacagcugggcaaguu

SEQ ID NO: 395365 - RNA, 19 nt, Homo sapiens
gcacgcugguggagaaacg

SEQ ID NO: 395366 - RNA, 19 nt, Homo sapiens
ggaaccugacgaaacagaa

SEQ ID NO: 395367 - RNA, 19 nt, Homo sapiens
ucucugaucccuaugugaa

SEQ ID NO: 395368 - RNA, 19 nt, Homo sapiens
ggcaugaaauguucuugcu

SEQ ID NO: 395369 - RNA, 19 nt, Homo sapiens
gacgaugccacgaauuugu

SEQ ID NO: 395370 - RNA, 19 nt, Homo sapiens
gcaagggguuccugaccaa

SEQ ID NO: 395371 - RNA, 19 nt, Homo sapiens
ugggaagucugucgauugg

SEQ ID NO: 395372 - RNA, 19 nt, Homo sapiens
ucacugacuuuggcaugug

SEQ ID NO: 395373 - RNA, 19 nt, Homo sapiens
ggaccucccgcaacgacuu

SEQ ID NO: 395374 - RNA, 19 nt, Homo sapiens
ggccugcaaugucaagucu

SEQ ID NO: 395375 - RNA, 19 nt, Homo sapiens
guaaccuaauuccuaugga

SEQ ID NO: 395376 - RNA, 19 nt, Homo sapiens
uggaacaaacugucaccua

SEQ ID NO: 395377 - RNA, 19 nt, Homo sapiens
uggcgaggcccguaaccua

SEQ ID NO: 395378 - RNA, 19 nt, Homo sapiens
gcaccagggcaugaaaugu

SEQ ID NO: 395379 - RNA, 19 nt, Homo sapiens
gccacgaauuugugaccuu

SEQ ID NO: 395380 - RNA, 19 nt, Homo sapiens
gcagcggcgagaacuuuga

SEQ ID NO: 395381 - RNA, 19 nt, Homo sapiens
gucgauuggugguccuuug

SEQ ID NO: 395382 - RNA, 19 nt, Homo sapiens
ccucaugguucuaggaaaa

SEQ ID NO: 395383 - RNA, 19 nt, Homo sapiens
ggugaaagccacgcuaaac

SEQ ID NO: 395384 - RNA, 19 nt, Homo sapiens
ugagauccacguaacuguu

SEQ ID NO: 395385 - RNA, 19 nt, Homo sapiens
gccugugcccgucauguaa

SEQ ID NO: 395386 - RNA, 19 nt, Homo sapiens
caggacagccucccuucga

SEQ ID NO: 395387 - RNA, 19 nt, Homo sapiens
cgacaacccgcaccuucug

SEQ ID NO: 395388 - RNA, 19 nt, Homo sapiens
gaccugaagcuggacaaug

SEQ ID NO: 395389 - RNA, 19 nt, Homo sapiens
ccgccuguauuucgugaug

SEQ ID NO: 395390 - RNA, 19 nt, Homo sapiens
cucggaaccugacgaaaca

SEQ ID NO: 395391 - RNA, 19 nt, Homo sapiens
gagaucccgccuccuuuca

SEQ ID NO: 395392 - RNA, 19 nt, Homo sapiens
ccuuuggaguucugcugua

SEQ ID NO: 395393 - RNA, 19 nt, Homo sapiens
ccaggaggagggcgaguau

SEQ ID NO: 395394 - RNA, 19 nt, Homo sapiens
gcugguacaaguuacugaa

SEQ ID NO: 395395 - RNA, 19 nt, Homo sapiens
cgacgaugccacgaauuug

SEQ ID NO: 395396 - RNA, 19 nt, Homo sapiens
agaaguuugaggcuuguaa

SEQ ID NO: 395397 - RNA, 19 nt, Homo sapiens
ccagaaguuugaggcuugu

SEQ ID NO: 395398 - RNA, 19 nt, Homo sapiens
ggacgacaacccgcaccuu

SEQ ID NO: 395399 - RNA, 19 nt, Homo sapiens
acugcacgcugguggagaa

SEQ ID NO: 395400 - RNA, 19 nt, Homo sapiens
ggaggagggcgaguauuac

SEQ ID NO: 395401 - RNA, 19 nt, Homo sapiens
aaucagggcaucaucuaca

SEQ ID NO: 395402 - RNA, 19 nt, Homo sapiens
ggccucuucuuccuucaca

SEQ ID NO: 395403 - RNA, 19 nt, Homo sapiens
gagcucuacgccaucaaga

SEQ ID NO: 395404 - RNA, 19 nt, Homo sapiens
cugcacaucuccgacuuca

SEQ ID NO: 395405 - RNA, 19 nt, Homo sapiens
gaagacccgaacggugaaa

SEQ ID NO: 395406 - RNA, 19 nt, Homo sapiens
cauccgugcacauggcuuu

SEQ ID NO: 395407 - RNA, 19 nt, Homo sapiens
gccuguauuucgugaugga

SEQ ID NO: 395408 - RNA, 19 nt, Homo sapiens
gaaguuugaggcuuguaac

SEQ ID NO: 395409 - RNA, 19 nt, Homo sapiens
gcgaggcccguaaccuaau

SEQ ID NO: 395410 - RNA, 19 nt, Homo sapiens
gagaagaugucaguaauuu

SEQ ID NO: 395411 - RNA, 19 nt, Homo sapiens
gcucaucacugaagaauug

SEQ ID NO: 395412 - RNA, 19 nt, Homo sapiens
caaaguggauucaaagauu

SEQ ID NO: 395413 - RNA, 19 nt, Homo sapiens
gggaaagugugaagaauaa

SEQ ID NO: 395414 - RNA, 19 nt, Homo sapiens
gacaaggacuucaguguaa

SEQ ID NO: 395415 - RNA, 19 nt, Homo sapiens
gggcauauaucaaagauga

SEQ ID NO: 395416 - RNA, 19 nt, Homo sapiens
ggauggaacuuucagauau

SEQ ID NO: 395417 - RNA, 19 nt, Homo sapiens
gaaguucaauggcuauuug

SEQ ID NO: 395418 - RNA, 19 nt, Homo sapiens
ggacaucuuccaaugauua

SEQ ID NO: 395419 - RNA, 19 nt, Homo sapiens
gaccggaucuucaaacauu

SEQ ID NO: 395420 - RNA, 19 nt, Homo sapiens
gcugaaccaucgccaaaua

SEQ ID NO: 395421 - RNA, 19 nt, Homo sapiens
gcaccugugucguccauaa

SEQ ID NO: 395422 - RNA, 19 nt, Homo sapiens
gaagaaacaaacaauggua

SEQ ID NO: 395423 - RNA, 19 nt, Homo sapiens
augaagggcuuuccaaaua

SEQ ID NO: 395424 - RNA, 19 nt, Homo sapiens
agaagucucuuaaugcuaa

SEQ ID NO: 395425 - RNA, 19 nt, Homo sapiens
ccagauuuguggcuuauaa

SEQ ID NO: 395426 - RNA, 19 nt, Homo sapiens
gaagaacucugugaaggau

SEQ ID NO: 395427 - RNA, 19 nt, Homo sapiens
ugaaaugccucuccacguu

SEQ ID NO: 395428 - RNA, 19 nt, Homo sapiens
caaucaggcuucuuaauuc

SEQ ID NO: 395429 - RNA, 19 nt, Homo sapiens
aaacagggcauauaucaaa

SEQ ID NO: 395430 - RNA, 19 nt, Homo sapiens
cauaaacgcugccaucauc

SEQ ID NO: 395431 - RNA, 19 nt, Homo sapiens
aaucugaucuugucuguau

SEQ ID NO: 395432 - RNA, 19 nt, Homo sapiens
caacagguuugcauucaug

SEQ ID NO: 395433 - RNA, 19 nt, Homo sapiens
gugcugugcucuucuuuaa

SEQ ID NO: 395434 - RNA, 19 nt, Homo sapiens
gaagggcuuuccaaauaga

SEQ ID NO: 395435 - RNA, 19 nt, Homo sapiens
ccaaucaggcuucuuaauu

SEQ ID NO: 395436 - RNA, 19 nt, Homo sapiens
gaaaggagagcagcaaaga

SEQ ID NO: 395437 - RNA, 19 nt, Homo sapiens
acaagaaccuuaccuucaa

SEQ ID NO: 395438 - RNA, 19 nt, Homo sapiens
ccacgagggucacuguaaa

SEQ ID NO: 395439 - RNA, 19 nt, Homo sapiens
guaaacagggcauauauca

SEQ ID NO: 395440 - RNA, 19 nt, Homo sapiens
gauuuacucugaagaaaca

SEQ ID NO: 395441 - RNA, 19 nt, Homo sapiens
gaauaaaguagaucugaga

SEQ ID NO: 395442 - RNA, 19 nt, Homo sapiens
gauguggaaugcaccauga

SEQ ID NO: 395443 - RNA, 19 nt, Homo sapiens
gcaggaugaugauguggaa

SEQ ID NO: 395444 - RNA, 19 nt, Homo sapiens
ggacuucaguguaaaauau

SEQ ID NO: 395445 - RNA, 19 nt, Homo sapiens
agaaauggaucuuguaaac

SEQ ID NO: 395446 - RNA, 19 nt, Homo sapiens
acagucagcgggugaauua

SEQ ID NO: 395447 - RNA, 19 nt, Homo sapiens
ugaaggugcugaagaagga

SEQ ID NO: 395448 - RNA, 19 nt, Homo sapiens
cgacaaggacuucagugua

SEQ ID NO: 395449 - RNA, 19 nt, Homo sapiens
ucuggagucuacuaauuua

SEQ ID NO: 395450 - RNA, 19 nt, Homo sapiens
caacugugcugugcucuuc

SEQ ID NO: 395451 - RNA, 19 nt, Homo sapiens
caacaucccacacaaguuc

SEQ ID NO: 395452 - RNA, 19 nt, Homo sapiens
gcaccaagcagaagaccaa

SEQ ID NO: 395453 - RNA, 19 nt, Homo sapiens
cuaugugucuccagaauug

SEQ ID NO: 395454 - RNA, 19 nt, Homo sapiens
gaaaugggauugggguuaa

SEQ ID NO: 395455 - RNA, 19 nt, Homo sapiens
ggagggaaagugugaagaa

SEQ ID NO: 395456 - RNA, 19 nt, Homo sapiens
cuaccuggcuccaugaaga

SEQ ID NO: 395457 - RNA, 19 nt, Homo sapiens
ggagaccucuaugcuguga

SEQ ID NO: 395458 - RNA, 19 nt, Homo sapiens
gauggaacuuucagauauc

SEQ ID NO: 395459 - RNA, 19 nt, Homo sapiens
ugaccagauuuguggcuua

SEQ ID NO: 395460 - RNA, 19 nt, Homo sapiens
caaacaaugguaucucuga

SEQ ID NO: 395461 - RNA, 19 nt, Homo sapiens
ucaaggagcaagugaagaa

SEQ ID NO: 395462 - RNA, 19 nt, Homo sapiens
ugagggacaucuuccaaug

SEQ ID NO: 395463 - RNA, 19 nt, Homo sapiens
caaagaaggaaaugggauu

SEQ ID NO: 395464 - RNA, 19 nt, Homo sapiens
guaaucugaucuugucugu

SEQ ID NO: 395465 - RNA, 19 nt, Homo sapiens
gauguuaacaggagccaaa

SEQ ID NO: 395466 - RNA, 19 nt, Homo sapiens
guauaccgcuccaccuaug

SEQ ID NO: 395467 - RNA, 19 nt, Homo sapiens
aaaguggauucaaagauug

SEQ ID NO: 395468 - RNA, 19 nt, Homo sapiens
aaacaaugguaucucugaa

SEQ ID NO: 395469 - RNA, 19 nt, Homo sapiens
ccgagaagaugucaguaau

SEQ ID NO: 395470 - RNA, 19 nt, Homo sapiens
gauguguguuugauauuca

SEQ ID NO: 395471 - RNA, 19 nt, Homo sapiens
gcaggccacucaugucagu

SEQ ID NO: 395472 - RNA, 19 nt, Homo sapiens
gagggaaagugugaagaau

SEQ ID NO: 395473 - RNA, 19 nt, Homo sapiens
uaaccaggaugaguuuaga

SEQ ID NO: 395474 - RNA, 19 nt, Homo sapiens
gaaccaucgccaaauagaa

SEQ ID NO: 395475 - RNA, 19 nt, Homo sapiens
cuauaucgcuccagagauc

SEQ ID NO: 395476 - RNA, 19 nt, Homo sapiens
ccaacaaacccacguacaa

SEQ ID NO: 395477 - RNA, 19 nt, Homo sapiens
gagaccggaucuucaaaca

SEQ ID NO: 395478 - RNA, 19 nt, Homo sapiens
gaagaugucaguaauuuug

SEQ ID NO: 395479 - RNA, 19 nt, Homo sapiens
uaacaaaguggauucaaag

SEQ ID NO: 395480 - RNA, 19 nt, Homo sapiens
aaauggaucuuguaaacag

SEQ ID NO: 395481 - RNA, 19 nt, Homo sapiens
ugaagggcuuuccaaauag

SEQ ID NO: 395482 - RNA, 19 nt, Homo sapiens
gaaagugugaagaauaaag

SEQ ID NO: 395483 - RNA, 19 nt, Homo sapiens
caaauagaaccgccuuuca

SEQ ID NO: 395484 - RNA, 19 nt, Homo sapiens
gaccagauuuguggcuuau

SEQ ID NO: 395485 - RNA, 19 nt, Homo sapiens
gccgugugcucaucacuga

SEQ ID NO: 395486 - RNA, 19 nt, Homo sapiens
cuacuaauuuaccugaaug

SEQ ID NO: 395487 - RNA, 19 nt, Homo sapiens
aaguagaucugagaaauuc

SEQ ID NO: 395488 - RNA, 19 nt, Homo sapiens
aaucaaaucccgagaagau

SEQ ID NO: 395489 - RNA, 19 nt, Homo sapiens
guacgggccugcaguagac

SEQ ID NO: 395490 - RNA, 19 nt, Homo sapiens
gaaggcgaguccaccagau

SEQ ID NO: 395491 - RNA, 19 nt, Homo sapiens
gaaauggaucuuguaaaca

SEQ ID NO: 395492 - RNA, 19 nt, Homo sapiens
gaugcaaagauguguguuu

SEQ ID NO: 395493 - RNA, 19 nt, Homo sapiens
gcuucagcuucuucucuua

SEQ ID NO: 395494 - RNA, 19 nt, Homo sapiens
aaaccaagacguucuguca

SEQ ID NO: 395495 - RNA, 19 nt, Homo sapiens
gauuaaccaggaugaguuu

SEQ ID NO: 395496 - RNA, 19 nt, Homo sapiens
gacuggaaauaaaugcauu

SEQ ID NO: 395497 - RNA, 19 nt, Homo sapiens
gacccugacuucauaaagg

SEQ ID NO: 395498 - RNA, 19 nt, Homo sapiens
ccacagggauccuaaaauc

SEQ ID NO: 395499 - RNA, 19 nt, Homo sapiens
auucaaagauugcagaaca

SEQ ID NO: 395500 - RNA, 19 nt, Homo sapiens
gaaacaaacaaugguaucu

SEQ ID NO: 395501 - RNA, 19 nt, Homo sapiens
agccauggcacuagaaaua

SEQ ID NO: 395502 - RNA, 19 nt, Homo sapiens
gaucugaaacuggacaaug

SEQ ID NO: 395503 - RNA, 19 nt, Homo sapiens
ugauggaguuugugaaugg

SEQ ID NO: 395504 - RNA, 19 nt, Homo sapiens
gaacguggccccuaacugu

SEQ ID NO: 395505 - RNA, 19 nt, Homo sapiens
cuccagaauugcaaccaua

SEQ ID NO: 395506 - RNA, 19 nt, Homo sapiens
caaugggcguguugcucua

SEQ ID NO: 395507 - RNA, 19 nt, Homo sapiens
gagcagcaaagaaggaaau

SEQ ID NO: 395508 - RNA, 19 nt, Homo sapiens
ggagagcagcaaagaagga

SEQ ID NO: 395509 - RNA, 19 nt, Homo sapiens
acgcugccaucaucuaauu

SEQ ID NO: 395510 - RNA, 19 nt, Homo sapiens
gaagaagccuuuagacuuu

SEQ ID NO: 395511 - RNA, 19 nt, Homo sapiens
gaacagcucuucaccauga

SEQ ID NO: 395512 - RNA, 19 nt, Homo sapiens
gauuaucucuuccaaguua

SEQ ID NO: 395513 - RNA, 19 nt, Homo sapiens
gaaacuggacaauguauua

SEQ ID NO: 395514 - RNA, 19 nt, Homo sapiens
gcaggaaggucuccauuug

SEQ ID NO: 395515 - RNA, 19 nt, Homo sapiens
agaaaucagucuagcauua

SEQ ID NO: 395516 - RNA, 19 nt, Homo sapiens
ugaagaacaugccagauuu

SEQ ID NO: 395517 - RNA, 19 nt, Homo sapiens
uuacauugcuccugaaauu

SEQ ID NO: 395518 - RNA, 19 nt, Homo sapiens
cuacucauguugccauuua

SEQ ID NO: 395519 - RNA, 19 nt, Homo sapiens
caaguguucugaagaguuu

SEQ ID NO: 395520 - RNA, 19 nt, Homo sapiens
cccaauaucuucucuugua

SEQ ID NO: 395521 - RNA, 19 nt, Homo sapiens
gaggagaccuaauguuuca

SEQ ID NO: 395522 - RNA, 19 nt, Homo sapiens
ggugguaccucccuuuaaa

SEQ ID NO: 395523 - RNA, 19 nt, Homo sapiens
gaaaucagucuagcauuaa

SEQ ID NO: 395524 - RNA, 19 nt, Homo sapiens
gcaaugaacaccagggaaa

SEQ ID NO: 395525 - RNA, 19 nt, Homo sapiens
gauuaugguuucaguguug

SEQ ID NO: 395526 - RNA, 19 nt, Homo sapiens
gcagauuguucuuuguuau

SEQ ID NO: 395527 - RNA, 19 nt, Homo sapiens
ggaguuagaagaagccuuu

SEQ ID NO: 395528 - RNA, 19 nt, Homo sapiens
uaucuucucuuguagacua

SEQ ID NO: 395529 - RNA, 19 nt, Homo sapiens
ggaucaaguuggugaagaa

SEQ ID NO: 395530 - RNA, 19 nt, Homo sapiens
gccauaaacucgucacaau

SEQ ID NO: 395531 - RNA, 19 nt, Homo sapiens
aaacaggauuugcugauau

SEQ ID NO: 395532 - RNA, 19 nt, Homo sapiens
gaaggucuccauuugauau

SEQ ID NO: 395533 - RNA, 19 nt, Homo sapiens
gaucguauuuaugcaauga

SEQ ID NO: 395534 - RNA, 19 nt, Homo sapiens
ggagacccguguacaguau

SEQ ID NO: 395535 - RNA, 19 nt, Homo sapiens
gaucagucauccaugcauu

SEQ ID NO: 395536 - RNA, 19 nt, Homo sapiens
aaacaaggauucugaacuc

SEQ ID NO: 395537 - RNA, 19 nt, Homo sapiens
caaauucgcauaccacguu

SEQ ID NO: 395538 - RNA, 19 nt, Homo sapiens
acauuaaacucacugacua

SEQ ID NO: 395539 - RNA, 19 nt, Homo sapiens
gcaaugagguucgagacau

SEQ ID NO: 395540 - RNA, 19 nt, Homo sapiens
gagcaggcauccaaucauc

SEQ ID NO: 395541 - RNA, 19 nt, Homo sapiens
cauaagaagugccauaaac

SEQ ID NO: 395542 - RNA, 19 nt, Homo sapiens
guaccucccuuuaaaccaa

SEQ ID NO: 395543 - RNA, 19 nt, Homo sapiens
cagagaagcauguguuuga

SEQ ID NO: 395544 - RNA, 19 nt, Homo sapiens
ggauauaagugcaucaacu

SEQ ID NO: 395545 - RNA, 19 nt, Homo sapiens
gcaagccuggauacaauua

SEQ ID NO: 395546 - RNA, 19 nt, Homo sapiens
gaccuaauguuucauaugc

SEQ ID NO: 395547 - RNA, 19 nt, Homo sapiens
cauaaacucgucacaauug

SEQ ID NO: 395548 - RNA, 19 nt, Homo sapiens
gaguauaucaauccucuuu

SEQ ID NO: 395549 - RNA, 19 nt, Homo sapiens
gaggagaagauuaugguuu

SEQ ID NO: 395550 - RNA, 19 nt, Homo sapiens
ggagaccuaauguuucaua

SEQ ID NO: 395551 - RNA, 19 nt, Homo sapiens
cauauaauccuucaaguca

SEQ ID NO: 395552 - RNA, 19 nt, Homo sapiens
agaagaagccuuuagacuu

SEQ ID NO: 395553 - RNA, 19 nt, Homo sapiens
aaacagaucguauuuaugc

SEQ ID NO: 395554 - RNA, 19 nt, Homo sapiens
gaaugugucugauccucau

SEQ ID NO: 395555 - RNA, 19 nt, Homo sapiens
gaacacagaggauuaucuc

SEQ ID NO: 395556 - RNA, 19 nt, Homo sapiens
ggaaggucuccauuugaua

SEQ ID NO: 395557 - RNA, 19 nt, Homo sapiens
caugagcgagggauaauuu

SEQ ID NO: 395558 - RNA, 19 nt, Homo sapiens
gcagaaaucagucuagcau

SEQ ID NO: 395559 - RNA, 19 nt, Homo sapiens
aagaggaaguuaugccaaa

SEQ ID NO: 395560 - RNA, 19 nt, Homo sapiens
gucuaggucuucaggauuu

SEQ ID NO: 395561 - RNA, 19 nt, Homo sapiens
caucucaguuggaguuaga

SEQ ID NO: 395562 - RNA, 19 nt, Homo sapiens
gaaauggauagaugaggaa

SEQ ID NO: 395563 - RNA, 19 nt, Homo sapiens
acagaugaguaaugaaguu

SEQ ID NO: 395564 - RNA, 19 nt, Homo sapiens
gauucucaguuuacuaaug

SEQ ID NO: 395565 - RNA, 19 nt, Homo sapiens
ggaggagaccuaauguuuc

SEQ ID NO: 395566 - RNA, 19 nt, Homo sapiens
gcacagacaguaauuccau

SEQ ID NO: 395567 - RNA, 19 nt, Homo sapiens
uggaggagaccuaauguuu

SEQ ID NO: 395568 - RNA, 19 nt, Homo sapiens
guaaauggaggagaccuaa

SEQ ID NO: 395569 - RNA, 19 nt, Homo sapiens
uauaauccuucaagucaug

SEQ ID NO: 395570 - RNA, 19 nt, Homo sapiens
cacccaauaucuucucuug

SEQ ID NO: 395571 - RNA, 19 nt, Homo sapiens
gcaaguguucugaagaguu

SEQ ID NO: 395572 - RNA, 19 nt, Homo sapiens
ggagauacaaccagcacuu

SEQ ID NO: 395573 - RNA, 19 nt, Homo sapiens
caaugagguucgagacaug

SEQ ID NO: 395574 - RNA, 19 nt, Homo sapiens
gaaggccacauuaaacuca

SEQ ID NO: 395575 - RNA, 19 nt, Homo sapiens
gccuacagaugaguaauga

SEQ ID NO: 395576 - RNA, 19 nt, Homo sapiens
aaucauccuuuccuuguug

SEQ ID NO: 395577 - RNA, 19 nt, Homo sapiens
gauauugauuggguacaga

SEQ ID NO: 395578 - RNA, 19 nt, Homo sapiens
uuugaugucugcagaagaa

SEQ ID NO: 395579 - RNA, 19 nt, Homo sapiens
uaauaaggacccuaaggaa

SEQ ID NO: 395580 - RNA, 19 nt, Homo sapiens
gagauacaaccagcacuuu

SEQ ID NO: 395581 - RNA, 19 nt, Homo sapiens
aggaaguuaugccaaagua

SEQ ID NO: 395582 - RNA, 19 nt, Homo sapiens
gaccaugcacagacaguaa

SEQ ID NO: 395583 - RNA, 19 nt, Homo sapiens
agucauccaugcauucuga

SEQ ID NO: 395584 - RNA, 19 nt, Homo sapiens
aagaagccuuuagacuuua

SEQ ID NO: 395585 - RNA, 19 nt, Homo sapiens
gaggaagauugaucagucu

SEQ ID NO: 395586 - RNA, 19 nt, Homo sapiens
aggagaagauuaugguuuc

SEQ ID NO: 395587 - RNA, 19 nt, Homo sapiens
ggauuacggccaggagaua

SEQ ID NO: 395588 - RNA, 19 nt, Homo sapiens
cacagacaguaauuccaua

SEQ ID NO: 395589 - RNA, 19 nt, Homo sapiens
gauauaagugcaucaacug

SEQ ID NO: 395590 - RNA, 19 nt, Homo sapiens
acuacuagcuuccagacaa

SEQ ID NO: 395591 - RNA, 19 nt, Homo sapiens
cugcaagccuggauacaau

SEQ ID NO: 395592 - RNA, 19 nt, Homo sapiens
agucugaauuugaagguuu

SEQ ID NO: 395593 - RNA, 19 nt, Homo sapiens
cacguucucugucuguaaa

SEQ ID NO: 395594 - RNA, 19 nt, Homo sapiens
aggauuaucucuuccaagu

SEQ ID NO: 395595 - RNA, 19 nt, Homo sapiens
ggagaagauuaugguuuca

SEQ ID NO: 395596 - RNA, 19 nt, Homo sapiens
gaaguuaugccaaaguacu

SEQ ID NO: 395597 - RNA, 19 nt, Homo sapiens
gagaccuaauguuucauau

SEQ ID NO: 395598 - RNA, 19 nt, Homo sapiens
ccaaucauccuuuccuugu

SEQ ID NO: 395599 - RNA, 19 nt, Homo sapiens
gaaggagacccguguacag

SEQ ID NO: 395600 - RNA, 19 nt, Homo sapiens
ggaauuugguuuggacaac

SEQ ID NO: 395601 - RNA, 19 nt, Homo sapiens
ucugugguacuccuaauua

SEQ ID NO: 395602 - RNA, 19 nt, Homo sapiens
gaaccuuccaucuccuuug

SEQ ID NO: 395603 - RNA, 19 nt, Homo sapiens
caaucauccuuuccuuguu

SEQ ID NO: 395604 - RNA, 19 nt, Homo sapiens
gacagagaagcauguguuu

SEQ ID NO: 395605 - RNA, 19 nt, Homo sapiens
guacuguugguucgauuaa

SEQ ID NO: 395606 - RNA, 19 nt, Homo sapiens
ccauaaacucgucacaauu

SEQ ID NO: 395607 - RNA, 19 nt, Homo sapiens
acgaugacauugugaggaa

SEQ ID NO: 395608 - RNA, 19 nt, Homo sapiens
guuagaagaagccuuuaga

SEQ ID NO: 395609 - RNA, 19 nt, Homo sapiens
gaugaugaggauauugauu

SEQ ID NO: 395610 - RNA, 19 nt, Homo sapiens
cgagagagaugcagaagau

SEQ ID NO: 395611 - RNA, 19 nt, Homo sapiens
caucaaggcucugaagaaa

SEQ ID NO: 395612 - RNA, 19 nt, Homo sapiens
cagaagaugugaagaaaca

SEQ ID NO: 395613 - RNA, 19 nt, Homo sapiens
guaaaucgauacaucauac

SEQ ID NO: 395614 - RNA, 19 nt, Homo sapiens
gaaguuggaggauuucuug

SEQ ID NO: 395615 - RNA, 19 nt, Homo sapiens
ccauugagcugaaggugaa

SEQ ID NO: 395616 - RNA, 19 nt, Homo sapiens
ccucgaagauuucaaguuc

SEQ ID NO: 395617 - RNA, 19 nt, Homo sapiens
gagaagcaguuggccauug

SEQ ID NO: 395618 - RNA, 19 nt, Homo sapiens
caggagaaauugacagaau

SEQ ID NO: 395619 - RNA, 19 nt, Homo sapiens
gaaggagggugcugagaac

SEQ ID NO: 395620 - RNA, 19 nt, Homo sapiens
gaccugaaguuggacaauu

SEQ ID NO: 395621 - RNA, 19 nt, Homo sapiens
ucaaauuccugaaguugga

SEQ ID NO: 395622 - RNA, 19 nt, Homo sapiens
gcugggaucuagcgagaga

SEQ ID NO: 395623 - RNA, 19 nt, Homo sapiens
gaagccaucggcaucauga

SEQ ID NO: 395624 - RNA, 19 nt, Homo sapiens
agaagcaguuggccauuga

SEQ ID NO: 395625 - RNA, 19 nt, Homo sapiens
ucaaggcucugaagaaagg

SEQ ID NO: 395626 - RNA, 19 nt, Homo sapiens
gaggauuucuuggacaaug

SEQ ID NO: 395627 - RNA, 19 nt, Homo sapiens
acaguaagaccaagauuga

SEQ ID NO: 395628 - RNA, 19 nt, Homo sapiens
uggagagccugauguguga

SEQ ID NO: 395629 - RNA, 19 nt, Homo sapiens
ggacagcucaccucagaag

SEQ ID NO: 395630 - RNA, 19 nt, Homo sapiens
ucggacagcucaccucaga

SEQ ID NO: 395631 - RNA, 19 nt, Homo sapiens
gaccaagauugacaucauc

SEQ ID NO: 395632 - RNA, 19 nt, Homo sapiens
ugacagaauccaaccagaa

SEQ ID NO: 395633 - RNA, 19 nt, Homo sapiens
gacaguaagaccaagauug

SEQ ID NO: 395634 - RNA, 19 nt, Homo sapiens
gcgaggcccaggagaaauu

SEQ ID NO: 395635 - RNA, 19 nt, Homo sapiens
gagcggaggcugggaucua

SEQ ID NO: 395636 - RNA, 19 nt, Homo sapiens
ggaaagggcacgggaacug

SEQ ID NO: 395637 - RNA, 19 nt, Homo sapiens
cagagaccaucccguggaa

SEQ ID NO: 395638 - RNA, 19 nt, Homo sapiens
acagcgacguguucucuga

SEQ ID NO: 395639 - RNA, 19 nt, Homo sapiens
gaccacgggugacauaucg

SEQ ID NO: 395640 - RNA, 19 nt, Homo sapiens
agaccaagauugacaucau

SEQ ID NO: 395641 - RNA, 19 nt, Homo sapiens
ugcagaagaugugaagaaa

SEQ ID NO: 395642 - RNA, 19 nt, Homo sapiens
ugaaggagggugcugagaa

SEQ ID NO: 395643 - RNA, 19 nt, Homo sapiens
gcaauggcagcaccaagga

SEQ ID NO: 395644 - RNA, 19 nt, Homo sapiens
ggacaguaagaccaagauu

SEQ ID NO: 395645 - RNA, 19 nt, Homo sapiens
gagaacaccagugaaguca

SEQ ID NO: 395646 - RNA, 19 nt, Homo sapiens
agaacaugauccagaccua

SEQ ID NO: 395647 - RNA, 19 nt, Homo sapiens
ugacagcccagcagauguu

SEQ ID NO: 395648 - RNA, 19 nt, Homo sapiens
ccaucaaggcucugaagaa

SEQ ID NO: 395649 - RNA, 19 nt, Homo sapiens
gagagaugcagaagaugug

SEQ ID NO: 395650 - RNA, 19 nt, Homo sapiens
ggaccggaccagcacauuc

SEQ ID NO: 395651 - RNA, 19 nt, Homo sapiens
gaagaaaggggacauugug

SEQ ID NO: 395652 - RNA, 19 nt, Homo sapiens
ccgcaacccugucauugag

SEQ ID NO: 395653 - RNA, 19 nt, Homo sapiens
gaacacaagaucgucuaca

SEQ ID NO: 395654 - RNA, 19 nt, Homo sapiens
gcccucaaauuccugaagu

SEQ ID NO: 395655 - RNA, 19 nt, Homo sapiens
gauccagaccuacagcaau

SEQ ID NO: 395656 - RNA, 19 nt, Homo sapiens
gacagaauccaaccagaag

SEQ ID NO: 395657 - RNA, 19 nt, Homo sapiens
accugaaguuggacaauuu

SEQ ID NO: 395658 - RNA, 19 nt, Homo sapiens
ggugcugggccuacaguuu

SEQ ID NO: 395659 - RNA, 19 nt, Homo sapiens
cgucaagaucgcagacuuu

SEQ ID NO: 395660 - RNA, 19 nt, Homo sapiens
gaaccucuucggcuguuuc

SEQ ID NO: 395661 - RNA, 19 nt, Homo sapiens
cagcgaggcccaggagaaa

SEQ ID NO: 395662 - RNA, 19 nt, Homo sapiens
gugcugggccuacaguuuc

SEQ ID NO: 395663 - RNA, 19 nt, Homo sapiens
ccucugacccucgaagauu

SEQ ID NO: 395664 - RNA, 19 nt, Homo sapiens
ggaccacgggugacauauc

SEQ ID NO: 395665 - RNA, 19 nt, Homo sapiens
uggaggauuucuuggacaa

SEQ ID NO: 395666 - RNA, 19 nt, Homo sapiens
gagcagccucaaagcagaa

SEQ ID NO: 395667 - RNA, 19 nt, Homo sapiens
cgagaacaccagugaaguc

SEQ ID NO: 395668 - RNA, 19 nt, Homo sapiens
gugaaccucuucggcuguu

SEQ ID NO: 395669 - RNA, 19 nt, Homo sapiens
ugacauaucgguggagaag

SEQ ID NO: 395670 - RNA, 19 nt, Homo sapiens
ggagaagcaguuggccauu

SEQ ID NO: 395671 - RNA, 19 nt, Homo sapiens
gaccggaccagcacauucu

SEQ ID NO: 395672 - RNA, 19 nt, Homo sapiens
caaagcagaagccgagaac

SEQ ID NO: 395673 - RNA, 19 nt, Homo sapiens
aggagaaauugacagaauc

SEQ ID NO: 395674 - RNA, 19 nt, Homo sapiens
agagagaugcagaagaugu

SEQ ID NO: 395675 - RNA, 19 nt, Homo sapiens
gacugggugugcugcucua

SEQ ID NO: 395676 - RNA, 19 nt, Homo sapiens
ccgaccagcuggagaacca

SEQ ID NO: 395677 - RNA, 19 nt, Homo sapiens
aggauuucuuggacaauga

SEQ ID NO: 395678 - RNA, 19 nt, Homo sapiens
ccucaaauuccugaaguug

SEQ ID NO: 395679 - RNA, 19 nt, Homo sapiens
gcgagagagaugcagaaga

SEQ ID NO: 395680 - RNA, 19 nt, Homo sapiens
gccaucggcaucaugagaa

SEQ ID NO: 395681 - RNA, 19 nt, Homo sapiens
cucugacccucgaagauuu

SEQ ID NO: 395682 - RNA, 19 nt, Homo sapiens
acauaucgguggagaagcu

SEQ ID NO: 395683 - RNA, 19 nt, Homo sapiens
ucagcgaggcccaggagaa

SEQ ID NO: 395684 - RNA, 19 nt, Homo sapiens
gugcuaggcagaugaacau

SEQ ID NO: 395685 - RNA, 19 nt, Homo sapiens
ugacaucauccgcaugcaa

SEQ ID NO: 395686 - RNA, 19 nt, Homo sapiens
auccagaccuacagcaaug

SEQ ID NO: 395687 - RNA, 19 nt, Homo sapiens
agauguugcaggacaguaa

SEQ ID NO: 395688 - RNA, 19 nt, Homo sapiens
ccacagcgacguguucucu

SEQ ID NO: 395689 - RNA, 19 nt, Homo sapiens
ccugugugcccucaaauuc

SEQ ID NO: 395690 - RNA, 19 nt, Homo sapiens
agaaauugacagaauccaa

SEQ ID NO: 395691 - RNA, 19 nt, Homo sapiens
gcagaagaugugaagaaac

SEQ ID NO: 395692 - RNA, 19 nt, Homo sapiens
gagagccugaugugugaga

SEQ ID NO: 395693 - RNA, 19 nt, Homo sapiens
guaagaccaagauugacau

SEQ ID NO: 395694 - RNA, 19 nt, Homo sapiens
gagaugcagaagaugugaa

SEQ ID NO: 395695 - RNA, 19 nt, Homo sapiens
gucaagaucgcagacuuug

SEQ ID NO: 395696 - RNA, 19 nt, Homo sapiens
ccggaccacgggugacaua

SEQ ID NO: 395697 - RNA, 19 nt, Homo sapiens
gugcuuaagcuggauaaca

SEQ ID NO: 395698 - RNA, 19 nt, Homo sapiens
gccgagaacaccagugaag

SEQ ID NO: 395699 - RNA, 19 nt, Homo sapiens
ucaaagcagaagccgagaa

SEQ ID NO: 395700 - RNA, 19 nt, Homo sapiens
cagcaaagguuucaguuua

SEQ ID NO: 395701 - RNA, 19 nt, Homo sapiens
gaaauuggaugauaucaag

SEQ ID NO: 395702 - RNA, 19 nt, Homo sapiens
gaagaacuuucacuuguug

SEQ ID NO: 395703 - RNA, 19 nt, Homo sapiens
cagaagauauuacagauug

SEQ ID NO: 395704 - RNA, 19 nt, Homo sapiens
ggaaugggauauggagaua

SEQ ID NO: 395705 - RNA, 19 nt, Homo sapiens
ucucagagcuccucaaaug

SEQ ID NO: 395706 - RNA, 19 nt, Homo sapiens
gacagaagaucucagcaaa

SEQ ID NO: 395707 - RNA, 19 nt, Homo sapiens
gaaguaagguauccaaggu

SEQ ID NO: 395708 - RNA, 19 nt, Homo sapiens
cagcagaaauuggaugaua

SEQ ID NO: 395709 - RNA, 19 nt, Homo sapiens
accaauagcuucugaguuu

SEQ ID NO: 395710 - RNA, 19 nt, Homo sapiens
ccagaaguauuaacagaaa

SEQ ID NO: 395711 - RNA, 19 nt, Homo sapiens
gaagagcuauuccuacagu

SEQ ID NO: 395712 - RNA, 19 nt, Homo sapiens
ggaaagaacugaaaaucaa

SEQ ID NO: 395713 - RNA, 19 nt, Homo sapiens
ugaaacacgugaagauuug

SEQ ID NO: 395714 - RNA, 19 nt, Homo sapiens
aaaccaagcugacucacaa

SEQ ID NO: 395715 - RNA, 19 nt, Homo sapiens
caggaaauguucagagauu

SEQ ID NO: 395716 - RNA, 19 nt, Homo sapiens
gaaagucacaacagauaaa

SEQ ID NO: 395717 - RNA, 19 nt, Homo sapiens
gcaaagaaggaaugggaua

SEQ ID NO: 395718 - RNA, 19 nt, Homo sapiens
cgagaaagaugcagaggau

SEQ ID NO: 395719 - RNA, 19 nt, Homo sapiens
gaagaucucagcaaagguu

SEQ ID NO: 395720 - RNA, 19 nt, Homo sapiens
gccaagauauccuagagaa

SEQ ID NO: 395721 - RNA, 19 nt, Homo sapiens
gcuagugauucuacaguaa

SEQ ID NO: 395722 - RNA, 19 nt, Homo sapiens
cuuaugggcugccaagaua

SEQ ID NO: 395723 - RNA, 19 nt, Homo sapiens
cagaaugacagaaauagua

SEQ ID NO: 395724 - RNA, 19 nt, Homo sapiens
gaagcucaagcaagauuua

SEQ ID NO: 395725 - RNA, 19 nt, Homo sapiens
gaucggaaacuccauggua

SEQ ID NO: 395726 - RNA, 19 nt, Homo sapiens
gaaauaaggaaagaacuga

SEQ ID NO: 395727 - RNA, 19 nt, Homo sapiens
gauaucaaggaucgaauua

SEQ ID NO: 395728 - RNA, 19 nt, Homo sapiens
ugagaaggcuguuaagaag

SEQ ID NO: 395729 - RNA, 19 nt, Homo sapiens
guaagaagagcuauuccua

SEQ ID NO: 395730 - RNA, 19 nt, Homo sapiens
ucaaauggaucuucaaagg

SEQ ID NO: 395731 - RNA, 19 nt, Homo sapiens
gcaugugucucuauuugga

SEQ ID NO: 395732 - RNA, 19 nt, Homo sapiens
gcaggauuauuauugaaga

SEQ ID NO: 395733 - RNA, 19 nt, Homo sapiens
uagaagaacuacaucacaa

SEQ ID NO: 395734 - RNA, 19 nt, Homo sapiens
gcugauugguguuaaguug

SEQ ID NO: 395735 - RNA, 19 nt, Homo sapiens
uauccaagguucuuaucua

SEQ ID NO: 395736 - RNA, 19 nt, Homo sapiens
gcaaagguuucaguuuaau

SEQ ID NO: 395737 - RNA, 19 nt, Homo sapiens
gaaaauccaucacgaauac

SEQ ID NO: 395738 - RNA, 19 nt, Homo sapiens
caaggauacuuucggaaga

SEQ ID NO: 395739 - RNA, 19 nt, Homo sapiens
gaaagaugcagaggaugua

SEQ ID NO: 395740 - RNA, 19 nt, Homo sapiens
caagauauccuagagaaug

SEQ ID NO: 395741 - RNA, 19 nt, Homo sapiens
ggaaagucacaacagauaa

SEQ ID NO: 395742 - RNA, 19 nt, Homo sapiens
guaaauaugagcacuggaa

SEQ ID NO: 395743 - RNA, 19 nt, Homo sapiens
gaaugugagugcuguucaa

SEQ ID NO: 395744 - RNA, 19 nt, Homo sapiens
gagaauaugauacagaugu

SEQ ID NO: 395745 - RNA, 19 nt, Homo sapiens
agaaggcuguuaagaagaa

SEQ ID NO: 395746 - RNA, 19 nt, Homo sapiens
ggacagaagaucucagcaa

SEQ ID NO: 395747 - RNA, 19 nt, Homo sapiens
cagagaauaugauacagau

SEQ ID NO: 395748 - RNA, 19 nt, Homo sapiens
ugaggaaagucacaacaga

SEQ ID NO: 395749 - RNA, 19 nt, Homo sapiens
uaucaaggaucgaauuaag

SEQ ID NO: 395750 - RNA, 19 nt, Homo sapiens
gaaacugugaauaguguaa

SEQ ID NO: 395751 - RNA, 19 nt, Homo sapiens
gcuccucaaaugaauauua

SEQ ID NO: 395752 - RNA, 19 nt, Homo sapiens
gaagaauuaaggcaucauu

SEQ ID NO: 395753 - RNA, 19 nt, Homo sapiens
gacgagaagauguuaguaa

SEQ ID NO: 395754 - RNA, 19 nt, Homo sapiens
guucuuggguugcaguauu

SEQ ID NO: 395755 - RNA, 19 nt, Homo sapiens
ccgaugacuuguccaauga

SEQ ID NO: 395756 - RNA, 19 nt, Homo sapiens
gaaggugcaaagaauguaa

SEQ ID NO: 395757 - RNA, 19 nt, Homo sapiens
aaauggaucuucaaaggau

SEQ ID NO: 395758 - RNA, 19 nt, Homo sapiens
gaacaucggccaugaaaau

SEQ ID NO: 395759 - RNA, 19 nt, Homo sapiens
ggagcgcucugauggacaa

SEQ ID NO: 395760 - RNA, 19 nt, Homo sapiens
aagaagagcuauuccuaca

SEQ ID NO: 395761 - RNA, 19 nt, Homo sapiens
gaaguagacagccugaugu

SEQ ID NO: 395762 - RNA, 19 nt, Homo sapiens
cagaagaucucagcaaagg

SEQ ID NO: 395763 - RNA, 19 nt, Homo sapiens
ccacgagcuucuucucuug

SEQ ID NO: 395764 - RNA, 19 nt, Homo sapiens
ggaaccacaggguacuuua

SEQ ID NO: 395765 - RNA, 19 nt, Homo sapiens
cacgugaacuggaaauuuc

SEQ ID NO: 395766 - RNA, 19 nt, Homo sapiens
gcagagaauaugauacaga

SEQ ID NO: 395767 - RNA, 19 nt, Homo sapiens
gacccucguuguucuacua

SEQ ID NO: 395768 - RNA, 19 nt, Homo sapiens
cagauacuccaaauaauga

SEQ ID NO: 395769 - RNA, 19 nt, Homo sapiens
gguguuaaguugcuagaca

SEQ ID NO: 395770 - RNA, 19 nt, Homo sapiens
gugcaaagaauguaaugaa

SEQ ID NO: 395771 - RNA, 19 nt, Homo sapiens
ccagauacuccaaauaaug

SEQ ID NO: 395772 - RNA, 19 nt, Homo sapiens
ggaaauuucaguuuauugg

SEQ ID NO: 395773 - RNA, 19 nt, Homo sapiens
ggacaggucacgugaacug

SEQ ID NO: 395774 - RNA, 19 nt, Homo sapiens
aaugaugucugugcuguuu

SEQ ID NO: 395775 - RNA, 19 nt, Homo sapiens
ggagauagaacaagcacau

SEQ ID NO: 395776 - RNA, 19 nt, Homo sapiens
uagacagccugauguguga

SEQ ID NO: 395777 - RNA, 19 nt, Homo sapiens
gaccaaaacuucaaagaca

SEQ ID NO: 395778 - RNA, 19 nt, Homo sapiens
uggcaugugucucuauuug

SEQ ID NO: 395779 - RNA, 19 nt, Homo sapiens
ugaaucaagucagaaguug

SEQ ID NO: 395780 - RNA, 19 nt, Homo sapiens
uaggauagaguuugcagua

SEQ ID NO: 395781 - RNA, 19 nt, Homo sapiens
caagcugacucacaagaag

SEQ ID NO: 395782 - RNA, 19 nt, Homo sapiens
ggccuagaauauaguggua

SEQ ID NO: 395783 - RNA, 19 nt, Homo sapiens
gagcuauuccuacaguaaa

SEQ ID NO: 395784 - RNA, 19 nt, Homo sapiens
gaaccacaggguacuuuau

SEQ ID NO: 395785 - RNA, 19 nt, Homo sapiens
gauagaguuugcaguagca

SEQ ID NO: 395786 - RNA, 19 nt, Homo sapiens
ugugauaaguccucuugaa

SEQ ID NO: 395787 - RNA, 19 nt, Homo sapiens
guacuucagcguaaauaug

SEQ ID NO: 395788 - RNA, 19 nt, Homo sapiens
aaauuggacuuugaucuug

SEQ ID NO: 395789 - RNA, 19 nt, Homo sapiens
guacgcaucccucaacuag

SEQ ID NO: 395790 - RNA, 19 nt, Homo sapiens
cuaaguccacgucaaagua

SEQ ID NO: 395791 - RNA, 19 nt, Homo sapiens
acagauguauucaaaugga

SEQ ID NO: 395792 - RNA, 19 nt, Homo sapiens
acaguuucauggaguuuaa

SEQ ID NO: 395793 - RNA, 19 nt, Homo sapiens
agagagaaauaaggaaaga

SEQ ID NO: 395794 - RNA, 19 nt, Homo sapiens
ugaugcacauucauacuga

SEQ ID NO: 395795 - RNA, 19 nt, Homo sapiens
agcaaagguuucaguuuaa

SEQ ID NO: 395796 - RNA, 19 nt, Homo sapiens
ccacaggguacuuuauuug

SEQ ID NO: 395797 - RNA, 19 nt, Homo sapiens
aguaugauaucuacgcaaa

SEQ ID NO: 395798 - RNA, 19 nt, Homo sapiens
gcucaagcaagauuuaaug

SEQ ID NO: 395799 - RNA, 19 nt, Homo sapiens
gagugaacaucggccauga

SEQ ID NO: 395800 - RNA, 19 nt, Homo sapiens
gaagagauguagcuauuaa

SEQ ID NO: 395801 - RNA, 19 nt, Homo sapiens
gaaagaguguuuguuguua

SEQ ID NO: 395802 - RNA, 19 nt, Homo sapiens
cauaagagaugugcauuua

SEQ ID NO: 395803 - RNA, 19 nt, Homo sapiens
gaaugcagcuuucauguau

SEQ ID NO: 395804 - RNA, 19 nt, Homo sapiens
ggaaggaaauaucucauga

SEQ ID NO: 395805 - RNA, 19 nt, Homo sapiens
ggaaggcgaucuuauugaa

SEQ ID NO: 395806 - RNA, 19 nt, Homo sapiens
cggcaaauguaguguauua

SEQ ID NO: 395807 - RNA, 19 nt, Homo sapiens
gaaguggucuugucacguu

SEQ ID NO: 395808 - RNA, 19 nt, Homo sapiens
uaucagaccugguuagauu

SEQ ID NO: 395809 - RNA, 19 nt, Homo sapiens
ccaaaucccuggaaggaaa

SEQ ID NO: 395810 - RNA, 19 nt, Homo sapiens
gaacgacaguggcgagaug

SEQ ID NO: 395811 - RNA, 19 nt, Homo sapiens
guaaugagguugcaauucu

SEQ ID NO: 395812 - RNA, 19 nt, Homo sapiens
gaauguaucugugaaguag

SEQ ID NO: 395813 - RNA, 19 nt, Homo sapiens
gaaccaacuugcacagaga

SEQ ID NO: 395814 - RNA, 19 nt, Homo sapiens
gcaaauguauuacccucuu

SEQ ID NO: 395815 - RNA, 19 nt, Homo sapiens
acacgaaacuuguuauugu

SEQ ID NO: 395816 - RNA, 19 nt, Homo sapiens
gagauuggauagcaaaugu

SEQ ID NO: 395817 - RNA, 19 nt, Homo sapiens
ggucaaauucucaaucaua

SEQ ID NO: 395818 - RNA, 19 nt, Homo sapiens
ugaguuccaucuccuauaa

SEQ ID NO: 395819 - RNA, 19 nt, Homo sapiens
acaaaugcaugaacaaguu

SEQ ID NO: 395820 - RNA, 19 nt, Homo sapiens
caaagcuguuaaacuguua

SEQ ID NO: 395821 - RNA, 19 nt, Homo sapiens
gaccagaaguucccugaau

SEQ ID NO: 395822 - RNA, 19 nt, Homo sapiens
gucaaggucuuaaauguga

SEQ ID NO: 395823 - RNA, 19 nt, Homo sapiens
gaggucaaauucucaauca

SEQ ID NO: 395824 - RNA, 19 nt, Homo sapiens
gcugaacucucuacaagug

SEQ ID NO: 395825 - RNA, 19 nt, Homo sapiens
agaaggcucucaaacguuu

SEQ ID NO: 395826 - RNA, 19 nt, Homo sapiens
ucagcaaccuuucaccuuu

SEQ ID NO: 395827 - RNA, 19 nt, Homo sapiens
ggacaucagcacaguauau

SEQ ID NO: 395828 - RNA, 19 nt, Homo sapiens
gagagaagaggucaaauuc

SEQ ID NO: 395829 - RNA, 19 nt, Homo sapiens
uaacaaaaguucccugaaa

SEQ ID NO: 395830 - RNA, 19 nt, Homo sapiens
caacagaagcauuuguauu

SEQ ID NO: 395831 - RNA, 19 nt, Homo sapiens
gguaagagacagaauguau

SEQ ID NO: 395832 - RNA, 19 nt, Homo sapiens
caagacaaaucaacagaag

SEQ ID NO: 395833 - RNA, 19 nt, Homo sapiens
agacauacacgaccaaauu

SEQ ID NO: 395834 - RNA, 19 nt, Homo sapiens
gcaaauguaguguauuaug

SEQ ID NO: 395835 - RNA, 19 nt, Homo sapiens
guauuacccucuuucagaa

SEQ ID NO: 395836 - RNA, 19 nt, Homo sapiens
gcagcacagucaugaaaga

SEQ ID NO: 395837 - RNA, 19 nt, Homo sapiens
cuagugcucuuaagccuaa

SEQ ID NO: 395838 - RNA, 19 nt, Homo sapiens
gguccaagaugcagagaug

SEQ ID NO: 395839 - RNA, 19 nt, Homo sapiens
ggaagagauguagcuauua

SEQ ID NO: 395840 - RNA, 19 nt, Homo sapiens
aggaagagauguagcuauu

SEQ ID NO: 395841 - RNA, 19 nt, Homo sapiens
ggucugaauuaccauaaga

SEQ ID NO: 395842 - RNA, 19 nt, Homo sapiens
cagauacauuucccucuuu

SEQ ID NO: 395843 - RNA, 19 nt, Homo sapiens
cuugaagagucgauuauuu

SEQ ID NO: 395844 - RNA, 19 nt, Homo sapiens
caaauguauuacccucuuu

SEQ ID NO: 395845 - RNA, 19 nt, Homo sapiens
caaauugccagauucaaga

SEQ ID NO: 395846 - RNA, 19 nt, Homo sapiens
acaaagcuguuaaacuguu

SEQ ID NO: 395847 - RNA, 19 nt, Homo sapiens
ccacacaccugaucaaucc

SEQ ID NO: 395848 - RNA, 19 nt, Homo sapiens
gaaggaaauaucucaugaa

SEQ ID NO: 395849 - RNA, 19 nt, Homo sapiens
cgagagaagaggucaaauu

SEQ ID NO: 395850 - RNA, 19 nt, Homo sapiens
ccaggaaggcgaucuuauu

SEQ ID NO: 395851 - RNA, 19 nt, Homo sapiens
ggaauaaaauccuaagaca

SEQ ID NO: 395852 - RNA, 19 nt, Homo sapiens
uacaaucgcucucuagaca

SEQ ID NO: 395853 - RNA, 19 nt, Homo sapiens
ggagacaugcuggaaauga

SEQ ID NO: 395854 - RNA, 19 nt, Homo sapiens
ggagauagccauccagcau

SEQ ID NO: 395855 - RNA, 19 nt, Homo sapiens
gaagaaacagaaaugaaag

SEQ ID NO: 395856 - RNA, 19 nt, Homo sapiens
gagacaugcuggaaaugau

SEQ ID NO: 395857 - RNA, 19 nt, Homo sapiens
uaaugagguugcaauucua

SEQ ID NO: 395858 - RNA, 19 nt, Homo sapiens
ugaauuaccauaagagaug

SEQ ID NO: 395859 - RNA, 19 nt, Homo sapiens
ggacaguuuggaauuguuu

SEQ ID NO: 395860 - RNA, 19 nt, Homo sapiens
cgaaaucacuacggcaaau

SEQ ID NO: 395861 - RNA, 19 nt, Homo sapiens
gcaacaauaucccacucau

SEQ ID NO: 395862 - RNA, 19 nt, Homo sapiens
agacacaaaugcaugaaca

SEQ ID NO: 395863 - RNA, 19 nt, Homo sapiens
ugagaaagcgcuacagugu

SEQ ID NO: 395864 - RNA, 19 nt, Homo sapiens
gaaagcggccagugauauc

SEQ ID NO: 395865 - RNA, 19 nt, Homo sapiens
caacugccuuggcgaagug

SEQ ID NO: 395866 - RNA, 19 nt, Homo sapiens
uguuagcacuguugaugua

SEQ ID NO: 395867 - RNA, 19 nt, Homo sapiens
ugaaagaguguuuguuguu

SEQ ID NO: 395868 - RNA, 19 nt, Homo sapiens
gccaugacccuaccucuga

SEQ ID NO: 395869 - RNA, 19 nt, Homo sapiens
caaucgcucucuagacaug

SEQ ID NO: 395870 - RNA, 19 nt, Homo sapiens
gggcuacaaucgcucucua

SEQ ID NO: 395871 - RNA, 19 nt, Homo sapiens
aacaauaucccacucauga

SEQ ID NO: 395872 - RNA, 19 nt, Homo sapiens
auacauacggucagguuua

SEQ ID NO: 395873 - RNA, 19 nt, Homo sapiens
cagcaaccuuucaccuuug

SEQ ID NO: 395874 - RNA, 19 nt, Homo sapiens
acagauacauuucccucuu

SEQ ID NO: 395875 - RNA, 19 nt, Homo sapiens
cgaaacuuguuauugugaa

SEQ ID NO: 395876 - RNA, 19 nt, Homo sapiens
acggucagguuuaacauuu

SEQ ID NO: 395877 - RNA, 19 nt, Homo sapiens
caugaagccauugaucuua

SEQ ID NO: 395878 - RNA, 19 nt, Homo sapiens
ggugaaacuuugugauuuu

SEQ ID NO: 395879 - RNA, 19 nt, Homo sapiens
cagagcacauaacgaaguu

SEQ ID NO: 395880 - RNA, 19 nt, Homo sapiens
cggaauguaugauaagauc

SEQ ID NO: 395881 - RNA, 19 nt, Homo sapiens
ggaauuguuuauggaggaa

SEQ ID NO: 395882 - RNA, 19 nt, Homo sapiens
aaacggcacuauuggagau

SEQ ID NO: 395883 - RNA, 19 nt, Homo sapiens
caucaacaagcaacaauau

SEQ ID NO: 395884 - RNA, 19 nt, Homo sapiens
aagaagcaaugguccaaga

SEQ ID NO: 395885 - RNA, 19 nt, Homo sapiens
ggagugaugacaaugauag

SEQ ID NO: 395886 - RNA, 19 nt, Homo sapiens
gaagaggucaaauucucaa

SEQ ID NO: 395887 - RNA, 19 nt, Homo sapiens
ugaaggguguggucugaau

SEQ ID NO: 395888 - RNA, 19 nt, Homo sapiens
uaucugaguugccaagaca

SEQ ID NO: 395889 - RNA, 19 nt, Homo sapiens
cuacaucacccaugaaagu

SEQ ID NO: 395890 - RNA, 19 nt, Homo sapiens
gugcagauguggccaggau

SEQ ID NO: 395891 - RNA, 19 nt, Homo sapiens
ucuacggaauguaugauaa

SEQ ID NO: 395892 - RNA, 19 nt, Homo sapiens
gaagcaaugguccaagaug

SEQ ID NO: 395893 - RNA, 19 nt, Homo sapiens
gaacagugggcucauggau

SEQ ID NO: 395894 - RNA, 19 nt, Homo sapiens
ccaucagagucguuuauug

SEQ ID NO: 395895 - RNA, 19 nt, Homo sapiens
uacauacggucagguuuaa

SEQ ID NO: 395896 - RNA, 19 nt, Homo sapiens
ggaagaagcaaugguccaa

SEQ ID NO: 395897 - RNA, 19 nt, Homo sapiens
gaauuaccauaagagaugu

SEQ ID NO: 395898 - RNA, 19 nt, Homo sapiens
uacauuucccucuuucuua

SEQ ID NO: 395899 - RNA, 19 nt, Homo sapiens
gcacuguugauguaucuga

SEQ ID NO: 395900 - RNA, 19 nt, Homo sapiens
caaaggacaugaaugaauu

SEQ ID NO: 395901 - RNA, 19 nt, Homo sapiens
gcagacaaguaaucacuaa

SEQ ID NO: 395902 - RNA, 19 nt, Homo sapiens
cacaagaaguguauugaua

SEQ ID NO: 395903 - RNA, 19 nt, Homo sapiens
gaaagaaacacucaacaau

SEQ ID NO: 395904 - RNA, 19 nt, Homo sapiens
gaagacagaaauaugguua

SEQ ID NO: 395905 - RNA, 19 nt, Homo sapiens
caaagaguaugucgaauca

SEQ ID NO: 395906 - RNA, 19 nt, Homo sapiens
ucaacaggcucgcugcuua

SEQ ID NO: 395907 - RNA, 19 nt, Homo sapiens
gcagauguauauccagaaa

SEQ ID NO: 395908 - RNA, 19 nt, Homo sapiens
ggaaaugagugacacaaag

SEQ ID NO: 395909 - RNA, 19 nt, Homo sapiens
caauaaaggccuuaaagaa

SEQ ID NO: 395910 - RNA, 19 nt, Homo sapiens
agacaaagauggacauauc

SEQ ID NO: 395911 - RNA, 19 nt, Homo sapiens
gcucgcugcuuaagagaua

SEQ ID NO: 395912 - RNA, 19 nt, Homo sapiens
ggacaugaaugaauuugag

SEQ ID NO: 395913 - RNA, 19 nt, Homo sapiens
gcgaggcuguuaacccuua

SEQ ID NO: 395914 - RNA, 19 nt, Homo sapiens
gcaauaaaggccuuaaaga

SEQ ID NO: 395915 - RNA, 19 nt, Homo sapiens
ggcaaggacucaaguguga

SEQ ID NO: 395916 - RNA, 19 nt, Homo sapiens
ccacacagauuuaaagucu

SEQ ID NO: 395917 - RNA, 19 nt, Homo sapiens
gcugagaggugcaggaaga

SEQ ID NO: 395918 - RNA, 19 nt, Homo sapiens
gagaaaccauguuccacaa

SEQ ID NO: 395919 - RNA, 19 nt, Homo sapiens
gcugauauccugaaucuug

SEQ ID NO: 395920 - RNA, 19 nt, Homo sapiens
gcagcaauuucgacaaaga

SEQ ID NO: 395921 - RNA, 19 nt, Homo sapiens
gaacaaagaaagaccaucu

SEQ ID NO: 395922 - RNA, 19 nt, Homo sapiens
acacaaaggacaugaauga

SEQ ID NO: 395923 - RNA, 19 nt, Homo sapiens
ggagaugccaagacgaaua

SEQ ID NO: 395924 - RNA, 19 nt, Homo sapiens
cacagacgcuccugaaguu

SEQ ID NO: 395925 - RNA, 19 nt, Homo sapiens
ccaugugacuuuaucugua

SEQ ID NO: 395926 - RNA, 19 nt, Homo sapiens
ggucugcaguuccuucauu

SEQ ID NO: 395927 - RNA, 19 nt, Homo sapiens
ccauuugacugcagcaauu

SEQ ID NO: 395928 - RNA, 19 nt, Homo sapiens
gagaacauguuaggagaug

SEQ ID NO: 395929 - RNA, 19 nt, Homo sapiens
gcaguuccuucauuccaaa

SEQ ID NO: 395930 - RNA, 19 nt, Homo sapiens
aaccugaacugaacaaaga

SEQ ID NO: 395931 - RNA, 19 nt, Homo sapiens
gagaagguccgguugaaau

SEQ ID NO: 395932 - RNA, 19 nt, Homo sapiens
gcuaaugaaugcaagauac

SEQ ID NO: 395933 - RNA, 19 nt, Homo sapiens
gcaaccaugucgccauuuc

SEQ ID NO: 395934 - RNA, 19 nt, Homo sapiens
ugacaugccacacagauuu

SEQ ID NO: 395935 - RNA, 19 nt, Homo sapiens
gauaaaaugugccaucuuc

SEQ ID NO: 395936 - RNA, 19 nt, Homo sapiens
gcgcaaccaugucgccauu

SEQ ID NO: 395937 - RNA, 19 nt, Homo sapiens
uaaaggccuuaaagaaaga

SEQ ID NO: 395938 - RNA, 19 nt, Homo sapiens
gcaauucacaagaagugua

SEQ ID NO: 395939 - RNA, 19 nt, Homo sapiens
gugcugugcucgucaaaga

SEQ ID NO: 395940 - RNA, 19 nt, Homo sapiens
caauaaacauagcuuguac

SEQ ID NO: 395941 - RNA, 19 nt, Homo sapiens
cccauugccuggucuagua

SEQ ID NO: 395942 - RNA, 19 nt, Homo sapiens
caacgggaagacagaaaua

SEQ ID NO: 395943 - RNA, 19 nt, Homo sapiens
ggaagagucaugcagauca

SEQ ID NO: 395944 - RNA, 19 nt, Homo sapiens
ccucaaggccgaaugcuaa

SEQ ID NO: 395945 - RNA, 19 nt, Homo sapiens
gaagagucaugcagaucau

SEQ ID NO: 395946 - RNA, 19 nt, Homo sapiens
auaaaggccuuaaagaaag

SEQ ID NO: 395947 - RNA, 19 nt, Homo sapiens
aagaguaugucgaaucaga

SEQ ID NO: 395948 - RNA, 19 nt, Homo sapiens
gugcaaggagaacauguua

SEQ ID NO: 395949 - RNA, 19 nt, Homo sapiens
gcauaaaccagaagcuaau

SEQ ID NO: 395950 - RNA, 19 nt, Homo sapiens
gagaacgggcagauguaua

SEQ ID NO: 395951 - RNA, 19 nt, Homo sapiens
ccagagacaggaaagaauu

SEQ ID NO: 395952 - RNA, 19 nt, Homo sapiens
gcauggaccagaauauguu

SEQ ID NO: 395953 - RNA, 19 nt, Homo sapiens
cagagaagguccgguugaa

SEQ ID NO: 395954 - RNA, 19 nt, Homo sapiens
caacaggcucgcugcuuaa

SEQ ID NO: 395955 - RNA, 19 nt, Homo sapiens
gaccuucugugaacacugu

SEQ ID NO: 395956 - RNA, 19 nt, Homo sapiens
gacaugccacacagauuua

SEQ ID NO: 395957 - RNA, 19 nt, Homo sapiens
aguaaucacuaacccguuu

SEQ ID NO: 395958 - RNA, 19 nt, Homo sapiens
gaaacacucaacaauaaag

SEQ ID NO: 395959 - RNA, 19 nt, Homo sapiens
uaagagauacugaacagau

SEQ ID NO: 395960 - RNA, 19 nt, Homo sapiens
caacugggaggaacuugaa

SEQ ID NO: 395961 - RNA, 19 nt, Homo sapiens
ggcauaaaccagaagcuaa

SEQ ID NO: 395962 - RNA, 19 nt, Homo sapiens
ccacaaggagagauucaaa

SEQ ID NO: 395963 - RNA, 19 nt, Homo sapiens
agacagaaauaugguuaga

SEQ ID NO: 395964 - RNA, 19 nt, Homo sapiens
gaacaacgggaagacagaa

SEQ ID NO: 395965 - RNA, 19 nt, Homo sapiens
uaaugacgaugccgugugu

SEQ ID NO: 395966 - RNA, 19 nt, Homo sapiens
cugcagcaauuucgacaaa

SEQ ID NO: 395967 - RNA, 19 nt, Homo sapiens
gcaaggagaacauguuagg

SEQ ID NO: 395968 - RNA, 19 nt, Homo sapiens
gcacgaugguagagaagag

SEQ ID NO: 395969 - RNA, 19 nt, Homo sapiens
gauggacgaugauguugag

SEQ ID NO: 395970 - RNA, 19 nt, Homo sapiens
gaaaugagugacacaaagg

SEQ ID NO: 395971 - RNA, 19 nt, Homo sapiens
caagacgaauaccuucugu

SEQ ID NO: 395972 - RNA, 19 nt, Homo sapiens
aaggagagauucaaaauug

SEQ ID NO: 395973 - RNA, 19 nt, Homo sapiens
gaaccugaacugaacaaag

SEQ ID NO: 395974 - RNA, 19 nt, Homo sapiens
gaagguccgguugaaauug

SEQ ID NO: 395975 - RNA, 19 nt, Homo sapiens
caacaagggaagagucaug

SEQ ID NO: 395976 - RNA, 19 nt, Homo sapiens
cgucaaagaguaugucgaa

SEQ ID NO: 395977 - RNA, 19 nt, Homo sapiens
gaguacagacgucucaaga

SEQ ID NO: 395978 - RNA, 19 nt, Homo sapiens
cuacuucacuaaugacgau

SEQ ID NO: 395979 - RNA, 19 nt, Homo sapiens
caugugacuuuaucuguag

SEQ ID NO: 395980 - RNA, 19 nt, Homo sapiens
cggcugauauccugaaucu

SEQ ID NO: 395981 - RNA, 19 nt, Homo sapiens
ggauggagcggcugauauc

SEQ ID NO: 395982 - RNA, 19 nt, Homo sapiens
auaucaagaucgcggauuu

SEQ ID NO: 395983 - RNA, 19 nt, Homo sapiens
ccaaagcugccacaaguuc

SEQ ID NO: 395984 - RNA, 19 nt, Homo sapiens
agaaagaaacacucaacaa

SEQ ID NO: 395985 - RNA, 19 nt, Homo sapiens
aaagauggacauaucaaga

SEQ ID NO: 395986 - RNA, 19 nt, Homo sapiens
acacagauuuaaagucuac

SEQ ID NO: 395987 - RNA, 19 nt, Homo sapiens
caaggccgaaugcuaauga

SEQ ID NO: 395988 - RNA, 19 nt, Homo sapiens
acucaacaauaaagacuga

SEQ ID NO: 395989 - RNA, 19 nt, Homo sapiens
ucaugcagaucauugugaa

SEQ ID NO: 395990 - RNA, 19 nt, Homo sapiens
ucaacagcauggaccagaa

SEQ ID NO: 395991 - RNA, 19 nt, Homo sapiens
cacgguggcuggagaagga

SEQ ID NO: 395992 - RNA, 19 nt, Homo sapiens
ccaaaggaauagucuacag

SEQ ID NO: 395993 - RNA, 19 nt, Homo sapiens
guacauuccagaccaagga

SEQ ID NO: 395994 - RNA, 19 nt, Homo sapiens
ggacucaagugugaugcau

SEQ ID NO: 395995 - RNA, 19 nt, Homo sapiens
gacuugauacugcaauaaa

SEQ ID NO: 395996 - RNA, 19 nt, Homo sapiens
gagcacugaucaacagcau

SEQ ID NO: 395997 - RNA, 19 nt, Homo sapiens
gcaaugcagcaauucacaa

SEQ ID NO: 395998 - RNA, 19 nt, Homo sapiens
acaaaggacaugaaugaau

SEQ ID NO: 395999 - RNA, 19 nt, Homo sapiens
ggaagacagaaauaugguu

SEQ ID NO: 396000 - RNA, 19 nt, Homo sapiens
ucaaggagcuggaugauga

SEQ ID NO: 396001 - RNA, 19 nt, Homo sapiens
ugaagaagauccuuauuga

SEQ ID NO: 396002 - RNA, 19 nt, Homo sapiens
gagaacaccugcaaagaga

SEQ ID NO: 396003 - RNA, 19 nt, Homo sapiens
ggaagaagaggcugaagaa

SEQ ID NO: 396004 - RNA, 19 nt, Homo sapiens
ggucaacgaugguguuugu

SEQ ID NO: 396005 - RNA, 19 nt, Homo sapiens
ccaaagagcagcaccagaa

SEQ ID NO: 396006 - RNA, 19 nt, Homo sapiens
ggaagaagucucuggaaga

SEQ ID NO: 396007 - RNA, 19 nt, Homo sapiens
ugaaugacuugaccuguga

SEQ ID NO: 396008 - RNA, 19 nt, Homo sapiens
gcuacgagcucaccaccaa

SEQ ID NO: 396009 - RNA, 19 nt, Homo sapiens
ggaguuugcuuaccuguac

SEQ ID NO: 396010 - RNA, 19 nt, Homo sapiens
gcaaagagaagggccguaa

SEQ ID NO: 396011 - RNA, 19 nt, Homo sapiens
ggagcuggaugaugacaug

SEQ ID NO: 396012 - RNA, 19 nt, Homo sapiens
ucagugccaugaaguauga

SEQ ID NO: 396013 - RNA, 19 nt, Homo sapiens
gcaccaacacuggcuauaa

SEQ ID NO: 396014 - RNA, 19 nt, Homo sapiens
gaaccuggagcaagagauu

SEQ ID NO: 396015 - RNA, 19 nt, Homo sapiens
gcgcagagaaccucaagaa

SEQ ID NO: 396016 - RNA, 19 nt, Homo sapiens
agaagaggcugaagaagag

SEQ ID NO: 396017 - RNA, 19 nt, Homo sapiens
agacagacgccaccucuuu

SEQ ID NO: 396018 - RNA, 19 nt, Homo sapiens
gaacagacgaguacaacag

SEQ ID NO: 396019 - RNA, 19 nt, Homo sapiens
ccugugaccucaauacaau

SEQ ID NO: 396020 - RNA, 19 nt, Homo sapiens
gaaggguuccgucugaaga

SEQ ID NO: 396021 - RNA, 19 nt, Homo sapiens
aagaagaggcugaagaaga

SEQ ID NO: 396022 - RNA, 19 nt, Homo sapiens
gagaugcugcggacaguga

SEQ ID NO: 396023 - RNA, 19 nt, Homo sapiens
caccaacacuggcuauaag

SEQ ID NO: 396024 - RNA, 19 nt, Homo sapiens
gaagggccguaaggagaga

SEQ ID NO: 396025 - RNA, 19 nt, Homo sapiens
ucaccaaucaucacuucua

SEQ ID NO: 396026 - RNA, 19 nt, Homo sapiens
gaagaagauccuuauugag

SEQ ID NO: 396027 - RNA, 19 nt, Homo sapiens
gaaggaggaagcugagaag

SEQ ID NO: 396028 - RNA, 19 nt, Homo sapiens
gaacaccugcaaagagaag

SEQ ID NO: 396029 - RNA, 19 nt, Homo sapiens
acccggagcuggacacaga

SEQ ID NO: 396030 - RNA, 19 nt, Homo sapiens
gcacggcugccuguccuaa

SEQ ID NO: 396031 - RNA, 19 nt, Homo sapiens
cugaagaagauccuuauug

SEQ ID NO: 396032 - RNA, 19 nt, Homo sapiens
cgcgaaggguuccgucuga

SEQ ID NO: 396033 - RNA, 19 nt, Homo sapiens
guacaacagcggcgucauc

SEQ ID NO: 396034 - RNA, 19 nt, Homo sapiens
ccaaucaucacuucuacga

SEQ ID NO: 396035 - RNA, 19 nt, Homo sapiens
ccucaccaaucaucacuuc

SEQ ID NO: 396036 - RNA, 19 nt, Homo sapiens
gcgaaggguuccgucugaa

SEQ ID NO: 396037 - RNA, 19 nt, Homo sapiens
gcgucucccucaccaauca

SEQ ID NO: 396038 - RNA, 19 nt, Homo sapiens
gcuacaggcugggaagaag

SEQ ID NO: 396039 - RNA, 19 nt, Homo sapiens
ucaacgaugguguuuguga

SEQ ID NO: 396040 - RNA, 19 nt, Homo sapiens
ggaggaggaggaggaagaa

SEQ ID NO: 396041 - RNA, 19 nt, Homo sapiens
gcgauggaacagacgagua

SEQ ID NO: 396042 - RNA, 19 nt, Homo sapiens
gagcucaccaccaacgaau

SEQ ID NO: 396043 - RNA, 19 nt, Homo sapiens
ggaggaagaagaggcugaa

SEQ ID NO: 396044 - RNA, 19 nt, Homo sapiens
ugaaggaggaagcugagaa

SEQ ID NO: 396045 - RNA, 19 nt, Homo sapiens
cgucugaagaagauccuua

SEQ ID NO: 396046 - RNA, 19 nt, Homo sapiens
ugagaacaccugcaaagag

SEQ ID NO: 396047 - RNA, 19 nt, Homo sapiens
ggacggucucggugacuga

SEQ ID NO: 396048 - RNA, 19 nt, Homo sapiens
gaccucaauacaauaaaug

SEQ ID NO: 396049 - RNA, 19 nt, Homo sapiens
ggaggaggaggaagaagag

SEQ ID NO: 396050 - RNA, 19 nt, Homo sapiens
gacagacgccaccucuuuc

SEQ ID NO: 396051 - RNA, 19 nt, Homo sapiens
accagaagcugugggaaga

SEQ ID NO: 396052 - RNA, 19 nt, Homo sapiens
cggccaccaucccauuuga

SEQ ID NO: 396053 - RNA, 19 nt, Homo sapiens
ucaagcuugucucgcagaa

SEQ ID NO: 396054 - RNA, 19 nt, Homo sapiens
gaagaagaggcugaagaag

SEQ ID NO: 396055 - RNA, 19 nt, Homo sapiens
aagcuugucucgcagaaac

SEQ ID NO: 396056 - RNA, 19 nt, Homo sapiens
ggaacagacgaguacaaca

SEQ ID NO: 396057 - RNA, 19 nt, Homo sapiens
gaaccucaagaaggcauga

SEQ ID NO: 396058 - RNA, 19 nt, Homo sapiens
gcucaccaccaacgaauac

SEQ ID NO: 396059 - RNA, 19 nt, Homo sapiens
gggaguuugcuuaccugua

SEQ ID NO: 396060 - RNA, 19 nt, Homo sapiens
cugagaagccagagagaga

SEQ ID NO: 396061 - RNA, 19 nt, Homo sapiens
gggcgucucccucaccaau

SEQ ID NO: 396062 - RNA, 19 nt, Homo sapiens
gugagaacaccugcaaaga

SEQ ID NO: 396063 - RNA, 19 nt, Homo sapiens
caccaaucaucacuucuac

SEQ ID NO: 396064 - RNA, 19 nt, Homo sapiens
gacaaguucagugccauga

SEQ ID NO: 396065 - RNA, 19 nt, Homo sapiens
gguggauacugaccuuugc

SEQ ID NO: 396066 - RNA, 19 nt, Homo sapiens
caaagagcagcaccagaag

SEQ ID NO: 396067 - RNA, 19 nt, Homo sapiens
ggaagaccagguggagaug

SEQ ID NO: 396068 - RNA, 19 nt, Homo sapiens
ugugaccucaauacaauaa

SEQ ID NO: 396069 - RNA, 19 nt, Homo sapiens
ggacuagugaaugacuuga

SEQ ID NO: 396070 - RNA, 19 nt, Homo sapiens
gggacuagugaaugacuug

SEQ ID NO: 396071 - RNA, 19 nt, Homo sapiens
ggaggaggaggaggaggaa

SEQ ID NO: 396072 - RNA, 19 nt, Homo sapiens
ggggugcgguggauacuga

SEQ ID NO: 396073 - RNA, 19 nt, Homo sapiens
acgaugaguccaagccuuu

SEQ ID NO: 396074 - RNA, 19 nt, Homo sapiens
cugaagcacccaccgaaga

SEQ ID NO: 396075 - RNA, 19 nt, Homo sapiens
agagagagaggccaaagag

SEQ ID NO: 396076 - RNA, 19 nt, Homo sapiens
cagagagagaggccaaaga

SEQ ID NO: 396077 - RNA, 19 nt, Homo sapiens
agaaggcacgggaggagaa

SEQ ID NO: 396078 - RNA, 19 nt, Homo sapiens
gguuccgucugaagaagau

SEQ ID NO: 396079 - RNA, 19 nt, Homo sapiens
gaagcugagaagccagaga

SEQ ID NO: 396080 - RNA, 19 nt, Homo sapiens
aaagagaagggccguaagg

SEQ ID NO: 396081 - RNA, 19 nt, Homo sapiens
ggcgucaucugugagaaca

SEQ ID NO: 396082 - RNA, 19 nt, Homo sapiens
gaccugugaccucaauaca

SEQ ID NO: 396083 - RNA, 19 nt, Homo sapiens
gaugaguccaagccuuuca

SEQ ID NO: 396084 - RNA, 19 nt, Homo sapiens
gaagaagaaugaccaaauu

SEQ ID NO: 396085 - RNA, 19 nt, Homo sapiens
gcaaacugcugguccauaa

SEQ ID NO: 396086 - RNA, 19 nt, Homo sapiens
agaaagagcuggugcauga

SEQ ID NO: 396087 - RNA, 19 nt, Homo sapiens
gcauauggauucugucaug

SEQ ID NO: 396088 - RNA, 19 nt, Homo sapiens
ggaagcauauggauucugu

SEQ ID NO: 396089 - RNA, 19 nt, Homo sapiens
ugaaaguggugaagaaaga

SEQ ID NO: 396090 - RNA, 19 nt, Homo sapiens
gcaggaagcauauggauuc

SEQ ID NO: 396091 - RNA, 19 nt, Homo sapiens
gaagauggaggaagcugua

SEQ ID NO: 396092 - RNA, 19 nt, Homo sapiens
gauugacccuuuaacugua

SEQ ID NO: 396093 - RNA, 19 nt, Homo sapiens
gucaaagccucccauguuu

SEQ ID NO: 396094 - RNA, 19 nt, Homo sapiens
gaacacagaggacuaccuu

SEQ ID NO: 396095 - RNA, 19 nt, Homo sapiens
gauauugacuggguacaga

SEQ ID NO: 396096 - RNA, 19 nt, Homo sapiens
ccaugaaaguggugaagaa

SEQ ID NO: 396097 - RNA, 19 nt, Homo sapiens
cccuuuaacuguauccuua

SEQ ID NO: 396098 - RNA, 19 nt, Homo sapiens
gggacuugcuggagaagaa

SEQ ID NO: 396099 - RNA, 19 nt, Homo sapiens
cagagaagcacguguuuga

SEQ ID NO: 396100 - RNA, 19 nt, Homo sapiens
gaagaaugaccaaauuuac

SEQ ID NO: 396101 - RNA, 19 nt, Homo sapiens
ggagacagauggaauugcu

SEQ ID NO: 396102 - RNA, 19 nt, Homo sapiens
guauaucaacccauuauug

SEQ ID NO: 396103 - RNA, 19 nt, Homo sapiens
cgucaaagccucccauguu

SEQ ID NO: 396104 - RNA, 19 nt, Homo sapiens
ggacuuugaccuaaucaga

SEQ ID NO: 396105 - RNA, 19 nt, Homo sapiens
gcaggacuuugaccuaauc

SEQ ID NO: 396106 - RNA, 19 nt, Homo sapiens
gaacgaggacgccgaccuu

SEQ ID NO: 396107 - RNA, 19 nt, Homo sapiens
gagaagacaaaucuaucua

SEQ ID NO: 396108 - RNA, 19 nt, Homo sapiens
acaucaagcucacagacua

SEQ ID NO: 396109 - RNA, 19 nt, Homo sapiens
ugggauggauggaaucaaa

SEQ ID NO: 396110 - RNA, 19 nt, Homo sapiens
gauggaauugcuuacauuu

SEQ ID NO: 396111 - RNA, 19 nt, Homo sapiens
guucgaaggcuuugaguau

SEQ ID NO: 396112 - RNA, 19 nt, Homo sapiens
agacagauggaauugcuua

SEQ ID NO: 396113 - RNA, 19 nt, Homo sapiens
gaccaaauuuacgccauga

SEQ ID NO: 396114 - RNA, 19 nt, Homo sapiens
gcugggaguccucauguuu

SEQ ID NO: 396115 - RNA, 19 nt, Homo sapiens
ccaaauuuacgccaugaaa

SEQ ID NO: 396116 - RNA, 19 nt, Homo sapiens
ccaggaaagugagcgugua

SEQ ID NO: 396117 - RNA, 19 nt, Homo sapiens
ggaaacagaacucgaugca

SEQ ID NO: 396118 - RNA, 19 nt, Homo sapiens
gaguauaucaacccauuau

SEQ ID NO: 396119 - RNA, 19 nt, Homo sapiens
ucgaaggcuuugaguauau

SEQ ID NO: 396120 - RNA, 19 nt, Homo sapiens
ugaagaagaaugaccaaau

SEQ ID NO: 396121 - RNA, 19 nt, Homo sapiens
ggaagcaugacagcauuaa

SEQ ID NO: 396122 - RNA, 19 nt, Homo sapiens
cagcauagacugggacuug

SEQ ID NO: 396123 - RNA, 19 nt, Homo sapiens
gaaggccucaucauucaug

SEQ ID NO: 396124 - RNA, 19 nt, Homo sapiens
ccaagagccuccaguagac

SEQ ID NO: 396125 - RNA, 19 nt, Homo sapiens
ggagaagacaaaucuaucu

SEQ ID NO: 396126 - RNA, 19 nt, Homo sapiens
cgaugaggaugccauaaag

SEQ ID NO: 396127 - RNA, 19 nt, Homo sapiens
ggccucaucauucauguuu

SEQ ID NO: 396128 - RNA, 19 nt, Homo sapiens
caaagccucccauguuuua

SEQ ID NO: 396129 - RNA, 19 nt, Homo sapiens
gguuguuccuggucauuga

SEQ ID NO: 396130 - RNA, 19 nt, Homo sapiens
gaagcaugacagcauuaaa

SEQ ID NO: 396131 - RNA, 19 nt, Homo sapiens
agauggaauugcuuacauu

SEQ ID NO: 396132 - RNA, 19 nt, Homo sapiens
cagauggaauugcuuacau

SEQ ID NO: 396133 - RNA, 19 nt, Homo sapiens
ggaagugagagacaugugu

SEQ ID NO: 396134 - RNA, 19 nt, Homo sapiens
gaagaaagagcuggugcau

SEQ ID NO: 396135 - RNA, 19 nt, Homo sapiens
cugcaggacuuugaccuaa

SEQ ID NO: 396136 - RNA, 19 nt, Homo sapiens
ugggaguccucauguuuga

SEQ ID NO: 396137 - RNA, 19 nt, Homo sapiens
gacagagaagcacguguuu

SEQ ID NO: 396138 - RNA, 19 nt, Homo sapiens
cgaggagacagauggaauu

SEQ ID NO: 396139 - RNA, 19 nt, Homo sapiens
ugucaugccuucccaagag

SEQ ID NO: 396140 - RNA, 19 nt, Homo sapiens
ugauugacccuuuaacugu

SEQ ID NO: 396141 - RNA, 19 nt, Homo sapiens
gaugaggaugccauaaaga

SEQ ID NO: 396142 - RNA, 19 nt, Homo sapiens
agacagagaagcacguguu

SEQ ID NO: 396143 - RNA, 19 nt, Homo sapiens
ccggaagcaugacagcauu

SEQ ID NO: 396144 - RNA, 19 nt, Homo sapiens
cccaagagccuccaguaga

SEQ ID NO: 396145 - RNA, 19 nt, Homo sapiens
acgcgugauugacccuuua

SEQ ID NO: 396146 - RNA, 19 nt, Homo sapiens
ggaucgaccagucagaguu

SEQ ID NO: 396147 - RNA, 19 nt, Homo sapiens
ggagcucugugaggaagug

SEQ ID NO: 396148 - RNA, 19 nt, Homo sapiens
ggagaggaguacggguuca

SEQ ID NO: 396149 - RNA, 19 nt, Homo sapiens
caacggccaccucuuccaa

SEQ ID NO: 396150 - RNA, 19 nt, Homo sapiens
gaggagacagauggaauug

SEQ ID NO: 396151 - RNA, 19 nt, Homo sapiens
uucgaaggcuuugaguaua

SEQ ID NO: 396152 - RNA, 19 nt, Homo sapiens
ggacuaccuuuuccaagug

SEQ ID NO: 396153 - RNA, 19 nt, Homo sapiens
caaauuuacgccaugaaag

SEQ ID NO: 396154 - RNA, 19 nt, Homo sapiens
gggagaagacaaaucuauc

SEQ ID NO: 396155 - RNA, 19 nt, Homo sapiens
gaucgaccagucagaguuc

SEQ ID NO: 396156 - RNA, 19 nt, Homo sapiens
uaaauaaggaccccaaaga

SEQ ID NO: 396157 - RNA, 19 nt, Homo sapiens
gaauaaaauguuccgauga

SEQ ID NO: 396158 - RNA, 19 nt, Homo sapiens
gugauugacccuuuaacug

SEQ ID NO: 396159 - RNA, 19 nt, Homo sapiens
cugcaucgcccucaacuuc

SEQ ID NO: 396160 - RNA, 19 nt, Homo sapiens
ucgaugggauggauggaau

SEQ ID NO: 396161 - RNA, 19 nt, Homo sapiens
aaauuuacgccaugaaagu

SEQ ID NO: 396162 - RNA, 19 nt, Homo sapiens
ggcuugggcugcaggacuu

SEQ ID NO: 396163 - RNA, 19 nt, Homo sapiens
uugcuuacauuuccucauc

SEQ ID NO: 396164 - RNA, 19 nt, Homo sapiens
gucaugcgguuuccaaggu

SEQ ID NO: 396165 - RNA, 19 nt, Homo sapiens
cgaaggcuuugaguauauc

SEQ ID NO: 396166 - RNA, 19 nt, Homo sapiens
cgacuacggucuggacaac

SEQ ID NO: 396167 - RNA, 19 nt, Homo sapiens
aagagcuggugcaugauga

SEQ ID NO: 396168 - RNA, 19 nt, Homo sapiens
caugaaaguggugaagaaa

SEQ ID NO: 396169 - RNA, 19 nt, Homo sapiens
gaggaccuuaagccaguua

SEQ ID NO: 396170 - RNA, 19 nt, Homo sapiens
ggaggaccuuaagccaguu

SEQ ID NO: 396171 - RNA, 19 nt, Homo sapiens
agcaggcgcucccuccauu

SEQ ID NO: 396172 - RNA, 19 nt, Homo sapiens
cgggagaagacaaaucuau

SEQ ID NO: 396173 - RNA, 19 nt, Homo sapiens
cuggugcgguugaagaaga

SEQ ID NO: 396174 - RNA, 19 nt, Homo sapiens
gcugcaggacuuugaccua

SEQ ID NO: 396175 - RNA, 19 nt, Homo sapiens
aagcaugacagcauuaaag

SEQ ID NO: 396176 - RNA, 19 nt, Homo sapiens
acgaugaggaugccauaaa

SEQ ID NO: 396177 - RNA, 19 nt, Homo sapiens
acuacggucuggacaacuu

SEQ ID NO: 396178 - RNA, 19 nt, Homo sapiens
cgacaacccggacaugaac

SEQ ID NO: 396179 - RNA, 19 nt, Homo sapiens
gcaugaugacgaggauauu

SEQ ID NO: 396180 - RNA, 19 nt, Homo sapiens
ugaguauaucaacccauua

SEQ ID NO: 396181 - RNA, 19 nt, Homo sapiens
agacgaugaggaugccaua

SEQ ID NO: 396182 - RNA, 19 nt, Homo sapiens
ccgacaacccggacaugaa

SEQ ID NO: 396183 - RNA, 19 nt, Homo sapiens
ugacacaacgagcacuuuc

SEQ ID NO: 396184 - RNA, 19 nt, Homo sapiens
gaaaggagguucuaaacua

SEQ ID NO: 396185 - RNA, 19 nt, Homo sapiens
ggaagaagcucauuugauu

SEQ ID NO: 396186 - RNA, 19 nt, Homo sapiens
gcaaagagguggcaguuaa

SEQ ID NO: 396187 - RNA, 19 nt, Homo sapiens
gaugaaagcucuaaagaug

SEQ ID NO: 396188 - RNA, 19 nt, Homo sapiens
gaacugcucuuuaaggauu

SEQ ID NO: 396189 - RNA, 19 nt, Homo sapiens
gagcaucacuugccuuuaa

SEQ ID NO: 396190 - RNA, 19 nt, Homo sapiens
gagaagaaauccuaaaguu

SEQ ID NO: 396191 - RNA, 19 nt, Homo sapiens
ggagaagacuuuaccauug

SEQ ID NO: 396192 - RNA, 19 nt, Homo sapiens
gaaaugaacuuacaaagac

SEQ ID NO: 396193 - RNA, 19 nt, Homo sapiens
gagcugggcuucugcauaa

SEQ ID NO: 396194 - RNA, 19 nt, Homo sapiens
gauggaagcuccugaagaa

SEQ ID NO: 396195 - RNA, 19 nt, Homo sapiens
gaaauuggaucuuacacuu

SEQ ID NO: 396196 - RNA, 19 nt, Homo sapiens
ugaaggagcugcauaaaga

SEQ ID NO: 396197 - RNA, 19 nt, Homo sapiens
ggaaaucacuugaauacug

SEQ ID NO: 396198 - RNA, 19 nt, Homo sapiens
ggaagucacucaacaguau

SEQ ID NO: 396199 - RNA, 19 nt, Homo sapiens
gaucaggaguugcaaguuu

SEQ ID NO: 396200 - RNA, 19 nt, Homo sapiens
caagaggagugaaagguua

SEQ ID NO: 396201 - RNA, 19 nt, Homo sapiens
gaugagaaguccuuaggua

SEQ ID NO: 396202 - RNA, 19 nt, Homo sapiens
uaacagaaauucaggaguu

SEQ ID NO: 396203 - RNA, 19 nt, Homo sapiens
gaacaaagcaaaucacuca

SEQ ID NO: 396204 - RNA, 19 nt, Homo sapiens
gauaaugacucccaggaaa

SEQ ID NO: 396205 - RNA, 19 nt, Homo sapiens
aagaaggacuuguguaaua

SEQ ID NO: 396206 - RNA, 19 nt, Homo sapiens
gcagauggcuuucaaacug

SEQ ID NO: 396207 - RNA, 19 nt, Homo sapiens
gaaaugagcuggagauucc

SEQ ID NO: 396208 - RNA, 19 nt, Homo sapiens
gaagagaaugcaucaguua

SEQ ID NO: 396209 - RNA, 19 nt, Homo sapiens
gugaaagucugaaucauuu

SEQ ID NO: 396210 - RNA, 19 nt, Homo sapiens
ccacacaaauguagaauug

SEQ ID NO: 396211 - RNA, 19 nt, Homo sapiens
ggacaaggcuagaagaauc

SEQ ID NO: 396212 - RNA, 19 nt, Homo sapiens
uagccaagcuuguuauuaa

SEQ ID NO: 396213 - RNA, 19 nt, Homo sapiens
gcagacagguucaugaaug

SEQ ID NO: 396214 - RNA, 19 nt, Homo sapiens
gaacuucuuucccugguuu

SEQ ID NO: 396215 - RNA, 19 nt, Homo sapiens
gaggagugauucaagauuu

SEQ ID NO: 396216 - RNA, 19 nt, Homo sapiens
gccagaagaucgcaccuua

SEQ ID NO: 396217 - RNA, 19 nt, Homo sapiens
gaaaucacuugaauacugu

SEQ ID NO: 396218 - RNA, 19 nt, Homo sapiens
ggaaaugaacuuacaaaga

SEQ ID NO: 396219 - RNA, 19 nt, Homo sapiens
aagcaaagaucacaacauu

SEQ ID NO: 396220 - RNA, 19 nt, Homo sapiens
aaaguagacucaccaaauu

SEQ ID NO: 396221 - RNA, 19 nt, Homo sapiens
gaacauggcaggagagaau

SEQ ID NO: 396222 - RNA, 19 nt, Homo sapiens
gaagauuguugagaaauug

SEQ ID NO: 396223 - RNA, 19 nt, Homo sapiens
gcaggaccgugcaagguua

SEQ ID NO: 396224 - RNA, 19 nt, Homo sapiens
uauaugagcuccuaggauu

SEQ ID NO: 396225 - RNA, 19 nt, Homo sapiens
gagaaugcaucaguuauug

SEQ ID NO: 396226 - RNA, 19 nt, Homo sapiens
ggaagagaaugcaucaguu

SEQ ID NO: 396227 - RNA, 19 nt, Homo sapiens
aaauauccgucucuucuua

SEQ ID NO: 396228 - RNA, 19 nt, Homo sapiens
aaagcuggaucuacauuua

SEQ ID NO: 396229 - RNA, 19 nt, Homo sapiens
gaaagauguucucaaggaa

SEQ ID NO: 396230 - RNA, 19 nt, Homo sapiens
ugaaagauguucucaagga

SEQ ID NO: 396231 - RNA, 19 nt, Homo sapiens
gaaugaagcucagugacuu

SEQ ID NO: 396232 - RNA, 19 nt, Homo sapiens
cagcaugacuucacacuga

SEQ ID NO: 396233 - RNA, 19 nt, Homo sapiens
gacacaaccuugaaauuau

SEQ ID NO: 396234 - RNA, 19 nt, Homo sapiens
aaacaugucuuucauccaa

SEQ ID NO: 396235 - RNA, 19 nt, Homo sapiens
cuagaagaauggucaauuu

SEQ ID NO: 396236 - RNA, 19 nt, Homo sapiens
ggucauggauucaagaaau

SEQ ID NO: 396237 - RNA, 19 nt, Homo sapiens
gaaagaaacgggccuuaug

SEQ ID NO: 396238 - RNA, 19 nt, Homo sapiens
guacaggcuuuaacagaaa

SEQ ID NO: 396239 - RNA, 19 nt, Homo sapiens
gcaagaugauguugacaga

SEQ ID NO: 396240 - RNA, 19 nt, Homo sapiens
ggaaaucaagagugaguua

SEQ ID NO: 396241 - RNA, 19 nt, Homo sapiens
gaaagaagccagagaagca

SEQ ID NO: 396242 - RNA, 19 nt, Homo sapiens
gagaagacuuuaccauugu

SEQ ID NO: 396243 - RNA, 19 nt, Homo sapiens
gaucaacacggaauuauug

SEQ ID NO: 396244 - RNA, 19 nt, Homo sapiens
gcagugcccuuuagagaga

SEQ ID NO: 396245 - RNA, 19 nt, Homo sapiens
gcaauauccuuagaagaaa

SEQ ID NO: 396246 - RNA, 19 nt, Homo sapiens
cagaugagaccaagaauaa

SEQ ID NO: 396247 - RNA, 19 nt, Homo sapiens
gaacuuaagacccagauga

SEQ ID NO: 396248 - RNA, 19 nt, Homo sapiens
agauagagcugcuaaaugu

SEQ ID NO: 396249 - RNA, 19 nt, Homo sapiens
gaaagccauugccagagua

SEQ ID NO: 396250 - RNA, 19 nt, Homo sapiens
uuccauggcucguguauua

SEQ ID NO: 396251 - RNA, 19 nt, Homo sapiens
ccaagaagaugggcuacua

SEQ ID NO: 396252 - RNA, 19 nt, Homo sapiens
guugagaaauuggaucuua

SEQ ID NO: 396253 - RNA, 19 nt, Homo sapiens
gagcuguacuuccaguuaa

SEQ ID NO: 396254 - RNA, 19 nt, Homo sapiens
aaacgaagcaauauccuua

SEQ ID NO: 396255 - RNA, 19 nt, Homo sapiens
cagcuaaaccuaaagauuu

SEQ ID NO: 396256 - RNA, 19 nt, Homo sapiens
gcgaauacuuccaggcuuu

SEQ ID NO: 396257 - RNA, 19 nt, Homo sapiens
gcauuggaauuaucucaaa

SEQ ID NO: 396258 - RNA, 19 nt, Homo sapiens
acacaaagcuggaucuaca

SEQ ID NO: 396259 - RNA, 19 nt, Homo sapiens
gauugaaguuuccuagauu

SEQ ID NO: 396260 - RNA, 19 nt, Homo sapiens
ggaaacauaucuaccuuac

SEQ ID NO: 396261 - RNA, 19 nt, Homo sapiens
acauagagaugaugaaaga

SEQ ID NO: 396262 - RNA, 19 nt, Homo sapiens
agacacaaccuugaaauua

SEQ ID NO: 396263 - RNA, 19 nt, Homo sapiens
gaaauccaauaguaccauu

SEQ ID NO: 396264 - RNA, 19 nt, Homo sapiens
ccacagauuugcaucauuc

SEQ ID NO: 396265 - RNA, 19 nt, Homo sapiens
ggagaaagguacaacuaca

SEQ ID NO: 396266 - RNA, 19 nt, Homo sapiens
caacauucgugcccaagaa

SEQ ID NO: 396267 - RNA, 19 nt, Homo sapiens
gaauguggaucaagaugga

SEQ ID NO: 396268 - RNA, 19 nt, Homo sapiens
agaaggaaaucaagaguga

SEQ ID NO: 396269 - RNA, 19 nt, Homo sapiens
uuacagagauccagaaagu

SEQ ID NO: 396270 - RNA, 19 nt, Homo sapiens
ggacuuauacuucgauaug

SEQ ID NO: 396271 - RNA, 19 nt, Homo sapiens
cccuaaagaugaaguguua

SEQ ID NO: 396272 - RNA, 19 nt, Homo sapiens
guucagagcuauucauaca

SEQ ID NO: 396273 - RNA, 19 nt, Homo sapiens
ugucuucccugucauauuu

SEQ ID NO: 396274 - RNA, 19 nt, Homo sapiens
gaacuuacaaagacauuga

SEQ ID NO: 396275 - RNA, 19 nt, Homo sapiens
caaauccauugaacucuuu

SEQ ID NO: 396276 - RNA, 19 nt, Homo sapiens
gacaguacuuuaagagauu

SEQ ID NO: 396277 - RNA, 19 nt, Homo sapiens
gaagcaauauccuuagaag

SEQ ID NO: 396278 - RNA, 19 nt, Homo sapiens
aaucugauguuaccaauga

SEQ ID NO: 396279 - RNA, 19 nt, Homo sapiens
ggaaagccauugccagagu

SEQ ID NO: 396280 - RNA, 19 nt, Homo sapiens
gaagccagauugaaguuuc

SEQ ID NO: 396281 - RNA, 19 nt, Homo sapiens
caaaguagacucaccaaau

SEQ ID NO: 396282 - RNA, 19 nt, Homo sapiens
uugcaucccuugacuguua

SEQ ID NO: 396283 - RNA, 19 nt, Homo sapiens
guaccaguguuuauacaaa

SEQ ID NO: 396284 - RNA, 19 nt, Homo sapiens
gaacuagcuucuugucuua

SEQ ID NO: 396285 - RNA, 19 nt, Homo sapiens
gaacaaaggccaugacauu

SEQ ID NO: 396286 - RNA, 19 nt, Homo sapiens
gcuagaaguuucaugauuu

SEQ ID NO: 396287 - RNA, 19 nt, Homo sapiens
ccaaggaucuuauaaagga

SEQ ID NO: 396288 - RNA, 19 nt, Homo sapiens
ugaauaagcugaguccaua

SEQ ID NO: 396289 - RNA, 19 nt, Homo sapiens
uaacauacccucaaacuga

SEQ ID NO: 396290 - RNA, 19 nt, Homo sapiens
gaagagacccacuaugaaa

SEQ ID NO: 396291 - RNA, 19 nt, Homo sapiens
gccagaaacucaagcauuu

SEQ ID NO: 396292 - RNA, 19 nt, Homo sapiens
gacaaugacuuuaugaaga

SEQ ID NO: 396293 - RNA, 19 nt, Homo sapiens
agaacgagcuggacaagua

SEQ ID NO: 396294 - RNA, 19 nt, Homo sapiens
ggacaggacucaucaagca

SEQ ID NO: 396295 - RNA, 19 nt, Homo sapiens
ggauugacaugauagaauu

SEQ ID NO: 396296 - RNA, 19 nt, Homo sapiens
gaucgaugcugcuccagua

SEQ ID NO: 396297 - RNA, 19 nt, Homo sapiens
gcaugccaguugacuauua

SEQ ID NO: 396298 - RNA, 19 nt, Homo sapiens
ggagagcucuggaccauuc

SEQ ID NO: 396299 - RNA, 19 nt, Homo sapiens
ccaaacuccuguccaauuu

SEQ ID NO: 396300 - RNA, 19 nt, Homo sapiens
gauggaagcuugucuaggu

SEQ ID NO: 396301 - RNA, 19 nt, Homo sapiens
gaaagaaagcccaaaguca

SEQ ID NO: 396302 - RNA, 19 nt, Homo sapiens
aaacugggcuauucccuuu

SEQ ID NO: 396303 - RNA, 19 nt, Homo sapiens
gcuguaaccugccuuguga

SEQ ID NO: 396304 - RNA, 19 nt, Homo sapiens
ucagaaagauuagggaauu

SEQ ID NO: 396305 - RNA, 19 nt, Homo sapiens
ggauagagguucguuugaa

SEQ ID NO: 396306 - RNA, 19 nt, Homo sapiens
gagaacagcaaacguaauu

SEQ ID NO: 396307 - RNA, 19 nt, Homo sapiens
caauagugcucuuuacaug

SEQ ID NO: 396308 - RNA, 19 nt, Homo sapiens
uaaccugccuugugauuga

SEQ ID NO: 396309 - RNA, 19 nt, Homo sapiens
guaccuugcuggaauauuc

SEQ ID NO: 396310 - RNA, 19 nt, Homo sapiens
cuugacaccuccuauaaua

SEQ ID NO: 396311 - RNA, 19 nt, Homo sapiens
gcaauuucauacuaccuaa

SEQ ID NO: 396312 - RNA, 19 nt, Homo sapiens
ccauauacuugucuaacua

SEQ ID NO: 396313 - RNA, 19 nt, Homo sapiens
gcaaaggaacgguaaaugu

SEQ ID NO: 396314 - RNA, 19 nt, Homo sapiens
caaaggccaugacauuuca

SEQ ID NO: 396315 - RNA, 19 nt, Homo sapiens
aaacugaggcuuaaaguau

SEQ ID NO: 396316 - RNA, 19 nt, Homo sapiens
gcacaacugcuauagauuc

SEQ ID NO: 396317 - RNA, 19 nt, Homo sapiens
gaacagcaacacaaauuca

SEQ ID NO: 396318 - RNA, 19 nt, Homo sapiens
ucacagaguucaugucaca

SEQ ID NO: 396319 - RNA, 19 nt, Homo sapiens
gcuggaauauucaagaaga

SEQ ID NO: 396320 - RNA, 19 nt, Homo sapiens
ugaacuagcuucuugucuu

SEQ ID NO: 396321 - RNA, 19 nt, Homo sapiens
gauagaauuuccaaagaag

SEQ ID NO: 396322 - RNA, 19 nt, Homo sapiens
ggacaauccaucagaaaga

SEQ ID NO: 396323 - RNA, 19 nt, Homo sapiens
gcaaugaagauucucaaga

SEQ ID NO: 396324 - RNA, 19 nt, Homo sapiens
cauggaagaugguaagguu

SEQ ID NO: 396325 - RNA, 19 nt, Homo sapiens
aaaccaaacuccuguccaa

SEQ ID NO: 396326 - RNA, 19 nt, Homo sapiens
ggaaacacuucaauguagu

SEQ ID NO: 396327 - RNA, 19 nt, Homo sapiens
ucaccgagguuaugccaaa

SEQ ID NO: 396328 - RNA, 19 nt, Homo sapiens
aaacguaauugcugcagaa

SEQ ID NO: 396329 - RNA, 19 nt, Homo sapiens
gaagcugucugauuucaac

SEQ ID NO: 396330 - RNA, 19 nt, Homo sapiens
caaauuaaacugaguccuu

SEQ ID NO: 396331 - RNA, 19 nt, Homo sapiens
ugacaagacugaauguuac

SEQ ID NO: 396332 - RNA, 19 nt, Homo sapiens
gcuauucccuuucuucaag

SEQ ID NO: 396333 - RNA, 19 nt, Homo sapiens
gaaacacuucaauguagua

SEQ ID NO: 396334 - RNA, 19 nt, Homo sapiens
cauagucagucuagaguug

SEQ ID NO: 396335 - RNA, 19 nt, Homo sapiens
ccacagacacaaguaauuu

SEQ ID NO: 396336 - RNA, 19 nt, Homo sapiens
gaaagauuagggaauuuga

SEQ ID NO: 396337 - RNA, 19 nt, Homo sapiens
gagguucguuugaagauuc

SEQ ID NO: 396338 - RNA, 19 nt, Homo sapiens
aaagaaagcccaaagucaa

SEQ ID NO: 396339 - RNA, 19 nt, Homo sapiens
aaacuccuguccaauuuga

SEQ ID NO: 396340 - RNA, 19 nt, Homo sapiens
guaggaaacacuucaaugu

SEQ ID NO: 396341 - RNA, 19 nt, Homo sapiens
gauagagguucguuugaag

SEQ ID NO: 396342 - RNA, 19 nt, Homo sapiens
ccaaaggaaucauuuacag

SEQ ID NO: 396343 - RNA, 19 nt, Homo sapiens
gguagaagcuuuugccuau

SEQ ID NO: 396344 - RNA, 19 nt, Homo sapiens
guauuucucuuaccugcuu

SEQ ID NO: 396345 - RNA, 19 nt, Homo sapiens
gaugguaagguugaaguua

SEQ ID NO: 396346 - RNA, 19 nt, Homo sapiens
guauguacccgguggagua

SEQ ID NO: 396347 - RNA, 19 nt, Homo sapiens
aagcuauccuugacaauga

SEQ ID NO: 396348 - RNA, 19 nt, Homo sapiens
gaagcuauccuugacaaug

SEQ ID NO: 396349 - RNA, 19 nt, Homo sapiens
guccaaggaucuuauaaag

SEQ ID NO: 396350 - RNA, 19 nt, Homo sapiens
caaacugaggcuuaaagua

SEQ ID NO: 396351 - RNA, 19 nt, Homo sapiens
gcuuugcucugauuauaau

SEQ ID NO: 396352 - RNA, 19 nt, Homo sapiens
caacucaggaugggauaua

SEQ ID NO: 396353 - RNA, 19 nt, Homo sapiens
ggaauauucaagaagauga

SEQ ID NO: 396354 - RNA, 19 nt, Homo sapiens
uaggaaacacuucaaugua

SEQ ID NO: 396355 - RNA, 19 nt, Homo sapiens
cagaaagauuagggaauuu

SEQ ID NO: 396356 - RNA, 19 nt, Homo sapiens
caaggacaguugcaucauc

SEQ ID NO: 396357 - RNA, 19 nt, Homo sapiens
uauuugaacuagcuucuug

SEQ ID NO: 396358 - RNA, 19 nt, Homo sapiens
acaguggcauuaggacuua

SEQ ID NO: 396359 - RNA, 19 nt, Homo sapiens
cagcaaaccugagggaaag

SEQ ID NO: 396360 - RNA, 19 nt, Homo sapiens
uaacugggaaggcuuaaga

SEQ ID NO: 396361 - RNA, 19 nt, Homo sapiens
gaagaugugagaacagcaa

SEQ ID NO: 396362 - RNA, 19 nt, Homo sapiens
acaguugcaucaucaaaga

SEQ ID NO: 396363 - RNA, 19 nt, Homo sapiens
ggacaguugcaucaucaaa

SEQ ID NO: 396364 - RNA, 19 nt, Homo sapiens
gauuguggauuguauguac

SEQ ID NO: 396365 - RNA, 19 nt, Homo sapiens
gcaacacaaauucaaauca

SEQ ID NO: 396366 - RNA, 19 nt, Homo sapiens
uaaagaugguccuggaagu

SEQ ID NO: 396367 - RNA, 19 nt, Homo sapiens
guacagaaacugggcuauu

SEQ ID NO: 396368 - RNA, 19 nt, Homo sapiens
aggaaacacuucaauguag

SEQ ID NO: 396369 - RNA, 19 nt, Homo sapiens
gaaagagagaagauuagug

SEQ ID NO: 396370 - RNA, 19 nt, Homo sapiens
gacaauccaucagaaagau

SEQ ID NO: 396371 - RNA, 19 nt, Homo sapiens
gaacauuuaaggacagcaa

SEQ ID NO: 396372 - RNA, 19 nt, Homo sapiens
caaaggaacgguaaauguc

SEQ ID NO: 396373 - RNA, 19 nt, Homo sapiens
caagcuugcugauguccuu

SEQ ID NO: 396374 - RNA, 19 nt, Homo sapiens
gaucgacaauguuuucaaa

SEQ ID NO: 396375 - RNA, 19 nt, Homo sapiens
ggaagaugguaagguugaa

SEQ ID NO: 396376 - RNA, 19 nt, Homo sapiens
ugagagacaaagguaauua

SEQ ID NO: 396377 - RNA, 19 nt, Homo sapiens
caacauagucagucuagag

SEQ ID NO: 396378 - RNA, 19 nt, Homo sapiens
uaaaauagcaguugacaug

SEQ ID NO: 396379 - RNA, 19 nt, Homo sapiens
gagaucauccugaacaaag

SEQ ID NO: 396380 - RNA, 19 nt, Homo sapiens
agacuguacagaacauuua

SEQ ID NO: 396381 - RNA, 19 nt, Homo sapiens
agaaagcaguacagaggaa

SEQ ID NO: 396382 - RNA, 19 nt, Homo sapiens
gagcuggaguuggaucaga

SEQ ID NO: 396383 - RNA, 19 nt, Homo sapiens
uaaauuggcaugacagagu

SEQ ID NO: 396384 - RNA, 19 nt, Homo sapiens
caaaggagauuacaucauu

SEQ ID NO: 396385 - RNA, 19 nt, Homo sapiens
caagggaguuacauuauua

SEQ ID NO: 396386 - RNA, 19 nt, Homo sapiens
ugacagagcuggagagaga

SEQ ID NO: 396387 - RNA, 19 nt, Homo sapiens
gcaagggaguuacauuauu

SEQ ID NO: 396388 - RNA, 19 nt, Homo sapiens
gagauuacaucauuagaga

SEQ ID NO: 396389 - RNA, 19 nt, Homo sapiens
aaacacaggugguuaaaug

SEQ ID NO: 396390 - RNA, 19 nt, Homo sapiens
agaagaagcucauuacaga

SEQ ID NO: 396391 - RNA, 19 nt, Homo sapiens
ggaauacuaugacaaagga

SEQ ID NO: 396392 - RNA, 19 nt, Homo sapiens
ggaagaagcacauaguuga

SEQ ID NO: 396393 - RNA, 19 nt, Homo sapiens
cgaaaguccuuguuaaaga

SEQ ID NO: 396394 - RNA, 19 nt, Homo sapiens
gaaaguccuuguuaaagau

SEQ ID NO: 396395 - RNA, 19 nt, Homo sapiens
gaguugagcuuguuaaagu

SEQ ID NO: 396396 - RNA, 19 nt, Homo sapiens
ggauuggucucucuccaua

SEQ ID NO: 396397 - RNA, 19 nt, Homo sapiens
gaucacagcuacuuugaca

SEQ ID NO: 396398 - RNA, 19 nt, Homo sapiens
ggaguuacauuauuaagca

SEQ ID NO: 396399 - RNA, 19 nt, Homo sapiens
cgagaaacauucaaccaaa

SEQ ID NO: 396400 - RNA, 19 nt, Homo sapiens
cagaggagcuccagaacaa

SEQ ID NO: 396401 - RNA, 19 nt, Homo sapiens
ugacagaagcauuugauua

SEQ ID NO: 396402 - RNA, 19 nt, Homo sapiens
gagcaugucuacucagaga

SEQ ID NO: 396403 - RNA, 19 nt, Homo sapiens
gauguugcaugccugguua

SEQ ID NO: 396404 - RNA, 19 nt, Homo sapiens
gcuaugaaguguauaagga

SEQ ID NO: 396405 - RNA, 19 nt, Homo sapiens
ucaaagacaugguggaaug

SEQ ID NO: 396406 - RNA, 19 nt, Homo sapiens
uguagucacugcugaguua

SEQ ID NO: 396407 - RNA, 19 nt, Homo sapiens
ggagaauacuuuggagaaa

SEQ ID NO: 396408 - RNA, 19 nt, Homo sapiens
ugaaagcuauuaccaaugu

SEQ ID NO: 396409 - RNA, 19 nt, Homo sapiens
caacagaaccuccugacuu

SEQ ID NO: 396410 - RNA, 19 nt, Homo sapiens
ugacaaauauccuccugaa

SEQ ID NO: 396411 - RNA, 19 nt, Homo sapiens
gaacccaccuccaaauucu

SEQ ID NO: 396412 - RNA, 19 nt, Homo sapiens
caacaacccggaccuauga

SEQ ID NO: 396413 - RNA, 19 nt, Homo sapiens
gguuauagaucgagaaaca

SEQ ID NO: 396414 - RNA, 19 nt, Homo sapiens
uuacagaugcccuuaauaa

SEQ ID NO: 396415 - RNA, 19 nt, Homo sapiens
ugaacaagcugcaggaugu

SEQ ID NO: 396416 - RNA, 19 nt, Homo sapiens
uauccuugcugaagaauuu

SEQ ID NO: 396417 - RNA, 19 nt, Homo sapiens
gcugugcucuccauucauu

SEQ ID NO: 396418 - RNA, 19 nt, Homo sapiens
cagcaagggaguuacauua

SEQ ID NO: 396419 - RNA, 19 nt, Homo sapiens
uagaugcugugaauuauug

SEQ ID NO: 396420 - RNA, 19 nt, Homo sapiens
gaagaaaaguugauuacug

SEQ ID NO: 396421 - RNA, 19 nt, Homo sapiens
caaaugaugaccuacaauu

SEQ ID NO: 396422 - RNA, 19 nt, Homo sapiens
gcgaagcgguccaugucua

SEQ ID NO: 396423 - RNA, 19 nt, Homo sapiens
aacagaaccuccugacuuu

SEQ ID NO: 396424 - RNA, 19 nt, Homo sapiens
gaaaggcugggaaaucuga

SEQ ID NO: 396425 - RNA, 19 nt, Homo sapiens
uaaauugguugacuuugga

SEQ ID NO: 396426 - RNA, 19 nt, Homo sapiens
caaccaaacugucgguaca

SEQ ID NO: 396427 - RNA, 19 nt, Homo sapiens
gagaugaacaauacagaaa

SEQ ID NO: 396428 - RNA, 19 nt, Homo sapiens
ggcacuagaucgagaggua

SEQ ID NO: 396429 - RNA, 19 nt, Homo sapiens
cagauaaagugccucuuga

SEQ ID NO: 396430 - RNA, 19 nt, Homo sapiens
cuucaggccucuccagaua

SEQ ID NO: 396431 - RNA, 19 nt, Homo sapiens
gaggaaggaugcugagauc

SEQ ID NO: 396432 - RNA, 19 nt, Homo sapiens
aaucauauccuucucguuu

SEQ ID NO: 396433 - RNA, 19 nt, Homo sapiens
gcaggagcaugucuacuca

SEQ ID NO: 396434 - RNA, 19 nt, Homo sapiens
caggucagcuaacauuauu

SEQ ID NO: 396435 - RNA, 19 nt, Homo sapiens
gaaguggaauacuaugaca

SEQ ID NO: 396436 - RNA, 19 nt, Homo sapiens
gauaugguucugaguuaua

SEQ ID NO: 396437 - RNA, 19 nt, Homo sapiens
uggauaugguucugaguua

SEQ ID NO: 396438 - RNA, 19 nt, Homo sapiens
gcacagaaggccaugauca

SEQ ID NO: 396439 - RNA, 19 nt, Homo sapiens
gcuuggaaguggaauacua

SEQ ID NO: 396440 - RNA, 19 nt, Homo sapiens
ggaccucaaggaucaauaa

SEQ ID NO: 396441 - RNA, 19 nt, Homo sapiens
uacagaaacuuccucagaa

SEQ ID NO: 396442 - RNA, 19 nt, Homo sapiens
caacagaaaggcugggaaa

SEQ ID NO: 396443 - RNA, 19 nt, Homo sapiens
caagggacaugacuucagu

SEQ ID NO: 396444 - RNA, 19 nt, Homo sapiens
gggagcagcugucgaagca

SEQ ID NO: 396445 - RNA, 19 nt, Homo sapiens
gcugugaauuauugaugua

SEQ ID NO: 396446 - RNA, 19 nt, Homo sapiens
ggacagaggcagcuuugau

SEQ ID NO: 396447 - RNA, 19 nt, Homo sapiens
gaagcagacuguggccauu

SEQ ID NO: 396448 - RNA, 19 nt, Homo sapiens
gagcgggaguaccauuuga

SEQ ID NO: 396449 - RNA, 19 nt, Homo sapiens
ggagaaccaggaaaccaua

SEQ ID NO: 396450 - RNA, 19 nt, Homo sapiens
cagaaaggcugggaaaucu

SEQ ID NO: 396451 - RNA, 19 nt, Homo sapiens
ggagaagguggccagauuu

SEQ ID NO: 396452 - RNA, 19 nt, Homo sapiens
gugguuaaaugaugcuaaa

SEQ ID NO: 396453 - RNA, 19 nt, Homo sapiens
ggagaaugguguggauaug

SEQ ID NO: 396454 - RNA, 19 nt, Homo sapiens
caacaagggacaugacuuc

SEQ ID NO: 396455 - RNA, 19 nt, Homo sapiens
gcugaagaauuuaccugaa

SEQ ID NO: 396456 - RNA, 19 nt, Homo sapiens
uacaaugugugguuaaaug

SEQ ID NO: 396457 - RNA, 19 nt, Homo sapiens
guaacugaaucaaucaauc

SEQ ID NO: 396458 - RNA, 19 nt, Homo sapiens
ugggaaaucugaagaaugg

SEQ ID NO: 396459 - RNA, 19 nt, Homo sapiens
gaagaguugagcuuguuaa

SEQ ID NO: 396460 - RNA, 19 nt, Homo sapiens
ggaagaguugagcuuguua

SEQ ID NO: 396461 - RNA, 19 nt, Homo sapiens
guacaaggacugccucugu

SEQ ID NO: 396462 - RNA, 19 nt, Homo sapiens
gcacccagauggacacucu

SEQ ID NO: 396463 - RNA, 19 nt, Homo sapiens
gguauuaucuacagagacu

SEQ ID NO: 396464 - RNA, 19 nt, Homo sapiens
caaggacaauaaguaugua

SEQ ID NO: 396465 - RNA, 19 nt, Homo sapiens
gaucauugacugcuuggaa

SEQ ID NO: 396466 - RNA, 19 nt, Homo sapiens
agaaauuccugcacaaugg

SEQ ID NO: 396467 - RNA, 19 nt, Homo sapiens
uccagaaccuugagauuau

SEQ ID NO: 396468 - RNA, 19 nt, Homo sapiens
ugaagaauuuaccugaaga

SEQ ID NO: 396469 - RNA, 19 nt, Homo sapiens
gaggacagcccaagcuaga

SEQ ID NO: 396470 - RNA, 19 nt, Homo sapiens
ugugaaagcuauuaccaau

SEQ ID NO: 396471 - RNA, 19 nt, Homo sapiens
ucucagcaacuucauauaa

SEQ ID NO: 396472 - RNA, 19 nt, Homo sapiens
ggauaugguucugaguuau

SEQ ID NO: 396473 - RNA, 19 nt, Homo sapiens
gaucaauaauccaacacau

SEQ ID NO: 396474 - RNA, 19 nt, Homo sapiens
gggaaugccuccagaugag

SEQ ID NO: 396475 - RNA, 19 nt, Homo sapiens
ggagcucuggaguauauua

SEQ ID NO: 396476 - RNA, 19 nt, Homo sapiens
guacuuucaaggacaauaa

SEQ ID NO: 396477 - RNA, 19 nt, Homo sapiens
gagaaacauucaaccaaac

SEQ ID NO: 396478 - RNA, 19 nt, Homo sapiens
gaucaaagacaugguggaa

SEQ ID NO: 396479 - RNA, 19 nt, Homo sapiens
uaagaaacacaggugguua

SEQ ID NO: 396480 - RNA, 19 nt, Homo sapiens
ucaggccucuccagauaaa

SEQ ID NO: 396481 - RNA, 19 nt, Homo sapiens
ggaaaucugaagaauggaa

SEQ ID NO: 396482 - RNA, 19 nt, Homo sapiens
gcugaggguuaccuuaaau

SEQ ID NO: 396483 - RNA, 19 nt, Homo sapiens
gacagaagcauuugauuac

SEQ ID NO: 396484 - RNA, 19 nt, Homo sapiens
guacagggcuccagaaauu

SEQ ID NO: 396485 - RNA, 19 nt, Homo sapiens
ggaaauaccuuggcugaug

SEQ ID NO: 396486 - RNA, 19 nt, Homo sapiens
ggaaacagaucuuuacaag

SEQ ID NO: 396487 - RNA, 19 nt, Homo sapiens
gagaauggguuauauaaag

SEQ ID NO: 396488 - RNA, 19 nt, Homo sapiens
ccaaagcucuggacuuauu

SEQ ID NO: 396489 - RNA, 19 nt, Homo sapiens
gcuaggaacuauuugcuuu

SEQ ID NO: 396490 - RNA, 19 nt, Homo sapiens
aagaagaccugaauuguau

SEQ ID NO: 396491 - RNA, 19 nt, Homo sapiens
uauaaagacugccugcuaa

SEQ ID NO: 396492 - RNA, 19 nt, Homo sapiens
caagaagaccugaauugua

SEQ ID NO: 396493 - RNA, 19 nt, Homo sapiens
gcaaugaccauaucugcua

SEQ ID NO: 396494 - RNA, 19 nt, Homo sapiens
gaaauaccuuggcugaugu

SEQ ID NO: 396495 - RNA, 19 nt, Homo sapiens
aaacagaucuuuacaagcu

SEQ ID NO: 396496 - RNA, 19 nt, Homo sapiens
ucacuggcaucucacuuua

SEQ ID NO: 396497 - RNA, 19 nt, Homo sapiens
caagaggauugaaguagaa

SEQ ID NO: 396498 - RNA, 19 nt, Homo sapiens
ccaaguccauugauauuug

SEQ ID NO: 396499 - RNA, 19 nt, Homo sapiens
caacaaaguucgaguagcu

SEQ ID NO: 396500 - RNA, 19 nt, Homo sapiens
ucgaguagcuaucaagaaa

SEQ ID NO: 396501 - RNA, 19 nt, Homo sapiens
cagcuucacucgacauuug

SEQ ID NO: 396502 - RNA, 19 nt, Homo sapiens
gcaggagcuuguggaaaua

SEQ ID NO: 396503 - RNA, 19 nt, Homo sapiens
ugaagagacugcuagauuc

SEQ ID NO: 396504 - RNA, 19 nt, Homo sapiens
guacaggaccucauggaaa

SEQ ID NO: 396505 - RNA, 19 nt, Homo sapiens
gaagaccugaauuguauaa

SEQ ID NO: 396506 - RNA, 19 nt, Homo sapiens
gaaauuugccuuguucaau

SEQ ID NO: 396507 - RNA, 19 nt, Homo sapiens
uuacugcgcuucagacaug

SEQ ID NO: 396508 - RNA, 19 nt, Homo sapiens
gcacuguucuguccucaag

SEQ ID NO: 396509 - RNA, 19 nt, Homo sapiens
gcaucucacuuuaugauag

SEQ ID NO: 396510 - RNA, 19 nt, Homo sapiens
ccaauuggcucuagucacu

SEQ ID NO: 396511 - RNA, 19 nt, Homo sapiens
acuaauugcuuucugguuu

SEQ ID NO: 396512 - RNA, 19 nt, Homo sapiens
gcaccuuacugcuuacugu

SEQ ID NO: 396513 - RNA, 19 nt, Homo sapiens
ggagaauggguuauauaaa

SEQ ID NO: 396514 - RNA, 19 nt, Homo sapiens
ugagaaauuugccuuguuc

SEQ ID NO: 396515 - RNA, 19 nt, Homo sapiens
ggaacuauuugcuuucucu

SEQ ID NO: 396516 - RNA, 19 nt, Homo sapiens
ugagagaaguacaaagguu

SEQ ID NO: 396517 - RNA, 19 nt, Homo sapiens
gugcaguacuuaauguuug

SEQ ID NO: 396518 - RNA, 19 nt, Homo sapiens
uauaagguaugugcuauug

SEQ ID NO: 396519 - RNA, 19 nt, Homo sapiens
agacaucgguguucuucuu

SEQ ID NO: 396520 - RNA, 19 nt, Homo sapiens
acccauaucuggagcagua

SEQ ID NO: 396521 - RNA, 19 nt, Homo sapiens
gaccauaucugcuauuuuc

SEQ ID NO: 396522 - RNA, 19 nt, Homo sapiens
cacaacaccucagcaauga

SEQ ID NO: 396523 - RNA, 19 nt, Homo sapiens
ugacagcaauggagaaugg

SEQ ID NO: 396524 - RNA, 19 nt, Homo sapiens
cagcagaucauuuaggaaa

SEQ ID NO: 396525 - RNA, 19 nt, Homo sapiens
agagaugacuguccaagug

SEQ ID NO: 396526 - RNA, 19 nt, Homo sapiens
cugcuaauaugaacagaaa

SEQ ID NO: 396527 - RNA, 19 nt, Homo sapiens
uaaagacugccugcuaaua

SEQ ID NO: 396528 - RNA, 19 nt, Homo sapiens
acaagaggauugaaguaga

SEQ ID NO: 396529 - RNA, 19 nt, Homo sapiens
ccacaugccuacgauugaa

SEQ ID NO: 396530 - RNA, 19 nt, Homo sapiens
guccucaaguacucaaaua

SEQ ID NO: 396531 - RNA, 19 nt, Homo sapiens
cauauacgcccuugagcua

SEQ ID NO: 396532 - RNA, 19 nt, Homo sapiens
gauaaugucaacaaaguuc

SEQ ID NO: 396533 - RNA, 19 nt, Homo sapiens
cuucaaaugugguuuauac

SEQ ID NO: 396534 - RNA, 19 nt, Homo sapiens
gagaacaucauuggaauca

SEQ ID NO: 396535 - RNA, 19 nt, Homo sapiens
gcuaauaugaacagaaaug

SEQ ID NO: 396536 - RNA, 19 nt, Homo sapiens
gugagaaauuugccuuguu

SEQ ID NO: 396537 - RNA, 19 nt, Homo sapiens
aaaauaaggugccauggaa

SEQ ID NO: 396538 - RNA, 19 nt, Homo sapiens
guuuauaccucgcagauac

SEQ ID NO: 396539 - RNA, 19 nt, Homo sapiens
aaagacugccugcuaauau

SEQ ID NO: 396540 - RNA, 19 nt, Homo sapiens
caauggagaauggguuaua

SEQ ID NO: 396541 - RNA, 19 nt, Homo sapiens
uuugaaagaugcagugguu

SEQ ID NO: 396542 - RNA, 19 nt, Homo sapiens
cccaaaugcugacuccaaa

SEQ ID NO: 396543 - RNA, 19 nt, Homo sapiens
ggugugcucugcuuaugau

SEQ ID NO: 396544 - RNA, 19 nt, Homo sapiens
cagggaagcauuaucuuga

SEQ ID NO: 396545 - RNA, 19 nt, Homo sapiens
cuccagaaauuauguugaa

SEQ ID NO: 396546 - RNA, 19 nt, Homo sapiens
uggagaauggguuauauaa

SEQ ID NO: 396547 - RNA, 19 nt, Homo sapiens
cuacuucaaaugugguuua

SEQ ID NO: 396548 - RNA, 19 nt, Homo sapiens
guacuucagugcaccuuac

SEQ ID NO: 396549 - RNA, 19 nt, Homo sapiens
acaccaaccucucguacau

SEQ ID NO: 396550 - RNA, 19 nt, Homo sapiens
acacaacaccucagcaaug

SEQ ID NO: 396551 - RNA, 19 nt, Homo sapiens
guacaucuucuaucuucaa

SEQ ID NO: 396552 - RNA, 19 nt, Homo sapiens
ggugagaaauuugccuugu

SEQ ID NO: 396553 - RNA, 19 nt, Homo sapiens
cuaauugcuuucugguuug

SEQ ID NO: 396554 - RNA, 19 nt, Homo sapiens
cacaagaagaccugaauug

SEQ ID NO: 396555 - RNA, 19 nt, Homo sapiens
uacaccaaguccauugaua

SEQ ID NO: 396556 - RNA, 19 nt, Homo sapiens
ggagcucuauccauauuuu

SEQ ID NO: 396557 - RNA, 19 nt, Homo sapiens
ccucaaguacucaaauauu

SEQ ID NO: 396558 - RNA, 19 nt, Homo sapiens
uuucaaccacgaacauuua

SEQ ID NO: 396559 - RNA, 19 nt, Homo sapiens
agcaggagcuuguggaaau

SEQ ID NO: 396560 - RNA, 19 nt, Homo sapiens
ucuagucacuggcaucuca

SEQ ID NO: 396561 - RNA, 19 nt, Homo sapiens
cauaucuggagcaguauua

SEQ ID NO: 396562 - RNA, 19 nt, Homo sapiens
caccaaccaucgagcaaau

SEQ ID NO: 396563 - RNA, 19 nt, Homo sapiens
uugaagagacugcuagauu

SEQ ID NO: 396564 - RNA, 19 nt, Homo sapiens
gagagauucuuccccaauu

SEQ ID NO: 396565 - RNA, 19 nt, Homo sapiens
gagcaaaugaaagauguau

SEQ ID NO: 396566 - RNA, 19 nt, Homo sapiens
gaaaagcucaaagaacuaa

SEQ ID NO: 396567 - RNA, 19 nt, Homo sapiens
cgaagcaccauucaaguuc

SEQ ID NO: 396568 - RNA, 19 nt, Homo sapiens
caaugaccauaucugcuau

SEQ ID NO: 396569 - RNA, 19 nt, Homo sapiens
cuauccagcagaucauuua

SEQ ID NO: 396570 - RNA, 19 nt, Homo sapiens
gcaccaaccaucgagcaaa

SEQ ID NO: 396571 - RNA, 19 nt, Homo sapiens
caaguucgacauggaauug

SEQ ID NO: 396572 - RNA, 19 nt, Homo sapiens
ccucagcaaugaccauauc

SEQ ID NO: 396573 - RNA, 19 nt, Homo sapiens
ucauggaaacagaucuuua

SEQ ID NO: 396574 - RNA, 19 nt, Homo sapiens
acuguucuguccucaagua

SEQ ID NO: 396575 - RNA, 19 nt, Homo sapiens
gcugagcugugggcgguuu

SEQ ID NO: 396576 - RNA, 19 nt, Homo sapiens
acacaagaggauugaagua

SEQ ID NO: 396577 - RNA, 19 nt, Homo sapiens
ccauugauauuuggucugu

SEQ ID NO: 396578 - RNA, 19 nt, Homo sapiens
caccaaguccauugauauu

SEQ ID NO: 396579 - RNA, 19 nt, Homo sapiens
aagacugccugcuaauaug

SEQ ID NO: 396580 - RNA, 19 nt, Homo sapiens
ugccuacgauugaaaugaa

SEQ ID NO: 396581 - RNA, 19 nt, Homo sapiens
guuccucccucuccugaau

SEQ ID NO: 396582 - RNA, 19 nt, Homo sapiens
ccagggaagcauuaucuug

SEQ ID NO: 396583 - RNA, 19 nt, Homo sapiens
uacccucgcaugacuguua

SEQ ID NO: 396584 - RNA, 19 nt, Homo sapiens
guacagggcuccagaaauu

SEQ ID NO: 396585 - RNA, 19 nt, Homo sapiens
ggaaacagaucuuuacaag

SEQ ID NO: 396586 - RNA, 19 nt, Homo sapiens
ccaaagcucuggacuuauu

SEQ ID NO: 396587 - RNA, 19 nt, Homo sapiens
gcuaggaacuauuugcuuu

SEQ ID NO: 396588 - RNA, 19 nt, Homo sapiens
aagaagaccugaauuguau

SEQ ID NO: 396589 - RNA, 19 nt, Homo sapiens
caagaagaccugaauugua

SEQ ID NO: 396590 - RNA, 19 nt, Homo sapiens
gcaaugaccauaucugcua

SEQ ID NO: 396591 - RNA, 19 nt, Homo sapiens
aaacagaucuuuacaagcu

SEQ ID NO: 396592 - RNA, 19 nt, Homo sapiens
caagaggauugaaguagaa

SEQ ID NO: 396593 - RNA, 19 nt, Homo sapiens
ccaaguccauugauauuug

SEQ ID NO: 396594 - RNA, 19 nt, Homo sapiens
caacaaaguucgaguagcu

SEQ ID NO: 396595 - RNA, 19 nt, Homo sapiens
ucgaguagcuaucaagaaa

SEQ ID NO: 396596 - RNA, 19 nt, Homo sapiens
ugaagagacugcuagauuc

SEQ ID NO: 396597 - RNA, 19 nt, Homo sapiens
guacaggaccucauggaaa

SEQ ID NO: 396598 - RNA, 19 nt, Homo sapiens
gaagaccugaauuguauaa

SEQ ID NO: 396599 - RNA, 19 nt, Homo sapiens
uuacugcgcuucagacaug

SEQ ID NO: 396600 - RNA, 19 nt, Homo sapiens
ggaacuauuugcuuucucu

SEQ ID NO: 396601 - RNA, 19 nt, Homo sapiens
acccauaucuggagcagua

SEQ ID NO: 396602 - RNA, 19 nt, Homo sapiens
gaccauaucugcuauuuuc

SEQ ID NO: 396603 - RNA, 19 nt, Homo sapiens
cacaacaccucagcaauga

SEQ ID NO: 396604 - RNA, 19 nt, Homo sapiens
acaagaggauugaaguaga

SEQ ID NO: 396605 - RNA, 19 nt, Homo sapiens
gauaaugucaacaaaguuc

SEQ ID NO: 396606 - RNA, 19 nt, Homo sapiens
gagaacaucauuggaauca

SEQ ID NO: 396607 - RNA, 19 nt, Homo sapiens
aaaauaaggugccauggaa

SEQ ID NO: 396608 - RNA, 19 nt, Homo sapiens
caagguccauuauuuugua

SEQ ID NO: 396609 - RNA, 19 nt, Homo sapiens
cccaaaugcugacuccaaa

SEQ ID NO: 396610 - RNA, 19 nt, Homo sapiens
ggugugcucugcuuaugau

SEQ ID NO: 396611 - RNA, 19 nt, Homo sapiens
cagggaagcauuaucuuga

SEQ ID NO: 396612 - RNA, 19 nt, Homo sapiens
cuccagaaauuauguugaa

SEQ ID NO: 396613 - RNA, 19 nt, Homo sapiens
acaccaaccucucguacau

SEQ ID NO: 396614 - RNA, 19 nt, Homo sapiens
acacaacaccucagcaaug

SEQ ID NO: 396615 - RNA, 19 nt, Homo sapiens
cacaagaagaccugaauug

SEQ ID NO: 396616 - RNA, 19 nt, Homo sapiens
uacaccaaguccauugaua

SEQ ID NO: 396617 - RNA, 19 nt, Homo sapiens
cauaucuggagcaguauua

SEQ ID NO: 396618 - RNA, 19 nt, Homo sapiens
uugaagagacugcuagauu

SEQ ID NO: 396619 - RNA, 19 nt, Homo sapiens
caccaaccaucgagcaaau

SEQ ID NO: 396620 - RNA, 19 nt, Homo sapiens
gaaaagcucaaagaacuaa

SEQ ID NO: 396621 - RNA, 19 nt, Homo sapiens
cgaagcaccauucaaguuc

SEQ ID NO: 396622 - RNA, 19 nt, Homo sapiens
caaugaccauaucugcuau

SEQ ID NO: 396623 - RNA, 19 nt, Homo sapiens
gagcaaaugaaagauguau

SEQ ID NO: 396624 - RNA, 19 nt, Homo sapiens
caaguucgacauggaauug

SEQ ID NO: 396625 - RNA, 19 nt, Homo sapiens
ccucagcaaugaccauauc

SEQ ID NO: 396626 - RNA, 19 nt, Homo sapiens
ucauggaaacagaucuuua

SEQ ID NO: 396627 - RNA, 19 nt, Homo sapiens
gcaccaaccaucgagcaaa

SEQ ID NO: 396628 - RNA, 19 nt, Homo sapiens
uccucaagguccauuauuu

SEQ ID NO: 396629 - RNA, 19 nt, Homo sapiens
acacaagaggauugaagua

SEQ ID NO: 396630 - RNA, 19 nt, Homo sapiens
ccauugauauuuggucugu

SEQ ID NO: 396631 - RNA, 19 nt, Homo sapiens
caccaaguccauugauauu

SEQ ID NO: 396632 - RNA, 19 nt, Homo sapiens
ccagggaagcauuaucuug

SEQ ID NO: 396633 - RNA, 19 nt, Homo sapiens
cucaagaucugugacuuug

SEQ ID NO: 396634 - RNA, 19 nt, Homo sapiens
gccaggauacagaucuuaa

SEQ ID NO: 396635 - RNA, 19 nt, Homo sapiens
ccgaagcaccauucaaguu

SEQ ID NO: 396636 - RNA, 19 nt, Homo sapiens
ccauucagcuaacguucug

SEQ ID NO: 396637 - RNA, 19 nt, Homo sapiens
ucgagcaaaugaaagaugu

SEQ ID NO: 396638 - RNA, 19 nt, Homo sapiens
ccaaccaucgagcaaauga

SEQ ID NO: 396639 - RNA, 19 nt, Homo sapiens
uggaugacuugccuaagga

SEQ ID NO: 396640 - RNA, 19 nt, Homo sapiens
caaguccauugauauuugg

SEQ ID NO: 396641 - RNA, 19 nt, Homo sapiens
acaccaaguccauugauau

SEQ ID NO: 396642 - RNA, 19 nt, Homo sapiens
uacaggaccucauggaaac

SEQ ID NO: 396643 - RNA, 19 nt, Homo sapiens
ucacaagaagaccugaauu

SEQ ID NO: 396644 - RNA, 19 nt, Homo sapiens
gaguagcuaucaagaaaau

SEQ ID NO: 396645 - RNA, 19 nt, Homo sapiens
ccaggauacagaucuuaaa

SEQ ID NO: 396646 - RNA, 19 nt, Homo sapiens
caggauacagaucuuaaau

SEQ ID NO: 396647 - RNA, 19 nt, Homo sapiens
ggcauggugugcucugcuu

SEQ ID NO: 396648 - RNA, 19 nt, Homo sapiens
ucucaagaucugugacuuu

SEQ ID NO: 396649 - RNA, 19 nt, Homo sapiens
caacaccaccugugaucuc

SEQ ID NO: 396650 - RNA, 19 nt, Homo sapiens
ccaucgagcaaaugaaaga

SEQ ID NO: 396651 - RNA, 19 nt, Homo sapiens
guaccuggaguuuaauaca

SEQ ID NO: 396652 - RNA, 19 nt, Homo sapiens
gcauggugugcucugcuua

SEQ ID NO: 396653 - RNA, 19 nt, Homo sapiens
uugcagauccagaccauga

SEQ ID NO: 396654 - RNA, 19 nt, Homo sapiens
ugucaacaaaguucgagua

SEQ ID NO: 396655 - RNA, 19 nt, Homo sapiens
agacacaacaccucagcaa

SEQ ID NO: 396656 - RNA, 19 nt, Homo sapiens
uuaauacagugagcucuag

SEQ ID NO: 396657 - RNA, 19 nt, Homo sapiens
cagccaggauacagaucuu

SEQ ID NO: 396658 - RNA, 19 nt, Homo sapiens
cuagauuccagccaggaua

SEQ ID NO: 396659 - RNA, 19 nt, Homo sapiens
gaagagacugcuagauucc

SEQ ID NO: 396660 - RNA, 19 nt, Homo sapiens
ggaaaagcucaaagaacua

SEQ ID NO: 396661 - RNA, 19 nt, Homo sapiens
ggacuuauuggacaaaaug

SEQ ID NO: 396662 - RNA, 19 nt, Homo sapiens
cuucagacaugagaacauc

SEQ ID NO: 396663 - RNA, 19 nt, Homo sapiens
aaccaucgagcaaaugaaa

SEQ ID NO: 396664 - RNA, 19 nt, Homo sapiens
ccacacaagaggauugaag

SEQ ID NO: 396665 - RNA, 19 nt, Homo sapiens
gaacuauuugcuuucucuu

SEQ ID NO: 396666 - RNA, 19 nt, Homo sapiens
uccaagggcuacaccaagu

SEQ ID NO: 396667 - RNA, 19 nt, Homo sapiens
gguacagggcuccagaaau

SEQ ID NO: 396668 - RNA, 19 nt, Homo sapiens
cauggaaacagaucuuuac

SEQ ID NO: 396669 - RNA, 19 nt, Homo sapiens
acauggaauuggaugacuu

SEQ ID NO: 396670 - RNA, 19 nt, Homo sapiens
cauucaaguucgacaugga

SEQ ID NO: 396671 - RNA, 19 nt, Homo sapiens
uauaguacaggaccucaug

SEQ ID NO: 396672 - RNA, 19 nt, Homo sapiens
gaugacuugccuaaggaaa

SEQ ID NO: 396673 - RNA, 19 nt, Homo sapiens
cagaccuacugccagagaa

SEQ ID NO: 396674 - RNA, 19 nt, Homo sapiens
ccuuugagcaccagaccua

SEQ ID NO: 396675 - RNA, 19 nt, Homo sapiens
gcucaacaccaccugugau

SEQ ID NO: 396676 - RNA, 19 nt, Homo sapiens
gcuacaccaaccucucgua

SEQ ID NO: 396677 - RNA, 19 nt, Homo sapiens
cauggaauuggaugacuug

SEQ ID NO: 396678 - RNA, 19 nt, Homo sapiens
gacauucaacccacacaag

SEQ ID NO: 396679 - RNA, 19 nt, Homo sapiens
caaagcucuggacuuauug

SEQ ID NO: 396680 - RNA, 19 nt, Homo sapiens
aaaguucgaguagcuauca

SEQ ID NO: 396681 - RNA, 19 nt, Homo sapiens
gcuacaccaaguccauuga

SEQ ID NO: 396682 - RNA, 19 nt, Homo sapiens
gcuccagaaauuauguuga

SEQ ID NO: 396683 - RNA, 19 nt, Homo sapiens
acagggcuccagaaauuau

SEQ ID NO: 396684 - RNA, 19 nt, Homo sapiens
gagaagauccugaccuuua

SEQ ID NO: 396685 - RNA, 19 nt, Homo sapiens
gaaaccaucugcccaacua

SEQ ID NO: 396686 - RNA, 19 nt, Homo sapiens
ccacacgccuuaaaucuaa

SEQ ID NO: 396687 - RNA, 19 nt, Homo sapiens
gaccaggaguucauauaua

SEQ ID NO: 396688 - RNA, 19 nt, Homo sapiens
gaucaggucaggccaaaua

SEQ ID NO: 396689 - RNA, 19 nt, Homo sapiens
gcaacacauuagaaacuua

SEQ ID NO: 396690 - RNA, 19 nt, Homo sapiens
ggaaacacaggaauuagua

SEQ ID NO: 396691 - RNA, 19 nt, Homo sapiens
guacuuaaauguucucauc

SEQ ID NO: 396692 - RNA, 19 nt, Homo sapiens
ccacaaggguuaucuguca

SEQ ID NO: 396693 - RNA, 19 nt, Homo sapiens
gaaauaugagccauucuaa

SEQ ID NO: 396694 - RNA, 19 nt, Homo sapiens
ccagaaagguaggaagaua

SEQ ID NO: 396695 - RNA, 19 nt, Homo sapiens
gcaaauguguuaggagaga

SEQ ID NO: 396696 - RNA, 19 nt, Homo sapiens
ccaacauccuucaucaaua

SEQ ID NO: 396697 - RNA, 19 nt, Homo sapiens
ccauagagcaaauguguua

SEQ ID NO: 396698 - RNA, 19 nt, Homo sapiens
caacuagccucaacugaca

SEQ ID NO: 396699 - RNA, 19 nt, Homo sapiens
cggagaaucugcagaggua

SEQ ID NO: 396700 - RNA, 19 nt, Homo sapiens
caacauccuucaucaauac

SEQ ID NO: 396701 - RNA, 19 nt, Homo sapiens
gagcaauguuucuuguauu

SEQ ID NO: 396702 - RNA, 19 nt, Homo sapiens
cagagacacucgcuuaaga

SEQ ID NO: 396703 - RNA, 19 nt, Homo sapiens
gaaagcaauuagccagaga

SEQ ID NO: 396704 - RNA, 19 nt, Homo sapiens
gcacagggaagaacgcuuu

SEQ ID NO: 396705 - RNA, 19 nt, Homo sapiens
cagaaggguugguaacaaa

SEQ ID NO: 396706 - RNA, 19 nt, Homo sapiens
gaaggucgcugugaagaag

SEQ ID NO: 396707 - RNA, 19 nt, Homo sapiens
uaacucacaugaccaacuu

SEQ ID NO: 396708 - RNA, 19 nt, Homo sapiens
caaggaauccagaaaggua

SEQ ID NO: 396709 - RNA, 19 nt, Homo sapiens
ucaauacuuuccugaguuu

SEQ ID NO: 396710 - RNA, 19 nt, Homo sapiens
agaagauccugaccuuuaa

SEQ ID NO: 396711 - RNA, 19 nt, Homo sapiens
ugaguuugaucauccauuu

SEQ ID NO: 396712 - RNA, 19 nt, Homo sapiens
guacaccacuccucaugug

SEQ ID NO: 396713 - RNA, 19 nt, Homo sapiens
ggcagggucugucaccaua

SEQ ID NO: 396714 - RNA, 19 nt, Homo sapiens
ucaggaaacacaggaauua

SEQ ID NO: 396715 - RNA, 19 nt, Homo sapiens
aaagaaauaugagccauuc

SEQ ID NO: 396716 - RNA, 19 nt, Homo sapiens
ccaggacauucuaccauuu

SEQ ID NO: 396717 - RNA, 19 nt, Homo sapiens
accaggaguucauauauaa

SEQ ID NO: 396718 - RNA, 19 nt, Homo sapiens
ggagagaagguuucacaug

SEQ ID NO: 396719 - RNA, 19 nt, Homo sapiens
ccaaagccaucgacaugug

SEQ ID NO: 396720 - RNA, 19 nt, Homo sapiens
gcaagcugcucccugaagu

SEQ ID NO: 396721 - RNA, 19 nt, Homo sapiens
agggugagcuguucaaguu

SEQ ID NO: 396722 - RNA, 19 nt, Homo sapiens
gaaacuuggucugagaugu

SEQ ID NO: 396723 - RNA, 19 nt, Homo sapiens
uaagaaggguucaggaaac

SEQ ID NO: 396724 - RNA, 19 nt, Homo sapiens
gacccaacauccuucauca

SEQ ID NO: 396725 - RNA, 19 nt, Homo sapiens
aacaaacucuugcauuuca

SEQ ID NO: 396726 - RNA, 19 nt, Homo sapiens
caucaauacuuuccugagu

SEQ ID NO: 396727 - RNA, 19 nt, Homo sapiens
gaggaauuguuauaacuac

SEQ ID NO: 396728 - RNA, 19 nt, Homo sapiens
gacaaaggagggacucaaa

SEQ ID NO: 396729 - RNA, 19 nt, Homo sapiens
agagguagcucgaaaccau

SEQ ID NO: 396730 - RNA, 19 nt, Homo sapiens
ggaccugccggacaauaaa

SEQ ID NO: 396731 - RNA, 19 nt, Homo sapiens
ggagaguuucugcaucuuu

SEQ ID NO: 396732 - RNA, 19 nt, Homo sapiens
agagcaauguuucuuguau

SEQ ID NO: 396733 - RNA, 19 nt, Homo sapiens
gggaagaacgcuuuagaca

SEQ ID NO: 396734 - RNA, 19 nt, Homo sapiens
gaccgaggccuucuccaaa

SEQ ID NO: 396735 - RNA, 19 nt, Homo sapiens
ggugaugccuuccuuuguc

SEQ ID NO: 396736 - RNA, 19 nt, Homo sapiens
ucagaaggguugguaacaa

SEQ ID NO: 396737 - RNA, 19 nt, Homo sapiens
augccaagcuguucaugua

SEQ ID NO: 396738 - RNA, 19 nt, Homo sapiens
gcaguccacuaugguagaa

SEQ ID NO: 396739 - RNA, 19 nt, Homo sapiens
uccaagauccgacguuuaa

SEQ ID NO: 396740 - RNA, 19 nt, Homo sapiens
cauccuucaucaauacuuu

SEQ ID NO: 396741 - RNA, 19 nt, Homo sapiens
uuagaaacuuggucugaga

SEQ ID NO: 396742 - RNA, 19 nt, Homo sapiens
cagcugaggaaagcaauua

SEQ ID NO: 396743 - RNA, 19 nt, Homo sapiens
guaaauaggaaguguuugg

SEQ ID NO: 396744 - RNA, 19 nt, Homo sapiens
ccaaagauacccacagaag

SEQ ID NO: 396745 - RNA, 19 nt, Homo sapiens
auggagaccucaugacaaa

SEQ ID NO: 396746 - RNA, 19 nt, Homo sapiens
gaaggcaccaauuccaaga

SEQ ID NO: 396747 - RNA, 19 nt, Homo sapiens
ucagagcaauguuucuugu

SEQ ID NO: 396748 - RNA, 19 nt, Homo sapiens
acaacaagccgcaccacua

SEQ ID NO: 396749 - RNA, 19 nt, Homo sapiens
ggugagcuguucaaguuca

SEQ ID NO: 396750 - RNA, 19 nt, Homo sapiens
gagccauucuaagcuuuaa

SEQ ID NO: 396751 - RNA, 19 nt, Homo sapiens
ugaacuggacccuggcuua

SEQ ID NO: 396752 - RNA, 19 nt, Homo sapiens
caacaccccuuccgcauug

SEQ ID NO: 396753 - RNA, 19 nt, Homo sapiens
ggaaggucgcugugaagaa

SEQ ID NO: 396754 - RNA, 19 nt, Homo sapiens
gauccgacguuuaaaagaa

SEQ ID NO: 396755 - RNA, 19 nt, Homo sapiens
ggucaggccaaauaaaguu

SEQ ID NO: 396756 - RNA, 19 nt, Homo sapiens
cagaggaauuguuauaacu

SEQ ID NO: 396757 - RNA, 19 nt, Homo sapiens
cagcagacccuacagagau

SEQ ID NO: 396758 - RNA, 19 nt, Homo sapiens
cauuuagccuugacaaaca

SEQ ID NO: 396759 - RNA, 19 nt, Homo sapiens
aaacuugacauuccauaga

SEQ ID NO: 396760 - RNA, 19 nt, Homo sapiens
uggagaagauccugaccuu

SEQ ID NO: 396761 - RNA, 19 nt, Homo sapiens
gacaacaucgucaaagugu

SEQ ID NO: 396762 - RNA, 19 nt, Homo sapiens
ccuuaaaucuaaucagcaa

SEQ ID NO: 396763 - RNA, 19 nt, Homo sapiens
cagcgccucuccagaccua

SEQ ID NO: 396764 - RNA, 19 nt, Homo sapiens
gagaguuucugcaucuuuu

SEQ ID NO: 396765 - RNA, 19 nt, Homo sapiens
cugcagagguagcucgaaa

SEQ ID NO: 396766 - RNA, 19 nt, Homo sapiens
cagugaagccaucgacuuu

SEQ ID NO: 396767 - RNA, 19 nt, Homo sapiens
cccaugagcuggagcagau

SEQ ID NO: 396768 - RNA, 19 nt, Homo sapiens
caccaaagccaucgacaug

SEQ ID NO: 396769 - RNA, 19 nt, Homo sapiens
cagcgagcaugaccauaug

SEQ ID NO: 396770 - RNA, 19 nt, Homo sapiens
ccucacaccacacgccuua

SEQ ID NO: 396771 - RNA, 19 nt, Homo sapiens
agguagagauccaccauug

SEQ ID NO: 396772 - RNA, 19 nt, Homo sapiens
ccuaugcacuuuccugaca

SEQ ID NO: 396773 - RNA, 19 nt, Homo sapiens
cccaaguacuuaaauguuc

SEQ ID NO: 396774 - RNA, 19 nt, Homo sapiens
ccaguuugccuuucuccua

SEQ ID NO: 396775 - RNA, 19 nt, Homo sapiens
gaaagggagaccacaugug

SEQ ID NO: 396776 - RNA, 19 nt, Homo sapiens
gaacuggacccuggcuuag

SEQ ID NO: 396777 - RNA, 19 nt, Homo sapiens
uuaaaccugcaacacauua

SEQ ID NO: 396778 - RNA, 19 nt, Homo sapiens
caauguuucuuguauucug

SEQ ID NO: 396779 - RNA, 19 nt, Homo sapiens
aaagggagaccacaugugu

SEQ ID NO: 396780 - RNA, 19 nt, Homo sapiens
caacaagccgcaccacuac

SEQ ID NO: 396781 - RNA, 19 nt, Homo sapiens
cccaauaacuacaccaaag

SEQ ID NO: 396782 - RNA, 19 nt, Homo sapiens
aaagauacccacagaaguc

SEQ ID NO: 396783 - RNA, 19 nt, Homo sapiens
ucccaaagauacccacaga

SEQ ID NO: 396784 - RNA, 19 nt, Homo sapiens
gaaagaagauacugaaaug

SEQ ID NO: 396785 - RNA, 19 nt, Homo sapiens
gaauguaucugcacuguga

SEQ ID NO: 396786 - RNA, 19 nt, Homo sapiens
aaacaaaccuugccuugaa

SEQ ID NO: 396787 - RNA, 19 nt, Homo sapiens
gaacagaugcagcugauuu

SEQ ID NO: 396788 - RNA, 19 nt, Homo sapiens
gaagauaggugacuuuggu

SEQ ID NO: 396789 - RNA, 19 nt, Homo sapiens
gaaaagaaaugcacuaaga

SEQ ID NO: 396790 - RNA, 19 nt, Homo sapiens
gcacagagaucucaaacca

SEQ ID NO: 396791 - RNA, 19 nt, Homo sapiens
ggaaagguaucaugauugu

SEQ ID NO: 396792 - RNA, 19 nt, Homo sapiens
cuaccuagcugcaucuaua

SEQ ID NO: 396793 - RNA, 19 nt, Homo sapiens
ccaguugggucaccacuua

SEQ ID NO: 396794 - RNA, 19 nt, Homo sapiens
cuacugauguuguugauaa

SEQ ID NO: 396795 - RNA, 19 nt, Homo sapiens
agagugaaguuaaccauua

SEQ ID NO: 396796 - RNA, 19 nt, Homo sapiens
gaaaggaauggauugguua

SEQ ID NO: 396797 - RNA, 19 nt, Homo sapiens
guacagaucuccacgucuu

SEQ ID NO: 396798 - RNA, 19 nt, Homo sapiens
ggagccaccugaucacuaa

SEQ ID NO: 396799 - RNA, 19 nt, Homo sapiens
gaucuggguucuagguaua

SEQ ID NO: 396800 - RNA, 19 nt, Homo sapiens
gaaaugcacuaagacaaga

SEQ ID NO: 396801 - RNA, 19 nt, Homo sapiens
ggagagagagugaaguuaa

SEQ ID NO: 396802 - RNA, 19 nt, Homo sapiens
gaucuggaguguagccaua

SEQ ID NO: 396803 - RNA, 19 nt, Homo sapiens
gcagacauuuaucuuugua

SEQ ID NO: 396804 - RNA, 19 nt, Homo sapiens
gaaacucacagucacauuu

SEQ ID NO: 396805 - RNA, 19 nt, Homo sapiens
ugaaucagauggugucauu

SEQ ID NO: 396806 - RNA, 19 nt, Homo sapiens
cagcagacauuuaucuuug

SEQ ID NO: 396807 - RNA, 19 nt, Homo sapiens
uuaaaugucugcagaguug

SEQ ID NO: 396808 - RNA, 19 nt, Homo sapiens
cagauggugucauuuagua

SEQ ID NO: 396809 - RNA, 19 nt, Homo sapiens
uggcaaaucuggcucaauu

SEQ ID NO: 396810 - RNA, 19 nt, Homo sapiens
caagagcucuguccgaugu

SEQ ID NO: 396811 - RNA, 19 nt, Homo sapiens
gcagggcccuuuacuggaa

SEQ ID NO: 396812 - RNA, 19 nt, Homo sapiens
gaggucaucaucauauuua

SEQ ID NO: 396813 - RNA, 19 nt, Homo sapiens
gaaagucucaugaacauuc

SEQ ID NO: 396814 - RNA, 19 nt, Homo sapiens
gaaagaacaaagcaaagaa

SEQ ID NO: 396815 - RNA, 19 nt, Homo sapiens
caaauguacugcacagaga

SEQ ID NO: 396816 - RNA, 19 nt, Homo sapiens
aaccuugccuugaaauuua

SEQ ID NO: 396817 - RNA, 19 nt, Homo sapiens
ggaaagaagauacugaaau

SEQ ID NO: 396818 - RNA, 19 nt, Homo sapiens
gcagagaaauuugaaaguc

SEQ ID NO: 396819 - RNA, 19 nt, Homo sapiens
gaggaaggauuucugaaca

SEQ ID NO: 396820 - RNA, 19 nt, Homo sapiens
gaaguuaaccauuacuaug

SEQ ID NO: 396821 - RNA, 19 nt, Homo sapiens
gaagaagaaguacaaguug

SEQ ID NO: 396822 - RNA, 19 nt, Homo sapiens
gaagaugaaguugaugaua

SEQ ID NO: 396823 - RNA, 19 nt, Homo sapiens
ucaaauuccucaucaaaca

SEQ ID NO: 396824 - RNA, 19 nt, Homo sapiens
ugaaaggaauggauugguu

SEQ ID NO: 396825 - RNA, 19 nt, Homo sapiens
uuagaagacuugaccauga

SEQ ID NO: 396826 - RNA, 19 nt, Homo sapiens
cuagaagucuuaauugugu

SEQ ID NO: 396827 - RNA, 19 nt, Homo sapiens
guaacgugcucacugugua

SEQ ID NO: 396828 - RNA, 19 nt, Homo sapiens
gaagcacucucccauccuu

SEQ ID NO: 396829 - RNA, 19 nt, Homo sapiens
cuagguauauggacuuaaa

SEQ ID NO: 396830 - RNA, 19 nt, Homo sapiens
gaagucccguuguaucaga

SEQ ID NO: 396831 - RNA, 19 nt, Homo sapiens
caucuauaaugucagcuua

SEQ ID NO: 396832 - RNA, 19 nt, Homo sapiens
guucugguaugcauucuuu

SEQ ID NO: 396833 - RNA, 19 nt, Homo sapiens
gaaacaaaccuugccuuga

SEQ ID NO: 396834 - RNA, 19 nt, Homo sapiens
ggucaccacuuaagucaau

SEQ ID NO: 396835 - RNA, 19 nt, Homo sapiens
ggaaagaacaaagcaaaga

SEQ ID NO: 396836 - RNA, 19 nt, Homo sapiens
cacaguaugucauuucauu

SEQ ID NO: 396837 - RNA, 19 nt, Homo sapiens
ggagagaggacaugaggaa

SEQ ID NO: 396838 - RNA, 19 nt, Homo sapiens
uaugaguacugcaaucuuu

SEQ ID NO: 396839 - RNA, 19 nt, Homo sapiens
uaaguaacgugcucacugu

SEQ ID NO: 396840 - RNA, 19 nt, Homo sapiens
gcacuaagacaagaacauu

SEQ ID NO: 396841 - RNA, 19 nt, Homo sapiens
aaaucuggcucaauuagaa

SEQ ID NO: 396842 - RNA, 19 nt, Homo sapiens
gaacccaagcuuauuauag

SEQ ID NO: 396843 - RNA, 19 nt, Homo sapiens
cgaugucacugaugaagaa

SEQ ID NO: 396844 - RNA, 19 nt, Homo sapiens
caaacaugcucuacgugaa

SEQ ID NO: 396845 - RNA, 19 nt, Homo sapiens
ccuguugugugcauauuua

SEQ ID NO: 396846 - RNA, 19 nt, Homo sapiens
gcaacuggcuggaaaagaa

SEQ ID NO: 396847 - RNA, 19 nt, Homo sapiens
agacagacuuggcuaaugu

SEQ ID NO: 396848 - RNA, 19 nt, Homo sapiens
uaagauggacgguagcuuu

SEQ ID NO: 396849 - RNA, 19 nt, Homo sapiens
gcaggaacuauucagcuua

SEQ ID NO: 396850 - RNA, 19 nt, Homo sapiens
ccagauagcgcuagaggaa

SEQ ID NO: 396851 - RNA, 19 nt, Homo sapiens
gaguguagccauacuugua

SEQ ID NO: 396852 - RNA, 19 nt, Homo sapiens
gaaaguguuugagauucuu

SEQ ID NO: 396853 - RNA, 19 nt, Homo sapiens
aaucagauggugucauuua

SEQ ID NO: 396854 - RNA, 19 nt, Homo sapiens
gaaaagaaagggaaaagaa

SEQ ID NO: 396855 - RNA, 19 nt, Homo sapiens
aaacucacagucacauuua

SEQ ID NO: 396856 - RNA, 19 nt, Homo sapiens
ccacguacuuaauuuacuu

SEQ ID NO: 396857 - RNA, 19 nt, Homo sapiens
gggaguuccucuuuaacaa

SEQ ID NO: 396858 - RNA, 19 nt, Homo sapiens
gagaggacaugaggaagga

SEQ ID NO: 396859 - RNA, 19 nt, Homo sapiens
agaagauacugaaaugcua

SEQ ID NO: 396860 - RNA, 19 nt, Homo sapiens
ugaagaagaaguacaaguu

SEQ ID NO: 396861 - RNA, 19 nt, Homo sapiens
gcugaaaugcugacuggua

SEQ ID NO: 396862 - RNA, 19 nt, Homo sapiens
aaggaaggaugaacaaguu

SEQ ID NO: 396863 - RNA, 19 nt, Homo sapiens
gagaagucccguuguauca

SEQ ID NO: 396864 - RNA, 19 nt, Homo sapiens
gauaagaaaggcaaaucaa

SEQ ID NO: 396865 - RNA, 19 nt, Homo sapiens
cugaaaugcugacugguaa

SEQ ID NO: 396866 - RNA, 19 nt, Homo sapiens
gagacagacuuggcuaaug

SEQ ID NO: 396867 - RNA, 19 nt, Homo sapiens
aaacauauaccacccauag

SEQ ID NO: 396868 - RNA, 19 nt, Homo sapiens
gaaaacacuuacacuaguu

SEQ ID NO: 396869 - RNA, 19 nt, Homo sapiens
gcaugagccuacugauguu

SEQ ID NO: 396870 - RNA, 19 nt, Homo sapiens
cacaugaacuugaacagau

SEQ ID NO: 396871 - RNA, 19 nt, Homo sapiens
gcaaugaacaucaagaaac

SEQ ID NO: 396872 - RNA, 19 nt, Homo sapiens
ccaaggcaagcaugaauaa

SEQ ID NO: 396873 - RNA, 19 nt, Homo sapiens
gcuccuagaagucuuaauu

SEQ ID NO: 396874 - RNA, 19 nt, Homo sapiens
gacgguagcuuugauugug

SEQ ID NO: 396875 - RNA, 19 nt, Homo sapiens
aacccaagcuuauuauaga

SEQ ID NO: 396876 - RNA, 19 nt, Homo sapiens
ugggaaagguaucaugauu

SEQ ID NO: 396877 - RNA, 19 nt, Homo sapiens
guuugaaaguuguacauga

SEQ ID NO: 396878 - RNA, 19 nt, Homo sapiens
gugagacuguacauaauug

SEQ ID NO: 396879 - RNA, 19 nt, Homo sapiens
gcaaaucuggcucaauuag

SEQ ID NO: 396880 - RNA, 19 nt, Homo sapiens
uaugaacccaagcuuauua

SEQ ID NO: 396881 - RNA, 19 nt, Homo sapiens
aagaagaaguacaaguuga

SEQ ID NO: 396882 - RNA, 19 nt, Homo sapiens
guaucaugauugucaguuu

SEQ ID NO: 396883 - RNA, 19 nt, Homo sapiens
uauauucacucugcaaaug

SEQ ID NO: 396884 - RNA, 19 nt, Homo sapiens
gaacaucaguacuucauga

SEQ ID NO: 396885 - RNA, 19 nt, Homo sapiens
gaagaucccuaaugcuuuc

SEQ ID NO: 396886 - RNA, 19 nt, Homo sapiens
ccacaccgcugccucugua

SEQ ID NO: 396887 - RNA, 19 nt, Homo sapiens
gaacaauccuuuucaguau

SEQ ID NO: 396888 - RNA, 19 nt, Homo sapiens
gcucaagauuggugacuuu

SEQ ID NO: 396889 - RNA, 19 nt, Homo sapiens
aaaugaggccugugaaaua

SEQ ID NO: 396890 - RNA, 19 nt, Homo sapiens
gcuuugaccuggaggaauu

SEQ ID NO: 396891 - RNA, 19 nt, Homo sapiens
ucaagaagaucccuaaugc

SEQ ID NO: 396892 - RNA, 19 nt, Homo sapiens
gaaccuggcccugcuuaaa

SEQ ID NO: 396893 - RNA, 19 nt, Homo sapiens
gaacugugagcucaagauu

SEQ ID NO: 396894 - RNA, 19 nt, Homo sapiens
aaaccagucuuucgacaug

SEQ ID NO: 396895 - RNA, 19 nt, Homo sapiens
gcacucggcucaggucauc

SEQ ID NO: 396896 - RNA, 19 nt, Homo sapiens
ggugccaucucagacaaua

SEQ ID NO: 396897 - RNA, 19 nt, Homo sapiens
ugaccuggaggaauucuua

SEQ ID NO: 396898 - RNA, 19 nt, Homo sapiens
gacccaccuuucagccuua

SEQ ID NO: 396899 - RNA, 19 nt, Homo sapiens
ggauuauucugcagguuca

SEQ ID NO: 396900 - RNA, 19 nt, Homo sapiens
caagauuggugacuuuggu

SEQ ID NO: 396901 - RNA, 19 nt, Homo sapiens
gugccuugcugccacagua

SEQ ID NO: 396902 - RNA, 19 nt, Homo sapiens
ugacccagcagcuaucuaa

SEQ ID NO: 396903 - RNA, 19 nt, Homo sapiens
uggcuacgguguuggcuuu

SEQ ID NO: 396904 - RNA, 19 nt, Homo sapiens
ugaagauccucaagcacuu

SEQ ID NO: 396905 - RNA, 19 nt, Homo sapiens
gggccuauauccagagcuu

SEQ ID NO: 396906 - RNA, 19 nt, Homo sapiens
gaagauccucaagcacuuu

SEQ ID NO: 396907 - RNA, 19 nt, Homo sapiens
caaguaccaugauccugau

SEQ ID NO: 396908 - RNA, 19 nt, Homo sapiens
aagaagaucccuaaugcuu

SEQ ID NO: 396909 - RNA, 19 nt, Homo sapiens
ggacuagugcucagugaca

SEQ ID NO: 396910 - RNA, 19 nt, Homo sapiens
aaagcgaccugcaccagau

SEQ ID NO: 396911 - RNA, 19 nt, Homo sapiens
ucugugggcugcaucuuug

SEQ ID NO: 396912 - RNA, 19 nt, Homo sapiens
guaccaugauccugaugau

SEQ ID NO: 396913 - RNA, 19 nt, Homo sapiens
uuggaacgcuggacucgaa

SEQ ID NO: 396914 - RNA, 19 nt, Homo sapiens
gcagguggccaucaagaag

SEQ ID NO: 396915 - RNA, 19 nt, Homo sapiens
uggcugaaauugaggacuu

SEQ ID NO: 396916 - RNA, 19 nt, Homo sapiens
acugugagcucaagauugg

SEQ ID NO: 396917 - RNA, 19 nt, Homo sapiens
caccugaugucaaccuugu

SEQ ID NO: 396918 - RNA, 19 nt, Homo sapiens
gauccucaagcacuuuaaa

SEQ ID NO: 396919 - RNA, 19 nt, Homo sapiens
agaagaucccuaaugcuuu

SEQ ID NO: 396920 - RNA, 19 nt, Homo sapiens
ugaggccugugaaauacaa

SEQ ID NO: 396921 - RNA, 19 nt, Homo sapiens
cauuguggcugaaauugag

SEQ ID NO: 396922 - RNA, 19 nt, Homo sapiens
gaguauacacaggcuauug

SEQ ID NO: 396923 - RNA, 19 nt, Homo sapiens
caacaucaucgccaucaag

SEQ ID NO: 396924 - RNA, 19 nt, Homo sapiens
gcuacgguguuggcuuuga

SEQ ID NO: 396925 - RNA, 19 nt, Homo sapiens
gagaucaucgagaccauag

SEQ ID NO: 396926 - RNA, 19 nt, Homo sapiens
ccaaggagcgggagaaacg

SEQ ID NO: 396927 - RNA, 19 nt, Homo sapiens
aagcugcccugcucaaguc

SEQ ID NO: 396928 - RNA, 19 nt, Homo sapiens
ccuuugacuuugccuuuga

SEQ ID NO: 396929 - RNA, 19 nt, Homo sapiens
gcucagugacaaugacaga

SEQ ID NO: 396930 - RNA, 19 nt, Homo sapiens
ggcaagaacgagccaagga

SEQ ID NO: 396931 - RNA, 19 nt, Homo sapiens
ccaucaagaagaucccuaa

SEQ ID NO: 396932 - RNA, 19 nt, Homo sapiens
aaugaggccugugaaauac

SEQ ID NO: 396933 - RNA, 19 nt, Homo sapiens
caggauccaugggagcauu

SEQ ID NO: 396934 - RNA, 19 nt, Homo sapiens
agagucaccugaugucaac

SEQ ID NO: 396935 - RNA, 19 nt, Homo sapiens
gaacgcuggacucgaaugg

SEQ ID NO: 396936 - RNA, 19 nt, Homo sapiens
gacuagugcucagugacaa

SEQ ID NO: 396937 - RNA, 19 nt, Homo sapiens
cccagcagcuaucuaaguc

SEQ ID NO: 396938 - RNA, 19 nt, Homo sapiens
gcccuuugacuuugccuuu

SEQ ID NO: 396939 - RNA, 19 nt, Homo sapiens
accaugauccugaugauga

SEQ ID NO: 396940 - RNA, 19 nt, Homo sapiens
acccuuuccuggccaagua

SEQ ID NO: 396941 - RNA, 19 nt, Homo sapiens
cuucaugacugaguaugug

SEQ ID NO: 396942 - RNA, 19 nt, Homo sapiens
ggaacacgugcgcuacuuc

SEQ ID NO: 396943 - RNA, 19 nt, Homo sapiens
gcccuauggcgaauucaaa

SEQ ID NO: 396944 - RNA, 19 nt, Homo sapiens
ggagcgggagcgaaaggaa

SEQ ID NO: 396945 - RNA, 19 nt, Homo sapiens
ccuucgaugugaccuuuga

SEQ ID NO: 396946 - RNA, 19 nt, Homo sapiens
gacaacaucaucgccauca

SEQ ID NO: 396947 - RNA, 19 nt, Homo sapiens
caucucagacccaccuuuc

SEQ ID NO: 396948 - RNA, 19 nt, Homo sapiens
aggcucggcuuggauuauu

SEQ ID NO: 396949 - RNA, 19 nt, Homo sapiens
ccauuguggcugaaauuga

SEQ ID NO: 396950 - RNA, 19 nt, Homo sapiens
uaaacacgacaacaucauc

SEQ ID NO: 396951 - RNA, 19 nt, Homo sapiens
caaaaugaggccugugaaa

SEQ ID NO: 396952 - RNA, 19 nt, Homo sapiens
agauucagccucucucuca

SEQ ID NO: 396953 - RNA, 19 nt, Homo sapiens
cagagucaccugaugucaa

SEQ ID NO: 396954 - RNA, 19 nt, Homo sapiens
cugcccugcucaagucuuu

SEQ ID NO: 396955 - RNA, 19 nt, Homo sapiens
cgagaucaucgagaccaua

SEQ ID NO: 396956 - RNA, 19 nt, Homo sapiens
gaccuggaggaauucuuaa

SEQ ID NO: 396957 - RNA, 19 nt, Homo sapiens
cgaauucaaaucugucuac

SEQ ID NO: 396958 - RNA, 19 nt, Homo sapiens
uggccgagccucugaagga

SEQ ID NO: 396959 - RNA, 19 nt, Homo sapiens
caggauggccaggcagauu

SEQ ID NO: 396960 - RNA, 19 nt, Homo sapiens
uggaggaauucuuaaacca

SEQ ID NO: 396961 - RNA, 19 nt, Homo sapiens
gcuacuuccuguaccaacu

SEQ ID NO: 396962 - RNA, 19 nt, Homo sapiens
auugaggacuuccaugcaa

SEQ ID NO: 396963 - RNA, 19 nt, Homo sapiens
cagcagguggccaucaaga

SEQ ID NO: 396964 - RNA, 19 nt, Homo sapiens
gaucccuaaugcuuucgau

SEQ ID NO: 396965 - RNA, 19 nt, Homo sapiens
gacaugggcguggcugaug

SEQ ID NO: 396966 - RNA, 19 nt, Homo sapiens
ccccaggaguuuugccuua

SEQ ID NO: 396967 - RNA, 19 nt, Homo sapiens
aaacuauguacaccagcua

SEQ ID NO: 396968 - RNA, 19 nt, Homo sapiens
aguauacacaggcuauuga

SEQ ID NO: 396969 - RNA, 19 nt, Homo sapiens
uggaacacgugcgcuacuu

SEQ ID NO: 396970 - RNA, 19 nt, Homo sapiens
gugaggcucggcuuggauu

SEQ ID NO: 396971 - RNA, 19 nt, Homo sapiens
ugacgugggcgacgaguac

SEQ ID NO: 396972 - RNA, 19 nt, Homo sapiens
gagccaaggagcgggagaa

SEQ ID NO: 396973 - RNA, 19 nt, Homo sapiens
ccaucucagacaauacuaa

SEQ ID NO: 396974 - RNA, 19 nt, Homo sapiens
ccaugauccugaugaugag

SEQ ID NO: 396975 - RNA, 19 nt, Homo sapiens
ggcugcaucuuuggugaga

SEQ ID NO: 396976 - RNA, 19 nt, Homo sapiens
gaacaucaguacuucauga

SEQ ID NO: 396977 - RNA, 19 nt, Homo sapiens
gcaaauggcggacacaauu

SEQ ID NO: 396978 - RNA, 19 nt, Homo sapiens
gaacaauccuuuucaguau

SEQ ID NO: 396979 - RNA, 19 nt, Homo sapiens
gcucaagauuggugacuuu

SEQ ID NO: 396980 - RNA, 19 nt, Homo sapiens
aaaugaggccugugaaaua

SEQ ID NO: 396981 - RNA, 19 nt, Homo sapiens
gcuuugaccuggaggaauu

SEQ ID NO: 396982 - RNA, 19 nt, Homo sapiens
gaacugugagcucaagauu

SEQ ID NO: 396983 - RNA, 19 nt, Homo sapiens
aaaccagucuuucgacaug

SEQ ID NO: 396984 - RNA, 19 nt, Homo sapiens
gagggaagauaccuagaag

SEQ ID NO: 396985 - RNA, 19 nt, Homo sapiens
ggagggaagauaccuagaa

SEQ ID NO: 396986 - RNA, 19 nt, Homo sapiens
gcacucggcucaggucauc

SEQ ID NO: 396987 - RNA, 19 nt, Homo sapiens
ggugccaucucagacaaua

SEQ ID NO: 396988 - RNA, 19 nt, Homo sapiens
ugaccuggaggaauucuua

SEQ ID NO: 396989 - RNA, 19 nt, Homo sapiens
gacccaccuuucagccuua

SEQ ID NO: 396990 - RNA, 19 nt, Homo sapiens
ggauuauucugcagguuca

SEQ ID NO: 396991 - RNA, 19 nt, Homo sapiens
caagauuggugacuuuggu

SEQ ID NO: 396992 - RNA, 19 nt, Homo sapiens
gugccuugcugccacagua

SEQ ID NO: 396993 - RNA, 19 nt, Homo sapiens
ugacccagcagcuaucuaa

SEQ ID NO: 396994 - RNA, 19 nt, Homo sapiens
uggcuacgguguuggcuuu

SEQ ID NO: 396995 - RNA, 19 nt, Homo sapiens
gggccuauauccagagcuu

SEQ ID NO: 396996 - RNA, 19 nt, Homo sapiens
caaguaccaugauccugau

SEQ ID NO: 396997 - RNA, 19 nt, Homo sapiens
ggacuagugcucagugaca

SEQ ID NO: 396998 - RNA, 19 nt, Homo sapiens
aaagcgaccugcaccagau

SEQ ID NO: 396999 - RNA, 19 nt, Homo sapiens
ucugugggcugcaucuuug

SEQ ID NO: 397000 - RNA, 19 nt, Homo sapiens
guaccaugauccugaugau

SEQ ID NO: 397001 - RNA, 19 nt, Homo sapiens
caaacgagcggagggaaga

SEQ ID NO: 397002 - RNA, 19 nt, Homo sapiens
uuggaacgcuggacucgaa

SEQ ID NO: 397003 - RNA, 19 nt, Homo sapiens
uggcugaaauugaggacuu

SEQ ID NO: 397004 - RNA, 19 nt, Homo sapiens
gggaaucgcgggacagaca

SEQ ID NO: 397005 - RNA, 19 nt, Homo sapiens
acugugagcucaagauugg

SEQ ID NO: 397006 - RNA, 19 nt, Homo sapiens
caccugaugucaaccuugu

SEQ ID NO: 397007 - RNA, 19 nt, Homo sapiens
ugaggccugugaaauacaa

SEQ ID NO: 397008 - RNA, 19 nt, Homo sapiens
cauuguggcugaaauugag

SEQ ID NO: 397009 - RNA, 19 nt, Homo sapiens
gaguauacacaggcuauug

SEQ ID NO: 397010 - RNA, 19 nt, Homo sapiens
gcuacgguguuggcuuuga

SEQ ID NO: 397011 - RNA, 19 nt, Homo sapiens
caaauggcggacacaauuc

SEQ ID NO: 397012 - RNA, 19 nt, Homo sapiens
ccaaggagcgggagaaacg

SEQ ID NO: 397013 - RNA, 19 nt, Homo sapiens
aagcugcccugcucaaguc

SEQ ID NO: 397014 - RNA, 19 nt, Homo sapiens
ccuuugacuuugccuuuga

SEQ ID NO: 397015 - RNA, 19 nt, Homo sapiens
ggacuucgggagccaguag

SEQ ID NO: 397016 - RNA, 19 nt, Homo sapiens
gcucagugacaaugacaga

SEQ ID NO: 397017 - RNA, 19 nt, Homo sapiens
ggcaagaacgagccaagga

SEQ ID NO: 397018 - RNA, 19 nt, Homo sapiens
aaugaggccugugaaauac

SEQ ID NO: 397019 - RNA, 19 nt, Homo sapiens
caggauccaugggagcauu

SEQ ID NO: 397020 - RNA, 19 nt, Homo sapiens
agagucaccugaugucaac

SEQ ID NO: 397021 - RNA, 19 nt, Homo sapiens
gaacgcuggacucgaaugg

SEQ ID NO: 397022 - RNA, 19 nt, Homo sapiens
gacuagugcucagugacaa

SEQ ID NO: 397023 - RNA, 19 nt, Homo sapiens
cccagcagcuaucuaaguc

SEQ ID NO: 397024 - RNA, 19 nt, Homo sapiens
gcccuuugacuuugccuuu

SEQ ID NO: 397025 - RNA, 19 nt, Homo sapiens
accaugauccugaugauga

SEQ ID NO: 397026 - RNA, 19 nt, Homo sapiens
acccuuuccuggccaagua

SEQ ID NO: 397027 - RNA, 19 nt, Homo sapiens
cuucaugacugaguaugug

SEQ ID NO: 397028 - RNA, 19 nt, Homo sapiens
ccgcagaggagcagagguu

SEQ ID NO: 397029 - RNA, 19 nt, Homo sapiens
ggaacacgugcgcuacuuc

SEQ ID NO: 397030 - RNA, 19 nt, Homo sapiens
ggagcgggagcgaaaggaa

SEQ ID NO: 397031 - RNA, 19 nt, Homo sapiens
gaaucgcgggacagacaaa

SEQ ID NO: 397032 - RNA, 19 nt, Homo sapiens
gccggacgcucuagaaucc

SEQ ID NO: 397033 - RNA, 19 nt, Homo sapiens
caucucagacccaccuuuc

SEQ ID NO: 397034 - RNA, 19 nt, Homo sapiens
aggcucggcuuggauuauu

SEQ ID NO: 397035 - RNA, 19 nt, Homo sapiens
ccauuguggcugaaauuga

SEQ ID NO: 397036 - RNA, 19 nt, Homo sapiens
caaaaugaggccugugaaa

SEQ ID NO: 397037 - RNA, 19 nt, Homo sapiens
agauucagccucucucuca

SEQ ID NO: 397038 - RNA, 19 nt, Homo sapiens
cagagucaccugaugucaa

SEQ ID NO: 397039 - RNA, 19 nt, Homo sapiens
cugcccugcucaagucuuu

SEQ ID NO: 397040 - RNA, 19 nt, Homo sapiens
gaccuggaggaauucuuaa

SEQ ID NO: 397041 - RNA, 19 nt, Homo sapiens
ggaggaccgggaucucugu

SEQ ID NO: 397042 - RNA, 19 nt, Homo sapiens
caggauggccaggcagauu

SEQ ID NO: 397043 - RNA, 19 nt, Homo sapiens
uggaggaauucuuaaacca

SEQ ID NO: 397044 - RNA, 19 nt, Homo sapiens
gcuacuuccuguaccaacu

SEQ ID NO: 397045 - RNA, 19 nt, Homo sapiens
ggaaucgcgggacagacaa

SEQ ID NO: 397046 - RNA, 19 nt, Homo sapiens
auugaggacuuccaugcaa

SEQ ID NO: 397047 - RNA, 19 nt, Homo sapiens
gacaugggcguggcugaug

SEQ ID NO: 397048 - RNA, 19 nt, Homo sapiens
ccccaggaguuuugccuua

SEQ ID NO: 397049 - RNA, 19 nt, Homo sapiens
aaacuauguacaccagcua

SEQ ID NO: 397050 - RNA, 19 nt, Homo sapiens
aguauacacaggcuauuga

SEQ ID NO: 397051 - RNA, 19 nt, Homo sapiens
uggaacacgugcgcuacuu

SEQ ID NO: 397052 - RNA, 19 nt, Homo sapiens
gugaggcucggcuuggauu

SEQ ID NO: 397053 - RNA, 19 nt, Homo sapiens
gagccaaggagcgggagaa

SEQ ID NO: 397054 - RNA, 19 nt, Homo sapiens
ccaucucagacaauacuaa

SEQ ID NO: 397055 - RNA, 19 nt, Homo sapiens
ccaugauccugaugaugag

SEQ ID NO: 397056 - RNA, 19 nt, Homo sapiens
ggcugcaucuuuggugaga

SEQ ID NO: 397057 - RNA, 19 nt, Homo sapiens
gaacaucaguacuucauga

SEQ ID NO: 397058 - RNA, 19 nt, Homo sapiens
gcaaauggcggacacaauu

SEQ ID NO: 397059 - RNA, 19 nt, Homo sapiens
gaagaucccuaaugcuuuc

SEQ ID NO: 397060 - RNA, 19 nt, Homo sapiens
ccacaccgcugccucugua

SEQ ID NO: 397061 - RNA, 19 nt, Homo sapiens
gaacaauccuuuucaguau

SEQ ID NO: 397062 - RNA, 19 nt, Homo sapiens
gcucaagauuggugacuuu

SEQ ID NO: 397063 - RNA, 19 nt, Homo sapiens
aaaugaggccugugaaaua

SEQ ID NO: 397064 - RNA, 19 nt, Homo sapiens
gcuuugaccuggaggaauu

SEQ ID NO: 397065 - RNA, 19 nt, Homo sapiens
ucaagaagaucccuaaugc

SEQ ID NO: 397066 - RNA, 19 nt, Homo sapiens
gaaccuggcccugcuuaaa

SEQ ID NO: 397067 - RNA, 19 nt, Homo sapiens
gaacugugagcucaagauu

SEQ ID NO: 397068 - RNA, 19 nt, Homo sapiens
aaaccagucuuucgacaug

SEQ ID NO: 397069 - RNA, 19 nt, Homo sapiens
gagggaagauaccuagaag

SEQ ID NO: 397070 - RNA, 19 nt, Homo sapiens
ggagggaagauaccuagaa

SEQ ID NO: 397071 - RNA, 19 nt, Homo sapiens
gcacucggcucaggucauc

SEQ ID NO: 397072 - RNA, 19 nt, Homo sapiens
ggugccaucucagacaaua

SEQ ID NO: 397073 - RNA, 19 nt, Homo sapiens
ugaccuggaggaauucuua

SEQ ID NO: 397074 - RNA, 19 nt, Homo sapiens
gacccaccuuucagccuua

SEQ ID NO: 397075 - RNA, 19 nt, Homo sapiens
ggauuauucugcagguuca

SEQ ID NO: 397076 - RNA, 19 nt, Homo sapiens
caagauuggugacuuuggu

SEQ ID NO: 397077 - RNA, 19 nt, Homo sapiens
gugccuugcugccacagua

SEQ ID NO: 397078 - RNA, 19 nt, Homo sapiens
ugacccagcagcuaucuaa

SEQ ID NO: 397079 - RNA, 19 nt, Homo sapiens
uggcuacgguguuggcuuu

SEQ ID NO: 397080 - RNA, 19 nt, Homo sapiens
ugaagauccucaagcacuu

SEQ ID NO: 397081 - RNA, 19 nt, Homo sapiens
gggccuauauccagagcuu

SEQ ID NO: 397082 - RNA, 19 nt, Homo sapiens
gaagauccucaagcacuuu

SEQ ID NO: 397083 - RNA, 19 nt, Homo sapiens
caaguaccaugauccugau

SEQ ID NO: 397084 - RNA, 19 nt, Homo sapiens
aagaagaucccuaaugcuu

SEQ ID NO: 397085 - RNA, 19 nt, Homo sapiens
ggacuagugcucagugaca

SEQ ID NO: 397086 - RNA, 19 nt, Homo sapiens
aaagcgaccugcaccagau

SEQ ID NO: 397087 - RNA, 19 nt, Homo sapiens
ucugugggcugcaucuuug

SEQ ID NO: 397088 - RNA, 19 nt, Homo sapiens
guaccaugauccugaugau

SEQ ID NO: 397089 - RNA, 19 nt, Homo sapiens
uuggaacgcuggacucgaa

SEQ ID NO: 397090 - RNA, 19 nt, Homo sapiens
caaacgagcggagggaaga

SEQ ID NO: 397091 - RNA, 19 nt, Homo sapiens
gcagguggccaucaagaag

SEQ ID NO: 397092 - RNA, 19 nt, Homo sapiens
uggcugaaauugaggacuu

SEQ ID NO: 397093 - RNA, 19 nt, Homo sapiens
acugugagcucaagauugg

SEQ ID NO: 397094 - RNA, 19 nt, Homo sapiens
gggaaucgcgggacagaca

SEQ ID NO: 397095 - RNA, 19 nt, Homo sapiens
caccugaugucaaccuugu

SEQ ID NO: 397096 - RNA, 19 nt, Homo sapiens
gauccucaagcacuuuaaa

SEQ ID NO: 397097 - RNA, 19 nt, Homo sapiens
agaagaucccuaaugcuuu

SEQ ID NO: 397098 - RNA, 19 nt, Homo sapiens
ugaggccugugaaauacaa

SEQ ID NO: 397099 - RNA, 19 nt, Homo sapiens
cauuguggcugaaauugag

SEQ ID NO: 397100 - RNA, 19 nt, Homo sapiens
gaguauacacaggcuauug

SEQ ID NO: 397101 - RNA, 19 nt, Homo sapiens
caacaucaucgccaucaag

SEQ ID NO: 397102 - RNA, 19 nt, Homo sapiens
gcuacgguguuggcuuuga

SEQ ID NO: 397103 - RNA, 19 nt, Homo sapiens
caaauggcggacacaauuc

SEQ ID NO: 397104 - RNA, 19 nt, Homo sapiens
gagaucaucgagaccauag

SEQ ID NO: 397105 - RNA, 19 nt, Homo sapiens
ccaaggagcgggagaaacg

SEQ ID NO: 397106 - RNA, 19 nt, Homo sapiens
aagcugcccugcucaaguc

SEQ ID NO: 397107 - RNA, 19 nt, Homo sapiens
ccuuugacuuugccuuuga

SEQ ID NO: 397108 - RNA, 19 nt, Homo sapiens
ggacuucgggagccaguag

SEQ ID NO: 397109 - RNA, 19 nt, Homo sapiens
gcucagugacaaugacaga

SEQ ID NO: 397110 - RNA, 19 nt, Homo sapiens
ggcaagaacgagccaagga

SEQ ID NO: 397111 - RNA, 19 nt, Homo sapiens
ccaucaagaagaucccuaa

SEQ ID NO: 397112 - RNA, 19 nt, Homo sapiens
aaugaggccugugaaauac

SEQ ID NO: 397113 - RNA, 19 nt, Homo sapiens
caggauccaugggagcauu

SEQ ID NO: 397114 - RNA, 19 nt, Homo sapiens
agagucaccugaugucaac

SEQ ID NO: 397115 - RNA, 19 nt, Homo sapiens
gaacgcuggacucgaaugg

SEQ ID NO: 397116 - RNA, 19 nt, Homo sapiens
gacuagugcucagugacaa

SEQ ID NO: 397117 - RNA, 19 nt, Homo sapiens
cccagcagcuaucuaaguc

SEQ ID NO: 397118 - RNA, 19 nt, Homo sapiens
gcccuuugacuuugccuuu

SEQ ID NO: 397119 - RNA, 19 nt, Homo sapiens
accaugauccugaugauga

SEQ ID NO: 397120 - RNA, 19 nt, Homo sapiens
acccuuuccuggccaagua

SEQ ID NO: 397121 - RNA, 19 nt, Homo sapiens
cuucaugacugaguaugug

SEQ ID NO: 397122 - RNA, 19 nt, Homo sapiens
ccgcagaggagcagagguu

SEQ ID NO: 397123 - RNA, 19 nt, Homo sapiens
ggaacacgugcgcuacuuc

SEQ ID NO: 397124 - RNA, 19 nt, Homo sapiens
gcccuauggcgaauucaaa

SEQ ID NO: 397125 - RNA, 19 nt, Homo sapiens
ggagcgggagcgaaaggaa

SEQ ID NO: 397126 - RNA, 19 nt, Homo sapiens
gccggacgcucuagaaucc

SEQ ID NO: 397127 - RNA, 19 nt, Homo sapiens
gaaucgcgggacagacaaa

SEQ ID NO: 397128 - RNA, 19 nt, Homo sapiens
gacaacaucaucgccauca

SEQ ID NO: 397129 - RNA, 19 nt, Homo sapiens
ccuucgaugugaccuuuga

SEQ ID NO: 397130 - RNA, 19 nt, Homo sapiens
caucucagacccaccuuuc

SEQ ID NO: 397131 - RNA, 19 nt, Homo sapiens
aggcucggcuuggauuauu

SEQ ID NO: 397132 - RNA, 19 nt, Homo sapiens
ccauuguggcugaaauuga

SEQ ID NO: 397133 - RNA, 19 nt, Homo sapiens
uaaacacgacaacaucauc

SEQ ID NO: 397134 - RNA, 19 nt, Homo sapiens
caaaaugaggccugugaaa

SEQ ID NO: 397135 - RNA, 19 nt, Homo sapiens
agauucagccucucucuca

SEQ ID NO: 397136 - RNA, 19 nt, Homo sapiens
cagagucaccugaugucaa

SEQ ID NO: 397137 - RNA, 19 nt, Homo sapiens
cugcccugcucaagucuuu

SEQ ID NO: 397138 - RNA, 19 nt, Homo sapiens
cgagaucaucgagaccaua

SEQ ID NO: 397139 - RNA, 19 nt, Homo sapiens
gaccuggaggaauucuuaa

SEQ ID NO: 397140 - RNA, 19 nt, Homo sapiens
ggaggaccgggaucucugu

SEQ ID NO: 397141 - RNA, 19 nt, Homo sapiens
cgaauucaaaucugucuac

SEQ ID NO: 397142 - RNA, 19 nt, Homo sapiens
uggccgagccucugaagga

SEQ ID NO: 397143 - RNA, 19 nt, Homo sapiens
caggauggccaggcagauu

SEQ ID NO: 397144 - RNA, 19 nt, Homo sapiens
uggaggaauucuuaaacca

SEQ ID NO: 397145 - RNA, 19 nt, Homo sapiens
gcuacuuccuguaccaacu

SEQ ID NO: 397146 - RNA, 19 nt, Homo sapiens
ggaaucgcgggacagacaa

SEQ ID NO: 397147 - RNA, 19 nt, Homo sapiens
auugaggacuuccaugcaa

SEQ ID NO: 397148 - RNA, 19 nt, Homo sapiens
gaucccuaaugcuuucgau

SEQ ID NO: 397149 - RNA, 19 nt, Homo sapiens
cagcagguggccaucaaga

SEQ ID NO: 397150 - RNA, 19 nt, Homo sapiens
gacaugggcguggcugaug

SEQ ID NO: 397151 - RNA, 19 nt, Homo sapiens
ccccaggaguuuugccuua

SEQ ID NO: 397152 - RNA, 19 nt, Homo sapiens
aaacuauguacaccagcua

SEQ ID NO: 397153 - RNA, 19 nt, Homo sapiens
aguauacacaggcuauuga

SEQ ID NO: 397154 - RNA, 19 nt, Homo sapiens
uggaacacgugcgcuacuu

SEQ ID NO: 397155 - RNA, 19 nt, Homo sapiens
gugaggcucggcuuggauu

SEQ ID NO: 397156 - RNA, 19 nt, Homo sapiens
gagccaaggagcgggagaa

SEQ ID NO: 397157 - RNA, 19 nt, Homo sapiens
gaacaucaguacuucauga

SEQ ID NO: 397158 - RNA, 19 nt, Homo sapiens
gaagaucccuaaugcuuuc

SEQ ID NO: 397159 - RNA, 19 nt, Homo sapiens
ccacaccgcugccucugua

SEQ ID NO: 397160 - RNA, 19 nt, Homo sapiens
gaacaauccuuuucaguau

SEQ ID NO: 397161 - RNA, 19 nt, Homo sapiens
gcucaagauuggugacuuu

SEQ ID NO: 397162 - RNA, 19 nt, Homo sapiens
aaaugaggccugugaaaua

SEQ ID NO: 397163 - RNA, 19 nt, Homo sapiens
gcuuugaccuggaggaauu

SEQ ID NO: 397164 - RNA, 19 nt, Homo sapiens
ucaagaagaucccuaaugc

SEQ ID NO: 397165 - RNA, 19 nt, Homo sapiens
gaaccuggcccugcuuaaa

SEQ ID NO: 397166 - RNA, 19 nt, Homo sapiens
gaacugugagcucaagauu

SEQ ID NO: 397167 - RNA, 19 nt, Homo sapiens
aaaccagucuuucgacaug

SEQ ID NO: 397168 - RNA, 19 nt, Homo sapiens
gcacucggcucaggucauc

SEQ ID NO: 397169 - RNA, 19 nt, Homo sapiens
ggugccaucucagacaaua

SEQ ID NO: 397170 - RNA, 19 nt, Homo sapiens
ugaccuggaggaauucuua

SEQ ID NO: 397171 - RNA, 19 nt, Homo sapiens
gacccaccuuucagccuua

SEQ ID NO: 397172 - RNA, 19 nt, Homo sapiens
ggauuauucugcagguuca

SEQ ID NO: 397173 - RNA, 19 nt, Homo sapiens
caagauuggugacuuuggu

SEQ ID NO: 397174 - RNA, 19 nt, Homo sapiens
gugccuugcugccacagua

SEQ ID NO: 397175 - RNA, 19 nt, Homo sapiens
ugacccagcagcuaucuaa

SEQ ID NO: 397176 - RNA, 19 nt, Homo sapiens
uggcuacgguguuggcuuu

SEQ ID NO: 397177 - RNA, 19 nt, Homo sapiens
ugaagauccucaagcacuu

SEQ ID NO: 397178 - RNA, 19 nt, Homo sapiens
gggccuauauccagagcuu

SEQ ID NO: 397179 - RNA, 19 nt, Homo sapiens
gaagauccucaagcacuuu

SEQ ID NO: 397180 - RNA, 19 nt, Homo sapiens
caaguaccaugauccugau

SEQ ID NO: 397181 - RNA, 19 nt, Homo sapiens
aagaagaucccuaaugcuu

SEQ ID NO: 397182 - RNA, 19 nt, Homo sapiens
ggacuagugcucagugaca

SEQ ID NO: 397183 - RNA, 19 nt, Homo sapiens
aaagcgaccugcaccagau

SEQ ID NO: 397184 - RNA, 19 nt, Homo sapiens
ucugugggcugcaucuuug

SEQ ID NO: 397185 - RNA, 19 nt, Homo sapiens
guaccaugauccugaugau

SEQ ID NO: 397186 - RNA, 19 nt, Homo sapiens
uuggaacgcuggacucgaa

SEQ ID NO: 397187 - RNA, 19 nt, Homo sapiens
gcagguggccaucaagaag

SEQ ID NO: 397188 - RNA, 19 nt, Homo sapiens
uggcugaaauugaggacuu

SEQ ID NO: 397189 - RNA, 19 nt, Homo sapiens
acugugagcucaagauugg

SEQ ID NO: 397190 - RNA, 19 nt, Homo sapiens
caccugaugucaaccuugu

SEQ ID NO: 397191 - RNA, 19 nt, Homo sapiens
gauccucaagcacuuuaaa

SEQ ID NO: 397192 - RNA, 19 nt, Homo sapiens
agaagaucccuaaugcuuu

SEQ ID NO: 397193 - RNA, 19 nt, Homo sapiens
ugaggccugugaaauacaa

SEQ ID NO: 397194 - RNA, 19 nt, Homo sapiens
cauuguggcugaaauugag

SEQ ID NO: 397195 - RNA, 19 nt, Homo sapiens
gaguauacacaggcuauug

SEQ ID NO: 397196 - RNA, 19 nt, Homo sapiens
caacaucaucgccaucaag

SEQ ID NO: 397197 - RNA, 19 nt, Homo sapiens
gcuacgguguuggcuuuga

SEQ ID NO: 397198 - RNA, 19 nt, Homo sapiens
gagaucaucgagaccauag

SEQ ID NO: 397199 - RNA, 19 nt, Homo sapiens
ccaaggagcgggagaaacg

SEQ ID NO: 397200 - RNA, 19 nt, Homo sapiens
aagcugcccugcucaaguc

SEQ ID NO: 397201 - RNA, 19 nt, Homo sapiens
ccuuugacuuugccuuuga

SEQ ID NO: 397202 - RNA, 19 nt, Homo sapiens
gcucagugacaaugacaga

SEQ ID NO: 397203 - RNA, 19 nt, Homo sapiens
ggcaagaacgagccaagga

SEQ ID NO: 397204 - RNA, 19 nt, Homo sapiens
ccaucaagaagaucccuaa

SEQ ID NO: 397205 - RNA, 19 nt, Homo sapiens
aaugaggccugugaaauac

SEQ ID NO: 397206 - RNA, 19 nt, Homo sapiens
caggauccaugggagcauu

SEQ ID NO: 397207 - RNA, 19 nt, Homo sapiens
agagucaccugaugucaac

SEQ ID NO: 397208 - RNA, 19 nt, Homo sapiens
gaacgcuggacucgaaugg

SEQ ID NO: 397209 - RNA, 19 nt, Homo sapiens
gacuagugcucagugacaa

SEQ ID NO: 397210 - RNA, 19 nt, Homo sapiens
cccagcagcuaucuaaguc

SEQ ID NO: 397211 - RNA, 19 nt, Homo sapiens
gcccuuugacuuugccuuu

SEQ ID NO: 397212 - RNA, 19 nt, Homo sapiens
accaugauccugaugauga

SEQ ID NO: 397213 - RNA, 19 nt, Homo sapiens
acccuuuccuggccaagua

SEQ ID NO: 397214 - RNA, 19 nt, Homo sapiens
cuucaugacugaguaugug

SEQ ID NO: 397215 - RNA, 19 nt, Homo sapiens
ggaacacgugcgcuacuuc

SEQ ID NO: 397216 - RNA, 19 nt, Homo sapiens
gcccuauggcgaauucaaa

SEQ ID NO: 397217 - RNA, 19 nt, Homo sapiens
ggagcgggagcgaaaggaa

SEQ ID NO: 397218 - RNA, 19 nt, Homo sapiens
ccuucgaugugaccuuuga

SEQ ID NO: 397219 - RNA, 19 nt, Homo sapiens
gacaacaucaucgccauca

SEQ ID NO: 397220 - RNA, 19 nt, Homo sapiens
caucucagacccaccuuuc

SEQ ID NO: 397221 - RNA, 19 nt, Homo sapiens
aggcucggcuuggauuauu

SEQ ID NO: 397222 - RNA, 19 nt, Homo sapiens
ccauuguggcugaaauuga

SEQ ID NO: 397223 - RNA, 19 nt, Homo sapiens
uaaacacgacaacaucauc

SEQ ID NO: 397224 - RNA, 19 nt, Homo sapiens
caaaaugaggccugugaaa

SEQ ID NO: 397225 - RNA, 19 nt, Homo sapiens
agauucagccucucucuca

SEQ ID NO: 397226 - RNA, 19 nt, Homo sapiens
cgagaucaucgagaccaua

SEQ ID NO: 397227 - RNA, 19 nt, Homo sapiens
cagagucaccugaugucaa

SEQ ID NO: 397228 - RNA, 19 nt, Homo sapiens
cugcccugcucaagucuuu

SEQ ID NO: 397229 - RNA, 19 nt, Homo sapiens
gaccuggaggaauucuuaa

SEQ ID NO: 397230 - RNA, 19 nt, Homo sapiens
uggccgagccucugaagga

SEQ ID NO: 397231 - RNA, 19 nt, Homo sapiens
cgaauucaaaucugucuac

SEQ ID NO: 397232 - RNA, 19 nt, Homo sapiens
caggauggccaggcagauu

SEQ ID NO: 397233 - RNA, 19 nt, Homo sapiens
uggaggaauucuuaaacca

SEQ ID NO: 397234 - RNA, 19 nt, Homo sapiens
gcuacuuccuguaccaacu

SEQ ID NO: 397235 - RNA, 19 nt, Homo sapiens
gaucccuaaugcuuucgau

SEQ ID NO: 397236 - RNA, 19 nt, Homo sapiens
auugaggacuuccaugcaa

SEQ ID NO: 397237 - RNA, 19 nt, Homo sapiens
cagcagguggccaucaaga

SEQ ID NO: 397238 - RNA, 19 nt, Homo sapiens
gacaugggcguggcugaug

SEQ ID NO: 397239 - RNA, 19 nt, Homo sapiens
ccccaggaguuuugccuua

SEQ ID NO: 397240 - RNA, 19 nt, Homo sapiens
aaacuauguacaccagcua

SEQ ID NO: 397241 - RNA, 19 nt, Homo sapiens
aguauacacaggcuauuga

SEQ ID NO: 397242 - RNA, 19 nt, Homo sapiens
uggaacacgugcgcuacuu

SEQ ID NO: 397243 - RNA, 19 nt, Homo sapiens
gugaggcucggcuuggauu

SEQ ID NO: 397244 - RNA, 19 nt, Homo sapiens
gagccaaggagcgggagaa

SEQ ID NO: 397245 - RNA, 19 nt, Homo sapiens
ccaucucagacaauacuaa

SEQ ID NO: 397246 - RNA, 19 nt, Homo sapiens
ugacgugggcgacgaguac

SEQ ID NO: 397247 - RNA, 19 nt, Homo sapiens
ccaugauccugaugaugag

SEQ ID NO: 397248 - RNA, 19 nt, Homo sapiens
ggcugcaucuuuggugaga

SEQ ID NO: 397249 - RNA, 19 nt, Homo sapiens
ggagcuagaucaugaaaga

SEQ ID NO: 397250 - RNA, 19 nt, Homo sapiens
gagaaacucuucccugaug

SEQ ID NO: 397251 - RNA, 19 nt, Homo sapiens
ucacaguccugaaacgaua

SEQ ID NO: 397252 - RNA, 19 nt, Homo sapiens
ugaaagaaauguugcaauc

SEQ ID NO: 397253 - RNA, 19 nt, Homo sapiens
gauuggagauucuacauuc

SEQ ID NO: 397254 - RNA, 19 nt, Homo sapiens
agaaaucccuagaagaauu

SEQ ID NO: 397255 - RNA, 19 nt, Homo sapiens
ggauauagcuuugagaaac

SEQ ID NO: 397256 - RNA, 19 nt, Homo sapiens
gaacacaacaaacuuaaag

SEQ ID NO: 397257 - RNA, 19 nt, Homo sapiens
gcucauggaugcaaaucuu

SEQ ID NO: 397258 - RNA, 19 nt, Homo sapiens
acagagagcuaguucuuau

SEQ ID NO: 397259 - RNA, 19 nt, Homo sapiens
gaagcuaagccgaccauuu

SEQ ID NO: 397260 - RNA, 19 nt, Homo sapiens
ucaaugaugugucuucaau

SEQ ID NO: 397261 - RNA, 19 nt, Homo sapiens
ccacagaaaucccuagaag

SEQ ID NO: 397262 - RNA, 19 nt, Homo sapiens
gaagcaagcgugacaacaa

SEQ ID NO: 397263 - RNA, 19 nt, Homo sapiens
cucaggagcucaaggaaua

SEQ ID NO: 397264 - RNA, 19 nt, Homo sapiens
gaugacgccuuauguagug

SEQ ID NO: 397265 - RNA, 19 nt, Homo sapiens
ugaaagggaacacacaaua

SEQ ID NO: 397266 - RNA, 19 nt, Homo sapiens
gaucaguggaauaaaguua

SEQ ID NO: 397267 - RNA, 19 nt, Homo sapiens
gacaagcaguuagaugaaa

SEQ ID NO: 397268 - RNA, 19 nt, Homo sapiens
acagaaaucccuagaagaa

SEQ ID NO: 397269 - RNA, 19 nt, Homo sapiens
acaauucaguggucuuauu

SEQ ID NO: 397270 - RNA, 19 nt, Homo sapiens
caccaaagaucccugacaa

SEQ ID NO: 397271 - RNA, 19 nt, Homo sapiens
ggaacaccauguccugaau

SEQ ID NO: 397272 - RNA, 19 nt, Homo sapiens
aaccaagaauggaguuaua

SEQ ID NO: 397273 - RNA, 19 nt, Homo sapiens
gaaagggaacacacaauag

SEQ ID NO: 397274 - RNA, 19 nt, Homo sapiens
agauggagcuagaucauga

SEQ ID NO: 397275 - RNA, 19 nt, Homo sapiens
ucagaacacaacaaacuua

SEQ ID NO: 397276 - RNA, 19 nt, Homo sapiens
gaaaacagaccuaaauaug

SEQ ID NO: 397277 - RNA, 19 nt, Homo sapiens
ggaacgaguuuuaugauga

SEQ ID NO: 397278 - RNA, 19 nt, Homo sapiens
gcaagcgugacaacaauuu

SEQ ID NO: 397279 - RNA, 19 nt, Homo sapiens
cuagaagaauuucaagaug

SEQ ID NO: 397280 - RNA, 19 nt, Homo sapiens
gaaauguugcaaucaagaa

SEQ ID NO: 397281 - RNA, 19 nt, Homo sapiens
aaacagaccuaaauaugcu

SEQ ID NO: 397282 - RNA, 19 nt, Homo sapiens
gacuuaaagcccaguaaua

SEQ ID NO: 397283 - RNA, 19 nt, Homo sapiens
gaaagaaauguugcaauca

SEQ ID NO: 397284 - RNA, 19 nt, Homo sapiens
gggagucgguuagucauug

SEQ ID NO: 397285 - RNA, 19 nt, Homo sapiens
gaggagagaaccaagaaug

SEQ ID NO: 397286 - RNA, 19 nt, Homo sapiens
caacacccguacaucaaug

SEQ ID NO: 397287 - RNA, 19 nt, Homo sapiens
gcccaguaauauaguagua

SEQ ID NO: 397288 - RNA, 19 nt, Homo sapiens
ggcaugggcuacaaggaaa

SEQ ID NO: 397289 - RNA, 19 nt, Homo sapiens
ggaaucaagcaccuucauu

SEQ ID NO: 397290 - RNA, 19 nt, Homo sapiens
agagcuaguucuuaugaaa

SEQ ID NO: 397291 - RNA, 19 nt, Homo sapiens
ggagucgguuagucauuga

SEQ ID NO: 397292 - RNA, 19 nt, Homo sapiens
gaacaccauguccugaauu

SEQ ID NO: 397293 - RNA, 19 nt, Homo sapiens
ggaauaguaugcgcagcuu

SEQ ID NO: 397294 - RNA, 19 nt, Homo sapiens
uguccuaccuucucuauca

SEQ ID NO: 397295 - RNA, 19 nt, Homo sapiens
aaacaauucaguggucuua

SEQ ID NO: 397296 - RNA, 19 nt, Homo sapiens
gagaaaugguuugccacaa

SEQ ID NO: 397297 - RNA, 19 nt, Homo sapiens
ccucugggcugcuguagau

SEQ ID NO: 397298 - RNA, 19 nt, Homo sapiens
gaaccaagaauggaguuau

SEQ ID NO: 397299 - RNA, 19 nt, Homo sapiens
ccaaaaugcugguaauaga

SEQ ID NO: 397300 - RNA, 19 nt, Homo sapiens
gauauagcuuugagaaacu

SEQ ID NO: 397301 - RNA, 19 nt, Homo sapiens
gaagaaacugcaaccaaca

SEQ ID NO: 397302 - RNA, 19 nt, Homo sapiens
caauucaguggucuuauuu

SEQ ID NO: 397303 - RNA, 19 nt, Homo sapiens
ugaugugucuucaauguca

SEQ ID NO: 397304 - RNA, 19 nt, Homo sapiens
gcuagaucaugaaagaaug

SEQ ID NO: 397305 - RNA, 19 nt, Homo sapiens
gaagcuccaccaccaaaga

SEQ ID NO: 397306 - RNA, 19 nt, Homo sapiens
guccugaauucaugaagaa

SEQ ID NO: 397307 - RNA, 19 nt, Homo sapiens
ggacuuaaagcccaguaau

SEQ ID NO: 397308 - RNA, 19 nt, Homo sapiens
aaugaugugucuucaaugu

SEQ ID NO: 397309 - RNA, 19 nt, Homo sapiens
uagaagaguggaaagaauu

SEQ ID NO: 397310 - RNA, 19 nt, Homo sapiens
gagagcuaguucuuaugaa

SEQ ID NO: 397311 - RNA, 19 nt, Homo sapiens
gggcugcuguagaugacua

SEQ ID NO: 397312 - RNA, 19 nt, Homo sapiens
gugcagcagugaucaaugg

SEQ ID NO: 397313 - RNA, 19 nt, Homo sapiens
ggacugcaggaacgaguuu

SEQ ID NO: 397314 - RNA, 19 nt, Homo sapiens
ggagagaaccaagaaugga

SEQ ID NO: 397315 - RNA, 19 nt, Homo sapiens
ugacucagaacacaacaaa

SEQ ID NO: 397316 - RNA, 19 nt, Homo sapiens
ugauugcacuuugaagauu

SEQ ID NO: 397317 - RNA, 19 nt, Homo sapiens
aagcuaagccgaccauuuc

SEQ ID NO: 397318 - RNA, 19 nt, Homo sapiens
aaagggaacacacaauaga

SEQ ID NO: 397319 - RNA, 19 nt, Homo sapiens
cagaacacaacaaacuuaa

SEQ ID NO: 397320 - RNA, 19 nt, Homo sapiens
cuuaaagcccaguaauaua

SEQ ID NO: 397321 - RNA, 19 nt, Homo sapiens
uaucagaugcuguguggaa

SEQ ID NO: 397322 - RNA, 19 nt, Homo sapiens
gccaagugauucagaugga

SEQ ID NO: 397323 - RNA, 19 nt, Homo sapiens
gaauaguaugcgcagcuua

SEQ ID NO: 397324 - RNA, 19 nt, Homo sapiens
caucgucgucugucaauga

SEQ ID NO: 397325 - RNA, 19 nt, Homo sapiens
gaacacacaauagaagagu

SEQ ID NO: 397326 - RNA, 19 nt, Homo sapiens
ucaggcaagggauuuguua

SEQ ID NO: 397327 - RNA, 19 nt, Homo sapiens
gaccuaaauaugcuggaua

SEQ ID NO: 397328 - RNA, 19 nt, Homo sapiens
uuaaagcccaguaauauag

SEQ ID NO: 397329 - RNA, 19 nt, Homo sapiens
aagcaagcgugacaacaau

SEQ ID NO: 397330 - RNA, 19 nt, Homo sapiens
gcagcccucuccuuuagca

SEQ ID NO: 397331 - RNA, 19 nt, Homo sapiens
gaugaaagggaacacacaa

SEQ ID NO: 397332 - RNA, 19 nt, Homo sapiens
gauugcacuuugaagauuc

SEQ ID NO: 397333 - RNA, 19 nt, Homo sapiens
guguagagauuggagauuc

SEQ ID NO: 397334 - RNA, 19 nt, Homo sapiens
cuacagagagcuaguucuu

SEQ ID NO: 397335 - RNA, 19 nt, Homo sapiens
uaugaugacgccuuaugua

SEQ ID NO: 397336 - RNA, 19 nt, Homo sapiens
aaagcccaguaauauagua

SEQ ID NO: 397337 - RNA, 19 nt, Homo sapiens
ugucuucaaugucaacaga

SEQ ID NO: 397338 - RNA, 19 nt, Homo sapiens
uaugaugccauucuugaaa

SEQ ID NO: 397339 - RNA, 19 nt, Homo sapiens
gagcuaguucuuaugaaau

SEQ ID NO: 397340 - RNA, 19 nt, Homo sapiens
gaagaguggaaagaauuga

SEQ ID NO: 397341 - RNA, 19 nt, Homo sapiens
auagaagaguggaaagaau

SEQ ID NO: 397342 - RNA, 19 nt, Homo sapiens
ggacuuacguugaaaacag

SEQ ID NO: 397343 - RNA, 19 nt, Homo sapiens
cagaugcuguguggaauca

SEQ ID NO: 397344 - RNA, 19 nt, Homo sapiens
ugauucagauggagcuaga

SEQ ID NO: 397345 - RNA, 19 nt, Homo sapiens
gggaacacacaauagaaga

SEQ ID NO: 397346 - RNA, 19 nt, Homo sapiens
ugacaagcaguuagaugaa

SEQ ID NO: 397347 - RNA, 19 nt, Homo sapiens
caaagaucccugacaagca

SEQ ID NO: 397348 - RNA, 19 nt, Homo sapiens
agagagcuaguucuuauga

SEQ ID NO: 397349 - RNA, 19 nt, Homo sapiens
ggagcuagaucaugaaaga

SEQ ID NO: 397350 - RNA, 19 nt, Homo sapiens
gagaaacucuucccugaug

SEQ ID NO: 397351 - RNA, 19 nt, Homo sapiens
ucacaguccugaaacgaua

SEQ ID NO: 397352 - RNA, 19 nt, Homo sapiens
ugaaagaaauguugcaauc

SEQ ID NO: 397353 - RNA, 19 nt, Homo sapiens
gauuggagauucuacauuc

SEQ ID NO: 397354 - RNA, 19 nt, Homo sapiens
agaaaucccuagaagaauu

SEQ ID NO: 397355 - RNA, 19 nt, Homo sapiens
ggauauagcuuugagaaac

SEQ ID NO: 397356 - RNA, 19 nt, Homo sapiens
gaacacaacaaacuuaaag

SEQ ID NO: 397357 - RNA, 19 nt, Homo sapiens
gcucauggaugcaaaucuu

SEQ ID NO: 397358 - RNA, 19 nt, Homo sapiens
acagagagcuaguucuuau

SEQ ID NO: 397359 - RNA, 19 nt, Homo sapiens
gaagcuaagccgaccauuu

SEQ ID NO: 397360 - RNA, 19 nt, Homo sapiens
ucaaugaugugucuucaau

SEQ ID NO: 397361 - RNA, 19 nt, Homo sapiens
ccacagaaaucccuagaag

SEQ ID NO: 397362 - RNA, 19 nt, Homo sapiens
gaagcaagcgugacaacaa

SEQ ID NO: 397363 - RNA, 19 nt, Homo sapiens
cucaggagcucaaggaaua

SEQ ID NO: 397364 - RNA, 19 nt, Homo sapiens
gaugacgccuuauguagug

SEQ ID NO: 397365 - RNA, 19 nt, Homo sapiens
ugaaagggaacacacaaua

SEQ ID NO: 397366 - RNA, 19 nt, Homo sapiens
gaucaguggaauaaaguua

SEQ ID NO: 397367 - RNA, 19 nt, Homo sapiens
gacaagcaguuagaugaaa

SEQ ID NO: 397368 - RNA, 19 nt, Homo sapiens
acagaaaucccuagaagaa

SEQ ID NO: 397369 - RNA, 19 nt, Homo sapiens
acaauucaguggucuuauu

SEQ ID NO: 397370 - RNA, 19 nt, Homo sapiens
caccaaagaucccugacaa

SEQ ID NO: 397371 - RNA, 19 nt, Homo sapiens
ggaacaccauguccugaau

SEQ ID NO: 397372 - RNA, 19 nt, Homo sapiens
aaccaagaauggaguuaua

SEQ ID NO: 397373 - RNA, 19 nt, Homo sapiens
gaaagggaacacacaauag

SEQ ID NO: 397374 - RNA, 19 nt, Homo sapiens
agauggagcuagaucauga

SEQ ID NO: 397375 - RNA, 19 nt, Homo sapiens
ucagaacacaacaaacuua

SEQ ID NO: 397376 - RNA, 19 nt, Homo sapiens
gaaaacagaccuaaauaug

SEQ ID NO: 397377 - RNA, 19 nt, Homo sapiens
ggaacgaguuuuaugauga

SEQ ID NO: 397378 - RNA, 19 nt, Homo sapiens
gcaagcgugacaacaauuu

SEQ ID NO: 397379 - RNA, 19 nt, Homo sapiens
cuagaagaauuucaagaug

SEQ ID NO: 397380 - RNA, 19 nt, Homo sapiens
gaaauguugcaaucaagaa

SEQ ID NO: 397381 - RNA, 19 nt, Homo sapiens
aaacagaccuaaauaugcu

SEQ ID NO: 397382 - RNA, 19 nt, Homo sapiens
gacuuaaagcccaguaaua

SEQ ID NO: 397383 - RNA, 19 nt, Homo sapiens
gaaagaaauguugcaauca

SEQ ID NO: 397384 - RNA, 19 nt, Homo sapiens
gggagucgguuagucauug

SEQ ID NO: 397385 - RNA, 19 nt, Homo sapiens
gaggagagaaccaagaaug

SEQ ID NO: 397386 - RNA, 19 nt, Homo sapiens
caacacccguacaucaaug

SEQ ID NO: 397387 - RNA, 19 nt, Homo sapiens
gcccaguaauauaguagua

SEQ ID NO: 397388 - RNA, 19 nt, Homo sapiens
ggcaugggcuacaaggaaa

SEQ ID NO: 397389 - RNA, 19 nt, Homo sapiens
ggaaucaagcaccuucauu

SEQ ID NO: 397390 - RNA, 19 nt, Homo sapiens
agagcuaguucuuaugaaa

SEQ ID NO: 397391 - RNA, 19 nt, Homo sapiens
ggagucgguuagucauuga

SEQ ID NO: 397392 - RNA, 19 nt, Homo sapiens
gaacaccauguccugaauu

SEQ ID NO: 397393 - RNA, 19 nt, Homo sapiens
ggaauaguaugcgcagcuu

SEQ ID NO: 397394 - RNA, 19 nt, Homo sapiens
uguccuaccuucucuauca

SEQ ID NO: 397395 - RNA, 19 nt, Homo sapiens
aaacaauucaguggucuua

SEQ ID NO: 397396 - RNA, 19 nt, Homo sapiens
ccucugggcugcuguagau

SEQ ID NO: 397397 - RNA, 19 nt, Homo sapiens
gaaccaagaauggaguuau

SEQ ID NO: 397398 - RNA, 19 nt, Homo sapiens
ccaaaaugcugguaauaga

SEQ ID NO: 397399 - RNA, 19 nt, Homo sapiens
gauauagcuuugagaaacu

SEQ ID NO: 397400 - RNA, 19 nt, Homo sapiens
gaagaaacugcaaccaaca

SEQ ID NO: 397401 - RNA, 19 nt, Homo sapiens
caauucaguggucuuauuu

SEQ ID NO: 397402 - RNA, 19 nt, Homo sapiens
ugaugugucuucaauguca

SEQ ID NO: 397403 - RNA, 19 nt, Homo sapiens
gcuagaucaugaaagaaug

SEQ ID NO: 397404 - RNA, 19 nt, Homo sapiens
gaagcuccaccaccaaaga

SEQ ID NO: 397405 - RNA, 19 nt, Homo sapiens
guccugaauucaugaagaa

SEQ ID NO: 397406 - RNA, 19 nt, Homo sapiens
ggacuuaaagcccaguaau

SEQ ID NO: 397407 - RNA, 19 nt, Homo sapiens
aaugaugugucuucaaugu

SEQ ID NO: 397408 - RNA, 19 nt, Homo sapiens
uagaagaguggaaagaauu

SEQ ID NO: 397409 - RNA, 19 nt, Homo sapiens
gagagcuaguucuuaugaa

SEQ ID NO: 397410 - RNA, 19 nt, Homo sapiens
gggcugcuguagaugacua

SEQ ID NO: 397411 - RNA, 19 nt, Homo sapiens
gugcagcagugaucaaugg

SEQ ID NO: 397412 - RNA, 19 nt, Homo sapiens
ggacugcaggaacgaguuu

SEQ ID NO: 397413 - RNA, 19 nt, Homo sapiens
ggagagaaccaagaaugga

SEQ ID NO: 397414 - RNA, 19 nt, Homo sapiens
ugacucagaacacaacaaa

SEQ ID NO: 397415 - RNA, 19 nt, Homo sapiens
ugauugcacuuugaagauu

SEQ ID NO: 397416 - RNA, 19 nt, Homo sapiens
aagcuaagccgaccauuuc

SEQ ID NO: 397417 - RNA, 19 nt, Homo sapiens
aaagggaacacacaauaga

SEQ ID NO: 397418 - RNA, 19 nt, Homo sapiens
cagaacacaacaaacuuaa

SEQ ID NO: 397419 - RNA, 19 nt, Homo sapiens
ggaaaacguugacauuugg

SEQ ID NO: 397420 - RNA, 19 nt, Homo sapiens
cuuaaagcccaguaauaua

SEQ ID NO: 397421 - RNA, 19 nt, Homo sapiens
uaucagaugcuguguggaa

SEQ ID NO: 397422 - RNA, 19 nt, Homo sapiens
gccaagugauucagaugga

SEQ ID NO: 397423 - RNA, 19 nt, Homo sapiens
gaauaguaugcgcagcuua

SEQ ID NO: 397424 - RNA, 19 nt, Homo sapiens
caucgucgucugucaauga

SEQ ID NO: 397425 - RNA, 19 nt, Homo sapiens
gaacacacaauagaagagu

SEQ ID NO: 397426 - RNA, 19 nt, Homo sapiens
ucaggcaagggauuuguua

SEQ ID NO: 397427 - RNA, 19 nt, Homo sapiens
gaccuaaauaugcuggaua

SEQ ID NO: 397428 - RNA, 19 nt, Homo sapiens
uuaaagcccaguaauauag

SEQ ID NO: 397429 - RNA, 19 nt, Homo sapiens
aagcaagcgugacaacaau

SEQ ID NO: 397430 - RNA, 19 nt, Homo sapiens
gcagcccucuccuuuagca

SEQ ID NO: 397431 - RNA, 19 nt, Homo sapiens
gaugaaagggaacacacaa

SEQ ID NO: 397432 - RNA, 19 nt, Homo sapiens
gauugcacuuugaagauuc

SEQ ID NO: 397433 - RNA, 19 nt, Homo sapiens
guguagagauuggagauuc

SEQ ID NO: 397434 - RNA, 19 nt, Homo sapiens
cuacagagagcuaguucuu

SEQ ID NO: 397435 - RNA, 19 nt, Homo sapiens
uaugaugacgccuuaugua

SEQ ID NO: 397436 - RNA, 19 nt, Homo sapiens
aaagcccaguaauauagua

SEQ ID NO: 397437 - RNA, 19 nt, Homo sapiens
ugucuucaaugucaacaga

SEQ ID NO: 397438 - RNA, 19 nt, Homo sapiens
uaugaugccauucuugaaa

SEQ ID NO: 397439 - RNA, 19 nt, Homo sapiens
gagcuaguucuuaugaaau

SEQ ID NO: 397440 - RNA, 19 nt, Homo sapiens
gaagaguggaaagaauuga

SEQ ID NO: 397441 - RNA, 19 nt, Homo sapiens
auagaagaguggaaagaau

SEQ ID NO: 397442 - RNA, 19 nt, Homo sapiens
ggacuuacguugaaaacag

SEQ ID NO: 397443 - RNA, 19 nt, Homo sapiens
ccagguacagaucauauug

SEQ ID NO: 397444 - RNA, 19 nt, Homo sapiens
cagaugcuguguggaauca

SEQ ID NO: 397445 - RNA, 19 nt, Homo sapiens
ugauucagauggagcuaga

SEQ ID NO: 397446 - RNA, 19 nt, Homo sapiens
gggaacacacaauagaaga

SEQ ID NO: 397447 - RNA, 19 nt, Homo sapiens
ugacaagcaguuagaugaa

SEQ ID NO: 397448 - RNA, 19 nt, Homo sapiens
caaagaucccugacaagca

SEQ ID NO: 397449 - RNA, 19 nt, Homo sapiens
ggagcuagaucaugaaaga

SEQ ID NO: 397450 - RNA, 19 nt, Homo sapiens
gagaaacucuucccugaug

SEQ ID NO: 397451 - RNA, 19 nt, Homo sapiens
ucacaguccugaaacgaua

SEQ ID NO: 397452 - RNA, 19 nt, Homo sapiens
ugaaagaaauguugcaauc

SEQ ID NO: 397453 - RNA, 19 nt, Homo sapiens
gauuggagauucuacauuc

SEQ ID NO: 397454 - RNA, 19 nt, Homo sapiens
agaaaucccuagaagaauu

SEQ ID NO: 397455 - RNA, 19 nt, Homo sapiens
ggauauagcuuugagaaac

SEQ ID NO: 397456 - RNA, 19 nt, Homo sapiens
gaacacaacaaacuuaaag

SEQ ID NO: 397457 - RNA, 19 nt, Homo sapiens
gcucauggaugcaaaucuu

SEQ ID NO: 397458 - RNA, 19 nt, Homo sapiens
acagagagcuaguucuuau

SEQ ID NO: 397459 - RNA, 19 nt, Homo sapiens
gaagcuaagccgaccauuu

SEQ ID NO: 397460 - RNA, 19 nt, Homo sapiens
ucaaugaugugucuucaau

SEQ ID NO: 397461 - RNA, 19 nt, Homo sapiens
ccacagaaaucccuagaag

SEQ ID NO: 397462 - RNA, 19 nt, Homo sapiens
gaagcaagcgugacaacaa

SEQ ID NO: 397463 - RNA, 19 nt, Homo sapiens
cucaggagcucaaggaaua

SEQ ID NO: 397464 - RNA, 19 nt, Homo sapiens
gaugacgccuuauguagug

SEQ ID NO: 397465 - RNA, 19 nt, Homo sapiens
ugaaagggaacacacaaua

SEQ ID NO: 397466 - RNA, 19 nt, Homo sapiens
gaucaguggaauaaaguua

SEQ ID NO: 397467 - RNA, 19 nt, Homo sapiens
gacaagcaguuagaugaaa

SEQ ID NO: 397468 - RNA, 19 nt, Homo sapiens
acagaaaucccuagaagaa

SEQ ID NO: 397469 - RNA, 19 nt, Homo sapiens
acaauucaguggucuuauu

SEQ ID NO: 397470 - RNA, 19 nt, Homo sapiens
caccaaagaucccugacaa

SEQ ID NO: 397471 - RNA, 19 nt, Homo sapiens
ggaacaccauguccugaau

SEQ ID NO: 397472 - RNA, 19 nt, Homo sapiens
aaccaagaauggaguuaua

SEQ ID NO: 397473 - RNA, 19 nt, Homo sapiens
gaaagggaacacacaauag

SEQ ID NO: 397474 - RNA, 19 nt, Homo sapiens
agauggagcuagaucauga

SEQ ID NO: 397475 - RNA, 19 nt, Homo sapiens
ucagaacacaacaaacuua

SEQ ID NO: 397476 - RNA, 19 nt, Homo sapiens
gaaaacagaccuaaauaug

SEQ ID NO: 397477 - RNA, 19 nt, Homo sapiens
ggaacgaguuuuaugauga

SEQ ID NO: 397478 - RNA, 19 nt, Homo sapiens
gcaagcgugacaacaauuu

SEQ ID NO: 397479 - RNA, 19 nt, Homo sapiens
cuagaagaauuucaagaug

SEQ ID NO: 397480 - RNA, 19 nt, Homo sapiens
gaaauguugcaaucaagaa

SEQ ID NO: 397481 - RNA, 19 nt, Homo sapiens
aaacagaccuaaauaugcu

SEQ ID NO: 397482 - RNA, 19 nt, Homo sapiens
gacuuaaagcccaguaaua

SEQ ID NO: 397483 - RNA, 19 nt, Homo sapiens
gaaagaaauguugcaauca

SEQ ID NO: 397484 - RNA, 19 nt, Homo sapiens
gggagucgguuagucauug

SEQ ID NO: 397485 - RNA, 19 nt, Homo sapiens
gaggagagaaccaagaaug

SEQ ID NO: 397486 - RNA, 19 nt, Homo sapiens
caacacccguacaucaaug

SEQ ID NO: 397487 - RNA, 19 nt, Homo sapiens
gcccaguaauauaguagua

SEQ ID NO: 397488 - RNA, 19 nt, Homo sapiens
ggcaugggcuacaaggaaa

SEQ ID NO: 397489 - RNA, 19 nt, Homo sapiens
ggaaucaagcaccuucauu

SEQ ID NO: 397490 - RNA, 19 nt, Homo sapiens
agagcuaguucuuaugaaa

SEQ ID NO: 397491 - RNA, 19 nt, Homo sapiens
ggagucgguuagucauuga

SEQ ID NO: 397492 - RNA, 19 nt, Homo sapiens
gaacaccauguccugaauu

SEQ ID NO: 397493 - RNA, 19 nt, Homo sapiens
ggaauaguaugcgcagcuu

SEQ ID NO: 397494 - RNA, 19 nt, Homo sapiens
uguccuaccuucucuauca

SEQ ID NO: 397495 - RNA, 19 nt, Homo sapiens
aaacaauucaguggucuua

SEQ ID NO: 397496 - RNA, 19 nt, Homo sapiens
ccucugggcugcuguagau

SEQ ID NO: 397497 - RNA, 19 nt, Homo sapiens
gaaccaagaauggaguuau

SEQ ID NO: 397498 - RNA, 19 nt, Homo sapiens
ccaaaaugcugguaauaga

SEQ ID NO: 397499 - RNA, 19 nt, Homo sapiens
gauauagcuuugagaaacu

SEQ ID NO: 397500 - RNA, 19 nt, Homo sapiens
gaagaaacugcaaccaaca

SEQ ID NO: 397501 - RNA, 19 nt, Homo sapiens
caauucaguggucuuauuu

SEQ ID NO: 397502 - RNA, 19 nt, Homo sapiens
ugaugugucuucaauguca

SEQ ID NO: 397503 - RNA, 19 nt, Homo sapiens
gcuagaucaugaaagaaug

SEQ ID NO: 397504 - RNA, 19 nt, Homo sapiens
gaagcuccaccaccaaaga

SEQ ID NO: 397505 - RNA, 19 nt, Homo sapiens
guccugaauucaugaagaa

SEQ ID NO: 397506 - RNA, 19 nt, Homo sapiens
ggacuuaaagcccaguaau

SEQ ID NO: 397507 - RNA, 19 nt, Homo sapiens
aaugaugugucuucaaugu

SEQ ID NO: 397508 - RNA, 19 nt, Homo sapiens
uagaagaguggaaagaauu

SEQ ID NO: 397509 - RNA, 19 nt, Homo sapiens
gagagcuaguucuuaugaa

SEQ ID NO: 397510 - RNA, 19 nt, Homo sapiens
gggcugcuguagaugacua

SEQ ID NO: 397511 - RNA, 19 nt, Homo sapiens
gugcagcagugaucaaugg

SEQ ID NO: 397512 - RNA, 19 nt, Homo sapiens
ggacugcaggaacgaguuu

SEQ ID NO: 397513 - RNA, 19 nt, Homo sapiens
ggagagaaccaagaaugga

SEQ ID NO: 397514 - RNA, 19 nt, Homo sapiens
ugacucagaacacaacaaa

SEQ ID NO: 397515 - RNA, 19 nt, Homo sapiens
ugauugcacuuugaagauu

SEQ ID NO: 397516 - RNA, 19 nt, Homo sapiens
aagcuaagccgaccauuuc

SEQ ID NO: 397517 - RNA, 19 nt, Homo sapiens
aaagggaacacacaauaga

SEQ ID NO: 397518 - RNA, 19 nt, Homo sapiens
cagaacacaacaaacuuaa

SEQ ID NO: 397519 - RNA, 19 nt, Homo sapiens
ggaaaacguugacauuugg

SEQ ID NO: 397520 - RNA, 19 nt, Homo sapiens
cuuaaagcccaguaauaua

SEQ ID NO: 397521 - RNA, 19 nt, Homo sapiens
uaucagaugcuguguggaa

SEQ ID NO: 397522 - RNA, 19 nt, Homo sapiens
gccaagugauucagaugga

SEQ ID NO: 397523 - RNA, 19 nt, Homo sapiens
gaauaguaugcgcagcuua

SEQ ID NO: 397524 - RNA, 19 nt, Homo sapiens
caucgucgucugucaauga

SEQ ID NO: 397525 - RNA, 19 nt, Homo sapiens
gaacacacaauagaagagu

SEQ ID NO: 397526 - RNA, 19 nt, Homo sapiens
ucaggcaagggauuuguua

SEQ ID NO: 397527 - RNA, 19 nt, Homo sapiens
gaccuaaauaugcuggaua

SEQ ID NO: 397528 - RNA, 19 nt, Homo sapiens
uuaaagcccaguaauauag

SEQ ID NO: 397529 - RNA, 19 nt, Homo sapiens
aagcaagcgugacaacaau

SEQ ID NO: 397530 - RNA, 19 nt, Homo sapiens
gaugaaagggaacacacaa

SEQ ID NO: 397531 - RNA, 19 nt, Homo sapiens
gauugcacuuugaagauuc

SEQ ID NO: 397532 - RNA, 19 nt, Homo sapiens
guguagagauuggagauuc

SEQ ID NO: 397533 - RNA, 19 nt, Homo sapiens
cuacagagagcuaguucuu

SEQ ID NO: 397534 - RNA, 19 nt, Homo sapiens
uaugaugacgccuuaugua

SEQ ID NO: 397535 - RNA, 19 nt, Homo sapiens
aaagcccaguaauauagua

SEQ ID NO: 397536 - RNA, 19 nt, Homo sapiens
ugucuucaaugucaacaga

SEQ ID NO: 397537 - RNA, 19 nt, Homo sapiens
gcagcccucuccuuuaggu

SEQ ID NO: 397538 - RNA, 19 nt, Homo sapiens
uaugaugccauucuugaaa

SEQ ID NO: 397539 - RNA, 19 nt, Homo sapiens
gagcuaguucuuaugaaau

SEQ ID NO: 397540 - RNA, 19 nt, Homo sapiens
gaagaguggaaagaauuga

SEQ ID NO: 397541 - RNA, 19 nt, Homo sapiens
auagaagaguggaaagaau

SEQ ID NO: 397542 - RNA, 19 nt, Homo sapiens
ggacuuacguugaaaacag

SEQ ID NO: 397543 - RNA, 19 nt, Homo sapiens
ccagguacagaucauauug

SEQ ID NO: 397544 - RNA, 19 nt, Homo sapiens
cagaugcuguguggaauca

SEQ ID NO: 397545 - RNA, 19 nt, Homo sapiens
ugauucagauggagcuaga

SEQ ID NO: 397546 - RNA, 19 nt, Homo sapiens
gggaacacacaauagaaga

SEQ ID NO: 397547 - RNA, 19 nt, Homo sapiens
ugacaagcaguuagaugaa

SEQ ID NO: 397548 - RNA, 19 nt, Homo sapiens
caaagaucccugacaagca

SEQ ID NO: 397549 - RNA, 19 nt, Homo sapiens
ggagcuagaucaugaaaga

SEQ ID NO: 397550 - RNA, 19 nt, Homo sapiens
gagaaacucuucccugaug

SEQ ID NO: 397551 - RNA, 19 nt, Homo sapiens
ucacaguccugaaacgaua

SEQ ID NO: 397552 - RNA, 19 nt, Homo sapiens
ugaaagaaauguugcaauc

SEQ ID NO: 397553 - RNA, 19 nt, Homo sapiens
gauuggagauucuacauuc

SEQ ID NO: 397554 - RNA, 19 nt, Homo sapiens
agaaaucccuagaagaauu

SEQ ID NO: 397555 - RNA, 19 nt, Homo sapiens
ggauauagcuuugagaaac

SEQ ID NO: 397556 - RNA, 19 nt, Homo sapiens
gaacacaacaaacuuaaag

SEQ ID NO: 397557 - RNA, 19 nt, Homo sapiens
gcucauggaugcaaaucuu

SEQ ID NO: 397558 - RNA, 19 nt, Homo sapiens
acagagagcuaguucuuau

SEQ ID NO: 397559 - RNA, 19 nt, Homo sapiens
gaagcuaagccgaccauuu

SEQ ID NO: 397560 - RNA, 19 nt, Homo sapiens
ucaaugaugugucuucaau

SEQ ID NO: 397561 - RNA, 19 nt, Homo sapiens
ccacagaaaucccuagaag

SEQ ID NO: 397562 - RNA, 19 nt, Homo sapiens
gaagcaagcgugacaacaa

SEQ ID NO: 397563 - RNA, 19 nt, Homo sapiens
cucaggagcucaaggaaua

SEQ ID NO: 397564 - RNA, 19 nt, Homo sapiens
gaugacgccuuauguagug

SEQ ID NO: 397565 - RNA, 19 nt, Homo sapiens
ugaaagggaacacacaaua

SEQ ID NO: 397566 - RNA, 19 nt, Homo sapiens
gaucaguggaauaaaguua

SEQ ID NO: 397567 - RNA, 19 nt, Homo sapiens
gacaagcaguuagaugaaa

SEQ ID NO: 397568 - RNA, 19 nt, Homo sapiens
acagaaaucccuagaagaa

SEQ ID NO: 397569 - RNA, 19 nt, Homo sapiens
acaauucaguggucuuauu

SEQ ID NO: 397570 - RNA, 19 nt, Homo sapiens
caccaaagaucccugacaa

SEQ ID NO: 397571 - RNA, 19 nt, Homo sapiens
ggaacaccauguccugaau

SEQ ID NO: 397572 - RNA, 19 nt, Homo sapiens
aaccaagaauggaguuaua

SEQ ID NO: 397573 - RNA, 19 nt, Homo sapiens
gaaagggaacacacaauag

SEQ ID NO: 397574 - RNA, 19 nt, Homo sapiens
agauggagcuagaucauga

SEQ ID NO: 397575 - RNA, 19 nt, Homo sapiens
ucagaacacaacaaacuua

SEQ ID NO: 397576 - RNA, 19 nt, Homo sapiens
gaaaacagaccuaaauaug

SEQ ID NO: 397577 - RNA, 19 nt, Homo sapiens
ggaacgaguuuuaugauga

SEQ ID NO: 397578 - RNA, 19 nt, Homo sapiens
gcaagcgugacaacaauuu

SEQ ID NO: 397579 - RNA, 19 nt, Homo sapiens
cuagaagaauuucaagaug

SEQ ID NO: 397580 - RNA, 19 nt, Homo sapiens
gaaauguugcaaucaagaa

SEQ ID NO: 397581 - RNA, 19 nt, Homo sapiens
aaacagaccuaaauaugcu

SEQ ID NO: 397582 - RNA, 19 nt, Homo sapiens
gacuuaaagcccaguaaua

SEQ ID NO: 397583 - RNA, 19 nt, Homo sapiens
gaaagaaauguugcaauca

SEQ ID NO: 397584 - RNA, 19 nt, Homo sapiens
gggagucgguuagucauug

SEQ ID NO: 397585 - RNA, 19 nt, Homo sapiens
gaggagagaaccaagaaug

SEQ ID NO: 397586 - RNA, 19 nt, Homo sapiens
caacacccguacaucaaug

SEQ ID NO: 397587 - RNA, 19 nt, Homo sapiens
gcccaguaauauaguagua

SEQ ID NO: 397588 - RNA, 19 nt, Homo sapiens
ggcaugggcuacaaggaaa

SEQ ID NO: 397589 - RNA, 19 nt, Homo sapiens
ggaaucaagcaccuucauu

SEQ ID NO: 397590 - RNA, 19 nt, Homo sapiens
agagcuaguucuuaugaaa

SEQ ID NO: 397591 - RNA, 19 nt, Homo sapiens
ggagucgguuagucauuga

SEQ ID NO: 397592 - RNA, 19 nt, Homo sapiens
gaacaccauguccugaauu

SEQ ID NO: 397593 - RNA, 19 nt, Homo sapiens
ggaauaguaugcgcagcuu

SEQ ID NO: 397594 - RNA, 19 nt, Homo sapiens
uguccuaccuucucuauca

SEQ ID NO: 397595 - RNA, 19 nt, Homo sapiens
aaacaauucaguggucuua

SEQ ID NO: 397596 - RNA, 19 nt, Homo sapiens
gagaaaugguuugccacaa

SEQ ID NO: 397597 - RNA, 19 nt, Homo sapiens
ccucugggcugcuguagau

SEQ ID NO: 397598 - RNA, 19 nt, Homo sapiens
gaaccaagaauggaguuau

SEQ ID NO: 397599 - RNA, 19 nt, Homo sapiens
ccaaaaugcugguaauaga

SEQ ID NO: 397600 - RNA, 19 nt, Homo sapiens
gauauagcuuugagaaacu

SEQ ID NO: 397601 - RNA, 19 nt, Homo sapiens
gaagaaacugcaaccaaca

SEQ ID NO: 397602 - RNA, 19 nt, Homo sapiens
caauucaguggucuuauuu

SEQ ID NO: 397603 - RNA, 19 nt, Homo sapiens
ugaugugucuucaauguca

SEQ ID NO: 397604 - RNA, 19 nt, Homo sapiens
gcuagaucaugaaagaaug

SEQ ID NO: 397605 - RNA, 19 nt, Homo sapiens
gaagcuccaccaccaaaga

SEQ ID NO: 397606 - RNA, 19 nt, Homo sapiens
guccugaauucaugaagaa

SEQ ID NO: 397607 - RNA, 19 nt, Homo sapiens
ggacuuaaagcccaguaau

SEQ ID NO: 397608 - RNA, 19 nt, Homo sapiens
aaugaugugucuucaaugu

SEQ ID NO: 397609 - RNA, 19 nt, Homo sapiens
uagaagaguggaaagaauu

SEQ ID NO: 397610 - RNA, 19 nt, Homo sapiens
gagagcuaguucuuaugaa

SEQ ID NO: 397611 - RNA, 19 nt, Homo sapiens
gggcugcuguagaugacua

SEQ ID NO: 397612 - RNA, 19 nt, Homo sapiens
gugcagcagugaucaaugg

SEQ ID NO: 397613 - RNA, 19 nt, Homo sapiens
ggacugcaggaacgaguuu

SEQ ID NO: 397614 - RNA, 19 nt, Homo sapiens
ggagagaaccaagaaugga

SEQ ID NO: 397615 - RNA, 19 nt, Homo sapiens
ugacucagaacacaacaaa

SEQ ID NO: 397616 - RNA, 19 nt, Homo sapiens
ugauugcacuuugaagauu

SEQ ID NO: 397617 - RNA, 19 nt, Homo sapiens
aagcuaagccgaccauuuc

SEQ ID NO: 397618 - RNA, 19 nt, Homo sapiens
aaagggaacacacaauaga

SEQ ID NO: 397619 - RNA, 19 nt, Homo sapiens
cagaacacaacaaacuuaa

SEQ ID NO: 397620 - RNA, 19 nt, Homo sapiens
cuuaaagcccaguaauaua

SEQ ID NO: 397621 - RNA, 19 nt, Homo sapiens
uaucagaugcuguguggaa

SEQ ID NO: 397622 - RNA, 19 nt, Homo sapiens
gccaagugauucagaugga

SEQ ID NO: 397623 - RNA, 19 nt, Homo sapiens
gaauaguaugcgcagcuua

SEQ ID NO: 397624 - RNA, 19 nt, Homo sapiens
caucgucgucugucaauga

SEQ ID NO: 397625 - RNA, 19 nt, Homo sapiens
gaacacacaauagaagagu

SEQ ID NO: 397626 - RNA, 19 nt, Homo sapiens
ucaggcaagggauuuguua

SEQ ID NO: 397627 - RNA, 19 nt, Homo sapiens
gaccuaaauaugcuggaua

SEQ ID NO: 397628 - RNA, 19 nt, Homo sapiens
uuaaagcccaguaauauag

SEQ ID NO: 397629 - RNA, 19 nt, Homo sapiens
aagcaagcgugacaacaau

SEQ ID NO: 397630 - RNA, 19 nt, Homo sapiens
gaugaaagggaacacacaa

SEQ ID NO: 397631 - RNA, 19 nt, Homo sapiens
gauugcacuuugaagauuc

SEQ ID NO: 397632 - RNA, 19 nt, Homo sapiens
guguagagauuggagauuc

SEQ ID NO: 397633 - RNA, 19 nt, Homo sapiens
cuacagagagcuaguucuu

SEQ ID NO: 397634 - RNA, 19 nt, Homo sapiens
uaugaugacgccuuaugua

SEQ ID NO: 397635 - RNA, 19 nt, Homo sapiens
aaagcccaguaauauagua

SEQ ID NO: 397636 - RNA, 19 nt, Homo sapiens
ugucuucaaugucaacaga

SEQ ID NO: 397637 - RNA, 19 nt, Homo sapiens
uaugaugccauucuugaaa

SEQ ID NO: 397638 - RNA, 19 nt, Homo sapiens
gcagcccucuccuuuaggu

SEQ ID NO: 397639 - RNA, 19 nt, Homo sapiens
gagcuaguucuuaugaaau

SEQ ID NO: 397640 - RNA, 19 nt, Homo sapiens
gaagaguggaaagaauuga

SEQ ID NO: 397641 - RNA, 19 nt, Homo sapiens
auagaagaguggaaagaau

SEQ ID NO: 397642 - RNA, 19 nt, Homo sapiens
ggacuuacguugaaaacag

SEQ ID NO: 397643 - RNA, 19 nt, Homo sapiens
cagaugcuguguggaauca

SEQ ID NO: 397644 - RNA, 19 nt, Homo sapiens
ugauucagauggagcuaga

SEQ ID NO: 397645 - RNA, 19 nt, Homo sapiens
gggaacacacaauagaaga

SEQ ID NO: 397646 - RNA, 19 nt, Homo sapiens
ugacaagcaguuagaugaa

SEQ ID NO: 397647 - RNA, 19 nt, Homo sapiens
caaagaucccugacaagca

SEQ ID NO: 397648 - RNA, 19 nt, Homo sapiens
agagagcuaguucuuauga

SEQ ID NO: 397649 - RNA, 19 nt, Homo sapiens
ggaaggagcucacuuacca

SEQ ID NO: 397650 - RNA, 19 nt, Homo sapiens
ggagcucacuuaccaggaa

SEQ ID NO: 397651 - RNA, 19 nt, Homo sapiens
gcccugagguucuggcaaa

SEQ ID NO: 397652 - RNA, 19 nt, Homo sapiens
ucaacuggaugcauuacaa

SEQ ID NO: 397653 - RNA, 19 nt, Homo sapiens
ugaacaacaucgucaagug

SEQ ID NO: 397654 - RNA, 19 nt, Homo sapiens
ggagaugaccggcuaugug

SEQ ID NO: 397655 - RNA, 19 nt, Homo sapiens
ggcaggagcugaacaagac

SEQ ID NO: 397656 - RNA, 19 nt, Homo sapiens
aaagcugccuggagucuug

SEQ ID NO: 397657 - RNA, 19 nt, Homo sapiens
gcgacgagcacguucaauu

SEQ ID NO: 397658 - RNA, 19 nt, Homo sapiens
gcgccgaccugaacaacau

SEQ ID NO: 397659 - RNA, 19 nt, Homo sapiens
cgacgagcacguucaauuc

SEQ ID NO: 397660 - RNA, 19 nt, Homo sapiens
ggccauagaccuccuugga

SEQ ID NO: 397661 - RNA, 19 nt, Homo sapiens
gccuugggcucucuucugu

SEQ ID NO: 397662 - RNA, 19 nt, Homo sapiens
gcaccucccacacuccuau

SEQ ID NO: 397663 - RNA, 19 nt, Homo sapiens
acacuccuauggucacaga

SEQ ID NO: 397664 - RNA, 19 nt, Homo sapiens
gaagguggcggugaagaag

SEQ ID NO: 397665 - RNA, 19 nt, Homo sapiens
guaggagucugggcacaag

SEQ ID NO: 397666 - RNA, 19 nt, Homo sapiens
gccauagaccuccuuggaa

SEQ ID NO: 397667 - RNA, 19 nt, Homo sapiens
uuccacagcuggccugguu

SEQ ID NO: 397668 - RNA, 19 nt, Homo sapiens
ccaggugucaaaugagaaa

SEQ ID NO: 397669 - RNA, 19 nt, Homo sapiens
agaaggaccugagcagcau

SEQ ID NO: 397670 - RNA, 19 nt, Homo sapiens
gagcgacgagcacguucaa

SEQ ID NO: 397671 - RNA, 19 nt, Homo sapiens
ugaagcgcaucauggaagu

SEQ ID NO: 397672 - RNA, 19 nt, Homo sapiens
ucaguccucuuuccuuguc

SEQ ID NO: 397673 - RNA, 19 nt, Homo sapiens
ugucagggcacaugugaug

SEQ ID NO: 397674 - RNA, 19 nt, Homo sapiens
caaccaaacaguggauauc

SEQ ID NO: 397675 - RNA, 19 nt, Homo sapiens
guguggcucugcccuggaa

SEQ ID NO: 397676 - RNA, 19 nt, Homo sapiens
gcaacguggcugugaacga

SEQ ID NO: 397677 - RNA, 19 nt, Homo sapiens
cagaggccgagccauauga

SEQ ID NO: 397678 - RNA, 19 nt, Homo sapiens
ggaccugagcagcaucuuc

SEQ ID NO: 397679 - RNA, 19 nt, Homo sapiens
guaccgggcaccugagauc

SEQ ID NO: 397680 - RNA, 19 nt, Homo sapiens
agccagaggccgagccaua

SEQ ID NO: 397681 - RNA, 19 nt, Homo sapiens
agaagguggcggugaagaa

SEQ ID NO: 397682 - RNA, 19 nt, Homo sapiens
gccagaggccgagccauau

SEQ ID NO: 397683 - RNA, 19 nt, Homo sapiens
gggaagcgacuacauugac

SEQ ID NO: 397684 - RNA, 19 nt, Homo sapiens
ccgggaagcgacuacauug

SEQ ID NO: 397685 - RNA, 19 nt, Homo sapiens
cuggaugcauuacaaccaa

SEQ ID NO: 397686 - RNA, 19 nt, Homo sapiens
gugcuugccauguguagga

SEQ ID NO: 397687 - RNA, 19 nt, Homo sapiens
gaagcacgagaacgucauc

SEQ ID NO: 397688 - RNA, 19 nt, Homo sapiens
ggagaggcagagccagugu

SEQ ID NO: 397689 - RNA, 19 nt, Homo sapiens
gcacgcuggaggaguggaa

SEQ ID NO: 397690 - RNA, 19 nt, Homo sapiens
gcugaagcgcaucauggaa

SEQ ID NO: 397691 - RNA, 19 nt, Homo sapiens
cggcaggagcugaacaaga

SEQ ID NO: 397692 - RNA, 19 nt, Homo sapiens
cccaaggccagcagccaua

SEQ ID NO: 397693 - RNA, 19 nt, Homo sapiens
ccacagcuggccugguuuc

SEQ ID NO: 397694 - RNA, 19 nt, Homo sapiens
cuggcagccuggagauuga

SEQ ID NO: 397695 - RNA, 19 nt, Homo sapiens
aggccgagccauaugauga

SEQ ID NO: 397696 - RNA, 19 nt, Homo sapiens
ccagaggccgagccauaug

SEQ ID NO: 397697 - RNA, 19 nt, Homo sapiens
gcugagcgacgagcacguu

SEQ ID NO: 397698 - RNA, 19 nt, Homo sapiens
ggaaggagcucacuuacca

SEQ ID NO: 397699 - RNA, 19 nt, Homo sapiens
ggagcucacuuaccaggaa

SEQ ID NO: 397700 - RNA, 19 nt, Homo sapiens
gcccugagguucuggcaaa

SEQ ID NO: 397701 - RNA, 19 nt, Homo sapiens
ucaacuggaugcauuacaa

SEQ ID NO: 397702 - RNA, 19 nt, Homo sapiens
ugaacaacaucgucaagug

SEQ ID NO: 397703 - RNA, 19 nt, Homo sapiens
ggagaugaccggcuaugug

SEQ ID NO: 397704 - RNA, 19 nt, Homo sapiens
ggcaggagcugaacaagac

SEQ ID NO: 397705 - RNA, 19 nt, Homo sapiens
gcgacgagcacguucaauu

SEQ ID NO: 397706 - RNA, 19 nt, Homo sapiens
gcgccgaccugaacaacau

SEQ ID NO: 397707 - RNA, 19 nt, Homo sapiens
cgacgagcacguucaauuc

SEQ ID NO: 397708 - RNA, 19 nt, Homo sapiens
ggccauagaccuccuugga

SEQ ID NO: 397709 - RNA, 19 nt, Homo sapiens
gcaccucccacacuccuau

SEQ ID NO: 397710 - RNA, 19 nt, Homo sapiens
acacuccuauggucacaga

SEQ ID NO: 397711 - RNA, 19 nt, Homo sapiens
gaagguggcggugaagaag

SEQ ID NO: 397712 - RNA, 19 nt, Homo sapiens
gccauagaccuccuuggaa

SEQ ID NO: 397713 - RNA, 19 nt, Homo sapiens
uuccacagcuggccugguu

SEQ ID NO: 397714 - RNA, 19 nt, Homo sapiens
ggagaaucuacacgcauga

SEQ ID NO: 397715 - RNA, 19 nt, Homo sapiens
agaaggaccugagcagcau

SEQ ID NO: 397716 - RNA, 19 nt, Homo sapiens
gagcgacgagcacguucaa

SEQ ID NO: 397717 - RNA, 19 nt, Homo sapiens
ugaagcgcaucauggaagu

SEQ ID NO: 397718 - RNA, 19 nt, Homo sapiens
caaccaaacaguggauauc

SEQ ID NO: 397719 - RNA, 19 nt, Homo sapiens
guguggcucugcccuggaa

SEQ ID NO: 397720 - RNA, 19 nt, Homo sapiens
gcaacguggcugugaacga

SEQ ID NO: 397721 - RNA, 19 nt, Homo sapiens
cagaggccgagccauauga

SEQ ID NO: 397722 - RNA, 19 nt, Homo sapiens
ggaccugagcagcaucuuc

SEQ ID NO: 397723 - RNA, 19 nt, Homo sapiens
guaccgggcaccugagauc

SEQ ID NO: 397724 - RNA, 19 nt, Homo sapiens
agccagaggccgagccaua

SEQ ID NO: 397725 - RNA, 19 nt, Homo sapiens
agaagguggcggugaagaa

SEQ ID NO: 397726 - RNA, 19 nt, Homo sapiens
gccagaggccgagccauau

SEQ ID NO: 397727 - RNA, 19 nt, Homo sapiens
gggaagcgacuacauugac

SEQ ID NO: 397728 - RNA, 19 nt, Homo sapiens
ccgggaagcgacuacauug

SEQ ID NO: 397729 - RNA, 19 nt, Homo sapiens
cuggaugcauuacaaccaa

SEQ ID NO: 397730 - RNA, 19 nt, Homo sapiens
gaagcacgagaacgucauc

SEQ ID NO: 397731 - RNA, 19 nt, Homo sapiens
gcacgcuggaggaguggaa

SEQ ID NO: 397732 - RNA, 19 nt, Homo sapiens
gcugaagcgcaucauggaa

SEQ ID NO: 397733 - RNA, 19 nt, Homo sapiens
cggcaggagcugaacaaga

SEQ ID NO: 397734 - RNA, 19 nt, Homo sapiens
ccacagcuggccugguuuc

SEQ ID NO: 397735 - RNA, 19 nt, Homo sapiens
cuggcagccuggagauuga

SEQ ID NO: 397736 - RNA, 19 nt, Homo sapiens
aggccgagccauaugauga

SEQ ID NO: 397737 - RNA, 19 nt, Homo sapiens
gcugagcgacgagcacguu

SEQ ID NO: 397738 - RNA, 19 nt, Homo sapiens
ccagaggccgagccauaug

SEQ ID NO: 397739 - RNA, 19 nt, Homo sapiens
ggaaagagcuaauuuacaa

SEQ ID NO: 397740 - RNA, 19 nt, Homo sapiens
gcauucagcugguauaauu

SEQ ID NO: 397741 - RNA, 19 nt, Homo sapiens
gaaccaaacucaugcaaag

SEQ ID NO: 397742 - RNA, 19 nt, Homo sapiens
caagauguguauuugguua

SEQ ID NO: 397743 - RNA, 19 nt, Homo sapiens
aaagagagcuuaucgugaa

SEQ ID NO: 397744 - RNA, 19 nt, Homo sapiens
gaugauagguuagaaauag

SEQ ID NO: 397745 - RNA, 19 nt, Homo sapiens
gaagaaagaagcaagaaug

SEQ ID NO: 397746 - RNA, 19 nt, Homo sapiens
acaaagaagucauggauug

SEQ ID NO: 397747 - RNA, 19 nt, Homo sapiens
cagcagaguucaugaagaa

SEQ ID NO: 397748 - RNA, 19 nt, Homo sapiens
ccaaggcacugaccauauu

SEQ ID NO: 397749 - RNA, 19 nt, Homo sapiens
uagcaaaccugucagcauu

SEQ ID NO: 397750 - RNA, 19 nt, Homo sapiens
ggagcuggaucaugaaaga

SEQ ID NO: 397751 - RNA, 19 nt, Homo sapiens
gaaguuaucucuuaauccu

SEQ ID NO: 397752 - RNA, 19 nt, Homo sapiens
uagaguaggugaauuuguu

SEQ ID NO: 397753 - RNA, 19 nt, Homo sapiens
gcacugaccauauugauca

SEQ ID NO: 397754 - RNA, 19 nt, Homo sapiens
gguaugggcuacaaagaga

SEQ ID NO: 397755 - RNA, 19 nt, Homo sapiens
ccaaauaaucuuccaggua

SEQ ID NO: 397756 - RNA, 19 nt, Homo sapiens
gcaaaccugucagcauuga

SEQ ID NO: 397757 - RNA, 19 nt, Homo sapiens
gaauggaaagagcuaauuu

SEQ ID NO: 397758 - RNA, 19 nt, Homo sapiens
gcggaucucuguagacgaa

SEQ ID NO: 397759 - RNA, 19 nt, Homo sapiens
gaagaaagagaacaugcaa

SEQ ID NO: 397760 - RNA, 19 nt, Homo sapiens
gaucaguggaauaaaguua

SEQ ID NO: 397761 - RNA, 19 nt, Homo sapiens
gcaagaaugguguuguaaa

SEQ ID NO: 397762 - RNA, 19 nt, Homo sapiens
aaagagaacaugcaauuga

SEQ ID NO: 397763 - RNA, 19 nt, Homo sapiens
cagaugcuuugugguauua

SEQ ID NO: 397764 - RNA, 19 nt, Homo sapiens
aaaguauccuggaaucaaa

SEQ ID NO: 397765 - RNA, 19 nt, Homo sapiens
aagcaagaaugguguugua

SEQ ID NO: 397766 - RNA, 19 nt, Homo sapiens
agaaagagaacaugcaauu

SEQ ID NO: 397767 - RNA, 19 nt, Homo sapiens
uaaguaauuuggugucugu

SEQ ID NO: 397768 - RNA, 19 nt, Homo sapiens
ugauacaguucuugggaua

SEQ ID NO: 397769 - RNA, 19 nt, Homo sapiens
gaaagagaacaugcaauug

SEQ ID NO: 397770 - RNA, 19 nt, Homo sapiens
acaaagagaacguugauau

SEQ ID NO: 397771 - RNA, 19 nt, Homo sapiens
cuagaagaauuucaagaug

SEQ ID NO: 397772 - RNA, 19 nt, Homo sapiens
caagaaugguguuguaaaa

SEQ ID NO: 397773 - RNA, 19 nt, Homo sapiens
ggcugucgaugauagguua

SEQ ID NO: 397774 - RNA, 19 nt, Homo sapiens
aagagaacaugcaauugaa

SEQ ID NO: 397775 - RNA, 19 nt, Homo sapiens
gaacuuguccucuuaaaau

SEQ ID NO: 397776 - RNA, 19 nt, Homo sapiens
caucaucuguaacuguuga

SEQ ID NO: 397777 - RNA, 19 nt, Homo sapiens
caggugagcaguuagagua

SEQ ID NO: 397778 - RNA, 19 nt, Homo sapiens
ugauaggauugccugcuua

SEQ ID NO: 397779 - RNA, 19 nt, Homo sapiens
gggaguugauggaaccaaa

SEQ ID NO: 397780 - RNA, 19 nt, Homo sapiens
gagcuaauuuacaaagaag

SEQ ID NO: 397781 - RNA, 19 nt, Homo sapiens
caaaguauccuggaaucaa

SEQ ID NO: 397782 - RNA, 19 nt, Homo sapiens
cauuucaggugagcaguua

SEQ ID NO: 397783 - RNA, 19 nt, Homo sapiens
gaacaugcaauugaagaau

SEQ ID NO: 397784 - RNA, 19 nt, Homo sapiens
gauuguuugugcugcauuu

SEQ ID NO: 397785 - RNA, 19 nt, Homo sapiens
ccagaugcuuugugguauu

SEQ ID NO: 397786 - RNA, 19 nt, Homo sapiens
agaaauagcaaaccuguca

SEQ ID NO: 397787 - RNA, 19 nt, Homo sapiens
ggacagcgugcacuaacuu

SEQ ID NO: 397788 - RNA, 19 nt, Homo sapiens
gagcuuaucgugaacuugu

SEQ ID NO: 397789 - RNA, 19 nt, Homo sapiens
gauaaaaugaggcagaaua

SEQ ID NO: 397790 - RNA, 19 nt, Homo sapiens
gagaacaugcaauugaaga

SEQ ID NO: 397791 - RNA, 19 nt, Homo sapiens
gaauguccuaccuucuuua

SEQ ID NO: 397792 - RNA, 19 nt, Homo sapiens
ugaaggcugucgaugauag

SEQ ID NO: 397793 - RNA, 19 nt, Homo sapiens
gaugcuuugugguauuaaa

SEQ ID NO: 397794 - RNA, 19 nt, Homo sapiens
agaagaauuucaagaugug

SEQ ID NO: 397795 - RNA, 19 nt, Homo sapiens
ccaaacucaugcaaagaga

SEQ ID NO: 397796 - RNA, 19 nt, Homo sapiens
gaguugauggaaccaaaua

SEQ ID NO: 397797 - RNA, 19 nt, Homo sapiens
ggaagaaagaagcaagaau

SEQ ID NO: 397798 - RNA, 19 nt, Homo sapiens
ugggagagcuggugaaagg

SEQ ID NO: 397799 - RNA, 19 nt, Homo sapiens
guauuaaacaucugcauuc

SEQ ID NO: 397800 - RNA, 19 nt, Homo sapiens
uggaauuaauggaugcuaa

SEQ ID NO: 397801 - RNA, 19 nt, Homo sapiens
caacugugaggaauuaugu

SEQ ID NO: 397802 - RNA, 19 nt, Homo sapiens
aaacuucagccaacuguga

SEQ ID NO: 397803 - RNA, 19 nt, Homo sapiens
caaagagaacguugauauc

SEQ ID NO: 397804 - RNA, 19 nt, Homo sapiens
gaagucauccuggguaugg

SEQ ID NO: 397805 - RNA, 19 nt, Homo sapiens
gguauuaaacaucugcauu

SEQ ID NO: 397806 - RNA, 19 nt, Homo sapiens
gccuucagaugcagcagua

SEQ ID NO: 397807 - RNA, 19 nt, Homo sapiens
agccaacugugaggaauua

SEQ ID NO: 397808 - RNA, 19 nt, Homo sapiens
ggaagaaagagaacaugca

SEQ ID NO: 397809 - RNA, 19 nt, Homo sapiens
ggagagcuggugaaagguu

SEQ ID NO: 397810 - RNA, 19 nt, Homo sapiens
ugaagauccuugacuuugg

SEQ ID NO: 397811 - RNA, 19 nt, Homo sapiens
ucgugaacuuguccucuua

SEQ ID NO: 397812 - RNA, 19 nt, Homo sapiens
gagagcuuaucgugaacuu

SEQ ID NO: 397813 - RNA, 19 nt, Homo sapiens
gcaguuagaguaggugaau

SEQ ID NO: 397814 - RNA, 19 nt, Homo sapiens
ggaauuaugucgaaaacag

SEQ ID NO: 397815 - RNA, 19 nt, Homo sapiens
gugaacuuguccucuuaaa

SEQ ID NO: 397816 - RNA, 19 nt, Homo sapiens
gacaguuucucaucaucug

SEQ ID NO: 397817 - RNA, 19 nt, Homo sapiens
ugauggaaccaaauagaaa

SEQ ID NO: 397818 - RNA, 19 nt, Homo sapiens
uuucauccauguccacuga

SEQ ID NO: 397819 - RNA, 19 nt, Homo sapiens
gaaaacagaccaaaguauc

SEQ ID NO: 397820 - RNA, 19 nt, Homo sapiens
gaacaccaucagcagaguu

SEQ ID NO: 397821 - RNA, 19 nt, Homo sapiens
cagcugguauaauucauag

SEQ ID NO: 397822 - RNA, 19 nt, Homo sapiens
gaaacuaagccguccuuuu

SEQ ID NO: 397823 - RNA, 19 nt, Homo sapiens
ugaaaugcuugggaguuga

SEQ ID NO: 397824 - RNA, 19 nt, Homo sapiens
caucaugagcgacaguaaa

SEQ ID NO: 397825 - RNA, 19 nt, Homo sapiens
agucauggauugggaagaa

SEQ ID NO: 397826 - RNA, 19 nt, Homo sapiens
gaagaauggaaagagcuaa

SEQ ID NO: 397827 - RNA, 19 nt, Homo sapiens
ugugaggaauuaugucgaa

SEQ ID NO: 397828 - RNA, 19 nt, Homo sapiens
gucaguggguugcaucaug

SEQ ID NO: 397829 - RNA, 19 nt, Homo sapiens
uaauggaugcuaacuuaug

SEQ ID NO: 397830 - RNA, 19 nt, Homo sapiens
agaccaaaguauccuggaa

SEQ ID NO: 397831 - RNA, 19 nt, Homo sapiens
gcuuggacuugcccaucua

SEQ ID NO: 397832 - RNA, 19 nt, Homo sapiens
aggauugccugcuuagaug

SEQ ID NO: 397833 - RNA, 19 nt, Homo sapiens
cugaaaugcuugggaguug

SEQ ID NO: 397834 - RNA, 19 nt, Homo sapiens
cuugaaggcugucgaugau

SEQ ID NO: 397835 - RNA, 19 nt, Homo sapiens
uuacaaagaagucauggau

SEQ ID NO: 397836 - RNA, 19 nt, Homo sapiens
acccauacaucacuguuug

SEQ ID NO: 397837 - RNA, 19 nt, Homo sapiens
acaagcggaucucuguaga

SEQ ID NO: 397838 - RNA, 19 nt, Homo sapiens
aaacaagucaagccagaga

SEQ ID NO: 397839 - RNA, 19 nt, Homo sapiens
ggaaagagcuaauuuacaa

SEQ ID NO: 397840 - RNA, 19 nt, Homo sapiens
gcauucagcugguauaauu

SEQ ID NO: 397841 - RNA, 19 nt, Homo sapiens
gaaccaaacucaugcaaag

SEQ ID NO: 397842 - RNA, 19 nt, Homo sapiens
caagauguguauuugguua

SEQ ID NO: 397843 - RNA, 19 nt, Homo sapiens
aaagagagcuuaucgugaa

SEQ ID NO: 397844 - RNA, 19 nt, Homo sapiens
gaugauagguuagaaauag

SEQ ID NO: 397845 - RNA, 19 nt, Homo sapiens
gaagaaagaagcaagaaug

SEQ ID NO: 397846 - RNA, 19 nt, Homo sapiens
acaaagaagucauggauug

SEQ ID NO: 397847 - RNA, 19 nt, Homo sapiens
cagcagaguucaugaagaa

SEQ ID NO: 397848 - RNA, 19 nt, Homo sapiens
ccaaggcacugaccauauu

SEQ ID NO: 397849 - RNA, 19 nt, Homo sapiens
uagcaaaccugucagcauu

SEQ ID NO: 397850 - RNA, 19 nt, Homo sapiens
cagcacagaugcagcagua

SEQ ID NO: 397851 - RNA, 19 nt, Homo sapiens
ggagcuggaucaugaaaga

SEQ ID NO: 397852 - RNA, 19 nt, Homo sapiens
gaaguuaucucuuaauccu

SEQ ID NO: 397853 - RNA, 19 nt, Homo sapiens
uagaguaggugaauuuguu

SEQ ID NO: 397854 - RNA, 19 nt, Homo sapiens
gcacugaccauauugauca

SEQ ID NO: 397855 - RNA, 19 nt, Homo sapiens
gguaugggcuacaaagaga

SEQ ID NO: 397856 - RNA, 19 nt, Homo sapiens
ccaaauaaucuuccaggua

SEQ ID NO: 397857 - RNA, 19 nt, Homo sapiens
gcaaaccugucagcauuga

SEQ ID NO: 397858 - RNA, 19 nt, Homo sapiens
gaauggaaagagcuaauuu

SEQ ID NO: 397859 - RNA, 19 nt, Homo sapiens
gcggaucucuguagacgaa

SEQ ID NO: 397860 - RNA, 19 nt, Homo sapiens
gaagaaagagaacaugcaa

SEQ ID NO: 397861 - RNA, 19 nt, Homo sapiens
gaucaguggaauaaaguua

SEQ ID NO: 397862 - RNA, 19 nt, Homo sapiens
gcaagaaugguguuguaaa

SEQ ID NO: 397863 - RNA, 19 nt, Homo sapiens
aaagagaacaugcaauuga

SEQ ID NO: 397864 - RNA, 19 nt, Homo sapiens
cagaugcuuugugguauua

SEQ ID NO: 397865 - RNA, 19 nt, Homo sapiens
aaaguauccuggaaucaaa

SEQ ID NO: 397866 - RNA, 19 nt, Homo sapiens
aagcaagaaugguguugua

SEQ ID NO: 397867 - RNA, 19 nt, Homo sapiens
agaaagagaacaugcaauu

SEQ ID NO: 397868 - RNA, 19 nt, Homo sapiens
uaaguaauuuggugucugu

SEQ ID NO: 397869 - RNA, 19 nt, Homo sapiens
ugauacaguucuugggaua

SEQ ID NO: 397870 - RNA, 19 nt, Homo sapiens
gaaagagaacaugcaauug

SEQ ID NO: 397871 - RNA, 19 nt, Homo sapiens
acaaagagaacguugauau

SEQ ID NO: 397872 - RNA, 19 nt, Homo sapiens
cuagaagaauuucaagaug

SEQ ID NO: 397873 - RNA, 19 nt, Homo sapiens
caagaaugguguuguaaaa

SEQ ID NO: 397874 - RNA, 19 nt, Homo sapiens
ggcugucgaugauagguua

SEQ ID NO: 397875 - RNA, 19 nt, Homo sapiens
aagagaacaugcaauugaa

SEQ ID NO: 397876 - RNA, 19 nt, Homo sapiens
gaacuuguccucuuaaaau

SEQ ID NO: 397877 - RNA, 19 nt, Homo sapiens
caucaucuguaacuguuga

SEQ ID NO: 397878 - RNA, 19 nt, Homo sapiens
caggugagcaguuagagua

SEQ ID NO: 397879 - RNA, 19 nt, Homo sapiens
ugauaggauugccugcuua

SEQ ID NO: 397880 - RNA, 19 nt, Homo sapiens
gggaguugauggaaccaaa

SEQ ID NO: 397881 - RNA, 19 nt, Homo sapiens
gagcuaauuuacaaagaag

SEQ ID NO: 397882 - RNA, 19 nt, Homo sapiens
caaaguauccuggaaucaa

SEQ ID NO: 397883 - RNA, 19 nt, Homo sapiens
cauuucaggugagcaguua

SEQ ID NO: 397884 - RNA, 19 nt, Homo sapiens
gaacaugcaauugaagaau

SEQ ID NO: 397885 - RNA, 19 nt, Homo sapiens
gauuguuugugcugcauuu

SEQ ID NO: 397886 - RNA, 19 nt, Homo sapiens
ccagaugcuuugugguauu

SEQ ID NO: 397887 - RNA, 19 nt, Homo sapiens
agaaauagcaaaccuguca

SEQ ID NO: 397888 - RNA, 19 nt, Homo sapiens
ggacagcgugcacuaacuu

SEQ ID NO: 397889 - RNA, 19 nt, Homo sapiens
gagcuuaucgugaacuugu

SEQ ID NO: 397890 - RNA, 19 nt, Homo sapiens
gauaaaaugaggcagaaua

SEQ ID NO: 397891 - RNA, 19 nt, Homo sapiens
gagaacaugcaauugaaga

SEQ ID NO: 397892 - RNA, 19 nt, Homo sapiens
gaauguccuaccuucuuua

SEQ ID NO: 397893 - RNA, 19 nt, Homo sapiens
ugaaggcugucgaugauag

SEQ ID NO: 397894 - RNA, 19 nt, Homo sapiens
gaugcuuugugguauuaaa

SEQ ID NO: 397895 - RNA, 19 nt, Homo sapiens
agaagaauuucaagaugug

SEQ ID NO: 397896 - RNA, 19 nt, Homo sapiens
ccaaacucaugcaaagaga

SEQ ID NO: 397897 - RNA, 19 nt, Homo sapiens
gaguugauggaaccaaaua

SEQ ID NO: 397898 - RNA, 19 nt, Homo sapiens
ggaagaaagaagcaagaau

SEQ ID NO: 397899 - RNA, 19 nt, Homo sapiens
ugggagagcuggugaaagg

SEQ ID NO: 397900 - RNA, 19 nt, Homo sapiens
gaucagccuucagcacaga

SEQ ID NO: 397901 - RNA, 19 nt, Homo sapiens
guauuaaacaucugcauuc

SEQ ID NO: 397902 - RNA, 19 nt, Homo sapiens
uggaauuaauggaugcuaa

SEQ ID NO: 397903 - RNA, 19 nt, Homo sapiens
caacugugaggaauuaugu

SEQ ID NO: 397904 - RNA, 19 nt, Homo sapiens
aaacuucagccaacuguga

SEQ ID NO: 397905 - RNA, 19 nt, Homo sapiens
caaagagaacguugauauc

SEQ ID NO: 397906 - RNA, 19 nt, Homo sapiens
gaagucauccuggguaugg

SEQ ID NO: 397907 - RNA, 19 nt, Homo sapiens
gguauuaaacaucugcauu

SEQ ID NO: 397908 - RNA, 19 nt, Homo sapiens
agccaacugugaggaauua

SEQ ID NO: 397909 - RNA, 19 nt, Homo sapiens
ggaagaaagagaacaugca

SEQ ID NO: 397910 - RNA, 19 nt, Homo sapiens
ggagagcuggugaaagguu

SEQ ID NO: 397911 - RNA, 19 nt, Homo sapiens
ugaagauccuugacuuugg

SEQ ID NO: 397912 - RNA, 19 nt, Homo sapiens
ucgugaacuuguccucuua

SEQ ID NO: 397913 - RNA, 19 nt, Homo sapiens
gagagcuuaucgugaacuu

SEQ ID NO: 397914 - RNA, 19 nt, Homo sapiens
gcaguuagaguaggugaau

SEQ ID NO: 397915 - RNA, 19 nt, Homo sapiens
gcacagaugcagcaguaag

SEQ ID NO: 397916 - RNA, 19 nt, Homo sapiens
ggaauuaugucgaaaacag

SEQ ID NO: 397917 - RNA, 19 nt, Homo sapiens
gugaacuuguccucuuaaa

SEQ ID NO: 397918 - RNA, 19 nt, Homo sapiens
gacaguuucucaucaucug

SEQ ID NO: 397919 - RNA, 19 nt, Homo sapiens
ugauggaaccaaauagaaa

SEQ ID NO: 397920 - RNA, 19 nt, Homo sapiens
uuucauccauguccacuga

SEQ ID NO: 397921 - RNA, 19 nt, Homo sapiens
gaaaacagaccaaaguauc

SEQ ID NO: 397922 - RNA, 19 nt, Homo sapiens
gaacaccaucagcagaguu

SEQ ID NO: 397923 - RNA, 19 nt, Homo sapiens
cagcugguauaauucauag

SEQ ID NO: 397924 - RNA, 19 nt, Homo sapiens
gaaacuaagccguccuuuu

SEQ ID NO: 397925 - RNA, 19 nt, Homo sapiens
ugaaaugcuugggaguuga

SEQ ID NO: 397926 - RNA, 19 nt, Homo sapiens
caucaugagcgacaguaaa

SEQ ID NO: 397927 - RNA, 19 nt, Homo sapiens
agucauggauugggaagaa

SEQ ID NO: 397928 - RNA, 19 nt, Homo sapiens
gaagaauggaaagagcuaa

SEQ ID NO: 397929 - RNA, 19 nt, Homo sapiens
ugugaggaauuaugucgaa

SEQ ID NO: 397930 - RNA, 19 nt, Homo sapiens
gucaguggguugcaucaug

SEQ ID NO: 397931 - RNA, 19 nt, Homo sapiens
uaauggaugcuaacuuaug

SEQ ID NO: 397932 - RNA, 19 nt, Homo sapiens
agaccaaaguauccuggaa

SEQ ID NO: 397933 - RNA, 19 nt, Homo sapiens
gcuuggacuugcccaucua

SEQ ID NO: 397934 - RNA, 19 nt, Homo sapiens
aggauugccugcuuagaug

SEQ ID NO: 397935 - RNA, 19 nt, Homo sapiens
cugaaaugcuugggaguug

SEQ ID NO: 397936 - RNA, 19 nt, Homo sapiens
cuugaaggcugucgaugau

SEQ ID NO: 397937 - RNA, 19 nt, Homo sapiens
uuacaaagaagucauggau

SEQ ID NO: 397938 - RNA, 19 nt, Homo sapiens
acccauacaucacuguuug

SEQ ID NO: 397939 - RNA, 19 nt, Homo sapiens
ggaaagagcuaauuuacaa

SEQ ID NO: 397940 - RNA, 19 nt, Homo sapiens
gcauucagcugguauaauu

SEQ ID NO: 397941 - RNA, 19 nt, Homo sapiens
gaaccaaacucaugcaaag

SEQ ID NO: 397942 - RNA, 19 nt, Homo sapiens
caagauguguauuugguua

SEQ ID NO: 397943 - RNA, 19 nt, Homo sapiens
aaagagagcuuaucgugaa

SEQ ID NO: 397944 - RNA, 19 nt, Homo sapiens
gaugauagguuagaaauag

SEQ ID NO: 397945 - RNA, 19 nt, Homo sapiens
gaagaaagaagcaagaaug

SEQ ID NO: 397946 - RNA, 19 nt, Homo sapiens
acaaagaagucauggauug

SEQ ID NO: 397947 - RNA, 19 nt, Homo sapiens
cagcagaguucaugaagaa

SEQ ID NO: 397948 - RNA, 19 nt, Homo sapiens
uagcaaaccugucagcauu

SEQ ID NO: 397949 - RNA, 19 nt, Homo sapiens
cagcacagaugcagcagua

SEQ ID NO: 397950 - RNA, 19 nt, Homo sapiens
ggaagagacuauauugauc

SEQ ID NO: 397951 - RNA, 19 nt, Homo sapiens
ggagcuggaucaugaaaga

SEQ ID NO: 397952 - RNA, 19 nt, Homo sapiens
gaaguuaucucuuaauccu

SEQ ID NO: 397953 - RNA, 19 nt, Homo sapiens
uagaguaggugaauuuguu

SEQ ID NO: 397954 - RNA, 19 nt, Homo sapiens
gguaugggcuacaaagaga

SEQ ID NO: 397955 - RNA, 19 nt, Homo sapiens
ccaaauaaucuuccaggua

SEQ ID NO: 397956 - RNA, 19 nt, Homo sapiens
gcaaaccugucagcauuga

SEQ ID NO: 397957 - RNA, 19 nt, Homo sapiens
gaauggaaagagcuaauuu

SEQ ID NO: 397958 - RNA, 19 nt, Homo sapiens
gcggaucucuguagacgaa

SEQ ID NO: 397959 - RNA, 19 nt, Homo sapiens
gaagaaagagaacaugcaa

SEQ ID NO: 397960 - RNA, 19 nt, Homo sapiens
gaucaguggaauaaaguua

SEQ ID NO: 397961 - RNA, 19 nt, Homo sapiens
gcaagaaugguguuguaaa

SEQ ID NO: 397962 - RNA, 19 nt, Homo sapiens
aaagagaacaugcaauuga

SEQ ID NO: 397963 - RNA, 19 nt, Homo sapiens
gaagagacuauauugauca

SEQ ID NO: 397964 - RNA, 19 nt, Homo sapiens
cagaugcuuugugguauua

SEQ ID NO: 397965 - RNA, 19 nt, Homo sapiens
aaaguauccuggaaucaaa

SEQ ID NO: 397966 - RNA, 19 nt, Homo sapiens
aagcaagaaugguguugua

SEQ ID NO: 397967 - RNA, 19 nt, Homo sapiens
agaaagagaacaugcaauu

SEQ ID NO: 397968 - RNA, 19 nt, Homo sapiens
uaaguaauuuggugucugu

SEQ ID NO: 397969 - RNA, 19 nt, Homo sapiens
gggaagagacuauauugau

SEQ ID NO: 397970 - RNA, 19 nt, Homo sapiens
ugauacaguucuugggaua

SEQ ID NO: 397971 - RNA, 19 nt, Homo sapiens
gaaagagaacaugcaauug

SEQ ID NO: 397972 - RNA, 19 nt, Homo sapiens
acaaagagaacguugauau

SEQ ID NO: 397973 - RNA, 19 nt, Homo sapiens
cuagaagaauuucaagaug

SEQ ID NO: 397974 - RNA, 19 nt, Homo sapiens
caagaaugguguuguaaaa

SEQ ID NO: 397975 - RNA, 19 nt, Homo sapiens
ggcugucgaugauagguua

SEQ ID NO: 397976 - RNA, 19 nt, Homo sapiens
aagagaacaugcaauugaa

SEQ ID NO: 397977 - RNA, 19 nt, Homo sapiens
gaacuuguccucuuaaaau

SEQ ID NO: 397978 - RNA, 19 nt, Homo sapiens
caucaucuguaacuguuga

SEQ ID NO: 397979 - RNA, 19 nt, Homo sapiens
caggugagcaguuagagua

SEQ ID NO: 397980 - RNA, 19 nt, Homo sapiens
ugauaggauugccugcuua

SEQ ID NO: 397981 - RNA, 19 nt, Homo sapiens
gggaguugauggaaccaaa

SEQ ID NO: 397982 - RNA, 19 nt, Homo sapiens
gagcuaauuuacaaagaag

SEQ ID NO: 397983 - RNA, 19 nt, Homo sapiens
caaaguauccuggaaucaa

SEQ ID NO: 397984 - RNA, 19 nt, Homo sapiens
cauuucaggugagcaguua

SEQ ID NO: 397985 - RNA, 19 nt, Homo sapiens
gaacaugcaauugaagaau

SEQ ID NO: 397986 - RNA, 19 nt, Homo sapiens
gauuguuugugcugcauuu

SEQ ID NO: 397987 - RNA, 19 nt, Homo sapiens
ccagaugcuuugugguauu

SEQ ID NO: 397988 - RNA, 19 nt, Homo sapiens
agaaauagcaaaccuguca

SEQ ID NO: 397989 - RNA, 19 nt, Homo sapiens
ggacagcgugcacuaacuu

SEQ ID NO: 397990 - RNA, 19 nt, Homo sapiens
gagcuuaucgugaacuugu

SEQ ID NO: 397991 - RNA, 19 nt, Homo sapiens
gauaaaaugaggcagaaua

SEQ ID NO: 397992 - RNA, 19 nt, Homo sapiens
gagaacaugcaauugaaga

SEQ ID NO: 397993 - RNA, 19 nt, Homo sapiens
gaauguccuaccuucuuua

SEQ ID NO: 397994 - RNA, 19 nt, Homo sapiens
ugaaggcugucgaugauag

SEQ ID NO: 397995 - RNA, 19 nt, Homo sapiens
gaugcuuugugguauuaaa

SEQ ID NO: 397996 - RNA, 19 nt, Homo sapiens
agaagaauuucaagaugug

SEQ ID NO: 397997 - RNA, 19 nt, Homo sapiens
ccaaacucaugcaaagaga

SEQ ID NO: 397998 - RNA, 19 nt, Homo sapiens
gaguugauggaaccaaaua

SEQ ID NO: 397999 - RNA, 19 nt, Homo sapiens
ggaagaaagaagcaagaau

SEQ ID NO: 398000 - RNA, 19 nt, Homo sapiens
gaucagccuucagcacaga

SEQ ID NO: 398001 - RNA, 19 nt, Homo sapiens
guauuaaacaucugcauuc

SEQ ID NO: 398002 - RNA, 19 nt, Homo sapiens
uggaauuaauggaugcuaa

SEQ ID NO: 398003 - RNA, 19 nt, Homo sapiens
caacugugaggaauuaugu

SEQ ID NO: 398004 - RNA, 19 nt, Homo sapiens
aaacuucagccaacuguga

SEQ ID NO: 398005 - RNA, 19 nt, Homo sapiens
caaagagaacguugauauc

SEQ ID NO: 398006 - RNA, 19 nt, Homo sapiens
gaagucauccuggguaugg

SEQ ID NO: 398007 - RNA, 19 nt, Homo sapiens
gguauuaaacaucugcauu

SEQ ID NO: 398008 - RNA, 19 nt, Homo sapiens
agccaacugugaggaauua

SEQ ID NO: 398009 - RNA, 19 nt, Homo sapiens
ggaagaaagagaacaugca

SEQ ID NO: 398010 - RNA, 19 nt, Homo sapiens
ugaagauccuugacuuugg

SEQ ID NO: 398011 - RNA, 19 nt, Homo sapiens
ucgugaacuuguccucuua

SEQ ID NO: 398012 - RNA, 19 nt, Homo sapiens
gagagcuuaucgugaacuu

SEQ ID NO: 398013 - RNA, 19 nt, Homo sapiens
gcaguuagaguaggugaau

SEQ ID NO: 398014 - RNA, 19 nt, Homo sapiens
gcacagaugcagcaguaag

SEQ ID NO: 398015 - RNA, 19 nt, Homo sapiens
ggaauuaugucgaaaacag

SEQ ID NO: 398016 - RNA, 19 nt, Homo sapiens
gugaacuuguccucuuaaa

SEQ ID NO: 398017 - RNA, 19 nt, Homo sapiens
gacaguuucucaucaucug

SEQ ID NO: 398018 - RNA, 19 nt, Homo sapiens
ugauggaaccaaauagaaa

SEQ ID NO: 398019 - RNA, 19 nt, Homo sapiens
uuucauccauguccacuga

SEQ ID NO: 398020 - RNA, 19 nt, Homo sapiens
gaaaacagaccaaaguauc

SEQ ID NO: 398021 - RNA, 19 nt, Homo sapiens
gaacaccaucagcagaguu

SEQ ID NO: 398022 - RNA, 19 nt, Homo sapiens
cagcugguauaauucauag

SEQ ID NO: 398023 - RNA, 19 nt, Homo sapiens
gaaacuaagccguccuuuu

SEQ ID NO: 398024 - RNA, 19 nt, Homo sapiens
ugaaaugcuugggaguuga

SEQ ID NO: 398025 - RNA, 19 nt, Homo sapiens
caucaugagcgacaguaaa

SEQ ID NO: 398026 - RNA, 19 nt, Homo sapiens
agucauggauugggaagaa

SEQ ID NO: 398027 - RNA, 19 nt, Homo sapiens
gaagaauggaaagagcuaa

SEQ ID NO: 398028 - RNA, 19 nt, Homo sapiens
ugugaggaauuaugucgaa

SEQ ID NO: 398029 - RNA, 19 nt, Homo sapiens
uaauggaugcuaacuuaug

SEQ ID NO: 398030 - RNA, 19 nt, Homo sapiens
agaccaaaguauccuggaa

SEQ ID NO: 398031 - RNA, 19 nt, Homo sapiens
gcuuggacuugcccaucua

SEQ ID NO: 398032 - RNA, 19 nt, Homo sapiens
aggauugccugcuuagaug

SEQ ID NO: 398033 - RNA, 19 nt, Homo sapiens
cugaaaugcuugggaguug

SEQ ID NO: 398034 - RNA, 19 nt, Homo sapiens
cuugaaggcugucgaugau

SEQ ID NO: 398035 - RNA, 19 nt, Homo sapiens
uuacaaagaagucauggau

SEQ ID NO: 398036 - RNA, 19 nt, Homo sapiens
acccauacaucacuguuug

SEQ ID NO: 398037 - RNA, 19 nt, Homo sapiens
acaagcggaucucuguaga

SEQ ID NO: 398038 - RNA, 19 nt, Homo sapiens
aaacaagucaagccagaga

SEQ ID NO: 398039 - RNA, 19 nt, Homo sapiens
ggaaagagcuaauuuacaa

SEQ ID NO: 398040 - RNA, 19 nt, Homo sapiens
gcauucagcugguauaauu

SEQ ID NO: 398041 - RNA, 19 nt, Homo sapiens
gaaccaaacucaugcaaag

SEQ ID NO: 398042 - RNA, 19 nt, Homo sapiens
caagauguguauuugguua

SEQ ID NO: 398043 - RNA, 19 nt, Homo sapiens
aaagagagcuuaucgugaa

SEQ ID NO: 398044 - RNA, 19 nt, Homo sapiens
gaugauagguuagaaauag

SEQ ID NO: 398045 - RNA, 19 nt, Homo sapiens
gaagaaagaagcaagaaug

SEQ ID NO: 398046 - RNA, 19 nt, Homo sapiens
acaaagaagucauggauug

SEQ ID NO: 398047 - RNA, 19 nt, Homo sapiens
cagcagaguucaugaagaa

SEQ ID NO: 398048 - RNA, 19 nt, Homo sapiens
uagcaaaccugucagcauu

SEQ ID NO: 398049 - RNA, 19 nt, Homo sapiens
ggaagagacuauauugauc

SEQ ID NO: 398050 - RNA, 19 nt, Homo sapiens
ggagcuggaucaugaaaga

SEQ ID NO: 398051 - RNA, 19 nt, Homo sapiens
gaaguuaucucuuaauccu

SEQ ID NO: 398052 - RNA, 19 nt, Homo sapiens
uagaguaggugaauuuguu

SEQ ID NO: 398053 - RNA, 19 nt, Homo sapiens
gguaugggcuacaaagaga

SEQ ID NO: 398054 - RNA, 19 nt, Homo sapiens
ccaaauaaucuuccaggua

SEQ ID NO: 398055 - RNA, 19 nt, Homo sapiens
gcaaaccugucagcauuga

SEQ ID NO: 398056 - RNA, 19 nt, Homo sapiens
gaauggaaagagcuaauuu

SEQ ID NO: 398057 - RNA, 19 nt, Homo sapiens
gcggaucucuguagacgaa

SEQ ID NO: 398058 - RNA, 19 nt, Homo sapiens
gaagaaagagaacaugcaa

SEQ ID NO: 398059 - RNA, 19 nt, Homo sapiens
gaucaguggaauaaaguua

SEQ ID NO: 398060 - RNA, 19 nt, Homo sapiens
gcaagaaugguguuguaaa

SEQ ID NO: 398061 - RNA, 19 nt, Homo sapiens
aaagagaacaugcaauuga

SEQ ID NO: 398062 - RNA, 19 nt, Homo sapiens
gaagagacuauauugauca

SEQ ID NO: 398063 - RNA, 19 nt, Homo sapiens
cagaugcuuugugguauua

SEQ ID NO: 398064 - RNA, 19 nt, Homo sapiens
aaaguauccuggaaucaaa

SEQ ID NO: 398065 - RNA, 19 nt, Homo sapiens
aagcaagaaugguguugua

SEQ ID NO: 398066 - RNA, 19 nt, Homo sapiens
agaaagagaacaugcaauu

SEQ ID NO: 398067 - RNA, 19 nt, Homo sapiens
uaaguaauuuggugucugu

SEQ ID NO: 398068 - RNA, 19 nt, Homo sapiens
gggaagagacuauauugau

SEQ ID NO: 398069 - RNA, 19 nt, Homo sapiens
ugauacaguucuugggaua

SEQ ID NO: 398070 - RNA, 19 nt, Homo sapiens
gaaagagaacaugcaauug

SEQ ID NO: 398071 - RNA, 19 nt, Homo sapiens
acaaagagaacguugauau

SEQ ID NO: 398072 - RNA, 19 nt, Homo sapiens
cuagaagaauuucaagaug

SEQ ID NO: 398073 - RNA, 19 nt, Homo sapiens
caagaaugguguuguaaaa

SEQ ID NO: 398074 - RNA, 19 nt, Homo sapiens
ggcugucgaugauagguua

SEQ ID NO: 398075 - RNA, 19 nt, Homo sapiens
aagagaacaugcaauugaa

SEQ ID NO: 398076 - RNA, 19 nt, Homo sapiens
gaacuuguccucuuaaaau

SEQ ID NO: 398077 - RNA, 19 nt, Homo sapiens
caucaucuguaacuguuga

SEQ ID NO: 398078 - RNA, 19 nt, Homo sapiens
caggugagcaguuagagua

SEQ ID NO: 398079 - RNA, 19 nt, Homo sapiens
ugauaggauugccugcuua

SEQ ID NO: 398080 - RNA, 19 nt, Homo sapiens
gggaguugauggaaccaaa

SEQ ID NO: 398081 - RNA, 19 nt, Homo sapiens
gagcuaauuuacaaagaag

SEQ ID NO: 398082 - RNA, 19 nt, Homo sapiens
caaaguauccuggaaucaa

SEQ ID NO: 398083 - RNA, 19 nt, Homo sapiens
cauuucaggugagcaguua

SEQ ID NO: 398084 - RNA, 19 nt, Homo sapiens
gaacaugcaauugaagaau

SEQ ID NO: 398085 - RNA, 19 nt, Homo sapiens
gauuguuugugcugcauuu

SEQ ID NO: 398086 - RNA, 19 nt, Homo sapiens
ccagaugcuuugugguauu

SEQ ID NO: 398087 - RNA, 19 nt, Homo sapiens
agaaauagcaaaccuguca

SEQ ID NO: 398088 - RNA, 19 nt, Homo sapiens
ggacagcgugcacuaacuu

SEQ ID NO: 398089 - RNA, 19 nt, Homo sapiens
gagcuuaucgugaacuugu

SEQ ID NO: 398090 - RNA, 19 nt, Homo sapiens
gauaaaaugaggcagaaua

SEQ ID NO: 398091 - RNA, 19 nt, Homo sapiens
gagaacaugcaauugaaga

SEQ ID NO: 398092 - RNA, 19 nt, Homo sapiens
gaauguccuaccuucuuua

SEQ ID NO: 398093 - RNA, 19 nt, Homo sapiens
ugaaggcugucgaugauag

SEQ ID NO: 398094 - RNA, 19 nt, Homo sapiens
gaugcuuugugguauuaaa

SEQ ID NO: 398095 - RNA, 19 nt, Homo sapiens
agaagaauuucaagaugug

SEQ ID NO: 398096 - RNA, 19 nt, Homo sapiens
ccaaacucaugcaaagaga

SEQ ID NO: 398097 - RNA, 19 nt, Homo sapiens
gaguugauggaaccaaaua

SEQ ID NO: 398098 - RNA, 19 nt, Homo sapiens
ggaagaaagaagcaagaau

SEQ ID NO: 398099 - RNA, 19 nt, Homo sapiens
guauuaaacaucugcauuc

SEQ ID NO: 398100 - RNA, 19 nt, Homo sapiens
uggaauuaauggaugcuaa

SEQ ID NO: 398101 - RNA, 19 nt, Homo sapiens
caacugugaggaauuaugu

SEQ ID NO: 398102 - RNA, 19 nt, Homo sapiens
aaacuucagccaacuguga

SEQ ID NO: 398103 - RNA, 19 nt, Homo sapiens
caaagagaacguugauauc

SEQ ID NO: 398104 - RNA, 19 nt, Homo sapiens
gaagucauccuggguaugg

SEQ ID NO: 398105 - RNA, 19 nt, Homo sapiens
gguauuaaacaucugcauu

SEQ ID NO: 398106 - RNA, 19 nt, Homo sapiens
gccuucagaugcagcagua

SEQ ID NO: 398107 - RNA, 19 nt, Homo sapiens
agccaacugugaggaauua

SEQ ID NO: 398108 - RNA, 19 nt, Homo sapiens
ggaagaaagagaacaugca

SEQ ID NO: 398109 - RNA, 19 nt, Homo sapiens
ugaagauccuugacuuugg

SEQ ID NO: 398110 - RNA, 19 nt, Homo sapiens
ucgugaacuuguccucuua

SEQ ID NO: 398111 - RNA, 19 nt, Homo sapiens
gagagcuuaucgugaacuu

SEQ ID NO: 398112 - RNA, 19 nt, Homo sapiens
gcaguuagaguaggugaau

SEQ ID NO: 398113 - RNA, 19 nt, Homo sapiens
ggaauuaugucgaaaacag

SEQ ID NO: 398114 - RNA, 19 nt, Homo sapiens
gugaacuuguccucuuaaa

SEQ ID NO: 398115 - RNA, 19 nt, Homo sapiens
gacaguuucucaucaucug

SEQ ID NO: 398116 - RNA, 19 nt, Homo sapiens
gaaacuaagccguccuuuu

SEQ ID NO: 398117 - RNA, 19 nt, Homo sapiens
ugauggaaccaaauagaaa

SEQ ID NO: 398118 - RNA, 19 nt, Homo sapiens
uuucauccauguccacuga

SEQ ID NO: 398119 - RNA, 19 nt, Homo sapiens
gaaaacagaccaaaguauc

SEQ ID NO: 398120 - RNA, 19 nt, Homo sapiens
gaacaccaucagcagaguu

SEQ ID NO: 398121 - RNA, 19 nt, Homo sapiens
cagcugguauaauucauag

SEQ ID NO: 398122 - RNA, 19 nt, Homo sapiens
ugaaaugcuugggaguuga

SEQ ID NO: 398123 - RNA, 19 nt, Homo sapiens
agucauggauugggaagaa

SEQ ID NO: 398124 - RNA, 19 nt, Homo sapiens
gaagaauggaaagagcuaa

SEQ ID NO: 398125 - RNA, 19 nt, Homo sapiens
ugugaggaauuaugucgaa

SEQ ID NO: 398126 - RNA, 19 nt, Homo sapiens
caucaugagcgacaguaaa

SEQ ID NO: 398127 - RNA, 19 nt, Homo sapiens
uaauggaugcuaacuuaug

SEQ ID NO: 398128 - RNA, 19 nt, Homo sapiens
agaccaaaguauccuggaa

SEQ ID NO: 398129 - RNA, 19 nt, Homo sapiens
gcuuggacuugcccaucua

SEQ ID NO: 398130 - RNA, 19 nt, Homo sapiens
aggauugccugcuuagaug

SEQ ID NO: 398131 - RNA, 19 nt, Homo sapiens
cugaaaugcuugggaguug

SEQ ID NO: 398132 - RNA, 19 nt, Homo sapiens
cuugaaggcugucgaugau

SEQ ID NO: 398133 - RNA, 19 nt, Homo sapiens
uuacaaagaagucauggau

SEQ ID NO: 398134 - RNA, 19 nt, Homo sapiens
acccauacaucacuguuug

SEQ ID NO: 398135 - RNA, 19 nt, Homo sapiens
acaagcggaucucuguaga

SEQ ID NO: 398136 - RNA, 19 nt, Homo sapiens
aaacaagucaagccagaga

SEQ ID NO: 398137 - RNA, 19 nt, Homo sapiens
gcuggaucaugaaagaaug

SEQ ID NO: 398138 - RNA, 19 nt, Homo sapiens
ccacaaaugcuugcuugga

SEQ ID NO: 398139 - RNA, 19 nt, Homo sapiens
gcaagaaacuguugaauua

SEQ ID NO: 398140 - RNA, 19 nt, Homo sapiens
ggaaagaacuuaucuacaa

SEQ ID NO: 398141 - RNA, 19 nt, Homo sapiens
gcaugugucuguauucaua

SEQ ID NO: 398142 - RNA, 19 nt, Homo sapiens
guuccaagauguuuacuua

SEQ ID NO: 398143 - RNA, 19 nt, Homo sapiens
ucacgcagcucucuaaauu

SEQ ID NO: 398144 - RNA, 19 nt, Homo sapiens
agauguagcuuccaaauuu

SEQ ID NO: 398145 - RNA, 19 nt, Homo sapiens
ggaauaagguaauugaaca

SEQ ID NO: 398146 - RNA, 19 nt, Homo sapiens
gcaguuggaugaaagagaa

SEQ ID NO: 398147 - RNA, 19 nt, Homo sapiens
caaagaugcuagugauuga

SEQ ID NO: 398148 - RNA, 19 nt, Homo sapiens
auacagcacuacuuacuua

SEQ ID NO: 398149 - RNA, 19 nt, Homo sapiens
gacauaaacccaucuguaa

SEQ ID NO: 398150 - RNA, 19 nt, Homo sapiens
gaaacuauguggagaaucg

SEQ ID NO: 398151 - RNA, 19 nt, Homo sapiens
cauaaacccaucuguaaua

SEQ ID NO: 398152 - RNA, 19 nt, Homo sapiens
gaaagaacuuaucuacaag

SEQ ID NO: 398153 - RNA, 19 nt, Homo sapiens
gaaagagaacacacaauug

SEQ ID NO: 398154 - RNA, 19 nt, Homo sapiens
ugaagugugugaaccauaa

SEQ ID NO: 398155 - RNA, 19 nt, Homo sapiens
gagaugaugugauggaaca

SEQ ID NO: 398156 - RNA, 19 nt, Homo sapiens
gaaagcaaaucagacacaa

SEQ ID NO: 398157 - RNA, 19 nt, Homo sapiens
gaaauugcaacccacagua

SEQ ID NO: 398158 - RNA, 19 nt, Homo sapiens
ccaaacacaugccaagaga

SEQ ID NO: 398159 - RNA, 19 nt, Homo sapiens
cauauguggugacacguua

SEQ ID NO: 398160 - RNA, 19 nt, Homo sapiens
ugaaagagaacacacaauu

SEQ ID NO: 398161 - RNA, 19 nt, Homo sapiens
caaguaacauuguagucaa

SEQ ID NO: 398162 - RNA, 19 nt, Homo sapiens
ccucagggcucuaccaaga

SEQ ID NO: 398163 - RNA, 19 nt, Homo sapiens
caaugaugcuuacuacaga

SEQ ID NO: 398164 - RNA, 19 nt, Homo sapiens
ggagagaauccaagccuaa

SEQ ID NO: 398165 - RNA, 19 nt, Homo sapiens
agaaaugguucgccacaaa

SEQ ID NO: 398166 - RNA, 19 nt, Homo sapiens
acugauggaugccaacuua

SEQ ID NO: 398167 - RNA, 19 nt, Homo sapiens
guggaugugucauauauug

SEQ ID NO: 398168 - RNA, 19 nt, Homo sapiens
aaagagaacacacaauuga

SEQ ID NO: 398169 - RNA, 19 nt, Homo sapiens
gaauuagacccguuuccua

SEQ ID NO: 398170 - RNA, 19 nt, Homo sapiens
ucucagaucuucacuaugg

SEQ ID NO: 398171 - RNA, 19 nt, Homo sapiens
ugacauaaacccaucugua

SEQ ID NO: 398172 - RNA, 19 nt, Homo sapiens
acaaggaaguaaugaauuc

SEQ ID NO: 398173 - RNA, 19 nt, Homo sapiens
gaagaauggaaagaacuua

SEQ ID NO: 398174 - RNA, 19 nt, Homo sapiens
ggaacaccauguccagaau

SEQ ID NO: 398175 - RNA, 19 nt, Homo sapiens
ggugacacguuauuacaga

SEQ ID NO: 398176 - RNA, 19 nt, Homo sapiens
gauguagcuuccaaauuug

SEQ ID NO: 398177 - RNA, 19 nt, Homo sapiens
gaucuauuacucugacaua

SEQ ID NO: 398178 - RNA, 19 nt, Homo sapiens
ccagggacuuguugucaaa

SEQ ID NO: 398179 - RNA, 19 nt, Homo sapiens
ugucauauauugccaaaca

SEQ ID NO: 398180 - RNA, 19 nt, Homo sapiens
gacaagcaguuggaugaaa

SEQ ID NO: 398181 - RNA, 19 nt, Homo sapiens
gcauuaagcaccuccauuc

SEQ ID NO: 398182 - RNA, 19 nt, Homo sapiens
gggauucgauaaacaagug

SEQ ID NO: 398183 - RNA, 19 nt, Homo sapiens
acgcagcucucuaaauuga

SEQ ID NO: 398184 - RNA, 19 nt, Homo sapiens
gcagugaacagcagugaga

SEQ ID NO: 398185 - RNA, 19 nt, Homo sapiens
guccagaauucaugaagaa

SEQ ID NO: 398186 - RNA, 19 nt, Homo sapiens
caaaucagacacaauuaga

SEQ ID NO: 398187 - RNA, 19 nt, Homo sapiens
gcaaaucagacacaauuag

SEQ ID NO: 398188 - RNA, 19 nt, Homo sapiens
cccaaacucuucccagauu

SEQ ID NO: 398189 - RNA, 19 nt, Homo sapiens
caugaugacuccauaugug

SEQ ID NO: 398190 - RNA, 19 nt, Homo sapiens
caagucugauugcacauug

SEQ ID NO: 398191 - RNA, 19 nt, Homo sapiens
gaacacacaauugaagaau

SEQ ID NO: 398192 - RNA, 19 nt, Homo sapiens
gaacaccauguccagaauu

SEQ ID NO: 398193 - RNA, 19 nt, Homo sapiens
gagccuccauuucuuauac

SEQ ID NO: 398194 - RNA, 19 nt, Homo sapiens
aagcaaaucagacacaauu

SEQ ID NO: 398195 - RNA, 19 nt, Homo sapiens
ggacgacgccuuacagcau

SEQ ID NO: 398196 - RNA, 19 nt, Homo sapiens
ggacuccgagcacaauaaa

SEQ ID NO: 398197 - RNA, 19 nt, Homo sapiens
uauggcaacuuaugcaaga

SEQ ID NO: 398198 - RNA, 19 nt, Homo sapiens
gagaaucggcccaaguaug

SEQ ID NO: 398199 - RNA, 19 nt, Homo sapiens
gccaguauauaagcuguuu

SEQ ID NO: 398200 - RNA, 19 nt, Homo sapiens
gcuccaggcuagugugaga

SEQ ID NO: 398201 - RNA, 19 nt, Homo sapiens
uacaagcugugguauuuau

SEQ ID NO: 398202 - RNA, 19 nt, Homo sapiens
gagaacacacaauugaaga

SEQ ID NO: 398203 - RNA, 19 nt, Homo sapiens
ucaaagaugcuagugauug

SEQ ID NO: 398204 - RNA, 19 nt, Homo sapiens
ugucaaagaugcuagugau

SEQ ID NO: 398205 - RNA, 19 nt, Homo sapiens
gaugccaacuuaugucaag

SEQ ID NO: 398206 - RNA, 19 nt, Homo sapiens
acaaguggaugugucauau

SEQ ID NO: 398207 - RNA, 19 nt, Homo sapiens
acacacaaaugcagacaca

SEQ ID NO: 398208 - RNA, 19 nt, Homo sapiens
gaacaacuaggaacaccau

SEQ ID NO: 398209 - RNA, 19 nt, Homo sapiens
gagaaaugguucgccacaa

SEQ ID NO: 398210 - RNA, 19 nt, Homo sapiens
gccaaacauuacaacauga

SEQ ID NO: 398211 - RNA, 19 nt, Homo sapiens
ucaaugacaucuccuccau

SEQ ID NO: 398212 - RNA, 19 nt, Homo sapiens
ggaaguaaugaauucagaa

SEQ ID NO: 398213 - RNA, 19 nt, Homo sapiens
acacacaauugaagaaugg

SEQ ID NO: 398214 - RNA, 19 nt, Homo sapiens
ugccaaacauuacaacaug

SEQ ID NO: 398215 - RNA, 19 nt, Homo sapiens
agagaagccuuuuccauaa

SEQ ID NO: 398216 - RNA, 19 nt, Homo sapiens
gacucaaccuucacaguuc

SEQ ID NO: 398217 - RNA, 19 nt, Homo sapiens
gauuaaauggcaccuguau

SEQ ID NO: 398218 - RNA, 19 nt, Homo sapiens
ucagacccuugaagaugua

SEQ ID NO: 398219 - RNA, 19 nt, Homo sapiens
cuagucagauggauguaga

SEQ ID NO: 398220 - RNA, 19 nt, Homo sapiens
cuacagaaagcaaaucaga

SEQ ID NO: 398221 - RNA, 19 nt, Homo sapiens
gaugaaagagaacacacaa

SEQ ID NO: 398222 - RNA, 19 nt, Homo sapiens
ccaggaagggacuauauug

SEQ ID NO: 398223 - RNA, 19 nt, Homo sapiens
aaguggaugugucauauau

SEQ ID NO: 398224 - RNA, 19 nt, Homo sapiens
gagaagccuuuuccauaaa

SEQ ID NO: 398225 - RNA, 19 nt, Homo sapiens
ucuaguugcucuugcuuug

SEQ ID NO: 398226 - RNA, 19 nt, Homo sapiens
gagagaauccaagccuaaa

SEQ ID NO: 398227 - RNA, 19 nt, Homo sapiens
gaaguaaugaauucagaag

SEQ ID NO: 398228 - RNA, 19 nt, Homo sapiens
ccaguggaauaagguaauu

SEQ ID NO: 398229 - RNA, 19 nt, Homo sapiens
caaggagaacguggauaua

SEQ ID NO: 398230 - RNA, 19 nt, Homo sapiens
caaguggaugugucauaua

SEQ ID NO: 398231 - RNA, 19 nt, Homo sapiens
uaacugcccuuuuaaaugg

SEQ ID NO: 398232 - RNA, 19 nt, Homo sapiens
gaauccaagccuaaaauua

SEQ ID NO: 398233 - RNA, 19 nt, Homo sapiens
cgagcacaauaaacucaaa

SEQ ID NO: 398234 - RNA, 19 nt, Homo sapiens
guaauugaacaacuaggaa

SEQ ID NO: 398235 - RNA, 19 nt, Homo sapiens
ggagaacguggauauaugg

SEQ ID NO: 398236 - RNA, 19 nt, Homo sapiens
agaaaacgcuggaggaguu

SEQ ID NO: 398237 - RNA, 19 nt, Homo sapiens
uaugagccuccauuucuua

SEQ ID NO: 398238 - RNA, 19 nt, Homo sapiens
uuaaauggcaccuguauac

SEQ ID NO: 398239 - RNA, 19 nt, Homo sapiens
gcaagaaacuguugaauua

SEQ ID NO: 398240 - RNA, 19 nt, Homo sapiens
ggaaagaacuuaucuacaa

SEQ ID NO: 398241 - RNA, 19 nt, Homo sapiens
gcaugugucuguauucaua

SEQ ID NO: 398242 - RNA, 19 nt, Homo sapiens
guuccaagauguuuacuua

SEQ ID NO: 398243 - RNA, 19 nt, Homo sapiens
agauguagcuuccaaauuu

SEQ ID NO: 398244 - RNA, 19 nt, Homo sapiens
ggaauaagguaauugaaca

SEQ ID NO: 398245 - RNA, 19 nt, Homo sapiens
gcaguuggaugaaagagaa

SEQ ID NO: 398246 - RNA, 19 nt, Homo sapiens
caaagaugcuagugauuga

SEQ ID NO: 398247 - RNA, 19 nt, Homo sapiens
gcaagccacucuucuucua

SEQ ID NO: 398248 - RNA, 19 nt, Homo sapiens
auacagcacuacuuacuua

SEQ ID NO: 398249 - RNA, 19 nt, Homo sapiens
gacauaaacccaucuguaa

SEQ ID NO: 398250 - RNA, 19 nt, Homo sapiens
gaaacuauguggagaaucg

SEQ ID NO: 398251 - RNA, 19 nt, Homo sapiens
cauaaacccaucuguaaua

SEQ ID NO: 398252 - RNA, 19 nt, Homo sapiens
gaaagaacuuaucuacaag

SEQ ID NO: 398253 - RNA, 19 nt, Homo sapiens
gaaagagaacacacaauug

SEQ ID NO: 398254 - RNA, 19 nt, Homo sapiens
ugaagugugugaaccauaa

SEQ ID NO: 398255 - RNA, 19 nt, Homo sapiens
gagaugaugugauggaaca

SEQ ID NO: 398256 - RNA, 19 nt, Homo sapiens
gaaaucaccuguccaucgu

SEQ ID NO: 398257 - RNA, 19 nt, Homo sapiens
gaaagcaaaucagacacaa

SEQ ID NO: 398258 - RNA, 19 nt, Homo sapiens
gaaauugcaacccacagua

SEQ ID NO: 398259 - RNA, 19 nt, Homo sapiens
ccaaacacaugccaagaga

SEQ ID NO: 398260 - RNA, 19 nt, Homo sapiens
cauauguggugacacguua

SEQ ID NO: 398261 - RNA, 19 nt, Homo sapiens
ugaaagagaacacacaauu

SEQ ID NO: 398262 - RNA, 19 nt, Homo sapiens
caaguaacauuguagucaa

SEQ ID NO: 398263 - RNA, 19 nt, Homo sapiens
ccucagggcucuaccaaga

SEQ ID NO: 398264 - RNA, 19 nt, Homo sapiens
caaugaugcuuacuacaga

SEQ ID NO: 398265 - RNA, 19 nt, Homo sapiens
ggagagaauccaagccuaa

SEQ ID NO: 398266 - RNA, 19 nt, Homo sapiens
agaaaugguucgccacaaa

SEQ ID NO: 398267 - RNA, 19 nt, Homo sapiens
acugauggaugccaacuua

SEQ ID NO: 398268 - RNA, 19 nt, Homo sapiens
guggaugugucauauauug

SEQ ID NO: 398269 - RNA, 19 nt, Homo sapiens
aaagagaacacacaauuga

SEQ ID NO: 398270 - RNA, 19 nt, Homo sapiens
gaauuagacccguuuccua

SEQ ID NO: 398271 - RNA, 19 nt, Homo sapiens
ucucagaucuucacuaugg

SEQ ID NO: 398272 - RNA, 19 nt, Homo sapiens
ugacauaaacccaucugua

SEQ ID NO: 398273 - RNA, 19 nt, Homo sapiens
acaaggaaguaaugaauuc

SEQ ID NO: 398274 - RNA, 19 nt, Homo sapiens
gaagaauggaaagaacuua

SEQ ID NO: 398275 - RNA, 19 nt, Homo sapiens
ggaacaccauguccagaau

SEQ ID NO: 398276 - RNA, 19 nt, Homo sapiens
ggugacacguuauuacaga

SEQ ID NO: 398277 - RNA, 19 nt, Homo sapiens
gauguagcuuccaaauuug

SEQ ID NO: 398278 - RNA, 19 nt, Homo sapiens
gaucuauuacucugacaua

SEQ ID NO: 398279 - RNA, 19 nt, Homo sapiens
ccagggacuuguugucaaa

SEQ ID NO: 398280 - RNA, 19 nt, Homo sapiens
ugucauauauugccaaaca

SEQ ID NO: 398281 - RNA, 19 nt, Homo sapiens
uaaacaaucuccauaucuc

SEQ ID NO: 398282 - RNA, 19 nt, Homo sapiens
gacaagcaguuggaugaaa

SEQ ID NO: 398283 - RNA, 19 nt, Homo sapiens
gcauuaagcaccuccauuc

SEQ ID NO: 398284 - RNA, 19 nt, Homo sapiens
gggauucgauaaacaagug

SEQ ID NO: 398285 - RNA, 19 nt, Homo sapiens
aaacaagggauucgauaaa

SEQ ID NO: 398286 - RNA, 19 nt, Homo sapiens
gcagugaacagcagugaga

SEQ ID NO: 398287 - RNA, 19 nt, Homo sapiens
ggugcuugcuauaugcuua

SEQ ID NO: 398288 - RNA, 19 nt, Homo sapiens
gcaucacgcugcacaaugg

SEQ ID NO: 398289 - RNA, 19 nt, Homo sapiens
guccagaauucaugaagaa

SEQ ID NO: 398290 - RNA, 19 nt, Homo sapiens
cggaauggcuagugugaga

SEQ ID NO: 398291 - RNA, 19 nt, Homo sapiens
ggaaugugguuaaugaaaa

SEQ ID NO: 398292 - RNA, 19 nt, Homo sapiens
caaaucagacacaauuaga

SEQ ID NO: 398293 - RNA, 19 nt, Homo sapiens
gcaaaucagacacaauuag

SEQ ID NO: 398294 - RNA, 19 nt, Homo sapiens
cccaaacucuucccagauu

SEQ ID NO: 398295 - RNA, 19 nt, Homo sapiens
caugaugacuccauaugug

SEQ ID NO: 398296 - RNA, 19 nt, Homo sapiens
caagucugauugcacauug

SEQ ID NO: 398297 - RNA, 19 nt, Homo sapiens
ucuggaaugugguuaauga

SEQ ID NO: 398298 - RNA, 19 nt, Homo sapiens
aaucaccuguccaucguua

SEQ ID NO: 398299 - RNA, 19 nt, Homo sapiens
aaacaaguagggaggauuu

SEQ ID NO: 398300 - RNA, 19 nt, Homo sapiens
gaacacacaauugaagaau

SEQ ID NO: 398301 - RNA, 19 nt, Homo sapiens
gaacaccauguccagaauu

SEQ ID NO: 398302 - RNA, 19 nt, Homo sapiens
gagccuccauuucuuauac

SEQ ID NO: 398303 - RNA, 19 nt, Homo sapiens
aagcaaaucagacacaauu

SEQ ID NO: 398304 - RNA, 19 nt, Homo sapiens
ggacgacgccuuacagcau

SEQ ID NO: 398305 - RNA, 19 nt, Homo sapiens
ggacuccgagcacaauaaa

SEQ ID NO: 398306 - RNA, 19 nt, Homo sapiens
gagaaucggcccaaguaug

SEQ ID NO: 398307 - RNA, 19 nt, Homo sapiens
uauggcaacuuaugcaaga

SEQ ID NO: 398308 - RNA, 19 nt, Homo sapiens
gccaguauauaagcuguuu

SEQ ID NO: 398309 - RNA, 19 nt, Homo sapiens
uacaagcugugguauuuau

SEQ ID NO: 398310 - RNA, 19 nt, Homo sapiens
cuccauaucuccaaagaau

SEQ ID NO: 398311 - RNA, 19 nt, Homo sapiens
gagaacacacaauugaaga

SEQ ID NO: 398312 - RNA, 19 nt, Homo sapiens
ucaaagaugcuagugauug

SEQ ID NO: 398313 - RNA, 19 nt, Homo sapiens
ugucaaagaugcuagugau

SEQ ID NO: 398314 - RNA, 19 nt, Homo sapiens
ugagugaguuuaagauugg

SEQ ID NO: 398315 - RNA, 19 nt, Homo sapiens
gaugccaacuuaugucaag

SEQ ID NO: 398316 - RNA, 19 nt, Homo sapiens
acaaguggaugugucauau

SEQ ID NO: 398317 - RNA, 19 nt, Homo sapiens
acacacaaaugcagacaca

SEQ ID NO: 398318 - RNA, 19 nt, Homo sapiens
gaacaacuaggaacaccau

SEQ ID NO: 398319 - RNA, 19 nt, Homo sapiens
gagaaaugguucgccacaa

SEQ ID NO: 398320 - RNA, 19 nt, Homo sapiens
gccaaacauuacaacauga

SEQ ID NO: 398321 - RNA, 19 nt, Homo sapiens
ucaaugacaucuccuccau

SEQ ID NO: 398322 - RNA, 19 nt, Homo sapiens
ggaaguaaugaauucagaa

SEQ ID NO: 398323 - RNA, 19 nt, Homo sapiens
acacacaauugaagaaugg

SEQ ID NO: 398324 - RNA, 19 nt, Homo sapiens
ugccaaacauuacaacaug

SEQ ID NO: 398325 - RNA, 19 nt, Homo sapiens
agagaagccuuuuccauaa

SEQ ID NO: 398326 - RNA, 19 nt, Homo sapiens
gacucaaccuucacaguuc

SEQ ID NO: 398327 - RNA, 19 nt, Homo sapiens
caagggauucgauaaacaa

SEQ ID NO: 398328 - RNA, 19 nt, Homo sapiens
gaauggcuagugugagaaa

SEQ ID NO: 398329 - RNA, 19 nt, Homo sapiens
gauuaaauggcaccuguau

SEQ ID NO: 398330 - RNA, 19 nt, Homo sapiens
ucagacccuugaagaugua

SEQ ID NO: 398331 - RNA, 19 nt, Homo sapiens
cuagucagauggauguaga

SEQ ID NO: 398332 - RNA, 19 nt, Homo sapiens
cuacagaaagcaaaucaga

SEQ ID NO: 398333 - RNA, 19 nt, Homo sapiens
gaugaaagagaacacacaa

SEQ ID NO: 398334 - RNA, 19 nt, Homo sapiens
ccaggaagggacuauauug

SEQ ID NO: 398335 - RNA, 19 nt, Homo sapiens
aaguggaugugucauauau

SEQ ID NO: 398336 - RNA, 19 nt, Homo sapiens
gagaagccuuuuccauaaa

SEQ ID NO: 398337 - RNA, 19 nt, Homo sapiens
ucuaguugcucuugcuuug

SEQ ID NO: 398338 - RNA, 19 nt, Homo sapiens
gagagaauccaagccuaaa

SEQ ID NO: 398339 - RNA, 19 nt, Homo sapiens
ggaaagaacuuaucuacaa

SEQ ID NO: 398340 - RNA, 19 nt, Homo sapiens
gcaugugucuguauucaua

SEQ ID NO: 398341 - RNA, 19 nt, Homo sapiens
agauguagcuuccaaauuu

SEQ ID NO: 398342 - RNA, 19 nt, Homo sapiens
ggaauaagguaauugaaca

SEQ ID NO: 398343 - RNA, 19 nt, Homo sapiens
gcaguuggaugaaagagaa

SEQ ID NO: 398344 - RNA, 19 nt, Homo sapiens
caaagaugcuagugauuga

SEQ ID NO: 398345 - RNA, 19 nt, Homo sapiens
auacagcacuacuuacuua

SEQ ID NO: 398346 - RNA, 19 nt, Homo sapiens
gacauaaacccaucuguaa

SEQ ID NO: 398347 - RNA, 19 nt, Homo sapiens
gaaacuauguggagaaucg

SEQ ID NO: 398348 - RNA, 19 nt, Homo sapiens
gccagucacucauaucuuu

SEQ ID NO: 398349 - RNA, 19 nt, Homo sapiens
cauaaacccaucuguaaua

SEQ ID NO: 398350 - RNA, 19 nt, Homo sapiens
gaaagaacuuaucuacaag

SEQ ID NO: 398351 - RNA, 19 nt, Homo sapiens
gaaagagaacacacaauug

SEQ ID NO: 398352 - RNA, 19 nt, Homo sapiens
ugaagugugugaaccauaa

SEQ ID NO: 398353 - RNA, 19 nt, Homo sapiens
gagaugaugugauggaaca

SEQ ID NO: 398354 - RNA, 19 nt, Homo sapiens
gaaagcaaaucagacacaa

SEQ ID NO: 398355 - RNA, 19 nt, Homo sapiens
gaaauugcaacccacagua

SEQ ID NO: 398356 - RNA, 19 nt, Homo sapiens
ccaaacacaugccaagaga

SEQ ID NO: 398357 - RNA, 19 nt, Homo sapiens
cauauguggugacacguua

SEQ ID NO: 398358 - RNA, 19 nt, Homo sapiens
ugaaagagaacacacaauu

SEQ ID NO: 398359 - RNA, 19 nt, Homo sapiens
caaguaacauuguagucaa

SEQ ID NO: 398360 - RNA, 19 nt, Homo sapiens
ccucagggcucuaccaaga

SEQ ID NO: 398361 - RNA, 19 nt, Homo sapiens
caaugaugcuuacuacaga

SEQ ID NO: 398362 - RNA, 19 nt, Homo sapiens
ggagagaauccaagccuaa

SEQ ID NO: 398363 - RNA, 19 nt, Homo sapiens
agaaaugguucgccacaaa

SEQ ID NO: 398364 - RNA, 19 nt, Homo sapiens
acugauggaugccaacuua

SEQ ID NO: 398365 - RNA, 19 nt, Homo sapiens
aaagagaacacacaauuga

SEQ ID NO: 398366 - RNA, 19 nt, Homo sapiens
ugacauaaacccaucugua

SEQ ID NO: 398367 - RNA, 19 nt, Homo sapiens
acaaggaaguaaugaauuc

SEQ ID NO: 398368 - RNA, 19 nt, Homo sapiens
gaagaauggaaagaacuua

SEQ ID NO: 398369 - RNA, 19 nt, Homo sapiens
ggaacaccauguccagaau

SEQ ID NO: 398370 - RNA, 19 nt, Homo sapiens
ggugacacguuauuacaga

SEQ ID NO: 398371 - RNA, 19 nt, Homo sapiens
gauguagcuuccaaauuug

SEQ ID NO: 398372 - RNA, 19 nt, Homo sapiens
gaucuauuacucugacaua

SEQ ID NO: 398373 - RNA, 19 nt, Homo sapiens
ccagggacuuguugucaaa

SEQ ID NO: 398374 - RNA, 19 nt, Homo sapiens
gacaagcaguuggaugaaa

SEQ ID NO: 398375 - RNA, 19 nt, Homo sapiens
gcauuaagcaccuccauuc

SEQ ID NO: 398376 - RNA, 19 nt, Homo sapiens
gcagugaacagcagugaga

SEQ ID NO: 398377 - RNA, 19 nt, Homo sapiens
guccagaauucaugaagaa

SEQ ID NO: 398378 - RNA, 19 nt, Homo sapiens
ggcaagaguucuaaggaau

SEQ ID NO: 398379 - RNA, 19 nt, Homo sapiens
caaaucagacacaauuaga

SEQ ID NO: 398380 - RNA, 19 nt, Homo sapiens
gcaaaucagacacaauuag

SEQ ID NO: 398381 - RNA, 19 nt, Homo sapiens
cccaaacucuucccagauu

SEQ ID NO: 398382 - RNA, 19 nt, Homo sapiens
caugaugacuccauaugug

SEQ ID NO: 398383 - RNA, 19 nt, Homo sapiens
caagucugauugcacauug

SEQ ID NO: 398384 - RNA, 19 nt, Homo sapiens
gcucuuggaucucuacagu

SEQ ID NO: 398385 - RNA, 19 nt, Homo sapiens
gaacacacaauugaagaau

SEQ ID NO: 398386 - RNA, 19 nt, Homo sapiens
ccuccuagcauguagaaua

SEQ ID NO: 398387 - RNA, 19 nt, Homo sapiens
gaacaccauguccagaauu

SEQ ID NO: 398388 - RNA, 19 nt, Homo sapiens
aagcaaaucagacacaauu

SEQ ID NO: 398389 - RNA, 19 nt, Homo sapiens
ggacgacgccuuacagcau

SEQ ID NO: 398390 - RNA, 19 nt, Homo sapiens
ggacuccgagcacaauaaa

SEQ ID NO: 398391 - RNA, 19 nt, Homo sapiens
gagaaucggcccaaguaug

SEQ ID NO: 398392 - RNA, 19 nt, Homo sapiens
gccaguauauaagcuguuu

SEQ ID NO: 398393 - RNA, 19 nt, Homo sapiens
gagaacacacaauugaaga

SEQ ID NO: 398394 - RNA, 19 nt, Homo sapiens
ucaaagaugcuagugauug

SEQ ID NO: 398395 - RNA, 19 nt, Homo sapiens
ugucaaagaugcuagugau

SEQ ID NO: 398396 - RNA, 19 nt, Homo sapiens
gaugccaacuuaugucaag

SEQ ID NO: 398397 - RNA, 19 nt, Homo sapiens
acacacaaaugcagacaca

SEQ ID NO: 398398 - RNA, 19 nt, Homo sapiens
gaacaacuaggaacaccau

SEQ ID NO: 398399 - RNA, 19 nt, Homo sapiens
gagaaaugguucgccacaa

SEQ ID NO: 398400 - RNA, 19 nt, Homo sapiens
ucaaugacaucuccuccau

SEQ ID NO: 398401 - RNA, 19 nt, Homo sapiens
ggaaguaaugaauucagaa

SEQ ID NO: 398402 - RNA, 19 nt, Homo sapiens
acacacaauugaagaaugg

SEQ ID NO: 398403 - RNA, 19 nt, Homo sapiens
agagaagccuuuuccauaa

SEQ ID NO: 398404 - RNA, 19 nt, Homo sapiens
caaguaggcaagaguucua

SEQ ID NO: 398405 - RNA, 19 nt, Homo sapiens
gauuaaauggcaccuguau

SEQ ID NO: 398406 - RNA, 19 nt, Homo sapiens
ucagacccuugaagaugua

SEQ ID NO: 398407 - RNA, 19 nt, Homo sapiens
cuagucagauggauguaga

SEQ ID NO: 398408 - RNA, 19 nt, Homo sapiens
cuacagaaagcaaaucaga

SEQ ID NO: 398409 - RNA, 19 nt, Homo sapiens
gaugaaagagaacacacaa

SEQ ID NO: 398410 - RNA, 19 nt, Homo sapiens
ccaggaagggacuauauug

SEQ ID NO: 398411 - RNA, 19 nt, Homo sapiens
caguauccuuaaucaagua

SEQ ID NO: 398412 - RNA, 19 nt, Homo sapiens
ccaguauccuuaaucaagu

SEQ ID NO: 398413 - RNA, 19 nt, Homo sapiens
gagaagccuuuuccauaaa

SEQ ID NO: 398414 - RNA, 19 nt, Homo sapiens
ucuaguugcucuugcuuug

SEQ ID NO: 398415 - RNA, 19 nt, Homo sapiens
gagagaauccaagccuaaa

SEQ ID NO: 398416 - RNA, 19 nt, Homo sapiens
gaaguaaugaauucagaag

SEQ ID NO: 398417 - RNA, 19 nt, Homo sapiens
ccaguggaauaagguaauu

SEQ ID NO: 398418 - RNA, 19 nt, Homo sapiens
caaggagaacguggauaua

SEQ ID NO: 398419 - RNA, 19 nt, Homo sapiens
uuaccaguauccuuaauca

SEQ ID NO: 398420 - RNA, 19 nt, Homo sapiens
uaacugcccuuuuaaaugg

SEQ ID NO: 398421 - RNA, 19 nt, Homo sapiens
gaauccaagccuaaaauua

SEQ ID NO: 398422 - RNA, 19 nt, Homo sapiens
cgagcacaauaaacucaaa

SEQ ID NO: 398423 - RNA, 19 nt, Homo sapiens
guaauugaacaacuaggaa

SEQ ID NO: 398424 - RNA, 19 nt, Homo sapiens
ggagaacguggauauaugg

SEQ ID NO: 398425 - RNA, 19 nt, Homo sapiens
uuaaauggcaccuguauac

SEQ ID NO: 398426 - RNA, 19 nt, Homo sapiens
ggacagccuucuccuucag

SEQ ID NO: 398427 - RNA, 19 nt, Homo sapiens
uaagaaacuauguggagaa

SEQ ID NO: 398428 - RNA, 19 nt, Homo sapiens
ccuagcauguagaauauuc

SEQ ID NO: 398429 - RNA, 19 nt, Homo sapiens
acaaggagaacguggauau

SEQ ID NO: 398430 - RNA, 19 nt, Homo sapiens
gcaggcacaagcuucauga

SEQ ID NO: 398431 - RNA, 19 nt, Homo sapiens
ccaaguaacauuguaguca

SEQ ID NO: 398432 - RNA, 19 nt, Homo sapiens
gagcugguccucaugaagu

SEQ ID NO: 398433 - RNA, 19 nt, Homo sapiens
gcaugugugugucucuauc

SEQ ID NO: 398434 - RNA, 19 nt, Homo sapiens
cuacaaggaaguaaugaau

SEQ ID NO: 398435 - RNA, 19 nt, Homo sapiens
uggagaaucggcccaagua

SEQ ID NO: 398436 - RNA, 19 nt, Homo sapiens
ggacagcaggcacaagcuu

SEQ ID NO: 398437 - RNA, 19 nt, Homo sapiens
caagaguucuaaggaaucu

SEQ ID NO: 398438 - RNA, 19 nt, Homo sapiens
gcaagaguucuaaggaauc

SEQ ID NO: 398439 - RNA, 19 nt, Homo sapiens
gcaagaaacuguugaauua

SEQ ID NO: 398440 - RNA, 19 nt, Homo sapiens
ggaaagaacuuaucuacaa

SEQ ID NO: 398441 - RNA, 19 nt, Homo sapiens
gcaugugucuguauucaua

SEQ ID NO: 398442 - RNA, 19 nt, Homo sapiens
guuccaagauguuuacuua

SEQ ID NO: 398443 - RNA, 19 nt, Homo sapiens
agauguagcuuccaaauuu

SEQ ID NO: 398444 - RNA, 19 nt, Homo sapiens
ggaauaagguaauugaaca

SEQ ID NO: 398445 - RNA, 19 nt, Homo sapiens
gcaguuggaugaaagagaa

SEQ ID NO: 398446 - RNA, 19 nt, Homo sapiens
caaagaugcuagugauuga

SEQ ID NO: 398447 - RNA, 19 nt, Homo sapiens
auacagcacuacuuacuua

SEQ ID NO: 398448 - RNA, 19 nt, Homo sapiens
gacauaaacccaucuguaa

SEQ ID NO: 398449 - RNA, 19 nt, Homo sapiens
gaaacuauguggagaaucg

SEQ ID NO: 398450 - RNA, 19 nt, Homo sapiens
cauaaacccaucuguaaua

SEQ ID NO: 398451 - RNA, 19 nt, Homo sapiens
gaaagaacuuaucuacaag

SEQ ID NO: 398452 - RNA, 19 nt, Homo sapiens
gaaagagaacacacaauug

SEQ ID NO: 398453 - RNA, 19 nt, Homo sapiens
ugaagugugugaaccauaa

SEQ ID NO: 398454 - RNA, 19 nt, Homo sapiens
gagaugaugugauggaaca

SEQ ID NO: 398455 - RNA, 19 nt, Homo sapiens
gaaagcaaaucagacacaa

SEQ ID NO: 398456 - RNA, 19 nt, Homo sapiens
gaaauugcaacccacagua

SEQ ID NO: 398457 - RNA, 19 nt, Homo sapiens
ccaaacacaugccaagaga

SEQ ID NO: 398458 - RNA, 19 nt, Homo sapiens
cauauguggugacacguua

SEQ ID NO: 398459 - RNA, 19 nt, Homo sapiens
ugaaagagaacacacaauu

SEQ ID NO: 398460 - RNA, 19 nt, Homo sapiens
caaguaacauuguagucaa

SEQ ID NO: 398461 - RNA, 19 nt, Homo sapiens
ccucagggcucuaccaaga

SEQ ID NO: 398462 - RNA, 19 nt, Homo sapiens
caaugaugcuuacuacaga

SEQ ID NO: 398463 - RNA, 19 nt, Homo sapiens
ggagagaauccaagccuaa

SEQ ID NO: 398464 - RNA, 19 nt, Homo sapiens
agaaaugguucgccacaaa

SEQ ID NO: 398465 - RNA, 19 nt, Homo sapiens
acugauggaugccaacuua

SEQ ID NO: 398466 - RNA, 19 nt, Homo sapiens
guggaugugucauauauug

SEQ ID NO: 398467 - RNA, 19 nt, Homo sapiens
gaauuagacccguuuccua

SEQ ID NO: 398468 - RNA, 19 nt, Homo sapiens
aaagagaacacacaauuga

SEQ ID NO: 398469 - RNA, 19 nt, Homo sapiens
ugacauaaacccaucugua

SEQ ID NO: 398470 - RNA, 19 nt, Homo sapiens
acaaggaaguaaugaauuc

SEQ ID NO: 398471 - RNA, 19 nt, Homo sapiens
gaagaauggaaagaacuua

SEQ ID NO: 398472 - RNA, 19 nt, Homo sapiens
ggaacaccauguccagaau

SEQ ID NO: 398473 - RNA, 19 nt, Homo sapiens
ggugacacguuauuacaga

SEQ ID NO: 398474 - RNA, 19 nt, Homo sapiens
gauguagcuuccaaauuug

SEQ ID NO: 398475 - RNA, 19 nt, Homo sapiens
gaucuauuacucugacaua

SEQ ID NO: 398476 - RNA, 19 nt, Homo sapiens
ccagggacuuguugucaaa

SEQ ID NO: 398477 - RNA, 19 nt, Homo sapiens
ugucauauauugccaaaca

SEQ ID NO: 398478 - RNA, 19 nt, Homo sapiens
gacaagcaguuggaugaaa

SEQ ID NO: 398479 - RNA, 19 nt, Homo sapiens
gcauuaagcaccuccauuc

SEQ ID NO: 398480 - RNA, 19 nt, Homo sapiens
gggauucgauaaacaagug

SEQ ID NO: 398481 - RNA, 19 nt, Homo sapiens
gcagugaacagcagugaga

SEQ ID NO: 398482 - RNA, 19 nt, Homo sapiens
guccagaauucaugaagaa

SEQ ID NO: 398483 - RNA, 19 nt, Homo sapiens
caaaucagacacaauuaga

SEQ ID NO: 398484 - RNA, 19 nt, Homo sapiens
gcaaaucagacacaauuag

SEQ ID NO: 398485 - RNA, 19 nt, Homo sapiens
cccaaacucuucccagauu

SEQ ID NO: 398486 - RNA, 19 nt, Homo sapiens
caugaugacuccauaugug

SEQ ID NO: 398487 - RNA, 19 nt, Homo sapiens
caagucugauugcacauug

SEQ ID NO: 398488 - RNA, 19 nt, Homo sapiens
gagccuccauuucuuauac

SEQ ID NO: 398489 - RNA, 19 nt, Homo sapiens
gaacacacaauugaagaau

SEQ ID NO: 398490 - RNA, 19 nt, Homo sapiens
gaacaccauguccagaauu

SEQ ID NO: 398491 - RNA, 19 nt, Homo sapiens
aagcaaaucagacacaauu

SEQ ID NO: 398492 - RNA, 19 nt, Homo sapiens
ggacgacgccuuacagcau

SEQ ID NO: 398493 - RNA, 19 nt, Homo sapiens
ggacuccgagcacaauaaa

SEQ ID NO: 398494 - RNA, 19 nt, Homo sapiens
gagaaucggcccaaguaug

SEQ ID NO: 398495 - RNA, 19 nt, Homo sapiens
gccaguauauaagcuguuu

SEQ ID NO: 398496 - RNA, 19 nt, Homo sapiens
uacaagcugugguauuuau

SEQ ID NO: 398497 - RNA, 19 nt, Homo sapiens
gagaacacacaauugaaga

SEQ ID NO: 398498 - RNA, 19 nt, Homo sapiens
ucaaagaugcuagugauug

SEQ ID NO: 398499 - RNA, 19 nt, Homo sapiens
ugucaaagaugcuagugau

SEQ ID NO: 398500 - RNA, 19 nt, Homo sapiens
gaugccaacuuaugucaag

SEQ ID NO: 398501 - RNA, 19 nt, Homo sapiens
acaaguggaugugucauau

SEQ ID NO: 398502 - RNA, 19 nt, Homo sapiens
acacacaaaugcagacaca

SEQ ID NO: 398503 - RNA, 19 nt, Homo sapiens
gaacaacuaggaacaccau

SEQ ID NO: 398504 - RNA, 19 nt, Homo sapiens
gagaaaugguucgccacaa

SEQ ID NO: 398505 - RNA, 19 nt, Homo sapiens
gccaaacauuacaacauga

SEQ ID NO: 398506 - RNA, 19 nt, Homo sapiens
ucaaugacaucuccuccau

SEQ ID NO: 398507 - RNA, 19 nt, Homo sapiens
ggaaguaaugaauucagaa

SEQ ID NO: 398508 - RNA, 19 nt, Homo sapiens
acacacaauugaagaaugg

SEQ ID NO: 398509 - RNA, 19 nt, Homo sapiens
ugccaaacauuacaacaug

SEQ ID NO: 398510 - RNA, 19 nt, Homo sapiens
agagaagccuuuuccauaa

SEQ ID NO: 398511 - RNA, 19 nt, Homo sapiens
gacucaaccuucacaguuc

SEQ ID NO: 398512 - RNA, 19 nt, Homo sapiens
gauuaaauggcaccuguau

SEQ ID NO: 398513 - RNA, 19 nt, Homo sapiens
ucagacccuugaagaugua

SEQ ID NO: 398514 - RNA, 19 nt, Homo sapiens
cuagucagauggauguaga

SEQ ID NO: 398515 - RNA, 19 nt, Homo sapiens
cuacagaaagcaaaucaga

SEQ ID NO: 398516 - RNA, 19 nt, Homo sapiens
gaugaaagagaacacacaa

SEQ ID NO: 398517 - RNA, 19 nt, Homo sapiens
ccaggaagggacuauauug

SEQ ID NO: 398518 - RNA, 19 nt, Homo sapiens
aaguggaugugucauauau

SEQ ID NO: 398519 - RNA, 19 nt, Homo sapiens
gagaagccuuuuccauaaa

SEQ ID NO: 398520 - RNA, 19 nt, Homo sapiens
ucuaguugcucuugcuuug

SEQ ID NO: 398521 - RNA, 19 nt, Homo sapiens
caaguggaugugucauaua

SEQ ID NO: 398522 - RNA, 19 nt, Homo sapiens
gagagaauccaagccuaaa

SEQ ID NO: 398523 - RNA, 19 nt, Homo sapiens
gaaguaaugaauucagaag

SEQ ID NO: 398524 - RNA, 19 nt, Homo sapiens
ccaguggaauaagguaauu

SEQ ID NO: 398525 - RNA, 19 nt, Homo sapiens
caaggagaacguggauaua

SEQ ID NO: 398526 - RNA, 19 nt, Homo sapiens
uaacugcccuuuuaaaugg

SEQ ID NO: 398527 - RNA, 19 nt, Homo sapiens
gaauccaagccuaaaauua

SEQ ID NO: 398528 - RNA, 19 nt, Homo sapiens
uaugagccuccauuucuua

SEQ ID NO: 398529 - RNA, 19 nt, Homo sapiens
cgagcacaauaaacucaaa

SEQ ID NO: 398530 - RNA, 19 nt, Homo sapiens
guaauugaacaacuaggaa

SEQ ID NO: 398531 - RNA, 19 nt, Homo sapiens
ggagaacguggauauaugg

SEQ ID NO: 398532 - RNA, 19 nt, Homo sapiens
agaaaacgcuggaggaguu

SEQ ID NO: 398533 - RNA, 19 nt, Homo sapiens
uuaaauggcaccuguauac

SEQ ID NO: 398534 - RNA, 19 nt, Homo sapiens
ggacagccuucuccuucag

SEQ ID NO: 398535 - RNA, 19 nt, Homo sapiens
uaagaaacuauguggagaa

SEQ ID NO: 398536 - RNA, 19 nt, Homo sapiens
acaaggagaacguggauau

SEQ ID NO: 398537 - RNA, 19 nt, Homo sapiens
gcaggcacaagcuucauga

SEQ ID NO: 398538 - RNA, 19 nt, Homo sapiens
ccaaguaacauuguaguca

SEQ ID NO: 398539 - RNA, 19 nt, Homo sapiens
gaaacuagcucugauccua

SEQ ID NO: 398540 - RNA, 19 nt, Homo sapiens
gggaugcucuaacgaauua

SEQ ID NO: 398541 - RNA, 19 nt, Homo sapiens
caaauacucuaguuccaaa

SEQ ID NO: 398542 - RNA, 19 nt, Homo sapiens
uaacaacagucauuggauu

SEQ ID NO: 398543 - RNA, 19 nt, Homo sapiens
gaacugaagauucuggauu

SEQ ID NO: 398544 - RNA, 19 nt, Homo sapiens
ccuaguagaugcagaauuc

SEQ ID NO: 398545 - RNA, 19 nt, Homo sapiens
gaaaugggccuaguagaug

SEQ ID NO: 398546 - RNA, 19 nt, Homo sapiens
ggaaaugggccuaguagau

SEQ ID NO: 398547 - RNA, 19 nt, Homo sapiens
gaauacagccuuucaagca

SEQ ID NO: 398548 - RNA, 19 nt, Homo sapiens
ggaguggcaugaagcugua

SEQ ID NO: 398549 - RNA, 19 nt, Homo sapiens
ggaagcagcacaucuacaa

SEQ ID NO: 398550 - RNA, 19 nt, Homo sapiens
ucaaaggccuuaaguacau

SEQ ID NO: 398551 - RNA, 19 nt, Homo sapiens
caaauaaagucacauucuc

SEQ ID NO: 398552 - RNA, 19 nt, Homo sapiens
caacuucuaugacuucuac

SEQ ID NO: 398553 - RNA, 19 nt, Homo sapiens
gggagaagguggccaucaa

SEQ ID NO: 398554 - RNA, 19 nt, Homo sapiens
gaacuugauucccuuacag

SEQ ID NO: 398555 - RNA, 19 nt, Homo sapiens
ggaccaguauuugucacua

SEQ ID NO: 398556 - RNA, 19 nt, Homo sapiens
gccguuugaugauuccuua

SEQ ID NO: 398557 - RNA, 19 nt, Homo sapiens
cuaauccugugugaucuua

SEQ ID NO: 398558 - RNA, 19 nt, Homo sapiens
caaaccugguggauugaaa

SEQ ID NO: 398559 - RNA, 19 nt, Homo sapiens
gcucaaaggccuuaaguac

SEQ ID NO: 398560 - RNA, 19 nt, Homo sapiens
ggauuucacucagcuguuc

SEQ ID NO: 398561 - RNA, 19 nt, Homo sapiens
aaagucacauucucagguu

SEQ ID NO: 398562 - RNA, 19 nt, Homo sapiens
gaagguggccaucaagaag

SEQ ID NO: 398563 - RNA, 19 nt, Homo sapiens
gaugcagaauucaaagaug

SEQ ID NO: 398564 - RNA, 19 nt, Homo sapiens
caacagucauuggauuuag

SEQ ID NO: 398565 - RNA, 19 nt, Homo sapiens
gcaaauacucuaguuccaa

SEQ ID NO: 398566 - RNA, 19 nt, Homo sapiens
gggagaaacuagcucugau

SEQ ID NO: 398567 - RNA, 19 nt, Homo sapiens
gcagaacuugauucccuua

SEQ ID NO: 398568 - RNA, 19 nt, Homo sapiens
aaacucagcccuucuugga

SEQ ID NO: 398569 - RNA, 19 nt, Homo sapiens
gccagacacugcccaagga

SEQ ID NO: 398570 - RNA, 19 nt, Homo sapiens
cagcagccguuugaugauu

SEQ ID NO: 398571 - RNA, 19 nt, Homo sapiens
ccucacccaucccuucuuu

SEQ ID NO: 398572 - RNA, 19 nt, Homo sapiens
aacugaagauucuggauuu

SEQ ID NO: 398573 - RNA, 19 nt, Homo sapiens
ucuaacgaauuaccacaaa

SEQ ID NO: 398574 - RNA, 19 nt, Homo sapiens
ucauugggcuccuggaugu

SEQ ID NO: 398575 - RNA, 19 nt, Homo sapiens
agaagaugcuggagcuaga

SEQ ID NO: 398576 - RNA, 19 nt, Homo sapiens
acaaagcggccaaauccua

SEQ ID NO: 398577 - RNA, 19 nt, Homo sapiens
ugcagaagcugaacgacaa

SEQ ID NO: 398578 - RNA, 19 nt, Homo sapiens
gggcuguggucccuuugaa

SEQ ID NO: 398579 - RNA, 19 nt, Homo sapiens
gaaacagcagaacuugauu

SEQ ID NO: 398580 - RNA, 19 nt, Homo sapiens
ugaaacagcagaacuugau

SEQ ID NO: 398581 - RNA, 19 nt, Homo sapiens
ugacccagauccugaaagu

SEQ ID NO: 398582 - RNA, 19 nt, Homo sapiens
gaaugaggacugugaacug

SEQ ID NO: 398583 - RNA, 19 nt, Homo sapiens
gugaggagaagauccagua

SEQ ID NO: 398584 - RNA, 19 nt, Homo sapiens
ccaaauaaagucacauucu

SEQ ID NO: 398585 - RNA, 19 nt, Homo sapiens
gaagcugagccgacccuuu

SEQ ID NO: 398586 - RNA, 19 nt, Homo sapiens
ugugugaucuuaucuugau

SEQ ID NO: 398587 - RNA, 19 nt, Homo sapiens
cuucuguucucuccucuuu

SEQ ID NO: 398588 - RNA, 19 nt, Homo sapiens
cgacaaagcggccaaaucc

SEQ ID NO: 398589 - RNA, 19 nt, Homo sapiens
gauugaaacagcagaacuu

SEQ ID NO: 398590 - RNA, 19 nt, Homo sapiens
gauccuaacaggccacguu

SEQ ID NO: 398591 - RNA, 19 nt, Homo sapiens
gaaacucacaguggaugaa

SEQ ID NO: 398592 - RNA, 19 nt, Homo sapiens
aaugaggacugugaacuga

SEQ ID NO: 398593 - RNA, 19 nt, Homo sapiens
uggcagugaugcuguguug

SEQ ID NO: 398594 - RNA, 19 nt, Homo sapiens
gagaagguggccaucaaga

SEQ ID NO: 398595 - RNA, 19 nt, Homo sapiens
cugcggaccugcuggagaa

SEQ ID NO: 398596 - RNA, 19 nt, Homo sapiens
ucagcuggaugcacuacaa

SEQ ID NO: 398597 - RNA, 19 nt, Homo sapiens
caaccuggcugugaaugag

SEQ ID NO: 398598 - RNA, 19 nt, Homo sapiens
gcaaccuggcugugaauga

SEQ ID NO: 398599 - RNA, 19 nt, Homo sapiens
ucacccaucccuucuuuga

SEQ ID NO: 398600 - RNA, 19 nt, Homo sapiens
ccaggaaggauuucacuca

SEQ ID NO: 398601 - RNA, 19 nt, Homo sapiens
ccugugugaucuuaucuug

SEQ ID NO: 398602 - RNA, 19 nt, Homo sapiens
aaacuagcucugauccuaa

SEQ ID NO: 398603 - RNA, 19 nt, Homo sapiens
ggagaaacuagcucugauc

SEQ ID NO: 398604 - RNA, 19 nt, Homo sapiens
guuugaugauuccuuagaa

SEQ ID NO: 398605 - RNA, 19 nt, Homo sapiens
gggagcugcugcugcugaa

SEQ ID NO: 398606 - RNA, 19 nt, Homo sapiens
caaggagauugugaacuuc

SEQ ID NO: 398607 - RNA, 19 nt, Homo sapiens
ggaguucagugaggagaag

SEQ ID NO: 398608 - RNA, 19 nt, Homo sapiens
aaucugggauggagguguu

SEQ ID NO: 398609 - RNA, 19 nt, Homo sapiens
gugaugcuguguugguuuc

SEQ ID NO: 398610 - RNA, 19 nt, Homo sapiens
aaacugcccaucuggagaa

SEQ ID NO: 398611 - RNA, 19 nt, Homo sapiens
ccaaggaccaguauuuguc

SEQ ID NO: 398612 - RNA, 19 nt, Homo sapiens
gaacgacaaagcggccaaa

SEQ ID NO: 398613 - RNA, 19 nt, Homo sapiens
ggacugugaacugaagauu

SEQ ID NO: 398614 - RNA, 19 nt, Homo sapiens
acaacagucauuggauuua

SEQ ID NO: 398615 - RNA, 19 nt, Homo sapiens
gcagugaugcuguguuggu

SEQ ID NO: 398616 - RNA, 19 nt, Homo sapiens
acucagcccuucuuggaau

SEQ ID NO: 398617 - RNA, 19 nt, Homo sapiens
ucuguucucuccucuuuua

SEQ ID NO: 398618 - RNA, 19 nt, Homo sapiens
aauggaagcagcacaucua

SEQ ID NO: 398619 - RNA, 19 nt, Homo sapiens
gcgcaacuucuaugacuuc

SEQ ID NO: 398620 - RNA, 19 nt, Homo sapiens
acccagauccugaaaguga

SEQ ID NO: 398621 - RNA, 19 nt, Homo sapiens
uguaucagaugcucaaagg

SEQ ID NO: 398622 - RNA, 19 nt, Homo sapiens
uagggaugcucuaacgaau

SEQ ID NO: 398623 - RNA, 19 nt, Homo sapiens
gcagaagcugaacgacaaa

SEQ ID NO: 398624 - RNA, 19 nt, Homo sapiens
aagcugagccgacccuuuc

SEQ ID NO: 398625 - RNA, 19 nt, Homo sapiens
cugcaucacuccagucucu

SEQ ID NO: 398626 - RNA, 19 nt, Homo sapiens
gaccaguauuugucacuac

SEQ ID NO: 398627 - RNA, 19 nt, Homo sapiens
caaggaccaguauuuguca

SEQ ID NO: 398628 - RNA, 19 nt, Homo sapiens
cccagcagccguuugauga

SEQ ID NO: 398629 - RNA, 19 nt, Homo sapiens
acugugaacugaagauucu

SEQ ID NO: 398630 - RNA, 19 nt, Homo sapiens
ugaggacugugaacugaag

SEQ ID NO: 398631 - RNA, 19 nt, Homo sapiens
gcccaaggaccaguauuug

SEQ ID NO: 398632 - RNA, 19 nt, Homo sapiens
gcuguagggacucaucuug

SEQ ID NO: 398633 - RNA, 19 nt, Homo sapiens
gaauggaagcagcacaucu

SEQ ID NO: 398634 - RNA, 19 nt, Homo sapiens
ucacaguggaugaauggaa

SEQ ID NO: 398635 - RNA, 19 nt, Homo sapiens
ccacccuaauccuguguga

SEQ ID NO: 398636 - RNA, 19 nt, Homo sapiens
cuagggaugcucuaacgaa

SEQ ID NO: 398637 - RNA, 19 nt, Homo sapiens
augcagaauucaaagaugu

SEQ ID NO: 398638 - RNA, 19 nt, Homo sapiens
agaagguggccaucaagaa

SEQ ID NO: 398639 - RNA, 19 nt, Homo sapiens
gaagaaagcuggaagaauu

SEQ ID NO: 398640 - RNA, 19 nt, Homo sapiens
ccagaaagcuaauucaucu

SEQ ID NO: 398641 - RNA, 19 nt, Homo sapiens
gcccuucacugccaugaua

SEQ ID NO: 398642 - RNA, 19 nt, Homo sapiens
ugacauaucugagggagaa

SEQ ID NO: 398643 - RNA, 19 nt, Homo sapiens
gcacauggauggagguucu

SEQ ID NO: 398644 - RNA, 19 nt, Homo sapiens
caacguguauagugccuaa

SEQ ID NO: 398645 - RNA, 19 nt, Homo sapiens
gaagaauuccugaacaaau

SEQ ID NO: 398646 - RNA, 19 nt, Homo sapiens
ggauuuaucuuuccccaua

SEQ ID NO: 398647 - RNA, 19 nt, Homo sapiens
ugggagaacugaaggauga

SEQ ID NO: 398648 - RNA, 19 nt, Homo sapiens
gggcauacuuucucucuag

SEQ ID NO: 398649 - RNA, 19 nt, Homo sapiens
gguagucauucuuacaauu

SEQ ID NO: 398650 - RNA, 19 nt, Homo sapiens
ggauggagguucucuggau

SEQ ID NO: 398651 - RNA, 19 nt, Homo sapiens
guaaacaacguguauagug

SEQ ID NO: 398652 - RNA, 19 nt, Homo sapiens
gaucaagcucugugacuuu

SEQ ID NO: 398653 - RNA, 19 nt, Homo sapiens
uaagggagcugcagguucu

SEQ ID NO: 398654 - RNA, 19 nt, Homo sapiens
uuagugguaugucucuuua

SEQ ID NO: 398655 - RNA, 19 nt, Homo sapiens
gacauuugguggacuuuau

SEQ ID NO: 398656 - RNA, 19 nt, Homo sapiens
gcagagagagcagauuuga

SEQ ID NO: 398657 - RNA, 19 nt, Homo sapiens
guggugaucuguagacuuc

SEQ ID NO: 398658 - RNA, 19 nt, Homo sapiens
guagacuucugguuguauu

SEQ ID NO: 398659 - RNA, 19 nt, Homo sapiens
gagcagauuugaagcaacu

SEQ ID NO: 398660 - RNA, 19 nt, Homo sapiens
gaucaaguccugaagaaag

SEQ ID NO: 398661 - RNA, 19 nt, Homo sapiens
gagguucucuggaucaagu

SEQ ID NO: 398662 - RNA, 19 nt, Homo sapiens
gagagcagauuugaagcaa

SEQ ID NO: 398663 - RNA, 19 nt, Homo sapiens
ggucauggccagaaagcua

SEQ ID NO: 398664 - RNA, 19 nt, Homo sapiens
gaugacgacuuugagaaga

SEQ ID NO: 398665 - RNA, 19 nt, Homo sapiens
gagggagccuugugagauc

SEQ ID NO: 398666 - RNA, 19 nt, Homo sapiens
acugaaggaugacgacuuu

SEQ ID NO: 398667 - RNA, 19 nt, Homo sapiens
ugucacaaauugaucaaga

SEQ ID NO: 398668 - RNA, 19 nt, Homo sapiens
gagaucugaugcugaggaa

SEQ ID NO: 398669 - RNA, 19 nt, Homo sapiens
caacgagccuccuccaaaa

SEQ ID NO: 398670 - RNA, 19 nt, Homo sapiens
cuacagcgauggcgagauc

SEQ ID NO: 398671 - RNA, 19 nt, Homo sapiens
caucagagaguguacauca

SEQ ID NO: 398672 - RNA, 19 nt, Homo sapiens
ucaacgagccuccuccaaa

SEQ ID NO: 398673 - RNA, 19 nt, Homo sapiens
guaccaaugcuguuguaaa

SEQ ID NO: 398674 - RNA, 19 nt, Homo sapiens
ugguaugucucuuuaaguu

SEQ ID NO: 398675 - RNA, 19 nt, Homo sapiens
caguugacauccaaaucua

SEQ ID NO: 398676 - RNA, 19 nt, Homo sapiens
gacaaaggaugaagaacac

SEQ ID NO: 398677 - RNA, 19 nt, Homo sapiens
guagucauucuuacaauug

SEQ ID NO: 398678 - RNA, 19 nt, Homo sapiens
ugacaaaggaugaagaaca

SEQ ID NO: 398679 - RNA, 19 nt, Homo sapiens
ggcacaagguccuacaugu

SEQ ID NO: 398680 - RNA, 19 nt, Homo sapiens
uaaaaggccugacauaucu

SEQ ID NO: 398681 - RNA, 19 nt, Homo sapiens
ggagggagccuugugagau

SEQ ID NO: 398682 - RNA, 19 nt, Homo sapiens
ccaugcugcuggcgucuaa

SEQ ID NO: 398683 - RNA, 19 nt, Homo sapiens
cuacaugucgccagaaaga

SEQ ID NO: 398684 - RNA, 19 nt, Homo sapiens
guacaucgugggcuucuau

SEQ ID NO: 398685 - RNA, 19 nt, Homo sapiens
cgacggcucugcaguuaac

SEQ ID NO: 398686 - RNA, 19 nt, Homo sapiens
gcaguugacauccaaaucu

SEQ ID NO: 398687 - RNA, 19 nt, Homo sapiens
gcacaagguccuacauguc

SEQ ID NO: 398688 - RNA, 19 nt, Homo sapiens
gaaugucacaaauugauca

SEQ ID NO: 398689 - RNA, 19 nt, Homo sapiens
gaucugaugcugaggaagu

SEQ ID NO: 398690 - RNA, 19 nt, Homo sapiens
guuguuggauuacauaguc

SEQ ID NO: 398691 - RNA, 19 nt, Homo sapiens
uggaucaaguccugaagaa

SEQ ID NO: 398692 - RNA, 19 nt, Homo sapiens
ugaaggaugacgacuuuga

SEQ ID NO: 398693 - RNA, 19 nt, Homo sapiens
uaccaaugcuguuguaaac

SEQ ID NO: 398694 - RNA, 19 nt, Homo sapiens
agucuggaauuucaagauu

SEQ ID NO: 398695 - RNA, 19 nt, Homo sapiens
cuaaguggauuggcuuugu

SEQ ID NO: 398696 - RNA, 19 nt, Homo sapiens
cccgacggcucugcaguua

SEQ ID NO: 398697 - RNA, 19 nt, Homo sapiens
gaaggugggagaacugaag

SEQ ID NO: 398698 - RNA, 19 nt, Homo sapiens
agagagagcagauuugaag

SEQ ID NO: 398699 - RNA, 19 nt, Homo sapiens
ccgcagagagagcagauuu

SEQ ID NO: 398700 - RNA, 19 nt, Homo sapiens
gucuggaauuucaagauuu

SEQ ID NO: 398701 - RNA, 19 nt, Homo sapiens
gggagaagcacaagaucau

SEQ ID NO: 398702 - RNA, 19 nt, Homo sapiens
gugcaacucuccguacauc

SEQ ID NO: 398703 - RNA, 19 nt, Homo sapiens
uaaguggauuggcuuugug

SEQ ID NO: 398704 - RNA, 19 nt, Homo sapiens
gguaugucucuuuaaguuu

SEQ ID NO: 398705 - RNA, 19 nt, Homo sapiens
ucagagaguguacaucaug

SEQ ID NO: 398706 - RNA, 19 nt, Homo sapiens
caauggcggugugguguuc

SEQ ID NO: 398707 - RNA, 19 nt, Homo sapiens
augcuuugcugcuaugaaa

SEQ ID NO: 398708 - RNA, 19 nt, Homo sapiens
acaagaucaugcacagaga

SEQ ID NO: 398709 - RNA, 19 nt, Homo sapiens
ccaaaaugcccaagaagaa

SEQ ID NO: 398710 - RNA, 19 nt, Homo sapiens
uuucggacuuugacauuug

SEQ ID NO: 398711 - RNA, 19 nt, Homo sapiens
ggguagucauucuuacaau

SEQ ID NO: 398712 - RNA, 19 nt, Homo sapiens
ggaugacgacuuugagaag

SEQ ID NO: 398713 - RNA, 19 nt, Homo sapiens
ccaguggaguguucagucu

SEQ ID NO: 398714 - RNA, 19 nt, Homo sapiens
ggagaucaaacccgcaauc

SEQ ID NO: 398715 - RNA, 19 nt, Homo sapiens
gaaggaugacgacuuugag

SEQ ID NO: 398716 - RNA, 19 nt, Homo sapiens
ccaaguaccaaugcuguug

SEQ ID NO: 398717 - RNA, 19 nt, Homo sapiens
gugccaggcugaauuacag

SEQ ID NO: 398718 - RNA, 19 nt, Homo sapiens
gaugaagaacacagcaugu

SEQ ID NO: 398719 - RNA, 19 nt, Homo sapiens
guucagaugugcauuucac

SEQ ID NO: 398720 - RNA, 19 nt, Homo sapiens
gcaauggcggugugguguu

SEQ ID NO: 398721 - RNA, 19 nt, Homo sapiens
cgacgcccauccagcugaa

SEQ ID NO: 398722 - RNA, 19 nt, Homo sapiens
gcagaaggugggagaacug

SEQ ID NO: 398723 - RNA, 19 nt, Homo sapiens
gacuuugacauuugacauu

SEQ ID NO: 398724 - RNA, 19 nt, Homo sapiens
uggauuacauagucaacga

SEQ ID NO: 398725 - RNA, 19 nt, Homo sapiens
ugaguuguuggauuacaua

SEQ ID NO: 398726 - RNA, 19 nt, Homo sapiens
cgaccucccauggcaauuu

SEQ ID NO: 398727 - RNA, 19 nt, Homo sapiens
ggaggccccuuagcucaua

SEQ ID NO: 398728 - RNA, 19 nt, Homo sapiens
gguccaaaaugcccaagaa

SEQ ID NO: 398729 - RNA, 19 nt, Homo sapiens
ucccaugccugucucuguu

SEQ ID NO: 398730 - RNA, 19 nt, Homo sapiens
gcuccaccaucggccuuaa

SEQ ID NO: 398731 - RNA, 19 nt, Homo sapiens
gccagaaagcuaauucauc

SEQ ID NO: 398732 - RNA, 19 nt, Homo sapiens
ucauuacucugugcaguca

SEQ ID NO: 398733 - RNA, 19 nt, Homo sapiens
ggaucaaguccugaagaaa

SEQ ID NO: 398734 - RNA, 19 nt, Homo sapiens
aaguaccaaugcuguugua

SEQ ID NO: 398735 - RNA, 19 nt, Homo sapiens
ggugaucuguagacuucug

SEQ ID NO: 398736 - RNA, 19 nt, Homo sapiens
aggcugaauuacagugaaa

SEQ ID NO: 398737 - RNA, 19 nt, Homo sapiens
agauucuacucuugucauu

SEQ ID NO: 398738 - RNA, 19 nt, Homo sapiens
uuggaggccuugcagaaga

SEQ ID NO: 398739 - RNA, 19 nt, Homo sapiens
caaagacgaugacuucgaa

SEQ ID NO: 398740 - RNA, 19 nt, Homo sapiens
auaaaugccucaucaagaa

SEQ ID NO: 398741 - RNA, 19 nt, Homo sapiens
gaucagcauuugcauggaa

SEQ ID NO: 398742 - RNA, 19 nt, Homo sapiens
uggaggagcuggaacuuga

SEQ ID NO: 398743 - RNA, 19 nt, Homo sapiens
uccaggaguuugucaauaa

SEQ ID NO: 398744 - RNA, 19 nt, Homo sapiens
gaaagaggccaagaggauu

SEQ ID NO: 398745 - RNA, 19 nt, Homo sapiens
ggaagcugauccaccuuga

SEQ ID NO: 398746 - RNA, 19 nt, Homo sapiens
gucaauaaaugccucauca

SEQ ID NO: 398747 - RNA, 19 nt, Homo sapiens
gaaugcaacucgccguaca

SEQ ID NO: 398748 - RNA, 19 nt, Homo sapiens
ccaggaguuugucaauaaa

SEQ ID NO: 398749 - RNA, 19 nt, Homo sapiens
gacgaugacuucgaaagga

SEQ ID NO: 398750 - RNA, 19 nt, Homo sapiens
gaacuccuggacuauauug

SEQ ID NO: 398751 - RNA, 19 nt, Homo sapiens
ugaaagaggccaagaggau

SEQ ID NO: 398752 - RNA, 19 nt, Homo sapiens
gguccgagguggaagaagu

SEQ ID NO: 398753 - RNA, 19 nt, Homo sapiens
ugaagaugcucacaaacca

SEQ ID NO: 398754 - RNA, 19 nt, Homo sapiens
ugaacgagccaccuccuaa

SEQ ID NO: 398755 - RNA, 19 nt, Homo sapiens
gagagaagcaccagaucau

SEQ ID NO: 398756 - RNA, 19 nt, Homo sapiens
gcucugcuuccuuagguua

SEQ ID NO: 398757 - RNA, 19 nt, Homo sapiens
caauaaaugccucaucaag

SEQ ID NO: 398758 - RNA, 19 nt, Homo sapiens
ucuuugaacuccuggacua

SEQ ID NO: 398759 - RNA, 19 nt, Homo sapiens
aauaaaugccucaucaaga

SEQ ID NO: 398760 - RNA, 19 nt, Homo sapiens
gaagaaggagagccucaca

SEQ ID NO: 398761 - RNA, 19 nt, Homo sapiens
gaucaugcaccgagaugug

SEQ ID NO: 398762 - RNA, 19 nt, Homo sapiens
gggcggaccugaagaugcu

SEQ ID NO: 398763 - RNA, 19 nt, Homo sapiens
gaacgagccaccuccuaag

SEQ ID NO: 398764 - RNA, 19 nt, Homo sapiens
gcauuugcauggaacacau

SEQ ID NO: 398765 - RNA, 19 nt, Homo sapiens
ugguggaccugcagaagaa

SEQ ID NO: 398766 - RNA, 19 nt, Homo sapiens
gguugcagggcacacauua

SEQ ID NO: 398767 - RNA, 19 nt, Homo sapiens
acucaaagacgaugacuuc

SEQ ID NO: 398768 - RNA, 19 nt, Homo sapiens
ucacaaaccacaccuucau

SEQ ID NO: 398769 - RNA, 19 nt, Homo sapiens
uggaccaggugcugaaaga

SEQ ID NO: 398770 - RNA, 19 nt, Homo sapiens
gaucaagcugugugacuuc

SEQ ID NO: 398771 - RNA, 19 nt, Homo sapiens
gaugugaagcccuccaaca

SEQ ID NO: 398772 - RNA, 19 nt, Homo sapiens
cgagagaagcaccagauca

SEQ ID NO: 398773 - RNA, 19 nt, Homo sapiens
uggcguaccuccgagagaa

SEQ ID NO: 398774 - RNA, 19 nt, Homo sapiens
uugaacuccuggacuauau

SEQ ID NO: 398775 - RNA, 19 nt, Homo sapiens
gcaacucgccguacaucgu

SEQ ID NO: 398776 - RNA, 19 nt, Homo sapiens
caaaccacaccuucaucaa

SEQ ID NO: 398777 - RNA, 19 nt, Homo sapiens
uggacuauauugugaacga

SEQ ID NO: 398778 - RNA, 19 nt, Homo sapiens
ucaaagacgaugacuucga

SEQ ID NO: 398779 - RNA, 19 nt, Homo sapiens
cuccuggacuauauuguga

SEQ ID NO: 398780 - RNA, 19 nt, Homo sapiens
ccuccaacauccucgugaa

SEQ ID NO: 398781 - RNA, 19 nt, Homo sapiens
aggaguuugucaauaaaug

SEQ ID NO: 398782 - RNA, 19 nt, Homo sapiens
gagcuggaggccaucuuug

SEQ ID NO: 398783 - RNA, 19 nt, Homo sapiens
ccaacauccucgugaacuc

SEQ ID NO: 398784 - RNA, 19 nt, Homo sapiens
guacaucgugggcuucuac

SEQ ID NO: 398785 - RNA, 19 nt, Homo sapiens
gaccugaagaugcucacaa

SEQ ID NO: 398786 - RNA, 19 nt, Homo sapiens
uuccaggaguuugucaaua

SEQ ID NO: 398787 - RNA, 19 nt, Homo sapiens
agaucaagcugugugacuu

SEQ ID NO: 398788 - RNA, 19 nt, Homo sapiens
guaaaacccugcggcugaa

SEQ ID NO: 398789 - RNA, 19 nt, Homo sapiens
aaaccacaccuucaucaag

SEQ ID NO: 398790 - RNA, 19 nt, Homo sapiens
aagcugauccaccuugaga

SEQ ID NO: 398791 - RNA, 19 nt, Homo sapiens
acaaaccacaccuucauca

SEQ ID NO: 398792 - RNA, 19 nt, Homo sapiens
accugaagaugcucacaaa

SEQ ID NO: 398793 - RNA, 19 nt, Homo sapiens
ucaauaaaugccucaucaa

SEQ ID NO: 398794 - RNA, 19 nt, Homo sapiens
gcagaagaagcggcuggaa

SEQ ID NO: 398795 - RNA, 19 nt, Homo sapiens
aaggagagccucacagcau

SEQ ID NO: 398796 - RNA, 19 nt, Homo sapiens
aaagaggccaagaggauuc

SEQ ID NO: 398797 - RNA, 19 nt, Homo sapiens
gagaucaagcugugugacu

SEQ ID NO: 398798 - RNA, 19 nt, Homo sapiens
gagaugugaagcccuccaa

SEQ ID NO: 398799 - RNA, 19 nt, Homo sapiens
ugccauggccaucuuugaa

SEQ ID NO: 398800 - RNA, 19 nt, Homo sapiens
gaagaaggaucuacggaua

SEQ ID NO: 398801 - RNA, 19 nt, Homo sapiens
gggaugaguugugugaaua

SEQ ID NO: 398802 - RNA, 19 nt, Homo sapiens
gcagaggccaguccauaua

SEQ ID NO: 398803 - RNA, 19 nt, Homo sapiens
gguggaggcugaugacuug

SEQ ID NO: 398804 - RNA, 19 nt, Homo sapiens
cagaagggcuacaauguca

SEQ ID NO: 398805 - RNA, 19 nt, Homo sapiens
ucauucaccuuucguguuu

SEQ ID NO: 398806 - RNA, 19 nt, Homo sapiens
ccaauguccuuaucaacaa

SEQ ID NO: 398807 - RNA, 19 nt, Homo sapiens
gaauggacuuugcacacuu

SEQ ID NO: 398808 - RNA, 19 nt, Homo sapiens
ccauccaaguuguauauuu

SEQ ID NO: 398809 - RNA, 19 nt, Homo sapiens
caaagaagcagaccauugg

SEQ ID NO: 398810 - RNA, 19 nt, Homo sapiens
cagagaggcuggucauauc

SEQ ID NO: 398811 - RNA, 19 nt, Homo sapiens
ccaaagaagcagaccauug

SEQ ID NO: 398812 - RNA, 19 nt, Homo sapiens
cuacggauauccugcaugu

SEQ ID NO: 398813 - RNA, 19 nt, Homo sapiens
acccagagcugaaccagaa

SEQ ID NO: 398814 - RNA, 19 nt, Homo sapiens
ggagauugcugugucuauc

SEQ ID NO: 398815 - RNA, 19 nt, Homo sapiens
gugaagaugugugacuuug

SEQ ID NO: 398816 - RNA, 19 nt, Homo sapiens
ccgcagagcguaugagcua

SEQ ID NO: 398817 - RNA, 19 nt, Homo sapiens
ucauggaccuggacaucaa

SEQ ID NO: 398818 - RNA, 19 nt, Homo sapiens
uuuaaucucucgacugaau

SEQ ID NO: 398819 - RNA, 19 nt, Homo sapiens
uggcaucaguggcuacuug

SEQ ID NO: 398820 - RNA, 19 nt, Homo sapiens
ggagggccaugugaagaug

SEQ ID NO: 398821 - RNA, 19 nt, Homo sapiens
caacaaggagggccaugug

SEQ ID NO: 398822 - RNA, 19 nt, Homo sapiens
gaugugaagcccuccaaug

SEQ ID NO: 398823 - RNA, 19 nt, Homo sapiens
agaagcggcugcucaugga

SEQ ID NO: 398824 - RNA, 19 nt, Homo sapiens
gaaccagaagggcuacaau

SEQ ID NO: 398825 - RNA, 19 nt, Homo sapiens
ggaccuggacaucaacaug

SEQ ID NO: 398826 - RNA, 19 nt, Homo sapiens
acaccucuaucccggcuuu

SEQ ID NO: 398827 - RNA, 19 nt, Homo sapiens
accggaaggugcuggauaa

SEQ ID NO: 398828 - RNA, 19 nt, Homo sapiens
cauuggagacagaaacuuu

SEQ ID NO: 398829 - RNA, 19 nt, Homo sapiens
ccaagaagacggacauugc

SEQ ID NO: 398830 - RNA, 19 nt, Homo sapiens
caucaccauuggagacaga

SEQ ID NO: 398831 - RNA, 19 nt, Homo sapiens
ggaccuucaucaccauugg

SEQ ID NO: 398832 - RNA, 19 nt, Homo sapiens
aauggacuuugcacacuuu

SEQ ID NO: 398833 - RNA, 19 nt, Homo sapiens
gugcucacccacaccauaa

SEQ ID NO: 398834 - RNA, 19 nt, Homo sapiens
agaaggaucuacggauauc

SEQ ID NO: 398835 - RNA, 19 nt, Homo sapiens
gcuacuugguggacucugu

SEQ ID NO: 398836 - RNA, 19 nt, Homo sapiens
ccuccaauguccuuaucaa

SEQ ID NO: 398837 - RNA, 19 nt, Homo sapiens
uggagcaucugcacagcaa

SEQ ID NO: 398838 - RNA, 19 nt, Homo sapiens
gaagggcuacaaugucaag

SEQ ID NO: 398839 - RNA, 19 nt, Homo sapiens
acagagaggcuggucauau

SEQ ID NO: 398840 - RNA, 19 nt, Homo sapiens
gagcacagccuacgauccu

SEQ ID NO: 398841 - RNA, 19 nt, Homo sapiens
uuauggguuuggcuuguuu

SEQ ID NO: 398842 - RNA, 19 nt, Homo sapiens
ugaauggacuuugcacacu

SEQ ID NO: 398843 - RNA, 19 nt, Homo sapiens
caaggagggccaugugaag

SEQ ID NO: 398844 - RNA, 19 nt, Homo sapiens
ccagaagggcuacaauguc

SEQ ID NO: 398845 - RNA, 19 nt, Homo sapiens
ggacauccuuggggagauu

SEQ ID NO: 398846 - RNA, 19 nt, Homo sapiens
ugucccaagugccaaagaa

SEQ ID NO: 398847 - RNA, 19 nt, Homo sapiens
gauccugggagaagacuca

SEQ ID NO: 398848 - RNA, 19 nt, Homo sapiens
gaaaauccaagaggaagaa

SEQ ID NO: 398849 - RNA, 19 nt, Homo sapiens
gcaccuugcagacgugauc

SEQ ID NO: 398850 - RNA, 19 nt, Homo sapiens
ucuacacugucaccuucua

SEQ ID NO: 398851 - RNA, 19 nt, Homo sapiens
ccagagcggcaccaucaug

SEQ ID NO: 398852 - RNA, 19 nt, Homo sapiens
ggaucaacccagagcugaa

SEQ ID NO: 398853 - RNA, 19 nt, Homo sapiens
acaaggagggccaugugaa

SEQ ID NO: 398854 - RNA, 19 nt, Homo sapiens
ugucggugauccacagaga

SEQ ID NO: 398855 - RNA, 19 nt, Homo sapiens
ccacccauccagcccauau

SEQ ID NO: 398856 - RNA, 19 nt, Homo sapiens
gggagauugcugugucuau

SEQ ID NO: 398857 - RNA, 19 nt, Homo sapiens
ccaagaggaagaaggaucu

SEQ ID NO: 398858 - RNA, 19 nt, Homo sapiens
gaacucacaggagcagaag

SEQ ID NO: 398859 - RNA, 19 nt, Homo sapiens
ucacccacaccauaagcua

SEQ ID NO: 398860 - RNA, 19 nt, Homo sapiens
gacagagaggcuggucaua

SEQ ID NO: 398861 - RNA, 19 nt, Homo sapiens
gcucauggaccuggacauc

SEQ ID NO: 398862 - RNA, 19 nt, Homo sapiens
caauguccuuaucaacaag

SEQ ID NO: 398863 - RNA, 19 nt, Homo sapiens
gaagcccuccaauguccuu

SEQ ID NO: 398864 - RNA, 19 nt, Homo sapiens
ugaacucacaggagcagaa

SEQ ID NO: 398865 - RNA, 19 nt, Homo sapiens
caagaagacggacauugcu

SEQ ID NO: 398866 - RNA, 19 nt, Homo sapiens
gcccuccaauguccuuauc

SEQ ID NO: 398867 - RNA, 19 nt, Homo sapiens
aagaaggaucuacggauau

SEQ ID NO: 398868 - RNA, 19 nt, Homo sapiens
gagaugugaagcccuccaa

SEQ ID NO: 398869 - RNA, 19 nt, Homo sapiens
gucauucaccuuucguguu

SEQ ID NO: 398870 - RNA, 19 nt, Homo sapiens
gccaugugaagauguguga

SEQ ID NO: 398871 - RNA, 19 nt, Homo sapiens
uaccggaaggugcuggaua

SEQ ID NO: 398872 - RNA, 19 nt, Homo sapiens
gaagaaggaucuacggaua

SEQ ID NO: 398873 - RNA, 19 nt, Homo sapiens
gggaugaguugugugaaua

SEQ ID NO: 398874 - RNA, 19 nt, Homo sapiens
gguggaggcugaugacuug

SEQ ID NO: 398875 - RNA, 19 nt, Homo sapiens
cagaagggcuacaauguca

SEQ ID NO: 398876 - RNA, 19 nt, Homo sapiens
ucauucaccuuucguguuu

SEQ ID NO: 398877 - RNA, 19 nt, Homo sapiens
ccaauguccuuaucaacaa

SEQ ID NO: 398878 - RNA, 19 nt, Homo sapiens
gaauggacuuugcacacuu

SEQ ID NO: 398879 - RNA, 19 nt, Homo sapiens
ccauccaaguuguauauuu

SEQ ID NO: 398880 - RNA, 19 nt, Homo sapiens
caaagaagcagaccauugg

SEQ ID NO: 398881 - RNA, 19 nt, Homo sapiens
ccaaagaagcagaccauug

SEQ ID NO: 398882 - RNA, 19 nt, Homo sapiens
cuacggauauccugcaugu

SEQ ID NO: 398883 - RNA, 19 nt, Homo sapiens
acccagagcugaaccagaa

SEQ ID NO: 398884 - RNA, 19 nt, Homo sapiens
ggagauugcugugucuauc

SEQ ID NO: 398885 - RNA, 19 nt, Homo sapiens
gugaagaugugugacuuug

SEQ ID NO: 398886 - RNA, 19 nt, Homo sapiens
gcaguccucuagauuaguc

SEQ ID NO: 398887 - RNA, 19 nt, Homo sapiens
ccgcagagcguaugagcua

SEQ ID NO: 398888 - RNA, 19 nt, Homo sapiens
ucauggaccuggacaucaa

SEQ ID NO: 398889 - RNA, 19 nt, Homo sapiens
uuuaaucucucgacugaau

SEQ ID NO: 398890 - RNA, 19 nt, Homo sapiens
uggcaucaguggcuacuug

SEQ ID NO: 398891 - RNA, 19 nt, Homo sapiens
ggagggccaugugaagaug

SEQ ID NO: 398892 - RNA, 19 nt, Homo sapiens
caacaaggagggccaugug

SEQ ID NO: 398893 - RNA, 19 nt, Homo sapiens
gaugugaagcccuccaaug

SEQ ID NO: 398894 - RNA, 19 nt, Homo sapiens
agaagcggcugcucaugga

SEQ ID NO: 398895 - RNA, 19 nt, Homo sapiens
gaaccagaagggcuacaau

SEQ ID NO: 398896 - RNA, 19 nt, Homo sapiens
ccgcaguccucuagauuag

SEQ ID NO: 398897 - RNA, 19 nt, Homo sapiens
ggaccuggacaucaacaug

SEQ ID NO: 398898 - RNA, 19 nt, Homo sapiens
acaccucuaucccggcuuu

SEQ ID NO: 398899 - RNA, 19 nt, Homo sapiens
accggaaggugcuggauaa

SEQ ID NO: 398900 - RNA, 19 nt, Homo sapiens
cauuggagacagaaacuuu

SEQ ID NO: 398901 - RNA, 19 nt, Homo sapiens
ccaagaagacggacauugc

SEQ ID NO: 398902 - RNA, 19 nt, Homo sapiens
caucaccauuggagacaga

SEQ ID NO: 398903 - RNA, 19 nt, Homo sapiens
ggaccuucaucaccauugg

SEQ ID NO: 398904 - RNA, 19 nt, Homo sapiens
aauggacuuugcacacuuu

SEQ ID NO: 398905 - RNA, 19 nt, Homo sapiens
gugcucacccacaccauaa

SEQ ID NO: 398906 - RNA, 19 nt, Homo sapiens
agaaggaucuacggauauc

SEQ ID NO: 398907 - RNA, 19 nt, Homo sapiens
gcuacuugguggacucugu

SEQ ID NO: 398908 - RNA, 19 nt, Homo sapiens
ccuccaauguccuuaucaa

SEQ ID NO: 398909 - RNA, 19 nt, Homo sapiens
uggagcaucugcacagcaa

SEQ ID NO: 398910 - RNA, 19 nt, Homo sapiens
gaagggcuacaaugucaag

SEQ ID NO: 398911 - RNA, 19 nt, Homo sapiens
uuauggguuuggcuuguuu

SEQ ID NO: 398912 - RNA, 19 nt, Homo sapiens
ugaauggacuuugcacacu

SEQ ID NO: 398913 - RNA, 19 nt, Homo sapiens
caaggagggccaugugaag

SEQ ID NO: 398914 - RNA, 19 nt, Homo sapiens
ccagaagggcuacaauguc

SEQ ID NO: 398915 - RNA, 19 nt, Homo sapiens
ggacauccuuggggagauu

SEQ ID NO: 398916 - RNA, 19 nt, Homo sapiens
ugucccaagugccaaagaa

SEQ ID NO: 398917 - RNA, 19 nt, Homo sapiens
gauccugggagaagacuca

SEQ ID NO: 398918 - RNA, 19 nt, Homo sapiens
gaaaauccaagaggaagaa

SEQ ID NO: 398919 - RNA, 19 nt, Homo sapiens
ucuacacugucaccuucua

SEQ ID NO: 398920 - RNA, 19 nt, Homo sapiens
ccagagcggcaccaucaug

SEQ ID NO: 398921 - RNA, 19 nt, Homo sapiens
ggaucaacccagagcugaa

SEQ ID NO: 398922 - RNA, 19 nt, Homo sapiens
acaaggagggccaugugaa

SEQ ID NO: 398923 - RNA, 19 nt, Homo sapiens
ugucggugauccacagaga

SEQ ID NO: 398924 - RNA, 19 nt, Homo sapiens
ccaagaggaagaaggaucu

SEQ ID NO: 398925 - RNA, 19 nt, Homo sapiens
gggagauugcugugucuau

SEQ ID NO: 398926 - RNA, 19 nt, Homo sapiens
gaacucacaggagcagaag

SEQ ID NO: 398927 - RNA, 19 nt, Homo sapiens
ucacccacaccauaagcua

SEQ ID NO: 398928 - RNA, 19 nt, Homo sapiens
gcccgcaguccucuagauu

SEQ ID NO: 398929 - RNA, 19 nt, Homo sapiens
gcucauggaccuggacauc

SEQ ID NO: 398930 - RNA, 19 nt, Homo sapiens
cccgcaguccucuagauua

SEQ ID NO: 398931 - RNA, 19 nt, Homo sapiens
caauguccuuaucaacaag

SEQ ID NO: 398932 - RNA, 19 nt, Homo sapiens
gaagcccuccaauguccuu

SEQ ID NO: 398933 - RNA, 19 nt, Homo sapiens
ugaacucacaggagcagaa

SEQ ID NO: 398934 - RNA, 19 nt, Homo sapiens
caagaagacggacauugcu

SEQ ID NO: 398935 - RNA, 19 nt, Homo sapiens
aagaaggaucuacggauau

SEQ ID NO: 398936 - RNA, 19 nt, Homo sapiens
gcccuccaauguccuuauc

SEQ ID NO: 398937 - RNA, 19 nt, Homo sapiens
gagaugugaagcccuccaa

SEQ ID NO: 398938 - RNA, 19 nt, Homo sapiens
gucauucaccuuucguguu

SEQ ID NO: 398939 - RNA, 19 nt, Homo sapiens
gccaugugaagauguguga

SEQ ID NO: 398940 - RNA, 19 nt, Homo sapiens
uaccggaaggugcuggaua

SEQ ID NO: 398941 - RNA, 19 nt, Homo sapiens
gaagaaggaucuacggaua

SEQ ID NO: 398942 - RNA, 19 nt, Homo sapiens
gggaugaguugugugaaua

SEQ ID NO: 398943 - RNA, 19 nt, Homo sapiens
gguggaggcugaugacuug

SEQ ID NO: 398944 - RNA, 19 nt, Homo sapiens
cagaagggcuacaauguca

SEQ ID NO: 398945 - RNA, 19 nt, Homo sapiens
ucauucaccuuucguguuu

SEQ ID NO: 398946 - RNA, 19 nt, Homo sapiens
ccaauguccuuaucaacaa

SEQ ID NO: 398947 - RNA, 19 nt, Homo sapiens
gaauggacuuugcacacuu

SEQ ID NO: 398948 - RNA, 19 nt, Homo sapiens
ccauccaaguuguauauuu

SEQ ID NO: 398949 - RNA, 19 nt, Homo sapiens
caaagaagcagaccauugg

SEQ ID NO: 398950 - RNA, 19 nt, Homo sapiens
caccuucucuccauucuau

SEQ ID NO: 398951 - RNA, 19 nt, Homo sapiens
ccaaagaagcagaccauug

SEQ ID NO: 398952 - RNA, 19 nt, Homo sapiens
cuacggauauccugcaugu

SEQ ID NO: 398953 - RNA, 19 nt, Homo sapiens
acccagagcugaaccagaa

SEQ ID NO: 398954 - RNA, 19 nt, Homo sapiens
ggagauugcugugucuauc

SEQ ID NO: 398955 - RNA, 19 nt, Homo sapiens
ccagggagguacucaagau

SEQ ID NO: 398956 - RNA, 19 nt, Homo sapiens
gugaagaugugugacuuug

SEQ ID NO: 398957 - RNA, 19 nt, Homo sapiens
ccgcagagcguaugagcua

SEQ ID NO: 398958 - RNA, 19 nt, Homo sapiens
ucauggaccuggacaucaa

SEQ ID NO: 398959 - RNA, 19 nt, Homo sapiens
uuuaaucucucgacugaau

SEQ ID NO: 398960 - RNA, 19 nt, Homo sapiens
caccuucucuccauucuag

SEQ ID NO: 398961 - RNA, 19 nt, Homo sapiens
uggcaucaguggcuacuug

SEQ ID NO: 398962 - RNA, 19 nt, Homo sapiens
ggagggccaugugaagaug

SEQ ID NO: 398963 - RNA, 19 nt, Homo sapiens
gggagguacucaagaugug

SEQ ID NO: 398964 - RNA, 19 nt, Homo sapiens
caacaaggagggccaugug

SEQ ID NO: 398965 - RNA, 19 nt, Homo sapiens
gaugugaagcccuccaaug

SEQ ID NO: 398966 - RNA, 19 nt, Homo sapiens
agaagcggcugcucaugga

SEQ ID NO: 398967 - RNA, 19 nt, Homo sapiens
cacaucccauugauugauu

SEQ ID NO: 398968 - RNA, 19 nt, Homo sapiens
gaaccagaagggcuacaau

SEQ ID NO: 398969 - RNA, 19 nt, Homo sapiens
ggaccuggacaucaacaug

SEQ ID NO: 398970 - RNA, 19 nt, Homo sapiens
acaccucuaucccggcuuu

SEQ ID NO: 398971 - RNA, 19 nt, Homo sapiens
accggaaggugcuggauaa

SEQ ID NO: 398972 - RNA, 19 nt, Homo sapiens
cauuggagacagaaacuuu

SEQ ID NO: 398973 - RNA, 19 nt, Homo sapiens
ccaagaagacggacauugc

SEQ ID NO: 398974 - RNA, 19 nt, Homo sapiens
caucaccauuggagacaga

SEQ ID NO: 398975 - RNA, 19 nt, Homo sapiens
ggaccuucaucaccauugg

SEQ ID NO: 398976 - RNA, 19 nt, Homo sapiens
aauggacuuugcacacuuu

SEQ ID NO: 398977 - RNA, 19 nt, Homo sapiens
gugcucacccacaccauaa

SEQ ID NO: 398978 - RNA, 19 nt, Homo sapiens
agaaggaucuacggauauc

SEQ ID NO: 398979 - RNA, 19 nt, Homo sapiens
gcuacuugguggacucugu

SEQ ID NO: 398980 - RNA, 19 nt, Homo sapiens
ccuccaauguccuuaucaa

SEQ ID NO: 398981 - RNA, 19 nt, Homo sapiens
uggagcaucugcacagcaa

SEQ ID NO: 398982 - RNA, 19 nt, Homo sapiens
gaagggcuacaaugucaag

SEQ ID NO: 398983 - RNA, 19 nt, Homo sapiens
uuauggguuuggcuuguuu

SEQ ID NO: 398984 - RNA, 19 nt, Homo sapiens
ugaauggacuuugcacacu

SEQ ID NO: 398985 - RNA, 19 nt, Homo sapiens
caaggagggccaugugaag

SEQ ID NO: 398986 - RNA, 19 nt, Homo sapiens
ccagaagggcuacaauguc

SEQ ID NO: 398987 - RNA, 19 nt, Homo sapiens
ggacauccuuggggagauu

SEQ ID NO: 398988 - RNA, 19 nt, Homo sapiens
acaucccauugauugauua

SEQ ID NO: 398989 - RNA, 19 nt, Homo sapiens
ugucccaagugccaaagaa

SEQ ID NO: 398990 - RNA, 19 nt, Homo sapiens
gauccugggagaagacuca

SEQ ID NO: 398991 - RNA, 19 nt, Homo sapiens
gaaaauccaagaggaagaa

SEQ ID NO: 398992 - RNA, 19 nt, Homo sapiens
ucuacacugucaccuucua

SEQ ID NO: 398993 - RNA, 19 nt, Homo sapiens
ccagacgccucaccuucuc

SEQ ID NO: 398994 - RNA, 19 nt, Homo sapiens
ccagagcggcaccaucaug

SEQ ID NO: 398995 - RNA, 19 nt, Homo sapiens
ccagacgccucaccuucuc

SEQ ID NO: 398996 - RNA, 19 nt, Homo sapiens
ggaucaacccagagcugaa

SEQ ID NO: 398997 - RNA, 19 nt, Homo sapiens
acaaggagggccaugugaa

SEQ ID NO: 398998 - RNA, 19 nt, Homo sapiens
ugucggugauccacagaga

SEQ ID NO: 398999 - RNA, 19 nt, Homo sapiens
gggagauugcugugucuau

SEQ ID NO: 399000 - RNA, 19 nt, Homo sapiens
ccacaucccauugauugau

SEQ ID NO: 399001 - RNA, 19 nt, Homo sapiens
gaacucacaggagcagaag

SEQ ID NO: 399002 - RNA, 19 nt, Homo sapiens
ucccauugauugauuaguc

SEQ ID NO: 399003 - RNA, 19 nt, Homo sapiens
ccaagaggaagaaggaucu

SEQ ID NO: 399004 - RNA, 19 nt, Homo sapiens
ucacccacaccauaagcua

SEQ ID NO: 399005 - RNA, 19 nt, Homo sapiens
ccagugcgggcugagauaa

SEQ ID NO: 399006 - RNA, 19 nt, Homo sapiens
cccauugauugauuaguca

SEQ ID NO: 399007 - RNA, 19 nt, Homo sapiens
gcucauggaccuggacauc

SEQ ID NO: 399008 - RNA, 19 nt, Homo sapiens
caauguccuuaucaacaag

SEQ ID NO: 399009 - RNA, 19 nt, Homo sapiens
gaagcccuccaauguccuu

SEQ ID NO: 399010 - RNA, 19 nt, Homo sapiens
ugaacucacaggagcagaa

SEQ ID NO: 399011 - RNA, 19 nt, Homo sapiens
caagaagacggacauugcu

SEQ ID NO: 399012 - RNA, 19 nt, Homo sapiens
gcccuccaauguccuuauc

SEQ ID NO: 399013 - RNA, 19 nt, Homo sapiens
aagaaggaucuacggauau

SEQ ID NO: 399014 - RNA, 19 nt, Homo sapiens
gagaugugaagcccuccaa

SEQ ID NO: 399015 - RNA, 19 nt, Homo sapiens
gucauucaccuuucguguu

SEQ ID NO: 399016 - RNA, 19 nt, Homo sapiens
gccaugugaagauguguga

SEQ ID NO: 399017 - RNA, 19 nt, Homo sapiens
uaccggaaggugcuggaua

SEQ ID NO: 399018 - RNA, 19 nt, Homo sapiens
gcaaguaaauggacaguua

SEQ ID NO: 399019 - RNA, 19 nt, Homo sapiens
gcacucagcuggugaauuc

SEQ ID NO: 399020 - RNA, 19 nt, Homo sapiens
gaacauacauggccugaag

SEQ ID NO: 399021 - RNA, 19 nt, Homo sapiens
gcaaugcugucauauuauu

SEQ ID NO: 399022 - RNA, 19 nt, Homo sapiens
gaagauggugaucgaauua

SEQ ID NO: 399023 - RNA, 19 nt, Homo sapiens
aggcaaugcugucauauua

SEQ ID NO: 399024 - RNA, 19 nt, Homo sapiens
gaacauguccuuggaagaa

SEQ ID NO: 399025 - RNA, 19 nt, Homo sapiens
uaagugcgauucaucauau

SEQ ID NO: 399026 - RNA, 19 nt, Homo sapiens
ugaaggcaaugcugucaua

SEQ ID NO: 399027 - RNA, 19 nt, Homo sapiens
gaacaagacauacgauauc

SEQ ID NO: 399028 - RNA, 19 nt, Homo sapiens
gcaucaagaucccaaauag

SEQ ID NO: 399029 - RNA, 19 nt, Homo sapiens
cuacagcauuugaauauga

SEQ ID NO: 399030 - RNA, 19 nt, Homo sapiens
gcaguucaaugauggaaau

SEQ ID NO: 399031 - RNA, 19 nt, Homo sapiens
guuaaaggccuuacuuauu

SEQ ID NO: 399032 - RNA, 19 nt, Homo sapiens
gccagcaccugaagaauug

SEQ ID NO: 399033 - RNA, 19 nt, Homo sapiens
gagaagugaugaggaaaug

SEQ ID NO: 399034 - RNA, 19 nt, Homo sapiens
gaauuacagugagaaguga

SEQ ID NO: 399035 - RNA, 19 nt, Homo sapiens
caacuacagcauuugaaua

SEQ ID NO: 399036 - RNA, 19 nt, Homo sapiens
agaagcaaauuaugucuga

SEQ ID NO: 399037 - RNA, 19 nt, Homo sapiens
guaaauggacaguuaauag

SEQ ID NO: 399038 - RNA, 19 nt, Homo sapiens
gaagugaugaggaaaugaa

SEQ ID NO: 399039 - RNA, 19 nt, Homo sapiens
ugaagauggugaucgaauu

SEQ ID NO: 399040 - RNA, 19 nt, Homo sapiens
gaugaaugaacaagacaua

SEQ ID NO: 399041 - RNA, 19 nt, Homo sapiens
caacaacuacagcauuuga

SEQ ID NO: 399042 - RNA, 19 nt, Homo sapiens
guaaaggucauacuacuag

SEQ ID NO: 399043 - RNA, 19 nt, Homo sapiens
cagauucacuuccaagcaa

SEQ ID NO: 399044 - RNA, 19 nt, Homo sapiens
gaaagcccaggaccaguaa

SEQ ID NO: 399045 - RNA, 19 nt, Homo sapiens
uaaaggccuuacuuauuug

SEQ ID NO: 399046 - RNA, 19 nt, Homo sapiens
ccaauggccagaugaauga

SEQ ID NO: 399047 - RNA, 19 nt, Homo sapiens
agcaauagcuuaaagaagu

SEQ ID NO: 399048 - RNA, 19 nt, Homo sapiens
gcaauagcuuaaagaaguc

SEQ ID NO: 399049 - RNA, 19 nt, Homo sapiens
guaauggaacagcaaguaa

SEQ ID NO: 399050 - RNA, 19 nt, Homo sapiens
gggaaaauauuagcuguaa

SEQ ID NO: 399051 - RNA, 19 nt, Homo sapiens
gagccucuuuaaccuguaa

SEQ ID NO: 399052 - RNA, 19 nt, Homo sapiens
ugaaagcccaggaccagua

SEQ ID NO: 399053 - RNA, 19 nt, Homo sapiens
gugaagcccuccaauaugc

SEQ ID NO: 399054 - RNA, 19 nt, Homo sapiens
gacgugaagcccuccaaua

SEQ ID NO: 399055 - RNA, 19 nt, Homo sapiens
ggucauacuacuagauauu

SEQ ID NO: 399056 - RNA, 19 nt, Homo sapiens
guggacaccugccgcugua

SEQ ID NO: 399057 - RNA, 19 nt, Homo sapiens
uggaacaaaugcuuauaug

SEQ ID NO: 399058 - RNA, 19 nt, Homo sapiens
cuacaaagcauaucauguc

SEQ ID NO: 399059 - RNA, 19 nt, Homo sapiens
ggccagcaccugaagaauu

SEQ ID NO: 399060 - RNA, 19 nt, Homo sapiens
ggagccauuuguacauuuc

SEQ ID NO: 399061 - RNA, 19 nt, Homo sapiens
caaguaaauggacaguuaa

SEQ ID NO: 399062 - RNA, 19 nt, Homo sapiens
gcccagcagucucagauuc

SEQ ID NO: 399063 - RNA, 19 nt, Homo sapiens
ggugaucgaauuacaguga

SEQ ID NO: 399064 - RNA, 19 nt, Homo sapiens
ucagggaugugcuggaugu

SEQ ID NO: 399065 - RNA, 19 nt, Homo sapiens
gaaaacagccaaaagaaag

SEQ ID NO: 399066 - RNA, 19 nt, Homo sapiens
ccuccaauaugcuaguaaa

SEQ ID NO: 399067 - RNA, 19 nt, Homo sapiens
gaauugcaguagcaguugu

SEQ ID NO: 399068 - RNA, 19 nt, Homo sapiens
gccagaacauguccuugga

SEQ ID NO: 399069 - RNA, 19 nt, Homo sapiens
gauauuacacuggaacuuc

SEQ ID NO: 399070 - RNA, 19 nt, Homo sapiens
gcacagucuacaaagcaua

SEQ ID NO: 399071 - RNA, 19 nt, Homo sapiens
gaaugaacaagacauacga

SEQ ID NO: 399072 - RNA, 19 nt, Homo sapiens
agcaacaacuacagcauuu

SEQ ID NO: 399073 - RNA, 19 nt, Homo sapiens
agguuaagcugugugauuu

SEQ ID NO: 399074 - RNA, 19 nt, Homo sapiens
gaucuuuggauguauauag

SEQ ID NO: 399075 - RNA, 19 nt, Homo sapiens
ccagaugaaugaacaagac

SEQ ID NO: 399076 - RNA, 19 nt, Homo sapiens
cgaauuacagugagaagug

SEQ ID NO: 399077 - RNA, 19 nt, Homo sapiens
gaagcaaauuaugucugaa

SEQ ID NO: 399078 - RNA, 19 nt, Homo sapiens
ugaacaagacauacgauau

SEQ ID NO: 399079 - RNA, 19 nt, Homo sapiens
uaauggaacagcaaguaaa

SEQ ID NO: 399080 - RNA, 19 nt, Homo sapiens
gggaugugcuggaugugau

SEQ ID NO: 399081 - RNA, 19 nt, Homo sapiens
ggauuucaauauguacaga

SEQ ID NO: 399082 - RNA, 19 nt, Homo sapiens
agugagaagugaugaggaa

SEQ ID NO: 399083 - RNA, 19 nt, Homo sapiens
ggagcaguauggaauucau

SEQ ID NO: 399084 - RNA, 19 nt, Homo sapiens
ggaacaaaugcuuauaugg

SEQ ID NO: 399085 - RNA, 19 nt, Homo sapiens
cagguuaagcugugugauu

SEQ ID NO: 399086 - RNA, 19 nt, Homo sapiens
uaaaggucauacuacuaga

SEQ ID NO: 399087 - RNA, 19 nt, Homo sapiens
gaugugagccucuuuaacc

SEQ ID NO: 399088 - RNA, 19 nt, Homo sapiens
caacggaggcacagucuac

SEQ ID NO: 399089 - RNA, 19 nt, Homo sapiens
cugcagauauuuccaagag

SEQ ID NO: 399090 - RNA, 19 nt, Homo sapiens
gcauuugaauaugaagaug

SEQ ID NO: 399091 - RNA, 19 nt, Homo sapiens
gcagugcauuguugaugag

SEQ ID NO: 399092 - RNA, 19 nt, Homo sapiens
gaagcccuccaauaugcua

SEQ ID NO: 399093 - RNA, 19 nt, Homo sapiens
gaaaggccagcaccugaag

SEQ ID NO: 399094 - RNA, 19 nt, Homo sapiens
ccaauaugcuaguaaacac

SEQ ID NO: 399095 - RNA, 19 nt, Homo sapiens
gcugguaauucgcaucaag

SEQ ID NO: 399096 - RNA, 19 nt, Homo sapiens
guacauuucaucacucagu

SEQ ID NO: 399097 - RNA, 19 nt, Homo sapiens
cggagccauuuguacauuu

SEQ ID NO: 399098 - RNA, 19 nt, Homo sapiens
uuuaaugccucuccagcuu

SEQ ID NO: 399099 - RNA, 19 nt, Homo sapiens
ugcaguagcaguuguuaaa

SEQ ID NO: 399100 - RNA, 19 nt, Homo sapiens
caggaugugagccucuuua

SEQ ID NO: 399101 - RNA, 19 nt, Homo sapiens
uggaagaauugcaguagca

SEQ ID NO: 399102 - RNA, 19 nt, Homo sapiens
cauccuccauucccuuguu

SEQ ID NO: 399103 - RNA, 19 nt, Homo sapiens
guauuaaugcuuugugaca

SEQ ID NO: 399104 - RNA, 19 nt, Homo sapiens
aaaccagggaucuuuaaug

SEQ ID NO: 399105 - RNA, 19 nt, Homo sapiens
aaacacaagaggacagguu

SEQ ID NO: 399106 - RNA, 19 nt, Homo sapiens
uacauggccugaaggugaa

SEQ ID NO: 399107 - RNA, 19 nt, Homo sapiens
ggaugugcuggaugugaua

SEQ ID NO: 399108 - RNA, 19 nt, Homo sapiens
agaugaagauggugaucga

SEQ ID NO: 399109 - RNA, 19 nt, Homo sapiens
aaccagggaucuuuaaugc

SEQ ID NO: 399110 - RNA, 19 nt, Homo sapiens
gagcaguauggaauucauu

SEQ ID NO: 399111 - RNA, 19 nt, Homo sapiens
gcuuauauggcgccugaaa

SEQ ID NO: 399112 - RNA, 19 nt, Homo sapiens
ucugaugucuggagcuuag

SEQ ID NO: 399113 - RNA, 19 nt, Homo sapiens
uauggcgccugaaaggauu

SEQ ID NO: 399114 - RNA, 19 nt, Homo sapiens
aaggucauacuacuagaua

SEQ ID NO: 399115 - RNA, 19 nt, Homo sapiens
gcccugcugccuccucaua

SEQ ID NO: 399116 - RNA, 19 nt, Homo sapiens
gugcauuguugaugaggau

SEQ ID NO: 399117 - RNA, 19 nt, Homo sapiens
gaucaccccuccccucuuc

SEQ ID NO: 399118 - RNA, 19 nt, Homo sapiens
gcaaguaaauggacaguua

SEQ ID NO: 399119 - RNA, 19 nt, Homo sapiens
gcacucagcuggugaauuc

SEQ ID NO: 399120 - RNA, 19 nt, Homo sapiens
gaacauacauggccugaag

SEQ ID NO: 399121 - RNA, 19 nt, Homo sapiens
gcaaugcugucauauuauu

SEQ ID NO: 399122 - RNA, 19 nt, Homo sapiens
gaagauggugaucgaauua

SEQ ID NO: 399123 - RNA, 19 nt, Homo sapiens
aggcaaugcugucauauua

SEQ ID NO: 399124 - RNA, 19 nt, Homo sapiens
gaacauguccuuggaagaa

SEQ ID NO: 399125 - RNA, 19 nt, Homo sapiens
uaagugcgauucaucauau

SEQ ID NO: 399126 - RNA, 19 nt, Homo sapiens
ugaaggcaaugcugucaua

SEQ ID NO: 399127 - RNA, 19 nt, Homo sapiens
gaacaagacauacgauauc

SEQ ID NO: 399128 - RNA, 19 nt, Homo sapiens
gcaucaagaucccaaauag

SEQ ID NO: 399129 - RNA, 19 nt, Homo sapiens
cuacagcauuugaauauga

SEQ ID NO: 399130 - RNA, 19 nt, Homo sapiens
gcaguucaaugauggaaau

SEQ ID NO: 399131 - RNA, 19 nt, Homo sapiens
guuaaaggccuuacuuauu

SEQ ID NO: 399132 - RNA, 19 nt, Homo sapiens
gccagcaccugaagaauug

SEQ ID NO: 399133 - RNA, 19 nt, Homo sapiens
gagaagugaugaggaaaug

SEQ ID NO: 399134 - RNA, 19 nt, Homo sapiens
gaauuacagugagaaguga

SEQ ID NO: 399135 - RNA, 19 nt, Homo sapiens
caacuacagcauuugaaua

SEQ ID NO: 399136 - RNA, 19 nt, Homo sapiens
agaagcaaauuaugucuga

SEQ ID NO: 399137 - RNA, 19 nt, Homo sapiens
guaaauggacaguuaauag

SEQ ID NO: 399138 - RNA, 19 nt, Homo sapiens
gaagugaugaggaaaugaa

SEQ ID NO: 399139 - RNA, 19 nt, Homo sapiens
ugaagauggugaucgaauu

SEQ ID NO: 399140 - RNA, 19 nt, Homo sapiens
gaugaaugaacaagacaua

SEQ ID NO: 399141 - RNA, 19 nt, Homo sapiens
caacaacuacagcauuuga

SEQ ID NO: 399142 - RNA, 19 nt, Homo sapiens
guaaaggucauacuacuag

SEQ ID NO: 399143 - RNA, 19 nt, Homo sapiens
cagauucacuuccaagcaa

SEQ ID NO: 399144 - RNA, 19 nt, Homo sapiens
gaaagcccaggaccaguaa

SEQ ID NO: 399145 - RNA, 19 nt, Homo sapiens
uaaaggccuuacuuauuug

SEQ ID NO: 399146 - RNA, 19 nt, Homo sapiens
ccaauggccagaugaauga

SEQ ID NO: 399147 - RNA, 19 nt, Homo sapiens
agcaauagcuuaaagaagu

SEQ ID NO: 399148 - RNA, 19 nt, Homo sapiens
gcaauagcuuaaagaaguc

SEQ ID NO: 399149 - RNA, 19 nt, Homo sapiens
guaauggaacagcaaguaa

SEQ ID NO: 399150 - RNA, 19 nt, Homo sapiens
gggaaaauauuagcuguaa

SEQ ID NO: 399151 - RNA, 19 nt, Homo sapiens
gagccucuuuaaccuguaa

SEQ ID NO: 399152 - RNA, 19 nt, Homo sapiens
ugaaagcccaggaccagua

SEQ ID NO: 399153 - RNA, 19 nt, Homo sapiens
gugaagcccuccaauaugc

SEQ ID NO: 399154 - RNA, 19 nt, Homo sapiens
gacgugaagcccuccaaua

SEQ ID NO: 399155 - RNA, 19 nt, Homo sapiens
ggucauacuacuagauauu

SEQ ID NO: 399156 - RNA, 19 nt, Homo sapiens
guggacaccugccgcugua

SEQ ID NO: 399157 - RNA, 19 nt, Homo sapiens
uggaacaaaugcuuauaug

SEQ ID NO: 399158 - RNA, 19 nt, Homo sapiens
cuacaaagcauaucauguc

SEQ ID NO: 399159 - RNA, 19 nt, Homo sapiens
ggccagcaccugaagaauu

SEQ ID NO: 399160 - RNA, 19 nt, Homo sapiens
ggagccauuuguacauuuc

SEQ ID NO: 399161 - RNA, 19 nt, Homo sapiens
caaguaaauggacaguuaa

SEQ ID NO: 399162 - RNA, 19 nt, Homo sapiens
gcccagcagucucagauuc

SEQ ID NO: 399163 - RNA, 19 nt, Homo sapiens
ggugaucgaauuacaguga

SEQ ID NO: 399164 - RNA, 19 nt, Homo sapiens
ucagggaugugcuggaugu

SEQ ID NO: 399165 - RNA, 19 nt, Homo sapiens
gaaaacagccaaaagaaag

SEQ ID NO: 399166 - RNA, 19 nt, Homo sapiens
ccuccaauaugcuaguaaa

SEQ ID NO: 399167 - RNA, 19 nt, Homo sapiens
gaauugcaguagcaguugu

SEQ ID NO: 399168 - RNA, 19 nt, Homo sapiens
gccagaacauguccuugga

SEQ ID NO: 399169 - RNA, 19 nt, Homo sapiens
gauauuacacuggaacuuc

SEQ ID NO: 399170 - RNA, 19 nt, Homo sapiens
gcacagucuacaaagcaua

SEQ ID NO: 399171 - RNA, 19 nt, Homo sapiens
gaaugaacaagacauacga

SEQ ID NO: 399172 - RNA, 19 nt, Homo sapiens
agcaacaacuacagcauuu

SEQ ID NO: 399173 - RNA, 19 nt, Homo sapiens
agguuaagcugugugauuu

SEQ ID NO: 399174 - RNA, 19 nt, Homo sapiens
gaucuuuggauguauauag

SEQ ID NO: 399175 - RNA, 19 nt, Homo sapiens
ccagaugaaugaacaagac

SEQ ID NO: 399176 - RNA, 19 nt, Homo sapiens
cgaauuacagugagaagug

SEQ ID NO: 399177 - RNA, 19 nt, Homo sapiens
gaagcaaauuaugucugaa

SEQ ID NO: 399178 - RNA, 19 nt, Homo sapiens
ugaacaagacauacgauau

SEQ ID NO: 399179 - RNA, 19 nt, Homo sapiens
uaauggaacagcaaguaaa

SEQ ID NO: 399180 - RNA, 19 nt, Homo sapiens
gggaugugcuggaugugau

SEQ ID NO: 399181 - RNA, 19 nt, Homo sapiens
ggauuucaauauguacaga

SEQ ID NO: 399182 - RNA, 19 nt, Homo sapiens
agugagaagugaugaggaa

SEQ ID NO: 399183 - RNA, 19 nt, Homo sapiens
ggagcaguauggaauucau

SEQ ID NO: 399184 - RNA, 19 nt, Homo sapiens
ggaacaaaugcuuauaugg

SEQ ID NO: 399185 - RNA, 19 nt, Homo sapiens
cagguuaagcugugugauu

SEQ ID NO: 399186 - RNA, 19 nt, Homo sapiens
uaaaggucauacuacuaga

SEQ ID NO: 399187 - RNA, 19 nt, Homo sapiens
gaugugagccucuuuaacc

SEQ ID NO: 399188 - RNA, 19 nt, Homo sapiens
caacggaggcacagucuac

SEQ ID NO: 399189 - RNA, 19 nt, Homo sapiens
cugcagauauuuccaagag

SEQ ID NO: 399190 - RNA, 19 nt, Homo sapiens
gcauuugaauaugaagaug

SEQ ID NO: 399191 - RNA, 19 nt, Homo sapiens
gcagugcauuguugaugag

SEQ ID NO: 399192 - RNA, 19 nt, Homo sapiens
gaagcccuccaauaugcua

SEQ ID NO: 399193 - RNA, 19 nt, Homo sapiens
gaaaggccagcaccugaag

SEQ ID NO: 399194 - RNA, 19 nt, Homo sapiens
ccaauaugcuaguaaacac

SEQ ID NO: 399195 - RNA, 19 nt, Homo sapiens
gcugguaauucgcaucaag

SEQ ID NO: 399196 - RNA, 19 nt, Homo sapiens
guacauuucaucacucagu

SEQ ID NO: 399197 - RNA, 19 nt, Homo sapiens
cggagccauuuguacauuu

SEQ ID NO: 399198 - RNA, 19 nt, Homo sapiens
uuuaaugccucuccagcuu

SEQ ID NO: 399199 - RNA, 19 nt, Homo sapiens
ugcaguagcaguuguuaaa

SEQ ID NO: 399200 - RNA, 19 nt, Homo sapiens
caggaugugagccucuuua

SEQ ID NO: 399201 - RNA, 19 nt, Homo sapiens
uggaagaauugcaguagca

SEQ ID NO: 399202 - RNA, 19 nt, Homo sapiens
cauccuccauucccuuguu

SEQ ID NO: 399203 - RNA, 19 nt, Homo sapiens
guauuaaugcuuugugaca

SEQ ID NO: 399204 - RNA, 19 nt, Homo sapiens
aaaccagggaucuuuaaug

SEQ ID NO: 399205 - RNA, 19 nt, Homo sapiens
aaacacaagaggacagguu

SEQ ID NO: 399206 - RNA, 19 nt, Homo sapiens
uacauggccugaaggugaa

SEQ ID NO: 399207 - RNA, 19 nt, Homo sapiens
ggaugugcuggaugugaua

SEQ ID NO: 399208 - RNA, 19 nt, Homo sapiens
agaugaagauggugaucga

SEQ ID NO: 399209 - RNA, 19 nt, Homo sapiens
aaccagggaucuuuaaugc

SEQ ID NO: 399210 - RNA, 19 nt, Homo sapiens
gagcaguauggaauucauu

SEQ ID NO: 399211 - RNA, 19 nt, Homo sapiens
gcuuauauggcgccugaaa

SEQ ID NO: 399212 - RNA, 19 nt, Homo sapiens
ucugaugucuggagcuuag

SEQ ID NO: 399213 - RNA, 19 nt, Homo sapiens
uauggcgccugaaaggauu

SEQ ID NO: 399214 - RNA, 19 nt, Homo sapiens
aaggucauacuacuagaua

SEQ ID NO: 399215 - RNA, 19 nt, Homo sapiens
gcccugcugccuccucaua

SEQ ID NO: 399216 - RNA, 19 nt, Homo sapiens
gugcauuguugaugaggau

SEQ ID NO: 399217 - RNA, 19 nt, Homo sapiens
gaucaccccuccccucuuc

SEQ ID NO: 399218 - RNA, 19 nt, Homo sapiens
gcaaguaaauggacaguua

SEQ ID NO: 399219 - RNA, 19 nt, Homo sapiens
gcacucagcuggugaauuc

SEQ ID NO: 399220 - RNA, 19 nt, Homo sapiens
gaacauacauggccugaag

SEQ ID NO: 399221 - RNA, 19 nt, Homo sapiens
gcaaugcugucauauuauu

SEQ ID NO: 399222 - RNA, 19 nt, Homo sapiens
gaagauggugaucgaauua

SEQ ID NO: 399223 - RNA, 19 nt, Homo sapiens
aggcaaugcugucauauua

SEQ ID NO: 399224 - RNA, 19 nt, Homo sapiens
gaacauguccuuggaagaa

SEQ ID NO: 399225 - RNA, 19 nt, Homo sapiens
uaagugcgauucaucauau

SEQ ID NO: 399226 - RNA, 19 nt, Homo sapiens
ugaaggcaaugcugucaua

SEQ ID NO: 399227 - RNA, 19 nt, Homo sapiens
gaacaagacauacgauauc

SEQ ID NO: 399228 - RNA, 19 nt, Homo sapiens
gcaucaagaucccaaauag

SEQ ID NO: 399229 - RNA, 19 nt, Homo sapiens
cuacagcauuugaauauga

SEQ ID NO: 399230 - RNA, 19 nt, Homo sapiens
gcaguucaaugauggaaau

SEQ ID NO: 399231 - RNA, 19 nt, Homo sapiens
guuaaaggccuuacuuauu

SEQ ID NO: 399232 - RNA, 19 nt, Homo sapiens
gccagcaccugaagaauug

SEQ ID NO: 399233 - RNA, 19 nt, Homo sapiens
gagaagugaugaggaaaug

SEQ ID NO: 399234 - RNA, 19 nt, Homo sapiens
gaauuacagugagaaguga

SEQ ID NO: 399235 - RNA, 19 nt, Homo sapiens
caacuacagcauuugaaua

SEQ ID NO: 399236 - RNA, 19 nt, Homo sapiens
agaagcaaauuaugucuga

SEQ ID NO: 399237 - RNA, 19 nt, Homo sapiens
guaaauggacaguuaauag

SEQ ID NO: 399238 - RNA, 19 nt, Homo sapiens
gaagugaugaggaaaugaa

SEQ ID NO: 399239 - RNA, 19 nt, Homo sapiens
ugaagauggugaucgaauu

SEQ ID NO: 399240 - RNA, 19 nt, Homo sapiens
gaugaaugaacaagacaua

SEQ ID NO: 399241 - RNA, 19 nt, Homo sapiens
caacaacuacagcauuuga

SEQ ID NO: 399242 - RNA, 19 nt, Homo sapiens
guaaaggucauacuacuag

SEQ ID NO: 399243 - RNA, 19 nt, Homo sapiens
cagauucacuuccaagcaa

SEQ ID NO: 399244 - RNA, 19 nt, Homo sapiens
uaaaggccuuacuuauuug

SEQ ID NO: 399245 - RNA, 19 nt, Homo sapiens
ccaauggccagaugaauga

SEQ ID NO: 399246 - RNA, 19 nt, Homo sapiens
agcaauagcuuaaagaagu

SEQ ID NO: 399247 - RNA, 19 nt, Homo sapiens
gcaauagcuuaaagaaguc

SEQ ID NO: 399248 - RNA, 19 nt, Homo sapiens
guaauggaacagcaaguaa

SEQ ID NO: 399249 - RNA, 19 nt, Homo sapiens
gggaaaauauuagcuguaa

SEQ ID NO: 399250 - RNA, 19 nt, Homo sapiens
gagccucuuuaaccuguaa

SEQ ID NO: 399251 - RNA, 19 nt, Homo sapiens
gugaagcccuccaauaugc

SEQ ID NO: 399252 - RNA, 19 nt, Homo sapiens
gacgugaagcccuccaaua

SEQ ID NO: 399253 - RNA, 19 nt, Homo sapiens
ggucauacuacuagauauu

SEQ ID NO: 399254 - RNA, 19 nt, Homo sapiens
guggacaccugccgcugua

SEQ ID NO: 399255 - RNA, 19 nt, Homo sapiens
uggaacaaaugcuuauaug

SEQ ID NO: 399256 - RNA, 19 nt, Homo sapiens
cuacaaagcauaucauguc

SEQ ID NO: 399257 - RNA, 19 nt, Homo sapiens
ggccagcaccugaagaauu

SEQ ID NO: 399258 - RNA, 19 nt, Homo sapiens
ggagccauuuguacauuuc

SEQ ID NO: 399259 - RNA, 19 nt, Homo sapiens
caaguaaauggacaguuaa

SEQ ID NO: 399260 - RNA, 19 nt, Homo sapiens
gcccagcagucucagauuc

SEQ ID NO: 399261 - RNA, 19 nt, Homo sapiens
ggugaucgaauuacaguga

SEQ ID NO: 399262 - RNA, 19 nt, Homo sapiens
ucagggaugugcuggaugu

SEQ ID NO: 399263 - RNA, 19 nt, Homo sapiens
gaaaacagccaaaagaaag

SEQ ID NO: 399264 - RNA, 19 nt, Homo sapiens
ccuccaauaugcuaguaaa

SEQ ID NO: 399265 - RNA, 19 nt, Homo sapiens
gaauugcaguagcaguugu

SEQ ID NO: 399266 - RNA, 19 nt, Homo sapiens
gccagaacauguccuugga

SEQ ID NO: 399267 - RNA, 19 nt, Homo sapiens
gauauuacacuggaacuuc

SEQ ID NO: 399268 - RNA, 19 nt, Homo sapiens
gcacagucuacaaagcaua

SEQ ID NO: 399269 - RNA, 19 nt, Homo sapiens
gaaugaacaagacauacga

SEQ ID NO: 399270 - RNA, 19 nt, Homo sapiens
agcaacaacuacagcauuu

SEQ ID NO: 399271 - RNA, 19 nt, Homo sapiens
agguuaagcugugugauuu

SEQ ID NO: 399272 - RNA, 19 nt, Homo sapiens
gaucuuuggauguauauag

SEQ ID NO: 399273 - RNA, 19 nt, Homo sapiens
ccagaugaaugaacaagac

SEQ ID NO: 399274 - RNA, 19 nt, Homo sapiens
cgaauuacagugagaagug

SEQ ID NO: 399275 - RNA, 19 nt, Homo sapiens
gaagcaaauuaugucugaa

SEQ ID NO: 399276 - RNA, 19 nt, Homo sapiens
ugaacaagacauacgauau

SEQ ID NO: 399277 - RNA, 19 nt, Homo sapiens
uaauggaacagcaaguaaa

SEQ ID NO: 399278 - RNA, 19 nt, Homo sapiens
gggaugugcuggaugugau

SEQ ID NO: 399279 - RNA, 19 nt, Homo sapiens
ggauuucaauauguacaga

SEQ ID NO: 399280 - RNA, 19 nt, Homo sapiens
agugagaagugaugaggaa

SEQ ID NO: 399281 - RNA, 19 nt, Homo sapiens
ggagcaguauggaauucau

SEQ ID NO: 399282 - RNA, 19 nt, Homo sapiens
ggaacaaaugcuuauaugg

SEQ ID NO: 399283 - RNA, 19 nt, Homo sapiens
cagguuaagcugugugauu

SEQ ID NO: 399284 - RNA, 19 nt, Homo sapiens
uaaaggucauacuacuaga

SEQ ID NO: 399285 - RNA, 19 nt, Homo sapiens
caacggaggcacagucuac

SEQ ID NO: 399286 - RNA, 19 nt, Homo sapiens
cugcagauauuuccaagag

SEQ ID NO: 399287 - RNA, 19 nt, Homo sapiens
gcauuugaauaugaagaug

SEQ ID NO: 399288 - RNA, 19 nt, Homo sapiens
gaugugagccucuuuaacc

SEQ ID NO: 399289 - RNA, 19 nt, Homo sapiens
gcagugcauuguugaugag

SEQ ID NO: 399290 - RNA, 19 nt, Homo sapiens
gaagcccuccaauaugcua

SEQ ID NO: 399291 - RNA, 19 nt, Homo sapiens
gaaaggccagcaccugaag

SEQ ID NO: 399292 - RNA, 19 nt, Homo sapiens
ccaauaugcuaguaaacac

SEQ ID NO: 399293 - RNA, 19 nt, Homo sapiens
gcugguaauucgcaucaag

SEQ ID NO: 399294 - RNA, 19 nt, Homo sapiens
guacauuucaucacucagu

SEQ ID NO: 399295 - RNA, 19 nt, Homo sapiens
cggagccauuuguacauuu

SEQ ID NO: 399296 - RNA, 19 nt, Homo sapiens
uuuaaugccucuccagcuu

SEQ ID NO: 399297 - RNA, 19 nt, Homo sapiens
ugcaguagcaguuguuaaa

SEQ ID NO: 399298 - RNA, 19 nt, Homo sapiens
uggaagaauugcaguagca

SEQ ID NO: 399299 - RNA, 19 nt, Homo sapiens
caggaugugagccucuuua

SEQ ID NO: 399300 - RNA, 19 nt, Homo sapiens
cauccuccauucccuuguu

SEQ ID NO: 399301 - RNA, 19 nt, Homo sapiens
guauuaaugcuuugugaca

SEQ ID NO: 399302 - RNA, 19 nt, Homo sapiens
aaaccagggaucuuuaaug

SEQ ID NO: 399303 - RNA, 19 nt, Homo sapiens
aaacacaagaggacagguu

SEQ ID NO: 399304 - RNA, 19 nt, Homo sapiens
uacauggccugaaggugaa

SEQ ID NO: 399305 - RNA, 19 nt, Homo sapiens
agaugaagauggugaucga

SEQ ID NO: 399306 - RNA, 19 nt, Homo sapiens
ggaugugcuggaugugaua

SEQ ID NO: 399307 - RNA, 19 nt, Homo sapiens
aaccagggaucuuuaaugc

SEQ ID NO: 399308 - RNA, 19 nt, Homo sapiens
gagcaguauggaauucauu

SEQ ID NO: 399309 - RNA, 19 nt, Homo sapiens
gcuuauauggcgccugaaa

SEQ ID NO: 399310 - RNA, 19 nt, Homo sapiens
ucugaugucuggagcuuag

SEQ ID NO: 399311 - RNA, 19 nt, Homo sapiens
uauggcgccugaaaggauu

SEQ ID NO: 399312 - RNA, 19 nt, Homo sapiens
aaggucauacuacuagaua

SEQ ID NO: 399313 - RNA, 19 nt, Homo sapiens
gcccugcugccuccucaua

SEQ ID NO: 399314 - RNA, 19 nt, Homo sapiens
gugcauuguugaugaggau

SEQ ID NO: 399315 - RNA, 19 nt, Homo sapiens
gaucaccccuccccucuuc

SEQ ID NO: 399316 - RNA, 19 nt, Homo sapiens
auaagugcgauucaucaua

SEQ ID NO: 399317 - RNA, 19 nt, Homo sapiens
ggaacagcaaguaaaugga

SEQ ID NO: 399318 - RNA, 19 nt, Homo sapiens
gcacucagcuggugaauuc

SEQ ID NO: 399319 - RNA, 19 nt, Homo sapiens
gaacauguccuuggaagaa

SEQ ID NO: 399320 - RNA, 19 nt, Homo sapiens
ucacuugacugcuuauauu

SEQ ID NO: 399321 - RNA, 19 nt, Homo sapiens
uaagugcgauucaucauau

SEQ ID NO: 399322 - RNA, 19 nt, Homo sapiens
caugacagcuugugaugaa

SEQ ID NO: 399323 - RNA, 19 nt, Homo sapiens
gcaaauaaacgaagucauc

SEQ ID NO: 399324 - RNA, 19 nt, Homo sapiens
ggccagagcuagagaugaa

SEQ ID NO: 399325 - RNA, 19 nt, Homo sapiens
ugacaacucauccuuauuu

SEQ ID NO: 399326 - RNA, 19 nt, Homo sapiens
gugaugaauugccguauuu

SEQ ID NO: 399327 - RNA, 19 nt, Homo sapiens
gcaguucaaugauggaaau

SEQ ID NO: 399328 - RNA, 19 nt, Homo sapiens
guuaaaggccuuacuuauu

SEQ ID NO: 399329 - RNA, 19 nt, Homo sapiens
gccagcaccugaagaauug

SEQ ID NO: 399330 - RNA, 19 nt, Homo sapiens
ggaaugaugagggaaauuu

SEQ ID NO: 399331 - RNA, 19 nt, Homo sapiens
gaaugaugagggaaauuua

SEQ ID NO: 399332 - RNA, 19 nt, Homo sapiens
uuuaauagccucacacuaa

SEQ ID NO: 399333 - RNA, 19 nt, Homo sapiens
agaagcaaauuaugucuga

SEQ ID NO: 399334 - RNA, 19 nt, Homo sapiens
gaggucauacuacuagaua

SEQ ID NO: 399335 - RNA, 19 nt, Homo sapiens
ggaggacuuugaggucaua

SEQ ID NO: 399336 - RNA, 19 nt, Homo sapiens
ggcagaauguacauauuga

SEQ ID NO: 399337 - RNA, 19 nt, Homo sapiens
ggacuuugaggucauacua

SEQ ID NO: 399338 - RNA, 19 nt, Homo sapiens
gaaagcccaggaccaguaa

SEQ ID NO: 399339 - RNA, 19 nt, Homo sapiens
uaaaggccuuacuuauuug

SEQ ID NO: 399340 - RNA, 19 nt, Homo sapiens
ggagagcaguggaaaugca

SEQ ID NO: 399341 - RNA, 19 nt, Homo sapiens
ggaaaugcaccaaggagau

SEQ ID NO: 399342 - RNA, 19 nt, Homo sapiens
gacaacucauccuuauuug

SEQ ID NO: 399343 - RNA, 19 nt, Homo sapiens
ugaaagcccaggaccagua

SEQ ID NO: 399344 - RNA, 19 nt, Homo sapiens
gugaagcccuccaauaugc

SEQ ID NO: 399345 - RNA, 19 nt, Homo sapiens
gacgugaagcccuccaaua

SEQ ID NO: 399346 - RNA, 19 nt, Homo sapiens
ggucauacuacuagauauu

SEQ ID NO: 399347 - RNA, 19 nt, Homo sapiens
caacucauccuuauuuguc

SEQ ID NO: 399348 - RNA, 19 nt, Homo sapiens
uggaacaaaugcuuauaug

SEQ ID NO: 399349 - RNA, 19 nt, Homo sapiens
gaaaugcaccaaggagaug

SEQ ID NO: 399350 - RNA, 19 nt, Homo sapiens
uuaauagccucacacuaau

SEQ ID NO: 399351 - RNA, 19 nt, Homo sapiens
ggccagcaccugaagaauu

SEQ ID NO: 399352 - RNA, 19 nt, Homo sapiens
ggagccauuuguacauuuc

SEQ ID NO: 399353 - RNA, 19 nt, Homo sapiens
caaggcagaauguacauau

SEQ ID NO: 399354 - RNA, 19 nt, Homo sapiens
gacagcuugugaugaauug

SEQ ID NO: 399355 - RNA, 19 nt, Homo sapiens
gaaaacagccaaaagaaag

SEQ ID NO: 399356 - RNA, 19 nt, Homo sapiens
ccuccaauaugcuaguaaa

SEQ ID NO: 399357 - RNA, 19 nt, Homo sapiens
gaauugcaguagcaguugu

SEQ ID NO: 399358 - RNA, 19 nt, Homo sapiens
gccagaacauguccuugga

SEQ ID NO: 399359 - RNA, 19 nt, Homo sapiens
gauauuacacuggaacuuc

SEQ ID NO: 399360 - RNA, 19 nt, Homo sapiens
agguuaagcugugugauuu

SEQ ID NO: 399361 - RNA, 19 nt, Homo sapiens
gaucuuuggauguauauag

SEQ ID NO: 399362 - RNA, 19 nt, Homo sapiens
caagcaaagugugaagugu

SEQ ID NO: 399363 - RNA, 19 nt, Homo sapiens
gaagcaaauuaugucugaa

SEQ ID NO: 399364 - RNA, 19 nt, Homo sapiens
gaugaauugccguauuuau

SEQ ID NO: 399365 - RNA, 19 nt, Homo sapiens
cuugacaacucauccuuau

SEQ ID NO: 399366 - RNA, 19 nt, Homo sapiens
ggauuucaauauguacaga

SEQ ID NO: 399367 - RNA, 19 nt, Homo sapiens
ggagcaguauggaauucau

SEQ ID NO: 399368 - RNA, 19 nt, Homo sapiens
ggaacaaaugcuuauaugg

SEQ ID NO: 399369 - RNA, 19 nt, Homo sapiens
cagguuaagcugugugauu

SEQ ID NO: 399370 - RNA, 19 nt, Homo sapiens
gcucaaggcagaauguaca

SEQ ID NO: 399371 - RNA, 19 nt, Homo sapiens
gcagugcauuguugaugag

SEQ ID NO: 399372 - RNA, 19 nt, Homo sapiens
gaagcccuccaauaugcua

SEQ ID NO: 399373 - RNA, 19 nt, Homo sapiens
gaaaggccagcaccugaag

SEQ ID NO: 399374 - RNA, 19 nt, Homo sapiens
ugugaugaauugccguauu

SEQ ID NO: 399375 - RNA, 19 nt, Homo sapiens
ccaauaugcuaguaaacac

SEQ ID NO: 399376 - RNA, 19 nt, Homo sapiens
guacauuucaucacucagu

SEQ ID NO: 399377 - RNA, 19 nt, Homo sapiens
cggagccauuuguacauuu

SEQ ID NO: 399378 - RNA, 19 nt, Homo sapiens
uuuaaugccucuccagcuu

SEQ ID NO: 399379 - RNA, 19 nt, Homo sapiens
ugcaguagcaguuguuaaa

SEQ ID NO: 399380 - RNA, 19 nt, Homo sapiens
uggaagaauugcaguagca

SEQ ID NO: 399381 - RNA, 19 nt, Homo sapiens
guauuaaugcuuugugaca

SEQ ID NO: 399382 - RNA, 19 nt, Homo sapiens
aauagccucacacuaauuu

SEQ ID NO: 399383 - RNA, 19 nt, Homo sapiens
aaaccagggaucuuuaaug

SEQ ID NO: 399384 - RNA, 19 nt, Homo sapiens
aaacacaagaggacagguu

SEQ ID NO: 399385 - RNA, 19 nt, Homo sapiens
uagccucacacuaauuuaa

SEQ ID NO: 399386 - RNA, 19 nt, Homo sapiens
gugccacuccagcaaauaa

SEQ ID NO: 399387 - RNA, 19 nt, Homo sapiens
aaccagggaucuuuaaugc

SEQ ID NO: 399388 - RNA, 19 nt, Homo sapiens
gagcaguauggaauucauu

SEQ ID NO: 399389 - RNA, 19 nt, Homo sapiens
gcuuauauggcgccugaaa

SEQ ID NO: 399390 - RNA, 19 nt, Homo sapiens
ugacagcuugugaugaauu

SEQ ID NO: 399391 - RNA, 19 nt, Homo sapiens
guggagagcaguggaaaug

SEQ ID NO: 399392 - RNA, 19 nt, Homo sapiens
ucugaugucuggagcuuag

SEQ ID NO: 399393 - RNA, 19 nt, Homo sapiens
uauggcgccugaaaggauu

SEQ ID NO: 399394 - RNA, 19 nt, Homo sapiens
gugcauuguugaugaggau

SEQ ID NO: 399395 - RNA, 19 nt, Homo sapiens
uaauagccucacacuaauu

SEQ ID NO: 399396 - RNA, 19 nt, Homo sapiens
cuugggagguuuccauauc

SEQ ID NO: 399397 - RNA, 19 nt, Homo sapiens
auaagugcgauucaucaua

SEQ ID NO: 399398 - RNA, 19 nt, Homo sapiens
gaccaguaaccaaggagaa

SEQ ID NO: 399399 - RNA, 19 nt, Homo sapiens
ccaagcaaagugugaagug

SEQ ID NO: 399400 - RNA, 19 nt, Homo sapiens
caguagcaguuguuaaagg

SEQ ID NO: 399401 - RNA, 19 nt, Homo sapiens
gaaaaugccagaacauguc

SEQ ID NO: 399402 - RNA, 19 nt, Homo sapiens
aaggcagaauguacauauu

SEQ ID NO: 399403 - RNA, 19 nt, Homo sapiens
cgaaaacagccaaaagaaa

SEQ ID NO: 399404 - RNA, 19 nt, Homo sapiens
ugaauucuauagccaagac

SEQ ID NO: 399405 - RNA, 19 nt, Homo sapiens
caagaggacagguuaagcu

SEQ ID NO: 399406 - RNA, 19 nt, Homo sapiens
acauguccuuggaagaauu

SEQ ID NO: 399407 - RNA, 19 nt, Homo sapiens
ggaaaaugccagaacaugu

SEQ ID NO: 399408 - RNA, 19 nt, Homo sapiens
ccagagcuagagaugaauu

SEQ ID NO: 399409 - RNA, 19 nt, Homo sapiens
gguaaaggguggggcauug

SEQ ID NO: 399410 - RNA, 19 nt, Homo sapiens
uauuuguccuggaggugua

SEQ ID NO: 399411 - RNA, 19 nt, Homo sapiens
gccucacacuaauuuaaau

SEQ ID NO: 399412 - RNA, 19 nt, Homo sapiens
uuaggaaucucuuuuaugg

SEQ ID NO: 399413 - RNA, 19 nt, Homo sapiens
acgugaagcccuccaauau

SEQ ID NO: 399414 - RNA, 19 nt, Homo sapiens
aagaauugcaguagcaguu

SEQ ID NO: 399415 - RNA, 19 nt, Homo sapiens
ggggaucuuuggauguaua

SEQ ID NO: 399416 - RNA, 19 nt, Homo sapiens
gaauuuugauggaggacuu

SEQ ID NO: 399417 - RNA, 19 nt, Homo sapiens
ucggagccauuuguacauu

SEQ ID NO: 399418 - RNA, 19 nt, Homo sapiens
gagcaucucuguuugguaa

SEQ ID NO: 399419 - RNA, 19 nt, Homo sapiens
uauaacagcucaaagagua

SEQ ID NO: 399420 - RNA, 19 nt, Homo sapiens
gaacagaaacggcuacuga

SEQ ID NO: 399421 - RNA, 19 nt, Homo sapiens
gggaaagguugaauuaauu

SEQ ID NO: 399422 - RNA, 19 nt, Homo sapiens
gauaaaggcuuaggacuuc

SEQ ID NO: 399423 - RNA, 19 nt, Homo sapiens
cuagauggaugaauuauga

SEQ ID NO: 399424 - RNA, 19 nt, Homo sapiens
ccaaagaacggccuacaua

SEQ ID NO: 399425 - RNA, 19 nt, Homo sapiens
gcgaaacccuggccuuaaa

SEQ ID NO: 399426 - RNA, 19 nt, Homo sapiens
gaagcagccuuacuauuca

SEQ ID NO: 399427 - RNA, 19 nt, Homo sapiens
ucacagugcuuaaagaaga

SEQ ID NO: 399428 - RNA, 19 nt, Homo sapiens
agaaugaacugucuagaug

SEQ ID NO: 399429 - RNA, 19 nt, Homo sapiens
cgucaagccuucuaaugua

SEQ ID NO: 399430 - RNA, 19 nt, Homo sapiens
gauaaaggccagacaauuc

SEQ ID NO: 399431 - RNA, 19 nt, Homo sapiens
gaacagaggguuuugauuu

SEQ ID NO: 399432 - RNA, 19 nt, Homo sapiens
ggaaacaucugcccaaucc

SEQ ID NO: 399433 - RNA, 19 nt, Homo sapiens
gcucauggauacaucacua

SEQ ID NO: 399434 - RNA, 19 nt, Homo sapiens
gaggauugcuucccugaau

SEQ ID NO: 399435 - RNA, 19 nt, Homo sapiens
gaaagguagugaguaauuc

SEQ ID NO: 399436 - RNA, 19 nt, Homo sapiens
aaugaaagguagugaguaa

SEQ ID NO: 399437 - RNA, 19 nt, Homo sapiens
gcucuagguuucuugauga

SEQ ID NO: 399438 - RNA, 19 nt, Homo sapiens
ccaccuaccuauucaucua

SEQ ID NO: 399439 - RNA, 19 nt, Homo sapiens
gauacagugugaagucuga

SEQ ID NO: 399440 - RNA, 19 nt, Homo sapiens
uagaagggcuagaauagga

SEQ ID NO: 399441 - RNA, 19 nt, Homo sapiens
cagaagggauacaguguga

SEQ ID NO: 399442 - RNA, 19 nt, Homo sapiens
cagaugaccuggagccuau

SEQ ID NO: 399443 - RNA, 19 nt, Homo sapiens
gaaaaugucucagucgaaa

SEQ ID NO: 399444 - RNA, 19 nt, Homo sapiens
cuacaugaauccaaaggaa

SEQ ID NO: 399445 - RNA, 19 nt, Homo sapiens
uaaauaaccaggaagcauu

SEQ ID NO: 399446 - RNA, 19 nt, Homo sapiens
ggaaauaaugggaaagguu

SEQ ID NO: 399447 - RNA, 19 nt, Homo sapiens
ugaagcagccuuacuauuc

SEQ ID NO: 399448 - RNA, 19 nt, Homo sapiens
gagcucuucuugugaaaug

SEQ ID NO: 399449 - RNA, 19 nt, Homo sapiens
caaguucacuacagcauca

SEQ ID NO: 399450 - RNA, 19 nt, Homo sapiens
ggauacaucacuagauaaa

SEQ ID NO: 399451 - RNA, 19 nt, Homo sapiens
guaaauagccaggaacaga

SEQ ID NO: 399452 - RNA, 19 nt, Homo sapiens
ugacacuugugguauagua

SEQ ID NO: 399453 - RNA, 19 nt, Homo sapiens
caaguugacuaaacagcaa

SEQ ID NO: 399454 - RNA, 19 nt, Homo sapiens
ggauugccuuuguaguuaa

SEQ ID NO: 399455 - RNA, 19 nt, Homo sapiens
acaagaugcucuggucaua

SEQ ID NO: 399456 - RNA, 19 nt, Homo sapiens
gaagguuccagaaucgaua

SEQ ID NO: 399457 - RNA, 19 nt, Homo sapiens
gguggacucuguugcuaaa

SEQ ID NO: 399458 - RNA, 19 nt, Homo sapiens
uaaguucaauugugucugu

SEQ ID NO: 399459 - RNA, 19 nt, Homo sapiens
ugggaaagguugaauuaau

SEQ ID NO: 399460 - RNA, 19 nt, Homo sapiens
gauccgagccacaguaaau

SEQ ID NO: 399461 - RNA, 19 nt, Homo sapiens
aggauugccuuuguaguua

SEQ ID NO: 399462 - RNA, 19 nt, Homo sapiens
ucuaugagcaucucuguuu

SEQ ID NO: 399463 - RNA, 19 nt, Homo sapiens
ucucagacuucucuuauuc

SEQ ID NO: 399464 - RNA, 19 nt, Homo sapiens
ugaaagguagugaguaauu

SEQ ID NO: 399465 - RNA, 19 nt, Homo sapiens
acccagagcucaaccagaa

SEQ ID NO: 399466 - RNA, 19 nt, Homo sapiens
gaauaaacccagagcucaa

SEQ ID NO: 399467 - RNA, 19 nt, Homo sapiens
cugcaucggucaagagaaa

SEQ ID NO: 399468 - RNA, 19 nt, Homo sapiens
aguggaaagugauuuguaa

SEQ ID NO: 399469 - RNA, 19 nt, Homo sapiens
cgguagugaugaaauuaua

SEQ ID NO: 399470 - RNA, 19 nt, Homo sapiens
auggauacaucacuagaua

SEQ ID NO: 399471 - RNA, 19 nt, Homo sapiens
ggcauggacuaccagauga

SEQ ID NO: 399472 - RNA, 19 nt, Homo sapiens
gguagugaguaauucuuug

SEQ ID NO: 399473 - RNA, 19 nt, Homo sapiens
gguauaguauuaguggaaa

SEQ ID NO: 399474 - RNA, 19 nt, Homo sapiens
cagcaucaauagaaaguca

SEQ ID NO: 399475 - RNA, 19 nt, Homo sapiens
caucaaugcucucggucaa

SEQ ID NO: 399476 - RNA, 19 nt, Homo sapiens
gaacaaccucagaccaguu

SEQ ID NO: 399477 - RNA, 19 nt, Homo sapiens
ucauauaacagcucaaaga

SEQ ID NO: 399478 - RNA, 19 nt, Homo sapiens
gaaaguccaucugcugcau

SEQ ID NO: 399479 - RNA, 19 nt, Homo sapiens
aaugggaaagguugaauua

SEQ ID NO: 399480 - RNA, 19 nt, Homo sapiens
gcacagccuucccuaacgu

SEQ ID NO: 399481 - RNA, 19 nt, Homo sapiens
aaaaggagcucuucuugug

SEQ ID NO: 399482 - RNA, 19 nt, Homo sapiens
uaaauagccaggaacagaa

SEQ ID NO: 399483 - RNA, 19 nt, Homo sapiens
gaucaaggagugaaguaau

SEQ ID NO: 399484 - RNA, 19 nt, Homo sapiens
gggaguuccuagcaaguug

SEQ ID NO: 399485 - RNA, 19 nt, Homo sapiens
ucacaaguccugccaagug

SEQ ID NO: 399486 - RNA, 19 nt, Homo sapiens
uggaaucaguggcuacuug

SEQ ID NO: 399487 - RNA, 19 nt, Homo sapiens
ccacagguucuaugauuug

SEQ ID NO: 399488 - RNA, 19 nt, Homo sapiens
gggcauggacuaccagaug

SEQ ID NO: 399489 - RNA, 19 nt, Homo sapiens
ucauagaagggcuagaaua

SEQ ID NO: 399490 - RNA, 19 nt, Homo sapiens
agaaacggcuacugaugga

SEQ ID NO: 399491 - RNA, 19 nt, Homo sapiens
aaacuccacuugcaugaag

SEQ ID NO: 399492 - RNA, 19 nt, Homo sapiens
cauagaagggcuagaauag

SEQ ID NO: 399493 - RNA, 19 nt, Homo sapiens
cacuugugguauaguauua

SEQ ID NO: 399494 - RNA, 19 nt, Homo sapiens
ggccuuggaaucuauagua

SEQ ID NO: 399495 - RNA, 19 nt, Homo sapiens
ggugugcauuuccaucuug

SEQ ID NO: 399496 - RNA, 19 nt, Homo sapiens
guuccagaaucgauaguga

SEQ ID NO: 399497 - RNA, 19 nt, Homo sapiens
gaaguaauugacagggaaa

SEQ ID NO: 399498 - RNA, 19 nt, Homo sapiens
gcguugaggccgcaucuuu

SEQ ID NO: 399499 - RNA, 19 nt, Homo sapiens
uguguaaguuguaaggauu

SEQ ID NO: 399500 - RNA, 19 nt, Homo sapiens
uaagguuggguuagcaaua

SEQ ID NO: 399501 - RNA, 19 nt, Homo sapiens
gaagggauacagugugaag

SEQ ID NO: 399502 - RNA, 19 nt, Homo sapiens
uccauucacugucaccuuu

SEQ ID NO: 399503 - RNA, 19 nt, Homo sapiens
aagagaaacuccacuugca

SEQ ID NO: 399504 - RNA, 19 nt, Homo sapiens
gggcagaucauggcaguga

SEQ ID NO: 399505 - RNA, 19 nt, Homo sapiens
cagguucuaugauuuguag

SEQ ID NO: 399506 - RNA, 19 nt, Homo sapiens
acccacagguucuaugauu

SEQ ID NO: 399507 - RNA, 19 nt, Homo sapiens
cuagcaaguugacuaaaca

SEQ ID NO: 399508 - RNA, 19 nt, Homo sapiens
uggcuuuguuuguuuguuu

SEQ ID NO: 399509 - RNA, 19 nt, Homo sapiens
aaggagcucuucuugugaa

SEQ ID NO: 399510 - RNA, 19 nt, Homo sapiens
gaacugucuagauggauga

SEQ ID NO: 399511 - RNA, 19 nt, Homo sapiens
cugcagaguuuguugacuu

SEQ ID NO: 399512 - RNA, 19 nt, Homo sapiens
caagugaagaugugcgauu

SEQ ID NO: 399513 - RNA, 19 nt, Homo sapiens
ggccucaaguucaauaugg

SEQ ID NO: 399514 - RNA, 19 nt, Homo sapiens
guagugaguaauucuuuga

SEQ ID NO: 399515 - RNA, 19 nt, Homo sapiens
cagugaagcagccuuacua

SEQ ID NO: 399516 - RNA, 19 nt, Homo sapiens
gcagcuugcaucuuuguug

SEQ ID NO: 399517 - RNA, 19 nt, Homo sapiens
cacccuacaugaauccaaa

SEQ ID NO: 399518 - RNA, 19 nt, Homo sapiens
gagcaucucuguuugguaa

SEQ ID NO: 399519 - RNA, 19 nt, Homo sapiens
uauaacagcucaaagagua

SEQ ID NO: 399520 - RNA, 19 nt, Homo sapiens
gaacagaaacggcuacuga

SEQ ID NO: 399521 - RNA, 19 nt, Homo sapiens
gggaaagguugaauuaauu

SEQ ID NO: 399522 - RNA, 19 nt, Homo sapiens
gauaaaggcuuaggacuuc

SEQ ID NO: 399523 - RNA, 19 nt, Homo sapiens
cuagauggaugaauuauga

SEQ ID NO: 399524 - RNA, 19 nt, Homo sapiens
ccaaagaacggccuacaua

SEQ ID NO: 399525 - RNA, 19 nt, Homo sapiens
gcgaaacccuggccuuaaa

SEQ ID NO: 399526 - RNA, 19 nt, Homo sapiens
gaagcagccuuacuauuca

SEQ ID NO: 399527 - RNA, 19 nt, Homo sapiens
ucacagugcuuaaagaaga

SEQ ID NO: 399528 - RNA, 19 nt, Homo sapiens
agaaugaacugucuagaug

SEQ ID NO: 399529 - RNA, 19 nt, Homo sapiens
cgucaagccuucuaaugua

SEQ ID NO: 399530 - RNA, 19 nt, Homo sapiens
gauaaaggccagacaauuc

SEQ ID NO: 399531 - RNA, 19 nt, Homo sapiens
gaacagaggguuuugauuu

SEQ ID NO: 399532 - RNA, 19 nt, Homo sapiens
ggaaacaucugcccaaucc

SEQ ID NO: 399533 - RNA, 19 nt, Homo sapiens
gcagauguccaacuuauau

SEQ ID NO: 399534 - RNA, 19 nt, Homo sapiens
gagcugauauacuuggaaa

SEQ ID NO: 399535 - RNA, 19 nt, Homo sapiens
gcucauggauacaucacua

SEQ ID NO: 399536 - RNA, 19 nt, Homo sapiens
gaggauugcuucccugaau

SEQ ID NO: 399537 - RNA, 19 nt, Homo sapiens
gaaagguagugaguaauuc

SEQ ID NO: 399538 - RNA, 19 nt, Homo sapiens
aaugaaagguagugaguaa

SEQ ID NO: 399539 - RNA, 19 nt, Homo sapiens
gcucuagguuucuugauga

SEQ ID NO: 399540 - RNA, 19 nt, Homo sapiens
ccaccuaccuauucaucua

SEQ ID NO: 399541 - RNA, 19 nt, Homo sapiens
gauacagugugaagucuga

SEQ ID NO: 399542 - RNA, 19 nt, Homo sapiens
gcugauauacuuggaaaua

SEQ ID NO: 399543 - RNA, 19 nt, Homo sapiens
uagaagggcuagaauagga

SEQ ID NO: 399544 - RNA, 19 nt, Homo sapiens
cagaagggauacaguguga

SEQ ID NO: 399545 - RNA, 19 nt, Homo sapiens
cagaugaccuggagccuau

SEQ ID NO: 399546 - RNA, 19 nt, Homo sapiens
cuacaugaauccaaaggaa

SEQ ID NO: 399547 - RNA, 19 nt, Homo sapiens
uaaauaaccaggaagcauu

SEQ ID NO: 399548 - RNA, 19 nt, Homo sapiens
ggaaauaaugggaaagguu

SEQ ID NO: 399549 - RNA, 19 nt, Homo sapiens
ugaagcagccuuacuauuc

SEQ ID NO: 399550 - RNA, 19 nt, Homo sapiens
gagcucuucuugugaaaug

SEQ ID NO: 399551 - RNA, 19 nt, Homo sapiens
caaguucacuacagcauca

SEQ ID NO: 399552 - RNA, 19 nt, Homo sapiens
ggauacaucacuagauaaa

SEQ ID NO: 399553 - RNA, 19 nt, Homo sapiens
guaaauagccaggaacaga

SEQ ID NO: 399554 - RNA, 19 nt, Homo sapiens
cugaggagcugauauacuu

SEQ ID NO: 399555 - RNA, 19 nt, Homo sapiens
ugacacuugugguauagua

SEQ ID NO: 399556 - RNA, 19 nt, Homo sapiens
caaguugacuaaacagcaa

SEQ ID NO: 399557 - RNA, 19 nt, Homo sapiens
ggauugccuuuguaguuaa

SEQ ID NO: 399558 - RNA, 19 nt, Homo sapiens
acaagaugcucuggucaua

SEQ ID NO: 399559 - RNA, 19 nt, Homo sapiens
gguggacucuguugcuaaa

SEQ ID NO: 399560 - RNA, 19 nt, Homo sapiens
uaaguucaauugugucugu

SEQ ID NO: 399561 - RNA, 19 nt, Homo sapiens
ugggaaagguugaauuaau

SEQ ID NO: 399562 - RNA, 19 nt, Homo sapiens
gauccgagccacaguaaau

SEQ ID NO: 399563 - RNA, 19 nt, Homo sapiens
gacaggaggcuggcaauuu

SEQ ID NO: 399564 - RNA, 19 nt, Homo sapiens
aggauugccuuuguaguua

SEQ ID NO: 399565 - RNA, 19 nt, Homo sapiens
ucuaugagcaucucuguuu

SEQ ID NO: 399566 - RNA, 19 nt, Homo sapiens
ucucagacuucucuuauuc

SEQ ID NO: 399567 - RNA, 19 nt, Homo sapiens
guucugaggagcugauaua

SEQ ID NO: 399568 - RNA, 19 nt, Homo sapiens
ugaaagguagugaguaauu

SEQ ID NO: 399569 - RNA, 19 nt, Homo sapiens
acccagagcucaaccagaa

SEQ ID NO: 399570 - RNA, 19 nt, Homo sapiens
gaauaaacccagagcucaa

SEQ ID NO: 399571 - RNA, 19 nt, Homo sapiens
acaggaggcuggcaauuuc

SEQ ID NO: 399572 - RNA, 19 nt, Homo sapiens
aguggaaagugauuuguaa

SEQ ID NO: 399573 - RNA, 19 nt, Homo sapiens
cgguagugaugaaauuaua

SEQ ID NO: 399574 - RNA, 19 nt, Homo sapiens
auggauacaucacuagaua

SEQ ID NO: 399575 - RNA, 19 nt, Homo sapiens
ggcauggacuaccagauga

SEQ ID NO: 399576 - RNA, 19 nt, Homo sapiens
gguagugaguaauucuuug

SEQ ID NO: 399577 - RNA, 19 nt, Homo sapiens
gguauaguauuaguggaaa

SEQ ID NO: 399578 - RNA, 19 nt, Homo sapiens
cagcaucaauagaaaguca

SEQ ID NO: 399579 - RNA, 19 nt, Homo sapiens
caucaaugcucucggucaa

SEQ ID NO: 399580 - RNA, 19 nt, Homo sapiens
gaacaaccucagaccaguu

SEQ ID NO: 399581 - RNA, 19 nt, Homo sapiens
ucauauaacagcucaaaga

SEQ ID NO: 399582 - RNA, 19 nt, Homo sapiens
aaugggaaagguugaauua

SEQ ID NO: 399583 - RNA, 19 nt, Homo sapiens
aaaaggagcucuucuugug

SEQ ID NO: 399584 - RNA, 19 nt, Homo sapiens
uaaauagccaggaacagaa

SEQ ID NO: 399585 - RNA, 19 nt, Homo sapiens
gaucaaggagugaaguaau

SEQ ID NO: 399586 - RNA, 19 nt, Homo sapiens
gggaguuccuagcaaguug

SEQ ID NO: 399587 - RNA, 19 nt, Homo sapiens
ucacaaguccugccaagug

SEQ ID NO: 399588 - RNA, 19 nt, Homo sapiens
uggaaucaguggcuacuug

SEQ ID NO: 399589 - RNA, 19 nt, Homo sapiens
ccacagguucuaugauuug

SEQ ID NO: 399590 - RNA, 19 nt, Homo sapiens
gggcauggacuaccagaug

SEQ ID NO: 399591 - RNA, 19 nt, Homo sapiens
ucauagaagggcuagaaua

SEQ ID NO: 399592 - RNA, 19 nt, Homo sapiens
agaaacggcuacugaugga

SEQ ID NO: 399593 - RNA, 19 nt, Homo sapiens
cauagaagggcuagaauag

SEQ ID NO: 399594 - RNA, 19 nt, Homo sapiens
cacuugugguauaguauua

SEQ ID NO: 399595 - RNA, 19 nt, Homo sapiens
ggccuuggaaucuauagua

SEQ ID NO: 399596 - RNA, 19 nt, Homo sapiens
gaaguaauugacagggaaa

SEQ ID NO: 399597 - RNA, 19 nt, Homo sapiens
gcguugaggccgcaucuuu

SEQ ID NO: 399598 - RNA, 19 nt, Homo sapiens
uguguaaguuguaaggauu

SEQ ID NO: 399599 - RNA, 19 nt, Homo sapiens
uaagguuggguuagcaaua

SEQ ID NO: 399600 - RNA, 19 nt, Homo sapiens
gaagggauacagugugaag

SEQ ID NO: 399601 - RNA, 19 nt, Homo sapiens
gugcuugugauuuguauuu

SEQ ID NO: 399602 - RNA, 19 nt, Homo sapiens
uccauucacugucaccuuu

SEQ ID NO: 399603 - RNA, 19 nt, Homo sapiens
gggcagaucauggcaguga

SEQ ID NO: 399604 - RNA, 19 nt, Homo sapiens
cagguucuaugauuuguag

SEQ ID NO: 399605 - RNA, 19 nt, Homo sapiens
acccacagguucuaugauu

SEQ ID NO: 399606 - RNA, 19 nt, Homo sapiens
cuagcaaguugacuaaaca

SEQ ID NO: 399607 - RNA, 19 nt, Homo sapiens
uggcuuuguuuguuuguuu

SEQ ID NO: 399608 - RNA, 19 nt, Homo sapiens
aaggagcucuucuugugaa

SEQ ID NO: 399609 - RNA, 19 nt, Homo sapiens
gaacugucuagauggauga

SEQ ID NO: 399610 - RNA, 19 nt, Homo sapiens
cugcagaguuuguugacuu

SEQ ID NO: 399611 - RNA, 19 nt, Homo sapiens
caagugaagaugugcgauu

SEQ ID NO: 399612 - RNA, 19 nt, Homo sapiens
ggccucaaguucaauaugg

SEQ ID NO: 399613 - RNA, 19 nt, Homo sapiens
guagugaguaauucuuuga

SEQ ID NO: 399614 - RNA, 19 nt, Homo sapiens
cagugaagcagccuuacua

SEQ ID NO: 399615 - RNA, 19 nt, Homo sapiens
cacccuacaugaauccaaa

SEQ ID NO: 399616 - RNA, 19 nt, Homo sapiens
cuaauguacucaucaaugc

SEQ ID NO: 399617 - RNA, 19 nt, Homo sapiens
ugauggauuuggauauuuc

SEQ ID NO: 399618 - RNA, 19 nt, Homo sapiens
ggaagagaccaaaguauaa

SEQ ID NO: 399619 - RNA, 19 nt, Homo sapiens
gcauugagauugaccagaa

SEQ ID NO: 399620 - RNA, 19 nt, Homo sapiens
ccaccaagccggacuauga

SEQ ID NO: 399621 - RNA, 19 nt, Homo sapiens
gucaaagacugccuuacua

SEQ ID NO: 399622 - RNA, 19 nt, Homo sapiens
gaagaccggccacgucauu

SEQ ID NO: 399623 - RNA, 19 nt, Homo sapiens
ucaacgaccuggagaacuu

SEQ ID NO: 399624 - RNA, 19 nt, Homo sapiens
gaacaagcgcauccucaug

SEQ ID NO: 399625 - RNA, 19 nt, Homo sapiens
gaagagaccaaaguauaau

SEQ ID NO: 399626 - RNA, 19 nt, Homo sapiens
ggaacaaggaggagaacaa

SEQ ID NO: 399627 - RNA, 19 nt, Homo sapiens
caaagacugccuuacuaaa

SEQ ID NO: 399628 - RNA, 19 nt, Homo sapiens
ucaaagacugccuuacuaa

SEQ ID NO: 399629 - RNA, 19 nt, Homo sapiens
aggaagagaccaaaguaua

SEQ ID NO: 399630 - RNA, 19 nt, Homo sapiens
aagacugccuuacuaaaga

SEQ ID NO: 399631 - RNA, 19 nt, Homo sapiens
caggacaguuucccuacaa

SEQ ID NO: 399632 - RNA, 19 nt, Homo sapiens
uguacuaccugaaggagaa

SEQ ID NO: 399633 - RNA, 19 nt, Homo sapiens
gaacaaggaggagaacaag

SEQ ID NO: 399634 - RNA, 19 nt, Homo sapiens
gaagcugucccgccuggaa

SEQ ID NO: 399635 - RNA, 19 nt, Homo sapiens
caacacggacgucuucauc

SEQ ID NO: 399636 - RNA, 19 nt, Homo sapiens
gaacugcaagacggacuuu

SEQ ID NO: 399637 - RNA, 19 nt, Homo sapiens
gacaguuucccuacaagaa

SEQ ID NO: 399638 - RNA, 19 nt, Homo sapiens
uggagagcauugagauuga

SEQ ID NO: 399639 - RNA, 19 nt, Homo sapiens
ggacaguuucccuacaaga

SEQ ID NO: 399640 - RNA, 19 nt, Homo sapiens
ugaaggcgcuguacuaccu

SEQ ID NO: 399641 - RNA, 19 nt, Homo sapiens
ggagaagcacggugucauc

SEQ ID NO: 399642 - RNA, 19 nt, Homo sapiens
gcuggcaacaggacaguuu

SEQ ID NO: 399643 - RNA, 19 nt, Homo sapiens
acaggaagagaccaaagua

SEQ ID NO: 399644 - RNA, 19 nt, Homo sapiens
gcauggagagcauugagau

SEQ ID NO: 399645 - RNA, 19 nt, Homo sapiens
gaucacaggaagagaccaa

SEQ ID NO: 399646 - RNA, 19 nt, Homo sapiens
cguccucccuggaacagaa

SEQ ID NO: 399647 - RNA, 19 nt, Homo sapiens
gaccucaaccuggauauca

SEQ ID NO: 399648 - RNA, 19 nt, Homo sapiens
caagaugacaguggcgauu

SEQ ID NO: 399649 - RNA, 19 nt, Homo sapiens
ccacgucauugccguuaag

SEQ ID NO: 399650 - RNA, 19 nt, Homo sapiens
aaagacugccuuacuaaag

SEQ ID NO: 399651 - RNA, 19 nt, Homo sapiens
ggacguucaucaccaacac

SEQ ID NO: 399652 - RNA, 19 nt, Homo sapiens
ugcaggagaucaugaagca

SEQ ID NO: 399653 - RNA, 19 nt, Homo sapiens
accagaagcugcaggagau

SEQ ID NO: 399654 - RNA, 19 nt, Homo sapiens
gaccaaaguauaauaagcu

SEQ ID NO: 399655 - RNA, 19 nt, Homo sapiens
uuacuaaagaucacaggaa

SEQ ID NO: 399656 - RNA, 19 nt, Homo sapiens
ugacaguggcgauugugaa

SEQ ID NO: 399657 - RNA, 19 nt, Homo sapiens
ggagaacuugggcgagaug

SEQ ID NO: 399658 - RNA, 19 nt, Homo sapiens
agacugccuuacuaaagau

SEQ ID NO: 399659 - RNA, 19 nt, Homo sapiens
cgucaaagacugccuuacu

SEQ ID NO: 399660 - RNA, 19 nt, Homo sapiens
gguccucaccaaaguccua

SEQ ID NO: 399661 - RNA, 19 nt, Homo sapiens
agaccaaaguauaauaagc

SEQ ID NO: 399662 - RNA, 19 nt, Homo sapiens
cuaaagaucacaggaagag

SEQ ID NO: 399663 - RNA, 19 nt, Homo sapiens
cgucaagcccuccaacauc

SEQ ID NO: 399664 - RNA, 19 nt, Homo sapiens
gccacgucauugccguuaa

SEQ ID NO: 399665 - RNA, 19 nt, Homo sapiens
caggaagagaccaaaguau

SEQ ID NO: 399666 - RNA, 19 nt, Homo sapiens
ggagagcauugagauugac

SEQ ID NO: 399667 - RNA, 19 nt, Homo sapiens
caaagcugaagcaggagaa

SEQ ID NO: 399668 - RNA, 19 nt, Homo sapiens
acaagcgcauccucaugga

SEQ ID NO: 399669 - RNA, 19 nt, Homo sapiens
gagaccaaaguauaauaag

SEQ ID NO: 399670 - RNA, 19 nt, Homo sapiens
caccaacacggacgucuuc

SEQ ID NO: 399671 - RNA, 19 nt, Homo sapiens
ggccacgucauugccguua

SEQ ID NO: 399672 - RNA, 19 nt, Homo sapiens
guauggagccugggcaucu

SEQ ID NO: 399673 - RNA, 19 nt, Homo sapiens
gacaguggcgauugugaag

SEQ ID NO: 399674 - RNA, 19 nt, Homo sapiens
agaugacaguggcgauugu

SEQ ID NO: 399675 - RNA, 19 nt, Homo sapiens
acaggacaguuucccuaca

SEQ ID NO: 399676 - RNA, 19 nt, Homo sapiens
ggaagagaccaaaguauaa

SEQ ID NO: 399677 - RNA, 19 nt, Homo sapiens
gcauugagauugaccagaa

SEQ ID NO: 399678 - RNA, 19 nt, Homo sapiens
ccaccaagccggacuauga

SEQ ID NO: 399679 - RNA, 19 nt, Homo sapiens
gucaaagacugccuuacua

SEQ ID NO: 399680 - RNA, 19 nt, Homo sapiens
gaagaccggccacgucauu

SEQ ID NO: 399681 - RNA, 19 nt, Homo sapiens
ucaacgaccuggagaacuu

SEQ ID NO: 399682 - RNA, 19 nt, Homo sapiens
gaacaagcgcauccucaug

SEQ ID NO: 399683 - RNA, 19 nt, Homo sapiens
gaagagaccaaaguauaau

SEQ ID NO: 399684 - RNA, 19 nt, Homo sapiens
ggaacaaggaggagaacaa

SEQ ID NO: 399685 - RNA, 19 nt, Homo sapiens
caaagacugccuuacuaaa

SEQ ID NO: 399686 - RNA, 19 nt, Homo sapiens
ucaaagacugccuuacuaa

SEQ ID NO: 399687 - RNA, 19 nt, Homo sapiens
aggaagagaccaaaguaua

SEQ ID NO: 399688 - RNA, 19 nt, Homo sapiens
aagacugccuuacuaaaga

SEQ ID NO: 399689 - RNA, 19 nt, Homo sapiens
caggacaguuucccuacaa

SEQ ID NO: 399690 - RNA, 19 nt, Homo sapiens
uguacuaccugaaggagaa

SEQ ID NO: 399691 - RNA, 19 nt, Homo sapiens
gaacaaggaggagaacaag

SEQ ID NO: 399692 - RNA, 19 nt, Homo sapiens
gaagcugucccgccuggaa

SEQ ID NO: 399693 - RNA, 19 nt, Homo sapiens
caacacggacgucuucauc

SEQ ID NO: 399694 - RNA, 19 nt, Homo sapiens
gaacugcaagacggacuuu

SEQ ID NO: 399695 - RNA, 19 nt, Homo sapiens
gacaguuucccuacaagaa

SEQ ID NO: 399696 - RNA, 19 nt, Homo sapiens
uggagagcauugagauuga

SEQ ID NO: 399697 - RNA, 19 nt, Homo sapiens
ggacaguuucccuacaaga

SEQ ID NO: 399698 - RNA, 19 nt, Homo sapiens
ugaaggcgcuguacuaccu

SEQ ID NO: 399699 - RNA, 19 nt, Homo sapiens
ggagaagcacggugucauc

SEQ ID NO: 399700 - RNA, 19 nt, Homo sapiens
gcuggcaacaggacaguuu

SEQ ID NO: 399701 - RNA, 19 nt, Homo sapiens
acaggaagagaccaaagua

SEQ ID NO: 399702 - RNA, 19 nt, Homo sapiens
gcauggagagcauugagau

SEQ ID NO: 399703 - RNA, 19 nt, Homo sapiens
gaucacaggaagagaccaa

SEQ ID NO: 399704 - RNA, 19 nt, Homo sapiens
cguccucccuggaacagaa

SEQ ID NO: 399705 - RNA, 19 nt, Homo sapiens
gaccucaaccuggauauca

SEQ ID NO: 399706 - RNA, 19 nt, Homo sapiens
caagaugacaguggcgauu

SEQ ID NO: 399707 - RNA, 19 nt, Homo sapiens
ccacgucauugccguuaag

SEQ ID NO: 399708 - RNA, 19 nt, Homo sapiens
aaagacugccuuacuaaag

SEQ ID NO: 399709 - RNA, 19 nt, Homo sapiens
ggacguucaucaccaacac

SEQ ID NO: 399710 - RNA, 19 nt, Homo sapiens
ugcaggagaucaugaagca

SEQ ID NO: 399711 - RNA, 19 nt, Homo sapiens
accagaagcugcaggagau

SEQ ID NO: 399712 - RNA, 19 nt, Homo sapiens
gaccaaaguauaauaagcu

SEQ ID NO: 399713 - RNA, 19 nt, Homo sapiens
uuacuaaagaucacaggaa

SEQ ID NO: 399714 - RNA, 19 nt, Homo sapiens
ugacaguggcgauugugaa

SEQ ID NO: 399715 - RNA, 19 nt, Homo sapiens
ggagaacuugggcgagaug

SEQ ID NO: 399716 - RNA, 19 nt, Homo sapiens
agacugccuuacuaaagau

SEQ ID NO: 399717 - RNA, 19 nt, Homo sapiens
cgucaaagacugccuuacu

SEQ ID NO: 399718 - RNA, 19 nt, Homo sapiens
gguccucaccaaaguccua

SEQ ID NO: 399719 - RNA, 19 nt, Homo sapiens
agaccaaaguauaauaagc

SEQ ID NO: 399720 - RNA, 19 nt, Homo sapiens
cuaaagaucacaggaagag

SEQ ID NO: 399721 - RNA, 19 nt, Homo sapiens
cgucaagcccuccaacauc

SEQ ID NO: 399722 - RNA, 19 nt, Homo sapiens
gccacgucauugccguuaa

SEQ ID NO: 399723 - RNA, 19 nt, Homo sapiens
caggaagagaccaaaguau

SEQ ID NO: 399724 - RNA, 19 nt, Homo sapiens
ggagagcauugagauugac

SEQ ID NO: 399725 - RNA, 19 nt, Homo sapiens
caaagcugaagcaggagaa

SEQ ID NO: 399726 - RNA, 19 nt, Homo sapiens
acaagcgcauccucaugga

SEQ ID NO: 399727 - RNA, 19 nt, Homo sapiens
gagaccaaaguauaauaag

SEQ ID NO: 399728 - RNA, 19 nt, Homo sapiens
caccaacacggacgucuuc

SEQ ID NO: 399729 - RNA, 19 nt, Homo sapiens
ggccacgucauugccguua

SEQ ID NO: 399730 - RNA, 19 nt, Homo sapiens
guauggagccugggcaucu

SEQ ID NO: 399731 - RNA, 19 nt, Homo sapiens
gacaguggcgauugugaag

SEQ ID NO: 399732 - RNA, 19 nt, Homo sapiens
agaugacaguggcgauugu

SEQ ID NO: 399733 - RNA, 19 nt, Homo sapiens
acaggacaguuucccuaca

SEQ ID NO: 399734 - RNA, 19 nt, Homo sapiens
gagcugagaucgcaccauu

SEQ ID NO: 399735 - RNA, 19 nt, Homo sapiens
acaacuaggugaacacaua

SEQ ID NO: 399736 - RNA, 19 nt, Homo sapiens
gcucaugccuguaauuuca

SEQ ID NO: 399737 - RNA, 19 nt, Homo sapiens
ggaucucucucaacaacua

SEQ ID NO: 399738 - RNA, 19 nt, Homo sapiens
gaaacccugucugcauuaa

SEQ ID NO: 399739 - RNA, 19 nt, Homo sapiens
gugaaacccugucugcauu

SEQ ID NO: 399740 - RNA, 19 nt, Homo sapiens
ggacacagcagugaauaga

SEQ ID NO: 399741 - RNA, 19 nt, Homo sapiens
caaggaggguggaucacuu

SEQ ID NO: 399742 - RNA, 19 nt, Homo sapiens
uaacugagagaacgagaaa

SEQ ID NO: 399743 - RNA, 19 nt, Homo sapiens
gaagcugucccgccuggaa

SEQ ID NO: 399744 - RNA, 19 nt, Homo sapiens
gcacgccugugugugugua

SEQ ID NO: 399745 - RNA, 19 nt, Homo sapiens
ucgggaggcuguaauccua

SEQ ID NO: 399746 - RNA, 19 nt, Homo sapiens
cuauggaucucucucaaca

SEQ ID NO: 399747 - RNA, 19 nt, Homo sapiens
ugagagaacgagaaaguug

SEQ ID NO: 399748 - RNA, 19 nt, Homo sapiens
gaaaccccgucuccacuaa

SEQ ID NO: 399749 - RNA, 19 nt, Homo sapiens
ccuguaauuucaguacuuu

SEQ ID NO: 399750 - RNA, 19 nt, Homo sapiens
gcagugaauagaacagaug

SEQ ID NO: 399751 - RNA, 19 nt, Homo sapiens
ugaaacccugucugcauua

SEQ ID NO: 399752 - RNA, 19 nt, Homo sapiens
uuggacaucugcaccauug

SEQ ID NO: 399753 - RNA, 19 nt, Homo sapiens
acacagcagugaauagaac

SEQ ID NO: 399754 - RNA, 19 nt, Homo sapiens
guuauugugaucacucuaa

SEQ ID NO: 399755 - RNA, 19 nt, Homo sapiens
gcaaaacuccaucucagaa

SEQ ID NO: 399756 - RNA, 19 nt, Homo sapiens
ggugaaacccugucugcau

SEQ ID NO: 399757 - RNA, 19 nt, Homo sapiens
cguccucccuggaacagaa

SEQ ID NO: 399758 - RNA, 19 nt, Homo sapiens
gaccucaaccuggauauca

SEQ ID NO: 399759 - RNA, 19 nt, Homo sapiens
ggacaccugaguuauugug

SEQ ID NO: 399760 - RNA, 19 nt, Homo sapiens
caucugcaccauugaccua

SEQ ID NO: 399761 - RNA, 19 nt, Homo sapiens
caccugaguuauugugauc

SEQ ID NO: 399762 - RNA, 19 nt, Homo sapiens
gccuguaauuucaguacuu

SEQ ID NO: 399763 - RNA, 19 nt, Homo sapiens
cuacagggagccaugauca

SEQ ID NO: 399764 - RNA, 19 nt, Homo sapiens
ggagacggugggaauugaa

SEQ ID NO: 399765 - RNA, 19 nt, Homo sapiens
agaccacccugaccaacau

SEQ ID NO: 399766 - RNA, 19 nt, Homo sapiens
ggggacaccugaguuauug

SEQ ID NO: 399767 - RNA, 19 nt, Homo sapiens
uggagacggugggaauuga

SEQ ID NO: 399768 - RNA, 19 nt, Homo sapiens
gagaccacccugaccaaca

SEQ ID NO: 399769 - RNA, 19 nt, Homo sapiens
ggugggaauugaacaaagc

SEQ ID NO: 399770 - RNA, 19 nt, Homo sapiens
gccuauggaucucucucaa

SEQ ID NO: 399771 - RNA, 19 nt, Homo sapiens
aaaacuccaucucagaaaa

SEQ ID NO: 399772 - RNA, 19 nt, Homo sapiens
gaucgcaccauugcacuuc

SEQ ID NO: 399773 - RNA, 19 nt, Homo sapiens
caacuaggugaacacauag

SEQ ID NO: 399774 - RNA, 19 nt, Homo sapiens
caacaacuaggugaacaca

SEQ ID NO: 399775 - RNA, 19 nt, Homo sapiens
guaacugagagaacgagaa

SEQ ID NO: 399776 - RNA, 19 nt, Homo sapiens
acucacaccuguaauucca

SEQ ID NO: 399777 - RNA, 19 nt, Homo sapiens
ugacucacaccuguaauuc

SEQ ID NO: 399778 - RNA, 19 nt, Homo sapiens
gcugagaucgcaccauugc

SEQ ID NO: 399779 - RNA, 19 nt, Homo sapiens
gguggcacauaccuguaau

SEQ ID NO: 399780 - RNA, 19 nt, Homo sapiens
caaagcugaagcaggagaa

SEQ ID NO: 399781 - RNA, 19 nt, Homo sapiens
gacacagcagugaauagaa

SEQ ID NO: 399782 - RNA, 19 nt, Homo sapiens
ggugcacgccugugugugu

SEQ ID NO: 399783 - RNA, 19 nt, Homo sapiens
ccacugaaugggagucugu

SEQ ID NO: 399784 - RNA, 19 nt, Homo sapiens
ggccaaggaggguggauca

SEQ ID NO: 399785 - RNA, 19 nt, Homo sapiens
guggguggccugugccuau

SEQ ID NO: 399786 - RNA, 19 nt, Homo sapiens
ggacaucugcaccauugac

SEQ ID NO: 399787 - RNA, 19 nt, Homo sapiens
ucacuugaggucaggaguu

SEQ ID NO: 399788 - RNA, 19 nt, Homo sapiens
acaccugaguuauugugau

SEQ ID NO: 399789 - RNA, 19 nt, Homo sapiens
caguggcucaugccuguaa

SEQ ID NO: 399790 - RNA, 19 nt, Homo sapiens
gcaggagaaccgcuugaac

SEQ ID NO: 399791 - RNA, 19 nt, Homo sapiens
cacuugaggucaggaguuc

SEQ ID NO: 399792 - RNA, 19 nt, Homo sapiens
uggcucaugccuguaauuu

SEQ ID NO: 399793 - RNA, 19 nt, Homo sapiens
gguggccugugccuaugga

SEQ ID NO: 399794 - RNA, 19 nt, Homo sapiens
caaauuagcuguugagaua

SEQ ID NO: 399795 - RNA, 19 nt, Homo sapiens
ggaaagacuuacguuauua

SEQ ID NO: 399796 - RNA, 19 nt, Homo sapiens
gcucaucucuuuauucuuu

SEQ ID NO: 399797 - RNA, 19 nt, Homo sapiens
caaauggaauucugugaua

SEQ ID NO: 399798 - RNA, 19 nt, Homo sapiens
ccagaaggauuucauuaua

SEQ ID NO: 399799 - RNA, 19 nt, Homo sapiens
caagccagcuggagaaaua

SEQ ID NO: 399800 - RNA, 19 nt, Homo sapiens
gaagaaaccucagugaaau

SEQ ID NO: 399801 - RNA, 19 nt, Homo sapiens
gcagauacaucagagauaa

SEQ ID NO: 399802 - RNA, 19 nt, Homo sapiens
gaaaggaaguggaccucua

SEQ ID NO: 399803 - RNA, 19 nt, Homo sapiens
gauaggagguuuacauuuc

SEQ ID NO: 399804 - RNA, 19 nt, Homo sapiens
gaucuuaagccaaguaaua

SEQ ID NO: 399805 - RNA, 19 nt, Homo sapiens
ggacagaaagaauauagua

SEQ ID NO: 399806 - RNA, 19 nt, Homo sapiens
uggaggaacuuaauacaua

SEQ ID NO: 399807 - RNA, 19 nt, Homo sapiens
gcauucagcuccacacuug

SEQ ID NO: 399808 - RNA, 19 nt, Homo sapiens
gcaagacuauggaaaggaa

SEQ ID NO: 399809 - RNA, 19 nt, Homo sapiens
ugaauggucucagaaauaa

SEQ ID NO: 399810 - RNA, 19 nt, Homo sapiens
gcaguuugcucauacuuug

SEQ ID NO: 399811 - RNA, 19 nt, Homo sapiens
guaaugaccucaaaacuuu

SEQ ID NO: 399812 - RNA, 19 nt, Homo sapiens
gcucauacuuugugacuug

SEQ ID NO: 399813 - RNA, 19 nt, Homo sapiens
ggaaagcgaacaaggagua

SEQ ID NO: 399814 - RNA, 19 nt, Homo sapiens
ggcaguuaguccuuuauua

SEQ ID NO: 399815 - RNA, 19 nt, Homo sapiens
gaucaaagaaggaagcaaa

SEQ ID NO: 399816 - RNA, 19 nt, Homo sapiens
caaaagggguggauuauau

SEQ ID NO: 399817 - RNA, 19 nt, Homo sapiens
agaaauggcuggugaucuu

SEQ ID NO: 399818 - RNA, 19 nt, Homo sapiens
gaacgacacacauguuaga

SEQ ID NO: 399819 - RNA, 19 nt, Homo sapiens
gcaguuaguccuuuauuau

SEQ ID NO: 399820 - RNA, 19 nt, Homo sapiens
gggauggauuugauuauga

SEQ ID NO: 399821 - RNA, 19 nt, Homo sapiens
gaaucaacauccacacuuc

SEQ ID NO: 399822 - RNA, 19 nt, Homo sapiens
ggagaaauaugguacucau

SEQ ID NO: 399823 - RNA, 19 nt, Homo sapiens
ccucaucucuuuguucuaa

SEQ ID NO: 399824 - RNA, 19 nt, Homo sapiens
gcgagaaacuagacaaagu

SEQ ID NO: 399825 - RNA, 19 nt, Homo sapiens
gaaacauccuaaacaaucu

SEQ ID NO: 399826 - RNA, 19 nt, Homo sapiens
caacaacgaauucuucaga

SEQ ID NO: 399827 - RNA, 19 nt, Homo sapiens
cuacagaaauuacucucaa

SEQ ID NO: 399828 - RNA, 19 nt, Homo sapiens
ggaauuacauaggccuuau

SEQ ID NO: 399829 - RNA, 19 nt, Homo sapiens
agaagaaaccucagugaaa

SEQ ID NO: 399830 - RNA, 19 nt, Homo sapiens
uagcaguucuuccaucuga

SEQ ID NO: 399831 - RNA, 19 nt, Homo sapiens
ccgcuaaacuugcauaucu

SEQ ID NO: 399832 - RNA, 19 nt, Homo sapiens
uacauaggccuuaucaaua

SEQ ID NO: 399833 - RNA, 19 nt, Homo sapiens
guaagggaacuuugcgaua

SEQ ID NO: 399834 - RNA, 19 nt, Homo sapiens
caaaguauacuguggacaa

SEQ ID NO: 399835 - RNA, 19 nt, Homo sapiens
ggacuuguaacaucucuga

SEQ ID NO: 399836 - RNA, 19 nt, Homo sapiens
gaaggcggagcgugaagua

SEQ ID NO: 399837 - RNA, 19 nt, Homo sapiens
cgagguccaucccaauaaa

SEQ ID NO: 399838 - RNA, 19 nt, Homo sapiens
acauaggccuuaucaauag

SEQ ID NO: 399839 - RNA, 19 nt, Homo sapiens
cauccacacuuccgugauu

SEQ ID NO: 399840 - RNA, 19 nt, Homo sapiens
ggauggauuugauuaugau

SEQ ID NO: 399841 - RNA, 19 nt, Homo sapiens
gugauuaucugcgugcauu

SEQ ID NO: 399842 - RNA, 19 nt, Homo sapiens
cacacucgcuucugaauca

SEQ ID NO: 399843 - RNA, 19 nt, Homo sapiens
ccagcacacucgcuucuga

SEQ ID NO: 399844 - RNA, 19 nt, Homo sapiens
aaacuugcauaucuucaga

SEQ ID NO: 399845 - RNA, 19 nt, Homo sapiens
ggccagaaggauuucauua

SEQ ID NO: 399846 - RNA, 19 nt, Homo sapiens
uuacauaggccuuaucaau

SEQ ID NO: 399847 - RNA, 19 nt, Homo sapiens
gaagaaaagcccagagaaa

SEQ ID NO: 399848 - RNA, 19 nt, Homo sapiens
gauuugaccuuccugacau

SEQ ID NO: 399849 - RNA, 19 nt, Homo sapiens
cgacaagcauagaaacauc

SEQ ID NO: 399850 - RNA, 19 nt, Homo sapiens
ggaggaacuuaauacauac

SEQ ID NO: 399851 - RNA, 19 nt, Homo sapiens
ccaaagugcugggauuaca

SEQ ID NO: 399852 - RNA, 19 nt, Homo sapiens
gcuagggaauaucaauaga

SEQ ID NO: 399853 - RNA, 19 nt, Homo sapiens
cgaccuaacacaucugaaa

SEQ ID NO: 399854 - RNA, 19 nt, Homo sapiens
uaagggaacuuugcgauac

SEQ ID NO: 399855 - RNA, 19 nt, Homo sapiens
gcuguugagauacuuaaua

SEQ ID NO: 399856 - RNA, 19 nt, Homo sapiens
uaucaagaacugccuaauu

SEQ ID NO: 399857 - RNA, 19 nt, Homo sapiens
agacaggguuucaccaugu

SEQ ID NO: 399858 - RNA, 19 nt, Homo sapiens
aaagaaaccugaggaucga

SEQ ID NO: 399859 - RNA, 19 nt, Homo sapiens
uaacaaaagggguggauua

SEQ ID NO: 399860 - RNA, 19 nt, Homo sapiens
ugaccuuccugacaugaaa

SEQ ID NO: 399861 - RNA, 19 nt, Homo sapiens
guucuucguugcuuaugaa

SEQ ID NO: 399862 - RNA, 19 nt, Homo sapiens
aaaugccgcagccaaauua

SEQ ID NO: 399863 - RNA, 19 nt, Homo sapiens
ccacccacccaacuaauuu

SEQ ID NO: 399864 - RNA, 19 nt, Homo sapiens
gauaugcaguuuuccuuaa

SEQ ID NO: 399865 - RNA, 19 nt, Homo sapiens
gcuuaugaauggucucaga

SEQ ID NO: 399866 - RNA, 19 nt, Homo sapiens
ccacaugauaggagguuua

SEQ ID NO: 399867 - RNA, 19 nt, Homo sapiens
uuuccuggcucaucucuuu

SEQ ID NO: 399868 - RNA, 19 nt, Homo sapiens
cauagaaacauccuaaaca

SEQ ID NO: 399869 - RNA, 19 nt, Homo sapiens
acaauuggccgcuaaacuu

SEQ ID NO: 399870 - RNA, 19 nt, Homo sapiens
gcaugggccagaaggauuu

SEQ ID NO: 399871 - RNA, 19 nt, Homo sapiens
gcuaauucuugcugaacuu

SEQ ID NO: 399872 - RNA, 19 nt, Homo sapiens
gauggaaagcgaacaagga

SEQ ID NO: 399873 - RNA, 19 nt, Homo sapiens
gaagaggcgagaaacuaga

SEQ ID NO: 399874 - RNA, 19 nt, Homo sapiens
gaccagugaugauucucuu

SEQ ID NO: 399875 - RNA, 19 nt, Homo sapiens
agaaacauccuaaacaauc

SEQ ID NO: 399876 - RNA, 19 nt, Homo sapiens
caagagguuuggcauggau

SEQ ID NO: 399877 - RNA, 19 nt, Homo sapiens
ggugacuucucagcagaua

SEQ ID NO: 399878 - RNA, 19 nt, Homo sapiens
cuacuaaacaggaagcaaa

SEQ ID NO: 399879 - RNA, 19 nt, Homo sapiens
aucaagaacugccuaauuc

SEQ ID NO: 399880 - RNA, 19 nt, Homo sapiens
gaaauggcuggugaucuuu

SEQ ID NO: 399881 - RNA, 19 nt, Homo sapiens
ugagagcagugauuaugau

SEQ ID NO: 399882 - RNA, 19 nt, Homo sapiens
caaaacaauuggccgcuaa

SEQ ID NO: 399883 - RNA, 19 nt, Homo sapiens
guacagguucuacuaaaca

SEQ ID NO: 399884 - RNA, 19 nt, Homo sapiens
gaagaaaagacuaacugua

SEQ ID NO: 399885 - RNA, 19 nt, Homo sapiens
ugacaacaacgaauucuuc

SEQ ID NO: 399886 - RNA, 19 nt, Homo sapiens
aaguggaccucuacgcuuu

SEQ ID NO: 399887 - RNA, 19 nt, Homo sapiens
gaaagcgaacaaggaguaa

SEQ ID NO: 399888 - RNA, 19 nt, Homo sapiens
aaacaguucuucguugcuu

SEQ ID NO: 399889 - RNA, 19 nt, Homo sapiens
gauuauccauggggaauua

SEQ ID NO: 399890 - RNA, 19 nt, Homo sapiens
uguuagagcccuucugaaa

SEQ ID NO: 399891 - RNA, 19 nt, Homo sapiens
ggaucgaccuaacacaucu

SEQ ID NO: 399892 - RNA, 19 nt, Homo sapiens
cagaagaaaccucagugaa

SEQ ID NO: 399893 - RNA, 19 nt, Homo sapiens
aaaugggacagaaagaaua

SEQ ID NO: 399894 - RNA, 19 nt, Homo sapiens
acagagaggucacuuauua

SEQ ID NO: 399895 - RNA, 19 nt, Homo sapiens
gcacaaagauuauugaaac

SEQ ID NO: 399896 - RNA, 19 nt, Homo sapiens
gaagcacagucucaacuua

SEQ ID NO: 399897 - RNA, 19 nt, Homo sapiens
gcuauagccuuccuugaua

SEQ ID NO: 399898 - RNA, 19 nt, Homo sapiens
guacgaaggugcugaaugu

SEQ ID NO: 399899 - RNA, 19 nt, Homo sapiens
ugagaaacaucuugaauug

SEQ ID NO: 399900 - RNA, 19 nt, Homo sapiens
ccagauaacuuccagaaug

SEQ ID NO: 399901 - RNA, 19 nt, Homo sapiens
ggacuucacugcagcaaga

SEQ ID NO: 399902 - RNA, 19 nt, Homo sapiens
gggaaugucuuaaacuuga

SEQ ID NO: 399903 - RNA, 19 nt, Homo sapiens
agagaaagcacaaagauua

SEQ ID NO: 399904 - RNA, 19 nt, Homo sapiens
cuaaagaaguccucucuga

SEQ ID NO: 399905 - RNA, 19 nt, Homo sapiens
gaaguucgggaaugucuua

SEQ ID NO: 399906 - RNA, 19 nt, Homo sapiens
gaaaugagaaagaaguuug

SEQ ID NO: 399907 - RNA, 19 nt, Homo sapiens
gcucaaaucuaauccaagu

SEQ ID NO: 399908 - RNA, 19 nt, Homo sapiens
cagauaacuuccagaauga

SEQ ID NO: 399909 - RNA, 19 nt, Homo sapiens
gauggaaccugacaaugug

SEQ ID NO: 399910 - RNA, 19 nt, Homo sapiens
ggaaauguaugaugaagcu

SEQ ID NO: 399911 - RNA, 19 nt, Homo sapiens
uagaggaaauguaugauga

SEQ ID NO: 399912 - RNA, 19 nt, Homo sapiens
gcagaaacgagauuauuau

SEQ ID NO: 399913 - RNA, 19 nt, Homo sapiens
gaaagcacaaagauuauug

SEQ ID NO: 399914 - RNA, 19 nt, Homo sapiens
gaaccuaggaaagcuauaa

SEQ ID NO: 399915 - RNA, 19 nt, Homo sapiens
ggcggaccauuuagauuua

SEQ ID NO: 399916 - RNA, 19 nt, Homo sapiens
ucgagaaggucuagagaaa

SEQ ID NO: 399917 - RNA, 19 nt, Homo sapiens
aagcugcacuuccugauuu

SEQ ID NO: 399918 - RNA, 19 nt, Homo sapiens
gagcagaggccuauuugau

SEQ ID NO: 399919 - RNA, 19 nt, Homo sapiens
aaaugcagauguugagaaa

SEQ ID NO: 399920 - RNA, 19 nt, Homo sapiens
caaugugaaugcccugaaa

SEQ ID NO: 399921 - RNA, 19 nt, Homo sapiens
gagauuauacugcugcuau

SEQ ID NO: 399922 - RNA, 19 nt, Homo sapiens
gcacagucucaacuuauaa

SEQ ID NO: 399923 - RNA, 19 nt, Homo sapiens
gaauauacaguucguucaa

SEQ ID NO: 399924 - RNA, 19 nt, Homo sapiens
ugauaauacugaagcguuu

SEQ ID NO: 399925 - RNA, 19 nt, Homo sapiens
gagaaggucuagagaaagc

SEQ ID NO: 399926 - RNA, 19 nt, Homo sapiens
gauggcagauacacagaug

SEQ ID NO: 399927 - RNA, 19 nt, Homo sapiens
gagaaagcacaaagauuau

SEQ ID NO: 399928 - RNA, 19 nt, Homo sapiens
agaggucacuuauuacuca

SEQ ID NO: 399929 - RNA, 19 nt, Homo sapiens
ucggagggcuacugucuuu

SEQ ID NO: 399930 - RNA, 19 nt, Homo sapiens
ccugauaacuauauugcuu

SEQ ID NO: 399931 - RNA, 19 nt, Homo sapiens
gaaguuugacgacggagaa

SEQ ID NO: 399932 - RNA, 19 nt, Homo sapiens
gaacuucgagcugaauguu

SEQ ID NO: 399933 - RNA, 19 nt, Homo sapiens
cgcagaaacgagauuauua

SEQ ID NO: 399934 - RNA, 19 nt, Homo sapiens
uuaugaaacugcucaggaa

SEQ ID NO: 399935 - RNA, 19 nt, Homo sapiens
cugaugaaaugcagcguuu

SEQ ID NO: 399936 - RNA, 19 nt, Homo sapiens
cuauagccuuccuugauaa

SEQ ID NO: 399937 - RNA, 19 nt, Homo sapiens
uggaguaaaugcagauguu

SEQ ID NO: 399938 - RNA, 19 nt, Homo sapiens
ucaaaucuaauccaaguga

SEQ ID NO: 399939 - RNA, 19 nt, Homo sapiens
cgagaagccuguugaagcu

SEQ ID NO: 399940 - RNA, 19 nt, Homo sapiens
caaaucuaauccaagugaa

SEQ ID NO: 399941 - RNA, 19 nt, Homo sapiens
cgacggagaagauccuuug

SEQ ID NO: 399942 - RNA, 19 nt, Homo sapiens
cagcucaggcggaccauuu

SEQ ID NO: 399943 - RNA, 19 nt, Homo sapiens
gaggaaauguaugaugaag

SEQ ID NO: 399944 - RNA, 19 nt, Homo sapiens
ugauagaggaaauguauga

SEQ ID NO: 399945 - RNA, 19 nt, Homo sapiens
ggaagcacagucucaacuu

SEQ ID NO: 399946 - RNA, 19 nt, Homo sapiens
cacagaagcuggaacucau

SEQ ID NO: 399947 - RNA, 19 nt, Homo sapiens
gcucaggaacacaaugaaa

SEQ ID NO: 399948 - RNA, 19 nt, Homo sapiens
gaaaacagagccaagcauu

SEQ ID NO: 399949 - RNA, 19 nt, Homo sapiens
aaacuugaccaggaucaua

SEQ ID NO: 399950 - RNA, 19 nt, Homo sapiens
cuaggaaagcuauaaguga

SEQ ID NO: 399951 - RNA, 19 nt, Homo sapiens
gaaggagaaccuaggaaag

SEQ ID NO: 399952 - RNA, 19 nt, Homo sapiens
gugcucaaaucuaauccaa

SEQ ID NO: 399953 - RNA, 19 nt, Homo sapiens
gaagccuguugaagcuauu

SEQ ID NO: 399954 - RNA, 19 nt, Homo sapiens
ggacgagaagccuguugaa

SEQ ID NO: 399955 - RNA, 19 nt, Homo sapiens
gcacuuccugauuuaacua

SEQ ID NO: 399956 - RNA, 19 nt, Homo sapiens
guagauggugacccugaua

SEQ ID NO: 399957 - RNA, 19 nt, Homo sapiens
uuacagagaggucacuuau

SEQ ID NO: 399958 - RNA, 19 nt, Homo sapiens
gcggaccauuuagauuuaa

SEQ ID NO: 399959 - RNA, 19 nt, Homo sapiens
aaagaaguccucucugauc

SEQ ID NO: 399960 - RNA, 19 nt, Homo sapiens
gaguaaaugcagauguuga

SEQ ID NO: 399961 - RNA, 19 nt, Homo sapiens
uaaaugcagauguugagaa

SEQ ID NO: 399962 - RNA, 19 nt, Homo sapiens
ggaaguggagauuauacug

SEQ ID NO: 399963 - RNA, 19 nt, Homo sapiens
gcacuuaacgcuuuuggaa

SEQ ID NO: 399964 - RNA, 19 nt, Homo sapiens
ucgggaaugucuuaaacuu

SEQ ID NO: 399965 - RNA, 19 nt, Homo sapiens
uaagcacacuguacuacca

SEQ ID NO: 399966 - RNA, 19 nt, Homo sapiens
ggagaaccuaggaaagcua

SEQ ID NO: 399967 - RNA, 19 nt, Homo sapiens
agaaggagaaccuaggaaa

SEQ ID NO: 399968 - RNA, 19 nt, Homo sapiens
agcacagucucaacuuaua

SEQ ID NO: 399969 - RNA, 19 nt, Homo sapiens
ccacagaagcuggaacuca

SEQ ID NO: 399970 - RNA, 19 nt, Homo sapiens
uaaagaaguccucucugau

SEQ ID NO: 399971 - RNA, 19 nt, Homo sapiens
gcuagcugaugcuuuaucu

SEQ ID NO: 399972 - RNA, 19 nt, Homo sapiens
gaggauuugccacugcuuu

SEQ ID NO: 399973 - RNA, 19 nt, Homo sapiens
ucagugaaguucgggaaug

SEQ ID NO: 399974 - RNA, 19 nt, Homo sapiens
cgagcugaauguuuuauaa

SEQ ID NO: 399975 - RNA, 19 nt, Homo sapiens
gauccagaaaugagaaaga

SEQ ID NO: 399976 - RNA, 19 nt, Homo sapiens
agcagaggccuauuugaua

SEQ ID NO: 399977 - RNA, 19 nt, Homo sapiens
gguuuguucugaaguuuua

SEQ ID NO: 399978 - RNA, 19 nt, Homo sapiens
cuauuaggguuuguucuga

SEQ ID NO: 399979 - RNA, 19 nt, Homo sapiens
gcaguacgaaggugcugaa

SEQ ID NO: 399980 - RNA, 19 nt, Homo sapiens
ggugcugaauguggaguaa

SEQ ID NO: 399981 - RNA, 19 nt, Homo sapiens
uagagaaagcacaaagauu

SEQ ID NO: 399982 - RNA, 19 nt, Homo sapiens
gugaaugcccugaaagauc

SEQ ID NO: 399983 - RNA, 19 nt, Homo sapiens
ccaacuaggagaccacgaa

SEQ ID NO: 399984 - RNA, 19 nt, Homo sapiens
gcagaacuacgggaacuuc

SEQ ID NO: 399985 - RNA, 19 nt, Homo sapiens
uguuugggaugcagaacua

SEQ ID NO: 399986 - RNA, 19 nt, Homo sapiens
uagcugaugcuuuaucuca

SEQ ID NO: 399987 - RNA, 19 nt, Homo sapiens
aggcggaccauuuagauuu

SEQ ID NO: 399988 - RNA, 19 nt, Homo sapiens
ccagaaaugagaaagaagu

SEQ ID NO: 399989 - RNA, 19 nt, Homo sapiens
gcuauuaggguuuguucug

SEQ ID NO: 399990 - RNA, 19 nt, Homo sapiens
guucgggaaugucuuaaac

SEQ ID NO: 399991 - RNA, 19 nt, Homo sapiens
gaaacagucgcagaaacga

SEQ ID NO: 399992 - RNA, 19 nt, Homo sapiens
agauggaaccugacaaugu

SEQ ID NO: 399993 - RNA, 19 nt, Homo sapiens
agaagccuguugaagcuau

SEQ ID NO: 399994 - RNA, 19 nt, Homo sapiens
gggaguaucuguugcauua

SEQ ID NO: 399995 - RNA, 19 nt, Homo sapiens
gaaagcgucuuaaagcaua

SEQ ID NO: 399996 - RNA, 19 nt, Homo sapiens
guaaagaacugaaggaaau

SEQ ID NO: 399997 - RNA, 19 nt, Homo sapiens
caaccaaacuugauauuca

SEQ ID NO: 399998 - RNA, 19 nt, Homo sapiens
aaacaaggauuucagugua

SEQ ID NO: 399999 - RNA, 19 nt, Homo sapiens
ggacaguucuucgagauaa

SEQ ID NO: 400000 - RNA, 19 nt, Homo sapiens
gcaaaccucugaugucuuc

SEQ ID NO: 400001 - RNA, 19 nt, Homo sapiens
gagcagacuuagaagauaa

SEQ ID NO: 400002 - RNA, 19 nt, Homo sapiens
ggacaacucaaauucaaua

SEQ ID NO: 400003 - RNA, 19 nt, Homo sapiens
gcagugcagugucagauuu

SEQ ID NO: 400004 - RNA, 19 nt, Homo sapiens
caacagcaguuaacacguu

SEQ ID NO: 400005 - RNA, 19 nt, Homo sapiens
guagaccacuuaaucacua

SEQ ID NO: 400006 - RNA, 19 nt, Homo sapiens
ugaugaagguugagaauga

SEQ ID NO: 400007 - RNA, 19 nt, Homo sapiens
ccucaaagcucuuaaaugc

SEQ ID NO: 400008 - RNA, 19 nt, Homo sapiens
gaaaguuguugcuucuaga

SEQ ID NO: 400009 - RNA, 19 nt, Homo sapiens
gaacaacccacauaguaga

SEQ ID NO: 400010 - RNA, 19 nt, Homo sapiens
gaucuuaccagucauuuga

SEQ ID NO: 400011 - RNA, 19 nt, Homo sapiens
caacguaauuucuguucuu

SEQ ID NO: 400012 - RNA, 19 nt, Homo sapiens
gaacuugacaacguaauuu

SEQ ID NO: 400013 - RNA, 19 nt, Homo sapiens
gaagagcaccuaccugugu

SEQ ID NO: 400014 - RNA, 19 nt, Homo sapiens
ggacuccauugaauacauu

SEQ ID NO: 400015 - RNA, 19 nt, Homo sapiens
agucagagcuuccuacaga

SEQ ID NO: 400016 - RNA, 19 nt, Homo sapiens
ggacacauauauuaaacuc

SEQ ID NO: 400017 - RNA, 19 nt, Homo sapiens
gauaaauucuggugaagag

SEQ ID NO: 400018 - RNA, 19 nt, Homo sapiens
ggacaguuacaagaaauua

SEQ ID NO: 400019 - RNA, 19 nt, Homo sapiens
ccuaagagaggaauuuaua

SEQ ID NO: 400020 - RNA, 19 nt, Homo sapiens
aaacauaccucuggaugga

SEQ ID NO: 400021 - RNA, 19 nt, Homo sapiens
gaagagaacguugaaagug

SEQ ID NO: 400022 - RNA, 19 nt, Homo sapiens
caaaauaaguguugugguu

SEQ ID NO: 400023 - RNA, 19 nt, Homo sapiens
gagaaugagcgguaugaaa

SEQ ID NO: 400024 - RNA, 19 nt, Homo sapiens
ggaaaagccugcuguuguu

SEQ ID NO: 400025 - RNA, 19 nt, Homo sapiens
acaauugaccuuugacuaa

SEQ ID NO: 400026 - RNA, 19 nt, Homo sapiens
ugccucaucuugauuuaua

SEQ ID NO: 400027 - RNA, 19 nt, Homo sapiens
guagugaagcccacaauug

SEQ ID NO: 400028 - RNA, 19 nt, Homo sapiens
gaaaauaccuaagagacuu

SEQ ID NO: 400029 - RNA, 19 nt, Homo sapiens
gagcuucauuguuggagaa

SEQ ID NO: 400030 - RNA, 19 nt, Homo sapiens
caacucaaauucaauacgu

SEQ ID NO: 400031 - RNA, 19 nt, Homo sapiens
gcagagcucaccaggguaa

SEQ ID NO: 400032 - RNA, 19 nt, Homo sapiens
uaaaacaccugaucagcua

SEQ ID NO: 400033 - RNA, 19 nt, Homo sapiens
caccugaucagcuaaauaa

SEQ ID NO: 400034 - RNA, 19 nt, Homo sapiens
uggcuuugcuuaacauaaa

SEQ ID NO: 400035 - RNA, 19 nt, Homo sapiens
ggaauuguuucaguuaagu

SEQ ID NO: 400036 - RNA, 19 nt, Homo sapiens
gggcaaaccucugaugucu

SEQ ID NO: 400037 - RNA, 19 nt, Homo sapiens
gaacaauugaggaaguuug

SEQ ID NO: 400038 - RNA, 19 nt, Homo sapiens
uacaagagccuuugggaaa

SEQ ID NO: 400039 - RNA, 19 nt, Homo sapiens
gaaagcgguuugagacaac

SEQ ID NO: 400040 - RNA, 19 nt, Homo sapiens
uaaaagaacugagugaaga

SEQ ID NO: 400041 - RNA, 19 nt, Homo sapiens
cagaggccauggauacuga

SEQ ID NO: 400042 - RNA, 19 nt, Homo sapiens
ucucguugcuguuuacauu

SEQ ID NO: 400043 - RNA, 19 nt, Homo sapiens
caauugaccuuugacuaau

SEQ ID NO: 400044 - RNA, 19 nt, Homo sapiens
uaacuuggcuuugcuuaac

SEQ ID NO: 400045 - RNA, 19 nt, Homo sapiens
ugaggaagccacaaauuug

SEQ ID NO: 400046 - RNA, 19 nt, Homo sapiens
gggauuaaauauggaguau

SEQ ID NO: 400047 - RNA, 19 nt, Homo sapiens
uaggagagcagacuuagaa

SEQ ID NO: 400048 - RNA, 19 nt, Homo sapiens
gaacugagugaagaugaaa

SEQ ID NO: 400049 - RNA, 19 nt, Homo sapiens
caacugauuugucuguuuu

SEQ ID NO: 400050 - RNA, 19 nt, Homo sapiens
gagcuguauucgagaagaa

SEQ ID NO: 400051 - RNA, 19 nt, Homo sapiens
gacaugaggcugaugaaau

SEQ ID NO: 400052 - RNA, 19 nt, Homo sapiens
gagagcagacuuagaagau

SEQ ID NO: 400053 - RNA, 19 nt, Homo sapiens
ccacauaguagacacagaa

SEQ ID NO: 400054 - RNA, 19 nt, Homo sapiens
uauuugaucuuaccaguca

SEQ ID NO: 400055 - RNA, 19 nt, Homo sapiens
gauaaugcaauaccaacaa

SEQ ID NO: 400056 - RNA, 19 nt, Homo sapiens
acacuucuguuucaugguu

SEQ ID NO: 400057 - RNA, 19 nt, Homo sapiens
gcccacaauugaccuuuga

SEQ ID NO: 400058 - RNA, 19 nt, Homo sapiens
gcacauuauucaggaacuu

SEQ ID NO: 400059 - RNA, 19 nt, Homo sapiens
gguaaagaacugaaggaaa

SEQ ID NO: 400060 - RNA, 19 nt, Homo sapiens
ccaugacucuuauauacug

SEQ ID NO: 400061 - RNA, 19 nt, Homo sapiens
cauggauacugacaacuga

SEQ ID NO: 400062 - RNA, 19 nt, Homo sapiens
caaacaaggauuucagugu

SEQ ID NO: 400063 - RNA, 19 nt, Homo sapiens
cuauaggacuccauugaau

SEQ ID NO: 400064 - RNA, 19 nt, Homo sapiens
gccguaagguguauguaga

SEQ ID NO: 400065 - RNA, 19 nt, Homo sapiens
gcucuuaaaugcuuaucuc

SEQ ID NO: 400066 - RNA, 19 nt, Homo sapiens
uaacuuggaaucucagcua

SEQ ID NO: 400067 - RNA, 19 nt, Homo sapiens
ugaaggaaaucugccauuc

SEQ ID NO: 400068 - RNA, 19 nt, Homo sapiens
caagcuaucuacacacucu

SEQ ID NO: 400069 - RNA, 19 nt, Homo sapiens
ugaaaguuguugcuucuag

SEQ ID NO: 400070 - RNA, 19 nt, Homo sapiens
cauugucucuaguggauuu

SEQ ID NO: 400071 - RNA, 19 nt, Homo sapiens
gaaaccaacaauagcaaug

SEQ ID NO: 400072 - RNA, 19 nt, Homo sapiens
ccacaucucguugcuguuu

SEQ ID NO: 400073 - RNA, 19 nt, Homo sapiens
uauaggacuccauugaaua

SEQ ID NO: 400074 - RNA, 19 nt, Homo sapiens
guauguagaccacuuaauc

SEQ ID NO: 400075 - RNA, 19 nt, Homo sapiens
ggugagguuuguugaugaa

SEQ ID NO: 400076 - RNA, 19 nt, Homo sapiens
acaugaggcugaugaaauc

SEQ ID NO: 400077 - RNA, 19 nt, Homo sapiens
cguugaaagugccauguuu

SEQ ID NO: 400078 - RNA, 19 nt, Homo sapiens
ugaauacauuagccauuga

SEQ ID NO: 400079 - RNA, 19 nt, Homo sapiens
aaacacgaccuggauuuaa

SEQ ID NO: 400080 - RNA, 19 nt, Homo sapiens
gcugacauguauagaagug

SEQ ID NO: 400081 - RNA, 19 nt, Homo sapiens
caacaguggagcacauuau

SEQ ID NO: 400082 - RNA, 19 nt, Homo sapiens
gaaacucucagggaaguga

SEQ ID NO: 400083 - RNA, 19 nt, Homo sapiens
agagcagacuuagaagaua

SEQ ID NO: 400084 - RNA, 19 nt, Homo sapiens
ggacaugaggcugaugaaa

SEQ ID NO: 400085 - RNA, 19 nt, Homo sapiens
ggauuucaguguagauuuu

SEQ ID NO: 400086 - RNA, 19 nt, Homo sapiens
gaggaaggaauacauuuua

SEQ ID NO: 400087 - RNA, 19 nt, Homo sapiens
agaaucaaauggaaacaca

SEQ ID NO: 400088 - RNA, 19 nt, Homo sapiens
guuguugcuucuagacuuu

SEQ ID NO: 400089 - RNA, 19 nt, Homo sapiens
ggagagcagacuuagaaga

SEQ ID NO: 400090 - RNA, 19 nt, Homo sapiens
cugaucagcuaaauaaaca

SEQ ID NO: 400091 - RNA, 19 nt, Homo sapiens
gguggacacauauauuaaa

SEQ ID NO: 400092 - RNA, 19 nt, Homo sapiens
gagcuuccguccaccaucu

SEQ ID NO: 400093 - RNA, 19 nt, Homo sapiens
uagcuugacugcaguacug

SEQ ID NO: 400094 - RNA, 19 nt, Homo sapiens
gaagauggauugaagagaa

SEQ ID NO: 400095 - RNA, 19 nt, Homo sapiens
gaacagucccuuccuaaua

SEQ ID NO: 400096 - RNA, 19 nt, Homo sapiens
gaaguucuguugaggcuua

SEQ ID NO: 400097 - RNA, 19 nt, Homo sapiens
gaaauaaagucacaaccaa

SEQ ID NO: 400098 - RNA, 19 nt, Homo sapiens
gaagagaacguccaccuua

SEQ ID NO: 400099 - RNA, 19 nt, Homo sapiens
ugaaaugccuuaauuguga

SEQ ID NO: 400100 - RNA, 19 nt, Homo sapiens
ggacacgucuguucuguau

SEQ ID NO: 400101 - RNA, 19 nt, Homo sapiens
ugucguagcugaauucuuu

SEQ ID NO: 400102 - RNA, 19 nt, Homo sapiens
caagcaggccuucuaauua

SEQ ID NO: 400103 - RNA, 19 nt, Homo sapiens
gaacaggugucuuaaugca

SEQ ID NO: 400104 - RNA, 19 nt, Homo sapiens
gcacauuggugaccuuguu

SEQ ID NO: 400105 - RNA, 19 nt, Homo sapiens
gcauuuggauaguuucuuu

SEQ ID NO: 400106 - RNA, 19 nt, Homo sapiens
ggaagaaacaggaagauug

SEQ ID NO: 400107 - RNA, 19 nt, Homo sapiens
gaacaaggcgauuaggaaa

SEQ ID NO: 400108 - RNA, 19 nt, Homo sapiens
gcaagcaggccuucuaauu

SEQ ID NO: 400109 - RNA, 19 nt, Homo sapiens
aaacuuacccugagaauga

SEQ ID NO: 400110 - RNA, 19 nt, Homo sapiens
ggauagggauggccacauu

SEQ ID NO: 400111 - RNA, 19 nt, Homo sapiens
gaugagacuugaagccuuu

SEQ ID NO: 400112 - RNA, 19 nt, Homo sapiens
gcagaacagucccuuccua

SEQ ID NO: 400113 - RNA, 19 nt, Homo sapiens
gaacugauaugcaggaaaa

SEQ ID NO: 400114 - RNA, 19 nt, Homo sapiens
gaacaaagaacugcaccua

SEQ ID NO: 400115 - RNA, 19 nt, Homo sapiens
gcucugagauggcuguuga

SEQ ID NO: 400116 - RNA, 19 nt, Homo sapiens
gacaacaucugaaggguau

SEQ ID NO: 400117 - RNA, 19 nt, Homo sapiens
ggaaggaaauaaagucaca

SEQ ID NO: 400118 - RNA, 19 nt, Homo sapiens
gagaauaggacauggauau

SEQ ID NO: 400119 - RNA, 19 nt, Homo sapiens
ccaccggccugcuuucaua

SEQ ID NO: 400120 - RNA, 19 nt, Homo sapiens
ggugaaauguggaaauguu

SEQ ID NO: 400121 - RNA, 19 nt, Homo sapiens
gaacuggcauuauuuaagc

SEQ ID NO: 400122 - RNA, 19 nt, Homo sapiens
ggagucguaugcacuguuu

SEQ ID NO: 400123 - RNA, 19 nt, Homo sapiens
gaaauugugcagugaugua

SEQ ID NO: 400124 - RNA, 19 nt, Homo sapiens
ccaaagagaucgucuacag

SEQ ID NO: 400125 - RNA, 19 nt, Homo sapiens
ccaagaaucuacaaugaca

SEQ ID NO: 400126 - RNA, 19 nt, Homo sapiens
guagcugaauucuuucuuu

SEQ ID NO: 400127 - RNA, 19 nt, Homo sapiens
ggcaauggcuuugugcuuu

SEQ ID NO: 400128 - RNA, 19 nt, Homo sapiens
gcaguggcuuguuccuaua

SEQ ID NO: 400129 - RNA, 19 nt, Homo sapiens
guacauaugcccuaggaaa

SEQ ID NO: 400130 - RNA, 19 nt, Homo sapiens
ugugaacuauggcuuaaua

SEQ ID NO: 400131 - RNA, 19 nt, Homo sapiens
ucacacacauuucagcauu

SEQ ID NO: 400132 - RNA, 19 nt, Homo sapiens
gaaaugccuuaauugugaa

SEQ ID NO: 400133 - RNA, 19 nt, Homo sapiens
ggccaucgcugccuaaaca

SEQ ID NO: 400134 - RNA, 19 nt, Homo sapiens
ucauggaacuggcauuauu

SEQ ID NO: 400135 - RNA, 19 nt, Homo sapiens
guaccuguguguauagaaa

SEQ ID NO: 400136 - RNA, 19 nt, Homo sapiens
gaaauaugcaagcacauug

SEQ ID NO: 400137 - RNA, 19 nt, Homo sapiens
gggaugcucugucaugguu

SEQ ID NO: 400138 - RNA, 19 nt, Homo sapiens
cauguuugcugacuauaaa

SEQ ID NO: 400139 - RNA, 19 nt, Homo sapiens
gcagugauguaaauguuca

SEQ ID NO: 400140 - RNA, 19 nt, Homo sapiens
auaaggacaucuccacuuu

SEQ ID NO: 400141 - RNA, 19 nt, Homo sapiens
gagaugagaggaucacuug

SEQ ID NO: 400142 - RNA, 19 nt, Homo sapiens
gaaauguccgcauggauga

SEQ ID NO: 400143 - RNA, 19 nt, Homo sapiens
gagcaaucacuguauaauu

SEQ ID NO: 400144 - RNA, 19 nt, Homo sapiens
acaaagaacugcaccuaag

SEQ ID NO: 400145 - RNA, 19 nt, Homo sapiens
gaagauaugggagcgaauu

SEQ ID NO: 400146 - RNA, 19 nt, Homo sapiens
gaacuauggcuuaauacug

SEQ ID NO: 400147 - RNA, 19 nt, Homo sapiens
gauaaagccaggaaggaaa

SEQ ID NO: 400148 - RNA, 19 nt, Homo sapiens
uuggugaccuuguucuuua

SEQ ID NO: 400149 - RNA, 19 nt, Homo sapiens
gaagacagccaagcauuuc

SEQ ID NO: 400150 - RNA, 19 nt, Homo sapiens
caacagaagucuaaauccu

SEQ ID NO: 400151 - RNA, 19 nt, Homo sapiens
gcaccgacauguggagcua

SEQ ID NO: 400152 - RNA, 19 nt, Homo sapiens
gaagaaacaggaagauugg

SEQ ID NO: 400153 - RNA, 19 nt, Homo sapiens
gcucacaucuggaagaaac

SEQ ID NO: 400154 - RNA, 19 nt, Homo sapiens
gagcucacaucuggaagaa

SEQ ID NO: 400155 - RNA, 19 nt, Homo sapiens
ggaaauaaagucacaacca

SEQ ID NO: 400156 - RNA, 19 nt, Homo sapiens
ccgcauggaugaucacgaa

SEQ ID NO: 400157 - RNA, 19 nt, Homo sapiens
ccuaggaguucgagacuga

SEQ ID NO: 400158 - RNA, 19 nt, Homo sapiens
aagagaacguccaccuuaa

SEQ ID NO: 400159 - RNA, 19 nt, Homo sapiens
gagcaacacguacacaaug

SEQ ID NO: 400160 - RNA, 19 nt, Homo sapiens
ugacagaacaaggcgauua

SEQ ID NO: 400161 - RNA, 19 nt, Homo sapiens
acaggugucuuaaugcauu

SEQ ID NO: 400162 - RNA, 19 nt, Homo sapiens
gaaagccugaaaugccuua

SEQ ID NO: 400163 - RNA, 19 nt, Homo sapiens
ggaaaaugauguucagaug

SEQ ID NO: 400164 - RNA, 19 nt, Homo sapiens
gugcagugauguaaauguu

SEQ ID NO: 400165 - RNA, 19 nt, Homo sapiens
gaaucugccuggaacaaag

SEQ ID NO: 400166 - RNA, 19 nt, Homo sapiens
gagaagacagccaagcauu

SEQ ID NO: 400167 - RNA, 19 nt, Homo sapiens
caacugucguagcugaauu

SEQ ID NO: 400168 - RNA, 19 nt, Homo sapiens
acgaacaggugucuuaaug

SEQ ID NO: 400169 - RNA, 19 nt, Homo sapiens
aagcaggccuucuaauuag

SEQ ID NO: 400170 - RNA, 19 nt, Homo sapiens
caaauaguauacacugucu

SEQ ID NO: 400171 - RNA, 19 nt, Homo sapiens
ggaauguccguauggauga

SEQ ID NO: 400172 - RNA, 19 nt, Homo sapiens
caugguggcacgugaguua

SEQ ID NO: 400173 - RNA, 19 nt, Homo sapiens
gauaugggagcgaauuuau

SEQ ID NO: 400174 - RNA, 19 nt, Homo sapiens
acauuaagcucacggacuu

SEQ ID NO: 400175 - RNA, 19 nt, Homo sapiens
ugagaagucuguccugaag

SEQ ID NO: 400176 - RNA, 19 nt, Homo sapiens
uauggcagaugcacagaaa

SEQ ID NO: 400177 - RNA, 19 nt, Homo sapiens
agaaacugcucgugguuga

SEQ ID NO: 400178 - RNA, 19 nt, Homo sapiens
uagcugaauucuuucuuug

SEQ ID NO: 400179 - RNA, 19 nt, Homo sapiens
acacgucuguucuguaugu

SEQ ID NO: 400180 - RNA, 19 nt, Homo sapiens
gauagggauggccacauua

SEQ ID NO: 400181 - RNA, 19 nt, Homo sapiens
gcagggaugcucugucaug

SEQ ID NO: 400182 - RNA, 19 nt, Homo sapiens
gcacuggcuuggguuguau

SEQ ID NO: 400183 - RNA, 19 nt, Homo sapiens
ggaacuggcauuauuuaag

SEQ ID NO: 400184 - RNA, 19 nt, Homo sapiens
cuuccaacuucgaaacuua

SEQ ID NO: 400185 - RNA, 19 nt, Homo sapiens
gacaacccguuuggcauuu

SEQ ID NO: 400186 - RNA, 19 nt, Homo sapiens
cauuguaacugugaacuau

SEQ ID NO: 400187 - RNA, 19 nt, Homo sapiens
ggaugaucaugacaaacaa

SEQ ID NO: 400188 - RNA, 19 nt, Homo sapiens
ccaaugucauguagagguu

SEQ ID NO: 400189 - RNA, 19 nt, Homo sapiens
caguaggugagaauaauua

SEQ ID NO: 400190 - RNA, 19 nt, Homo sapiens
gcgaugggcaaauuauauu

SEQ ID NO: 400191 - RNA, 19 nt, Homo sapiens
auaaauccaugaguccaua

SEQ ID NO: 400192 - RNA, 19 nt, Homo sapiens
aaucaucucacaugcauuu

SEQ ID NO: 400193 - RNA, 19 nt, Homo sapiens
gaaacaggaagauuggaau

SEQ ID NO: 400194 - RNA, 19 nt, Homo sapiens
ggaaauggcuaccuauuaa

SEQ ID NO: 400195 - RNA, 19 nt, Homo sapiens
gaacuggacuuauuugauu

SEQ ID NO: 400196 - RNA, 19 nt, Homo sapiens
ggacaugucuguucuguau

SEQ ID NO: 400197 - RNA, 19 nt, Homo sapiens
guacaguccuuccuaauaa

SEQ ID NO: 400198 - RNA, 19 nt, Homo sapiens
gaagagaacguccacuuua

SEQ ID NO: 400199 - RNA, 19 nt, Homo sapiens
gaaguucuguugaggcuua

SEQ ID NO: 400200 - RNA, 19 nt, Homo sapiens
gcucaaaucugcuguguau

SEQ ID NO: 400201 - RNA, 19 nt, Homo sapiens
ugaaaugccuuaauuguga

SEQ ID NO: 400202 - RNA, 19 nt, Homo sapiens
aaacaucucuugcuaaaug

SEQ ID NO: 400203 - RNA, 19 nt, Homo sapiens
gcacacauaucacacauca

SEQ ID NO: 400204 - RNA, 19 nt, Homo sapiens
ggaaacaccucaucucuac

SEQ ID NO: 400205 - RNA, 19 nt, Homo sapiens
ugucacagcugaauucuuu

SEQ ID NO: 400206 - RNA, 19 nt, Homo sapiens
gggaugcucugucauguuu

SEQ ID NO: 400207 - RNA, 19 nt, Homo sapiens
ugaaacaucucuugcuaaa

SEQ ID NO: 400208 - RNA, 19 nt, Homo sapiens
gagcaugccuguagucuca

SEQ ID NO: 400209 - RNA, 19 nt, Homo sapiens
gcucacaccuguaauccua

SEQ ID NO: 400210 - RNA, 19 nt, Homo sapiens
gaacaggugucuuaaugca

SEQ ID NO: 400211 - RNA, 19 nt, Homo sapiens
gcacauuggugaccuuguu

SEQ ID NO: 400212 - RNA, 19 nt, Homo sapiens
ggaagaaacaggaagauug

SEQ ID NO: 400213 - RNA, 19 nt, Homo sapiens
caagggaaauguaaucaga

SEQ ID NO: 400214 - RNA, 19 nt, Homo sapiens
gggaaauggcuaccuauua

SEQ ID NO: 400215 - RNA, 19 nt, Homo sapiens
gugcagugauguaaauaua

SEQ ID NO: 400216 - RNA, 19 nt, Homo sapiens
gcaguacaguccuuccuaa

SEQ ID NO: 400217 - RNA, 19 nt, Homo sapiens
gcaagacccuguauuaaaa

SEQ ID NO: 400218 - RNA, 19 nt, Homo sapiens
gaacaaagaacugcaccua

SEQ ID NO: 400219 - RNA, 19 nt, Homo sapiens
gcucugagauggcuguuga

SEQ ID NO: 400220 - RNA, 19 nt, Homo sapiens
gacaacaucugaaggguau

SEQ ID NO: 400221 - RNA, 19 nt, Homo sapiens
caaauuaucuucccuucuc

SEQ ID NO: 400222 - RNA, 19 nt, Homo sapiens
ggaaggaaauaaagucaca

SEQ ID NO: 400223 - RNA, 19 nt, Homo sapiens
ccaccggccugcuuucaua

SEQ ID NO: 400224 - RNA, 19 nt, Homo sapiens
ggugaaauguggaaauguu

SEQ ID NO: 400225 - RNA, 19 nt, Homo sapiens
ccuaguaacuuggacuuua

SEQ ID NO: 400226 - RNA, 19 nt, Homo sapiens
gaacuggcauuauuuaagc

SEQ ID NO: 400227 - RNA, 19 nt, Homo sapiens
aaacuuggcuguagacauc

SEQ ID NO: 400228 - RNA, 19 nt, Homo sapiens
acacagaccuccaagacuu

SEQ ID NO: 400229 - RNA, 19 nt, Homo sapiens
gaacgccuucuaauuagua

SEQ ID NO: 400230 - RNA, 19 nt, Homo sapiens
aaacuuacccugagcauga

SEQ ID NO: 400231 - RNA, 19 nt, Homo sapiens
guacauaugcccuaggaaa

SEQ ID NO: 400232 - RNA, 19 nt, Homo sapiens
ucacacacauuucagcauu

SEQ ID NO: 400233 - RNA, 19 nt, Homo sapiens
gaaaugccuuaauugugaa

SEQ ID NO: 400234 - RNA, 19 nt, Homo sapiens
ggccaucgcugccuaaaca

SEQ ID NO: 400235 - RNA, 19 nt, Homo sapiens
gagcaagacccuguauuaa

SEQ ID NO: 400236 - RNA, 19 nt, Homo sapiens
ucauggaacuggcauuauu

SEQ ID NO: 400237 - RNA, 19 nt, Homo sapiens
guaccuguguguauagaaa

SEQ ID NO: 400238 - RNA, 19 nt, Homo sapiens
aagagaacguccacuuuaa

SEQ ID NO: 400239 - RNA, 19 nt, Homo sapiens
cauguuugcugacuauaaa

SEQ ID NO: 400240 - RNA, 19 nt, Homo sapiens
gaaaaugugugcagugaga

SEQ ID NO: 400241 - RNA, 19 nt, Homo sapiens
uaaagucccaguugaaauu

SEQ ID NO: 400242 - RNA, 19 nt, Homo sapiens
gagaugagaggaucacuug

SEQ ID NO: 400243 - RNA, 19 nt, Homo sapiens
ugacucaccucaaauaugg

SEQ ID NO: 400244 - RNA, 19 nt, Homo sapiens
cauccuggcuggaaacuug

SEQ ID NO: 400245 - RNA, 19 nt, Homo sapiens
cuaguaacuuggacuuuaa

SEQ ID NO: 400246 - RNA, 19 nt, Homo sapiens
gaaacccuugucucuauua

SEQ ID NO: 400247 - RNA, 19 nt, Homo sapiens
ucacagagccuauuauuuu

SEQ ID NO: 400248 - RNA, 19 nt, Homo sapiens
ucaaaucugcuguguauga

SEQ ID NO: 400249 - RNA, 19 nt, Homo sapiens
ccucaccuguuccuaauuu

SEQ ID NO: 400250 - RNA, 19 nt, Homo sapiens
agagcaagacccuguauua

SEQ ID NO: 400251 - RNA, 19 nt, Homo sapiens
caucucauaugcauuguau

SEQ ID NO: 400252 - RNA, 19 nt, Homo sapiens
uauggcagaugcacaaauu

SEQ ID NO: 400253 - RNA, 19 nt, Homo sapiens
acaaagaacugcaccuaag

SEQ ID NO: 400254 - RNA, 19 nt, Homo sapiens
ggacaauuguaacugugaa

SEQ ID NO: 400255 - RNA, 19 nt, Homo sapiens
ucaguacuguggagaguuu

SEQ ID NO: 400256 - RNA, 19 nt, Homo sapiens
gaaauggcuaccuauuaaa

SEQ ID NO: 400257 - RNA, 19 nt, Homo sapiens
cacaugaacaggugucuua

SEQ ID NO: 400258 - RNA, 19 nt, Homo sapiens
gauaaagccaggaaggaaa

SEQ ID NO: 400259 - RNA, 19 nt, Homo sapiens
uuggugaccuuguucuuua

SEQ ID NO: 400260 - RNA, 19 nt, Homo sapiens
gcaccgacguggagcuaga

SEQ ID NO: 400261 - RNA, 19 nt, Homo sapiens
cgaggaagauccgcagauu

SEQ ID NO: 400262 - RNA, 19 nt, Homo sapiens
caacagaagucuaaauccu

SEQ ID NO: 400263 - RNA, 19 nt, Homo sapiens
gaaacaaucacugugcaaa

SEQ ID NO: 400264 - RNA, 19 nt, Homo sapiens
gcaggaaaaugaaauaugu

SEQ ID NO: 400265 - RNA, 19 nt, Homo sapiens
ugagugcauugaagaagua

SEQ ID NO: 400266 - RNA, 19 nt, Homo sapiens
ggaccauccuggcuggaaa

SEQ ID NO: 400267 - RNA, 19 nt, Homo sapiens
ucccacaguucacaaauaa

SEQ ID NO: 400268 - RNA, 19 nt, Homo sapiens
aaauacaccucccacaguu

SEQ ID NO: 400269 - RNA, 19 nt, Homo sapiens
gcaguggcuuguuccugua

SEQ ID NO: 400270 - RNA, 19 nt, Homo sapiens
agagaaacauggagaagau

SEQ ID NO: 400271 - RNA, 19 nt, Homo sapiens
gaagacagccaagcauuuc

SEQ ID NO: 400272 - RNA, 19 nt, Homo sapiens
gaagaaacaggaagauugg

SEQ ID NO: 400273 - RNA, 19 nt, Homo sapiens
gcucacaucuggaagaaac

SEQ ID NO: 400274 - RNA, 19 nt, Homo sapiens
ccaaggagaucgucuacag

SEQ ID NO: 400275 - RNA, 19 nt, Homo sapiens
gugaaacuauggcuuaaca

SEQ ID NO: 400276 - RNA, 19 nt, Homo sapiens
gagcucacaucuggaagaa

SEQ ID NO: 400277 - RNA, 19 nt, Homo sapiens
uaaaugucccaaugucaua

SEQ ID NO: 400278 - RNA, 19 nt, Homo sapiens
agaguucgccuacagauaa

SEQ ID NO: 400279 - RNA, 19 nt, Homo sapiens
cuaauacucuccucgacaa

SEQ ID NO: 400280 - RNA, 19 nt, Homo sapiens
cugaggacauuuccaguuu

SEQ ID NO: 400281 - RNA, 19 nt, Homo sapiens
acaggugucuuaaugcauu

SEQ ID NO: 400282 - RNA, 19 nt, Homo sapiens
gagaucgucuacagggauu

SEQ ID NO: 400283 - RNA, 19 nt, Homo sapiens
gggauacaguaagagaaua

SEQ ID NO: 400284 - RNA, 19 nt, Homo sapiens
gaggaaaauucuuacgaua

SEQ ID NO: 400285 - RNA, 19 nt, Homo sapiens
gaaagccugaaaugccuua

SEQ ID NO: 400286 - RNA, 19 nt, Homo sapiens
ggaaaaugauguucagaug

SEQ ID NO: 400287 - RNA, 19 nt, Homo sapiens
gagaagacagccaagcauu

SEQ ID NO: 400288 - RNA, 19 nt, Homo sapiens
gaucaucugugccauugag

SEQ ID NO: 400289 - RNA, 19 nt, Homo sapiens
gaaucugccuggaacaaag

SEQ ID NO: 400290 - RNA, 19 nt, Homo sapiens
ggaaaagcaugaagucuca

SEQ ID NO: 400291 - RNA, 19 nt, Homo sapiens
cuccuaaucucuucucaaa

SEQ ID NO: 400292 - RNA, 19 nt, Homo sapiens
ucugaaacaucucuugcua

SEQ ID NO: 400293 - RNA, 19 nt, Homo sapiens
gaugaucuauaggauguga

SEQ ID NO: 400294 - RNA, 19 nt, Homo sapiens
uaacaggucuccucuuaaa

SEQ ID NO: 400295 - RNA, 19 nt, Homo sapiens
ggaaugagccucuguauca

SEQ ID NO: 400296 - RNA, 19 nt, Homo sapiens
uguaacaggucuccucuua

SEQ ID NO: 400297 - RNA, 19 nt, Homo sapiens
ggaaguacgugguaugcaa

SEQ ID NO: 400298 - RNA, 19 nt, Homo sapiens
ccacauccauuucaucuau

SEQ ID NO: 400299 - RNA, 19 nt, Homo sapiens
cauaaccucuccucagaaa

SEQ ID NO: 400300 - RNA, 19 nt, Homo sapiens
ccaaagcuguagagauuga

SEQ ID NO: 400301 - RNA, 19 nt, Homo sapiens
caaaggaucgccauggaaa

SEQ ID NO: 400302 - RNA, 19 nt, Homo sapiens
ggagcaagcccaacagaug

SEQ ID NO: 400303 - RNA, 19 nt, Homo sapiens
cgaauucgauaaacgguau

SEQ ID NO: 400304 - RNA, 19 nt, Homo sapiens
gcuaagcccacauccauuu

SEQ ID NO: 400305 - RNA, 19 nt, Homo sapiens
gagcaagcccaacagauga

SEQ ID NO: 400306 - RNA, 19 nt, Homo sapiens
ucagaaauguucagcgaau

SEQ ID NO: 400307 - RNA, 19 nt, Homo sapiens
auccaaagcuguagagauu

SEQ ID NO: 400308 - RNA, 19 nt, Homo sapiens
acgcagggauucacauaaa

SEQ ID NO: 400309 - RNA, 19 nt, Homo sapiens
uaaccucuccucagaaaug

SEQ ID NO: 400310 - RNA, 19 nt, Homo sapiens
ccacaacaacaacugcuaa

SEQ ID NO: 400311 - RNA, 19 nt, Homo sapiens
guucagcgaauucgauaaa

SEQ ID NO: 400312 - RNA, 19 nt, Homo sapiens
uccauaaccucuccucaga

SEQ ID NO: 400313 - RNA, 19 nt, Homo sapiens
guaacaggucuccucuuaa

SEQ ID NO: 400314 - RNA, 19 nt, Homo sapiens
cagaaauguucagcgaauu

SEQ ID NO: 400315 - RNA, 19 nt, Homo sapiens
aaugagaucuacccugucu

SEQ ID NO: 400316 - RNA, 19 nt, Homo sapiens
gaggcuauccuauccaaag

SEQ ID NO: 400317 - RNA, 19 nt, Homo sapiens
aauccaugcuuggguguaa

SEQ ID NO: 400318 - RNA, 19 nt, Homo sapiens
cuacgcagggauucacaua

SEQ ID NO: 400319 - RNA, 19 nt, Homo sapiens
cgaaucauccacaacaaca

SEQ ID NO: 400320 - RNA, 19 nt, Homo sapiens
gcauauugcgauccuggaa

SEQ ID NO: 400321 - RNA, 19 nt, Homo sapiens
uuucugagccugauaguca

SEQ ID NO: 400322 - RNA, 19 nt, Homo sapiens
gcccaacagaugaaucaaa

SEQ ID NO: 400323 - RNA, 19 nt, Homo sapiens
aaucgacaauuaucucaag

SEQ ID NO: 400324 - RNA, 19 nt, Homo sapiens
aaaccaaacggcuucuaga

SEQ ID NO: 400325 - RNA, 19 nt, Homo sapiens
caaaccaaacggcuucuag

SEQ ID NO: 400326 - RNA, 19 nt, Homo sapiens
gccgaaucauccacaacaa

SEQ ID NO: 400327 - RNA, 19 nt, Homo sapiens
uauccuauccaaagcugua

SEQ ID NO: 400328 - RNA, 19 nt, Homo sapiens
caacagcugccacacuucu

SEQ ID NO: 400329 - RNA, 19 nt, Homo sapiens
gcaaaccaaacggcuucua

SEQ ID NO: 400330 - RNA, 19 nt, Homo sapiens
ucaaaggaucgccauggaa

SEQ ID NO: 400331 - RNA, 19 nt, Homo sapiens
aaaacugacucguuagaga

SEQ ID NO: 400332 - RNA, 19 nt, Homo sapiens
cuccugaagugccgaauca

SEQ ID NO: 400333 - RNA, 19 nt, Homo sapiens
caaagaaaaugagaucuac

SEQ ID NO: 400334 - RNA, 19 nt, Homo sapiens
gauugaggagcaaaccaaa

SEQ ID NO: 400335 - RNA, 19 nt, Homo sapiens
cggaggcuauccuauccaa

SEQ ID NO: 400336 - RNA, 19 nt, Homo sapiens
gaaucauccacaacaacaa

SEQ ID NO: 400337 - RNA, 19 nt, Homo sapiens
ucgccuuucugcuuauuau

SEQ ID NO: 400338 - RNA, 19 nt, Homo sapiens
ccaaagaaaaugagaucua

SEQ ID NO: 400339 - RNA, 19 nt, Homo sapiens
cccaacagaugaaucaaaa

SEQ ID NO: 400340 - RNA, 19 nt, Homo sapiens
ccauuucaucuauuucuga

SEQ ID NO: 400341 - RNA, 19 nt, Homo sapiens
gcaagcuucuuuuaguugu

SEQ ID NO: 400342 - RNA, 19 nt, Homo sapiens
caacugcuaagcccacauc

SEQ ID NO: 400343 - RNA, 19 nt, Homo sapiens
auauugcgauccuggaaug

SEQ ID NO: 400344 - RNA, 19 nt, Homo sapiens
cacauccauuucaucuauu

SEQ ID NO: 400345 - RNA, 19 nt, Homo sapiens
agaaauguucagcgaauuc

SEQ ID NO: 400346 - RNA, 19 nt, Homo sapiens
aucaacagcugccacacuu

SEQ ID NO: 400347 - RNA, 19 nt, Homo sapiens
acaaggagcaagcccaaca

SEQ ID NO: 400348 - RNA, 19 nt, Homo sapiens
gaauucgauaaacgguaua

SEQ ID NO: 400349 - RNA, 19 nt, Homo sapiens
gaauccaugcuugggugua

SEQ ID NO: 400350 - RNA, 19 nt, Homo sapiens
guacgugguaugcaagaag

SEQ ID NO: 400351 - RNA, 19 nt, Homo sapiens
gcccacauccauuucaucu

SEQ ID NO: 400352 - RNA, 19 nt, Homo sapiens
cccugcagauggcugauga

SEQ ID NO: 400353 - RNA, 19 nt, Homo sapiens
cauccugaaaccaaagaaa

SEQ ID NO: 400354 - RNA, 19 nt, Homo sapiens
gaaauguucagcgaauucg

SEQ ID NO: 400355 - RNA, 19 nt, Homo sapiens
ggcauggagcugauaguca

SEQ ID NO: 400356 - RNA, 19 nt, Homo sapiens
caacaaagauggugcauua

SEQ ID NO: 400357 - RNA, 19 nt, Homo sapiens
ggacgugacuuacauaguu

SEQ ID NO: 400358 - RNA, 19 nt, Homo sapiens
gcugucaucuguuugauua

SEQ ID NO: 400359 - RNA, 19 nt, Homo sapiens
cuaaagaacucuccuauuc

SEQ ID NO: 400360 - RNA, 19 nt, Homo sapiens
gggcugggcuuucugcuua

SEQ ID NO: 400361 - RNA, 19 nt, Homo sapiens
gggcaagucugaagaacua

SEQ ID NO: 400362 - RNA, 19 nt, Homo sapiens
caacuucacugcaacauca

SEQ ID NO: 400363 - RNA, 19 nt, Homo sapiens
aaacguggcuugcuuugaa

SEQ ID NO: 400364 - RNA, 19 nt, Homo sapiens
cuaauggaaugauugguua

SEQ ID NO: 400365 - RNA, 19 nt, Homo sapiens
caaagauggugcauuauca

SEQ ID NO: 400366 - RNA, 19 nt, Homo sapiens
ggagcuggcuguggaagua

SEQ ID NO: 400367 - RNA, 19 nt, Homo sapiens
gguggaguauuuagaagua

SEQ ID NO: 400368 - RNA, 19 nt, Homo sapiens
gugaaaugcucaagaaugu

SEQ ID NO: 400369 - RNA, 19 nt, Homo sapiens
acugauagcuugacuaaug

SEQ ID NO: 400370 - RNA, 19 nt, Homo sapiens
gcucaagaauguagucaga

SEQ ID NO: 400371 - RNA, 19 nt, Homo sapiens
gaaugaagcagguaaagau

SEQ ID NO: 400372 - RNA, 19 nt, Homo sapiens
ccgcuaaacccuuggauua

SEQ ID NO: 400373 - RNA, 19 nt, Homo sapiens
ucagauaccuagugacuuc

SEQ ID NO: 400374 - RNA, 19 nt, Homo sapiens
gaaaaugccaugaaaauug

SEQ ID NO: 400375 - RNA, 19 nt, Homo sapiens
ccaauuauucacugacuua

SEQ ID NO: 400376 - RNA, 19 nt, Homo sapiens
gugaacuucugauacauuu

SEQ ID NO: 400377 - RNA, 19 nt, Homo sapiens
gcuaaacccuuggauuaug

SEQ ID NO: 400378 - RNA, 19 nt, Homo sapiens
gaacacccaagucaaggua

SEQ ID NO: 400379 - RNA, 19 nt, Homo sapiens
ggaccagcaucuaauguca

SEQ ID NO: 400380 - RNA, 19 nt, Homo sapiens
gaagcaguuucucggauga

SEQ ID NO: 400381 - RNA, 19 nt, Homo sapiens
gaggaugcuuuccacauga

SEQ ID NO: 400382 - RNA, 19 nt, Homo sapiens
caccaucacuugaacagaa

SEQ ID NO: 400383 - RNA, 19 nt, Homo sapiens
caauauuacugaugugugu

SEQ ID NO: 400384 - RNA, 19 nt, Homo sapiens
ggacaaugccaauagguau

SEQ ID NO: 400385 - RNA, 19 nt, Homo sapiens
agaaagcccuggccaacuu

SEQ ID NO: 400386 - RNA, 19 nt, Homo sapiens
gcucccagcuccuuucaug

SEQ ID NO: 400387 - RNA, 19 nt, Homo sapiens
ccagcgaccuucauucaga

SEQ ID NO: 400388 - RNA, 19 nt, Homo sapiens
aaccugagaucuuuaaaug

SEQ ID NO: 400389 - RNA, 19 nt, Homo sapiens
ggucauggauaacaacauc

SEQ ID NO: 400390 - RNA, 19 nt, Homo sapiens
ggacuccugagaacaauaa

SEQ ID NO: 400391 - RNA, 19 nt, Homo sapiens
gguucacgcuccuguauga

SEQ ID NO: 400392 - RNA, 19 nt, Homo sapiens
aaaugucguucucccaaua

SEQ ID NO: 400393 - RNA, 19 nt, Homo sapiens
cgacugauguggcagacuu

SEQ ID NO: 400394 - RNA, 19 nt, Homo sapiens
gaaaugcucaagaauguag

SEQ ID NO: 400395 - RNA, 19 nt, Homo sapiens
gaacucuccuauucaugga

SEQ ID NO: 400396 - RNA, 19 nt, Homo sapiens
gcacacugcuuaguauucu

SEQ ID NO: 400397 - RNA, 19 nt, Homo sapiens
gcugguggauccaaauguu

SEQ ID NO: 400398 - RNA, 19 nt, Homo sapiens
gcaugaauguccagacuac

SEQ ID NO: 400399 - RNA, 19 nt, Homo sapiens
aaagaacucuccuauucau

SEQ ID NO: 400400 - RNA, 19 nt, Homo sapiens
ucacugauagcuugacuaa

SEQ ID NO: 400401 - RNA, 19 nt, Homo sapiens
gcaaaccagaccauggaua

SEQ ID NO: 400402 - RNA, 19 nt, Homo sapiens
aaacagcuuuccacacaau

SEQ ID NO: 400403 - RNA, 19 nt, Homo sapiens
uuacacuccucguccauuu

SEQ ID NO: 400404 - RNA, 19 nt, Homo sapiens
ggacagacggaaaugaaau

SEQ ID NO: 400405 - RNA, 19 nt, Homo sapiens
ggaaguacucaucgacuga

SEQ ID NO: 400406 - RNA, 19 nt, Homo sapiens
gaagggcaagucugaagaa

SEQ ID NO: 400407 - RNA, 19 nt, Homo sapiens
ccugagaucuuuaaauguc

SEQ ID NO: 400408 - RNA, 19 nt, Homo sapiens
cggccacucuguugaauga

SEQ ID NO: 400409 - RNA, 19 nt, Homo sapiens
ggaaggagagacacucaug

SEQ ID NO: 400410 - RNA, 19 nt, Homo sapiens
gaacagaaucaagcugaga

SEQ ID NO: 400411 - RNA, 19 nt, Homo sapiens
gaaggcagccaacaugaag

SEQ ID NO: 400412 - RNA, 19 nt, Homo sapiens
ugaggaugcuuuccacaug

SEQ ID NO: 400413 - RNA, 19 nt, Homo sapiens
gacaaugccaauagguaua

SEQ ID NO: 400414 - RNA, 19 nt, Homo sapiens
uuuaaccacuugccucuuu

SEQ ID NO: 400415 - RNA, 19 nt, Homo sapiens
gagaaggcagccaacauga

SEQ ID NO: 400416 - RNA, 19 nt, Homo sapiens
aaacaacugcauaaccuuu

SEQ ID NO: 400417 - RNA, 19 nt, Homo sapiens
uaaagaacucuccuauuca

SEQ ID NO: 400418 - RNA, 19 nt, Homo sapiens
uagcuugacuaauggaaug

SEQ ID NO: 400419 - RNA, 19 nt, Homo sapiens
cagauccucuuaccacaau

SEQ ID NO: 400420 - RNA, 19 nt, Homo sapiens
gccaaucccuccacauucu

SEQ ID NO: 400421 - RNA, 19 nt, Homo sapiens
ggacaguuaccuccuggaa

SEQ ID NO: 400422 - RNA, 19 nt, Homo sapiens
agacggaaaugaaauuguc

SEQ ID NO: 400423 - RNA, 19 nt, Homo sapiens
gggacaaugccaauaggua

SEQ ID NO: 400424 - RNA, 19 nt, Homo sapiens
uggauuauguggagauuca

SEQ ID NO: 400425 - RNA, 19 nt, Homo sapiens
ggacuuccuaccaauuauu

SEQ ID NO: 400426 - RNA, 19 nt, Homo sapiens
gcagcugauuccagaacaa

SEQ ID NO: 400427 - RNA, 19 nt, Homo sapiens
uacgugaaaugcucaagaa

SEQ ID NO: 400428 - RNA, 19 nt, Homo sapiens
cuacagaguacgugaaaug

SEQ ID NO: 400429 - RNA, 19 nt, Homo sapiens
ucauucagauaccuaguga

SEQ ID NO: 400430 - RNA, 19 nt, Homo sapiens
cagguaacacuacagagua

SEQ ID NO: 400431 - RNA, 19 nt, Homo sapiens
cuaaacccuuggauuaugu

SEQ ID NO: 400432 - RNA, 19 nt, Homo sapiens
gaaagcuuccauucugaga

SEQ ID NO: 400433 - RNA, 19 nt, Homo sapiens
cauggugaccugcaucuuu

SEQ ID NO: 400434 - RNA, 19 nt, Homo sapiens
ccacaugaacccugaagug

SEQ ID NO: 400435 - RNA, 19 nt, Homo sapiens
auagguauauccucuggaa

SEQ ID NO: 400436 - RNA, 19 nt, Homo sapiens
gcauuaucauugcuaccaa

SEQ ID NO: 400437 - RNA, 19 nt, Homo sapiens
gccagagaauccugaaaca

SEQ ID NO: 400438 - RNA, 19 nt, Homo sapiens
ugacagcccuucccuuuug

SEQ ID NO: 400439 - RNA, 19 nt, Homo sapiens
uaaaugucguucucccaau

SEQ ID NO: 400440 - RNA, 19 nt, Homo sapiens
gaaaaccugagaucuuuaa

SEQ ID NO: 400441 - RNA, 19 nt, Homo sapiens
cucaacaccugccuucuga

SEQ ID NO: 400442 - RNA, 19 nt, Homo sapiens
gacagacggaaaugaaauu

SEQ ID NO: 400443 - RNA, 19 nt, Homo sapiens
caugaacccugaagugaac

SEQ ID NO: 400444 - RNA, 19 nt, Homo sapiens
ccagaacaaaucauuaugu

SEQ ID NO: 400445 - RNA, 19 nt, Homo sapiens
gaacacugaggaugcuuuc

SEQ ID NO: 400446 - RNA, 19 nt, Homo sapiens
caccuacccugauugacuu

SEQ ID NO: 400447 - RNA, 19 nt, Homo sapiens
gauggugcauuaucauugc

SEQ ID NO: 400448 - RNA, 19 nt, Homo sapiens
uuucugcugucaucuguuu

SEQ ID NO: 400449 - RNA, 19 nt, Homo sapiens
caacaccugccuucugaau

SEQ ID NO: 400450 - RNA, 19 nt, Homo sapiens
ucucaaaccauuaagucua

SEQ ID NO: 400451 - RNA, 19 nt, Homo sapiens
gagaagggcaagucugaag

SEQ ID NO: 400452 - RNA, 19 nt, Homo sapiens
aaacccuaccuguggauua

SEQ ID NO: 400453 - RNA, 19 nt, Homo sapiens
acaccugccuucugaaugg

SEQ ID NO: 400454 - RNA, 19 nt, Homo sapiens
cacacuccuuucacugaua

SEQ ID NO: 400455 - RNA, 19 nt, Homo sapiens
ugagaacaauaaggaguau

SEQ ID NO: 400456 - RNA, 19 nt, Homo sapiens
gaacaaugccgccugucaa

SEQ ID NO: 400457 - RNA, 19 nt, Homo sapiens
caaugccgccugucaauaa

SEQ ID NO: 400458 - RNA, 19 nt, Homo sapiens
caaagaagucgcagacgaa

SEQ ID NO: 400459 - RNA, 19 nt, Homo sapiens
ccaaacuccugccugagaa

SEQ ID NO: 400460 - RNA, 19 nt, Homo sapiens
gauauuaccgccagagaca

SEQ ID NO: 400461 - RNA, 19 nt, Homo sapiens
ggaacaaugccgccuguca

SEQ ID NO: 400462 - RNA, 19 nt, Homo sapiens
gauguagaagacacuaauu

SEQ ID NO: 400463 - RNA, 19 nt, Homo sapiens
gagaauguuaccagacuuc

SEQ ID NO: 400464 - RNA, 19 nt, Homo sapiens
agaccgagauguagaagac

SEQ ID NO: 400465 - RNA, 19 nt, Homo sapiens
guagaagacacuaauugca

SEQ ID NO: 400466 - RNA, 19 nt, Homo sapiens
gaaaaugccaccauccaau

SEQ ID NO: 400467 - RNA, 19 nt, Homo sapiens
agaagucgcagacgaagga

SEQ ID NO: 400468 - RNA, 19 nt, Homo sapiens
gaagacacuaauugcacaa

SEQ ID NO: 400469 - RNA, 19 nt, Homo sapiens
aaaugccaccauccaauaa

SEQ ID NO: 400470 - RNA, 19 nt, Homo sapiens
aaauagcacauccaccaaa

SEQ ID NO: 400471 - RNA, 19 nt, Homo sapiens
gagauguagaagacacuaa

SEQ ID NO: 400472 - RNA, 19 nt, Homo sapiens
gaauguuaccagacuucaa

SEQ ID NO: 400473 - RNA, 19 nt, Homo sapiens
acaaugccgccugucaaua

SEQ ID NO: 400474 - RNA, 19 nt, Homo sapiens
ugagaauguuaccagacuu

SEQ ID NO: 400475 - RNA, 19 nt, Homo sapiens
aaugccgccugucaauaaa

SEQ ID NO: 400476 - RNA, 19 nt, Homo sapiens
aaaaugccaccauccaaua

SEQ ID NO: 400477 - RNA, 19 nt, Homo sapiens
ggagccugcuaaggaacaa

SEQ ID NO: 400478 - RNA, 19 nt, Homo sapiens
gacacuaauugcacaaaau

SEQ ID NO: 400479 - RNA, 19 nt, Homo sapiens
acacggaggagagccauga

SEQ ID NO: 400480 - RNA, 19 nt, Homo sapiens
ccucuugccacaucuugaa

SEQ ID NO: 400481 - RNA, 19 nt, Homo sapiens
cugagaauguuaccagacu

SEQ ID NO: 400482 - RNA, 19 nt, Homo sapiens
gccagagccggagcagaua

SEQ ID NO: 400483 - RNA, 19 nt, Homo sapiens
uauuaccgccagagacaaa

SEQ ID NO: 400484 - RNA, 19 nt, Homo sapiens
cacaagaucugaagugaaa

SEQ ID NO: 400485 - RNA, 19 nt, Homo sapiens
aaagucaccugcccaauaa

SEQ ID NO: 400486 - RNA, 19 nt, Homo sapiens
gaagugaaauugugcaaag

SEQ ID NO: 400487 - RNA, 19 nt, Homo sapiens
caaagucaccugcccaaua

SEQ ID NO: 400488 - RNA, 19 nt, Homo sapiens
gaucugaagugaaauugug

SEQ ID NO: 400489 - RNA, 19 nt, Homo sapiens
gaaagucaccugcccaaga

SEQ ID NO: 400490 - RNA, 19 nt, Homo sapiens
cagcaucgcuccugcagaa

SEQ ID NO: 400491 - RNA, 19 nt, Homo sapiens
aaagucaccugcccaagaa

SEQ ID NO: 400492 - RNA, 19 nt, Homo sapiens
ccaacaccaugguccgaua

SEQ ID NO: 400493 - RNA, 19 nt, Homo sapiens
caagaucugaagugaaauu

SEQ ID NO: 400494 - RNA, 19 nt, Homo sapiens
agacacugcucucgaagga

SEQ ID NO: 400495 - RNA, 19 nt, Homo sapiens
caagugaggccauagcaau

SEQ ID NO: 400496 - RNA, 19 nt, Homo sapiens
gugaaauugugcaaaguca

SEQ ID NO: 400497 - RNA, 19 nt, Homo sapiens
gcaauuccccuacaucaaa

SEQ ID NO: 400498 - RNA, 19 nt, Homo sapiens
gaacaugcagaaggcacua

SEQ ID NO: 400499 - RNA, 19 nt, Homo sapiens
ccgagaagcccacaagauc

SEQ ID NO: 400500 - RNA, 19 nt, Homo sapiens
gaaccaggaagagaacaug

SEQ ID NO: 400501 - RNA, 19 nt, Homo sapiens
guaugcacgucgaggucua

SEQ ID NO: 400502 - RNA, 19 nt, Homo sapiens
gagaagcccacaagaucug

SEQ ID NO: 400503 - RNA, 19 nt, Homo sapiens
ccacaagaucugaagugaa

SEQ ID NO: 400504 - RNA, 19 nt, Homo sapiens
cccacaagaucugaaguga

SEQ ID NO: 400505 - RNA, 19 nt, Homo sapiens
gcaacuccccuacaucaaa

SEQ ID NO: 400506 - RNA, 19 nt, Homo sapiens
gccaccagaucucccaaca

SEQ ID NO: 400507 - RNA, 19 nt, Homo sapiens
ccagaucucccaacaccau

SEQ ID NO: 400508 - RNA, 19 nt, Homo sapiens
aggaagagaacaugcagaa

SEQ ID NO: 400509 - RNA, 19 nt, Homo sapiens
ggaaguuaagagaaaguca

SEQ ID NO: 400510 - RNA, 19 nt, Homo sapiens
gccgagaagcccacaagau

SEQ ID NO: 400511 - RNA, 19 nt, Homo sapiens
caacuccccuacaucaaau

SEQ ID NO: 400512 - RNA, 19 nt, Homo sapiens
gcuggaaguuaagagaaag

SEQ ID NO: 400513 - RNA, 19 nt, Homo sapiens
gcagaaccaggaagagaac

SEQ ID NO: 400514 - RNA, 19 nt, Homo sapiens
cgagaagcccacaagaucu

SEQ ID NO: 400515 - RNA, 19 nt, Homo sapiens
cagcuggaaguuaagagaa

SEQ ID NO: 400516 - RNA, 19 nt, Homo sapiens
cccaagaaacaccgaguga

SEQ ID NO: 400517 - RNA, 19 nt, Homo sapiens
ccagcuggaaauuaagaaa

SEQ ID NO: 400518 - RNA, 19 nt, Homo sapiens
gcaaagucaccugcccaau

SEQ ID NO: 400519 - RNA, 19 nt, Homo sapiens
gcccacaagaucugaagug

SEQ ID NO: 400520 - RNA, 19 nt, Homo sapiens
agcuggaaguuaagagaaa

SEQ ID NO: 400521 - RNA, 19 nt, Homo sapiens
ccagcuggaaguuaagaga

SEQ ID NO: 400522 - RNA, 19 nt, Homo sapiens
ccaagugaggccauagcaa

SEQ ID NO: 400523 - RNA, 19 nt, Homo sapiens
gaaaagaacugcuugcauu

SEQ ID NO: 400524 - RNA, 19 nt, Homo sapiens
gaacuggggugauguuuua

SEQ ID NO: 400525 - RNA, 19 nt, Homo sapiens
caacauuucugccagguuu

SEQ ID NO: 400526 - RNA, 19 nt, Homo sapiens
cauagaggaugauguaauu

SEQ ID NO: 400527 - RNA, 19 nt, Homo sapiens
ggagaugacagaaauauga

SEQ ID NO: 400528 - RNA, 19 nt, Homo sapiens
guagagauuucauagcuau

SEQ ID NO: 400529 - RNA, 19 nt, Homo sapiens
gcaggcccaucauacauuu

SEQ ID NO: 400530 - RNA, 19 nt, Homo sapiens
aaacaaaucucagaacagu

SEQ ID NO: 400531 - RNA, 19 nt, Homo sapiens
guaauuggcuuuugaauca

SEQ ID NO: 400532 - RNA, 19 nt, Homo sapiens
gaaauuaaacgagcgaaga

SEQ ID NO: 400533 - RNA, 19 nt, Homo sapiens
caggagagcugcaguugug

SEQ ID NO: 400534 - RNA, 19 nt, Homo sapiens
gaaauaccuuugccuggau

SEQ ID NO: 400535 - RNA, 19 nt, Homo sapiens
gaacugcuugcauuucuuu

SEQ ID NO: 400536 - RNA, 19 nt, Homo sapiens
gaaagcaccaucaucauag

SEQ ID NO: 400537 - RNA, 19 nt, Homo sapiens
ugaaagcaccaucaucaua

SEQ ID NO: 400538 - RNA, 19 nt, Homo sapiens
gaauagggagacaaucuaa

SEQ ID NO: 400539 - RNA, 19 nt, Homo sapiens
ggaggccacaugauacuua

SEQ ID NO: 400540 - RNA, 19 nt, Homo sapiens
gcaguuaacaucugaagug

SEQ ID NO: 400541 - RNA, 19 nt, Homo sapiens
uaaggcagcugaaaaguaa

SEQ ID NO: 400542 - RNA, 19 nt, Homo sapiens
guuaggaggccacaugaua

SEQ ID NO: 400543 - RNA, 19 nt, Homo sapiens
ccggauaggcuaaucaaua

SEQ ID NO: 400544 - RNA, 19 nt, Homo sapiens
caccaucuuucuaaucuuu

SEQ ID NO: 400545 - RNA, 19 nt, Homo sapiens
auacuaaugcccuaucuua

SEQ ID NO: 400546 - RNA, 19 nt, Homo sapiens
guuaacaucugaagugucu

SEQ ID NO: 400547 - RNA, 19 nt, Homo sapiens
guaaauugccuucuagaca

SEQ ID NO: 400548 - RNA, 19 nt, Homo sapiens
ggacuuagugcaacagguu

SEQ ID NO: 400549 - RNA, 19 nt, Homo sapiens
ucaauacccuuggcacuga

SEQ ID NO: 400550 - RNA, 19 nt, Homo sapiens
gguuggagaugacagaaau

SEQ ID NO: 400551 - RNA, 19 nt, Homo sapiens
uaggucaaguucauaguuu

SEQ ID NO: 400552 - RNA, 19 nt, Homo sapiens
agaauuaggucaaguucau

SEQ ID NO: 400553 - RNA, 19 nt, Homo sapiens
uggcauuccuuucuuuaaa

SEQ ID NO: 400554 - RNA, 19 nt, Homo sapiens
uaacagcaaauaaccauug

SEQ ID NO: 400555 - RNA, 19 nt, Homo sapiens
gugcacgacugcgucaaua

SEQ ID NO: 400556 - RNA, 19 nt, Homo sapiens
gugaaaacaugcaccguua

SEQ ID NO: 400557 - RNA, 19 nt, Homo sapiens
uaacaucugaagugucuaa

SEQ ID NO: 400558 - RNA, 19 nt, Homo sapiens
ucaccuagcagauauguau

SEQ ID NO: 400559 - RNA, 19 nt, Homo sapiens
aaaguaaauugccuucuag

SEQ ID NO: 400560 - RNA, 19 nt, Homo sapiens
gaccguuacuaucgugaaa

SEQ ID NO: 400561 - RNA, 19 nt, Homo sapiens
ccaaaguggacaccauuaa

SEQ ID NO: 400562 - RNA, 19 nt, Homo sapiens
aaugugcacugaaucguuu

SEQ ID NO: 400563 - RNA, 19 nt, Homo sapiens
caucugaagugucuaaugc

SEQ ID NO: 400564 - RNA, 19 nt, Homo sapiens
caaagaauagggagacaau

SEQ ID NO: 400565 - RNA, 19 nt, Homo sapiens
ccagaaugauuuugacaua

SEQ ID NO: 400566 - RNA, 19 nt, Homo sapiens
gcacugaugggcacuggaa

SEQ ID NO: 400567 - RNA, 19 nt, Homo sapiens
gaugacagaaauaugauug

SEQ ID NO: 400568 - RNA, 19 nt, Homo sapiens
cuagagcucaguauacuaa

SEQ ID NO: 400569 - RNA, 19 nt, Homo sapiens
ugguuaaucuggacuuauu

SEQ ID NO: 400570 - RNA, 19 nt, Homo sapiens
cggauaggcuaaucaauac

SEQ ID NO: 400571 - RNA, 19 nt, Homo sapiens
aaucuccuuuguccauuua

SEQ ID NO: 400572 - RNA, 19 nt, Homo sapiens
ucuagacacugaaggcaaa

SEQ ID NO: 400573 - RNA, 19 nt, Homo sapiens
gguggugucucacucuuuc

SEQ ID NO: 400574 - RNA, 19 nt, Homo sapiens
gcauaggacagacuuagga

SEQ ID NO: 400575 - RNA, 19 nt, Homo sapiens
gaauuaggucaaguucaua

SEQ ID NO: 400576 - RNA, 19 nt, Homo sapiens
gaccugggccucugcaaga

SEQ ID NO: 400577 - RNA, 19 nt, Homo sapiens
gaucgagcaugguccucuu

SEQ ID NO: 400578 - RNA, 19 nt, Homo sapiens
uagagcaguuaacaucuga

SEQ ID NO: 400579 - RNA, 19 nt, Homo sapiens
caucaugagccguugcuaa

SEQ ID NO: 400580 - RNA, 19 nt, Homo sapiens
ucaccgagaccgacguuaa

SEQ ID NO: 400581 - RNA, 19 nt, Homo sapiens
ugauugauuugaaguggaa

SEQ ID NO: 400582 - RNA, 19 nt, Homo sapiens
guaauuaaggcagcugaaa

SEQ ID NO: 400583 - RNA, 19 nt, Homo sapiens
gaggccacaugauacuuau

SEQ ID NO: 400584 - RNA, 19 nt, Homo sapiens
ccugaucucuuuccucauc

SEQ ID NO: 400585 - RNA, 19 nt, Homo sapiens
cugcuugcauuucuuuauu

SEQ ID NO: 400586 - RNA, 19 nt, Homo sapiens
gagcugcaguugugaaagc

SEQ ID NO: 400587 - RNA, 19 nt, Homo sapiens
gcacgacugcgucaauauc

SEQ ID NO: 400588 - RNA, 19 nt, Homo sapiens
aaaccaacaugaagcacau

SEQ ID NO: 400589 - RNA, 19 nt, Homo sapiens
auuauuggcuugcacuuug

SEQ ID NO: 400590 - RNA, 19 nt, Homo sapiens
aaagcaccaucaucauaga

SEQ ID NO: 400591 - RNA, 19 nt, Homo sapiens
aaauaccuuugccuggaua

SEQ ID NO: 400592 - RNA, 19 nt, Homo sapiens
agauguguaucacccagua

SEQ ID NO: 400593 - RNA, 19 nt, Homo sapiens
guccuuaggcuuacaaugu

SEQ ID NO: 400594 - RNA, 19 nt, Homo sapiens
gagagcugcaguugugaaa

SEQ ID NO: 400595 - RNA, 19 nt, Homo sapiens
uaguagagauuucauagcu

SEQ ID NO: 400596 - RNA, 19 nt, Homo sapiens
cgaggcagagcagucauua

SEQ ID NO: 400597 - RNA, 19 nt, Homo sapiens
gagcaggcccaucauacau

SEQ ID NO: 400598 - RNA, 19 nt, Homo sapiens
gacccuauauguggcauuc

SEQ ID NO: 400599 - RNA, 19 nt, Homo sapiens
uuaaaggacccuauaugug

SEQ ID NO: 400600 - RNA, 19 nt, Homo sapiens
ggggugauguuuuacuuuu

SEQ ID NO: 400601 - RNA, 19 nt, Homo sapiens
gaugauggagcgcgugguu

SEQ ID NO: 400602 - RNA, 19 nt, Homo sapiens
uaacuuugcauguucuugu

SEQ ID NO: 400603 - RNA, 19 nt, Homo sapiens
uguuugauauugucaccua

SEQ ID NO: 400604 - RNA, 19 nt, Homo sapiens
gcuggaugcugguucucuu

SEQ ID NO: 400605 - RNA, 19 nt, Homo sapiens
gaaaccagaaugauuuuga

SEQ ID NO: 400606 - RNA, 19 nt, Homo sapiens
ggaugcugguucucuuugu

SEQ ID NO: 400607 - RNA, 19 nt, Homo sapiens
gaugcugguucucuuugug

SEQ ID NO: 400608 - RNA, 19 nt, Homo sapiens
gcauguucuuguuuuguua

SEQ ID NO: 400609 - RNA, 19 nt, Homo sapiens
cauguaagaauccaaagug

SEQ ID NO: 400610 - RNA, 19 nt, Homo sapiens
gccaugagcaggcccauca

SEQ ID NO: 400611 - RNA, 19 nt, Homo sapiens
ggacagacuuaggaguuuu

SEQ ID NO: 400612 - RNA, 19 nt, Homo sapiens
ugugaaagcaccaucauca

SEQ ID NO: 400613 - RNA, 19 nt, Homo sapiens
uagaggacauauucacagu

SEQ ID NO: 400614 - RNA, 19 nt, Homo sapiens
agcaugagcucugugugua

SEQ ID NO: 400615 - RNA, 19 nt, Homo sapiens
agaccgacguuaagaugau

SEQ ID NO: 400616 - RNA, 19 nt, Homo sapiens
ccugaauuguuugauauug

SEQ ID NO: 400617 - RNA, 19 nt, Homo sapiens
ucccugaauuguuugauau

SEQ ID NO: 400618 - RNA, 19 nt, Homo sapiens
gcuugcauuucuuuauuuc

SEQ ID NO: 400619 - RNA, 19 nt, Homo sapiens
aggcagagcagucauuaug

SEQ ID NO: 400620 - RNA, 19 nt, Homo sapiens
gcgucaauaucacaaucaa

SEQ ID NO: 400621 - RNA, 19 nt, Homo sapiens
acaggcccauggaugagua

SEQ ID NO: 400622 - RNA, 19 nt, Homo sapiens
guuuagagcaguuaacauc

SEQ ID NO: 400623 - RNA, 19 nt, Homo sapiens
cgacguggccuuccucgau

SEQ ID NO: 400624 - RNA, 19 nt, Homo sapiens
cagaggagaaggucaucuu

SEQ ID NO: 400625 - RNA, 19 nt, Homo sapiens
cgucugaacagguggcaaa

SEQ ID NO: 400626 - RNA, 19 nt, Homo sapiens
cguggccgauggagaguuc

SEQ ID NO: 400627 - RNA, 19 nt, Homo sapiens
ucacaugccuuaugaauag

SEQ ID NO: 400628 - RNA, 19 nt, Homo sapiens
ggaagcggauggagaagaa

SEQ ID NO: 400629 - RNA, 19 nt, Homo sapiens
gggauacucuguuuaugaa

SEQ ID NO: 400630 - RNA, 19 nt, Homo sapiens
gaagcgcagucaccugaaa

SEQ ID NO: 400631 - RNA, 19 nt, Homo sapiens
gcagugaaguucccuugug

SEQ ID NO: 400632 - RNA, 19 nt, Homo sapiens
gcagcgaggucaugagcaa

SEQ ID NO: 400633 - RNA, 19 nt, Homo sapiens
gcauagaggagaucuguga

SEQ ID NO: 400634 - RNA, 19 nt, Homo sapiens
gcaacauggugucugagaa

SEQ ID NO: 400635 - RNA, 19 nt, Homo sapiens
gagcaccuguuguauguca

SEQ ID NO: 400636 - RNA, 19 nt, Homo sapiens
ucacaagccuccugcuguu

SEQ ID NO: 400637 - RNA, 19 nt, Homo sapiens
cagaagagcugggcaccuu

SEQ ID NO: 400638 - RNA, 19 nt, Homo sapiens
ggacggcgaacuugcagua

SEQ ID NO: 400639 - RNA, 19 nt, Homo sapiens
ccaagaagaccaaguagau

SEQ ID NO: 400640 - RNA, 19 nt, Homo sapiens
uuacugagcaccuguugua

SEQ ID NO: 400641 - RNA, 19 nt, Homo sapiens
gcacaucagagacaaggaa

SEQ ID NO: 400642 - RNA, 19 nt, Homo sapiens
gccagugccuccagaaugu

SEQ ID NO: 400643 - RNA, 19 nt, Homo sapiens
agaaggaggccaagagaaa

SEQ ID NO: 400644 - RNA, 19 nt, Homo sapiens
ugagcaacauggugucuga

SEQ ID NO: 400645 - RNA, 19 nt, Homo sapiens
guccucaacuucaucaaga

SEQ ID NO: 400646 - RNA, 19 nt, Homo sapiens
gaggagcagauccaaguuu

SEQ ID NO: 400647 - RNA, 19 nt, Homo sapiens
cuacggcguuuacaccaaa

SEQ ID NO: 400648 - RNA, 19 nt, Homo sapiens
gcacaccagcuccucuuga

SEQ ID NO: 400649 - RNA, 19 nt, Homo sapiens
gcaccuucguccucaacuu

SEQ ID NO: 400650 - RNA, 19 nt, Homo sapiens
gcucauugaugggaagaug

SEQ ID NO: 400651 - RNA, 19 nt, Homo sapiens
agaccaagaagaccaagua

SEQ ID NO: 400652 - RNA, 19 nt, Homo sapiens
cuaaagcuguguguguuga

SEQ ID NO: 400653 - RNA, 19 nt, Homo sapiens
agacacagaagaccaagaa

SEQ ID NO: 400654 - RNA, 19 nt, Homo sapiens
gaaacgagacacagaagac

SEQ ID NO: 400655 - RNA, 19 nt, Homo sapiens
ggucuaaagcugugugugu

SEQ ID NO: 400656 - RNA, 19 nt, Homo sapiens
cugagcaccuguuguaugu

SEQ ID NO: 400657 - RNA, 19 nt, Homo sapiens
gagaaggaggccaagagaa

SEQ ID NO: 400658 - RNA, 19 nt, Homo sapiens
uagaggagaucugugacuu

SEQ ID NO: 400659 - RNA, 19 nt, Homo sapiens
gcaaacgugccaacuccuu

SEQ ID NO: 400660 - RNA, 19 nt, Homo sapiens
gggaggagcagauccaagu

SEQ ID NO: 400661 - RNA, 19 nt, Homo sapiens
cugcuggacucaaagaaga

SEQ ID NO: 400662 - RNA, 19 nt, Homo sapiens
gaggaggccaaggaaauuu

SEQ ID NO: 400663 - RNA, 19 nt, Homo sapiens
acacagaagaccaagaaga

SEQ ID NO: 400664 - RNA, 19 nt, Homo sapiens
uaaagggacauguaacaag

SEQ ID NO: 400665 - RNA, 19 nt, Homo sapiens
gaagagcugggcaccuuag

SEQ ID NO: 400666 - RNA, 19 nt, Homo sapiens
gagagaaggaggccaagag

SEQ ID NO: 400667 - RNA, 19 nt, Homo sapiens
ggacaucaaggaggucuuc

SEQ ID NO: 400668 - RNA, 19 nt, Homo sapiens
gucuaaagcuguguguguu

SEQ ID NO: 400669 - RNA, 19 nt, Homo sapiens
gucacaugccuuaugaaua

SEQ ID NO: 400670 - RNA, 19 nt, Homo sapiens
cagcuccucuugacucagu

SEQ ID NO: 400671 - RNA, 19 nt, Homo sapiens
cgaggaggccaaggaaauu

SEQ ID NO: 400672 - RNA, 19 nt, Homo sapiens
ugucaggcuuggagaguau

SEQ ID NO: 400673 - RNA, 19 nt, Homo sapiens
gagcuggaccuggacauca

SEQ ID NO: 400674 - RNA, 19 nt, Homo sapiens
ggccugcuguucuguccuu

SEQ ID NO: 400675 - RNA, 19 nt, Homo sapiens
gggagugcauagaggagau

SEQ ID NO: 400676 - RNA, 19 nt, Homo sapiens
gugggcuccuucacaacua

SEQ ID NO: 400677 - RNA, 19 nt, Homo sapiens
cggcgaacuugcaguaucu

SEQ ID NO: 400678 - RNA, 19 nt, Homo sapiens
ggaggagcagauccaaguu

SEQ ID NO: 400679 - RNA, 19 nt, Homo sapiens
gcaggacggcgaacuugca

SEQ ID NO: 400680 - RNA, 19 nt, Homo sapiens
cuucacaacuacggcguuu

SEQ ID NO: 400681 - RNA, 19 nt, Homo sapiens
caacauggugucugagaac

SEQ ID NO: 400682 - RNA, 19 nt, Homo sapiens
gaaggaggccaagagaaac

SEQ ID NO: 400683 - RNA, 19 nt, Homo sapiens
caagaagaccaaguagauc

SEQ ID NO: 400684 - RNA, 19 nt, Homo sapiens
ccuggaagcggauggagaa

SEQ ID NO: 400685 - RNA, 19 nt, Homo sapiens
gccgcuaccucgacuggau

SEQ ID NO: 400686 - RNA, 19 nt, Homo sapiens
ucacaacuacggcguuuac

SEQ ID NO: 400687 - RNA, 19 nt, Homo sapiens
ccacagcagccgagagaag

SEQ ID NO: 400688 - RNA, 19 nt, Homo sapiens
gugcauagaggagaucugu

SEQ ID NO: 400689 - RNA, 19 nt, Homo sapiens
ucgaggaggccaaggaaau

SEQ ID NO: 400690 - RNA, 19 nt, Homo sapiens
uaccacagcagccgagaga

SEQ ID NO: 400691 - RNA, 19 nt, Homo sapiens
agagaaggaggccaagaga

SEQ ID NO: 400692 - RNA, 19 nt, Homo sapiens
ugaaacgagacacagaaga

SEQ ID NO: 400693 - RNA, 19 nt, Homo sapiens
gcugugcgccuggcuacaa

SEQ ID NO: 400694 - RNA, 19 nt, Homo sapiens
ggggauacucuguuuauga

SEQ ID NO: 400695 - RNA, 19 nt, Homo sapiens
ugucacaugccuuaugaau

SEQ ID NO: 400696 - RNA, 19 nt, Homo sapiens
agaagagcugggcaccuua

SEQ ID NO: 400697 - RNA, 19 nt, Homo sapiens
acaccggccugcuguucug

SEQ ID NO: 400698 - RNA, 19 nt, Homo sapiens
uuaaagggacauguaacaa

SEQ ID NO: 400699 - RNA, 19 nt, Homo sapiens
ccugaaacgagacacagaa

SEQ ID NO: 400700 - RNA, 19 nt, Homo sapiens
ccucaacuucaucaagauu

SEQ ID NO: 400701 - RNA, 19 nt, Homo sapiens
gaauauaggcgcacacuua

SEQ ID NO: 400702 - RNA, 19 nt, Homo sapiens
ucaacaagcucaugaagau

SEQ ID NO: 400703 - RNA, 19 nt, Homo sapiens
ggacagaggcuauucaaca

SEQ ID NO: 400704 - RNA, 19 nt, Homo sapiens
gagaacagcagccucauga

SEQ ID NO: 400705 - RNA, 19 nt, Homo sapiens
gaacucuccucgaaugugu

SEQ ID NO: 400706 - RNA, 19 nt, Homo sapiens
gacagccacuggaaacuuu

SEQ ID NO: 400707 - RNA, 19 nt, Homo sapiens
caagaaagccacagagaug

SEQ ID NO: 400708 - RNA, 19 nt, Homo sapiens
gacagaggcuauucaacaa

SEQ ID NO: 400709 - RNA, 19 nt, Homo sapiens
ccaaauggcuguggagcaa

SEQ ID NO: 400710 - RNA, 19 nt, Homo sapiens
gcaggaaagugucgcaaag

SEQ ID NO: 400711 - RNA, 19 nt, Homo sapiens
cggcagagaucggcuauga

SEQ ID NO: 400712 - RNA, 19 nt, Homo sapiens
gagcagaggcuuugagaag

SEQ ID NO: 400713 - RNA, 19 nt, Homo sapiens
gaacagcagccucaugaag

SEQ ID NO: 400714 - RNA, 19 nt, Homo sapiens
ggaaagugucgcaaaguug

SEQ ID NO: 400715 - RNA, 19 nt, Homo sapiens
uggaggagcugaagcacaa

SEQ ID NO: 400716 - RNA, 19 nt, Homo sapiens
gaaguucaauguggagaag

SEQ ID NO: 400717 - RNA, 19 nt, Homo sapiens
ucacacagauucaccuuuu

SEQ ID NO: 400718 - RNA, 19 nt, Homo sapiens
caucgaagccucagguaga

SEQ ID NO: 400719 - RNA, 19 nt, Homo sapiens
cgaauaagcgggacaagca

SEQ ID NO: 400720 - RNA, 19 nt, Homo sapiens
acaaguacgugcccuaugg

SEQ ID NO: 400721 - RNA, 19 nt, Homo sapiens
gaggaggagcuacagauga

SEQ ID NO: 400722 - RNA, 19 nt, Homo sapiens
gcagagacccugggagugu

SEQ ID NO: 400723 - RNA, 19 nt, Homo sapiens
gcccuugucuggcauuugu

SEQ ID NO: 400724 - RNA, 19 nt, Homo sapiens
cagaggugcuggccaagug

SEQ ID NO: 400725 - RNA, 19 nt, Homo sapiens
gcauuugucaggaauauag

SEQ ID NO: 400726 - RNA, 19 nt, Homo sapiens
caaggaugccuaugacaau

SEQ ID NO: 400727 - RNA, 19 nt, Homo sapiens
ccacauggagacauucuug

SEQ ID NO: 400728 - RNA, 19 nt, Homo sapiens
ccagggugcuugugaaguc

SEQ ID NO: 400729 - RNA, 19 nt, Homo sapiens
ggacagccacuggaaacuu

SEQ ID NO: 400730 - RNA, 19 nt, Homo sapiens
aggaaagugucgcaaaguu

SEQ ID NO: 400731 - RNA, 19 nt, Homo sapiens
gugcuucuuucaccaaaug

SEQ ID NO: 400732 - RNA, 19 nt, Homo sapiens
caaguggaggugcuucuuu

SEQ ID NO: 400733 - RNA, 19 nt, Homo sapiens
gagcaggagcagaggcuuu

SEQ ID NO: 400734 - RNA, 19 nt, Homo sapiens
gauggcaguggcacgaaua

SEQ ID NO: 400735 - RNA, 19 nt, Homo sapiens
ugggaacucuccucgaaug

SEQ ID NO: 400736 - RNA, 19 nt, Homo sapiens
ggaggaggagcuacagaug

SEQ ID NO: 400737 - RNA, 19 nt, Homo sapiens
aauauaggcgcacacuuaa

SEQ ID NO: 400738 - RNA, 19 nt, Homo sapiens
ggacagcugcuaggcaugu

SEQ ID NO: 400739 - RNA, 19 nt, Homo sapiens
ucaaggaugccuaugacaa

SEQ ID NO: 400740 - RNA, 19 nt, Homo sapiens
ccaagaaagccacagagau

SEQ ID NO: 400741 - RNA, 19 nt, Homo sapiens
ggauggcaguggcacgaau

SEQ ID NO: 400742 - RNA, 19 nt, Homo sapiens
ggagaacagcagccucaug

SEQ ID NO: 400743 - RNA, 19 nt, Homo sapiens
ggaugccuaugacaaugug

SEQ ID NO: 400744 - RNA, 19 nt, Homo sapiens
gaauaagcgggacaagcaa

SEQ ID NO: 400745 - RNA, 19 nt, Homo sapiens
ccuuggaccuagaggauug

SEQ ID NO: 400746 - RNA, 19 nt, Homo sapiens
ggaaguucaauguggagaa

SEQ ID NO: 400747 - RNA, 19 nt, Homo sapiens
uuugggaacucuccucgaa

SEQ ID NO: 400748 - RNA, 19 nt, Homo sapiens
uggauguccuggccaagaa

SEQ ID NO: 400749 - RNA, 19 nt, Homo sapiens
caggaauggugucaucagu

SEQ ID NO: 400750 - RNA, 19 nt, Homo sapiens
ccgcaggaauggugucauc

SEQ ID NO: 400751 - RNA, 19 nt, Homo sapiens
uggaggugcugcccuacuu

SEQ ID NO: 400752 - RNA, 19 nt, Homo sapiens
ccgcucaucuucaacacau

SEQ ID NO: 400753 - RNA, 19 nt, Homo sapiens
gccaagaaagccacagaga

SEQ ID NO: 400754 - RNA, 19 nt, Homo sapiens
uggagaagccgcucaucuu

SEQ ID NO: 400755 - RNA, 19 nt, Homo sapiens
gagaugcagcggaaguuca

SEQ ID NO: 400756 - RNA, 19 nt, Homo sapiens
acagccacauggagacauu

SEQ ID NO: 400757 - RNA, 19 nt, Homo sapiens
cauccagggcugagauuga

SEQ ID NO: 400758 - RNA, 19 nt, Homo sapiens
caagugcgacagccacaug

SEQ ID NO: 400759 - RNA, 19 nt, Homo sapiens
gcacgaauaagcgggacaa

SEQ ID NO: 400760 - RNA, 19 nt, Homo sapiens
cuagaggauuguccaccuu

SEQ ID NO: 400761 - RNA, 19 nt, Homo sapiens
ggaacucuccucgaaugug

SEQ ID NO: 400762 - RNA, 19 nt, Homo sapiens
gugccagggugcuugugaa

SEQ ID NO: 400763 - RNA, 19 nt, Homo sapiens
cagguagagucagcgauga

SEQ ID NO: 400764 - RNA, 19 nt, Homo sapiens
ucagcgccauccuggacua

SEQ ID NO: 400765 - RNA, 19 nt, Homo sapiens
uggcauuugucaggaauau

SEQ ID NO: 400766 - RNA, 19 nt, Homo sapiens
cgugagggcugguguuuug

SEQ ID NO: 400767 - RNA, 19 nt, Homo sapiens
ccucaaggaugccuaugac

SEQ ID NO: 400768 - RNA, 19 nt, Homo sapiens
gaagugccagggugcuugu

SEQ ID NO: 400769 - RNA, 19 nt, Homo sapiens
ucacucuguugcugucuuc

SEQ ID NO: 400770 - RNA, 19 nt, Homo sapiens
aaguggaggugcuucuuuc

SEQ ID NO: 400771 - RNA, 19 nt, Homo sapiens
gggugcuugugaagucuaa

SEQ ID NO: 400772 - RNA, 19 nt, Homo sapiens
gaacuggcaaccucuucca

SEQ ID NO: 400773 - RNA, 19 nt, Homo sapiens
ggacuggagcagccucauc

SEQ ID NO: 400774 - RNA, 19 nt, Homo sapiens
ggaauauaggcgcacacuu

SEQ ID NO: 400775 - RNA, 19 nt, Homo sapiens
ggaggugcugcccuacuug

SEQ ID NO: 400776 - RNA, 19 nt, Homo sapiens
ggucaauaaaccacuguuc

SEQ ID NO: 400777 - RNA, 19 nt, Homo sapiens
ggagcagaggcuuugagaa

SEQ ID NO: 400778 - RNA, 19 nt, Homo sapiens
ggagaugcagcggaaguuc

SEQ ID NO: 400779 - RNA, 19 nt, Homo sapiens
aggcaugugugaccagauc

SEQ ID NO: 400780 - RNA, 19 nt, Homo sapiens
gugccuggacuacguguug

SEQ ID NO: 400781 - RNA, 19 nt, Homo sapiens
ccacguacgaggccaccaa

SEQ ID NO: 400782 - RNA, 19 nt, Homo sapiens
aaggaugccuaugacaaug

SEQ ID NO: 400783 - RNA, 19 nt, Homo sapiens
caacaagcucaugaagaug

SEQ ID NO: 400784 - RNA, 19 nt, Homo sapiens
auaagcgggacaagcaaua

SEQ ID NO: 400785 - RNA, 19 nt, Homo sapiens
gaccuucuaugggcauuuu

SEQ ID NO: 400786 - RNA, 19 nt, Homo sapiens
aggcagagcacaaggagau

SEQ ID NO: 400787 - RNA, 19 nt, Homo sapiens
gccugacgcuggagaugca

SEQ ID NO: 400788 - RNA, 19 nt, Homo sapiens
ggauguccuggccaagaaa

SEQ ID NO: 400789 - RNA, 19 nt, Homo sapiens
ggugugggccgaaccugau

SEQ ID NO: 400790 - RNA, 19 nt, Homo sapiens
ccaccaugcagcugaagug

SEQ ID NO: 400791 - RNA, 19 nt, Homo sapiens
uggcggugcugcaggaaag

SEQ ID NO: 400792 - RNA, 19 nt, Homo sapiens
gcaccaccaccaccaguga

SEQ ID NO: 400793 - RNA, 19 nt, Homo sapiens
ggaggcgccuuugcuuugu

SEQ ID NO: 400794 - RNA, 19 nt, Homo sapiens
gcaagagcgcucacugcuu

SEQ ID NO: 400795 - RNA, 19 nt, Homo sapiens
gaaccgcagagcuaagcaa

SEQ ID NO: 400796 - RNA, 19 nt, Homo sapiens
cuaagcaacggaagcaaga

SEQ ID NO: 400797 - RNA, 19 nt, Homo sapiens
caggaggcgccuuugcuuu

SEQ ID NO: 400798 - RNA, 19 nt, Homo sapiens
gagcuaagcaacggaagca

SEQ ID NO: 400799 - RNA, 19 nt, Homo sapiens
caccaccagugaccugcuu

SEQ ID NO: 400800 - RNA, 19 nt, Homo sapiens
uuccagaaccgcagagcua

SEQ ID NO: 400801 - RNA, 19 nt, Homo sapiens
aggaggcgccuuugcuuug

SEQ ID NO: 400802 - RNA, 19 nt, Homo sapiens
gcaaggagcuucuggaaua

SEQ ID NO: 400803 - RNA, 19 nt, Homo sapiens
gcaaagaucccucaaauau

SEQ ID NO: 400804 - RNA, 19 nt, Homo sapiens
gcauggaagugaauauuaa

SEQ ID NO: 400805 - RNA, 19 nt, Homo sapiens
gcaaggaaguaaacucaaa

SEQ ID NO: 400806 - RNA, 19 nt, Homo sapiens
guaaagauguggaugaaug

SEQ ID NO: 400807 - RNA, 19 nt, Homo sapiens
gaacauacauccaaaauca

SEQ ID NO: 400808 - RNA, 19 nt, Homo sapiens
gaagaacugugcaauaaag

SEQ ID NO: 400809 - RNA, 19 nt, Homo sapiens
gaacaugugugcucagcuu

SEQ ID NO: 400810 - RNA, 19 nt, Homo sapiens
ggaaguaaacucaaacaaa

SEQ ID NO: 400811 - RNA, 19 nt, Homo sapiens
gaagccauuucuaaacaua

SEQ ID NO: 400812 - RNA, 19 nt, Homo sapiens
gaagaaaggauucaaacuu

SEQ ID NO: 400813 - RNA, 19 nt, Homo sapiens
gcacgucagucaacuaaug

SEQ ID NO: 400814 - RNA, 19 nt, Homo sapiens
gaaaggagaaugaacaaau

SEQ ID NO: 400815 - RNA, 19 nt, Homo sapiens
auacgaagcuggaauuuga

SEQ ID NO: 400816 - RNA, 19 nt, Homo sapiens
uauaugagcugcaaagaug

SEQ ID NO: 400817 - RNA, 19 nt, Homo sapiens
gaaguaaggagguaagauu

SEQ ID NO: 400818 - RNA, 19 nt, Homo sapiens
gcacaggaaucuucuucuu

SEQ ID NO: 400819 - RNA, 19 nt, Homo sapiens
aauaacagcugaaggguuu

SEQ ID NO: 400820 - RNA, 19 nt, Homo sapiens
ccuaaugccuuauuucaaa

SEQ ID NO: 400821 - RNA, 19 nt, Homo sapiens
gaaaauggauugcuggaaa

SEQ ID NO: 400822 - RNA, 19 nt, Homo sapiens
caaugaagauggauauaug

SEQ ID NO: 400823 - RNA, 19 nt, Homo sapiens
gagaagggcuccuacuauc

SEQ ID NO: 400824 - RNA, 19 nt, Homo sapiens
gcagucaaauuugugauaa

SEQ ID NO: 400825 - RNA, 19 nt, Homo sapiens
ucgaagaacugugcaauaa

SEQ ID NO: 400826 - RNA, 19 nt, Homo sapiens
gcaacaggcuucacaaguc

SEQ ID NO: 400827 - RNA, 19 nt, Homo sapiens
gaaugaacauacauccaaa

SEQ ID NO: 400828 - RNA, 19 nt, Homo sapiens
cagaagagaugguggucua

SEQ ID NO: 400829 - RNA, 19 nt, Homo sapiens
gaaaccaucucccaugaag

SEQ ID NO: 400830 - RNA, 19 nt, Homo sapiens
uaaagaagcugugauggau

SEQ ID NO: 400831 - RNA, 19 nt, Homo sapiens
caaagaucccucaaauaua

SEQ ID NO: 400832 - RNA, 19 nt, Homo sapiens
aggaugagauaucagauua

SEQ ID NO: 400833 - RNA, 19 nt, Homo sapiens
ggaggguccuaaugccuua

SEQ ID NO: 400834 - RNA, 19 nt, Homo sapiens
ucaacaaucucaucuggaa

SEQ ID NO: 400835 - RNA, 19 nt, Homo sapiens
aagagaugguggucuauua

SEQ ID NO: 400836 - RNA, 19 nt, Homo sapiens
guaaaugugaccuugaaua

SEQ ID NO: 400837 - RNA, 19 nt, Homo sapiens
aagaaaggauucaaacuug

SEQ ID NO: 400838 - RNA, 19 nt, Homo sapiens
gaacucauuaaaccgauua

SEQ ID NO: 400839 - RNA, 19 nt, Homo sapiens
ggagguugcagucaaauuu

SEQ ID NO: 400840 - RNA, 19 nt, Homo sapiens
gcugaggguuggcauguaa

SEQ ID NO: 400841 - RNA, 19 nt, Homo sapiens
aggcaaaccuucugucaaa

SEQ ID NO: 400842 - RNA, 19 nt, Homo sapiens
cuaagaagcugugucaaug

SEQ ID NO: 400843 - RNA, 19 nt, Homo sapiens
gaauuuagagucaacagaa

SEQ ID NO: 400844 - RNA, 19 nt, Homo sapiens
ggaaagugaacucauuaaa

SEQ ID NO: 400845 - RNA, 19 nt, Homo sapiens
uauuagagcucacucaugu

SEQ ID NO: 400846 - RNA, 19 nt, Homo sapiens
uuacuucucuugcuaucua

SEQ ID NO: 400847 - RNA, 19 nt, Homo sapiens
acaaagcaaugaaagcaaa

SEQ ID NO: 400848 - RNA, 19 nt, Homo sapiens
aaugugaccuugaauauuc

SEQ ID NO: 400849 - RNA, 19 nt, Homo sapiens
cuagauggauguauacgaa

SEQ ID NO: 400850 - RNA, 19 nt, Homo sapiens
gauuaacccucgucuagau

SEQ ID NO: 400851 - RNA, 19 nt, Homo sapiens
ucaaagaaguaaggaggua

SEQ ID NO: 400852 - RNA, 19 nt, Homo sapiens
ucacacaaggucuacauua

SEQ ID NO: 400853 - RNA, 19 nt, Homo sapiens
aaacaagugggacauauuu

SEQ ID NO: 400854 - RNA, 19 nt, Homo sapiens
ggaugaagccauuucuaaa

SEQ ID NO: 400855 - RNA, 19 nt, Homo sapiens
caaacaggguaaucuugaa

SEQ ID NO: 400856 - RNA, 19 nt, Homo sapiens
ggaggugauguuauuaaua

SEQ ID NO: 400857 - RNA, 19 nt, Homo sapiens
gugaagauauagaugaaug

SEQ ID NO: 400858 - RNA, 19 nt, Homo sapiens
gaaagauuguaaagaugug

SEQ ID NO: 400859 - RNA, 19 nt, Homo sapiens
ggacaaccacagagggaua

SEQ ID NO: 400860 - RNA, 19 nt, Homo sapiens
aaaggagaaugaacaaaug

SEQ ID NO: 400861 - RNA, 19 nt, Homo sapiens
gaaauucuuacuucucuug

SEQ ID NO: 400862 - RNA, 19 nt, Homo sapiens
aaugugcagucuuugauua

SEQ ID NO: 400863 - RNA, 19 nt, Homo sapiens
uagaaaccaucucccauga

SEQ ID NO: 400864 - RNA, 19 nt, Homo sapiens
gaaagugaacucauuaaac

SEQ ID NO: 400865 - RNA, 19 nt, Homo sapiens
aaguucagcuuaagaauga

SEQ ID NO: 400866 - RNA, 19 nt, Homo sapiens
gaaguucagcuuaagaaug

SEQ ID NO: 400867 - RNA, 19 nt, Homo sapiens
cagaaggcgugauacugua

SEQ ID NO: 400868 - RNA, 19 nt, Homo sapiens
gauaauacaccuggaaguu

SEQ ID NO: 400869 - RNA, 19 nt, Homo sapiens
gugcagucuuugauuauuu

SEQ ID NO: 400870 - RNA, 19 nt, Homo sapiens
gcaaugaagauggauauau

SEQ ID NO: 400871 - RNA, 19 nt, Homo sapiens
gcaaauucuuuacuugaag

SEQ ID NO: 400872 - RNA, 19 nt, Homo sapiens
guacugugaugcauuucaa

SEQ ID NO: 400873 - RNA, 19 nt, Homo sapiens
gauaucagauuagguugga

SEQ ID NO: 400874 - RNA, 19 nt, Homo sapiens
aauaagcauugccugguua

SEQ ID NO: 400875 - RNA, 19 nt, Homo sapiens
caaggagcuucuggaauaa

SEQ ID NO: 400876 - RNA, 19 nt, Homo sapiens
gaagaguugugagguuguu

SEQ ID NO: 400877 - RNA, 19 nt, Homo sapiens
ugaaagagaaugcaucgaa

SEQ ID NO: 400878 - RNA, 19 nt, Homo sapiens
ccacagagggauauaguga

SEQ ID NO: 400879 - RNA, 19 nt, Homo sapiens
guggaagaauuagaacaua

SEQ ID NO: 400880 - RNA, 19 nt, Homo sapiens
cccgaaggcuacagauaua

SEQ ID NO: 400881 - RNA, 19 nt, Homo sapiens
gaugaaggcagaagagaug

SEQ ID NO: 400882 - RNA, 19 nt, Homo sapiens
gagaaugcaucgaagaacu

SEQ ID NO: 400883 - RNA, 19 nt, Homo sapiens
ggaagugaauauuaauggu

SEQ ID NO: 400884 - RNA, 19 nt, Homo sapiens
gaaaacaagugggacauau

SEQ ID NO: 400885 - RNA, 19 nt, Homo sapiens
gaacuagugucuaaauacc

SEQ ID NO: 400886 - RNA, 19 nt, Homo sapiens
ggaucuggaugaagccauu

SEQ ID NO: 400887 - RNA, 19 nt, Homo sapiens
ggacaaagcaaugaaagca

SEQ ID NO: 400888 - RNA, 19 nt, Homo sapiens
ucagaagaguugugagguu

SEQ ID NO: 400889 - RNA, 19 nt, Homo sapiens
guggaugaaugcucuuuga

SEQ ID NO: 400890 - RNA, 19 nt, Homo sapiens
cacaaggucuacauuacaa

SEQ ID NO: 400891 - RNA, 19 nt, Homo sapiens
ugagauaucagauuagguu

SEQ ID NO: 400892 - RNA, 19 nt, Homo sapiens
caucuggaauuuagaguca

SEQ ID NO: 400893 - RNA, 19 nt, Homo sapiens
ccuugaaccuugacacaaa

SEQ ID NO: 400894 - RNA, 19 nt, Homo sapiens
ccaaacaggguaaucuuga

SEQ ID NO: 400895 - RNA, 19 nt, Homo sapiens
gaagagaugguggucuauu

SEQ ID NO: 400896 - RNA, 19 nt, Homo sapiens
gcugugauggauauaaaua

SEQ ID NO: 400897 - RNA, 19 nt, Homo sapiens
aagaagcugugauggauau

SEQ ID NO: 400898 - RNA, 19 nt, Homo sapiens
gaugaaugcucugagaaca

SEQ ID NO: 400899 - RNA, 19 nt, Homo sapiens
gugaauaucguaucauugu

SEQ ID NO: 400900 - RNA, 19 nt, Homo sapiens
gagcagcacaggaaucuuc

SEQ ID NO: 400901 - RNA, 19 nt, Homo sapiens
gaauauuaaugguguacag

SEQ ID NO: 400902 - RNA, 19 nt, Homo sapiens
gaacaugcacuacaauaaa

SEQ ID NO: 400903 - RNA, 19 nt, Homo sapiens
gaaaccacuucauacauuu

SEQ ID NO: 400904 - RNA, 19 nt, Homo sapiens
gcauggauauguuaugaaa

SEQ ID NO: 400905 - RNA, 19 nt, Homo sapiens
uacaagagcugcuucauga

SEQ ID NO: 400906 - RNA, 19 nt, Homo sapiens
ccacuugauugaugacuua

SEQ ID NO: 400907 - RNA, 19 nt, Homo sapiens
gaaaucagcugguaauucc

SEQ ID NO: 400908 - RNA, 19 nt, Homo sapiens
gagaagaguugacauugga

SEQ ID NO: 400909 - RNA, 19 nt, Homo sapiens
ggaagaaggccauauacaa

SEQ ID NO: 400910 - RNA, 19 nt, Homo sapiens
gaagggaauuuguuaacga

SEQ ID NO: 400911 - RNA, 19 nt, Homo sapiens
guacagggcucugaacaug

SEQ ID NO: 400912 - RNA, 19 nt, Homo sapiens
ccaauaugcugaagaccua

SEQ ID NO: 400913 - RNA, 19 nt, Homo sapiens
gcacaacucuacagacagu

SEQ ID NO: 400914 - RNA, 19 nt, Homo sapiens
cgagaaaguuacagagaaa

SEQ ID NO: 400915 - RNA, 19 nt, Homo sapiens
gaagagcugucuauaacca

SEQ ID NO: 400916 - RNA, 19 nt, Homo sapiens
gcacuacaauaaagcaaau

SEQ ID NO: 400917 - RNA, 19 nt, Homo sapiens
guaugaagaugccaugaug

SEQ ID NO: 400918 - RNA, 19 nt, Homo sapiens
gaagaaggccauauacaag

SEQ ID NO: 400919 - RNA, 19 nt, Homo sapiens
ucaagugguuuagcaauuu

SEQ ID NO: 400920 - RNA, 19 nt, Homo sapiens
ggaaauggcugaaaacaag

SEQ ID NO: 400921 - RNA, 19 nt, Homo sapiens
caaugaagggaauuuguua

SEQ ID NO: 400922 - RNA, 19 nt, Homo sapiens
ggagaagaguugacauugg

SEQ ID NO: 400923 - RNA, 19 nt, Homo sapiens
ugacagcacagcccucuua

SEQ ID NO: 400924 - RNA, 19 nt, Homo sapiens
gcaaugaagggaauuuguu

SEQ ID NO: 400925 - RNA, 19 nt, Homo sapiens
cuuaacauuuggacacuua

SEQ ID NO: 400926 - RNA, 19 nt, Homo sapiens
ccuaagaggucccgggauu

SEQ ID NO: 400927 - RNA, 19 nt, Homo sapiens
ugucugaaauaucaccuua

SEQ ID NO: 400928 - RNA, 19 nt, Homo sapiens
cagcacaacucuacagaca

SEQ ID NO: 400929 - RNA, 19 nt, Homo sapiens
ggaaguugcucagaucaca

SEQ ID NO: 400930 - RNA, 19 nt, Homo sapiens
acauucagauggagaagua

SEQ ID NO: 400931 - RNA, 19 nt, Homo sapiens
gaaggcaacaacaaagaaa

SEQ ID NO: 400932 - RNA, 19 nt, Homo sapiens
ugauauggaucgcuuaugu

SEQ ID NO: 400933 - RNA, 19 nt, Homo sapiens
gaaaagagccucccauuac

SEQ ID NO: 400934 - RNA, 19 nt, Homo sapiens
gcaaggggaugguuguuuu

SEQ ID NO: 400935 - RNA, 19 nt, Homo sapiens
guagaaauuucaacaacuc

SEQ ID NO: 400936 - RNA, 19 nt, Homo sapiens
gaagagggcgaacucguau

SEQ ID NO: 400937 - RNA, 19 nt, Homo sapiens
guuaugaaaucagcuggua

SEQ ID NO: 400938 - RNA, 19 nt, Homo sapiens
caaguuauaugugucuaga

SEQ ID NO: 400939 - RNA, 19 nt, Homo sapiens
ccucucagcucaucaagug

SEQ ID NO: 400940 - RNA, 19 nt, Homo sapiens
gaacugaacacugccaugu

SEQ ID NO: 400941 - RNA, 19 nt, Homo sapiens
gaggauauaugcagcaacu

SEQ ID NO: 400942 - RNA, 19 nt, Homo sapiens
gaacucaaucaguagcuuu

SEQ ID NO: 400943 - RNA, 19 nt, Homo sapiens
caucacguuucucucauuu

SEQ ID NO: 400944 - RNA, 19 nt, Homo sapiens
caauaaccguccagugaug

SEQ ID NO: 400945 - RNA, 19 nt, Homo sapiens
cacaauaaccguccaguga

SEQ ID NO: 400946 - RNA, 19 nt, Homo sapiens
gaguagaaauuucaacaac

SEQ ID NO: 400947 - RNA, 19 nt, Homo sapiens
gaucagagagcaggaaaug

SEQ ID NO: 400948 - RNA, 19 nt, Homo sapiens
gcacugucuuguucuugaa

SEQ ID NO: 400949 - RNA, 19 nt, Homo sapiens
ccgagaaaguuacagagaa

SEQ ID NO: 400950 - RNA, 19 nt, Homo sapiens
gaggagaagaguugacauu

SEQ ID NO: 400951 - RNA, 19 nt, Homo sapiens
uguaaagucucuauuagca

SEQ ID NO: 400952 - RNA, 19 nt, Homo sapiens
ucugcaagcuggauaguga

SEQ ID NO: 400953 - RNA, 19 nt, Homo sapiens
gagaaggcaacaacaaaga

SEQ ID NO: 400954 - RNA, 19 nt, Homo sapiens
cugaagagcugucuauaac

SEQ ID NO: 400955 - RNA, 19 nt, Homo sapiens
ggacaccuuuggcaaugug

SEQ ID NO: 400956 - RNA, 19 nt, Homo sapiens
gcgagaaggcaacaacaaa

SEQ ID NO: 400957 - RNA, 19 nt, Homo sapiens
gacguaaaguucaacagau

SEQ ID NO: 400958 - RNA, 19 nt, Homo sapiens
gaaaaguucuaccaaaucu

SEQ ID NO: 400959 - RNA, 19 nt, Homo sapiens
acuaugagccaguuugaua

SEQ ID NO: 400960 - RNA, 19 nt, Homo sapiens
ucagacccguguaaacauu

SEQ ID NO: 400961 - RNA, 19 nt, Homo sapiens
uauacaaggucaucugcaa

SEQ ID NO: 400962 - RNA, 19 nt, Homo sapiens
ugaacaugcacuacaauaa

SEQ ID NO: 400963 - RNA, 19 nt, Homo sapiens
guacugaagagcugucuau

SEQ ID NO: 400964 - RNA, 19 nt, Homo sapiens
ggccagauuugcagucaau

SEQ ID NO: 400965 - RNA, 19 nt, Homo sapiens
ccaaaaggccaaauuaaaa

SEQ ID NO: 400966 - RNA, 19 nt, Homo sapiens
ugaagagggcgaacucgua

SEQ ID NO: 400967 - RNA, 19 nt, Homo sapiens
uaauuccaaugacagauga

SEQ ID NO: 400968 - RNA, 19 nt, Homo sapiens
cuugauugaugacuuauug

SEQ ID NO: 400969 - RNA, 19 nt, Homo sapiens
guguguaaagucucuauua

SEQ ID NO: 400970 - RNA, 19 nt, Homo sapiens
gcuagacccaggacaguuu

SEQ ID NO: 400971 - RNA, 19 nt, Homo sapiens
ugagcaggauguugaguau

SEQ ID NO: 400972 - RNA, 19 nt, Homo sapiens
aagagcugcuucaugagua

SEQ ID NO: 400973 - RNA, 19 nt, Homo sapiens
acagaugcauuaccucuca

SEQ ID NO: 400974 - RNA, 19 nt, Homo sapiens
gaugguaaccugucugaag

SEQ ID NO: 400975 - RNA, 19 nt, Homo sapiens
gaaaacaaacgcaagcaaa

SEQ ID NO: 400976 - RNA, 19 nt, Homo sapiens
guucugagcaggauguuga

SEQ ID NO: 400977 - RNA, 19 nt, Homo sapiens
agugaugugucucuuguuu

SEQ ID NO: 400978 - RNA, 19 nt, Homo sapiens
gggccaaacuccuuacaac

SEQ ID NO: 400979 - RNA, 19 nt, Homo sapiens
gaugagcaccugagagcaa

SEQ ID NO: 400980 - RNA, 19 nt, Homo sapiens
cgacguaaaguucaacaga

SEQ ID NO: 400981 - RNA, 19 nt, Homo sapiens
aagaugccaugaugccuuu

SEQ ID NO: 400982 - RNA, 19 nt, Homo sapiens
gaugacuuauugcaaaugg

SEQ ID NO: 400983 - RNA, 19 nt, Homo sapiens
gcaauuuccgugaguuuua

SEQ ID NO: 400984 - RNA, 19 nt, Homo sapiens
caagugguuuagcaauuuc

SEQ ID NO: 400985 - RNA, 19 nt, Homo sapiens
caacaaagaaagagaccau

SEQ ID NO: 400986 - RNA, 19 nt, Homo sapiens
cgaaguacaucaggaggau

SEQ ID NO: 400987 - RNA, 19 nt, Homo sapiens
ccaggagcaaccauaauuu

SEQ ID NO: 400988 - RNA, 19 nt, Homo sapiens
cuaagaaggucugaaaauu

SEQ ID NO: 400989 - RNA, 19 nt, Homo sapiens
uaacgaugcauccacuuga

SEQ ID NO: 400990 - RNA, 19 nt, Homo sapiens
gggaggcauggauauguua

SEQ ID NO: 400991 - RNA, 19 nt, Homo sapiens
ccacgagucugaggaccaa

SEQ ID NO: 400992 - RNA, 19 nt, Homo sapiens
ggaauuuguuaacgaugca

SEQ ID NO: 400993 - RNA, 19 nt, Homo sapiens
aaacuccucugaccagucu

SEQ ID NO: 400994 - RNA, 19 nt, Homo sapiens
gcaacaacaaagaaagaga

SEQ ID NO: 400995 - RNA, 19 nt, Homo sapiens
gcacugauucggaaaauga

SEQ ID NO: 400996 - RNA, 19 nt, Homo sapiens
ugacacagcacaacucuac

SEQ ID NO: 400997 - RNA, 19 nt, Homo sapiens
aaagaauguuggcgugugu

SEQ ID NO: 400998 - RNA, 19 nt, Homo sapiens
ggggaugguuguuuucuuu

SEQ ID NO: 400999 - RNA, 19 nt, Homo sapiens
cagcucaucaagugguuua

SEQ ID NO: 401000 - RNA, 19 nt, Homo sapiens
uaucccagcuccaauaugc

SEQ ID NO: 401001 - RNA, 19 nt, Homo sapiens
ggucagauaaugagaugug

SEQ ID NO: 401002 - RNA, 19 nt, Homo sapiens
gcagugagcuggacaaguc

SEQ ID NO: 401003 - RNA, 19 nt, Homo sapiens
uaagaccacuccugaauug

SEQ ID NO: 401004 - RNA, 19 nt, Homo sapiens
ggaagacgguucugaucaa

SEQ ID NO: 401005 - RNA, 19 nt, Homo sapiens
ggucugaguuucacauuug

SEQ ID NO: 401006 - RNA, 19 nt, Homo sapiens
gaacuagagcgcaagauug

SEQ ID NO: 401007 - RNA, 19 nt, Homo sapiens
ggaacuagagcgcaagauu

SEQ ID NO: 401008 - RNA, 19 nt, Homo sapiens
ugacagagucccagaagga

SEQ ID NO: 401009 - RNA, 19 nt, Homo sapiens
gaagacgguucugaucaag

SEQ ID NO: 401010 - RNA, 19 nt, Homo sapiens
caaauaaaaugcugucaag

SEQ ID NO: 401011 - RNA, 19 nt, Homo sapiens
uugagucucugauggauga

SEQ ID NO: 401012 - RNA, 19 nt, Homo sapiens
gggucugaguuucacauuu

SEQ ID NO: 401013 - RNA, 19 nt, Homo sapiens
gcaucccuuuccuggcuua

SEQ ID NO: 401014 - RNA, 19 nt, Homo sapiens
cgccagauccagagucuaa

SEQ ID NO: 401015 - RNA, 19 nt, Homo sapiens
aaaaugcugucaagagaaa

SEQ ID NO: 401016 - RNA, 19 nt, Homo sapiens
gcggaggagugguacaagu

SEQ ID NO: 401017 - RNA, 19 nt, Homo sapiens
caagauugagucucugaug

SEQ ID NO: 401018 - RNA, 19 nt, Homo sapiens
gaccacuccugaauugucu

SEQ ID NO: 401019 - RNA, 19 nt, Homo sapiens
cuaagaccacuccugaauu

SEQ ID NO: 401020 - RNA, 19 nt, Homo sapiens
ccuaagaccacuccugaau

SEQ ID NO: 401021 - RNA, 19 nt, Homo sapiens
guucugaucaagaccauug

SEQ ID NO: 401022 - RNA, 19 nt, Homo sapiens
acaucgagaucgccaccua

SEQ ID NO: 401023 - RNA, 19 nt, Homo sapiens
cacuugaugugaccuaugu

SEQ ID NO: 401024 - RNA, 19 nt, Homo sapiens
gagccagggucugaguuuc

SEQ ID NO: 401025 - RNA, 19 nt, Homo sapiens
uuucaugucccgauaagaa

SEQ ID NO: 401026 - RNA, 19 nt, Homo sapiens
agaaggagcagcgcaguga

SEQ ID NO: 401027 - RNA, 19 nt, Homo sapiens
gauugagucucugauggau

SEQ ID NO: 401028 - RNA, 19 nt, Homo sapiens
caagucuucugcccacagu

SEQ ID NO: 401029 - RNA, 19 nt, Homo sapiens
agucuucugcccacaguua

SEQ ID NO: 401030 - RNA, 19 nt, Homo sapiens
auaaaaugcugucaagaga

SEQ ID NO: 401031 - RNA, 19 nt, Homo sapiens
ccaagcaggagaugaacga

SEQ ID NO: 401032 - RNA, 19 nt, Homo sapiens
ucccugcccugacacuuga

SEQ ID NO: 401033 - RNA, 19 nt, Homo sapiens
ucuuuugccuccuuaaaua

SEQ ID NO: 401034 - RNA, 19 nt, Homo sapiens
caucgagaagguacgcuuu

SEQ ID NO: 401035 - RNA, 19 nt, Homo sapiens
aacuagagcgcaagauuga

SEQ ID NO: 401036 - RNA, 19 nt, Homo sapiens
gcccugacacuugauguga

SEQ ID NO: 401037 - RNA, 19 nt, Homo sapiens
gcccuaggccugcucaaag

SEQ ID NO: 401038 - RNA, 19 nt, Homo sapiens
agacgguucugaucaagac

SEQ ID NO: 401039 - RNA, 19 nt, Homo sapiens
cggaagacgguucugauca

SEQ ID NO: 401040 - RNA, 19 nt, Homo sapiens
gacacuugaugugaccuau

SEQ ID NO: 401041 - RNA, 19 nt, Homo sapiens
gacgccagauccagagucu

SEQ ID NO: 401042 - RNA, 19 nt, Homo sapiens
ugagccagggucugaguuu

SEQ ID NO: 401043 - RNA, 19 nt, Homo sapiens
caaagcccaaacccuaaga

SEQ ID NO: 401044 - RNA, 19 nt, Homo sapiens
ucgccaacuucaucgagaa

SEQ ID NO: 401045 - RNA, 19 nt, Homo sapiens
ccgauaagaagccaaugau

SEQ ID NO: 401046 - RNA, 19 nt, Homo sapiens
gcuccucaacgucaagaug

SEQ ID NO: 401047 - RNA, 19 nt, Homo sapiens
uggaugagauugaguuccu

SEQ ID NO: 401048 - RNA, 19 nt, Homo sapiens
caaggucuaugcuaaauua

SEQ ID NO: 401049 - RNA, 19 nt, Homo sapiens
gcaaagcgcuugguauuga

SEQ ID NO: 401050 - RNA, 19 nt, Homo sapiens
gagaacaacuagcaacaaa

SEQ ID NO: 401051 - RNA, 19 nt, Homo sapiens
gaacugcacuauugucuca

SEQ ID NO: 401052 - RNA, 19 nt, Homo sapiens
gaaagacggauugagauua

SEQ ID NO: 401053 - RNA, 19 nt, Homo sapiens
gcaagguggugacuaagaa

SEQ ID NO: 401054 - RNA, 19 nt, Homo sapiens
gcaaauaugcuaucuguag

SEQ ID NO: 401055 - RNA, 19 nt, Homo sapiens
aaagacggauugagauuaa

SEQ ID NO: 401056 - RNA, 19 nt, Homo sapiens
gaagaaggccaaugaagug

SEQ ID NO: 401057 - RNA, 19 nt, Homo sapiens
ggacuuaucucagaaaauu

SEQ ID NO: 401058 - RNA, 19 nt, Homo sapiens
gaugacaaauucagcagaa

SEQ ID NO: 401059 - RNA, 19 nt, Homo sapiens
ugacauggcugacacuugu

SEQ ID NO: 401060 - RNA, 19 nt, Homo sapiens
cagccaagcuuguugcaaa

SEQ ID NO: 401061 - RNA, 19 nt, Homo sapiens
cagcagccgugaucgcuua

SEQ ID NO: 401062 - RNA, 19 nt, Homo sapiens
uggaggaacugcacuauug

SEQ ID NO: 401063 - RNA, 19 nt, Homo sapiens
gcaaacaugcuuccugcua

SEQ ID NO: 401064 - RNA, 19 nt, Homo sapiens
caaacaugcuuccugcuau

SEQ ID NO: 401065 - RNA, 19 nt, Homo sapiens
ggaaagacggauugagauu

SEQ ID NO: 401066 - RNA, 19 nt, Homo sapiens
caggagaacucacaaugga

SEQ ID NO: 401067 - RNA, 19 nt, Homo sapiens
ggaagaaggccaaugaagu

SEQ ID NO: 401068 - RNA, 19 nt, Homo sapiens
gcaggugcagaucauauua

SEQ ID NO: 401069 - RNA, 19 nt, Homo sapiens
ucaucuaucuugauccuuu

SEQ ID NO: 401070 - RNA, 19 nt, Homo sapiens
cauucuggcuuccuugaua

SEQ ID NO: 401071 - RNA, 19 nt, Homo sapiens
ccaugucccuuuauaauag

SEQ ID NO: 401072 - RNA, 19 nt, Homo sapiens
ggaccuacaugcuucucaa

SEQ ID NO: 401073 - RNA, 19 nt, Homo sapiens
gggaagcucagacuacuuu

SEQ ID NO: 401074 - RNA, 19 nt, Homo sapiens
ccaugcagcugacaaacuu

SEQ ID NO: 401075 - RNA, 19 nt, Homo sapiens
ccuugcagcuuuaacuaua

SEQ ID NO: 401076 - RNA, 19 nt, Homo sapiens
gcaguaguagucaccaaua

SEQ ID NO: 401077 - RNA, 19 nt, Homo sapiens
cuacaugcuucucaaauuc

SEQ ID NO: 401078 - RNA, 19 nt, Homo sapiens
caccaggacuuaucucaga

SEQ ID NO: 401079 - RNA, 19 nt, Homo sapiens
agaggaaacuaauaaagug

SEQ ID NO: 401080 - RNA, 19 nt, Homo sapiens
guaccuaucccuuucgauu

SEQ ID NO: 401081 - RNA, 19 nt, Homo sapiens
ccuacaugcuucucaaauu

SEQ ID NO: 401082 - RNA, 19 nt, Homo sapiens
uaggcaagguggugacuaa

SEQ ID NO: 401083 - RNA, 19 nt, Homo sapiens
ggaaacuaauaaagugugu

SEQ ID NO: 401084 - RNA, 19 nt, Homo sapiens
cgauuuggcuuuaccuuca

SEQ ID NO: 401085 - RNA, 19 nt, Homo sapiens
gaacaacuagcaacaaagg

SEQ ID NO: 401086 - RNA, 19 nt, Homo sapiens
caucuugacucauggaauc

SEQ ID NO: 401087 - RNA, 19 nt, Homo sapiens
gccaugucccuuuauaaua

SEQ ID NO: 401088 - RNA, 19 nt, Homo sapiens
gcagaagccaucaggagaa

SEQ ID NO: 401089 - RNA, 19 nt, Homo sapiens
gauuaaugccugcaagauu

SEQ ID NO: 401090 - RNA, 19 nt, Homo sapiens
uagcuuggauucuccuuug

SEQ ID NO: 401091 - RNA, 19 nt, Homo sapiens
cagacuacuuuguauguga

SEQ ID NO: 401092 - RNA, 19 nt, Homo sapiens
gcugcaagauuucagacuu

SEQ ID NO: 401093 - RNA, 19 nt, Homo sapiens
ucagccaugucccuuuaua

SEQ ID NO: 401094 - RNA, 19 nt, Homo sapiens
uaaaguggauaagggagaa

SEQ ID NO: 401095 - RNA, 19 nt, Homo sapiens
ccaagcuuguugcaaauau

SEQ ID NO: 401096 - RNA, 19 nt, Homo sapiens
ucccacaucagguauauua

SEQ ID NO: 401097 - RNA, 19 nt, Homo sapiens
cuaccugcauuaucucauu

SEQ ID NO: 401098 - RNA, 19 nt, Homo sapiens
cuacaucccacaucaggua

SEQ ID NO: 401099 - RNA, 19 nt, Homo sapiens
caacaacgcaugcuuugag

SEQ ID NO: 401100 - RNA, 19 nt, Homo sapiens
gauguuauugucucuugua

SEQ ID NO: 401101 - RNA, 19 nt, Homo sapiens
aaacaugcuuccugcuaug

SEQ ID NO: 401102 - RNA, 19 nt, Homo sapiens
auuaaugccugcaagauug

SEQ ID NO: 401103 - RNA, 19 nt, Homo sapiens
cugcaagauuucagacuuu

SEQ ID NO: 401104 - RNA, 19 nt, Homo sapiens
ggaccuccuaccugcauua

SEQ ID NO: 401105 - RNA, 19 nt, Homo sapiens
gugauugacaucucuauga

SEQ ID NO: 401106 - RNA, 19 nt, Homo sapiens
caucaacaacgcaugcuuu

SEQ ID NO: 401107 - RNA, 19 nt, Homo sapiens
ggcaggauaagaaagauaa

SEQ ID NO: 401108 - RNA, 19 nt, Homo sapiens
caugcuuccugcuauguaa

SEQ ID NO: 401109 - RNA, 19 nt, Homo sapiens
aggacaagaugaagcauug

SEQ ID NO: 401110 - RNA, 19 nt, Homo sapiens
cagaguuuaugccaucuug

SEQ ID NO: 401111 - RNA, 19 nt, Homo sapiens
uugcaaauaugcuaucugu

SEQ ID NO: 401112 - RNA, 19 nt, Homo sapiens
ggaucuauuuggccucuca

SEQ ID NO: 401113 - RNA, 19 nt, Homo sapiens
ccuccuaccugcauuaucu

SEQ ID NO: 401114 - RNA, 19 nt, Homo sapiens
ccacaucagguauauuaga

SEQ ID NO: 401115 - RNA, 19 nt, Homo sapiens
ugacaucucuaugauccuu

SEQ ID NO: 401116 - RNA, 19 nt, Homo sapiens
guaccauagucuucuggaa

SEQ ID NO: 401117 - RNA, 19 nt, Homo sapiens
auucagccaugucccuuua

SEQ ID NO: 401118 - RNA, 19 nt, Homo sapiens
aaauacaggugauugacau

SEQ ID NO: 401119 - RNA, 19 nt, Homo sapiens
gaacauuguaccauagucu

SEQ ID NO: 401120 - RNA, 19 nt, Homo sapiens
aagcucagacuacuuugua

SEQ ID NO: 401121 - RNA, 19 nt, Homo sapiens
ugauugacaucucuaugau

SEQ ID NO: 401122 - RNA, 19 nt, Homo sapiens
gacuuugccuugauucaca

SEQ ID NO: 401123 - RNA, 19 nt, Homo sapiens
acuauugucucaccugaug

SEQ ID NO: 401124 - RNA, 19 nt, Homo sapiens
caagcuuguugcaaauaug

SEQ ID NO: 401125 - RNA, 19 nt, Homo sapiens
cguagugccuuuugauuaa

SEQ ID NO: 401126 - RNA, 19 nt, Homo sapiens
gguuuuaggugguaucgua

SEQ ID NO: 401127 - RNA, 19 nt, Homo sapiens
cagaucauauuaucaccau

SEQ ID NO: 401128 - RNA, 19 nt, Homo sapiens
guagaggaaacuaauaaag

SEQ ID NO: 401129 - RNA, 19 nt, Homo sapiens
agacuacuuuguaugugaa

SEQ ID NO: 401130 - RNA, 19 nt, Homo sapiens
ugaggguguuugacuguga

SEQ ID NO: 401131 - RNA, 19 nt, Homo sapiens
gaugugcuguagcuugauc

SEQ ID NO: 401132 - RNA, 19 nt, Homo sapiens
gccaggaugccgaauauca

SEQ ID NO: 401133 - RNA, 19 nt, Homo sapiens
gcuccaguguagcuuucua

SEQ ID NO: 401134 - RNA, 19 nt, Homo sapiens
ugacaaauucagcagaaga

SEQ ID NO: 401135 - RNA, 19 nt, Homo sapiens
uggccaggaugccgaauau

SEQ ID NO: 401136 - RNA, 19 nt, Homo sapiens
gaggacaagaugaagcauu

SEQ ID NO: 401137 - RNA, 19 nt, Homo sapiens
gaucuuccuuagccuacug

SEQ ID NO: 401138 - RNA, 19 nt, Homo sapiens
uaccauagucuucuggaaa

SEQ ID NO: 401139 - RNA, 19 nt, Homo sapiens
ggcuuuaccuucaucuauc

SEQ ID NO: 401140 - RNA, 19 nt, Homo sapiens
ggauucuccuuuguaccua

SEQ ID NO: 401141 - RNA, 19 nt, Homo sapiens
gggaaagacggauugagau

SEQ ID NO: 401142 - RNA, 19 nt, Homo sapiens
gaauccguuucuuaccuau

SEQ ID NO: 401143 - RNA, 19 nt, Homo sapiens
uaugccaucuugacucaug

SEQ ID NO: 401144 - RNA, 19 nt, Homo sapiens
gagagugaccuccauugca

SEQ ID NO: 401145 - RNA, 19 nt, Homo sapiens
acgcaaagcgcuugguauu

SEQ ID NO: 401146 - RNA, 19 nt, Homo sapiens
ccugcuauguaauugcuaa

SEQ ID NO: 401147 - RNA, 19 nt, Homo sapiens
caucccacaucagguauau

SEQ ID NO: 401148 - RNA, 19 nt, Homo sapiens
gaucauuucuuuccaguuu

SEQ ID NO: 401149 - RNA, 19 nt, Homo sapiens
uaagugagaccaccaaaua

SEQ ID NO: 401150 - RNA, 19 nt, Homo sapiens
gaagaacuguaucauuguu

SEQ ID NO: 401151 - RNA, 19 nt, Homo sapiens
ucaacuagauucaggagua

SEQ ID NO: 401152 - RNA, 19 nt, Homo sapiens
auacagggauucuuugaua

SEQ ID NO: 401153 - RNA, 19 nt, Homo sapiens
uggaagaacuguaucauug

SEQ ID NO: 401154 - RNA, 19 nt, Homo sapiens
aaacauaacugucacuuac

SEQ ID NO: 401155 - RNA, 19 nt, Homo sapiens
gcaagguggucacgaagaa

SEQ ID NO: 401156 - RNA, 19 nt, Homo sapiens
auucagaccuugacuauuu

SEQ ID NO: 401157 - RNA, 19 nt, Homo sapiens
ccaacugacuuaaagguaa

SEQ ID NO: 401158 - RNA, 19 nt, Homo sapiens
caucagaucuuuguauaug

SEQ ID NO: 401159 - RNA, 19 nt, Homo sapiens
ggacuuagccacacacaau

SEQ ID NO: 401160 - RNA, 19 nt, Homo sapiens
gaucaaugccugcaagauu

SEQ ID NO: 401161 - RNA, 19 nt, Homo sapiens
gauacuacaucaacuagau

SEQ ID NO: 401162 - RNA, 19 nt, Homo sapiens
ggugaucucuuccuuuguu

SEQ ID NO: 401163 - RNA, 19 nt, Homo sapiens
caaaguguaugcuauccuu

SEQ ID NO: 401164 - RNA, 19 nt, Homo sapiens
gaagaaggcgaaugaagug

SEQ ID NO: 401165 - RNA, 19 nt, Homo sapiens
caaaggugaugaagacugu

SEQ ID NO: 401166 - RNA, 19 nt, Homo sapiens
gaaauucagaccuugacua

SEQ ID NO: 401167 - RNA, 19 nt, Homo sapiens
uauggacacugacacauuu

SEQ ID NO: 401168 - RNA, 19 nt, Homo sapiens
uaaauaaugccgccuuuga

SEQ ID NO: 401169 - RNA, 19 nt, Homo sapiens
ggaagaaggcgaaugaagu

SEQ ID NO: 401170 - RNA, 19 nt, Homo sapiens
ugaacugucuuaaaugaga

SEQ ID NO: 401171 - RNA, 19 nt, Homo sapiens
gaaccugcauugucauucu

SEQ ID NO: 401172 - RNA, 19 nt, Homo sapiens
caggugaucucuuccuuug

SEQ ID NO: 401173 - RNA, 19 nt, Homo sapiens
cuaagaauguauagagcua

SEQ ID NO: 401174 - RNA, 19 nt, Homo sapiens
gaacugucuuaaaugagaa

SEQ ID NO: 401175 - RNA, 19 nt, Homo sapiens
caaacacaauuccgcaaga

SEQ ID NO: 401176 - RNA, 19 nt, Homo sapiens
gaccagcuauuuccagaau

SEQ ID NO: 401177 - RNA, 19 nt, Homo sapiens
gugguuauuuggucuuuaa

SEQ ID NO: 401178 - RNA, 19 nt, Homo sapiens
cagaguaacugccgugauc

SEQ ID NO: 401179 - RNA, 19 nt, Homo sapiens
gaauguauagagcuaguuu

SEQ ID NO: 401180 - RNA, 19 nt, Homo sapiens
auuaaagccuucuguguaa

SEQ ID NO: 401181 - RNA, 19 nt, Homo sapiens
gcaccaagauucaggucau

SEQ ID NO: 401182 - RNA, 19 nt, Homo sapiens
ccaccaaaguguaugcuau

SEQ ID NO: 401183 - RNA, 19 nt, Homo sapiens
ggguggaccuggcauuuau

SEQ ID NO: 401184 - RNA, 19 nt, Homo sapiens
cguggaaacuuaagugaga

SEQ ID NO: 401185 - RNA, 19 nt, Homo sapiens
caauggaaauucagaccuu

SEQ ID NO: 401186 - RNA, 19 nt, Homo sapiens
guaaaacccuguauagaau

SEQ ID NO: 401187 - RNA, 19 nt, Homo sapiens
gggaaaugguggugguuau

SEQ ID NO: 401188 - RNA, 19 nt, Homo sapiens
guaaucauuucagcuaaga

SEQ ID NO: 401189 - RNA, 19 nt, Homo sapiens
caacugacuuaaagguaau

SEQ ID NO: 401190 - RNA, 19 nt, Homo sapiens
guguauuucuggaucauuu

SEQ ID NO: 401191 - RNA, 19 nt, Homo sapiens
gauauaggaaccugcauug

SEQ ID NO: 401192 - RNA, 19 nt, Homo sapiens
gaucuuggccgaagcaauc

SEQ ID NO: 401193 - RNA, 19 nt, Homo sapiens
ggguauacauuagacauau

SEQ ID NO: 401194 - RNA, 19 nt, Homo sapiens
ucagauacagggauucuuu

SEQ ID NO: 401195 - RNA, 19 nt, Homo sapiens
caacuagauucaggaguau

SEQ ID NO: 401196 - RNA, 19 nt, Homo sapiens
aacaggagccagagaaaua

SEQ ID NO: 401197 - RNA, 19 nt, Homo sapiens
uuacugugcuuaauuugga

SEQ ID NO: 401198 - RNA, 19 nt, Homo sapiens
auucagcaaugauagguua

SEQ ID NO: 401199 - RNA, 19 nt, Homo sapiens
gaaacacugcaccaagauu

SEQ ID NO: 401200 - RNA, 19 nt, Homo sapiens
cagguugaauguggaauuu

SEQ ID NO: 401201 - RNA, 19 nt, Homo sapiens
agugaacugucuuaaauga

SEQ ID NO: 401202 - RNA, 19 nt, Homo sapiens
guuauuuggucuuuaagug

SEQ ID NO: 401203 - RNA, 19 nt, Homo sapiens
cuaaagcucaagaucauuu

SEQ ID NO: 401204 - RNA, 19 nt, Homo sapiens
gaauguggaauuugcuuug

SEQ ID NO: 401205 - RNA, 19 nt, Homo sapiens
gaauuaagaacugaugguu

SEQ ID NO: 401206 - RNA, 19 nt, Homo sapiens
auaggaaccugcauuguca

SEQ ID NO: 401207 - RNA, 19 nt, Homo sapiens
caaaaggguuacaucaauu

SEQ ID NO: 401208 - RNA, 19 nt, Homo sapiens
ggaagaacuguaucauugu

SEQ ID NO: 401209 - RNA, 19 nt, Homo sapiens
aaagccaacugacuuaaag

SEQ ID NO: 401210 - RNA, 19 nt, Homo sapiens
ccuaaagccaacugacuua

SEQ ID NO: 401211 - RNA, 19 nt, Homo sapiens
gguaaaacccuguauagaa

SEQ ID NO: 401212 - RNA, 19 nt, Homo sapiens
ggaaaugguggugguuauu

SEQ ID NO: 401213 - RNA, 19 nt, Homo sapiens
auuaagaacugaugguuuc

SEQ ID NO: 401214 - RNA, 19 nt, Homo sapiens
ggauauaggaaccugcauu

SEQ ID NO: 401215 - RNA, 19 nt, Homo sapiens
aauaaauaaugccgccuuu

SEQ ID NO: 401216 - RNA, 19 nt, Homo sapiens
ccaaaaggguuacaucaau

SEQ ID NO: 401217 - RNA, 19 nt, Homo sapiens
ccugcaugcuucucagaua

SEQ ID NO: 401218 - RNA, 19 nt, Homo sapiens
gcaguguauuucuggauca

SEQ ID NO: 401219 - RNA, 19 nt, Homo sapiens
gugcuuguauugguuuaaa

SEQ ID NO: 401220 - RNA, 19 nt, Homo sapiens
uuguuuagccuccaacuua

SEQ ID NO: 401221 - RNA, 19 nt, Homo sapiens
uaaagccaacugacuuaaa

SEQ ID NO: 401222 - RNA, 19 nt, Homo sapiens
agcaucagaucuuuguaua

SEQ ID NO: 401223 - RNA, 19 nt, Homo sapiens
ccauacgcccgacaagaua

SEQ ID NO: 401224 - RNA, 19 nt, Homo sapiens
gguaaucauuucagcuaag

SEQ ID NO: 401225 - RNA, 19 nt, Homo sapiens
ugguuacugugcuuaauuu

SEQ ID NO: 401226 - RNA, 19 nt, Homo sapiens
uagccuccaacuuaaauua

SEQ ID NO: 401227 - RNA, 19 nt, Homo sapiens
uaucagagcaguguauuuc

SEQ ID NO: 401228 - RNA, 19 nt, Homo sapiens
agccuucuguguaaauaua

SEQ ID NO: 401229 - RNA, 19 nt, Homo sapiens
aaagccuucuguguaaaua

SEQ ID NO: 401230 - RNA, 19 nt, Homo sapiens
agaggaagaaggcgaauga

SEQ ID NO: 401231 - RNA, 19 nt, Homo sapiens
ucugacuucugacuuguuu

SEQ ID NO: 401232 - RNA, 19 nt, Homo sapiens
gcaagccuacucugacuuc

SEQ ID NO: 401233 - RNA, 19 nt, Homo sapiens
cuccuggcguggaaacuua

SEQ ID NO: 401234 - RNA, 19 nt, Homo sapiens
gagugaaccuuggaaaauu

SEQ ID NO: 401235 - RNA, 19 nt, Homo sapiens
uuguggaagucauaguuua

SEQ ID NO: 401236 - RNA, 19 nt, Homo sapiens
ucagccaugucccgcuaua

SEQ ID NO: 401237 - RNA, 19 nt, Homo sapiens
gcagugcuuguauugguuu

SEQ ID NO: 401238 - RNA, 19 nt, Homo sapiens
uguuuagccuccaacuuaa

SEQ ID NO: 401239 - RNA, 19 nt, Homo sapiens
ucacgaagaaguucagcaa

SEQ ID NO: 401240 - RNA, 19 nt, Homo sapiens
cgaagaaguucagcaacca

SEQ ID NO: 401241 - RNA, 19 nt, Homo sapiens
ccaagauucaggucauuga

SEQ ID NO: 401242 - RNA, 19 nt, Homo sapiens
augaaacacugcaccaaga

SEQ ID NO: 401243 - RNA, 19 nt, Homo sapiens
guggaagucauaguuuaua

SEQ ID NO: 401244 - RNA, 19 nt, Homo sapiens
gaacuguaucauuguuuca

SEQ ID NO: 401245 - RNA, 19 nt, Homo sapiens
ccucuaacacuguacuaaa

SEQ ID NO: 401246 - RNA, 19 nt, Homo sapiens
ggagcagcuuaaucccaaa

SEQ ID NO: 401247 - RNA, 19 nt, Homo sapiens
aaauucagaccuugacuau

SEQ ID NO: 401248 - RNA, 19 nt, Homo sapiens
agacagagcuaauggauaa

SEQ ID NO: 401249 - RNA, 19 nt, Homo sapiens
gcucugaaguugcaaauaa

SEQ ID NO: 401250 - RNA, 19 nt, Homo sapiens
ggaagucuguuguauauca

SEQ ID NO: 401251 - RNA, 19 nt, Homo sapiens
gaaacagccuggaguuaga

SEQ ID NO: 401252 - RNA, 19 nt, Homo sapiens
gcacggaacuggacaugga

SEQ ID NO: 401253 - RNA, 19 nt, Homo sapiens
caucagcccuguuccuuaa

SEQ ID NO: 401254 - RNA, 19 nt, Homo sapiens
aaaggcacauaaagucuua

SEQ ID NO: 401255 - RNA, 19 nt, Homo sapiens
ggaaauggagguauugaug

SEQ ID NO: 401256 - RNA, 19 nt, Homo sapiens
cgaauacugucccucauga

SEQ ID NO: 401257 - RNA, 19 nt, Homo sapiens
aaagagaagccaccgauaa

SEQ ID NO: 401258 - RNA, 19 nt, Homo sapiens
ggaguuaaaggcacauaaa

SEQ ID NO: 401259 - RNA, 19 nt, Homo sapiens
gagagaggcgccuauaaga

SEQ ID NO: 401260 - RNA, 19 nt, Homo sapiens
ccgcggagauccugaaaga

SEQ ID NO: 401261 - RNA, 19 nt, Homo sapiens
uuccaaggaugucagauua

SEQ ID NO: 401262 - RNA, 19 nt, Homo sapiens
ccagggaaauggagguauu

SEQ ID NO: 401263 - RNA, 19 nt, Homo sapiens
aguucuagcugcuuucuua

SEQ ID NO: 401264 - RNA, 19 nt, Homo sapiens
gaagaagacagagcuaaug

SEQ ID NO: 401265 - RNA, 19 nt, Homo sapiens
cagagcuaauggauaaaua

SEQ ID NO: 401266 - RNA, 19 nt, Homo sapiens
ccaaggaugucagauuaga

SEQ ID NO: 401267 - RNA, 19 nt, Homo sapiens
gaaauggagguauugaugu

SEQ ID NO: 401268 - RNA, 19 nt, Homo sapiens
gcacauaaagucuuaacuc

SEQ ID NO: 401269 - RNA, 19 nt, Homo sapiens
gaagacagagcuaauggau

SEQ ID NO: 401270 - RNA, 19 nt, Homo sapiens
uuacaugucugcugucauc

SEQ ID NO: 401271 - RNA, 19 nt, Homo sapiens
ggaagaagacagagcuaau

SEQ ID NO: 401272 - RNA, 19 nt, Homo sapiens
gcggagauccugaaagaga

SEQ ID NO: 401273 - RNA, 19 nt, Homo sapiens
gcagguuuaacucacauua

SEQ ID NO: 401274 - RNA, 19 nt, Homo sapiens
caugagugauacaguguuu

SEQ ID NO: 401275 - RNA, 19 nt, Homo sapiens
gagaggcgccuauaagauc

SEQ ID NO: 401276 - RNA, 19 nt, Homo sapiens
caaagagggcccaguccua

SEQ ID NO: 401277 - RNA, 19 nt, Homo sapiens
guagcuaagucuccugaug

SEQ ID NO: 401278 - RNA, 19 nt, Homo sapiens
ggagaaacaagaguugaaa

SEQ ID NO: 401279 - RNA, 19 nt, Homo sapiens
gaagucuguuguauaucaa

SEQ ID NO: 401280 - RNA, 19 nt, Homo sapiens
aaauggagguauugauguu

SEQ ID NO: 401281 - RNA, 19 nt, Homo sapiens
gccuauaagaucuauguua

SEQ ID NO: 401282 - RNA, 19 nt, Homo sapiens
caaagagaagccaccgaua

SEQ ID NO: 401283 - RNA, 19 nt, Homo sapiens
gaagagggguuccauugug

SEQ ID NO: 401284 - RNA, 19 nt, Homo sapiens
gcgccuuggugcugaauug

SEQ ID NO: 401285 - RNA, 19 nt, Homo sapiens
ggggaagucuguuguauau

SEQ ID NO: 401286 - RNA, 19 nt, Homo sapiens
caccuuuccugcuucagua

SEQ ID NO: 401287 - RNA, 19 nt, Homo sapiens
agauaaagacuguggauau

SEQ ID NO: 401288 - RNA, 19 nt, Homo sapiens
gaaagagagaggcgccuau

SEQ ID NO: 401289 - RNA, 19 nt, Homo sapiens
ggccuggaguugccauuga

SEQ ID NO: 401290 - RNA, 19 nt, Homo sapiens
guauauccaggaagaaauu

SEQ ID NO: 401291 - RNA, 19 nt, Homo sapiens
gacaauacccagagaugug

SEQ ID NO: 401292 - RNA, 19 nt, Homo sapiens
cacauaaagucuuaacucu

SEQ ID NO: 401293 - RNA, 19 nt, Homo sapiens
caagagaccaauggagaaa

SEQ ID NO: 401294 - RNA, 19 nt, Homo sapiens
auacagcugugauggaguu

SEQ ID NO: 401295 - RNA, 19 nt, Homo sapiens
caagggaggacucgaaaca

SEQ ID NO: 401296 - RNA, 19 nt, Homo sapiens
gaugauggccaaagagaag

SEQ ID NO: 401297 - RNA, 19 nt, Homo sapiens
gagcgccuguggcccuauu

SEQ ID NO: 401298 - RNA, 19 nt, Homo sapiens
guuaaaggcacauaaaguc

SEQ ID NO: 401299 - RNA, 19 nt, Homo sapiens
guucguggccaagauauuu

SEQ ID NO: 401300 - RNA, 19 nt, Homo sapiens
gaggugguggugacgaaua

SEQ ID NO: 401301 - RNA, 19 nt, Homo sapiens
gagaagccaccgauaacug

SEQ ID NO: 401302 - RNA, 19 nt, Homo sapiens
gauacaguguuuccuugca

SEQ ID NO: 401303 - RNA, 19 nt, Homo sapiens
uaaagacuguggauaucag

SEQ ID NO: 401304 - RNA, 19 nt, Homo sapiens
aaagagagaggcgccuaua

SEQ ID NO: 401305 - RNA, 19 nt, Homo sapiens
gaagccaccgauaacugua

SEQ ID NO: 401306 - RNA, 19 nt, Homo sapiens
cgaaagcagguuuaacuca

SEQ ID NO: 401307 - RNA, 19 nt, Homo sapiens
gcaagcugcuagcauccau

SEQ ID NO: 401308 - RNA, 19 nt, Homo sapiens
cgaaacagccuggaguuag

SEQ ID NO: 401309 - RNA, 19 nt, Homo sapiens
gauucuuucugaagccauu

SEQ ID NO: 401310 - RNA, 19 nt, Homo sapiens
cugaguggcucugaaguug

SEQ ID NO: 401311 - RNA, 19 nt, Homo sapiens
gagaaacaagaguugaaau

SEQ ID NO: 401312 - RNA, 19 nt, Homo sapiens
gaguggcucugaaguugca

SEQ ID NO: 401313 - RNA, 19 nt, Homo sapiens
gcagugccaugagugauac

SEQ ID NO: 401314 - RNA, 19 nt, Homo sapiens
uugacgauguggagaguuu

SEQ ID NO: 401315 - RNA, 19 nt, Homo sapiens
uaaaggcacauaaagucuu

SEQ ID NO: 401316 - RNA, 19 nt, Homo sapiens
ucaagagaccaauggagaa

SEQ ID NO: 401317 - RNA, 19 nt, Homo sapiens
cauugaugauggccaaaga

SEQ ID NO: 401318 - RNA, 19 nt, Homo sapiens
agagaccaauggagaaaca

SEQ ID NO: 401319 - RNA, 19 nt, Homo sapiens
cuauggaucuucaucaaaa

SEQ ID NO: 401320 - RNA, 19 nt, Homo sapiens
cacuauggaucuucaucaa

SEQ ID NO: 401321 - RNA, 19 nt, Homo sapiens
gccuguggcccuauuacua

SEQ ID NO: 401322 - RNA, 19 nt, Homo sapiens
caauggagaaacaagaguu

SEQ ID NO: 401323 - RNA, 19 nt, Homo sapiens
gaggagggauuaaaagagu

SEQ ID NO: 401324 - RNA, 19 nt, Homo sapiens
caagauaaagacuguggau

SEQ ID NO: 401325 - RNA, 19 nt, Homo sapiens
gcaagcagagcaagaugag

SEQ ID NO: 401326 - RNA, 19 nt, Homo sapiens
aaggaugucagauuagaaa

SEQ ID NO: 401327 - RNA, 19 nt, Homo sapiens
ggaguugccauugaugaug

SEQ ID NO: 401328 - RNA, 19 nt, Homo sapiens
aaagagggcccaguccuau

SEQ ID NO: 401329 - RNA, 19 nt, Homo sapiens
gaccaauggagaaacaaga

SEQ ID NO: 401330 - RNA, 19 nt, Homo sapiens
ucaucagcccuguuccuua

SEQ ID NO: 401331 - RNA, 19 nt, Homo sapiens
gucccaagauaaagacugu

SEQ ID NO: 401332 - RNA, 19 nt, Homo sapiens
gcgccuauaagaucuaugu

SEQ ID NO: 401333 - RNA, 19 nt, Homo sapiens
aaagcagguuuaacucaca

SEQ ID NO: 401334 - RNA, 19 nt, Homo sapiens
ucgaaacagccuggaguua

SEQ ID NO: 401335 - RNA, 19 nt, Homo sapiens
ggaugacauuauugacgau

SEQ ID NO: 401336 - RNA, 19 nt, Homo sapiens
aagcauucauguuguuaca

SEQ ID NO: 401337 - RNA, 19 nt, Homo sapiens
agagagaggcgccuauaag

SEQ ID NO: 401338 - RNA, 19 nt, Homo sapiens
ccuuagagccucaccuuuc

SEQ ID NO: 401339 - RNA, 19 nt, Homo sapiens
agguuuaacucacauuauc

SEQ ID NO: 401340 - RNA, 19 nt, Homo sapiens
caaggaugucagauuagaa

SEQ ID NO: 401341 - RNA, 19 nt, Homo sapiens
uguuacaucuuccaaggau

SEQ ID NO: 401342 - RNA, 19 nt, Homo sapiens
gaaauugcuaugccuacag

SEQ ID NO: 401343 - RNA, 19 nt, Homo sapiens
gaguuaaaggcacauaaag

SEQ ID NO: 401344 - RNA, 19 nt, Homo sapiens
auacaguguuuccuugcaa

SEQ ID NO: 401345 - RNA, 19 nt, Homo sapiens
cagacaauacccagagaug

SEQ ID NO: 401346 - RNA, 19 nt, Homo sapiens
ggaggccgcaucgcaauca

SEQ ID NO: 401347 - RNA, 19 nt, Homo sapiens
ugaauacagcugugaugga

SEQ ID NO: 401348 - RNA, 19 nt, Homo sapiens
ggaaagaggugcauauaag

SEQ ID NO: 401349 - RNA, 19 nt, Homo sapiens
aagaagagaucccagauua

SEQ ID NO: 401350 - RNA, 19 nt, Homo sapiens
gggccaaacuggaaacaua

SEQ ID NO: 401351 - RNA, 19 nt, Homo sapiens
ccuguaaccucacuucuua

SEQ ID NO: 401352 - RNA, 19 nt, Homo sapiens
gaaacaagaguacaaauuc

SEQ ID NO: 401353 - RNA, 19 nt, Homo sapiens
guauggagcuaucaaagaa

SEQ ID NO: 401354 - RNA, 19 nt, Homo sapiens
uaaccucacuucuuauuga

SEQ ID NO: 401355 - RNA, 19 nt, Homo sapiens
gcagagacccugaaggaaa

SEQ ID NO: 401356 - RNA, 19 nt, Homo sapiens
ccaauacaauuccacauga

SEQ ID NO: 401357 - RNA, 19 nt, Homo sapiens
uaugauaccugcaauugaa

SEQ ID NO: 401358 - RNA, 19 nt, Homo sapiens
gagcaucucccuucuuauu

SEQ ID NO: 401359 - RNA, 19 nt, Homo sapiens
gugcaaagcuggucuaacu

SEQ ID NO: 401360 - RNA, 19 nt, Homo sapiens
ggaauaagauuuguaagcu

SEQ ID NO: 401361 - RNA, 19 nt, Homo sapiens
uaacagagaaacaagagua

SEQ ID NO: 401362 - RNA, 19 nt, Homo sapiens
ucacaaagccuucuuccaa

SEQ ID NO: 401363 - RNA, 19 nt, Homo sapiens
gaaagaggugcauauaaga

SEQ ID NO: 401364 - RNA, 19 nt, Homo sapiens
auucagggcuucuucaaua

SEQ ID NO: 401365 - RNA, 19 nt, Homo sapiens
ggucuaacucaucuuauua

SEQ ID NO: 401366 - RNA, 19 nt, Homo sapiens
gaaaccaagaugaacauaa

SEQ ID NO: 401367 - RNA, 19 nt, Homo sapiens
gaagagaucccagauuaca

SEQ ID NO: 401368 - RNA, 19 nt, Homo sapiens
gcauauaagaucuuuguga

SEQ ID NO: 401369 - RNA, 19 nt, Homo sapiens
aaaaggagguuguccauaa

SEQ ID NO: 401370 - RNA, 19 nt, Homo sapiens
ccaggaaccuaacagagaa

SEQ ID NO: 401371 - RNA, 19 nt, Homo sapiens
cacaaagccuucuuccaaa

SEQ ID NO: 401372 - RNA, 19 nt, Homo sapiens
gaaggaaagaggugcauau

SEQ ID NO: 401373 - RNA, 19 nt, Homo sapiens
caauauuccuguugacaau

SEQ ID NO: 401374 - RNA, 19 nt, Homo sapiens
uagacaagcauauggaaua

SEQ ID NO: 401375 - RNA, 19 nt, Homo sapiens
gaggcuccauugucucuaa

SEQ ID NO: 401376 - RNA, 19 nt, Homo sapiens
caauacaauuccacaugaa

SEQ ID NO: 401377 - RNA, 19 nt, Homo sapiens
gaaccuaacagagaaacaa

SEQ ID NO: 401378 - RNA, 19 nt, Homo sapiens
gaucccagauuacaggaau

SEQ ID NO: 401379 - RNA, 19 nt, Homo sapiens
ugaagagucugccauugau

SEQ ID NO: 401380 - RNA, 19 nt, Homo sapiens
gaggaaggauugccaucau

SEQ ID NO: 401381 - RNA, 19 nt, Homo sapiens
gcaaagcuggucuaacuca

SEQ ID NO: 401382 - RNA, 19 nt, Homo sapiens
caaagguggucugguguug

SEQ ID NO: 401383 - RNA, 19 nt, Homo sapiens
aaaccaagaugaacauaac

SEQ ID NO: 401384 - RNA, 19 nt, Homo sapiens
gacgccaccugaauuagaa

SEQ ID NO: 401385 - RNA, 19 nt, Homo sapiens
gaauuagaaaccaagauga

SEQ ID NO: 401386 - RNA, 19 nt, Homo sapiens
ccaagaagguuuugauguu

SEQ ID NO: 401387 - RNA, 19 nt, Homo sapiens
cagcagagacccugaagga

SEQ ID NO: 401388 - RNA, 19 nt, Homo sapiens
gcuccauugucucuaaauu

SEQ ID NO: 401389 - RNA, 19 nt, Homo sapiens
aggcuuagaugacugaguu

SEQ ID NO: 401390 - RNA, 19 nt, Homo sapiens
gaaauucagggcuucuuca

SEQ ID NO: 401391 - RNA, 19 nt, Homo sapiens
cuaaauugcuggcuuccau

SEQ ID NO: 401392 - RNA, 19 nt, Homo sapiens
aaacucgaauucaucaugu

SEQ ID NO: 401393 - RNA, 19 nt, Homo sapiens
gauguugacagcuuucuug

SEQ ID NO: 401394 - RNA, 19 nt, Homo sapiens
gcaucucccuucuuauuac

SEQ ID NO: 401395 - RNA, 19 nt, Homo sapiens
gggauggauuucacaggaa

SEQ ID NO: 401396 - RNA, 19 nt, Homo sapiens
caagaagagaucccagauu

SEQ ID NO: 401397 - RNA, 19 nt, Homo sapiens
caagaugaacauaaccaaa

SEQ ID NO: 401398 - RNA, 19 nt, Homo sapiens
gguaagaccucguuuuagu

SEQ ID NO: 401399 - RNA, 19 nt, Homo sapiens
gaaacauaggcuuagauga

SEQ ID NO: 401400 - RNA, 19 nt, Homo sapiens
aaaggagguuguccauaau

SEQ ID NO: 401401 - RNA, 19 nt, Homo sapiens
cagagacccugaaggaaag

SEQ ID NO: 401402 - RNA, 19 nt, Homo sapiens
gcuggucuaacucaucuua

SEQ ID NO: 401403 - RNA, 19 nt, Homo sapiens
gcaaagugcagguuuacca

SEQ ID NO: 401404 - RNA, 19 nt, Homo sapiens
ucauggagcuccugaucau

SEQ ID NO: 401405 - RNA, 19 nt, Homo sapiens
caucauguauggagcuauc

SEQ ID NO: 401406 - RNA, 19 nt, Homo sapiens
ggagguuguccauaauuga

SEQ ID NO: 401407 - RNA, 19 nt, Homo sapiens
ggccaaacuggaaacauaa

SEQ ID NO: 401408 - RNA, 19 nt, Homo sapiens
acucauggcuuguugucuu

SEQ ID NO: 401409 - RNA, 19 nt, Homo sapiens
gauguuggaggaaggauug

SEQ ID NO: 401410 - RNA, 19 nt, Homo sapiens
caagaagguuuugauguuu

SEQ ID NO: 401411 - RNA, 19 nt, Homo sapiens
ugucaaguccaguaaauga

SEQ ID NO: 401412 - RNA, 19 nt, Homo sapiens
cuaagaagauagaccaacu

SEQ ID NO: 401413 - RNA, 19 nt, Homo sapiens
ccucacuucuuauugauuc

SEQ ID NO: 401414 - RNA, 19 nt, Homo sapiens
aaacauaggcuuagaugac

SEQ ID NO: 401415 - RNA, 19 nt, Homo sapiens
ucagaaacauaggcuuaga

SEQ ID NO: 401416 - RNA, 19 nt, Homo sapiens
caaauucaagagucuguga

SEQ ID NO: 401417 - RNA, 19 nt, Homo sapiens
caaacucgaauucaucaug

SEQ ID NO: 401418 - RNA, 19 nt, Homo sapiens
gaguccauguccuaccuuu

SEQ ID NO: 401419 - RNA, 19 nt, Homo sapiens
ggaaauucagggcuucuuc

SEQ ID NO: 401420 - RNA, 19 nt, Homo sapiens
ugggcaaagugcagguuua

SEQ ID NO: 401421 - RNA, 19 nt, Homo sapiens
ucagcaaacucgaauucau

SEQ ID NO: 401422 - RNA, 19 nt, Homo sapiens
acacuuggaauaagauuug

SEQ ID NO: 401423 - RNA, 19 nt, Homo sapiens
guccauaauugacuuuaag

SEQ ID NO: 401424 - RNA, 19 nt, Homo sapiens
gugauacccuacuuuccuu

SEQ ID NO: 401425 - RNA, 19 nt, Homo sapiens
ugaauuagaaaccaagaug

SEQ ID NO: 401426 - RNA, 19 nt, Homo sapiens
gauugaagagucugccauu

SEQ ID NO: 401427 - RNA, 19 nt, Homo sapiens
uggucuaacucaucuuauu

SEQ ID NO: 401428 - RNA, 19 nt, Homo sapiens
gugcauauaagaucuuugu

SEQ ID NO: 401429 - RNA, 19 nt, Homo sapiens
ccugggaauugcagugauu

SEQ ID NO: 401430 - RNA, 19 nt, Homo sapiens
gagaaacaagaguacaaau

SEQ ID NO: 401431 - RNA, 19 nt, Homo sapiens
ggaauuuuguugucagaga

SEQ ID NO: 401432 - RNA, 19 nt, Homo sapiens
aagaagauagaccaacuuu

SEQ ID NO: 401433 - RNA, 19 nt, Homo sapiens
ggaggaaggauugccauca

SEQ ID NO: 401434 - RNA, 19 nt, Homo sapiens
cagggcuucuucaauauuc

SEQ ID NO: 401435 - RNA, 19 nt, Homo sapiens
acaaagccuucuuccaaag

SEQ ID NO: 401436 - RNA, 19 nt, Homo sapiens
gguugugggugauguugga

SEQ ID NO: 401437 - RNA, 19 nt, Homo sapiens
ccaugcugauuccuaaaga

SEQ ID NO: 401438 - RNA, 19 nt, Homo sapiens
gcucuucagcuccgccuuu

SEQ ID NO: 401439 - RNA, 19 nt, Homo sapiens
caagaguacaaauucaaga

SEQ ID NO: 401440 - RNA, 19 nt, Homo sapiens
cagagaaacaagaguacaa

SEQ ID NO: 401441 - RNA, 19 nt, Homo sapiens
aagguggucugguguuguu

SEQ ID NO: 401442 - RNA, 19 nt, Homo sapiens
ugaaaagccgaaaagauua

SEQ ID NO: 401443 - RNA, 19 nt, Homo sapiens
aaagccuucuuccaaaguu

SEQ ID NO: 401444 - RNA, 19 nt, Homo sapiens
ugugacgccaccugaauua

SEQ ID NO: 401445 - RNA, 19 nt, Homo sapiens
ggauuuacaccagaaggaa

SEQ ID NO: 401446 - RNA, 19 nt, Homo sapiens
caggaaccgucaugcuugu

SEQ ID NO: 401447 - RNA, 19 nt, Homo sapiens
aaggaaagaggugcauaua

SEQ ID NO: 401448 - RNA, 19 nt, Homo sapiens
gaagagcuaucuacacuaa

SEQ ID NO: 401449 - RNA, 19 nt, Homo sapiens
caaauaagaugguguguau

SEQ ID NO: 401450 - RNA, 19 nt, Homo sapiens
gaagaauucuguacauuug

SEQ ID NO: 401451 - RNA, 19 nt, Homo sapiens
ucaagaaccugcuauugua

SEQ ID NO: 401452 - RNA, 19 nt, Homo sapiens
gaacucagaucucccucua

SEQ ID NO: 401453 - RNA, 19 nt, Homo sapiens
gagcaagaaucauaucuga

SEQ ID NO: 401454 - RNA, 19 nt, Homo sapiens
ggaaauauuuguaccacuu

SEQ ID NO: 401455 - RNA, 19 nt, Homo sapiens
ccacacagaucucaucauu

SEQ ID NO: 401456 - RNA, 19 nt, Homo sapiens
uauauaggcugaugucuuu

SEQ ID NO: 401457 - RNA, 19 nt, Homo sapiens
gauauuacauucaccuuug

SEQ ID NO: 401458 - RNA, 19 nt, Homo sapiens
gaaugaauguugauguuug

SEQ ID NO: 401459 - RNA, 19 nt, Homo sapiens
ggagcaggauauucuguua

SEQ ID NO: 401460 - RNA, 19 nt, Homo sapiens
caagacaguuguucauaaa

SEQ ID NO: 401461 - RNA, 19 nt, Homo sapiens
ggauauauguguggauuaa

SEQ ID NO: 401462 - RNA, 19 nt, Homo sapiens
gcauccagauucucaauaa

SEQ ID NO: 401463 - RNA, 19 nt, Homo sapiens
acacagaucucaucauugu

SEQ ID NO: 401464 - RNA, 19 nt, Homo sapiens
caaaguccauguuaugcua

SEQ ID NO: 401465 - RNA, 19 nt, Homo sapiens
ccucagcaccuuaauauua

SEQ ID NO: 401466 - RNA, 19 nt, Homo sapiens
guuaagagcguaaguguaa

SEQ ID NO: 401467 - RNA, 19 nt, Homo sapiens
guacacaucagauaucuuu

SEQ ID NO: 401468 - RNA, 19 nt, Homo sapiens
gcagaggagugaaacagaa

SEQ ID NO: 401469 - RNA, 19 nt, Homo sapiens
ggagaugcuuccuaagaaa

SEQ ID NO: 401470 - RNA, 19 nt, Homo sapiens
gcucuggucuguucugaaa

SEQ ID NO: 401471 - RNA, 19 nt, Homo sapiens
uaagcuggcugagaaauaa

SEQ ID NO: 401472 - RNA, 19 nt, Homo sapiens
acaaggguaucaagaauuu

SEQ ID NO: 401473 - RNA, 19 nt, Homo sapiens
gguagggucuuucuuaugu

SEQ ID NO: 401474 - RNA, 19 nt, Homo sapiens
aaacagaaccucauuuaga

SEQ ID NO: 401475 - RNA, 19 nt, Homo sapiens
ugaaacagaaccucauuua

SEQ ID NO: 401476 - RNA, 19 nt, Homo sapiens
gcauaccacuucacacuug

SEQ ID NO: 401477 - RNA, 19 nt, Homo sapiens
uaugcuaggugcacaauaa

SEQ ID NO: 401478 - RNA, 19 nt, Homo sapiens
gcagauagcaauaagguau

SEQ ID NO: 401479 - RNA, 19 nt, Homo sapiens
gcacuucucuaagggcuuu

SEQ ID NO: 401480 - RNA, 19 nt, Homo sapiens
gaauaucuccugcggugua

SEQ ID NO: 401481 - RNA, 19 nt, Homo sapiens
gauauaaaccucaugaaca

SEQ ID NO: 401482 - RNA, 19 nt, Homo sapiens
gguaacauauuccuaaucu

SEQ ID NO: 401483 - RNA, 19 nt, Homo sapiens
ucuaagggcuuuacaagga

SEQ ID NO: 401484 - RNA, 19 nt, Homo sapiens
ggauguacuuagcauguuu

SEQ ID NO: 401485 - RNA, 19 nt, Homo sapiens
aaacaaggguaucaagaau

SEQ ID NO: 401486 - RNA, 19 nt, Homo sapiens
uaccuuaccuuuccguuaa

SEQ ID NO: 401487 - RNA, 19 nt, Homo sapiens
gaugcuugguuuacauuaa

SEQ ID NO: 401488 - RNA, 19 nt, Homo sapiens
cagaaugaauguugauguu

SEQ ID NO: 401489 - RNA, 19 nt, Homo sapiens
gcagaaggaauguagguuu

SEQ ID NO: 401490 - RNA, 19 nt, Homo sapiens
ggaaggagagcauuacuca

SEQ ID NO: 401491 - RNA, 19 nt, Homo sapiens
ucaaccaguuugcauuuaa

SEQ ID NO: 401492 - RNA, 19 nt, Homo sapiens
gcaugauaaugauaggaua

SEQ ID NO: 401493 - RNA, 19 nt, Homo sapiens
acacuaaguucguaauguu

SEQ ID NO: 401494 - RNA, 19 nt, Homo sapiens
agaagaagauugcaaaguc

SEQ ID NO: 401495 - RNA, 19 nt, Homo sapiens
gcacuuuaccacuacauaa

SEQ ID NO: 401496 - RNA, 19 nt, Homo sapiens
caagauugaugaugugauc

SEQ ID NO: 401497 - RNA, 19 nt, Homo sapiens
aaugaugacuucaagauug

SEQ ID NO: 401498 - RNA, 19 nt, Homo sapiens
caaccaguuugcauuuaaa

SEQ ID NO: 401499 - RNA, 19 nt, Homo sapiens
gaucaaugacuguagcuuu

SEQ ID NO: 401500 - RNA, 19 nt, Homo sapiens
gaaacugugccaacugaaa

SEQ ID NO: 401501 - RNA, 19 nt, Homo sapiens
caaaugaagcugcaaacuu

SEQ ID NO: 401502 - RNA, 19 nt, Homo sapiens
gcucaguggucuuccugua

SEQ ID NO: 401503 - RNA, 19 nt, Homo sapiens
guuaauagguuuaguagcu

SEQ ID NO: 401504 - RNA, 19 nt, Homo sapiens
uccauuaacuucuaccuaa

SEQ ID NO: 401505 - RNA, 19 nt, Homo sapiens
ggguuuguuuggaauaaua

SEQ ID NO: 401506 - RNA, 19 nt, Homo sapiens
aacauaagcuggcugagaa

SEQ ID NO: 401507 - RNA, 19 nt, Homo sapiens
cuagguagggucuuucuua

SEQ ID NO: 401508 - RNA, 19 nt, Homo sapiens
uugaugaugugauccaaua

SEQ ID NO: 401509 - RNA, 19 nt, Homo sapiens
uaagguauuugguggcauu

SEQ ID NO: 401510 - RNA, 19 nt, Homo sapiens
caucaacacaguauaugua

SEQ ID NO: 401511 - RNA, 19 nt, Homo sapiens
cuacucgccuguccaauug

SEQ ID NO: 401512 - RNA, 19 nt, Homo sapiens
aaucauaucugacccucaa

SEQ ID NO: 401513 - RNA, 19 nt, Homo sapiens
gcccuuaagaguuuaguua

SEQ ID NO: 401514 - RNA, 19 nt, Homo sapiens
gugaagagcuaucuacacu

SEQ ID NO: 401515 - RNA, 19 nt, Homo sapiens
gacaguuguucauaaaguu

SEQ ID NO: 401516 - RNA, 19 nt, Homo sapiens
acucauagcugguaaaauu

SEQ ID NO: 401517 - RNA, 19 nt, Homo sapiens
ccagugacaugcuguagau

SEQ ID NO: 401518 - RNA, 19 nt, Homo sapiens
uaagaugguguguauguaa

SEQ ID NO: 401519 - RNA, 19 nt, Homo sapiens
uaacuugguucuguguaaa

SEQ ID NO: 401520 - RNA, 19 nt, Homo sapiens
ugugauuucuugcaacuuu

SEQ ID NO: 401521 - RNA, 19 nt, Homo sapiens
gcuaaagguagaaguguuu

SEQ ID NO: 401522 - RNA, 19 nt, Homo sapiens
caacucagccagugccauu

SEQ ID NO: 401523 - RNA, 19 nt, Homo sapiens
gaaacagaaccucauuuag

SEQ ID NO: 401524 - RNA, 19 nt, Homo sapiens
ccgaggaagugacugguuu

SEQ ID NO: 401525 - RNA, 19 nt, Homo sapiens
ugaaguaggagucagauga

SEQ ID NO: 401526 - RNA, 19 nt, Homo sapiens
gguagaagaagauugcaaa

SEQ ID NO: 401527 - RNA, 19 nt, Homo sapiens
cauuacuccuuuacucaua

SEQ ID NO: 401528 - RNA, 19 nt, Homo sapiens
gaaucaaccaguuugcauu

SEQ ID NO: 401529 - RNA, 19 nt, Homo sapiens
cagaaggaauguagguuuc

SEQ ID NO: 401530 - RNA, 19 nt, Homo sapiens
caacauaagcuggcugaga

SEQ ID NO: 401531 - RNA, 19 nt, Homo sapiens
gaaauaagacagggcaaca

SEQ ID NO: 401532 - RNA, 19 nt, Homo sapiens
uaagacagggcaacauuga

SEQ ID NO: 401533 - RNA, 19 nt, Homo sapiens
gcaaauucauuaggucagu

SEQ ID NO: 401534 - RNA, 19 nt, Homo sapiens
gauggcaaauucauuaggu

SEQ ID NO: 401535 - RNA, 19 nt, Homo sapiens
cuaccuaaaucaccuggaa

SEQ ID NO: 401536 - RNA, 19 nt, Homo sapiens
uggagaugcuuccuaagaa

SEQ ID NO: 401537 - RNA, 19 nt, Homo sapiens
uuaacuugguucuguguaa

SEQ ID NO: 401538 - RNA, 19 nt, Homo sapiens
gaugugauccaauaacugu

SEQ ID NO: 401539 - RNA, 19 nt, Homo sapiens
gccaaaugcuuaaacugau

SEQ ID NO: 401540 - RNA, 19 nt, Homo sapiens
caccuaaauugcaguauca

SEQ ID NO: 401541 - RNA, 19 nt, Homo sapiens
agacauaggagcaggauau

SEQ ID NO: 401542 - RNA, 19 nt, Homo sapiens
aaugucaggcuuuagauua

SEQ ID NO: 401543 - RNA, 19 nt, Homo sapiens
gccaugcucuggucuguuc

SEQ ID NO: 401544 - RNA, 19 nt, Homo sapiens
uucaagcccuuaagaguuu

SEQ ID NO: 401545 - RNA, 19 nt, Homo sapiens
ccauuaacuucuaccuaaa

SEQ ID NO: 401546 - RNA, 19 nt, Homo sapiens
gagcgugagugcaaagaag

SEQ ID NO: 401547 - RNA, 19 nt, Homo sapiens
ugcuuaaacugaucaauga

SEQ ID NO: 401548 - RNA, 19 nt, Homo sapiens
gcccagagcuuccugagua

SEQ ID NO: 401549 - RNA, 19 nt, Homo sapiens
gggcagauaugaccugaca

SEQ ID NO: 401550 - RNA, 19 nt, Homo sapiens
caggaggccucacugaaga

SEQ ID NO: 401551 - RNA, 19 nt, Homo sapiens
ggagacagaccaagaaguc

SEQ ID NO: 401552 - RNA, 19 nt, Homo sapiens
ccaccugccuggauacuuc

SEQ ID NO: 401553 - RNA, 19 nt, Homo sapiens
gcugcuauauauggcauua

SEQ ID NO: 401554 - RNA, 19 nt, Homo sapiens
caucuacaauggcaaagga

SEQ ID NO: 401555 - RNA, 19 nt, Homo sapiens
uuaaccaccugccuggaua

SEQ ID NO: 401556 - RNA, 19 nt, Homo sapiens
gggaagaggccagggagua

SEQ ID NO: 401557 - RNA, 19 nt, Homo sapiens
gcugugccaucuuguguau

SEQ ID NO: 401558 - RNA, 19 nt, Homo sapiens
ggaagaggccagggaguau

SEQ ID NO: 401559 - RNA, 19 nt, Homo sapiens
gaagaggccagggaguauu

SEQ ID NO: 401560 - RNA, 19 nt, Homo sapiens
cgccgaagcuggacuugga

SEQ ID NO: 401561 - RNA, 19 nt, Homo sapiens
ccucucugcugcugcuaua

SEQ ID NO: 401562 - RNA, 19 nt, Homo sapiens
ggagagcuacaucuacaau

SEQ ID NO: 401563 - RNA, 19 nt, Homo sapiens
ggaacgggagugucuggaa

SEQ ID NO: 401564 - RNA, 19 nt, Homo sapiens
gaguagccauacccggauu

SEQ ID NO: 401565 - RNA, 19 nt, Homo sapiens
ugggagagcuacaucuaca

SEQ ID NO: 401566 - RNA, 19 nt, Homo sapiens
agagcuacaucuacaaugg

SEQ ID NO: 401567 - RNA, 19 nt, Homo sapiens
cuacaucuacaauggcaaa

SEQ ID NO: 401568 - RNA, 19 nt, Homo sapiens
ucucugcugcugcuauaua

SEQ ID NO: 401569 - RNA, 19 nt, Homo sapiens
ugaggagacagaccaagaa

SEQ ID NO: 401570 - RNA, 19 nt, Homo sapiens
gugaggagacagaccaaga

SEQ ID NO: 401571 - RNA, 19 nt, Homo sapiens
gaaccuggaacgggagugu

SEQ ID NO: 401572 - RNA, 19 nt, Homo sapiens
gcuguuccccuaaauaaaa

SEQ ID NO: 401573 - RNA, 19 nt, Homo sapiens
gaagccgcuaggccucaua

SEQ ID NO: 401574 - RNA, 19 nt, Homo sapiens
gagagcuacaucuacaaug

SEQ ID NO: 401575 - RNA, 19 nt, Homo sapiens
aagaggccagggaguauuu

SEQ ID NO: 401576 - RNA, 19 nt, Homo sapiens
ggaagccgcuaggccucau

SEQ ID NO: 401577 - RNA, 19 nt, Homo sapiens
ucacugaagagcugcuuuc

SEQ ID NO: 401578 - RNA, 19 nt, Homo sapiens
guacaggggcacuucguaa

SEQ ID NO: 401579 - RNA, 19 nt, Homo sapiens
ccucauagacgccgaagcu

SEQ ID NO: 401580 - RNA, 19 nt, Homo sapiens
gaggagacagaccaagaag

SEQ ID NO: 401581 - RNA, 19 nt, Homo sapiens
gggaguauuuugaggacaa

SEQ ID NO: 401582 - RNA, 19 nt, Homo sapiens
gaaccgugccccugauuca

SEQ ID NO: 401583 - RNA, 19 nt, Homo sapiens
ucaaauggcugguauaauu

SEQ ID NO: 401584 - RNA, 19 nt, Homo sapiens
gcugaaaccucuuuaaauc

SEQ ID NO: 401585 - RNA, 19 nt, Homo sapiens
gaacagaucguugugauga

SEQ ID NO: 401586 - RNA, 19 nt, Homo sapiens
uggaagaucugacuaaaga

SEQ ID NO: 401587 - RNA, 19 nt, Homo sapiens
gaaagaugguguucuacau

SEQ ID NO: 401588 - RNA, 19 nt, Homo sapiens
ccauggaucuacuggaaua

SEQ ID NO: 401589 - RNA, 19 nt, Homo sapiens
gaccauggaucuacuggaa

SEQ ID NO: 401590 - RNA, 19 nt, Homo sapiens
ggacuacacuggagaggau

SEQ ID NO: 401591 - RNA, 19 nt, Homo sapiens
caaauggcugguauaauua

SEQ ID NO: 401592 - RNA, 19 nt, Homo sapiens
ggucauauuugcuuucuag

SEQ ID NO: 401593 - RNA, 19 nt, Homo sapiens
ugacauugcuuacucugaa

SEQ ID NO: 401594 - RNA, 19 nt, Homo sapiens
guaaaggaccugaaugaga

SEQ ID NO: 401595 - RNA, 19 nt, Homo sapiens
ggaaacugaugaacaccaa

SEQ ID NO: 401596 - RNA, 19 nt, Homo sapiens
cagaaugguuuggaaagua

SEQ ID NO: 401597 - RNA, 19 nt, Homo sapiens
gaagggucauauuugcuuu

SEQ ID NO: 401598 - RNA, 19 nt, Homo sapiens
ugaaccaccugccggauaa

SEQ ID NO: 401599 - RNA, 19 nt, Homo sapiens
gaguaugcguugagacauu

SEQ ID NO: 401600 - RNA, 19 nt, Homo sapiens
ccacaggugucugcaauug

SEQ ID NO: 401601 - RNA, 19 nt, Homo sapiens
gaagaucugacuaaagaga

SEQ ID NO: 401602 - RNA, 19 nt, Homo sapiens
gagaggcgaugcagaagca

SEQ ID NO: 401603 - RNA, 19 nt, Homo sapiens
ucuaggagguuuguuguuu

SEQ ID NO: 401604 - RNA, 19 nt, Homo sapiens
gaagagcugccuccuggaa

SEQ ID NO: 401605 - RNA, 19 nt, Homo sapiens
aggaucacguguucauuua

SEQ ID NO: 401606 - RNA, 19 nt, Homo sapiens
gcagaaugguuuggaaagu

SEQ ID NO: 401607 - RNA, 19 nt, Homo sapiens
gaagcugaaaccucuuuaa

SEQ ID NO: 401608 - RNA, 19 nt, Homo sapiens
gaccauccauuacauguac

SEQ ID NO: 401609 - RNA, 19 nt, Homo sapiens
ccaugaaagugaugcaguu

SEQ ID NO: 401610 - RNA, 19 nt, Homo sapiens
ggaagacucggacguggaa

SEQ ID NO: 401611 - RNA, 19 nt, Homo sapiens
acaggugucugcaauugaa

SEQ ID NO: 401612 - RNA, 19 nt, Homo sapiens
gaucguggcagguucaaau

SEQ ID NO: 401613 - RNA, 19 nt, Homo sapiens
gaaaccucuuuaaaucuuc

SEQ ID NO: 401614 - RNA, 19 nt, Homo sapiens
guacgaguaugcguugaga

SEQ ID NO: 401615 - RNA, 19 nt, Homo sapiens
cuaaagagacccugcacaa

SEQ ID NO: 401616 - RNA, 19 nt, Homo sapiens
gagucuggguccaugauga

SEQ ID NO: 401617 - RNA, 19 nt, Homo sapiens
gggcauaggauccggcaaa

SEQ ID NO: 401618 - RNA, 19 nt, Homo sapiens
aaaggaaacugaugaacac

SEQ ID NO: 401619 - RNA, 19 nt, Homo sapiens
aaaacaaucuccaccauga

SEQ ID NO: 401620 - RNA, 19 nt, Homo sapiens
aagaugguguucuacauug

SEQ ID NO: 401621 - RNA, 19 nt, Homo sapiens
uuacuucacugaccaugga

SEQ ID NO: 401622 - RNA, 19 nt, Homo sapiens
caggaucacguguucauuu

SEQ ID NO: 401623 - RNA, 19 nt, Homo sapiens
gaucacguguucauuuacu

SEQ ID NO: 401624 - RNA, 19 nt, Homo sapiens
guucaaauggcugguauaa

SEQ ID NO: 401625 - RNA, 19 nt, Homo sapiens
ugagaagggucauauuugc

SEQ ID NO: 401626 - RNA, 19 nt, Homo sapiens
ccagccacgucaugcagua

SEQ ID NO: 401627 - RNA, 19 nt, Homo sapiens
ccaaggugcagaaugguuu

SEQ ID NO: 401628 - RNA, 19 nt, Homo sapiens
gauguuaccccacaaaauu

SEQ ID NO: 401629 - RNA, 19 nt, Homo sapiens
caaucccacuccaggaauu

SEQ ID NO: 401630 - RNA, 19 nt, Homo sapiens
ggucaaccuuugugagaag

SEQ ID NO: 401631 - RNA, 19 nt, Homo sapiens
cuggagagguggagugaga

SEQ ID NO: 401632 - RNA, 19 nt, Homo sapiens
cagaggcccugcugcacuu

SEQ ID NO: 401633 - RNA, 19 nt, Homo sapiens
caugcaguauggaaacaaa

SEQ ID NO: 401634 - RNA, 19 nt, Homo sapiens
uauagaugauccugaagau

SEQ ID NO: 401635 - RNA, 19 nt, Homo sapiens
accgaaagaugguguucua

SEQ ID NO: 401636 - RNA, 19 nt, Homo sapiens
guugagaggcgaugcagaa

SEQ ID NO: 401637 - RNA, 19 nt, Homo sapiens
gacaaucccacuccaggaa

SEQ ID NO: 401638 - RNA, 19 nt, Homo sapiens
aagcugaaaccucuuuaaa

SEQ ID NO: 401639 - RNA, 19 nt, Homo sapiens
aaagaugguguucuacauu

SEQ ID NO: 401640 - RNA, 19 nt, Homo sapiens
cguggaagaucugacuaaa

SEQ ID NO: 401641 - RNA, 19 nt, Homo sapiens
uccauuacauguacaaaca

SEQ ID NO: 401642 - RNA, 19 nt, Homo sapiens
cauaggauccggcaaaguc

SEQ ID NO: 401643 - RNA, 19 nt, Homo sapiens
caaugggauuccugacgaa

SEQ ID NO: 401644 - RNA, 19 nt, Homo sapiens
gaagucagugcguaagauc

SEQ ID NO: 401645 - RNA, 19 nt, Homo sapiens
gagaagucagugcguaaga

SEQ ID NO: 401646 - RNA, 19 nt, Homo sapiens
agaaugguuuggaaaguag

SEQ ID NO: 401647 - RNA, 19 nt, Homo sapiens
caacaccagccacgucaug

SEQ ID NO: 401648 - RNA, 19 nt, Homo sapiens
aaauuuccuugcuguguug

SEQ ID NO: 401649 - RNA, 19 nt, Homo sapiens
ccagaucauucaccgcaau

SEQ ID NO: 401650 - RNA, 19 nt, Homo sapiens
uccaggaccuucuucacaa

SEQ ID NO: 401651 - RNA, 19 nt, Homo sapiens
ggugcagaaugguuuggaa

SEQ ID NO: 401652 - RNA, 19 nt, Homo sapiens
guccuacgccuguuacuau

SEQ ID NO: 401653 - RNA, 19 nt, Homo sapiens
cgaaagaugguguucuaca

SEQ ID NO: 401654 - RNA, 19 nt, Homo sapiens
caauggcacagaugucuau

SEQ ID NO: 401655 - RNA, 19 nt, Homo sapiens
gugccuuggucacuacuga

SEQ ID NO: 401656 - RNA, 19 nt, Homo sapiens
aagagacccugcacaagca

SEQ ID NO: 401657 - RNA, 19 nt, Homo sapiens
gagaccauccauuacaugu

SEQ ID NO: 401658 - RNA, 19 nt, Homo sapiens
gcagugaagggcauaggau

SEQ ID NO: 401659 - RNA, 19 nt, Homo sapiens
ggauaaaauuguccaugga

SEQ ID NO: 401660 - RNA, 19 nt, Homo sapiens
gaugaacaccaaugaucug

SEQ ID NO: 401661 - RNA, 19 nt, Homo sapiens
caucaauguuuaugcaacu

SEQ ID NO: 401662 - RNA, 19 nt, Homo sapiens
acagaucguugugaugaug

SEQ ID NO: 401663 - RNA, 19 nt, Homo sapiens
ugaugcaguuucaggguau

SEQ ID NO: 401664 - RNA, 19 nt, Homo sapiens
gaugguguucuacauugaa

SEQ ID NO: 401665 - RNA, 19 nt, Homo sapiens
gaugacuugcucgcuguua

SEQ ID NO: 401666 - RNA, 19 nt, Homo sapiens
aguaugcguugagacauuu

SEQ ID NO: 401667 - RNA, 19 nt, Homo sapiens
ggacguggaagaucugacu

SEQ ID NO: 401668 - RNA, 19 nt, Homo sapiens
gguacagcgucaacuggau

SEQ ID NO: 401669 - RNA, 19 nt, Homo sapiens
uccuauagaugauccugaa

SEQ ID NO: 401670 - RNA, 19 nt, Homo sapiens
aaacugaugaacaccaaug

SEQ ID NO: 401671 - RNA, 19 nt, Homo sapiens
caaaauguaccgaaagaug

SEQ ID NO: 401672 - RNA, 19 nt, Homo sapiens
cugagaauuugaagcugaa

SEQ ID NO: 401673 - RNA, 19 nt, Homo sapiens
acuccaaggugcagaaugg

SEQ ID NO: 401674 - RNA, 19 nt, Homo sapiens
guauugagaagggucauau

SEQ ID NO: 401675 - RNA, 19 nt, Homo sapiens
agaagucagugcguaagau

SEQ ID NO: 401676 - RNA, 19 nt, Homo sapiens
gugcagaaugguuuggaaa

SEQ ID NO: 401677 - RNA, 19 nt, Homo sapiens
cuacgccuguuacuaugau

SEQ ID NO: 401678 - RNA, 19 nt, Homo sapiens
cauugaagccugugagucu

SEQ ID NO: 401679 - RNA, 19 nt, Homo sapiens
uguacgaugacauugcuua

SEQ ID NO: 401680 - RNA, 19 nt, Homo sapiens
cacaaaauguaccgaaaga

SEQ ID NO: 401681 - RNA, 19 nt, Homo sapiens
cauuacauguacaaacaca

SEQ ID NO: 401682 - RNA, 19 nt, Homo sapiens
ccaggaccuucuucacaag

SEQ ID NO: 401683 - RNA, 19 nt, Homo sapiens
ggaagacucugaacaauga

SEQ ID NO: 401684 - RNA, 19 nt, Homo sapiens
gaacaagccuggagucuac

SEQ ID NO: 401685 - RNA, 19 nt, Homo sapiens
acaccaaggucuacaacua

SEQ ID NO: 401686 - RNA, 19 nt, Homo sapiens
ccaauaaagugacccuguu

SEQ ID NO: 401687 - RNA, 19 nt, Homo sapiens
ugaaauggauuaagaacac

SEQ ID NO: 401688 - RNA, 19 nt, Homo sapiens
caccauagcugccaauagc

SEQ ID NO: 401689 - RNA, 19 nt, Homo sapiens
ggaaagauuaccagcaaca

SEQ ID NO: 401690 - RNA, 19 nt, Homo sapiens
ccagcaacauguucugugu

SEQ ID NO: 401691 - RNA, 19 nt, Homo sapiens
caggaagacucugaacaau

SEQ ID NO: 401692 - RNA, 19 nt, Homo sapiens
caacgaacaguggguggua

SEQ ID NO: 401693 - RNA, 19 nt, Homo sapiens
caguaucucuucagucucu

SEQ ID NO: 401694 - RNA, 19 nt, Homo sapiens
acaggaagacucugaacaa

SEQ ID NO: 401695 - RNA, 19 nt, Homo sapiens
uucagucucuauaccaaua

SEQ ID NO: 401696 - RNA, 19 nt, Homo sapiens
cccaguaucucuucagucu

SEQ ID NO: 401697 - RNA, 19 nt, Homo sapiens
aauccacuccugauccuua

SEQ ID NO: 401698 - RNA, 19 nt, Homo sapiens
ugugguggcucccucauca

SEQ ID NO: 401699 - RNA, 19 nt, Homo sapiens
gaagccuccuacccuggaa

SEQ ID NO: 401700 - RNA, 19 nt, Homo sapiens
cuccuacccuggaaagauu

SEQ ID NO: 401701 - RNA, 19 nt, Homo sapiens
gaggcaaggauucauguca

SEQ ID NO: 401702 - RNA, 19 nt, Homo sapiens
gcucuccucacgugcagua

SEQ ID NO: 401703 - RNA, 19 nt, Homo sapiens
caauaaagugacccuguuc

SEQ ID NO: 401704 - RNA, 19 nt, Homo sapiens
gaacaccauagcugccaau

SEQ ID NO: 401705 - RNA, 19 nt, Homo sapiens
aagauuaccagcaacaugu

SEQ ID NO: 401706 - RNA, 19 nt, Homo sapiens
gaaagauuaccagcaacau

SEQ ID NO: 401707 - RNA, 19 nt, Homo sapiens
gaauucuggcuaccacuuc

SEQ ID NO: 401708 - RNA, 19 nt, Homo sapiens
agaacaagccuggagucua

SEQ ID NO: 401709 - RNA, 19 nt, Homo sapiens
ugaugaugaugacaagauc

SEQ ID NO: 401710 - RNA, 19 nt, Homo sapiens
aaagauuaccagcaacaug

SEQ ID NO: 401711 - RNA, 19 nt, Homo sapiens
caucaaugcagccaagauc

SEQ ID NO: 401712 - RNA, 19 nt, Homo sapiens
gcugugcccagaagaacaa

SEQ ID NO: 401713 - RNA, 19 nt, Homo sapiens
gacaggaagacucugaaca

SEQ ID NO: 401714 - RNA, 19 nt, Homo sapiens
cagucucuauaccaauaaa

SEQ ID NO: 401715 - RNA, 19 nt, Homo sapiens
ggauuaagaacaccauagc

SEQ ID NO: 401716 - RNA, 19 nt, Homo sapiens
gagagcacaacaucgaagu

SEQ ID NO: 401717 - RNA, 19 nt, Homo sapiens
guggcucccucaucaacga

SEQ ID NO: 401718 - RNA, 19 nt, Homo sapiens
ggauucaugucagggugau

SEQ ID NO: 401719 - RNA, 19 nt, Homo sapiens
gggagagcacaacaucgaa

SEQ ID NO: 401720 - RNA, 19 nt, Homo sapiens
gagucuacaccaaggucua

SEQ ID NO: 401721 - RNA, 19 nt, Homo sapiens
gugaaauggauuaagaaca

SEQ ID NO: 401722 - RNA, 19 nt, Homo sapiens
gggaggcaaggauucaugu

SEQ ID NO: 401723 - RNA, 19 nt, Homo sapiens
gaacaggccuggagucuac

SEQ ID NO: 401724 - RNA, 19 nt, Homo sapiens
acaccaaggucuacaacua

SEQ ID NO: 401725 - RNA, 19 nt, Homo sapiens
gccggacucuggacaauga

SEQ ID NO: 401726 - RNA, 19 nt, Homo sapiens
ggaaagauuaccaacaaca

SEQ ID NO: 401727 - RNA, 19 nt, Homo sapiens
gaaagauuaccaacaacau

SEQ ID NO: 401728 - RNA, 19 nt, Homo sapiens
uaccagguguccuugaauu

SEQ ID NO: 401729 - RNA, 19 nt, Homo sapiens
ugcagucucuauaccaaua

SEQ ID NO: 401730 - RNA, 19 nt, Homo sapiens
caccugccgucaucaauuc

SEQ ID NO: 401731 - RNA, 19 nt, Homo sapiens
acaaugacauccugcugau

SEQ ID NO: 401732 - RNA, 19 nt, Homo sapiens
ccaugaaucuacuucugau

SEQ ID NO: 401733 - RNA, 19 nt, Homo sapiens
gaaucuacuucugauccuu

SEQ ID NO: 401734 - RNA, 19 nt, Homo sapiens
acaacuauguggacuggau

SEQ ID NO: 401735 - RNA, 19 nt, Homo sapiens
uauguggacuggauuaagg

SEQ ID NO: 401736 - RNA, 19 nt, Homo sapiens
uaaagugacccugcucuca

SEQ ID NO: 401737 - RNA, 19 nt, Homo sapiens
ccuaccagguguccuugaa

SEQ ID NO: 401738 - RNA, 19 nt, Homo sapiens
caccaugaaucuacuucug

SEQ ID NO: 401739 - RNA, 19 nt, Homo sapiens
aaucuacuucugauccuua

SEQ ID NO: 401740 - RNA, 19 nt, Homo sapiens
cuucugauccuuaccuuug

SEQ ID NO: 401741 - RNA, 19 nt, Homo sapiens
caccaaggucuacaacuau

SEQ ID NO: 401742 - RNA, 19 nt, Homo sapiens
ggccuggagucuacaccaa

SEQ ID NO: 401743 - RNA, 19 nt, Homo sapiens
gcagucucuauaccaauaa

SEQ ID NO: 401744 - RNA, 19 nt, Homo sapiens
aaagauuaccaacaacaug

SEQ ID NO: 401745 - RNA, 19 nt, Homo sapiens
ucaccugccgucaucaauu

SEQ ID NO: 401746 - RNA, 19 nt, Homo sapiens
gaauucuggcuaccacuuc

SEQ ID NO: 401747 - RNA, 19 nt, Homo sapiens
caacuauguggacuggauu

SEQ ID NO: 401748 - RNA, 19 nt, Homo sapiens
gcccuguggucuccaaugg

SEQ ID NO: 401749 - RNA, 19 nt, Homo sapiens
aaugacauccugcugauca

SEQ ID NO: 401750 - RNA, 19 nt, Homo sapiens
caucaaugcagccaagauc

SEQ ID NO: 401751 - RNA, 19 nt, Homo sapiens
ugaugaugaugacaagauc

SEQ ID NO: 401752 - RNA, 19 nt, Homo sapiens
cagucucuauaccaauaaa

SEQ ID NO: 401753 - RNA, 19 nt, Homo sapiens
caaggucuacaacuaugug

SEQ ID NO: 401754 - RNA, 19 nt, Homo sapiens
cagccggacucuggacaau

SEQ ID NO: 401755 - RNA, 19 nt, Homo sapiens
gagagcacaacaucgaagu

SEQ ID NO: 401756 - RNA, 19 nt, Homo sapiens
ugcgguggcucccucauca

SEQ ID NO: 401757 - RNA, 19 nt, Homo sapiens
cagguguccuugaauucug

SEQ ID NO: 401758 - RNA, 19 nt, Homo sapiens
aagauuaccaacaacaugu

SEQ ID NO: 401759 - RNA, 19 nt, Homo sapiens
gggagagcacaacaucgaa

SEQ ID NO: 401760 - RNA, 19 nt, Homo sapiens
ucugcagucucuauaccaa

SEQ ID NO: 401761 - RNA, 19 nt, Homo sapiens
gagucuacaccaaggucua

SEQ ID NO: 401762 - RNA, 19 nt, Homo sapiens
ggauuaaggacaccauagc

SEQ ID NO: 401763 - RNA, 19 nt, Homo sapiens
accaaggucuacaacuaug

SEQ ID NO: 401764 - RNA, 19 nt, Homo sapiens
gaacaggccuggagucuac

SEQ ID NO: 401765 - RNA, 19 nt, Homo sapiens
acaccaaggucuacaacua

SEQ ID NO: 401766 - RNA, 19 nt, Homo sapiens
gggacacucuggacaauga

SEQ ID NO: 401767 - RNA, 19 nt, Homo sapiens
gggcaacacucugagcuuu

SEQ ID NO: 401768 - RNA, 19 nt, Homo sapiens
ugacgaugaugacaagauu

SEQ ID NO: 401769 - RNA, 19 nt, Homo sapiens
gaucauccgccacccuaaa

SEQ ID NO: 401770 - RNA, 19 nt, Homo sapiens
ugcagucucuauaccaaua

SEQ ID NO: 401771 - RNA, 19 nt, Homo sapiens
gagcuuuggugcugacuac

SEQ ID NO: 401772 - RNA, 19 nt, Homo sapiens
gcaacacucugagcuuugg

SEQ ID NO: 401773 - RNA, 19 nt, Homo sapiens
caacggacagcuccaagga

SEQ ID NO: 401774 - RNA, 19 nt, Homo sapiens
cuaccaccaugaauccauu

SEQ ID NO: 401775 - RNA, 19 nt, Homo sapiens
gaaagauuaccaacagcau

SEQ ID NO: 401776 - RNA, 19 nt, Homo sapiens
acaacuauguggacuggau

SEQ ID NO: 401777 - RNA, 19 nt, Homo sapiens
uauguggacuggauuaagg

SEQ ID NO: 401778 - RNA, 19 nt, Homo sapiens
ggagagcacaacaucaaag

SEQ ID NO: 401779 - RNA, 19 nt, Homo sapiens
cuggaaagauuaccaacag

SEQ ID NO: 401780 - RNA, 19 nt, Homo sapiens
gagagcacaacaucaaagu

SEQ ID NO: 401781 - RNA, 19 nt, Homo sapiens
caccaaggucuacaacuau

SEQ ID NO: 401782 - RNA, 19 nt, Homo sapiens
ggccuggagucuacaccaa

SEQ ID NO: 401783 - RNA, 19 nt, Homo sapiens
gggagagcacaacaucaaa

SEQ ID NO: 401784 - RNA, 19 nt, Homo sapiens
gcagucucuauaccaauaa

SEQ ID NO: 401785 - RNA, 19 nt, Homo sapiens
caacuauguggacuggauu

SEQ ID NO: 401786 - RNA, 19 nt, Homo sapiens
cagggacacucuggacaau

SEQ ID NO: 401787 - RNA, 19 nt, Homo sapiens
ugggagagcacaacaucaa

SEQ ID NO: 401788 - RNA, 19 nt, Homo sapiens
gaauucuggcucccacuuc

SEQ ID NO: 401789 - RNA, 19 nt, Homo sapiens
caucaaugcggccaagauc

SEQ ID NO: 401790 - RNA, 19 nt, Homo sapiens
cagucucuauaccaauaaa

SEQ ID NO: 401791 - RNA, 19 nt, Homo sapiens
caaggucuacaacuaugug

SEQ ID NO: 401792 - RNA, 19 nt, Homo sapiens
ugcgguggcucccucauca

SEQ ID NO: 401793 - RNA, 19 nt, Homo sapiens
ggcugugccuggaagaaca

SEQ ID NO: 401794 - RNA, 19 nt, Homo sapiens
ucugcagucucuauaccaa

SEQ ID NO: 401795 - RNA, 19 nt, Homo sapiens
gagucuacaccaaggucua

SEQ ID NO: 401796 - RNA, 19 nt, Homo sapiens
ugugggagcugcuguugcu

SEQ ID NO: 401797 - RNA, 19 nt, Homo sapiens
ucaaugcggccaagaucau

SEQ ID NO: 401798 - RNA, 19 nt, Homo sapiens
accaaggucuacaacuaug

SEQ ID NO: 401799 - RNA, 19 nt, Homo sapiens
ggcaacacucugagcuuug

SEQ ID NO: 401800 - RNA, 19 nt, Homo sapiens
caccugccgucaucaaugc

SEQ ID NO: 401801 - RNA, 19 nt, Homo sapiens
ucaccugccgucaucaaug

SEQ ID NO: 401802 - RNA, 19 nt, Homo sapiens
cagcgaacaguggguggua

SEQ ID NO: 401803 - RNA, 19 nt, Homo sapiens
ggaacaaccucaccacaua

SEQ ID NO: 401804 - RNA, 19 nt, Homo sapiens
caaggagucuggaugaaua

SEQ ID NO: 401805 - RNA, 19 nt, Homo sapiens
gaacaaacccugccaagug

SEQ ID NO: 401806 - RNA, 19 nt, Homo sapiens
guaauugacuaccauguaa

SEQ ID NO: 401807 - RNA, 19 nt, Homo sapiens
acaagaugcucaacaauaa

SEQ ID NO: 401808 - RNA, 19 nt, Homo sapiens
ggaagauaauggagaauga

SEQ ID NO: 401809 - RNA, 19 nt, Homo sapiens
acaaagugcugaaggauaa

SEQ ID NO: 401810 - RNA, 19 nt, Homo sapiens
ggucagauuucuccaauga

SEQ ID NO: 401811 - RNA, 19 nt, Homo sapiens
ggaacuaccuagaugaaga

SEQ ID NO: 401812 - RNA, 19 nt, Homo sapiens
agacgaagcucucuuacaa

SEQ ID NO: 401813 - RNA, 19 nt, Homo sapiens
ucaaagcucugacgaucua

SEQ ID NO: 401814 - RNA, 19 nt, Homo sapiens
guaugcagcuguuggagua

SEQ ID NO: 401815 - RNA, 19 nt, Homo sapiens
gcagacaccugguucuaga

SEQ ID NO: 401816 - RNA, 19 nt, Homo sapiens
gaauaucacugucccagau

SEQ ID NO: 401817 - RNA, 19 nt, Homo sapiens
gguggcugcuucucuauua

SEQ ID NO: 401818 - RNA, 19 nt, Homo sapiens
uuaaagagauggagcaaga

SEQ ID NO: 401819 - RNA, 19 nt, Homo sapiens
ggaaagucauggagguaaa

SEQ ID NO: 401820 - RNA, 19 nt, Homo sapiens
gacaaccucuucacucaaa

SEQ ID NO: 401821 - RNA, 19 nt, Homo sapiens
gaagaacuguaaugcuguu

SEQ ID NO: 401822 - RNA, 19 nt, Homo sapiens
caccauaucuucccauuuc

SEQ ID NO: 401823 - RNA, 19 nt, Homo sapiens
agaacuagcucugcccuua

SEQ ID NO: 401824 - RNA, 19 nt, Homo sapiens
ggaagcuucuagagacuuu

SEQ ID NO: 401825 - RNA, 19 nt, Homo sapiens
ggagugaggaacugaauuu

SEQ ID NO: 401826 - RNA, 19 nt, Homo sapiens
gaucaagcuuuacuucaug

SEQ ID NO: 401827 - RNA, 19 nt, Homo sapiens
ugacuaccauguaauagaa

SEQ ID NO: 401828 - RNA, 19 nt, Homo sapiens
uaacagagugcauagcaua

SEQ ID NO: 401829 - RNA, 19 nt, Homo sapiens
gcauagcacuuaacagagu

SEQ ID NO: 401830 - RNA, 19 nt, Homo sapiens
gauccuuccuuauuccuaa

SEQ ID NO: 401831 - RNA, 19 nt, Homo sapiens
gggaagcaguucuugcaaa

SEQ ID NO: 401832 - RNA, 19 nt, Homo sapiens
gaggugacuuggaauauca

SEQ ID NO: 401833 - RNA, 19 nt, Homo sapiens
ggaagcaguucuugcaaag

SEQ ID NO: 401834 - RNA, 19 nt, Homo sapiens
ggaucaagcuuuacuucau

SEQ ID NO: 401835 - RNA, 19 nt, Homo sapiens
ccagauggguuucggauca

SEQ ID NO: 401836 - RNA, 19 nt, Homo sapiens
gaucagaagcuccaaguuc

SEQ ID NO: 401837 - RNA, 19 nt, Homo sapiens
gcaggugacuucaucucuu

SEQ ID NO: 401838 - RNA, 19 nt, Homo sapiens
ggacgauccuccgaugaaa

SEQ ID NO: 401839 - RNA, 19 nt, Homo sapiens
cuuaaaugcuguaugcuuu

SEQ ID NO: 401840 - RNA, 19 nt, Homo sapiens
caauagagcagguaucuuc

SEQ ID NO: 401841 - RNA, 19 nt, Homo sapiens
cuccagagcuccaagauau

SEQ ID NO: 401842 - RNA, 19 nt, Homo sapiens
gaugggacguggaguaaca

SEQ ID NO: 401843 - RNA, 19 nt, Homo sapiens
gcaguuugaggacauauuu

SEQ ID NO: 401844 - RNA, 19 nt, Homo sapiens
uaaagccaauguaaccaaa

SEQ ID NO: 401845 - RNA, 19 nt, Homo sapiens
uagcaaauguaacuaggaa

SEQ ID NO: 401846 - RNA, 19 nt, Homo sapiens
gaaggaccgcuacggagua

SEQ ID NO: 401847 - RNA, 19 nt, Homo sapiens
ccuauacucuuccuuccua

SEQ ID NO: 401848 - RNA, 19 nt, Homo sapiens
uaaaugcaccuuagcagaa

SEQ ID NO: 401849 - RNA, 19 nt, Homo sapiens
guaaaagucugaugaggaa

SEQ ID NO: 401850 - RNA, 19 nt, Homo sapiens
gcaccugccagaaggcuua

SEQ ID NO: 401851 - RNA, 19 nt, Homo sapiens
gauccgacccuacgugauu

SEQ ID NO: 401852 - RNA, 19 nt, Homo sapiens
auacagggcugcaggaaau

SEQ ID NO: 401853 - RNA, 19 nt, Homo sapiens
ugagguggcugcuucucua

SEQ ID NO: 401854 - RNA, 19 nt, Homo sapiens
ccuccuaccuuugugaaua

SEQ ID NO: 401855 - RNA, 19 nt, Homo sapiens
uacaagaugcucaacaaua

SEQ ID NO: 401856 - RNA, 19 nt, Homo sapiens
gcuacaaagugcugaagga

SEQ ID NO: 401857 - RNA, 19 nt, Homo sapiens
gguuucggaucaagcuuua

SEQ ID NO: 401858 - RNA, 19 nt, Homo sapiens
uacaaucgguucaaaggaa

SEQ ID NO: 401859 - RNA, 19 nt, Homo sapiens
auacaagucugagaucaaa

SEQ ID NO: 401860 - RNA, 19 nt, Homo sapiens
ccaaguuccugucuucugu

SEQ ID NO: 401861 - RNA, 19 nt, Homo sapiens
agaggaagauaauggagaa

SEQ ID NO: 401862 - RNA, 19 nt, Homo sapiens
gcaagagaguggucagaac

SEQ ID NO: 401863 - RNA, 19 nt, Homo sapiens
aagcagccauuucuccuuu

SEQ ID NO: 401864 - RNA, 19 nt, Homo sapiens
ugggagacaugaaacauau

SEQ ID NO: 401865 - RNA, 19 nt, Homo sapiens
gcuccaaguuccugucuuc

SEQ ID NO: 401866 - RNA, 19 nt, Homo sapiens
gagaaagaggccaguggua

SEQ ID NO: 401867 - RNA, 19 nt, Homo sapiens
caacaauaacacagguaua

SEQ ID NO: 401868 - RNA, 19 nt, Homo sapiens
gaacuguaaugcuguuuug

SEQ ID NO: 401869 - RNA, 19 nt, Homo sapiens
ggagaaugagaacauauau

SEQ ID NO: 401870 - RNA, 19 nt, Homo sapiens
gaacaugcacuagaugaca

SEQ ID NO: 401871 - RNA, 19 nt, Homo sapiens
gcaaauguaacuaggaaca

SEQ ID NO: 401872 - RNA, 19 nt, Homo sapiens
gaaaugcuauaccuuaccu

SEQ ID NO: 401873 - RNA, 19 nt, Homo sapiens
ggacguggaguaacaagau

SEQ ID NO: 401874 - RNA, 19 nt, Homo sapiens
ggaauccuccuaccuuugu

SEQ ID NO: 401875 - RNA, 19 nt, Homo sapiens
ccaaagaagaacuguaaug

SEQ ID NO: 401876 - RNA, 19 nt, Homo sapiens
uaacuaggaacaugcacua

SEQ ID NO: 401877 - RNA, 19 nt, Homo sapiens
gugcauagcauacacuguu

SEQ ID NO: 401878 - RNA, 19 nt, Homo sapiens
ggugaugacugugggaaga

SEQ ID NO: 401879 - RNA, 19 nt, Homo sapiens
uugcaaagguucccagaga

SEQ ID NO: 401880 - RNA, 19 nt, Homo sapiens
caggagcccuauuacaaga

SEQ ID NO: 401881 - RNA, 19 nt, Homo sapiens
gaaggauaauguggagaug

SEQ ID NO: 401882 - RNA, 19 nt, Homo sapiens
cuaccuagaugaagagagu

SEQ ID NO: 401883 - RNA, 19 nt, Homo sapiens
caagucauucuaccucuuu

SEQ ID NO: 401884 - RNA, 19 nt, Homo sapiens
ccagagcuccaagauauaa

SEQ ID NO: 401885 - RNA, 19 nt, Homo sapiens
ggugggcccugguaguuug

SEQ ID NO: 401886 - RNA, 19 nt, Homo sapiens
acaagucugagaucaaaua

SEQ ID NO: 401887 - RNA, 19 nt, Homo sapiens
ugacacaggcuacaaagug

SEQ ID NO: 401888 - RNA, 19 nt, Homo sapiens
caacuugcccaacaucaau

SEQ ID NO: 401889 - RNA, 19 nt, Homo sapiens
ggcagacgaagcucucuua

SEQ ID NO: 401890 - RNA, 19 nt, Homo sapiens
ggaaggagccauggucauc

SEQ ID NO: 401891 - RNA, 19 nt, Homo sapiens
auucagaggugacuuggaa

SEQ ID NO: 401892 - RNA, 19 nt, Homo sapiens
guccugauccuguuccaua

SEQ ID NO: 401893 - RNA, 19 nt, Homo sapiens
ugagguaaagccaauguaa

SEQ ID NO: 401894 - RNA, 19 nt, Homo sapiens
gaaagugaccagggacaug

SEQ ID NO: 401895 - RNA, 19 nt, Homo sapiens
cagagacccugauggagau

SEQ ID NO: 401896 - RNA, 19 nt, Homo sapiens
gagucuggaugaauaaagu

SEQ ID NO: 401897 - RNA, 19 nt, Homo sapiens
caagauauaagcccuccaa

SEQ ID NO: 401898 - RNA, 19 nt, Homo sapiens
ccuccucccucaucucaaa

SEQ ID NO: 401899 - RNA, 19 nt, Homo sapiens
gcccuuaaaugcuguaugc

SEQ ID NO: 401900 - RNA, 19 nt, Homo sapiens
ggagcccuauuacaagaug

SEQ ID NO: 401901 - RNA, 19 nt, Homo sapiens
gucaggagcccuauuacaa

SEQ ID NO: 401902 - RNA, 19 nt, Homo sapiens
guuccugucuucuguuuua

SEQ ID NO: 401903 - RNA, 19 nt, Homo sapiens
acacaaaggucuccaauua

SEQ ID NO: 401904 - RNA, 19 nt, Homo sapiens
ggaacaaccucaccacaua

SEQ ID NO: 401905 - RNA, 19 nt, Homo sapiens
caaggagucuggaugaaua

SEQ ID NO: 401906 - RNA, 19 nt, Homo sapiens
gagaagagcauucagguuu

SEQ ID NO: 401907 - RNA, 19 nt, Homo sapiens
acaagaugcucaacaauaa

SEQ ID NO: 401908 - RNA, 19 nt, Homo sapiens
acaaagugcugaaggauaa

SEQ ID NO: 401909 - RNA, 19 nt, Homo sapiens
ggucagauuucuccaauga

SEQ ID NO: 401910 - RNA, 19 nt, Homo sapiens
gaacacauuugggcccaua

SEQ ID NO: 401911 - RNA, 19 nt, Homo sapiens
gaaauaaacccucguggau

SEQ ID NO: 401912 - RNA, 19 nt, Homo sapiens
guaaagggccucugcauug

SEQ ID NO: 401913 - RNA, 19 nt, Homo sapiens
cagaugggcuuaccacaaa

SEQ ID NO: 401914 - RNA, 19 nt, Homo sapiens
gaauaucacugucccagau

SEQ ID NO: 401915 - RNA, 19 nt, Homo sapiens
gguggcugcuucucuauua

SEQ ID NO: 401916 - RNA, 19 nt, Homo sapiens
aauaaacccucguggauaa

SEQ ID NO: 401917 - RNA, 19 nt, Homo sapiens
gacaaccucuucacucaaa

SEQ ID NO: 401918 - RNA, 19 nt, Homo sapiens
ggagaaaguugggaagguu

SEQ ID NO: 401919 - RNA, 19 nt, Homo sapiens
gcacacuccacauuacuua

SEQ ID NO: 401920 - RNA, 19 nt, Homo sapiens
gaucaagcuuuacuucaug

SEQ ID NO: 401921 - RNA, 19 nt, Homo sapiens
ggucucaaguggaaauaaa

SEQ ID NO: 401922 - RNA, 19 nt, Homo sapiens
gcaacaggcuggcauaagg

SEQ ID NO: 401923 - RNA, 19 nt, Homo sapiens
gaauggcacauguaaauga

SEQ ID NO: 401924 - RNA, 19 nt, Homo sapiens
ccaccaagcccuuaaauuc

SEQ ID NO: 401925 - RNA, 19 nt, Homo sapiens
gaggugacuuggaauauca

SEQ ID NO: 401926 - RNA, 19 nt, Homo sapiens
acacggaccuugucagaug

SEQ ID NO: 401927 - RNA, 19 nt, Homo sapiens
ggaucaagcuuuacuucau

SEQ ID NO: 401928 - RNA, 19 nt, Homo sapiens
ccagauggguuucggauca

SEQ ID NO: 401929 - RNA, 19 nt, Homo sapiens
ucacagggcugauuguucu

SEQ ID NO: 401930 - RNA, 19 nt, Homo sapiens
gaugggacguggaguaaca

SEQ ID NO: 401931 - RNA, 19 nt, Homo sapiens
gcaguuugaggacauauuu

SEQ ID NO: 401932 - RNA, 19 nt, Homo sapiens
aaacuacaaccacgauaua

SEQ ID NO: 401933 - RNA, 19 nt, Homo sapiens
gagcaaggcagccagagaa

SEQ ID NO: 401934 - RNA, 19 nt, Homo sapiens
gacagcacacuccacauua

SEQ ID NO: 401935 - RNA, 19 nt, Homo sapiens
auacagggcugcaggaaau

SEQ ID NO: 401936 - RNA, 19 nt, Homo sapiens
ccuccuaccuuugugaaua

SEQ ID NO: 401937 - RNA, 19 nt, Homo sapiens
ugagguggcugcuucucua

SEQ ID NO: 401938 - RNA, 19 nt, Homo sapiens
gggacccacuccuucauuu

SEQ ID NO: 401939 - RNA, 19 nt, Homo sapiens
caaaagacauggagaaagu

SEQ ID NO: 401940 - RNA, 19 nt, Homo sapiens
ggacuagccuuggccuaau

SEQ ID NO: 401941 - RNA, 19 nt, Homo sapiens
ggaacggugagcugacuua

SEQ ID NO: 401942 - RNA, 19 nt, Homo sapiens
gcacacggaccuugucaga

SEQ ID NO: 401943 - RNA, 19 nt, Homo sapiens
uacaagaugcucaacaaua

SEQ ID NO: 401944 - RNA, 19 nt, Homo sapiens
gcuacaaagugcugaagga

SEQ ID NO: 401945 - RNA, 19 nt, Homo sapiens
gguuucggaucaagcuuua

SEQ ID NO: 401946 - RNA, 19 nt, Homo sapiens
auacaagucugagaucaaa

SEQ ID NO: 401947 - RNA, 19 nt, Homo sapiens
gcccuuaaauucccauugu

SEQ ID NO: 401948 - RNA, 19 nt, Homo sapiens
gcuuggaccugacuauuag

SEQ ID NO: 401949 - RNA, 19 nt, Homo sapiens
gcagaugggcuuaccacaa

SEQ ID NO: 401950 - RNA, 19 nt, Homo sapiens
uaaagggccucugcauugu

SEQ ID NO: 401951 - RNA, 19 nt, Homo sapiens
cgacagcacacuccacauu

SEQ ID NO: 401952 - RNA, 19 nt, Homo sapiens
gcaggucuauggagucuac

SEQ ID NO: 401953 - RNA, 19 nt, Homo sapiens
caacaauaacacagguaua

SEQ ID NO: 401954 - RNA, 19 nt, Homo sapiens
ggacguggaguaacaagau

SEQ ID NO: 401955 - RNA, 19 nt, Homo sapiens
ggaauccuccuaccuuugu

SEQ ID NO: 401956 - RNA, 19 nt, Homo sapiens
cauuagaagucacccaaau

SEQ ID NO: 401957 - RNA, 19 nt, Homo sapiens
caggagcccuauuacaaga

SEQ ID NO: 401958 - RNA, 19 nt, Homo sapiens
gaaggauaauguggagaug

SEQ ID NO: 401959 - RNA, 19 nt, Homo sapiens
ucaaccggcucaucaaaca

SEQ ID NO: 401960 - RNA, 19 nt, Homo sapiens
acaagucugagaucaaaua

SEQ ID NO: 401961 - RNA, 19 nt, Homo sapiens
ugacacaggcuacaaagug

SEQ ID NO: 401962 - RNA, 19 nt, Homo sapiens
aaauaaacccucguggaua

SEQ ID NO: 401963 - RNA, 19 nt, Homo sapiens
uaucagaccauauggaaug

SEQ ID NO: 401964 - RNA, 19 nt, Homo sapiens
acggugagcugacuuacuu

SEQ ID NO: 401965 - RNA, 19 nt, Homo sapiens
gcagcaagcaggucuaugg

SEQ ID NO: 401966 - RNA, 19 nt, Homo sapiens
uaccugggcuugcaugaug

SEQ ID NO: 401967 - RNA, 19 nt, Homo sapiens
ggaccugacuauuagaaaa

SEQ ID NO: 401968 - RNA, 19 nt, Homo sapiens
auucagaggugacuuggaa

SEQ ID NO: 401969 - RNA, 19 nt, Homo sapiens
guccugauccuguuccaua

SEQ ID NO: 401970 - RNA, 19 nt, Homo sapiens
ucuauggagucuacacaaa

SEQ ID NO: 401971 - RNA, 19 nt, Homo sapiens
gagucuggaugaauaaagu

SEQ ID NO: 401972 - RNA, 19 nt, Homo sapiens
gagaaaguugggaagguuu

SEQ ID NO: 401973 - RNA, 19 nt, Homo sapiens
ggagcccuauuacaagaug

SEQ ID NO: 401974 - RNA, 19 nt, Homo sapiens
gucaggagcccuauuacaa

SEQ ID NO: 401975 - RNA, 19 nt, Homo sapiens
ggagaagagcauucagguu

SEQ ID NO: 401976 - RNA, 19 nt, Homo sapiens
gggacuagccuuggccuaa

SEQ ID NO: 401977 - RNA, 19 nt, Homo sapiens
gacguggaguaacaagauu

SEQ ID NO: 401978 - RNA, 19 nt, Homo sapiens
gcuggaggcucucauacag

SEQ ID NO: 401979 - RNA, 19 nt, Homo sapiens
cuucgagagugccaaauga

SEQ ID NO: 401980 - RNA, 19 nt, Homo sapiens
cugaucaccuucucuacaa

SEQ ID NO: 401981 - RNA, 19 nt, Homo sapiens
ucagaggugacuuggaaua

SEQ ID NO: 401982 - RNA, 19 nt, Homo sapiens
caauauguuuggccagauc

SEQ ID NO: 401983 - RNA, 19 nt, Homo sapiens
ccaacuggcuguauaaccu

SEQ ID NO: 401984 - RNA, 19 nt, Homo sapiens
cuuagucgauuaccuggaa

SEQ ID NO: 401985 - RNA, 19 nt, Homo sapiens
gggcugaucaccuucucua

SEQ ID NO: 401986 - RNA, 19 nt, Homo sapiens
acaagauucccaccuguaa

SEQ ID NO: 401987 - RNA, 19 nt, Homo sapiens
gcuacauccuccacacaga

SEQ ID NO: 401988 - RNA, 19 nt, Homo sapiens
ggccuaauccuuccucuag

SEQ ID NO: 401989 - RNA, 19 nt, Homo sapiens
uuacuuaucagaccauaug

SEQ ID NO: 401990 - RNA, 19 nt, Homo sapiens
gggcuuaccacaaaguguu

SEQ ID NO: 401991 - RNA, 19 nt, Homo sapiens
acaaaggucuccaauuacg

SEQ ID NO: 401992 - RNA, 19 nt, Homo sapiens
caaagacacgugccuugga

SEQ ID NO: 401993 - RNA, 19 nt, Homo sapiens
ccacauacaagucugagau

SEQ ID NO: 401994 - RNA, 19 nt, Homo sapiens
gaacaaccucaccacauac

SEQ ID NO: 401995 - RNA, 19 nt, Homo sapiens
agccaaguauuucuucaaa

SEQ ID NO: 401996 - RNA, 19 nt, Homo sapiens
gccuugaaauguauuaucu

SEQ ID NO: 401997 - RNA, 19 nt, Homo sapiens
gaacaccagcugacaccau

SEQ ID NO: 401998 - RNA, 19 nt, Homo sapiens
caacucagaacacauuugg

SEQ ID NO: 401999 - RNA, 19 nt, Homo sapiens
auucacuccugaccacuua

SEQ ID NO: 402000 - RNA, 19 nt, Homo sapiens
gggccuuugucaucuuuga

SEQ ID NO: 402001 - RNA, 19 nt, Homo sapiens
gagccacaguguccugauc

SEQ ID NO: 402002 - RNA, 19 nt, Homo sapiens
guucugugcuggcuacuac

SEQ ID NO: 402003 - RNA, 19 nt, Homo sapiens
gaagauggcuugcgcaugu

SEQ ID NO: 402004 - RNA, 19 nt, Homo sapiens
guaaaugucuucauguuga

SEQ ID NO: 402005 - RNA, 19 nt, Homo sapiens
gcaaaucucucuacuucaa

SEQ ID NO: 402006 - RNA, 19 nt, Homo sapiens
guugugaucuguuguaaua

SEQ ID NO: 402007 - RNA, 19 nt, Homo sapiens
ucacaaagcuauuuaagug

SEQ ID NO: 402008 - RNA, 19 nt, Homo sapiens
cauauaagguuccgucuuu

SEQ ID NO: 402009 - RNA, 19 nt, Homo sapiens
ggagaucgauuugcaguaa

SEQ ID NO: 402010 - RNA, 19 nt, Homo sapiens
gaauuuacaucagcaagua

SEQ ID NO: 402011 - RNA, 19 nt, Homo sapiens
gagacucacuguacuuuaa

SEQ ID NO: 402012 - RNA, 19 nt, Homo sapiens
gaagauguaugggcuauug

SEQ ID NO: 402013 - RNA, 19 nt, Homo sapiens
gaaaccaucucgaaagugu

SEQ ID NO: 402014 - RNA, 19 nt, Homo sapiens
caaauuugauggcucuaua

SEQ ID NO: 402015 - RNA, 19 nt, Homo sapiens
ggacaagaauaccauguga

SEQ ID NO: 402016 - RNA, 19 nt, Homo sapiens
gaaggucacuuaggcgaua

SEQ ID NO: 402017 - RNA, 19 nt, Homo sapiens
uaacaucggucuuuauugu

SEQ ID NO: 402018 - RNA, 19 nt, Homo sapiens
gcaauggucagaagaauuu

SEQ ID NO: 402019 - RNA, 19 nt, Homo sapiens
aaagacagcuggugaguug

SEQ ID NO: 402020 - RNA, 19 nt, Homo sapiens
gaacaagggugugguguca

SEQ ID NO: 402021 - RNA, 19 nt, Homo sapiens
ggaaacaugugggcaauug

SEQ ID NO: 402022 - RNA, 19 nt, Homo sapiens
ggugaugacugcucuguuu

SEQ ID NO: 402023 - RNA, 19 nt, Homo sapiens
gcacagacguugccgugaa

SEQ ID NO: 402024 - RNA, 19 nt, Homo sapiens
ggaauuaccuggacuuugc

SEQ ID NO: 402025 - RNA, 19 nt, Homo sapiens
gaucuaaaccucacuaaug

SEQ ID NO: 402026 - RNA, 19 nt, Homo sapiens
gauauugacugucucucua

SEQ ID NO: 402027 - RNA, 19 nt, Homo sapiens
gauaacaggugcccagguu

SEQ ID NO: 402028 - RNA, 19 nt, Homo sapiens
gaaccugugugucaaaugu

SEQ ID NO: 402029 - RNA, 19 nt, Homo sapiens
gaaggaaacuccagagaac

SEQ ID NO: 402030 - RNA, 19 nt, Homo sapiens
gugaaggacuuggugauua

SEQ ID NO: 402031 - RNA, 19 nt, Homo sapiens
aaacauagguugugccaau

SEQ ID NO: 402032 - RNA, 19 nt, Homo sapiens
ccacaauuaugucagauuu

SEQ ID NO: 402033 - RNA, 19 nt, Homo sapiens
gcauuuagcacaguauuua

SEQ ID NO: 402034 - RNA, 19 nt, Homo sapiens
gaacaggucaugaucaaug

SEQ ID NO: 402035 - RNA, 19 nt, Homo sapiens
guuccaggcucuccucuua

SEQ ID NO: 402036 - RNA, 19 nt, Homo sapiens
ggaaauccgguaagguuua

SEQ ID NO: 402037 - RNA, 19 nt, Homo sapiens
gaaauugaguacagugugu

SEQ ID NO: 402038 - RNA, 19 nt, Homo sapiens
gcuugacccugaaauauuu

SEQ ID NO: 402039 - RNA, 19 nt, Homo sapiens
ugagauggauuaccagaaa

SEQ ID NO: 402040 - RNA, 19 nt, Homo sapiens
caagagaucuagauuguac

SEQ ID NO: 402041 - RNA, 19 nt, Homo sapiens
gaaaugagcaugggcugua

SEQ ID NO: 402042 - RNA, 19 nt, Homo sapiens
gaaucaggcuuaucaaugg

SEQ ID NO: 402043 - RNA, 19 nt, Homo sapiens
gauaacagagugauuugua

SEQ ID NO: 402044 - RNA, 19 nt, Homo sapiens
gaccuucccaguuauauua

SEQ ID NO: 402045 - RNA, 19 nt, Homo sapiens
aagcaaagcugggcaauug

SEQ ID NO: 402046 - RNA, 19 nt, Homo sapiens
gauacaugaugcaguuuaa

SEQ ID NO: 402047 - RNA, 19 nt, Homo sapiens
ggaauauucugucaaugga

SEQ ID NO: 402048 - RNA, 19 nt, Homo sapiens
gaauuuacauccugaccuu

SEQ ID NO: 402049 - RNA, 19 nt, Homo sapiens
ccucugcccucgauucuua

SEQ ID NO: 402050 - RNA, 19 nt, Homo sapiens
uaagugagcccaccaugua

SEQ ID NO: 402051 - RNA, 19 nt, Homo sapiens
gcccuuccguccacaauua

SEQ ID NO: 402052 - RNA, 19 nt, Homo sapiens
gaagucagcuuugguugug

SEQ ID NO: 402053 - RNA, 19 nt, Homo sapiens
ggacuuugcuccaugagau

SEQ ID NO: 402054 - RNA, 19 nt, Homo sapiens
gacaagcgguuacacaaga

SEQ ID NO: 402055 - RNA, 19 nt, Homo sapiens
ggagaugcauccagggaaa

SEQ ID NO: 402056 - RNA, 19 nt, Homo sapiens
caucaaaucuggaacaucu

SEQ ID NO: 402057 - RNA, 19 nt, Homo sapiens
gagaugacuuugacuccua

SEQ ID NO: 402058 - RNA, 19 nt, Homo sapiens
caacaugggcucagacauu

SEQ ID NO: 402059 - RNA, 19 nt, Homo sapiens
ucacaacccuugauaguag

SEQ ID NO: 402060 - RNA, 19 nt, Homo sapiens
ucucaaagaugauuucgaa

SEQ ID NO: 402061 - RNA, 19 nt, Homo sapiens
gagcauauaacacuggaua

SEQ ID NO: 402062 - RNA, 19 nt, Homo sapiens
gaccaugucuccucuagug

SEQ ID NO: 402063 - RNA, 19 nt, Homo sapiens
gaacaccaucauacaauuu

SEQ ID NO: 402064 - RNA, 19 nt, Homo sapiens
ccacagaucauuuccauug

SEQ ID NO: 402065 - RNA, 19 nt, Homo sapiens
gauguuggcuaaugaagga

SEQ ID NO: 402066 - RNA, 19 nt, Homo sapiens
gaugggauguggccagaaa

SEQ ID NO: 402067 - RNA, 19 nt, Homo sapiens
gaacgcaucagccugguaa

SEQ ID NO: 402068 - RNA, 19 nt, Homo sapiens
caacugcaauuaaauccaa

SEQ ID NO: 402069 - RNA, 19 nt, Homo sapiens
ggagggaggucgugcacuu

SEQ ID NO: 402070 - RNA, 19 nt, Homo sapiens
ccaaaggacuucacacaag

SEQ ID NO: 402071 - RNA, 19 nt, Homo sapiens
aaucaaaccugacuuaugg

SEQ ID NO: 402072 - RNA, 19 nt, Homo sapiens
acaaugagauguucgauag

SEQ ID NO: 402073 - RNA, 19 nt, Homo sapiens
gccaaucaauucagcagua

SEQ ID NO: 402074 - RNA, 19 nt, Homo sapiens
ucaugucgcuuuaguuauu

SEQ ID NO: 402075 - RNA, 19 nt, Homo sapiens
ccaaauauauggguugaau

SEQ ID NO: 402076 - RNA, 19 nt, Homo sapiens
gucacgaccuucccaguua

SEQ ID NO: 402077 - RNA, 19 nt, Homo sapiens
ggacaagacucacaaugcu

SEQ ID NO: 402078 - RNA, 19 nt, Homo sapiens
ggaagcggaucacugucua

SEQ ID NO: 402079 - RNA, 19 nt, Homo sapiens
gaaaugaagggcuuauugu

SEQ ID NO: 402080 - RNA, 19 nt, Homo sapiens
gggagaauguccaauuuca

SEQ ID NO: 402081 - RNA, 19 nt, Homo sapiens
guucaugucgcuuuaguua

SEQ ID NO: 402082 - RNA, 19 nt, Homo sapiens
ggacuacucuaccgaugga

SEQ ID NO: 402083 - RNA, 19 nt, Homo sapiens
gaaacugcgucugugauga

SEQ ID NO: 402084 - RNA, 19 nt, Homo sapiens
uggcaaaucucucuacuuc

SEQ ID NO: 402085 - RNA, 19 nt, Homo sapiens
ggucaucaauccugaacuu

SEQ ID NO: 402086 - RNA, 19 nt, Homo sapiens
caauucagcucacagacaa

SEQ ID NO: 402087 - RNA, 19 nt, Homo sapiens
acaaggagcuccaacagau

SEQ ID NO: 402088 - RNA, 19 nt, Homo sapiens
gauuugggaucaugucuga

SEQ ID NO: 402089 - RNA, 19 nt, Homo sapiens
ggaaguacuugcacugagu

SEQ ID NO: 402090 - RNA, 19 nt, Homo sapiens
gggccaaacugcuacuuga

SEQ ID NO: 402091 - RNA, 19 nt, Homo sapiens
caacccaacucaaagacaa

SEQ ID NO: 402092 - RNA, 19 nt, Homo sapiens
gagagugucuuacaauguc

SEQ ID NO: 402093 - RNA, 19 nt, Homo sapiens
gccaauugguggacacuuu

SEQ ID NO: 402094 - RNA, 19 nt, Homo sapiens
ucagccaucuguauucuuu

SEQ ID NO: 402095 - RNA, 19 nt, Homo sapiens
ucuggaacaucucuaauuu

SEQ ID NO: 402096 - RNA, 19 nt, Homo sapiens
caacugguaucgaauccaa

SEQ ID NO: 402097 - RNA, 19 nt, Homo sapiens
caaacuggauuucaagaca

SEQ ID NO: 402098 - RNA, 19 nt, Homo sapiens
aagcagaucaucccaguua

SEQ ID NO: 402099 - RNA, 19 nt, Homo sapiens
aagaaugccuuccaaguau

SEQ ID NO: 402100 - RNA, 19 nt, Homo sapiens
gagcuacaguuaagcauag

SEQ ID NO: 402101 - RNA, 19 nt, Homo sapiens
uaacauucuuggucacaaa

SEQ ID NO: 402102 - RNA, 19 nt, Homo sapiens
gaagaugcccucaccaaca

SEQ ID NO: 402103 - RNA, 19 nt, Homo sapiens
gaagauggcuugcgcaugu

SEQ ID NO: 402104 - RNA, 19 nt, Homo sapiens
guaaaugucuucauguuga

SEQ ID NO: 402105 - RNA, 19 nt, Homo sapiens
gcaaaucucucuacuucaa

SEQ ID NO: 402106 - RNA, 19 nt, Homo sapiens
guugugaucuguuguaaua

SEQ ID NO: 402107 - RNA, 19 nt, Homo sapiens
ucacaaagcuauuuaagug

SEQ ID NO: 402108 - RNA, 19 nt, Homo sapiens
cauauaagguuccgucuuu

SEQ ID NO: 402109 - RNA, 19 nt, Homo sapiens
ggagaucgauuugcaguaa

SEQ ID NO: 402110 - RNA, 19 nt, Homo sapiens
gaauuuacaucagcaagua

SEQ ID NO: 402111 - RNA, 19 nt, Homo sapiens
gagacucacuguacuuuaa

SEQ ID NO: 402112 - RNA, 19 nt, Homo sapiens
gaagauguaugggcuauug

SEQ ID NO: 402113 - RNA, 19 nt, Homo sapiens
gaaaccaucucgaaagugu

SEQ ID NO: 402114 - RNA, 19 nt, Homo sapiens
caaauuugauggcucuaua

SEQ ID NO: 402115 - RNA, 19 nt, Homo sapiens
ggacaagaauaccauguga

SEQ ID NO: 402116 - RNA, 19 nt, Homo sapiens
gaaggucacuuaggcgaua

SEQ ID NO: 402117 - RNA, 19 nt, Homo sapiens
uaacaucggucuuuauugu

SEQ ID NO: 402118 - RNA, 19 nt, Homo sapiens
gcaauggucagaagaauuu

SEQ ID NO: 402119 - RNA, 19 nt, Homo sapiens
aaagacagcuggugaguug

SEQ ID NO: 402120 - RNA, 19 nt, Homo sapiens
gaacaagggugugguguca

SEQ ID NO: 402121 - RNA, 19 nt, Homo sapiens
ggaaacaugugggcaauug

SEQ ID NO: 402122 - RNA, 19 nt, Homo sapiens
ggugaugacugcucuguuu

SEQ ID NO: 402123 - RNA, 19 nt, Homo sapiens
gcacagacguugccgugaa

SEQ ID NO: 402124 - RNA, 19 nt, Homo sapiens
ggaauuaccuggacuuugc

SEQ ID NO: 402125 - RNA, 19 nt, Homo sapiens
gaucuaaaccucacuaaug

SEQ ID NO: 402126 - RNA, 19 nt, Homo sapiens
gauauugacugucucucua

SEQ ID NO: 402127 - RNA, 19 nt, Homo sapiens
gauaacaggugcccagguu

SEQ ID NO: 402128 - RNA, 19 nt, Homo sapiens
gaaccugugugucaaaugu

SEQ ID NO: 402129 - RNA, 19 nt, Homo sapiens
gaaggaaacuccagagaac

SEQ ID NO: 402130 - RNA, 19 nt, Homo sapiens
gugaaggacuuggugauua

SEQ ID NO: 402131 - RNA, 19 nt, Homo sapiens
aaacauagguugugccaau

SEQ ID NO: 402132 - RNA, 19 nt, Homo sapiens
ccacaauuaugucagauuu

SEQ ID NO: 402133 - RNA, 19 nt, Homo sapiens
gcauuuagcacaguauuua

SEQ ID NO: 402134 - RNA, 19 nt, Homo sapiens
gaacaggucaugaucaaug

SEQ ID NO: 402135 - RNA, 19 nt, Homo sapiens
guuccaggcucuccucuua

SEQ ID NO: 402136 - RNA, 19 nt, Homo sapiens
ggaaauccgguaagguuua

SEQ ID NO: 402137 - RNA, 19 nt, Homo sapiens
gaaauugaguacagugugu

SEQ ID NO: 402138 - RNA, 19 nt, Homo sapiens
gcuugacccugaaauauuu

SEQ ID NO: 402139 - RNA, 19 nt, Homo sapiens
ugagauggauuaccagaaa

SEQ ID NO: 402140 - RNA, 19 nt, Homo sapiens
caagagaucuagauuguac

SEQ ID NO: 402141 - RNA, 19 nt, Homo sapiens
gaaaugagcaugggcugua

SEQ ID NO: 402142 - RNA, 19 nt, Homo sapiens
gaaucaggcuuaucaaugg

SEQ ID NO: 402143 - RNA, 19 nt, Homo sapiens
gauaacagagugauuugua

SEQ ID NO: 402144 - RNA, 19 nt, Homo sapiens
gaccuucccaguuauauua

SEQ ID NO: 402145 - RNA, 19 nt, Homo sapiens
aagcaaagcugggcaauug

SEQ ID NO: 402146 - RNA, 19 nt, Homo sapiens
gauacaugaugcaguuuaa

SEQ ID NO: 402147 - RNA, 19 nt, Homo sapiens
ggaauauucugucaaugga

SEQ ID NO: 402148 - RNA, 19 nt, Homo sapiens
gaauuuacauccugaccuu

SEQ ID NO: 402149 - RNA, 19 nt, Homo sapiens
ccucugcccucgauucuua

SEQ ID NO: 402150 - RNA, 19 nt, Homo sapiens
uaagugagcccaccaugua

SEQ ID NO: 402151 - RNA, 19 nt, Homo sapiens
gcccuuccguccacaauua

SEQ ID NO: 402152 - RNA, 19 nt, Homo sapiens
gaagucagcuuugguugug

SEQ ID NO: 402153 - RNA, 19 nt, Homo sapiens
ggacuuugcuccaugagau

SEQ ID NO: 402154 - RNA, 19 nt, Homo sapiens
gacaagcgguuacacaaga

SEQ ID NO: 402155 - RNA, 19 nt, Homo sapiens
ggagaugcauccagggaaa

SEQ ID NO: 402156 - RNA, 19 nt, Homo sapiens
caucaaaucuggaacaucu

SEQ ID NO: 402157 - RNA, 19 nt, Homo sapiens
gagaugacuuugacuccua

SEQ ID NO: 402158 - RNA, 19 nt, Homo sapiens
caacaugggcucagacauu

SEQ ID NO: 402159 - RNA, 19 nt, Homo sapiens
ucacaacccuugauaguag

SEQ ID NO: 402160 - RNA, 19 nt, Homo sapiens
ucucaaagaugauuucgaa

SEQ ID NO: 402161 - RNA, 19 nt, Homo sapiens
gagcauauaacacuggaua

SEQ ID NO: 402162 - RNA, 19 nt, Homo sapiens
gaccaugucuccucuagug

SEQ ID NO: 402163 - RNA, 19 nt, Homo sapiens
gaacaccaucauacaauuu

SEQ ID NO: 402164 - RNA, 19 nt, Homo sapiens
ccacagaucauuuccauug

SEQ ID NO: 402165 - RNA, 19 nt, Homo sapiens
gauguuggcuaaugaagga

SEQ ID NO: 402166 - RNA, 19 nt, Homo sapiens
gaugggauguggccagaaa

SEQ ID NO: 402167 - RNA, 19 nt, Homo sapiens
gaacgcaucagccugguaa

SEQ ID NO: 402168 - RNA, 19 nt, Homo sapiens
caacugcaauuaaauccaa

SEQ ID NO: 402169 - RNA, 19 nt, Homo sapiens
ggagggaggucgugcacuu

SEQ ID NO: 402170 - RNA, 19 nt, Homo sapiens
ccaaaggacuucacacaag

SEQ ID NO: 402171 - RNA, 19 nt, Homo sapiens
aaucaaaccugacuuaugg

SEQ ID NO: 402172 - RNA, 19 nt, Homo sapiens
acaaugagauguucgauag

SEQ ID NO: 402173 - RNA, 19 nt, Homo sapiens
gccaaucaauucagcagua

SEQ ID NO: 402174 - RNA, 19 nt, Homo sapiens
ucaugucgcuuuaguuauu

SEQ ID NO: 402175 - RNA, 19 nt, Homo sapiens
ccaaauauauggguugaau

SEQ ID NO: 402176 - RNA, 19 nt, Homo sapiens
gucacgaccuucccaguua

SEQ ID NO: 402177 - RNA, 19 nt, Homo sapiens
ggacaagacucacaaugcu

SEQ ID NO: 402178 - RNA, 19 nt, Homo sapiens
ggaagcggaucacugucua

SEQ ID NO: 402179 - RNA, 19 nt, Homo sapiens
gaaaugaagggcuuauugu

SEQ ID NO: 402180 - RNA, 19 nt, Homo sapiens
gggagaauguccaauuuca

SEQ ID NO: 402181 - RNA, 19 nt, Homo sapiens
guucaugucgcuuuaguua

SEQ ID NO: 402182 - RNA, 19 nt, Homo sapiens
ggacuacucuaccgaugga

SEQ ID NO: 402183 - RNA, 19 nt, Homo sapiens
gaaacugcgucugugauga

SEQ ID NO: 402184 - RNA, 19 nt, Homo sapiens
uggcaaaucucucuacuuc

SEQ ID NO: 402185 - RNA, 19 nt, Homo sapiens
ggucaucaauccugaacuu

SEQ ID NO: 402186 - RNA, 19 nt, Homo sapiens
caauucagcucacagacaa

SEQ ID NO: 402187 - RNA, 19 nt, Homo sapiens
acaaggagcuccaacagau

SEQ ID NO: 402188 - RNA, 19 nt, Homo sapiens
gauuugggaucaugucuga

SEQ ID NO: 402189 - RNA, 19 nt, Homo sapiens
ggaaguacuugcacugagu

SEQ ID NO: 402190 - RNA, 19 nt, Homo sapiens
gggccaaacugcuacuuga

SEQ ID NO: 402191 - RNA, 19 nt, Homo sapiens
caacccaacucaaagacaa

SEQ ID NO: 402192 - RNA, 19 nt, Homo sapiens
gagagugucuuacaauguc

SEQ ID NO: 402193 - RNA, 19 nt, Homo sapiens
gccaauugguggacacuuu

SEQ ID NO: 402194 - RNA, 19 nt, Homo sapiens
ucagccaucuguauucuuu

SEQ ID NO: 402195 - RNA, 19 nt, Homo sapiens
ucuggaacaucucuaauuu

SEQ ID NO: 402196 - RNA, 19 nt, Homo sapiens
caacugguaucgaauccaa

SEQ ID NO: 402197 - RNA, 19 nt, Homo sapiens
caaacuggauuucaagaca

SEQ ID NO: 402198 - RNA, 19 nt, Homo sapiens
aagcagaucaucccaguua

SEQ ID NO: 402199 - RNA, 19 nt, Homo sapiens
aagaaugccuuccaaguau

SEQ ID NO: 402200 - RNA, 19 nt, Homo sapiens
gagcuacaguuaagcauag

SEQ ID NO: 402201 - RNA, 19 nt, Homo sapiens
uaacauucuuggucacaaa

SEQ ID NO: 402202 - RNA, 19 nt, Homo sapiens
gaagaugcccucaccaaca

SEQ ID NO: 402203 - RNA, 19 nt, Homo sapiens
ccagauggcuuaaauaaua

SEQ ID NO: 402204 - RNA, 19 nt, Homo sapiens
gaacuuggaucacaucaga

SEQ ID NO: 402205 - RNA, 19 nt, Homo sapiens
gcacgaagguuuacaagga

SEQ ID NO: 402206 - RNA, 19 nt, Homo sapiens
gcuauaggauguuaaauga

SEQ ID NO: 402207 - RNA, 19 nt, Homo sapiens
ggaagaaccuacugaaaca

SEQ ID NO: 402208 - RNA, 19 nt, Homo sapiens
cccaguaacucuaaucuua

SEQ ID NO: 402209 - RNA, 19 nt, Homo sapiens
ggacgccgaugaccuauga

SEQ ID NO: 402210 - RNA, 19 nt, Homo sapiens
gacuuuaccuuuccucaaa

SEQ ID NO: 402211 - RNA, 19 nt, Homo sapiens
gaagugaaaccaucaaaca

SEQ ID NO: 402212 - RNA, 19 nt, Homo sapiens
ucaagaacauuuaggcuau

SEQ ID NO: 402213 - RNA, 19 nt, Homo sapiens
ggacguucguacagucuuu

SEQ ID NO: 402214 - RNA, 19 nt, Homo sapiens
ccacacagacccauguuaa

SEQ ID NO: 402215 - RNA, 19 nt, Homo sapiens
caagaacauuuaggcuaua

SEQ ID NO: 402216 - RNA, 19 nt, Homo sapiens
agacuugaauuuaccauga

SEQ ID NO: 402217 - RNA, 19 nt, Homo sapiens
gaucuuacugcuauccuua

SEQ ID NO: 402218 - RNA, 19 nt, Homo sapiens
guaaagaccuaaaaccaaa

SEQ ID NO: 402219 - RNA, 19 nt, Homo sapiens
ucaaauugguaaagaccua

SEQ ID NO: 402220 - RNA, 19 nt, Homo sapiens
ggaaccaccuguacugucu

SEQ ID NO: 402221 - RNA, 19 nt, Homo sapiens
ggaaacugcaggagaagaa

SEQ ID NO: 402222 - RNA, 19 nt, Homo sapiens
gaacauuuaggcuauagga

SEQ ID NO: 402223 - RNA, 19 nt, Homo sapiens
uacaaggacuuacuggaaa

SEQ ID NO: 402224 - RNA, 19 nt, Homo sapiens
gugaaaccaucaaacaugu

SEQ ID NO: 402225 - RNA, 19 nt, Homo sapiens
gaagacacuuggucaacgu

SEQ ID NO: 402226 - RNA, 19 nt, Homo sapiens
ggagugaggacgccgauga

SEQ ID NO: 402227 - RNA, 19 nt, Homo sapiens
gauaaaugacaccaugaaa

SEQ ID NO: 402228 - RNA, 19 nt, Homo sapiens
ccucaugcccuguugauaa

SEQ ID NO: 402229 - RNA, 19 nt, Homo sapiens
gaucaaggccucgaaguca

SEQ ID NO: 402230 - RNA, 19 nt, Homo sapiens
caucaaacauguuccaaaa

SEQ ID NO: 402231 - RNA, 19 nt, Homo sapiens
gagcccagaugugaccuuu

SEQ ID NO: 402232 - RNA, 19 nt, Homo sapiens
gaggcguccuggucaauga

SEQ ID NO: 402233 - RNA, 19 nt, Homo sapiens
ccaaagugcugggauuaca

SEQ ID NO: 402234 - RNA, 19 nt, Homo sapiens
uaccagauggcuuaaauaa

SEQ ID NO: 402235 - RNA, 19 nt, Homo sapiens
ggauaaaugacaccaugaa

SEQ ID NO: 402236 - RNA, 19 nt, Homo sapiens
ugucauccauggugaagaa

SEQ ID NO: 402237 - RNA, 19 nt, Homo sapiens
agacaggguuucaccaugu

SEQ ID NO: 402238 - RNA, 19 nt, Homo sapiens
gaaaccaucaaacauguuc

SEQ ID NO: 402239 - RNA, 19 nt, Homo sapiens
gaccuaugaagucaaauuu

SEQ ID NO: 402240 - RNA, 19 nt, Homo sapiens
caccacaccaggcuaauuu

SEQ ID NO: 402241 - RNA, 19 nt, Homo sapiens
gaagguuuacaaggacuua

SEQ ID NO: 402242 - RNA, 19 nt, Homo sapiens
ccaaguaccugggacuaca

SEQ ID NO: 402243 - RNA, 19 nt, Homo sapiens
ccacaaugauauuacaaac

SEQ ID NO: 402244 - RNA, 19 nt, Homo sapiens
guaccagauggcuuaaaua

SEQ ID NO: 402245 - RNA, 19 nt, Homo sapiens
gaccagcacucucaaacac

SEQ ID NO: 402246 - RNA, 19 nt, Homo sapiens
uuacaaggacuuacuggaa

SEQ ID NO: 402247 - RNA, 19 nt, Homo sapiens
acugcaagaugaaugagua

SEQ ID NO: 402248 - RNA, 19 nt, Homo sapiens
ucaccaaguggauaaauga

SEQ ID NO: 402249 - RNA, 19 nt, Homo sapiens
cauuuaggcuauaggaugu

SEQ ID NO: 402250 - RNA, 19 nt, Homo sapiens
cuuggaaacugcaggagaa

SEQ ID NO: 402251 - RNA, 19 nt, Homo sapiens
gacaggguuucaccauguu

SEQ ID NO: 402252 - RNA, 19 nt, Homo sapiens
ugaggacgccgaugaccua

SEQ ID NO: 402253 - RNA, 19 nt, Homo sapiens
cagauggcuuaaauaauag

SEQ ID NO: 402254 - RNA, 19 nt, Homo sapiens
aaaaguaccagauggcuua

SEQ ID NO: 402255 - RNA, 19 nt, Homo sapiens
caaacauguuccaaaagua

SEQ ID NO: 402256 - RNA, 19 nt, Homo sapiens
ccucagugcuggagaagag

SEQ ID NO: 402257 - RNA, 19 nt, Homo sapiens
caaguucaccaaguggaua

SEQ ID NO: 402258 - RNA, 19 nt, Homo sapiens
acacagacccauguuaaug

SEQ ID NO: 402259 - RNA, 19 nt, Homo sapiens
cucaugcccuguugauaaa

SEQ ID NO: 402260 - RNA, 19 nt, Homo sapiens
ggcuauaggauguuaaaug

SEQ ID NO: 402261 - RNA, 19 nt, Homo sapiens
ucaagugauucucgugcuu

SEQ ID NO: 402262 - RNA, 19 nt, Homo sapiens
cacagacccauguuaauga

SEQ ID NO: 402263 - RNA, 19 nt, Homo sapiens
gcccagggugacaagauua

SEQ ID NO: 402264 - RNA, 19 nt, Homo sapiens
guacaccgagacccuuauu

SEQ ID NO: 402265 - RNA, 19 nt, Homo sapiens
ggccagcccacaaugauau

SEQ ID NO: 402266 - RNA, 19 nt, Homo sapiens
gaagaaccuacugaaacaa

SEQ ID NO: 402267 - RNA, 19 nt, Homo sapiens
caccaccuuugacccagua

SEQ ID NO: 402268 - RNA, 19 nt, Homo sapiens
gaagaagcccagggugaca

SEQ ID NO: 402269 - RNA, 19 nt, Homo sapiens
gauguuaaaugacaaaagg

SEQ ID NO: 402270 - RNA, 19 nt, Homo sapiens
aguaccagauggcuuaaau

SEQ ID NO: 402271 - RNA, 19 nt, Homo sapiens
ucaaacauguuccaaaagu

SEQ ID NO: 402272 - RNA, 19 nt, Homo sapiens
gacuugaauuuaccaugau

SEQ ID NO: 402273 - RNA, 19 nt, Homo sapiens
cauccauggugaagaaagu

SEQ ID NO: 402274 - RNA, 19 nt, Homo sapiens
acaccgagacccuuauuca

SEQ ID NO: 402275 - RNA, 19 nt, Homo sapiens
ggugacaagauuauugaug

SEQ ID NO: 402276 - RNA, 19 nt, Homo sapiens
gcuaacgccacacugaguu

SEQ ID NO: 402277 - RNA, 19 nt, Homo sapiens
ggagagcucagaggaucaa

SEQ ID NO: 402278 - RNA, 19 nt, Homo sapiens
ggaucaaggccucgaaguc

SEQ ID NO: 402279 - RNA, 19 nt, Homo sapiens
gcaaguucaccaaguggau

SEQ ID NO: 402280 - RNA, 19 nt, Homo sapiens
ccuugaaugugcacuuuua

SEQ ID NO: 402281 - RNA, 19 nt, Homo sapiens
uuuaggcuauaggauguua

SEQ ID NO: 402282 - RNA, 19 nt, Homo sapiens
caaauugguaaagaccuaa

SEQ ID NO: 402283 - RNA, 19 nt, Homo sapiens
gcccagaugugaccuuucc

SEQ ID NO: 402284 - RNA, 19 nt, Homo sapiens
ggugucuccuuccuucugu

SEQ ID NO: 402285 - RNA, 19 nt, Homo sapiens
cagaugauccacccaccuu

SEQ ID NO: 402286 - RNA, 19 nt, Homo sapiens
ccaucaaacauguuccaaa

SEQ ID NO: 402287 - RNA, 19 nt, Homo sapiens
aagaaccuacugaaacaaa

SEQ ID NO: 402288 - RNA, 19 nt, Homo sapiens
gaccuaaaaccaaaacaaa

SEQ ID NO: 402289 - RNA, 19 nt, Homo sapiens
ccaaugacccaggagucua

SEQ ID NO: 402290 - RNA, 19 nt, Homo sapiens
ucaaggccucgaagucauu

SEQ ID NO: 402291 - RNA, 19 nt, Homo sapiens
acgccacacugaguuaauu

SEQ ID NO: 402292 - RNA, 19 nt, Homo sapiens
cagggugacaagauuauug

SEQ ID NO: 402293 - RNA, 19 nt, Homo sapiens
gccgaugaccuaugaaguc

SEQ ID NO: 402294 - RNA, 19 nt, Homo sapiens
ccguuggugugcagaggua

SEQ ID NO: 402295 - RNA, 19 nt, Homo sapiens
agucggaacuuggaucaca

SEQ ID NO: 402296 - RNA, 19 nt, Homo sapiens
agugaaaccaucaaacaug

SEQ ID NO: 402297 - RNA, 19 nt, Homo sapiens
uggagaagagucagugaga

SEQ ID NO: 402298 - RNA, 19 nt, Homo sapiens
gugcaccugggcagugaua

SEQ ID NO: 402299 - RNA, 19 nt, Homo sapiens
gccacacugaguuaauuaa

SEQ ID NO: 402300 - RNA, 19 nt, Homo sapiens
ccaccacaccaggcuaauu

SEQ ID NO: 402301 - RNA, 19 nt, Homo sapiens
cuccuggguucaagugauu

SEQ ID NO: 402302 - RNA, 19 nt, Homo sapiens
gacacuuggucaacguaca

SEQ ID NO: 402303 - RNA, 19 nt, Homo sapiens
ccagauggcuuaaauaaua

SEQ ID NO: 402304 - RNA, 19 nt, Homo sapiens
gcacgaagguuuacaagga

SEQ ID NO: 402305 - RNA, 19 nt, Homo sapiens
gcuauaggauguuaaauga

SEQ ID NO: 402306 - RNA, 19 nt, Homo sapiens
ggaagaaccuacugaaaca

SEQ ID NO: 402307 - RNA, 19 nt, Homo sapiens
cccaguaacucuaaucuua

SEQ ID NO: 402308 - RNA, 19 nt, Homo sapiens
ggacgccgaugaccuauga

SEQ ID NO: 402309 - RNA, 19 nt, Homo sapiens
gacuuuaccuuuccucaaa

SEQ ID NO: 402310 - RNA, 19 nt, Homo sapiens
gaagugaaaccaucaaaca

SEQ ID NO: 402311 - RNA, 19 nt, Homo sapiens
ucaagaacauuuaggcuau

SEQ ID NO: 402312 - RNA, 19 nt, Homo sapiens
ggacguucguacagucuuu

SEQ ID NO: 402313 - RNA, 19 nt, Homo sapiens
ccacacagacccauguuaa

SEQ ID NO: 402314 - RNA, 19 nt, Homo sapiens
caagaacauuuaggcuaua

SEQ ID NO: 402315 - RNA, 19 nt, Homo sapiens
agacuugaauuuaccauga

SEQ ID NO: 402316 - RNA, 19 nt, Homo sapiens
gaucuuacugcuauccuua

SEQ ID NO: 402317 - RNA, 19 nt, Homo sapiens
guaaagaccuaaaaccaaa

SEQ ID NO: 402318 - RNA, 19 nt, Homo sapiens
ucaaauugguaaagaccua

SEQ ID NO: 402319 - RNA, 19 nt, Homo sapiens
ggaaccaccuguacugucu

SEQ ID NO: 402320 - RNA, 19 nt, Homo sapiens
ggaaacugcaggagaagaa

SEQ ID NO: 402321 - RNA, 19 nt, Homo sapiens
gaacauuuaggcuauagga

SEQ ID NO: 402322 - RNA, 19 nt, Homo sapiens
uacaaggacuuacuggaaa

SEQ ID NO: 402323 - RNA, 19 nt, Homo sapiens
gugaaaccaucaaacaugu

SEQ ID NO: 402324 - RNA, 19 nt, Homo sapiens
gaagacacuuggucaacgu

SEQ ID NO: 402325 - RNA, 19 nt, Homo sapiens
ggagugaggacgccgauga

SEQ ID NO: 402326 - RNA, 19 nt, Homo sapiens
gauaaaugacaccaugaaa

SEQ ID NO: 402327 - RNA, 19 nt, Homo sapiens
ccucaugcccuguugauaa

SEQ ID NO: 402328 - RNA, 19 nt, Homo sapiens
gaucaaggccucgaaguca

SEQ ID NO: 402329 - RNA, 19 nt, Homo sapiens
caucaaacauguuccaaaa

SEQ ID NO: 402330 - RNA, 19 nt, Homo sapiens
gagcccagaugugaccuuu

SEQ ID NO: 402331 - RNA, 19 nt, Homo sapiens
gaggcguccuggucaauga

SEQ ID NO: 402332 - RNA, 19 nt, Homo sapiens
ccaaagugcugggauuaca

SEQ ID NO: 402333 - RNA, 19 nt, Homo sapiens
uaccagauggcuuaaauaa

SEQ ID NO: 402334 - RNA, 19 nt, Homo sapiens
ggauaaaugacaccaugaa

SEQ ID NO: 402335 - RNA, 19 nt, Homo sapiens
ugucauccauggugaagaa

SEQ ID NO: 402336 - RNA, 19 nt, Homo sapiens
agacaggguuucaccaugu

SEQ ID NO: 402337 - RNA, 19 nt, Homo sapiens
gaaaccaucaaacauguuc

SEQ ID NO: 402338 - RNA, 19 nt, Homo sapiens
gaccuaugaagucaaauuu

SEQ ID NO: 402339 - RNA, 19 nt, Homo sapiens
caccacaccaggcuaauuu

SEQ ID NO: 402340 - RNA, 19 nt, Homo sapiens
gaagguuuacaaggacuua

SEQ ID NO: 402341 - RNA, 19 nt, Homo sapiens
ccaaguaccugggacuaca

SEQ ID NO: 402342 - RNA, 19 nt, Homo sapiens
ccacaaugauauuacaaac

SEQ ID NO: 402343 - RNA, 19 nt, Homo sapiens
guaccagauggcuuaaaua

SEQ ID NO: 402344 - RNA, 19 nt, Homo sapiens
gaccagcacucucaaacac

SEQ ID NO: 402345 - RNA, 19 nt, Homo sapiens
uuacaaggacuuacuggaa

SEQ ID NO: 402346 - RNA, 19 nt, Homo sapiens
acugcaagaugaaugagua

SEQ ID NO: 402347 - RNA, 19 nt, Homo sapiens
ucaccaaguggauaaauga

SEQ ID NO: 402348 - RNA, 19 nt, Homo sapiens
cauuuaggcuauaggaugu

SEQ ID NO: 402349 - RNA, 19 nt, Homo sapiens
gacaggguuucaccauguu

SEQ ID NO: 402350 - RNA, 19 nt, Homo sapiens
cuuggaaacugcaggagaa

SEQ ID NO: 402351 - RNA, 19 nt, Homo sapiens
ugaggacgccgaugaccua

SEQ ID NO: 402352 - RNA, 19 nt, Homo sapiens
cagauggcuuaaauaauag

SEQ ID NO: 402353 - RNA, 19 nt, Homo sapiens
aaaaguaccagauggcuua

SEQ ID NO: 402354 - RNA, 19 nt, Homo sapiens
caaacauguuccaaaagua

SEQ ID NO: 402355 - RNA, 19 nt, Homo sapiens
ccucagugcuggagaagag

SEQ ID NO: 402356 - RNA, 19 nt, Homo sapiens
caaguucaccaaguggaua

SEQ ID NO: 402357 - RNA, 19 nt, Homo sapiens
acacagacccauguuaaug

SEQ ID NO: 402358 - RNA, 19 nt, Homo sapiens
cucaugcccuguugauaaa

SEQ ID NO: 402359 - RNA, 19 nt, Homo sapiens
ggcuauaggauguuaaaug

SEQ ID NO: 402360 - RNA, 19 nt, Homo sapiens
ucaagugauucucgugcuu

SEQ ID NO: 402361 - RNA, 19 nt, Homo sapiens
cacagacccauguuaauga

SEQ ID NO: 402362 - RNA, 19 nt, Homo sapiens
guacaccgagacccuuauu

SEQ ID NO: 402363 - RNA, 19 nt, Homo sapiens
gcccagggugacaagauua

SEQ ID NO: 402364 - RNA, 19 nt, Homo sapiens
ggccagcccacaaugauau

SEQ ID NO: 402365 - RNA, 19 nt, Homo sapiens
gaagaaccuacugaaacaa

SEQ ID NO: 402366 - RNA, 19 nt, Homo sapiens
gaagaagcccagggugaca

SEQ ID NO: 402367 - RNA, 19 nt, Homo sapiens
caccaccuuugacccagua

SEQ ID NO: 402368 - RNA, 19 nt, Homo sapiens
gauguuaaaugacaaaagg

SEQ ID NO: 402369 - RNA, 19 nt, Homo sapiens
aguaccagauggcuuaaau

SEQ ID NO: 402370 - RNA, 19 nt, Homo sapiens
ucaaacauguuccaaaagu

SEQ ID NO: 402371 - RNA, 19 nt, Homo sapiens
gacuugaauuuaccaugau

SEQ ID NO: 402372 - RNA, 19 nt, Homo sapiens
cauccauggugaagaaagu

SEQ ID NO: 402373 - RNA, 19 nt, Homo sapiens
ggugacaagauuauugaug

SEQ ID NO: 402374 - RNA, 19 nt, Homo sapiens
acaccgagacccuuauuca

SEQ ID NO: 402375 - RNA, 19 nt, Homo sapiens
gcuaacgccacacugaguu

SEQ ID NO: 402376 - RNA, 19 nt, Homo sapiens
ggagagcucagaggaucaa

SEQ ID NO: 402377 - RNA, 19 nt, Homo sapiens
ggaucaaggccucgaaguc

SEQ ID NO: 402378 - RNA, 19 nt, Homo sapiens
gcaaguucaccaaguggau

SEQ ID NO: 402379 - RNA, 19 nt, Homo sapiens
ccuugaaugugcacuuuua

SEQ ID NO: 402380 - RNA, 19 nt, Homo sapiens
uuuaggcuauaggauguua

SEQ ID NO: 402381 - RNA, 19 nt, Homo sapiens
caaauugguaaagaccuaa

SEQ ID NO: 402382 - RNA, 19 nt, Homo sapiens
gcccagaugugaccuuucc

SEQ ID NO: 402383 - RNA, 19 nt, Homo sapiens
ggugucuccuuccuucugu

SEQ ID NO: 402384 - RNA, 19 nt, Homo sapiens
cagaugauccacccaccuu

SEQ ID NO: 402385 - RNA, 19 nt, Homo sapiens
ccaucaaacauguuccaaa

SEQ ID NO: 402386 - RNA, 19 nt, Homo sapiens
aagaaccuacugaaacaaa

SEQ ID NO: 402387 - RNA, 19 nt, Homo sapiens
gaccuaaaaccaaaacaaa

SEQ ID NO: 402388 - RNA, 19 nt, Homo sapiens
ccaaugacccaggagucua

SEQ ID NO: 402389 - RNA, 19 nt, Homo sapiens
ucaaggccucgaagucauu

SEQ ID NO: 402390 - RNA, 19 nt, Homo sapiens
acgccacacugaguuaauu

SEQ ID NO: 402391 - RNA, 19 nt, Homo sapiens
cagggugacaagauuauug

SEQ ID NO: 402392 - RNA, 19 nt, Homo sapiens
gccgaugaccuaugaaguc

SEQ ID NO: 402393 - RNA, 19 nt, Homo sapiens
ccguuggugugcagaggua

SEQ ID NO: 402394 - RNA, 19 nt, Homo sapiens
gugcaccugggcagugaua

SEQ ID NO: 402395 - RNA, 19 nt, Homo sapiens
agugaaaccaucaaacaug

SEQ ID NO: 402396 - RNA, 19 nt, Homo sapiens
uggagaagagucagugaga

SEQ ID NO: 402397 - RNA, 19 nt, Homo sapiens
gccacacugaguuaauuaa

SEQ ID NO: 402398 - RNA, 19 nt, Homo sapiens
ccaccacaccaggcuaauu

SEQ ID NO: 402399 - RNA, 19 nt, Homo sapiens
cuccuggguucaagugauu

SEQ ID NO: 402400 - RNA, 19 nt, Homo sapiens
gacacuuggucaacguaca

SEQ ID NO: 402401 - RNA, 19 nt, Homo sapiens
gguaaagaccuaaaaccaa

SEQ ID NO: 402402 - RNA, 19 nt, Homo sapiens
cgccacacugaguuaauua

SEQ ID NO: 402403 - RNA, 19 nt, Homo sapiens
gaaguaaacuguccagaug

SEQ ID NO: 402404 - RNA, 19 nt, Homo sapiens
gaacagcguugauauccua

SEQ ID NO: 402405 - RNA, 19 nt, Homo sapiens
gaacaacaaugguuuagug

SEQ ID NO: 402406 - RNA, 19 nt, Homo sapiens
caagcaaucugaagaauga

SEQ ID NO: 402407 - RNA, 19 nt, Homo sapiens
ggaaaugucucaauagagu

SEQ ID NO: 402408 - RNA, 19 nt, Homo sapiens
ggaaauaaacugccauaaa

SEQ ID NO: 402409 - RNA, 19 nt, Homo sapiens
gaacagguauuucuucaca

SEQ ID NO: 402410 - RNA, 19 nt, Homo sapiens
gcauggaaauuaaguguuu

SEQ ID NO: 402411 - RNA, 19 nt, Homo sapiens
gaugagaucuuucuaucaa

SEQ ID NO: 402412 - RNA, 19 nt, Homo sapiens
caacauaugcauaaccuua

SEQ ID NO: 402413 - RNA, 19 nt, Homo sapiens
aaacugagcuucgaugauu

SEQ ID NO: 402414 - RNA, 19 nt, Homo sapiens
gaucauacguguaaaccaa

SEQ ID NO: 402415 - RNA, 19 nt, Homo sapiens
aauaagagauggugaagaa

SEQ ID NO: 402416 - RNA, 19 nt, Homo sapiens
ggaguuacauauaauccua

SEQ ID NO: 402417 - RNA, 19 nt, Homo sapiens
gcucugugcuggauuaauu

SEQ ID NO: 402418 - RNA, 19 nt, Homo sapiens
gauggccacuuaauacuaa

SEQ ID NO: 402419 - RNA, 19 nt, Homo sapiens
caaguaacccuaaaugaaa

SEQ ID NO: 402420 - RNA, 19 nt, Homo sapiens
gaagaaggaggaauagauu

SEQ ID NO: 402421 - RNA, 19 nt, Homo sapiens
ccaaacagcuacccuaauc

SEQ ID NO: 402422 - RNA, 19 nt, Homo sapiens
cuagaaagcauggaaauua

SEQ ID NO: 402423 - RNA, 19 nt, Homo sapiens
ucacaggccuggacuaaau

SEQ ID NO: 402424 - RNA, 19 nt, Homo sapiens
gcauauaccauacacuuaa

SEQ ID NO: 402425 - RNA, 19 nt, Homo sapiens
cauaaacccucauuacaau

SEQ ID NO: 402426 - RNA, 19 nt, Homo sapiens
gcgcauuucuuaaacuaaa

SEQ ID NO: 402427 - RNA, 19 nt, Homo sapiens
ccaaggacuuuccauuaaa

SEQ ID NO: 402428 - RNA, 19 nt, Homo sapiens
gccagggucucaagguuua

SEQ ID NO: 402429 - RNA, 19 nt, Homo sapiens
gcaagaagcugauguuccu

SEQ ID NO: 402430 - RNA, 19 nt, Homo sapiens
gaagccagagcgacauuua

SEQ ID NO: 402431 - RNA, 19 nt, Homo sapiens
ccauagcaauacagaauaa

SEQ ID NO: 402432 - RNA, 19 nt, Homo sapiens
uacauuagcgcauuucuua

SEQ ID NO: 402433 - RNA, 19 nt, Homo sapiens
ucaaacagucccucgauua

SEQ ID NO: 402434 - RNA, 19 nt, Homo sapiens
gaggaggguuuaaagcaaa

SEQ ID NO: 402435 - RNA, 19 nt, Homo sapiens
ccgaauggauacaaaguuu

SEQ ID NO: 402436 - RNA, 19 nt, Homo sapiens
ugaugcaucuggaauuuaa

SEQ ID NO: 402437 - RNA, 19 nt, Homo sapiens
aaucugaccucuccucaaa

SEQ ID NO: 402438 - RNA, 19 nt, Homo sapiens
cgauguaguugaaauaaga

SEQ ID NO: 402439 - RNA, 19 nt, Homo sapiens
caucuggaauuuaaaguga

SEQ ID NO: 402440 - RNA, 19 nt, Homo sapiens
aacagucccucgauuaaua

SEQ ID NO: 402441 - RNA, 19 nt, Homo sapiens
uaaaggauguguucucuac

SEQ ID NO: 402442 - RNA, 19 nt, Homo sapiens
uggcaaugcuucaggauuu

SEQ ID NO: 402443 - RNA, 19 nt, Homo sapiens
caggaaagucgcauuauuu

SEQ ID NO: 402444 - RNA, 19 nt, Homo sapiens
caaacagucccucgauuaa

SEQ ID NO: 402445 - RNA, 19 nt, Homo sapiens
gauaaugaaugggaaagga

SEQ ID NO: 402446 - RNA, 19 nt, Homo sapiens
ccaaguuacugccaccuuu

SEQ ID NO: 402447 - RNA, 19 nt, Homo sapiens
caggaaaugucucaauaga

SEQ ID NO: 402448 - RNA, 19 nt, Homo sapiens
cauccggaguuacauauaa

SEQ ID NO: 402449 - RNA, 19 nt, Homo sapiens
aaacaggaaagucgcauua

SEQ ID NO: 402450 - RNA, 19 nt, Homo sapiens
ccauuaaugugccaagaaa

SEQ ID NO: 402451 - RNA, 19 nt, Homo sapiens
ucucucagcuccuaugaaa

SEQ ID NO: 402452 - RNA, 19 nt, Homo sapiens
ggaaagaauauacaacuuc

SEQ ID NO: 402453 - RNA, 19 nt, Homo sapiens
caacuggucacuuuccaua

SEQ ID NO: 402454 - RNA, 19 nt, Homo sapiens
ggacaaguaacccuaaaug

SEQ ID NO: 402455 - RNA, 19 nt, Homo sapiens
gugauuauguuggcuuuaa

SEQ ID NO: 402456 - RNA, 19 nt, Homo sapiens
caacgaacaacaaugguuu

SEQ ID NO: 402457 - RNA, 19 nt, Homo sapiens
gacaaacucucaguggauu

SEQ ID NO: 402458 - RNA, 19 nt, Homo sapiens
ggauucaggaggaccauua

SEQ ID NO: 402459 - RNA, 19 nt, Homo sapiens
caugaugcaucuggaauuu

SEQ ID NO: 402460 - RNA, 19 nt, Homo sapiens
gcacaacgaacaacaaugg

SEQ ID NO: 402461 - RNA, 19 nt, Homo sapiens
uuuaagagcuucuauuugg

SEQ ID NO: 402462 - RNA, 19 nt, Homo sapiens
gcauuauagucguauuuga

SEQ ID NO: 402463 - RNA, 19 nt, Homo sapiens
acaggaaagucgcauuauu

SEQ ID NO: 402464 - RNA, 19 nt, Homo sapiens
ggugugaccucauuuggau

SEQ ID NO: 402465 - RNA, 19 nt, Homo sapiens
gaagaaaggacaacgacau

SEQ ID NO: 402466 - RNA, 19 nt, Homo sapiens
aacaagauccugagugaua

SEQ ID NO: 402467 - RNA, 19 nt, Homo sapiens
ggagccagcuugccuuagu

SEQ ID NO: 402468 - RNA, 19 nt, Homo sapiens
ggacuuuccauuaaacuga

SEQ ID NO: 402469 - RNA, 19 nt, Homo sapiens
gcaaucugaagaaugaaua

SEQ ID NO: 402470 - RNA, 19 nt, Homo sapiens
guaugucacuguuggaaau

SEQ ID NO: 402471 - RNA, 19 nt, Homo sapiens
caacgacauugccaugaug

SEQ ID NO: 402472 - RNA, 19 nt, Homo sapiens
ccaaauacaacauucaguu

SEQ ID NO: 402473 - RNA, 19 nt, Homo sapiens
gguguaggaucaagcaaga

SEQ ID NO: 402474 - RNA, 19 nt, Homo sapiens
gaggauggcucagaugaag

SEQ ID NO: 402475 - RNA, 19 nt, Homo sapiens
acaaguaacccuaaaugaa

SEQ ID NO: 402476 - RNA, 19 nt, Homo sapiens
uauguuggcuuuaaugcaa

SEQ ID NO: 402477 - RNA, 19 nt, Homo sapiens
uccaggaaaugucucaaua

SEQ ID NO: 402478 - RNA, 19 nt, Homo sapiens
ggccuggacuaaauugauu

SEQ ID NO: 402479 - RNA, 19 nt, Homo sapiens
gcagcucucuuugccauau

SEQ ID NO: 402480 - RNA, 19 nt, Homo sapiens
ccauaaaucuuguggaaaa

SEQ ID NO: 402481 - RNA, 19 nt, Homo sapiens
accaaggacuuuccauuaa

SEQ ID NO: 402482 - RNA, 19 nt, Homo sapiens
uaugauaugugcaggcuau

SEQ ID NO: 402483 - RNA, 19 nt, Homo sapiens
aacagcagaugccagaaua

SEQ ID NO: 402484 - RNA, 19 nt, Homo sapiens
cagauuacauacaaccuau

SEQ ID NO: 402485 - RNA, 19 nt, Homo sapiens
cuuaguuucugguaucaua

SEQ ID NO: 402486 - RNA, 19 nt, Homo sapiens
uaacagcagugagcuuaau

SEQ ID NO: 402487 - RNA, 19 nt, Homo sapiens
aaccauaaaucuuguggaa

SEQ ID NO: 402488 - RNA, 19 nt, Homo sapiens
ggaccacccagauuucaaa

SEQ ID NO: 402489 - RNA, 19 nt, Homo sapiens
uaacauaugggauuugcaa

SEQ ID NO: 402490 - RNA, 19 nt, Homo sapiens
aaccaaggacuuuccauua

SEQ ID NO: 402491 - RNA, 19 nt, Homo sapiens
uaaauuagcaagccuucaa

SEQ ID NO: 402492 - RNA, 19 nt, Homo sapiens
cagcagaugccagaauaua

SEQ ID NO: 402493 - RNA, 19 nt, Homo sapiens
ucauaaacccucauuacaa

SEQ ID NO: 402494 - RNA, 19 nt, Homo sapiens
gaugaaagugauuauguug

SEQ ID NO: 402495 - RNA, 19 nt, Homo sapiens
uagcgcauuucuuaaacua

SEQ ID NO: 402496 - RNA, 19 nt, Homo sapiens
gcaagaggaggguuuaaag

SEQ ID NO: 402497 - RNA, 19 nt, Homo sapiens
gcacuuggacagagucaug

SEQ ID NO: 402498 - RNA, 19 nt, Homo sapiens
uaaucuggcuuucuguguu

SEQ ID NO: 402499 - RNA, 19 nt, Homo sapiens
ugagugauauugcguugga

SEQ ID NO: 402500 - RNA, 19 nt, Homo sapiens
gacaaguaacccuaaauga

SEQ ID NO: 402501 - RNA, 19 nt, Homo sapiens
gaaagcauggaaauuaagu

SEQ ID NO: 402502 - RNA, 19 nt, Homo sapiens
caaagccaaucuucucuac

SEQ ID NO: 402503 - RNA, 19 nt, Homo sapiens
uaacagggcagaaaugauu

SEQ ID NO: 402504 - RNA, 19 nt, Homo sapiens
caacaggccugguguguac

SEQ ID NO: 402505 - RNA, 19 nt, Homo sapiens
gcacugagcuggcccuacu

SEQ ID NO: 402506 - RNA, 19 nt, Homo sapiens
guaacugccuguacaacau

SEQ ID NO: 402507 - RNA, 19 nt, Homo sapiens
gggcagaaaugauuaaaau

SEQ ID NO: 402508 - RNA, 19 nt, Homo sapiens
caacucagcagacccauca

SEQ ID NO: 402509 - RNA, 19 nt, Homo sapiens
gcaacaggccuggugugua

SEQ ID NO: 402510 - RNA, 19 nt, Homo sapiens
ucugcucuaucuuggauua

SEQ ID NO: 402511 - RNA, 19 nt, Homo sapiens
ggaguaacagggcagaaau

SEQ ID NO: 402512 - RNA, 19 nt, Homo sapiens
ggugugugcuggcuaugug

SEQ ID NO: 402513 - RNA, 19 nt, Homo sapiens
ggccagccuuggacacuug

SEQ ID NO: 402514 - RNA, 19 nt, Homo sapiens
guggcucucucgugucuga

SEQ ID NO: 402515 - RNA, 19 nt, Homo sapiens
gggaguaacagggcagaaa

SEQ ID NO: 402516 - RNA, 19 nt, Homo sapiens
aaagcaaggugacagaacu

SEQ ID NO: 402517 - RNA, 19 nt, Homo sapiens
acacugcucgcuucggaua

SEQ ID NO: 402518 - RNA, 19 nt, Homo sapiens
cgacauugcacuccuccaa

SEQ ID NO: 402519 - RNA, 19 nt, Homo sapiens
ggccuccacugcacuguca

SEQ ID NO: 402520 - RNA, 19 nt, Homo sapiens
gcagacccaucaccuucuc

SEQ ID NO: 402521 - RNA, 19 nt, Homo sapiens
ggaagccuaugaggucaag

SEQ ID NO: 402522 - RNA, 19 nt, Homo sapiens
cauggugugugcuggcuau

SEQ ID NO: 402523 - RNA, 19 nt, Homo sapiens
ccaagccacugcagcaacu

SEQ ID NO: 402524 - RNA, 19 nt, Homo sapiens
ccagcgagcaccacaagga

SEQ ID NO: 402525 - RNA, 19 nt, Homo sapiens
gccauucugcucuaucuug

SEQ ID NO: 402526 - RNA, 19 nt, Homo sapiens
gaguaacagggcagaaaug

SEQ ID NO: 402527 - RNA, 19 nt, Homo sapiens
ccucugaucagucgugaga

SEQ ID NO: 402528 - RNA, 19 nt, Homo sapiens
uaugaaggcguccaugugu

SEQ ID NO: 402529 - RNA, 19 nt, Homo sapiens
ccuccuggauccaaagcaa

SEQ ID NO: 402530 - RNA, 19 nt, Homo sapiens
cugaggagccgcacuuugu

SEQ ID NO: 402531 - RNA, 19 nt, Homo sapiens
gcaccacaaggaagccuau

SEQ ID NO: 402532 - RNA, 19 nt, Homo sapiens
cagcuucgaggacaggaaa

SEQ ID NO: 402533 - RNA, 19 nt, Homo sapiens
ggaccaucacugagaguca

SEQ ID NO: 402534 - RNA, 19 nt, Homo sapiens
gaucuuugagcccauucuu

SEQ ID NO: 402535 - RNA, 19 nt, Homo sapiens
cccaccagcuagacuccua

SEQ ID NO: 402536 - RNA, 19 nt, Homo sapiens
ccacaaggaagccuaugag

SEQ ID NO: 402537 - RNA, 19 nt, Homo sapiens
cugggacccuuggcuauga

SEQ ID NO: 402538 - RNA, 19 nt, Homo sapiens
uuuacugccuguagcaaug

SEQ ID NO: 402539 - RNA, 19 nt, Homo sapiens
uugcugaggcccauccuuu

SEQ ID NO: 402540 - RNA, 19 nt, Homo sapiens
ccaaagcaaggugacagaa

SEQ ID NO: 402541 - RNA, 19 nt, Homo sapiens
ugaaggcguccaugugugu

SEQ ID NO: 402542 - RNA, 19 nt, Homo sapiens
ggucagcaucaccuaugaa

SEQ ID NO: 402543 - RNA, 19 nt, Homo sapiens
guaacagggcagaaaugau

SEQ ID NO: 402544 - RNA, 19 nt, Homo sapiens
cagcgagcaccacaaggaa

SEQ ID NO: 402545 - RNA, 19 nt, Homo sapiens
gcucuaucuuggauuacuc

SEQ ID NO: 402546 - RNA, 19 nt, Homo sapiens
guaccugacgggcauugug

SEQ ID NO: 402547 - RNA, 19 nt, Homo sapiens
caaagcaaggugacagaac

SEQ ID NO: 402548 - RNA, 19 nt, Homo sapiens
gcagauuucucaccuguaa

SEQ ID NO: 402549 - RNA, 19 nt, Homo sapiens
gcucugacccugaugcuua

SEQ ID NO: 402550 - RNA, 19 nt, Homo sapiens
gggcagaggagcagaauaa

SEQ ID NO: 402551 - RNA, 19 nt, Homo sapiens
ugacauacauggaauagca

SEQ ID NO: 402552 - RNA, 19 nt, Homo sapiens
gggaggacgugaugaguga

SEQ ID NO: 402553 - RNA, 19 nt, Homo sapiens
gaugauacagucuccauaa

SEQ ID NO: 402554 - RNA, 19 nt, Homo sapiens
caaacucucugaacucauc

SEQ ID NO: 402555 - RNA, 19 nt, Homo sapiens
gacagcagauggugauuuc

SEQ ID NO: 402556 - RNA, 19 nt, Homo sapiens
ggauguaccuuucuucacu

SEQ ID NO: 402557 - RNA, 19 nt, Homo sapiens
cagaggagcagaauaaguu

SEQ ID NO: 402558 - RNA, 19 nt, Homo sapiens
ugacccugaugcuuaauaa

SEQ ID NO: 402559 - RNA, 19 nt, Homo sapiens
gcagauacacgaacuggau

SEQ ID NO: 402560 - RNA, 19 nt, Homo sapiens
gauccacccugacuaugau

SEQ ID NO: 402561 - RNA, 19 nt, Homo sapiens
cuaccaagcugcccucuac

SEQ ID NO: 402562 - RNA, 19 nt, Homo sapiens
ccacacguuugauuucuuc

SEQ ID NO: 402563 - RNA, 19 nt, Homo sapiens
caagugacccugacaugug

SEQ ID NO: 402564 - RNA, 19 nt, Homo sapiens
ggcaguggcuguuggaaag

SEQ ID NO: 402565 - RNA, 19 nt, Homo sapiens
gccaaacucucugaacuca

SEQ ID NO: 402566 - RNA, 19 nt, Homo sapiens
aagcauaaccuucggcaaa

SEQ ID NO: 402567 - RNA, 19 nt, Homo sapiens
acaccaacgucugcagaua

SEQ ID NO: 402568 - RNA, 19 nt, Homo sapiens
uuucucaccuguaagauga

SEQ ID NO: 402569 - RNA, 19 nt, Homo sapiens
ccuguaagaugaagauaag

SEQ ID NO: 402570 - RNA, 19 nt, Homo sapiens
uacacgaacuggauccaaa

SEQ ID NO: 402571 - RNA, 19 nt, Homo sapiens
gagaaguacgggaaggauu

SEQ ID NO: 402572 - RNA, 19 nt, Homo sapiens
accaugcacucaauaaaga

SEQ ID NO: 402573 - RNA, 19 nt, Homo sapiens
caagacagcagauggugau

SEQ ID NO: 402574 - RNA, 19 nt, Homo sapiens
ggaugauacagucuccaua

SEQ ID NO: 402575 - RNA, 19 nt, Homo sapiens
ccagaacgucucucaccua

SEQ ID NO: 402576 - RNA, 19 nt, Homo sapiens
ggagaagccaggagucuac

SEQ ID NO: 402577 - RNA, 19 nt, Homo sapiens
cagccaaacucucugaacu

SEQ ID NO: 402578 - RNA, 19 nt, Homo sapiens
gcagaggagcagaauaagu

SEQ ID NO: 402579 - RNA, 19 nt, Homo sapiens
acaucuaccucccgaccua

SEQ ID NO: 402580 - RNA, 19 nt, Homo sapiens
caggagcggccaugaagaa

SEQ ID NO: 402581 - RNA, 19 nt, Homo sapiens
uuucuucacugcagauuuc

SEQ ID NO: 402582 - RNA, 19 nt, Homo sapiens
gcccagcucugacccugau

SEQ ID NO: 402583 - RNA, 19 nt, Homo sapiens
gagcggccaugaagaagcu

SEQ ID NO: 402584 - RNA, 19 nt, Homo sapiens
gauggugauuucccugaca

SEQ ID NO: 402585 - RNA, 19 nt, Homo sapiens
ccaccaugcacucaauaaa

SEQ ID NO: 402586 - RNA, 19 nt, Homo sapiens
acuaagagaauacaggaaa

SEQ ID NO: 402587 - RNA, 19 nt, Homo sapiens
aagugacccugacauguga

SEQ ID NO: 402588 - RNA, 19 nt, Homo sapiens
gggccaccaugcacucaau

SEQ ID NO: 402589 - RNA, 19 nt, Homo sapiens
aaccgaaucuucaggucuu

SEQ ID NO: 402590 - RNA, 19 nt, Homo sapiens
aagaugaagauaaggauga

SEQ ID NO: 402591 - RNA, 19 nt, Homo sapiens
gauuguuccugggcccuuu

SEQ ID NO: 402592 - RNA, 19 nt, Homo sapiens
ccagaucacccagaacaug

SEQ ID NO: 402593 - RNA, 19 nt, Homo sapiens
ggccagaucacccagaaca

SEQ ID NO: 402594 - RNA, 19 nt, Homo sapiens
gacgugaggguccugauuc

SEQ ID NO: 402595 - RNA, 19 nt, Homo sapiens
cgacgugaggguccugauu

SEQ ID NO: 402596 - RNA, 19 nt, Homo sapiens
gaucacccagaacauguug

SEQ ID NO: 402597 - RNA, 19 nt, Homo sapiens
cauccagugugcauacauc

SEQ ID NO: 402598 - RNA, 19 nt, Homo sapiens
gcaggagcggccaugaaga

SEQ ID NO: 402599 - RNA, 19 nt, Homo sapiens
guaagaugaagauaaggau

SEQ ID NO: 402600 - RNA, 19 nt, Homo sapiens
cgugaugagugaggacuug

SEQ ID NO: 402601 - RNA, 19 nt, Homo sapiens
ggaccuacgggcagcuguu

SEQ ID NO: 402602 - RNA, 19 nt, Homo sapiens
ccaagugacccugacaugu

SEQ ID NO: 402603 - RNA, 19 nt, Homo sapiens
gaagauaaggaugauacag

SEQ ID NO: 402604 - RNA, 19 nt, Homo sapiens
ugauccacccugacuauga

SEQ ID NO: 402605 - RNA, 19 nt, Homo sapiens
gaugaagauaaggaugaua

SEQ ID NO: 402606 - RNA, 19 nt, Homo sapiens
cagcaggagcggccaugaa

SEQ ID NO: 402607 - RNA, 19 nt, Homo sapiens
uccgaggccuugugucaug

SEQ ID NO: 402608 - RNA, 19 nt, Homo sapiens
agaaguacgggaaggauuc

SEQ ID NO: 402609 - RNA, 19 nt, Homo sapiens
ucacagcugcccacugcaa

SEQ ID NO: 402610 - RNA, 19 nt, Homo sapiens
guuggaaagauuuaagguu

SEQ ID NO: 402611 - RNA, 19 nt, Homo sapiens
cuacaccucgggccacuug

SEQ ID NO: 402612 - RNA, 19 nt, Homo sapiens
cagaucacccagaacaugu

SEQ ID NO: 402613 - RNA, 19 nt, Homo sapiens
agacagcagauggugauuu

SEQ ID NO: 402614 - RNA, 19 nt, Homo sapiens
ugcacucaauaaagaauga

SEQ ID NO: 402615 - RNA, 19 nt, Homo sapiens
caccaugcacucaauaaag

SEQ ID NO: 402616 - RNA, 19 nt, Homo sapiens
gccaccaugcacucaauaa

SEQ ID NO: 402617 - RNA, 19 nt, Homo sapiens
aagauaaggaugauacagu

SEQ ID NO: 402618 - RNA, 19 nt, Homo sapiens
gccaagugacccugacaug

SEQ ID NO: 402619 - RNA, 19 nt, Homo sapiens
guccuuauccauccacugu

SEQ ID NO: 402620 - RNA, 19 nt, Homo sapiens
uguaagaugaagauaagga

SEQ ID NO: 402621 - RNA, 19 nt, Homo sapiens
agauuucucaccuguaaga

SEQ ID NO: 402622 - RNA, 19 nt, Homo sapiens
cuaagagaauacaggaaaa

SEQ ID NO: 402623 - RNA, 19 nt, Homo sapiens
gggcaagacagcagauggu

SEQ ID NO: 402624 - RNA, 19 nt, Homo sapiens
gcuccauccuugcaucacu

SEQ ID NO: 402625 - RNA, 19 nt, Homo sapiens
gcauuugucuccuccuuua

SEQ ID NO: 402626 - RNA, 19 nt, Homo sapiens
uaacugagucaucaucuua

SEQ ID NO: 402627 - RNA, 19 nt, Homo sapiens
ggacugaucgugacaaaug

SEQ ID NO: 402628 - RNA, 19 nt, Homo sapiens
ccgaagaaauugacccaua

SEQ ID NO: 402629 - RNA, 19 nt, Homo sapiens
gcaggaagaucccaacagu

SEQ ID NO: 402630 - RNA, 19 nt, Homo sapiens
gaagaacggugccacuuac

SEQ ID NO: 402631 - RNA, 19 nt, Homo sapiens
gaaaagccaucaccaagaa

SEQ ID NO: 402632 - RNA, 19 nt, Homo sapiens
gagcuggacuucauguuuc

SEQ ID NO: 402633 - RNA, 19 nt, Homo sapiens
ucaaggauguggaugagaa

SEQ ID NO: 402634 - RNA, 19 nt, Homo sapiens
gaauccuucuugauaguuu

SEQ ID NO: 402635 - RNA, 19 nt, Homo sapiens
caaagacucucccguggau

SEQ ID NO: 402636 - RNA, 19 nt, Homo sapiens
gcuagugggucuggguuua

SEQ ID NO: 402637 - RNA, 19 nt, Homo sapiens
gagcguauauaauugaagu

SEQ ID NO: 402638 - RNA, 19 nt, Homo sapiens
gcuggaaucuccuuugcaa

SEQ ID NO: 402639 - RNA, 19 nt, Homo sapiens
acucugggcugcuggaaua

SEQ ID NO: 402640 - RNA, 19 nt, Homo sapiens
ggaauugggagcacgauga

SEQ ID NO: 402641 - RNA, 19 nt, Homo sapiens
cgaagaaauugacccauag

SEQ ID NO: 402642 - RNA, 19 nt, Homo sapiens
gcaaucccaucugauaaga

SEQ ID NO: 402643 - RNA, 19 nt, Homo sapiens
gaaguugccucuuuuagga

SEQ ID NO: 402644 - RNA, 19 nt, Homo sapiens
gaacggugccacuuacgaa

SEQ ID NO: 402645 - RNA, 19 nt, Homo sapiens
ugaagaacggugccacuua

SEQ ID NO: 402646 - RNA, 19 nt, Homo sapiens
gaaagugacagcuggaauc

SEQ ID NO: 402647 - RNA, 19 nt, Homo sapiens
gugaagugauuggaauuaa

SEQ ID NO: 402648 - RNA, 19 nt, Homo sapiens
auaggacacucaagacuuu

SEQ ID NO: 402649 - RNA, 19 nt, Homo sapiens
ggaaagcacccugaacaug

SEQ ID NO: 402650 - RNA, 19 nt, Homo sapiens
agacaucgcacucaucaaa

SEQ ID NO: 402651 - RNA, 19 nt, Homo sapiens
gaagugauuggaauuaaca

SEQ ID NO: 402652 - RNA, 19 nt, Homo sapiens
ggaugggacuggucguguu

SEQ ID NO: 402653 - RNA, 19 nt, Homo sapiens
caaauguaauguugcagau

SEQ ID NO: 402654 - RNA, 19 nt, Homo sapiens
aggaagaucccaacaguuu

SEQ ID NO: 402655 - RNA, 19 nt, Homo sapiens
gcagacaucgcacucauca

SEQ ID NO: 402656 - RNA, 19 nt, Homo sapiens
uuaggaaucucuuuggaau

SEQ ID NO: 402657 - RNA, 19 nt, Homo sapiens
ucaggagcguauauaauug

SEQ ID NO: 402658 - RNA, 19 nt, Homo sapiens
aggaaucucuuuggaauug

SEQ ID NO: 402659 - RNA, 19 nt, Homo sapiens
gauacaaugcguagauaga

SEQ ID NO: 402660 - RNA, 19 nt, Homo sapiens
ucaccaagaagaaguauau

SEQ ID NO: 402661 - RNA, 19 nt, Homo sapiens
cuaaugcagucgauacaau

SEQ ID NO: 402662 - RNA, 19 nt, Homo sapiens
gaucucaggagcguauaua

SEQ ID NO: 402663 - RNA, 19 nt, Homo sapiens
ggugaagugauuggaauua

SEQ ID NO: 402664 - RNA, 19 nt, Homo sapiens
gaugucagcgacgucauua

SEQ ID NO: 402665 - RNA, 19 nt, Homo sapiens
cggccgaaguugccucuuu

SEQ ID NO: 402666 - RNA, 19 nt, Homo sapiens
acaguuugcgccauaaaua

SEQ ID NO: 402667 - RNA, 19 nt, Homo sapiens
cccaacaguuugcgccaua

SEQ ID NO: 402668 - RNA, 19 nt, Homo sapiens
gauuggaauuaacacuuug

SEQ ID NO: 402669 - RNA, 19 nt, Homo sapiens
caacaagcaccgggucaaa

SEQ ID NO: 402670 - RNA, 19 nt, Homo sapiens
gaaaacgacgucauaauca

SEQ ID NO: 402671 - RNA, 19 nt, Homo sapiens
ccuggacggugaagugauu

SEQ ID NO: 402672 - RNA, 19 nt, Homo sapiens
ggaaaacgacgucauaauc

SEQ ID NO: 402673 - RNA, 19 nt, Homo sapiens
ggacuucccagacgugauc

SEQ ID NO: 402674 - RNA, 19 nt, Homo sapiens
ggaagaucccaacaguuug

SEQ ID NO: 402675 - RNA, 19 nt, Homo sapiens
ucgauacaaugcguagaua

SEQ ID NO: 402676 - RNA, 19 nt, Homo sapiens
ggauguggaugagaaagca

SEQ ID NO: 402677 - RNA, 19 nt, Homo sapiens
gcucugcccuucuguaucc

SEQ ID NO: 402678 - RNA, 19 nt, Homo sapiens
gcagcgacgccaacaccua

SEQ ID NO: 402679 - RNA, 19 nt, Homo sapiens
caacuaaugcagucgauac

SEQ ID NO: 402680 - RNA, 19 nt, Homo sapiens
ugucagcgacgucauuaaa

SEQ ID NO: 402681 - RNA, 19 nt, Homo sapiens
cucaggagcguauauaauu

SEQ ID NO: 402682 - RNA, 19 nt, Homo sapiens
gaugggacuggucguguuu

SEQ ID NO: 402683 - RNA, 19 nt, Homo sapiens
ccaacaguuugcgccauaa

SEQ ID NO: 402684 - RNA, 19 nt, Homo sapiens
ugagcuggacuucauguuu

SEQ ID NO: 402685 - RNA, 19 nt, Homo sapiens
caaggaaaacgacgucaua

SEQ ID NO: 402686 - RNA, 19 nt, Homo sapiens
gcaacucagacauggacua

SEQ ID NO: 402687 - RNA, 19 nt, Homo sapiens
gcccuucuguauccuaugu

SEQ ID NO: 402688 - RNA, 19 nt, Homo sapiens
gagacucccuggccaacag

SEQ ID NO: 402689 - RNA, 19 nt, Homo sapiens
gaauaggacacucaagacu

SEQ ID NO: 402690 - RNA, 19 nt, Homo sapiens
ucacucacguccagcaaag

SEQ ID NO: 402691 - RNA, 19 nt, Homo sapiens
guucauaucgaauuguuuc

SEQ ID NO: 402692 - RNA, 19 nt, Homo sapiens
caagucagcacccaaaggu

SEQ ID NO: 402693 - RNA, 19 nt, Homo sapiens
cagcauuugucuccuccuu

SEQ ID NO: 402694 - RNA, 19 nt, Homo sapiens
gaagaucccaacaguuugc

SEQ ID NO: 402695 - RNA, 19 nt, Homo sapiens
gcaaagccaaagagcugaa

SEQ ID NO: 402696 - RNA, 19 nt, Homo sapiens
ccgacgccaucaucaacua

SEQ ID NO: 402697 - RNA, 19 nt, Homo sapiens
acucagacauggacuacau

SEQ ID NO: 402698 - RNA, 19 nt, Homo sapiens
ggaauaggacacucaagac

SEQ ID NO: 402699 - RNA, 19 nt, Homo sapiens
uggaauaggacacucaaga

SEQ ID NO: 402700 - RNA, 19 nt, Homo sapiens
cacagugauucccgaagaa

SEQ ID NO: 402701 - RNA, 19 nt, Homo sapiens
caacaguuugcgccauaaa

SEQ ID NO: 402702 - RNA, 19 nt, Homo sapiens
gucggaagauggacugauc

SEQ ID NO: 402703 - RNA, 19 nt, Homo sapiens
ggaaaagccaucaccaaga

SEQ ID NO: 402704 - RNA, 19 nt, Homo sapiens
ucgcggacgugguggagaa

SEQ ID NO: 402705 - RNA, 19 nt, Homo sapiens
gggucuggguuuauugugu

SEQ ID NO: 402706 - RNA, 19 nt, Homo sapiens
gaugacggaugaggacucu

SEQ ID NO: 402707 - RNA, 19 nt, Homo sapiens
gucauaaucagcaucaaug

SEQ ID NO: 402708 - RNA, 19 nt, Homo sapiens
caggagcguauauaauuga

SEQ ID NO: 402709 - RNA, 19 nt, Homo sapiens
ugaagugauuggaauuaac

SEQ ID NO: 402710 - RNA, 19 nt, Homo sapiens
gaguuugagcuauuaaagu

SEQ ID NO: 402711 - RNA, 19 nt, Homo sapiens
uuaacugagucaucaucuu

SEQ ID NO: 402712 - RNA, 19 nt, Homo sapiens
gaagaaauugacccauagg

SEQ ID NO: 402713 - RNA, 19 nt, Homo sapiens
aaguacuucuuacacauug

SEQ ID NO: 402714 - RNA, 19 nt, Homo sapiens
gggaaagcacccugaacau

SEQ ID NO: 402715 - RNA, 19 nt, Homo sapiens
gcaagcuuccguuuucuaa

SEQ ID NO: 402716 - RNA, 19 nt, Homo sapiens
ccuuugcaaucccaucuga

SEQ ID NO: 402717 - RNA, 19 nt, Homo sapiens
aaaccuggacggugaagug

SEQ ID NO: 402718 - RNA, 19 nt, Homo sapiens
aaaucaaggauguggauga

SEQ ID NO: 402719 - RNA, 19 nt, Homo sapiens
gggagcacgaugacucuga

SEQ ID NO: 402720 - RNA, 19 nt, Homo sapiens
gguuuauugugucggaaga

SEQ ID NO: 402721 - RNA, 19 nt, Homo sapiens
aaagcacccugaacauggu

SEQ ID NO: 402722 - RNA, 19 nt, Homo sapiens
uuugcaaucccaucugaua

SEQ ID NO: 402723 - RNA, 19 nt, Homo sapiens
ggaaucuccuuugcaaucc

SEQ ID NO: 402724 - RNA, 19 nt, Homo sapiens
uggaaucuccuuugcaauc

SEQ ID NO: 402725 - RNA, 19 nt, Homo sapiens
gcaaauacauguccuggau

SEQ ID NO: 402726 - RNA, 19 nt, Homo sapiens
gugaggagacuaugauaua

SEQ ID NO: 402727 - RNA, 19 nt, Homo sapiens
gaaccucaguuuccucauc

SEQ ID NO: 402728 - RNA, 19 nt, Homo sapiens
gguggugaguucugacuaa

SEQ ID NO: 402729 - RNA, 19 nt, Homo sapiens
ugaggagacuaugauauaa

SEQ ID NO: 402730 - RNA, 19 nt, Homo sapiens
acacccagaucugcaaaua

SEQ ID NO: 402731 - RNA, 19 nt, Homo sapiens
gaagugguggcaaagguuu

SEQ ID NO: 402732 - RNA, 19 nt, Homo sapiens
uacauguccuggaucaaua

SEQ ID NO: 402733 - RNA, 19 nt, Homo sapiens
aaauacauguccuggauca

SEQ ID NO: 402734 - RNA, 19 nt, Homo sapiens
gaacggaugagcacgaucu

SEQ ID NO: 402735 - RNA, 19 nt, Homo sapiens
guauguaaaucuucauggu

SEQ ID NO: 402736 - RNA, 19 nt, Homo sapiens
gccacucccugcuguguga

SEQ ID NO: 402737 - RNA, 19 nt, Homo sapiens
cuggaucaauaaagucaua

SEQ ID NO: 402738 - RNA, 19 nt, Homo sapiens
ggugaguucugacuaaagg

SEQ ID NO: 402739 - RNA, 19 nt, Homo sapiens
gagacuaugauauaacaug

SEQ ID NO: 402740 - RNA, 19 nt, Homo sapiens
ggucaccaacaacaugaua

SEQ ID NO: 402741 - RNA, 19 nt, Homo sapiens
ucacuauccugagcccuaa

SEQ ID NO: 402742 - RNA, 19 nt, Homo sapiens
aaagguuuauuccagagaa

SEQ ID NO: 402743 - RNA, 19 nt, Homo sapiens
ggaagugguggcaaagguu

SEQ ID NO: 402744 - RNA, 19 nt, Homo sapiens
ccaggacccuugccagagu

SEQ ID NO: 402745 - RNA, 19 nt, Homo sapiens
cacaguggguggugaguuc

SEQ ID NO: 402746 - RNA, 19 nt, Homo sapiens
gggagaagccuguauucca

SEQ ID NO: 402747 - RNA, 19 nt, Homo sapiens
guacugaagcugaaaugca

SEQ ID NO: 402748 - RNA, 19 nt, Homo sapiens
acccagaucugcaaauaca

SEQ ID NO: 402749 - RNA, 19 nt, Homo sapiens
ugacgugccuaccucuuag

SEQ ID NO: 402750 - RNA, 19 nt, Homo sapiens
ucaguuuccucaucugcaa

SEQ ID NO: 402751 - RNA, 19 nt, Homo sapiens
cagcugauccagauguuau

SEQ ID NO: 402752 - RNA, 19 nt, Homo sapiens
gugccuaccucuuagacau

SEQ ID NO: 402753 - RNA, 19 nt, Homo sapiens
aagcugaaaugcaggaagu

SEQ ID NO: 402754 - RNA, 19 nt, Homo sapiens
uggcaggucucgcucuuca

SEQ ID NO: 402755 - RNA, 19 nt, Homo sapiens
gaguucugacuaaagguua

SEQ ID NO: 402756 - RNA, 19 nt, Homo sapiens
gucauacgcuccaacugau

SEQ ID NO: 402757 - RNA, 19 nt, Homo sapiens
ccacaccucuaaacaucuc

SEQ ID NO: 402758 - RNA, 19 nt, Homo sapiens
guggugaguucugacuaaa

SEQ ID NO: 402759 - RNA, 19 nt, Homo sapiens
cuaaacaucuccccucuca

SEQ ID NO: 402760 - RNA, 19 nt, Homo sapiens
ccugagcccuaaagagugu

SEQ ID NO: 402761 - RNA, 19 nt, Homo sapiens
aggagacuaugauauaaca

SEQ ID NO: 402762 - RNA, 19 nt, Homo sapiens
agucauacgcuccaacuga

SEQ ID NO: 402763 - RNA, 19 nt, Homo sapiens
uguccuggaucaauaaagu

SEQ ID NO: 402764 - RNA, 19 nt, Homo sapiens
gcagauccuggccaugaga

SEQ ID NO: 402765 - RNA, 19 nt, Homo sapiens
ccagaucugcaaauacaug

SEQ ID NO: 402766 - RNA, 19 nt, Homo sapiens
gcgaacggaugagcacgau

SEQ ID NO: 402767 - RNA, 19 nt, Homo sapiens
ugcaggaagugguggcaaa

SEQ ID NO: 402768 - RNA, 19 nt, Homo sapiens
cuccacaccucuaaacauc

SEQ ID NO: 402769 - RNA, 19 nt, Homo sapiens
ggaccacucgcucuguugu

SEQ ID NO: 402770 - RNA, 19 nt, Homo sapiens
gccaagugcccucucugaa

SEQ ID NO: 402771 - RNA, 19 nt, Homo sapiens
caagccaagugcccucucu

SEQ ID NO: 402772 - RNA, 19 nt, Homo sapiens
gcacugggagaagccugua

SEQ ID NO: 402773 - RNA, 19 nt, Homo sapiens
ucaccaacaacaugauaug

SEQ ID NO: 402774 - RNA, 19 nt, Homo sapiens
ccucuuagacauguuguga

SEQ ID NO: 402775 - RNA, 19 nt, Homo sapiens
ccaagugcccucucugaac

SEQ ID NO: 402776 - RNA, 19 nt, Homo sapiens
gcaggucucgcucuucaac

SEQ ID NO: 402777 - RNA, 19 nt, Homo sapiens
acgcagauccuggccauga

SEQ ID NO: 402778 - RNA, 19 nt, Homo sapiens
ccggaccacucgcucuguu

SEQ ID NO: 402779 - RNA, 19 nt, Homo sapiens
gaggagacuaugauauaac

SEQ ID NO: 402780 - RNA, 19 nt, Homo sapiens
caaagguuuauuccagaga

SEQ ID NO: 402781 - RNA, 19 nt, Homo sapiens
ccagcugauccagauguua

SEQ ID NO: 402782 - RNA, 19 nt, Homo sapiens
auacauguccuggaucaau

SEQ ID NO: 402783 - RNA, 19 nt, Homo sapiens
gcaaauacauguccuggau

SEQ ID NO: 402784 - RNA, 19 nt, Homo sapiens
gugaggagacuaugauaua

SEQ ID NO: 402785 - RNA, 19 nt, Homo sapiens
gaaccucaguuuccucauc

SEQ ID NO: 402786 - RNA, 19 nt, Homo sapiens
gguggugaguucugacuaa

SEQ ID NO: 402787 - RNA, 19 nt, Homo sapiens
ugaggagacuaugauauaa

SEQ ID NO: 402788 - RNA, 19 nt, Homo sapiens
acacccagaucugcaaaua

SEQ ID NO: 402789 - RNA, 19 nt, Homo sapiens
gaagugguggcaaagguuu

SEQ ID NO: 402790 - RNA, 19 nt, Homo sapiens
uacauguccuggaucaaua

SEQ ID NO: 402791 - RNA, 19 nt, Homo sapiens
aaauacauguccuggauca

SEQ ID NO: 402792 - RNA, 19 nt, Homo sapiens
gaacggaugagcacgaucu

SEQ ID NO: 402793 - RNA, 19 nt, Homo sapiens
guauguaaaucuucauggu

SEQ ID NO: 402794 - RNA, 19 nt, Homo sapiens
gccacucccugcuguguga

SEQ ID NO: 402795 - RNA, 19 nt, Homo sapiens
cuggaucaauaaagucaua

SEQ ID NO: 402796 - RNA, 19 nt, Homo sapiens
ggugaguucugacuaaagg

SEQ ID NO: 402797 - RNA, 19 nt, Homo sapiens
gagacuaugauauaacaug

SEQ ID NO: 402798 - RNA, 19 nt, Homo sapiens
ggucaccaacaacaugaua

SEQ ID NO: 402799 - RNA, 19 nt, Homo sapiens
ucacuauccugagcccuaa

SEQ ID NO: 402800 - RNA, 19 nt, Homo sapiens
aaagguuuauuccagagaa

SEQ ID NO: 402801 - RNA, 19 nt, Homo sapiens
ggaagugguggcaaagguu

SEQ ID NO: 402802 - RNA, 19 nt, Homo sapiens
ccaggacccuugccagagu

SEQ ID NO: 402803 - RNA, 19 nt, Homo sapiens
cacaguggguggugaguuc

SEQ ID NO: 402804 - RNA, 19 nt, Homo sapiens
guacugaagcugaaaugca

SEQ ID NO: 402805 - RNA, 19 nt, Homo sapiens
acccagaucugcaaauaca

SEQ ID NO: 402806 - RNA, 19 nt, Homo sapiens
ugacgugccuaccucuuag

SEQ ID NO: 402807 - RNA, 19 nt, Homo sapiens
ucaguuuccucaucugcaa

SEQ ID NO: 402808 - RNA, 19 nt, Homo sapiens
cagcugauccagauguuau

SEQ ID NO: 402809 - RNA, 19 nt, Homo sapiens
uggcaggucucgcucuuca

SEQ ID NO: 402810 - RNA, 19 nt, Homo sapiens
gugccuaccucuuagacau

SEQ ID NO: 402811 - RNA, 19 nt, Homo sapiens
aagcugaaaugcaggaagu

SEQ ID NO: 402812 - RNA, 19 nt, Homo sapiens
gaguucugacuaaagguua

SEQ ID NO: 402813 - RNA, 19 nt, Homo sapiens
gucauacgcuccaacugau

SEQ ID NO: 402814 - RNA, 19 nt, Homo sapiens
ccacaccucuaaacaucuc

SEQ ID NO: 402815 - RNA, 19 nt, Homo sapiens
guggugaguucugacuaaa

SEQ ID NO: 402816 - RNA, 19 nt, Homo sapiens
cuaaacaucuccccucuca

SEQ ID NO: 402817 - RNA, 19 nt, Homo sapiens
ccugagcccuaaagagugu

SEQ ID NO: 402818 - RNA, 19 nt, Homo sapiens
aggagacuaugauauaaca

SEQ ID NO: 402819 - RNA, 19 nt, Homo sapiens
agucauacgcuccaacuga

SEQ ID NO: 402820 - RNA, 19 nt, Homo sapiens
uguccuggaucaauaaagu

SEQ ID NO: 402821 - RNA, 19 nt, Homo sapiens
gcgaacggaugagcacgau

SEQ ID NO: 402822 - RNA, 19 nt, Homo sapiens
ccagaucugcaaauacaug

SEQ ID NO: 402823 - RNA, 19 nt, Homo sapiens
ugcaggaagugguggcaaa

SEQ ID NO: 402824 - RNA, 19 nt, Homo sapiens
ggaccacucgcucuguugu

SEQ ID NO: 402825 - RNA, 19 nt, Homo sapiens
cuccacaccucuaaacauc

SEQ ID NO: 402826 - RNA, 19 nt, Homo sapiens
gccaagugcccucucugaa

SEQ ID NO: 402827 - RNA, 19 nt, Homo sapiens
caagccaagugcccucucu

SEQ ID NO: 402828 - RNA, 19 nt, Homo sapiens
ucaccaacaacaugauaug

SEQ ID NO: 402829 - RNA, 19 nt, Homo sapiens
ccucuuagacauguuguga

SEQ ID NO: 402830 - RNA, 19 nt, Homo sapiens
ccaagugcccucucugaac

SEQ ID NO: 402831 - RNA, 19 nt, Homo sapiens
gcaggucucgcucuucaac

SEQ ID NO: 402832 - RNA, 19 nt, Homo sapiens
ccggaccacucgcucuguu

SEQ ID NO: 402833 - RNA, 19 nt, Homo sapiens
gaggagacuaugauauaac

SEQ ID NO: 402834 - RNA, 19 nt, Homo sapiens
caaagguuuauuccagaga

SEQ ID NO: 402835 - RNA, 19 nt, Homo sapiens
ccagcugauccagauguua

SEQ ID NO: 402836 - RNA, 19 nt, Homo sapiens
auacauguccuggaucaau

SEQ ID NO: 402837 - RNA, 19 nt, Homo sapiens
ccacauaacauuugcacuu

SEQ ID NO: 402838 - RNA, 19 nt, Homo sapiens
cacauaacauuugcacuuu

SEQ ID NO: 402839 - RNA, 19 nt, Homo sapiens
ggacagaagcagcucuugu

SEQ ID NO: 402840 - RNA, 19 nt, Homo sapiens
gaauagacuccuucgugau

SEQ ID NO: 402841 - RNA, 19 nt, Homo sapiens
ggaugugccacccgccuuu

SEQ ID NO: 402842 - RNA, 19 nt, Homo sapiens
cauaacauuugcacuuucg

SEQ ID NO: 402843 - RNA, 19 nt, Homo sapiens
gcggaucuuuggacagaag

SEQ ID NO: 402844 - RNA, 19 nt, Homo sapiens
uggcaucauccaaggaaua

SEQ ID NO: 402845 - RNA, 19 nt, Homo sapiens
aggcggaucuuuggacaga

SEQ ID NO: 402846 - RNA, 19 nt, Homo sapiens
gcacugccugcgggacaua

SEQ ID NO: 402847 - RNA, 19 nt, Homo sapiens
cuacgacgcggagaacaaa

SEQ ID NO: 402848 - RNA, 19 nt, Homo sapiens
ucacgcggguagcccucua

SEQ ID NO: 402849 - RNA, 19 nt, Homo sapiens
acauaacauuugcacuuuc

SEQ ID NO: 402850 - RNA, 19 nt, Homo sapiens
gcuauaagaggagcuugau

SEQ ID NO: 402851 - RNA, 19 nt, Homo sapiens
cucgguggcucagguguuu

SEQ ID NO: 402852 - RNA, 19 nt, Homo sapiens
aauagacuccuucgugauc

SEQ ID NO: 402853 - RNA, 19 nt, Homo sapiens
gacaugaaguugcuauuaa

SEQ ID NO: 402854 - RNA, 19 nt, Homo sapiens
caacaagacugagaaagaa

SEQ ID NO: 402855 - RNA, 19 nt, Homo sapiens
gaagcagugugaucaguuu

SEQ ID NO: 402856 - RNA, 19 nt, Homo sapiens
ggacaugaaguugcuauua

SEQ ID NO: 402857 - RNA, 19 nt, Homo sapiens
ggagauccuuguuuacuug

SEQ ID NO: 402858 - RNA, 19 nt, Homo sapiens
gcacuaaaguuucugugau

SEQ ID NO: 402859 - RNA, 19 nt, Homo sapiens
gaacaagccaacagugaaa

SEQ ID NO: 402860 - RNA, 19 nt, Homo sapiens
ggaacuaggaggaggaaua

SEQ ID NO: 402861 - RNA, 19 nt, Homo sapiens
cagcaaagucugauguuua

SEQ ID NO: 402862 - RNA, 19 nt, Homo sapiens
gcucgaagcugccgaaguc

SEQ ID NO: 402863 - RNA, 19 nt, Homo sapiens
ggacaucauuaaaggagaa

SEQ ID NO: 402864 - RNA, 19 nt, Homo sapiens
ugaccaagcugauugacaa

SEQ ID NO: 402865 - RNA, 19 nt, Homo sapiens
gaacaaagcagcaaaacaa

SEQ ID NO: 402866 - RNA, 19 nt, Homo sapiens
gaacugguggagcccauua

SEQ ID NO: 402867 - RNA, 19 nt, Homo sapiens
cgaagucccugucggaaga

SEQ ID NO: 402868 - RNA, 19 nt, Homo sapiens
gaacugagaaguguauaug

SEQ ID NO: 402869 - RNA, 19 nt, Homo sapiens
caaaguggccuccaagaau

SEQ ID NO: 402870 - RNA, 19 nt, Homo sapiens
ugaaagagaugcccaugca

SEQ ID NO: 402871 - RNA, 19 nt, Homo sapiens
ugaaauugcuauccagaug

SEQ ID NO: 402872 - RNA, 19 nt, Homo sapiens
gaacuaggaggaggaauau

SEQ ID NO: 402873 - RNA, 19 nt, Homo sapiens
caaaggcaguuuuauauga

SEQ ID NO: 402874 - RNA, 19 nt, Homo sapiens
gaaauugcuauccagauga

SEQ ID NO: 402875 - RNA, 19 nt, Homo sapiens
ggaacaagccaacagugaa

SEQ ID NO: 402876 - RNA, 19 nt, Homo sapiens
gauguaauucccacuguaa

SEQ ID NO: 402877 - RNA, 19 nt, Homo sapiens
uuagaagccuggaauaauc

SEQ ID NO: 402878 - RNA, 19 nt, Homo sapiens
gauuagaagccuggaauaa

SEQ ID NO: 402879 - RNA, 19 nt, Homo sapiens
gcaguguggugccagaaug

SEQ ID NO: 402880 - RNA, 19 nt, Homo sapiens
aaaguggccuccaagaaug

SEQ ID NO: 402881 - RNA, 19 nt, Homo sapiens
gugaugaggugaaagagau

SEQ ID NO: 402882 - RNA, 19 nt, Homo sapiens
cagccaguauucugaaauu

SEQ ID NO: 402883 - RNA, 19 nt, Homo sapiens
ugaaguugcuauuaaaugg

SEQ ID NO: 402884 - RNA, 19 nt, Homo sapiens
ggaaugaacgcacagaucu

SEQ ID NO: 402885 - RNA, 19 nt, Homo sapiens
aagaaauacucgacgcuuu

SEQ ID NO: 402886 - RNA, 19 nt, Homo sapiens
cacuaaaguuucugugauu

SEQ ID NO: 402887 - RNA, 19 nt, Homo sapiens
uuaaauggacuucgugauu

SEQ ID NO: 402888 - RNA, 19 nt, Homo sapiens
ggagaucugugcgcugguu

SEQ ID NO: 402889 - RNA, 19 nt, Homo sapiens
gcaaacgccauguguggaa

SEQ ID NO: 402890 - RNA, 19 nt, Homo sapiens
ccagcaaagucugauguuu

SEQ ID NO: 402891 - RNA, 19 nt, Homo sapiens
gcgagucucuccagaagca

SEQ ID NO: 402892 - RNA, 19 nt, Homo sapiens
uguaauagcauagggauuu

SEQ ID NO: 402893 - RNA, 19 nt, Homo sapiens
agucugauguuuacuguga

SEQ ID NO: 402894 - RNA, 19 nt, Homo sapiens
gauccuggcugcucuugag

SEQ ID NO: 402895 - RNA, 19 nt, Homo sapiens
caacaacaagacugagaaa

SEQ ID NO: 402896 - RNA, 19 nt, Homo sapiens
cgacauaugcaaagacguu

SEQ ID NO: 402897 - RNA, 19 nt, Homo sapiens
gugauaugcugaaggacaa

SEQ ID NO: 402898 - RNA, 19 nt, Homo sapiens
ccauuucuguguccuuuau

SEQ ID NO: 402899 - RNA, 19 nt, Homo sapiens
caagacugagaaagaaaua

SEQ ID NO: 402900 - RNA, 19 nt, Homo sapiens
acaacaagacugagaaaga

SEQ ID NO: 402901 - RNA, 19 nt, Homo sapiens
ccaagcugauugacaacaa

SEQ ID NO: 402902 - RNA, 19 nt, Homo sapiens
ugaaggaggugaccaagcu

SEQ ID NO: 402903 - RNA, 19 nt, Homo sapiens
ccaaaguggccuccaagaa

SEQ ID NO: 402904 - RNA, 19 nt, Homo sapiens
agaacuauaucagccagua

SEQ ID NO: 402905 - RNA, 19 nt, Homo sapiens
gcuauuaaauggacuucgu

SEQ ID NO: 402906 - RNA, 19 nt, Homo sapiens
ugucaucccugcccuggaa

SEQ ID NO: 402907 - RNA, 19 nt, Homo sapiens
caacugugauuuggcuuuc

SEQ ID NO: 402908 - RNA, 19 nt, Homo sapiens
ugauguaauucccacugua

SEQ ID NO: 402909 - RNA, 19 nt, Homo sapiens
cuagauggauguugaugca

SEQ ID NO: 402910 - RNA, 19 nt, Homo sapiens
gcaccuagcagagcugaau

SEQ ID NO: 402911 - RNA, 19 nt, Homo sapiens
uguaauucccacuguaaua

SEQ ID NO: 402912 - RNA, 19 nt, Homo sapiens
ggagucagacggugcuaug

SEQ ID NO: 402913 - RNA, 19 nt, Homo sapiens
gaggugaccaagcugauug

SEQ ID NO: 402914 - RNA, 19 nt, Homo sapiens
gaggugugcucugcucuca

SEQ ID NO: 402915 - RNA, 19 nt, Homo sapiens
ugaaggacaaugccacuga

SEQ ID NO: 402916 - RNA, 19 nt, Homo sapiens
ggcagaaaccacagcauug

SEQ ID NO: 402917 - RNA, 19 nt, Homo sapiens
gcagugugaucaguuugug

SEQ ID NO: 402918 - RNA, 19 nt, Homo sapiens
guaauucccacuguaauag

SEQ ID NO: 402919 - RNA, 19 nt, Homo sapiens
ggaacugagaaguguauau

SEQ ID NO: 402920 - RNA, 19 nt, Homo sapiens
guugggaacugagaagugu

SEQ ID NO: 402921 - RNA, 19 nt, Homo sapiens
gccagacccuuaccagaag

SEQ ID NO: 402922 - RNA, 19 nt, Homo sapiens
gaacuauaucagccaguau

SEQ ID NO: 402923 - RNA, 19 nt, Homo sapiens
ugccaggacugcauucaga

SEQ ID NO: 402924 - RNA, 19 nt, Homo sapiens
gaaguugcuauuaaaugga

SEQ ID NO: 402925 - RNA, 19 nt, Homo sapiens
gcagaaaccacagcauugg

SEQ ID NO: 402926 - RNA, 19 nt, Homo sapiens
gccaucugccugaauguaa

SEQ ID NO: 402927 - RNA, 19 nt, Homo sapiens
ucugcuagauggauguuga

SEQ ID NO: 402928 - RNA, 19 nt, Homo sapiens
gaucuguuugacuuuguua

SEQ ID NO: 402929 - RNA, 19 nt, Homo sapiens
gacaacaacaagacugaga

SEQ ID NO: 402930 - RNA, 19 nt, Homo sapiens
aaagucugauguuuacugu

SEQ ID NO: 402931 - RNA, 19 nt, Homo sapiens
ggaccaacuccaccuuugu

SEQ ID NO: 402932 - RNA, 19 nt, Homo sapiens
gcugguggcuugggacauc

SEQ ID NO: 402933 - RNA, 19 nt, Homo sapiens
caaagucugauguuuacug

SEQ ID NO: 402934 - RNA, 19 nt, Homo sapiens
guucugugaugaggugaaa

SEQ ID NO: 402935 - RNA, 19 nt, Homo sapiens
acaugucccuggcuguuga

SEQ ID NO: 402936 - RNA, 19 nt, Homo sapiens
gcagaccguuuggaacaag

SEQ ID NO: 402937 - RNA, 19 nt, Homo sapiens
ggaggugaccaagcugauu

SEQ ID NO: 402938 - RNA, 19 nt, Homo sapiens
guucugagcccugacaugu

SEQ ID NO: 402939 - RNA, 19 nt, Homo sapiens
ucacgugacucagccaaag

SEQ ID NO: 402940 - RNA, 19 nt, Homo sapiens
gcacgaggucccagcaaag

SEQ ID NO: 402941 - RNA, 19 nt, Homo sapiens
cggaccaacuccaccuuug

SEQ ID NO: 402942 - RNA, 19 nt, Homo sapiens
ggugugcucugcucucaac

SEQ ID NO: 402943 - RNA, 19 nt, Homo sapiens
gcaaagccagcaggacaug

SEQ ID NO: 402944 - RNA, 19 nt, Homo sapiens
gagccacaguuucuugacu

SEQ ID NO: 402945 - RNA, 19 nt, Homo sapiens
gggaaugaacgcacagauc

SEQ ID NO: 402946 - RNA, 19 nt, Homo sapiens
ccuggcugcucuugagaaa

SEQ ID NO: 402947 - RNA, 19 nt, Homo sapiens
acugugaggugugugaauu

SEQ ID NO: 402948 - RNA, 19 nt, Homo sapiens
ugguggagcccauuaagaa

SEQ ID NO: 402949 - RNA, 19 nt, Homo sapiens
aaauugcuauccagaugau

SEQ ID NO: 402950 - RNA, 19 nt, Homo sapiens
aaaccgaacaugucugcuu

SEQ ID NO: 402951 - RNA, 19 nt, Homo sapiens
uggcagaaaccacagcauu

SEQ ID NO: 402952 - RNA, 19 nt, Homo sapiens
cagaagcagugugaucagu

SEQ ID NO: 402953 - RNA, 19 nt, Homo sapiens
gagaaucgcuagagccaaa

SEQ ID NO: 402954 - RNA, 19 nt, Homo sapiens
gaacaaugacuucagcaaa

SEQ ID NO: 402955 - RNA, 19 nt, Homo sapiens
ggacagagaccaggauuug

SEQ ID NO: 402956 - RNA, 19 nt, Homo sapiens
gggaguaccucaaguucuu

SEQ ID NO: 402957 - RNA, 19 nt, Homo sapiens
agacggagcucaagaaugc

SEQ ID NO: 402958 - RNA, 19 nt, Homo sapiens
caagucaccugugcccuuu

SEQ ID NO: 402959 - RNA, 19 nt, Homo sapiens
caaaugggaauucuucuau

SEQ ID NO: 402960 - RNA, 19 nt, Homo sapiens
ugaaggccauggcaaguga

SEQ ID NO: 402961 - RNA, 19 nt, Homo sapiens
gcuguuagcucccaaaaga

SEQ ID NO: 402962 - RNA, 19 nt, Homo sapiens
gccaaaggcaccuccuaua

SEQ ID NO: 402963 - RNA, 19 nt, Homo sapiens
guacagcuccaucaagaau

SEQ ID NO: 402964 - RNA, 19 nt, Homo sapiens
aaacugcucuggacuugca

SEQ ID NO: 402965 - RNA, 19 nt, Homo sapiens
cccaagggcuuacucuuuc

SEQ ID NO: 402966 - RNA, 19 nt, Homo sapiens
ucaagggcaugauccucua

SEQ ID NO: 402967 - RNA, 19 nt, Homo sapiens
gggcaugacucuggaccaa

SEQ ID NO: 402968 - RNA, 19 nt, Homo sapiens
gaaccuggagugccucaau

SEQ ID NO: 402969 - RNA, 19 nt, Homo sapiens
ccaaaugggaauucuucua

SEQ ID NO: 402970 - RNA, 19 nt, Homo sapiens
cgggaagucuccucucaug

SEQ ID NO: 402971 - RNA, 19 nt, Homo sapiens
gggcuuacucuuucucuug

SEQ ID NO: 402972 - RNA, 19 nt, Homo sapiens
cagaugcaguccuggauca

SEQ ID NO: 402973 - RNA, 19 nt, Homo sapiens
gccagugacuacagcaaga

SEQ ID NO: 402974 - RNA, 19 nt, Homo sapiens
acagcuccaucaagaauga

SEQ ID NO: 402975 - RNA, 19 nt, Homo sapiens
ccggaugccucucaaguca

SEQ ID NO: 402976 - RNA, 19 nt, Homo sapiens
gcccugagaugagguuuag

SEQ ID NO: 402977 - RNA, 19 nt, Homo sapiens
gacgcucucugucugaguu

SEQ ID NO: 402978 - RNA, 19 nt, Homo sapiens
aggccuaccuggaguuuga

SEQ ID NO: 402979 - RNA, 19 nt, Homo sapiens
gcaguggcaaugaggauga

SEQ ID NO: 402980 - RNA, 19 nt, Homo sapiens
aaaggcaccuccuauacca

SEQ ID NO: 402981 - RNA, 19 nt, Homo sapiens
ccaaaggcaccuccuauac

SEQ ID NO: 402982 - RNA, 19 nt, Homo sapiens
cugaugggccugacucuuu

SEQ ID NO: 402983 - RNA, 19 nt, Homo sapiens
gggcugccgucuacaagca

SEQ ID NO: 402984 - RNA, 19 nt, Homo sapiens
gagcagauggccuuuacuc

SEQ ID NO: 402985 - RNA, 19 nt, Homo sapiens
aaaugggaauucuucuaug

SEQ ID NO: 402986 - RNA, 19 nt, Homo sapiens
cugaugccguuucugcuuu

SEQ ID NO: 402987 - RNA, 19 nt, Homo sapiens
cuggaucacucgcaucaau

SEQ ID NO: 402988 - RNA, 19 nt, Homo sapiens
uuguacagcuccaucaaga

SEQ ID NO: 402989 - RNA, 19 nt, Homo sapiens
ccgcgagacugacaucgau

SEQ ID NO: 402990 - RNA, 19 nt, Homo sapiens
cugggcaccugaaggauga

SEQ ID NO: 402991 - RNA, 19 nt, Homo sapiens
gccaucagcauccacaaug

SEQ ID NO: 402992 - RNA, 19 nt, Homo sapiens
gcaagaacaaugacuucag

SEQ ID NO: 402993 - RNA, 19 nt, Homo sapiens
gggcaagaacaaugacuuc

SEQ ID NO: 402994 - RNA, 19 nt, Homo sapiens
ggccaaaggcaccuccuau

SEQ ID NO: 402995 - RNA, 19 nt, Homo sapiens
ugaugggccugacucuuuc

SEQ ID NO: 402996 - RNA, 19 nt, Homo sapiens
cggaggaccugcugacacu

SEQ ID NO: 402997 - RNA, 19 nt, Homo sapiens
gcaccugaaggaugacaug

SEQ ID NO: 402998 - RNA, 19 nt, Homo sapiens
ggcggaagcccugagauga

SEQ ID NO: 402999 - RNA, 19 nt, Homo sapiens
gaucacucgcaucaaugua

SEQ ID NO: 403000 - RNA, 19 nt, Homo sapiens
cagagacggagcucaagaa

SEQ ID NO: 403001 - RNA, 19 nt, Homo sapiens
aacaaugacuucagcaaac

SEQ ID NO: 403002 - RNA, 19 nt, Homo sapiens
ggaucacucgcaucaaugu

SEQ ID NO: 403003 - RNA, 19 nt, Homo sapiens
gaucuccacggccauaaca

SEQ ID NO: 403004 - RNA, 19 nt, Homo sapiens
ggagccggaugccucucaa

SEQ ID NO: 403005 - RNA, 19 nt, Homo sapiens
gcgagacugacaucgauga

SEQ ID NO: 403006 - RNA, 19 nt, Homo sapiens
uaaaacugcucuggacuug

SEQ ID NO: 403007 - RNA, 19 nt, Homo sapiens
gagacggagcucaagaaug

SEQ ID NO: 403008 - RNA, 19 nt, Homo sapiens
gaaguuacggcuggaagca

SEQ ID NO: 403009 - RNA, 19 nt, Homo sapiens
caagaggcuguaccgacua

SEQ ID NO: 403010 - RNA, 19 nt, Homo sapiens
aaugggaauucuucuaugg

SEQ ID NO: 403011 - RNA, 19 nt, Homo sapiens
gaaccggauucugguacca

SEQ ID NO: 403012 - RNA, 19 nt, Homo sapiens
ggugcuaccgcgagacuga

SEQ ID NO: 403013 - RNA, 19 nt, Homo sapiens
cuaccuggaguuugagaaa

SEQ ID NO: 403014 - RNA, 19 nt, Homo sapiens
ggaggccuaccuggaguuu

SEQ ID NO: 403015 - RNA, 19 nt, Homo sapiens
ggaguaccucaaguucuuu

SEQ ID NO: 403016 - RNA, 19 nt, Homo sapiens
cgacucggccaucgaaagu

SEQ ID NO: 403017 - RNA, 19 nt, Homo sapiens
ggccuggcuuggacagaga

SEQ ID NO: 403018 - RNA, 19 nt, Homo sapiens
gcagaaggaggaguacaag

SEQ ID NO: 403019 - RNA, 19 nt, Homo sapiens
uggagcagauggccuuuac

SEQ ID NO: 403020 - RNA, 19 nt, Homo sapiens
ucacucgcaucaauguagu

SEQ ID NO: 403021 - RNA, 19 nt, Homo sapiens
gaagcugcagugggccaua

SEQ ID NO: 403022 - RNA, 19 nt, Homo sapiens
gcugacacuggauucauga

SEQ ID NO: 403023 - RNA, 19 nt, Homo sapiens
gacuagauggcuucaggaa

SEQ ID NO: 403024 - RNA, 19 nt, Homo sapiens
ccaagggcuuacucuuucu

SEQ ID NO: 403025 - RNA, 19 nt, Homo sapiens
gugauaauguuuugcacuu

SEQ ID NO: 403026 - RNA, 19 nt, Homo sapiens
gggcaaggaggcugaagag

SEQ ID NO: 403027 - RNA, 19 nt, Homo sapiens
uaccucaaguucuuugucu

SEQ ID NO: 403028 - RNA, 19 nt, Homo sapiens
acaaugacuucagcaaacu

SEQ ID NO: 403029 - RNA, 19 nt, Homo sapiens
acacuggauucaugaacca

SEQ ID NO: 403030 - RNA, 19 nt, Homo sapiens
aagagcagcggcagaagga

SEQ ID NO: 403031 - RNA, 19 nt, Homo sapiens
ccucaaguucuuugucuuc

SEQ ID NO: 403032 - RNA, 19 nt, Homo sapiens
ggaagcacagacaccuugu

SEQ ID NO: 403033 - RNA, 19 nt, Homo sapiens
acucggccaucgaaaguca

SEQ ID NO: 403034 - RNA, 19 nt, Homo sapiens
gggccaaaggcaccuccua

SEQ ID NO: 403035 - RNA, 19 nt, Homo sapiens
aggaugaggacgacgauga

SEQ ID NO: 403036 - RNA, 19 nt, Homo sapiens
cccgggaagucuccucuca

SEQ ID NO: 403037 - RNA, 19 nt, Homo sapiens
gaagcccugagaugagguu

SEQ ID NO: 403038 - RNA, 19 nt, Homo sapiens
ucagagacggagcucaaga

SEQ ID NO: 403039 - RNA, 19 nt, Homo sapiens
gaccugcugacacuggauu

SEQ ID NO: 403040 - RNA, 19 nt, Homo sapiens
aaccuggagugccucaaug

SEQ ID NO: 403041 - RNA, 19 nt, Homo sapiens
gcgcucaugcugcucaaca

SEQ ID NO: 403042 - RNA, 19 nt, Homo sapiens
gcugaccugugcgcucaug

SEQ ID NO: 403043 - RNA, 19 nt, Homo sapiens
ggaugaggacgacgaugag

SEQ ID NO: 403044 - RNA, 19 nt, Homo sapiens
gagccaaaugggaauucuu

SEQ ID NO: 403045 - RNA, 19 nt, Homo sapiens
gcaccugggcaagaacaau

SEQ ID NO: 403046 - RNA, 19 nt, Homo sapiens
caaaggcaccuccuauacc

SEQ ID NO: 403047 - RNA, 19 nt, Homo sapiens
gaaucgcuagagccaaaug

SEQ ID NO: 403048 - RNA, 19 nt, Homo sapiens
gcccaaagcgguagaauua

SEQ ID NO: 403049 - RNA, 19 nt, Homo sapiens
gagcugacauugaaauaug

SEQ ID NO: 403050 - RNA, 19 nt, Homo sapiens
ccaaagcgguagaauuaaa

SEQ ID NO: 403051 - RNA, 19 nt, Homo sapiens
guacagcuauuucucauca

SEQ ID NO: 403052 - RNA, 19 nt, Homo sapiens
gagguuaggugaagugguu

SEQ ID NO: 403053 - RNA, 19 nt, Homo sapiens
gaaagggagucacaagaca

SEQ ID NO: 403054 - RNA, 19 nt, Homo sapiens
cagcaggcauaucucauua

SEQ ID NO: 403055 - RNA, 19 nt, Homo sapiens
aaacggaacucuucaucuu

SEQ ID NO: 403056 - RNA, 19 nt, Homo sapiens
ucaaguaccucccugaaug

SEQ ID NO: 403057 - RNA, 19 nt, Homo sapiens
gaaggaaccugagcuacga

SEQ ID NO: 403058 - RNA, 19 nt, Homo sapiens
ccauggauguuucuucuuu

SEQ ID NO: 403059 - RNA, 19 nt, Homo sapiens
ggagaacacaugaaagaaa

SEQ ID NO: 403060 - RNA, 19 nt, Homo sapiens
ucaauucucuaucauguug

SEQ ID NO: 403061 - RNA, 19 nt, Homo sapiens
uuaauugguuugugccuua

SEQ ID NO: 403062 - RNA, 19 nt, Homo sapiens
ggagcaagaugaggaagaa

SEQ ID NO: 403063 - RNA, 19 nt, Homo sapiens
gagaacacaugaaagaaag

SEQ ID NO: 403064 - RNA, 19 nt, Homo sapiens
ugaaacagcucaggagaga

SEQ ID NO: 403065 - RNA, 19 nt, Homo sapiens
gaggagaacacaugaaaga

SEQ ID NO: 403066 - RNA, 19 nt, Homo sapiens
ugagguugcuuuauccuaa

SEQ ID NO: 403067 - RNA, 19 nt, Homo sapiens
ggaaacaguacagcuauuu

SEQ ID NO: 403068 - RNA, 19 nt, Homo sapiens
caucaauucucuaucaugu

SEQ ID NO: 403069 - RNA, 19 nt, Homo sapiens
gcccugcacucaauucuga

SEQ ID NO: 403070 - RNA, 19 nt, Homo sapiens
aaacuuggauugggagauu

SEQ ID NO: 403071 - RNA, 19 nt, Homo sapiens
gacaaccaccugagcaaua

SEQ ID NO: 403072 - RNA, 19 nt, Homo sapiens
gaaagaaagaaccucaaga

SEQ ID NO: 403073 - RNA, 19 nt, Homo sapiens
ccaauuagcauuccaucaa

SEQ ID NO: 403074 - RNA, 19 nt, Homo sapiens
auccaugccuggcuuauua

SEQ ID NO: 403075 - RNA, 19 nt, Homo sapiens
ggucuuacucuuuguauga

SEQ ID NO: 403076 - RNA, 19 nt, Homo sapiens
ucucaucaauucucuauca

SEQ ID NO: 403077 - RNA, 19 nt, Homo sapiens
ugagucaagucaaauaugu

SEQ ID NO: 403078 - RNA, 19 nt, Homo sapiens
gcagaaacuaccagauuug

SEQ ID NO: 403079 - RNA, 19 nt, Homo sapiens
caucuuggcugugauuuca

SEQ ID NO: 403080 - RNA, 19 nt, Homo sapiens
guacguagccagaaugaca

SEQ ID NO: 403081 - RNA, 19 nt, Homo sapiens
gcgguagaauuaaagaaga

SEQ ID NO: 403082 - RNA, 19 nt, Homo sapiens
aaacagcucaggagagaaa

SEQ ID NO: 403083 - RNA, 19 nt, Homo sapiens
ugcagaaacuaccagauuu

SEQ ID NO: 403084 - RNA, 19 nt, Homo sapiens
caauuagcauuccaucaau

SEQ ID NO: 403085 - RNA, 19 nt, Homo sapiens
gcaagugacaacagccuuu

SEQ ID NO: 403086 - RNA, 19 nt, Homo sapiens
guagccauauuaauugguu

SEQ ID NO: 403087 - RNA, 19 nt, Homo sapiens
gcacagaaagggagucaca

SEQ ID NO: 403088 - RNA, 19 nt, Homo sapiens
gaacacaugaaagaaagaa

SEQ ID NO: 403089 - RNA, 19 nt, Homo sapiens
gugcagaaacuaccagauu

SEQ ID NO: 403090 - RNA, 19 nt, Homo sapiens
ccacagcaaaugagaugua

SEQ ID NO: 403091 - RNA, 19 nt, Homo sapiens
gguuccagcuucccuuuga

SEQ ID NO: 403092 - RNA, 19 nt, Homo sapiens
acggaacucuucaucuuaa

SEQ ID NO: 403093 - RNA, 19 nt, Homo sapiens
guuugugccuuacauuauu

SEQ ID NO: 403094 - RNA, 19 nt, Homo sapiens
ggucguggcuaccauuaag

SEQ ID NO: 403095 - RNA, 19 nt, Homo sapiens
gaugaggagcugacauuga

SEQ ID NO: 403096 - RNA, 19 nt, Homo sapiens
ggaagcguauaccuaaucu

SEQ ID NO: 403097 - RNA, 19 nt, Homo sapiens
agagagcccugcacucaau

SEQ ID NO: 403098 - RNA, 19 nt, Homo sapiens
gaugggcagcuaaucuaua

SEQ ID NO: 403099 - RNA, 19 nt, Homo sapiens
augaggagcugacauugaa

SEQ ID NO: 403100 - RNA, 19 nt, Homo sapiens
gggacgaggucaaggagau

SEQ ID NO: 403101 - RNA, 19 nt, Homo sapiens
ccucaacaauggugugguu

SEQ ID NO: 403102 - RNA, 19 nt, Homo sapiens
aaauacaggugcuauaagg

SEQ ID NO: 403103 - RNA, 19 nt, Homo sapiens
ucuagggucuuacucuuug

SEQ ID NO: 403104 - RNA, 19 nt, Homo sapiens
caagcacugacacucauua

SEQ ID NO: 403105 - RNA, 19 nt, Homo sapiens
gauguuucuucuuugacua

SEQ ID NO: 403106 - RNA, 19 nt, Homo sapiens
acaguguucugguugguaa

SEQ ID NO: 403107 - RNA, 19 nt, Homo sapiens
ggauugggagauuucauuu

SEQ ID NO: 403108 - RNA, 19 nt, Homo sapiens
uggcugugauuucaguaua

SEQ ID NO: 403109 - RNA, 19 nt, Homo sapiens
ucauggcccugguguuuau

SEQ ID NO: 403110 - RNA, 19 nt, Homo sapiens
uggugguucuguauaaaua

SEQ ID NO: 403111 - RNA, 19 nt, Homo sapiens
ccauuauucuagggucuua

SEQ ID NO: 403112 - RNA, 19 nt, Homo sapiens
ugaccaccuugcacuauug

SEQ ID NO: 403113 - RNA, 19 nt, Homo sapiens
gcucaggagagaaaugaaa

SEQ ID NO: 403114 - RNA, 19 nt, Homo sapiens
gaaagguccacuucguaug

SEQ ID NO: 403115 - RNA, 19 nt, Homo sapiens
ccagagagcccugcacuca

SEQ ID NO: 403116 - RNA, 19 nt, Homo sapiens
ggacgaggucaaggagaua

SEQ ID NO: 403117 - RNA, 19 nt, Homo sapiens
cagaagauaccgagacugu

SEQ ID NO: 403118 - RNA, 19 nt, Homo sapiens
ucuagcauauuugcgguua

SEQ ID NO: 403119 - RNA, 19 nt, Homo sapiens
gaaaggggaguaaaacuug

SEQ ID NO: 403120 - RNA, 19 nt, Homo sapiens
uaacguugcuguggacuac

SEQ ID NO: 403121 - RNA, 19 nt, Homo sapiens
gaauuuguagacauacuug

SEQ ID NO: 403122 - RNA, 19 nt, Homo sapiens
uagcauauuugcgguuaga

SEQ ID NO: 403123 - RNA, 19 nt, Homo sapiens
ccucauggcccugguguuu

SEQ ID NO: 403124 - RNA, 19 nt, Homo sapiens
ggacuacauuacuguugca

SEQ ID NO: 403125 - RNA, 19 nt, Homo sapiens
ggaaggaugggcagcuaau

SEQ ID NO: 403126 - RNA, 19 nt, Homo sapiens
gaaauauggcgccaagcau

SEQ ID NO: 403127 - RNA, 19 nt, Homo sapiens
gcaagaugaggaagaagau

SEQ ID NO: 403128 - RNA, 19 nt, Homo sapiens
ggauguuucuucuuugacu

SEQ ID NO: 403129 - RNA, 19 nt, Homo sapiens
caaaggagaguauccaaaa

SEQ ID NO: 403130 - RNA, 19 nt, Homo sapiens
gaagcucaaaggagaguau

SEQ ID NO: 403131 - RNA, 19 nt, Homo sapiens
gcacuccugaucuggaauu

SEQ ID NO: 403132 - RNA, 19 nt, Homo sapiens
gcuguggacuacauuacug

SEQ ID NO: 403133 - RNA, 19 nt, Homo sapiens
ucugaaugcugccaucaug

SEQ ID NO: 403134 - RNA, 19 nt, Homo sapiens
gagaacggcaggagcacaa

SEQ ID NO: 403135 - RNA, 19 nt, Homo sapiens
aagaauguguuaugaaucg

SEQ ID NO: 403136 - RNA, 19 nt, Homo sapiens
gcaggcaccagcagcagaa

SEQ ID NO: 403137 - RNA, 19 nt, Homo sapiens
aaaccaaacggaacucuuc

SEQ ID NO: 403138 - RNA, 19 nt, Homo sapiens
ggacaaaggugauuuuccu

SEQ ID NO: 403139 - RNA, 19 nt, Homo sapiens
aaagaaagaaccucaagag

SEQ ID NO: 403140 - RNA, 19 nt, Homo sapiens
gguaaagccucagcaacag

SEQ ID NO: 403141 - RNA, 19 nt, Homo sapiens
gagagaaaugaaacgcuuu

SEQ ID NO: 403142 - RNA, 19 nt, Homo sapiens
cuauacaguugcuccaaug

SEQ ID NO: 403143 - RNA, 19 nt, Homo sapiens
gcagcuuccuuccaagucu

SEQ ID NO: 403144 - RNA, 19 nt, Homo sapiens
guccacaucuaacaaaguc

SEQ ID NO: 403145 - RNA, 19 nt, Homo sapiens
gcugugauuucaguauaug

SEQ ID NO: 403146 - RNA, 19 nt, Homo sapiens
ggagcugacauugaaauau

SEQ ID NO: 403147 - RNA, 19 nt, Homo sapiens
ucugggagccugcaaguga

SEQ ID NO: 403148 - RNA, 19 nt, Homo sapiens
gcccaaagcgguagaauua

SEQ ID NO: 403149 - RNA, 19 nt, Homo sapiens
gaacuggaguggaguagga

SEQ ID NO: 403150 - RNA, 19 nt, Homo sapiens
gagcugacauugaaauaug

SEQ ID NO: 403151 - RNA, 19 nt, Homo sapiens
ccaaagcgguagaauuaaa

SEQ ID NO: 403152 - RNA, 19 nt, Homo sapiens
guacagcuauuucucauca

SEQ ID NO: 403153 - RNA, 19 nt, Homo sapiens
gagguuaggugaagugguu

SEQ ID NO: 403154 - RNA, 19 nt, Homo sapiens
gaaagggagucacaagaca

SEQ ID NO: 403155 - RNA, 19 nt, Homo sapiens
cagcaggcauaucucauua

SEQ ID NO: 403156 - RNA, 19 nt, Homo sapiens
aaacggaacucuucaucuu

SEQ ID NO: 403157 - RNA, 19 nt, Homo sapiens
ucaaguaccucccugaaug

SEQ ID NO: 403158 - RNA, 19 nt, Homo sapiens
gaaaugcuguuugcucgaa

SEQ ID NO: 403159 - RNA, 19 nt, Homo sapiens
ccauggauguuucuucuuu

SEQ ID NO: 403160 - RNA, 19 nt, Homo sapiens
ggagaacacaugaaagaaa

SEQ ID NO: 403161 - RNA, 19 nt, Homo sapiens
ucaauucucuaucauguug

SEQ ID NO: 403162 - RNA, 19 nt, Homo sapiens
uuaauugguuugugccuua

SEQ ID NO: 403163 - RNA, 19 nt, Homo sapiens
ggagcaagaugaggaagaa

SEQ ID NO: 403164 - RNA, 19 nt, Homo sapiens
gagaacacaugaaagaaag

SEQ ID NO: 403165 - RNA, 19 nt, Homo sapiens
ugaaacagcucaggagaga

SEQ ID NO: 403166 - RNA, 19 nt, Homo sapiens
gaggagaacacaugaaaga

SEQ ID NO: 403167 - RNA, 19 nt, Homo sapiens
ugagguugcuuuauccuaa

SEQ ID NO: 403168 - RNA, 19 nt, Homo sapiens
gagcaauacuaaugacaau

SEQ ID NO: 403169 - RNA, 19 nt, Homo sapiens
ggaaacaguacagcuauuu

SEQ ID NO: 403170 - RNA, 19 nt, Homo sapiens
caucaauucucuaucaugu

SEQ ID NO: 403171 - RNA, 19 nt, Homo sapiens
gcccugcacucaauucuga

SEQ ID NO: 403172 - RNA, 19 nt, Homo sapiens
aaacuuggauugggagauu

SEQ ID NO: 403173 - RNA, 19 nt, Homo sapiens
gacaaccaccugagcaaua

SEQ ID NO: 403174 - RNA, 19 nt, Homo sapiens
gaaagaaagaaccucaaga

SEQ ID NO: 403175 - RNA, 19 nt, Homo sapiens
gcagauggucccacuuauu

SEQ ID NO: 403176 - RNA, 19 nt, Homo sapiens
ccaauuagcauuccaucaa

SEQ ID NO: 403177 - RNA, 19 nt, Homo sapiens
auccaugccuggcuuauua

SEQ ID NO: 403178 - RNA, 19 nt, Homo sapiens
ggucuuacucuuuguauga

SEQ ID NO: 403179 - RNA, 19 nt, Homo sapiens
gcaauacuaaugacaauag

SEQ ID NO: 403180 - RNA, 19 nt, Homo sapiens
cagcucugcuuuaggcaua

SEQ ID NO: 403181 - RNA, 19 nt, Homo sapiens
uagcagauggucccacuua

SEQ ID NO: 403182 - RNA, 19 nt, Homo sapiens
ucucaucaauucucuauca

SEQ ID NO: 403183 - RNA, 19 nt, Homo sapiens
ugagucaagucaaauaugu

SEQ ID NO: 403184 - RNA, 19 nt, Homo sapiens
gcagaaacuaccagauuug

SEQ ID NO: 403185 - RNA, 19 nt, Homo sapiens
caucuuggcugugauuuca

SEQ ID NO: 403186 - RNA, 19 nt, Homo sapiens
gcgguagaauuaaagaaga

SEQ ID NO: 403187 - RNA, 19 nt, Homo sapiens
aaacagcucaggagagaaa

SEQ ID NO: 403188 - RNA, 19 nt, Homo sapiens
ugcagaaacuaccagauuu

SEQ ID NO: 403189 - RNA, 19 nt, Homo sapiens
caauuagcauuccaucaau

SEQ ID NO: 403190 - RNA, 19 nt, Homo sapiens
guagccauauuaauugguu

SEQ ID NO: 403191 - RNA, 19 nt, Homo sapiens
gcacagaaagggagucaca

SEQ ID NO: 403192 - RNA, 19 nt, Homo sapiens
gaacacaugaaagaaagaa

SEQ ID NO: 403193 - RNA, 19 nt, Homo sapiens
gcaagugacaacagccuuu

SEQ ID NO: 403194 - RNA, 19 nt, Homo sapiens
gugcagaaacuaccagauu

SEQ ID NO: 403195 - RNA, 19 nt, Homo sapiens
ccacagcaaaugagaugua

SEQ ID NO: 403196 - RNA, 19 nt, Homo sapiens
gguuccagcuucccuuuga

SEQ ID NO: 403197 - RNA, 19 nt, Homo sapiens
acggaacucuucaucuuaa

SEQ ID NO: 403198 - RNA, 19 nt, Homo sapiens
guuugugccuuacauuauu

SEQ ID NO: 403199 - RNA, 19 nt, Homo sapiens
ggucguggcuaccauuaag

SEQ ID NO: 403200 - RNA, 19 nt, Homo sapiens
gaugaggagcugacauuga

SEQ ID NO: 403201 - RNA, 19 nt, Homo sapiens
uccagugacucuuguguuu

SEQ ID NO: 403202 - RNA, 19 nt, Homo sapiens
agagagcccugcacucaau

SEQ ID NO: 403203 - RNA, 19 nt, Homo sapiens
gaugggcagcuaaucuaua

SEQ ID NO: 403204 - RNA, 19 nt, Homo sapiens
augaggagcugacauugaa

SEQ ID NO: 403205 - RNA, 19 nt, Homo sapiens
gggacgaggucaaggagau

SEQ ID NO: 403206 - RNA, 19 nt, Homo sapiens
ccucaacaauggugugguu

SEQ ID NO: 403207 - RNA, 19 nt, Homo sapiens
aaauacaggugcuauaagg

SEQ ID NO: 403208 - RNA, 19 nt, Homo sapiens
ucuagggucuuacucuuug

SEQ ID NO: 403209 - RNA, 19 nt, Homo sapiens
caagcacugacacucauua

SEQ ID NO: 403210 - RNA, 19 nt, Homo sapiens
gauguuucuucuuugacua

SEQ ID NO: 403211 - RNA, 19 nt, Homo sapiens
acaguguucugguugguaa

SEQ ID NO: 403212 - RNA, 19 nt, Homo sapiens
cagauggucccacuuauuc

SEQ ID NO: 403213 - RNA, 19 nt, Homo sapiens
ggauugggagauuucauuu

SEQ ID NO: 403214 - RNA, 19 nt, Homo sapiens
uggcugugauuucaguaua

SEQ ID NO: 403215 - RNA, 19 nt, Homo sapiens
ucauggcccugguguuuau

SEQ ID NO: 403216 - RNA, 19 nt, Homo sapiens
uggugguucuguauaaaua

SEQ ID NO: 403217 - RNA, 19 nt, Homo sapiens
ugaccaccuugcacuauug

SEQ ID NO: 403218 - RNA, 19 nt, Homo sapiens
gcucaggagagaaaugaaa

SEQ ID NO: 403219 - RNA, 19 nt, Homo sapiens
gaaagguccacuucguaug

SEQ ID NO: 403220 - RNA, 19 nt, Homo sapiens
ccagagagcccugcacuca

SEQ ID NO: 403221 - RNA, 19 nt, Homo sapiens
gauggucccacuuauucua

SEQ ID NO: 403222 - RNA, 19 nt, Homo sapiens
ggacgaggucaaggagaua

SEQ ID NO: 403223 - RNA, 19 nt, Homo sapiens
cagaagauaccgagacugu

SEQ ID NO: 403224 - RNA, 19 nt, Homo sapiens
ugaggugacuuuuccauaa

SEQ ID NO: 403225 - RNA, 19 nt, Homo sapiens
caagucaaauauguagaug

SEQ ID NO: 403226 - RNA, 19 nt, Homo sapiens
ucuagcauauuugcgguua

SEQ ID NO: 403227 - RNA, 19 nt, Homo sapiens
gaaaggggaguaaaacuug

SEQ ID NO: 403228 - RNA, 19 nt, Homo sapiens
uaacguugcuguggacuac

SEQ ID NO: 403229 - RNA, 19 nt, Homo sapiens
gaauuuguagacauacuug

SEQ ID NO: 403230 - RNA, 19 nt, Homo sapiens
caaauauguagaugccuuu

SEQ ID NO: 403231 - RNA, 19 nt, Homo sapiens
uagcauauuugcgguuaga

SEQ ID NO: 403232 - RNA, 19 nt, Homo sapiens
ccucauggcccugguguuu

SEQ ID NO: 403233 - RNA, 19 nt, Homo sapiens
ggacuacauuacuguugca

SEQ ID NO: 403234 - RNA, 19 nt, Homo sapiens
ggaaggaugggcagcuaau

SEQ ID NO: 403235 - RNA, 19 nt, Homo sapiens
gaaauauggcgccaagcau

SEQ ID NO: 403236 - RNA, 19 nt, Homo sapiens
gcaagaugaggaagaagau

SEQ ID NO: 403237 - RNA, 19 nt, Homo sapiens
gggauuaguagccgucuga

SEQ ID NO: 403238 - RNA, 19 nt, Homo sapiens
ggauguuucuucuuugacu

SEQ ID NO: 403239 - RNA, 19 nt, Homo sapiens
caaaggagaguauccaaaa

SEQ ID NO: 403240 - RNA, 19 nt, Homo sapiens
gaagcucaaaggagaguau

SEQ ID NO: 403241 - RNA, 19 nt, Homo sapiens
gcacuccugaucuggaauu

SEQ ID NO: 403242 - RNA, 19 nt, Homo sapiens
gcuguggacuacauuacug

SEQ ID NO: 403243 - RNA, 19 nt, Homo sapiens
ucugaaugcugccaucaug

SEQ ID NO: 403244 - RNA, 19 nt, Homo sapiens
gagaacggcaggagcacaa

SEQ ID NO: 403245 - RNA, 19 nt, Homo sapiens
aagaauguguuaugaaucg

SEQ ID NO: 403246 - RNA, 19 nt, Homo sapiens
gcaggcaccagcagcagaa

SEQ ID NO: 403247 - RNA, 19 nt, Homo sapiens
aggcaugcauguccaguga

SEQ ID NO: 403248 - RNA, 19 nt, Homo sapiens
gagcugacauugaaauaug

SEQ ID NO: 403249 - RNA, 19 nt, Homo sapiens
gaaagggagucacaagaca

SEQ ID NO: 403250 - RNA, 19 nt, Homo sapiens
cagcaggcauaucucauua

SEQ ID NO: 403251 - RNA, 19 nt, Homo sapiens
ucaaguaccucccugaaug

SEQ ID NO: 403252 - RNA, 19 nt, Homo sapiens
uuaauugguuugugccuua

SEQ ID NO: 403253 - RNA, 19 nt, Homo sapiens
ggagcaagaugaggaagaa

SEQ ID NO: 403254 - RNA, 19 nt, Homo sapiens
ugaaacagcucaggagaga

SEQ ID NO: 403255 - RNA, 19 nt, Homo sapiens
gagcaauacuaaugacaau

SEQ ID NO: 403256 - RNA, 19 nt, Homo sapiens
caaguauaaugcagaaaga

SEQ ID NO: 403257 - RNA, 19 nt, Homo sapiens
gcccugcacucaauucuga

SEQ ID NO: 403258 - RNA, 19 nt, Homo sapiens
aaacuuggauugggagauu

SEQ ID NO: 403259 - RNA, 19 nt, Homo sapiens
gacaaccaccugagcaaua

SEQ ID NO: 403260 - RNA, 19 nt, Homo sapiens
ccaauuagcauuccaucaa

SEQ ID NO: 403261 - RNA, 19 nt, Homo sapiens
auccaugccuggcuuauua

SEQ ID NO: 403262 - RNA, 19 nt, Homo sapiens
gcaauacuaaugacaauag

SEQ ID NO: 403263 - RNA, 19 nt, Homo sapiens
ccaucaaccugcugucuau

SEQ ID NO: 403264 - RNA, 19 nt, Homo sapiens
aaacagcucaggagagaaa

SEQ ID NO: 403265 - RNA, 19 nt, Homo sapiens
caauuagcauuccaucaau

SEQ ID NO: 403266 - RNA, 19 nt, Homo sapiens
guagccauauuaauugguu

SEQ ID NO: 403267 - RNA, 19 nt, Homo sapiens
gcacagaaagggagucaca

SEQ ID NO: 403268 - RNA, 19 nt, Homo sapiens
guuugugccuuacauuauu

SEQ ID NO: 403269 - RNA, 19 nt, Homo sapiens
ggucguggcuaccauuaag

SEQ ID NO: 403270 - RNA, 19 nt, Homo sapiens
gaugaggagcugacauuga

SEQ ID NO: 403271 - RNA, 19 nt, Homo sapiens
agagagcccugcacucaau

SEQ ID NO: 403272 - RNA, 19 nt, Homo sapiens
gaugggcagcuaaucuaua

SEQ ID NO: 403273 - RNA, 19 nt, Homo sapiens
augaggagcugacauugaa

SEQ ID NO: 403274 - RNA, 19 nt, Homo sapiens
ccucaacaauggugugguu

SEQ ID NO: 403275 - RNA, 19 nt, Homo sapiens
aaauacaggugcuauaagg

SEQ ID NO: 403276 - RNA, 19 nt, Homo sapiens
acaguguucugguugguaa

SEQ ID NO: 403277 - RNA, 19 nt, Homo sapiens
ggauugggagauuucauuu

SEQ ID NO: 403278 - RNA, 19 nt, Homo sapiens
ucauggcccugguguuuau

SEQ ID NO: 403279 - RNA, 19 nt, Homo sapiens
uggugguucuguauaaaua

SEQ ID NO: 403280 - RNA, 19 nt, Homo sapiens
gcucaggagagaaaugaaa

SEQ ID NO: 403281 - RNA, 19 nt, Homo sapiens
gaaagguccacuucguaug

SEQ ID NO: 403282 - RNA, 19 nt, Homo sapiens
ccagagagcccugcacuca

SEQ ID NO: 403283 - RNA, 19 nt, Homo sapiens
cagaagauaccgagacugu

SEQ ID NO: 403284 - RNA, 19 nt, Homo sapiens
gaaaggggaguaaaacuug

SEQ ID NO: 403285 - RNA, 19 nt, Homo sapiens
uggcugugauuucgguaua

SEQ ID NO: 403286 - RNA, 19 nt, Homo sapiens
uaacguugcuguggacuac

SEQ ID NO: 403287 - RNA, 19 nt, Homo sapiens
ccucauggcccugguguuu

SEQ ID NO: 403288 - RNA, 19 nt, Homo sapiens
ggacuacauuacuguugca

SEQ ID NO: 403289 - RNA, 19 nt, Homo sapiens
ggaaggaugggcagcuaau

SEQ ID NO: 403290 - RNA, 19 nt, Homo sapiens
gaaauauggcgccaagcau

SEQ ID NO: 403291 - RNA, 19 nt, Homo sapiens
gcaagaugaggaagaagau

SEQ ID NO: 403292 - RNA, 19 nt, Homo sapiens
caaaggagaguauccaaaa

SEQ ID NO: 403293 - RNA, 19 nt, Homo sapiens
gaagcucaaaggagaguau

SEQ ID NO: 403294 - RNA, 19 nt, Homo sapiens
gcacuccugaucuggaauu

SEQ ID NO: 403295 - RNA, 19 nt, Homo sapiens
gcuguggacuacauuacug

SEQ ID NO: 403296 - RNA, 19 nt, Homo sapiens
ucugaaugcugccaucaug

SEQ ID NO: 403297 - RNA, 19 nt, Homo sapiens
gagaacggcaggagcacaa

SEQ ID NO: 403298 - RNA, 19 nt, Homo sapiens
gguaaagccucagcaacag

SEQ ID NO: 403299 - RNA, 19 nt, Homo sapiens
gagagaaaugaaacgcuuu

SEQ ID NO: 403300 - RNA, 19 nt, Homo sapiens
caccugagcaauacuaaug

SEQ ID NO: 403301 - RNA, 19 nt, Homo sapiens
ggagcugacauugaaauau

SEQ ID NO: 403302 - RNA, 19 nt, Homo sapiens
gagcugcuguccaggaacu

SEQ ID NO: 403303 - RNA, 19 nt, Homo sapiens
ccagagggacagucaucua

SEQ ID NO: 403304 - RNA, 19 nt, Homo sapiens
cagaaagggagucacaaga

SEQ ID NO: 403305 - RNA, 19 nt, Homo sapiens
ucaaaggagaguauccaaa

SEQ ID NO: 403306 - RNA, 19 nt, Homo sapiens
ccagcaggcauaucucauu

SEQ ID NO: 403307 - RNA, 19 nt, Homo sapiens
ccaaguauaaugcagaaag

SEQ ID NO: 403308 - RNA, 19 nt, Homo sapiens
gcugugauuucgguauaug

SEQ ID NO: 403309 - RNA, 19 nt, Homo sapiens
ggacaaccaccugagcaau

SEQ ID NO: 403310 - RNA, 19 nt, Homo sapiens
aagaugaggagcugacauu

SEQ ID NO: 403311 - RNA, 19 nt, Homo sapiens
caucuuggcugugauuucg

SEQ ID NO: 403312 - RNA, 19 nt, Homo sapiens
uggcucaucuuggcuguga

SEQ ID NO: 403313 - RNA, 19 nt, Homo sapiens
gcccugguguuuaucaagu

SEQ ID NO: 403314 - RNA, 19 nt, Homo sapiens
acccugagccauuaucuaa

SEQ ID NO: 403315 - RNA, 19 nt, Homo sapiens
cuacuuugccacagauuau

SEQ ID NO: 403316 - RNA, 19 nt, Homo sapiens
gguuugugccuuacauuau

SEQ ID NO: 403317 - RNA, 19 nt, Homo sapiens
ggaaaggggaguaaaacuu

SEQ ID NO: 403318 - RNA, 19 nt, Homo sapiens
ugaaauauggcgccaagca

SEQ ID NO: 403319 - RNA, 19 nt, Homo sapiens
ggcaggugguggagcaaga

SEQ ID NO: 403320 - RNA, 19 nt, Homo sapiens
gaggagcugacauugaaau

SEQ ID NO: 403321 - RNA, 19 nt, Homo sapiens
cauuaagucagucagcuuu

SEQ ID NO: 403322 - RNA, 19 nt, Homo sapiens
gaacuuuccagcaguaucc

SEQ ID NO: 403323 - RNA, 19 nt, Homo sapiens
gcucaucuuggcugugauu

SEQ ID NO: 403324 - RNA, 19 nt, Homo sapiens
gguguggugggaaugauuu

SEQ ID NO: 403325 - RNA, 19 nt, Homo sapiens
uaucaucucuauuguugcu

SEQ ID NO: 403326 - RNA, 19 nt, Homo sapiens
ggacugcguggcucaucuu

SEQ ID NO: 403327 - RNA, 19 nt, Homo sapiens
gaaagcauugccagcucuu

SEQ ID NO: 403328 - RNA, 19 nt, Homo sapiens
gugaagacccagaggaaag

SEQ ID NO: 403329 - RNA, 19 nt, Homo sapiens
ggugaagacccagaggaaa

SEQ ID NO: 403330 - RNA, 19 nt, Homo sapiens
uauccucgcuggugaagac

SEQ ID NO: 403331 - RNA, 19 nt, Homo sapiens
gccaucaaccugcugucua

SEQ ID NO: 403332 - RNA, 19 nt, Homo sapiens
gcaggagcacaacgacaga

SEQ ID NO: 403333 - RNA, 19 nt, Homo sapiens
ggaugggcagcuaaucuau

SEQ ID NO: 403334 - RNA, 19 nt, Homo sapiens
agacuggaacacaaccaua

SEQ ID NO: 403335 - RNA, 19 nt, Homo sapiens
aagaugaggaagaagauga

SEQ ID NO: 403336 - RNA, 19 nt, Homo sapiens
agacacuguugcagagaau

SEQ ID NO: 403337 - RNA, 19 nt, Homo sapiens
ggagucacaagacacuguu

SEQ ID NO: 403338 - RNA, 19 nt, Homo sapiens
uaaauacaggugcuauaag

SEQ ID NO: 403339 - RNA, 19 nt, Homo sapiens
ccggaaggaugggcagcua

SEQ ID NO: 403340 - RNA, 19 nt, Homo sapiens
aagacacuguugcagagaa

SEQ ID NO: 403341 - RNA, 19 nt, Homo sapiens
cagcucaggagagaaauga

SEQ ID NO: 403342 - RNA, 19 nt, Homo sapiens
caaucuccaucaccuuugg

SEQ ID NO: 403343 - RNA, 19 nt, Homo sapiens
acaaccaccugagcaauac

SEQ ID NO: 403344 - RNA, 19 nt, Homo sapiens
uuaagucagucagcuuuua

SEQ ID NO: 403345 - RNA, 19 nt, Homo sapiens
uuucuacaguguucugguu

SEQ ID NO: 403346 - RNA, 19 nt, Homo sapiens
cacagaagauaccgagacu

SEQ ID NO: 403347 - RNA, 19 nt, Homo sapiens
uggugugguuggugaauau

SEQ ID NO: 403348 - RNA, 19 nt, Homo sapiens
cauagaaagugacguguua

SEQ ID NO: 403349 - RNA, 19 nt, Homo sapiens
gaagaagacuccuaugaca

SEQ ID NO: 403350 - RNA, 19 nt, Homo sapiens
gaaggaaccugagacagaa

SEQ ID NO: 403351 - RNA, 19 nt, Homo sapiens
gcugggaaguggcuuaaua

SEQ ID NO: 403352 - RNA, 19 nt, Homo sapiens
ggagagaaaugagcccaua

SEQ ID NO: 403353 - RNA, 19 nt, Homo sapiens
gggaggagcuggaggaaga

SEQ ID NO: 403354 - RNA, 19 nt, Homo sapiens
cauauucccugcccugaua

SEQ ID NO: 403355 - RNA, 19 nt, Homo sapiens
ggaugcaguuguauaguuu

SEQ ID NO: 403356 - RNA, 19 nt, Homo sapiens
gggaagugcucaagaccua

SEQ ID NO: 403357 - RNA, 19 nt, Homo sapiens
gagcggacgucccuaaugu

SEQ ID NO: 403358 - RNA, 19 nt, Homo sapiens
gcagggcuaugcucacauu

SEQ ID NO: 403359 - RNA, 19 nt, Homo sapiens
ccacagagcuaaagugacu

SEQ ID NO: 403360 - RNA, 19 nt, Homo sapiens
gaaacugaguccuguucuu

SEQ ID NO: 403361 - RNA, 19 nt, Homo sapiens
ggaggacccugaccgcuau

SEQ ID NO: 403362 - RNA, 19 nt, Homo sapiens
gggcugagaugcgcaaaga

SEQ ID NO: 403363 - RNA, 19 nt, Homo sapiens
caaagggccucugagaaug

SEQ ID NO: 403364 - RNA, 19 nt, Homo sapiens
ccaaagggccucugagaau

SEQ ID NO: 403365 - RNA, 19 nt, Homo sapiens
aaccagcgcugcccucuuu

SEQ ID NO: 403366 - RNA, 19 nt, Homo sapiens
aaauagaugaguccuguua

SEQ ID NO: 403367 - RNA, 19 nt, Homo sapiens
gcucauggcccuaguguuc

SEQ ID NO: 403368 - RNA, 19 nt, Homo sapiens
ccagggagcaucauucauu

SEQ ID NO: 403369 - RNA, 19 nt, Homo sapiens
gcagguuuauccagaugaa

SEQ ID NO: 403370 - RNA, 19 nt, Homo sapiens
cagggagcaucauucauuu

SEQ ID NO: 403371 - RNA, 19 nt, Homo sapiens
ucacauucauggccucuga

SEQ ID NO: 403372 - RNA, 19 nt, Homo sapiens
ugaaggaaccugagacaga

SEQ ID NO: 403373 - RNA, 19 nt, Homo sapiens
caugauguccuuguuauuu

SEQ ID NO: 403374 - RNA, 19 nt, Homo sapiens
ggugccagcuguuucauca

SEQ ID NO: 403375 - RNA, 19 nt, Homo sapiens
ggaguguucccaaugcuuu

SEQ ID NO: 403376 - RNA, 19 nt, Homo sapiens
ggagcugugugaccauaga

SEQ ID NO: 403377 - RNA, 19 nt, Homo sapiens
gagaaaugagcccauauuc

SEQ ID NO: 403378 - RNA, 19 nt, Homo sapiens
cagcaggccuaccucauca

SEQ ID NO: 403379 - RNA, 19 nt, Homo sapiens
gacuuuggcucccgcuuug

SEQ ID NO: 403380 - RNA, 19 nt, Homo sapiens
gaagacuccuaugacaguu

SEQ ID NO: 403381 - RNA, 19 nt, Homo sapiens
ggaagaagacuccuaugac

SEQ ID NO: 403382 - RNA, 19 nt, Homo sapiens
gaagagcugacccucaaau

SEQ ID NO: 403383 - RNA, 19 nt, Homo sapiens
aggaagagcugacccucaa

SEQ ID NO: 403384 - RNA, 19 nt, Homo sapiens
ggacgugggacuucucaga

SEQ ID NO: 403385 - RNA, 19 nt, Homo sapiens
gcucaagaccuacaaugug

SEQ ID NO: 403386 - RNA, 19 nt, Homo sapiens
ucauuuagccugcugagaa

SEQ ID NO: 403387 - RNA, 19 nt, Homo sapiens
cucauuggcuugugucuga

SEQ ID NO: 403388 - RNA, 19 nt, Homo sapiens
gauggaagaagacuccuau

SEQ ID NO: 403389 - RNA, 19 nt, Homo sapiens
gaugagcggacgucccuaa

SEQ ID NO: 403390 - RNA, 19 nt, Homo sapiens
gagaagaagaaaccaagug

SEQ ID NO: 403391 - RNA, 19 nt, Homo sapiens
gaugaguccuguuagaaaa

SEQ ID NO: 403392 - RNA, 19 nt, Homo sapiens
uggaugcaguuguauaguu

SEQ ID NO: 403393 - RNA, 19 nt, Homo sapiens
ugagaaugcugguagaaac

SEQ ID NO: 403394 - RNA, 19 nt, Homo sapiens
gggcuaugcucacauucau

SEQ ID NO: 403395 - RNA, 19 nt, Homo sapiens
gcugguugaucaugucuuc

SEQ ID NO: 403396 - RNA, 19 nt, Homo sapiens
gcugaacacccucaucaug

SEQ ID NO: 403397 - RNA, 19 nt, Homo sapiens
gagcgaagcacgugaucau

SEQ ID NO: 403398 - RNA, 19 nt, Homo sapiens
ggagaagccaggagaacga

SEQ ID NO: 403399 - RNA, 19 nt, Homo sapiens
aaacugcccaggagagaaa

SEQ ID NO: 403400 - RNA, 19 nt, Homo sapiens
gacauucacugaggacaca

SEQ ID NO: 403401 - RNA, 19 nt, Homo sapiens
aggaagaagugugugauga

SEQ ID NO: 403402 - RNA, 19 nt, Homo sapiens
ccaaugcuuuguccaugau

SEQ ID NO: 403403 - RNA, 19 nt, Homo sapiens
auagaugaguccuguuaga

SEQ ID NO: 403404 - RNA, 19 nt, Homo sapiens
aaacugaguccuguucuug

SEQ ID NO: 403405 - RNA, 19 nt, Homo sapiens
ggccacagagcuaaaguga

SEQ ID NO: 403406 - RNA, 19 nt, Homo sapiens
uggaagaagacuccuauga

SEQ ID NO: 403407 - RNA, 19 nt, Homo sapiens
gcagcaggccuaccucauc

SEQ ID NO: 403408 - RNA, 19 nt, Homo sapiens
ugguggugcucuacaagua

SEQ ID NO: 403409 - RNA, 19 nt, Homo sapiens
ucaagucugugcgcuucua

SEQ ID NO: 403410 - RNA, 19 nt, Homo sapiens
gaucagcgucaucgugguu

SEQ ID NO: 403411 - RNA, 19 nt, Homo sapiens
ggaagaagugugugaugag

SEQ ID NO: 403412 - RNA, 19 nt, Homo sapiens
ggacuucaucuucuacagu

SEQ ID NO: 403413 - RNA, 19 nt, Homo sapiens
agagaaaugagcccauauu

SEQ ID NO: 403414 - RNA, 19 nt, Homo sapiens
ugacagcgaggaagaagug

SEQ ID NO: 403415 - RNA, 19 nt, Homo sapiens
cccaaugcuuuguccauga

SEQ ID NO: 403416 - RNA, 19 nt, Homo sapiens
cagcagguuuauccagaug

SEQ ID NO: 403417 - RNA, 19 nt, Homo sapiens
uucauuggaugcaguugua

SEQ ID NO: 403418 - RNA, 19 nt, Homo sapiens
gaaacugcccaggagagaa

SEQ ID NO: 403419 - RNA, 19 nt, Homo sapiens
gguuaugaccaucuucuug

SEQ ID NO: 403420 - RNA, 19 nt, Homo sapiens
gggagcaucauucauuuag

SEQ ID NO: 403421 - RNA, 19 nt, Homo sapiens
agaagagcauccggcauga

SEQ ID NO: 403422 - RNA, 19 nt, Homo sapiens
uagaaagugacguguuaaa

SEQ ID NO: 403423 - RNA, 19 nt, Homo sapiens
acucuagugccauauauuu

SEQ ID NO: 403424 - RNA, 19 nt, Homo sapiens
uugaucaugucuucacuga

SEQ ID NO: 403425 - RNA, 19 nt, Homo sapiens
gaauggacagcucaucuac

SEQ ID NO: 403426 - RNA, 19 nt, Homo sapiens
gagcugacccucaaauacg

SEQ ID NO: 403427 - RNA, 19 nt, Homo sapiens
gaggaagaagugugugaug

SEQ ID NO: 403428 - RNA, 19 nt, Homo sapiens
uccaugauguccuuguuau

SEQ ID NO: 403429 - RNA, 19 nt, Homo sapiens
aggaagcacagcagguuua

SEQ ID NO: 403430 - RNA, 19 nt, Homo sapiens
gcccuaguguucaucaagu

SEQ ID NO: 403431 - RNA, 19 nt, Homo sapiens
cgaggaguguucccaaugc

SEQ ID NO: 403432 - RNA, 19 nt, Homo sapiens
ggaagcacagcagguuuau

SEQ ID NO: 403433 - RNA, 19 nt, Homo sapiens
acccggagauggaagaaga

SEQ ID NO: 403434 - RNA, 19 nt, Homo sapiens
gagcugaaggaaccugaga

SEQ ID NO: 403435 - RNA, 19 nt, Homo sapiens
agaauggacagcucaucua

SEQ ID NO: 403436 - RNA, 19 nt, Homo sapiens
gcacgugaucaugcuguuu

SEQ ID NO: 403437 - RNA, 19 nt, Homo sapiens
guccaugauguccuuguua

SEQ ID NO: 403438 - RNA, 19 nt, Homo sapiens
gcugagaugcgcaaagagu

SEQ ID NO: 403439 - RNA, 19 nt, Homo sapiens
gaaccugagacagaagcua

SEQ ID NO: 403440 - RNA, 19 nt, Homo sapiens
gcagggaauuuucauugga

SEQ ID NO: 403441 - RNA, 19 nt, Homo sapiens
cccaucagcucuacaucug

SEQ ID NO: 403442 - RNA, 19 nt, Homo sapiens
gagagaaaugagcccauau

SEQ ID NO: 403443 - RNA, 19 nt, Homo sapiens
auccauggcugguugauca

SEQ ID NO: 403444 - RNA, 19 nt, Homo sapiens
gugcugaacacccucauca

SEQ ID NO: 403445 - RNA, 19 nt, Homo sapiens
agaugaguccuguuagaaa

SEQ ID NO: 403446 - RNA, 19 nt, Homo sapiens
gaggagacagccagaagca

SEQ ID NO: 403447 - RNA, 19 nt, Homo sapiens
cagcucaucuacacgacau

SEQ ID NO: 403448 - RNA, 19 nt, Homo sapiens
cauagaaagugacguguua

SEQ ID NO: 403449 - RNA, 19 nt, Homo sapiens
gaaggaaccugagacagaa

SEQ ID NO: 403450 - RNA, 19 nt, Homo sapiens
gcugggaaguggcuuaaua

SEQ ID NO: 403451 - RNA, 19 nt, Homo sapiens
ggagagaaaugagcccaua

SEQ ID NO: 403452 - RNA, 19 nt, Homo sapiens
gggaggagcuggaggaaga

SEQ ID NO: 403453 - RNA, 19 nt, Homo sapiens
cauauucccugcccugaua

SEQ ID NO: 403454 - RNA, 19 nt, Homo sapiens
ggaugcaguuguauaguuu

SEQ ID NO: 403455 - RNA, 19 nt, Homo sapiens
gggaagugcucaagaccua

SEQ ID NO: 403456 - RNA, 19 nt, Homo sapiens
gagcggacgucccuaaugu

SEQ ID NO: 403457 - RNA, 19 nt, Homo sapiens
gcagggcuaugcucacauu

SEQ ID NO: 403458 - RNA, 19 nt, Homo sapiens
ccacagagcuaaagugacu

SEQ ID NO: 403459 - RNA, 19 nt, Homo sapiens
gaaacugaguccuguucuu

SEQ ID NO: 403460 - RNA, 19 nt, Homo sapiens
ggaggacccugaccgcuau

SEQ ID NO: 403461 - RNA, 19 nt, Homo sapiens
gggcugagaugcgcaaaga

SEQ ID NO: 403462 - RNA, 19 nt, Homo sapiens
caaagggccucugagaaug

SEQ ID NO: 403463 - RNA, 19 nt, Homo sapiens
ccaaagggccucugagaau

SEQ ID NO: 403464 - RNA, 19 nt, Homo sapiens
aaccagcgcugcccucuuu

SEQ ID NO: 403465 - RNA, 19 nt, Homo sapiens
aaauagaugaguccuguua

SEQ ID NO: 403466 - RNA, 19 nt, Homo sapiens
gcucauggcccuaguguuc

SEQ ID NO: 403467 - RNA, 19 nt, Homo sapiens
ccagggagcaucauucauu

SEQ ID NO: 403468 - RNA, 19 nt, Homo sapiens
gcagguuuauccagaugaa

SEQ ID NO: 403469 - RNA, 19 nt, Homo sapiens
cagggagcaucauucauuu

SEQ ID NO: 403470 - RNA, 19 nt, Homo sapiens
ggaagacuccuaugacagu

SEQ ID NO: 403471 - RNA, 19 nt, Homo sapiens
ucacauucauggccucuga

SEQ ID NO: 403472 - RNA, 19 nt, Homo sapiens
caugauguccuuguuauuu

SEQ ID NO: 403473 - RNA, 19 nt, Homo sapiens
ugaaggaaccugagacaga

SEQ ID NO: 403474 - RNA, 19 nt, Homo sapiens
ggugccagcuguuucauca

SEQ ID NO: 403475 - RNA, 19 nt, Homo sapiens
ggaguguucccaaugcuuu

SEQ ID NO: 403476 - RNA, 19 nt, Homo sapiens
ggagcugugugaccauaga

SEQ ID NO: 403477 - RNA, 19 nt, Homo sapiens
gagaaaugagcccauauuc

SEQ ID NO: 403478 - RNA, 19 nt, Homo sapiens
cagcaggccuaccucauca

SEQ ID NO: 403479 - RNA, 19 nt, Homo sapiens
gacuuuggcucccgcuuug

SEQ ID NO: 403480 - RNA, 19 nt, Homo sapiens
gaagacuccuaugacaguu

SEQ ID NO: 403481 - RNA, 19 nt, Homo sapiens
gaagagcugacccucaaau

SEQ ID NO: 403482 - RNA, 19 nt, Homo sapiens
aggaagagcugacccucaa

SEQ ID NO: 403483 - RNA, 19 nt, Homo sapiens
ggacgugggacuucucaga

SEQ ID NO: 403484 - RNA, 19 nt, Homo sapiens
gcucaagaccuacaaugug

SEQ ID NO: 403485 - RNA, 19 nt, Homo sapiens
ucauuuagccugcugagaa

SEQ ID NO: 403486 - RNA, 19 nt, Homo sapiens
cucauuggcuugugucuga

SEQ ID NO: 403487 - RNA, 19 nt, Homo sapiens
gaugagcggacgucccuaa

SEQ ID NO: 403488 - RNA, 19 nt, Homo sapiens
gagaagaagaaaccaagug

SEQ ID NO: 403489 - RNA, 19 nt, Homo sapiens
gaugaguccuguuagaaaa

SEQ ID NO: 403490 - RNA, 19 nt, Homo sapiens
uggaugcaguuguauaguu

SEQ ID NO: 403491 - RNA, 19 nt, Homo sapiens
ugagaaugcugguagaaac

SEQ ID NO: 403492 - RNA, 19 nt, Homo sapiens
gggcuaugcucacauucau

SEQ ID NO: 403493 - RNA, 19 nt, Homo sapiens
gcugguugaucaugucuuc

SEQ ID NO: 403494 - RNA, 19 nt, Homo sapiens
gcugaacacccucaucaug

SEQ ID NO: 403495 - RNA, 19 nt, Homo sapiens
gagcgaagcacgugaucau

SEQ ID NO: 403496 - RNA, 19 nt, Homo sapiens
ggagaagccaggagaacga

SEQ ID NO: 403497 - RNA, 19 nt, Homo sapiens
aaacugcccaggagagaaa

SEQ ID NO: 403498 - RNA, 19 nt, Homo sapiens
gacauucacugaggacaca

SEQ ID NO: 403499 - RNA, 19 nt, Homo sapiens
aggaagaagugugugauga

SEQ ID NO: 403500 - RNA, 19 nt, Homo sapiens
ccaaugcuuuguccaugau

SEQ ID NO: 403501 - RNA, 19 nt, Homo sapiens
auagaugaguccuguuaga

SEQ ID NO: 403502 - RNA, 19 nt, Homo sapiens
aaacugaguccuguucuug

SEQ ID NO: 403503 - RNA, 19 nt, Homo sapiens
gcagcaggccuaccucauc

SEQ ID NO: 403504 - RNA, 19 nt, Homo sapiens
ugguggugcucuacaagua

SEQ ID NO: 403505 - RNA, 19 nt, Homo sapiens
ucaagucugugcgcuucua

SEQ ID NO: 403506 - RNA, 19 nt, Homo sapiens
ggccacagagcuaaaguga

SEQ ID NO: 403507 - RNA, 19 nt, Homo sapiens
gaucagcgucaucgugguu

SEQ ID NO: 403508 - RNA, 19 nt, Homo sapiens
ggaagaagugugugaugag

SEQ ID NO: 403509 - RNA, 19 nt, Homo sapiens
ggacuucaucuucuacagu

SEQ ID NO: 403510 - RNA, 19 nt, Homo sapiens
agagaaaugagcccauauu

SEQ ID NO: 403511 - RNA, 19 nt, Homo sapiens
ugacagcgaggaagaagug

SEQ ID NO: 403512 - RNA, 19 nt, Homo sapiens
cccaaugcuuuguccauga

SEQ ID NO: 403513 - RNA, 19 nt, Homo sapiens
cagcagguuuauccagaug

SEQ ID NO: 403514 - RNA, 19 nt, Homo sapiens
uucauuggaugcaguugua

SEQ ID NO: 403515 - RNA, 19 nt, Homo sapiens
gaaacugcccaggagagaa

SEQ ID NO: 403516 - RNA, 19 nt, Homo sapiens
gguuaugaccaucuucuug

SEQ ID NO: 403517 - RNA, 19 nt, Homo sapiens
gggagcaucauucauuuag

SEQ ID NO: 403518 - RNA, 19 nt, Homo sapiens
agaagagcauccggcauga

SEQ ID NO: 403519 - RNA, 19 nt, Homo sapiens
acucuagugccauauauuu

SEQ ID NO: 403520 - RNA, 19 nt, Homo sapiens
uugaucaugucuucacuga

SEQ ID NO: 403521 - RNA, 19 nt, Homo sapiens
uagaaagugacguguuaaa

SEQ ID NO: 403522 - RNA, 19 nt, Homo sapiens
gaauggacagcucaucuac

SEQ ID NO: 403523 - RNA, 19 nt, Homo sapiens
gagcugacccucaaauacg

SEQ ID NO: 403524 - RNA, 19 nt, Homo sapiens
gaggaagaagugugugaug

SEQ ID NO: 403525 - RNA, 19 nt, Homo sapiens
uccaugauguccuuguuau

SEQ ID NO: 403526 - RNA, 19 nt, Homo sapiens
aggaagcacagcagguuua

SEQ ID NO: 403527 - RNA, 19 nt, Homo sapiens
gcccuaguguucaucaagu

SEQ ID NO: 403528 - RNA, 19 nt, Homo sapiens
cgaggaguguucccaaugc

SEQ ID NO: 403529 - RNA, 19 nt, Homo sapiens
ggaagcacagcagguuuau

SEQ ID NO: 403530 - RNA, 19 nt, Homo sapiens
gagcugaaggaaccugaga

SEQ ID NO: 403531 - RNA, 19 nt, Homo sapiens
agaauggacagcucaucua

SEQ ID NO: 403532 - RNA, 19 nt, Homo sapiens
gcacgugaucaugcuguuu

SEQ ID NO: 403533 - RNA, 19 nt, Homo sapiens
guccaugauguccuuguua

SEQ ID NO: 403534 - RNA, 19 nt, Homo sapiens
gcugagaugcgcaaagagu

SEQ ID NO: 403535 - RNA, 19 nt, Homo sapiens
gcagggaauuuucauugga

SEQ ID NO: 403536 - RNA, 19 nt, Homo sapiens
cccaucagcucuacaucug

SEQ ID NO: 403537 - RNA, 19 nt, Homo sapiens
gaaccugagacagaagcua

SEQ ID NO: 403538 - RNA, 19 nt, Homo sapiens
gagagaaaugagcccauau

SEQ ID NO: 403539 - RNA, 19 nt, Homo sapiens
auccauggcugguugauca

SEQ ID NO: 403540 - RNA, 19 nt, Homo sapiens
gugcugaacacccucauca

SEQ ID NO: 403541 - RNA, 19 nt, Homo sapiens
agaugaguccuguuagaaa

SEQ ID NO: 403542 - RNA, 19 nt, Homo sapiens
gaggagacagccagaagca

SEQ ID NO: 403543 - RNA, 19 nt, Homo sapiens
cagcucaucuacacgacau

SEQ ID NO: 403544 - RNA, 19 nt, Homo sapiens
gcgaggaagaaguguguga

SEQ ID NO: 403545 - RNA, 19 nt, Homo sapiens
uagaugaguccuguuagaa

SEQ ID NO: 403546 - RNA, 19 nt, Homo sapiens
auaccacgcuggccugcuu

SEQ ID NO: 403547 - RNA, 19 nt, Homo sapiens
gauggaagacuccuaugac

SEQ ID NO: 403548 - RNA, 19 nt, Homo sapiens
guaacaaucugcuuucuuu

SEQ ID NO: 403549 - RNA, 19 nt, Homo sapiens
gaagaaacuccaccuauuu

SEQ ID NO: 403550 - RNA, 19 nt, Homo sapiens
gcacuuauguaaacaauca

SEQ ID NO: 403551 - RNA, 19 nt, Homo sapiens
ggucagagccucccuauga

SEQ ID NO: 403552 - RNA, 19 nt, Homo sapiens
acacauauuugcacaagua

SEQ ID NO: 403553 - RNA, 19 nt, Homo sapiens
caaacaggcugauaucuuc

SEQ ID NO: 403554 - RNA, 19 nt, Homo sapiens
ugaagaaacuccaccuauu

SEQ ID NO: 403555 - RNA, 19 nt, Homo sapiens
ggaagaggcucagcacaga

SEQ ID NO: 403556 - RNA, 19 nt, Homo sapiens
ggaagaacauugauuucau

SEQ ID NO: 403557 - RNA, 19 nt, Homo sapiens
gggcaacuauucaugagaa

SEQ ID NO: 403558 - RNA, 19 nt, Homo sapiens
gaacuacaccuacauuugg

SEQ ID NO: 403559 - RNA, 19 nt, Homo sapiens
aauaugaacugcaggcaaa

SEQ ID NO: 403560 - RNA, 19 nt, Homo sapiens
gcaaacaaacuuauucuac

SEQ ID NO: 403561 - RNA, 19 nt, Homo sapiens
cauggaggcugugagcuua

SEQ ID NO: 403562 - RNA, 19 nt, Homo sapiens
gaaacaggacccuaucaau

SEQ ID NO: 403563 - RNA, 19 nt, Homo sapiens
uaaacaaucagaccacauu

SEQ ID NO: 403564 - RNA, 19 nt, Homo sapiens
agagguuugugaagauuua

SEQ ID NO: 403565 - RNA, 19 nt, Homo sapiens
ccugaacccuccaaauuug

SEQ ID NO: 403566 - RNA, 19 nt, Homo sapiens
acaagcaaaucccaaauuc

SEQ ID NO: 403567 - RNA, 19 nt, Homo sapiens
cuacugaaauuaucauugg

SEQ ID NO: 403568 - RNA, 19 nt, Homo sapiens
aaacaggacccuaucaaug

SEQ ID NO: 403569 - RNA, 19 nt, Homo sapiens
caagagguuugugaagauu

SEQ ID NO: 403570 - RNA, 19 nt, Homo sapiens
gcacaaguacaguaacaau

SEQ ID NO: 403571 - RNA, 19 nt, Homo sapiens
ucaagagguuugugaagau

SEQ ID NO: 403572 - RNA, 19 nt, Homo sapiens
ggaccucuaccauuacauu

SEQ ID NO: 403573 - RNA, 19 nt, Homo sapiens
caaucugcuuucuuuguaa

SEQ ID NO: 403574 - RNA, 19 nt, Homo sapiens
acaaucagaccacauuuga

SEQ ID NO: 403575 - RNA, 19 nt, Homo sapiens
uaacaaacaggcugauauc

SEQ ID NO: 403576 - RNA, 19 nt, Homo sapiens
aaguagagaugcccauaga

SEQ ID NO: 403577 - RNA, 19 nt, Homo sapiens
gaagucagccuugguuugg

SEQ ID NO: 403578 - RNA, 19 nt, Homo sapiens
cgcaggauccuacaccuua

SEQ ID NO: 403579 - RNA, 19 nt, Homo sapiens
gaccacauuugaagaaacu

SEQ ID NO: 403580 - RNA, 19 nt, Homo sapiens
ccaaauuugucuaagaacu

SEQ ID NO: 403581 - RNA, 19 nt, Homo sapiens
cuccaaauuugucuaagaa

SEQ ID NO: 403582 - RNA, 19 nt, Homo sapiens
ccuccaaauuugucuaaga

SEQ ID NO: 403583 - RNA, 19 nt, Homo sapiens
acccuucauucaccuauua

SEQ ID NO: 403584 - RNA, 19 nt, Homo sapiens
gaccucuaccauuacauua

SEQ ID NO: 403585 - RNA, 19 nt, Homo sapiens
gauagaaugaaccaauaug

SEQ ID NO: 403586 - RNA, 19 nt, Homo sapiens
gcugauucuuuaaaugguu

SEQ ID NO: 403587 - RNA, 19 nt, Homo sapiens
gaaagcuccaaauccauga

SEQ ID NO: 403588 - RNA, 19 nt, Homo sapiens
gaaaacaggauccucauuc

SEQ ID NO: 403589 - RNA, 19 nt, Homo sapiens
gcacaagcaaaucccaaau

SEQ ID NO: 403590 - RNA, 19 nt, Homo sapiens
aaacaggauccucauucua

SEQ ID NO: 403591 - RNA, 19 nt, Homo sapiens
caagcuaccugugguggau

SEQ ID NO: 403592 - RNA, 19 nt, Homo sapiens
gaagaggcucagcacagaa

SEQ ID NO: 403593 - RNA, 19 nt, Homo sapiens
aggcugauaucuucauaau

SEQ ID NO: 403594 - RNA, 19 nt, Homo sapiens
acaaacaggcugauaucuu

SEQ ID NO: 403595 - RNA, 19 nt, Homo sapiens
caaguacaguaacaaucug

SEQ ID NO: 403596 - RNA, 19 nt, Homo sapiens
agaacuacaccuacauuug

SEQ ID NO: 403597 - RNA, 19 nt, Homo sapiens
ccagggagaauaaggaugu

SEQ ID NO: 403598 - RNA, 19 nt, Homo sapiens
caucaccaucaacaacuua

SEQ ID NO: 403599 - RNA, 19 nt, Homo sapiens
ccucuaccauuacauuaca

SEQ ID NO: 403600 - RNA, 19 nt, Homo sapiens
cagaccacauuugaagaaa

SEQ ID NO: 403601 - RNA, 19 nt, Homo sapiens
ucagaccacauuugaagaa

SEQ ID NO: 403602 - RNA, 19 nt, Homo sapiens
acaggcugauaucuucaua

SEQ ID NO: 403603 - RNA, 19 nt, Homo sapiens
ucagagaagagucaggaaa

SEQ ID NO: 403604 - RNA, 19 nt, Homo sapiens
cucaagagguuugugaaga

SEQ ID NO: 403605 - RNA, 19 nt, Homo sapiens
gaaugaaccaauaugaacu

SEQ ID NO: 403606 - RNA, 19 nt, Homo sapiens
ggcuacaucugguacaaag

SEQ ID NO: 403607 - RNA, 19 nt, Homo sapiens
cacaagcaaaucccaaauu

SEQ ID NO: 403608 - RNA, 19 nt, Homo sapiens
cagcaucguuggcaauagg

SEQ ID NO: 403609 - RNA, 19 nt, Homo sapiens
ugaaacaggacccuaucaa

SEQ ID NO: 403610 - RNA, 19 nt, Homo sapiens
uuaacaaacaggcugauau

SEQ ID NO: 403611 - RNA, 19 nt, Homo sapiens
aaacaaucagaccacauuu

SEQ ID NO: 403612 - RNA, 19 nt, Homo sapiens
caucccugcugauccagaa

SEQ ID NO: 403613 - RNA, 19 nt, Homo sapiens
gcaggauccuacaccuuac

SEQ ID NO: 403614 - RNA, 19 nt, Homo sapiens
cuccugaacccuccaaauu

SEQ ID NO: 403615 - RNA, 19 nt, Homo sapiens
caucuccagcagcaacuua

SEQ ID NO: 403616 - RNA, 19 nt, Homo sapiens
aacaggacccuaucaaugu

SEQ ID NO: 403617 - RNA, 19 nt, Homo sapiens
aaucagaccacauuugaag

SEQ ID NO: 403618 - RNA, 19 nt, Homo sapiens
ugaagucagccuugguuug

SEQ ID NO: 403619 - RNA, 19 nt, Homo sapiens
gagucuaucuggcauucag

SEQ ID NO: 403620 - RNA, 19 nt, Homo sapiens
gguuuuagguggagucuau

SEQ ID NO: 403621 - RNA, 19 nt, Homo sapiens
acaaguacaguaacaaucu

SEQ ID NO: 403622 - RNA, 19 nt, Homo sapiens
cccaaauucuccuccugaa

SEQ ID NO: 403623 - RNA, 19 nt, Homo sapiens
acaggacccuaucaaugug

SEQ ID NO: 403624 - RNA, 19 nt, Homo sapiens
aaaugaaacaggacccuau

SEQ ID NO: 403625 - RNA, 19 nt, Homo sapiens
uacaguaacaaucugcuuu

SEQ ID NO: 403626 - RNA, 19 nt, Homo sapiens
aagcaaaucccaaauucuc

SEQ ID NO: 403627 - RNA, 19 nt, Homo sapiens
gauccuacaccuuacacau

SEQ ID NO: 403628 - RNA, 19 nt, Homo sapiens
agaaugaaccaauaugaac

SEQ ID NO: 403629 - RNA, 19 nt, Homo sapiens
guaacaugacacauuugaa

SEQ ID NO: 403630 - RNA, 19 nt, Homo sapiens
uguaacaugacacauuuga

SEQ ID NO: 403631 - RNA, 19 nt, Homo sapiens
uccugaacccuccaaauuu

SEQ ID NO: 403632 - RNA, 19 nt, Homo sapiens
uugcugcacuuauguaaac

SEQ ID NO: 403633 - RNA, 19 nt, Homo sapiens
uaccugugguggaugaaug

SEQ ID NO: 403634 - RNA, 19 nt, Homo sapiens
gcaggcaaagucugaaguc

SEQ ID NO: 403635 - RNA, 19 nt, Homo sapiens
uaacaaucugcuuucuuug

SEQ ID NO: 403636 - RNA, 19 nt, Homo sapiens
guacaguaacaaucugcuu

SEQ ID NO: 403637 - RNA, 19 nt, Homo sapiens
ggcacaagcaaaucccaaa

SEQ ID NO: 403638 - RNA, 19 nt, Homo sapiens
ccauggaggcugugagcuu

SEQ ID NO: 403639 - RNA, 19 nt, Homo sapiens
auacacauauuugcacaag

SEQ ID NO: 403640 - RNA, 19 nt, Homo sapiens
gucgaagucucugguaagu

SEQ ID NO: 403641 - RNA, 19 nt, Homo sapiens
caaucagaccacauuugaa

SEQ ID NO: 403642 - RNA, 19 nt, Homo sapiens
uuagaagacagccuacaug

SEQ ID NO: 403643 - RNA, 19 nt, Homo sapiens
cuaagaacuucgaaaacuu

SEQ ID NO: 403644 - RNA, 19 nt, Homo sapiens
ccagaccuccccagaauuu

SEQ ID NO: 403645 - RNA, 19 nt, Homo sapiens
gggagaauaaggaugucuu

SEQ ID NO: 403646 - RNA, 19 nt, Homo sapiens
ccaccuauuuugcaaacaa

SEQ ID NO: 403647 - RNA, 19 nt, Homo sapiens
ugguuuggcuuccuauucu

SEQ ID NO: 403648 - RNA, 19 nt, Homo sapiens
ggucagagccucccuauga

SEQ ID NO: 403649 - RNA, 19 nt, Homo sapiens
gcugauaccuucaugaaau

SEQ ID NO: 403650 - RNA, 19 nt, Homo sapiens
gaauacaagcuccugauaa

SEQ ID NO: 403651 - RNA, 19 nt, Homo sapiens
ggcaggagauuuauggaaa

SEQ ID NO: 403652 - RNA, 19 nt, Homo sapiens
gaucauaccacuggacuaa

SEQ ID NO: 403653 - RNA, 19 nt, Homo sapiens
ccacuggacuaagaacuuu

SEQ ID NO: 403654 - RNA, 19 nt, Homo sapiens
gacaauuaaugggaaguuu

SEQ ID NO: 403655 - RNA, 19 nt, Homo sapiens
gcacaguauucuuggacaa

SEQ ID NO: 403656 - RNA, 19 nt, Homo sapiens
caguauucuuggacaauua

SEQ ID NO: 403657 - RNA, 19 nt, Homo sapiens
ugacagccgugcucaggaa

SEQ ID NO: 403658 - RNA, 19 nt, Homo sapiens
aggaguaacuggauauuuc

SEQ ID NO: 403659 - RNA, 19 nt, Homo sapiens
ggaccucuaccauuacauu

SEQ ID NO: 403660 - RNA, 19 nt, Homo sapiens
ucauaccacuggacuaaga

SEQ ID NO: 403661 - RNA, 19 nt, Homo sapiens
aaagcuauuugcacaaguu

SEQ ID NO: 403662 - RNA, 19 nt, Homo sapiens
gagcaauugguaaaguaua

SEQ ID NO: 403663 - RNA, 19 nt, Homo sapiens
cuagaggaguaacuggaua

SEQ ID NO: 403664 - RNA, 19 nt, Homo sapiens
ggacuaagaacuuucaaaa

SEQ ID NO: 403665 - RNA, 19 nt, Homo sapiens
ugaauacaagcuccugaua

SEQ ID NO: 403666 - RNA, 19 nt, Homo sapiens
cgcaggauccuacaccuua

SEQ ID NO: 403667 - RNA, 19 nt, Homo sapiens
ugaugggacuagaggagua

SEQ ID NO: 403668 - RNA, 19 nt, Homo sapiens
aauacaagcuccugauaac

SEQ ID NO: 403669 - RNA, 19 nt, Homo sapiens
aagacuggcaggagauuua

SEQ ID NO: 403670 - RNA, 19 nt, Homo sapiens
ggaguaacuggauauuuca

SEQ ID NO: 403671 - RNA, 19 nt, Homo sapiens
gaggaguaacuggauauuu

SEQ ID NO: 403672 - RNA, 19 nt, Homo sapiens
gaccucuaccauuacauua

SEQ ID NO: 403673 - RNA, 19 nt, Homo sapiens
gcaggacccuaugaaugug

SEQ ID NO: 403674 - RNA, 19 nt, Homo sapiens
cugauaccuucaugaaauu

SEQ ID NO: 403675 - RNA, 19 nt, Homo sapiens
uugagcaauugguaaagua

SEQ ID NO: 403676 - RNA, 19 nt, Homo sapiens
ggacaauuaaugggaaguu

SEQ ID NO: 403677 - RNA, 19 nt, Homo sapiens
uauuucaccuucaccuuau

SEQ ID NO: 403678 - RNA, 19 nt, Homo sapiens
gaagacuggcaggagauuu

SEQ ID NO: 403679 - RNA, 19 nt, Homo sapiens
caauuaaugggaaguuuca

SEQ ID NO: 403680 - RNA, 19 nt, Homo sapiens
acaagcuccugauaacuuc

SEQ ID NO: 403681 - RNA, 19 nt, Homo sapiens
acaguauucuuggacaauu

SEQ ID NO: 403682 - RNA, 19 nt, Homo sapiens
ccucuaccauuacauuaca

SEQ ID NO: 403683 - RNA, 19 nt, Homo sapiens
ggcuacaucugguacaaag

SEQ ID NO: 403684 - RNA, 19 nt, Homo sapiens
uacaagcuccugauaacuu

SEQ ID NO: 403685 - RNA, 19 nt, Homo sapiens
gaacaggcugauaccuuca

SEQ ID NO: 403686 - RNA, 19 nt, Homo sapiens
ggaagacuggcaggagauu

SEQ ID NO: 403687 - RNA, 19 nt, Homo sapiens
auauuucaccuucaccuua

SEQ ID NO: 403688 - RNA, 19 nt, Homo sapiens
gcaggauccuacaccuuac

SEQ ID NO: 403689 - RNA, 19 nt, Homo sapiens
caucccugcugauccagaa

SEQ ID NO: 403690 - RNA, 19 nt, Homo sapiens
caucuccagcagcaacuua

SEQ ID NO: 403691 - RNA, 19 nt, Homo sapiens
cagccgugcucaggaaguu

SEQ ID NO: 403692 - RNA, 19 nt, Homo sapiens
gauauuucaccuucaccuu

SEQ ID NO: 403693 - RNA, 19 nt, Homo sapiens
gauccuacaccuuacacau

SEQ ID NO: 403694 - RNA, 19 nt, Homo sapiens
ugcaggacccuaugaaugu

SEQ ID NO: 403695 - RNA, 19 nt, Homo sapiens
gaugggacuagaggaguaa

SEQ ID NO: 403696 - RNA, 19 nt, Homo sapiens
uaaagcuauuugcacaagu

SEQ ID NO: 403697 - RNA, 19 nt, Homo sapiens
auaaagcuauuugcacaag

SEQ ID NO: 403698 - RNA, 19 nt, Homo sapiens
aggacccucuuucuauuug

SEQ ID NO: 403699 - RNA, 19 nt, Homo sapiens
gcucaggaaguuucuggau

SEQ ID NO: 403700 - RNA, 19 nt, Homo sapiens
ccagaauugggaaucuauu

SEQ ID NO: 403701 - RNA, 19 nt, Homo sapiens
uaacuggauauuucaccuu

SEQ ID NO: 403702 - RNA, 19 nt, Homo sapiens
guccagaccuccccagaau

SEQ ID NO: 403703 - RNA, 19 nt, Homo sapiens
ggacccucuuucuauuugg

SEQ ID NO: 403704 - RNA, 19 nt, Homo sapiens
uagaggaguaacuggauau

SEQ ID NO: 403705 - RNA, 19 nt, Homo sapiens
ugaaggaccucuaccauua

SEQ ID NO: 403706 - RNA, 19 nt, Homo sapiens
gaauacaaguuccugauaa

SEQ ID NO: 403707 - RNA, 19 nt, Homo sapiens
cguaguagauggucaaaua

SEQ ID NO: 403708 - RNA, 19 nt, Homo sapiens
gcagacaguugcuuucauu

SEQ ID NO: 403709 - RNA, 19 nt, Homo sapiens
ggucagagccucccuauga

SEQ ID NO: 403710 - RNA, 19 nt, Homo sapiens
aaaguuaucugcacaaguu

SEQ ID NO: 403711 - RNA, 19 nt, Homo sapiens
gggaaacuauucaggagua

SEQ ID NO: 403712 - RNA, 19 nt, Homo sapiens
gcugauacuucaugaaauu

SEQ ID NO: 403713 - RNA, 19 nt, Homo sapiens
gaucauaccacuggacuaa

SEQ ID NO: 403714 - RNA, 19 nt, Homo sapiens
gaacuacaccuacauuugg

SEQ ID NO: 403715 - RNA, 19 nt, Homo sapiens
ccacuggacuaagaacuuu

SEQ ID NO: 403716 - RNA, 19 nt, Homo sapiens
gaaacaggacccuaucaau

SEQ ID NO: 403717 - RNA, 19 nt, Homo sapiens
gacaguugcuuucauucuu

SEQ ID NO: 403718 - RNA, 19 nt, Homo sapiens
gacaauuaaugggaaguuu

SEQ ID NO: 403719 - RNA, 19 nt, Homo sapiens
aaacaggacccuaucaaug

SEQ ID NO: 403720 - RNA, 19 nt, Homo sapiens
gaggagaaacuggacauuu

SEQ ID NO: 403721 - RNA, 19 nt, Homo sapiens
uagcagccgugaugucauu

SEQ ID NO: 403722 - RNA, 19 nt, Homo sapiens
guacaaagggcaaaugaag

SEQ ID NO: 403723 - RNA, 19 nt, Homo sapiens
ggacaucuuccuggccuua

SEQ ID NO: 403724 - RNA, 19 nt, Homo sapiens
ggaccucuaccauuacauu

SEQ ID NO: 403725 - RNA, 19 nt, Homo sapiens
ucauaccacuggacuaaga

SEQ ID NO: 403726 - RNA, 19 nt, Homo sapiens
ucaggaguauucauauguu

SEQ ID NO: 403727 - RNA, 19 nt, Homo sapiens
gcucacagcaucacuuuua

SEQ ID NO: 403728 - RNA, 19 nt, Homo sapiens
ggacuaagaacuuucaaaa

SEQ ID NO: 403729 - RNA, 19 nt, Homo sapiens
ugaauacaaguuccugaua

SEQ ID NO: 403730 - RNA, 19 nt, Homo sapiens
caggaguauucauauguuu

SEQ ID NO: 403731 - RNA, 19 nt, Homo sapiens
cgcaggauccuacaccuua

SEQ ID NO: 403732 - RNA, 19 nt, Homo sapiens
guaguagauggucaaauaa

SEQ ID NO: 403733 - RNA, 19 nt, Homo sapiens
cauuacaucauacguagua

SEQ ID NO: 403734 - RNA, 19 nt, Homo sapiens
ggaaacuauucaggaguau

SEQ ID NO: 403735 - RNA, 19 nt, Homo sapiens
gaaaagacucugacaagga

SEQ ID NO: 403736 - RNA, 19 nt, Homo sapiens
acucacagcuugcaguugu

SEQ ID NO: 403737 - RNA, 19 nt, Homo sapiens
cagcaucacuuuuaaacuu

SEQ ID NO: 403738 - RNA, 19 nt, Homo sapiens
gccgugaugucauuucugu

SEQ ID NO: 403739 - RNA, 19 nt, Homo sapiens
uaacccaccagcagaauau

SEQ ID NO: 403740 - RNA, 19 nt, Homo sapiens
gcaaaugaaggaccucuac

SEQ ID NO: 403741 - RNA, 19 nt, Homo sapiens
gaaagcuccaaauccauga

SEQ ID NO: 403742 - RNA, 19 nt, Homo sapiens
gaaaacaggauccucauuc

SEQ ID NO: 403743 - RNA, 19 nt, Homo sapiens
cauuucaccuucaccuuau

SEQ ID NO: 403744 - RNA, 19 nt, Homo sapiens
acauuucaccuucaccuua

SEQ ID NO: 403745 - RNA, 19 nt, Homo sapiens
gaccucuaccauuacauua

SEQ ID NO: 403746 - RNA, 19 nt, Homo sapiens
aaacaggauccucauucua

SEQ ID NO: 403747 - RNA, 19 nt, Homo sapiens
caagcuaccugugguggau

SEQ ID NO: 403748 - RNA, 19 nt, Homo sapiens
gaugucauuucuguauuuc

SEQ ID NO: 403749 - RNA, 19 nt, Homo sapiens
gugaugucauuucuguauu

SEQ ID NO: 403750 - RNA, 19 nt, Homo sapiens
cauuauagcagccgugaug

SEQ ID NO: 403751 - RNA, 19 nt, Homo sapiens
aaacuauucaggaguauuc

SEQ ID NO: 403752 - RNA, 19 nt, Homo sapiens
ggacaauuaaugggaaguu

SEQ ID NO: 403753 - RNA, 19 nt, Homo sapiens
acaaagggcaaaugaagga

SEQ ID NO: 403754 - RNA, 19 nt, Homo sapiens
caauuaaugggaaguuuca

SEQ ID NO: 403755 - RNA, 19 nt, Homo sapiens
agaacuacaccuacauuug

SEQ ID NO: 403756 - RNA, 19 nt, Homo sapiens
gaaacuauucaggaguauu

SEQ ID NO: 403757 - RNA, 19 nt, Homo sapiens
ccucuaccauuacauuaca

SEQ ID NO: 403758 - RNA, 19 nt, Homo sapiens
cuauucaggaguauucaua

SEQ ID NO: 403759 - RNA, 19 nt, Homo sapiens
ggcuacaucugguacaaag

SEQ ID NO: 403760 - RNA, 19 nt, Homo sapiens
ugaaacaggacccuaucaa

SEQ ID NO: 403761 - RNA, 19 nt, Homo sapiens
cucaaaguauuuaccauca

SEQ ID NO: 403762 - RNA, 19 nt, Homo sapiens
aaacuggacauuucaccuu

SEQ ID NO: 403763 - RNA, 19 nt, Homo sapiens
ugaugggacuagaggagaa

SEQ ID NO: 403764 - RNA, 19 nt, Homo sapiens
cagcuacaguccaaaauug

SEQ ID NO: 403765 - RNA, 19 nt, Homo sapiens
acaguugcuuucauucuuc

SEQ ID NO: 403766 - RNA, 19 nt, Homo sapiens
gaaggaccucuaccauuac

SEQ ID NO: 403767 - RNA, 19 nt, Homo sapiens
gcaggauccuacaccuuac

SEQ ID NO: 403768 - RNA, 19 nt, Homo sapiens
caucccugcugauccagaa

SEQ ID NO: 403769 - RNA, 19 nt, Homo sapiens
aacaggacccuaucaaugu

SEQ ID NO: 403770 - RNA, 19 nt, Homo sapiens
caucuccagcagcaacuua

SEQ ID NO: 403771 - RNA, 19 nt, Homo sapiens
cgugaugucauuucuguau

SEQ ID NO: 403772 - RNA, 19 nt, Homo sapiens
aggcugauacuucaugaaa

SEQ ID NO: 403773 - RNA, 19 nt, Homo sapiens
gguacaaagggcaaaugaa

SEQ ID NO: 403774 - RNA, 19 nt, Homo sapiens
acaggacccuaucaaugug

SEQ ID NO: 403775 - RNA, 19 nt, Homo sapiens
aaaugaaacaggacccuau

SEQ ID NO: 403776 - RNA, 19 nt, Homo sapiens
gauccuacaccuuacacau

SEQ ID NO: 403777 - RNA, 19 nt, Homo sapiens
ggcugauacuucaugaaau

SEQ ID NO: 403778 - RNA, 19 nt, Homo sapiens
gaacaggcugauacuucau

SEQ ID NO: 403779 - RNA, 19 nt, Homo sapiens
guauuuaccaucagcuaca

SEQ ID NO: 403780 - RNA, 19 nt, Homo sapiens
uaccugugguggaugaaug

SEQ ID NO: 403781 - RNA, 19 nt, Homo sapiens
cauucuuccucaaaguauu

SEQ ID NO: 403782 - RNA, 19 nt, Homo sapiens
ggcagacaguugcuuucau

SEQ ID NO: 403783 - RNA, 19 nt, Homo sapiens
uauagcagccgugauguca

SEQ ID NO: 403784 - RNA, 19 nt, Homo sapiens
gccgagccaaccaaaguuu

SEQ ID NO: 403785 - RNA, 19 nt, Homo sapiens
aggacccucuuucuauuug

SEQ ID NO: 403786 - RNA, 19 nt, Homo sapiens
aauacaaguuccugauaac

SEQ ID NO: 403787 - RNA, 19 nt, Homo sapiens
uuccuggccuuaauccauu

SEQ ID NO: 403788 - RNA, 19 nt, Homo sapiens
ucaggaacaggacaucuuc

SEQ ID NO: 403789 - RNA, 19 nt, Homo sapiens
cuaacccaccagcagaaua

SEQ ID NO: 403790 - RNA, 19 nt, Homo sapiens
ccagaccuccccagaauuu

SEQ ID NO: 403791 - RNA, 19 nt, Homo sapiens
gcucaggaaguuucuggau

SEQ ID NO: 403792 - RNA, 19 nt, Homo sapiens
acaggcugauacuucauga

SEQ ID NO: 403793 - RNA, 19 nt, Homo sapiens
ugucauuucuguauuucag

SEQ ID NO: 403794 - RNA, 19 nt, Homo sapiens
ccagaauugggaaacuauu

SEQ ID NO: 403795 - RNA, 19 nt, Homo sapiens
caaggagauuuaugaaaag

SEQ ID NO: 403796 - RNA, 19 nt, Homo sapiens
uaaugggaaguuucagcua

SEQ ID NO: 403797 - RNA, 19 nt, Homo sapiens
ugacucacagcuugcaguu

SEQ ID NO: 403798 - RNA, 19 nt, Homo sapiens
cugcccaagucacgauuga

SEQ ID NO: 403799 - RNA, 19 nt, Homo sapiens
ucaaaguauuuaccaucag

SEQ ID NO: 403800 - RNA, 19 nt, Homo sapiens
guccagaccuccccagaau

SEQ ID NO: 403801 - RNA, 19 nt, Homo sapiens
gcccaagucacgauugaag

SEQ ID NO: 403802 - RNA, 19 nt, Homo sapiens
auucaggaguauucauaug

SEQ ID NO: 403803 - RNA, 19 nt, Homo sapiens
gcuuucauucuuccucaaa

SEQ ID NO: 403804 - RNA, 19 nt, Homo sapiens
cagccgugaugucauuucu

SEQ ID NO: 403805 - RNA, 19 nt, Homo sapiens
gcacacaccucaucacuug

SEQ ID NO: 403806 - RNA, 19 nt, Homo sapiens
gaagaugguuucuauaaag

SEQ ID NO: 403807 - RNA, 19 nt, Homo sapiens
caacaggacccucuuuaua

SEQ ID NO: 403808 - RNA, 19 nt, Homo sapiens
ggucagagccucccuauga

SEQ ID NO: 403809 - RNA, 19 nt, Homo sapiens
gaaagaguauauuccaaug

SEQ ID NO: 403810 - RNA, 19 nt, Homo sapiens
gauauuacccugaauucua

SEQ ID NO: 403811 - RNA, 19 nt, Homo sapiens
caauagaaaugaacacaga

SEQ ID NO: 403812 - RNA, 19 nt, Homo sapiens
gaaaugaacacagagauau

SEQ ID NO: 403813 - RNA, 19 nt, Homo sapiens
cauggaggcugugaucuua

SEQ ID NO: 403814 - RNA, 19 nt, Homo sapiens
gaaucuugcuggcuacauu

SEQ ID NO: 403815 - RNA, 19 nt, Homo sapiens
gaagagaaagaguauauuc

SEQ ID NO: 403816 - RNA, 19 nt, Homo sapiens
gagaaagaguauauuccaa

SEQ ID NO: 403817 - RNA, 19 nt, Homo sapiens
auacagggcucccaauaga

SEQ ID NO: 403818 - RNA, 19 nt, Homo sapiens
gcucaugccugccucuuuc

SEQ ID NO: 403819 - RNA, 19 nt, Homo sapiens
gcacaauauucuuggacaa

SEQ ID NO: 403820 - RNA, 19 nt, Homo sapiens
gaaauacggaacccaguga

SEQ ID NO: 403821 - RNA, 19 nt, Homo sapiens
gcauacagggcucccaaua

SEQ ID NO: 403822 - RNA, 19 nt, Homo sapiens
caucucaaccucaaacuuu

SEQ ID NO: 403823 - RNA, 19 nt, Homo sapiens
caacagagugucagauaug

SEQ ID NO: 403824 - RNA, 19 nt, Homo sapiens
ggacaacucgauguaaauu

SEQ ID NO: 403825 - RNA, 19 nt, Homo sapiens
acaggacccucuuuauauu

SEQ ID NO: 403826 - RNA, 19 nt, Homo sapiens
guagacggucaaagaauua

SEQ ID NO: 403827 - RNA, 19 nt, Homo sapiens
guggacaacucgauguaaa

SEQ ID NO: 403828 - RNA, 19 nt, Homo sapiens
acaaagggcaaaugacaua

SEQ ID NO: 403829 - RNA, 19 nt, Homo sapiens
gacaauuaaugggaaguuu

SEQ ID NO: 403830 - RNA, 19 nt, Homo sapiens
guacaaagggcaaaugaca

SEQ ID NO: 403831 - RNA, 19 nt, Homo sapiens
ccaaauccaucacagucaa

SEQ ID NO: 403832 - RNA, 19 nt, Homo sapiens
gcucuaugcuugcucuguu

SEQ ID NO: 403833 - RNA, 19 nt, Homo sapiens
cgaugggacuggaggagua

SEQ ID NO: 403834 - RNA, 19 nt, Homo sapiens
ccaaagaugucagaacaag

SEQ ID NO: 403835 - RNA, 19 nt, Homo sapiens
guugaugacuucacacugu

SEQ ID NO: 403836 - RNA, 19 nt, Homo sapiens
gcaaggaaagcuccaaauc

SEQ ID NO: 403837 - RNA, 19 nt, Homo sapiens
gagcaagacccacucuguu

SEQ ID NO: 403838 - RNA, 19 nt, Homo sapiens
gaacaagacuccccaucau

SEQ ID NO: 403839 - RNA, 19 nt, Homo sapiens
acaacucgauguaaauuuc

SEQ ID NO: 403840 - RNA, 19 nt, Homo sapiens
ccuuguaccugacauguga

SEQ ID NO: 403841 - RNA, 19 nt, Homo sapiens
gagaaaaccucuacuuguc

SEQ ID NO: 403842 - RNA, 19 nt, Homo sapiens
gcucacagcaucacuuuua

SEQ ID NO: 403843 - RNA, 19 nt, Homo sapiens
agaaaugaacacagagaua

SEQ ID NO: 403844 - RNA, 19 nt, Homo sapiens
aggaguaacuggacauuuc

SEQ ID NO: 403845 - RNA, 19 nt, Homo sapiens
caccauuuccuaagagaua

SEQ ID NO: 403846 - RNA, 19 nt, Homo sapiens
gcccacaacugcccaaguc

SEQ ID NO: 403847 - RNA, 19 nt, Homo sapiens
aguagacggucaaagaauu

SEQ ID NO: 403848 - RNA, 19 nt, Homo sapiens
guaguagacggucaaagaa

SEQ ID NO: 403849 - RNA, 19 nt, Homo sapiens
aaggaaagcuccaaaucca

SEQ ID NO: 403850 - RNA, 19 nt, Homo sapiens
cagcaucacuuuuaaacuu

SEQ ID NO: 403851 - RNA, 19 nt, Homo sapiens
ucuacuaguuccuccaauu

SEQ ID NO: 403852 - RNA, 19 nt, Homo sapiens
ggaagagaaagaguauauu

SEQ ID NO: 403853 - RNA, 19 nt, Homo sapiens
acaacagagugucagauau

SEQ ID NO: 403854 - RNA, 19 nt, Homo sapiens
acccuucauucaccuauua

SEQ ID NO: 403855 - RNA, 19 nt, Homo sapiens
gaguaggaaagcugaaauu

SEQ ID NO: 403856 - RNA, 19 nt, Homo sapiens
gaugguuucuauaaagagu

SEQ ID NO: 403857 - RNA, 19 nt, Homo sapiens
agauauugccuguguguuu

SEQ ID NO: 403858 - RNA, 19 nt, Homo sapiens
acauuucaccuucaccuua

SEQ ID NO: 403859 - RNA, 19 nt, Homo sapiens
ugcaggauccuacaccuua

SEQ ID NO: 403860 - RNA, 19 nt, Homo sapiens
uguaguagacggucaaaga

SEQ ID NO: 403861 - RNA, 19 nt, Homo sapiens
gaaauguggcucucuccau

SEQ ID NO: 403862 - RNA, 19 nt, Homo sapiens
gacuggauauuacccugaa

SEQ ID NO: 403863 - RNA, 19 nt, Homo sapiens
aacaggacccucuuuauau

SEQ ID NO: 403864 - RNA, 19 nt, Homo sapiens
gcccagccacccaaaguuu

SEQ ID NO: 403865 - RNA, 19 nt, Homo sapiens
uaacuggacauuucaccuu

SEQ ID NO: 403866 - RNA, 19 nt, Homo sapiens
ccacucagaacucaccaaa

SEQ ID NO: 403867 - RNA, 19 nt, Homo sapiens
aaugggaaguuucagcuau

SEQ ID NO: 403868 - RNA, 19 nt, Homo sapiens
ccaacaggacccucuuuau

SEQ ID NO: 403869 - RNA, 19 nt, Homo sapiens
ggaguaacuggacauuuca

SEQ ID NO: 403870 - RNA, 19 nt, Homo sapiens
uggaagagaaagaguauau

SEQ ID NO: 403871 - RNA, 19 nt, Homo sapiens
gacaacucgauguaaauuu

SEQ ID NO: 403872 - RNA, 19 nt, Homo sapiens
ggacaauuaaugggaaguu

SEQ ID NO: 403873 - RNA, 19 nt, Homo sapiens
aagaguauauuccaaugca

SEQ ID NO: 403874 - RNA, 19 nt, Homo sapiens
aacaacagagugucagaua

SEQ ID NO: 403875 - RNA, 19 nt, Homo sapiens
caauuaaugggaaguuuca

SEQ ID NO: 403876 - RNA, 19 nt, Homo sapiens
ggagaaaaccucuacuugu

SEQ ID NO: 403877 - RNA, 19 nt, Homo sapiens
uaugucaucucaaccucaa

SEQ ID NO: 403878 - RNA, 19 nt, Homo sapiens
uuccaaagaugucagaaca

SEQ ID NO: 403879 - RNA, 19 nt, Homo sapiens
uaacaacagcuacucaaac

SEQ ID NO: 403880 - RNA, 19 nt, Homo sapiens
acagggcucccaauagaaa

SEQ ID NO: 403881 - RNA, 19 nt, Homo sapiens
aaacuguaaaccaggauaa

SEQ ID NO: 403882 - RNA, 19 nt, Homo sapiens
aacaacagcuacucaaacu

SEQ ID NO: 403883 - RNA, 19 nt, Homo sapiens
ggaaucacgaagagcaaga

SEQ ID NO: 403884 - RNA, 19 nt, Homo sapiens
aguaggaaagcugaaauua

SEQ ID NO: 403885 - RNA, 19 nt, Homo sapiens
gaggguaacaacagagugu

SEQ ID NO: 403886 - RNA, 19 nt, Homo sapiens
ccucuuaacuguccuugcu

SEQ ID NO: 403887 - RNA, 19 nt, Homo sapiens
caaacuguaaaccaggaua

SEQ ID NO: 403888 - RNA, 19 nt, Homo sapiens
gacggucaaagaauuauau

SEQ ID NO: 403889 - RNA, 19 nt, Homo sapiens
gucauuagaauuucacaug

SEQ ID NO: 403890 - RNA, 19 nt, Homo sapiens
acucagaacucaccaaaau

SEQ ID NO: 403891 - RNA, 19 nt, Homo sapiens
gaaagcuccaaauccauca

SEQ ID NO: 403892 - RNA, 19 nt, Homo sapiens
gaggaguaacuggacauuu

SEQ ID NO: 403893 - RNA, 19 nt, Homo sapiens
gcaggauccuacaccuuac

SEQ ID NO: 403894 - RNA, 19 nt, Homo sapiens
caucccugcugauccagaa

SEQ ID NO: 403895 - RNA, 19 nt, Homo sapiens
cagagugucagauauguca

SEQ ID NO: 403896 - RNA, 19 nt, Homo sapiens
ucacuuggcaggauaaugc

SEQ ID NO: 403897 - RNA, 19 nt, Homo sapiens
caaaauguucgacaccaua

SEQ ID NO: 403898 - RNA, 19 nt, Homo sapiens
cuauuaccguucaggagaa

SEQ ID NO: 403899 - RNA, 19 nt, Homo sapiens
caucuccagcagcaacuua

SEQ ID NO: 403900 - RNA, 19 nt, Homo sapiens
caaagaugucagaacaaga

SEQ ID NO: 403901 - RNA, 19 nt, Homo sapiens
cauaacaacagcuacucaa

SEQ ID NO: 403902 - RNA, 19 nt, Homo sapiens
caaauccaucacagucaaa

SEQ ID NO: 403903 - RNA, 19 nt, Homo sapiens
uaugcuugcucuguucgua

SEQ ID NO: 403904 - RNA, 19 nt, Homo sapiens
uaacccacgggcacaauau

SEQ ID NO: 403905 - RNA, 19 nt, Homo sapiens
gaauacaaguuccugauaa

SEQ ID NO: 403906 - RNA, 19 nt, Homo sapiens
gcagacaguugcuuugauu

SEQ ID NO: 403907 - RNA, 19 nt, Homo sapiens
aaaguuaucugcacaaguu

SEQ ID NO: 403908 - RNA, 19 nt, Homo sapiens
gggaaacuauucaugagua

SEQ ID NO: 403909 - RNA, 19 nt, Homo sapiens
ucaaggagauuuauggaaa

SEQ ID NO: 403910 - RNA, 19 nt, Homo sapiens
gcugauaccuucaugaaau

SEQ ID NO: 403911 - RNA, 19 nt, Homo sapiens
gaucauaccacuggacuaa

SEQ ID NO: 403912 - RNA, 19 nt, Homo sapiens
gaacuacaccuacauuugg

SEQ ID NO: 403913 - RNA, 19 nt, Homo sapiens
guaguagacggucaaauaa

SEQ ID NO: 403914 - RNA, 19 nt, Homo sapiens
guacaaaggacaacugaug

SEQ ID NO: 403915 - RNA, 19 nt, Homo sapiens
ggaaacuauucaugaguau

SEQ ID NO: 403916 - RNA, 19 nt, Homo sapiens
uguaguagacggucaaaua

SEQ ID NO: 403917 - RNA, 19 nt, Homo sapiens
ccacuggacuaagaacuuu

SEQ ID NO: 403918 - RNA, 19 nt, Homo sapiens
gaaacaggacccuaugaau

SEQ ID NO: 403919 - RNA, 19 nt, Homo sapiens
ggaagacgcaggauccuau

SEQ ID NO: 403920 - RNA, 19 nt, Homo sapiens
gacaauuaaugggaaguuu

SEQ ID NO: 403921 - RNA, 19 nt, Homo sapiens
aaacaggacccuaugaaug

SEQ ID NO: 403922 - RNA, 19 nt, Homo sapiens
ugauaggacuagaggagua

SEQ ID NO: 403923 - RNA, 19 nt, Homo sapiens
guagacggucaaauaaaua

SEQ ID NO: 403924 - RNA, 19 nt, Homo sapiens
gaagacgcaggauccuaua

SEQ ID NO: 403925 - RNA, 19 nt, Homo sapiens
aggaguaacuggauauuuc

SEQ ID NO: 403926 - RNA, 19 nt, Homo sapiens
ggaccucuaccauuacauu

SEQ ID NO: 403927 - RNA, 19 nt, Homo sapiens
ucauaccacuggacuaaga

SEQ ID NO: 403928 - RNA, 19 nt, Homo sapiens
gcucacagcaucacuuuua

SEQ ID NO: 403929 - RNA, 19 nt, Homo sapiens
cuagaggaguaacuggaua

SEQ ID NO: 403930 - RNA, 19 nt, Homo sapiens
cuacagccgugcucaggaa

SEQ ID NO: 403931 - RNA, 19 nt, Homo sapiens
ggacuaagaacuuucaaaa

SEQ ID NO: 403932 - RNA, 19 nt, Homo sapiens
ugaauacaaguuccugaua

SEQ ID NO: 403933 - RNA, 19 nt, Homo sapiens
cgcaggauccuauaccuua

SEQ ID NO: 403934 - RNA, 19 nt, Homo sapiens
aguagacggucaaauaaau

SEQ ID NO: 403935 - RNA, 19 nt, Homo sapiens
gaaaagacucugacaagga

SEQ ID NO: 403936 - RNA, 19 nt, Homo sapiens
gacaguugcuuugauucuu

SEQ ID NO: 403937 - RNA, 19 nt, Homo sapiens
cagcaucacuuuuaaacuu

SEQ ID NO: 403938 - RNA, 19 nt, Homo sapiens
gacaacugauggaccucua

SEQ ID NO: 403939 - RNA, 19 nt, Homo sapiens
acaaucaccuacaguccaa

SEQ ID NO: 403940 - RNA, 19 nt, Homo sapiens
ugaaacaggacccuaugaa

SEQ ID NO: 403941 - RNA, 19 nt, Homo sapiens
gaaaacaggauccucauuc

SEQ ID NO: 403942 - RNA, 19 nt, Homo sapiens
ggaguaacuggauauuuca

SEQ ID NO: 403943 - RNA, 19 nt, Homo sapiens
gaggaguaacuggauauuu

SEQ ID NO: 403944 - RNA, 19 nt, Homo sapiens
gaccucuaccauuacauua

SEQ ID NO: 403945 - RNA, 19 nt, Homo sapiens
caauuugccucagaaucuu

SEQ ID NO: 403946 - RNA, 19 nt, Homo sapiens
aaacaggauccucauucua

SEQ ID NO: 403947 - RNA, 19 nt, Homo sapiens
cugauaccuucaugaaauu

SEQ ID NO: 403948 - RNA, 19 nt, Homo sapiens
gauauuucaccuucaacuu

SEQ ID NO: 403949 - RNA, 19 nt, Homo sapiens
ggacaauuaaugggaaguu

SEQ ID NO: 403950 - RNA, 19 nt, Homo sapiens
gauaggacuagaggaguaa

SEQ ID NO: 403951 - RNA, 19 nt, Homo sapiens
uccuauaccuuacacauca

SEQ ID NO: 403952 - RNA, 19 nt, Homo sapiens
caauuaaugggaaguuuca

SEQ ID NO: 403953 - RNA, 19 nt, Homo sapiens
agaacuacaccuacauuug

SEQ ID NO: 403954 - RNA, 19 nt, Homo sapiens
ccagggagaauaaggaugu

SEQ ID NO: 403955 - RNA, 19 nt, Homo sapiens
gcaggauccuauaccuuac

SEQ ID NO: 403956 - RNA, 19 nt, Homo sapiens
ccucuaccauuacauuaca

SEQ ID NO: 403957 - RNA, 19 nt, Homo sapiens
gccuaucacugcucaaguc

SEQ ID NO: 403958 - RNA, 19 nt, Homo sapiens
ggcuacaucugguacaaag

SEQ ID NO: 403959 - RNA, 19 nt, Homo sapiens
gaacaggcugauaccuuca

SEQ ID NO: 403960 - RNA, 19 nt, Homo sapiens
caaggagauuuauggaaaa

SEQ ID NO: 403961 - RNA, 19 nt, Homo sapiens
acaauuugccucagaaucu

SEQ ID NO: 403962 - RNA, 19 nt, Homo sapiens
acaguugcuuugauucuuc

SEQ ID NO: 403963 - RNA, 19 nt, Homo sapiens
ggcagacaguugcuuugau

SEQ ID NO: 403964 - RNA, 19 nt, Homo sapiens
guccacaauuugccucaga

SEQ ID NO: 403965 - RNA, 19 nt, Homo sapiens
caucccugcugauccagaa

SEQ ID NO: 403966 - RNA, 19 nt, Homo sapiens
gcccugccacccaaaguuu

SEQ ID NO: 403967 - RNA, 19 nt, Homo sapiens
aaugggaaguuucagcaau

SEQ ID NO: 403968 - RNA, 19 nt, Homo sapiens
uaacccaccggcagaguau

SEQ ID NO: 403969 - RNA, 19 nt, Homo sapiens
aacaggacccuaugaaugu

SEQ ID NO: 403970 - RNA, 19 nt, Homo sapiens
gauccuauaccuuacacau

SEQ ID NO: 403971 - RNA, 19 nt, Homo sapiens
cagccgugcucaggaaguu

SEQ ID NO: 403972 - RNA, 19 nt, Homo sapiens
cuacaucugguacaaagga

SEQ ID NO: 403973 - RNA, 19 nt, Homo sapiens
aaaugaaacaggacccuau

SEQ ID NO: 403974 - RNA, 19 nt, Homo sapiens
caaaacccagggagaauaa

SEQ ID NO: 403975 - RNA, 19 nt, Homo sapiens
uuucagcaaucaggacaaa

SEQ ID NO: 403976 - RNA, 19 nt, Homo sapiens
cuggauauuucaccuucaa

SEQ ID NO: 403977 - RNA, 19 nt, Homo sapiens
uaguagacggucaaauaaa

SEQ ID NO: 403978 - RNA, 19 nt, Homo sapiens
gggaagacgcaggauccua

SEQ ID NO: 403979 - RNA, 19 nt, Homo sapiens
aauacaaguuccugauaac

SEQ ID NO: 403980 - RNA, 19 nt, Homo sapiens
ucaaacuacuuacaaucac

SEQ ID NO: 403981 - RNA, 19 nt, Homo sapiens
gcucaggaaguuucuggau

SEQ ID NO: 403982 - RNA, 19 nt, Homo sapiens
gggagaauaaggaugucuu

SEQ ID NO: 403983 - RNA, 19 nt, Homo sapiens
ccagaauugggaaacuauu

SEQ ID NO: 403984 - RNA, 19 nt, Homo sapiens
caccuacaguccaaaauug

SEQ ID NO: 403985 - RNA, 19 nt, Homo sapiens
cuaacccaccggcagagua

SEQ ID NO: 403986 - RNA, 19 nt, Homo sapiens
uaacuggauauuucaccuu

SEQ ID NO: 403987 - RNA, 19 nt, Homo sapiens
ggacaaaagcucucuaucc

SEQ ID NO: 403988 - RNA, 19 nt, Homo sapiens
ggauguucuucuacuuguc

SEQ ID NO: 403989 - RNA, 19 nt, Homo sapiens
acaaaggacaacugaugga

SEQ ID NO: 403990 - RNA, 19 nt, Homo sapiens
cucaaacuacuuacaauca

SEQ ID NO: 403991 - RNA, 19 nt, Homo sapiens
aggauguucuucuacuugu

SEQ ID NO: 403992 - RNA, 19 nt, Homo sapiens
uagaggaguaacuggauau

SEQ ID NO: 403993 - RNA, 19 nt, Homo sapiens
ugacggaccucuaccauua

SEQ ID NO: 403994 - RNA, 19 nt, Homo sapiens
gaguauucuuggacaauua

SEQ ID NO: 403995 - RNA, 19 nt, Homo sapiens
gaaacaguauauuccaaug

SEQ ID NO: 403996 - RNA, 19 nt, Homo sapiens
caacaggacccucuaucua

SEQ ID NO: 403997 - RNA, 19 nt, Homo sapiens
gaacuacaccuacauuugg

SEQ ID NO: 403998 - RNA, 19 nt, Homo sapiens
gagaaacaguauauuccaa

SEQ ID NO: 403999 - RNA, 19 nt, Homo sapiens
ggaacuacaccuacauuug

SEQ ID NO: 404000 - RNA, 19 nt, Homo sapiens
ccaaagugcuaggauuaaa

SEQ ID NO: 404001 - RNA, 19 nt, Homo sapiens
gcugugaccucccaaagug

SEQ ID NO: 404002 - RNA, 19 nt, Homo sapiens
gcccaccacugcccaagua

SEQ ID NO: 404003 - RNA, 19 nt, Homo sapiens
gaaacaggacccuaucaau

SEQ ID NO: 404004 - RNA, 19 nt, Homo sapiens
ccaaauccaugauagucaa

SEQ ID NO: 404005 - RNA, 19 nt, Homo sapiens
gacaauuaaugggaaguuu

SEQ ID NO: 404006 - RNA, 19 nt, Homo sapiens
aaacaggacccuaucaaug

SEQ ID NO: 404007 - RNA, 19 nt, Homo sapiens
cgaugggacuggaggagua

SEQ ID NO: 404008 - RNA, 19 nt, Homo sapiens
auauuucacugucaccuua

SEQ ID NO: 404009 - RNA, 19 nt, Homo sapiens
aggaguaacuggauauuuc

SEQ ID NO: 404010 - RNA, 19 nt, Homo sapiens
ggaccucuaccauuacauu

SEQ ID NO: 404011 - RNA, 19 nt, Homo sapiens
gcaaaugacggaccucuac

SEQ ID NO: 404012 - RNA, 19 nt, Homo sapiens
gcucacagcaucacuuuua

SEQ ID NO: 404013 - RNA, 19 nt, Homo sapiens
acaggacccucuaucuauu

SEQ ID NO: 404014 - RNA, 19 nt, Homo sapiens
gcagaguauucuuggacaa

SEQ ID NO: 404015 - RNA, 19 nt, Homo sapiens
gaaaacaggauacucauuc

SEQ ID NO: 404016 - RNA, 19 nt, Homo sapiens
gacgagaaacaguauauuc

SEQ ID NO: 404017 - RNA, 19 nt, Homo sapiens
cagcaucacuuuuaaacuu

SEQ ID NO: 404018 - RNA, 19 nt, Homo sapiens
ggaguaacuggauauuuca

SEQ ID NO: 404019 - RNA, 19 nt, Homo sapiens
gaggaguaacuggauauuu

SEQ ID NO: 404020 - RNA, 19 nt, Homo sapiens
ugcaggauccuacaccuua

SEQ ID NO: 404021 - RNA, 19 nt, Homo sapiens
gaccucuaccauuacauua

SEQ ID NO: 404022 - RNA, 19 nt, Homo sapiens
ggacgagaaacaguauauu

SEQ ID NO: 404023 - RNA, 19 nt, Homo sapiens
ucccaaagugcuaggauua

SEQ ID NO: 404024 - RNA, 19 nt, Homo sapiens
ggacaauuaaugggaaguu

SEQ ID NO: 404025 - RNA, 19 nt, Homo sapiens
caauuaaugggaaguuuca

SEQ ID NO: 404026 - RNA, 19 nt, Homo sapiens
agaguauucuuggacaauu

SEQ ID NO: 404027 - RNA, 19 nt, Homo sapiens
ccucuaccauuacauuaca

SEQ ID NO: 404028 - RNA, 19 nt, Homo sapiens
ugaaacaggacccuaucaa

SEQ ID NO: 404029 - RNA, 19 nt, Homo sapiens
aaacaggauacucauucua

SEQ ID NO: 404030 - RNA, 19 nt, Homo sapiens
ggcuacaucugguacaaag

SEQ ID NO: 404031 - RNA, 19 nt, Homo sapiens
gaaccuaagagucggaacu

SEQ ID NO: 404032 - RNA, 19 nt, Homo sapiens
gcaggauccuacaccuuac

SEQ ID NO: 404033 - RNA, 19 nt, Homo sapiens
caucccugcugauccagaa

SEQ ID NO: 404034 - RNA, 19 nt, Homo sapiens
uaacccaccggcagaguau

SEQ ID NO: 404035 - RNA, 19 nt, Homo sapiens
aacaggacccuaucaaugu

SEQ ID NO: 404036 - RNA, 19 nt, Homo sapiens
aacaggacccucuaucuau

SEQ ID NO: 404037 - RNA, 19 nt, Homo sapiens
acaggacccuaucaaugug

SEQ ID NO: 404038 - RNA, 19 nt, Homo sapiens
aaaugaaacaggacccuau

SEQ ID NO: 404039 - RNA, 19 nt, Homo sapiens
gauauuucacugucaccuu

SEQ ID NO: 404040 - RNA, 19 nt, Homo sapiens
ggaggaguaacuggauauu

SEQ ID NO: 404041 - RNA, 19 nt, Homo sapiens
cuacaccuuacacaucaua

SEQ ID NO: 404042 - RNA, 19 nt, Homo sapiens
cuggaggaguaacuggaua

SEQ ID NO: 404043 - RNA, 19 nt, Homo sapiens
gauccuacaccuuacacau

SEQ ID NO: 404044 - RNA, 19 nt, Homo sapiens
gugcuaggauuaaaacaug

SEQ ID NO: 404045 - RNA, 19 nt, Homo sapiens
ugccuuacaucaccaucaa

SEQ ID NO: 404046 - RNA, 19 nt, Homo sapiens
ccaacaggacccucuaucu

SEQ ID NO: 404047 - RNA, 19 nt, Homo sapiens
aacaguauauuccaaugca

SEQ ID NO: 404048 - RNA, 19 nt, Homo sapiens
gacagcaucuccccagguu

SEQ ID NO: 404049 - RNA, 19 nt, Homo sapiens
uaacuggauauuucacugu

SEQ ID NO: 404050 - RNA, 19 nt, Homo sapiens
gaagccaagccacccaaag

SEQ ID NO: 404051 - RNA, 19 nt, Homo sapiens
caaauccaugauagucaaa

SEQ ID NO: 404052 - RNA, 19 nt, Homo sapiens
ccagaccuccccagaauuu

SEQ ID NO: 404053 - RNA, 19 nt, Homo sapiens
gaugggacuggaggaguaa

SEQ ID NO: 404054 - RNA, 19 nt, Homo sapiens
uccuacaccuuacacauca

SEQ ID NO: 404055 - RNA, 19 nt, Homo sapiens
ggcaaaugacggaccucua

SEQ ID NO: 404056 - RNA, 19 nt, Homo sapiens
cggaacuacaccuacauuu

SEQ ID NO: 404057 - RNA, 19 nt, Homo sapiens
acggucaaauuauauaugg

SEQ ID NO: 404058 - RNA, 19 nt, Homo sapiens
cgagaaacaguauauucca

SEQ ID NO: 404059 - RNA, 19 nt, Homo sapiens
cuaacccaccggcagagua

SEQ ID NO: 404060 - RNA, 19 nt, Homo sapiens
ccuaagagucggaacuaca

SEQ ID NO: 404061 - RNA, 19 nt, Homo sapiens
caugauagucaaagucucu

SEQ ID NO: 404062 - RNA, 19 nt, Homo sapiens
ggauguucuucuacuuguc

SEQ ID NO: 404063 - RNA, 19 nt, Homo sapiens
guccagaccuccccagaau

SEQ ID NO: 404064 - RNA, 19 nt, Homo sapiens
caguggacgagaaacagua

SEQ ID NO: 404065 - RNA, 19 nt, Homo sapiens
agucggaacuacaccuaca

SEQ ID NO: 404066 - RNA, 19 nt, Homo sapiens
aaaccaacaggacccucua

SEQ ID NO: 404067 - RNA, 19 nt, Homo sapiens
aggauguucuucuacuugu

SEQ ID NO: 404068 - RNA, 19 nt, Homo sapiens
uaccuaugcugguccaaac

SEQ ID NO: 404069 - RNA, 19 nt, Homo sapiens
uauaugggccugccuacag

SEQ ID NO: 404070 - RNA, 19 nt, Homo sapiens
cuacaguggacgagaaaca

SEQ ID NO: 404071 - RNA, 19 nt, Homo sapiens
gaaugucacacaggaggau

SEQ ID NO: 404072 - RNA, 19 nt, Homo sapiens
ucagggaccucuaccauua

SEQ ID NO: 404073 - RNA, 19 nt, Homo sapiens
gaagaugguuucuauaaag

SEQ ID NO: 404074 - RNA, 19 nt, Homo sapiens
ggucagagccucccuauga

SEQ ID NO: 404075 - RNA, 19 nt, Homo sapiens
caauagaaaugaacacaga

SEQ ID NO: 404076 - RNA, 19 nt, Homo sapiens
gaaaugaacacagagauau

SEQ ID NO: 404077 - RNA, 19 nt, Homo sapiens
gaaacaguauauuccaaug

SEQ ID NO: 404078 - RNA, 19 nt, Homo sapiens
caacaggacccucuaccua

SEQ ID NO: 404079 - RNA, 19 nt, Homo sapiens
gaacuacaccuacauuugg

SEQ ID NO: 404080 - RNA, 19 nt, Homo sapiens
gacauuacccugaauucua

SEQ ID NO: 404081 - RNA, 19 nt, Homo sapiens
gagaaacaguauauuccaa

SEQ ID NO: 404082 - RNA, 19 nt, Homo sapiens
guaguagacggucaaauaa

SEQ ID NO: 404083 - RNA, 19 nt, Homo sapiens
auacagggcucccaauaga

SEQ ID NO: 404084 - RNA, 19 nt, Homo sapiens
guagacggucaaauaauua

SEQ ID NO: 404085 - RNA, 19 nt, Homo sapiens
uguaguagacggucaaaua

SEQ ID NO: 404086 - RNA, 19 nt, Homo sapiens
ggacaacucaauguaaauu

SEQ ID NO: 404087 - RNA, 19 nt, Homo sapiens
gaaacaggacccuaucaau

SEQ ID NO: 404088 - RNA, 19 nt, Homo sapiens
cacaggauccuacacuuua

SEQ ID NO: 404089 - RNA, 19 nt, Homo sapiens
gcauacagggcucccaaua

SEQ ID NO: 404090 - RNA, 19 nt, Homo sapiens
caucucaaccucaaacuuu

SEQ ID NO: 404091 - RNA, 19 nt, Homo sapiens
caacagagugucagauaug

SEQ ID NO: 404092 - RNA, 19 nt, Homo sapiens
gacaauuaaugggaaguuu

SEQ ID NO: 404093 - RNA, 19 nt, Homo sapiens
gcacaguauucuuggacaa

SEQ ID NO: 404094 - RNA, 19 nt, Homo sapiens
cacggaggcugugaucuua

SEQ ID NO: 404095 - RNA, 19 nt, Homo sapiens
aguagacggucaaauaauu

SEQ ID NO: 404096 - RNA, 19 nt, Homo sapiens
caguauucuuggacaauua

SEQ ID NO: 404097 - RNA, 19 nt, Homo sapiens
aaacaggacccuaucaaug

SEQ ID NO: 404098 - RNA, 19 nt, Homo sapiens
guugaugacuucacacugu

SEQ ID NO: 404099 - RNA, 19 nt, Homo sapiens
gcaaggaaagcuccaaauc

SEQ ID NO: 404100 - RNA, 19 nt, Homo sapiens
gagcaagacccacucuguu

SEQ ID NO: 404101 - RNA, 19 nt, Homo sapiens
uaacaucucaggaggaaau

SEQ ID NO: 404102 - RNA, 19 nt, Homo sapiens
ugaugggacuggaggagua

SEQ ID NO: 404103 - RNA, 19 nt, Homo sapiens
gcucacagcaucacuuuua

SEQ ID NO: 404104 - RNA, 19 nt, Homo sapiens
ccuuguaccugaugucuga

SEQ ID NO: 404105 - RNA, 19 nt, Homo sapiens
agaaaugaacacagagaua

SEQ ID NO: 404106 - RNA, 19 nt, Homo sapiens
caccauuuccuaagagaua

SEQ ID NO: 404107 - RNA, 19 nt, Homo sapiens
ccagaagcccuauaaguca

SEQ ID NO: 404108 - RNA, 19 nt, Homo sapiens
acaggacccucuaccuauu

SEQ ID NO: 404109 - RNA, 19 nt, Homo sapiens
gacgagaaacaguauauuc

SEQ ID NO: 404110 - RNA, 19 nt, Homo sapiens
ggaccucuaccauuauguu

SEQ ID NO: 404111 - RNA, 19 nt, Homo sapiens
ucuacuaguuccuccaauu

SEQ ID NO: 404112 - RNA, 19 nt, Homo sapiens
cagcaucacuuuuaaacuu

SEQ ID NO: 404113 - RNA, 19 nt, Homo sapiens
gacacaggauccuacacuu

SEQ ID NO: 404114 - RNA, 19 nt, Homo sapiens
acaacagagugucagauau

SEQ ID NO: 404115 - RNA, 19 nt, Homo sapiens
uucccaagaugucagaaua

SEQ ID NO: 404116 - RNA, 19 nt, Homo sapiens
ccacggaggcugugaucuu

SEQ ID NO: 404117 - RNA, 19 nt, Homo sapiens
gaguaggaaagcugaaauu

SEQ ID NO: 404118 - RNA, 19 nt, Homo sapiens
gaugguuucuauaaagagu

SEQ ID NO: 404119 - RNA, 19 nt, Homo sapiens
agauauugccuguguguuu

SEQ ID NO: 404120 - RNA, 19 nt, Homo sapiens
aacaacagcugcucaaacu

SEQ ID NO: 404121 - RNA, 19 nt, Homo sapiens
gaaaacaggauccucauuc

SEQ ID NO: 404122 - RNA, 19 nt, Homo sapiens
gaccucuaccauuauguua

SEQ ID NO: 404123 - RNA, 19 nt, Homo sapiens
gaaauguggcucucuccau

SEQ ID NO: 404124 - RNA, 19 nt, Homo sapiens
uuggacaacucaauguaaa

SEQ ID NO: 404125 - RNA, 19 nt, Homo sapiens
aaacaggauccucauucua

SEQ ID NO: 404126 - RNA, 19 nt, Homo sapiens
caagcuaccugugguggau

SEQ ID NO: 404127 - RNA, 19 nt, Homo sapiens
ggacgagaaacaguauauu

SEQ ID NO: 404128 - RNA, 19 nt, Homo sapiens
ccucuuagcuguccuugcu

SEQ ID NO: 404129 - RNA, 19 nt, Homo sapiens
caucaccaucaauaacuua

SEQ ID NO: 404130 - RNA, 19 nt, Homo sapiens
aggaguaacuggacguuuc

SEQ ID NO: 404131 - RNA, 19 nt, Homo sapiens
acacaggauccuacacuuu

SEQ ID NO: 404132 - RNA, 19 nt, Homo sapiens
ccacucagaacucaccaaa

SEQ ID NO: 404133 - RNA, 19 nt, Homo sapiens
gaaaauccuuguaccugau

SEQ ID NO: 404134 - RNA, 19 nt, Homo sapiens
gacuggacauuacccugaa

SEQ ID NO: 404135 - RNA, 19 nt, Homo sapiens
ggacaauuaaugggaaguu

SEQ ID NO: 404136 - RNA, 19 nt, Homo sapiens
uaacuggacguuucaccuu

SEQ ID NO: 404137 - RNA, 19 nt, Homo sapiens
gaagacacaggauccuaca

SEQ ID NO: 404138 - RNA, 19 nt, Homo sapiens
aacaacagagugucagaua

SEQ ID NO: 404139 - RNA, 19 nt, Homo sapiens
caagaugucagaauaagac

SEQ ID NO: 404140 - RNA, 19 nt, Homo sapiens
caauuaaugggaaguuuca

SEQ ID NO: 404141 - RNA, 19 nt, Homo sapiens
agaacuacaccuacauuug

SEQ ID NO: 404142 - RNA, 19 nt, Homo sapiens
ccagggagaauaaggaugu

SEQ ID NO: 404143 - RNA, 19 nt, Homo sapiens
uaugucaucucaaccucaa

SEQ ID NO: 404144 - RNA, 19 nt, Homo sapiens
gaauaagacuccccaucau

SEQ ID NO: 404145 - RNA, 19 nt, Homo sapiens
ggacauuacccugaauucu

SEQ ID NO: 404146 - RNA, 19 nt, Homo sapiens
ccucuaccauuauguuaca

SEQ ID NO: 404147 - RNA, 19 nt, Homo sapiens
acaguauucuuggacaauu

SEQ ID NO: 404148 - RNA, 19 nt, Homo sapiens
ggaguaacuggacguuuca

SEQ ID NO: 404149 - RNA, 19 nt, Homo sapiens
ggcuacaucugguacaaag

SEQ ID NO: 404150 - RNA, 19 nt, Homo sapiens
acagggcucccaauagaaa

SEQ ID NO: 404151 - RNA, 19 nt, Homo sapiens
ugaaacaggacccuaucaa

SEQ ID NO: 404152 - RNA, 19 nt, Homo sapiens
aguaggaaagcugaaauua

SEQ ID NO: 404153 - RNA, 19 nt, Homo sapiens
gaggguaacaacagagugu

SEQ ID NO: 404154 - RNA, 19 nt, Homo sapiens
gugccugccucuuucacuu

SEQ ID NO: 404155 - RNA, 19 nt, Homo sapiens
gcuugugccugccucuuuc

SEQ ID NO: 404156 - RNA, 19 nt, Homo sapiens
gucauuagaauuucacaug

SEQ ID NO: 404157 - RNA, 19 nt, Homo sapiens
uaacaacagcugcucaaac

SEQ ID NO: 404158 - RNA, 19 nt, Homo sapiens
acucagaacucaccaaaau

SEQ ID NO: 404159 - RNA, 19 nt, Homo sapiens
acauuacccugaauucuac

SEQ ID NO: 404160 - RNA, 19 nt, Homo sapiens
caccaucaauaacuuaaac

SEQ ID NO: 404161 - RNA, 19 nt, Homo sapiens
caucccugcugauccagaa

SEQ ID NO: 404162 - RNA, 19 nt, Homo sapiens
cagagugucagauauguca

SEQ ID NO: 404163 - RNA, 19 nt, Homo sapiens
ucacuuggcaggauaaugc

SEQ ID NO: 404164 - RNA, 19 nt, Homo sapiens
uaacccaccggcacaguau

SEQ ID NO: 404165 - RNA, 19 nt, Homo sapiens
aacaggacccuaucaaugu

SEQ ID NO: 404166 - RNA, 19 nt, Homo sapiens
gauccuacacuuuacacau

SEQ ID NO: 404167 - RNA, 19 nt, Homo sapiens
guucaacaccauaacaaca

SEQ ID NO: 404168 - RNA, 19 nt, Homo sapiens
cuacaucugguacaaagga

SEQ ID NO: 404169 - RNA, 19 nt, Homo sapiens
cguuucaccuucaccuuau

SEQ ID NO: 404170 - RNA, 19 nt, Homo sapiens
cacagcauauaaccuggaa

SEQ ID NO: 404171 - RNA, 19 nt, Homo sapiens
cagcauauaaccuggaaag

SEQ ID NO: 404172 - RNA, 19 nt, Homo sapiens
ugacggaccucuaccauua

SEQ ID NO: 404173 - RNA, 19 nt, Homo sapiens
gcaaggaaaucuccaaauc

SEQ ID NO: 404174 - RNA, 19 nt, Homo sapiens
gaagagaaacaguauauuc

SEQ ID NO: 404175 - RNA, 19 nt, Homo sapiens
ggucagagccucccuguga

SEQ ID NO: 404176 - RNA, 19 nt, Homo sapiens
caacaggacccucuaucua

SEQ ID NO: 404177 - RNA, 19 nt, Homo sapiens
caacugagacacugagaaa

SEQ ID NO: 404178 - RNA, 19 nt, Homo sapiens
gaacuacaccuacauuugg

SEQ ID NO: 404179 - RNA, 19 nt, Homo sapiens
ccucuaccauuacauuaua

SEQ ID NO: 404180 - RNA, 19 nt, Homo sapiens
gagaaacaguauauuccaa

SEQ ID NO: 404181 - RNA, 19 nt, Homo sapiens
gaaacaggacccuaucaau

SEQ ID NO: 404182 - RNA, 19 nt, Homo sapiens
gacaauuaaugggaaguuu

SEQ ID NO: 404183 - RNA, 19 nt, Homo sapiens
gcucuaugcuugcucuguu

SEQ ID NO: 404184 - RNA, 19 nt, Homo sapiens
aaacaggacccuaucaaug

SEQ ID NO: 404185 - RNA, 19 nt, Homo sapiens
gcaggaaccuacaccuuac

SEQ ID NO: 404186 - RNA, 19 nt, Homo sapiens
ccagaauugugaaacuauu

SEQ ID NO: 404187 - RNA, 19 nt, Homo sapiens
ggaccucuaccauuacauu

SEQ ID NO: 404188 - RNA, 19 nt, Homo sapiens
ggaaaugacggaccucuac

SEQ ID NO: 404189 - RNA, 19 nt, Homo sapiens
gcucacagcaucacuuuua

SEQ ID NO: 404190 - RNA, 19 nt, Homo sapiens
acaggacccucuaucuauu

SEQ ID NO: 404191 - RNA, 19 nt, Homo sapiens
gaaccuacaccuuacacau

SEQ ID NO: 404192 - RNA, 19 nt, Homo sapiens
ugaugagacuagagaagaa

SEQ ID NO: 404193 - RNA, 19 nt, Homo sapiens
gaaaacaggauacucauuc

SEQ ID NO: 404194 - RNA, 19 nt, Homo sapiens
gcauacaguggaagagaaa

SEQ ID NO: 404195 - RNA, 19 nt, Homo sapiens
ggacgcaagcuaccuaugg

SEQ ID NO: 404196 - RNA, 19 nt, Homo sapiens
cagcaucacuuuuaaacuu

SEQ ID NO: 404197 - RNA, 19 nt, Homo sapiens
ggaagagaaacaguauauu

SEQ ID NO: 404198 - RNA, 19 nt, Homo sapiens
cguauauaguugaugguaa

SEQ ID NO: 404199 - RNA, 19 nt, Homo sapiens
ugacagccgugcucagaca

SEQ ID NO: 404200 - RNA, 19 nt, Homo sapiens
acccuucauucaccuauua

SEQ ID NO: 404201 - RNA, 19 nt, Homo sapiens
gaaauucaagacaaagaag

SEQ ID NO: 404202 - RNA, 19 nt, Homo sapiens
cauuucaccuucaccuuau

SEQ ID NO: 404203 - RNA, 19 nt, Homo sapiens
acauuucaccuucaccuua

SEQ ID NO: 404204 - RNA, 19 nt, Homo sapiens
ugcaggaaccuacaccuua

SEQ ID NO: 404205 - RNA, 19 nt, Homo sapiens
gaccucuaccauuacauua

SEQ ID NO: 404206 - RNA, 19 nt, Homo sapiens
gcccagccacccaaaguuu

SEQ ID NO: 404207 - RNA, 19 nt, Homo sapiens
ggaaggaugcaggaaccua

SEQ ID NO: 404208 - RNA, 19 nt, Homo sapiens
caccuucaccuuauacuug

SEQ ID NO: 404209 - RNA, 19 nt, Homo sapiens
uggaagagaaacaguauau

SEQ ID NO: 404210 - RNA, 19 nt, Homo sapiens
ggacaauuaaugggaaguu

SEQ ID NO: 404211 - RNA, 19 nt, Homo sapiens
caauuaaugggaaguuuca

SEQ ID NO: 404212 - RNA, 19 nt, Homo sapiens
agaacuacaccuacauuug

SEQ ID NO: 404213 - RNA, 19 nt, Homo sapiens
gaggugaugagacuagaga

SEQ ID NO: 404214 - RNA, 19 nt, Homo sapiens
ugaaacaggacccuaucaa

SEQ ID NO: 404215 - RNA, 19 nt, Homo sapiens
aaacaggauacucauucua

SEQ ID NO: 404216 - RNA, 19 nt, Homo sapiens
caagcuaccuaugguggau

SEQ ID NO: 404217 - RNA, 19 nt, Homo sapiens
gacgcaagcuaccuauggu

SEQ ID NO: 404218 - RNA, 19 nt, Homo sapiens
gaugagacuagagaagaaa

SEQ ID NO: 404219 - RNA, 19 nt, Homo sapiens
aaagcgaggugaugagacu

SEQ ID NO: 404220 - RNA, 19 nt, Homo sapiens
gggaaaugacggaccucua

SEQ ID NO: 404221 - RNA, 19 nt, Homo sapiens
gugaugagacuagagaaga

SEQ ID NO: 404222 - RNA, 19 nt, Homo sapiens
caucccugcugauccagaa

SEQ ID NO: 404223 - RNA, 19 nt, Homo sapiens
aaugggaaguuucagcaau

SEQ ID NO: 404224 - RNA, 19 nt, Homo sapiens
uaacccaccggcagaguau

SEQ ID NO: 404225 - RNA, 19 nt, Homo sapiens
aacaggacccuaucaaugu

SEQ ID NO: 404226 - RNA, 19 nt, Homo sapiens
aacaggacccucuaucuau

SEQ ID NO: 404227 - RNA, 19 nt, Homo sapiens
gagacuagagaagaaauuc

SEQ ID NO: 404228 - RNA, 19 nt, Homo sapiens
caggacccucuaucuauuu

SEQ ID NO: 404229 - RNA, 19 nt, Homo sapiens
agagaagaaauucgacauu

SEQ ID NO: 404230 - RNA, 19 nt, Homo sapiens
acaggacccuaucaaugug

SEQ ID NO: 404231 - RNA, 19 nt, Homo sapiens
aaaugaaacaggacccuau

SEQ ID NO: 404232 - RNA, 19 nt, Homo sapiens
uaccuaugguggaugaaug

SEQ ID NO: 404233 - RNA, 19 nt, Homo sapiens
cuacaccuuacacaucaua

SEQ ID NO: 404234 - RNA, 19 nt, Homo sapiens
caacgcaucccugcugauc

SEQ ID NO: 404235 - RNA, 19 nt, Homo sapiens
gggccugcauacaguggaa

SEQ ID NO: 404236 - RNA, 19 nt, Homo sapiens
uuucagcaaucaggacaaa

SEQ ID NO: 404237 - RNA, 19 nt, Homo sapiens
gacccucuaucuauuuggu

SEQ ID NO: 404238 - RNA, 19 nt, Homo sapiens
ccaacaggacccucuaucu

SEQ ID NO: 404239 - RNA, 19 nt, Homo sapiens
gcgaggugaugagacuaga

SEQ ID NO: 404240 - RNA, 19 nt, Homo sapiens
gaaugucacccggaaggau

SEQ ID NO: 404241 - RNA, 19 nt, Homo sapiens
gacuagagaagaaauucga

SEQ ID NO: 404242 - RNA, 19 nt, Homo sapiens
ugcauacaguggaagagaa

SEQ ID NO: 404243 - RNA, 19 nt, Homo sapiens
ccagaccuccccagaauuu

SEQ ID NO: 404244 - RNA, 19 nt, Homo sapiens
caguggaagagaaacagua

SEQ ID NO: 404245 - RNA, 19 nt, Homo sapiens
caaggaaaucuccaaaucc

SEQ ID NO: 404246 - RNA, 19 nt, Homo sapiens
ggcaaggaaaucuccaaau

SEQ ID NO: 404247 - RNA, 19 nt, Homo sapiens
cuaacccaccggcagagua

SEQ ID NO: 404248 - RNA, 19 nt, Homo sapiens
guccagaccuccccagaau

SEQ ID NO: 404249 - RNA, 19 nt, Homo sapiens
cacagcgcaucaccuggaa

SEQ ID NO: 404250 - RNA, 19 nt, Homo sapiens
aaaccaacaggacccucua

SEQ ID NO: 404251 - RNA, 19 nt, Homo sapiens
ggauguucuucuacuuguc

SEQ ID NO: 404252 - RNA, 19 nt, Homo sapiens
aggauguucuucuacuugu

SEQ ID NO: 404253 - RNA, 19 nt, Homo sapiens
ugagacuagagaagaaauu

SEQ ID NO: 404254 - RNA, 19 nt, Homo sapiens
guggaagagaaacaguaua

SEQ ID NO: 404255 - RNA, 19 nt, Homo sapiens
ugacggaccucuaccauua

SEQ ID NO: 404256 - RNA, 19 nt, Homo sapiens
gaaacaguauauuccaaug

SEQ ID NO: 404257 - RNA, 19 nt, Homo sapiens
caacaggacccucuaucua

SEQ ID NO: 404258 - RNA, 19 nt, Homo sapiens
gaacuacaccuacauuugg

SEQ ID NO: 404259 - RNA, 19 nt, Homo sapiens
gagaaacaguauauuccaa

SEQ ID NO: 404260 - RNA, 19 nt, Homo sapiens
ggaacuacaccuacauuug

SEQ ID NO: 404261 - RNA, 19 nt, Homo sapiens
gcccaccacugcccaagua

SEQ ID NO: 404262 - RNA, 19 nt, Homo sapiens
gaaacaggacccuaucaau

SEQ ID NO: 404263 - RNA, 19 nt, Homo sapiens
gacaauuaaugggaaguuu

SEQ ID NO: 404264 - RNA, 19 nt, Homo sapiens
aaacaggacccuaucaaug

SEQ ID NO: 404265 - RNA, 19 nt, Homo sapiens
cgaugggacuggaggagua

SEQ ID NO: 404266 - RNA, 19 nt, Homo sapiens
acccuuacuucaccuauua

SEQ ID NO: 404267 - RNA, 19 nt, Homo sapiens
auauuucacugucaccuua

SEQ ID NO: 404268 - RNA, 19 nt, Homo sapiens
aggaguaacuggauauuuc

SEQ ID NO: 404269 - RNA, 19 nt, Homo sapiens
ggaccucuaccauuacauu

SEQ ID NO: 404270 - RNA, 19 nt, Homo sapiens
gcaaaugacggaccucuac

SEQ ID NO: 404271 - RNA, 19 nt, Homo sapiens
gcucacagcaucacuuuua

SEQ ID NO: 404272 - RNA, 19 nt, Homo sapiens
acaggacccucuaucuauu

SEQ ID NO: 404273 - RNA, 19 nt, Homo sapiens
gaaaacaggauacucauuc

SEQ ID NO: 404274 - RNA, 19 nt, Homo sapiens
gacgagaaacaguauauuc

SEQ ID NO: 404275 - RNA, 19 nt, Homo sapiens
cagcaucacuuuuaaacuu

SEQ ID NO: 404276 - RNA, 19 nt, Homo sapiens
ggaguaacuggauauuuca

SEQ ID NO: 404277 - RNA, 19 nt, Homo sapiens
gaggaguaacuggauauuu

SEQ ID NO: 404278 - RNA, 19 nt, Homo sapiens
ugcaggauccuacaccuua

SEQ ID NO: 404279 - RNA, 19 nt, Homo sapiens
gaccucuaccauuacauua

SEQ ID NO: 404280 - RNA, 19 nt, Homo sapiens
ggacgagaaacaguauauu

SEQ ID NO: 404281 - RNA, 19 nt, Homo sapiens
aaugggaaguuucagcuau

SEQ ID NO: 404282 - RNA, 19 nt, Homo sapiens
gaauuuacccuuacuucac

SEQ ID NO: 404283 - RNA, 19 nt, Homo sapiens
ggacaauuaaugggaaguu

SEQ ID NO: 404284 - RNA, 19 nt, Homo sapiens
caauuaaugggaaguuuca

SEQ ID NO: 404285 - RNA, 19 nt, Homo sapiens
ccucuaccauuacauuaca

SEQ ID NO: 404286 - RNA, 19 nt, Homo sapiens
ugaaacaggacccuaucaa

SEQ ID NO: 404287 - RNA, 19 nt, Homo sapiens
aaacaggauacucauucua

SEQ ID NO: 404288 - RNA, 19 nt, Homo sapiens
ggcuacaucugguacaaag

SEQ ID NO: 404289 - RNA, 19 nt, Homo sapiens
gaaccuaagagucggaacu

SEQ ID NO: 404290 - RNA, 19 nt, Homo sapiens
gcaggauccuacaccuuac

SEQ ID NO: 404291 - RNA, 19 nt, Homo sapiens
caucccugcugauccagaa

SEQ ID NO: 404292 - RNA, 19 nt, Homo sapiens
uaacccaccggcagaguau

SEQ ID NO: 404293 - RNA, 19 nt, Homo sapiens
aacaggacccuaucaaugu

SEQ ID NO: 404294 - RNA, 19 nt, Homo sapiens
aacaggacccucuaucuau

SEQ ID NO: 404295 - RNA, 19 nt, Homo sapiens
caggacccucuaucuauuu

SEQ ID NO: 404296 - RNA, 19 nt, Homo sapiens
ucuggucccugccauggaa

SEQ ID NO: 404297 - RNA, 19 nt, Homo sapiens
cagaauuuacccuuacuuc

SEQ ID NO: 404298 - RNA, 19 nt, Homo sapiens
acaggacccuaucaaugug

SEQ ID NO: 404299 - RNA, 19 nt, Homo sapiens
aaaugaaacaggacccuau

SEQ ID NO: 404300 - RNA, 19 nt, Homo sapiens
gauauuucacugucaccuu

SEQ ID NO: 404301 - RNA, 19 nt, Homo sapiens
ggaggaguaacuggauauu

SEQ ID NO: 404302 - RNA, 19 nt, Homo sapiens
cuacaccuuacacaucaua

SEQ ID NO: 404303 - RNA, 19 nt, Homo sapiens
cuggaggaguaacuggaua

SEQ ID NO: 404304 - RNA, 19 nt, Homo sapiens
gauccuacaccuuacacau

SEQ ID NO: 404305 - RNA, 19 nt, Homo sapiens
uuucagcuaucaggacaaa

SEQ ID NO: 404306 - RNA, 19 nt, Homo sapiens
ugccuuacaucaccaucaa

SEQ ID NO: 404307 - RNA, 19 nt, Homo sapiens
gacccucuaucuauuuggu

SEQ ID NO: 404308 - RNA, 19 nt, Homo sapiens
ccaacaggacccucuaucu

SEQ ID NO: 404309 - RNA, 19 nt, Homo sapiens
aacaguauauuccaaugca

SEQ ID NO: 404310 - RNA, 19 nt, Homo sapiens
uaacuggauauuucacugu

SEQ ID NO: 404311 - RNA, 19 nt, Homo sapiens
agaauuuacccuuacuuca

SEQ ID NO: 404312 - RNA, 19 nt, Homo sapiens
ccagaccuccccagaauuu

SEQ ID NO: 404313 - RNA, 19 nt, Homo sapiens
gaugggacuggaggaguaa

SEQ ID NO: 404314 - RNA, 19 nt, Homo sapiens
uccuacaccuuacacauca

SEQ ID NO: 404315 - RNA, 19 nt, Homo sapiens
uacccuuacuucaccuauu

SEQ ID NO: 404316 - RNA, 19 nt, Homo sapiens
acggucaaauuauauaugg

SEQ ID NO: 404317 - RNA, 19 nt, Homo sapiens
cggaacuacaccuacauuu

SEQ ID NO: 404318 - RNA, 19 nt, Homo sapiens
ggcaaaugacggaccucua

SEQ ID NO: 404319 - RNA, 19 nt, Homo sapiens
cgagaaacaguauauucca

SEQ ID NO: 404320 - RNA, 19 nt, Homo sapiens
uaaugggaaguuucagcua

SEQ ID NO: 404321 - RNA, 19 nt, Homo sapiens
cuaacccaccggcagagua

SEQ ID NO: 404322 - RNA, 19 nt, Homo sapiens
ccuaagagucggaacuaca

SEQ ID NO: 404323 - RNA, 19 nt, Homo sapiens
caguggacgagaaacagua

SEQ ID NO: 404324 - RNA, 19 nt, Homo sapiens
ggauguucuucuacuuguc

SEQ ID NO: 404325 - RNA, 19 nt, Homo sapiens
guccagaccuccccagaau

SEQ ID NO: 404326 - RNA, 19 nt, Homo sapiens
agucggaacuacaccuaca

SEQ ID NO: 404327 - RNA, 19 nt, Homo sapiens
gaaauacggaggggaguga

SEQ ID NO: 404328 - RNA, 19 nt, Homo sapiens
aaaccaacaggacccucua

SEQ ID NO: 404329 - RNA, 19 nt, Homo sapiens
cauggaaaccagacagagu

SEQ ID NO: 404330 - RNA, 19 nt, Homo sapiens
aggauguucuucuacuugu

SEQ ID NO: 404331 - RNA, 19 nt, Homo sapiens
cuucaccuauuaccguuca

SEQ ID NO: 404332 - RNA, 19 nt, Homo sapiens
cuacaguggacgagaaaca

SEQ ID NO: 404333 - RNA, 19 nt, Homo sapiens
uauaugggccugccuacag

SEQ ID NO: 404334 - RNA, 19 nt, Homo sapiens
gaaugucacacaggaggau

SEQ ID NO: 404335 - RNA, 19 nt, Homo sapiens
gaauacaaguuccugauaa

SEQ ID NO: 404336 - RNA, 19 nt, Homo sapiens
gcacagagcacaucaaaug

SEQ ID NO: 404337 - RNA, 19 nt, Homo sapiens
ggucagagccucccuauga

SEQ ID NO: 404338 - RNA, 19 nt, Homo sapiens
gcugauaccuucaugaaau

SEQ ID NO: 404339 - RNA, 19 nt, Homo sapiens
gaaaaggacucuugaauac

SEQ ID NO: 404340 - RNA, 19 nt, Homo sapiens
caacaggacccucuuucua

SEQ ID NO: 404341 - RNA, 19 nt, Homo sapiens
ggcaggagauuuauggaaa

SEQ ID NO: 404342 - RNA, 19 nt, Homo sapiens
gaucauaccacuggacuaa

SEQ ID NO: 404343 - RNA, 19 nt, Homo sapiens
gagagaaccucgacuuguc

SEQ ID NO: 404344 - RNA, 19 nt, Homo sapiens
uagcagcccugaugucauu

SEQ ID NO: 404345 - RNA, 19 nt, Homo sapiens
aaaggacucuugaauacaa

SEQ ID NO: 404346 - RNA, 19 nt, Homo sapiens
ccacuggacuaagaacuuu

SEQ ID NO: 404347 - RNA, 19 nt, Homo sapiens
ucagucaccucuuacuauu

SEQ ID NO: 404348 - RNA, 19 nt, Homo sapiens
gacaauuaaugggaaguuu

SEQ ID NO: 404349 - RNA, 19 nt, Homo sapiens
gcacaguauucuuggacaa

SEQ ID NO: 404350 - RNA, 19 nt, Homo sapiens
caguauucuuggacaauua

SEQ ID NO: 404351 - RNA, 19 nt, Homo sapiens
ccaaguagcagcccugaug

SEQ ID NO: 404352 - RNA, 19 nt, Homo sapiens
ucauaccacuggacuaaga

SEQ ID NO: 404353 - RNA, 19 nt, Homo sapiens
cagagcacaucaaauggaa

SEQ ID NO: 404354 - RNA, 19 nt, Homo sapiens
aaagaacuccauuucauug

SEQ ID NO: 404355 - RNA, 19 nt, Homo sapiens
ggacuaagaacuuucaaaa

SEQ ID NO: 404356 - RNA, 19 nt, Homo sapiens
ugaauacaaguuccugaua

SEQ ID NO: 404357 - RNA, 19 nt, Homo sapiens
acaggacccucuuucuauu

SEQ ID NO: 404358 - RNA, 19 nt, Homo sapiens
ccuccagauuuaugaauuu

SEQ ID NO: 404359 - RNA, 19 nt, Homo sapiens
ggagagaaccucgacuugu

SEQ ID NO: 404360 - RNA, 19 nt, Homo sapiens
cagauuacuccaaagcaua

SEQ ID NO: 404361 - RNA, 19 nt, Homo sapiens
ucccuucagucaccucuua

SEQ ID NO: 404362 - RNA, 19 nt, Homo sapiens
gaagaaaagaacuccauuu

SEQ ID NO: 404363 - RNA, 19 nt, Homo sapiens
ugaaaaggacucuugaaua

SEQ ID NO: 404364 - RNA, 19 nt, Homo sapiens
gaaauucaagacaaagaag

SEQ ID NO: 404365 - RNA, 19 nt, Homo sapiens
aagacuggcaggagauuua

SEQ ID NO: 404366 - RNA, 19 nt, Homo sapiens
gaaaagacuaugaaaagga

SEQ ID NO: 404367 - RNA, 19 nt, Homo sapiens
gcaggacccuaugaaugug

SEQ ID NO: 404368 - RNA, 19 nt, Homo sapiens
cugauaccuucaugaaauu

SEQ ID NO: 404369 - RNA, 19 nt, Homo sapiens
aaugggaaguuucagcuau

SEQ ID NO: 404370 - RNA, 19 nt, Homo sapiens
agucaccucuuacuauuca

SEQ ID NO: 404371 - RNA, 19 nt, Homo sapiens
gcaggagauuuauggaaaa

SEQ ID NO: 404372 - RNA, 19 nt, Homo sapiens
ucagauuacuccaaagcau

SEQ ID NO: 404373 - RNA, 19 nt, Homo sapiens
ggacaauuaaugggaaguu

SEQ ID NO: 404374 - RNA, 19 nt, Homo sapiens
ccacagaggagaacaugca

SEQ ID NO: 404375 - RNA, 19 nt, Homo sapiens
gaagacuggcaggagauuu

SEQ ID NO: 404376 - RNA, 19 nt, Homo sapiens
caauuaaugggaaguuuca

SEQ ID NO: 404377 - RNA, 19 nt, Homo sapiens
acaguauucuuggacaauu

SEQ ID NO: 404378 - RNA, 19 nt, Homo sapiens
cagcaauugguaaaguaua

SEQ ID NO: 404379 - RNA, 19 nt, Homo sapiens
ucccucagauuacuccaaa

SEQ ID NO: 404380 - RNA, 19 nt, Homo sapiens
caccagcacaguauucuug

SEQ ID NO: 404381 - RNA, 19 nt, Homo sapiens
gaacaggcugauaccuuca

SEQ ID NO: 404382 - RNA, 19 nt, Homo sapiens
ggaagacuggcaggagauu

SEQ ID NO: 404383 - RNA, 19 nt, Homo sapiens
uaacccaccagcacaguau

SEQ ID NO: 404384 - RNA, 19 nt, Homo sapiens
ggaaaagacuaugaaaagg

SEQ ID NO: 404385 - RNA, 19 nt, Homo sapiens
cucuuuaucccucagauua

SEQ ID NO: 404386 - RNA, 19 nt, Homo sapiens
aacaggacccucuuucuau

SEQ ID NO: 404387 - RNA, 19 nt, Homo sapiens
caucuccagcagcaacuua

SEQ ID NO: 404388 - RNA, 19 nt, Homo sapiens
agauuacuccaaagcauaa

SEQ ID NO: 404389 - RNA, 19 nt, Homo sapiens
caggacccucuuucuauuu

SEQ ID NO: 404390 - RNA, 19 nt, Homo sapiens
uucagcaauugguaaagua

SEQ ID NO: 404391 - RNA, 19 nt, Homo sapiens
uuucagcuaucaggacaaa

SEQ ID NO: 404392 - RNA, 19 nt, Homo sapiens
caggagagaaccucgacuu

SEQ ID NO: 404393 - RNA, 19 nt, Homo sapiens
uaugcuugcucugcucgua

SEQ ID NO: 404394 - RNA, 19 nt, Homo sapiens
ugcaggacccuaugaaugu

SEQ ID NO: 404395 - RNA, 19 nt, Homo sapiens
aggacccucuuucuauuug

SEQ ID NO: 404396 - RNA, 19 nt, Homo sapiens
cugcacagagcacaucaaa

SEQ ID NO: 404397 - RNA, 19 nt, Homo sapiens
aauacaaguuccugauaac

SEQ ID NO: 404398 - RNA, 19 nt, Homo sapiens
ccagaccuccccagaauuu

SEQ ID NO: 404399 - RNA, 19 nt, Homo sapiens
cugcaggacccuaugaaug

SEQ ID NO: 404400 - RNA, 19 nt, Homo sapiens
uuuuaucccuccagauuua

SEQ ID NO: 404401 - RNA, 19 nt, Homo sapiens
acagagcacaucaaaugga

SEQ ID NO: 404402 - RNA, 19 nt, Homo sapiens
caaguagcagcccugaugu

SEQ ID NO: 404403 - RNA, 19 nt, Homo sapiens
gcgaggaaagcuccacauc

SEQ ID NO: 404404 - RNA, 19 nt, Homo sapiens
caaagcauaaugggcucua

SEQ ID NO: 404405 - RNA, 19 nt, Homo sapiens
gcucuuuaucccucagauu

SEQ ID NO: 404406 - RNA, 19 nt, Homo sapiens
uaaugggaaguuucagcua

SEQ ID NO: 404407 - RNA, 19 nt, Homo sapiens
ccagcacaguauucuugga

SEQ ID NO: 404408 - RNA, 19 nt, Homo sapiens
cccuccagauuuaugaauu

SEQ ID NO: 404409 - RNA, 19 nt, Homo sapiens
guccagaccuccccagaau

SEQ ID NO: 404410 - RNA, 19 nt, Homo sapiens
ccaacaggacccucuuucu

SEQ ID NO: 404411 - RNA, 19 nt, Homo sapiens
ggacccucuuucuauuugg

SEQ ID NO: 404412 - RNA, 19 nt, Homo sapiens
gaacuuagccauacugugu

SEQ ID NO: 404413 - RNA, 19 nt, Homo sapiens
gagcauggcugccucuuca

SEQ ID NO: 404414 - RNA, 19 nt, Homo sapiens
gagaaugugcaguuauuua

SEQ ID NO: 404415 - RNA, 19 nt, Homo sapiens
ggugaugacugcuugauga

SEQ ID NO: 404416 - RNA, 19 nt, Homo sapiens
ucacagagguggacagugu

SEQ ID NO: 404417 - RNA, 19 nt, Homo sapiens
guaaacguauccucuguau

SEQ ID NO: 404418 - RNA, 19 nt, Homo sapiens
gauggagaaugugcaguua

SEQ ID NO: 404419 - RNA, 19 nt, Homo sapiens
aaacguauccucuguauuc

SEQ ID NO: 404420 - RNA, 19 nt, Homo sapiens
ccaagucgacuaugccuua

SEQ ID NO: 404421 - RNA, 19 nt, Homo sapiens
gaugacugcuugaugaaga

SEQ ID NO: 404422 - RNA, 19 nt, Homo sapiens
cacaguaggugaagaaugu

SEQ ID NO: 404423 - RNA, 19 nt, Homo sapiens
cugagaaucugcucuacua

SEQ ID NO: 404424 - RNA, 19 nt, Homo sapiens
ggccaggugugacagagua

SEQ ID NO: 404425 - RNA, 19 nt, Homo sapiens
gaaccugcaccgcuccaua

SEQ ID NO: 404426 - RNA, 19 nt, Homo sapiens
gaugugggccuuugauaga

SEQ ID NO: 404427 - RNA, 19 nt, Homo sapiens
gggccaggguagcuaagua

SEQ ID NO: 404428 - RNA, 19 nt, Homo sapiens
uggagaaugugcaguuauu

SEQ ID NO: 404429 - RNA, 19 nt, Homo sapiens
cagcugcucugguggaguu

SEQ ID NO: 404430 - RNA, 19 nt, Homo sapiens
gagaugugggccuuugaua

SEQ ID NO: 404431 - RNA, 19 nt, Homo sapiens
ccaugcauccugauccuua

SEQ ID NO: 404432 - RNA, 19 nt, Homo sapiens
ccagaggccugagccagaa

SEQ ID NO: 404433 - RNA, 19 nt, Homo sapiens
gauaggaccuggccuucac

SEQ ID NO: 404434 - RNA, 19 nt, Homo sapiens
ugacaucaaggcccuaauu

SEQ ID NO: 404435 - RNA, 19 nt, Homo sapiens
gggcugccauucauuccaa

SEQ ID NO: 404436 - RNA, 19 nt, Homo sapiens
ggauggagaaugugcaguu

SEQ ID NO: 404437 - RNA, 19 nt, Homo sapiens
gcuccagccucuccaagau

SEQ ID NO: 404438 - RNA, 19 nt, Homo sapiens
gaccuggccuucacugucu

SEQ ID NO: 404439 - RNA, 19 nt, Homo sapiens
guacaagcacuucaucaca

SEQ ID NO: 404440 - RNA, 19 nt, Homo sapiens
gcuccacacgcuccaauaa

SEQ ID NO: 404441 - RNA, 19 nt, Homo sapiens
ggagaaugugcaguuauuu

SEQ ID NO: 404442 - RNA, 19 nt, Homo sapiens
cgauuagggucgaguguca

SEQ ID NO: 404443 - RNA, 19 nt, Homo sapiens
uauccucuguauucaguaa

SEQ ID NO: 404444 - RNA, 19 nt, Homo sapiens
gagcccuucucccugguuu

SEQ ID NO: 404445 - RNA, 19 nt, Homo sapiens
ggccagugcucgcaagaag

SEQ ID NO: 404446 - RNA, 19 nt, Homo sapiens
ggcacugacuccaagauca

SEQ ID NO: 404447 - RNA, 19 nt, Homo sapiens
auccugauccuuaagauua

SEQ ID NO: 404448 - RNA, 19 nt, Homo sapiens
cgucauugccuacauccua

SEQ ID NO: 404449 - RNA, 19 nt, Homo sapiens
ggagggcugccauucauuc

SEQ ID NO: 404450 - RNA, 19 nt, Homo sapiens
ggacagggguuuggagaug

SEQ ID NO: 404451 - RNA, 19 nt, Homo sapiens
acaagcacuucaucacaga

SEQ ID NO: 404452 - RNA, 19 nt, Homo sapiens
uaaguacagggccaaguuu

SEQ ID NO: 404453 - RNA, 19 nt, Homo sapiens
agagugacguguacaagca

SEQ ID NO: 404454 - RNA, 19 nt, Homo sapiens
cgacuaugccuuagacaca

SEQ ID NO: 404455 - RNA, 19 nt, Homo sapiens
caugcauccugauccuuaa

SEQ ID NO: 404456 - RNA, 19 nt, Homo sapiens
uguccaaccuggccaagga

SEQ ID NO: 404457 - RNA, 19 nt, Homo sapiens
gcucuuugaccgcaucauu

SEQ ID NO: 404458 - RNA, 19 nt, Homo sapiens
gacaucaaggcccuaauug

SEQ ID NO: 404459 - RNA, 19 nt, Homo sapiens
gugaugggcugugggacaa

SEQ ID NO: 404460 - RNA, 19 nt, Homo sapiens
ccaacucaguggacaugug

SEQ ID NO: 404461 - RNA, 19 nt, Homo sapiens
ggguguacauggugaugga

SEQ ID NO: 404462 - RNA, 19 nt, Homo sapiens
gccaauugcaggaggguuu

SEQ ID NO: 404463 - RNA, 19 nt, Homo sapiens
gaaccauccccauuucuuu

SEQ ID NO: 404464 - RNA, 19 nt, Homo sapiens
ugugugaccugccucugaa

SEQ ID NO: 404465 - RNA, 19 nt, Homo sapiens
cagccuggguucuauccuu

SEQ ID NO: 404466 - RNA, 19 nt, Homo sapiens
gcuaccagcagcaauacaa

SEQ ID NO: 404467 - RNA, 19 nt, Homo sapiens
gcagggccaggguagcuaa

SEQ ID NO: 404468 - RNA, 19 nt, Homo sapiens
gcacugacuccaagaucau

SEQ ID NO: 404469 - RNA, 19 nt, Homo sapiens
gccuguggauggagaaugu

SEQ ID NO: 404470 - RNA, 19 nt, Homo sapiens
cuaaguacagggccaaguu

SEQ ID NO: 404471 - RNA, 19 nt, Homo sapiens
aaguuugacccacguguua

SEQ ID NO: 404472 - RNA, 19 nt, Homo sapiens
ccaugccguuugaggauga

SEQ ID NO: 404473 - RNA, 19 nt, Homo sapiens
cguauccucuguauucagu

SEQ ID NO: 404474 - RNA, 19 nt, Homo sapiens
cagcuucagccgaguggua

SEQ ID NO: 404475 - RNA, 19 nt, Homo sapiens
ggaaacaaaacuaaagaga

SEQ ID NO: 404476 - RNA, 19 nt, Homo sapiens
gggcgucauugccuacauc

SEQ ID NO: 404477 - RNA, 19 nt, Homo sapiens
gaucaucaucaccgacuuc

SEQ ID NO: 404478 - RNA, 19 nt, Homo sapiens
ugccauucauuccaacaaa

SEQ ID NO: 404479 - RNA, 19 nt, Homo sapiens
ggagaugugggccuuugau

SEQ ID NO: 404480 - RNA, 19 nt, Homo sapiens
cuccacagcugccuucagu

SEQ ID NO: 404481 - RNA, 19 nt, Homo sapiens
caccuguaguccuccauga

SEQ ID NO: 404482 - RNA, 19 nt, Homo sapiens
agaucugucuuccuucaug

SEQ ID NO: 404483 - RNA, 19 nt, Homo sapiens
gcauccugauccuuaagau

SEQ ID NO: 404484 - RNA, 19 nt, Homo sapiens
uggcacgccugaguacauu

SEQ ID NO: 404485 - RNA, 19 nt, Homo sapiens
agaaucugcucuacuacca

SEQ ID NO: 404486 - RNA, 19 nt, Homo sapiens
gugcacaccugcccaucgu

SEQ ID NO: 404487 - RNA, 19 nt, Homo sapiens
gacccuggagcccguauga

SEQ ID NO: 404488 - RNA, 19 nt, Homo sapiens
caaguuugacccacguguu

SEQ ID NO: 404489 - RNA, 19 nt, Homo sapiens
guugauguccauuccauuc

SEQ ID NO: 404490 - RNA, 19 nt, Homo sapiens
cuuggugccuucuuuguag

SEQ ID NO: 404491 - RNA, 19 nt, Homo sapiens
gcccacaguaggugaagaa

SEQ ID NO: 404492 - RNA, 19 nt, Homo sapiens
uccacacgcuccaauaagu

SEQ ID NO: 404493 - RNA, 19 nt, Homo sapiens
cccagaaccuccuuaaacg

SEQ ID NO: 404494 - RNA, 19 nt, Homo sapiens
cagcuaaguaugacaucaa

SEQ ID NO: 404495 - RNA, 19 nt, Homo sapiens
gcagccguaugccaucaag

SEQ ID NO: 404496 - RNA, 19 nt, Homo sapiens
gccauggcguggaccuuca

SEQ ID NO: 404497 - RNA, 19 nt, Homo sapiens
ucccuugcccuuugacuuu

SEQ ID NO: 404498 - RNA, 19 nt, Homo sapiens
gcuccagcccuuucucugu

SEQ ID NO: 404499 - RNA, 19 nt, Homo sapiens
ggcaggaggcaguggagaa

SEQ ID NO: 404500 - RNA, 19 nt, Homo sapiens
guguuacagcuaaguauga

SEQ ID NO: 404501 - RNA, 19 nt, Homo sapiens
ggauaggaccuggccuuca

SEQ ID NO: 404502 - RNA, 19 nt, Homo sapiens
agcuggaucuggucaagaa

SEQ ID NO: 404503 - RNA, 19 nt, Homo sapiens
ccacaguaggugaagaaug

SEQ ID NO: 404504 - RNA, 19 nt, Homo sapiens
caaccuggccaaggacuuc

SEQ ID NO: 404505 - RNA, 19 nt, Homo sapiens
gacuaugccuuagacacau

SEQ ID NO: 404506 - RNA, 19 nt, Homo sapiens
ggacccuuugggacaguua

SEQ ID NO: 404507 - RNA, 19 nt, Homo sapiens
ccccauggccucagaauuu

SEQ ID NO: 404508 - RNA, 19 nt, Homo sapiens
caagucgacuaugccuuag

SEQ ID NO: 404509 - RNA, 19 nt, Homo sapiens
caaagcuugugccuugacu

SEQ ID NO: 404510 - RNA, 19 nt, Homo sapiens
ccagaaccauccccauuuc

SEQ ID NO: 404511 - RNA, 19 nt, Homo sapiens
gggguuggguggcugcuuu

SEQ ID NO: 404512 - RNA, 19 nt, Homo sapiens
gaacauaggugucuuugug

SEQ ID NO: 404513 - RNA, 19 nt, Homo sapiens
gaaagggucuguauaauca

SEQ ID NO: 404514 - RNA, 19 nt, Homo sapiens
gaagaaagaccacagagaa

SEQ ID NO: 404515 - RNA, 19 nt, Homo sapiens
gaaaguauggguaucuaua

SEQ ID NO: 404516 - RNA, 19 nt, Homo sapiens
gauaugggcccucacauuu

SEQ ID NO: 404517 - RNA, 19 nt, Homo sapiens
gcuagacuguuauguaauu

SEQ ID NO: 404518 - RNA, 19 nt, Homo sapiens
gaaaucaguaugacaauga

SEQ ID NO: 404519 - RNA, 19 nt, Homo sapiens
gcagagugguggaaugcua

SEQ ID NO: 404520 - RNA, 19 nt, Homo sapiens
gggcaggauucaucaaauu

SEQ ID NO: 404521 - RNA, 19 nt, Homo sapiens
caaccucacugaaaccuau

SEQ ID NO: 404522 - RNA, 19 nt, Homo sapiens
gcuugcagcucaucagaaa

SEQ ID NO: 404523 - RNA, 19 nt, Homo sapiens
ggaccugacuacaaagaau

SEQ ID NO: 404524 - RNA, 19 nt, Homo sapiens
gauaagccagucuauauau

SEQ ID NO: 404525 - RNA, 19 nt, Homo sapiens
ccaaucagcucguacuuac

SEQ ID NO: 404526 - RNA, 19 nt, Homo sapiens
gaugcuagacuguuaugua

SEQ ID NO: 404527 - RNA, 19 nt, Homo sapiens
acaaugaugucacuguuug

SEQ ID NO: 404528 - RNA, 19 nt, Homo sapiens
gugauaagccagucuauau

SEQ ID NO: 404529 - RNA, 19 nt, Homo sapiens
cgucuuguaucucuaauug

SEQ ID NO: 404530 - RNA, 19 nt, Homo sapiens
guacuuacuuggagagaca

SEQ ID NO: 404531 - RNA, 19 nt, Homo sapiens
ccaagcaaccucacugaaa

SEQ ID NO: 404532 - RNA, 19 nt, Homo sapiens
gcagagccauguccauugg

SEQ ID NO: 404533 - RNA, 19 nt, Homo sapiens
ccauuggaauuguugguaa

SEQ ID NO: 404534 - RNA, 19 nt, Homo sapiens
caguuggucugaaaucaaa

SEQ ID NO: 404535 - RNA, 19 nt, Homo sapiens
caagcaaccucacugaaac

SEQ ID NO: 404536 - RNA, 19 nt, Homo sapiens
gugguggaaugcuauguuu

SEQ ID NO: 404537 - RNA, 19 nt, Homo sapiens
ggaaugcuauguuuuagga

SEQ ID NO: 404538 - RNA, 19 nt, Homo sapiens
ggcagcaccuccuugauuc

SEQ ID NO: 404539 - RNA, 19 nt, Homo sapiens
augcuagacuguuauguaa

SEQ ID NO: 404540 - RNA, 19 nt, Homo sapiens
ugauaagccagucuauaua

SEQ ID NO: 404541 - RNA, 19 nt, Homo sapiens
ggaaucaguccagauguga

SEQ ID NO: 404542 - RNA, 19 nt, Homo sapiens
cugaauuuauggaguguaa

SEQ ID NO: 404543 - RNA, 19 nt, Homo sapiens
cgaaaucaguaugacaaug

SEQ ID NO: 404544 - RNA, 19 nt, Homo sapiens
guccaucugcuaacuauuu

SEQ ID NO: 404545 - RNA, 19 nt, Homo sapiens
cgucaggaguguuuggauu

SEQ ID NO: 404546 - RNA, 19 nt, Homo sapiens
ugaaagggucuguauaauc

SEQ ID NO: 404547 - RNA, 19 nt, Homo sapiens
aagccagucuauauaugua

SEQ ID NO: 404548 - RNA, 19 nt, Homo sapiens
gauaccaacacaacgauau

SEQ ID NO: 404549 - RNA, 19 nt, Homo sapiens
gccugugucucgucuugua

SEQ ID NO: 404550 - RNA, 19 nt, Homo sapiens
acugaaaccuauauaaugg

SEQ ID NO: 404551 - RNA, 19 nt, Homo sapiens
uuugaaagggucuguauaa

SEQ ID NO: 404552 - RNA, 19 nt, Homo sapiens
gccagucuauauauguauu

SEQ ID NO: 404553 - RNA, 19 nt, Homo sapiens
ccuccuugauucucaguuu

SEQ ID NO: 404554 - RNA, 19 nt, Homo sapiens
gaaagaccacagagaaagg

SEQ ID NO: 404555 - RNA, 19 nt, Homo sapiens
gguguuggucuccuuauug

SEQ ID NO: 404556 - RNA, 19 nt, Homo sapiens
cggcagcaccuccuugauu

SEQ ID NO: 404557 - RNA, 19 nt, Homo sapiens
cauuggaauuguugguaaa

SEQ ID NO: 404558 - RNA, 19 nt, Homo sapiens
cacauacugaugacaauaa

SEQ ID NO: 404559 - RNA, 19 nt, Homo sapiens
ccacauacugaugacaaua

SEQ ID NO: 404560 - RNA, 19 nt, Homo sapiens
ucuuguaucucuaauugga

SEQ ID NO: 404561 - RNA, 19 nt, Homo sapiens
ccagauuuguauucgauag

SEQ ID NO: 404562 - RNA, 19 nt, Homo sapiens
aagaaagaccacagagaaa

SEQ ID NO: 404563 - RNA, 19 nt, Homo sapiens
cuacaaagaauguuuccau

SEQ ID NO: 404564 - RNA, 19 nt, Homo sapiens
cugcgugccuuaagagaga

SEQ ID NO: 404565 - RNA, 19 nt, Homo sapiens
gauagaccacugccugugu

SEQ ID NO: 404566 - RNA, 19 nt, Homo sapiens
cacugaaaccuauauaaug

SEQ ID NO: 404567 - RNA, 19 nt, Homo sapiens
gguggaaugcuauguuuua

SEQ ID NO: 404568 - RNA, 19 nt, Homo sapiens
ugaagaaagaccacagaga

SEQ ID NO: 404569 - RNA, 19 nt, Homo sapiens
gaugaugugucuccauucc

SEQ ID NO: 404570 - RNA, 19 nt, Homo sapiens
caaucuaugaugaugauga

SEQ ID NO: 404571 - RNA, 19 nt, Homo sapiens
ugauaugggcccucacauu

SEQ ID NO: 404572 - RNA, 19 nt, Homo sapiens
gcuuacugcugaugcuaga

SEQ ID NO: 404573 - RNA, 19 nt, Homo sapiens
auaggugucuuugugguuu

SEQ ID NO: 404574 - RNA, 19 nt, Homo sapiens
uaagugauaagccagucua

SEQ ID NO: 404575 - RNA, 19 nt, Homo sapiens
gaguuuacaaucuaugaug

SEQ ID NO: 404576 - RNA, 19 nt, Homo sapiens
aaaccuguccaucugcuaa

SEQ ID NO: 404577 - RNA, 19 nt, Homo sapiens
aaaggcugaugaaccaaug

SEQ ID NO: 404578 - RNA, 19 nt, Homo sapiens
gacuuggaguuuacaaucu

SEQ ID NO: 404579 - RNA, 19 nt, Homo sapiens
gaugauaugggcccucaca

SEQ ID NO: 404580 - RNA, 19 nt, Homo sapiens
ccagauaccaacacaacga

SEQ ID NO: 404581 - RNA, 19 nt, Homo sapiens
uaagccagucuauauaugu

SEQ ID NO: 404582 - RNA, 19 nt, Homo sapiens
gccaccauguuucgaaauc

SEQ ID NO: 404583 - RNA, 19 nt, Homo sapiens
ugaacuaguuaaacauggu

SEQ ID NO: 404584 - RNA, 19 nt, Homo sapiens
ggcaggauucaucaaauug

SEQ ID NO: 404585 - RNA, 19 nt, Homo sapiens
ccuuauugcugguuaugau

SEQ ID NO: 404586 - RNA, 19 nt, Homo sapiens
aagggucuguauaaucauu

SEQ ID NO: 404587 - RNA, 19 nt, Homo sapiens
auaagccagucuauauaug

SEQ ID NO: 404588 - RNA, 19 nt, Homo sapiens
augaugaugugucuccauu

SEQ ID NO: 404589 - RNA, 19 nt, Homo sapiens
aaucagcucguacuuacuu

SEQ ID NO: 404590 - RNA, 19 nt, Homo sapiens
ggaagcaagacccagauac

SEQ ID NO: 404591 - RNA, 19 nt, Homo sapiens
agccacaguuggucugaaa

SEQ ID NO: 404592 - RNA, 19 nt, Homo sapiens
agaaaaggcugaugaacca

SEQ ID NO: 404593 - RNA, 19 nt, Homo sapiens
acuuggaguuuacaaucua

SEQ ID NO: 404594 - RNA, 19 nt, Homo sapiens
ccaccauguuucgaaauca

SEQ ID NO: 404595 - RNA, 19 nt, Homo sapiens
ugcugaugcuagacuguua

SEQ ID NO: 404596 - RNA, 19 nt, Homo sapiens
uugaaagggucuguauaau

SEQ ID NO: 404597 - RNA, 19 nt, Homo sapiens
gcugaugaaccugcagaaa

SEQ ID NO: 404598 - RNA, 19 nt, Homo sapiens
cacaguuggucugaaauca

SEQ ID NO: 404599 - RNA, 19 nt, Homo sapiens
gaccugacuacaaagaaug

SEQ ID NO: 404600 - RNA, 19 nt, Homo sapiens
cccaaucagcucguacuua

SEQ ID NO: 404601 - RNA, 19 nt, Homo sapiens
ggauuccagauuuguauuc

SEQ ID NO: 404602 - RNA, 19 nt, Homo sapiens
cagggcaggauucaucaaa

SEQ ID NO: 404603 - RNA, 19 nt, Homo sapiens
aggaaucaguccagaugug

SEQ ID NO: 404604 - RNA, 19 nt, Homo sapiens
uuaggaaucaguccagaug

SEQ ID NO: 404605 - RNA, 19 nt, Homo sapiens
ccgccaccauguuucgaaa

SEQ ID NO: 404606 - RNA, 19 nt, Homo sapiens
ugguaaagacuuggaguuu

SEQ ID NO: 404607 - RNA, 19 nt, Homo sapiens
uuccaaaccuguccaucug

SEQ ID NO: 404608 - RNA, 19 nt, Homo sapiens
gaagcaagacccagauacc

SEQ ID NO: 404609 - RNA, 19 nt, Homo sapiens
gcaaccucacugaaaccua

SEQ ID NO: 404610 - RNA, 19 nt, Homo sapiens
ccacaguuggucugaaauc

SEQ ID NO: 404611 - RNA, 19 nt, Homo sapiens
cugcucaaccugcugauga

SEQ ID NO: 404612 - RNA, 19 nt, Homo sapiens
gaacauaggugucuuugug

SEQ ID NO: 404613 - RNA, 19 nt, Homo sapiens
gaaagggucuguauaauca

SEQ ID NO: 404614 - RNA, 19 nt, Homo sapiens
gaagaaagaccacagagaa

SEQ ID NO: 404615 - RNA, 19 nt, Homo sapiens
gaaaguauggguaucuaua

SEQ ID NO: 404616 - RNA, 19 nt, Homo sapiens
gauaugggcccucacauuu

SEQ ID NO: 404617 - RNA, 19 nt, Homo sapiens
gcuagacuguuauguaauu

SEQ ID NO: 404618 - RNA, 19 nt, Homo sapiens
gaaaucaguaugacaauga

SEQ ID NO: 404619 - RNA, 19 nt, Homo sapiens
gcagagugguggaaugcua

SEQ ID NO: 404620 - RNA, 19 nt, Homo sapiens
gggcaggauucaucaaauu

SEQ ID NO: 404621 - RNA, 19 nt, Homo sapiens
caaccucacugaaaccuau

SEQ ID NO: 404622 - RNA, 19 nt, Homo sapiens
caagucaaauccagaccua

SEQ ID NO: 404623 - RNA, 19 nt, Homo sapiens
gcuugcagcucaucagaaa

SEQ ID NO: 404624 - RNA, 19 nt, Homo sapiens
ggaccugacuacaaagaau

SEQ ID NO: 404625 - RNA, 19 nt, Homo sapiens
gauaagccagucuauauau

SEQ ID NO: 404626 - RNA, 19 nt, Homo sapiens
ccaaucagcucguacuuac

SEQ ID NO: 404627 - RNA, 19 nt, Homo sapiens
gaugcuagacuguuaugua

SEQ ID NO: 404628 - RNA, 19 nt, Homo sapiens
acaaugaugucacuguuug

SEQ ID NO: 404629 - RNA, 19 nt, Homo sapiens
gugauaagccagucuauau

SEQ ID NO: 404630 - RNA, 19 nt, Homo sapiens
cgucuuguaucucuaauug

SEQ ID NO: 404631 - RNA, 19 nt, Homo sapiens
guacuuacuuggagagaca

SEQ ID NO: 404632 - RNA, 19 nt, Homo sapiens
ccaagcaaccucacugaaa

SEQ ID NO: 404633 - RNA, 19 nt, Homo sapiens
ccaccggacugaaagagaa

SEQ ID NO: 404634 - RNA, 19 nt, Homo sapiens
gcagagccauguccauugg

SEQ ID NO: 404635 - RNA, 19 nt, Homo sapiens
ccauuggaauuguugguaa

SEQ ID NO: 404636 - RNA, 19 nt, Homo sapiens
caguuggucugaaaucaaa

SEQ ID NO: 404637 - RNA, 19 nt, Homo sapiens
caagcaaccucacugaaac

SEQ ID NO: 404638 - RNA, 19 nt, Homo sapiens
gugguggaaugcuauguuu

SEQ ID NO: 404639 - RNA, 19 nt, Homo sapiens
ggaaugcuauguuuuagga

SEQ ID NO: 404640 - RNA, 19 nt, Homo sapiens
gcgugcagguucucuuuga

SEQ ID NO: 404641 - RNA, 19 nt, Homo sapiens
augcuagacuguuauguaa

SEQ ID NO: 404642 - RNA, 19 nt, Homo sapiens
ugauaagccagucuauaua

SEQ ID NO: 404643 - RNA, 19 nt, Homo sapiens
ggaaucaguccagauguga

SEQ ID NO: 404644 - RNA, 19 nt, Homo sapiens
cugaauuuauggaguguaa

SEQ ID NO: 404645 - RNA, 19 nt, Homo sapiens
guccaucugcuaacuauuu

SEQ ID NO: 404646 - RNA, 19 nt, Homo sapiens
cgucaggaguguuuggauu

SEQ ID NO: 404647 - RNA, 19 nt, Homo sapiens
cgaaaucaguaugacaaug

SEQ ID NO: 404648 - RNA, 19 nt, Homo sapiens
gcaaggugaaguuucgaaa

SEQ ID NO: 404649 - RNA, 19 nt, Homo sapiens
ugaaagggucuguauaauc

SEQ ID NO: 404650 - RNA, 19 nt, Homo sapiens
aagccagucuauauaugua

SEQ ID NO: 404651 - RNA, 19 nt, Homo sapiens
gauaccaacacaacgauau

SEQ ID NO: 404652 - RNA, 19 nt, Homo sapiens
gccugugucucgucuugua

SEQ ID NO: 404653 - RNA, 19 nt, Homo sapiens
uauguuggauguuggucua

SEQ ID NO: 404654 - RNA, 19 nt, Homo sapiens
ccagaccuauguuggaugu

SEQ ID NO: 404655 - RNA, 19 nt, Homo sapiens
acugaaaccuauauaaugg

SEQ ID NO: 404656 - RNA, 19 nt, Homo sapiens
uuugaaagggucuguauaa

SEQ ID NO: 404657 - RNA, 19 nt, Homo sapiens
gccagucuauauauguauu

SEQ ID NO: 404658 - RNA, 19 nt, Homo sapiens
gaaagaccacagagaaagg

SEQ ID NO: 404659 - RNA, 19 nt, Homo sapiens
aaggugaaguuucgaaauc

SEQ ID NO: 404660 - RNA, 19 nt, Homo sapiens
ggauguuggucuacuaggu

SEQ ID NO: 404661 - RNA, 19 nt, Homo sapiens
gguguuggucuccuuauug

SEQ ID NO: 404662 - RNA, 19 nt, Homo sapiens
gugacugucuccuggaaau

SEQ ID NO: 404663 - RNA, 19 nt, Homo sapiens
agaccuauguuggauguug

SEQ ID NO: 404664 - RNA, 19 nt, Homo sapiens
cauuggaauuguugguaaa

SEQ ID NO: 404665 - RNA, 19 nt, Homo sapiens
gaaaagacaaugacaaguc

SEQ ID NO: 404666 - RNA, 19 nt, Homo sapiens
cacauacugaugacaauaa

SEQ ID NO: 404667 - RNA, 19 nt, Homo sapiens
ccacauacugaugacaaua

SEQ ID NO: 404668 - RNA, 19 nt, Homo sapiens
ucuuguaucucuaauugga

SEQ ID NO: 404669 - RNA, 19 nt, Homo sapiens
ccagauuuguauucgauag

SEQ ID NO: 404670 - RNA, 19 nt, Homo sapiens
aagaaagaccacagagaaa

SEQ ID NO: 404671 - RNA, 19 nt, Homo sapiens
caaauccagaccuauguug

SEQ ID NO: 404672 - RNA, 19 nt, Homo sapiens
cuacaaagaauguuuccau

SEQ ID NO: 404673 - RNA, 19 nt, Homo sapiens
cugcgugccuuaagagaga

SEQ ID NO: 404674 - RNA, 19 nt, Homo sapiens
gccaguagcagagugguaa

SEQ ID NO: 404675 - RNA, 19 nt, Homo sapiens
gauagaccacugccugugu

SEQ ID NO: 404676 - RNA, 19 nt, Homo sapiens
cacugaaaccuauauaaug

SEQ ID NO: 404677 - RNA, 19 nt, Homo sapiens
gguggaaugcuauguuuua

SEQ ID NO: 404678 - RNA, 19 nt, Homo sapiens
ugaagaaagaccacagaga

SEQ ID NO: 404679 - RNA, 19 nt, Homo sapiens
guuggauguuggucuacua

SEQ ID NO: 404680 - RNA, 19 nt, Homo sapiens
gaugaugugucuccauucc

SEQ ID NO: 404681 - RNA, 19 nt, Homo sapiens
caaucuaugaugaugauga

SEQ ID NO: 404682 - RNA, 19 nt, Homo sapiens
ugauaugggcccucacauu

SEQ ID NO: 404683 - RNA, 19 nt, Homo sapiens
gcuuacugcugaugcuaga

SEQ ID NO: 404684 - RNA, 19 nt, Homo sapiens
auaggugucuuugugguuu

SEQ ID NO: 404685 - RNA, 19 nt, Homo sapiens
uaagugauaagccagucua

SEQ ID NO: 404686 - RNA, 19 nt, Homo sapiens
gaguuuacaaucuaugaug

SEQ ID NO: 404687 - RNA, 19 nt, Homo sapiens
aaaccuguccaucugcuaa

SEQ ID NO: 404688 - RNA, 19 nt, Homo sapiens
aaaggcugaugaaccaaug

SEQ ID NO: 404689 - RNA, 19 nt, Homo sapiens
gacuuggaguuuacaaucu

SEQ ID NO: 404690 - RNA, 19 nt, Homo sapiens
gaugauaugggcccucaca

SEQ ID NO: 404691 - RNA, 19 nt, Homo sapiens
ccagauaccaacacaacga

SEQ ID NO: 404692 - RNA, 19 nt, Homo sapiens
gaaguuucgaaaucaguau

SEQ ID NO: 404693 - RNA, 19 nt, Homo sapiens
gcucagcaaggugaaguuu

SEQ ID NO: 404694 - RNA, 19 nt, Homo sapiens
uaagccagucuauauaugu

SEQ ID NO: 404695 - RNA, 19 nt, Homo sapiens
ugaacuaguuaaacauggu

SEQ ID NO: 404696 - RNA, 19 nt, Homo sapiens
ccuuauugcugguuaugau

SEQ ID NO: 404697 - RNA, 19 nt, Homo sapiens
ggcaggauucaucaaauug

SEQ ID NO: 404698 - RNA, 19 nt, Homo sapiens
ugaaguuucgaaaucagua

SEQ ID NO: 404699 - RNA, 19 nt, Homo sapiens
caaggugaaguuucgaaau

SEQ ID NO: 404700 - RNA, 19 nt, Homo sapiens
ucagcaaggugaaguuucg

SEQ ID NO: 404701 - RNA, 19 nt, Homo sapiens
aagggucuguauaaucauu

SEQ ID NO: 404702 - RNA, 19 nt, Homo sapiens
auaagccagucuauauaug

SEQ ID NO: 404703 - RNA, 19 nt, Homo sapiens
augaugaugugucuccauu

SEQ ID NO: 404704 - RNA, 19 nt, Homo sapiens
aaucagcucguacuuacuu

SEQ ID NO: 404705 - RNA, 19 nt, Homo sapiens
ggaagcaagacccagauac

SEQ ID NO: 404706 - RNA, 19 nt, Homo sapiens
agccacaguuggucugaaa

SEQ ID NO: 404707 - RNA, 19 nt, Homo sapiens
agaaaaggcugaugaacca

SEQ ID NO: 404708 - RNA, 19 nt, Homo sapiens
acuuggaguuuacaaucua

SEQ ID NO: 404709 - RNA, 19 nt, Homo sapiens
ugcugaugcuagacuguua

SEQ ID NO: 404710 - RNA, 19 nt, Homo sapiens
uugaaagggucuguauaau

SEQ ID NO: 404711 - RNA, 19 nt, Homo sapiens
gcugaugaaccugcagaaa

SEQ ID NO: 404712 - RNA, 19 nt, Homo sapiens
gagaguagcuucugugaug

SEQ ID NO: 404713 - RNA, 19 nt, Homo sapiens
gcacagagcucgaaaacua

SEQ ID NO: 404714 - RNA, 19 nt, Homo sapiens
ggaaagaacuaugugaaug

SEQ ID NO: 404715 - RNA, 19 nt, Homo sapiens
gcaagaauauacucaguca

SEQ ID NO: 404716 - RNA, 19 nt, Homo sapiens
ggacgaccauauuuauuuc

SEQ ID NO: 404717 - RNA, 19 nt, Homo sapiens
gcucaacaauacuaucuug

SEQ ID NO: 404718 - RNA, 19 nt, Homo sapiens
gacagaggauaacauagaa

SEQ ID NO: 404719 - RNA, 19 nt, Homo sapiens
gagcuuacuuugccuggaa

SEQ ID NO: 404720 - RNA, 19 nt, Homo sapiens
caaugaagcuggauuuagg

SEQ ID NO: 404721 - RNA, 19 nt, Homo sapiens
gggacgaccauauuuauuu

SEQ ID NO: 404722 - RNA, 19 nt, Homo sapiens
gcauauagguuugguguac

SEQ ID NO: 404723 - RNA, 19 nt, Homo sapiens
gaaccaauuaccaagcaua

SEQ ID NO: 404724 - RNA, 19 nt, Homo sapiens
guaaacuuguccagauuga

SEQ ID NO: 404725 - RNA, 19 nt, Homo sapiens
uaacauagaaguuggaauc

SEQ ID NO: 404726 - RNA, 19 nt, Homo sapiens
gguauuagcaacugagaaa

SEQ ID NO: 404727 - RNA, 19 nt, Homo sapiens
gaaguuggaaucugcaaug

SEQ ID NO: 404728 - RNA, 19 nt, Homo sapiens
caucuuaacccuaaaggaa

SEQ ID NO: 404729 - RNA, 19 nt, Homo sapiens
gaaagaacuaugugaaugg

SEQ ID NO: 404730 - RNA, 19 nt, Homo sapiens
gaauuaaagcugcaaaugg

SEQ ID NO: 404731 - RNA, 19 nt, Homo sapiens
ugacagaggauaacauaga

SEQ ID NO: 404732 - RNA, 19 nt, Homo sapiens
gaggauaacauagaaguug

SEQ ID NO: 404733 - RNA, 19 nt, Homo sapiens
uaaugaagaucuggaacuu

SEQ ID NO: 404734 - RNA, 19 nt, Homo sapiens
ggaauuaaagcugcaaaug

SEQ ID NO: 404735 - RNA, 19 nt, Homo sapiens
ugccauagcauaacaauga

SEQ ID NO: 404736 - RNA, 19 nt, Homo sapiens
ugagcgaaguguacacaaa

SEQ ID NO: 404737 - RNA, 19 nt, Homo sapiens
augaagaucuggaacuuga

SEQ ID NO: 404738 - RNA, 19 nt, Homo sapiens
cuacagcaaugggaaagaa

SEQ ID NO: 404739 - RNA, 19 nt, Homo sapiens
ugagggacgaccauauuua

SEQ ID NO: 404740 - RNA, 19 nt, Homo sapiens
gcauacuuauuucuacaug

SEQ ID NO: 404741 - RNA, 19 nt, Homo sapiens
gcauaacaaugaagugacu

SEQ ID NO: 404742 - RNA, 19 nt, Homo sapiens
guuggaaucugcaaugaag

SEQ ID NO: 404743 - RNA, 19 nt, Homo sapiens
gaagaugccauucauacag

SEQ ID NO: 404744 - RNA, 19 nt, Homo sapiens
gagggacgaccauauuuau

SEQ ID NO: 404745 - RNA, 19 nt, Homo sapiens
ccaauuaccaagcauauag

SEQ ID NO: 404746 - RNA, 19 nt, Homo sapiens
acacaaaguagaaccaauu

SEQ ID NO: 404747 - RNA, 19 nt, Homo sapiens
ugcaaauggugugguauua

SEQ ID NO: 404748 - RNA, 19 nt, Homo sapiens
gcaaugaagcuggauuuag

SEQ ID NO: 404749 - RNA, 19 nt, Homo sapiens
acagccaucuuaacccuaa

SEQ ID NO: 404750 - RNA, 19 nt, Homo sapiens
cuggaaagcuacagcaaug

SEQ ID NO: 404751 - RNA, 19 nt, Homo sapiens
ggaaugagggacgaccaua

SEQ ID NO: 404752 - RNA, 19 nt, Homo sapiens
aaaacuagcucaacaauac

SEQ ID NO: 404753 - RNA, 19 nt, Homo sapiens
uuaccaagcauauagguuu

SEQ ID NO: 404754 - RNA, 19 nt, Homo sapiens
cacaaaguagaaccaauua

SEQ ID NO: 404755 - RNA, 19 nt, Homo sapiens
ugguuuaaaucgacuguuu

SEQ ID NO: 404756 - RNA, 19 nt, Homo sapiens
gaaugagggacgaccauau

SEQ ID NO: 404757 - RNA, 19 nt, Homo sapiens
aauuaaagcugcaaauggu

SEQ ID NO: 404758 - RNA, 19 nt, Homo sapiens
gggaaagaacuaugugaau

SEQ ID NO: 404759 - RNA, 19 nt, Homo sapiens
gaaauccauucuguaugau

SEQ ID NO: 404760 - RNA, 19 nt, Homo sapiens
uagcuucugugaugcaaga

SEQ ID NO: 404761 - RNA, 19 nt, Homo sapiens
caaauggugugguauuagc

SEQ ID NO: 404762 - RNA, 19 nt, Homo sapiens
gaaaacuagcucaacaaua

SEQ ID NO: 404763 - RNA, 19 nt, Homo sapiens
gaaguguacacaaaguaga

SEQ ID NO: 404764 - RNA, 19 nt, Homo sapiens
aaugacagaggauaacaua

SEQ ID NO: 404765 - RNA, 19 nt, Homo sapiens
gcgaaguguacacaaagua

SEQ ID NO: 404766 - RNA, 19 nt, Homo sapiens
gggcaaaugacagaggaua

SEQ ID NO: 404767 - RNA, 19 nt, Homo sapiens
acaaugaagugacugaaaa

SEQ ID NO: 404768 - RNA, 19 nt, Homo sapiens
gccauagcauaacaaugaa

SEQ ID NO: 404769 - RNA, 19 nt, Homo sapiens
aauccauucuguaugauga

SEQ ID NO: 404770 - RNA, 19 nt, Homo sapiens
aaacuuguccagauugaau

SEQ ID NO: 404771 - RNA, 19 nt, Homo sapiens
gcaaugggaaagaacuaug

SEQ ID NO: 404772 - RNA, 19 nt, Homo sapiens
aauacuaucuuguguacca

SEQ ID NO: 404773 - RNA, 19 nt, Homo sapiens
gcaaauggugugguauuag

SEQ ID NO: 404774 - RNA, 19 nt, Homo sapiens
gaggcuuacuccaacugaa

SEQ ID NO: 404775 - RNA, 19 nt, Homo sapiens
ggcaaaugacagaggauaa

SEQ ID NO: 404776 - RNA, 19 nt, Homo sapiens
gguaaacuuguccagauug

SEQ ID NO: 404777 - RNA, 19 nt, Homo sapiens
gaagaucuggaacuugaag

SEQ ID NO: 404778 - RNA, 19 nt, Homo sapiens
uagaaccaauuaccaagca

SEQ ID NO: 404779 - RNA, 19 nt, Homo sapiens
ugguaaacuuguccagauu

SEQ ID NO: 404780 - RNA, 19 nt, Homo sapiens
acauucagcccgucuggua

SEQ ID NO: 404781 - RNA, 19 nt, Homo sapiens
gcuuuucgcugacuacauu

SEQ ID NO: 404782 - RNA, 19 nt, Homo sapiens
gagcgaaguguacacaaag

SEQ ID NO: 404783 - RNA, 19 nt, Homo sapiens
uagcauaacaaugaaguga

SEQ ID NO: 404784 - RNA, 19 nt, Homo sapiens
gcaaaugacagaggauaac

SEQ ID NO: 404785 - RNA, 19 nt, Homo sapiens
ggaacuugaagaugccauu

SEQ ID NO: 404786 - RNA, 19 nt, Homo sapiens
cagcccgucugguaaacuu

SEQ ID NO: 404787 - RNA, 19 nt, Homo sapiens
ccaagaacccauuccuaca

SEQ ID NO: 404788 - RNA, 19 nt, Homo sapiens
uaccaagcauauagguuug

SEQ ID NO: 404789 - RNA, 19 nt, Homo sapiens
gaacuugaagaugccauuc

SEQ ID NO: 404790 - RNA, 19 nt, Homo sapiens
ccagauugaauaugcuuug

SEQ ID NO: 404791 - RNA, 19 nt, Homo sapiens
aaugagggacgaccauauu

SEQ ID NO: 404792 - RNA, 19 nt, Homo sapiens
ggauuuaggaggcuuacuc

SEQ ID NO: 404793 - RNA, 19 nt, Homo sapiens
caagaacccauuccuacag

SEQ ID NO: 404794 - RNA, 19 nt, Homo sapiens
gauaacauagaaguuggaa

SEQ ID NO: 404795 - RNA, 19 nt, Homo sapiens
uuacuuauuugugguugga

SEQ ID NO: 404796 - RNA, 19 nt, Homo sapiens
caaaguagaaccaauuacc

SEQ ID NO: 404797 - RNA, 19 nt, Homo sapiens
guacacaaaguagaaccaa

SEQ ID NO: 404798 - RNA, 19 nt, Homo sapiens
caaaugacagaggauaaca

SEQ ID NO: 404799 - RNA, 19 nt, Homo sapiens
caaugggaaagaacuaugu

SEQ ID NO: 404800 - RNA, 19 nt, Homo sapiens
cagcaaugggaaagaacua

SEQ ID NO: 404801 - RNA, 19 nt, Homo sapiens
cgaaguguacacaaaguag

SEQ ID NO: 404802 - RNA, 19 nt, Homo sapiens
uaccaagaacccauuccua

SEQ ID NO: 404803 - RNA, 19 nt, Homo sapiens
ggauaacauagaaguugga

SEQ ID NO: 404804 - RNA, 19 nt, Homo sapiens
cagaggauaacauagaagu

SEQ ID NO: 404805 - RNA, 19 nt, Homo sapiens
ggugugguauuagcaacug

SEQ ID NO: 404806 - RNA, 19 nt, Homo sapiens
cgaccauauuuauuucagu

SEQ ID NO: 404807 - RNA, 19 nt, Homo sapiens
uaacaaugaagugacugaa

SEQ ID NO: 404808 - RNA, 19 nt, Homo sapiens
gggaauuaaagcugcaaau

SEQ ID NO: 404809 - RNA, 19 nt, Homo sapiens
ucagucaggugguguucgu

SEQ ID NO: 404810 - RNA, 19 nt, Homo sapiens
cauauagguuugguguaca

SEQ ID NO: 404811 - RNA, 19 nt, Homo sapiens
ugggaaagaacuaugugaa

SEQ ID NO: 404812 - RNA, 19 nt, Homo sapiens
gaaaugaccugccgugaua

SEQ ID NO: 404813 - RNA, 19 nt, Homo sapiens
ggaagaagaugaaucagau

SEQ ID NO: 404814 - RNA, 19 nt, Homo sapiens
ggaaucagaugcaaagaug

SEQ ID NO: 404815 - RNA, 19 nt, Homo sapiens
ugaagaagguuccaacaaa

SEQ ID NO: 404816 - RNA, 19 nt, Homo sapiens
gagaagaagcagagaaaua

SEQ ID NO: 404817 - RNA, 19 nt, Homo sapiens
cagcuggguuggugaauua

SEQ ID NO: 404818 - RNA, 19 nt, Homo sapiens
gaaggaagaagaugaauca

SEQ ID NO: 404819 - RNA, 19 nt, Homo sapiens
gacaugaaauuguuccaaa

SEQ ID NO: 404820 - RNA, 19 nt, Homo sapiens
gcgcaacucuacaugauug

SEQ ID NO: 404821 - RNA, 19 nt, Homo sapiens
cauaguacaugacgaaguu

SEQ ID NO: 404822 - RNA, 19 nt, Homo sapiens
ggcagaugcucguucuuua

SEQ ID NO: 404823 - RNA, 19 nt, Homo sapiens
uaaggaaucucugaaggaa

SEQ ID NO: 404824 - RNA, 19 nt, Homo sapiens
gaagaagguuccaacaaaa

SEQ ID NO: 404825 - RNA, 19 nt, Homo sapiens
gcuacaacauuccacuaaa

SEQ ID NO: 404826 - RNA, 19 nt, Homo sapiens
uggcugcaguuucauguua

SEQ ID NO: 404827 - RNA, 19 nt, Homo sapiens
caacuucagaucuaacuuu

SEQ ID NO: 404828 - RNA, 19 nt, Homo sapiens
gaauggcaguagcagguuu

SEQ ID NO: 404829 - RNA, 19 nt, Homo sapiens
uggaagacaugaaauuguu

SEQ ID NO: 404830 - RNA, 19 nt, Homo sapiens
gcaaagacggaaauagaga

SEQ ID NO: 404831 - RNA, 19 nt, Homo sapiens
agacauagcaagagaagaa

SEQ ID NO: 404832 - RNA, 19 nt, Homo sapiens
gccgugauaucguuaaaga

SEQ ID NO: 404833 - RNA, 19 nt, Homo sapiens
caaguugaauaugcuauga

SEQ ID NO: 404834 - RNA, 19 nt, Homo sapiens
gaucuaacuuuggcuacaa

SEQ ID NO: 404835 - RNA, 19 nt, Homo sapiens
ggucuuacagugugaauga

SEQ ID NO: 404836 - RNA, 19 nt, Homo sapiens
cuacuccaguccaauguaa

SEQ ID NO: 404837 - RNA, 19 nt, Homo sapiens
gaaaauaguaguacagcua

SEQ ID NO: 404838 - RNA, 19 nt, Homo sapiens
uagcagacauagcaagaga

SEQ ID NO: 404839 - RNA, 19 nt, Homo sapiens
uccagcaucuauuguauuu

SEQ ID NO: 404840 - RNA, 19 nt, Homo sapiens
ugacgaaguuaaggauaaa

SEQ ID NO: 404841 - RNA, 19 nt, Homo sapiens
uaacuuuggcuacaacauu

SEQ ID NO: 404842 - RNA, 19 nt, Homo sapiens
agaagaagcagagaaauau

SEQ ID NO: 404843 - RNA, 19 nt, Homo sapiens
ggcaguagcagguuuguug

SEQ ID NO: 404844 - RNA, 19 nt, Homo sapiens
aggaaucucugaaggaaga

SEQ ID NO: 404845 - RNA, 19 nt, Homo sapiens
gaccugccgugauaucguu

SEQ ID NO: 404846 - RNA, 19 nt, Homo sapiens
gaaauagagaagcuucaga

SEQ ID NO: 404847 - RNA, 19 nt, Homo sapiens
ccaguccaauguaacuauu

SEQ ID NO: 404848 - RNA, 19 nt, Homo sapiens
cagacagaguggccaugua

SEQ ID NO: 404849 - RNA, 19 nt, Homo sapiens
caaagacggaaauagagaa

SEQ ID NO: 404850 - RNA, 19 nt, Homo sapiens
gugcgcaacucuacaugau

SEQ ID NO: 404851 - RNA, 19 nt, Homo sapiens
gcuuccaacuucagaucua

SEQ ID NO: 404852 - RNA, 19 nt, Homo sapiens
gaagaagaugaaucagaug

SEQ ID NO: 404853 - RNA, 19 nt, Homo sapiens
gcagaugcucguucuuuag

SEQ ID NO: 404854 - RNA, 19 nt, Homo sapiens
uuacauaguacaugacgaa

SEQ ID NO: 404855 - RNA, 19 nt, Homo sapiens
cugcaaagacggaaauaga

SEQ ID NO: 404856 - RNA, 19 nt, Homo sapiens
uaguacagcuauuggaauc

SEQ ID NO: 404857 - RNA, 19 nt, Homo sapiens
aagagaagaagcagagaaa

SEQ ID NO: 404858 - RNA, 19 nt, Homo sapiens
augacgaaguuaaggauaa

SEQ ID NO: 404859 - RNA, 19 nt, Homo sapiens
auagagaagcuucagauga

SEQ ID NO: 404860 - RNA, 19 nt, Homo sapiens
agacagaguggccauguau

SEQ ID NO: 404861 - RNA, 19 nt, Homo sapiens
acgcgucccuuuggguuua

SEQ ID NO: 404862 - RNA, 19 nt, Homo sapiens
uaagagaagaagcagagaa

SEQ ID NO: 404863 - RNA, 19 nt, Homo sapiens
gaaugacggugcgcaacuc

SEQ ID NO: 404864 - RNA, 19 nt, Homo sapiens
gcaugcauauacacucuac

SEQ ID NO: 404865 - RNA, 19 nt, Homo sapiens
cuacaacauuccacuaaaa

SEQ ID NO: 404866 - RNA, 19 nt, Homo sapiens
gcagacauagcaagagaag

SEQ ID NO: 404867 - RNA, 19 nt, Homo sapiens
gcagguuuguuggcagaug

SEQ ID NO: 404868 - RNA, 19 nt, Homo sapiens
guacagcuauuggaaucag

SEQ ID NO: 404869 - RNA, 19 nt, Homo sapiens
uaacuaauggaagacauga

SEQ ID NO: 404870 - RNA, 19 nt, Homo sapiens
ggcuacaacauuccacuaa

SEQ ID NO: 404871 - RNA, 19 nt, Homo sapiens
ucagcuggguuggugaauu

SEQ ID NO: 404872 - RNA, 19 nt, Homo sapiens
ggaagacaugaaauuguuc

SEQ ID NO: 404873 - RNA, 19 nt, Homo sapiens
aaauagagaagcuucagau

SEQ ID NO: 404874 - RNA, 19 nt, Homo sapiens
gugcaugcauauacacucu

SEQ ID NO: 404875 - RNA, 19 nt, Homo sapiens
aagaagaugaaucagauga

SEQ ID NO: 404876 - RNA, 19 nt, Homo sapiens
acuaauggaagacaugaaa

SEQ ID NO: 404877 - RNA, 19 nt, Homo sapiens
augcaaagaugguguuguc

SEQ ID NO: 404878 - RNA, 19 nt, Homo sapiens
gcagacagaguggccaugu

SEQ ID NO: 404879 - RNA, 19 nt, Homo sapiens
guaguacagcuauuggaau

SEQ ID NO: 404880 - RNA, 19 nt, Homo sapiens
gugauaucguuaaagaagu

SEQ ID NO: 404881 - RNA, 19 nt, Homo sapiens
uggcagaugcucguucuuu

SEQ ID NO: 404882 - RNA, 19 nt, Homo sapiens
cgugauaucguuaaagaag

SEQ ID NO: 404883 - RNA, 19 nt, Homo sapiens
ccugucagccucuacauuc

SEQ ID NO: 404884 - RNA, 19 nt, Homo sapiens
agacggaaauagagaagcu

SEQ ID NO: 404885 - RNA, 19 nt, Homo sapiens
cccaucagguguuucauac

SEQ ID NO: 404886 - RNA, 19 nt, Homo sapiens
ggaauggcaguagcagguu

SEQ ID NO: 404887 - RNA, 19 nt, Homo sapiens
uaauguugaucggcauguu

SEQ ID NO: 404888 - RNA, 19 nt, Homo sapiens
caugacgaaguuaaggaua

SEQ ID NO: 404889 - RNA, 19 nt, Homo sapiens
agaaaugaccugccgugau

SEQ ID NO: 404890 - RNA, 19 nt, Homo sapiens
ggaaauagagaagcuucag

SEQ ID NO: 404891 - RNA, 19 nt, Homo sapiens
ugaaggcuguggaaaauag

SEQ ID NO: 404892 - RNA, 19 nt, Homo sapiens
acuauuuagcccuggauua

SEQ ID NO: 404893 - RNA, 19 nt, Homo sapiens
acuccagcaucuauuguau

SEQ ID NO: 404894 - RNA, 19 nt, Homo sapiens
acagaguggccauguaugu

SEQ ID NO: 404895 - RNA, 19 nt, Homo sapiens
cuuccaacuucagaucuaa

SEQ ID NO: 404896 - RNA, 19 nt, Homo sapiens
uaugaaggcuguggaaaau

SEQ ID NO: 404897 - RNA, 19 nt, Homo sapiens
gcuaugaaggcuguggaaa

SEQ ID NO: 404898 - RNA, 19 nt, Homo sapiens
aauggaagacaugaaauug

SEQ ID NO: 404899 - RNA, 19 nt, Homo sapiens
cauguuagggucuuacagu

SEQ ID NO: 404900 - RNA, 19 nt, Homo sapiens
aacuucagaucuaacuuug

SEQ ID NO: 404901 - RNA, 19 nt, Homo sapiens
aggaagaagaugaaucaga

SEQ ID NO: 404902 - RNA, 19 nt, Homo sapiens
gcuauuggaaucagaugca

SEQ ID NO: 404903 - RNA, 19 nt, Homo sapiens
guacaugacgaaguuaagg

SEQ ID NO: 404904 - RNA, 19 nt, Homo sapiens
ggugcgcaacucuacauga

SEQ ID NO: 404905 - RNA, 19 nt, Homo sapiens
ugaucggcauguuggaaug

SEQ ID NO: 404906 - RNA, 19 nt, Homo sapiens
aacuuuggcuacaacauuc

SEQ ID NO: 404907 - RNA, 19 nt, Homo sapiens
guuggcagaugcucguucu

SEQ ID NO: 404908 - RNA, 19 nt, Homo sapiens
ugaaggaagaagaugaauc

SEQ ID NO: 404909 - RNA, 19 nt, Homo sapiens
gguguuucauacgguuauu

SEQ ID NO: 404910 - RNA, 19 nt, Homo sapiens
ugacccaucagguguuuca

SEQ ID NO: 404911 - RNA, 19 nt, Homo sapiens
gaaaugaccugccgugaua

SEQ ID NO: 404912 - RNA, 19 nt, Homo sapiens
ggaagaagaugaaucagau

SEQ ID NO: 404913 - RNA, 19 nt, Homo sapiens
ggaaucagaugcaaagaug

SEQ ID NO: 404914 - RNA, 19 nt, Homo sapiens
ugaagaagguuccaacaaa

SEQ ID NO: 404915 - RNA, 19 nt, Homo sapiens
gagaagaagcagagaaaua

SEQ ID NO: 404916 - RNA, 19 nt, Homo sapiens
cagcuggguuggugaauua

SEQ ID NO: 404917 - RNA, 19 nt, Homo sapiens
gaaggaagaagaugaauca

SEQ ID NO: 404918 - RNA, 19 nt, Homo sapiens
gacaugaaauuguuccaaa

SEQ ID NO: 404919 - RNA, 19 nt, Homo sapiens
gcgcaacucuacaugauug

SEQ ID NO: 404920 - RNA, 19 nt, Homo sapiens
cauaguacaugacgaaguu

SEQ ID NO: 404921 - RNA, 19 nt, Homo sapiens
ggcagaugcucguucuuua

SEQ ID NO: 404922 - RNA, 19 nt, Homo sapiens
uaaggaaucucugaaggaa

SEQ ID NO: 404923 - RNA, 19 nt, Homo sapiens
gaagaagguuccaacaaaa

SEQ ID NO: 404924 - RNA, 19 nt, Homo sapiens
gcuacaacauuccacuaaa

SEQ ID NO: 404925 - RNA, 19 nt, Homo sapiens
caacuucagaucuaacuuu

SEQ ID NO: 404926 - RNA, 19 nt, Homo sapiens
gaauggcaguagcagguuu

SEQ ID NO: 404927 - RNA, 19 nt, Homo sapiens
uggaagacaugaaauuguu

SEQ ID NO: 404928 - RNA, 19 nt, Homo sapiens
gcaaagacggaaauagaga

SEQ ID NO: 404929 - RNA, 19 nt, Homo sapiens
agacauagcaagagaagaa

SEQ ID NO: 404930 - RNA, 19 nt, Homo sapiens
gccgugauaucguuaaaga

SEQ ID NO: 404931 - RNA, 19 nt, Homo sapiens
caaguugaauaugcuauga

SEQ ID NO: 404932 - RNA, 19 nt, Homo sapiens
gaucuaacuuuggcuacaa

SEQ ID NO: 404933 - RNA, 19 nt, Homo sapiens
cuacuccaguccaauguaa

SEQ ID NO: 404934 - RNA, 19 nt, Homo sapiens
gaaaauaguaguacagcua

SEQ ID NO: 404935 - RNA, 19 nt, Homo sapiens
uagcagacauagcaagaga

SEQ ID NO: 404936 - RNA, 19 nt, Homo sapiens
uccagcaucuauuguauuu

SEQ ID NO: 404937 - RNA, 19 nt, Homo sapiens
ugacgaaguuaaggauaaa

SEQ ID NO: 404938 - RNA, 19 nt, Homo sapiens
uaacuuuggcuacaacauu

SEQ ID NO: 404939 - RNA, 19 nt, Homo sapiens
agaagaagcagagaaauau

SEQ ID NO: 404940 - RNA, 19 nt, Homo sapiens
ggcaguagcagguuuguug

SEQ ID NO: 404941 - RNA, 19 nt, Homo sapiens
aggaaucucugaaggaaga

SEQ ID NO: 404942 - RNA, 19 nt, Homo sapiens
gaccugccgugauaucguu

SEQ ID NO: 404943 - RNA, 19 nt, Homo sapiens
gaaauagagaagcuucaga

SEQ ID NO: 404944 - RNA, 19 nt, Homo sapiens
ccaguccaauguaacuauu

SEQ ID NO: 404945 - RNA, 19 nt, Homo sapiens
cagacagaguggccaugua

SEQ ID NO: 404946 - RNA, 19 nt, Homo sapiens
caaagacggaaauagagaa

SEQ ID NO: 404947 - RNA, 19 nt, Homo sapiens
gugcgcaacucuacaugau

SEQ ID NO: 404948 - RNA, 19 nt, Homo sapiens
gcuuccaacuucagaucua

SEQ ID NO: 404949 - RNA, 19 nt, Homo sapiens
gaagaagaugaaucagaug

SEQ ID NO: 404950 - RNA, 19 nt, Homo sapiens
gcagaugcucguucuuuag

SEQ ID NO: 404951 - RNA, 19 nt, Homo sapiens
uuacauaguacaugacgaa

SEQ ID NO: 404952 - RNA, 19 nt, Homo sapiens
cugcaaagacggaaauaga

SEQ ID NO: 404953 - RNA, 19 nt, Homo sapiens
uaguacagcuauuggaauc

SEQ ID NO: 404954 - RNA, 19 nt, Homo sapiens
aagagaagaagcagagaaa

SEQ ID NO: 404955 - RNA, 19 nt, Homo sapiens
augacgaaguuaaggauaa

SEQ ID NO: 404956 - RNA, 19 nt, Homo sapiens
auagagaagcuucagauga

SEQ ID NO: 404957 - RNA, 19 nt, Homo sapiens
agacagaguggccauguau

SEQ ID NO: 404958 - RNA, 19 nt, Homo sapiens
acgcgucccuuuggguuua

SEQ ID NO: 404959 - RNA, 19 nt, Homo sapiens
uaagagaagaagcagagaa

SEQ ID NO: 404960 - RNA, 19 nt, Homo sapiens
gaaugacggugcgcaacuc

SEQ ID NO: 404961 - RNA, 19 nt, Homo sapiens
gcaugcauauacacucuac

SEQ ID NO: 404962 - RNA, 19 nt, Homo sapiens
cuacaacauuccacuaaaa

SEQ ID NO: 404963 - RNA, 19 nt, Homo sapiens
gcagacauagcaagagaag

SEQ ID NO: 404964 - RNA, 19 nt, Homo sapiens
gcagguuuguuggcagaug

SEQ ID NO: 404965 - RNA, 19 nt, Homo sapiens
uaacuaauggaagacauga

SEQ ID NO: 404966 - RNA, 19 nt, Homo sapiens
guacagcuauuggaaucag

SEQ ID NO: 404967 - RNA, 19 nt, Homo sapiens
ggcuacaacauuccacuaa

SEQ ID NO: 404968 - RNA, 19 nt, Homo sapiens
ucagcuggguuggugaauu

SEQ ID NO: 404969 - RNA, 19 nt, Homo sapiens
ggaagacaugaaauuguuc

SEQ ID NO: 404970 - RNA, 19 nt, Homo sapiens
aaauagagaagcuucagau

SEQ ID NO: 404971 - RNA, 19 nt, Homo sapiens
gugcaugcauauacacucu

SEQ ID NO: 404972 - RNA, 19 nt, Homo sapiens
aagaagaugaaucagauga

SEQ ID NO: 404973 - RNA, 19 nt, Homo sapiens
acuaauggaagacaugaaa

SEQ ID NO: 404974 - RNA, 19 nt, Homo sapiens
gcagacagaguggccaugu

SEQ ID NO: 404975 - RNA, 19 nt, Homo sapiens
augcaaagaugguguuguc

SEQ ID NO: 404976 - RNA, 19 nt, Homo sapiens
gugauaucguuaaagaagu

SEQ ID NO: 404977 - RNA, 19 nt, Homo sapiens
guaguacagcuauuggaau

SEQ ID NO: 404978 - RNA, 19 nt, Homo sapiens
uggcagaugcucguucuuu

SEQ ID NO: 404979 - RNA, 19 nt, Homo sapiens
cgugauaucguuaaagaag

SEQ ID NO: 404980 - RNA, 19 nt, Homo sapiens
ccugucagccucuacauuc

SEQ ID NO: 404981 - RNA, 19 nt, Homo sapiens
agacggaaauagagaagcu

SEQ ID NO: 404982 - RNA, 19 nt, Homo sapiens
cccaucagguguuucauac

SEQ ID NO: 404983 - RNA, 19 nt, Homo sapiens
ggaauggcaguagcagguu

SEQ ID NO: 404984 - RNA, 19 nt, Homo sapiens
uaauguugaucggcauguu

SEQ ID NO: 404985 - RNA, 19 nt, Homo sapiens
caugacgaaguuaaggaua

SEQ ID NO: 404986 - RNA, 19 nt, Homo sapiens
agaaaugaccugccgugau

SEQ ID NO: 404987 - RNA, 19 nt, Homo sapiens
ggaaauagagaagcuucag

SEQ ID NO: 404988 - RNA, 19 nt, Homo sapiens
ugaaggcuguggaaaauag

SEQ ID NO: 404989 - RNA, 19 nt, Homo sapiens
acuauuuagcccuggauua

SEQ ID NO: 404990 - RNA, 19 nt, Homo sapiens
acuccagcaucuauuguau

SEQ ID NO: 404991 - RNA, 19 nt, Homo sapiens
acagaguggccauguaugu

SEQ ID NO: 404992 - RNA, 19 nt, Homo sapiens
cuuccaacuucagaucuaa

SEQ ID NO: 404993 - RNA, 19 nt, Homo sapiens
gcuaugaaggcuguggaaa

SEQ ID NO: 404994 - RNA, 19 nt, Homo sapiens
aauggaagacaugaaauug

SEQ ID NO: 404995 - RNA, 19 nt, Homo sapiens
uaugaaggcuguggaaaau

SEQ ID NO: 404996 - RNA, 19 nt, Homo sapiens
aacuucagaucuaacuuug

SEQ ID NO: 404997 - RNA, 19 nt, Homo sapiens
aggaagaagaugaaucaga

SEQ ID NO: 404998 - RNA, 19 nt, Homo sapiens
gcuauuggaaucagaugca

SEQ ID NO: 404999 - RNA, 19 nt, Homo sapiens
guacaugacgaaguuaagg

SEQ ID NO: 405000 - RNA, 19 nt, Homo sapiens
ggugcgcaacucuacauga

SEQ ID NO: 405001 - RNA, 19 nt, Homo sapiens
aacuuuggcuacaacauuc

SEQ ID NO: 405002 - RNA, 19 nt, Homo sapiens
guuggcagaugcucguucu

SEQ ID NO: 405003 - RNA, 19 nt, Homo sapiens
ugaucggcauguuggaaug

SEQ ID NO: 405004 - RNA, 19 nt, Homo sapiens
ugaaggaagaagaugaauc

SEQ ID NO: 405005 - RNA, 19 nt, Homo sapiens
gguguuucauacgguuauu

SEQ ID NO: 405006 - RNA, 19 nt, Homo sapiens
ugacccaucagguguuuca

SEQ ID NO: 405007 - RNA, 19 nt, Homo sapiens
caaacaagcuuauacacaa

SEQ ID NO: 405008 - RNA, 19 nt, Homo sapiens
aaacaugucucgaagauau

SEQ ID NO: 405009 - RNA, 19 nt, Homo sapiens
ccacaugcauuggaaauaa

SEQ ID NO: 405010 - RNA, 19 nt, Homo sapiens
gaccauggauguuaguaaa

SEQ ID NO: 405011 - RNA, 19 nt, Homo sapiens
gacauuacauacugaauug

SEQ ID NO: 405012 - RNA, 19 nt, Homo sapiens
ggugagcgguggugguuua

SEQ ID NO: 405013 - RNA, 19 nt, Homo sapiens
gcucauugcucaaagguau

SEQ ID NO: 405014 - RNA, 19 nt, Homo sapiens
gcucaaagguauuuauuac

SEQ ID NO: 405015 - RNA, 19 nt, Homo sapiens
cuaauguucugacuaauga

SEQ ID NO: 405016 - RNA, 19 nt, Homo sapiens
ggacauuacauacugaauu

SEQ ID NO: 405017 - RNA, 19 nt, Homo sapiens
gaaagacaguaaucagagu

SEQ ID NO: 405018 - RNA, 19 nt, Homo sapiens
uaaauaagaccauggaugu

SEQ ID NO: 405019 - RNA, 19 nt, Homo sapiens
gagcgguggugguuuauuc

SEQ ID NO: 405020 - RNA, 19 nt, Homo sapiens
aaucagaguucucaaacaa

SEQ ID NO: 405021 - RNA, 19 nt, Homo sapiens
gagaauggaaagacaguaa

SEQ ID NO: 405022 - RNA, 19 nt, Homo sapiens
gaaauugcaacacuaacaa

SEQ ID NO: 405023 - RNA, 19 nt, Homo sapiens
gaaaacaugucucgaagau

SEQ ID NO: 405024 - RNA, 19 nt, Homo sapiens
ugucauuucuguccaauug

SEQ ID NO: 405025 - RNA, 19 nt, Homo sapiens
gggcaccauuucaguguaa

SEQ ID NO: 405026 - RNA, 19 nt, Homo sapiens
gcacuugcuuuagcuauca

SEQ ID NO: 405027 - RNA, 19 nt, Homo sapiens
ggaaauugcaacacuaaca

SEQ ID NO: 405028 - RNA, 19 nt, Homo sapiens
aauaagaccauggauguua

SEQ ID NO: 405029 - RNA, 19 nt, Homo sapiens
gcuuauaccaaguugaaua

SEQ ID NO: 405030 - RNA, 19 nt, Homo sapiens
gaauuggguccuugucauu

SEQ ID NO: 405031 - RNA, 19 nt, Homo sapiens
gaacagaaagaaaaggaua

SEQ ID NO: 405032 - RNA, 19 nt, Homo sapiens
guccuacucuuccacacua

SEQ ID NO: 405033 - RNA, 19 nt, Homo sapiens
uaacaagagagaauggaaa

SEQ ID NO: 405034 - RNA, 19 nt, Homo sapiens
augcuaauguucugacuaa

SEQ ID NO: 405035 - RNA, 19 nt, Homo sapiens
ggagaaaugaccuugaagu

SEQ ID NO: 405036 - RNA, 19 nt, Homo sapiens
aauaggacauuacauacug

SEQ ID NO: 405037 - RNA, 19 nt, Homo sapiens
cauauuagcagcgguuauu

SEQ ID NO: 405038 - RNA, 19 nt, Homo sapiens
gcuaauguucugacuaaug

SEQ ID NO: 405039 - RNA, 19 nt, Homo sapiens
gaauaugccauggaagcua

SEQ ID NO: 405040 - RNA, 19 nt, Homo sapiens
ggauaaauagaaucagaga

SEQ ID NO: 405041 - RNA, 19 nt, Homo sapiens
cauggaagcuauuggacau

SEQ ID NO: 405042 - RNA, 19 nt, Homo sapiens
aagcugagcgugagaagaa

SEQ ID NO: 405043 - RNA, 19 nt, Homo sapiens
ggaagaagaagccaaagcu

SEQ ID NO: 405044 - RNA, 19 nt, Homo sapiens
aguaaacucucugcugaaa

SEQ ID NO: 405045 - RNA, 19 nt, Homo sapiens
gagaaaugaccuugaaguc

SEQ ID NO: 405046 - RNA, 19 nt, Homo sapiens
acaagacuauaaagaagga

SEQ ID NO: 405047 - RNA, 19 nt, Homo sapiens
gaaguggagcaguugauca

SEQ ID NO: 405048 - RNA, 19 nt, Homo sapiens
cuauaaagaaggagaaaug

SEQ ID NO: 405049 - RNA, 19 nt, Homo sapiens
uaacuucugaugcuaaugu

SEQ ID NO: 405050 - RNA, 19 nt, Homo sapiens
cauaacuucugaugcuaau

SEQ ID NO: 405051 - RNA, 19 nt, Homo sapiens
ucauuucuguccaauugaa

SEQ ID NO: 405052 - RNA, 19 nt, Homo sapiens
gagugacccuaguggaaau

SEQ ID NO: 405053 - RNA, 19 nt, Homo sapiens
ucauggacgucuuaaucuu

SEQ ID NO: 405054 - RNA, 19 nt, Homo sapiens
gaauggaaagacaguaauc

SEQ ID NO: 405055 - RNA, 19 nt, Homo sapiens
ucaaacaagcuuauacaca

SEQ ID NO: 405056 - RNA, 19 nt, Homo sapiens
gcugugugauaucaaacaa

SEQ ID NO: 405057 - RNA, 19 nt, Homo sapiens
ugaauuggguccuugucau

SEQ ID NO: 405058 - RNA, 19 nt, Homo sapiens
gcaacacuaacaagagaga

SEQ ID NO: 405059 - RNA, 19 nt, Homo sapiens
uggcaggcauaacuucuga

SEQ ID NO: 405060 - RNA, 19 nt, Homo sapiens
guggacaucucaggucuuc

SEQ ID NO: 405061 - RNA, 19 nt, Homo sapiens
uaaucagaguucucaaaca

SEQ ID NO: 405062 - RNA, 19 nt, Homo sapiens
uccagaaggucgcuuauac

SEQ ID NO: 405063 - RNA, 19 nt, Homo sapiens
uugcaacacuaacaagaga

SEQ ID NO: 405064 - RNA, 19 nt, Homo sapiens
guggaaauugcaacacuaa

SEQ ID NO: 405065 - RNA, 19 nt, Homo sapiens
cagagugacccuaguggaa

SEQ ID NO: 405066 - RNA, 19 nt, Homo sapiens
aauaugccauggaagcuau

SEQ ID NO: 405067 - RNA, 19 nt, Homo sapiens
gaaggccacaugcauugga

SEQ ID NO: 405068 - RNA, 19 nt, Homo sapiens
ggacaucucaggucuucag

SEQ ID NO: 405069 - RNA, 19 nt, Homo sapiens
gcaggcauaacuucugaug

SEQ ID NO: 405070 - RNA, 19 nt, Homo sapiens
ucagaguucucaaacaaaa

SEQ ID NO: 405071 - RNA, 19 nt, Homo sapiens
cugcagcugugucaauguu

SEQ ID NO: 405072 - RNA, 19 nt, Homo sapiens
gagcgugagaagaaagaaa

SEQ ID NO: 405073 - RNA, 19 nt, Homo sapiens
gauggaaggccacaugcau

SEQ ID NO: 405074 - RNA, 19 nt, Homo sapiens
caucuggaacuauauaaag

SEQ ID NO: 405075 - RNA, 19 nt, Homo sapiens
uuucauugcuguacauugg

SEQ ID NO: 405076 - RNA, 19 nt, Homo sapiens
guaaucagaguucucaaac

SEQ ID NO: 405077 - RNA, 19 nt, Homo sapiens
aagagagaauggaaagaca

SEQ ID NO: 405078 - RNA, 19 nt, Homo sapiens
cacaugcauuggaaauaau

SEQ ID NO: 405079 - RNA, 19 nt, Homo sapiens
uggaaagacaguaaucaga

SEQ ID NO: 405080 - RNA, 19 nt, Homo sapiens
ucgcuuauaccaaguugaa

SEQ ID NO: 405081 - RNA, 19 nt, Homo sapiens
ggucgcuuauaccaaguug

SEQ ID NO: 405082 - RNA, 19 nt, Homo sapiens
auaagaccauggauguuag

SEQ ID NO: 405083 - RNA, 19 nt, Homo sapiens
ucccuuugguguuucauug

SEQ ID NO: 405084 - RNA, 19 nt, Homo sapiens
uauaccaaguugaauaugc

SEQ ID NO: 405085 - RNA, 19 nt, Homo sapiens
cuucauggacgucuuaauc

SEQ ID NO: 405086 - RNA, 19 nt, Homo sapiens
gaugguuacccuucaugga

SEQ ID NO: 405087 - RNA, 19 nt, Homo sapiens
cgaugaugguuacccuuca

SEQ ID NO: 405088 - RNA, 19 nt, Homo sapiens
acuaggaaggcuuuacuuu

SEQ ID NO: 405089 - RNA, 19 nt, Homo sapiens
uaaaagcaguccuacucuu

SEQ ID NO: 405090 - RNA, 19 nt, Homo sapiens
gagagaauggaaagacagu

SEQ ID NO: 405091 - RNA, 19 nt, Homo sapiens
caagagagaauggaaagac

SEQ ID NO: 405092 - RNA, 19 nt, Homo sapiens
ccauggauguuaguaaacu

SEQ ID NO: 405093 - RNA, 19 nt, Homo sapiens
auacacaauuuggaggaaa

SEQ ID NO: 405094 - RNA, 19 nt, Homo sapiens
gaugcuaauguucugacua

SEQ ID NO: 405095 - RNA, 19 nt, Homo sapiens
uggaaggccacaugcauug

SEQ ID NO: 405096 - RNA, 19 nt, Homo sapiens
ggaagcuauuggacaugca

SEQ ID NO: 405097 - RNA, 19 nt, Homo sapiens
ggauguuaguaaacucucu

SEQ ID NO: 405098 - RNA, 19 nt, Homo sapiens
gccacaugcauuggaaaua

SEQ ID NO: 405099 - RNA, 19 nt, Homo sapiens
uauacacaauuuggaggaa

SEQ ID NO: 405100 - RNA, 19 nt, Homo sapiens
ccaucuggaacuauauaaa

SEQ ID NO: 405101 - RNA, 19 nt, Homo sapiens
cuaacaagagagaauggaa

SEQ ID NO: 405102 - RNA, 19 nt, Homo sapiens
aguugaauaugccauggaa

SEQ ID NO: 405103 - RNA, 19 nt, Homo sapiens
gcgcugcagcugugucaau

SEQ ID NO: 405104 - RNA, 19 nt, Homo sapiens
agagugacccuaguggaaa

SEQ ID NO: 405105 - RNA, 19 nt, Homo sapiens
caacauccacaagcuucuu

SEQ ID NO: 405106 - RNA, 19 nt, Homo sapiens
uaucaggagccaauaccuu

SEQ ID NO: 405107 - RNA, 19 nt, Homo sapiens
uaaaggcaguucugaaaua

SEQ ID NO: 405108 - RNA, 19 nt, Homo sapiens
gaaggaagauuauuucaag

SEQ ID NO: 405109 - RNA, 19 nt, Homo sapiens
gaacuucucugggacaauu

SEQ ID NO: 405110 - RNA, 19 nt, Homo sapiens
ggaguagcauuauuauuug

SEQ ID NO: 405111 - RNA, 19 nt, Homo sapiens
ggaagaacuugaagagguu

SEQ ID NO: 405112 - RNA, 19 nt, Homo sapiens
gcaagaaguuuaccacaag

SEQ ID NO: 405113 - RNA, 19 nt, Homo sapiens
gaaagaagccaucaagucu

SEQ ID NO: 405114 - RNA, 19 nt, Homo sapiens
agagauugaugcucacaua

SEQ ID NO: 405115 - RNA, 19 nt, Homo sapiens
caucaagucuucacucauc

SEQ ID NO: 405116 - RNA, 19 nt, Homo sapiens
cauaaaggcaguucugaaa

SEQ ID NO: 405117 - RNA, 19 nt, Homo sapiens
aaaggcaguucugaaauaa

SEQ ID NO: 405118 - RNA, 19 nt, Homo sapiens
ucaaggacauuuaaggaau

SEQ ID NO: 405119 - RNA, 19 nt, Homo sapiens
caaucuggcuuugcaguuu

SEQ ID NO: 405120 - RNA, 19 nt, Homo sapiens
gcuaauugcugaugcuaag

SEQ ID NO: 405121 - RNA, 19 nt, Homo sapiens
gaaaaucuccauuguaugu

SEQ ID NO: 405122 - RNA, 19 nt, Homo sapiens
uggaggaguugaugagaaa

SEQ ID NO: 405123 - RNA, 19 nt, Homo sapiens
gggacaauuucaguucuaa

SEQ ID NO: 405124 - RNA, 19 nt, Homo sapiens
gcaauuggcucugcuucag

SEQ ID NO: 405125 - RNA, 19 nt, Homo sapiens
ggccagaauuuccacaugu

SEQ ID NO: 405126 - RNA, 19 nt, Homo sapiens
gaagcugaaugcaacaaac

SEQ ID NO: 405127 - RNA, 19 nt, Homo sapiens
ggaccuuuguacaguguga

SEQ ID NO: 405128 - RNA, 19 nt, Homo sapiens
gaaaggaccccagcuguuu

SEQ ID NO: 405129 - RNA, 19 nt, Homo sapiens
gaugcuaagacuuuaauug

SEQ ID NO: 405130 - RNA, 19 nt, Homo sapiens
caaggacauuuaaggaauc

SEQ ID NO: 405131 - RNA, 19 nt, Homo sapiens
gccagaauuuccacauguu

SEQ ID NO: 405132 - RNA, 19 nt, Homo sapiens
gaggagaagcugaaugcaa

SEQ ID NO: 405133 - RNA, 19 nt, Homo sapiens
ucacaaaggaagaacuuga

SEQ ID NO: 405134 - RNA, 19 nt, Homo sapiens
ugaaagaagccaucaaguc

SEQ ID NO: 405135 - RNA, 19 nt, Homo sapiens
gaaguuuaccacaagucua

SEQ ID NO: 405136 - RNA, 19 nt, Homo sapiens
ugccaugucucgucccuuu

SEQ ID NO: 405137 - RNA, 19 nt, Homo sapiens
gacccaagcuguguccaau

SEQ ID NO: 405138 - RNA, 19 nt, Homo sapiens
gauugaugcucacauaggu

SEQ ID NO: 405139 - RNA, 19 nt, Homo sapiens
gaagaacuugaagagguua

SEQ ID NO: 405140 - RNA, 19 nt, Homo sapiens
caaaggaagaacuugaaga

SEQ ID NO: 405141 - RNA, 19 nt, Homo sapiens
agaagaagaugcagaucca

SEQ ID NO: 405142 - RNA, 19 nt, Homo sapiens
caaugacaguggagagugu

SEQ ID NO: 405143 - RNA, 19 nt, Homo sapiens
gccaucaagucuucacuca

SEQ ID NO: 405144 - RNA, 19 nt, Homo sapiens
caaguggaauaugccauug

SEQ ID NO: 405145 - RNA, 19 nt, Homo sapiens
gagguuaucaaggacauuu

SEQ ID NO: 405146 - RNA, 19 nt, Homo sapiens
caagaaguuuaccacaagu

SEQ ID NO: 405147 - RNA, 19 nt, Homo sapiens
guacauaaaggcaguucug

SEQ ID NO: 405148 - RNA, 19 nt, Homo sapiens
cgaaggaagauuauuucaa

SEQ ID NO: 405149 - RNA, 19 nt, Homo sapiens
gcuguggagaagagaauua

SEQ ID NO: 405150 - RNA, 19 nt, Homo sapiens
gaacuugaagagguuauca

SEQ ID NO: 405151 - RNA, 19 nt, Homo sapiens
caucauccucaaacaagua

SEQ ID NO: 405152 - RNA, 19 nt, Homo sapiens
ugcaagaaguuuaccacaa

SEQ ID NO: 405153 - RNA, 19 nt, Homo sapiens
gguuaucaaggacauuuaa

SEQ ID NO: 405154 - RNA, 19 nt, Homo sapiens
ccagagcuccuugcaagaa

SEQ ID NO: 405155 - RNA, 19 nt, Homo sapiens
gagcccagcagcauugaga

SEQ ID NO: 405156 - RNA, 19 nt, Homo sapiens
uaucaaggacauuuaagga

SEQ ID NO: 405157 - RNA, 19 nt, Homo sapiens
ccauugggauccagacauc

SEQ ID NO: 405158 - RNA, 19 nt, Homo sapiens
aauaugccauugaggcuau

SEQ ID NO: 405159 - RNA, 19 nt, Homo sapiens
gccaugagugggcuaauug

SEQ ID NO: 405160 - RNA, 19 nt, Homo sapiens
ucaaguggaauaugccauu

SEQ ID NO: 405161 - RNA, 19 nt, Homo sapiens
acauugagcuagccacagu

SEQ ID NO: 405162 - RNA, 19 nt, Homo sapiens
aggcaguucugaaauaaag

SEQ ID NO: 405163 - RNA, 19 nt, Homo sapiens
gaccccagcuguuucauau

SEQ ID NO: 405164 - RNA, 19 nt, Homo sapiens
gcuccuugcaagaaguuua

SEQ ID NO: 405165 - RNA, 19 nt, Homo sapiens
gugccuagcuguggagaag

SEQ ID NO: 405166 - RNA, 19 nt, Homo sapiens
ugggacaauuucaguucua

SEQ ID NO: 405167 - RNA, 19 nt, Homo sapiens
cacaaaggaagaacuugaa

SEQ ID NO: 405168 - RNA, 19 nt, Homo sapiens
gaguagcauuauuauuugg

SEQ ID NO: 405169 - RNA, 19 nt, Homo sapiens
gcaguuuggagaagaagau

SEQ ID NO: 405170 - RNA, 19 nt, Homo sapiens
aaaggaagaacuugaagag

SEQ ID NO: 405171 - RNA, 19 nt, Homo sapiens
ccacauguucacaaaggaa

SEQ ID NO: 405172 - RNA, 19 nt, Homo sapiens
cuuuggaguagcauuauua

SEQ ID NO: 405173 - RNA, 19 nt, Homo sapiens
uugcugaugcuaagacuuu

SEQ ID NO: 405174 - RNA, 19 nt, Homo sapiens
uaucaagcuugguucuaca

SEQ ID NO: 405175 - RNA, 19 nt, Homo sapiens
acaaugagacaaugacagu

SEQ ID NO: 405176 - RNA, 19 nt, Homo sapiens
gauggagcccagcagcauu

SEQ ID NO: 405177 - RNA, 19 nt, Homo sapiens
guggagaagagaauuacuu

SEQ ID NO: 405178 - RNA, 19 nt, Homo sapiens
ggacaauuucaguucuaau

SEQ ID NO: 405179 - RNA, 19 nt, Homo sapiens
uaauggaggagaagcugaa

SEQ ID NO: 405180 - RNA, 19 nt, Homo sapiens
ucccgaaggaagauuauuu

SEQ ID NO: 405181 - RNA, 19 nt, Homo sapiens
aaucuggcuuugcaguuug

SEQ ID NO: 405182 - RNA, 19 nt, Homo sapiens
uguccaaucuggcuuugca

SEQ ID NO: 405183 - RNA, 19 nt, Homo sapiens
cccaagcuguguccaaucu

SEQ ID NO: 405184 - RNA, 19 nt, Homo sapiens
ugccaugagugggcuaauu

SEQ ID NO: 405185 - RNA, 19 nt, Homo sapiens
aacaaguaauggaggagaa

SEQ ID NO: 405186 - RNA, 19 nt, Homo sapiens
gaggcuaucaagcuugguu

SEQ ID NO: 405187 - RNA, 19 nt, Homo sapiens
cuaucaagcuugguucuac

SEQ ID NO: 405188 - RNA, 19 nt, Homo sapiens
gcuaucaagcuugguucua

SEQ ID NO: 405189 - RNA, 19 nt, Homo sapiens
gcccagcagcauugagaaa

SEQ ID NO: 405190 - RNA, 19 nt, Homo sapiens
agaauuacuuccccacuga

SEQ ID NO: 405191 - RNA, 19 nt, Homo sapiens
caccuacaaugagacaaug

SEQ ID NO: 405192 - RNA, 19 nt, Homo sapiens
gcugaugcuaagacuuuaa

SEQ ID NO: 405193 - RNA, 19 nt, Homo sapiens
gagauugaugcucacauag

SEQ ID NO: 405194 - RNA, 19 nt, Homo sapiens
gcuugguucuacagccauu

SEQ ID NO: 405195 - RNA, 19 nt, Homo sapiens
uuggaggaguugaugagaa

SEQ ID NO: 405196 - RNA, 19 nt, Homo sapiens
ccaaucuggcuuugcaguu

SEQ ID NO: 405197 - RNA, 19 nt, Homo sapiens
cauagguugugccaugagu

SEQ ID NO: 405198 - RNA, 19 nt, Homo sapiens
acauaaaggcaguucugaa

SEQ ID NO: 405199 - RNA, 19 nt, Homo sapiens
ucaccuacaaugagacaau

SEQ ID NO: 405200 - RNA, 19 nt, Homo sapiens
ccagaguggagacacagaa

SEQ ID NO: 405201 - RNA, 19 nt, Homo sapiens
cagaauuuccacauguuca

SEQ ID NO: 405202 - RNA, 19 nt, Homo sapiens
cagagcuccuugcaagaag

SEQ ID NO: 405203 - RNA, 19 nt, Homo sapiens
ucucgucccuuuggaguag

SEQ ID NO: 405204 - RNA, 19 nt, Homo sapiens
cuccuacccucgccauguu

SEQ ID NO: 405205 - RNA, 19 nt, Homo sapiens
uggccagaauuuccacaug

SEQ ID NO: 405206 - RNA, 19 nt, Homo sapiens
gagcuccuugcaagaaguu

SEQ ID NO: 405207 - RNA, 19 nt, Homo sapiens
gaaaguaccugacaaauua

SEQ ID NO: 405208 - RNA, 19 nt, Homo sapiens
gcaauuacaugccugucua

SEQ ID NO: 405209 - RNA, 19 nt, Homo sapiens
gaaaugaggccucuugguu

SEQ ID NO: 405210 - RNA, 19 nt, Homo sapiens
ggaggucccuggauugaaa

SEQ ID NO: 405211 - RNA, 19 nt, Homo sapiens
gcaaggcccucagguauau

SEQ ID NO: 405212 - RNA, 19 nt, Homo sapiens
gaagaaaguaccugacaaa

SEQ ID NO: 405213 - RNA, 19 nt, Homo sapiens
gcccagggauuguguuuaa

SEQ ID NO: 405214 - RNA, 19 nt, Homo sapiens
gguuaggacucuauauaaa

SEQ ID NO: 405215 - RNA, 19 nt, Homo sapiens
gcagcuaacuggaaauaca

SEQ ID NO: 405216 - RNA, 19 nt, Homo sapiens
gagagagacuaaacauugu

SEQ ID NO: 405217 - RNA, 19 nt, Homo sapiens
ccacuuaccuguguguuug

SEQ ID NO: 405218 - RNA, 19 nt, Homo sapiens
agaaauagaaguuggagua

SEQ ID NO: 405219 - RNA, 19 nt, Homo sapiens
aaacauugguugugugaug

SEQ ID NO: 405220 - RNA, 19 nt, Homo sapiens
gagcaaggcccucagguau

SEQ ID NO: 405221 - RNA, 19 nt, Homo sapiens
uuacaugccugucuacugu

SEQ ID NO: 405222 - RNA, 19 nt, Homo sapiens
agagagagacuaaacauug

SEQ ID NO: 405223 - RNA, 19 nt, Homo sapiens
gggauuguguuuaaaguag

SEQ ID NO: 405224 - RNA, 19 nt, Homo sapiens
ccucuugguuguuguauga

SEQ ID NO: 405225 - RNA, 19 nt, Homo sapiens
gauugaugcucaccuuguu

SEQ ID NO: 405226 - RNA, 19 nt, Homo sapiens
ugaggcagcuaacuggaaa

SEQ ID NO: 405227 - RNA, 19 nt, Homo sapiens
agaaaguaccugacaaauu

SEQ ID NO: 405228 - RNA, 19 nt, Homo sapiens
cuacuguucuaucaauuga

SEQ ID NO: 405229 - RNA, 19 nt, Homo sapiens
gaagaagaaauuugauugg

SEQ ID NO: 405230 - RNA, 19 nt, Homo sapiens
guaaaagaauugccgauau

SEQ ID NO: 405231 - RNA, 19 nt, Homo sapiens
guaauugucacacagaaga

SEQ ID NO: 405232 - RNA, 19 nt, Homo sapiens
agacuaaacauugucguua

SEQ ID NO: 405233 - RNA, 19 nt, Homo sapiens
aauagaaguuggaguagug

SEQ ID NO: 405234 - RNA, 19 nt, Homo sapiens
gugguuaggacucuauaua

SEQ ID NO: 405235 - RNA, 19 nt, Homo sapiens
ucauggaggucccuggauu

SEQ ID NO: 405236 - RNA, 19 nt, Homo sapiens
guacagagggcacgcuaug

SEQ ID NO: 405237 - RNA, 19 nt, Homo sapiens
ccugacaaauuauuggauu

SEQ ID NO: 405238 - RNA, 19 nt, Homo sapiens
caaguauggcuaugagauu

SEQ ID NO: 405239 - RNA, 19 nt, Homo sapiens
uaacaacaaaccaacauca

SEQ ID NO: 405240 - RNA, 19 nt, Homo sapiens
uaaccaggguggccuuaca

SEQ ID NO: 405241 - RNA, 19 nt, Homo sapiens
agaagaaaguaccugacaa

SEQ ID NO: 405242 - RNA, 19 nt, Homo sapiens
gcagcgggaguuaaacaaa

SEQ ID NO: 405243 - RNA, 19 nt, Homo sapiens
gcccucagguauauaagug

SEQ ID NO: 405244 - RNA, 19 nt, Homo sapiens
gaaauagaaguuggaguag

SEQ ID NO: 405245 - RNA, 19 nt, Homo sapiens
ucucaggucuacacacaga

SEQ ID NO: 405246 - RNA, 19 nt, Homo sapiens
gcaguaauugucacacaga

SEQ ID NO: 405247 - RNA, 19 nt, Homo sapiens
gaagugguuaggacucuau

SEQ ID NO: 405248 - RNA, 19 nt, Homo sapiens
ugguauagaugaagagcaa

SEQ ID NO: 405249 - RNA, 19 nt, Homo sapiens
uuacuacuguggguuuaaa

SEQ ID NO: 405250 - RNA, 19 nt, Homo sapiens
gcugaaaugaggccucuug

SEQ ID NO: 405251 - RNA, 19 nt, Homo sapiens
gagacuaaacauugucguu

SEQ ID NO: 405252 - RNA, 19 nt, Homo sapiens
gguuacuacuguggguuua

SEQ ID NO: 405253 - RNA, 19 nt, Homo sapiens
gaauugccgauauuucuca

SEQ ID NO: 405254 - RNA, 19 nt, Homo sapiens
gaccgccacauuaccauuu

SEQ ID NO: 405255 - RNA, 19 nt, Homo sapiens
agugugauccugcagguua

SEQ ID NO: 405256 - RNA, 19 nt, Homo sapiens
ugacagcagaucccaggua

SEQ ID NO: 405257 - RNA, 19 nt, Homo sapiens
agagauugaugcucaccuu

SEQ ID NO: 405258 - RNA, 19 nt, Homo sapiens
ugucuacuguucuaucaau

SEQ ID NO: 405259 - RNA, 19 nt, Homo sapiens
aguggaaacugcaauuaca

SEQ ID NO: 405260 - RNA, 19 nt, Homo sapiens
cacacagaaugcugaaaug

SEQ ID NO: 405261 - RNA, 19 nt, Homo sapiens
gaaaacauugguuguguga

SEQ ID NO: 405262 - RNA, 19 nt, Homo sapiens
ugacucacuuauucaagau

SEQ ID NO: 405263 - RNA, 19 nt, Homo sapiens
aaugaggccucuugguugu

SEQ ID NO: 405264 - RNA, 19 nt, Homo sapiens
acacacagaaugcugaaau

SEQ ID NO: 405265 - RNA, 19 nt, Homo sapiens
gacaugcuguguaaaagaa

SEQ ID NO: 405266 - RNA, 19 nt, Homo sapiens
ugagauuccuguggacaug

SEQ ID NO: 405267 - RNA, 19 nt, Homo sapiens
gauuguguuuaaaguagug

SEQ ID NO: 405268 - RNA, 19 nt, Homo sapiens
cuguggacaugcuguguaa

SEQ ID NO: 405269 - RNA, 19 nt, Homo sapiens
gcuaugaggcagcuaacug

SEQ ID NO: 405270 - RNA, 19 nt, Homo sapiens
ggauuguguuuaaaguagu

SEQ ID NO: 405271 - RNA, 19 nt, Homo sapiens
gugcaguaauugucacaca

SEQ ID NO: 405272 - RNA, 19 nt, Homo sapiens
ugguuaggacucuauauaa

SEQ ID NO: 405273 - RNA, 19 nt, Homo sapiens
ugaggccucuugguuguug

SEQ ID NO: 405274 - RNA, 19 nt, Homo sapiens
cuaacuggaaauacaagua

SEQ ID NO: 405275 - RNA, 19 nt, Homo sapiens
cagaagaaaguaccugaca

SEQ ID NO: 405276 - RNA, 19 nt, Homo sapiens
ccaaguagaauaugcuuuu

SEQ ID NO: 405277 - RNA, 19 nt, Homo sapiens
acaacaaaccaacaucaug

SEQ ID NO: 405278 - RNA, 19 nt, Homo sapiens
ggaguagugacaguugaaa

SEQ ID NO: 405279 - RNA, 19 nt, Homo sapiens
caaaccuucagaaauagaa

SEQ ID NO: 405280 - RNA, 19 nt, Homo sapiens
acacagaaugcugaaauga

SEQ ID NO: 405281 - RNA, 19 nt, Homo sapiens
caguaauugucacacagaa

SEQ ID NO: 405282 - RNA, 19 nt, Homo sapiens
gucguuaguuuaccagauc

SEQ ID NO: 405283 - RNA, 19 nt, Homo sapiens
cagagagagacuaaacauu

SEQ ID NO: 405284 - RNA, 19 nt, Homo sapiens
agagcaaggcccucaggua

SEQ ID NO: 405285 - RNA, 19 nt, Homo sapiens
cgaagugguuaggacucua

SEQ ID NO: 405286 - RNA, 19 nt, Homo sapiens
gguaacaacaaaccaacau

SEQ ID NO: 405287 - RNA, 19 nt, Homo sapiens
ugaugccacuuaccugugu

SEQ ID NO: 405288 - RNA, 19 nt, Homo sapiens
aaauagaaguuggaguagu

SEQ ID NO: 405289 - RNA, 19 nt, Homo sapiens
cagcgggaguuaaacaaac

SEQ ID NO: 405290 - RNA, 19 nt, Homo sapiens
cuugguuguuguaugauuu

SEQ ID NO: 405291 - RNA, 19 nt, Homo sapiens
gauccgugaugccacuuac

SEQ ID NO: 405292 - RNA, 19 nt, Homo sapiens
cagggauuguguuuaaagu

SEQ ID NO: 405293 - RNA, 19 nt, Homo sapiens
aaacugagucaaccagcuu

SEQ ID NO: 405294 - RNA, 19 nt, Homo sapiens
aaagaauugccgauauuuc

SEQ ID NO: 405295 - RNA, 19 nt, Homo sapiens
ccugucuacuguucuauca

SEQ ID NO: 405296 - RNA, 19 nt, Homo sapiens
gccacuuaccuguguguuu

SEQ ID NO: 405297 - RNA, 19 nt, Homo sapiens
cagcuaacuggaaauacaa

SEQ ID NO: 405298 - RNA, 19 nt, Homo sapiens
caaccagcuuccuugaaaa

SEQ ID NO: 405299 - RNA, 19 nt, Homo sapiens
aaguauggcuaugagauuc

SEQ ID NO: 405300 - RNA, 19 nt, Homo sapiens
ggguggccuuacaucagua

SEQ ID NO: 405301 - RNA, 19 nt, Homo sapiens
ccacugcagcgggaguuaa

SEQ ID NO: 405302 - RNA, 19 nt, Homo sapiens
uuucucaggucuacacaca

SEQ ID NO: 405303 - RNA, 19 nt, Homo sapiens
cgauauuucucaggucuac

SEQ ID NO: 405304 - RNA, 19 nt, Homo sapiens
ggacaugcuguguaaaaga

SEQ ID NO: 405305 - RNA, 19 nt, Homo sapiens
aacauugguugugugauga

SEQ ID NO: 405306 - RNA, 19 nt, Homo sapiens
gggcccagggauuguguuu

SEQ ID NO: 405307 - RNA, 19 nt, Homo sapiens
gaaguauguugcugaaauu

SEQ ID NO: 405308 - RNA, 19 nt, Homo sapiens
gaagagacauuguuguucu

SEQ ID NO: 405309 - RNA, 19 nt, Homo sapiens
gaagaucugugcuuuggau

SEQ ID NO: 405310 - RNA, 19 nt, Homo sapiens
cugaagaaauugagaagua

SEQ ID NO: 405311 - RNA, 19 nt, Homo sapiens
gcacauaccaugccuggaa

SEQ ID NO: 405312 - RNA, 19 nt, Homo sapiens
caucguggguuucgacuuu

SEQ ID NO: 405313 - RNA, 19 nt, Homo sapiens
ccauuaagcuggugaucaa

SEQ ID NO: 405314 - RNA, 19 nt, Homo sapiens
gaaagaacagugcggaaga

SEQ ID NO: 405315 - RNA, 19 nt, Homo sapiens
guauguugcugaaauugaa

SEQ ID NO: 405316 - RNA, 19 nt, Homo sapiens
gaucaaggcacuccuggaa

SEQ ID NO: 405317 - RNA, 19 nt, Homo sapiens
agaaguauguugcugaaau

SEQ ID NO: 405318 - RNA, 19 nt, Homo sapiens
gaaauugagaaguauguug

SEQ ID NO: 405319 - RNA, 19 nt, Homo sapiens
cgagaucaaucccucaaga

SEQ ID NO: 405320 - RNA, 19 nt, Homo sapiens
gaacagugcggaagaucug

SEQ ID NO: 405321 - RNA, 19 nt, Homo sapiens
guacaucacccgcuacauc

SEQ ID NO: 405322 - RNA, 19 nt, Homo sapiens
ugagaaguauguugcugaa

SEQ ID NO: 405323 - RNA, 19 nt, Homo sapiens
gcaaggauagucaucaaca

SEQ ID NO: 405324 - RNA, 19 nt, Homo sapiens
gaagaagucaguggccaaa

SEQ ID NO: 405325 - RNA, 19 nt, Homo sapiens
ucaaggcacuccuggaagu

SEQ ID NO: 405326 - RNA, 19 nt, Homo sapiens
uggccaaacugcaggauga

SEQ ID NO: 405327 - RNA, 19 nt, Homo sapiens
gaagaaauugagaaguaug

SEQ ID NO: 405328 - RNA, 19 nt, Homo sapiens
gcaggaggccgucaagaag

SEQ ID NO: 405329 - RNA, 19 nt, Homo sapiens
gaagaaaacgaaaagaaga

SEQ ID NO: 405330 - RNA, 19 nt, Homo sapiens
ggaagagacauuguuguuc

SEQ ID NO: 405331 - RNA, 19 nt, Homo sapiens
ggccuuuccauuccauuua

SEQ ID NO: 405332 - RNA, 19 nt, Homo sapiens
caccgccgaugcaaggaua

SEQ ID NO: 405333 - RNA, 19 nt, Homo sapiens
cggaagaucugugcuuugg

SEQ ID NO: 405334 - RNA, 19 nt, Homo sapiens
caaacugcaggaugaaaga

SEQ ID NO: 405335 - RNA, 19 nt, Homo sapiens
cgaggaagagacauuguug

SEQ ID NO: 405336 - RNA, 19 nt, Homo sapiens
uggagaagaacuauacuga

SEQ ID NO: 405337 - RNA, 19 nt, Homo sapiens
gcacuccuaggcucuauca

SEQ ID NO: 405338 - RNA, 19 nt, Homo sapiens
aaagaacagugcggaagau

SEQ ID NO: 405339 - RNA, 19 nt, Homo sapiens
gccuuuccauuccauuuau

SEQ ID NO: 405340 - RNA, 19 nt, Homo sapiens
gagaucaaucccucaagau

SEQ ID NO: 405341 - RNA, 19 nt, Homo sapiens
cauugaacuugcugucaug

SEQ ID NO: 405342 - RNA, 19 nt, Homo sapiens
cugaguguccuacaauaaa

SEQ ID NO: 405343 - RNA, 19 nt, Homo sapiens
cuacaucgccagucugaag

SEQ ID NO: 405344 - RNA, 19 nt, Homo sapiens
gaucugugcuuuggaugac

SEQ ID NO: 405345 - RNA, 19 nt, Homo sapiens
caaggauagucaucaacag

SEQ ID NO: 405346 - RNA, 19 nt, Homo sapiens
agaagucaguggccaaacu

SEQ ID NO: 405347 - RNA, 19 nt, Homo sapiens
agacauuguuguucuuggu

SEQ ID NO: 405348 - RNA, 19 nt, Homo sapiens
acauugaacuugcugucau

SEQ ID NO: 405349 - RNA, 19 nt, Homo sapiens
aggaagagacauuguuguu

SEQ ID NO: 405350 - RNA, 19 nt, Homo sapiens
ggccgugagugugcgcuuu

SEQ ID NO: 405351 - RNA, 19 nt, Homo sapiens
cgcaggaggccgucaagaa

SEQ ID NO: 405352 - RNA, 19 nt, Homo sapiens
gaggaagagacauuguugu

SEQ ID NO: 405353 - RNA, 19 nt, Homo sapiens
ugaguguccuacaauaaac

SEQ ID NO: 405354 - RNA, 19 nt, Homo sapiens
agucugaagcagcguuaua

SEQ ID NO: 405355 - RNA, 19 nt, Homo sapiens
caacgucugcauggccuuu

SEQ ID NO: 405356 - RNA, 19 nt, Homo sapiens
ugcggaagaucugugcuuu

SEQ ID NO: 405357 - RNA, 19 nt, Homo sapiens
ccaaacugcaggaugaaag

SEQ ID NO: 405358 - RNA, 19 nt, Homo sapiens
uguguaggccuuuccauuc

SEQ ID NO: 405359 - RNA, 19 nt, Homo sapiens
uuccauuuauucacacuga

SEQ ID NO: 405360 - RNA, 19 nt, Homo sapiens
caaaagaaagcaucaugau

SEQ ID NO: 405361 - RNA, 19 nt, Homo sapiens
uccauuccauuuauucaca

SEQ ID NO: 405362 - RNA, 19 nt, Homo sapiens
cgacggccaccucuuccaa

SEQ ID NO: 405363 - RNA, 19 nt, Homo sapiens
ccagucugaagcagcguua

SEQ ID NO: 405364 - RNA, 19 nt, Homo sapiens
gcggaagaucugugcuuug

SEQ ID NO: 405365 - RNA, 19 nt, Homo sapiens
gguugguguucgaggaaga

SEQ ID NO: 405366 - RNA, 19 nt, Homo sapiens
acugaguguccuacaauaa

SEQ ID NO: 405367 - RNA, 19 nt, Homo sapiens
gaaacaaaagaaagcauca

SEQ ID NO: 405368 - RNA, 19 nt, Homo sapiens
gagaaguauguugcugaaa

SEQ ID NO: 405369 - RNA, 19 nt, Homo sapiens
augcaaggauagucaucaa

SEQ ID NO: 405370 - RNA, 19 nt, Homo sapiens
gaaguauguugcugaaauu

SEQ ID NO: 405371 - RNA, 19 nt, Homo sapiens
gaagagacauuguuguucu

SEQ ID NO: 405372 - RNA, 19 nt, Homo sapiens
gaagaucugugcuuuggau

SEQ ID NO: 405373 - RNA, 19 nt, Homo sapiens
cugaagaaauugagaagua

SEQ ID NO: 405374 - RNA, 19 nt, Homo sapiens
gcacauaccaugccuggaa

SEQ ID NO: 405375 - RNA, 19 nt, Homo sapiens
caucguggguuucgacuuu

SEQ ID NO: 405376 - RNA, 19 nt, Homo sapiens
ccaugucacuucagcguua

SEQ ID NO: 405377 - RNA, 19 nt, Homo sapiens
ccauuaagcuggugaucaa

SEQ ID NO: 405378 - RNA, 19 nt, Homo sapiens
gaaagaacagugcggaaga

SEQ ID NO: 405379 - RNA, 19 nt, Homo sapiens
guauguugcugaaauugaa

SEQ ID NO: 405380 - RNA, 19 nt, Homo sapiens
gaucaaggcacuccuggaa

SEQ ID NO: 405381 - RNA, 19 nt, Homo sapiens
agaaguauguugcugaaau

SEQ ID NO: 405382 - RNA, 19 nt, Homo sapiens
gaaauugagaaguauguug

SEQ ID NO: 405383 - RNA, 19 nt, Homo sapiens
cgagaucaaucccucaaga

SEQ ID NO: 405384 - RNA, 19 nt, Homo sapiens
ggaggguccugccauguca

SEQ ID NO: 405385 - RNA, 19 nt, Homo sapiens
gaacagugcggaagaucug

SEQ ID NO: 405386 - RNA, 19 nt, Homo sapiens
guacaucacccgcuacauc

SEQ ID NO: 405387 - RNA, 19 nt, Homo sapiens
ugagaaguauguugcugaa

SEQ ID NO: 405388 - RNA, 19 nt, Homo sapiens
gcaaggauagucaucaaca

SEQ ID NO: 405389 - RNA, 19 nt, Homo sapiens
gaagaagucaguggccaaa

SEQ ID NO: 405390 - RNA, 19 nt, Homo sapiens
ucaaggcacuccuggaagu

SEQ ID NO: 405391 - RNA, 19 nt, Homo sapiens
uggccaaacugcaggauga

SEQ ID NO: 405392 - RNA, 19 nt, Homo sapiens
gaagaaauugagaaguaug

SEQ ID NO: 405393 - RNA, 19 nt, Homo sapiens
gcaggaggccgucaagaag

SEQ ID NO: 405394 - RNA, 19 nt, Homo sapiens
gaagaaaacgaaaagaaga

SEQ ID NO: 405395 - RNA, 19 nt, Homo sapiens
ggaagagacauuguuguuc

SEQ ID NO: 405396 - RNA, 19 nt, Homo sapiens
ggccuuuccauuccauuua

SEQ ID NO: 405397 - RNA, 19 nt, Homo sapiens
caccgccgaugcaaggaua

SEQ ID NO: 405398 - RNA, 19 nt, Homo sapiens
cggaagaucugugcuuugg

SEQ ID NO: 405399 - RNA, 19 nt, Homo sapiens
cgaggaagagacauuguug

SEQ ID NO: 405400 - RNA, 19 nt, Homo sapiens
caaacugcaggaugaaaga

SEQ ID NO: 405401 - RNA, 19 nt, Homo sapiens
uggagaagaacuauacuga

SEQ ID NO: 405402 - RNA, 19 nt, Homo sapiens
gcacuccuaggcucuauca

SEQ ID NO: 405403 - RNA, 19 nt, Homo sapiens
aaagaacagugcggaagau

SEQ ID NO: 405404 - RNA, 19 nt, Homo sapiens
gccuuuccauuccauuuau

SEQ ID NO: 405405 - RNA, 19 nt, Homo sapiens
gagaucaaucccucaagau

SEQ ID NO: 405406 - RNA, 19 nt, Homo sapiens
cauugaacuugcugucaug

SEQ ID NO: 405407 - RNA, 19 nt, Homo sapiens
cugaguguccuacaauaaa

SEQ ID NO: 405408 - RNA, 19 nt, Homo sapiens
cuacaucgccagucugaag

SEQ ID NO: 405409 - RNA, 19 nt, Homo sapiens
gaucugugcuuuggaugac

SEQ ID NO: 405410 - RNA, 19 nt, Homo sapiens
caaggauagucaucaacag

SEQ ID NO: 405411 - RNA, 19 nt, Homo sapiens
agaagucaguggccaaacu

SEQ ID NO: 405412 - RNA, 19 nt, Homo sapiens
acauugaacuugcugucau

SEQ ID NO: 405413 - RNA, 19 nt, Homo sapiens
aggaagagacauuguuguu

SEQ ID NO: 405414 - RNA, 19 nt, Homo sapiens
agacauuguuguucuuggu

SEQ ID NO: 405415 - RNA, 19 nt, Homo sapiens
ggccgugagugugcgcuuu

SEQ ID NO: 405416 - RNA, 19 nt, Homo sapiens
cgcaggaggccgucaagaa

SEQ ID NO: 405417 - RNA, 19 nt, Homo sapiens
gaggaagagacauuguugu

SEQ ID NO: 405418 - RNA, 19 nt, Homo sapiens
ugaguguccuacaauaaac

SEQ ID NO: 405419 - RNA, 19 nt, Homo sapiens
caacgucugcauggccuuu

SEQ ID NO: 405420 - RNA, 19 nt, Homo sapiens
ugcggaagaucugugcuuu

SEQ ID NO: 405421 - RNA, 19 nt, Homo sapiens
uguguaggccuuuccauuc

SEQ ID NO: 405422 - RNA, 19 nt, Homo sapiens
ccaaacugcaggaugaaag

SEQ ID NO: 405423 - RNA, 19 nt, Homo sapiens
uuccauuuauucacacuga

SEQ ID NO: 405424 - RNA, 19 nt, Homo sapiens
caaaagaaagcaucaugau

SEQ ID NO: 405425 - RNA, 19 nt, Homo sapiens
uccauuccauuuauucaca

SEQ ID NO: 405426 - RNA, 19 nt, Homo sapiens
cgacggccaccucuuccaa

SEQ ID NO: 405427 - RNA, 19 nt, Homo sapiens
gcggaagaucugugcuuug

SEQ ID NO: 405428 - RNA, 19 nt, Homo sapiens
guccugccaugucacuuca

SEQ ID NO: 405429 - RNA, 19 nt, Homo sapiens
gguugguguucgaggaaga

SEQ ID NO: 405430 - RNA, 19 nt, Homo sapiens
acugaguguccuacaauaa

SEQ ID NO: 405431 - RNA, 19 nt, Homo sapiens
gaaacaaaagaaagcauca

SEQ ID NO: 405432 - RNA, 19 nt, Homo sapiens
gagaaguauguugcugaaa

SEQ ID NO: 405433 - RNA, 19 nt, Homo sapiens
gguccugccaugucacuuc

SEQ ID NO: 405434 - RNA, 19 nt, Homo sapiens
augcaaggauagucaucaa

SEQ ID NO: 405435 - RNA, 19 nt, Homo sapiens
guucagaccugguugauuu

SEQ ID NO: 405436 - RNA, 19 nt, Homo sapiens
caacggagguacuauacug

SEQ ID NO: 405437 - RNA, 19 nt, Homo sapiens
gaagcaagacuaaagaugu

SEQ ID NO: 405438 - RNA, 19 nt, Homo sapiens
gacuaaagauguauaagca

SEQ ID NO: 405439 - RNA, 19 nt, Homo sapiens
aagcaagacuaaagaugua

SEQ ID NO: 405440 - RNA, 19 nt, Homo sapiens
ccccaaauguuacaaauua

SEQ ID NO: 405441 - RNA, 19 nt, Homo sapiens
ggcaauugcuggagaagau

SEQ ID NO: 405442 - RNA, 19 nt, Homo sapiens
ucaaggcgcuucuuuccau

SEQ ID NO: 405443 - RNA, 19 nt, Homo sapiens
gcaaugcugucuacaaucc

SEQ ID NO: 405444 - RNA, 19 nt, Homo sapiens
gcaagacuaaagauguaua

SEQ ID NO: 405445 - RNA, 19 nt, Homo sapiens
gcgcuucuuuccauacuau

SEQ ID NO: 405446 - RNA, 19 nt, Homo sapiens
ccaugcggcuggugaaaga

SEQ ID NO: 405447 - RNA, 19 nt, Homo sapiens
auacagcuuugauccagua

SEQ ID NO: 405448 - RNA, 19 nt, Homo sapiens
caaggcgcuucuuuccaua

SEQ ID NO: 405449 - RNA, 19 nt, Homo sapiens
gaaggguuuucaauucaua

SEQ ID NO: 405450 - RNA, 19 nt, Homo sapiens
gagaagauuuugcaauugu

SEQ ID NO: 405451 - RNA, 19 nt, Homo sapiens
guacuauacuggcaauugc

SEQ ID NO: 405452 - RNA, 19 nt, Homo sapiens
cuccggaucugcauaguga

SEQ ID NO: 405453 - RNA, 19 nt, Homo sapiens
ccagagagacuccuucaag

SEQ ID NO: 405454 - RNA, 19 nt, Homo sapiens
cugcaaugcugucuacaau

SEQ ID NO: 405455 - RNA, 19 nt, Homo sapiens
aggaaggacugaucugugu

SEQ ID NO: 405456 - RNA, 19 nt, Homo sapiens
gacaaagauuauugaagca

SEQ ID NO: 405457 - RNA, 19 nt, Homo sapiens
ucgauugagugaaggguuu

SEQ ID NO: 405458 - RNA, 19 nt, Homo sapiens
gcucuuaucaccaaucagu

SEQ ID NO: 405459 - RNA, 19 nt, Homo sapiens
gggauagccccaaauguua

SEQ ID NO: 405460 - RNA, 19 nt, Homo sapiens
acugaucugugugcucuua

SEQ ID NO: 405461 - RNA, 19 nt, Homo sapiens
ugagagagauguguacacu

SEQ ID NO: 405462 - RNA, 19 nt, Homo sapiens
aguagggucuuaccagaga

SEQ ID NO: 405463 - RNA, 19 nt, Homo sapiens
caacaucaucgguggacuu

SEQ ID NO: 405464 - RNA, 19 nt, Homo sapiens
aauaauaaggccaugacua

SEQ ID NO: 405465 - RNA, 19 nt, Homo sapiens
ggagaagauuuugcaauug

SEQ ID NO: 405466 - RNA, 19 nt, Homo sapiens
gguacuauacuggcaauug

SEQ ID NO: 405467 - RNA, 19 nt, Homo sapiens
gagguacuauacuggcaau

SEQ ID NO: 405468 - RNA, 19 nt, Homo sapiens
ucgguggacuugaugaaga

SEQ ID NO: 405469 - RNA, 19 nt, Homo sapiens
uggagaagauuuugcaauu

SEQ ID NO: 405470 - RNA, 19 nt, Homo sapiens
gcacuccggaucugcauag

SEQ ID NO: 405471 - RNA, 19 nt, Homo sapiens
gauuauugaagcaagacua

SEQ ID NO: 405472 - RNA, 19 nt, Homo sapiens
ugugugcucuuaucaccaa

SEQ ID NO: 405473 - RNA, 19 nt, Homo sapiens
guauucaaggcgcuucuuu

SEQ ID NO: 405474 - RNA, 19 nt, Homo sapiens
uaucaccaaucaguucaga

SEQ ID NO: 405475 - RNA, 19 nt, Homo sapiens
gaucugugugcucuuauca

SEQ ID NO: 405476 - RNA, 19 nt, Homo sapiens
uuuaagaacaugcagaaug

SEQ ID NO: 405477 - RNA, 19 nt, Homo sapiens
gcaauugcuggagaagauu

SEQ ID NO: 405478 - RNA, 19 nt, Homo sapiens
caucagggaggaaacuguu

SEQ ID NO: 405479 - RNA, 19 nt, Homo sapiens
gaacuguaccuuggauggu

SEQ ID NO: 405480 - RNA, 19 nt, Homo sapiens
gugcucuuaucaccaauca

SEQ ID NO: 405481 - RNA, 19 nt, Homo sapiens
caauugcuggagaagauuu

SEQ ID NO: 405482 - RNA, 19 nt, Homo sapiens
ugcagaauguggagcaugu

SEQ ID NO: 405483 - RNA, 19 nt, Homo sapiens
cgguggacuugaugaagaa

SEQ ID NO: 405484 - RNA, 19 nt, Homo sapiens
auaauaaggccaugacuac

SEQ ID NO: 405485 - RNA, 19 nt, Homo sapiens
ggaucugcauagugaccaa

SEQ ID NO: 405486 - RNA, 19 nt, Homo sapiens
ugaagcaagacuaaagaug

SEQ ID NO: 405487 - RNA, 19 nt, Homo sapiens
uaaggaaggacugaucugu

SEQ ID NO: 405488 - RNA, 19 nt, Homo sapiens
gcugcaaugcugucuacaa

SEQ ID NO: 405489 - RNA, 19 nt, Homo sapiens
ucaauucauacgcgggaua

SEQ ID NO: 405490 - RNA, 19 nt, Homo sapiens
uuucaacggagguacuaua

SEQ ID NO: 405491 - RNA, 19 nt, Homo sapiens
gcugacaaagauuauugaa

SEQ ID NO: 405492 - RNA, 19 nt, Homo sapiens
cgugcgauguuguccucua

SEQ ID NO: 405493 - RNA, 19 nt, Homo sapiens
gauuuucgcccuacguuuu

SEQ ID NO: 405494 - RNA, 19 nt, Homo sapiens
uggacuugaugaagaagga

SEQ ID NO: 405495 - RNA, 19 nt, Homo sapiens
cggcugagagagaugugua

SEQ ID NO: 405496 - RNA, 19 nt, Homo sapiens
gcgauguuguccucuacag

SEQ ID NO: 405497 - RNA, 19 nt, Homo sapiens
gaauaaaggugacuaugga

SEQ ID NO: 405498 - RNA, 19 nt, Homo sapiens
gacaagauguuuaagauga

SEQ ID NO: 405499 - RNA, 19 nt, Homo sapiens
aaacagggcuccuaacauc

SEQ ID NO: 405500 - RNA, 19 nt, Homo sapiens
gaaggacgaucaugacaag

SEQ ID NO: 405501 - RNA, 19 nt, Homo sapiens
gaucaugacaagauguuua

SEQ ID NO: 405502 - RNA, 19 nt, Homo sapiens
uugaugggcuccuuuauuu

SEQ ID NO: 405503 - RNA, 19 nt, Homo sapiens
gcaauauuguccagaugaa

SEQ ID NO: 405504 - RNA, 19 nt, Homo sapiens
gaugcgaaauggauaugaa

SEQ ID NO: 405505 - RNA, 19 nt, Homo sapiens
ggacgaucaugacaagaug

SEQ ID NO: 405506 - RNA, 19 nt, Homo sapiens
aaaggugacuauggauaua

SEQ ID NO: 405507 - RNA, 19 nt, Homo sapiens
cgaaauggauaugaauugu

SEQ ID NO: 405508 - RNA, 19 nt, Homo sapiens
gcgccaaucuucgcucuga

SEQ ID NO: 405509 - RNA, 19 nt, Homo sapiens
gcgaaauggauaugaauug

SEQ ID NO: 405510 - RNA, 19 nt, Homo sapiens
uaaaggugacuauggauau

SEQ ID NO: 405511 - RNA, 19 nt, Homo sapiens
aaaccuggcugacugucuu

SEQ ID NO: 405512 - RNA, 19 nt, Homo sapiens
caggcgcacucuugauaaa

SEQ ID NO: 405513 - RNA, 19 nt, Homo sapiens
ggcgcacucuugauaaaug

SEQ ID NO: 405514 - RNA, 19 nt, Homo sapiens
ggcagcagcuaacuucaca

SEQ ID NO: 405515 - RNA, 19 nt, Homo sapiens
ccagcaauauuguccagau

SEQ ID NO: 405516 - RNA, 19 nt, Homo sapiens
ccaaacagggcuccuaaca

SEQ ID NO: 405517 - RNA, 19 nt, Homo sapiens
cuguacaguuugcagaaua

SEQ ID NO: 405518 - RNA, 19 nt, Homo sapiens
gauacuacacaccgacuau

SEQ ID NO: 405519 - RNA, 19 nt, Homo sapiens
gaagggccagcgcuguauu

SEQ ID NO: 405520 - RNA, 19 nt, Homo sapiens
gaaauggauaugaauuguc

SEQ ID NO: 405521 - RNA, 19 nt, Homo sapiens
uauaagaugcgaaauggau

SEQ ID NO: 405522 - RNA, 19 nt, Homo sapiens
cagcaauauuguccagaug

SEQ ID NO: 405523 - RNA, 19 nt, Homo sapiens
ccacuugccagggaacuuu

SEQ ID NO: 405524 - RNA, 19 nt, Homo sapiens
cuucaguguucgaaucauu

SEQ ID NO: 405525 - RNA, 19 nt, Homo sapiens
cugccaaccuucaguguuc

SEQ ID NO: 405526 - RNA, 19 nt, Homo sapiens
agauauuacuccugugugu

SEQ ID NO: 405527 - RNA, 19 nt, Homo sapiens
caugacaagauguuuaaga

SEQ ID NO: 405528 - RNA, 19 nt, Homo sapiens
caaacagggcuccuaacau

SEQ ID NO: 405529 - RNA, 19 nt, Homo sapiens
auaaaggugacuauggaua

SEQ ID NO: 405530 - RNA, 19 nt, Homo sapiens
ccuccuggcuggcuaugau

SEQ ID NO: 405531 - RNA, 19 nt, Homo sapiens
uaagaugcgaaauggauau

SEQ ID NO: 405532 - RNA, 19 nt, Homo sapiens
uuuauaagaugcgaaaugg

SEQ ID NO: 405533 - RNA, 19 nt, Homo sapiens
guacaguuugcagaauaua

SEQ ID NO: 405534 - RNA, 19 nt, Homo sapiens
caagauguuuaagaugagu

SEQ ID NO: 405535 - RNA, 19 nt, Homo sapiens
ugacaagauguuuaagaug

SEQ ID NO: 405536 - RNA, 19 nt, Homo sapiens
aaagauauuacuccugugu

SEQ ID NO: 405537 - RNA, 19 nt, Homo sapiens
uguacaguuugcagaauau

SEQ ID NO: 405538 - RNA, 19 nt, Homo sapiens
agaauaaaggugacuaugg

SEQ ID NO: 405539 - RNA, 19 nt, Homo sapiens
ugaaggacgaucaugacaa

SEQ ID NO: 405540 - RNA, 19 nt, Homo sapiens
gauauuacuccuguguguu

SEQ ID NO: 405541 - RNA, 19 nt, Homo sapiens
gugacuauggauauaauug

SEQ ID NO: 405542 - RNA, 19 nt, Homo sapiens
gcacucuugauaaaugguu

SEQ ID NO: 405543 - RNA, 19 nt, Homo sapiens
gcgcacucuugauaaaugg

SEQ ID NO: 405544 - RNA, 19 nt, Homo sapiens
cgugcaacuuuauaagaug

SEQ ID NO: 405545 - RNA, 19 nt, Homo sapiens
ucaggcgcacucuugauaa

SEQ ID NO: 405546 - RNA, 19 nt, Homo sapiens
cuacacaccgacuaucuca

SEQ ID NO: 405547 - RNA, 19 nt, Homo sapiens
acgugcaacuuuauaagau

SEQ ID NO: 405548 - RNA, 19 nt, Homo sapiens
acaagauguuuaagaugag

SEQ ID NO: 405549 - RNA, 19 nt, Homo sapiens
aagggccagcgcuguauua

SEQ ID NO: 405550 - RNA, 19 nt, Homo sapiens
auaagaugcgaaauggaua

SEQ ID NO: 405551 - RNA, 19 nt, Homo sapiens
uaacuucacacgccgaaac

SEQ ID NO: 405552 - RNA, 19 nt, Homo sapiens
cagaauaaaggugacuaug

SEQ ID NO: 405553 - RNA, 19 nt, Homo sapiens
cacucuugauaaaugguua

SEQ ID NO: 405554 - RNA, 19 nt, Homo sapiens
uaacauuuccuuccccaaa

SEQ ID NO: 405555 - RNA, 19 nt, Homo sapiens
gaaaccuggcugacugucu

SEQ ID NO: 405556 - RNA, 19 nt, Homo sapiens
aaacgugcaacuuuauaag

SEQ ID NO: 405557 - RNA, 19 nt, Homo sapiens
ucagaauaaaggugacuau

SEQ ID NO: 405558 - RNA, 19 nt, Homo sapiens
uuugaugggcuccuuuauu

SEQ ID NO: 405559 - RNA, 19 nt, Homo sapiens
ccacggcagcagcuaacuu

SEQ ID NO: 405560 - RNA, 19 nt, Homo sapiens
gcaaucaugucuauuaugu

SEQ ID NO: 405561 - RNA, 19 nt, Homo sapiens
gaacaaauguacggaaugu

SEQ ID NO: 405562 - RNA, 19 nt, Homo sapiens
cauggugacugaugacuuu

SEQ ID NO: 405563 - RNA, 19 nt, Homo sapiens
gaaggaaggucggcagauc

SEQ ID NO: 405564 - RNA, 19 nt, Homo sapiens
ggaccgggaugcaguguca

SEQ ID NO: 405565 - RNA, 19 nt, Homo sapiens
uggccaaccucuuguauga

SEQ ID NO: 405566 - RNA, 19 nt, Homo sapiens
gaauugcucuggcgaucga

SEQ ID NO: 405567 - RNA, 19 nt, Homo sapiens
uaaaauagccugucuuuca

SEQ ID NO: 405568 - RNA, 19 nt, Homo sapiens
gccaaccucuuguaugaga

SEQ ID NO: 405569 - RNA, 19 nt, Homo sapiens
gucggcagaucaaaccuua

SEQ ID NO: 405570 - RNA, 19 nt, Homo sapiens
cggcagaucaaaccuuaua

SEQ ID NO: 405571 - RNA, 19 nt, Homo sapiens
gaaccuguaugaguugaag

SEQ ID NO: 405572 - RNA, 19 nt, Homo sapiens
gaaauaaaauagccugucu

SEQ ID NO: 405573 - RNA, 19 nt, Homo sapiens
ggcugaaccuguaugaguu

SEQ ID NO: 405574 - RNA, 19 nt, Homo sapiens
ucaugucuauuauguccua

SEQ ID NO: 405575 - RNA, 19 nt, Homo sapiens
ccgcaaucaugucuauuau

SEQ ID NO: 405576 - RNA, 19 nt, Homo sapiens
ccuuuaagcccuucauuug

SEQ ID NO: 405577 - RNA, 19 nt, Homo sapiens
ccgaacaaauguacggaau

SEQ ID NO: 405578 - RNA, 19 nt, Homo sapiens
acaccgcaaucaugucuau

SEQ ID NO: 405579 - RNA, 19 nt, Homo sapiens
ccggaucaccuguuugaaa

SEQ ID NO: 405580 - RNA, 19 nt, Homo sapiens
caccugcgccgaacaaaug

SEQ ID NO: 405581 - RNA, 19 nt, Homo sapiens
acaaauguacggaaugugu

SEQ ID NO: 405582 - RNA, 19 nt, Homo sapiens
gaaggcuagacccgguuua

SEQ ID NO: 405583 - RNA, 19 nt, Homo sapiens
aaaauagccugucuuucaa

SEQ ID NO: 405584 - RNA, 19 nt, Homo sapiens
gggagucauuguccacauc

SEQ ID NO: 405585 - RNA, 19 nt, Homo sapiens
ggugacugaugacuuugug

SEQ ID NO: 405586 - RNA, 19 nt, Homo sapiens
gcaccugcgccgaacaaau

SEQ ID NO: 405587 - RNA, 19 nt, Homo sapiens
gcccuucauuugcucucua

SEQ ID NO: 405588 - RNA, 19 nt, Homo sapiens
caaccucuuguaugagaaa

SEQ ID NO: 405589 - RNA, 19 nt, Homo sapiens
gaaggucggcagaucaaac

SEQ ID NO: 405590 - RNA, 19 nt, Homo sapiens
caugguggccaaccucuug

SEQ ID NO: 405591 - RNA, 19 nt, Homo sapiens
uagacccgguuuacuggaa

SEQ ID NO: 405592 - RNA, 19 nt, Homo sapiens
cuaguacaccgcaaucaug

SEQ ID NO: 405593 - RNA, 19 nt, Homo sapiens
guacaccgcaaucaugucu

SEQ ID NO: 405594 - RNA, 19 nt, Homo sapiens
gacccgguuuacuggaauu

SEQ ID NO: 405595 - RNA, 19 nt, Homo sapiens
cggcugaaccuguaugagu

SEQ ID NO: 405596 - RNA, 19 nt, Homo sapiens
accgcaaucaugucuauua

SEQ ID NO: 405597 - RNA, 19 nt, Homo sapiens
ggagucauuguccacauca

SEQ ID NO: 405598 - RNA, 19 nt, Homo sapiens
caaaccuuauacccucaug

SEQ ID NO: 405599 - RNA, 19 nt, Homo sapiens
ugaaggcccgaauggacua

SEQ ID NO: 405600 - RNA, 19 nt, Homo sapiens
gguuggacccgaagaccuu

SEQ ID NO: 405601 - RNA, 19 nt, Homo sapiens
cuuauacccucaugagcau

SEQ ID NO: 405602 - RNA, 19 nt, Homo sapiens
gcugaaccuguaugaguug

SEQ ID NO: 405603 - RNA, 19 nt, Homo sapiens
cgaacaaauguacggaaug

SEQ ID NO: 405604 - RNA, 19 nt, Homo sapiens
ggacacugaaggcccgaau

SEQ ID NO: 405605 - RNA, 19 nt, Homo sapiens
caucaucgagaaggacaaa

SEQ ID NO: 405606 - RNA, 19 nt, Homo sapiens
ggaaggucggcagaucaaa

SEQ ID NO: 405607 - RNA, 19 nt, Homo sapiens
ggcuagacccgguuuacug

SEQ ID NO: 405608 - RNA, 19 nt, Homo sapiens
aaauagccugucuuucaaa

SEQ ID NO: 405609 - RNA, 19 nt, Homo sapiens
gaccuuuaagcccuucauu

SEQ ID NO: 405610 - RNA, 19 nt, Homo sapiens
aaauguacggaauguguga

SEQ ID NO: 405611 - RNA, 19 nt, Homo sapiens
caacaucucucgcauuaug

SEQ ID NO: 405612 - RNA, 19 nt, Homo sapiens
cgcaacaucucucgcauua

SEQ ID NO: 405613 - RNA, 19 nt, Homo sapiens
gagagagcuuccucgguua

SEQ ID NO: 405614 - RNA, 19 nt, Homo sapiens
gaucaguggcuuugaauga

SEQ ID NO: 405615 - RNA, 19 nt, Homo sapiens
gauagacucuucuuuugua

SEQ ID NO: 405616 - RNA, 19 nt, Homo sapiens
gagaccaacugggauauug

SEQ ID NO: 405617 - RNA, 19 nt, Homo sapiens
ggagauggacacagcuaua

SEQ ID NO: 405618 - RNA, 19 nt, Homo sapiens
ugaaauagagggaccauug

SEQ ID NO: 405619 - RNA, 19 nt, Homo sapiens
gaaauacagaugcauuauc

SEQ ID NO: 405620 - RNA, 19 nt, Homo sapiens
gaaauagagggaccauugu

SEQ ID NO: 405621 - RNA, 19 nt, Homo sapiens
cuagagcuauucauucaug

SEQ ID NO: 405622 - RNA, 19 nt, Homo sapiens
acgcugauuuccaguauuu

SEQ ID NO: 405623 - RNA, 19 nt, Homo sapiens
acagaugcauuauccagaa

SEQ ID NO: 405624 - RNA, 19 nt, Homo sapiens
ggaccauugucuacagaga

SEQ ID NO: 405625 - RNA, 19 nt, Homo sapiens
gcaugcgagugcuguacua

SEQ ID NO: 405626 - RNA, 19 nt, Homo sapiens
caugaucaguggcuuugaa

SEQ ID NO: 405627 - RNA, 19 nt, Homo sapiens
gccagauggugauugauga

SEQ ID NO: 405628 - RNA, 19 nt, Homo sapiens
ucaguggcuuugaaugaaa

SEQ ID NO: 405629 - RNA, 19 nt, Homo sapiens
gauauugcccacaugauca

SEQ ID NO: 405630 - RNA, 19 nt, Homo sapiens
gagaugcccguucuuacaa

SEQ ID NO: 405631 - RNA, 19 nt, Homo sapiens
gauccggcgucugcacuuu

SEQ ID NO: 405632 - RNA, 19 nt, Homo sapiens
ugaaugaaauacagaugca

SEQ ID NO: 405633 - RNA, 19 nt, Homo sapiens
ggauauugcccacaugauc

SEQ ID NO: 405634 - RNA, 19 nt, Homo sapiens
aaauacagaugcauuaucc

SEQ ID NO: 405635 - RNA, 19 nt, Homo sapiens
acacagcuauaguccuaga

SEQ ID NO: 405636 - RNA, 19 nt, Homo sapiens
cuacgcugauuuccaguau

SEQ ID NO: 405637 - RNA, 19 nt, Homo sapiens
acagagaccaacugggaua

SEQ ID NO: 405638 - RNA, 19 nt, Homo sapiens
cgagaugcccguucuuaca

SEQ ID NO: 405639 - RNA, 19 nt, Homo sapiens
gcugauuuccaguauuuga

SEQ ID NO: 405640 - RNA, 19 nt, Homo sapiens
ggugauugccgcagacaug

SEQ ID NO: 405641 - RNA, 19 nt, Homo sapiens
uccuagagcuauucauuca

SEQ ID NO: 405642 - RNA, 19 nt, Homo sapiens
gagggaccauugucuacag

SEQ ID NO: 405643 - RNA, 19 nt, Homo sapiens
gagauggacacagcuauag

SEQ ID NO: 405644 - RNA, 19 nt, Homo sapiens
ccucaguccucggcguuaa

SEQ ID NO: 405645 - RNA, 19 nt, Homo sapiens
ggccagauggugauugaug

SEQ ID NO: 405646 - RNA, 19 nt, Homo sapiens
cagacaugcugggauccua

SEQ ID NO: 405647 - RNA, 19 nt, Homo sapiens
cuaccgagaugcccguucu

SEQ ID NO: 405648 - RNA, 19 nt, Homo sapiens
gauggacacagcuauaguc

SEQ ID NO: 405649 - RNA, 19 nt, Homo sapiens
ggugauugaugaggagcuu

SEQ ID NO: 405650 - RNA, 19 nt, Homo sapiens
gugcuguacuaccgagaug

SEQ ID NO: 405651 - RNA, 19 nt, Homo sapiens
ucuuacaaccgguuucaaa

SEQ ID NO: 405652 - RNA, 19 nt, Homo sapiens
cggaggcuaugcugaugga

SEQ ID NO: 405653 - RNA, 19 nt, Homo sapiens
caucggaggcuaugcugau

SEQ ID NO: 405654 - RNA, 19 nt, Homo sapiens
ucggccagauggugauuga

SEQ ID NO: 405655 - RNA, 19 nt, Homo sapiens
gcaaguucucggccagaug

SEQ ID NO: 405656 - RNA, 19 nt, Homo sapiens
caaucacgcggacccagaa

SEQ ID NO: 405657 - RNA, 19 nt, Homo sapiens
cugcuaccgugacuaagau

SEQ ID NO: 405658 - RNA, 19 nt, Homo sapiens
gagcuuccucgguuaugug

SEQ ID NO: 405659 - RNA, 19 nt, Homo sapiens
gcacuuuacagagguccaa

SEQ ID NO: 405660 - RNA, 19 nt, Homo sapiens
caugcuugguguagccuau

SEQ ID NO: 405661 - RNA, 19 nt, Homo sapiens
caguggcuuugaaugaaau

SEQ ID NO: 405662 - RNA, 19 nt, Homo sapiens
cuuggcuaguucaaagaua

SEQ ID NO: 405663 - RNA, 19 nt, Homo sapiens
uaccgugacuaagauggaa

SEQ ID NO: 405664 - RNA, 19 nt, Homo sapiens
ucuaugagcuucgaaauaa

SEQ ID NO: 405665 - RNA, 19 nt, Homo sapiens
cuacagagaugccuacuca

SEQ ID NO: 405666 - RNA, 19 nt, Homo sapiens
ugaagaaggugauagagau

SEQ ID NO: 405667 - RNA, 19 nt, Homo sapiens
ggaugcagcugcuuguguu

SEQ ID NO: 405668 - RNA, 19 nt, Homo sapiens
cugcagaggugacuauuug

SEQ ID NO: 405669 - RNA, 19 nt, Homo sapiens
ccaacaugguguaucagua

SEQ ID NO: 405670 - RNA, 19 nt, Homo sapiens
gaucaacccauaccugcua

SEQ ID NO: 405671 - RNA, 19 nt, Homo sapiens
gaagagccaggaaucgaaa

SEQ ID NO: 405672 - RNA, 19 nt, Homo sapiens
caaccacccuggccuucaa

SEQ ID NO: 405673 - RNA, 19 nt, Homo sapiens
ccaaacugcuugccaacau

SEQ ID NO: 405674 - RNA, 19 nt, Homo sapiens
cgaaaugcuucauggaaca

SEQ ID NO: 405675 - RNA, 19 nt, Homo sapiens
uuuaagcucuggcacauug

SEQ ID NO: 405676 - RNA, 19 nt, Homo sapiens
uguagcagcugccuccaaa

SEQ ID NO: 405677 - RNA, 19 nt, Homo sapiens
gcuguuggcucggcaaugu

SEQ ID NO: 405678 - RNA, 19 nt, Homo sapiens
uggcugaucuacaugagaa

SEQ ID NO: 405679 - RNA, 19 nt, Homo sapiens
gaagggaaccggauuucag

SEQ ID NO: 405680 - RNA, 19 nt, Homo sapiens
guuccgccauggagucaua

SEQ ID NO: 405681 - RNA, 19 nt, Homo sapiens
gcagaggugacuauuuguu

SEQ ID NO: 405682 - RNA, 19 nt, Homo sapiens
caaacugcuugccaacaug

SEQ ID NO: 405683 - RNA, 19 nt, Homo sapiens
cauccuccauccuauuuau

SEQ ID NO: 405684 - RNA, 19 nt, Homo sapiens
caagccaccuacagagaug

SEQ ID NO: 405685 - RNA, 19 nt, Homo sapiens
gcucggcaaugucgaaucu

SEQ ID NO: 405686 - RNA, 19 nt, Homo sapiens
cagaggugacuauuuguuu

SEQ ID NO: 405687 - RNA, 19 nt, Homo sapiens
ggcaaugucgaaucuauga

SEQ ID NO: 405688 - RNA, 19 nt, Homo sapiens
uuacacuacucacuacuca

SEQ ID NO: 405689 - RNA, 19 nt, Homo sapiens
gaaucuaugagcuucgaaa

SEQ ID NO: 405690 - RNA, 19 nt, Homo sapiens
ucuacuacguggacaguga

SEQ ID NO: 405691 - RNA, 19 nt, Homo sapiens
caacaugguguaucaguac

SEQ ID NO: 405692 - RNA, 19 nt, Homo sapiens
gaagaaggugauagagauc

SEQ ID NO: 405693 - RNA, 19 nt, Homo sapiens
uaaggaacgcaucucugua

SEQ ID NO: 405694 - RNA, 19 nt, Homo sapiens
gugaagaaggugauagaga

SEQ ID NO: 405695 - RNA, 19 nt, Homo sapiens
ggaaucgaaaugcuucaug

SEQ ID NO: 405696 - RNA, 19 nt, Homo sapiens
ggccuucaauuguaucagu

SEQ ID NO: 405697 - RNA, 19 nt, Homo sapiens
ggauccgagucuccaguga

SEQ ID NO: 405698 - RNA, 19 nt, Homo sapiens
gacccauccuccauccuau

SEQ ID NO: 405699 - RNA, 19 nt, Homo sapiens
gaucuacaugagaaguaua

SEQ ID NO: 405700 - RNA, 19 nt, Homo sapiens
cuaccaagccaccuacaga

SEQ ID NO: 405701 - RNA, 19 nt, Homo sapiens
ggagcaggccuaugaucug

SEQ ID NO: 405702 - RNA, 19 nt, Homo sapiens
uacagcgggugcuuacauu

SEQ ID NO: 405703 - RNA, 19 nt, Homo sapiens
gccuucaauuguaucagua

SEQ ID NO: 405704 - RNA, 19 nt, Homo sapiens
ccagggagucucagugaug

SEQ ID NO: 405705 - RNA, 19 nt, Homo sapiens
gaaaugcuucauggaacaa

SEQ ID NO: 405706 - RNA, 19 nt, Homo sapiens
ugacccauccuccauccua

SEQ ID NO: 405707 - RNA, 19 nt, Homo sapiens
gaucggggcuauuccuaug

SEQ ID NO: 405708 - RNA, 19 nt, Homo sapiens
cauugaccucuauguguua

SEQ ID NO: 405709 - RNA, 19 nt, Homo sapiens
gugacaauguggcugaucu

SEQ ID NO: 405710 - RNA, 19 nt, Homo sapiens
ggaaguggagcaggccuau

SEQ ID NO: 405711 - RNA, 19 nt, Homo sapiens
ugaucuacaugagaaguau

SEQ ID NO: 405712 - RNA, 19 nt, Homo sapiens
ucggcaaugucgaaucuau

SEQ ID NO: 405713 - RNA, 19 nt, Homo sapiens
gggcuacagcgggugcuua

SEQ ID NO: 405714 - RNA, 19 nt, Homo sapiens
acacuacucacuacucaau

SEQ ID NO: 405715 - RNA, 19 nt, Homo sapiens
gaggugacuauuuguuuua

SEQ ID NO: 405716 - RNA, 19 nt, Homo sapiens
aaguggagcaggccuauga

SEQ ID NO: 405717 - RNA, 19 nt, Homo sapiens
gcccuggccucuacuacgu

SEQ ID NO: 405718 - RNA, 19 nt, Homo sapiens
uugccaacaugguguauca

SEQ ID NO: 405719 - RNA, 19 nt, Homo sapiens
gaaauaaggaacgcaucuc

SEQ ID NO: 405720 - RNA, 19 nt, Homo sapiens
cgaaauaaggaacgcaucu

SEQ ID NO: 405721 - RNA, 19 nt, Homo sapiens
aacauuacacuacucacua

SEQ ID NO: 405722 - RNA, 19 nt, Homo sapiens
gcugcagaggugacuauuu

SEQ ID NO: 405723 - RNA, 19 nt, Homo sapiens
agaagagccaggaaucgaa

SEQ ID NO: 405724 - RNA, 19 nt, Homo sapiens
guuaaacauuacacuacuc

SEQ ID NO: 405725 - RNA, 19 nt, Homo sapiens
auaaggaacgcaucucugu

SEQ ID NO: 405726 - RNA, 19 nt, Homo sapiens
cagaagagccaggaaucga

SEQ ID NO: 405727 - RNA, 19 nt, Homo sapiens
ccaagccaccuacagagau

SEQ ID NO: 405728 - RNA, 19 nt, Homo sapiens
ugacaauguggcugaucua

SEQ ID NO: 405729 - RNA, 19 nt, Homo sapiens
guccagggagucucaguga

SEQ ID NO: 405730 - RNA, 19 nt, Homo sapiens
acauuacacuacucacuac

SEQ ID NO: 405731 - RNA, 19 nt, Homo sapiens
cgccauggagucauaguug

SEQ ID NO: 405732 - RNA, 19 nt, Homo sapiens
gcagcugcuuguguuucuu

SEQ ID NO: 405733 - RNA, 19 nt, Homo sapiens
ggaacgcaucucuguagca

SEQ ID NO: 405734 - RNA, 19 nt, Homo sapiens
aaggaacgcaucucuguag

SEQ ID NO: 405735 - RNA, 19 nt, Homo sapiens
agaggugacuauuuguuuu

SEQ ID NO: 405736 - RNA, 19 nt, Homo sapiens
cuacaugagaaguauagug

SEQ ID NO: 405737 - RNA, 19 nt, Homo sapiens
cacccuggccuucaaguuc

SEQ ID NO: 405738 - RNA, 19 nt, Homo sapiens
cuacagcgggugcuuacau

SEQ ID NO: 405739 - RNA, 19 nt, Homo sapiens
gguucuggcucuguguaug

SEQ ID NO: 405740 - RNA, 19 nt, Homo sapiens
cccagacggugaagaaggu

SEQ ID NO: 405741 - RNA, 19 nt, Homo sapiens
aaacauuacacuacucacu

SEQ ID NO: 405742 - RNA, 19 nt, Homo sapiens
uguguuaccagucauuaau

SEQ ID NO: 405743 - RNA, 19 nt, Homo sapiens
ucuggcacauugaccucua

SEQ ID NO: 405744 - RNA, 19 nt, Homo sapiens
gaugcagcugcuuguguuu

SEQ ID NO: 405745 - RNA, 19 nt, Homo sapiens
cuggcucuguguaugcaua

SEQ ID NO: 405746 - RNA, 19 nt, Homo sapiens
gagaugcccuguacugaug

SEQ ID NO: 405747 - RNA, 19 nt, Homo sapiens
gagaccagauacccaaauu

SEQ ID NO: 405748 - RNA, 19 nt, Homo sapiens
ggaagagugucugcaauuc

SEQ ID NO: 405749 - RNA, 19 nt, Homo sapiens
aaagauggcggcuaccuua

SEQ ID NO: 405750 - RNA, 19 nt, Homo sapiens
ggagauguguuaccgauac

SEQ ID NO: 405751 - RNA, 19 nt, Homo sapiens
gauggcggcuaccuuacua

SEQ ID NO: 405752 - RNA, 19 nt, Homo sapiens
gcaauucacugccaaugcu

SEQ ID NO: 405753 - RNA, 19 nt, Homo sapiens
gggaaggcaugaccaagga

SEQ ID NO: 405754 - RNA, 19 nt, Homo sapiens
uaaaguuugucacagagaa

SEQ ID NO: 405755 - RNA, 19 nt, Homo sapiens
gaacaaccacuggguccua

SEQ ID NO: 405756 - RNA, 19 nt, Homo sapiens
ccacagcauugaacugaau

SEQ ID NO: 405757 - RNA, 19 nt, Homo sapiens
aauaagagaugcccuguac

SEQ ID NO: 405758 - RNA, 19 nt, Homo sapiens
gaagagugucugcaauuca

SEQ ID NO: 405759 - RNA, 19 nt, Homo sapiens
gaaagauggcggcuaccuu

SEQ ID NO: 405760 - RNA, 19 nt, Homo sapiens
uaucauggccgugcaguuu

SEQ ID NO: 405761 - RNA, 19 nt, Homo sapiens
gagggcagguguacucagu

SEQ ID NO: 405762 - RNA, 19 nt, Homo sapiens
cugacaagcugacaccuau

SEQ ID NO: 405763 - RNA, 19 nt, Homo sapiens
caaggaagagugucugcaa

SEQ ID NO: 405764 - RNA, 19 nt, Homo sapiens
uaagagaugcccuguacug

SEQ ID NO: 405765 - RNA, 19 nt, Homo sapiens
ugggaaagccgagaaguuu

SEQ ID NO: 405766 - RNA, 19 nt, Homo sapiens
ccaaucgagugacugacaa

SEQ ID NO: 405767 - RNA, 19 nt, Homo sapiens
guagagcggcaaguacuuu

SEQ ID NO: 405768 - RNA, 19 nt, Homo sapiens
ucuuuaaggagauguguua

SEQ ID NO: 405769 - RNA, 19 nt, Homo sapiens
gacaagcugacaccuauuc

SEQ ID NO: 405770 - RNA, 19 nt, Homo sapiens
ucaccuaccagcucgguuu

SEQ ID NO: 405771 - RNA, 19 nt, Homo sapiens
gcaguccuuugccauugga

SEQ ID NO: 405772 - RNA, 19 nt, Homo sapiens
gguccuacaucgccaaucg

SEQ ID NO: 405773 - RNA, 19 nt, Homo sapiens
ucauggccgugcaguuuga

SEQ ID NO: 405774 - RNA, 19 nt, Homo sapiens
ugccaaugcucucgcuuug

SEQ ID NO: 405775 - RNA, 19 nt, Homo sapiens
uagcugaugcugucaccua

SEQ ID NO: 405776 - RNA, 19 nt, Homo sapiens
caauaagagaugcccugua

SEQ ID NO: 405777 - RNA, 19 nt, Homo sapiens
gaccagauacccaaauucg

SEQ ID NO: 405778 - RNA, 19 nt, Homo sapiens
cgggagcuccuacaucuau

SEQ ID NO: 405779 - RNA, 19 nt, Homo sapiens
ggagaccagauacccaaau

SEQ ID NO: 405780 - RNA, 19 nt, Homo sapiens
aaggaagagugucugcaau

SEQ ID NO: 405781 - RNA, 19 nt, Homo sapiens
aggaagagugucugcaauu

SEQ ID NO: 405782 - RNA, 19 nt, Homo sapiens
uccgggagcuccuacaucu

SEQ ID NO: 405783 - RNA, 19 nt, Homo sapiens
cugggacccucaagaagga

SEQ ID NO: 405784 - RNA, 19 nt, Homo sapiens
ccuauucacgaccgcauuu

SEQ ID NO: 405785 - RNA, 19 nt, Homo sapiens
ccacugggaccacuaucau

SEQ ID NO: 405786 - RNA, 19 nt, Homo sapiens
ggcaguaccggaggagaaa

SEQ ID NO: 405787 - RNA, 19 nt, Homo sapiens
ggaaggcaugaccaaggaa

SEQ ID NO: 405788 - RNA, 19 nt, Homo sapiens
gguagagcggcaaguacuu

SEQ ID NO: 405789 - RNA, 19 nt, Homo sapiens
gggagcuccuacaucuaug

SEQ ID NO: 405790 - RNA, 19 nt, Homo sapiens
gccaaucgagugacugaca

SEQ ID NO: 405791 - RNA, 19 nt, Homo sapiens
gcugauacccaggcaguag

SEQ ID NO: 405792 - RNA, 19 nt, Homo sapiens
auucgccguugccacuuua

SEQ ID NO: 405793 - RNA, 19 nt, Homo sapiens
gcuauguugaugcuaccua

SEQ ID NO: 405794 - RNA, 19 nt, Homo sapiens
gaaugaaacucaacucaau

SEQ ID NO: 405795 - RNA, 19 nt, Homo sapiens
caacccagcucauuucuuc

SEQ ID NO: 405796 - RNA, 19 nt, Homo sapiens
gaagaaacaguccaaacaa

SEQ ID NO: 405797 - RNA, 19 nt, Homo sapiens
ggaagaaacaguccaaaca

SEQ ID NO: 405798 - RNA, 19 nt, Homo sapiens
caucgcagcuggcaucuuc

SEQ ID NO: 405799 - RNA, 19 nt, Homo sapiens
gcuaguguuugccgaauga

SEQ ID NO: 405800 - RNA, 19 nt, Homo sapiens
gcauugaggcccaguaaga

SEQ ID NO: 405801 - RNA, 19 nt, Homo sapiens
gagcauugaggcccaguaa

SEQ ID NO: 405802 - RNA, 19 nt, Homo sapiens
cacuucauaucuccuaaua

SEQ ID NO: 405803 - RNA, 19 nt, Homo sapiens
agcaauggcuguauuugaa

SEQ ID NO: 405804 - RNA, 19 nt, Homo sapiens
cagcaucuauccucaugga

SEQ ID NO: 405805 - RNA, 19 nt, Homo sapiens
acacagugcccaacaagaa

SEQ ID NO: 405806 - RNA, 19 nt, Homo sapiens
aagaaacaguccaaacaau

SEQ ID NO: 405807 - RNA, 19 nt, Homo sapiens
agauugaggugcuggaaga

SEQ ID NO: 405808 - RNA, 19 nt, Homo sapiens
ggacagcugcagacacaga

SEQ ID NO: 405809 - RNA, 19 nt, Homo sapiens
ccgcaggaaugccgucuug

SEQ ID NO: 405810 - RNA, 19 nt, Homo sapiens
caauggcuguauuugaaga

SEQ ID NO: 405811 - RNA, 19 nt, Homo sapiens
ggaggcuucucuuuugaua

SEQ ID NO: 405812 - RNA, 19 nt, Homo sapiens
gaccucaccucuacagcau

SEQ ID NO: 405813 - RNA, 19 nt, Homo sapiens
gcaggaaugccgucuugga

SEQ ID NO: 405814 - RNA, 19 nt, Homo sapiens
cgaaugaaacucaacucaa

SEQ ID NO: 405815 - RNA, 19 nt, Homo sapiens
guaucaagguuacauuggu

SEQ ID NO: 405816 - RNA, 19 nt, Homo sapiens
ugacaacccagcucauuuc

SEQ ID NO: 405817 - RNA, 19 nt, Homo sapiens
cagcuggcaucuucaacga

SEQ ID NO: 405818 - RNA, 19 nt, Homo sapiens
ggaggaggaagccaagaau

SEQ ID NO: 405819 - RNA, 19 nt, Homo sapiens
ugggacagcugcagacaca

SEQ ID NO: 405820 - RNA, 19 nt, Homo sapiens
cauacacagugcccaacaa

SEQ ID NO: 405821 - RNA, 19 nt, Homo sapiens
gauacaagagcaacugaag

SEQ ID NO: 405822 - RNA, 19 nt, Homo sapiens
ggaggaagccaagaaucug

SEQ ID NO: 405823 - RNA, 19 nt, Homo sapiens
caggaaugccgucuuggaa

SEQ ID NO: 405824 - RNA, 19 nt, Homo sapiens
uggcuguauuugaagauaa

SEQ ID NO: 405825 - RNA, 19 nt, Homo sapiens
uacagcaucuauccucaug

SEQ ID NO: 405826 - RNA, 19 nt, Homo sapiens
gcagaugcuuuucagguau

SEQ ID NO: 405827 - RNA, 19 nt, Homo sapiens
gcagauacaagagcaacug

SEQ ID NO: 405828 - RNA, 19 nt, Homo sapiens
ggauacaagcuuccaaagg

SEQ ID NO: 405829 - RNA, 19 nt, Homo sapiens
ccaguaagacacucaugug

SEQ ID NO: 405830 - RNA, 19 nt, Homo sapiens
guuggaggcuucucuuuug

SEQ ID NO: 405831 - RNA, 19 nt, Homo sapiens
ggaagccgauuuugcaaag

SEQ ID NO: 405832 - RNA, 19 nt, Homo sapiens
gcaauggcuguauuugaag

SEQ ID NO: 405833 - RNA, 19 nt, Homo sapiens
gcagacacagacaugacaa

SEQ ID NO: 405834 - RNA, 19 nt, Homo sapiens
ggucuauaaggauggcaua

SEQ ID NO: 405835 - RNA, 19 nt, Homo sapiens
uuacuggaccucaccucua

SEQ ID NO: 405836 - RNA, 19 nt, Homo sapiens
uggcggcugugucggugua

SEQ ID NO: 405837 - RNA, 19 nt, Homo sapiens
ggagauugaggugcuggaa

SEQ ID NO: 405838 - RNA, 19 nt, Homo sapiens
caaauugggcagcugaaaa

SEQ ID NO: 405839 - RNA, 19 nt, Homo sapiens
ucauguggcuaguguuugc

SEQ ID NO: 405840 - RNA, 19 nt, Homo sapiens
gaggaggaagccaagaauc

SEQ ID NO: 405841 - RNA, 19 nt, Homo sapiens
acucauguggcuaguguuu

SEQ ID NO: 405842 - RNA, 19 nt, Homo sapiens
ccucaccucuacagcaucu

SEQ ID NO: 405843 - RNA, 19 nt, Homo sapiens
ggcuguauuugaagauaag

SEQ ID NO: 405844 - RNA, 19 nt, Homo sapiens
aaggauggcauaguucuug

SEQ ID NO: 405845 - RNA, 19 nt, Homo sapiens
ccgaaugaaacucaacuca

SEQ ID NO: 405846 - RNA, 19 nt, Homo sapiens
gcuccggaagcaacauuga

SEQ ID NO: 405847 - RNA, 19 nt, Homo sapiens
cagauacaagagcaacuga

SEQ ID NO: 405848 - RNA, 19 nt, Homo sapiens
gaaaggaacguucagauug

SEQ ID NO: 405849 - RNA, 19 nt, Homo sapiens
ugauugagauuaacccuua

SEQ ID NO: 405850 - RNA, 19 nt, Homo sapiens
ggacucggcucucaggaaa

SEQ ID NO: 405851 - RNA, 19 nt, Homo sapiens
aaaggaacguucagauuga

SEQ ID NO: 405852 - RNA, 19 nt, Homo sapiens
gguugaagcugcgccuuua

SEQ ID NO: 405853 - RNA, 19 nt, Homo sapiens
ucagcuggguccuacauua

SEQ ID NO: 405854 - RNA, 19 nt, Homo sapiens
acaaggugauugagauuaa

SEQ ID NO: 405855 - RNA, 19 nt, Homo sapiens
gaacaaggugauugagauu

SEQ ID NO: 405856 - RNA, 19 nt, Homo sapiens
ggaagccaaucaauaaugg

SEQ ID NO: 405857 - RNA, 19 nt, Homo sapiens
ggaagaugguugggugaaa

SEQ ID NO: 405858 - RNA, 19 nt, Homo sapiens
gaaaguagaaaguacagau

SEQ ID NO: 405859 - RNA, 19 nt, Homo sapiens
gauuaacccuuaccugcuu

SEQ ID NO: 405860 - RNA, 19 nt, Homo sapiens
gguauauucuguugcaguu

SEQ ID NO: 405861 - RNA, 19 nt, Homo sapiens
gaagaugguugggugaaag

SEQ ID NO: 405862 - RNA, 19 nt, Homo sapiens
ccacuaaguagaauaaaga

SEQ ID NO: 405863 - RNA, 19 nt, Homo sapiens
ugaacaaggugauugagau

SEQ ID NO: 405864 - RNA, 19 nt, Homo sapiens
gcuccuggcugacuucuag

SEQ ID NO: 405865 - RNA, 19 nt, Homo sapiens
ccgggaagccaaucaauaa

SEQ ID NO: 405866 - RNA, 19 nt, Homo sapiens
guaaagugaugcucauagg

SEQ ID NO: 405867 - RNA, 19 nt, Homo sapiens
gcagggcuauugcuuaugc

SEQ ID NO: 405868 - RNA, 19 nt, Homo sapiens
ccaccacgcucgccuucaa

SEQ ID NO: 405869 - RNA, 19 nt, Homo sapiens
ccgcagggcuauugcuuau

SEQ ID NO: 405870 - RNA, 19 nt, Homo sapiens
ggcuaucggccuaaucuua

SEQ ID NO: 405871 - RNA, 19 nt, Homo sapiens
gaaagggcacgcucuugug

SEQ ID NO: 405872 - RNA, 19 nt, Homo sapiens
ccuccaagcugcuguccaa

SEQ ID NO: 405873 - RNA, 19 nt, Homo sapiens
acucggcucucaggaaaua

SEQ ID NO: 405874 - RNA, 19 nt, Homo sapiens
guggaaagauucagagacu

SEQ ID NO: 405875 - RNA, 19 nt, Homo sapiens
gaggcguugucaauaugua

SEQ ID NO: 405876 - RNA, 19 nt, Homo sapiens
agaaaggaacguucagauu

SEQ ID NO: 405877 - RNA, 19 nt, Homo sapiens
ugaagaggccuaugaccuu

SEQ ID NO: 405878 - RNA, 19 nt, Homo sapiens
ggagaacguauuucagugu

SEQ ID NO: 405879 - RNA, 19 nt, Homo sapiens
gcagaaagggcacgcucuu

SEQ ID NO: 405880 - RNA, 19 nt, Homo sapiens
gagaaaggaacguucagau

SEQ ID NO: 405881 - RNA, 19 nt, Homo sapiens
gggaagccaaucaauaaug

SEQ ID NO: 405882 - RNA, 19 nt, Homo sapiens
aagcugcgccuuuagauga

SEQ ID NO: 405883 - RNA, 19 nt, Homo sapiens
cuucuagucuucugguuga

SEQ ID NO: 405884 - RNA, 19 nt, Homo sapiens
aagcugcuguccaacauga

SEQ ID NO: 405885 - RNA, 19 nt, Homo sapiens
aaagugaugcucauaggaa

SEQ ID NO: 405886 - RNA, 19 nt, Homo sapiens
ccaagcugcuguccaacau

SEQ ID NO: 405887 - RNA, 19 nt, Homo sapiens
gcggguauauucuguugca

SEQ ID NO: 405888 - RNA, 19 nt, Homo sapiens
ggagaaaggaacguucaga

SEQ ID NO: 405889 - RNA, 19 nt, Homo sapiens
gaagcugcgccuuuagaug

SEQ ID NO: 405890 - RNA, 19 nt, Homo sapiens
ggaccuaagccacguuaag

SEQ ID NO: 405891 - RNA, 19 nt, Homo sapiens
ucacagagacagcuauucu

SEQ ID NO: 405892 - RNA, 19 nt, Homo sapiens
gaaugcaggcuguacuauc

SEQ ID NO: 405893 - RNA, 19 nt, Homo sapiens
ggaggccggugaagugcau

SEQ ID NO: 405894 - RNA, 19 nt, Homo sapiens
uaagccacguuaaguccaa

SEQ ID NO: 405895 - RNA, 19 nt, Homo sapiens
cuggaggcguugucaauau

SEQ ID NO: 405896 - RNA, 19 nt, Homo sapiens
gccuggagcccacagaauu

SEQ ID NO: 405897 - RNA, 19 nt, Homo sapiens
gugaccugcugcaccagua

SEQ ID NO: 405898 - RNA, 19 nt, Homo sapiens
ggucauggacaguggcuau

SEQ ID NO: 405899 - RNA, 19 nt, Homo sapiens
gggcaugggccucucuaug

SEQ ID NO: 405900 - RNA, 19 nt, Homo sapiens
ggacggagaaaggaacguu

SEQ ID NO: 405901 - RNA, 19 nt, Homo sapiens
gaccuaagccacguuaagu

SEQ ID NO: 405902 - RNA, 19 nt, Homo sapiens
guccuacauuagugccuua

SEQ ID NO: 405903 - RNA, 19 nt, Homo sapiens
guagaaaguacagauguca

SEQ ID NO: 405904 - RNA, 19 nt, Homo sapiens
gcccugaagaggccuauga

SEQ ID NO: 405905 - RNA, 19 nt, Homo sapiens
ggaaugcaggcuguacuau

SEQ ID NO: 405906 - RNA, 19 nt, Homo sapiens
gaacguucagauugagaug

SEQ ID NO: 405907 - RNA, 19 nt, Homo sapiens
ggcaugggccucucuaugg

SEQ ID NO: 405908 - RNA, 19 nt, Homo sapiens
gcgaaauggagaacguauu

SEQ ID NO: 405909 - RNA, 19 nt, Homo sapiens
aaugcaggcuguacuaucu

SEQ ID NO: 405910 - RNA, 19 nt, Homo sapiens
gcuggguccuacauuagug

SEQ ID NO: 405911 - RNA, 19 nt, Homo sapiens
uggaggcguugucaauaug

SEQ ID NO: 405912 - RNA, 19 nt, Homo sapiens
agaaagggcacgcucuugu

SEQ ID NO: 405913 - RNA, 19 nt, Homo sapiens
gcuguacuaucugcgaaau

SEQ ID NO: 405914 - RNA, 19 nt, Homo sapiens
aaaguacagaugucaguga

SEQ ID NO: 405915 - RNA, 19 nt, Homo sapiens
gggugaaaguagaaaguac

SEQ ID NO: 405916 - RNA, 19 nt, Homo sapiens
uguacuaucugcgaaaugg

SEQ ID NO: 405917 - RNA, 19 nt, Homo sapiens
uaaagugaugcucauagga

SEQ ID NO: 405918 - RNA, 19 nt, Homo sapiens
cagguuaggagaccguuga

SEQ ID NO: 405919 - RNA, 19 nt, Homo sapiens
agaggaggccggugaagug

SEQ ID NO: 405920 - RNA, 19 nt, Homo sapiens
gccgcagggcuauugcuua

SEQ ID NO: 405921 - RNA, 19 nt, Homo sapiens
gcucucaggaaauauguuc

SEQ ID NO: 405922 - RNA, 19 nt, Homo sapiens
gugaacaaggugauugaga

SEQ ID NO: 405923 - RNA, 19 nt, Homo sapiens
ggugaaaguagaaaguaca

SEQ ID NO: 405924 - RNA, 19 nt, Homo sapiens
ucuacuacguggaugaaca

SEQ ID NO: 405925 - RNA, 19 nt, Homo sapiens
uguaccacaugaaggaaga

SEQ ID NO: 405926 - RNA, 19 nt, Homo sapiens
gggacucggcucucaggaa

SEQ ID NO: 405927 - RNA, 19 nt, Homo sapiens
ggaacguucagauugagau

SEQ ID NO: 405928 - RNA, 19 nt, Homo sapiens
aaaguagaaaguacagaug

SEQ ID NO: 405929 - RNA, 19 nt, Homo sapiens
gggugaacaaggugauuga

SEQ ID NO: 405930 - RNA, 19 nt, Homo sapiens
uuaaguccaaggagaagaa

SEQ ID NO: 405931 - RNA, 19 nt, Homo sapiens
ggagcccacagaauucuuc

SEQ ID NO: 405932 - RNA, 19 nt, Homo sapiens
gugggugacuacagguuag

SEQ ID NO: 405933 - RNA, 19 nt, Homo sapiens
aacaaggugauugagauua

SEQ ID NO: 405934 - RNA, 19 nt, Homo sapiens
ggccuagccugagccaaag

SEQ ID NO: 405935 - RNA, 19 nt, Homo sapiens
guaccgggaagccaaucaa

SEQ ID NO: 405936 - RNA, 19 nt, Homo sapiens
cagaaagggcacgcucuug

SEQ ID NO: 405937 - RNA, 19 nt, Homo sapiens
caaggugauugagauuaac

SEQ ID NO: 405938 - RNA, 19 nt, Homo sapiens
cccacuaaguagaauaaag

SEQ ID NO: 405939 - RNA, 19 nt, Homo sapiens
gaugguugggugaaaguag

SEQ ID NO: 405940 - RNA, 19 nt, Homo sapiens
ccacaugaaggaagauggu

SEQ ID NO: 405941 - RNA, 19 nt, Homo sapiens
ggaggcguugucaauaugu

SEQ ID NO: 405942 - RNA, 19 nt, Homo sapiens
ccacucacagagacagcua

SEQ ID NO: 405943 - RNA, 19 nt, Homo sapiens
cagcuggguccuacauuag

SEQ ID NO: 405944 - RNA, 19 nt, Homo sapiens
gaaaggaacguucagauug

SEQ ID NO: 405945 - RNA, 19 nt, Homo sapiens
gaaugaagcccacagaauu

SEQ ID NO: 405946 - RNA, 19 nt, Homo sapiens
ugauugagauuaacccuua

SEQ ID NO: 405947 - RNA, 19 nt, Homo sapiens
ggacucggcucucaggaaa

SEQ ID NO: 405948 - RNA, 19 nt, Homo sapiens
aaaggaacguucagauuga

SEQ ID NO: 405949 - RNA, 19 nt, Homo sapiens
ucagcuggguccuacauua

SEQ ID NO: 405950 - RNA, 19 nt, Homo sapiens
acaaggugauugagauuaa

SEQ ID NO: 405951 - RNA, 19 nt, Homo sapiens
gaacaaggugauugagauu

SEQ ID NO: 405952 - RNA, 19 nt, Homo sapiens
ggaagccaaucaauaaugg

SEQ ID NO: 405953 - RNA, 19 nt, Homo sapiens
ggaagaugguugggugaaa

SEQ ID NO: 405954 - RNA, 19 nt, Homo sapiens
gaaaguagaaaguacagau

SEQ ID NO: 405955 - RNA, 19 nt, Homo sapiens
gauuaacccuuaccugcuu

SEQ ID NO: 405956 - RNA, 19 nt, Homo sapiens
ggaaugaagcccacagaau

SEQ ID NO: 405957 - RNA, 19 nt, Homo sapiens
gaagaugguugggugaaag

SEQ ID NO: 405958 - RNA, 19 nt, Homo sapiens
ccacuaaguagaauaaaga

SEQ ID NO: 405959 - RNA, 19 nt, Homo sapiens
ugaacaaggugauugagau

SEQ ID NO: 405960 - RNA, 19 nt, Homo sapiens
ccgggaagccaaucaauaa

SEQ ID NO: 405961 - RNA, 19 nt, Homo sapiens
gcagggcuauugcuuaugc

SEQ ID NO: 405962 - RNA, 19 nt, Homo sapiens
ccaccacgcucgccuucaa

SEQ ID NO: 405963 - RNA, 19 nt, Homo sapiens
ccgcagggcuauugcuuau

SEQ ID NO: 405964 - RNA, 19 nt, Homo sapiens
ggcuaucggccuaaucuua

SEQ ID NO: 405965 - RNA, 19 nt, Homo sapiens
ggucauggcgcuacuagau

SEQ ID NO: 405966 - RNA, 19 nt, Homo sapiens
ccuccaagcugcuguccaa

SEQ ID NO: 405967 - RNA, 19 nt, Homo sapiens
acucggcucucaggaaaua

SEQ ID NO: 405968 - RNA, 19 nt, Homo sapiens
gaggcguugucaauaugua

SEQ ID NO: 405969 - RNA, 19 nt, Homo sapiens
agaaaggaacguucagauu

SEQ ID NO: 405970 - RNA, 19 nt, Homo sapiens
ugaagaggccuaugaccuu

SEQ ID NO: 405971 - RNA, 19 nt, Homo sapiens
ggagaacguauuucagugu

SEQ ID NO: 405972 - RNA, 19 nt, Homo sapiens
gagaaaggaacguucagau

SEQ ID NO: 405973 - RNA, 19 nt, Homo sapiens
gggaagccaaucaauaaug

SEQ ID NO: 405974 - RNA, 19 nt, Homo sapiens
acacuacaguuucucuaug

SEQ ID NO: 405975 - RNA, 19 nt, Homo sapiens
aagcugcuguccaacauga

SEQ ID NO: 405976 - RNA, 19 nt, Homo sapiens
ggacacuacaguuucucua

SEQ ID NO: 405977 - RNA, 19 nt, Homo sapiens
ccaagcugcuguccaacau

SEQ ID NO: 405978 - RNA, 19 nt, Homo sapiens
ggagaaaggaacguucaga

SEQ ID NO: 405979 - RNA, 19 nt, Homo sapiens
ggaccuaagccacguuaag

SEQ ID NO: 405980 - RNA, 19 nt, Homo sapiens
ucauggcgcuacuagaugu

SEQ ID NO: 405981 - RNA, 19 nt, Homo sapiens
ucacagagacagcuauucu

SEQ ID NO: 405982 - RNA, 19 nt, Homo sapiens
gaaugcaggcuguacuauc

SEQ ID NO: 405983 - RNA, 19 nt, Homo sapiens
ggaggccggugaagugcau

SEQ ID NO: 405984 - RNA, 19 nt, Homo sapiens
uaagccacguuaaguccaa

SEQ ID NO: 405985 - RNA, 19 nt, Homo sapiens
cuggaggcguugucaauau

SEQ ID NO: 405986 - RNA, 19 nt, Homo sapiens
ccaggacacuacaguuucu

SEQ ID NO: 405987 - RNA, 19 nt, Homo sapiens
gugaccugcugcaccagua

SEQ ID NO: 405988 - RNA, 19 nt, Homo sapiens
ggucauggacaguggcuau

SEQ ID NO: 405989 - RNA, 19 nt, Homo sapiens
ggacggagaaaggaacguu

SEQ ID NO: 405990 - RNA, 19 nt, Homo sapiens
gggcaugggccucucuaug

SEQ ID NO: 405991 - RNA, 19 nt, Homo sapiens
gaccuaagccacguuaagu

SEQ ID NO: 405992 - RNA, 19 nt, Homo sapiens
guccuacauuagugccuua

SEQ ID NO: 405993 - RNA, 19 nt, Homo sapiens
guagaaaguacagauguca

SEQ ID NO: 405994 - RNA, 19 nt, Homo sapiens
gcccugaagaggccuauga

SEQ ID NO: 405995 - RNA, 19 nt, Homo sapiens
gacacuacaguuucucuau

SEQ ID NO: 405996 - RNA, 19 nt, Homo sapiens
ggaaugcaggcuguacuau

SEQ ID NO: 405997 - RNA, 19 nt, Homo sapiens
gaacguucagauugagaug

SEQ ID NO: 405998 - RNA, 19 nt, Homo sapiens
gggaaugaagcccacagaa

SEQ ID NO: 405999 - RNA, 19 nt, Homo sapiens
ggcaugggccucucuaugg

SEQ ID NO: 406000 - RNA, 19 nt, Homo sapiens
gcgaaauggagaacguauu

SEQ ID NO: 406001 - RNA, 19 nt, Homo sapiens
aaugcaggcuguacuaucu

SEQ ID NO: 406002 - RNA, 19 nt, Homo sapiens
gcuggguccuacauuagug

SEQ ID NO: 406003 - RNA, 19 nt, Homo sapiens
uggaggcguugucaauaug

SEQ ID NO: 406004 - RNA, 19 nt, Homo sapiens
gcuguacuaucugcgaaau

SEQ ID NO: 406005 - RNA, 19 nt, Homo sapiens
aaaguacagaugucaguga

SEQ ID NO: 406006 - RNA, 19 nt, Homo sapiens
gggugaaaguagaaaguac

SEQ ID NO: 406007 - RNA, 19 nt, Homo sapiens
uguacuaucugcgaaaugg

SEQ ID NO: 406008 - RNA, 19 nt, Homo sapiens
agaggaggccggugaagug

SEQ ID NO: 406009 - RNA, 19 nt, Homo sapiens
gccgcagggcuauugcuua

SEQ ID NO: 406010 - RNA, 19 nt, Homo sapiens
gcucucaggaaauauguuc

SEQ ID NO: 406011 - RNA, 19 nt, Homo sapiens
gaucuccagagcucgcuuu

SEQ ID NO: 406012 - RNA, 19 nt, Homo sapiens
gugaacaaggugauugaga

SEQ ID NO: 406013 - RNA, 19 nt, Homo sapiens
ggacccaggacacuacagu

SEQ ID NO: 406014 - RNA, 19 nt, Homo sapiens
gcucggacccaggacacua

SEQ ID NO: 406015 - RNA, 19 nt, Homo sapiens
ggugaaaguagaaaguaca

SEQ ID NO: 406016 - RNA, 19 nt, Homo sapiens
ucuacuacguggaugaaca

SEQ ID NO: 406017 - RNA, 19 nt, Homo sapiens
uguaccacaugaaggaaga

SEQ ID NO: 406018 - RNA, 19 nt, Homo sapiens
ggaacguucagauugagau

SEQ ID NO: 406019 - RNA, 19 nt, Homo sapiens
gggacucggcucucaggaa

SEQ ID NO: 406020 - RNA, 19 nt, Homo sapiens
aaugaagcccacagaauuc

SEQ ID NO: 406021 - RNA, 19 nt, Homo sapiens
aaaguagaaaguacagaug

SEQ ID NO: 406022 - RNA, 19 nt, Homo sapiens
gggugaacaaggugauuga

SEQ ID NO: 406023 - RNA, 19 nt, Homo sapiens
uuaaguccaaggagaagaa

SEQ ID NO: 406024 - RNA, 19 nt, Homo sapiens
aacaaggugauugagauua

SEQ ID NO: 406025 - RNA, 19 nt, Homo sapiens
ggccuagccugagccaaag

SEQ ID NO: 406026 - RNA, 19 nt, Homo sapiens
guaccgggaagccaaucaa

SEQ ID NO: 406027 - RNA, 19 nt, Homo sapiens
caaggugauugagauuaac

SEQ ID NO: 406028 - RNA, 19 nt, Homo sapiens
cccacuaaguagaauaaag

SEQ ID NO: 406029 - RNA, 19 nt, Homo sapiens
gaugguugggugaaaguag

SEQ ID NO: 406030 - RNA, 19 nt, Homo sapiens
ccacaugaaggaagauggu

SEQ ID NO: 406031 - RNA, 19 nt, Homo sapiens
ggaggcguugucaauaugu

SEQ ID NO: 406032 - RNA, 19 nt, Homo sapiens
ccacucacagagacagcua

SEQ ID NO: 406033 - RNA, 19 nt, Homo sapiens
cagcuggguccuacauuag

SEQ ID NO: 406034 - RNA, 19 nt, Homo sapiens
caaccacgcccacgucauu

SEQ ID NO: 406035 - RNA, 19 nt, Homo sapiens
ggacuucccucgccuucca

SEQ ID NO: 406036 - RNA, 19 nt, Homo sapiens
guccuucccuggucccaaa

SEQ ID NO: 406037 - RNA, 19 nt, Homo sapiens
gugcagcccuugggacuuc

SEQ ID NO: 406038 - RNA, 19 nt, Homo sapiens
cacaagcuaucgcuauggu

SEQ ID NO: 406039 - RNA, 19 nt, Homo sapiens
gcaaauguggugagaaaua

SEQ ID NO: 406040 - RNA, 19 nt, Homo sapiens
gcaaugaacugccaaaauu

SEQ ID NO: 406041 - RNA, 19 nt, Homo sapiens
gcaccuuuaucuaugguua

SEQ ID NO: 406042 - RNA, 19 nt, Homo sapiens
ugaaggaggucagguauau

SEQ ID NO: 406043 - RNA, 19 nt, Homo sapiens
caaauguggugagaaauau

SEQ ID NO: 406044 - RNA, 19 nt, Homo sapiens
ggacuugucugcacaucuc

SEQ ID NO: 406045 - RNA, 19 nt, Homo sapiens
ggugagaaauaucagcuau

SEQ ID NO: 406046 - RNA, 19 nt, Homo sapiens
cugcaaauguggugagaaa

SEQ ID NO: 406047 - RNA, 19 nt, Homo sapiens
ucaucuaccuggucacuau

SEQ ID NO: 406048 - RNA, 19 nt, Homo sapiens
ccagacuucucuuucuuau

SEQ ID NO: 406049 - RNA, 19 nt, Homo sapiens
ggcagcaccuuuaucuaug

SEQ ID NO: 406050 - RNA, 19 nt, Homo sapiens
caucauggcaguggaguuu

SEQ ID NO: 406051 - RNA, 19 nt, Homo sapiens
ggagcuccaugggauagaa

SEQ ID NO: 406052 - RNA, 19 nt, Homo sapiens
cgagucaucuugggcaaug

SEQ ID NO: 406053 - RNA, 19 nt, Homo sapiens
gaaccgaguguuugacaag

SEQ ID NO: 406054 - RNA, 19 nt, Homo sapiens
gcagcaccuuuaucuaugg

SEQ ID NO: 406055 - RNA, 19 nt, Homo sapiens
cggcagcaccuuuaucuau

SEQ ID NO: 406056 - RNA, 19 nt, Homo sapiens
uaaacucucuagggccaaa

SEQ ID NO: 406057 - RNA, 19 nt, Homo sapiens
ucauggcaguggaguuuga

SEQ ID NO: 406058 - RNA, 19 nt, Homo sapiens
ggaggucagguauauggaa

SEQ ID NO: 406059 - RNA, 19 nt, Homo sapiens
gcaggcgcuucaccacaga

SEQ ID NO: 406060 - RNA, 19 nt, Homo sapiens
gguggugaaccgaguguuu

SEQ ID NO: 406061 - RNA, 19 nt, Homo sapiens
uaucuaugguuauguggau

SEQ ID NO: 406062 - RNA, 19 nt, Homo sapiens
gugagaaauaucagcuaua

SEQ ID NO: 406063 - RNA, 19 nt, Homo sapiens
caucuacugugcacucucu

SEQ ID NO: 406064 - RNA, 19 nt, Homo sapiens
gugaaggaggucagguaua

SEQ ID NO: 406065 - RNA, 19 nt, Homo sapiens
cccagacuucucuuucuua

SEQ ID NO: 406066 - RNA, 19 nt, Homo sapiens
gaaggaggucagguauaug

SEQ ID NO: 406067 - RNA, 19 nt, Homo sapiens
auaaauaucgagaggacuu

SEQ ID NO: 406068 - RNA, 19 nt, Homo sapiens
ugaaccgaguguuugacaa

SEQ ID NO: 406069 - RNA, 19 nt, Homo sapiens
ggaccaucgagucaucuug

SEQ ID NO: 406070 - RNA, 19 nt, Homo sapiens
gucugcacaucucauggua

SEQ ID NO: 406071 - RNA, 19 nt, Homo sapiens
gaggagugcaggcgcuuca

SEQ ID NO: 406072 - RNA, 19 nt, Homo sapiens
gguguggaccaucgaguca

SEQ ID NO: 406073 - RNA, 19 nt, Homo sapiens
gcaaauguggugagaaaua

SEQ ID NO: 406074 - RNA, 19 nt, Homo sapiens
gcaaugaacugccaaaauu

SEQ ID NO: 406075 - RNA, 19 nt, Homo sapiens
gcaccuuuaucuaugguua

SEQ ID NO: 406076 - RNA, 19 nt, Homo sapiens
ugaaggaggucagguauau

SEQ ID NO: 406077 - RNA, 19 nt, Homo sapiens
caaauguggugagaaauau

SEQ ID NO: 406078 - RNA, 19 nt, Homo sapiens
ggacuugucugcacaucuc

SEQ ID NO: 406079 - RNA, 19 nt, Homo sapiens
ggugagaaauaucagcuau

SEQ ID NO: 406080 - RNA, 19 nt, Homo sapiens
cugcaaauguggugagaaa

SEQ ID NO: 406081 - RNA, 19 nt, Homo sapiens
ucaucuaccuggucacuau

SEQ ID NO: 406082 - RNA, 19 nt, Homo sapiens
ccagacuucucuuucuuau

SEQ ID NO: 406083 - RNA, 19 nt, Homo sapiens
ggcagcaccuuuaucuaug

SEQ ID NO: 406084 - RNA, 19 nt, Homo sapiens
caucauggcaguggaguuu

SEQ ID NO: 406085 - RNA, 19 nt, Homo sapiens
ggagcuccaugggauagaa

SEQ ID NO: 406086 - RNA, 19 nt, Homo sapiens
cgagucaucuugggcaaug

SEQ ID NO: 406087 - RNA, 19 nt, Homo sapiens
gaaccgaguguuugacaag

SEQ ID NO: 406088 - RNA, 19 nt, Homo sapiens
gcagcaccuuuaucuaugg

SEQ ID NO: 406089 - RNA, 19 nt, Homo sapiens
cggcagcaccuuuaucuau

SEQ ID NO: 406090 - RNA, 19 nt, Homo sapiens
uaaacucucuagggccaaa

SEQ ID NO: 406091 - RNA, 19 nt, Homo sapiens
ucauggcaguggaguuuga

SEQ ID NO: 406092 - RNA, 19 nt, Homo sapiens
ggaggucagguauauggaa

SEQ ID NO: 406093 - RNA, 19 nt, Homo sapiens
gcaggcgcuucaccacaga

SEQ ID NO: 406094 - RNA, 19 nt, Homo sapiens
gguggugaaccgaguguuu

SEQ ID NO: 406095 - RNA, 19 nt, Homo sapiens
uaucuaugguuauguggau

SEQ ID NO: 406096 - RNA, 19 nt, Homo sapiens
caucuacugugcacucucu

SEQ ID NO: 406097 - RNA, 19 nt, Homo sapiens
gugagaaauaucagcuaua

SEQ ID NO: 406098 - RNA, 19 nt, Homo sapiens
gugaaggaggucagguaua

SEQ ID NO: 406099 - RNA, 19 nt, Homo sapiens
cccagacuucucuuucuua

SEQ ID NO: 406100 - RNA, 19 nt, Homo sapiens
gaaggaggucagguauaug

SEQ ID NO: 406101 - RNA, 19 nt, Homo sapiens
ugaaccgaguguuugacaa

SEQ ID NO: 406102 - RNA, 19 nt, Homo sapiens
auaaauaucgagaggacuu

SEQ ID NO: 406103 - RNA, 19 nt, Homo sapiens
ggaccaucgagucaucuug

SEQ ID NO: 406104 - RNA, 19 nt, Homo sapiens
gucugcacaucucauggua

SEQ ID NO: 406105 - RNA, 19 nt, Homo sapiens
gaggagugcaggcgcuuca

SEQ ID NO: 406106 - RNA, 19 nt, Homo sapiens
gguguggaccaucgaguca

SEQ ID NO: 406107 - RNA, 19 nt, Homo sapiens
gacaagagcugcgagaaga

SEQ ID NO: 406108 - RNA, 19 nt, Homo sapiens
gccagacgcucuucaggua

SEQ ID NO: 406109 - RNA, 19 nt, Homo sapiens
ggaauaaacccagaaaaua

SEQ ID NO: 406110 - RNA, 19 nt, Homo sapiens
ccacagagcccgugaagag

SEQ ID NO: 406111 - RNA, 19 nt, Homo sapiens
gagcuacacgcguuaucua

SEQ ID NO: 406112 - RNA, 19 nt, Homo sapiens
gagaacugccaaagaaaug

SEQ ID NO: 406113 - RNA, 19 nt, Homo sapiens
ggacaagagcugcgagaag

SEQ ID NO: 406114 - RNA, 19 nt, Homo sapiens
uucgagaacugccaaagaa

SEQ ID NO: 406115 - RNA, 19 nt, Homo sapiens
gaugguggcguccaagaug

SEQ ID NO: 406116 - RNA, 19 nt, Homo sapiens
gaauaaacccagaaaauac

SEQ ID NO: 406117 - RNA, 19 nt, Homo sapiens
cgagaacugccaaagaaau

SEQ ID NO: 406118 - RNA, 19 nt, Homo sapiens
gcaauguggacgcaugugu

SEQ ID NO: 406119 - RNA, 19 nt, Homo sapiens
ugacuggaccgcagcucua

SEQ ID NO: 406120 - RNA, 19 nt, Homo sapiens
gauggagcuacacgcguua

SEQ ID NO: 406121 - RNA, 19 nt, Homo sapiens
gggaauaaacccagaaaau

SEQ ID NO: 406122 - RNA, 19 nt, Homo sapiens
aggaaacugugcaggcuau

SEQ ID NO: 406123 - RNA, 19 nt, Homo sapiens
ccgauacgcgagccacuaa

SEQ ID NO: 406124 - RNA, 19 nt, Homo sapiens
gaacugccaaagaaaugca

SEQ ID NO: 406125 - RNA, 19 nt, Homo sapiens
cuauggagguggaguaagc

SEQ ID NO: 406126 - RNA, 19 nt, Homo sapiens
guccugacccagacaguga

SEQ ID NO: 406127 - RNA, 19 nt, Homo sapiens
aaacugugcaggcuaugga

SEQ ID NO: 406128 - RNA, 19 nt, Homo sapiens
aagccuagcagaggacuuu

SEQ ID NO: 406129 - RNA, 19 nt, Homo sapiens
ggucuggccgcuaccacuu

SEQ ID NO: 406130 - RNA, 19 nt, Homo sapiens
ggagcuacacgcguuaucu

SEQ ID NO: 406131 - RNA, 19 nt, Homo sapiens
ggaugguggcguccaagau

SEQ ID NO: 406132 - RNA, 19 nt, Homo sapiens
caagagcugcgagaagauc

SEQ ID NO: 406133 - RNA, 19 nt, Homo sapiens
gaaacugugcaggcuaugg

SEQ ID NO: 406134 - RNA, 19 nt, Homo sapiens
gaacguagaaugaaaguaa

SEQ ID NO: 406135 - RNA, 19 nt, Homo sapiens
gaggaagaauucauuagaa

SEQ ID NO: 406136 - RNA, 19 nt, Homo sapiens
ggaugacgcuggcugauga

SEQ ID NO: 406137 - RNA, 19 nt, Homo sapiens
gaaauucagcgaacaaugu

SEQ ID NO: 406138 - RNA, 19 nt, Homo sapiens
ggagaccuaugcagauauu

SEQ ID NO: 406139 - RNA, 19 nt, Homo sapiens
ucacccauccugaauauua

SEQ ID NO: 406140 - RNA, 19 nt, Homo sapiens
gugguuggcucugaacuua

SEQ ID NO: 406141 - RNA, 19 nt, Homo sapiens
gcaagaaggaugacaagga

SEQ ID NO: 406142 - RNA, 19 nt, Homo sapiens
gacgcuggcugaugaugua

SEQ ID NO: 406143 - RNA, 19 nt, Homo sapiens
caggagaccuaugcagaua

SEQ ID NO: 406144 - RNA, 19 nt, Homo sapiens
guaggaaccuuggaagaga

SEQ ID NO: 406145 - RNA, 19 nt, Homo sapiens
ggaggaagaauucauuaga

SEQ ID NO: 406146 - RNA, 19 nt, Homo sapiens
gaaaucaggaacaaaugaa

SEQ ID NO: 406147 - RNA, 19 nt, Homo sapiens
gaaauaugaaccuccugua

SEQ ID NO: 406148 - RNA, 19 nt, Homo sapiens
caaaccgaauagaaacuuu

SEQ ID NO: 406149 - RNA, 19 nt, Homo sapiens
cgucagcauucuuucauuu

SEQ ID NO: 406150 - RNA, 19 nt, Homo sapiens
gaaaguaacaaaugaagac

SEQ ID NO: 406151 - RNA, 19 nt, Homo sapiens
gguuggcucugaacuuauu

SEQ ID NO: 406152 - RNA, 19 nt, Homo sapiens
caaaacauccugugucuuu

SEQ ID NO: 406153 - RNA, 19 nt, Homo sapiens
uaaggaaucuguggagcuu

SEQ ID NO: 406154 - RNA, 19 nt, Homo sapiens
cagcauucuuucauuugua

SEQ ID NO: 406155 - RNA, 19 nt, Homo sapiens
gcaagaggaggaaagauca

SEQ ID NO: 406156 - RNA, 19 nt, Homo sapiens
aagagaacguagaaugaaa

SEQ ID NO: 406157 - RNA, 19 nt, Homo sapiens
ccaguuggauggauuugau

SEQ ID NO: 406158 - RNA, 19 nt, Homo sapiens
gaaccaguuggauggauuu

SEQ ID NO: 406159 - RNA, 19 nt, Homo sapiens
guuccgaguugcugaagaa

SEQ ID NO: 406160 - RNA, 19 nt, Homo sapiens
gaacacuacgucagcauuc

SEQ ID NO: 406161 - RNA, 19 nt, Homo sapiens
aaagauaugacuccaauuc

SEQ ID NO: 406162 - RNA, 19 nt, Homo sapiens
gaagagauggguauaaagc

SEQ ID NO: 406163 - RNA, 19 nt, Homo sapiens
agacaaggaucugcuggaa

SEQ ID NO: 406164 - RNA, 19 nt, Homo sapiens
gaaucccuguucccacuga

SEQ ID NO: 406165 - RNA, 19 nt, Homo sapiens
uaagagaacguagaaugaa

SEQ ID NO: 406166 - RNA, 19 nt, Homo sapiens
gcauugacaggaagauuga

SEQ ID NO: 406167 - RNA, 19 nt, Homo sapiens
gccacaaaccgaauagaaa

SEQ ID NO: 406168 - RNA, 19 nt, Homo sapiens
ggacaaccaaauucaggaa

SEQ ID NO: 406169 - RNA, 19 nt, Homo sapiens
uuacugaaguuagagagaa

SEQ ID NO: 406170 - RNA, 19 nt, Homo sapiens
gagagaaauucagcgaaca

SEQ ID NO: 406171 - RNA, 19 nt, Homo sapiens
gaaccuccuguaccaacua

SEQ ID NO: 406172 - RNA, 19 nt, Homo sapiens
uuaagagaacguagaauga

SEQ ID NO: 406173 - RNA, 19 nt, Homo sapiens
gugcugacaucaaggcaau

SEQ ID NO: 406174 - RNA, 19 nt, Homo sapiens
ugaaccaguuggauggauu

SEQ ID NO: 406175 - RNA, 19 nt, Homo sapiens
augaagagauggguauaaa

SEQ ID NO: 406176 - RNA, 19 nt, Homo sapiens
ggaaaaugguugggagauu

SEQ ID NO: 406177 - RNA, 19 nt, Homo sapiens
ucucacccauccugaauau

SEQ ID NO: 406178 - RNA, 19 nt, Homo sapiens
cauuagaaaucaggaacaa

SEQ ID NO: 406179 - RNA, 19 nt, Homo sapiens
ggcuaaagaugaccucucu

SEQ ID NO: 406180 - RNA, 19 nt, Homo sapiens
gcaagaugggucaaaguca

SEQ ID NO: 406181 - RNA, 19 nt, Homo sapiens
ggccacaaaccgaauagaa

SEQ ID NO: 406182 - RNA, 19 nt, Homo sapiens
ccaaagcaguagcaaacca

SEQ ID NO: 406183 - RNA, 19 nt, Homo sapiens
ugaugaaauugacgccauu

SEQ ID NO: 406184 - RNA, 19 nt, Homo sapiens
caccguccaucguguuuau

SEQ ID NO: 406185 - RNA, 19 nt, Homo sapiens
acaaccaaauucaggaaau

SEQ ID NO: 406186 - RNA, 19 nt, Homo sapiens
uaucagaccaggccgcauu

SEQ ID NO: 406187 - RNA, 19 nt, Homo sapiens
agaaaucaggaacaaauga

SEQ ID NO: 406188 - RNA, 19 nt, Homo sapiens
ccauggcugucaucaggaa

SEQ ID NO: 406189 - RNA, 19 nt, Homo sapiens
ucugauggccuuaagagaa

SEQ ID NO: 406190 - RNA, 19 nt, Homo sapiens
ggauccagcacuuaucaga

SEQ ID NO: 406191 - RNA, 19 nt, Homo sapiens
agauaugacuccaauucug

SEQ ID NO: 406192 - RNA, 19 nt, Homo sapiens
ggaugacaaggacaagaaa

SEQ ID NO: 406193 - RNA, 19 nt, Homo sapiens
ccgaguugcugaagaacau

SEQ ID NO: 406194 - RNA, 19 nt, Homo sapiens
ucagcauucuuucauuugu

SEQ ID NO: 406195 - RNA, 19 nt, Homo sapiens
ccacaaaccgaauagaaac

SEQ ID NO: 406196 - RNA, 19 nt, Homo sapiens
caauucugguggugagaga

SEQ ID NO: 406197 - RNA, 19 nt, Homo sapiens
cuuguuagccaaagcagua

SEQ ID NO: 406198 - RNA, 19 nt, Homo sapiens
gguauaaagccuccuaagg

SEQ ID NO: 406199 - RNA, 19 nt, Homo sapiens
caaagcaguagcaaaccaa

SEQ ID NO: 406200 - RNA, 19 nt, Homo sapiens
cacccauccugaauauuau

SEQ ID NO: 406201 - RNA, 19 nt, Homo sapiens
ggaguugcccagaggaauc

SEQ ID NO: 406202 - RNA, 19 nt, Homo sapiens
ggcuguaucucuaaugaac

SEQ ID NO: 406203 - RNA, 19 nt, Homo sapiens
cuuaagagaacguagaaug

SEQ ID NO: 406204 - RNA, 19 nt, Homo sapiens
ggggagaugugaaaguuau

SEQ ID NO: 406205 - RNA, 19 nt, Homo sapiens
gcaccguccaucguguuua

SEQ ID NO: 406206 - RNA, 19 nt, Homo sapiens
cauggaggaagaauucauu

SEQ ID NO: 406207 - RNA, 19 nt, Homo sapiens
gacaucaaggcaaucugua

SEQ ID NO: 406208 - RNA, 19 nt, Homo sapiens
aaccaaaccucagccacuu

SEQ ID NO: 406209 - RNA, 19 nt, Homo sapiens
ugacaucaaggcaaucugu

SEQ ID NO: 406210 - RNA, 19 nt, Homo sapiens
ggagaugugaaaguuauca

SEQ ID NO: 406211 - RNA, 19 nt, Homo sapiens
ucucauggaggaagaauuc

SEQ ID NO: 406212 - RNA, 19 nt, Homo sapiens
gagguggcaagaaggauga

SEQ ID NO: 406213 - RNA, 19 nt, Homo sapiens
gagaaauucagcgaacaau

SEQ ID NO: 406214 - RNA, 19 nt, Homo sapiens
gacaaccaaauucaggaaa

SEQ ID NO: 406215 - RNA, 19 nt, Homo sapiens
gcucgguccugcucaacca

SEQ ID NO: 406216 - RNA, 19 nt, Homo sapiens
ggaaagaucaaaaguggau

SEQ ID NO: 406217 - RNA, 19 nt, Homo sapiens
aauagaaacuuuggaucca

SEQ ID NO: 406218 - RNA, 19 nt, Homo sapiens
uuggauggauuugauucua

SEQ ID NO: 406219 - RNA, 19 nt, Homo sapiens
ccaaaccucagccacuuuc

SEQ ID NO: 406220 - RNA, 19 nt, Homo sapiens
ccaggagaccuaugcagau

SEQ ID NO: 406221 - RNA, 19 nt, Homo sapiens
ucagagugguggucauggu

SEQ ID NO: 406222 - RNA, 19 nt, Homo sapiens
gaccugaucauggcuaaag

SEQ ID NO: 406223 - RNA, 19 nt, Homo sapiens
cguccaucguguuuauuga

SEQ ID NO: 406224 - RNA, 19 nt, Homo sapiens
uaugaagagauggguauaa

SEQ ID NO: 406225 - RNA, 19 nt, Homo sapiens
uggauggauuugauucuag

SEQ ID NO: 406226 - RNA, 19 nt, Homo sapiens
cugaaguuagagagaauua

SEQ ID NO: 406227 - RNA, 19 nt, Homo sapiens
caaacucguacgggaauug

SEQ ID NO: 406228 - RNA, 19 nt, Homo sapiens
cauccugaauauuaugaag

SEQ ID NO: 406229 - RNA, 19 nt, Homo sapiens
ucaaguggccaaggcaaga

SEQ ID NO: 406230 - RNA, 19 nt, Homo sapiens
gagaacguagaaugaaagu

SEQ ID NO: 406231 - RNA, 19 nt, Homo sapiens
caucaaggcaaucuguaca

SEQ ID NO: 406232 - RNA, 19 nt, Homo sapiens
ggcaagaugggucaaaguc

SEQ ID NO: 406233 - RNA, 19 nt, Homo sapiens
ccaaacucguacgggaauu

SEQ ID NO: 406234 - RNA, 19 nt, Homo sapiens
gcacgacuguguccaaaua

SEQ ID NO: 406235 - RNA, 19 nt, Homo sapiens
uaacagaccugauacuuug

SEQ ID NO: 406236 - RNA, 19 nt, Homo sapiens
caaggaaggugcuguguaa

SEQ ID NO: 406237 - RNA, 19 nt, Homo sapiens
guacaaagauaaucaaugc

SEQ ID NO: 406238 - RNA, 19 nt, Homo sapiens
uuaaugagcucacugguau

SEQ ID NO: 406239 - RNA, 19 nt, Homo sapiens
ggaaggugcuguguaauca

SEQ ID NO: 406240 - RNA, 19 nt, Homo sapiens
cacagaggcugguauguuu

SEQ ID NO: 406241 - RNA, 19 nt, Homo sapiens
uaaagcaguuugccaaguu

SEQ ID NO: 406242 - RNA, 19 nt, Homo sapiens
gauaucagauuugaacugu

SEQ ID NO: 406243 - RNA, 19 nt, Homo sapiens
ggauuuggcugcagauaag

SEQ ID NO: 406244 - RNA, 19 nt, Homo sapiens
gcacagaggcugguauguu

SEQ ID NO: 406245 - RNA, 19 nt, Homo sapiens
gggcguggauagaaauaaa

SEQ ID NO: 406246 - RNA, 19 nt, Homo sapiens
ccagggagauuggauagaa

SEQ ID NO: 406247 - RNA, 19 nt, Homo sapiens
guaaggaacagauugagaa

SEQ ID NO: 406248 - RNA, 19 nt, Homo sapiens
agagaaaccugaugucaca

SEQ ID NO: 406249 - RNA, 19 nt, Homo sapiens
uuccauaucucuucuugua

SEQ ID NO: 406250 - RNA, 19 nt, Homo sapiens
gaagagaaaccugauguca

SEQ ID NO: 406251 - RNA, 19 nt, Homo sapiens
gauauugccuuguugaaaa

SEQ ID NO: 406252 - RNA, 19 nt, Homo sapiens
gaaagagauaucagauuug

SEQ ID NO: 406253 - RNA, 19 nt, Homo sapiens
ugaaauugaugcuauugga

SEQ ID NO: 406254 - RNA, 19 nt, Homo sapiens
ccaaagaggaugagaagga

SEQ ID NO: 406255 - RNA, 19 nt, Homo sapiens
ccauaucucuucuuguaau

SEQ ID NO: 406256 - RNA, 19 nt, Homo sapiens
aagauugacccaacaguua

SEQ ID NO: 406257 - RNA, 19 nt, Homo sapiens
gcaaggaaggugcugugua

SEQ ID NO: 406258 - RNA, 19 nt, Homo sapiens
ugagcucacugguauuaaa

SEQ ID NO: 406259 - RNA, 19 nt, Homo sapiens
gauucacgcucguucaaug

SEQ ID NO: 406260 - RNA, 19 nt, Homo sapiens
ggacccacauauuuaagau

SEQ ID NO: 406261 - RNA, 19 nt, Homo sapiens
ugaacagccuuuacagguu

SEQ ID NO: 406262 - RNA, 19 nt, Homo sapiens
gcaaguugaagaugacauu

SEQ ID NO: 406263 - RNA, 19 nt, Homo sapiens
ucacugguauuaaagaauc

SEQ ID NO: 406264 - RNA, 19 nt, Homo sapiens
gcucacugguauuaaagaa

SEQ ID NO: 406265 - RNA, 19 nt, Homo sapiens
gaagugcagagaacaaugu

SEQ ID NO: 406266 - RNA, 19 nt, Homo sapiens
ggauauugccuuguugaaa

SEQ ID NO: 406267 - RNA, 19 nt, Homo sapiens
ugccuuaucuucuuugaug

SEQ ID NO: 406268 - RNA, 19 nt, Homo sapiens
gagugggcguggauagaaa

SEQ ID NO: 406269 - RNA, 19 nt, Homo sapiens
guaaagcaguuugccaagu

SEQ ID NO: 406270 - RNA, 19 nt, Homo sapiens
uuacaugacauacaacuga

SEQ ID NO: 406271 - RNA, 19 nt, Homo sapiens
cuaacagaccugauacuuu

SEQ ID NO: 406272 - RNA, 19 nt, Homo sapiens
gggauuuggcugcagauaa

SEQ ID NO: 406273 - RNA, 19 nt, Homo sapiens
cuuggaagcuguaaauaag

SEQ ID NO: 406274 - RNA, 19 nt, Homo sapiens
uauuggaucugagcuugua

SEQ ID NO: 406275 - RNA, 19 nt, Homo sapiens
gugcuucauucgaguuauu

SEQ ID NO: 406276 - RNA, 19 nt, Homo sapiens
acugaacccugaaggcuuu

SEQ ID NO: 406277 - RNA, 19 nt, Homo sapiens
gccacuaacagaccugaua

SEQ ID NO: 406278 - RNA, 19 nt, Homo sapiens
ugagaaacugcgagaagua

SEQ ID NO: 406279 - RNA, 19 nt, Homo sapiens
aaagcaguuugccaaguuu

SEQ ID NO: 406280 - RNA, 19 nt, Homo sapiens
gcugauggccacuaacaga

SEQ ID NO: 406281 - RNA, 19 nt, Homo sapiens
ggaagaccaaagaggauga

SEQ ID NO: 406282 - RNA, 19 nt, Homo sapiens
gaccaaagaggaugagaag

SEQ ID NO: 406283 - RNA, 19 nt, Homo sapiens
ugaugcagguggaagagaa

SEQ ID NO: 406284 - RNA, 19 nt, Homo sapiens
uaagauugacccaacaguu

SEQ ID NO: 406285 - RNA, 19 nt, Homo sapiens
uccauugccuccuaagauu

SEQ ID NO: 406286 - RNA, 19 nt, Homo sapiens
ucagugcuacuccucguua

SEQ ID NO: 406287 - RNA, 19 nt, Homo sapiens
gcugguauguuugccauca

SEQ ID NO: 406288 - RNA, 19 nt, Homo sapiens
cacauuccauugccuccua

SEQ ID NO: 406289 - RNA, 19 nt, Homo sapiens
gcguggauagaaauaaaua

SEQ ID NO: 406290 - RNA, 19 nt, Homo sapiens
guugccagguguacaaaga

SEQ ID NO: 406291 - RNA, 19 nt, Homo sapiens
cagggagauuggauagaaa

SEQ ID NO: 406292 - RNA, 19 nt, Homo sapiens
acaaugaagugcagagaac

SEQ ID NO: 406293 - RNA, 19 nt, Homo sapiens
ugccagguguacaaagaua

SEQ ID NO: 406294 - RNA, 19 nt, Homo sapiens
uaaggaacagauugagaaa

SEQ ID NO: 406295 - RNA, 19 nt, Homo sapiens
aaugagcucacugguauua

SEQ ID NO: 406296 - RNA, 19 nt, Homo sapiens
gaacuguuagcacgacugu

SEQ ID NO: 406297 - RNA, 19 nt, Homo sapiens
aaggugcuguguaaucauu

SEQ ID NO: 406298 - RNA, 19 nt, Homo sapiens
gacaaugaagugcagagaa

SEQ ID NO: 406299 - RNA, 19 nt, Homo sapiens
caaauucacauuccauugc

SEQ ID NO: 406300 - RNA, 19 nt, Homo sapiens
cuaggcagaucaagcaagu

SEQ ID NO: 406301 - RNA, 19 nt, Homo sapiens
aaauuggaauccuaaccuu

SEQ ID NO: 406302 - RNA, 19 nt, Homo sapiens
uagcacgacuguguccaaa

SEQ ID NO: 406303 - RNA, 19 nt, Homo sapiens
caagcaaguugaagaugac

SEQ ID NO: 406304 - RNA, 19 nt, Homo sapiens
cgugaacucuuugaaaugg

SEQ ID NO: 406305 - RNA, 19 nt, Homo sapiens
aggaacagauugagaaacu

SEQ ID NO: 406306 - RNA, 19 nt, Homo sapiens
cugcuaaaaugccggauua

SEQ ID NO: 406307 - RNA, 19 nt, Homo sapiens
ggaacagauugagaaacug

SEQ ID NO: 406308 - RNA, 19 nt, Homo sapiens
ucuuggaagcuguaaauaa

SEQ ID NO: 406309 - RNA, 19 nt, Homo sapiens
gaugaaauugaugcuauug

SEQ ID NO: 406310 - RNA, 19 nt, Homo sapiens
ccaagggcgugcugcucuu

SEQ ID NO: 406311 - RNA, 19 nt, Homo sapiens
gagaaacugcgagaaguag

SEQ ID NO: 406312 - RNA, 19 nt, Homo sapiens
uacaugacauacaacugaa

SEQ ID NO: 406313 - RNA, 19 nt, Homo sapiens
acccacauauuuaagauuc

SEQ ID NO: 406314 - RNA, 19 nt, Homo sapiens
gacccaacaguuaccauga

SEQ ID NO: 406315 - RNA, 19 nt, Homo sapiens
ucaaauucacauuccauug

SEQ ID NO: 406316 - RNA, 19 nt, Homo sapiens
uaugccaaauucagugcua

SEQ ID NO: 406317 - RNA, 19 nt, Homo sapiens
gaugaggccagggagauug

SEQ ID NO: 406318 - RNA, 19 nt, Homo sapiens
ugaaauggccagaacaaaa

SEQ ID NO: 406319 - RNA, 19 nt, Homo sapiens
gagagugggcguggauaga

SEQ ID NO: 406320 - RNA, 19 nt, Homo sapiens
aagaugacauucagcaacu

SEQ ID NO: 406321 - RNA, 19 nt, Homo sapiens
gcacuuacucuaggcagau

SEQ ID NO: 406322 - RNA, 19 nt, Homo sapiens
aagccugccuuaucuucuu

SEQ ID NO: 406323 - RNA, 19 nt, Homo sapiens
ggaagagaaaccugauguc

SEQ ID NO: 406324 - RNA, 19 nt, Homo sapiens
caacaguuaccaugaugca

SEQ ID NO: 406325 - RNA, 19 nt, Homo sapiens
agagauaucagauuugaac

SEQ ID NO: 406326 - RNA, 19 nt, Homo sapiens
uucgugaacucuuugaaau

SEQ ID NO: 406327 - RNA, 19 nt, Homo sapiens
gaugagagugggcguggau

SEQ ID NO: 406328 - RNA, 19 nt, Homo sapiens
ccagagugaacagccuuua

SEQ ID NO: 406329 - RNA, 19 nt, Homo sapiens
gcuguaaauaaggucauua

SEQ ID NO: 406330 - RNA, 19 nt, Homo sapiens
ggacugaugcgugcuucau

SEQ ID NO: 406331 - RNA, 19 nt, Homo sapiens
gaucagcggaagaccaaag

SEQ ID NO: 406332 - RNA, 19 nt, Homo sapiens
gguauuaaagaaucugaca

SEQ ID NO: 406333 - RNA, 19 nt, Homo sapiens
gugcuggaggugacaauga

SEQ ID NO: 406334 - RNA, 19 nt, Homo sapiens
gaagaaagccaaccuacaa

SEQ ID NO: 406335 - RNA, 19 nt, Homo sapiens
gaacaaagacuccuaucug

SEQ ID NO: 406336 - RNA, 19 nt, Homo sapiens
ggacaaugcuggagcuucu

SEQ ID NO: 406337 - RNA, 19 nt, Homo sapiens
ggaggauggugccaauauu

SEQ ID NO: 406338 - RNA, 19 nt, Homo sapiens
gaaagacgguauuaaucuc

SEQ ID NO: 406339 - RNA, 19 nt, Homo sapiens
gggaggaggugcucaagau

SEQ ID NO: 406340 - RNA, 19 nt, Homo sapiens
caaaaggggugcugaugua

SEQ ID NO: 406341 - RNA, 19 nt, Homo sapiens
guacuuccuuccugugauu

SEQ ID NO: 406342 - RNA, 19 nt, Homo sapiens
caagugugcugugaucaaa

SEQ ID NO: 406343 - RNA, 19 nt, Homo sapiens
caagagaaggcuuuaagaa

SEQ ID NO: 406344 - RNA, 19 nt, Homo sapiens
ugaaucugcugccgaauau

SEQ ID NO: 406345 - RNA, 19 nt, Homo sapiens
gcacagaugacuucaaugg

SEQ ID NO: 406346 - RNA, 19 nt, Homo sapiens
aacaaagacuccuaucuga

SEQ ID NO: 406347 - RNA, 19 nt, Homo sapiens
caugaagagugaaguguug

SEQ ID NO: 406348 - RNA, 19 nt, Homo sapiens
ggagaaagcgcccucuauc

SEQ ID NO: 406349 - RNA, 19 nt, Homo sapiens
ccacggagcaauacaguga

SEQ ID NO: 406350 - RNA, 19 nt, Homo sapiens
gagaaagcgcccucuauca

SEQ ID NO: 406351 - RNA, 19 nt, Homo sapiens
caaagacuccuaucugauc

SEQ ID NO: 406352 - RNA, 19 nt, Homo sapiens
cggcugaagugcgcaauaa

SEQ ID NO: 406353 - RNA, 19 nt, Homo sapiens
cagauccacucccgaaaga

SEQ ID NO: 406354 - RNA, 19 nt, Homo sapiens
gaaagcgcccucuaucauc

SEQ ID NO: 406355 - RNA, 19 nt, Homo sapiens
ucaagaucaugaagaguga

SEQ ID NO: 406356 - RNA, 19 nt, Homo sapiens
aagccaaccuacaauacua

SEQ ID NO: 406357 - RNA, 19 nt, Homo sapiens
ggucaagagucgggauuug

SEQ ID NO: 406358 - RNA, 19 nt, Homo sapiens
gaaagccaaccuacaauac

SEQ ID NO: 406359 - RNA, 19 nt, Homo sapiens
aagagaaggcuuuaagaaa

SEQ ID NO: 406360 - RNA, 19 nt, Homo sapiens
caacacccaaguuaaggua

SEQ ID NO: 406361 - RNA, 19 nt, Homo sapiens
gggcaagugugcugugauc

SEQ ID NO: 406362 - RNA, 19 nt, Homo sapiens
gaggauggugccaauauug

SEQ ID NO: 406363 - RNA, 19 nt, Homo sapiens
agaaagccaaccuacaaua

SEQ ID NO: 406364 - RNA, 19 nt, Homo sapiens
gcaagugugcugugaucaa

SEQ ID NO: 406365 - RNA, 19 nt, Homo sapiens
gggaugaggccgagcaaga

SEQ ID NO: 406366 - RNA, 19 nt, Homo sapiens
ccacgaggacuacauggaa

SEQ ID NO: 406367 - RNA, 19 nt, Homo sapiens
gaaccacaaggagaaguuu

SEQ ID NO: 406368 - RNA, 19 nt, Homo sapiens
caagaagaaagccaaccua

SEQ ID NO: 406369 - RNA, 19 nt, Homo sapiens
cugcacagaugacuucaau

SEQ ID NO: 406370 - RNA, 19 nt, Homo sapiens
caaugaaccacaaggagaa

SEQ ID NO: 406371 - RNA, 19 nt, Homo sapiens
ggagcaauacagugacauu

SEQ ID NO: 406372 - RNA, 19 nt, Homo sapiens
uggagacgcugcccacaga

SEQ ID NO: 406373 - RNA, 19 nt, Homo sapiens
ccaagcgcuuugacaguga

SEQ ID NO: 406374 - RNA, 19 nt, Homo sapiens
acaaggagaaguuugagaa

SEQ ID NO: 406375 - RNA, 19 nt, Homo sapiens
ccaugaaggacaagauaaa

SEQ ID NO: 406376 - RNA, 19 nt, Homo sapiens
gauccacucccgaaagaug

SEQ ID NO: 406377 - RNA, 19 nt, Homo sapiens
cagcccaacacccaaguua

SEQ ID NO: 406378 - RNA, 19 nt, Homo sapiens
ugaaggccauggagguaga

SEQ ID NO: 406379 - RNA, 19 nt, Homo sapiens
ccucuaucaucuucauuga

SEQ ID NO: 406380 - RNA, 19 nt, Homo sapiens
agagugaaguguugagagu

SEQ ID NO: 406381 - RNA, 19 nt, Homo sapiens
gaagagugaaguguugaga

SEQ ID NO: 406382 - RNA, 19 nt, Homo sapiens
agaaagacgguauuaaucu

SEQ ID NO: 406383 - RNA, 19 nt, Homo sapiens
gguggaggccauugucuug

SEQ ID NO: 406384 - RNA, 19 nt, Homo sapiens
gcagauccacucccgaaag

SEQ ID NO: 406385 - RNA, 19 nt, Homo sapiens
gaggaggugcucaagaugu

SEQ ID NO: 406386 - RNA, 19 nt, Homo sapiens
ggugaaggccauggaggua

SEQ ID NO: 406387 - RNA, 19 nt, Homo sapiens
ucaagagaaggcuuuaaga

SEQ ID NO: 406388 - RNA, 19 nt, Homo sapiens
gaucaugaagagugaagug

SEQ ID NO: 406389 - RNA, 19 nt, Homo sapiens
guaauugcagccacaaaca

SEQ ID NO: 406390 - RNA, 19 nt, Homo sapiens
agaaagcgcccucuaucau

SEQ ID NO: 406391 - RNA, 19 nt, Homo sapiens
guccugacgugaacuacga

SEQ ID NO: 406392 - RNA, 19 nt, Homo sapiens
aagaaagacgguauuaauc

SEQ ID NO: 406393 - RNA, 19 nt, Homo sapiens
ugccguaccuugucuccaa

SEQ ID NO: 406394 - RNA, 19 nt, Homo sapiens
gaacagugagaaaaucaaa

SEQ ID NO: 406395 - RNA, 19 nt, Homo sapiens
gccaugaaggacaagauaa

SEQ ID NO: 406396 - RNA, 19 nt, Homo sapiens
aaagcgcccucuaucaucu

SEQ ID NO: 406397 - RNA, 19 nt, Homo sapiens
agaggaggauggugccaau

SEQ ID NO: 406398 - RNA, 19 nt, Homo sapiens
gggccagaaucaugcagau

SEQ ID NO: 406399 - RNA, 19 nt, Homo sapiens
cacccaaguuaagguaauu

SEQ ID NO: 406400 - RNA, 19 nt, Homo sapiens
ggaggaggugcucaagaug

SEQ ID NO: 406401 - RNA, 19 nt, Homo sapiens
aaucugcugccgaauauug

SEQ ID NO: 406402 - RNA, 19 nt, Homo sapiens
gauguucauuggagauggu

SEQ ID NO: 406403 - RNA, 19 nt, Homo sapiens
ggaugaggccgagcaagau

SEQ ID NO: 406404 - RNA, 19 nt, Homo sapiens
gcccaacacccaaguuaag

SEQ ID NO: 406405 - RNA, 19 nt, Homo sapiens
uggagauggugccaagcua

SEQ ID NO: 406406 - RNA, 19 nt, Homo sapiens
ccuggugggugugaacaaa

SEQ ID NO: 406407 - RNA, 19 nt, Homo sapiens
gaugaggccgagcaagaug

SEQ ID NO: 406408 - RNA, 19 nt, Homo sapiens
acacccaaguuaagguaau

SEQ ID NO: 406409 - RNA, 19 nt, Homo sapiens
caaacaggguggacauccu

SEQ ID NO: 406410 - RNA, 19 nt, Homo sapiens
gcuaguccgggaugccuuu

SEQ ID NO: 406411 - RNA, 19 nt, Homo sapiens
agacgcugcccacagagua

SEQ ID NO: 406412 - RNA, 19 nt, Homo sapiens
gguggaugcugaaaagcua

SEQ ID NO: 406413 - RNA, 19 nt, Homo sapiens
agugaaguguugagaguca

SEQ ID NO: 406414 - RNA, 19 nt, Homo sapiens
gcagauguucauuggagau

SEQ ID NO: 406415 - RNA, 19 nt, Homo sapiens
gagcuggucgggucaagag

SEQ ID NO: 406416 - RNA, 19 nt, Homo sapiens
ucaagagucgggauuugug

SEQ ID NO: 406417 - RNA, 19 nt, Homo sapiens
gaagugcgcaauaaaagau

SEQ ID NO: 406418 - RNA, 19 nt, Homo sapiens
ggucaagagaaggcuuuaa

SEQ ID NO: 406419 - RNA, 19 nt, Homo sapiens
cacggcugcuggacaguga

SEQ ID NO: 406420 - RNA, 19 nt, Homo sapiens
cuacacgacagacguacuu

SEQ ID NO: 406421 - RNA, 19 nt, Homo sapiens
gaggaggauggugccaaua

SEQ ID NO: 406422 - RNA, 19 nt, Homo sapiens
aaaucaaagugaacaagac

SEQ ID NO: 406423 - RNA, 19 nt, Homo sapiens
gugagaaaaucaaagugaa

SEQ ID NO: 406424 - RNA, 19 nt, Homo sapiens
ugacucggcaggagaagau

SEQ ID NO: 406425 - RNA, 19 nt, Homo sapiens
gguaauugcagccacaaac

SEQ ID NO: 406426 - RNA, 19 nt, Homo sapiens
gucaagagaaggcuuuaag

SEQ ID NO: 406427 - RNA, 19 nt, Homo sapiens
augaaucugcugccgaaua

SEQ ID NO: 406428 - RNA, 19 nt, Homo sapiens
uccaagccaugaaggacaa

SEQ ID NO: 406429 - RNA, 19 nt, Homo sapiens
ucaugaagagugaaguguu

SEQ ID NO: 406430 - RNA, 19 nt, Homo sapiens
agaagaaagccaaccuaca

SEQ ID NO: 406431 - RNA, 19 nt, Homo sapiens
ccagaaucaugcagaucca

SEQ ID NO: 406432 - RNA, 19 nt, Homo sapiens
gagauggugccaagcuagu

SEQ ID NO: 406433 - RNA, 19 nt, Homo sapiens
acaaagacuccuaucugau

SEQ ID NO: 406434 - RNA, 19 nt, Homo sapiens
gaaugucaaugucaaggua

SEQ ID NO: 406435 - RNA, 19 nt, Homo sapiens
gauaagaucgaauccauuu

SEQ ID NO: 406436 - RNA, 19 nt, Homo sapiens
acaagaagcugcagcaaga

SEQ ID NO: 406437 - RNA, 19 nt, Homo sapiens
ggaagaccauguuggcaaa

SEQ ID NO: 406438 - RNA, 19 nt, Homo sapiens
caaaggcgguggcacauca

SEQ ID NO: 406439 - RNA, 19 nt, Homo sapiens
ccacaggcuccaacuauua

SEQ ID NO: 406440 - RNA, 19 nt, Homo sapiens
gcucggaguuuguacagaa

SEQ ID NO: 406441 - RNA, 19 nt, Homo sapiens
gagauucgaugcucagaca

SEQ ID NO: 406442 - RNA, 19 nt, Homo sapiens
gaaugcaccugccaucauc

SEQ ID NO: 406443 - RNA, 19 nt, Homo sapiens
cacaacagcugcauucauc

SEQ ID NO: 406444 - RNA, 19 nt, Homo sapiens
acaagacugucaucaagaa

SEQ ID NO: 406445 - RNA, 19 nt, Homo sapiens
ggauggauuugaucagaau

SEQ ID NO: 406446 - RNA, 19 nt, Homo sapiens
gcaggaggaauacaucaaa

SEQ ID NO: 406447 - RNA, 19 nt, Homo sapiens
ucagauggauggauuugau

SEQ ID NO: 406448 - RNA, 19 nt, Homo sapiens
uagauaagaucgaauccau

SEQ ID NO: 406449 - RNA, 19 nt, Homo sapiens
ucaggagaguggaauguug

SEQ ID NO: 406450 - RNA, 19 nt, Homo sapiens
gcaagaugaaccucucuga

SEQ ID NO: 406451 - RNA, 19 nt, Homo sapiens
gaucagaaugucaauguca

SEQ ID NO: 406452 - RNA, 19 nt, Homo sapiens
auacaagacugucaucaag

SEQ ID NO: 406453 - RNA, 19 nt, Homo sapiens
gaagccagaugugauguac

SEQ ID NO: 406454 - RNA, 19 nt, Homo sapiens
ggaggaauacaucaaagau

SEQ ID NO: 406455 - RNA, 19 nt, Homo sapiens
ggccaaggacuucgagaaa

SEQ ID NO: 406456 - RNA, 19 nt, Homo sapiens
gaggugaagcgaauccaaa

SEQ ID NO: 406457 - RNA, 19 nt, Homo sapiens
gaugagaucccagcacugu

SEQ ID NO: 406458 - RNA, 19 nt, Homo sapiens
cgagaaagcauacaagacu

SEQ ID NO: 406459 - RNA, 19 nt, Homo sapiens
ugaggagguugacuuggaa

SEQ ID NO: 406460 - RNA, 19 nt, Homo sapiens
acagggagguucagaggau

SEQ ID NO: 406461 - RNA, 19 nt, Homo sapiens
gaccagaagccagauguga

SEQ ID NO: 406462 - RNA, 19 nt, Homo sapiens
ucacacaacagcugcauuc

SEQ ID NO: 406463 - RNA, 19 nt, Homo sapiens
ucaugaugcucaccucaga

SEQ ID NO: 406464 - RNA, 19 nt, Homo sapiens
aauguuggcuguccgugaa

SEQ ID NO: 406465 - RNA, 19 nt, Homo sapiens
ccaaggacuucgagaaagc

SEQ ID NO: 406466 - RNA, 19 nt, Homo sapiens
cugaggagguugacuugga

SEQ ID NO: 406467 - RNA, 19 nt, Homo sapiens
ucacgcauuucgagcucua

SEQ ID NO: 406468 - RNA, 19 nt, Homo sapiens
gccgacagcagcaucauga

SEQ ID NO: 406469 - RNA, 19 nt, Homo sapiens
guacagccgcuacaagaag

SEQ ID NO: 406470 - RNA, 19 nt, Homo sapiens
aaucauggccacaaacaga

SEQ ID NO: 406471 - RNA, 19 nt, Homo sapiens
uggagaaggcucaggauga

SEQ ID NO: 406472 - RNA, 19 nt, Homo sapiens
cggaguuuguacagaagua

SEQ ID NO: 406473 - RNA, 19 nt, Homo sapiens
ccagaagccagaugugaug

SEQ ID NO: 406474 - RNA, 19 nt, Homo sapiens
gcuggucaucggacaauuu

SEQ ID NO: 406475 - RNA, 19 nt, Homo sapiens
gagcaugaguuuuacaagu

SEQ ID NO: 406476 - RNA, 19 nt, Homo sapiens
agacugucaucaagaagga

SEQ ID NO: 406477 - RNA, 19 nt, Homo sapiens
cauacaagacugucaucaa

SEQ ID NO: 406478 - RNA, 19 nt, Homo sapiens
gccaaggacuucgagaaag

SEQ ID NO: 406479 - RNA, 19 nt, Homo sapiens
ugcuggagcugcugaauca

SEQ ID NO: 406480 - RNA, 19 nt, Homo sapiens
cgccagaagagauugauuu

SEQ ID NO: 406481 - RNA, 19 nt, Homo sapiens
guaaucauggccacaaaca

SEQ ID NO: 406482 - RNA, 19 nt, Homo sapiens
gguggcacaucacacaaca

SEQ ID NO: 406483 - RNA, 19 nt, Homo sapiens
ggacuucgagaaagcauac

SEQ ID NO: 406484 - RNA, 19 nt, Homo sapiens
gcaccugccaucaucuuca

SEQ ID NO: 406485 - RNA, 19 nt, Homo sapiens
ggucgugggcucggaguuu

SEQ ID NO: 406486 - RNA, 19 nt, Homo sapiens
gagaaugcaccugccauca

SEQ ID NO: 406487 - RNA, 19 nt, Homo sapiens
aggaggaggugaagcgaau

SEQ ID NO: 406488 - RNA, 19 nt, Homo sapiens
gagguugacuuggaagacu

SEQ ID NO: 406489 - RNA, 19 nt, Homo sapiens
cgagcaggagcaugaguuu

SEQ ID NO: 406490 - RNA, 19 nt, Homo sapiens
cacuaucacuagcaagaug

SEQ ID NO: 406491 - RNA, 19 nt, Homo sapiens
uaccacaggcuccaacuau

SEQ ID NO: 406492 - RNA, 19 nt, Homo sapiens
cagcaccucugucccaaaa

SEQ ID NO: 406493 - RNA, 19 nt, Homo sapiens
caggaggaauacaucaaag

SEQ ID NO: 406494 - RNA, 19 nt, Homo sapiens
uggauggauuugaucagaa

SEQ ID NO: 406495 - RNA, 19 nt, Homo sapiens
uggaggcuguggaucagaa

SEQ ID NO: 406496 - RNA, 19 nt, Homo sapiens
gcaugaguuuuacaaguga

SEQ ID NO: 406497 - RNA, 19 nt, Homo sapiens
ggucaucggacaauuucug

SEQ ID NO: 406498 - RNA, 19 nt, Homo sapiens
ggaggugaagcgaauccaa

SEQ ID NO: 406499 - RNA, 19 nt, Homo sapiens
gaagccgacagcagcauca

SEQ ID NO: 406500 - RNA, 19 nt, Homo sapiens
ugacuuggaagacuaugug

SEQ ID NO: 406501 - RNA, 19 nt, Homo sapiens
uggaggugcaggaggaaua

SEQ ID NO: 406502 - RNA, 19 nt, Homo sapiens
caaugucaagguaaucaug

SEQ ID NO: 406503 - RNA, 19 nt, Homo sapiens
ugaagcgaauccaaagcau

SEQ ID NO: 406504 - RNA, 19 nt, Homo sapiens
gcauuucgagcucuacaag

SEQ ID NO: 406505 - RNA, 19 nt, Homo sapiens
ucaaagaugagcaaaagaa

SEQ ID NO: 406506 - RNA, 19 nt, Homo sapiens
gagcaaaagaaccugaaaa

SEQ ID NO: 406507 - RNA, 19 nt, Homo sapiens
ggaccuggaggaccuguac

SEQ ID NO: 406508 - RNA, 19 nt, Homo sapiens
accacaggcuccaacuauu

SEQ ID NO: 406509 - RNA, 19 nt, Homo sapiens
gaggcuguggaucagaaua

SEQ ID NO: 406510 - RNA, 19 nt, Homo sapiens
gugaagcgaauccaaagca

SEQ ID NO: 406511 - RNA, 19 nt, Homo sapiens
cacaggcuccaacuauuau

SEQ ID NO: 406512 - RNA, 19 nt, Homo sapiens
gcaaaggcgguggcacauc

SEQ ID NO: 406513 - RNA, 19 nt, Homo sapiens
gcugugggaagaccauguu

SEQ ID NO: 406514 - RNA, 19 nt, Homo sapiens
acaagcagaucggcaucga

SEQ ID NO: 406515 - RNA, 19 nt, Homo sapiens
gcauacaagacugucauca

SEQ ID NO: 406516 - RNA, 19 nt, Homo sapiens
gucgugggcucggaguuug

SEQ ID NO: 406517 - RNA, 19 nt, Homo sapiens
ggauuugaucagaauguca

SEQ ID NO: 406518 - RNA, 19 nt, Homo sapiens
gaaugucaaugucaaggua

SEQ ID NO: 406519 - RNA, 19 nt, Homo sapiens
gauaagaucgaauccauuu

SEQ ID NO: 406520 - RNA, 19 nt, Homo sapiens
ggaagaccauguuggcaaa

SEQ ID NO: 406521 - RNA, 19 nt, Homo sapiens
caaaggcgguggcacauca

SEQ ID NO: 406522 - RNA, 19 nt, Homo sapiens
ccacaggcuccaacuauua

SEQ ID NO: 406523 - RNA, 19 nt, Homo sapiens
gcucggaguuuguacagaa

SEQ ID NO: 406524 - RNA, 19 nt, Homo sapiens
gagauucgaugcucagaca

SEQ ID NO: 406525 - RNA, 19 nt, Homo sapiens
gaaugcaccugccaucauc

SEQ ID NO: 406526 - RNA, 19 nt, Homo sapiens
cacaacagcugcauucauc

SEQ ID NO: 406527 - RNA, 19 nt, Homo sapiens
acaagacugucaucaagaa

SEQ ID NO: 406528 - RNA, 19 nt, Homo sapiens
ggauggauuugaucagaau

SEQ ID NO: 406529 - RNA, 19 nt, Homo sapiens
ucagauggauggauuugau

SEQ ID NO: 406530 - RNA, 19 nt, Homo sapiens
uagauaagaucgaauccau

SEQ ID NO: 406531 - RNA, 19 nt, Homo sapiens
ucaggagaguggaauguug

SEQ ID NO: 406532 - RNA, 19 nt, Homo sapiens
gcaagaugaaccucucuga

SEQ ID NO: 406533 - RNA, 19 nt, Homo sapiens
gaucagaaugucaauguca

SEQ ID NO: 406534 - RNA, 19 nt, Homo sapiens
auacaagacugucaucaag

SEQ ID NO: 406535 - RNA, 19 nt, Homo sapiens
gaagccagaugugauguac

SEQ ID NO: 406536 - RNA, 19 nt, Homo sapiens
ggccaaggacuucgagaaa

SEQ ID NO: 406537 - RNA, 19 nt, Homo sapiens
gaggugaagcgaauccaaa

SEQ ID NO: 406538 - RNA, 19 nt, Homo sapiens
gaugagaucccagcacugu

SEQ ID NO: 406539 - RNA, 19 nt, Homo sapiens
cgagaaagcauacaagacu

SEQ ID NO: 406540 - RNA, 19 nt, Homo sapiens
ugaggagguugacuuggaa

SEQ ID NO: 406541 - RNA, 19 nt, Homo sapiens
acagggagguucagaggau

SEQ ID NO: 406542 - RNA, 19 nt, Homo sapiens
gaccagaagccagauguga

SEQ ID NO: 406543 - RNA, 19 nt, Homo sapiens
ucacacaacagcugcauuc

SEQ ID NO: 406544 - RNA, 19 nt, Homo sapiens
ucaugaugcucaccucaga

SEQ ID NO: 406545 - RNA, 19 nt, Homo sapiens
aauguuggcuguccgugaa

SEQ ID NO: 406546 - RNA, 19 nt, Homo sapiens
ccaaggacuucgagaaagc

SEQ ID NO: 406547 - RNA, 19 nt, Homo sapiens
cugaggagguugacuugga

SEQ ID NO: 406548 - RNA, 19 nt, Homo sapiens
ucacgcauuucgagcucua

SEQ ID NO: 406549 - RNA, 19 nt, Homo sapiens
gccgacagcagcaucauga

SEQ ID NO: 406550 - RNA, 19 nt, Homo sapiens
aaucauggccacaaacaga

SEQ ID NO: 406551 - RNA, 19 nt, Homo sapiens
gcuggucaucggacaauuu

SEQ ID NO: 406552 - RNA, 19 nt, Homo sapiens
cggaguuuguacagaagua

SEQ ID NO: 406553 - RNA, 19 nt, Homo sapiens
uggagaaggcucaggauga

SEQ ID NO: 406554 - RNA, 19 nt, Homo sapiens
ccagaagccagaugugaug

SEQ ID NO: 406555 - RNA, 19 nt, Homo sapiens
gagcaugaguuuuacaagu

SEQ ID NO: 406556 - RNA, 19 nt, Homo sapiens
agacugucaucaagaagga

SEQ ID NO: 406557 - RNA, 19 nt, Homo sapiens
cauacaagacugucaucaa

SEQ ID NO: 406558 - RNA, 19 nt, Homo sapiens
gccaaggacuucgagaaag

SEQ ID NO: 406559 - RNA, 19 nt, Homo sapiens
ugcuggagcugcugaauca

SEQ ID NO: 406560 - RNA, 19 nt, Homo sapiens
cgccagaagagauugauuu

SEQ ID NO: 406561 - RNA, 19 nt, Homo sapiens
guaaucauggccacaaaca

SEQ ID NO: 406562 - RNA, 19 nt, Homo sapiens
gguggcacaucacacaaca

SEQ ID NO: 406563 - RNA, 19 nt, Homo sapiens
ggacuucgagaaagcauac

SEQ ID NO: 406564 - RNA, 19 nt, Homo sapiens
gcaccugccaucaucuuca

SEQ ID NO: 406565 - RNA, 19 nt, Homo sapiens
ggucgugggcucggaguuu

SEQ ID NO: 406566 - RNA, 19 nt, Homo sapiens
gagaaugcaccugccauca

SEQ ID NO: 406567 - RNA, 19 nt, Homo sapiens
gagguugacuuggaagacu

SEQ ID NO: 406568 - RNA, 19 nt, Homo sapiens
aggaggaggugaagcgaau

SEQ ID NO: 406569 - RNA, 19 nt, Homo sapiens
cgagcaggagcaugaguuu

SEQ ID NO: 406570 - RNA, 19 nt, Homo sapiens
cacuaucacuagcaagaug

SEQ ID NO: 406571 - RNA, 19 nt, Homo sapiens
uaccacaggcuccaacuau

SEQ ID NO: 406572 - RNA, 19 nt, Homo sapiens
cagcaccucugucccaaaa

SEQ ID NO: 406573 - RNA, 19 nt, Homo sapiens
uggaggcuguggaucagaa

SEQ ID NO: 406574 - RNA, 19 nt, Homo sapiens
uggauggauuugaucagaa

SEQ ID NO: 406575 - RNA, 19 nt, Homo sapiens
gcaugaguuuuacaaguga

SEQ ID NO: 406576 - RNA, 19 nt, Homo sapiens
ggucaucggacaauuucug

SEQ ID NO: 406577 - RNA, 19 nt, Homo sapiens
ggaggugaagcgaauccaa

SEQ ID NO: 406578 - RNA, 19 nt, Homo sapiens
gaagccgacagcagcauca

SEQ ID NO: 406579 - RNA, 19 nt, Homo sapiens
ugacuuggaagacuaugug

SEQ ID NO: 406580 - RNA, 19 nt, Homo sapiens
caaugucaagguaaucaug

SEQ ID NO: 406581 - RNA, 19 nt, Homo sapiens
gcuacaaggaggaggugaa

SEQ ID NO: 406582 - RNA, 19 nt, Homo sapiens
gcauuucgagcucuacaag

SEQ ID NO: 406583 - RNA, 19 nt, Homo sapiens
ugaagcgaauccaaagcau

SEQ ID NO: 406584 - RNA, 19 nt, Homo sapiens
ggaccuggaggaccuguac

SEQ ID NO: 406585 - RNA, 19 nt, Homo sapiens
accacaggcuccaacuauu

SEQ ID NO: 406586 - RNA, 19 nt, Homo sapiens
gaggcuguggaucagaaua

SEQ ID NO: 406587 - RNA, 19 nt, Homo sapiens
gugaagcgaauccaaagca

SEQ ID NO: 406588 - RNA, 19 nt, Homo sapiens
cacaggcuccaacuauuau

SEQ ID NO: 406589 - RNA, 19 nt, Homo sapiens
gcaaaggcgguggcacauc

SEQ ID NO: 406590 - RNA, 19 nt, Homo sapiens
gcugugggaagaccauguu

SEQ ID NO: 406591 - RNA, 19 nt, Homo sapiens
acaagcagaucggcaucga

SEQ ID NO: 406592 - RNA, 19 nt, Homo sapiens
gcauacaagacugucauca

SEQ ID NO: 406593 - RNA, 19 nt, Homo sapiens
gucgugggcucggaguuug

SEQ ID NO: 406594 - RNA, 19 nt, Homo sapiens
ggauuugaucagaauguca

SEQ ID NO: 406595 - RNA, 19 nt, Homo sapiens
ggaacgaacuaaaugcuaa

SEQ ID NO: 406596 - RNA, 19 nt, Homo sapiens
gagagaagauggcgcuuga

SEQ ID NO: 406597 - RNA, 19 nt, Homo sapiens
ggacagccuuuguguguau

SEQ ID NO: 406598 - RNA, 19 nt, Homo sapiens
gaagguaaauuuguuguag

SEQ ID NO: 406599 - RNA, 19 nt, Homo sapiens
guguguaucucuccaauaa

SEQ ID NO: 406600 - RNA, 19 nt, Homo sapiens
caacaagguagacccauua

SEQ ID NO: 406601 - RNA, 19 nt, Homo sapiens
ccaagaacaucaagguuau

SEQ ID NO: 406602 - RNA, 19 nt, Homo sapiens
gaagaacuccagcugauug

SEQ ID NO: 406603 - RNA, 19 nt, Homo sapiens
gaacaugcuccaucuauca

SEQ ID NO: 406604 - RNA, 19 nt, Homo sapiens
cauacggacuguaccuuua

SEQ ID NO: 406605 - RNA, 19 nt, Homo sapiens
gaacaucaagguuaucaug

SEQ ID NO: 406606 - RNA, 19 nt, Homo sapiens
ucaaggagaucaaagaagu

SEQ ID NO: 406607 - RNA, 19 nt, Homo sapiens
gcacagaggaacgaacuaa

SEQ ID NO: 406608 - RNA, 19 nt, Homo sapiens
gaaaguaccagauucaacu

SEQ ID NO: 406609 - RNA, 19 nt, Homo sapiens
gcagaaggacagugagaaa

SEQ ID NO: 406610 - RNA, 19 nt, Homo sapiens
ugaucgagcugccuguuaa

SEQ ID NO: 406611 - RNA, 19 nt, Homo sapiens
gaacuccagcugauuguga

SEQ ID NO: 406612 - RNA, 19 nt, Homo sapiens
aaacauguccaucaagaaa

SEQ ID NO: 406613 - RNA, 19 nt, Homo sapiens
gaaaguguuggucaaggua

SEQ ID NO: 406614 - RNA, 19 nt, Homo sapiens
acaaacagaucaaggagau

SEQ ID NO: 406615 - RNA, 19 nt, Homo sapiens
caagguagacccauuagug

SEQ ID NO: 406616 - RNA, 19 nt, Homo sapiens
caagguacauccugaaggu

SEQ ID NO: 406617 - RNA, 19 nt, Homo sapiens
ggaacaugcuccaucuauc

SEQ ID NO: 406618 - RNA, 19 nt, Homo sapiens
ccaacaagguagacccauu

SEQ ID NO: 406619 - RNA, 19 nt, Homo sapiens
gaacggcgaguccauguca

SEQ ID NO: 406620 - RNA, 19 nt, Homo sapiens
gaacugguacagaaauuca

SEQ ID NO: 406621 - RNA, 19 nt, Homo sapiens
ccaagggagugcugcugua

SEQ ID NO: 406622 - RNA, 19 nt, Homo sapiens
ggagaaaguaccagauuca

SEQ ID NO: 406623 - RNA, 19 nt, Homo sapiens
gaacgaacuaaaugcuaaa

SEQ ID NO: 406624 - RNA, 19 nt, Homo sapiens
gcuacacucugcacaagau

SEQ ID NO: 406625 - RNA, 19 nt, Homo sapiens
uagccaaggucaugcagaa

SEQ ID NO: 406626 - RNA, 19 nt, Homo sapiens
guuaucauggcuacuaaua

SEQ ID NO: 406627 - RNA, 19 nt, Homo sapiens
gcacgaugcuggaguugcu

SEQ ID NO: 406628 - RNA, 19 nt, Homo sapiens
ugagggagcuguuugucau

SEQ ID NO: 406629 - RNA, 19 nt, Homo sapiens
acauguccaucaagaaauu

SEQ ID NO: 406630 - RNA, 19 nt, Homo sapiens
uaucauggcuacuaauagg

SEQ ID NO: 406631 - RNA, 19 nt, Homo sapiens
guaccagauucaacuuaug

SEQ ID NO: 406632 - RNA, 19 nt, Homo sapiens
agaagaaaguguuggucaa

SEQ ID NO: 406633 - RNA, 19 nt, Homo sapiens
ggccauggauaagaagaaa

SEQ ID NO: 406634 - RNA, 19 nt, Homo sapiens
guguaucucuccaauaaag

SEQ ID NO: 406635 - RNA, 19 nt, Homo sapiens
gggaacaugcuccaucuau

SEQ ID NO: 406636 - RNA, 19 nt, Homo sapiens
agauucaacuuaugagaug

SEQ ID NO: 406637 - RNA, 19 nt, Homo sapiens
gguacauccugaagguaaa

SEQ ID NO: 406638 - RNA, 19 nt, Homo sapiens
ggacuccgccaauauuauc

SEQ ID NO: 406639 - RNA, 19 nt, Homo sapiens
ggacuggacaaacagauca

SEQ ID NO: 406640 - RNA, 19 nt, Homo sapiens
cagcugauugugaaugaua

SEQ ID NO: 406641 - RNA, 19 nt, Homo sapiens
ccaaggucaugcagaagga

SEQ ID NO: 406642 - RNA, 19 nt, Homo sapiens
gcuacuaauaggauugaua

SEQ ID NO: 406643 - RNA, 19 nt, Homo sapiens
gcacugggaagacacuguu

SEQ ID NO: 406644 - RNA, 19 nt, Homo sapiens
caacuuaugagaugauugg

SEQ ID NO: 406645 - RNA, 19 nt, Homo sapiens
acaagauccugcccaacaa

SEQ ID NO: 406646 - RNA, 19 nt, Homo sapiens
ggaaugacagcuacacucu

SEQ ID NO: 406647 - RNA, 19 nt, Homo sapiens
gauccugcccaacaaggua

SEQ ID NO: 406648 - RNA, 19 nt, Homo sapiens
gaagaaaguguuggucaag

SEQ ID NO: 406649 - RNA, 19 nt, Homo sapiens
caagaaauuauggaaguga

SEQ ID NO: 406650 - RNA, 19 nt, Homo sapiens
accaagaacaucaagguua

SEQ ID NO: 406651 - RNA, 19 nt, Homo sapiens
cagaggaacgaacuaaaug

SEQ ID NO: 406652 - RNA, 19 nt, Homo sapiens
gcuuugaggccaccaagaa

SEQ ID NO: 406653 - RNA, 19 nt, Homo sapiens
guggacagccuuugugugu

SEQ ID NO: 406654 - RNA, 19 nt, Homo sapiens
ucacucaggaggacuuuga

SEQ ID NO: 406655 - RNA, 19 nt, Homo sapiens
ugcuaaaguucgccuauug

SEQ ID NO: 406656 - RNA, 19 nt, Homo sapiens
ggauaagaagaaaguguug

SEQ ID NO: 406657 - RNA, 19 nt, Homo sapiens
ucaagaaauuauggaagug

SEQ ID NO: 406658 - RNA, 19 nt, Homo sapiens
gagaaaguaccagauucaa

SEQ ID NO: 406659 - RNA, 19 nt, Homo sapiens
gguagacccauuaguguca

SEQ ID NO: 406660 - RNA, 19 nt, Homo sapiens
cacaagauccugcccaaca

SEQ ID NO: 406661 - RNA, 19 nt, Homo sapiens
uugaagaacuccagcugau

SEQ ID NO: 406662 - RNA, 19 nt, Homo sapiens
gugaucgagcugccuguua

SEQ ID NO: 406663 - RNA, 19 nt, Homo sapiens
uggagaaaguaccagauuc

SEQ ID NO: 406664 - RNA, 19 nt, Homo sapiens
guggagaaaguaccagauu

SEQ ID NO: 406665 - RNA, 19 nt, Homo sapiens
ccggguggcucuaaggaau

SEQ ID NO: 406666 - RNA, 19 nt, Homo sapiens
gagaacggcgaguccaugu

SEQ ID NO: 406667 - RNA, 19 nt, Homo sapiens
ggguggcucuaaggaauga

SEQ ID NO: 406668 - RNA, 19 nt, Homo sapiens
acagaggaacgaacuaaau

SEQ ID NO: 406669 - RNA, 19 nt, Homo sapiens
cagggcgcauugacagaaa

SEQ ID NO: 406670 - RNA, 19 nt, Homo sapiens
agaaaguguuggucaaggu

SEQ ID NO: 406671 - RNA, 19 nt, Homo sapiens
uaccagauucaacuuauga

SEQ ID NO: 406672 - RNA, 19 nt, Homo sapiens
ucaggaggacuuugagaug

SEQ ID NO: 406673 - RNA, 19 nt, Homo sapiens
aagauucauucucggaaga

SEQ ID NO: 406674 - RNA, 19 nt, Homo sapiens
cugaacugguacagaaauu

SEQ ID NO: 406675 - RNA, 19 nt, Homo sapiens
ggacuguaccuuuauucgu

SEQ ID NO: 406676 - RNA, 19 nt, Homo sapiens
cagcuacacucugcacaag

SEQ ID NO: 406677 - RNA, 19 nt, Homo sapiens
ucauacggacuguaccuuu

SEQ ID NO: 406678 - RNA, 19 nt, Homo sapiens
cgagcugccuguuaagcau

SEQ ID NO: 406679 - RNA, 19 nt, Homo sapiens
aguaccagauucaacuuau

SEQ ID NO: 406680 - RNA, 19 nt, Homo sapiens
ggacuuugagauggcagua

SEQ ID NO: 406681 - RNA, 19 nt, Homo sapiens
ccaccaagaacaucaaggu

SEQ ID NO: 406682 - RNA, 19 nt, Homo sapiens
caaccagcucgacggcuuu

SEQ ID NO: 406683 - RNA, 19 nt, Homo sapiens
ggucaagguacauccugaa

SEQ ID NO: 406684 - RNA, 19 nt, Homo sapiens
gauucaacuuaugagauga

SEQ ID NO: 406685 - RNA, 19 nt, Homo sapiens
uguccaagauugaagaacu

SEQ ID NO: 406686 - RNA, 19 nt, Homo sapiens
ugaagaacuccagcugauu

SEQ ID NO: 406687 - RNA, 19 nt, Homo sapiens
cagauucaacuuaugagau

SEQ ID NO: 406688 - RNA, 19 nt, Homo sapiens
caagggagugcugcuguau

SEQ ID NO: 406689 - RNA, 19 nt, Homo sapiens
uccagcugauugugaauga

SEQ ID NO: 406690 - RNA, 19 nt, Homo sapiens
ggcaguagccaaggucaug

SEQ ID NO: 406691 - RNA, 19 nt, Homo sapiens
agggagugcugcuguaugg

SEQ ID NO: 406692 - RNA, 19 nt, Homo sapiens
uaagcauccugagcucuuc

SEQ ID NO: 406693 - RNA, 19 nt, Homo sapiens
gccaauauuaucuguccaa

SEQ ID NO: 406694 - RNA, 19 nt, Homo sapiens
caauauuaucuguccaaga

SEQ ID NO: 406695 - RNA, 19 nt, Homo sapiens
cuaagaagcuggagucuaa

SEQ ID NO: 406696 - RNA, 19 nt, Homo sapiens
uaagagaggugauagaauu

SEQ ID NO: 406697 - RNA, 19 nt, Homo sapiens
gaacagauccgggaauuaa

SEQ ID NO: 406698 - RNA, 19 nt, Homo sapiens
gaacaagaguugcuuugga

SEQ ID NO: 406699 - RNA, 19 nt, Homo sapiens
gaucauggcuacaaacaga

SEQ ID NO: 406700 - RNA, 19 nt, Homo sapiens
gauguuggcuuauuguaaa

SEQ ID NO: 406701 - RNA, 19 nt, Homo sapiens
gagcagaucugagaaaugu

SEQ ID NO: 406702 - RNA, 19 nt, Homo sapiens
ggaguuaagggaacaauua

SEQ ID NO: 406703 - RNA, 19 nt, Homo sapiens
caugacagauguuggcuua

SEQ ID NO: 406704 - RNA, 19 nt, Homo sapiens
gugauagaauuaccucuua

SEQ ID NO: 406705 - RNA, 19 nt, Homo sapiens
gaaagugguuugagauagu

SEQ ID NO: 406706 - RNA, 19 nt, Homo sapiens
caucaaccaugcaucauuu

SEQ ID NO: 406707 - RNA, 19 nt, Homo sapiens
ggacugcaauuucuuaaag

SEQ ID NO: 406708 - RNA, 19 nt, Homo sapiens
uacaaagcauggugaaaua

SEQ ID NO: 406709 - RNA, 19 nt, Homo sapiens
ccaggaagauuagauagaa

SEQ ID NO: 406710 - RNA, 19 nt, Homo sapiens
gcagguauguucgcaauuc

SEQ ID NO: 406711 - RNA, 19 nt, Homo sapiens
ugacagauguuggcuuauu

SEQ ID NO: 406712 - RNA, 19 nt, Homo sapiens
gugaagugcuuaaacaguu

SEQ ID NO: 406713 - RNA, 19 nt, Homo sapiens
ugaagugcuuaaacaguua

SEQ ID NO: 406714 - RNA, 19 nt, Homo sapiens
ugagaaauguuuguacuga

SEQ ID NO: 406715 - RNA, 19 nt, Homo sapiens
gcagaucugagaaauguuu

SEQ ID NO: 406716 - RNA, 19 nt, Homo sapiens
caaaugaacaagcaagauu

SEQ ID NO: 406717 - RNA, 19 nt, Homo sapiens
ggaauuaagagaggugaua

SEQ ID NO: 406718 - RNA, 19 nt, Homo sapiens
ugaaagugcucguuugauc

SEQ ID NO: 406719 - RNA, 19 nt, Homo sapiens
gguuugagauagugguaua

SEQ ID NO: 406720 - RNA, 19 nt, Homo sapiens
gagaaauguuuguacugaa

SEQ ID NO: 406721 - RNA, 19 nt, Homo sapiens
gaucgugggugaagugcuu

SEQ ID NO: 406722 - RNA, 19 nt, Homo sapiens
gaagcuggagucuaaauug

SEQ ID NO: 406723 - RNA, 19 nt, Homo sapiens
uggauccacugguuuauaa

SEQ ID NO: 406724 - RNA, 19 nt, Homo sapiens
gaacuuaccaagcaguaug

SEQ ID NO: 406725 - RNA, 19 nt, Homo sapiens
gaacaagcaagauuagaca

SEQ ID NO: 406726 - RNA, 19 nt, Homo sapiens
uaaaagaacuuaccaagca

SEQ ID NO: 406727 - RNA, 19 nt, Homo sapiens
auaaggcgcuucaggacua

SEQ ID NO: 406728 - RNA, 19 nt, Homo sapiens
gcuacaaacagaccagaua

SEQ ID NO: 406729 - RNA, 19 nt, Homo sapiens
agaauuaccucuuacaaac

SEQ ID NO: 406730 - RNA, 19 nt, Homo sapiens
gacagauguuggcuuauug

SEQ ID NO: 406731 - RNA, 19 nt, Homo sapiens
gaaaaguggcugauucuaa

SEQ ID NO: 406732 - RNA, 19 nt, Homo sapiens
cagaacagauccgggaauu

SEQ ID NO: 406733 - RNA, 19 nt, Homo sapiens
ggauaugacuacacuaacu

SEQ ID NO: 406734 - RNA, 19 nt, Homo sapiens
gguuguaucuaguucuauu

SEQ ID NO: 406735 - RNA, 19 nt, Homo sapiens
ugagauauuugccgagaga

SEQ ID NO: 406736 - RNA, 19 nt, Homo sapiens
uaauggaguuacugaauca

SEQ ID NO: 406737 - RNA, 19 nt, Homo sapiens
gaacguuaauggaguuacu

SEQ ID NO: 406738 - RNA, 19 nt, Homo sapiens
gaaagugcucguuugauca

SEQ ID NO: 406739 - RNA, 19 nt, Homo sapiens
gauaugacuacacuaacua

SEQ ID NO: 406740 - RNA, 19 nt, Homo sapiens
gaucaucaaccaugcauca

SEQ ID NO: 406741 - RNA, 19 nt, Homo sapiens
uuacaaacccagaguuauu

SEQ ID NO: 406742 - RNA, 19 nt, Homo sapiens
agaaguugcuugaacacaa

SEQ ID NO: 406743 - RNA, 19 nt, Homo sapiens
gagauagugguauaagaaa

SEQ ID NO: 406744 - RNA, 19 nt, Homo sapiens
caaguacauuggugaaagu

SEQ ID NO: 406745 - RNA, 19 nt, Homo sapiens
ugagauagugguauaagaa

SEQ ID NO: 406746 - RNA, 19 nt, Homo sapiens
acagagagauucagagaac

SEQ ID NO: 406747 - RNA, 19 nt, Homo sapiens
guaucuaguucuauuguag

SEQ ID NO: 406748 - RNA, 19 nt, Homo sapiens
gaucugagaaauguuugua

SEQ ID NO: 406749 - RNA, 19 nt, Homo sapiens
caagcaagauuagacauac

SEQ ID NO: 406750 - RNA, 19 nt, Homo sapiens
ggagggcuaucagaacaga

SEQ ID NO: 406751 - RNA, 19 nt, Homo sapiens
gagauucagagaacguuaa

SEQ ID NO: 406752 - RNA, 19 nt, Homo sapiens
ucuuaaagguuguaucuag

SEQ ID NO: 406753 - RNA, 19 nt, Homo sapiens
uaauggagcagaucugaga

SEQ ID NO: 406754 - RNA, 19 nt, Homo sapiens
ugaaggcccuacagagugu

SEQ ID NO: 406755 - RNA, 19 nt, Homo sapiens
uaaagguuguaucuaguuc

SEQ ID NO: 406756 - RNA, 19 nt, Homo sapiens
cagcuggacugcaauuucu

SEQ ID NO: 406757 - RNA, 19 nt, Homo sapiens
ugaaagugguuugagauag

SEQ ID NO: 406758 - RNA, 19 nt, Homo sapiens
caaagcauggugaaauaga

SEQ ID NO: 406759 - RNA, 19 nt, Homo sapiens
caggaagauuagauagaaa

SEQ ID NO: 406760 - RNA, 19 nt, Homo sapiens
ugacagagagauucagaga

SEQ ID NO: 406761 - RNA, 19 nt, Homo sapiens
ggugaaagugcucguuuga

SEQ ID NO: 406762 - RNA, 19 nt, Homo sapiens
gcuggacugcaauuucuua

SEQ ID NO: 406763 - RNA, 19 nt, Homo sapiens
guacuucagcugacagaga

SEQ ID NO: 406764 - RNA, 19 nt, Homo sapiens
caagaguugcuuuggauau

SEQ ID NO: 406765 - RNA, 19 nt, Homo sapiens
uauugaaagugguuugaga

SEQ ID NO: 406766 - RNA, 19 nt, Homo sapiens
uuacaaagggaaaguguug

SEQ ID NO: 406767 - RNA, 19 nt, Homo sapiens
agaaauguuuguacugaag

SEQ ID NO: 406768 - RNA, 19 nt, Homo sapiens
gauuaugaagcaauuguga

SEQ ID NO: 406769 - RNA, 19 nt, Homo sapiens
acaagcaagauuagacaua

SEQ ID NO: 406770 - RNA, 19 nt, Homo sapiens
uguuaaagcuaccaaugga

SEQ ID NO: 406771 - RNA, 19 nt, Homo sapiens
ugacuacacuaacuaucau

SEQ ID NO: 406772 - RNA, 19 nt, Homo sapiens
uuaauggaguuacugaauc

SEQ ID NO: 406773 - RNA, 19 nt, Homo sapiens
ccacugguuuauaacaugu

SEQ ID NO: 406774 - RNA, 19 nt, Homo sapiens
uacacuaacuaucaugaga

SEQ ID NO: 406775 - RNA, 19 nt, Homo sapiens
uuacaaagcauggugaaau

SEQ ID NO: 406776 - RNA, 19 nt, Homo sapiens
ggaguuacugaaucaaaug

SEQ ID NO: 406777 - RNA, 19 nt, Homo sapiens
agagaacguuaauggaguu

SEQ ID NO: 406778 - RNA, 19 nt, Homo sapiens
gcaauuucuuaaagguugu

SEQ ID NO: 406779 - RNA, 19 nt, Homo sapiens
gcagaucgugggugaagug

SEQ ID NO: 406780 - RNA, 19 nt, Homo sapiens
aaaugaucauggcuacaaa

SEQ ID NO: 406781 - RNA, 19 nt, Homo sapiens
gauuugauacucugcauag

SEQ ID NO: 406782 - RNA, 19 nt, Homo sapiens
guuaauggaguuacugaau

SEQ ID NO: 406783 - RNA, 19 nt, Homo sapiens
aagguuguaucuaguucua

SEQ ID NO: 406784 - RNA, 19 nt, Homo sapiens
aacaagaguugcuuuggau

SEQ ID NO: 406785 - RNA, 19 nt, Homo sapiens
gcaagauuagacauacuga

SEQ ID NO: 406786 - RNA, 19 nt, Homo sapiens
ggugauagaauuaccucuu

SEQ ID NO: 406787 - RNA, 19 nt, Homo sapiens
gauuggagggcuaucagaa

SEQ ID NO: 406788 - RNA, 19 nt, Homo sapiens
caucauggcggacccuaga

SEQ ID NO: 406789 - RNA, 19 nt, Homo sapiens
aaagcauggugaaauagau

SEQ ID NO: 406790 - RNA, 19 nt, Homo sapiens
ccaugcaggucccauuaca

SEQ ID NO: 406791 - RNA, 19 nt, Homo sapiens
uggaguuacugaaucaaau

SEQ ID NO: 406792 - RNA, 19 nt, Homo sapiens
acaaguacauuggugaaag

SEQ ID NO: 406793 - RNA, 19 nt, Homo sapiens
cuagccagcuggacugcaa

SEQ ID NO: 406794 - RNA, 19 nt, Homo sapiens
aagagaggugauagaauua

SEQ ID NO: 406795 - RNA, 19 nt, Homo sapiens
ugaaauggcuauugaguua

SEQ ID NO: 406796 - RNA, 19 nt, Homo sapiens
gaagauauaugacuguuga

SEQ ID NO: 406797 - RNA, 19 nt, Homo sapiens
uggcauagcuuuaguaaug

SEQ ID NO: 406798 - RNA, 19 nt, Homo sapiens
gaagaugaaccacagcuua

SEQ ID NO: 406799 - RNA, 19 nt, Homo sapiens
gcaaugauaucguuagaca

SEQ ID NO: 406800 - RNA, 19 nt, Homo sapiens
ugaaugcaguuguuaauga

SEQ ID NO: 406801 - RNA, 19 nt, Homo sapiens
caaauugaaugcaguuguu

SEQ ID NO: 406802 - RNA, 19 nt, Homo sapiens
gagauaauuuggaaugguu

SEQ ID NO: 406803 - RNA, 19 nt, Homo sapiens
ggaauaaaguacuaagagu

SEQ ID NO: 406804 - RNA, 19 nt, Homo sapiens
caaggaagccauuaauuug

SEQ ID NO: 406805 - RNA, 19 nt, Homo sapiens
gaaacaaggaagccauuaa

SEQ ID NO: 406806 - RNA, 19 nt, Homo sapiens
ucacuuggguucauucuau

SEQ ID NO: 406807 - RNA, 19 nt, Homo sapiens
uagagaaacugguaaagga

SEQ ID NO: 406808 - RNA, 19 nt, Homo sapiens
ggacugggcauacucauau

SEQ ID NO: 406809 - RNA, 19 nt, Homo sapiens
ucagacagcuguauuccaa

SEQ ID NO: 406810 - RNA, 19 nt, Homo sapiens
ccaggaauguuagcuuaua

SEQ ID NO: 406811 - RNA, 19 nt, Homo sapiens
uggaaggcaucguaaauaa

SEQ ID NO: 406812 - RNA, 19 nt, Homo sapiens
uaacaaggacuuaaagaug

SEQ ID NO: 406813 - RNA, 19 nt, Homo sapiens
ugaaaucacuuguccaaag

SEQ ID NO: 406814 - RNA, 19 nt, Homo sapiens
gcccaaguguugucucuuu

SEQ ID NO: 406815 - RNA, 19 nt, Homo sapiens
gugccuggauccacuaaua

SEQ ID NO: 406816 - RNA, 19 nt, Homo sapiens
gaaaucacuuguccaaagg

SEQ ID NO: 406817 - RNA, 19 nt, Homo sapiens
gacagugacucgauggaaa

SEQ ID NO: 406818 - RNA, 19 nt, Homo sapiens
uaaacaggcuauuggcauu

SEQ ID NO: 406819 - RNA, 19 nt, Homo sapiens
aaccacagcuuaaggaauu

SEQ ID NO: 406820 - RNA, 19 nt, Homo sapiens
guccaaaggugaaucaguu

SEQ ID NO: 406821 - RNA, 19 nt, Homo sapiens
acaaggaagccauuaauuu

SEQ ID NO: 406822 - RNA, 19 nt, Homo sapiens
gacaaccagugaccaguuu

SEQ ID NO: 406823 - RNA, 19 nt, Homo sapiens
gcauagcuuuaguaaugua

SEQ ID NO: 406824 - RNA, 19 nt, Homo sapiens
gaucagagaaagacaguga

SEQ ID NO: 406825 - RNA, 19 nt, Homo sapiens
ugagugauaucuuagagaa

SEQ ID NO: 406826 - RNA, 19 nt, Homo sapiens
cagaggaucucacuugcuu

SEQ ID NO: 406827 - RNA, 19 nt, Homo sapiens
ggauaccagugaagacauu

SEQ ID NO: 406828 - RNA, 19 nt, Homo sapiens
gguuucuacugcuguauua

SEQ ID NO: 406829 - RNA, 19 nt, Homo sapiens
gaacugcacgucaagaugu

SEQ ID NO: 406830 - RNA, 19 nt, Homo sapiens
ccagaaccauuugaguaua

SEQ ID NO: 406831 - RNA, 19 nt, Homo sapiens
gcagugcauuuguaggaaa

SEQ ID NO: 406832 - RNA, 19 nt, Homo sapiens
gagaagauauaugacuguu

SEQ ID NO: 406833 - RNA, 19 nt, Homo sapiens
ugccgaaaguucaguauaa

SEQ ID NO: 406834 - RNA, 19 nt, Homo sapiens
ggaugcagguggucauaau

SEQ ID NO: 406835 - RNA, 19 nt, Homo sapiens
cugaauauguggaaacuau

SEQ ID NO: 406836 - RNA, 19 nt, Homo sapiens
ucgaaggucuggaauguau

SEQ ID NO: 406837 - RNA, 19 nt, Homo sapiens
cgaaugaugucccaggaau

SEQ ID NO: 406838 - RNA, 19 nt, Homo sapiens
ggaaacaaggaagccauua

SEQ ID NO: 406839 - RNA, 19 nt, Homo sapiens
gggauaugcugugcuggua

SEQ ID NO: 406840 - RNA, 19 nt, Homo sapiens
gcacuaggucuuauucaug

SEQ ID NO: 406841 - RNA, 19 nt, Homo sapiens
ggaaggcaucguaaauaaa

SEQ ID NO: 406842 - RNA, 19 nt, Homo sapiens
caaaaugcauugaucacua

SEQ ID NO: 406843 - RNA, 19 nt, Homo sapiens
gccgagaccugcuauucaa

SEQ ID NO: 406844 - RNA, 19 nt, Homo sapiens
gcacaagaaacucaacaug

SEQ ID NO: 406845 - RNA, 19 nt, Homo sapiens
auacagaccucaugauucu

SEQ ID NO: 406846 - RNA, 19 nt, Homo sapiens
guggugaaauggcuauuga

SEQ ID NO: 406847 - RNA, 19 nt, Homo sapiens
uggcauaucagauuuguuu

SEQ ID NO: 406848 - RNA, 19 nt, Homo sapiens
cagaaccauuugaguauau

SEQ ID NO: 406849 - RNA, 19 nt, Homo sapiens
ucauaugccuucugugguu

SEQ ID NO: 406850 - RNA, 19 nt, Homo sapiens
ggucuggaauguauacugu

SEQ ID NO: 406851 - RNA, 19 nt, Homo sapiens
gagauuggaaggcaucgua

SEQ ID NO: 406852 - RNA, 19 nt, Homo sapiens
ggaagccauuaauuugcua

SEQ ID NO: 406853 - RNA, 19 nt, Homo sapiens
uaauacagaccucaugauu

SEQ ID NO: 406854 - RNA, 19 nt, Homo sapiens
ggcugugagugauaucuua

SEQ ID NO: 406855 - RNA, 19 nt, Homo sapiens
guuugucagugcuuaauuu

SEQ ID NO: 406856 - RNA, 19 nt, Homo sapiens
ugauaacucugaauaugug

SEQ ID NO: 406857 - RNA, 19 nt, Homo sapiens
ggaucucacuugcuuaucu

SEQ ID NO: 406858 - RNA, 19 nt, Homo sapiens
ucaaaccacucucuauugg

SEQ ID NO: 406859 - RNA, 19 nt, Homo sapiens
uguaaaccauccacauuug

SEQ ID NO: 406860 - RNA, 19 nt, Homo sapiens
gccgaaaguucaguauaaa

SEQ ID NO: 406861 - RNA, 19 nt, Homo sapiens
gacaaggacccaauucuuc

SEQ ID NO: 406862 - RNA, 19 nt, Homo sapiens
gcacuacacaaauugaaug

SEQ ID NO: 406863 - RNA, 19 nt, Homo sapiens
gaccagacuuugaaaauga

SEQ ID NO: 406864 - RNA, 19 nt, Homo sapiens
ucccaggaauguuagcuua

SEQ ID NO: 406865 - RNA, 19 nt, Homo sapiens
auacgaagaugaagguuuc

SEQ ID NO: 406866 - RNA, 19 nt, Homo sapiens
guagauaccagccuuucaa

SEQ ID NO: 406867 - RNA, 19 nt, Homo sapiens
caaguguugucucuuuguu

SEQ ID NO: 406868 - RNA, 19 nt, Homo sapiens
cacaagaaacucaacauga

SEQ ID NO: 406869 - RNA, 19 nt, Homo sapiens
ucaugguggugauauaauu

SEQ ID NO: 406870 - RNA, 19 nt, Homo sapiens
ggauacuucuccaggauca

SEQ ID NO: 406871 - RNA, 19 nt, Homo sapiens
ggacaaccagugaccaguu

SEQ ID NO: 406872 - RNA, 19 nt, Homo sapiens
aaacacaaaggaugcagua

SEQ ID NO: 406873 - RNA, 19 nt, Homo sapiens
ggaagacaaccuccugaug

SEQ ID NO: 406874 - RNA, 19 nt, Homo sapiens
ucaaugauaagcaugauga

SEQ ID NO: 406875 - RNA, 19 nt, Homo sapiens
uuauuucucuucuggauga

SEQ ID NO: 406876 - RNA, 19 nt, Homo sapiens
caucugcaguucuuaauac

SEQ ID NO: 406877 - RNA, 19 nt, Homo sapiens
cuacugcuguauuaucuau

SEQ ID NO: 406878 - RNA, 19 nt, Homo sapiens
gagggcagcaguagaauca

SEQ ID NO: 406879 - RNA, 19 nt, Homo sapiens
cagcaaugauaucguuaga

SEQ ID NO: 406880 - RNA, 19 nt, Homo sapiens
guggugauauaauugacua

SEQ ID NO: 406881 - RNA, 19 nt, Homo sapiens
gaaggcaucguaaauaaaa

SEQ ID NO: 406882 - RNA, 19 nt, Homo sapiens
uugaggagucucugaauua

SEQ ID NO: 406883 - RNA, 19 nt, Homo sapiens
gaaugcuuaugaggaaauu

SEQ ID NO: 406884 - RNA, 19 nt, Homo sapiens
aguggcaucuaaaguauuu

SEQ ID NO: 406885 - RNA, 19 nt, Homo sapiens
gauaugcugugcugguaca

SEQ ID NO: 406886 - RNA, 19 nt, Homo sapiens
ugaggagucucugaauuau

SEQ ID NO: 406887 - RNA, 19 nt, Homo sapiens
ugaagaacccugucuccaa

SEQ ID NO: 406888 - RNA, 19 nt, Homo sapiens
gcuauucaaugcauguauc

SEQ ID NO: 406889 - RNA, 19 nt, Homo sapiens
uugacuaucugcuuaauca

SEQ ID NO: 406890 - RNA, 19 nt, Homo sapiens
uaaagaugccgaaaguuca

SEQ ID NO: 406891 - RNA, 19 nt, Homo sapiens
aaacaaggaagccauuaau

SEQ ID NO: 406892 - RNA, 19 nt, Homo sapiens
ggaggucucuaugcacuag

SEQ ID NO: 406893 - RNA, 19 nt, Homo sapiens
caauguuugucagugcuua

SEQ ID NO: 406894 - RNA, 19 nt, Homo sapiens
ugggaaugcuuaugaggaa

SEQ ID NO: 406895 - RNA, 19 nt, Homo sapiens
gagauaagguuguucaaua

SEQ ID NO: 406896 - RNA, 19 nt, Homo sapiens
acaaauggcuuuacaagaa

SEQ ID NO: 406897 - RNA, 19 nt, Homo sapiens
gcccaagccucucaaauuu

SEQ ID NO: 406898 - RNA, 19 nt, Homo sapiens
auaaacagcuucaagauga

SEQ ID NO: 406899 - RNA, 19 nt, Homo sapiens
gaacaaggaccacggaaug

SEQ ID NO: 406900 - RNA, 19 nt, Homo sapiens
ucacugugcuugucucuuu

SEQ ID NO: 406901 - RNA, 19 nt, Homo sapiens
gugaagaugucgaggagua

SEQ ID NO: 406902 - RNA, 19 nt, Homo sapiens
ggaaaucuaugagaacaug

SEQ ID NO: 406903 - RNA, 19 nt, Homo sapiens
gcaaaucacacuauguauu

SEQ ID NO: 406904 - RNA, 19 nt, Homo sapiens
ccggagggcuguaccuuua

SEQ ID NO: 406905 - RNA, 19 nt, Homo sapiens
ugaaggaaaucuaugagaa

SEQ ID NO: 406906 - RNA, 19 nt, Homo sapiens
ucacccagauugacaagua

SEQ ID NO: 406907 - RNA, 19 nt, Homo sapiens
caaaucacacuauguauug

SEQ ID NO: 406908 - RNA, 19 nt, Homo sapiens
ccaguuagcucaauaucau

SEQ ID NO: 406909 - RNA, 19 nt, Homo sapiens
gcaaggaugugguaguaca

SEQ ID NO: 406910 - RNA, 19 nt, Homo sapiens
ggagauuggugcagagaug

SEQ ID NO: 406911 - RNA, 19 nt, Homo sapiens
gcucugagauuggcauuga

SEQ ID NO: 406912 - RNA, 19 nt, Homo sapiens
gggcagaauuggccacuga

SEQ ID NO: 406913 - RNA, 19 nt, Homo sapiens
ggauugcccuuauugcuau

SEQ ID NO: 406914 - RNA, 19 nt, Homo sapiens
gagacuugguuccaucuuu

SEQ ID NO: 406915 - RNA, 19 nt, Homo sapiens
agacugagcucaaggauac

SEQ ID NO: 406916 - RNA, 19 nt, Homo sapiens
caaacaaccucuucauggu

SEQ ID NO: 406917 - RNA, 19 nt, Homo sapiens
ggaagaaccccaauuauga

SEQ ID NO: 406918 - RNA, 19 nt, Homo sapiens
ccucaucucuguuucaaau

SEQ ID NO: 406919 - RNA, 19 nt, Homo sapiens
gugaauggcuuugugaaug

SEQ ID NO: 406920 - RNA, 19 nt, Homo sapiens
gaaugcugguuacguuuga

SEQ ID NO: 406921 - RNA, 19 nt, Homo sapiens
gcacugcucucagacuaug

SEQ ID NO: 406922 - RNA, 19 nt, Homo sapiens
uaagcaaauucucucauga

SEQ ID NO: 406923 - RNA, 19 nt, Homo sapiens
aagacaagcugcuaacaga

SEQ ID NO: 406924 - RNA, 19 nt, Homo sapiens
caacuuccaugacuucagu

SEQ ID NO: 406925 - RNA, 19 nt, Homo sapiens
ccaaagagaaggaggaaga

SEQ ID NO: 406926 - RNA, 19 nt, Homo sapiens
gauaaacagcuucaagaug

SEQ ID NO: 406927 - RNA, 19 nt, Homo sapiens
caaauucucucaugaugcu

SEQ ID NO: 406928 - RNA, 19 nt, Homo sapiens
gcagagauggcauuacgaa

SEQ ID NO: 406929 - RNA, 19 nt, Homo sapiens
gcucaaaucgugaagaugu

SEQ ID NO: 406930 - RNA, 19 nt, Homo sapiens
gagaucauguccaauguac

SEQ ID NO: 406931 - RNA, 19 nt, Homo sapiens
ggagaaggacauugaugaa

SEQ ID NO: 406932 - RNA, 19 nt, Homo sapiens
caggagaaguggcuaagga

SEQ ID NO: 406933 - RNA, 19 nt, Homo sapiens
gccuuuaucucaccaguug

SEQ ID NO: 406934 - RNA, 19 nt, Homo sapiens
caauuaugaucucuaagug

SEQ ID NO: 406935 - RNA, 19 nt, Homo sapiens
cagauucguucuucuacaa

SEQ ID NO: 406936 - RNA, 19 nt, Homo sapiens
gggcuaggcuuggcuuaug

SEQ ID NO: 406937 - RNA, 19 nt, Homo sapiens
ggagcugucugaagaggau

SEQ ID NO: 406938 - RNA, 19 nt, Homo sapiens
auccagaaguuuccuauaa

SEQ ID NO: 406939 - RNA, 19 nt, Homo sapiens
cuaagcaaauucucucaug

SEQ ID NO: 406940 - RNA, 19 nt, Homo sapiens
ccaacacacugguggaugu

SEQ ID NO: 406941 - RNA, 19 nt, Homo sapiens
caacaaauggcuuuacaag

SEQ ID NO: 406942 - RNA, 19 nt, Homo sapiens
gagaaggacauugaugaaa

SEQ ID NO: 406943 - RNA, 19 nt, Homo sapiens
uaacauggcccacaaugca

SEQ ID NO: 406944 - RNA, 19 nt, Homo sapiens
ggagauguaacuuccacua

SEQ ID NO: 406945 - RNA, 19 nt, Homo sapiens
gggauugcccuuauugcua

SEQ ID NO: 406946 - RNA, 19 nt, Homo sapiens
agaaacagauggcauucau

SEQ ID NO: 406947 - RNA, 19 nt, Homo sapiens
gcagauucguucuucuaca

SEQ ID NO: 406948 - RNA, 19 nt, Homo sapiens
cugcaaggaugugguagua

SEQ ID NO: 406949 - RNA, 19 nt, Homo sapiens
ugaagaggauaaacagcuu

SEQ ID NO: 406950 - RNA, 19 nt, Homo sapiens
gcaaacugaaggaaaucua

SEQ ID NO: 406951 - RNA, 19 nt, Homo sapiens
ccaagccucucaaauuucu

SEQ ID NO: 406952 - RNA, 19 nt, Homo sapiens
ggauaaacagcuucaagau

SEQ ID NO: 406953 - RNA, 19 nt, Homo sapiens
agaaagacaaggacaagaa

SEQ ID NO: 406954 - RNA, 19 nt, Homo sapiens
gcgaacacuuugacuccaa

SEQ ID NO: 406955 - RNA, 19 nt, Homo sapiens
ucagagccauuccgcaguu

SEQ ID NO: 406956 - RNA, 19 nt, Homo sapiens
gcaauggagauguaacuuc

SEQ ID NO: 406957 - RNA, 19 nt, Homo sapiens
gcuuuagccuguggaauga

SEQ ID NO: 406958 - RNA, 19 nt, Homo sapiens
agacuugguuccaucuuug

SEQ ID NO: 406959 - RNA, 19 nt, Homo sapiens
gaaagacaaggacaagaag

SEQ ID NO: 406960 - RNA, 19 nt, Homo sapiens
ggcaacaaauggcuuuaca

SEQ ID NO: 406961 - RNA, 19 nt, Homo sapiens
aaacccaccuagagaacaa

SEQ ID NO: 406962 - RNA, 19 nt, Homo sapiens
ucaaugacauggaguuggu

SEQ ID NO: 406963 - RNA, 19 nt, Homo sapiens
gguguguuccgaaaguuua

SEQ ID NO: 406964 - RNA, 19 nt, Homo sapiens
gugaagauguccuaacacu

SEQ ID NO: 406965 - RNA, 19 nt, Homo sapiens
caacagcaacaccaugaga

SEQ ID NO: 406966 - RNA, 19 nt, Homo sapiens
caaauggcuuuacaagaac

SEQ ID NO: 406967 - RNA, 19 nt, Homo sapiens
ccaauuaugaucucuaagu

SEQ ID NO: 406968 - RNA, 19 nt, Homo sapiens
gggcagugguaccaauaau

SEQ ID NO: 406969 - RNA, 19 nt, Homo sapiens
ucaugaugcugauccagaa

SEQ ID NO: 406970 - RNA, 19 nt, Homo sapiens
ggaggaagacaaagacaag

SEQ ID NO: 406971 - RNA, 19 nt, Homo sapiens
gagacugagcucaaggaua

SEQ ID NO: 406972 - RNA, 19 nt, Homo sapiens
uggcaggugucacagcuuu

SEQ ID NO: 406973 - RNA, 19 nt, Homo sapiens
cagacuauguucuccacaa

SEQ ID NO: 406974 - RNA, 19 nt, Homo sapiens
gaaccuggccuccucuuuu

SEQ ID NO: 406975 - RNA, 19 nt, Homo sapiens
gaaggacauugaugaaaau

SEQ ID NO: 406976 - RNA, 19 nt, Homo sapiens
gcugacaucaucuccguuu

SEQ ID NO: 406977 - RNA, 19 nt, Homo sapiens
aggcaaaucacacuaugua

SEQ ID NO: 406978 - RNA, 19 nt, Homo sapiens
gaaggaaaucuaugagaac

SEQ ID NO: 406979 - RNA, 19 nt, Homo sapiens
guccugcaauggagaugua

SEQ ID NO: 406980 - RNA, 19 nt, Homo sapiens
acaagcugcuaacagauga

SEQ ID NO: 406981 - RNA, 19 nt, Homo sapiens
ccuauaacauggcccacaa

SEQ ID NO: 406982 - RNA, 19 nt, Homo sapiens
ugagugagauaagguuguu

SEQ ID NO: 406983 - RNA, 19 nt, Homo sapiens
guucgaaacauuauucuag

SEQ ID NO: 406984 - RNA, 19 nt, Homo sapiens
caaggaccacggaauguug

SEQ ID NO: 406985 - RNA, 19 nt, Homo sapiens
gcaacaaauggcuuuacaa

SEQ ID NO: 406986 - RNA, 19 nt, Homo sapiens
gauccagaaguuuccuaua

SEQ ID NO: 406987 - RNA, 19 nt, Homo sapiens
gugcagagauggcauuacg

SEQ ID NO: 406988 - RNA, 19 nt, Homo sapiens
gacaagcugcuaacagaug

SEQ ID NO: 406989 - RNA, 19 nt, Homo sapiens
cagagaucauguccaaugu

SEQ ID NO: 406990 - RNA, 19 nt, Homo sapiens
gacaaagacaagaaggaaa

SEQ ID NO: 406991 - RNA, 19 nt, Homo sapiens
caaacugaaggaaaucuau

SEQ ID NO: 406992 - RNA, 19 nt, Homo sapiens
gagauguaacuuccacuau

SEQ ID NO: 406993 - RNA, 19 nt, Homo sapiens
uaacagaugauggcaacaa

SEQ ID NO: 406994 - RNA, 19 nt, Homo sapiens
gcucaacagcaacuucuug

SEQ ID NO: 406995 - RNA, 19 nt, Homo sapiens
ggacacagaggcugauuua

SEQ ID NO: 406996 - RNA, 19 nt, Homo sapiens
ccaaggagauggcagaaga

SEQ ID NO: 406997 - RNA, 19 nt, Homo sapiens
ugucuuggcuuguauguuu

SEQ ID NO: 406998 - RNA, 19 nt, Homo sapiens
gaugggaccuacacccuaa

SEQ ID NO: 406999 - RNA, 19 nt, Homo sapiens
ggaauuaccuacacuacag

SEQ ID NO: 407000 - RNA, 19 nt, Homo sapiens
gaacagcaagcgcuacaaa

SEQ ID NO: 407001 - RNA, 19 nt, Homo sapiens
ccgcaaaguguuacuauua

SEQ ID NO: 407002 - RNA, 19 nt, Homo sapiens
caggaaaccuagccaaguu

SEQ ID NO: 407003 - RNA, 19 nt, Homo sapiens
caaccacuauguucuguau

SEQ ID NO: 407004 - RNA, 19 nt, Homo sapiens
gaugacagcuucccuugag

SEQ ID NO: 407005 - RNA, 19 nt, Homo sapiens
ccaaggagaugauugacau

SEQ ID NO: 407006 - RNA, 19 nt, Homo sapiens
gugcagggcuucuucacuu

SEQ ID NO: 407007 - RNA, 19 nt, Homo sapiens
gcucacucaugcccuauuu

SEQ ID NO: 407008 - RNA, 19 nt, Homo sapiens
gcaaaguguuacuauuauc

SEQ ID NO: 407009 - RNA, 19 nt, Homo sapiens
ggaccuacacccuaauuau

SEQ ID NO: 407010 - RNA, 19 nt, Homo sapiens
uaaugccacucgagacuuu

SEQ ID NO: 407011 - RNA, 19 nt, Homo sapiens
gagaagggcuauguccaau

SEQ ID NO: 407012 - RNA, 19 nt, Homo sapiens
ggagaaguuucaagcagau

SEQ ID NO: 407013 - RNA, 19 nt, Homo sapiens
gaagaucaguacucagaac

SEQ ID NO: 407014 - RNA, 19 nt, Homo sapiens
cagcuacgcuucggcauga

SEQ ID NO: 407015 - RNA, 19 nt, Homo sapiens
gaugcagaguucauuguug

SEQ ID NO: 407016 - RNA, 19 nt, Homo sapiens
ugaaacagcuagagaaagc

SEQ ID NO: 407017 - RNA, 19 nt, Homo sapiens
gaaggauaguucuguguac

SEQ ID NO: 407018 - RNA, 19 nt, Homo sapiens
ggagauggcagaagaugau

SEQ ID NO: 407019 - RNA, 19 nt, Homo sapiens
gagaacagcaggacuugga

SEQ ID NO: 407020 - RNA, 19 nt, Homo sapiens
gaagaugcagaguucauug

SEQ ID NO: 407021 - RNA, 19 nt, Homo sapiens
cagaagaucaguacucaga

SEQ ID NO: 407022 - RNA, 19 nt, Homo sapiens
ucaaggagcacgugaaaca

SEQ ID NO: 407023 - RNA, 19 nt, Homo sapiens
gaagggcuauguccaaucc

SEQ ID NO: 407024 - RNA, 19 nt, Homo sapiens
cagcaggacuuggaguuug

SEQ ID NO: 407025 - RNA, 19 nt, Homo sapiens
cugagaagcugguguccaa

SEQ ID NO: 407026 - RNA, 19 nt, Homo sapiens
cgcaaaguguuacuauuau

SEQ ID NO: 407027 - RNA, 19 nt, Homo sapiens
cccagaagcugcaguugga

SEQ ID NO: 407028 - RNA, 19 nt, Homo sapiens
acacagaggcugauuuaca

SEQ ID NO: 407029 - RNA, 19 nt, Homo sapiens
ggaagccuaucuccaacuc

SEQ ID NO: 407030 - RNA, 19 nt, Homo sapiens
accacuauguucuguauaa

SEQ ID NO: 407031 - RNA, 19 nt, Homo sapiens
gaagcuucgauuaugauuu

SEQ ID NO: 407032 - RNA, 19 nt, Homo sapiens
caucaaggagcacgugaaa

SEQ ID NO: 407033 - RNA, 19 nt, Homo sapiens
cuacacagggcgaaucaaa

SEQ ID NO: 407034 - RNA, 19 nt, Homo sapiens
ccagguaccucuacuacac

SEQ ID NO: 407035 - RNA, 19 nt, Homo sapiens
ucaaacagacggugcacaa

SEQ ID NO: 407036 - RNA, 19 nt, Homo sapiens
ccaaaucguacaacaagga

SEQ ID NO: 407037 - RNA, 19 nt, Homo sapiens
cuagauauccacaacaugu

SEQ ID NO: 407038 - RNA, 19 nt, Homo sapiens
acaaagaggcacagaagau

SEQ ID NO: 407039 - RNA, 19 nt, Homo sapiens
ggaacggcgugagcgagaa

SEQ ID NO: 407040 - RNA, 19 nt, Homo sapiens
ccuauuuccuucugacuca

SEQ ID NO: 407041 - RNA, 19 nt, Homo sapiens
gagcaggccaacaacaaug

SEQ ID NO: 407042 - RNA, 19 nt, Homo sapiens
cacagaggcugauuuacag

SEQ ID NO: 407043 - RNA, 19 nt, Homo sapiens
ugggaugucuuggcuugua

SEQ ID NO: 407044 - RNA, 19 nt, Homo sapiens
ggcagaagaugaugaugac

SEQ ID NO: 407045 - RNA, 19 nt, Homo sapiens
ugaucagccucuccuauuc

SEQ ID NO: 407046 - RNA, 19 nt, Homo sapiens
gaccuacacccuaauuauc

SEQ ID NO: 407047 - RNA, 19 nt, Homo sapiens
gcaaggagccgagauucgu

SEQ ID NO: 407048 - RNA, 19 nt, Homo sapiens
ucuaugaguuccuggacaa

SEQ ID NO: 407049 - RNA, 19 nt, Homo sapiens
cgagaagggcuauguccaa

SEQ ID NO: 407050 - RNA, 19 nt, Homo sapiens
gcacaacgugauuaagaca

SEQ ID NO: 407051 - RNA, 19 nt, Homo sapiens
cggcacaacgugauuaaga

SEQ ID NO: 407052 - RNA, 19 nt, Homo sapiens
gccgcaaaguguuacuauu

SEQ ID NO: 407053 - RNA, 19 nt, Homo sapiens
gacuagaacugggaugucu

SEQ ID NO: 407054 - RNA, 19 nt, Homo sapiens
cagaagcugcaguuggaua

SEQ ID NO: 407055 - RNA, 19 nt, Homo sapiens
uggcugacaucgcccagaa

SEQ ID NO: 407056 - RNA, 19 nt, Homo sapiens
gggaugucuuggcuuguau

SEQ ID NO: 407057 - RNA, 19 nt, Homo sapiens
gccuagauauccacaacau

SEQ ID NO: 407058 - RNA, 19 nt, Homo sapiens
cccaggauguggagaugaa

SEQ ID NO: 407059 - RNA, 19 nt, Homo sapiens
caaagaggcacagaagauc

SEQ ID NO: 407060 - RNA, 19 nt, Homo sapiens
cuacaaagaggcacagaag

SEQ ID NO: 407061 - RNA, 19 nt, Homo sapiens
acagcaagcgcuacaaaga

SEQ ID NO: 407062 - RNA, 19 nt, Homo sapiens
uuugaagcuucgauuauga

SEQ ID NO: 407063 - RNA, 19 nt, Homo sapiens
gggaccuacacccuaauua

SEQ ID NO: 407064 - RNA, 19 nt, Homo sapiens
ggaaaccuagccaaguuca

SEQ ID NO: 407065 - RNA, 19 nt, Homo sapiens
acaaugagugggccaggua

SEQ ID NO: 407066 - RNA, 19 nt, Homo sapiens
ccuccugccugaaguggaa

SEQ ID NO: 407067 - RNA, 19 nt, Homo sapiens
cagagcaggccaacaacaa

SEQ ID NO: 407068 - RNA, 19 nt, Homo sapiens
uggcagaagaugaugauga

SEQ ID NO: 407069 - RNA, 19 nt, Homo sapiens
cgaagaugcagaguucauu

SEQ ID NO: 407070 - RNA, 19 nt, Homo sapiens
cgugaaacagcuagagaaa

SEQ ID NO: 407071 - RNA, 19 nt, Homo sapiens
cggcggaggagaacaagaa

SEQ ID NO: 407072 - RNA, 19 nt, Homo sapiens
agcgagagcuggacacagu

SEQ ID NO: 407073 - RNA, 19 nt, Homo sapiens
gagaagcugguguccaagu

SEQ ID NO: 407074 - RNA, 19 nt, Homo sapiens
gccggugacuuacuguaca

SEQ ID NO: 407075 - RNA, 19 nt, Homo sapiens
gguuuccucccaaaucgua

SEQ ID NO: 407076 - RNA, 19 nt, Homo sapiens
ugcagaagaucaguacuca

SEQ ID NO: 407077 - RNA, 19 nt, Homo sapiens
acacagcugucggcuucaa

SEQ ID NO: 407078 - RNA, 19 nt, Homo sapiens
gauggcagaagaugaugau

SEQ ID NO: 407079 - RNA, 19 nt, Homo sapiens
ggcacaacgugauuaagac

SEQ ID NO: 407080 - RNA, 19 nt, Homo sapiens
gcuacaaagaggcacagaa

SEQ ID NO: 407081 - RNA, 19 nt, Homo sapiens
cuagaacugggaugucuug

SEQ ID NO: 407082 - RNA, 19 nt, Homo sapiens
agaggcugauuuacaguuc

SEQ ID NO: 407083 - RNA, 19 nt, Homo sapiens
ggaguuugccaaggagaug

SEQ ID NO: 407084 - RNA, 19 nt, Homo sapiens
gaaucuccuuggcugacau

SEQ ID NO: 407085 - RNA, 19 nt, Homo sapiens
ucccagagcaggccaacaa

SEQ ID NO: 407086 - RNA, 19 nt, Homo sapiens
ggaagagcccauggacaca

SEQ ID NO: 407087 - RNA, 19 nt, Homo sapiens
ccacuauguucuguauaag

SEQ ID NO: 407088 - RNA, 19 nt, Homo sapiens
ccuuguagccgcaaagugu

SEQ ID NO: 407089 - RNA, 19 nt, Homo sapiens
ccacacacagcucauaugc

SEQ ID NO: 407090 - RNA, 19 nt, Homo sapiens
caugaucagccucuccuau

SEQ ID NO: 407091 - RNA, 19 nt, Homo sapiens
gaaaccuagccaaguucaa

SEQ ID NO: 407092 - RNA, 19 nt, Homo sapiens
gcagggcuucuucacuuca

SEQ ID NO: 407093 - RNA, 19 nt, Homo sapiens
auaguucuguguacuccuu

SEQ ID NO: 407094 - RNA, 19 nt, Homo sapiens
gcgagaacagcaggacuug

SEQ ID NO: 407095 - RNA, 19 nt, Homo sapiens
caacauaguuugucauuca

SEQ ID NO: 407096 - RNA, 19 nt, Homo sapiens
gcaggaugcugucaacaua

SEQ ID NO: 407097 - RNA, 19 nt, Homo sapiens
ggaggaagguggcaagaug

SEQ ID NO: 407098 - RNA, 19 nt, Homo sapiens
ccaaggaggaggaugauua

SEQ ID NO: 407099 - RNA, 19 nt, Homo sapiens
ggacaacagugaguauaug

SEQ ID NO: 407100 - RNA, 19 nt, Homo sapiens
aaauaaagcuuggcaacuu

SEQ ID NO: 407101 - RNA, 19 nt, Homo sapiens
ggaaagcacuauggugugu

SEQ ID NO: 407102 - RNA, 19 nt, Homo sapiens
gaauauaggguuagaugug

SEQ ID NO: 407103 - RNA, 19 nt, Homo sapiens
gcaagaugguguuggaaag

SEQ ID NO: 407104 - RNA, 19 nt, Homo sapiens
cuaaacgccucaagaagga

SEQ ID NO: 407105 - RNA, 19 nt, Homo sapiens
agaaggaucuggugaaacu

SEQ ID NO: 407106 - RNA, 19 nt, Homo sapiens
ugagaaggaucuggugaaa

SEQ ID NO: 407107 - RNA, 19 nt, Homo sapiens
gagaacaacgugggccuua

SEQ ID NO: 407108 - RNA, 19 nt, Homo sapiens
aagaggaggugaacacaga

SEQ ID NO: 407109 - RNA, 19 nt, Homo sapiens
gcagcaacccugagaacaa

SEQ ID NO: 407110 - RNA, 19 nt, Homo sapiens
gcucagcuauggacacauc

SEQ ID NO: 407111 - RNA, 19 nt, Homo sapiens
gaaggagaaaguaaauguu

SEQ ID NO: 407112 - RNA, 19 nt, Homo sapiens
gccagugacuuugaauuug

SEQ ID NO: 407113 - RNA, 19 nt, Homo sapiens
ucaagaaggagaaaguaaa

SEQ ID NO: 407114 - RNA, 19 nt, Homo sapiens
gaacaacgugggccuuauc

SEQ ID NO: 407115 - RNA, 19 nt, Homo sapiens
caagaaggagaaaguaaau

SEQ ID NO: 407116 - RNA, 19 nt, Homo sapiens
gcggaauggagacuucuua

SEQ ID NO: 407117 - RNA, 19 nt, Homo sapiens
guucucaucuggugacagu

SEQ ID NO: 407118 - RNA, 19 nt, Homo sapiens
caagcuacauacuguccaa

SEQ ID NO: 407119 - RNA, 19 nt, Homo sapiens
caacgugggccuuaucaca

SEQ ID NO: 407120 - RNA, 19 nt, Homo sapiens
cauuacagccuaaauaaag

SEQ ID NO: 407121 - RNA, 19 nt, Homo sapiens
ccagugacuuugaauuugg

SEQ ID NO: 407122 - RNA, 19 nt, Homo sapiens
ucucaucaguucuccgauu

SEQ ID NO: 407123 - RNA, 19 nt, Homo sapiens
gcgcaucauugccuuugug

SEQ ID NO: 407124 - RNA, 19 nt, Homo sapiens
uguccaagcuacauacugu

SEQ ID NO: 407125 - RNA, 19 nt, Homo sapiens
uuaucacacuggcuaauga

SEQ ID NO: 407126 - RNA, 19 nt, Homo sapiens
gcaugggaagcacggaaua

SEQ ID NO: 407127 - RNA, 19 nt, Homo sapiens
gacugggacugaagacuca

SEQ ID NO: 407128 - RNA, 19 nt, Homo sapiens
ggaggacaaugagaaggau

SEQ ID NO: 407129 - RNA, 19 nt, Homo sapiens
gaagcccaguggaggacaa

SEQ ID NO: 407130 - RNA, 19 nt, Homo sapiens
gacgaugcccugcugaaga

SEQ ID NO: 407131 - RNA, 19 nt, Homo sapiens
ugacuuugaauuuggagua

SEQ ID NO: 407132 - RNA, 19 nt, Homo sapiens
cgacaaggcaagaaucaca

SEQ ID NO: 407133 - RNA, 19 nt, Homo sapiens
ggaaaggguagcugagucu

SEQ ID NO: 407134 - RNA, 19 nt, Homo sapiens
agaaggagaaaguaaaugu

SEQ ID NO: 407135 - RNA, 19 nt, Homo sapiens
aggcaagaaucacaagaug

SEQ ID NO: 407136 - RNA, 19 nt, Homo sapiens
gcaccgacaaggcaagaau

SEQ ID NO: 407137 - RNA, 19 nt, Homo sapiens
ggaauauaggguuagaugu

SEQ ID NO: 407138 - RNA, 19 nt, Homo sapiens
gugaguauaugcggaaugg

SEQ ID NO: 407139 - RNA, 19 nt, Homo sapiens
aggagaaaguaaauguuga

SEQ ID NO: 407140 - RNA, 19 nt, Homo sapiens
ggcaagaugguguuggaaa

SEQ ID NO: 407141 - RNA, 19 nt, Homo sapiens
gaugcugucaacauaguuu

SEQ ID NO: 407142 - RNA, 19 nt, Homo sapiens
ccauuacagccuaaauaaa

SEQ ID NO: 407143 - RNA, 19 nt, Homo sapiens
aaccauuacagccuaaaua

SEQ ID NO: 407144 - RNA, 19 nt, Homo sapiens
aauauaggguuagaugugu

SEQ ID NO: 407145 - RNA, 19 nt, Homo sapiens
ccaaggacggcaagaagga

SEQ ID NO: 407146 - RNA, 19 nt, Homo sapiens
guggcaagaugguguugga

SEQ ID NO: 407147 - RNA, 19 nt, Homo sapiens
cucaucaguucuccgauuu

SEQ ID NO: 407148 - RNA, 19 nt, Homo sapiens
aaagcacuauggugugugu

SEQ ID NO: 407149 - RNA, 19 nt, Homo sapiens
cacacuggcuaaugacugu

SEQ ID NO: 407150 - RNA, 19 nt, Homo sapiens
cggaauauaggguuagaug

SEQ ID NO: 407151 - RNA, 19 nt, Homo sapiens
ugccagugacuuugaauuu

SEQ ID NO: 407152 - RNA, 19 nt, Homo sapiens
aaggagaaaguaaauguug

SEQ ID NO: 407153 - RNA, 19 nt, Homo sapiens
uggcuaaacgccucaagaa

SEQ ID NO: 407154 - RNA, 19 nt, Homo sapiens
ggcggaaucagcagacauu

SEQ ID NO: 407155 - RNA, 19 nt, Homo sapiens
cagcaacccugagaacaac

SEQ ID NO: 407156 - RNA, 19 nt, Homo sapiens
ggguagcugagucugcuua

SEQ ID NO: 407157 - RNA, 19 nt, Homo sapiens
gaggaggugaacacagaaa

SEQ ID NO: 407158 - RNA, 19 nt, Homo sapiens
cagccaaggaggaggauga

SEQ ID NO: 407159 - RNA, 19 nt, Homo sapiens
acgaugcccugcugaagau

SEQ ID NO: 407160 - RNA, 19 nt, Homo sapiens
gucaacauaguuugucauu

SEQ ID NO: 407161 - RNA, 19 nt, Homo sapiens
ggaagaggaggugaacaca

SEQ ID NO: 407162 - RNA, 19 nt, Homo sapiens
gcccaguggaggacaauga

SEQ ID NO: 407163 - RNA, 19 nt, Homo sapiens
gacaaggcaagaaucacaa

SEQ ID NO: 407164 - RNA, 19 nt, Homo sapiens
accauuacagccuaaauaa

SEQ ID NO: 407165 - RNA, 19 nt, Homo sapiens
aagugagacuggagggaaa

SEQ ID NO: 407166 - RNA, 19 nt, Homo sapiens
caaggaggaggaugauuac

SEQ ID NO: 407167 - RNA, 19 nt, Homo sapiens
cacguugaauggcaaagau

SEQ ID NO: 407168 - RNA, 19 nt, Homo sapiens
ugacagccuuuguaaacac

SEQ ID NO: 407169 - RNA, 19 nt, Homo sapiens
gggaagcacggaauauagg

SEQ ID NO: 407170 - RNA, 19 nt, Homo sapiens
gaagacaagaagugagacu

SEQ ID NO: 407171 - RNA, 19 nt, Homo sapiens
ggagaaaguaaauguugac

SEQ ID NO: 407172 - RNA, 19 nt, Homo sapiens
ccucaagaaggagaaagua

SEQ ID NO: 407173 - RNA, 19 nt, Homo sapiens
agaacaacgugggccuuau

SEQ ID NO: 407174 - RNA, 19 nt, Homo sapiens
uaaauaaagcuuggcaacu

SEQ ID NO: 407175 - RNA, 19 nt, Homo sapiens
aggguuagauguguguuau

SEQ ID NO: 407176 - RNA, 19 nt, Homo sapiens
uggaggaguuguuguuagg

SEQ ID NO: 407177 - RNA, 19 nt, Homo sapiens
ccaccaaggacggcaagaa

SEQ ID NO: 407178 - RNA, 19 nt, Homo sapiens
cggaaucagcagacauuga

SEQ ID NO: 407179 - RNA, 19 nt, Homo sapiens
guggacaacagugaguaua

SEQ ID NO: 407180 - RNA, 19 nt, Homo sapiens
gcuuaugccaugcagaugu

SEQ ID NO: 407181 - RNA, 19 nt, Homo sapiens
gauuuuggcuggugaaggu

SEQ ID NO: 407182 - RNA, 19 nt, Homo sapiens
caacccaagggcaagauca

SEQ ID NO: 407183 - RNA, 19 nt, Homo sapiens
ggaugauuacgacgugaug

SEQ ID NO: 407184 - RNA, 19 nt, Homo sapiens
gacuuugaauuuggaguag

SEQ ID NO: 407185 - RNA, 19 nt, Homo sapiens
gggaagaggaggugaacac

SEQ ID NO: 407186 - RNA, 19 nt, Homo sapiens
ucaacauaguuugucauuc

SEQ ID NO: 407187 - RNA, 19 nt, Homo sapiens
caaggcaagaaucacaaga

SEQ ID NO: 407188 - RNA, 19 nt, Homo sapiens
uaggguuagauguguguua

SEQ ID NO: 407189 - RNA, 19 nt, Homo sapiens
uaugcggaauggagacuuc

SEQ ID NO: 407190 - RNA, 19 nt, Homo sapiens
gcacggaauauaggguuag

SEQ ID NO: 407191 - RNA, 19 nt, Homo sapiens
ugacugaggaagagcagau

SEQ ID NO: 407192 - RNA, 19 nt, Homo sapiens
cuuccugaccuaagcagua

SEQ ID NO: 407193 - RNA, 19 nt, Homo sapiens
gggcccaguuuggcugaug

SEQ ID NO: 407194 - RNA, 19 nt, Homo sapiens
caguggaggacaaugagaa

SEQ ID NO: 407195 - RNA, 19 nt, Homo sapiens
caacauaguuugucauuca

SEQ ID NO: 407196 - RNA, 19 nt, Homo sapiens
gcaggaugcugucaacaua

SEQ ID NO: 407197 - RNA, 19 nt, Homo sapiens
ggaggaagguggcaagaug

SEQ ID NO: 407198 - RNA, 19 nt, Homo sapiens
ccaaggaggaggaugauua

SEQ ID NO: 407199 - RNA, 19 nt, Homo sapiens
ggacaacagugaguauaug

SEQ ID NO: 407200 - RNA, 19 nt, Homo sapiens
aaauaaagcuuggcaacuu

SEQ ID NO: 407201 - RNA, 19 nt, Homo sapiens
ggaaagcacuauggugugu

SEQ ID NO: 407202 - RNA, 19 nt, Homo sapiens
gaauauaggguuagaugug

SEQ ID NO: 407203 - RNA, 19 nt, Homo sapiens
ggauauggcaccaauucua

SEQ ID NO: 407204 - RNA, 19 nt, Homo sapiens
gcaagaugguguuggaaag

SEQ ID NO: 407205 - RNA, 19 nt, Homo sapiens
cuaaacgccucaagaagga

SEQ ID NO: 407206 - RNA, 19 nt, Homo sapiens
agaaggaucuggugaaacu

SEQ ID NO: 407207 - RNA, 19 nt, Homo sapiens
ugagaaggaucuggugaaa

SEQ ID NO: 407208 - RNA, 19 nt, Homo sapiens
gagaacaacgugggccuua

SEQ ID NO: 407209 - RNA, 19 nt, Homo sapiens
aagaggaggugaacacaga

SEQ ID NO: 407210 - RNA, 19 nt, Homo sapiens
gcagcaacccugagaacaa

SEQ ID NO: 407211 - RNA, 19 nt, Homo sapiens
gcucagcuauggacacauc

SEQ ID NO: 407212 - RNA, 19 nt, Homo sapiens
gaaggagaaaguaaauguu

SEQ ID NO: 407213 - RNA, 19 nt, Homo sapiens
gcgggaugcuaaacauuga

SEQ ID NO: 407214 - RNA, 19 nt, Homo sapiens
gccagugacuuugaauuug

SEQ ID NO: 407215 - RNA, 19 nt, Homo sapiens
ucaagaaggagaaaguaaa

SEQ ID NO: 407216 - RNA, 19 nt, Homo sapiens
gaacaacgugggccuuauc

SEQ ID NO: 407217 - RNA, 19 nt, Homo sapiens
caagaaggagaaaguaaau

SEQ ID NO: 407218 - RNA, 19 nt, Homo sapiens
gcggaauggagacuucuua

SEQ ID NO: 407219 - RNA, 19 nt, Homo sapiens
guucucaucuggugacagu

SEQ ID NO: 407220 - RNA, 19 nt, Homo sapiens
caagcuacauacuguccaa

SEQ ID NO: 407221 - RNA, 19 nt, Homo sapiens
caacgugggccuuaucaca

SEQ ID NO: 407222 - RNA, 19 nt, Homo sapiens
cauuacagccuaaauaaag

SEQ ID NO: 407223 - RNA, 19 nt, Homo sapiens
ccagugacuuugaauuugg

SEQ ID NO: 407224 - RNA, 19 nt, Homo sapiens
ucucaucaguucuccgauu

SEQ ID NO: 407225 - RNA, 19 nt, Homo sapiens
gcgcaucauugccuuugug

SEQ ID NO: 407226 - RNA, 19 nt, Homo sapiens
uguccaagcuacauacugu

SEQ ID NO: 407227 - RNA, 19 nt, Homo sapiens
uuaucacacuggcuaauga

SEQ ID NO: 407228 - RNA, 19 nt, Homo sapiens
gcaugggaagcacggaaua

SEQ ID NO: 407229 - RNA, 19 nt, Homo sapiens
ggaggacaaugagaaggau

SEQ ID NO: 407230 - RNA, 19 nt, Homo sapiens
gaagcccaguggaggacaa

SEQ ID NO: 407231 - RNA, 19 nt, Homo sapiens
gacgaugcccugcugaaga

SEQ ID NO: 407232 - RNA, 19 nt, Homo sapiens
ugacuuugaauuuggagua

SEQ ID NO: 407233 - RNA, 19 nt, Homo sapiens
cgacaaggcaagaaucaca

SEQ ID NO: 407234 - RNA, 19 nt, Homo sapiens
ggaaaggguagcugagucu

SEQ ID NO: 407235 - RNA, 19 nt, Homo sapiens
agaaggagaaaguaaaugu

SEQ ID NO: 407236 - RNA, 19 nt, Homo sapiens
aggcaagaaucacaagaug

SEQ ID NO: 407237 - RNA, 19 nt, Homo sapiens
gcaccgacaaggcaagaau

SEQ ID NO: 407238 - RNA, 19 nt, Homo sapiens
ggaauauaggguuagaugu

SEQ ID NO: 407239 - RNA, 19 nt, Homo sapiens
gugaguauaugcggaaugg

SEQ ID NO: 407240 - RNA, 19 nt, Homo sapiens
gauauggcaccaauucuac

SEQ ID NO: 407241 - RNA, 19 nt, Homo sapiens
ugacaggguaggaauaugu

SEQ ID NO: 407242 - RNA, 19 nt, Homo sapiens
gacugggacugaaggugaa

SEQ ID NO: 407243 - RNA, 19 nt, Homo sapiens
aggagaaaguaaauguuga

SEQ ID NO: 407244 - RNA, 19 nt, Homo sapiens
ggcaagaugguguuggaaa

SEQ ID NO: 407245 - RNA, 19 nt, Homo sapiens
gaugcugucaacauaguuu

SEQ ID NO: 407246 - RNA, 19 nt, Homo sapiens
ccauuacagccuaaauaaa

SEQ ID NO: 407247 - RNA, 19 nt, Homo sapiens
aaccauuacagccuaaaua

SEQ ID NO: 407248 - RNA, 19 nt, Homo sapiens
aauauaggguuagaugugu

SEQ ID NO: 407249 - RNA, 19 nt, Homo sapiens
ccaaggacggcaagaagga

SEQ ID NO: 407250 - RNA, 19 nt, Homo sapiens
guggcaagaugguguugga

SEQ ID NO: 407251 - RNA, 19 nt, Homo sapiens
cucaucaguucuccgauuu

SEQ ID NO: 407252 - RNA, 19 nt, Homo sapiens
aaagcacuauggugugugu

SEQ ID NO: 407253 - RNA, 19 nt, Homo sapiens
cacacuggcuaaugacugu

SEQ ID NO: 407254 - RNA, 19 nt, Homo sapiens
cggaauauaggguuagaug

SEQ ID NO: 407255 - RNA, 19 nt, Homo sapiens
ugccagugacuuugaauuu

SEQ ID NO: 407256 - RNA, 19 nt, Homo sapiens
aaggagaaaguaaauguug

SEQ ID NO: 407257 - RNA, 19 nt, Homo sapiens
uggcuaaacgccucaagaa

SEQ ID NO: 407258 - RNA, 19 nt, Homo sapiens
ggcggaaucagcagacauu

SEQ ID NO: 407259 - RNA, 19 nt, Homo sapiens
guggauauggcaccaauuc

SEQ ID NO: 407260 - RNA, 19 nt, Homo sapiens
cagcaacccugagaacaac

SEQ ID NO: 407261 - RNA, 19 nt, Homo sapiens
ggguagcugagucugcuua

SEQ ID NO: 407262 - RNA, 19 nt, Homo sapiens
gaaggugaaagagguggaa

SEQ ID NO: 407263 - RNA, 19 nt, Homo sapiens
gaggaggugaacacagaaa

SEQ ID NO: 407264 - RNA, 19 nt, Homo sapiens
cagccaaggaggaggauga

SEQ ID NO: 407265 - RNA, 19 nt, Homo sapiens
acgaugcccugcugaagau

SEQ ID NO: 407266 - RNA, 19 nt, Homo sapiens
gggaugcuaaacauugaaa

SEQ ID NO: 407267 - RNA, 19 nt, Homo sapiens
gucaacauaguuugucauu

SEQ ID NO: 407268 - RNA, 19 nt, Homo sapiens
ggaagaggaggugaacaca

SEQ ID NO: 407269 - RNA, 19 nt, Homo sapiens
gcccaguggaggacaauga

SEQ ID NO: 407270 - RNA, 19 nt, Homo sapiens
gacaaggcaagaaucacaa

SEQ ID NO: 407271 - RNA, 19 nt, Homo sapiens
accauuacagccuaaauaa

SEQ ID NO: 407272 - RNA, 19 nt, Homo sapiens
aagugagacuggagggaaa

SEQ ID NO: 407273 - RNA, 19 nt, Homo sapiens
caaggaggaggaugauuac

SEQ ID NO: 407274 - RNA, 19 nt, Homo sapiens
cacguugaauggcaaagau

SEQ ID NO: 407275 - RNA, 19 nt, Homo sapiens
ugacagccuuuguaaacac

SEQ ID NO: 407276 - RNA, 19 nt, Homo sapiens
gggaagcacggaauauagg

SEQ ID NO: 407277 - RNA, 19 nt, Homo sapiens
gaagacaagaagugagacu

SEQ ID NO: 407278 - RNA, 19 nt, Homo sapiens
agaacaacgugggccuuau

SEQ ID NO: 407279 - RNA, 19 nt, Homo sapiens
ggagaaaguaaauguugac

SEQ ID NO: 407280 - RNA, 19 nt, Homo sapiens
ccucaagaaggagaaagua

SEQ ID NO: 407281 - RNA, 19 nt, Homo sapiens
uaaauaaagcuuggcaacu

SEQ ID NO: 407282 - RNA, 19 nt, Homo sapiens
aggguuagauguguguuau

SEQ ID NO: 407283 - RNA, 19 nt, Homo sapiens
ccaccaaggacggcaagaa

SEQ ID NO: 407284 - RNA, 19 nt, Homo sapiens
cggaaucagcagacauuga

SEQ ID NO: 407285 - RNA, 19 nt, Homo sapiens
guguggauauggcaccaau

SEQ ID NO: 407286 - RNA, 19 nt, Homo sapiens
uggaggaguuguuguuagg

SEQ ID NO: 407287 - RNA, 19 nt, Homo sapiens
guggacaacagugaguaua

SEQ ID NO: 407288 - RNA, 19 nt, Homo sapiens
gcuuaugccaugcagaugu

SEQ ID NO: 407289 - RNA, 19 nt, Homo sapiens
ggucugacaggguaggaau

SEQ ID NO: 407290 - RNA, 19 nt, Homo sapiens
gauuuuggcuggugaaggu

SEQ ID NO: 407291 - RNA, 19 nt, Homo sapiens
caacccaagggcaagauca

SEQ ID NO: 407292 - RNA, 19 nt, Homo sapiens
ggaugauuacgacgugaug

SEQ ID NO: 407293 - RNA, 19 nt, Homo sapiens
gacuuugaauuuggaguag

SEQ ID NO: 407294 - RNA, 19 nt, Homo sapiens
gggaagaggaggugaacac

SEQ ID NO: 407295 - RNA, 19 nt, Homo sapiens
cauaauagauccaguguuu

SEQ ID NO: 407296 - RNA, 19 nt, Homo sapiens
gcaaaucacuugagucuag

SEQ ID NO: 407297 - RNA, 19 nt, Homo sapiens
ggacaucaaucaaagaaug

SEQ ID NO: 407298 - RNA, 19 nt, Homo sapiens
gcagugagcugagaucuug

SEQ ID NO: 407299 - RNA, 19 nt, Homo sapiens
ugacaaagcuucaaaggau

SEQ ID NO: 407300 - RNA, 19 nt, Homo sapiens
gcauuugacuccaucuaua

SEQ ID NO: 407301 - RNA, 19 nt, Homo sapiens
ugaaagcacuugccaauuc

SEQ ID NO: 407302 - RNA, 19 nt, Homo sapiens
ccauccaucuucagaauua

SEQ ID NO: 407303 - RNA, 19 nt, Homo sapiens
caaaggaugccaaauauga

SEQ ID NO: 407304 - RNA, 19 nt, Homo sapiens
gacaugcaaucuuaucuaa

SEQ ID NO: 407305 - RNA, 19 nt, Homo sapiens
uuuaugagcucucuuguuu

SEQ ID NO: 407306 - RNA, 19 nt, Homo sapiens
gagaauaggacaucaauca

SEQ ID NO: 407307 - RNA, 19 nt, Homo sapiens
agaaggagccgaaugauuu

SEQ ID NO: 407308 - RNA, 19 nt, Homo sapiens
ucaaaucccugucaagaau

SEQ ID NO: 407309 - RNA, 19 nt, Homo sapiens
uaaagugacuggaauuauc

SEQ ID NO: 407310 - RNA, 19 nt, Homo sapiens
gaagggacauaugcauaaa

SEQ ID NO: 407311 - RNA, 19 nt, Homo sapiens
cagacaagcuuggucauaa

SEQ ID NO: 407312 - RNA, 19 nt, Homo sapiens
ggucagagccaccuguaua

SEQ ID NO: 407313 - RNA, 19 nt, Homo sapiens
gaauaggacaucaaucaaa

SEQ ID NO: 407314 - RNA, 19 nt, Homo sapiens
gauccaauguugaaggaaa

SEQ ID NO: 407315 - RNA, 19 nt, Homo sapiens
ggaaacuuacuccuaauaa

SEQ ID NO: 407316 - RNA, 19 nt, Homo sapiens
ugacaucacuggcauauac

SEQ ID NO: 407317 - RNA, 19 nt, Homo sapiens
uaacccagcuccugagaga

SEQ ID NO: 407318 - RNA, 19 nt, Homo sapiens
ucaauguggugcaauauau

SEQ ID NO: 407319 - RNA, 19 nt, Homo sapiens
ccaguguucuucucucuaa

SEQ ID NO: 407320 - RNA, 19 nt, Homo sapiens
cauggaaugucagauguua

SEQ ID NO: 407321 - RNA, 19 nt, Homo sapiens
ucagagaaagggaaacuua

SEQ ID NO: 407322 - RNA, 19 nt, Homo sapiens
gcaauuucaucucuucugu

SEQ ID NO: 407323 - RNA, 19 nt, Homo sapiens
ccuaaacugucauuucauu

SEQ ID NO: 407324 - RNA, 19 nt, Homo sapiens
gcgcacaccuauaaucuca

SEQ ID NO: 407325 - RNA, 19 nt, Homo sapiens
caagaauuaucauggaaug

SEQ ID NO: 407326 - RNA, 19 nt, Homo sapiens
gacaauugcagaaaucuuu

SEQ ID NO: 407327 - RNA, 19 nt, Homo sapiens
agacacaguuggaaucuug

SEQ ID NO: 407328 - RNA, 19 nt, Homo sapiens
gaacagaagggacauaugc

SEQ ID NO: 407329 - RNA, 19 nt, Homo sapiens
aagggaaacuuacuccuaa

SEQ ID NO: 407330 - RNA, 19 nt, Homo sapiens
ggacaugcaaucuuaucua

SEQ ID NO: 407331 - RNA, 19 nt, Homo sapiens
caagacaauugcagaaauc

SEQ ID NO: 407332 - RNA, 19 nt, Homo sapiens
uuugaacgcuugcuuauga

SEQ ID NO: 407333 - RNA, 19 nt, Homo sapiens
guauagaaauggugacauc

SEQ ID NO: 407334 - RNA, 19 nt, Homo sapiens
caggauaccaucucauuaa

SEQ ID NO: 407335 - RNA, 19 nt, Homo sapiens
ccaagacaauugcagaaau

SEQ ID NO: 407336 - RNA, 19 nt, Homo sapiens
gaaucuaucuguagcaaaa

SEQ ID NO: 407337 - RNA, 19 nt, Homo sapiens
gauguuacuuuguuaccaa

SEQ ID NO: 407338 - RNA, 19 nt, Homo sapiens
ugucagauguuacuuuguu

SEQ ID NO: 407339 - RNA, 19 nt, Homo sapiens
gaauuaucauggaauguca

SEQ ID NO: 407340 - RNA, 19 nt, Homo sapiens
ggucuacacauucugauuu

SEQ ID NO: 407341 - RNA, 19 nt, Homo sapiens
gggaugcccucucuccuau

SEQ ID NO: 407342 - RNA, 19 nt, Homo sapiens
gcagacaagcuuggucaua

SEQ ID NO: 407343 - RNA, 19 nt, Homo sapiens
gaaugucagauguuacuuu

SEQ ID NO: 407344 - RNA, 19 nt, Homo sapiens
cuucaaaggaugccaaaua

SEQ ID NO: 407345 - RNA, 19 nt, Homo sapiens
gagaaucuaucuguagcaa

SEQ ID NO: 407346 - RNA, 19 nt, Homo sapiens
gcagcagacugaugaccuu

SEQ ID NO: 407347 - RNA, 19 nt, Homo sapiens
ccaccauucugcuucauga

SEQ ID NO: 407348 - RNA, 19 nt, Homo sapiens
gggaaacuuacuccuaaua

SEQ ID NO: 407349 - RNA, 19 nt, Homo sapiens
gaaaugcaaaguggaacua

SEQ ID NO: 407350 - RNA, 19 nt, Homo sapiens
cgaaugauuucuucuagag

SEQ ID NO: 407351 - RNA, 19 nt, Homo sapiens
ggauaguccucaacagauc

SEQ ID NO: 407352 - RNA, 19 nt, Homo sapiens
ggagagaaucuaucuguag

SEQ ID NO: 407353 - RNA, 19 nt, Homo sapiens
ucacuugagucuaggaguu

SEQ ID NO: 407354 - RNA, 19 nt, Homo sapiens
gacaagcuuggucauaaua

SEQ ID NO: 407355 - RNA, 19 nt, Homo sapiens
gaugacagaauccugguuu

SEQ ID NO: 407356 - RNA, 19 nt, Homo sapiens
guacaaccaucaccaccau

SEQ ID NO: 407357 - RNA, 19 nt, Homo sapiens
uaaacagacucagaacaga

SEQ ID NO: 407358 - RNA, 19 nt, Homo sapiens
aaaccuggcugucauggau

SEQ ID NO: 407359 - RNA, 19 nt, Homo sapiens
agagauugcuccaagcuau

SEQ ID NO: 407360 - RNA, 19 nt, Homo sapiens
ggacuggaggcuuuauuug

SEQ ID NO: 407361 - RNA, 19 nt, Homo sapiens
caagcuuggucauaauaga

SEQ ID NO: 407362 - RNA, 19 nt, Homo sapiens
aaacuucuccuaaggcauu

SEQ ID NO: 407363 - RNA, 19 nt, Homo sapiens
cagaagggacauaugcaua

SEQ ID NO: 407364 - RNA, 19 nt, Homo sapiens
cuaauaaacagacucagaa

SEQ ID NO: 407365 - RNA, 19 nt, Homo sapiens
uuucaucucuucuguacuu

SEQ ID NO: 407366 - RNA, 19 nt, Homo sapiens
aacaggaacucgcuuugaa

SEQ ID NO: 407367 - RNA, 19 nt, Homo sapiens
caaccaccauucugcuuca

SEQ ID NO: 407368 - RNA, 19 nt, Homo sapiens
agaagggacauaugcauaa

SEQ ID NO: 407369 - RNA, 19 nt, Homo sapiens
gcaacaggguggaaguuuu

SEQ ID NO: 407370 - RNA, 19 nt, Homo sapiens
uaugauugguguagcugua

SEQ ID NO: 407371 - RNA, 19 nt, Homo sapiens
uauccuaucuuuguggaaa

SEQ ID NO: 407372 - RNA, 19 nt, Homo sapiens
gcuucuaucugccaggauu

SEQ ID NO: 407373 - RNA, 19 nt, Homo sapiens
agagccaccuguauagaaa

SEQ ID NO: 407374 - RNA, 19 nt, Homo sapiens
ugcaugagcauauuucuuu

SEQ ID NO: 407375 - RNA, 19 nt, Homo sapiens
ugccaaauaugaacuagug

SEQ ID NO: 407376 - RNA, 19 nt, Homo sapiens
uucaaaggaugccaaauau

SEQ ID NO: 407377 - RNA, 19 nt, Homo sapiens
caccagaaucuuuaaacua

SEQ ID NO: 407378 - RNA, 19 nt, Homo sapiens
gaugcccucucuccuaugu

SEQ ID NO: 407379 - RNA, 19 nt, Homo sapiens
caauguggugcaauauaua

SEQ ID NO: 407380 - RNA, 19 nt, Homo sapiens
ggauaccaucucauuaauu

SEQ ID NO: 407381 - RNA, 19 nt, Homo sapiens
aaagggaaacuuacuccua

SEQ ID NO: 407382 - RNA, 19 nt, Homo sapiens
gaaggagccgaaugauuuc

SEQ ID NO: 407383 - RNA, 19 nt, Homo sapiens
gaaagcacuugccaauucc

SEQ ID NO: 407384 - RNA, 19 nt, Homo sapiens
gggauccaauguugaagga

SEQ ID NO: 407385 - RNA, 19 nt, Homo sapiens
agagauuucuuccguguca

SEQ ID NO: 407386 - RNA, 19 nt, Homo sapiens
caccauccaucuucagaau

SEQ ID NO: 407387 - RNA, 19 nt, Homo sapiens
gcauaaaucaggauaccau

SEQ ID NO: 407388 - RNA, 19 nt, Homo sapiens
caaugaacuuugcccuguu

SEQ ID NO: 407389 - RNA, 19 nt, Homo sapiens
caaagucuuggauauauuc

SEQ ID NO: 407390 - RNA, 19 nt, Homo sapiens
agacaagcuuggucauaau

SEQ ID NO: 407391 - RNA, 19 nt, Homo sapiens
gucagauguuacuuuguua

SEQ ID NO: 407392 - RNA, 19 nt, Homo sapiens
aaugucagauguuacuuug

SEQ ID NO: 407393 - RNA, 19 nt, Homo sapiens
ggagccgaaugauuucuuc

SEQ ID NO: 407394 - RNA, 19 nt, Homo sapiens
ggacuaauucacccugaug

SEQ ID NO: 407395 - RNA, 19 nt, Homo sapiens
gaagagaagucaacaaaua

SEQ ID NO: 407396 - RNA, 19 nt, Homo sapiens
ggaagugaauggagacuga

SEQ ID NO: 407397 - RNA, 19 nt, Homo sapiens
agacugaucucaaaucuga

SEQ ID NO: 407398 - RNA, 19 nt, Homo sapiens
ggagaaagauaaagauaag

SEQ ID NO: 407399 - RNA, 19 nt, Homo sapiens
gaaaguacuugauguaucg

SEQ ID NO: 407400 - RNA, 19 nt, Homo sapiens
caaagacgauucuguaugg

SEQ ID NO: 407401 - RNA, 19 nt, Homo sapiens
ucacuugacaugcuuauua

SEQ ID NO: 407402 - RNA, 19 nt, Homo sapiens
ggaaagaggacaaggagaa

SEQ ID NO: 407403 - RNA, 19 nt, Homo sapiens
gaagaccaaugaccagaug

SEQ ID NO: 407404 - RNA, 19 nt, Homo sapiens
gauaauaccacaccauguu

SEQ ID NO: 407405 - RNA, 19 nt, Homo sapiens
ugacaaagacgauucugua

SEQ ID NO: 407406 - RNA, 19 nt, Homo sapiens
uaaguggaaugcaugaauu

SEQ ID NO: 407407 - RNA, 19 nt, Homo sapiens
gaaagaagggcaggagaaa

SEQ ID NO: 407408 - RNA, 19 nt, Homo sapiens
gcccuaaacuacacaagaa

SEQ ID NO: 407409 - RNA, 19 nt, Homo sapiens
uuagaaagcugacccaaca

SEQ ID NO: 407410 - RNA, 19 nt, Homo sapiens
ggacaaggagaaagauaaa

SEQ ID NO: 407411 - RNA, 19 nt, Homo sapiens
ccacacaggcccuaaacua

SEQ ID NO: 407412 - RNA, 19 nt, Homo sapiens
cuucugaacucuguugaua

SEQ ID NO: 407413 - RNA, 19 nt, Homo sapiens
agaggaagcugaggaaguu

SEQ ID NO: 407414 - RNA, 19 nt, Homo sapiens
gaacacgugaccagugaaa

SEQ ID NO: 407415 - RNA, 19 nt, Homo sapiens
gcauuauguucucugguaa

SEQ ID NO: 407416 - RNA, 19 nt, Homo sapiens
gaaagaggacaaggagaaa

SEQ ID NO: 407417 - RNA, 19 nt, Homo sapiens
agacgauucuguaugguuu

SEQ ID NO: 407418 - RNA, 19 nt, Homo sapiens
ugaagggacugaacuccaa

SEQ ID NO: 407419 - RNA, 19 nt, Homo sapiens
ugaggaaguuggaguugaa

SEQ ID NO: 407420 - RNA, 19 nt, Homo sapiens
ucagugugguggaucauuu

SEQ ID NO: 407421 - RNA, 19 nt, Homo sapiens
ggaagaaguccaugaugau

SEQ ID NO: 407422 - RNA, 19 nt, Homo sapiens
ugauccagcuccauauauu

SEQ ID NO: 407423 - RNA, 19 nt, Homo sapiens
aaucugaacugcagcuuuc

SEQ ID NO: 407424 - RNA, 19 nt, Homo sapiens
gaagaaguccaugaugaug

SEQ ID NO: 407425 - RNA, 19 nt, Homo sapiens
gaccaugauuauuuggaaa

SEQ ID NO: 407426 - RNA, 19 nt, Homo sapiens
ugcauuauguucucuggua

SEQ ID NO: 407427 - RNA, 19 nt, Homo sapiens
gcucaggcuucagauugua

SEQ ID NO: 407428 - RNA, 19 nt, Homo sapiens
gaaagcugacccaacaaga

SEQ ID NO: 407429 - RNA, 19 nt, Homo sapiens
caucaacgaacucaugaaa

SEQ ID NO: 407430 - RNA, 19 nt, Homo sapiens
ccagcuccauauauuguuu

SEQ ID NO: 407431 - RNA, 19 nt, Homo sapiens
caaccgggaugcagagaag

SEQ ID NO: 407432 - RNA, 19 nt, Homo sapiens
ucugaacucuguugauaau

SEQ ID NO: 407433 - RNA, 19 nt, Homo sapiens
cuaaaucagugugcugcua

SEQ ID NO: 407434 - RNA, 19 nt, Homo sapiens
cuacagaagcguacauuuc

SEQ ID NO: 407435 - RNA, 19 nt, Homo sapiens
gaaaagauacuguccuaau

SEQ ID NO: 407436 - RNA, 19 nt, Homo sapiens
agaaaguacuugauguauc

SEQ ID NO: 407437 - RNA, 19 nt, Homo sapiens
ugaacucuguugauaauac

SEQ ID NO: 407438 - RNA, 19 nt, Homo sapiens
gaggacaaggagaaagaua

SEQ ID NO: 407439 - RNA, 19 nt, Homo sapiens
gaagaugacaaagacgauu

SEQ ID NO: 407440 - RNA, 19 nt, Homo sapiens
aaagaauaguuggcuggua

SEQ ID NO: 407441 - RNA, 19 nt, Homo sapiens
gacaaagacgauucuguau

SEQ ID NO: 407442 - RNA, 19 nt, Homo sapiens
cagcucaggcuucagauug

SEQ ID NO: 407443 - RNA, 19 nt, Homo sapiens
acaaggagaaagauaaaga

SEQ ID NO: 407444 - RNA, 19 nt, Homo sapiens
aagaagggcaggagaaaga

SEQ ID NO: 407445 - RNA, 19 nt, Homo sapiens
acacgugaccagugaaauu

SEQ ID NO: 407446 - RNA, 19 nt, Homo sapiens
aaagauacuguccuaauuc

SEQ ID NO: 407447 - RNA, 19 nt, Homo sapiens
ugacauugccaucaacgaa

SEQ ID NO: 407448 - RNA, 19 nt, Homo sapiens
agaccaugauuauuuggaa

SEQ ID NO: 407449 - RNA, 19 nt, Homo sapiens
gauccagcuccauauauug

SEQ ID NO: 407450 - RNA, 19 nt, Homo sapiens
gaauuuuccucaucuugaa

SEQ ID NO: 407451 - RNA, 19 nt, Homo sapiens
ugaugaagaugacaaagac

SEQ ID NO: 407452 - RNA, 19 nt, Homo sapiens
uugguacucuucauucauu

SEQ ID NO: 407453 - RNA, 19 nt, Homo sapiens
ggcuucagauuguaugaga

SEQ ID NO: 407454 - RNA, 19 nt, Homo sapiens
guacauuucaguggaagaa

SEQ ID NO: 407455 - RNA, 19 nt, Homo sapiens
guugugauccagcuccaua

SEQ ID NO: 407456 - RNA, 19 nt, Homo sapiens
ugaauugcauuauguucuc

SEQ ID NO: 407457 - RNA, 19 nt, Homo sapiens
gguacucuucauucauuua

SEQ ID NO: 407458 - RNA, 19 nt, Homo sapiens
ugacaugcuuauuagaaag

SEQ ID NO: 407459 - RNA, 19 nt, Homo sapiens
cuaaacuacacaagaauga

SEQ ID NO: 407460 - RNA, 19 nt, Homo sapiens
ggugcuacguggaagugaa

SEQ ID NO: 407461 - RNA, 19 nt, Homo sapiens
uugaacacgugaccaguga

SEQ ID NO: 407462 - RNA, 19 nt, Homo sapiens
uacagaagcguacauuuca

SEQ ID NO: 407463 - RNA, 19 nt, Homo sapiens
ccagaagcguguuguuggu

SEQ ID NO: 407464 - RNA, 19 nt, Homo sapiens
gcaugaauugcauuauguu

SEQ ID NO: 407465 - RNA, 19 nt, Homo sapiens
agaaagaagggcaggagaa

SEQ ID NO: 407466 - RNA, 19 nt, Homo sapiens
ggaaaccagaagcguguug

SEQ ID NO: 407467 - RNA, 19 nt, Homo sapiens
ugcacaaccucaucaacaa

SEQ ID NO: 407468 - RNA, 19 nt, Homo sapiens
ccagguccaugguuugaag

SEQ ID NO: 407469 - RNA, 19 nt, Homo sapiens
ccguauuggucaucauuga

SEQ ID NO: 407470 - RNA, 19 nt, Homo sapiens
caaaagaaaguacuugaug

SEQ ID NO: 407471 - RNA, 19 nt, Homo sapiens
guacuuggccucgcugauc

SEQ ID NO: 407472 - RNA, 19 nt, Homo sapiens
caaggagaaagauaaagau

SEQ ID NO: 407473 - RNA, 19 nt, Homo sapiens
cuugauguaucgaacaguu

SEQ ID NO: 407474 - RNA, 19 nt, Homo sapiens
gggaugcagagaagaaaga

SEQ ID NO: 407475 - RNA, 19 nt, Homo sapiens
ucaacgaacucaugaaaag

SEQ ID NO: 407476 - RNA, 19 nt, Homo sapiens
acaaagacgauucuguaug

SEQ ID NO: 407477 - RNA, 19 nt, Homo sapiens
aagaggaacugggccugaa

SEQ ID NO: 407478 - RNA, 19 nt, Homo sapiens
ucaaccugcugccagaugu

SEQ ID NO: 407479 - RNA, 19 nt, Homo sapiens
gaacucuguugauaauacc

SEQ ID NO: 407480 - RNA, 19 nt, Homo sapiens
ugacgaaccggaagaagag

SEQ ID NO: 407481 - RNA, 19 nt, Homo sapiens
cacuugacaugcuuauuag

SEQ ID NO: 407482 - RNA, 19 nt, Homo sapiens
guuacgagauaucaaagac

SEQ ID NO: 407483 - RNA, 19 nt, Homo sapiens
ugaaauuggagcagaggaa

SEQ ID NO: 407484 - RNA, 19 nt, Homo sapiens
guaccacacaggcccuaaa

SEQ ID NO: 407485 - RNA, 19 nt, Homo sapiens
augaagagaagucaacaaa

SEQ ID NO: 407486 - RNA, 19 nt, Homo sapiens
ccucaucaacaacaagauu

SEQ ID NO: 407487 - RNA, 19 nt, Homo sapiens
gcaagcugcccaucaacca

SEQ ID NO: 407488 - RNA, 19 nt, Homo sapiens
caaugccagggaaagaaua

SEQ ID NO: 407489 - RNA, 19 nt, Homo sapiens
cuaaguggaaugcaugaau

SEQ ID NO: 407490 - RNA, 19 nt, Homo sapiens
acacaggcccuaaacuaca

SEQ ID NO: 407491 - RNA, 19 nt, Homo sapiens
gguaacacguagaguucag

SEQ ID NO: 407492 - RNA, 19 nt, Homo sapiens
ugaagagaagucaacaaau

SEQ ID NO: 407493 - RNA, 19 nt, Homo sapiens
aguuggaguugaacacuug

SEQ ID NO: 407494 - RNA, 19 nt, Homo sapiens
gaaaccagaagcguguugu

SEQ ID NO: 407495 - RNA, 19 nt, Homo sapiens
ggaccaagcugaccaaaca

SEQ ID NO: 407496 - RNA, 19 nt, Homo sapiens
ccaaacaggucaucgagua

SEQ ID NO: 407497 - RNA, 19 nt, Homo sapiens
gaauaaauguuggcaguga

SEQ ID NO: 407498 - RNA, 19 nt, Homo sapiens
ggacugacauucccucuuc

SEQ ID NO: 407499 - RNA, 19 nt, Homo sapiens
gacaaguucuuauaucuga

SEQ ID NO: 407500 - RNA, 19 nt, Homo sapiens
gcagagagacaaguucuua

SEQ ID NO: 407501 - RNA, 19 nt, Homo sapiens
gcucaaaugcuacuacuuu

SEQ ID NO: 407502 - RNA, 19 nt, Homo sapiens
ggaccaggguaccagauuu

SEQ ID NO: 407503 - RNA, 19 nt, Homo sapiens
caauaaagguggacugaca

SEQ ID NO: 407504 - RNA, 19 nt, Homo sapiens
gagacaaguucuuauaucu

SEQ ID NO: 407505 - RNA, 19 nt, Homo sapiens
gagcuacaccuucuucauu

SEQ ID NO: 407506 - RNA, 19 nt, Homo sapiens
gcagggcacgaguuauuua

SEQ ID NO: 407507 - RNA, 19 nt, Homo sapiens
ggugaaguguccuacuaaa

SEQ ID NO: 407508 - RNA, 19 nt, Homo sapiens
cguaaaagccccaaucuua

SEQ ID NO: 407509 - RNA, 19 nt, Homo sapiens
cagugucccuggagcaaua

SEQ ID NO: 407510 - RNA, 19 nt, Homo sapiens
gcuacuacuuugauuacaa

SEQ ID NO: 407511 - RNA, 19 nt, Homo sapiens
cugaagaacuuggagguuu

SEQ ID NO: 407512 - RNA, 19 nt, Homo sapiens
gagagacaaguucuuauau

SEQ ID NO: 407513 - RNA, 19 nt, Homo sapiens
gggcagggcacgaguuauu

SEQ ID NO: 407514 - RNA, 19 nt, Homo sapiens
agagagacaaguucuuaua

SEQ ID NO: 407515 - RNA, 19 nt, Homo sapiens
gagggcagcuacaacaaag

SEQ ID NO: 407516 - RNA, 19 nt, Homo sapiens
ccaaggacauacagaccaa

SEQ ID NO: 407517 - RNA, 19 nt, Homo sapiens
ggagggcagcuacaacaaa

SEQ ID NO: 407518 - RNA, 19 nt, Homo sapiens
ccaaacagcagcuaauucu

SEQ ID NO: 407519 - RNA, 19 nt, Homo sapiens
gaagagcugggucgacuca

SEQ ID NO: 407520 - RNA, 19 nt, Homo sapiens
agagacaaguucuuauauc

SEQ ID NO: 407521 - RNA, 19 nt, Homo sapiens
gcuacaccuucuucauuga

SEQ ID NO: 407522 - RNA, 19 nt, Homo sapiens
cuacauggcccagcucaaa

SEQ ID NO: 407523 - RNA, 19 nt, Homo sapiens
aaacauggacgcccacugu

SEQ ID NO: 407524 - RNA, 19 nt, Homo sapiens
gaccaaacagcagcuaauu

SEQ ID NO: 407525 - RNA, 19 nt, Homo sapiens
uggcccagcucaaaugcua

SEQ ID NO: 407526 - RNA, 19 nt, Homo sapiens
aaauguuggcagugaauua

SEQ ID NO: 407527 - RNA, 19 nt, Homo sapiens
gcaggguuucgcccaauaa

SEQ ID NO: 407528 - RNA, 19 nt, Homo sapiens
gggcacgaguuauuuaaaa

SEQ ID NO: 407529 - RNA, 19 nt, Homo sapiens
gcucagggucucaaacaug

SEQ ID NO: 407530 - RNA, 19 nt, Homo sapiens
gccgagagcuacaccuucu

SEQ ID NO: 407531 - RNA, 19 nt, Homo sapiens
ugacagacuacgccaagaa

SEQ ID NO: 407532 - RNA, 19 nt, Homo sapiens
cuacuacuuugauuacaag

SEQ ID NO: 407533 - RNA, 19 nt, Homo sapiens
gagaaggccuacgagaaaa

SEQ ID NO: 407534 - RNA, 19 nt, Homo sapiens
aauaaauguuggcagugaa

SEQ ID NO: 407535 - RNA, 19 nt, Homo sapiens
gggugaaguguccuacuaa

SEQ ID NO: 407536 - RNA, 19 nt, Homo sapiens
ggggugaaguguccuacua

SEQ ID NO: 407537 - RNA, 19 nt, Homo sapiens
ugaagaacuuggagguuuu

SEQ ID NO: 407538 - RNA, 19 nt, Homo sapiens
caaacaggucaucgaguau

SEQ ID NO: 407539 - RNA, 19 nt, Homo sapiens
cggauccucuucuucaaca

SEQ ID NO: 407540 - RNA, 19 nt, Homo sapiens
ccacccggauccucuucuu

SEQ ID NO: 407541 - RNA, 19 nt, Homo sapiens
gggcagcuacaacaaagug

SEQ ID NO: 407542 - RNA, 19 nt, Homo sapiens
gacucaagcuaguucuucu

SEQ ID NO: 407543 - RNA, 19 nt, Homo sapiens
caacugggucagccucugu

SEQ ID NO: 407544 - RNA, 19 nt, Homo sapiens
ugcaggguuucgcccaaua

SEQ ID NO: 407545 - RNA, 19 nt, Homo sapiens
cagggcacgaguuauuuaa

SEQ ID NO: 407546 - RNA, 19 nt, Homo sapiens
ggcagggcacgaguuauuu

SEQ ID NO: 407547 - RNA, 19 nt, Homo sapiens
agcuacaccuucuucauug

SEQ ID NO: 407548 - RNA, 19 nt, Homo sapiens
agaaccggguggcugaguu

SEQ ID NO: 407549 - RNA, 19 nt, Homo sapiens
aauguuggcagugaauuaa

SEQ ID NO: 407550 - RNA, 19 nt, Homo sapiens
gcauucaggaguuggagau

SEQ ID NO: 407551 - RNA, 19 nt, Homo sapiens
aaacaggucaucgaguaug

SEQ ID NO: 407552 - RNA, 19 nt, Homo sapiens
ugaccaaacagcagcuaau

SEQ ID NO: 407553 - RNA, 19 nt, Homo sapiens
cgagagcuacaccuucuuc

SEQ ID NO: 407554 - RNA, 19 nt, Homo sapiens
guaaaagccccaaucuuag

SEQ ID NO: 407555 - RNA, 19 nt, Homo sapiens
ggguuucgcccaauaaagg

SEQ ID NO: 407556 - RNA, 19 nt, Homo sapiens
cgacucaagcuaguucuuc

SEQ ID NO: 407557 - RNA, 19 nt, Homo sapiens
aauucuggcccgugacaua

SEQ ID NO: 407558 - RNA, 19 nt, Homo sapiens
cagcucaaaugcuacuacu

SEQ ID NO: 407559 - RNA, 19 nt, Homo sapiens
ggucgacucaagcuaguuc

SEQ ID NO: 407560 - RNA, 19 nt, Homo sapiens
gcauguacgagcaacucaa

SEQ ID NO: 407561 - RNA, 19 nt, Homo sapiens
gcccuugucuccccaguug

SEQ ID NO: 407562 - RNA, 19 nt, Homo sapiens
cagagagacaaguucuuau

SEQ ID NO: 407563 - RNA, 19 nt, Homo sapiens
gacacuaucagggaugaga

SEQ ID NO: 407564 - RNA, 19 nt, Homo sapiens
cccggcagcuggagaugau

SEQ ID NO: 407565 - RNA, 19 nt, Homo sapiens
gcaaguggaugaugagauu

SEQ ID NO: 407566 - RNA, 19 nt, Homo sapiens
aaacacagcuugcccaguu

SEQ ID NO: 407567 - RNA, 19 nt, Homo sapiens
ggacuugggucuagggauu

SEQ ID NO: 407568 - RNA, 19 nt, Homo sapiens
guacuggugugauuauuau

SEQ ID NO: 407569 - RNA, 19 nt, Homo sapiens
cauaguagcucccuuugga

SEQ ID NO: 407570 - RNA, 19 nt, Homo sapiens
gaucagcgcuauuuuguaa

SEQ ID NO: 407571 - RNA, 19 nt, Homo sapiens
gaucagaccucuugaaaau

SEQ ID NO: 407572 - RNA, 19 nt, Homo sapiens
auacggaaaugguuaagua

SEQ ID NO: 407573 - RNA, 19 nt, Homo sapiens
cugcugggcugcaacauua

SEQ ID NO: 407574 - RNA, 19 nt, Homo sapiens
cgaauucccucaaacucua

SEQ ID NO: 407575 - RNA, 19 nt, Homo sapiens
ccugucagcuuccucuuua

SEQ ID NO: 407576 - RNA, 19 nt, Homo sapiens
gcacaccgcuuucuguuuu

SEQ ID NO: 407577 - RNA, 19 nt, Homo sapiens
gcaccaccaugcauagcua

SEQ ID NO: 407578 - RNA, 19 nt, Homo sapiens
gcagcaagcuccuuucacu

SEQ ID NO: 407579 - RNA, 19 nt, Homo sapiens
gauaccagcuugccuugau

SEQ ID NO: 407580 - RNA, 19 nt, Homo sapiens
caccaugcauagcuaauuu

SEQ ID NO: 407581 - RNA, 19 nt, Homo sapiens
guaaaccgcugagguaugg

SEQ ID NO: 407582 - RNA, 19 nt, Homo sapiens
ggaaaugguuaaguacugu

SEQ ID NO: 407583 - RNA, 19 nt, Homo sapiens
ccagcugaauuucuuauga

SEQ ID NO: 407584 - RNA, 19 nt, Homo sapiens
gcugagguauggauaggaa

SEQ ID NO: 407585 - RNA, 19 nt, Homo sapiens
caagugggcggaaguuauu

SEQ ID NO: 407586 - RNA, 19 nt, Homo sapiens
gcaagugggcggaaguuau

SEQ ID NO: 407587 - RNA, 19 nt, Homo sapiens
gaaguuauucuggcaggua

SEQ ID NO: 407588 - RNA, 19 nt, Homo sapiens
guucuaauuccacguauuu

SEQ ID NO: 407589 - RNA, 19 nt, Homo sapiens
gguacuggugugauuauua

SEQ ID NO: 407590 - RNA, 19 nt, Homo sapiens
uaccaauguuugcuguuua

SEQ ID NO: 407591 - RNA, 19 nt, Homo sapiens
gaguagaucagaccucuug

SEQ ID NO: 407592 - RNA, 19 nt, Homo sapiens
caacauuauuccucugcaa

SEQ ID NO: 407593 - RNA, 19 nt, Homo sapiens
ggagugcagugucgugauc

SEQ ID NO: 407594 - RNA, 19 nt, Homo sapiens
gacaugcuguguuuaccaa

SEQ ID NO: 407595 - RNA, 19 nt, Homo sapiens
ugaccaacauauuucuuug

SEQ ID NO: 407596 - RNA, 19 nt, Homo sapiens
uggccucuuucacaaauua

SEQ ID NO: 407597 - RNA, 19 nt, Homo sapiens
cugccaauacuuugaauua

SEQ ID NO: 407598 - RNA, 19 nt, Homo sapiens
gauaggaacgaguagauca

SEQ ID NO: 407599 - RNA, 19 nt, Homo sapiens
gcagaucaaggccaacuau

SEQ ID NO: 407600 - RNA, 19 nt, Homo sapiens
gcagguacuggugugauua

SEQ ID NO: 407601 - RNA, 19 nt, Homo sapiens
uuaccaauguuugcuguuu

SEQ ID NO: 407602 - RNA, 19 nt, Homo sapiens
gcuagcaauugcaaaguca

SEQ ID NO: 407603 - RNA, 19 nt, Homo sapiens
gcauaaggaucuggaagag

SEQ ID NO: 407604 - RNA, 19 nt, Homo sapiens
uuccaaagccuuccuauug

SEQ ID NO: 407605 - RNA, 19 nt, Homo sapiens
ccacugcuaguuugacuuu

SEQ ID NO: 407606 - RNA, 19 nt, Homo sapiens
ucacuucgcuaguaagaac

SEQ ID NO: 407607 - RNA, 19 nt, Homo sapiens
gugcugauaugacccuguu

SEQ ID NO: 407608 - RNA, 19 nt, Homo sapiens
ggcagguacuggugugauu

SEQ ID NO: 407609 - RNA, 19 nt, Homo sapiens
ccaacacgcugggcaggaa

SEQ ID NO: 407610 - RNA, 19 nt, Homo sapiens
gcaaacugggucagaguga

SEQ ID NO: 407611 - RNA, 19 nt, Homo sapiens
gaccugacagccauacgua

SEQ ID NO: 407612 - RNA, 19 nt, Homo sapiens
uagaucagaccucuugaaa

SEQ ID NO: 407613 - RNA, 19 nt, Homo sapiens
gauagaagcgcagaucaag

SEQ ID NO: 407614 - RNA, 19 nt, Homo sapiens
ggauuccugccaauacuuu

SEQ ID NO: 407615 - RNA, 19 nt, Homo sapiens
aauaggaauucccuggauu

SEQ ID NO: 407616 - RNA, 19 nt, Homo sapiens
aaacaccagcuuagacuug

SEQ ID NO: 407617 - RNA, 19 nt, Homo sapiens
guauggauaggaacgagua

SEQ ID NO: 407618 - RNA, 19 nt, Homo sapiens
cuaaagugcugggaucaca

SEQ ID NO: 407619 - RNA, 19 nt, Homo sapiens
cggaaaugguuaaguacug

SEQ ID NO: 407620 - RNA, 19 nt, Homo sapiens
augaugagauuguggaguu

SEQ ID NO: 407621 - RNA, 19 nt, Homo sapiens
ggagauagaagcgcagauc

SEQ ID NO: 407622 - RNA, 19 nt, Homo sapiens
gcagugucgugaucaaggu

SEQ ID NO: 407623 - RNA, 19 nt, Homo sapiens
guaagaaccccuccguuuu

SEQ ID NO: 407624 - RNA, 19 nt, Homo sapiens
ggccauaguagcucccuuu

SEQ ID NO: 407625 - RNA, 19 nt, Homo sapiens
aaauaggaauucccuggau

SEQ ID NO: 407626 - RNA, 19 nt, Homo sapiens
accaauguuugcuguuuaa

SEQ ID NO: 407627 - RNA, 19 nt, Homo sapiens
aauugaaccuccuggcuau

SEQ ID NO: 407628 - RNA, 19 nt, Homo sapiens
gagggcagcaagcuccuuu

SEQ ID NO: 407629 - RNA, 19 nt, Homo sapiens
guggauacggaaaugguua

SEQ ID NO: 407630 - RNA, 19 nt, Homo sapiens
gaucaaggccaacuaugac

SEQ ID NO: 407631 - RNA, 19 nt, Homo sapiens
ggcaagcccuguguuccuu

SEQ ID NO: 407632 - RNA, 19 nt, Homo sapiens
guagaucagaccucuugaa

SEQ ID NO: 407633 - RNA, 19 nt, Homo sapiens
acaaggcagugaugaagca

SEQ ID NO: 407634 - RNA, 19 nt, Homo sapiens
acauauuucuuugcacuga

SEQ ID NO: 407635 - RNA, 19 nt, Homo sapiens
caaaacaggcuagcaauug

SEQ ID NO: 407636 - RNA, 19 nt, Homo sapiens
cauuauuccucugcaaaga

SEQ ID NO: 407637 - RNA, 19 nt, Homo sapiens
ccagcccacugcuaguuug

SEQ ID NO: 407638 - RNA, 19 nt, Homo sapiens
gagauagaagcgcagauca

SEQ ID NO: 407639 - RNA, 19 nt, Homo sapiens
gucuagggauuuccaacuu

SEQ ID NO: 407640 - RNA, 19 nt, Homo sapiens
gcgcaaggaggagauagaa

SEQ ID NO: 407641 - RNA, 19 nt, Homo sapiens
acacagcuugcccaguuua

SEQ ID NO: 407642 - RNA, 19 nt, Homo sapiens
ccacagguucucacacuca

SEQ ID NO: 407643 - RNA, 19 nt, Homo sapiens
gcuuauucuuccucccuuu

SEQ ID NO: 407644 - RNA, 19 nt, Homo sapiens
agaucaaggccaacuauga

SEQ ID NO: 407645 - RNA, 19 nt, Homo sapiens
uggcugaggcccacaaaga

SEQ ID NO: 407646 - RNA, 19 nt, Homo sapiens
ggcuuugaccaacauauuu

SEQ ID NO: 407647 - RNA, 19 nt, Homo sapiens
ucuagggauuuccaacuug

SEQ ID NO: 407648 - RNA, 19 nt, Homo sapiens
cagcaucgcgggucugcaa

SEQ ID NO: 407649 - RNA, 19 nt, Homo sapiens
caugcuguguuuaccaaug

SEQ ID NO: 407650 - RNA, 19 nt, Homo sapiens
gcaaaacaggcuagcaauu

SEQ ID NO: 407651 - RNA, 19 nt, Homo sapiens
cuagggauuuccaacuugu

SEQ ID NO: 407652 - RNA, 19 nt, Homo sapiens
cagguucucacacucaauu

SEQ ID NO: 407653 - RNA, 19 nt, Homo sapiens
gccuuggccuccuaaagug

SEQ ID NO: 407654 - RNA, 19 nt, Homo sapiens
caucauaugccugcagaau

SEQ ID NO: 407655 - RNA, 19 nt, Homo sapiens
gcgaauucccucaaacucu

SEQ ID NO: 407656 - RNA, 19 nt, Homo sapiens
caugguaucaguguucauu

SEQ ID NO: 407657 - RNA, 19 nt, Homo sapiens
cagcugaauuucuuaugac

SEQ ID NO: 407658 - RNA, 19 nt, Homo sapiens
caacuaugacgugcuggaa

SEQ ID NO: 407659 - RNA, 19 nt, Homo sapiens
cuuguaaccugaacuucug

SEQ ID NO: 407660 - RNA, 19 nt, Homo sapiens
cagcuuagacuuguuccaa

SEQ ID NO: 407661 - RNA, 19 nt, Homo sapiens
cuguuuaaauugcauguuc

SEQ ID NO: 407662 - RNA, 19 nt, Homo sapiens
ccugacagccauacguauu

SEQ ID NO: 407663 - RNA, 19 nt, Homo sapiens
uuuguaaaccgcugaggua

SEQ ID NO: 407664 - RNA, 19 nt, Homo sapiens
gaacuccugggcucaagca

SEQ ID NO: 407665 - RNA, 19 nt, Homo sapiens
ugagaucgcugucauguua

SEQ ID NO: 407666 - RNA, 19 nt, Homo sapiens
cagcuuggauuuauucuua

SEQ ID NO: 407667 - RNA, 19 nt, Homo sapiens
gagcaaguauuuacauuga

SEQ ID NO: 407668 - RNA, 19 nt, Homo sapiens
uaacacuccucuacacuua

SEQ ID NO: 407669 - RNA, 19 nt, Homo sapiens
aaacagaacagcuccaaua

SEQ ID NO: 407670 - RNA, 19 nt, Homo sapiens
ucgaauaacuguugagauu

SEQ ID NO: 407671 - RNA, 19 nt, Homo sapiens
gaauaacuguugagauugu

SEQ ID NO: 407672 - RNA, 19 nt, Homo sapiens
gcaaguauuuacauugaga

SEQ ID NO: 407673 - RNA, 19 nt, Homo sapiens
gcgggaagcuggaagaguu

SEQ ID NO: 407674 - RNA, 19 nt, Homo sapiens
cagaacagcuccaauagca

SEQ ID NO: 407675 - RNA, 19 nt, Homo sapiens
ggacauacagaaauuguug

SEQ ID NO: 407676 - RNA, 19 nt, Homo sapiens
agagaaugguggaagguua

SEQ ID NO: 407677 - RNA, 19 nt, Homo sapiens
aaggguaacuugaagauga

SEQ ID NO: 407678 - RNA, 19 nt, Homo sapiens
guucuacuguugucguaua

SEQ ID NO: 407679 - RNA, 19 nt, Homo sapiens
gcacaagacaucaucuaug

SEQ ID NO: 407680 - RNA, 19 nt, Homo sapiens
auaaacauguugacucuug

SEQ ID NO: 407681 - RNA, 19 nt, Homo sapiens
ccaguguccuacaaacuaa

SEQ ID NO: 407682 - RNA, 19 nt, Homo sapiens
gcagguuggucuccucuuc

SEQ ID NO: 407683 - RNA, 19 nt, Homo sapiens
gggcuaauccagaugcuaa

SEQ ID NO: 407684 - RNA, 19 nt, Homo sapiens
ggagugccagugaaugaua

SEQ ID NO: 407685 - RNA, 19 nt, Homo sapiens
gauggguuguuuacucuga

SEQ ID NO: 407686 - RNA, 19 nt, Homo sapiens
gagaaugguggaagguuaa

SEQ ID NO: 407687 - RNA, 19 nt, Homo sapiens
ucaagugaaugcugucaau

SEQ ID NO: 407688 - RNA, 19 nt, Homo sapiens
caacuuggagugccaguga

SEQ ID NO: 407689 - RNA, 19 nt, Homo sapiens
auaaaucccuggcuacuag

SEQ ID NO: 407690 - RNA, 19 nt, Homo sapiens
agaguauucuggccgauaa

SEQ ID NO: 407691 - RNA, 19 nt, Homo sapiens
ucuguaauguuccuccaua

SEQ ID NO: 407692 - RNA, 19 nt, Homo sapiens
ugagauuguucuacuguug

SEQ ID NO: 407693 - RNA, 19 nt, Homo sapiens
uaaaagcccuucugggaaa

SEQ ID NO: 407694 - RNA, 19 nt, Homo sapiens
gagugccagugaaugauaa

SEQ ID NO: 407695 - RNA, 19 nt, Homo sapiens
gaaugucaagcuuguuaaa

SEQ ID NO: 407696 - RNA, 19 nt, Homo sapiens
cuauguggauucuguaaug

SEQ ID NO: 407697 - RNA, 19 nt, Homo sapiens
ggagcaaguauuuacauug

SEQ ID NO: 407698 - RNA, 19 nt, Homo sapiens
gauaaaucccuggcuacua

SEQ ID NO: 407699 - RNA, 19 nt, Homo sapiens
aagaaugucaagcuuguua

SEQ ID NO: 407700 - RNA, 19 nt, Homo sapiens
gggaaaaggugcucaagug

SEQ ID NO: 407701 - RNA, 19 nt, Homo sapiens
cuacuguugucguauauuc

SEQ ID NO: 407702 - RNA, 19 nt, Homo sapiens
gguuaaacagcuuggauuu

SEQ ID NO: 407703 - RNA, 19 nt, Homo sapiens
cagaugcuaaggaccauua

SEQ ID NO: 407704 - RNA, 19 nt, Homo sapiens
guuacuuguucgaagcuua

SEQ ID NO: 407705 - RNA, 19 nt, Homo sapiens
ugauucauauccuucugua

SEQ ID NO: 407706 - RNA, 19 nt, Homo sapiens
aaauggcuguacucccuua

SEQ ID NO: 407707 - RNA, 19 nt, Homo sapiens
aaagguggccuggguuuaa

SEQ ID NO: 407708 - RNA, 19 nt, Homo sapiens
ggagagaguggaagaagca

SEQ ID NO: 407709 - RNA, 19 nt, Homo sapiens
gggugugugucuaaccuaa

SEQ ID NO: 407710 - RNA, 19 nt, Homo sapiens
ggccuggguuuaauacuca

SEQ ID NO: 407711 - RNA, 19 nt, Homo sapiens
caaagguggccuggguuua

SEQ ID NO: 407712 - RNA, 19 nt, Homo sapiens
caaagcauccacaaacauc

SEQ ID NO: 407713 - RNA, 19 nt, Homo sapiens
uacaaagcauccacaaaca

SEQ ID NO: 407714 - RNA, 19 nt, Homo sapiens
cuacaaagcauccacaaac

SEQ ID NO: 407715 - RNA, 19 nt, Homo sapiens
gggcagcagccaaggguaa

SEQ ID NO: 407716 - RNA, 19 nt, Homo sapiens
ccaaggagcaaguauuuac

SEQ ID NO: 407717 - RNA, 19 nt, Homo sapiens
gagaguauucuggccgaua

SEQ ID NO: 407718 - RNA, 19 nt, Homo sapiens
ucuuguuccugcugaguua

SEQ ID NO: 407719 - RNA, 19 nt, Homo sapiens
cuaauucuguggcuguugu

SEQ ID NO: 407720 - RNA, 19 nt, Homo sapiens
aaacagcuuggauuuauuc

SEQ ID NO: 407721 - RNA, 19 nt, Homo sapiens
ccaaagguggccuggguuu

SEQ ID NO: 407722 - RNA, 19 nt, Homo sapiens
guaacacuccucuacacuu

SEQ ID NO: 407723 - RNA, 19 nt, Homo sapiens
caccuucaaagucuuauaa

SEQ ID NO: 407724 - RNA, 19 nt, Homo sapiens
acacuuagccugugaugag

SEQ ID NO: 407725 - RNA, 19 nt, Homo sapiens
ggucuccucuucauauugc

SEQ ID NO: 407726 - RNA, 19 nt, Homo sapiens
gguuguuuacucugaaaua

SEQ ID NO: 407727 - RNA, 19 nt, Homo sapiens
gguuuaauacucaagagaa

SEQ ID NO: 407728 - RNA, 19 nt, Homo sapiens
acaauagcccauauaccua

SEQ ID NO: 407729 - RNA, 19 nt, Homo sapiens
ugccagauguuucuaugug

SEQ ID NO: 407730 - RNA, 19 nt, Homo sapiens
ugaaugcugucaaucaaaa

SEQ ID NO: 407731 - RNA, 19 nt, Homo sapiens
gaaaaggugcucaagugaa

SEQ ID NO: 407732 - RNA, 19 nt, Homo sapiens
guuccuccauacaguuaaa

SEQ ID NO: 407733 - RNA, 19 nt, Homo sapiens
uaauguuccuccauacagu

SEQ ID NO: 407734 - RNA, 19 nt, Homo sapiens
uaaacauguugacucuugu

SEQ ID NO: 407735 - RNA, 19 nt, Homo sapiens
gugugugucuaaccuaaug

SEQ ID NO: 407736 - RNA, 19 nt, Homo sapiens
gauggugugcucuaaaaua

SEQ ID NO: 407737 - RNA, 19 nt, Homo sapiens
gaaacagaacagcuccaau

SEQ ID NO: 407738 - RNA, 19 nt, Homo sapiens
ucccaaggagcaaguauuu

SEQ ID NO: 407739 - RNA, 19 nt, Homo sapiens
uuaugaggcuacagcaaug

SEQ ID NO: 407740 - RNA, 19 nt, Homo sapiens
gaagcucuaacggcuguuu

SEQ ID NO: 407741 - RNA, 19 nt, Homo sapiens
agugaaugcugucaaucaa

SEQ ID NO: 407742 - RNA, 19 nt, Homo sapiens
guuggucuccucuucauau

SEQ ID NO: 407743 - RNA, 19 nt, Homo sapiens
gauaaagacgaugcagguu

SEQ ID NO: 407744 - RNA, 19 nt, Homo sapiens
guuggauggugugcucuaa

SEQ ID NO: 407745 - RNA, 19 nt, Homo sapiens
aaaaggugcucaagugaau

SEQ ID NO: 407746 - RNA, 19 nt, Homo sapiens
aaaagaaugucaagcuugu

SEQ ID NO: 407747 - RNA, 19 nt, Homo sapiens
ccucccauguaccuuauau

SEQ ID NO: 407748 - RNA, 19 nt, Homo sapiens
cccaguguccuacaaacua

SEQ ID NO: 407749 - RNA, 19 nt, Homo sapiens
aggagcaaguauuuacauu

SEQ ID NO: 407750 - RNA, 19 nt, Homo sapiens
ggaaaaggugcucaaguga

SEQ ID NO: 407751 - RNA, 19 nt, Homo sapiens
ugaaaagaaugucaagcuu

SEQ ID NO: 407752 - RNA, 19 nt, Homo sapiens
gagauuguucuacuguugu

SEQ ID NO: 407753 - RNA, 19 nt, Homo sapiens
cgaauaacuguugagauug

SEQ ID NO: 407754 - RNA, 19 nt, Homo sapiens
gaagaguugaaggagagua

SEQ ID NO: 407755 - RNA, 19 nt, Homo sapiens
gaccaggacagcagaacug

SEQ ID NO: 407756 - RNA, 19 nt, Homo sapiens
gccagugaaugauaaagac

SEQ ID NO: 407757 - RNA, 19 nt, Homo sapiens
guugcucgcgcgacaagua

SEQ ID NO: 407758 - RNA, 19 nt, Homo sapiens
uguggauucuguaauguuc

SEQ ID NO: 407759 - RNA, 19 nt, Homo sapiens
uuauaucccucucugaaac

SEQ ID NO: 407760 - RNA, 19 nt, Homo sapiens
gugcacaagacaucaucua

SEQ ID NO: 407761 - RNA, 19 nt, Homo sapiens
guggaagguuaaacagcuu

SEQ ID NO: 407762 - RNA, 19 nt, Homo sapiens
uccaagacacugaggguaa

SEQ ID NO: 407763 - RNA, 19 nt, Homo sapiens
uucauauccuucuguacua

SEQ ID NO: 407764 - RNA, 19 nt, Homo sapiens
cagcuggacauacagaaau

SEQ ID NO: 407765 - RNA, 19 nt, Homo sapiens
ugagaucgcugucauguua

SEQ ID NO: 407766 - RNA, 19 nt, Homo sapiens
cagcuuggauuuauucuua

SEQ ID NO: 407767 - RNA, 19 nt, Homo sapiens
gagcaaguauuuacauuga

SEQ ID NO: 407768 - RNA, 19 nt, Homo sapiens
aaacagaacagcuccaaua

SEQ ID NO: 407769 - RNA, 19 nt, Homo sapiens
ucgaauaacuguugagauu

SEQ ID NO: 407770 - RNA, 19 nt, Homo sapiens
gaauaacuguugagauugu

SEQ ID NO: 407771 - RNA, 19 nt, Homo sapiens
gcaaguauuuacauugaga

SEQ ID NO: 407772 - RNA, 19 nt, Homo sapiens
gcgggaagcuggaagaguu

SEQ ID NO: 407773 - RNA, 19 nt, Homo sapiens
cagaacagcuccaauagca

SEQ ID NO: 407774 - RNA, 19 nt, Homo sapiens
ggacauacagaaauuguug

SEQ ID NO: 407775 - RNA, 19 nt, Homo sapiens
agagaaugguggaagguua

SEQ ID NO: 407776 - RNA, 19 nt, Homo sapiens
guucuacuguugucguaua

SEQ ID NO: 407777 - RNA, 19 nt, Homo sapiens
gcacaagacaucaucuaug

SEQ ID NO: 407778 - RNA, 19 nt, Homo sapiens
auaaacauguugacucuug

SEQ ID NO: 407779 - RNA, 19 nt, Homo sapiens
ccaguguccuacaaacuaa

SEQ ID NO: 407780 - RNA, 19 nt, Homo sapiens
gcagguuggucuccucuuc

SEQ ID NO: 407781 - RNA, 19 nt, Homo sapiens
gggcuaauccagaugcuaa

SEQ ID NO: 407782 - RNA, 19 nt, Homo sapiens
ggagugccagugaaugaua

SEQ ID NO: 407783 - RNA, 19 nt, Homo sapiens
gauggguuguuuacucuga

SEQ ID NO: 407784 - RNA, 19 nt, Homo sapiens
gagaaugguggaagguuaa

SEQ ID NO: 407785 - RNA, 19 nt, Homo sapiens
ucaagugaaugcugucaau

SEQ ID NO: 407786 - RNA, 19 nt, Homo sapiens
caacuuggagugccaguga

SEQ ID NO: 407787 - RNA, 19 nt, Homo sapiens
auaaaucccuggcuacuag

SEQ ID NO: 407788 - RNA, 19 nt, Homo sapiens
agaguauucuggccgauaa

SEQ ID NO: 407789 - RNA, 19 nt, Homo sapiens
ucuguaauguuccuccaua

SEQ ID NO: 407790 - RNA, 19 nt, Homo sapiens
ugagauuguucuacuguug

SEQ ID NO: 407791 - RNA, 19 nt, Homo sapiens
uaaaagcccuucugggaaa

SEQ ID NO: 407792 - RNA, 19 nt, Homo sapiens
gagugccagugaaugauaa

SEQ ID NO: 407793 - RNA, 19 nt, Homo sapiens
gaaugucaagcuuguuaaa

SEQ ID NO: 407794 - RNA, 19 nt, Homo sapiens
cuauguggauucuguaaug

SEQ ID NO: 407795 - RNA, 19 nt, Homo sapiens
ggagcaaguauuuacauug

SEQ ID NO: 407796 - RNA, 19 nt, Homo sapiens
gauaaaucccuggcuacua

SEQ ID NO: 407797 - RNA, 19 nt, Homo sapiens
aagaaugucaagcuuguua

SEQ ID NO: 407798 - RNA, 19 nt, Homo sapiens
cagcagccaaggacacuua

SEQ ID NO: 407799 - RNA, 19 nt, Homo sapiens
gggaaaaggugcucaagug

SEQ ID NO: 407800 - RNA, 19 nt, Homo sapiens
cuacuguugucguauauuc

SEQ ID NO: 407801 - RNA, 19 nt, Homo sapiens
gguuaaacagcuuggauuu

SEQ ID NO: 407802 - RNA, 19 nt, Homo sapiens
cagaugcuaaggaccauua

SEQ ID NO: 407803 - RNA, 19 nt, Homo sapiens
guuacuuguucgaagcuua

SEQ ID NO: 407804 - RNA, 19 nt, Homo sapiens
aaauggcuguacucccuua

SEQ ID NO: 407805 - RNA, 19 nt, Homo sapiens
aaagguggccuggguuuaa

SEQ ID NO: 407806 - RNA, 19 nt, Homo sapiens
ggagagaguggaagaagca

SEQ ID NO: 407807 - RNA, 19 nt, Homo sapiens
gggugugugucuaaccuaa

SEQ ID NO: 407808 - RNA, 19 nt, Homo sapiens
ggccuggguuuaauacuca

SEQ ID NO: 407809 - RNA, 19 nt, Homo sapiens
caaagguggccuggguuua

SEQ ID NO: 407810 - RNA, 19 nt, Homo sapiens
ccaaggagcaaguauuuac

SEQ ID NO: 407811 - RNA, 19 nt, Homo sapiens
gagaguauucuggccgaua

SEQ ID NO: 407812 - RNA, 19 nt, Homo sapiens
ucuuguuccugcugaguua

SEQ ID NO: 407813 - RNA, 19 nt, Homo sapiens
cuaauucuguggcuguugu

SEQ ID NO: 407814 - RNA, 19 nt, Homo sapiens
aaacagcuuggauuuauuc

SEQ ID NO: 407815 - RNA, 19 nt, Homo sapiens
ccaaagguggccuggguuu

SEQ ID NO: 407816 - RNA, 19 nt, Homo sapiens
caccuucaaagucuuauaa

SEQ ID NO: 407817 - RNA, 19 nt, Homo sapiens
acacuuagccugugaugag

SEQ ID NO: 407818 - RNA, 19 nt, Homo sapiens
ggucuccucuucauauugc

SEQ ID NO: 407819 - RNA, 19 nt, Homo sapiens
gguuguuuacucugaaaua

SEQ ID NO: 407820 - RNA, 19 nt, Homo sapiens
gguuuaauacucaagagaa

SEQ ID NO: 407821 - RNA, 19 nt, Homo sapiens
acaauagcccauauaccua

SEQ ID NO: 407822 - RNA, 19 nt, Homo sapiens
ugccagauguuucuaugug

SEQ ID NO: 407823 - RNA, 19 nt, Homo sapiens
ugaaugcugucaaucaaaa

SEQ ID NO: 407824 - RNA, 19 nt, Homo sapiens
gaaaaggugcucaagugaa

SEQ ID NO: 407825 - RNA, 19 nt, Homo sapiens
guuccuccauacaguuaaa

SEQ ID NO: 407826 - RNA, 19 nt, Homo sapiens
uaauguuccuccauacagu

SEQ ID NO: 407827 - RNA, 19 nt, Homo sapiens
gugugugucuaaccuaaug

SEQ ID NO: 407828 - RNA, 19 nt, Homo sapiens
uaaacauguugacucuugu

SEQ ID NO: 407829 - RNA, 19 nt, Homo sapiens
gauggugugcucuaaaaua

SEQ ID NO: 407830 - RNA, 19 nt, Homo sapiens
gaaacagaacagcuccaau

SEQ ID NO: 407831 - RNA, 19 nt, Homo sapiens
ucccaaggagcaaguauuu

SEQ ID NO: 407832 - RNA, 19 nt, Homo sapiens
uuaugaggcuacagcaaug

SEQ ID NO: 407833 - RNA, 19 nt, Homo sapiens
gaagcucuaacggcuguuu

SEQ ID NO: 407834 - RNA, 19 nt, Homo sapiens
agugaaugcugucaaucaa

SEQ ID NO: 407835 - RNA, 19 nt, Homo sapiens
guuggucuccucuucauau

SEQ ID NO: 407836 - RNA, 19 nt, Homo sapiens
gauaaagacgaugcagguu

SEQ ID NO: 407837 - RNA, 19 nt, Homo sapiens
guuggauggugugcucuaa

SEQ ID NO: 407838 - RNA, 19 nt, Homo sapiens
aaaaggugcucaagugaau

SEQ ID NO: 407839 - RNA, 19 nt, Homo sapiens
aaaagaaugucaagcuugu

SEQ ID NO: 407840 - RNA, 19 nt, Homo sapiens
ccucccauguaccuuauau

SEQ ID NO: 407841 - RNA, 19 nt, Homo sapiens
cccaguguccuacaaacua

SEQ ID NO: 407842 - RNA, 19 nt, Homo sapiens
aggagcaaguauuuacauu

SEQ ID NO: 407843 - RNA, 19 nt, Homo sapiens
ggaaaaggugcucaaguga

SEQ ID NO: 407844 - RNA, 19 nt, Homo sapiens
ugaaaagaaugucaagcuu

SEQ ID NO: 407845 - RNA, 19 nt, Homo sapiens
gaccaggacagcagaacug

SEQ ID NO: 407846 - RNA, 19 nt, Homo sapiens
gagauuguucuacuguugu

SEQ ID NO: 407847 - RNA, 19 nt, Homo sapiens
cgaauaacuguugagauug

SEQ ID NO: 407848 - RNA, 19 nt, Homo sapiens
gaagaguugaaggagagua

SEQ ID NO: 407849 - RNA, 19 nt, Homo sapiens
gccagugaaugauaaagac

SEQ ID NO: 407850 - RNA, 19 nt, Homo sapiens
cagcuggacauacagaaau

SEQ ID NO: 407851 - RNA, 19 nt, Homo sapiens
uguggauucuguaauguuc

SEQ ID NO: 407852 - RNA, 19 nt, Homo sapiens
guugcucgcgcgacaagua

SEQ ID NO: 407853 - RNA, 19 nt, Homo sapiens
uuauaucccucucugaaac

SEQ ID NO: 407854 - RNA, 19 nt, Homo sapiens
gugcacaagacaucaucua

SEQ ID NO: 407855 - RNA, 19 nt, Homo sapiens
guggaagguuaaacagcuu

SEQ ID NO: 407856 - RNA, 19 nt, Homo sapiens
gggaugagauuguaaaagc

SEQ ID NO: 407857 - RNA, 19 nt, Homo sapiens
guuucuauguggauucugu

SEQ ID NO: 407858 - RNA, 19 nt, Homo sapiens
ccuuauaucccucucugaa

SEQ ID NO: 407859 - RNA, 19 nt, Homo sapiens
ggcaucgaauaacuguuga

SEQ ID NO: 407860 - RNA, 19 nt, Homo sapiens
cuuuguauguuguguuguu

SEQ ID NO: 407861 - RNA, 19 nt, Homo sapiens
uacuuuguauguuguguug

SEQ ID NO: 407862 - RNA, 19 nt, Homo sapiens
ggacacuuagccugugaug

SEQ ID NO: 407863 - RNA, 19 nt, Homo sapiens
gugaaugcugucaaucaaa

SEQ ID NO: 407864 - RNA, 19 nt, Homo sapiens
gugucauccuguauugaaa

SEQ ID NO: 407865 - RNA, 19 nt, Homo sapiens
gaaaggaaauuaucacaga

SEQ ID NO: 407866 - RNA, 19 nt, Homo sapiens
gaacacauaucuagucuca

SEQ ID NO: 407867 - RNA, 19 nt, Homo sapiens
guacgacccuucuugaauu

SEQ ID NO: 407868 - RNA, 19 nt, Homo sapiens
caagaaauuucaugggauu

SEQ ID NO: 407869 - RNA, 19 nt, Homo sapiens
cagaagauguccaggcuuu

SEQ ID NO: 407870 - RNA, 19 nt, Homo sapiens
ccaagaaacugacauagag

SEQ ID NO: 407871 - RNA, 19 nt, Homo sapiens
acagaucacuggcagauuu

SEQ ID NO: 407872 - RNA, 19 nt, Homo sapiens
uuacgaagcugcucuggaa

SEQ ID NO: 407873 - RNA, 19 nt, Homo sapiens
gaggguguccugauuauuu

SEQ ID NO: 407874 - RNA, 19 nt, Homo sapiens
gacaugcagucggguauua

SEQ ID NO: 407875 - RNA, 19 nt, Homo sapiens
ucacaucucugaaguacau

SEQ ID NO: 407876 - RNA, 19 nt, Homo sapiens
ggaaacaauucagaacaug

SEQ ID NO: 407877 - RNA, 19 nt, Homo sapiens
gaacaugagcaaaguagug

SEQ ID NO: 407878 - RNA, 19 nt, Homo sapiens
acacauaucuagucucauc

SEQ ID NO: 407879 - RNA, 19 nt, Homo sapiens
gaaacaauucagaacauga

SEQ ID NO: 407880 - RNA, 19 nt, Homo sapiens
gaacagaucacuggcagau

SEQ ID NO: 407881 - RNA, 19 nt, Homo sapiens
caacaaagccaagaaacug

SEQ ID NO: 407882 - RNA, 19 nt, Homo sapiens
gccaauaggugugccaguu

SEQ ID NO: 407883 - RNA, 19 nt, Homo sapiens
acauagaguuggaucugua

SEQ ID NO: 407884 - RNA, 19 nt, Homo sapiens
gaaagcccgagcugccuua

SEQ ID NO: 407885 - RNA, 19 nt, Homo sapiens
cuugaucuguuucuugaua

SEQ ID NO: 407886 - RNA, 19 nt, Homo sapiens
gguccgaucucuucuugau

SEQ ID NO: 407887 - RNA, 19 nt, Homo sapiens
gggaggguguccugauuau

SEQ ID NO: 407888 - RNA, 19 nt, Homo sapiens
uggccaaguuguaugauaa

SEQ ID NO: 407889 - RNA, 19 nt, Homo sapiens
gaggcagacagaagcauua

SEQ ID NO: 407890 - RNA, 19 nt, Homo sapiens
ggaaaacugcguacucaua

SEQ ID NO: 407891 - RNA, 19 nt, Homo sapiens
gaguacagauugaacacau

SEQ ID NO: 407892 - RNA, 19 nt, Homo sapiens
gaagaggcagugcaaguca

SEQ ID NO: 407893 - RNA, 19 nt, Homo sapiens
cgacguggaaaggaaauua

SEQ ID NO: 407894 - RNA, 19 nt, Homo sapiens
uaucuagucucaucaaacu

SEQ ID NO: 407895 - RNA, 19 nt, Homo sapiens
cagaagagaaggacuggaa

SEQ ID NO: 407896 - RNA, 19 nt, Homo sapiens
gccaagaaacugacauaga

SEQ ID NO: 407897 - RNA, 19 nt, Homo sapiens
uggauucccucuacaacaa

SEQ ID NO: 407898 - RNA, 19 nt, Homo sapiens
ggaggucgagcuguguuua

SEQ ID NO: 407899 - RNA, 19 nt, Homo sapiens
guacagauugaacacauau

SEQ ID NO: 407900 - RNA, 19 nt, Homo sapiens
caucacaucucugaaguac

SEQ ID NO: 407901 - RNA, 19 nt, Homo sapiens
aagcugcucuggaaacaau

SEQ ID NO: 407902 - RNA, 19 nt, Homo sapiens
gagaaggacuggaaaacug

SEQ ID NO: 407903 - RNA, 19 nt, Homo sapiens
ccaauaggugugccaguuu

SEQ ID NO: 407904 - RNA, 19 nt, Homo sapiens
ccaggaagcauugcauuug

SEQ ID NO: 407905 - RNA, 19 nt, Homo sapiens
gcagacagaagcauuaaaa

SEQ ID NO: 407906 - RNA, 19 nt, Homo sapiens
ccaaggccaucacaucucu

SEQ ID NO: 407907 - RNA, 19 nt, Homo sapiens
cauaucuagucucaucaaa

SEQ ID NO: 407908 - RNA, 19 nt, Homo sapiens
ggaggcagacagaagcauu

SEQ ID NO: 407909 - RNA, 19 nt, Homo sapiens
auacuucuaugaggcauuu

SEQ ID NO: 407910 - RNA, 19 nt, Homo sapiens
ugggaucucuccuggcaaa

SEQ ID NO: 407911 - RNA, 19 nt, Homo sapiens
ggcaaagacuggacaagcu

SEQ ID NO: 407912 - RNA, 19 nt, Homo sapiens
ccacagcaaaugccaucua

SEQ ID NO: 407913 - RNA, 19 nt, Homo sapiens
cuacaacaaagccaagaaa

SEQ ID NO: 407914 - RNA, 19 nt, Homo sapiens
aggaaauuaucacagauga

SEQ ID NO: 407915 - RNA, 19 nt, Homo sapiens
cagcaaaugccaucuacug

SEQ ID NO: 407916 - RNA, 19 nt, Homo sapiens
gaaguacagcuuuuagaaa

SEQ ID NO: 407917 - RNA, 19 nt, Homo sapiens
gacauagaguuggaucugu

SEQ ID NO: 407918 - RNA, 19 nt, Homo sapiens
uggaaacaauucagaacau

SEQ ID NO: 407919 - RNA, 19 nt, Homo sapiens
ucacagaugauucuugaca

SEQ ID NO: 407920 - RNA, 19 nt, Homo sapiens
ggaaguacagcuuuuagaa

SEQ ID NO: 407921 - RNA, 19 nt, Homo sapiens
ggaaaaugcuaggagauuc

SEQ ID NO: 407922 - RNA, 19 nt, Homo sapiens
gcuccgggaugacccaauc

SEQ ID NO: 407923 - RNA, 19 nt, Homo sapiens
uauuauccaugcagcagaa

SEQ ID NO: 407924 - RNA, 19 nt, Homo sapiens
caggaagcauugcauuugg

SEQ ID NO: 407925 - RNA, 19 nt, Homo sapiens
cgaagcugcucuggaaaca

SEQ ID NO: 407926 - RNA, 19 nt, Homo sapiens
gcagucggguauuauccau

SEQ ID NO: 407927 - RNA, 19 nt, Homo sapiens
gcucgaaccacagcaaaug

SEQ ID NO: 407928 - RNA, 19 nt, Homo sapiens
ugagcaaaguaguggauuc

SEQ ID NO: 407929 - RNA, 19 nt, Homo sapiens
gcagggaggcagacagaag

SEQ ID NO: 407930 - RNA, 19 nt, Homo sapiens
gaagauguccaggcuuugg

SEQ ID NO: 407931 - RNA, 19 nt, Homo sapiens
ggacaugcagucggguauu

SEQ ID NO: 407932 - RNA, 19 nt, Homo sapiens
guggggaaauugcuuaaaa

SEQ ID NO: 407933 - RNA, 19 nt, Homo sapiens
caauaggugugccaguuuu

SEQ ID NO: 407934 - RNA, 19 nt, Homo sapiens
cacagaugauucuugacaa

SEQ ID NO: 407935 - RNA, 19 nt, Homo sapiens
gccaucacaucucugaagu

SEQ ID NO: 407936 - RNA, 19 nt, Homo sapiens
acuggugucuuuguacuuu

SEQ ID NO: 407937 - RNA, 19 nt, Homo sapiens
aguacagauugaacacaua

SEQ ID NO: 407938 - RNA, 19 nt, Homo sapiens
gaaucugauccgagucauu

SEQ ID NO: 407939 - RNA, 19 nt, Homo sapiens
gaagagaaggacuggaaaa

SEQ ID NO: 407940 - RNA, 19 nt, Homo sapiens
cgagcugccuuaacuucug

SEQ ID NO: 407941 - RNA, 19 nt, Homo sapiens
gaaugggccaagucagaga

SEQ ID NO: 407942 - RNA, 19 nt, Homo sapiens
aaucugauccgagucauug

SEQ ID NO: 407943 - RNA, 19 nt, Homo sapiens
guauguacgacccuucuug

SEQ ID NO: 407944 - RNA, 19 nt, Homo sapiens
gaucucuccuggcaaagac

SEQ ID NO: 407945 - RNA, 19 nt, Homo sapiens
gaagcgugacauucaggaa

SEQ ID NO: 407946 - RNA, 19 nt, Homo sapiens
gagguaccaggaagcauug

SEQ ID NO: 407947 - RNA, 19 nt, Homo sapiens
ugagcaaccugccgaaagc

SEQ ID NO: 407948 - RNA, 19 nt, Homo sapiens
aaacugcguacucauacuu

SEQ ID NO: 407949 - RNA, 19 nt, Homo sapiens
agagguaccaggaagcauu

SEQ ID NO: 407950 - RNA, 19 nt, Homo sapiens
gaucuguagcgguccuuug

SEQ ID NO: 407951 - RNA, 19 nt, Homo sapiens
aagccaagaaacugacaua

SEQ ID NO: 407952 - RNA, 19 nt, Homo sapiens
caauucagaacaugagcaa

SEQ ID NO: 407953 - RNA, 19 nt, Homo sapiens
ucgaaugggccaagucaga

SEQ ID NO: 407954 - RNA, 19 nt, Homo sapiens
cagaacaugagcaaaguag

SEQ ID NO: 407955 - RNA, 19 nt, Homo sapiens
ucagaacaugagcaaagua

SEQ ID NO: 407956 - RNA, 19 nt, Homo sapiens
augaggcauuugaggguua

SEQ ID NO: 407957 - RNA, 19 nt, Homo sapiens
cuaaauugcaggccaccuu

SEQ ID NO: 407958 - RNA, 19 nt, Homo sapiens
cacagcaaaugccaucuac

SEQ ID NO: 407959 - RNA, 19 nt, Homo sapiens
uauguacgacccuucuuga

SEQ ID NO: 407960 - RNA, 19 nt, Homo sapiens
ggauucccucuacaacaaa

SEQ ID NO: 407961 - RNA, 19 nt, Homo sapiens
caucgugaagcgugacauu

SEQ ID NO: 407962 - RNA, 19 nt, Homo sapiens
uuggccaaguuguaugaua

SEQ ID NO: 407963 - RNA, 19 nt, Homo sapiens
ggaucucuccuggcaaaga

SEQ ID NO: 407964 - RNA, 19 nt, Homo sapiens
aaagauggacgacaaagcu

SEQ ID NO: 407965 - RNA, 19 nt, Homo sapiens
gaacacaaaucaucagcaa

SEQ ID NO: 407966 - RNA, 19 nt, Homo sapiens
agaaucagcugacauaauu

SEQ ID NO: 407967 - RNA, 19 nt, Homo sapiens
caacaucugcuaucacuua

SEQ ID NO: 407968 - RNA, 19 nt, Homo sapiens
caacuccucuuucgucuuu

SEQ ID NO: 407969 - RNA, 19 nt, Homo sapiens
cauaguaagugguguagua

SEQ ID NO: 407970 - RNA, 19 nt, Homo sapiens
guaaagcuaucagucauuu

SEQ ID NO: 407971 - RNA, 19 nt, Homo sapiens
aagaggagaugauacauaa

SEQ ID NO: 407972 - RNA, 19 nt, Homo sapiens
guacuuauguugaggaaau

SEQ ID NO: 407973 - RNA, 19 nt, Homo sapiens
ucacagaccuuccuaucaa

SEQ ID NO: 407974 - RNA, 19 nt, Homo sapiens
gaucagcuguucauccauu

SEQ ID NO: 407975 - RNA, 19 nt, Homo sapiens
gaacgaauuuugcaaguuu

SEQ ID NO: 407976 - RNA, 19 nt, Homo sapiens
gaagacaguugugggauau

SEQ ID NO: 407977 - RNA, 19 nt, Homo sapiens
caacauagagcauacaaga

SEQ ID NO: 407978 - RNA, 19 nt, Homo sapiens
gacaagaaguuagaagaaa

SEQ ID NO: 407979 - RNA, 19 nt, Homo sapiens
gauaacacuugauuccauu

SEQ ID NO: 407980 - RNA, 19 nt, Homo sapiens
gagaagaagcacuuuguuu

SEQ ID NO: 407981 - RNA, 19 nt, Homo sapiens
guucauccauuucguguuu

SEQ ID NO: 407982 - RNA, 19 nt, Homo sapiens
aguaagugguguaguauua

SEQ ID NO: 407983 - RNA, 19 nt, Homo sapiens
ucauuaaugucucugguua

SEQ ID NO: 407984 - RNA, 19 nt, Homo sapiens
ugacauaauugacacaguu

SEQ ID NO: 407985 - RNA, 19 nt, Homo sapiens
gauccuauuugucuauuug

SEQ ID NO: 407986 - RNA, 19 nt, Homo sapiens
gaaugggauuuacuuaaug

SEQ ID NO: 407987 - RNA, 19 nt, Homo sapiens
gagaagauaacacuugauu

SEQ ID NO: 407988 - RNA, 19 nt, Homo sapiens
ggaaagacuugaagaacag

SEQ ID NO: 407989 - RNA, 19 nt, Homo sapiens
gaaacugaacucauuaaug

SEQ ID NO: 407990 - RNA, 19 nt, Homo sapiens
uuaaaugacuggucucaga

SEQ ID NO: 407991 - RNA, 19 nt, Homo sapiens
ugaagacaguugugggaua

SEQ ID NO: 407992 - RNA, 19 nt, Homo sapiens
gagcauacaagaacauuug

SEQ ID NO: 407993 - RNA, 19 nt, Homo sapiens
gaagaagcacuuuguuuua

SEQ ID NO: 407994 - RNA, 19 nt, Homo sapiens
gcauuggucacacuaauaa

SEQ ID NO: 407995 - RNA, 19 nt, Homo sapiens
cacaguagcuugauugcuu

SEQ ID NO: 407996 - RNA, 19 nt, Homo sapiens
gggauagaguugugauuug

SEQ ID NO: 407997 - RNA, 19 nt, Homo sapiens
aagaaaaccuggagaauaa

SEQ ID NO: 407998 - RNA, 19 nt, Homo sapiens
gaagaaauucccaaauaca

SEQ ID NO: 407999 - RNA, 19 nt, Homo sapiens
gcauaaaguacaauaguga

SEQ ID NO: 408000 - RNA, 19 nt, Homo sapiens
uggcauuucuccuaauuaa

SEQ ID NO: 408001 - RNA, 19 nt, Homo sapiens
caaagaaacaccugagaug

SEQ ID NO: 408002 - RNA, 19 nt, Homo sapiens
guagcuugcugucaaagaa

SEQ ID NO: 408003 - RNA, 19 nt, Homo sapiens
gugaagaauuuguacuuug

SEQ ID NO: 408004 - RNA, 19 nt, Homo sapiens
cugguaaacuguagacuuu

SEQ ID NO: 408005 - RNA, 19 nt, Homo sapiens
ggauagaguugugauuugu

SEQ ID NO: 408006 - RNA, 19 nt, Homo sapiens
uaaugucucugguuaacaa

SEQ ID NO: 408007 - RNA, 19 nt, Homo sapiens
guagacagauuagcaggaa

SEQ ID NO: 408008 - RNA, 19 nt, Homo sapiens
gaaagagcgaguggaauuu

SEQ ID NO: 408009 - RNA, 19 nt, Homo sapiens
ccaaauucauuaucucugu

SEQ ID NO: 408010 - RNA, 19 nt, Homo sapiens
acaaugaacagucagauuu

SEQ ID NO: 408011 - RNA, 19 nt, Homo sapiens
gcacuacagagcaauauau

SEQ ID NO: 408012 - RNA, 19 nt, Homo sapiens
gagaggugaugagccauuu

SEQ ID NO: 408013 - RNA, 19 nt, Homo sapiens
uaacuuacccagauauguu

SEQ ID NO: 408014 - RNA, 19 nt, Homo sapiens
ggaagaaaauacagagaaa

SEQ ID NO: 408015 - RNA, 19 nt, Homo sapiens
gccuagcugugaaggauua

SEQ ID NO: 408016 - RNA, 19 nt, Homo sapiens
gugcgaagcuagccaagga

SEQ ID NO: 408017 - RNA, 19 nt, Homo sapiens
ugucauaacuuacccagau

SEQ ID NO: 408018 - RNA, 19 nt, Homo sapiens
gaaggcaagauuuauguug

SEQ ID NO: 408019 - RNA, 19 nt, Homo sapiens
gauacucuacgaaugguua

SEQ ID NO: 408020 - RNA, 19 nt, Homo sapiens
gcuaugaggcuaaagaaug

SEQ ID NO: 408021 - RNA, 19 nt, Homo sapiens
ggauauagcagcaauaaaa

SEQ ID NO: 408022 - RNA, 19 nt, Homo sapiens
agugugaggucuacuuuaa

SEQ ID NO: 408023 - RNA, 19 nt, Homo sapiens
gagacucccuuugaccuuu

SEQ ID NO: 408024 - RNA, 19 nt, Homo sapiens
gacccaaggauccaaauaa

SEQ ID NO: 408025 - RNA, 19 nt, Homo sapiens
uagcaggaauuaucaacuu

SEQ ID NO: 408026 - RNA, 19 nt, Homo sapiens
gaauaaguggugacaagaa

SEQ ID NO: 408027 - RNA, 19 nt, Homo sapiens
uaucuuaguugcaguagug

SEQ ID NO: 408028 - RNA, 19 nt, Homo sapiens
gaacauuugggauagaguu

SEQ ID NO: 408029 - RNA, 19 nt, Homo sapiens
caugagggauccuauuugu

SEQ ID NO: 408030 - RNA, 19 nt, Homo sapiens
gcaagaaaauuaacaccaa

SEQ ID NO: 408031 - RNA, 19 nt, Homo sapiens
guagugauuuggcaagugu

SEQ ID NO: 408032 - RNA, 19 nt, Homo sapiens
agaaagagcgaguggaauu

SEQ ID NO: 408033 - RNA, 19 nt, Homo sapiens
gaagauaacacuugauucc

SEQ ID NO: 408034 - RNA, 19 nt, Homo sapiens
guauuaugauucagugcua

SEQ ID NO: 408035 - RNA, 19 nt, Homo sapiens
uuagaauaauggccaagua

SEQ ID NO: 408036 - RNA, 19 nt, Homo sapiens
ggacuauggaauggaauua

SEQ ID NO: 408037 - RNA, 19 nt, Homo sapiens
acacaaaucaucagcaaga

SEQ ID NO: 408038 - RNA, 19 nt, Homo sapiens
cuaauaacaucaacaucug

SEQ ID NO: 408039 - RNA, 19 nt, Homo sapiens
agaaacaccugagaugaau

SEQ ID NO: 408040 - RNA, 19 nt, Homo sapiens
uacaagaacauuugggaua

SEQ ID NO: 408041 - RNA, 19 nt, Homo sapiens
ggaucuaucuguugaugag

SEQ ID NO: 408042 - RNA, 19 nt, Homo sapiens
ccucuuucgucuuucuuua

SEQ ID NO: 408043 - RNA, 19 nt, Homo sapiens
ggucuuagugcuuuagaaa

SEQ ID NO: 408044 - RNA, 19 nt, Homo sapiens
aaagaggagaugauacaua

SEQ ID NO: 408045 - RNA, 19 nt, Homo sapiens
ccaaagaggagaugauaca

SEQ ID NO: 408046 - RNA, 19 nt, Homo sapiens
agaagaaauucccaaauac

SEQ ID NO: 408047 - RNA, 19 nt, Homo sapiens
gagcgaguggaauuuauuu

SEQ ID NO: 408048 - RNA, 19 nt, Homo sapiens
gaaaucacagaccuuccua

SEQ ID NO: 408049 - RNA, 19 nt, Homo sapiens
ugugagucauugugaauaa

SEQ ID NO: 408050 - RNA, 19 nt, Homo sapiens
gagaugaauuggugugaac

SEQ ID NO: 408051 - RNA, 19 nt, Homo sapiens
gaggagaugauacauaauc

SEQ ID NO: 408052 - RNA, 19 nt, Homo sapiens
uaaaguagacagauuagca

SEQ ID NO: 408053 - RNA, 19 nt, Homo sapiens
uggaaagacuugaagaaca

SEQ ID NO: 408054 - RNA, 19 nt, Homo sapiens
agauuugguucaccgaaua

SEQ ID NO: 408055 - RNA, 19 nt, Homo sapiens
aaagagcgaguggaauuua

SEQ ID NO: 408056 - RNA, 19 nt, Homo sapiens
uggagaagauaacacuuga

SEQ ID NO: 408057 - RNA, 19 nt, Homo sapiens
gcacccaacuccucuuucg

SEQ ID NO: 408058 - RNA, 19 nt, Homo sapiens
ugucauauuuauccuguga

SEQ ID NO: 408059 - RNA, 19 nt, Homo sapiens
aaaguagcuugcugucaaa

SEQ ID NO: 408060 - RNA, 19 nt, Homo sapiens
caagaacauuugggauaga

SEQ ID NO: 408061 - RNA, 19 nt, Homo sapiens
uuucuaagcuucuuugucu

SEQ ID NO: 408062 - RNA, 19 nt, Homo sapiens
caacaugagggauccuauu

SEQ ID NO: 408063 - RNA, 19 nt, Homo sapiens
aaagaaagagcgaguggaa

SEQ ID NO: 408064 - RNA, 19 nt, Homo sapiens
ggagaagaagcacuuuguu

SEQ ID NO: 408065 - RNA, 19 nt, Homo sapiens
ggaaaucauucuucacgua

SEQ ID NO: 408066 - RNA, 19 nt, Homo sapiens
ucuaugaucucuccaguaa

SEQ ID NO: 408067 - RNA, 19 nt, Homo sapiens
caaagaugcucugcgguuu

SEQ ID NO: 408068 - RNA, 19 nt, Homo sapiens
gcacggaugugaagagcau

SEQ ID NO: 408069 - RNA, 19 nt, Homo sapiens
uaugaucucuccaguaaau

SEQ ID NO: 408070 - RNA, 19 nt, Homo sapiens
gaggagcucuacacgaaga

SEQ ID NO: 408071 - RNA, 19 nt, Homo sapiens
ggacguaccgggcuuccua

SEQ ID NO: 408072 - RNA, 19 nt, Homo sapiens
uggaggagcucuacacgaa

SEQ ID NO: 408073 - RNA, 19 nt, Homo sapiens
caacagaucaagggaauga

SEQ ID NO: 408074 - RNA, 19 nt, Homo sapiens
gaaaccacgcguccuacua

SEQ ID NO: 408075 - RNA, 19 nt, Homo sapiens
caaaggaaacaauugaaga

SEQ ID NO: 408076 - RNA, 19 nt, Homo sapiens
ugaagauguugaagaaaug

SEQ ID NO: 408077 - RNA, 19 nt, Homo sapiens
ucacguaguuagacagaug

SEQ ID NO: 408078 - RNA, 19 nt, Homo sapiens
ggcaucagcugacacuuca

SEQ ID NO: 408079 - RNA, 19 nt, Homo sapiens
gcagugauccuguguaaaa

SEQ ID NO: 408080 - RNA, 19 nt, Homo sapiens
cgaagaaguuguggcauca

SEQ ID NO: 408081 - RNA, 19 nt, Homo sapiens
ggaaaagacucgugagaag

SEQ ID NO: 408082 - RNA, 19 nt, Homo sapiens
gacaaacgaguccacauga

SEQ ID NO: 408083 - RNA, 19 nt, Homo sapiens
ugaaugagguggagcuucu

SEQ ID NO: 408084 - RNA, 19 nt, Homo sapiens
gaccggcaguggcugauug

SEQ ID NO: 408085 - RNA, 19 nt, Homo sapiens
acagaugacugauccuaau

SEQ ID NO: 408086 - RNA, 19 nt, Homo sapiens
gauggucucauuaagcuuu

SEQ ID NO: 408087 - RNA, 19 nt, Homo sapiens
ggguugggauccugucuga

SEQ ID NO: 408088 - RNA, 19 nt, Homo sapiens
gcaccaggcccaugacauc

SEQ ID NO: 408089 - RNA, 19 nt, Homo sapiens
cuucaacaguggcaacgua

SEQ ID NO: 408090 - RNA, 19 nt, Homo sapiens
gacggucgacauugaauuu

SEQ ID NO: 408091 - RNA, 19 nt, Homo sapiens
aggcagugauccuguguaa

SEQ ID NO: 408092 - RNA, 19 nt, Homo sapiens
uaauguggcucuuacuuuu

SEQ ID NO: 408093 - RNA, 19 nt, Homo sapiens
gaugacugauccuaaugug

SEQ ID NO: 408094 - RNA, 19 nt, Homo sapiens
cacuucaggugcuugauuu

SEQ ID NO: 408095 - RNA, 19 nt, Homo sapiens
ccacgcguccuacuacaaa

SEQ ID NO: 408096 - RNA, 19 nt, Homo sapiens
caaccuuccuggugugaca

SEQ ID NO: 408097 - RNA, 19 nt, Homo sapiens
cuaauguggcucuuacuuu

SEQ ID NO: 408098 - RNA, 19 nt, Homo sapiens
caaaagugcuaaaaucaca

SEQ ID NO: 408099 - RNA, 19 nt, Homo sapiens
ucacacgaccugccaauca

SEQ ID NO: 408100 - RNA, 19 nt, Homo sapiens
gggaggaggcuucuuugug

SEQ ID NO: 408101 - RNA, 19 nt, Homo sapiens
ucacagucguuucuaugau

SEQ ID NO: 408102 - RNA, 19 nt, Homo sapiens
gacagaugacugauccuaa

SEQ ID NO: 408103 - RNA, 19 nt, Homo sapiens
aaaccccucugcuuuguua

SEQ ID NO: 408104 - RNA, 19 nt, Homo sapiens
cccaugacauccucaccua

SEQ ID NO: 408105 - RNA, 19 nt, Homo sapiens
aggaaacaauugaagaugu

SEQ ID NO: 408106 - RNA, 19 nt, Homo sapiens
ccagcagccugauuuagca

SEQ ID NO: 408107 - RNA, 19 nt, Homo sapiens
caauugaagauguugaaga

SEQ ID NO: 408108 - RNA, 19 nt, Homo sapiens
gauccuaauguggcucuua

SEQ ID NO: 408109 - RNA, 19 nt, Homo sapiens
ugaaggaccgccuggaguu

SEQ ID NO: 408110 - RNA, 19 nt, Homo sapiens
acagacaacucacuuuuga

SEQ ID NO: 408111 - RNA, 19 nt, Homo sapiens
acagggaggaggcuucuuu

SEQ ID NO: 408112 - RNA, 19 nt, Homo sapiens
gugcugacaucccgguugu

SEQ ID NO: 408113 - RNA, 19 nt, Homo sapiens
aaucauucuucacguaguu

SEQ ID NO: 408114 - RNA, 19 nt, Homo sapiens
gccaaucacagacaacuca

SEQ ID NO: 408115 - RNA, 19 nt, Homo sapiens
gggccagcagccugauuua

SEQ ID NO: 408116 - RNA, 19 nt, Homo sapiens
ugacaucccgguuguucuu

SEQ ID NO: 408117 - RNA, 19 nt, Homo sapiens
uaauaaaccccucugcuuu

SEQ ID NO: 408118 - RNA, 19 nt, Homo sapiens
gaaauugccaaaagugcua

SEQ ID NO: 408119 - RNA, 19 nt, Homo sapiens
cacagucguuucuaugauc

SEQ ID NO: 408120 - RNA, 19 nt, Homo sapiens
cucagggucuuaggugaua

SEQ ID NO: 408121 - RNA, 19 nt, Homo sapiens
gcucagacggucgacauug

SEQ ID NO: 408122 - RNA, 19 nt, Homo sapiens
ugcaacagaucaagggaau

SEQ ID NO: 408123 - RNA, 19 nt, Homo sapiens
gaggaaaauucaguuguug

SEQ ID NO: 408124 - RNA, 19 nt, Homo sapiens
gguucacagucguuucuau

SEQ ID NO: 408125 - RNA, 19 nt, Homo sapiens
gguuacaaaggaaacaauu

SEQ ID NO: 408126 - RNA, 19 nt, Homo sapiens
gcaauuggagcucuaaaau

SEQ ID NO: 408127 - RNA, 19 nt, Homo sapiens
gugagaaggugaaaaguag

SEQ ID NO: 408128 - RNA, 19 nt, Homo sapiens
cucagacggucgacauuga

SEQ ID NO: 408129 - RNA, 19 nt, Homo sapiens
acaacucacuuuugaagaa

SEQ ID NO: 408130 - RNA, 19 nt, Homo sapiens
gaaggaccgccuggaguuc

SEQ ID NO: 408131 - RNA, 19 nt, Homo sapiens
gaagaaauugccaaaagug

SEQ ID NO: 408132 - RNA, 19 nt, Homo sapiens
ugaggaaaauucaguuguu

SEQ ID NO: 408133 - RNA, 19 nt, Homo sapiens
aagaaaugcucaacaaccu

SEQ ID NO: 408134 - RNA, 19 nt, Homo sapiens
gcuggugaaaggcaguaua

SEQ ID NO: 408135 - RNA, 19 nt, Homo sapiens
caacucacuuuugaagaaa

SEQ ID NO: 408136 - RNA, 19 nt, Homo sapiens
caacaguggcaacguagag

SEQ ID NO: 408137 - RNA, 19 nt, Homo sapiens
guucacagucguuucuaug

SEQ ID NO: 408138 - RNA, 19 nt, Homo sapiens
guuacaaaggaaacaauug

SEQ ID NO: 408139 - RNA, 19 nt, Homo sapiens
uagacgagguggacaaacg

SEQ ID NO: 408140 - RNA, 19 nt, Homo sapiens
guauagacgagguggacaa

SEQ ID NO: 408141 - RNA, 19 nt, Homo sapiens
ggugaaaggcaguauagac

SEQ ID NO: 408142 - RNA, 19 nt, Homo sapiens
agacagaugacugauccua

SEQ ID NO: 408143 - RNA, 19 nt, Homo sapiens
acacuucaggugcuugauu

SEQ ID NO: 408144 - RNA, 19 nt, Homo sapiens
ugaagaaauugccaaaagu

SEQ ID NO: 408145 - RNA, 19 nt, Homo sapiens
gcugacaucccgguuguuc

SEQ ID NO: 408146 - RNA, 19 nt, Homo sapiens
gcugauugacacccucuau

SEQ ID NO: 408147 - RNA, 19 nt, Homo sapiens
guugggauccugucugaag

SEQ ID NO: 408148 - RNA, 19 nt, Homo sapiens
cuacagguuacaaaggaaa

SEQ ID NO: 408149 - RNA, 19 nt, Homo sapiens
ucggaaaccacgcguccua

SEQ ID NO: 408150 - RNA, 19 nt, Homo sapiens
acaaaggaaacaauugaag

SEQ ID NO: 408151 - RNA, 19 nt, Homo sapiens
ccuacagguuacaaaggaa

SEQ ID NO: 408152 - RNA, 19 nt, Homo sapiens
caccuguacggacaucuuu

SEQ ID NO: 408153 - RNA, 19 nt, Homo sapiens
ucacagacaacucacuuuu

SEQ ID NO: 408154 - RNA, 19 nt, Homo sapiens
uggagucccugaggaauac

SEQ ID NO: 408155 - RNA, 19 nt, Homo sapiens
cuggagucccugaggaaua

SEQ ID NO: 408156 - RNA, 19 nt, Homo sapiens
aaaccacgcguccuacuac

SEQ ID NO: 408157 - RNA, 19 nt, Homo sapiens
ggaaaccacgcguccuacu

SEQ ID NO: 408158 - RNA, 19 nt, Homo sapiens
ucguggaaaucauucuuca

SEQ ID NO: 408159 - RNA, 19 nt, Homo sapiens
ccuaauguggcucuuacuu

SEQ ID NO: 408160 - RNA, 19 nt, Homo sapiens
ucagacggucgacauugaa

SEQ ID NO: 408161 - RNA, 19 nt, Homo sapiens
uggagcuucuggugaugaa

SEQ ID NO: 408162 - RNA, 19 nt, Homo sapiens
aaucacagacaacucacuu

SEQ ID NO: 408163 - RNA, 19 nt, Homo sapiens
gcucuacacgaagaaguug

SEQ ID NO: 408164 - RNA, 19 nt, Homo sapiens
caaagggaaugaucuauug

SEQ ID NO: 408165 - RNA, 19 nt, Homo sapiens
gaagaccucuguaccaaga

SEQ ID NO: 408166 - RNA, 19 nt, Homo sapiens
acacucaaaucucuaagua

SEQ ID NO: 408167 - RNA, 19 nt, Homo sapiens
ggaagaaacagcaggagaa

SEQ ID NO: 408168 - RNA, 19 nt, Homo sapiens
gaagccaacuugagcaauc

SEQ ID NO: 408169 - RNA, 19 nt, Homo sapiens
gcagauaccucggauugag

SEQ ID NO: 408170 - RNA, 19 nt, Homo sapiens
gaagauuucugagcuggau

SEQ ID NO: 408171 - RNA, 19 nt, Homo sapiens
caaugcuuaugcuguguua

SEQ ID NO: 408172 - RNA, 19 nt, Homo sapiens
gaaagaggagcggaagaaa

SEQ ID NO: 408173 - RNA, 19 nt, Homo sapiens
aaacaaagggaaugaucua

SEQ ID NO: 408174 - RNA, 19 nt, Homo sapiens
uuucugagcuggaugcauu

SEQ ID NO: 408175 - RNA, 19 nt, Homo sapiens
gugaagaccucuguaccaa

SEQ ID NO: 408176 - RNA, 19 nt, Homo sapiens
cuuaugcuguguuauauga

SEQ ID NO: 408177 - RNA, 19 nt, Homo sapiens
gaaggaagacaaggaugaa

SEQ ID NO: 408178 - RNA, 19 nt, Homo sapiens
caaacuugcuucuguugag

SEQ ID NO: 408179 - RNA, 19 nt, Homo sapiens
gaagguguuugagcugaug

SEQ ID NO: 408180 - RNA, 19 nt, Homo sapiens
gaacugcaaugaaaagauc

SEQ ID NO: 408181 - RNA, 19 nt, Homo sapiens
gaaacaaagggaaugaucu

SEQ ID NO: 408182 - RNA, 19 nt, Homo sapiens
ggagaaacaaagggaauga

SEQ ID NO: 408183 - RNA, 19 nt, Homo sapiens
agaaacagcaggagaagga

SEQ ID NO: 408184 - RNA, 19 nt, Homo sapiens
ucaaggagaaagagaaaga

SEQ ID NO: 408185 - RNA, 19 nt, Homo sapiens
ggagaaggaagacaaggau

SEQ ID NO: 408186 - RNA, 19 nt, Homo sapiens
acaaagggaaugaucuauu

SEQ ID NO: 408187 - RNA, 19 nt, Homo sapiens
ggagauccgcaaugcuuau

SEQ ID NO: 408188 - RNA, 19 nt, Homo sapiens
ugaccagccuccacaccaa

SEQ ID NO: 408189 - RNA, 19 nt, Homo sapiens
gaguggcuguccaggagaa

SEQ ID NO: 408190 - RNA, 19 nt, Homo sapiens
gaagaaacagcaggagaag

SEQ ID NO: 408191 - RNA, 19 nt, Homo sapiens
agaaggaagacaaggauga

SEQ ID NO: 408192 - RNA, 19 nt, Homo sapiens
aaacuugcuucuguugaga

SEQ ID NO: 408193 - RNA, 19 nt, Homo sapiens
agaaagaggagcggaagaa

SEQ ID NO: 408194 - RNA, 19 nt, Homo sapiens
aagccaagguggauguguu

SEQ ID NO: 408195 - RNA, 19 nt, Homo sapiens
ugagaucaaggaugucauu

SEQ ID NO: 408196 - RNA, 19 nt, Homo sapiens
aagaggagcggaagaaaca

SEQ ID NO: 408197 - RNA, 19 nt, Homo sapiens
ggauugaggaugguaacaa

SEQ ID NO: 408198 - RNA, 19 nt, Homo sapiens
guggauguguuucgugaag

SEQ ID NO: 408199 - RNA, 19 nt, Homo sapiens
ggagcuauuuccccaagaa

SEQ ID NO: 408200 - RNA, 19 nt, Homo sapiens
uugaggaugguaacaauuu

SEQ ID NO: 408201 - RNA, 19 nt, Homo sapiens
agccugagaucaaggaugu

SEQ ID NO: 408202 - RNA, 19 nt, Homo sapiens
augcuuaugcuguguuaua

SEQ ID NO: 408203 - RNA, 19 nt, Homo sapiens
gcaaugcuuaugcuguguu

SEQ ID NO: 408204 - RNA, 19 nt, Homo sapiens
ucucuaaguauuucucuga

SEQ ID NO: 408205 - RNA, 19 nt, Homo sapiens
cugcagauaccucggauug

SEQ ID NO: 408206 - RNA, 19 nt, Homo sapiens
gagaaagaggagcggaaga

SEQ ID NO: 408207 - RNA, 19 nt, Homo sapiens
agggaaugaucuauugaga

SEQ ID NO: 408208 - RNA, 19 nt, Homo sapiens
guggugaugcagugacuaa

SEQ ID NO: 408209 - RNA, 19 nt, Homo sapiens
gaaacagcaggagaaggaa

SEQ ID NO: 408210 - RNA, 19 nt, Homo sapiens
ucucaggcacaauaaauau

SEQ ID NO: 408211 - RNA, 19 nt, Homo sapiens
caacuugagcaaucugaag

SEQ ID NO: 408212 - RNA, 19 nt, Homo sapiens
caagguggauguguuucgu

SEQ ID NO: 408213 - RNA, 19 nt, Homo sapiens
ccaaacuugcuucuguuga

SEQ ID NO: 408214 - RNA, 19 nt, Homo sapiens
ggauguguuucgugaagac

SEQ ID NO: 408215 - RNA, 19 nt, Homo sapiens
gacaucauccugaagaacu

SEQ ID NO: 408216 - RNA, 19 nt, Homo sapiens
agacaaggaugaaaagaag

SEQ ID NO: 408217 - RNA, 19 nt, Homo sapiens
uuauaccacugcccaucaa

SEQ ID NO: 408218 - RNA, 19 nt, Homo sapiens
ucaggcacaauaaauauag

SEQ ID NO: 408219 - RNA, 19 nt, Homo sapiens
ucccucaccuugccucuca

SEQ ID NO: 408220 - RNA, 19 nt, Homo sapiens
gcccuaccgcuuucgcuuu

SEQ ID NO: 408221 - RNA, 19 nt, Homo sapiens
gauccgcaaugcuuaugcu

SEQ ID NO: 408222 - RNA, 19 nt, Homo sapiens
ggacaucccagugccugau

SEQ ID NO: 408223 - RNA, 19 nt, Homo sapiens
gugaugcagugacuaaagc

SEQ ID NO: 408224 - RNA, 19 nt, Homo sapiens
ccucucaggcacaauaaau

SEQ ID NO: 408225 - RNA, 19 nt, Homo sapiens
aaagggaaugaucuauuga

SEQ ID NO: 408226 - RNA, 19 nt, Homo sapiens
agaaacaaagggaaugauc

SEQ ID NO: 408227 - RNA, 19 nt, Homo sapiens
ucauggagauccgcaaugc

SEQ ID NO: 408228 - RNA, 19 nt, Homo sapiens
gcaggagaaggaagacaag

SEQ ID NO: 408229 - RNA, 19 nt, Homo sapiens
guuauaccacugcccauca

SEQ ID NO: 408230 - RNA, 19 nt, Homo sapiens
gagaaacaaagggaaugau

SEQ ID NO: 408231 - RNA, 19 nt, Homo sapiens
gggagaaacaaagggaaug

SEQ ID NO: 408232 - RNA, 19 nt, Homo sapiens
uaugcuguguuauaugaca

SEQ ID NO: 408233 - RNA, 19 nt, Homo sapiens
ugacuaaagcagccaagca

SEQ ID NO: 408234 - RNA, 19 nt, Homo sapiens
ggugaugcagugacuaaag

SEQ ID NO: 408235 - RNA, 19 nt, Homo sapiens
ggaggaugaagacaaaggu

SEQ ID NO: 408236 - RNA, 19 nt, Homo sapiens
ucucucccauucugugaug

SEQ ID NO: 408237 - RNA, 19 nt, Homo sapiens
uggagauccgcaaugcuua

SEQ ID NO: 408238 - RNA, 19 nt, Homo sapiens
ggucauggagauccgcaau

SEQ ID NO: 408239 - RNA, 19 nt, Homo sapiens
gagaucaaggaugucauug

SEQ ID NO: 408240 - RNA, 19 nt, Homo sapiens
ggugcccacuccacuccuu

SEQ ID NO: 408241 - RNA, 19 nt, Homo sapiens
caaggagacucauguaaug

SEQ ID NO: 408242 - RNA, 19 nt, Homo sapiens
agacaaccauuuccaagua

SEQ ID NO: 408243 - RNA, 19 nt, Homo sapiens
gaaagaaguccauaagugu

SEQ ID NO: 408244 - RNA, 19 nt, Homo sapiens
ccagagaucuagcgacuga

SEQ ID NO: 408245 - RNA, 19 nt, Homo sapiens
gcaaacagguggaggucuu

SEQ ID NO: 408246 - RNA, 19 nt, Homo sapiens
gaaaugcauucuggugauu

SEQ ID NO: 408247 - RNA, 19 nt, Homo sapiens
agaaagaaguccauaagug

SEQ ID NO: 408248 - RNA, 19 nt, Homo sapiens
gaagaaagaaguccauaag

SEQ ID NO: 408249 - RNA, 19 nt, Homo sapiens
gauugaagauggaaaugau

SEQ ID NO: 408250 - RNA, 19 nt, Homo sapiens
cagauaagcaggagaagaa

SEQ ID NO: 408251 - RNA, 19 nt, Homo sapiens
gaugagauggaaacagaua

SEQ ID NO: 408252 - RNA, 19 nt, Homo sapiens
augcugagcuuuaucauau

SEQ ID NO: 408253 - RNA, 19 nt, Homo sapiens
ccaggaggcugaggaauuc

SEQ ID NO: 408254 - RNA, 19 nt, Homo sapiens
gaagaaaagccaucuaugu

SEQ ID NO: 408255 - RNA, 19 nt, Homo sapiens
ccaaggagacucauguaau

SEQ ID NO: 408256 - RNA, 19 nt, Homo sapiens
aaacagauaagcaggagaa

SEQ ID NO: 408257 - RNA, 19 nt, Homo sapiens
caauguggcugacuugacu

SEQ ID NO: 408258 - RNA, 19 nt, Homo sapiens
gcagcaaccuggagaaaau

SEQ ID NO: 408259 - RNA, 19 nt, Homo sapiens
gcugagcuuuaucauauca

SEQ ID NO: 408260 - RNA, 19 nt, Homo sapiens
gagaagaaagaaguccaua

SEQ ID NO: 408261 - RNA, 19 nt, Homo sapiens
ugaaugccgucaagaccaa

SEQ ID NO: 408262 - RNA, 19 nt, Homo sapiens
gcauucuggugauuacaug

SEQ ID NO: 408263 - RNA, 19 nt, Homo sapiens
caaggaugaugagauggaa

SEQ ID NO: 408264 - RNA, 19 nt, Homo sapiens
ggagacucauguaauggau

SEQ ID NO: 408265 - RNA, 19 nt, Homo sapiens
ggguagcaauccaggagaa

SEQ ID NO: 408266 - RNA, 19 nt, Homo sapiens
augaugagauggaaacaga

SEQ ID NO: 408267 - RNA, 19 nt, Homo sapiens
guacugaacccgggacuag

SEQ ID NO: 408268 - RNA, 19 nt, Homo sapiens
caagauugaagauggaaau

SEQ ID NO: 408269 - RNA, 19 nt, Homo sapiens
agaagaaagaaguccauaa

SEQ ID NO: 408270 - RNA, 19 nt, Homo sapiens
gaaaagccaucuauguacu

SEQ ID NO: 408271 - RNA, 19 nt, Homo sapiens
gagggugaaugccgucaag

SEQ ID NO: 408272 - RNA, 19 nt, Homo sapiens
gaacccgggacuagaagga

SEQ ID NO: 408273 - RNA, 19 nt, Homo sapiens
aaagccaucuauguacuga

SEQ ID NO: 408274 - RNA, 19 nt, Homo sapiens
ggccuucuaugcugagcuu

SEQ ID NO: 408275 - RNA, 19 nt, Homo sapiens
gacaaccauuuccaaguac

SEQ ID NO: 408276 - RNA, 19 nt, Homo sapiens
gaaaguccugucccugcuu

SEQ ID NO: 408277 - RNA, 19 nt, Homo sapiens
uacagauucuugccacaga

SEQ ID NO: 408278 - RNA, 19 nt, Homo sapiens
ccaaggaugaugagaugga

SEQ ID NO: 408279 - RNA, 19 nt, Homo sapiens
acccaaggaugaugagaug

SEQ ID NO: 408280 - RNA, 19 nt, Homo sapiens
aagaaaagccaucuaugua

SEQ ID NO: 408281 - RNA, 19 nt, Homo sapiens
ggaccugagggccuucuau

SEQ ID NO: 408282 - RNA, 19 nt, Homo sapiens
gggacuagaaggaaaauaa

SEQ ID NO: 408283 - RNA, 19 nt, Homo sapiens
gaccugagggccuucuaug

SEQ ID NO: 408284 - RNA, 19 nt, Homo sapiens
ggacuagaaggaaaauaaa

SEQ ID NO: 408285 - RNA, 19 nt, Homo sapiens
cuucuaugcugagcuuuau

SEQ ID NO: 408286 - RNA, 19 nt, Homo sapiens
cgucaagaccaaaguggaa

SEQ ID NO: 408287 - RNA, 19 nt, Homo sapiens
ggagaagaaagaaguccau

SEQ ID NO: 408288 - RNA, 19 nt, Homo sapiens
ccauaaguguggauuucuc

SEQ ID NO: 408289 - RNA, 19 nt, Homo sapiens
auaagcaggagaagaaaga

SEQ ID NO: 408290 - RNA, 19 nt, Homo sapiens
cagcagcaaccuggagaaa

SEQ ID NO: 408291 - RNA, 19 nt, Homo sapiens
gauaagcaggagaagaaag

SEQ ID NO: 408292 - RNA, 19 nt, Homo sapiens
uccaggaggcugaggaauu

SEQ ID NO: 408293 - RNA, 19 nt, Homo sapiens
aaaugcauucuggugauua

SEQ ID NO: 408294 - RNA, 19 nt, Homo sapiens
cagacaaccauuuccaagu

SEQ ID NO: 408295 - RNA, 19 nt, Homo sapiens
ugagcuuuaucauaucauc

SEQ ID NO: 408296 - RNA, 19 nt, Homo sapiens
ccuucuaugcugagcuuua

SEQ ID NO: 408297 - RNA, 19 nt, Homo sapiens
gagacucauguaauggauu

SEQ ID NO: 408298 - RNA, 19 nt, Homo sapiens
ccaauaggcugaaauucua

SEQ ID NO: 408299 - RNA, 19 nt, Homo sapiens
ccuaauaucugguggcuuu

SEQ ID NO: 408300 - RNA, 19 nt, Homo sapiens
gaauauugguuucucuuug

SEQ ID NO: 408301 - RNA, 19 nt, Homo sapiens
ugggagaacuggaagaaua

SEQ ID NO: 408302 - RNA, 19 nt, Homo sapiens
gauugauacuguuugcuua

SEQ ID NO: 408303 - RNA, 19 nt, Homo sapiens
ggcaacaagucaaggauaa

SEQ ID NO: 408304 - RNA, 19 nt, Homo sapiens
ggaagaauaacauccauug

SEQ ID NO: 408305 - RNA, 19 nt, Homo sapiens
gaaaguugguacaaaugau

SEQ ID NO: 408306 - RNA, 19 nt, Homo sapiens
ggagcgaaauguucagguu

SEQ ID NO: 408307 - RNA, 19 nt, Homo sapiens
ccaauguccuagagaguuu

SEQ ID NO: 408308 - RNA, 19 nt, Homo sapiens
aggcugaaauucuacuuua

SEQ ID NO: 408309 - RNA, 19 nt, Homo sapiens
gaucuguacuuuaaacuac

SEQ ID NO: 408310 - RNA, 19 nt, Homo sapiens
ggagauggugccacagaua

SEQ ID NO: 408311 - RNA, 19 nt, Homo sapiens
gaaaugugaucaggcaaca

SEQ ID NO: 408312 - RNA, 19 nt, Homo sapiens
uaacauccauugucguaca

SEQ ID NO: 408313 - RNA, 19 nt, Homo sapiens
caccacauccggcuaauuu

SEQ ID NO: 408314 - RNA, 19 nt, Homo sapiens
ucugguggcuuuaggagua

SEQ ID NO: 408315 - RNA, 19 nt, Homo sapiens
uuucaaagcugcucucaca

SEQ ID NO: 408316 - RNA, 19 nt, Homo sapiens
gagaagaaggaaucgauga

SEQ ID NO: 408317 - RNA, 19 nt, Homo sapiens
guacagcuccaaacaacuu

SEQ ID NO: 408318 - RNA, 19 nt, Homo sapiens
ggauaacgccaaaugguau

SEQ ID NO: 408319 - RNA, 19 nt, Homo sapiens
gggagaacuggaagaauaa

SEQ ID NO: 408320 - RNA, 19 nt, Homo sapiens
ccaaaugguauaucacuga

SEQ ID NO: 408321 - RNA, 19 nt, Homo sapiens
ccaaagugcugggauuaca

SEQ ID NO: 408322 - RNA, 19 nt, Homo sapiens
gauaacgccaaaugguaua

SEQ ID NO: 408323 - RNA, 19 nt, Homo sapiens
ggcugaaauucuacuuuaa

SEQ ID NO: 408324 - RNA, 19 nt, Homo sapiens
gagauggugccacagauau

SEQ ID NO: 408325 - RNA, 19 nt, Homo sapiens
gagcgaaauguucagguuu

SEQ ID NO: 408326 - RNA, 19 nt, Homo sapiens
cagaacggauuuguggaaa

SEQ ID NO: 408327 - RNA, 19 nt, Homo sapiens
aauaacauccauugucgua

SEQ ID NO: 408328 - RNA, 19 nt, Homo sapiens
gaagaauaacauccauugu

SEQ ID NO: 408329 - RNA, 19 nt, Homo sapiens
gcacggucaucagagaaga

SEQ ID NO: 408330 - RNA, 19 nt, Homo sapiens
caucagagaagaaggaauc

SEQ ID NO: 408331 - RNA, 19 nt, Homo sapiens
guuccaguauuauaugaug

SEQ ID NO: 408332 - RNA, 19 nt, Homo sapiens
gaacuggaagaauaacauc

SEQ ID NO: 408333 - RNA, 19 nt, Homo sapiens
gccaauaggcugaaauucu

SEQ ID NO: 408334 - RNA, 19 nt, Homo sapiens
ggaguauuguagagcaugu

SEQ ID NO: 408335 - RNA, 19 nt, Homo sapiens
caccuuuacucuuagaaau

SEQ ID NO: 408336 - RNA, 19 nt, Homo sapiens
ucaaggauaacgccaaaug

SEQ ID NO: 408337 - RNA, 19 nt, Homo sapiens
gcaggugcagagacucaua

SEQ ID NO: 408338 - RNA, 19 nt, Homo sapiens
aaacaccuuuacucuuaga

SEQ ID NO: 408339 - RNA, 19 nt, Homo sapiens
ccuauuacaacuugcuaua

SEQ ID NO: 408340 - RNA, 19 nt, Homo sapiens
ugcuuacaguugccuauua

SEQ ID NO: 408341 - RNA, 19 nt, Homo sapiens
ggaaaaggaaaagugauua

SEQ ID NO: 408342 - RNA, 19 nt, Homo sapiens
ucaaagcugcucucacaga

SEQ ID NO: 408343 - RNA, 19 nt, Homo sapiens
gcugaugcuuucauuggau

SEQ ID NO: 408344 - RNA, 19 nt, Homo sapiens
agucaaggauaacgccaaa

SEQ ID NO: 408345 - RNA, 19 nt, Homo sapiens
agaaaguugguacaaauga

SEQ ID NO: 408346 - RNA, 19 nt, Homo sapiens
gcuuacaguugccuauuac

SEQ ID NO: 408347 - RNA, 19 nt, Homo sapiens
ucagaacggauuuguggaa

SEQ ID NO: 408348 - RNA, 19 nt, Homo sapiens
ggacgcggugucagaaaug

SEQ ID NO: 408349 - RNA, 19 nt, Homo sapiens
ggucaucagagaagaagga

SEQ ID NO: 408350 - RNA, 19 nt, Homo sapiens
cuacaggagcgaaauguuc

SEQ ID NO: 408351 - RNA, 19 nt, Homo sapiens
gggagcaggugcagagacu

SEQ ID NO: 408352 - RNA, 19 nt, Homo sapiens
guaguuccaguauuauaug

SEQ ID NO: 408353 - RNA, 19 nt, Homo sapiens
gagcaggugcagagacuca

SEQ ID NO: 408354 - RNA, 19 nt, Homo sapiens
aauauugguuucucuuugg

SEQ ID NO: 408355 - RNA, 19 nt, Homo sapiens
acagcacggucaucagaga

SEQ ID NO: 408356 - RNA, 19 nt, Homo sapiens
agaaggaaucgaugagcua

SEQ ID NO: 408357 - RNA, 19 nt, Homo sapiens
cuacuuuaacggugaauau

SEQ ID NO: 408358 - RNA, 19 nt, Homo sapiens
cccagcaaccaauguauuu

SEQ ID NO: 408359 - RNA, 19 nt, Homo sapiens
gcugguaagucgccuacag

SEQ ID NO: 408360 - RNA, 19 nt, Homo sapiens
gaucaggcaacaagucaag

SEQ ID NO: 408361 - RNA, 19 nt, Homo sapiens
gacgcggugucagaaauga

SEQ ID NO: 408362 - RNA, 19 nt, Homo sapiens
ucucuuugguaugucaaua

SEQ ID NO: 408363 - RNA, 19 nt, Homo sapiens
cagagaagaaggaaucgau

SEQ ID NO: 408364 - RNA, 19 nt, Homo sapiens
aggauaacgccaaauggua

SEQ ID NO: 408365 - RNA, 19 nt, Homo sapiens
ggcauaagggagcugguaa

SEQ ID NO: 408366 - RNA, 19 nt, Homo sapiens
ugaggaagcuuuucuacuc

SEQ ID NO: 408367 - RNA, 19 nt, Homo sapiens
caauaucccagcaaccaau

SEQ ID NO: 408368 - RNA, 19 nt, Homo sapiens
gccaauguccuagagaguu

SEQ ID NO: 408369 - RNA, 19 nt, Homo sapiens
gcgcccagccaauguccua

SEQ ID NO: 408370 - RNA, 19 nt, Homo sapiens
aagaauaacauccauuguc

SEQ ID NO: 408371 - RNA, 19 nt, Homo sapiens
guucagguuuuccuaauau

SEQ ID NO: 408372 - RNA, 19 nt, Homo sapiens
guguggagagucaauuaaa

SEQ ID NO: 408373 - RNA, 19 nt, Homo sapiens
gucuugaucuccugaccuu

SEQ ID NO: 408374 - RNA, 19 nt, Homo sapiens
guggagagucaauuaaaca

SEQ ID NO: 408375 - RNA, 19 nt, Homo sapiens
uagccaggauggucuugau

SEQ ID NO: 408376 - RNA, 19 nt, Homo sapiens
ucgaugagcuagccaaaau

SEQ ID NO: 408377 - RNA, 19 nt, Homo sapiens
uagaaaguugguacaaaug

SEQ ID NO: 408378 - RNA, 19 nt, Homo sapiens
gcugggagaacuggaagaa

SEQ ID NO: 408379 - RNA, 19 nt, Homo sapiens
gcugaaauucuacuuuaac

SEQ ID NO: 408380 - RNA, 19 nt, Homo sapiens
gaggacgcggugucagaaa

SEQ ID NO: 408381 - RNA, 19 nt, Homo sapiens
caaaaucuguggcguugag

SEQ ID NO: 408382 - RNA, 19 nt, Homo sapiens
ugccucagccucccgagua

SEQ ID NO: 408383 - RNA, 19 nt, Homo sapiens
uuacaguugccuauuacaa

SEQ ID NO: 408384 - RNA, 19 nt, Homo sapiens
uccaaacaacuucagauga

SEQ ID NO: 408385 - RNA, 19 nt, Homo sapiens
ucguacagcuccaaacaac

SEQ ID NO: 408386 - RNA, 19 nt, Homo sapiens
gaggaagcuuuucuacuca

SEQ ID NO: 408387 - RNA, 19 nt, Homo sapiens
cugaugcuuucauuggauu

SEQ ID NO: 408388 - RNA, 19 nt, Homo sapiens
uaucccagcaaccaaugua

SEQ ID NO: 408389 - RNA, 19 nt, Homo sapiens
aaguguggagagucaauua

SEQ ID NO: 408390 - RNA, 19 nt, Homo sapiens
ccuuuacucuuagaaauac

SEQ ID NO: 408391 - RNA, 19 nt, Homo sapiens
uugauuuccuggagagguu

SEQ ID NO: 408392 - RNA, 19 nt, Homo sapiens
gagaacuggaagaauaaca

SEQ ID NO: 408393 - RNA, 19 nt, Homo sapiens
gcauaagggagcugguaag

SEQ ID NO: 408394 - RNA, 19 nt, Homo sapiens
caaggauaacgccaaaugg

SEQ ID NO: 408395 - RNA, 19 nt, Homo sapiens
ccaggauggucuugaucuc

SEQ ID NO: 408396 - RNA, 19 nt, Homo sapiens
gugaucaggcaacaaguca

SEQ ID NO: 408397 - RNA, 19 nt, Homo sapiens
cggcauaagggagcuggua

SEQ ID NO: 408398 - RNA, 19 nt, Homo sapiens
gaaccuagauugcaccauu

SEQ ID NO: 408399 - RNA, 19 nt, Homo sapiens
caacgucacucgcugcuuu

SEQ ID NO: 408400 - RNA, 19 nt, Homo sapiens
gcaagaaauucaaugagau

SEQ ID NO: 408401 - RNA, 19 nt, Homo sapiens
gacaugcucuucuugauca

SEQ ID NO: 408402 - RNA, 19 nt, Homo sapiens
gggcaucggucuaaagcuu

SEQ ID NO: 408403 - RNA, 19 nt, Homo sapiens
gaagaagggauaucuacug

SEQ ID NO: 408404 - RNA, 19 nt, Homo sapiens
gcaagcaccucaccgaaaa

SEQ ID NO: 408405 - RNA, 19 nt, Homo sapiens
gggcacuggugggccauua

SEQ ID NO: 408406 - RNA, 19 nt, Homo sapiens
ccacggauacggucacuga

SEQ ID NO: 408407 - RNA, 19 nt, Homo sapiens
ugcaagaaauucaaugaga

SEQ ID NO: 408408 - RNA, 19 nt, Homo sapiens
caacagagcgagauuccau

SEQ ID NO: 408409 - RNA, 19 nt, Homo sapiens
ccuguacccuugcaagaaa

SEQ ID NO: 408410 - RNA, 19 nt, Homo sapiens
ccugagucccuuaaucuua

SEQ ID NO: 408411 - RNA, 19 nt, Homo sapiens
uagcaccaacugugucuua

SEQ ID NO: 408412 - RNA, 19 nt, Homo sapiens
gcaucggucuaaagcuuug

SEQ ID NO: 408413 - RNA, 19 nt, Homo sapiens
gcaagcguggcaucucuuu

SEQ ID NO: 408414 - RNA, 19 nt, Homo sapiens
ggacaugcucuucuugauc

SEQ ID NO: 408415 - RNA, 19 nt, Homo sapiens
aggcagagguugcagugaa

SEQ ID NO: 408416 - RNA, 19 nt, Homo sapiens
gcaggagaaucgcuugaac

SEQ ID NO: 408417 - RNA, 19 nt, Homo sapiens
aagaagggauaucuacugu

SEQ ID NO: 408418 - RNA, 19 nt, Homo sapiens
cacuuuggauugucuacua

SEQ ID NO: 408419 - RNA, 19 nt, Homo sapiens
gucaagagaucgagaccau

SEQ ID NO: 408420 - RNA, 19 nt, Homo sapiens
ccaagaaguuccgcaagca

SEQ ID NO: 408421 - RNA, 19 nt, Homo sapiens
gcuuugagcauuacgagaa

SEQ ID NO: 408422 - RNA, 19 nt, Homo sapiens
cugagucccuuaaucuuau

SEQ ID NO: 408423 - RNA, 19 nt, Homo sapiens
uggauugucuacuaccaaa

SEQ ID NO: 408424 - RNA, 19 nt, Homo sapiens
gcacuggugggccauuaga

SEQ ID NO: 408425 - RNA, 19 nt, Homo sapiens
guaacucggcccaucaaga

SEQ ID NO: 408426 - RNA, 19 nt, Homo sapiens
gcaguaacucggcccauca

SEQ ID NO: 408427 - RNA, 19 nt, Homo sapiens
cauccuggccaacauugua

SEQ ID NO: 408428 - RNA, 19 nt, Homo sapiens
uacacucucuucccgauug

SEQ ID NO: 408429 - RNA, 19 nt, Homo sapiens
gcagugaaccuagauugca

SEQ ID NO: 408430 - RNA, 19 nt, Homo sapiens
gacuuuaaaccaccuaguu

SEQ ID NO: 408431 - RNA, 19 nt, Homo sapiens
aacugugacugaugacuuu

SEQ ID NO: 408432 - RNA, 19 nt, Homo sapiens
ugaagugguugugccauuc

SEQ ID NO: 408433 - RNA, 19 nt, Homo sapiens
gcaccaacugugucuuaga

SEQ ID NO: 408434 - RNA, 19 nt, Homo sapiens
gucacccucugccuccuua

SEQ ID NO: 408435 - RNA, 19 nt, Homo sapiens
acucuagccuggcaacaga

SEQ ID NO: 408436 - RNA, 19 nt, Homo sapiens
uaacugugacugaugacuu

SEQ ID NO: 408437 - RNA, 19 nt, Homo sapiens
gggaagaagggauaucuac

SEQ ID NO: 408438 - RNA, 19 nt, Homo sapiens
cggauacggucacugaagu

SEQ ID NO: 408439 - RNA, 19 nt, Homo sapiens
gcacggucuuggcgguguu

SEQ ID NO: 408440 - RNA, 19 nt, Homo sapiens
ggaaaauccagaacucaaa

SEQ ID NO: 408441 - RNA, 19 nt, Homo sapiens
gaagugguugugccauuca

SEQ ID NO: 408442 - RNA, 19 nt, Homo sapiens
cugaagugguugugccauu

SEQ ID NO: 408443 - RNA, 19 nt, Homo sapiens
ccaaauuccugugcaacgu

SEQ ID NO: 408444 - RNA, 19 nt, Homo sapiens
gcggacaugcucuucuuga

SEQ ID NO: 408445 - RNA, 19 nt, Homo sapiens
ccuguaaucccagcacuuu

SEQ ID NO: 408446 - RNA, 19 nt, Homo sapiens
uauccugagucccuuaauc

SEQ ID NO: 408447 - RNA, 19 nt, Homo sapiens
caaauuccaccaggccauu

SEQ ID NO: 408448 - RNA, 19 nt, Homo sapiens
ggaagaagggauaucuacu

SEQ ID NO: 408449 - RNA, 19 nt, Homo sapiens
guuuacagcaucaucuuug

SEQ ID NO: 408450 - RNA, 19 nt, Homo sapiens
ccucccacauggacucuga

SEQ ID NO: 408451 - RNA, 19 nt, Homo sapiens
gcaauggagccacaugacu

SEQ ID NO: 408452 - RNA, 19 nt, Homo sapiens
uggcggacaugcucuucuu

SEQ ID NO: 408453 - RNA, 19 nt, Homo sapiens
caacacagugcccgacagu

SEQ ID NO: 408454 - RNA, 19 nt, Homo sapiens
ugaucacccugccacuuug

SEQ ID NO: 408455 - RNA, 19 nt, Homo sapiens
cagcaauggagccacauga

SEQ ID NO: 408456 - RNA, 19 nt, Homo sapiens
uaacucggcccaucaagac

SEQ ID NO: 408457 - RNA, 19 nt, Homo sapiens
aaauccagaacucaaauga

SEQ ID NO: 408458 - RNA, 19 nt, Homo sapiens
caccaggccauuaaugaug

SEQ ID NO: 408459 - RNA, 19 nt, Homo sapiens
gaccauccuggccaacauu

SEQ ID NO: 408460 - RNA, 19 nt, Homo sapiens
acuguuuccucaccaagaa

SEQ ID NO: 408461 - RNA, 19 nt, Homo sapiens
ccaccaggccauuaaugau

SEQ ID NO: 408462 - RNA, 19 nt, Homo sapiens
ccacaucuucaucguguuc

SEQ ID NO: 408463 - RNA, 19 nt, Homo sapiens
gaaaauccagaacucaaau

SEQ ID NO: 408464 - RNA, 19 nt, Homo sapiens
ggccauuaaugaugcacau

SEQ ID NO: 408465 - RNA, 19 nt, Homo sapiens
ccgcaagcguggcaucucu

SEQ ID NO: 408466 - RNA, 19 nt, Homo sapiens
uugaucacccugccacuuu

SEQ ID NO: 408467 - RNA, 19 nt, Homo sapiens
cggacaugcucuucuugau

SEQ ID NO: 408468 - RNA, 19 nt, Homo sapiens
aaccuagauugcaccauug

SEQ ID NO: 408469 - RNA, 19 nt, Homo sapiens
uaaaaccccaucucuacua

SEQ ID NO: 408470 - RNA, 19 nt, Homo sapiens
gggcagaucaugggucaag

SEQ ID NO: 408471 - RNA, 19 nt, Homo sapiens
ugggcgucaucacuuauaa

SEQ ID NO: 408472 - RNA, 19 nt, Homo sapiens
uccugggcgucaucacuua

SEQ ID NO: 408473 - RNA, 19 nt, Homo sapiens
gcaguggcucacaccugua

SEQ ID NO: 408474 - RNA, 19 nt, Homo sapiens
cuggugggccauuagauuu

SEQ ID NO: 408475 - RNA, 19 nt, Homo sapiens
cgcaagcaccucaccgaaa

SEQ ID NO: 408476 - RNA, 19 nt, Homo sapiens
ucaucuggguggccauugu

SEQ ID NO: 408477 - RNA, 19 nt, Homo sapiens
gcagaucaugggucaagag

SEQ ID NO: 408478 - RNA, 19 nt, Homo sapiens
caguggcucacaccuguaa

SEQ ID NO: 408479 - RNA, 19 nt, Homo sapiens
acccuguuaucuacuguuu

SEQ ID NO: 408480 - RNA, 19 nt, Homo sapiens
aaaaccccaucucuacuaa

SEQ ID NO: 408481 - RNA, 19 nt, Homo sapiens
ggcaucggucuaaagcuuu

SEQ ID NO: 408482 - RNA, 19 nt, Homo sapiens
ccgauuguuuacagcauca

SEQ ID NO: 408483 - RNA, 19 nt, Homo sapiens
gggcuuccaggacagcaaa

SEQ ID NO: 408484 - RNA, 19 nt, Homo sapiens
caucauccacaucuucauc

SEQ ID NO: 408485 - RNA, 19 nt, Homo sapiens
aagcguggcaucucuuugu

SEQ ID NO: 408486 - RNA, 19 nt, Homo sapiens
ggcagagguugcagugaac

SEQ ID NO: 408487 - RNA, 19 nt, Homo sapiens
cagaucaugggucaagaga

SEQ ID NO: 408488 - RNA, 19 nt, Homo sapiens
gaagacuuuaaaccaccua

SEQ ID NO: 408489 - RNA, 19 nt, Homo sapiens
gcaccucaccgaaaaguuc

SEQ ID NO: 408490 - RNA, 19 nt, Homo sapiens
uuccuggucuuccucauca

SEQ ID NO: 408491 - RNA, 19 nt, Homo sapiens
gaaaucaguuuaccuguuu

SEQ ID NO: 408492 - RNA, 19 nt, Homo sapiens
gaauaaaucuucuguaucc

SEQ ID NO: 408493 - RNA, 19 nt, Homo sapiens
gcaagaugauacaauggua

SEQ ID NO: 408494 - RNA, 19 nt, Homo sapiens
gaaaugacagcaagaaguu

SEQ ID NO: 408495 - RNA, 19 nt, Homo sapiens
ggcaggaaauucuguauug

SEQ ID NO: 408496 - RNA, 19 nt, Homo sapiens
aaacuuccuugugguauua

SEQ ID NO: 408497 - RNA, 19 nt, Homo sapiens
guaccuggacuucgaauaa

SEQ ID NO: 408498 - RNA, 19 nt, Homo sapiens
ggaccaaagucucauuucu

SEQ ID NO: 408499 - RNA, 19 nt, Homo sapiens
guaacaaggguguaaauau

SEQ ID NO: 408500 - RNA, 19 nt, Homo sapiens
ggcgacaacuuccaucauu

SEQ ID NO: 408501 - RNA, 19 nt, Homo sapiens
ggacuucgaauaaaucuuc

SEQ ID NO: 408502 - RNA, 19 nt, Homo sapiens
ggaaaugacagcaagaagu

SEQ ID NO: 408503 - RNA, 19 nt, Homo sapiens
uaaacuuccuugugguauu

SEQ ID NO: 408504 - RNA, 19 nt, Homo sapiens
gaacuuccagaacauauuc

SEQ ID NO: 408505 - RNA, 19 nt, Homo sapiens
agaaaucaguuuaccuguu

SEQ ID NO: 408506 - RNA, 19 nt, Homo sapiens
gcacaguguugaagaucau

SEQ ID NO: 408507 - RNA, 19 nt, Homo sapiens
gaccuuagcagaccagaga

SEQ ID NO: 408508 - RNA, 19 nt, Homo sapiens
caaagucucauuucugugu

SEQ ID NO: 408509 - RNA, 19 nt, Homo sapiens
cuagcaauauuuccaguug

SEQ ID NO: 408510 - RNA, 19 nt, Homo sapiens
ucaaaggauucaaguucuu

SEQ ID NO: 408511 - RNA, 19 nt, Homo sapiens
ccaagaacuuccagaacau

SEQ ID NO: 408512 - RNA, 19 nt, Homo sapiens
gcaucacgcucucgaagca

SEQ ID NO: 408513 - RNA, 19 nt, Homo sapiens
gcaauuccaggcucaguau

SEQ ID NO: 408514 - RNA, 19 nt, Homo sapiens
gaaggagaacgcccuagug

SEQ ID NO: 408515 - RNA, 19 nt, Homo sapiens
gguaugaguguaaucuaaa

SEQ ID NO: 408516 - RNA, 19 nt, Homo sapiens
caagaacuuccagaacaua

SEQ ID NO: 408517 - RNA, 19 nt, Homo sapiens
uccaagaacuuccagaaca

SEQ ID NO: 408518 - RNA, 19 nt, Homo sapiens
gagaaacuccucccuuguc

SEQ ID NO: 408519 - RNA, 19 nt, Homo sapiens
ugguaugaguguaaucuaa

SEQ ID NO: 408520 - RNA, 19 nt, Homo sapiens
gcgacaacuuccaucauuc

SEQ ID NO: 408521 - RNA, 19 nt, Homo sapiens
auagcaagaugauacaaug

SEQ ID NO: 408522 - RNA, 19 nt, Homo sapiens
ccagaaggaccgcaagaug

SEQ ID NO: 408523 - RNA, 19 nt, Homo sapiens
cgucaaaggauucaaguuc

SEQ ID NO: 408524 - RNA, 19 nt, Homo sapiens
caaguucggcacaguguug

SEQ ID NO: 408525 - RNA, 19 nt, Homo sapiens
gaccaaagucucauuucug

SEQ ID NO: 408526 - RNA, 19 nt, Homo sapiens
aagauccuguucaauaaga

SEQ ID NO: 408527 - RNA, 19 nt, Homo sapiens
caacgucaaguacaacaau

SEQ ID NO: 408528 - RNA, 19 nt, Homo sapiens
gcagcaaacggaaaugaca

SEQ ID NO: 408529 - RNA, 19 nt, Homo sapiens
uaccuggacuucgaauaaa

SEQ ID NO: 408530 - RNA, 19 nt, Homo sapiens
gaaacuccucccuugucua

SEQ ID NO: 408531 - RNA, 19 nt, Homo sapiens
ugaguguaaucuaaacuuc

SEQ ID NO: 408532 - RNA, 19 nt, Homo sapiens
gaagauccuguucaauaag

SEQ ID NO: 408533 - RNA, 19 nt, Homo sapiens
accaaagucucauuucugu

SEQ ID NO: 408534 - RNA, 19 nt, Homo sapiens
caccugcagucgccuagaa

SEQ ID NO: 408535 - RNA, 19 nt, Homo sapiens
ucauugaccugcacaacca

SEQ ID NO: 408536 - RNA, 19 nt, Homo sapiens
gcggagagaaccgauuaaa

SEQ ID NO: 408537 - RNA, 19 nt, Homo sapiens
ccagauauagccguuggua

SEQ ID NO: 408538 - RNA, 19 nt, Homo sapiens
uagcaauauuuccaguuga

SEQ ID NO: 408539 - RNA, 19 nt, Homo sapiens
gucaaaggauucaaguucu

SEQ ID NO: 408540 - RNA, 19 nt, Homo sapiens
gcaggaaauucuguauugc

SEQ ID NO: 408541 - RNA, 19 nt, Homo sapiens
ggagagaaccgauuaaaac

SEQ ID NO: 408542 - RNA, 19 nt, Homo sapiens
gcuccaagaacuuccagaa

SEQ ID NO: 408543 - RNA, 19 nt, Homo sapiens
gggcaggaaauucuguauu

SEQ ID NO: 408544 - RNA, 19 nt, Homo sapiens
gauauagccguugguacaa

SEQ ID NO: 408545 - RNA, 19 nt, Homo sapiens
uagaaaacuugcucucaaa

SEQ ID NO: 408546 - RNA, 19 nt, Homo sapiens
agacgucugugccuagcaa

SEQ ID NO: 408547 - RNA, 19 nt, Homo sapiens
ucaaguacaacaaugacaa

SEQ ID NO: 408548 - RNA, 19 nt, Homo sapiens
ucaccagccucaacgucaa

SEQ ID NO: 408549 - RNA, 19 nt, Homo sapiens
cgaauaaaucuucuguauc

SEQ ID NO: 408550 - RNA, 19 nt, Homo sapiens
caaggacuacggcaacuca

SEQ ID NO: 408551 - RNA, 19 nt, Homo sapiens
caaccucaacccagagaga

SEQ ID NO: 408552 - RNA, 19 nt, Homo sapiens
ucaccaagaacaaccaguu

SEQ ID NO: 408553 - RNA, 19 nt, Homo sapiens
ucacgugauucucccuuca

SEQ ID NO: 408554 - RNA, 19 nt, Homo sapiens
guacaaagcggggaucuga

SEQ ID NO: 408555 - RNA, 19 nt, Homo sapiens
agauauagccguugguaca

SEQ ID NO: 408556 - RNA, 19 nt, Homo sapiens
ggcacaguguugaagauca

SEQ ID NO: 408557 - RNA, 19 nt, Homo sapiens
cugcggagcuggucgacau

SEQ ID NO: 408558 - RNA, 19 nt, Homo sapiens
aaucucagccucuccguau

SEQ ID NO: 408559 - RNA, 19 nt, Homo sapiens
uguugaagaucaucaccuu

SEQ ID NO: 408560 - RNA, 19 nt, Homo sapiens
ucaccaaccuccugaugcu

SEQ ID NO: 408561 - RNA, 19 nt, Homo sapiens
aaacuccucccuugucuag

SEQ ID NO: 408562 - RNA, 19 nt, Homo sapiens
uguaacaaggguguaaaua

SEQ ID NO: 408563 - RNA, 19 nt, Homo sapiens
ccuuguaugcuguuacuuu

SEQ ID NO: 408564 - RNA, 19 nt, Homo sapiens
guaugaguguaaucuaaac

SEQ ID NO: 408565 - RNA, 19 nt, Homo sapiens
ggagcuggucgacauaauc

SEQ ID NO: 408566 - RNA, 19 nt, Homo sapiens
ucaggaucaucguggagaa

SEQ ID NO: 408567 - RNA, 19 nt, Homo sapiens
aaacuugcucucaaacuuc

SEQ ID NO: 408568 - RNA, 19 nt, Homo sapiens
cuagaaaacuugcucucaa

SEQ ID NO: 408569 - RNA, 19 nt, Homo sapiens
gagcuggucgacauaaucu

SEQ ID NO: 408570 - RNA, 19 nt, Homo sapiens
cagcugaagugaccuuagc

SEQ ID NO: 408571 - RNA, 19 nt, Homo sapiens
ggaucucaagguccuguuu

SEQ ID NO: 408572 - RNA, 19 nt, Homo sapiens
agaaacuccucccuugucu

SEQ ID NO: 408573 - RNA, 19 nt, Homo sapiens
acgcggagagaaccgauua

SEQ ID NO: 408574 - RNA, 19 nt, Homo sapiens
ucuaaacuuccuuguggua

SEQ ID NO: 408575 - RNA, 19 nt, Homo sapiens
caaaggauucaaguucuuc

SEQ ID NO: 408576 - RNA, 19 nt, Homo sapiens
ugguuucccucccaccuuu

SEQ ID NO: 408577 - RNA, 19 nt, Homo sapiens
aaaacuugcucucaaacuu

SEQ ID NO: 408578 - RNA, 19 nt, Homo sapiens
acaaugguaugaguguaau

SEQ ID NO: 408579 - RNA, 19 nt, Homo sapiens
cggugcaccugguauaauc

SEQ ID NO: 408580 - RNA, 19 nt, Homo sapiens
ccaaccuccugaugcugaa

SEQ ID NO: 408581 - RNA, 19 nt, Homo sapiens
uauggugacacaaauguau

SEQ ID NO: 408582 - RNA, 19 nt, Homo sapiens
gagcuuuucucuacuugug

SEQ ID NO: 408583 - RNA, 19 nt, Homo sapiens
agauggcacugauccagau

SEQ ID NO: 408584 - RNA, 19 nt, Homo sapiens
ggucaccaaccuccugaug

SEQ ID NO: 408585 - RNA, 19 nt, Homo sapiens
gcacgcugcgcaucgacuu

SEQ ID NO: 408586 - RNA, 19 nt, Homo sapiens
gcagguuggccagucugua

SEQ ID NO: 408587 - RNA, 19 nt, Homo sapiens
uagcagaccagagauuuua

SEQ ID NO: 408588 - RNA, 19 nt, Homo sapiens
gccucaacgucaaguacaa

SEQ ID NO: 408589 - RNA, 19 nt, Homo sapiens
ucacaggcaggacccaguu

SEQ ID NO: 408590 - RNA, 19 nt, Homo sapiens
caaacggaaaugacagcaa

SEQ ID NO: 408591 - RNA, 19 nt, Homo sapiens
gaaaucaguuuaccuguuu

SEQ ID NO: 408592 - RNA, 19 nt, Homo sapiens
gaauaaaucuucuguaucc

SEQ ID NO: 408593 - RNA, 19 nt, Homo sapiens
gcaagaugauacaauggua

SEQ ID NO: 408594 - RNA, 19 nt, Homo sapiens
gaaaugacagcaagaaguu

SEQ ID NO: 408595 - RNA, 19 nt, Homo sapiens
ggcaggaaauucuguauug

SEQ ID NO: 408596 - RNA, 19 nt, Homo sapiens
aaacuuccuugugguauua

SEQ ID NO: 408597 - RNA, 19 nt, Homo sapiens
guaccuggacuucgaauaa

SEQ ID NO: 408598 - RNA, 19 nt, Homo sapiens
ggaccaaagucucauuucu

SEQ ID NO: 408599 - RNA, 19 nt, Homo sapiens
guaacaaggguguaaauau

SEQ ID NO: 408600 - RNA, 19 nt, Homo sapiens
ggcgacaacuuccaucauu

SEQ ID NO: 408601 - RNA, 19 nt, Homo sapiens
ggacuucgaauaaaucuuc

SEQ ID NO: 408602 - RNA, 19 nt, Homo sapiens
ggaaaugacagcaagaagu

SEQ ID NO: 408603 - RNA, 19 nt, Homo sapiens
uaaacuuccuugugguauu

SEQ ID NO: 408604 - RNA, 19 nt, Homo sapiens
gaacuuccagaacauauuc

SEQ ID NO: 408605 - RNA, 19 nt, Homo sapiens
agaaaucaguuuaccuguu

SEQ ID NO: 408606 - RNA, 19 nt, Homo sapiens
gcacaguguugaagaucau

SEQ ID NO: 408607 - RNA, 19 nt, Homo sapiens
gaccuuagcagaccagaga

SEQ ID NO: 408608 - RNA, 19 nt, Homo sapiens
caaagucucauuucugugu

SEQ ID NO: 408609 - RNA, 19 nt, Homo sapiens
cuagcaauauuuccaguug

SEQ ID NO: 408610 - RNA, 19 nt, Homo sapiens
ucaaaggauucaaguucuu

SEQ ID NO: 408611 - RNA, 19 nt, Homo sapiens
ccaagaacuuccagaacau

SEQ ID NO: 408612 - RNA, 19 nt, Homo sapiens
gcaucacgcucucgaagca

SEQ ID NO: 408613 - RNA, 19 nt, Homo sapiens
gcaauuccaggcucaguau

SEQ ID NO: 408614 - RNA, 19 nt, Homo sapiens
gaaggagaacgcccuagug

SEQ ID NO: 408615 - RNA, 19 nt, Homo sapiens
gguaugaguguaaucuaaa

SEQ ID NO: 408616 - RNA, 19 nt, Homo sapiens
caagaacuuccagaacaua

SEQ ID NO: 408617 - RNA, 19 nt, Homo sapiens
uccaagaacuuccagaaca

SEQ ID NO: 408618 - RNA, 19 nt, Homo sapiens
gagaaacuccucccuuguc

SEQ ID NO: 408619 - RNA, 19 nt, Homo sapiens
ugguaugaguguaaucuaa

SEQ ID NO: 408620 - RNA, 19 nt, Homo sapiens
gcgacaacuuccaucauuc

SEQ ID NO: 408621 - RNA, 19 nt, Homo sapiens
auagcaagaugauacaaug

SEQ ID NO: 408622 - RNA, 19 nt, Homo sapiens
ccagaaggaccgcaagaug

SEQ ID NO: 408623 - RNA, 19 nt, Homo sapiens
cgucaaaggauucaaguuc

SEQ ID NO: 408624 - RNA, 19 nt, Homo sapiens
caaguucggcacaguguug

SEQ ID NO: 408625 - RNA, 19 nt, Homo sapiens
gaccaaagucucauuucug

SEQ ID NO: 408626 - RNA, 19 nt, Homo sapiens
aagauccuguucaauaaga

SEQ ID NO: 408627 - RNA, 19 nt, Homo sapiens
caacgucaaguacaacaau

SEQ ID NO: 408628 - RNA, 19 nt, Homo sapiens
gcagcaaacggaaaugaca

SEQ ID NO: 408629 - RNA, 19 nt, Homo sapiens
uaccuggacuucgaauaaa

SEQ ID NO: 408630 - RNA, 19 nt, Homo sapiens
gaaacuccucccuugucua

SEQ ID NO: 408631 - RNA, 19 nt, Homo sapiens
ugaguguaaucuaaacuuc

SEQ ID NO: 408632 - RNA, 19 nt, Homo sapiens
gaagauccuguucaauaag

SEQ ID NO: 408633 - RNA, 19 nt, Homo sapiens
accaaagucucauuucugu

SEQ ID NO: 408634 - RNA, 19 nt, Homo sapiens
caccugcagucgccuagaa

SEQ ID NO: 408635 - RNA, 19 nt, Homo sapiens
ucauugaccugcacaacca

SEQ ID NO: 408636 - RNA, 19 nt, Homo sapiens
gcggagagaaccgauuaaa

SEQ ID NO: 408637 - RNA, 19 nt, Homo sapiens
ccagauauagccguuggua

SEQ ID NO: 408638 - RNA, 19 nt, Homo sapiens
uagcaauauuuccaguuga

SEQ ID NO: 408639 - RNA, 19 nt, Homo sapiens
gucaaaggauucaaguucu

SEQ ID NO: 408640 - RNA, 19 nt, Homo sapiens
gcaggaaauucuguauugc

SEQ ID NO: 408641 - RNA, 19 nt, Homo sapiens
ggagagaaccgauuaaaac

SEQ ID NO: 408642 - RNA, 19 nt, Homo sapiens
gcuccaagaacuuccagaa

SEQ ID NO: 408643 - RNA, 19 nt, Homo sapiens
gggcaggaaauucuguauu

SEQ ID NO: 408644 - RNA, 19 nt, Homo sapiens
gauauagccguugguacaa

SEQ ID NO: 408645 - RNA, 19 nt, Homo sapiens
uagaaaacuugcucucaaa

SEQ ID NO: 408646 - RNA, 19 nt, Homo sapiens
agacgucugugccuagcaa

SEQ ID NO: 408647 - RNA, 19 nt, Homo sapiens
ucaaguacaacaaugacaa

SEQ ID NO: 408648 - RNA, 19 nt, Homo sapiens
ucaccagccucaacgucaa

SEQ ID NO: 408649 - RNA, 19 nt, Homo sapiens
cgaauaaaucuucuguauc

SEQ ID NO: 408650 - RNA, 19 nt, Homo sapiens
caaggacuacggcaacuca

SEQ ID NO: 408651 - RNA, 19 nt, Homo sapiens
caaccucaacccagagaga

SEQ ID NO: 408652 - RNA, 19 nt, Homo sapiens
ucaccaagaacaaccaguu

SEQ ID NO: 408653 - RNA, 19 nt, Homo sapiens
ucacgugauucucccuuca

SEQ ID NO: 408654 - RNA, 19 nt, Homo sapiens
guacaaagcggggaucuga

SEQ ID NO: 408655 - RNA, 19 nt, Homo sapiens
agauauagccguugguaca

SEQ ID NO: 408656 - RNA, 19 nt, Homo sapiens
ggccuucgccucuccguau

SEQ ID NO: 408657 - RNA, 19 nt, Homo sapiens
ggcacaguguugaagauca

SEQ ID NO: 408658 - RNA, 19 nt, Homo sapiens
cugcggagcuggucgacau

SEQ ID NO: 408659 - RNA, 19 nt, Homo sapiens
uguugaagaucaucaccuu

SEQ ID NO: 408660 - RNA, 19 nt, Homo sapiens
ucaccaaccuccugaugcu

SEQ ID NO: 408661 - RNA, 19 nt, Homo sapiens
aaacuccucccuugucuag

SEQ ID NO: 408662 - RNA, 19 nt, Homo sapiens
uguaacaaggguguaaaua

SEQ ID NO: 408663 - RNA, 19 nt, Homo sapiens
ccuuguaugcuguuacuuu

SEQ ID NO: 408664 - RNA, 19 nt, Homo sapiens
guaugaguguaaucuaaac

SEQ ID NO: 408665 - RNA, 19 nt, Homo sapiens
ggagcuggucgacauaauc

SEQ ID NO: 408666 - RNA, 19 nt, Homo sapiens
ucaggaucaucguggagaa

SEQ ID NO: 408667 - RNA, 19 nt, Homo sapiens
aaacuugcucucaaacuuc

SEQ ID NO: 408668 - RNA, 19 nt, Homo sapiens
cuagaaaacuugcucucaa

SEQ ID NO: 408669 - RNA, 19 nt, Homo sapiens
gagcuggucgacauaaucu

SEQ ID NO: 408670 - RNA, 19 nt, Homo sapiens
cagcugaagugaccuuagc

SEQ ID NO: 408671 - RNA, 19 nt, Homo sapiens
ggaucucaagguccuguuu

SEQ ID NO: 408672 - RNA, 19 nt, Homo sapiens
agaaacuccucccuugucu

SEQ ID NO: 408673 - RNA, 19 nt, Homo sapiens
acgcggagagaaccgauua

SEQ ID NO: 408674 - RNA, 19 nt, Homo sapiens
ucuaaacuuccuuguggua

SEQ ID NO: 408675 - RNA, 19 nt, Homo sapiens
caaaggauucaaguucuuc

SEQ ID NO: 408676 - RNA, 19 nt, Homo sapiens
ugguuucccucccaccuuu

SEQ ID NO: 408677 - RNA, 19 nt, Homo sapiens
aaaacuugcucucaaacuu

SEQ ID NO: 408678 - RNA, 19 nt, Homo sapiens
acaaugguaugaguguaau

SEQ ID NO: 408679 - RNA, 19 nt, Homo sapiens
ccaaccuccugaugcugaa

SEQ ID NO: 408680 - RNA, 19 nt, Homo sapiens
uauggugacacaaauguau

SEQ ID NO: 408681 - RNA, 19 nt, Homo sapiens
gagcuuuucucuacuugug

SEQ ID NO: 408682 - RNA, 19 nt, Homo sapiens
agauggcacugauccagau

SEQ ID NO: 408683 - RNA, 19 nt, Homo sapiens
ggucaccaaccuccugaug

SEQ ID NO: 408684 - RNA, 19 nt, Homo sapiens
gcacgcugcgcaucgacuu

SEQ ID NO: 408685 - RNA, 19 nt, Homo sapiens
gcagguuggccagucugua

SEQ ID NO: 408686 - RNA, 19 nt, Homo sapiens
uagcagaccagagauuuua

SEQ ID NO: 408687 - RNA, 19 nt, Homo sapiens
gccucaacgucaaguacaa

SEQ ID NO: 408688 - RNA, 19 nt, Homo sapiens
ucacaggcaggacccaguu

SEQ ID NO: 408689 - RNA, 19 nt, Homo sapiens
caaacggaaaugacagcaa

SEQ ID NO: 408690 - RNA, 19 nt, Homo sapiens
aaagucucauuucuguguu

SEQ ID NO: 408691 - RNA, 19 nt, Homo sapiens
gaaaucaguuuaccuguuu

SEQ ID NO: 408692 - RNA, 19 nt, Homo sapiens
gaauaaaucuuccguaucc

SEQ ID NO: 408693 - RNA, 19 nt, Homo sapiens
gcaagaugauacaauggua

SEQ ID NO: 408694 - RNA, 19 nt, Homo sapiens
gaaaugacagcaagaaguu

SEQ ID NO: 408695 - RNA, 19 nt, Homo sapiens
ggcaggaaauucuguauug

SEQ ID NO: 408696 - RNA, 19 nt, Homo sapiens
aaacuuccuugugguauua

SEQ ID NO: 408697 - RNA, 19 nt, Homo sapiens
guaccuggacuucgaauaa

SEQ ID NO: 408698 - RNA, 19 nt, Homo sapiens
ggaccaaagucucauuucu

SEQ ID NO: 408699 - RNA, 19 nt, Homo sapiens
guaacaaggguguaaauau

SEQ ID NO: 408700 - RNA, 19 nt, Homo sapiens
ggcgacaacuuccaucauu

SEQ ID NO: 408701 - RNA, 19 nt, Homo sapiens
ggacuucgaauaaaucuuc

SEQ ID NO: 408702 - RNA, 19 nt, Homo sapiens
ucgaauaaaucuuccguau

SEQ ID NO: 408703 - RNA, 19 nt, Homo sapiens
ggaaaugacagcaagaagu

SEQ ID NO: 408704 - RNA, 19 nt, Homo sapiens
uaaacuuccuugugguauu

SEQ ID NO: 408705 - RNA, 19 nt, Homo sapiens
gaacuuccagaacauauuc

SEQ ID NO: 408706 - RNA, 19 nt, Homo sapiens
agaaaucaguuuaccuguu

SEQ ID NO: 408707 - RNA, 19 nt, Homo sapiens
gcacaguguugaagaucau

SEQ ID NO: 408708 - RNA, 19 nt, Homo sapiens
caaagucucauuucugugu

SEQ ID NO: 408709 - RNA, 19 nt, Homo sapiens
cuagcaauauuuccaguug

SEQ ID NO: 408710 - RNA, 19 nt, Homo sapiens
ucaaaggauucaaguucuu

SEQ ID NO: 408711 - RNA, 19 nt, Homo sapiens
ccaagaacuuccagaacau

SEQ ID NO: 408712 - RNA, 19 nt, Homo sapiens
gcaucacgcucucgaagca

SEQ ID NO: 408713 - RNA, 19 nt, Homo sapiens
gcaauuccaggcucaguau

SEQ ID NO: 408714 - RNA, 19 nt, Homo sapiens
gaaggagaacgcccuagug

SEQ ID NO: 408715 - RNA, 19 nt, Homo sapiens
gguaugaguguaaucuaaa

SEQ ID NO: 408716 - RNA, 19 nt, Homo sapiens
cagcugaagugaccuagca

SEQ ID NO: 408717 - RNA, 19 nt, Homo sapiens
caagaacuuccagaacaua

SEQ ID NO: 408718 - RNA, 19 nt, Homo sapiens
uccaagaacuuccagaaca

SEQ ID NO: 408719 - RNA, 19 nt, Homo sapiens
gagaaacuccucccuuguc

SEQ ID NO: 408720 - RNA, 19 nt, Homo sapiens
ugguaugaguguaaucuaa

SEQ ID NO: 408721 - RNA, 19 nt, Homo sapiens
gcgacaacuuccaucauuc

SEQ ID NO: 408722 - RNA, 19 nt, Homo sapiens
auagcaagaugauacaaug

SEQ ID NO: 408723 - RNA, 19 nt, Homo sapiens
ccagaaggaccgcaagaug

SEQ ID NO: 408724 - RNA, 19 nt, Homo sapiens
cgucaaaggauucaaguuc

SEQ ID NO: 408725 - RNA, 19 nt, Homo sapiens
caaguucggcacaguguug

SEQ ID NO: 408726 - RNA, 19 nt, Homo sapiens
gaccaaagucucauuucug

SEQ ID NO: 408727 - RNA, 19 nt, Homo sapiens
ugaccuagcagaccagaga

SEQ ID NO: 408728 - RNA, 19 nt, Homo sapiens
aagauccuguucaauaaga

SEQ ID NO: 408729 - RNA, 19 nt, Homo sapiens
caacgucaaguacaacaau

SEQ ID NO: 408730 - RNA, 19 nt, Homo sapiens
gcagcaaacggaaaugaca

SEQ ID NO: 408731 - RNA, 19 nt, Homo sapiens
uaccuggacuucgaauaaa

SEQ ID NO: 408732 - RNA, 19 nt, Homo sapiens
gaaacuccucccuugucua

SEQ ID NO: 408733 - RNA, 19 nt, Homo sapiens
ugaguguaaucuaaacuuc

SEQ ID NO: 408734 - RNA, 19 nt, Homo sapiens
gaagauccuguucaauaag

SEQ ID NO: 408735 - RNA, 19 nt, Homo sapiens
accaaagucucauuucugu

SEQ ID NO: 408736 - RNA, 19 nt, Homo sapiens
caccugcagucgccuagaa

SEQ ID NO: 408737 - RNA, 19 nt, Homo sapiens
ucauugaccugcacaacca

SEQ ID NO: 408738 - RNA, 19 nt, Homo sapiens
gcggagagaaccgauuaaa

SEQ ID NO: 408739 - RNA, 19 nt, Homo sapiens
ccagauauagccguuggua

SEQ ID NO: 408740 - RNA, 19 nt, Homo sapiens
uagcaauauuuccaguuga

SEQ ID NO: 408741 - RNA, 19 nt, Homo sapiens
gucaaaggauucaaguucu

SEQ ID NO: 408742 - RNA, 19 nt, Homo sapiens
gcaggaaauucuguauugc

SEQ ID NO: 408743 - RNA, 19 nt, Homo sapiens
ggagagaaccgauuaaaac

SEQ ID NO: 408744 - RNA, 19 nt, Homo sapiens
gcuccaagaacuuccagaa

SEQ ID NO: 408745 - RNA, 19 nt, Homo sapiens
gggcaggaaauucuguauu

SEQ ID NO: 408746 - RNA, 19 nt, Homo sapiens
gauauagccguugguacaa

SEQ ID NO: 408747 - RNA, 19 nt, Homo sapiens
uagaaaacuugcucucaaa

SEQ ID NO: 408748 - RNA, 19 nt, Homo sapiens
agacgucugugccuagcaa

SEQ ID NO: 408749 - RNA, 19 nt, Homo sapiens
ucaaguacaacaaugacaa

SEQ ID NO: 408750 - RNA, 19 nt, Homo sapiens
ucaccagccucaacgucaa

SEQ ID NO: 408751 - RNA, 19 nt, Homo sapiens
caaggacuacggcaacuca

SEQ ID NO: 408752 - RNA, 19 nt, Homo sapiens
caaccucaacccagagaga

SEQ ID NO: 408753 - RNA, 19 nt, Homo sapiens
ucaccaagaacaaccaguu

SEQ ID NO: 408754 - RNA, 19 nt, Homo sapiens
ucacgugauucucccuuca

SEQ ID NO: 408755 - RNA, 19 nt, Homo sapiens
agauauagccguugguaca

SEQ ID NO: 408756 - RNA, 19 nt, Homo sapiens
guacaaagcggggaucuga

SEQ ID NO: 408757 - RNA, 19 nt, Homo sapiens
ggcacaguguugaagauca

SEQ ID NO: 408758 - RNA, 19 nt, Homo sapiens
cugcggagcuggucgacau

SEQ ID NO: 408759 - RNA, 19 nt, Homo sapiens
uguugaagaucaucaccuu

SEQ ID NO: 408760 - RNA, 19 nt, Homo sapiens
ucaccaaccuccugaugcu

SEQ ID NO: 408761 - RNA, 19 nt, Homo sapiens
cgaauaaaucuuccguauc

SEQ ID NO: 408762 - RNA, 19 nt, Homo sapiens
aaacuccucccuugucuag

SEQ ID NO: 408763 - RNA, 19 nt, Homo sapiens
uguaacaaggguguaaaua

SEQ ID NO: 408764 - RNA, 19 nt, Homo sapiens
ccuuguaugcuguuacuuu

SEQ ID NO: 408765 - RNA, 19 nt, Homo sapiens
guaugaguguaaucuaaac

SEQ ID NO: 408766 - RNA, 19 nt, Homo sapiens
ggagcuggucgacauaauc

SEQ ID NO: 408767 - RNA, 19 nt, Homo sapiens
ucaggaucaucguggagaa

SEQ ID NO: 408768 - RNA, 19 nt, Homo sapiens
aaacuugcucucaaacuuc

SEQ ID NO: 408769 - RNA, 19 nt, Homo sapiens
cuagaaaacuugcucucaa

SEQ ID NO: 408770 - RNA, 19 nt, Homo sapiens
gagcuggucgacauaaucu

SEQ ID NO: 408771 - RNA, 19 nt, Homo sapiens
ggaucucaagguccuguuu

SEQ ID NO: 408772 - RNA, 19 nt, Homo sapiens
agaaacuccucccuugucu

SEQ ID NO: 408773 - RNA, 19 nt, Homo sapiens
acgcggagagaaccgauua

SEQ ID NO: 408774 - RNA, 19 nt, Homo sapiens
ucuaaacuuccuuguggua

SEQ ID NO: 408775 - RNA, 19 nt, Homo sapiens
aaacagcugaagugaccua

SEQ ID NO: 408776 - RNA, 19 nt, Homo sapiens
caaaggauucaaguucuuc

SEQ ID NO: 408777 - RNA, 19 nt, Homo sapiens
aaaacuugcucucaaacuu

SEQ ID NO: 408778 - RNA, 19 nt, Homo sapiens
acaaugguaugaguguaau

SEQ ID NO: 408779 - RNA, 19 nt, Homo sapiens
ccuagcagaccagagauuu

SEQ ID NO: 408780 - RNA, 19 nt, Homo sapiens
ccaaccuccugaugcugaa

SEQ ID NO: 408781 - RNA, 19 nt, Homo sapiens
uauggugacacaaauguau

SEQ ID NO: 408782 - RNA, 19 nt, Homo sapiens
gagcuuuucucuacuugug

SEQ ID NO: 408783 - RNA, 19 nt, Homo sapiens
agauggcacugauccagau

SEQ ID NO: 408784 - RNA, 19 nt, Homo sapiens
ggucaccaaccuccugaug

SEQ ID NO: 408785 - RNA, 19 nt, Homo sapiens
gcacgcugcgcaucgacuu

SEQ ID NO: 408786 - RNA, 19 nt, Homo sapiens
gcagguuggccagucugua

SEQ ID NO: 408787 - RNA, 19 nt, Homo sapiens
uagcagaccagagauuuua

SEQ ID NO: 408788 - RNA, 19 nt, Homo sapiens
gccucaacgucaaguacaa

SEQ ID NO: 408789 - RNA, 19 nt, Homo sapiens
ucacaggcaggacccaguu

SEQ ID NO: 408790 - RNA, 19 nt, Homo sapiens
aaagucucauuucuguguu

SEQ ID NO: 408791 - RNA, 19 nt, Homo sapiens
gaaaucaguuuaccuguuu

SEQ ID NO: 408792 - RNA, 19 nt, Homo sapiens
gaauaaaucuucuguaucc

SEQ ID NO: 408793 - RNA, 19 nt, Homo sapiens
gcaagaugauacaauggua

SEQ ID NO: 408794 - RNA, 19 nt, Homo sapiens
aaacuuccuugugguauua

SEQ ID NO: 408795 - RNA, 19 nt, Homo sapiens
guaccuggacuucgaauaa

SEQ ID NO: 408796 - RNA, 19 nt, Homo sapiens
ggaccaaagucucauuucu

SEQ ID NO: 408797 - RNA, 19 nt, Homo sapiens
guaacaaggguguaaauau

SEQ ID NO: 408798 - RNA, 19 nt, Homo sapiens
ggcgacaacuuccaucauu

SEQ ID NO: 408799 - RNA, 19 nt, Homo sapiens
ggacuucgaauaaaucuuc

SEQ ID NO: 408800 - RNA, 19 nt, Homo sapiens
uaaacuuccuugugguauu

SEQ ID NO: 408801 - RNA, 19 nt, Homo sapiens
gaacuuccagaacauauuc

SEQ ID NO: 408802 - RNA, 19 nt, Homo sapiens
agaaaucaguuuaccuguu

SEQ ID NO: 408803 - RNA, 19 nt, Homo sapiens
gaccuuagcagaccagaga

SEQ ID NO: 408804 - RNA, 19 nt, Homo sapiens
caaagucucauuucugugu

SEQ ID NO: 408805 - RNA, 19 nt, Homo sapiens
cuagcaauauuuccaguug

SEQ ID NO: 408806 - RNA, 19 nt, Homo sapiens
ucaaaggauucaaguucuu

SEQ ID NO: 408807 - RNA, 19 nt, Homo sapiens
ccaagaacuuccagaacau

SEQ ID NO: 408808 - RNA, 19 nt, Homo sapiens
gcaucacgcucucgaagca

SEQ ID NO: 408809 - RNA, 19 nt, Homo sapiens
gcaauuccaggcucaguau

SEQ ID NO: 408810 - RNA, 19 nt, Homo sapiens
gaaggagaacgcccuagug

SEQ ID NO: 408811 - RNA, 19 nt, Homo sapiens
gguaugaguguaaucuaaa

SEQ ID NO: 408812 - RNA, 19 nt, Homo sapiens
caagaacuuccagaacaua

SEQ ID NO: 408813 - RNA, 19 nt, Homo sapiens
uccaagaacuuccagaaca

SEQ ID NO: 408814 - RNA, 19 nt, Homo sapiens
gagaaacuccucccuuguc

SEQ ID NO: 408815 - RNA, 19 nt, Homo sapiens
ugguaugaguguaaucuaa

SEQ ID NO: 408816 - RNA, 19 nt, Homo sapiens
gcgacaacuuccaucauuc

SEQ ID NO: 408817 - RNA, 19 nt, Homo sapiens
auagcaagaugauacaaug

SEQ ID NO: 408818 - RNA, 19 nt, Homo sapiens
ccagaaggaccgcaagaug

SEQ ID NO: 408819 - RNA, 19 nt, Homo sapiens
cgucaaaggauucaaguuc

SEQ ID NO: 408820 - RNA, 19 nt, Homo sapiens
gaccaaagucucauuucug

SEQ ID NO: 408821 - RNA, 19 nt, Homo sapiens
aagauccuguucaauaaga

SEQ ID NO: 408822 - RNA, 19 nt, Homo sapiens
uaccuggacuucgaauaaa

SEQ ID NO: 408823 - RNA, 19 nt, Homo sapiens
gaaacuccucccuugucua

SEQ ID NO: 408824 - RNA, 19 nt, Homo sapiens
ugaguguaaucuaaacuuc

SEQ ID NO: 408825 - RNA, 19 nt, Homo sapiens
gaagauccuguucaauaag

SEQ ID NO: 408826 - RNA, 19 nt, Homo sapiens
accaaagucucauuucugu

SEQ ID NO: 408827 - RNA, 19 nt, Homo sapiens
caccugcagucgccuagaa

SEQ ID NO: 408828 - RNA, 19 nt, Homo sapiens
ucauugaccugcacaacca

SEQ ID NO: 408829 - RNA, 19 nt, Homo sapiens
gcggagagaaccgauuaaa

SEQ ID NO: 408830 - RNA, 19 nt, Homo sapiens
ccagauauagccguuggua

SEQ ID NO: 408831 - RNA, 19 nt, Homo sapiens
uagcaauauuuccaguuga

SEQ ID NO: 408832 - RNA, 19 nt, Homo sapiens
gucaaaggauucaaguucu

SEQ ID NO: 408833 - RNA, 19 nt, Homo sapiens
ggagagaaccgauuaaaac

SEQ ID NO: 408834 - RNA, 19 nt, Homo sapiens
gcuccaagaacuuccagaa

SEQ ID NO: 408835 - RNA, 19 nt, Homo sapiens
uagaaaacuugcucucaaa

SEQ ID NO: 408836 - RNA, 19 nt, Homo sapiens
agacgucugugccuagcaa

SEQ ID NO: 408837 - RNA, 19 nt, Homo sapiens
gauauagccguugguacaa

SEQ ID NO: 408838 - RNA, 19 nt, Homo sapiens
cgaauaaaucuucuguauc

SEQ ID NO: 408839 - RNA, 19 nt, Homo sapiens
caaggacuacggcaacuca

SEQ ID NO: 408840 - RNA, 19 nt, Homo sapiens
agauauagccguugguaca

SEQ ID NO: 408841 - RNA, 19 nt, Homo sapiens
ucacgugauucucccuuca

SEQ ID NO: 408842 - RNA, 19 nt, Homo sapiens
cggcauugucccagauaua

SEQ ID NO: 408843 - RNA, 19 nt, Homo sapiens
cugcggagcuggucgacau

SEQ ID NO: 408844 - RNA, 19 nt, Homo sapiens
aaacuccucccuugucuag

SEQ ID NO: 408845 - RNA, 19 nt, Homo sapiens
uguaacaaggguguaaaua

SEQ ID NO: 408846 - RNA, 19 nt, Homo sapiens
ccuuguaugcuguuacuuu

SEQ ID NO: 408847 - RNA, 19 nt, Homo sapiens
guaugaguguaaucuaaac

SEQ ID NO: 408848 - RNA, 19 nt, Homo sapiens
ggagcuggucgacauaauc

SEQ ID NO: 408849 - RNA, 19 nt, Homo sapiens
aaacuugcucucaaacuuc

SEQ ID NO: 408850 - RNA, 19 nt, Homo sapiens
cuagaaaacuugcucucaa

SEQ ID NO: 408851 - RNA, 19 nt, Homo sapiens
gagcuggucgacauaaucu

SEQ ID NO: 408852 - RNA, 19 nt, Homo sapiens
cagcugaagugaccuuagc

SEQ ID NO: 408853 - RNA, 19 nt, Homo sapiens
ggaucucaagguccuguuu

SEQ ID NO: 408854 - RNA, 19 nt, Homo sapiens
agaaacuccucccuugucu

SEQ ID NO: 408855 - RNA, 19 nt, Homo sapiens
acgcggagagaaccgauua

SEQ ID NO: 408856 - RNA, 19 nt, Homo sapiens
ucuaaacuuccuuguggua

SEQ ID NO: 408857 - RNA, 19 nt, Homo sapiens
caaaggauucaaguucuuc

SEQ ID NO: 408858 - RNA, 19 nt, Homo sapiens
aaaacuugcucucaaacuu

SEQ ID NO: 408859 - RNA, 19 nt, Homo sapiens
acaaugguaugaguguaau

SEQ ID NO: 408860 - RNA, 19 nt, Homo sapiens
uauggugacacaaauguau

SEQ ID NO: 408861 - RNA, 19 nt, Homo sapiens
agauggcacugauccagau

SEQ ID NO: 408862 - RNA, 19 nt, Homo sapiens
gcagguuggccagucugua

SEQ ID NO: 408863 - RNA, 19 nt, Homo sapiens
uagcagaccagagauuuua

SEQ ID NO: 408864 - RNA, 19 nt, Homo sapiens
ucacaggcaggacccaguu

SEQ ID NO: 408865 - RNA, 19 nt, Homo sapiens
ggcauugucccagauauag

SEQ ID NO: 408866 - RNA, 19 nt, Homo sapiens
aaagucucauuucuguguu

SEQ ID NO: 408867 - RNA, 19 nt, Homo sapiens
gcagucgccuagaaaacuu

SEQ ID NO: 408868 - RNA, 19 nt, Homo sapiens
caguugaccaaauauucua

SEQ ID NO: 408869 - RNA, 19 nt, Homo sapiens
ccaguugaccaaauauucu

SEQ ID NO: 408870 - RNA, 19 nt, Homo sapiens
gucugugccuagcaauauu

SEQ ID NO: 408871 - RNA, 19 nt, Homo sapiens
aaagagaaaucaguuuacc

SEQ ID NO: 408872 - RNA, 19 nt, Homo sapiens
gaggcagguuggccagucu

SEQ ID NO: 408873 - RNA, 19 nt, Homo sapiens
uauagccguugguacaaag

SEQ ID NO: 408874 - RNA, 19 nt, Homo sapiens
uaaucuaaacuuccuugug

SEQ ID NO: 408875 - RNA, 19 nt, Homo sapiens
cgucugugccuagcaauau

SEQ ID NO: 408876 - RNA, 19 nt, Homo sapiens
uuccaucauuccagagaaa

SEQ ID NO: 408877 - RNA, 19 nt, Homo sapiens
agaacgcccuagugcagau

SEQ ID NO: 408878 - RNA, 19 nt, Homo sapiens
ugagaaacuccucccuugu

SEQ ID NO: 408879 - RNA, 19 nt, Homo sapiens
auauagccguugguacaaa

SEQ ID NO: 408880 - RNA, 19 nt, Homo sapiens
gacggcauugucccagaua

SEQ ID NO: 408881 - RNA, 19 nt, Homo sapiens
gcggagcuggucgacauaa

SEQ ID NO: 408882 - RNA, 19 nt, Homo sapiens
gcacagaacuccacucaaa

SEQ ID NO: 408883 - RNA, 19 nt, Homo sapiens
ggacagcaguucauuguua

SEQ ID NO: 408884 - RNA, 19 nt, Homo sapiens
gagaagaggcuauguuuaa

SEQ ID NO: 408885 - RNA, 19 nt, Homo sapiens
ggacaaacuucgacccuuu

SEQ ID NO: 408886 - RNA, 19 nt, Homo sapiens
gcaaagaggccaaagauug

SEQ ID NO: 408887 - RNA, 19 nt, Homo sapiens
gggaggaaaugcugaauaa

SEQ ID NO: 408888 - RNA, 19 nt, Homo sapiens
ggaaggauguaaaguggua

SEQ ID NO: 408889 - RNA, 19 nt, Homo sapiens
caaccaagcuucauuaguc

SEQ ID NO: 408890 - RNA, 19 nt, Homo sapiens
gcacuuacuuuacgaccua

SEQ ID NO: 408891 - RNA, 19 nt, Homo sapiens
caggagagcuuaucacaga

SEQ ID NO: 408892 - RNA, 19 nt, Homo sapiens
gagcaugcauuguggugua

SEQ ID NO: 408893 - RNA, 19 nt, Homo sapiens
cgacaaagccgacuacaug

SEQ ID NO: 408894 - RNA, 19 nt, Homo sapiens
uaaacuggguuguuacauu

SEQ ID NO: 408895 - RNA, 19 nt, Homo sapiens
cagcagagcccaucgagua

SEQ ID NO: 408896 - RNA, 19 nt, Homo sapiens
uaaacucccucucuuaaau

SEQ ID NO: 408897 - RNA, 19 nt, Homo sapiens
gcagagugauucagguuga

SEQ ID NO: 408898 - RNA, 19 nt, Homo sapiens
gaggagggaugaugcagaa

SEQ ID NO: 408899 - RNA, 19 nt, Homo sapiens
ugggaaaucuuaacagaaa

SEQ ID NO: 408900 - RNA, 19 nt, Homo sapiens
guacgugcuuccuaaguaa

SEQ ID NO: 408901 - RNA, 19 nt, Homo sapiens
gguacgugcuuccuaagua

SEQ ID NO: 408902 - RNA, 19 nt, Homo sapiens
uaaauuaccugggaaaucu

SEQ ID NO: 408903 - RNA, 19 nt, Homo sapiens
gugguaguaugaaauguua

SEQ ID NO: 408904 - RNA, 19 nt, Homo sapiens
gaaguuggaggacgaguaa

SEQ ID NO: 408905 - RNA, 19 nt, Homo sapiens
gaagaaagcacguuaaucc

SEQ ID NO: 408906 - RNA, 19 nt, Homo sapiens
gagcagauaugaagaaagc

SEQ ID NO: 408907 - RNA, 19 nt, Homo sapiens
gaaggaaggauguaaagug

SEQ ID NO: 408908 - RNA, 19 nt, Homo sapiens
caaccaaaccucuugauau

SEQ ID NO: 408909 - RNA, 19 nt, Homo sapiens
gcgaggagcuucggcacua

SEQ ID NO: 408910 - RNA, 19 nt, Homo sapiens
ggagaagaggcuauguuua

SEQ ID NO: 408911 - RNA, 19 nt, Homo sapiens
ccacaaccaagcuucauua

SEQ ID NO: 408912 - RNA, 19 nt, Homo sapiens
ugucauggcuuauccagaa

SEQ ID NO: 408913 - RNA, 19 nt, Homo sapiens
guauggagcucacaucagu

SEQ ID NO: 408914 - RNA, 19 nt, Homo sapiens
gauguaaagugguaugauc

SEQ ID NO: 408915 - RNA, 19 nt, Homo sapiens
gaucgcuucuguuggcaua

SEQ ID NO: 408916 - RNA, 19 nt, Homo sapiens
ucaguaacgugaaguaugu

SEQ ID NO: 408917 - RNA, 19 nt, Homo sapiens
gacaagaagucagaggaaa

SEQ ID NO: 408918 - RNA, 19 nt, Homo sapiens
ugaaguaugucauguugga

SEQ ID NO: 408919 - RNA, 19 nt, Homo sapiens
gaaagcagacuacccgaau

SEQ ID NO: 408920 - RNA, 19 nt, Homo sapiens
gacaggagacuggauauuu

SEQ ID NO: 408921 - RNA, 19 nt, Homo sapiens
guuaaugacucccaagcaa

SEQ ID NO: 408922 - RNA, 19 nt, Homo sapiens
gaauaaggcugagguuggu

SEQ ID NO: 408923 - RNA, 19 nt, Homo sapiens
gaauaucuuuacccuuguu

SEQ ID NO: 408924 - RNA, 19 nt, Homo sapiens
gaauuucucucucucuuuu

SEQ ID NO: 408925 - RNA, 19 nt, Homo sapiens
aaacuggguuguuacauuc

SEQ ID NO: 408926 - RNA, 19 nt, Homo sapiens
gcaauucucagcauggauu

SEQ ID NO: 408927 - RNA, 19 nt, Homo sapiens
aaccaaaccucuugauaug

SEQ ID NO: 408928 - RNA, 19 nt, Homo sapiens
gagggaugaugcagaauuc

SEQ ID NO: 408929 - RNA, 19 nt, Homo sapiens
cagaacugcuugaagagaa

SEQ ID NO: 408930 - RNA, 19 nt, Homo sapiens
gaucugaguucgacuucau

SEQ ID NO: 408931 - RNA, 19 nt, Homo sapiens
gccaaacaauuacaagaau

SEQ ID NO: 408932 - RNA, 19 nt, Homo sapiens
cagcauggauuuauaucga

SEQ ID NO: 408933 - RNA, 19 nt, Homo sapiens
agaaacagguuacauggau

SEQ ID NO: 408934 - RNA, 19 nt, Homo sapiens
aaauguggcugcacuacuu

SEQ ID NO: 408935 - RNA, 19 nt, Homo sapiens
cagcgaaccucgagaccaa

SEQ ID NO: 408936 - RNA, 19 nt, Homo sapiens
gaaggcuacuggccggaaa

SEQ ID NO: 408937 - RNA, 19 nt, Homo sapiens
cagagacgcuuuugaaauu

SEQ ID NO: 408938 - RNA, 19 nt, Homo sapiens
cagaauggguccacgacaa

SEQ ID NO: 408939 - RNA, 19 nt, Homo sapiens
ccaaacaauuacaagaaug

SEQ ID NO: 408940 - RNA, 19 nt, Homo sapiens
aaagcagacuacccgaaua

SEQ ID NO: 408941 - RNA, 19 nt, Homo sapiens
uaguagugguguucaauuu

SEQ ID NO: 408942 - RNA, 19 nt, Homo sapiens
gaacagcacuggaaaacuc

SEQ ID NO: 408943 - RNA, 19 nt, Homo sapiens
gagcgaaguuucagagacu

SEQ ID NO: 408944 - RNA, 19 nt, Homo sapiens
ggaguucaccguucacguu

SEQ ID NO: 408945 - RNA, 19 nt, Homo sapiens
ccacagcuuugcccaugaa

SEQ ID NO: 408946 - RNA, 19 nt, Homo sapiens
ggccagccguguccaugua

SEQ ID NO: 408947 - RNA, 19 nt, Homo sapiens
ggagggaugaugcagaauu

SEQ ID NO: 408948 - RNA, 19 nt, Homo sapiens
agaagaaggugcuaauguc

SEQ ID NO: 408949 - RNA, 19 nt, Homo sapiens
gaguaagucgugaauuaaa

SEQ ID NO: 408950 - RNA, 19 nt, Homo sapiens
gaagcaaagaggccaaaga

SEQ ID NO: 408951 - RNA, 19 nt, Homo sapiens
ucacguugcuuuggccuuu

SEQ ID NO: 408952 - RNA, 19 nt, Homo sapiens
gaaacaaggcugagaaucc

SEQ ID NO: 408953 - RNA, 19 nt, Homo sapiens
gaggacaggagacuggaua

SEQ ID NO: 408954 - RNA, 19 nt, Homo sapiens
ggaggugguucaucagagu

SEQ ID NO: 408955 - RNA, 19 nt, Homo sapiens
acaaacagcuucccaaaau

SEQ ID NO: 408956 - RNA, 19 nt, Homo sapiens
aaacaaacagcuucccaaa

SEQ ID NO: 408957 - RNA, 19 nt, Homo sapiens
gccagaagauuggagaaga

SEQ ID NO: 408958 - RNA, 19 nt, Homo sapiens
gcagaccauguuccaguua

SEQ ID NO: 408959 - RNA, 19 nt, Homo sapiens
cagaaauacccacagcaua

SEQ ID NO: 408960 - RNA, 19 nt, Homo sapiens
gguugaggcuuucuagauc

SEQ ID NO: 408961 - RNA, 19 nt, Homo sapiens
caugguggguguuagagaa

SEQ ID NO: 408962 - RNA, 19 nt, Homo sapiens
gcuggaagcgucaggauau

SEQ ID NO: 408963 - RNA, 19 nt, Homo sapiens
gaauggaucagacgaugga

SEQ ID NO: 408964 - RNA, 19 nt, Homo sapiens
cgugaaguaugucauguug

SEQ ID NO: 408965 - RNA, 19 nt, Homo sapiens
cuacacaggaguuucagua

SEQ ID NO: 408966 - RNA, 19 nt, Homo sapiens
aaacgcagauuaccaugca

SEQ ID NO: 408967 - RNA, 19 nt, Homo sapiens
ggaaguuggaggacgagua

SEQ ID NO: 408968 - RNA, 19 nt, Homo sapiens
ccaagcuucauuagucuua

SEQ ID NO: 408969 - RNA, 19 nt, Homo sapiens
gaagaggcuauguuuaauc

SEQ ID NO: 408970 - RNA, 19 nt, Homo sapiens
cgacuucauugucagguau

SEQ ID NO: 408971 - RNA, 19 nt, Homo sapiens
gaauauccagcacuuacuu

SEQ ID NO: 408972 - RNA, 19 nt, Homo sapiens
gcccaugaaacgcagauua

SEQ ID NO: 408973 - RNA, 19 nt, Homo sapiens
ccacaccagcaccuuguua

SEQ ID NO: 408974 - RNA, 19 nt, Homo sapiens
gaguucgacuucauuguca

SEQ ID NO: 408975 - RNA, 19 nt, Homo sapiens
gacaucagccaguugacua

SEQ ID NO: 408976 - RNA, 19 nt, Homo sapiens
caacucagguuuugccauu

SEQ ID NO: 408977 - RNA, 19 nt, Homo sapiens
gcucauugaucggaauuuc

SEQ ID NO: 408978 - RNA, 19 nt, Homo sapiens
cagaccauguuccaguuaa

SEQ ID NO: 408979 - RNA, 19 nt, Homo sapiens
uaaagaagaaggugcuaau

SEQ ID NO: 408980 - RNA, 19 nt, Homo sapiens
caacugagggugauuaaaa

SEQ ID NO: 408981 - RNA, 19 nt, Homo sapiens
gagacgggcuggaccuuac

SEQ ID NO: 408982 - RNA, 19 nt, Homo sapiens
gaagauauauuccuccaau

SEQ ID NO: 408983 - RNA, 19 nt, Homo sapiens
caacugaaguggcuaaaga

SEQ ID NO: 408984 - RNA, 19 nt, Homo sapiens
uaaaggaagugaaucugua

SEQ ID NO: 408985 - RNA, 19 nt, Homo sapiens
gaaugaaccuucugcaaca

SEQ ID NO: 408986 - RNA, 19 nt, Homo sapiens
ggaacaauauugaugaugu

SEQ ID NO: 408987 - RNA, 19 nt, Homo sapiens
caaggaauaucuaguacuu

SEQ ID NO: 408988 - RNA, 19 nt, Homo sapiens
gaacugguguaaugauaug

SEQ ID NO: 408989 - RNA, 19 nt, Homo sapiens
gugaagaucuugaccaaug

SEQ ID NO: 408990 - RNA, 19 nt, Homo sapiens
gauggaaguuugagaguug

SEQ ID NO: 408991 - RNA, 19 nt, Homo sapiens
gaucagcauacacaaauua

SEQ ID NO: 408992 - RNA, 19 nt, Homo sapiens
ggcgcuauguguauuauua

SEQ ID NO: 408993 - RNA, 19 nt, Homo sapiens
caacaaugacuuaaccaua

SEQ ID NO: 408994 - RNA, 19 nt, Homo sapiens
guauagagcgugcagauaa

SEQ ID NO: 408995 - RNA, 19 nt, Homo sapiens
gggacgaacugguguaaug

SEQ ID NO: 408996 - RNA, 19 nt, Homo sapiens
ugacagccaucaucaaaga

SEQ ID NO: 408997 - RNA, 19 nt, Homo sapiens
gcucagaaaggaaauaauu

SEQ ID NO: 408998 - RNA, 19 nt, Homo sapiens
ugacaaggaauaucuagua

SEQ ID NO: 408999 - RNA, 19 nt, Homo sapiens
gaagaucagcauacacaaa

SEQ ID NO: 409000 - RNA, 19 nt, Homo sapiens
ugugucagauuaccaguua

SEQ ID NO: 409001 - RNA, 19 nt, Homo sapiens
gcacuuguggcaacagaua

SEQ ID NO: 409002 - RNA, 19 nt, Homo sapiens
gaaugaaccuuuugaugaa

SEQ ID NO: 409003 - RNA, 19 nt, Homo sapiens
gauagcauuugcaguauag

SEQ ID NO: 409004 - RNA, 19 nt, Homo sapiens
gacuuagacuugaccuaua

SEQ ID NO: 409005 - RNA, 19 nt, Homo sapiens
aaacagaacaagaugcuaa

SEQ ID NO: 409006 - RNA, 19 nt, Homo sapiens
gaagacaaguucauguacu

SEQ ID NO: 409007 - RNA, 19 nt, Homo sapiens
ggaaugcucagaaaggaaa

SEQ ID NO: 409008 - RNA, 19 nt, Homo sapiens
guagcugugucauguauau

SEQ ID NO: 409009 - RNA, 19 nt, Homo sapiens
cacaagaggcccuagauuu

SEQ ID NO: 409010 - RNA, 19 nt, Homo sapiens
gcuggacucuggaccauau

SEQ ID NO: 409011 - RNA, 19 nt, Homo sapiens
gggaagacaaguucaugua

SEQ ID NO: 409012 - RNA, 19 nt, Homo sapiens
ugaaguggcuaaagagcuu

SEQ ID NO: 409013 - RNA, 19 nt, Homo sapiens
gcacaagaggcccuagauu

SEQ ID NO: 409014 - RNA, 19 nt, Homo sapiens
cagauaaugacaaggaaua

SEQ ID NO: 409015 - RNA, 19 nt, Homo sapiens
gaaguaaggaccagagaca

SEQ ID NO: 409016 - RNA, 19 nt, Homo sapiens
gaucuugaccaauggcuaa

SEQ ID NO: 409017 - RNA, 19 nt, Homo sapiens
caacaaagaaugggcuuga

SEQ ID NO: 409018 - RNA, 19 nt, Homo sapiens
uuacacacaccuuucuuua

SEQ ID NO: 409019 - RNA, 19 nt, Homo sapiens
cauauaccaucuccagcua

SEQ ID NO: 409020 - RNA, 19 nt, Homo sapiens
cgauagcauuugcaguaua

SEQ ID NO: 409021 - RNA, 19 nt, Homo sapiens
gaguaacuauucccaguca

SEQ ID NO: 409022 - RNA, 19 nt, Homo sapiens
caccacagcuagaacuuau

SEQ ID NO: 409023 - RNA, 19 nt, Homo sapiens
acacagcaacaaugacuua

SEQ ID NO: 409024 - RNA, 19 nt, Homo sapiens
guacaggaaugaaccuucu

SEQ ID NO: 409025 - RNA, 19 nt, Homo sapiens
acagauaaguuugcaguug

SEQ ID NO: 409026 - RNA, 19 nt, Homo sapiens
gaucuugacaaagcaaaua

SEQ ID NO: 409027 - RNA, 19 nt, Homo sapiens
gaaacuauuccaauguuca

SEQ ID NO: 409028 - RNA, 19 nt, Homo sapiens
uaugacaccgccaaauuua

SEQ ID NO: 409029 - RNA, 19 nt, Homo sapiens
aaagagaucguuagcagaa

SEQ ID NO: 409030 - RNA, 19 nt, Homo sapiens
auagcuaccuguuaaagaa

SEQ ID NO: 409031 - RNA, 19 nt, Homo sapiens
ggaagugaaucuguauugg

SEQ ID NO: 409032 - RNA, 19 nt, Homo sapiens
ggaagucuaugugaucaag

SEQ ID NO: 409033 - RNA, 19 nt, Homo sapiens
agcuaaaggugaagauaua

SEQ ID NO: 409034 - RNA, 19 nt, Homo sapiens
guuaaagaaucaucuggau

SEQ ID NO: 409035 - RNA, 19 nt, Homo sapiens
uaccaucuccagcuauuua

SEQ ID NO: 409036 - RNA, 19 nt, Homo sapiens
gauauauuccuccaauuca

SEQ ID NO: 409037 - RNA, 19 nt, Homo sapiens
ggaauuggccgcugucacu

SEQ ID NO: 409038 - RNA, 19 nt, Homo sapiens
gaacuuaucaaacccuuuu

SEQ ID NO: 409039 - RNA, 19 nt, Homo sapiens
aaaggcagcuaaaggaagu

SEQ ID NO: 409040 - RNA, 19 nt, Homo sapiens
cagauuaccaguuauagga

SEQ ID NO: 409041 - RNA, 19 nt, Homo sapiens
gaggauggauucgacuuag

SEQ ID NO: 409042 - RNA, 19 nt, Homo sapiens
guaagaaacacagcaacaa

SEQ ID NO: 409043 - RNA, 19 nt, Homo sapiens
uauaccaucuccagcuauu

SEQ ID NO: 409044 - RNA, 19 nt, Homo sapiens
gacaaggaauaucuaguac

SEQ ID NO: 409045 - RNA, 19 nt, Homo sapiens
ggacaaaauguuucacuuu

SEQ ID NO: 409046 - RNA, 19 nt, Homo sapiens
guagaguucuuccacaaac

SEQ ID NO: 409047 - RNA, 19 nt, Homo sapiens
ggacgaacugguguaauga

SEQ ID NO: 409048 - RNA, 19 nt, Homo sapiens
uaagugaagaugacaauca

SEQ ID NO: 409049 - RNA, 19 nt, Homo sapiens
gacuugaccuauauuuauc

SEQ ID NO: 409050 - RNA, 19 nt, Homo sapiens
agaaacacagcaacaauga

SEQ ID NO: 409051 - RNA, 19 nt, Homo sapiens
ccacaaaugaagggauaua

SEQ ID NO: 409052 - RNA, 19 nt, Homo sapiens
gauauucugacaccacuga

SEQ ID NO: 409053 - RNA, 19 nt, Homo sapiens
guggugauaucaaaguaga

SEQ ID NO: 409054 - RNA, 19 nt, Homo sapiens
ggauucgacuuagacuuga

SEQ ID NO: 409055 - RNA, 19 nt, Homo sapiens
uguggaggcuaucaacaaa

SEQ ID NO: 409056 - RNA, 19 nt, Homo sapiens
uaagaaacacagcaacaau

SEQ ID NO: 409057 - RNA, 19 nt, Homo sapiens
gauguggcaggacucuuua

SEQ ID NO: 409058 - RNA, 19 nt, Homo sapiens
uaaguuugcaguuggcuaa

SEQ ID NO: 409059 - RNA, 19 nt, Homo sapiens
agauggcacuuucccguuu

SEQ ID NO: 409060 - RNA, 19 nt, Homo sapiens
ccaguuauaggaacaauuc

SEQ ID NO: 409061 - RNA, 19 nt, Homo sapiens
acaagaggcccuagauuuc

SEQ ID NO: 409062 - RNA, 19 nt, Homo sapiens
acgaacugguguaaugaua

SEQ ID NO: 409063 - RNA, 19 nt, Homo sapiens
guauacaggaacaauauug

SEQ ID NO: 409064 - RNA, 19 nt, Homo sapiens
gaaggcguauacaggaaca

SEQ ID NO: 409065 - RNA, 19 nt, Homo sapiens
agacaaagccaaccgauac

SEQ ID NO: 409066 - RNA, 19 nt, Homo sapiens
cacaagaugauguuugaaa

SEQ ID NO: 409067 - RNA, 19 nt, Homo sapiens
cauuauugcuaugggauuu

SEQ ID NO: 409068 - RNA, 19 nt, Homo sapiens
cgacuuagacuugaccuau

SEQ ID NO: 409069 - RNA, 19 nt, Homo sapiens
uggaggcuaucaacaaaga

SEQ ID NO: 409070 - RNA, 19 nt, Homo sapiens
gcauauuggugcuagaaaa

SEQ ID NO: 409071 - RNA, 19 nt, Homo sapiens
acacacaccuuucuuuagc

SEQ ID NO: 409072 - RNA, 19 nt, Homo sapiens
ugacaccacugacucugau

SEQ ID NO: 409073 - RNA, 19 nt, Homo sapiens
ugacaaagcaaauaaagac

SEQ ID NO: 409074 - RNA, 19 nt, Homo sapiens
cagaggcgcuauguguauu

SEQ ID NO: 409075 - RNA, 19 nt, Homo sapiens
gcugaaagacauuaugaca

SEQ ID NO: 409076 - RNA, 19 nt, Homo sapiens
gcguauacaggaacaauau

SEQ ID NO: 409077 - RNA, 19 nt, Homo sapiens
gggcuugaaacauuauaaa

SEQ ID NO: 409078 - RNA, 19 nt, Homo sapiens
ugucacugcuuguuguuug

SEQ ID NO: 409079 - RNA, 19 nt, Homo sapiens
ggauaaaacaccaugaaaa

SEQ ID NO: 409080 - RNA, 19 nt, Homo sapiens
uauagagcgugcagauaau

SEQ ID NO: 409081 - RNA, 19 nt, Homo sapiens
ucaagaaaucgauagcauu

SEQ ID NO: 409082 - RNA, 19 nt, Homo sapiens
gguaagagcuuucaccuuu

SEQ ID NO: 409083 - RNA, 19 nt, Homo sapiens
gaagugaggugggaaauau

SEQ ID NO: 409084 - RNA, 19 nt, Homo sapiens
gcagcaaccuccuuuguuu

SEQ ID NO: 409085 - RNA, 19 nt, Homo sapiens
ggagagguguguuaggaua

SEQ ID NO: 409086 - RNA, 19 nt, Homo sapiens
ggaguaugauuuaacagua

SEQ ID NO: 409087 - RNA, 19 nt, Homo sapiens
gagcacaacugagcacuuu

SEQ ID NO: 409088 - RNA, 19 nt, Homo sapiens
uuucagaucuccaguauuu

SEQ ID NO: 409089 - RNA, 19 nt, Homo sapiens
caacugagcacuuuaauag

SEQ ID NO: 409090 - RNA, 19 nt, Homo sapiens
uaggauaauuguccaguua

SEQ ID NO: 409091 - RNA, 19 nt, Homo sapiens
ggacuuagccucaguugau

SEQ ID NO: 409092 - RNA, 19 nt, Homo sapiens
gaaaccugauucauugauu

SEQ ID NO: 409093 - RNA, 19 nt, Homo sapiens
agagaggccuugagacaua

SEQ ID NO: 409094 - RNA, 19 nt, Homo sapiens
aaacccagcuugcagguaa

SEQ ID NO: 409095 - RNA, 19 nt, Homo sapiens
gcacaacugagcacuuuaa

SEQ ID NO: 409096 - RNA, 19 nt, Homo sapiens
guaacuagaugcagagcaa

SEQ ID NO: 409097 - RNA, 19 nt, Homo sapiens
ggaguuccuuuguaucuga

SEQ ID NO: 409098 - RNA, 19 nt, Homo sapiens
aaacgcagcugcaacugaa

SEQ ID NO: 409099 - RNA, 19 nt, Homo sapiens
gccaauugaucuaagcaua

SEQ ID NO: 409100 - RNA, 19 nt, Homo sapiens
gcaauaugaugacugaaag

SEQ ID NO: 409101 - RNA, 19 nt, Homo sapiens
guggagaccugaagcugua

SEQ ID NO: 409102 - RNA, 19 nt, Homo sapiens
caaggaguaugauuuaaca

SEQ ID NO: 409103 - RNA, 19 nt, Homo sapiens
acaauggccuuaacaucua

SEQ ID NO: 409104 - RNA, 19 nt, Homo sapiens
acaccacuguuuacgauua

SEQ ID NO: 409105 - RNA, 19 nt, Homo sapiens
acugagcacuuuaauagua

SEQ ID NO: 409106 - RNA, 19 nt, Homo sapiens
gugguaagcugaggaauau

SEQ ID NO: 409107 - RNA, 19 nt, Homo sapiens
caaauuaggcauacaagga

SEQ ID NO: 409108 - RNA, 19 nt, Homo sapiens
aaacaggaccucugaagaa

SEQ ID NO: 409109 - RNA, 19 nt, Homo sapiens
guagagccauguuuacugu

SEQ ID NO: 409110 - RNA, 19 nt, Homo sapiens
ggccuuaacaucuaccuua

SEQ ID NO: 409111 - RNA, 19 nt, Homo sapiens
agucaaagaaccaugauua

SEQ ID NO: 409112 - RNA, 19 nt, Homo sapiens
gaaacgcagcugcaacuga

SEQ ID NO: 409113 - RNA, 19 nt, Homo sapiens
uuaaggaugucaaggagaa

SEQ ID NO: 409114 - RNA, 19 nt, Homo sapiens
guaagagcuuucaccuuug

SEQ ID NO: 409115 - RNA, 19 nt, Homo sapiens
gauaguaacaauggccuua

SEQ ID NO: 409116 - RNA, 19 nt, Homo sapiens
cuaagcauagccugaauua

SEQ ID NO: 409117 - RNA, 19 nt, Homo sapiens
ggauaauuguccaguuaau

SEQ ID NO: 409118 - RNA, 19 nt, Homo sapiens
ggauuuaugcuucuuugaa

SEQ ID NO: 409119 - RNA, 19 nt, Homo sapiens
gaauuauccuaucaaugga

SEQ ID NO: 409120 - RNA, 19 nt, Homo sapiens
uaauuuaucgcgcuuacua

SEQ ID NO: 409121 - RNA, 19 nt, Homo sapiens
agaauuauccuaucaaugg

SEQ ID NO: 409122 - RNA, 19 nt, Homo sapiens
guucauuucuuugccaauu

SEQ ID NO: 409123 - RNA, 19 nt, Homo sapiens
ugaccgugcucuucacuau

SEQ ID NO: 409124 - RNA, 19 nt, Homo sapiens
ucaagggucagcaauauga

SEQ ID NO: 409125 - RNA, 19 nt, Homo sapiens
ggaaguucgugcaguacug

SEQ ID NO: 409126 - RNA, 19 nt, Homo sapiens
guuuguaccuucaaugugu

SEQ ID NO: 409127 - RNA, 19 nt, Homo sapiens
guucucugcccguaauuua

SEQ ID NO: 409128 - RNA, 19 nt, Homo sapiens
acaucuaccuuaacagcua

SEQ ID NO: 409129 - RNA, 19 nt, Homo sapiens
gcaaaauguucuuucaguu

SEQ ID NO: 409130 - RNA, 19 nt, Homo sapiens
gaucuaagcauagccugaa

SEQ ID NO: 409131 - RNA, 19 nt, Homo sapiens
cgauuucuaucugugauuu

SEQ ID NO: 409132 - RNA, 19 nt, Homo sapiens
ccuuaacagcuaccuauua

SEQ ID NO: 409133 - RNA, 19 nt, Homo sapiens
uuaauugucccuacauuug

SEQ ID NO: 409134 - RNA, 19 nt, Homo sapiens
gguauuaauugucccuaca

SEQ ID NO: 409135 - RNA, 19 nt, Homo sapiens
ucucuggaguuccuuugua

SEQ ID NO: 409136 - RNA, 19 nt, Homo sapiens
agagccauguuuacuguuu

SEQ ID NO: 409137 - RNA, 19 nt, Homo sapiens
gagcagcaaccuccuuugu

SEQ ID NO: 409138 - RNA, 19 nt, Homo sapiens
gcauuugcgugaucucaag

SEQ ID NO: 409139 - RNA, 19 nt, Homo sapiens
gccgauguuuaguucauuu

SEQ ID NO: 409140 - RNA, 19 nt, Homo sapiens
gucaaagaaccaugauuaa

SEQ ID NO: 409141 - RNA, 19 nt, Homo sapiens
uaacaauggccuuaacauc

SEQ ID NO: 409142 - RNA, 19 nt, Homo sapiens
gagccauguuuacuguuug

SEQ ID NO: 409143 - RNA, 19 nt, Homo sapiens
uaccuucaauguguaagua

SEQ ID NO: 409144 - RNA, 19 nt, Homo sapiens
ucgggaaguucgugcagua

SEQ ID NO: 409145 - RNA, 19 nt, Homo sapiens
gagcuuucaccuuugguaa

SEQ ID NO: 409146 - RNA, 19 nt, Homo sapiens
uaagagcuuucaccuuugg

SEQ ID NO: 409147 - RNA, 19 nt, Homo sapiens
cugagcacuuuaauaguaa

SEQ ID NO: 409148 - RNA, 19 nt, Homo sapiens
gagcaagauaugacuauag

SEQ ID NO: 409149 - RNA, 19 nt, Homo sapiens
gcagagcaagauaugacua

SEQ ID NO: 409150 - RNA, 19 nt, Homo sapiens
ccaaauauaagaguacuca

SEQ ID NO: 409151 - RNA, 19 nt, Homo sapiens
caacugaagcggagacucu

SEQ ID NO: 409152 - RNA, 19 nt, Homo sapiens
cuuaacagcuaccuauuac

SEQ ID NO: 409153 - RNA, 19 nt, Homo sapiens
gagagguguguuaggauaa

SEQ ID NO: 409154 - RNA, 19 nt, Homo sapiens
agagcaagauaugacuaua

SEQ ID NO: 409155 - RNA, 19 nt, Homo sapiens
gaccugaagcuguaacuag

SEQ ID NO: 409156 - RNA, 19 nt, Homo sapiens
gguaagcugaggaauaugu

SEQ ID NO: 409157 - RNA, 19 nt, Homo sapiens
uuucaagggucagcaauau

SEQ ID NO: 409158 - RNA, 19 nt, Homo sapiens
ucauuucuuugccaauuga

SEQ ID NO: 409159 - RNA, 19 nt, Homo sapiens
uaucauugccgauguuuag

SEQ ID NO: 409160 - RNA, 19 nt, Homo sapiens
uuaacaguaugacaugaug

SEQ ID NO: 409161 - RNA, 19 nt, Homo sapiens
uagccugaauuaugauguu

SEQ ID NO: 409162 - RNA, 19 nt, Homo sapiens
gacaaucucaggacuccaa

SEQ ID NO: 409163 - RNA, 19 nt, Homo sapiens
acaacugagcacuuuaaua

SEQ ID NO: 409164 - RNA, 19 nt, Homo sapiens
ucaagggugucaguaggaa

SEQ ID NO: 409165 - RNA, 19 nt, Homo sapiens
uccaguauuucggauauuu

SEQ ID NO: 409166 - RNA, 19 nt, Homo sapiens
caggaccucugaagaagca

SEQ ID NO: 409167 - RNA, 19 nt, Homo sapiens
gagguguguuaggauaauu

SEQ ID NO: 409168 - RNA, 19 nt, Homo sapiens
gauuuaacaguaugacaug

SEQ ID NO: 409169 - RNA, 19 nt, Homo sapiens
uaacagcuaccuauuacag

SEQ ID NO: 409170 - RNA, 19 nt, Homo sapiens
aauggauucuuuaguggaa

SEQ ID NO: 409171 - RNA, 19 nt, Homo sapiens
ugugguaagcugaggaaua

SEQ ID NO: 409172 - RNA, 19 nt, Homo sapiens
uccuaucaauggauucuuu

SEQ ID NO: 409173 - RNA, 19 nt, Homo sapiens
ccuccgagccuugcgauuu

SEQ ID NO: 409174 - RNA, 19 nt, Homo sapiens
gaaaaggccccagaugaau

SEQ ID NO: 409175 - RNA, 19 nt, Homo sapiens
ucagaggaagaacauguuu

SEQ ID NO: 409176 - RNA, 19 nt, Homo sapiens
ggaggaaacgcagcugcaa

SEQ ID NO: 409177 - RNA, 19 nt, Homo sapiens
ccaauugaucuaagcauag

SEQ ID NO: 409178 - RNA, 19 nt, Homo sapiens
gugcuugguggcccuauuu

SEQ ID NO: 409179 - RNA, 19 nt, Homo sapiens
gacuuagccucaguugaug

SEQ ID NO: 409180 - RNA, 19 nt, Homo sapiens
cacuguagagccauguuua

SEQ ID NO: 409181 - RNA, 19 nt, Homo sapiens
aaggauuuaugcuucuuug

SEQ ID NO: 409182 - RNA, 19 nt, Homo sapiens
ggaugucucugcucuguuc

SEQ ID NO: 409183 - RNA, 19 nt, Homo sapiens
gggcugaguuaaaggagaa

SEQ ID NO: 409184 - RNA, 19 nt, Homo sapiens
gagaauggcuacucaucac

SEQ ID NO: 409185 - RNA, 19 nt, Homo sapiens
ggagaauggcuacucauca

SEQ ID NO: 409186 - RNA, 19 nt, Homo sapiens
ucacagaggauaccauugu

SEQ ID NO: 409187 - RNA, 19 nt, Homo sapiens
ggaagcaagucaguuaaaa

SEQ ID NO: 409188 - RNA, 19 nt, Homo sapiens
gugcaugacggaacaauag

SEQ ID NO: 409189 - RNA, 19 nt, Homo sapiens
uccggaagcaagucaguua

SEQ ID NO: 409190 - RNA, 19 nt, Homo sapiens
cggaagcaagucaguuaaa

SEQ ID NO: 409191 - RNA, 19 nt, Homo sapiens
auaagugcaugacggaaca

SEQ ID NO: 409192 - RNA, 19 nt, Homo sapiens
gcaccuacuccgugucagu

SEQ ID NO: 409193 - RNA, 19 nt, Homo sapiens
cagaggauaccauugucuu

SEQ ID NO: 409194 - RNA, 19 nt, Homo sapiens
gcaugacggaacaauagga

SEQ ID NO: 409195 - RNA, 19 nt, Homo sapiens
ugaguuaaaggagaaauuc

SEQ ID NO: 409196 - RNA, 19 nt, Homo sapiens
gaguuaaaggagaaauuca

SEQ ID NO: 409197 - RNA, 19 nt, Homo sapiens
cacagaggauaccauuguc

SEQ ID NO: 409198 - RNA, 19 nt, Homo sapiens
cuucacagaggauaccauu

SEQ ID NO: 409199 - RNA, 19 nt, Homo sapiens
gcagagccuuugggaauaa

SEQ ID NO: 409200 - RNA, 19 nt, Homo sapiens
gcgcagagccuuugggaau

SEQ ID NO: 409201 - RNA, 19 nt, Homo sapiens
ccagaggcccaacgacuaa

SEQ ID NO: 409202 - RNA, 19 nt, Homo sapiens
cgcagagccuuugggaaua

SEQ ID NO: 409203 - RNA, 19 nt, Homo sapiens
ccaacugcuucgccucuug

SEQ ID NO: 409204 - RNA, 19 nt, Homo sapiens
cugcccaucuucuccauga

SEQ ID NO: 409205 - RNA, 19 nt, Homo sapiens
ggagcccaaugcugguguu

SEQ ID NO: 409206 - RNA, 19 nt, Homo sapiens
ggagauggugggccagcuu

SEQ ID NO: 409207 - RNA, 19 nt, Homo sapiens
ugggccagcuugucgguau

SEQ ID NO: 409208 - RNA, 19 nt, Homo sapiens
cagagccuuugggaauaaa

SEQ ID NO: 409209 - RNA, 19 nt, Homo sapiens
gcggcugcauggucuucuu

SEQ ID NO: 409210 - RNA, 19 nt, Homo sapiens
aaaugaagcugcccuaaua

SEQ ID NO: 409211 - RNA, 19 nt, Homo sapiens
gauuuaagcuuuccuguug

SEQ ID NO: 409212 - RNA, 19 nt, Homo sapiens
gaacaugguuugacucauc

SEQ ID NO: 409213 - RNA, 19 nt, Homo sapiens
caagaagacuuuaggaaug

SEQ ID NO: 409214 - RNA, 19 nt, Homo sapiens
ucucaucacuacaguauua

SEQ ID NO: 409215 - RNA, 19 nt, Homo sapiens
uaaacaggcugaccuuuga

SEQ ID NO: 409216 - RNA, 19 nt, Homo sapiens
gcauguaaauguaaacuca

SEQ ID NO: 409217 - RNA, 19 nt, Homo sapiens
caaguugucagguuauuua

SEQ ID NO: 409218 - RNA, 19 nt, Homo sapiens
ggauguacguggccaugua

SEQ ID NO: 409219 - RNA, 19 nt, Homo sapiens
cuaaauguuuggcauguaa

SEQ ID NO: 409220 - RNA, 19 nt, Homo sapiens
ccagcugccuauugauuua

SEQ ID NO: 409221 - RNA, 19 nt, Homo sapiens
ccuccaagcucuuagguuu

SEQ ID NO: 409222 - RNA, 19 nt, Homo sapiens
ggaguacucucaucacuac

SEQ ID NO: 409223 - RNA, 19 nt, Homo sapiens
ucacuuagcgaacccuuua

SEQ ID NO: 409224 - RNA, 19 nt, Homo sapiens
ugacaaggcacuucaugua

SEQ ID NO: 409225 - RNA, 19 nt, Homo sapiens
gaggagggcgcaucucuuu

SEQ ID NO: 409226 - RNA, 19 nt, Homo sapiens
ggucaaggcuacagaugug

SEQ ID NO: 409227 - RNA, 19 nt, Homo sapiens
acacaaacuuccuguucua

SEQ ID NO: 409228 - RNA, 19 nt, Homo sapiens
uguguaaacucaucugaaa

SEQ ID NO: 409229 - RNA, 19 nt, Homo sapiens
acaaggcacuucauguaaa

SEQ ID NO: 409230 - RNA, 19 nt, Homo sapiens
guaaacaggcugaccuuug

SEQ ID NO: 409231 - RNA, 19 nt, Homo sapiens
gcagugagucauaucuuaa

SEQ ID NO: 409232 - RNA, 19 nt, Homo sapiens
gacaaggcacuucauguaa

SEQ ID NO: 409233 - RNA, 19 nt, Homo sapiens
ccgcuuaccugcagcugua

SEQ ID NO: 409234 - RNA, 19 nt, Homo sapiens
guacagccagaccagauua

SEQ ID NO: 409235 - RNA, 19 nt, Homo sapiens
gaaauuguucccuggagaa

SEQ ID NO: 409236 - RNA, 19 nt, Homo sapiens
ucaaggcaguuaauucuca

SEQ ID NO: 409237 - RNA, 19 nt, Homo sapiens
uagcgaacccuuuauuuga

SEQ ID NO: 409238 - RNA, 19 nt, Homo sapiens
gaacacaagaugcaacaca

SEQ ID NO: 409239 - RNA, 19 nt, Homo sapiens
gaaugguucucucaacaag

SEQ ID NO: 409240 - RNA, 19 nt, Homo sapiens
ccuguugaaugacaaagua

SEQ ID NO: 409241 - RNA, 19 nt, Homo sapiens
cuacagaugugcugacaag

SEQ ID NO: 409242 - RNA, 19 nt, Homo sapiens
ggccauguaugaagccaaa

SEQ ID NO: 409243 - RNA, 19 nt, Homo sapiens
aagcuuuccuguugaauga

SEQ ID NO: 409244 - RNA, 19 nt, Homo sapiens
uauguaaucucuaggaagu

SEQ ID NO: 409245 - RNA, 19 nt, Homo sapiens
ggagacggaccaccucauu

SEQ ID NO: 409246 - RNA, 19 nt, Homo sapiens
gaauuugcacuguuuaauc

SEQ ID NO: 409247 - RNA, 19 nt, Homo sapiens
uaagaugacuguguuguac

SEQ ID NO: 409248 - RNA, 19 nt, Homo sapiens
gcugucuugugaucacuua

SEQ ID NO: 409249 - RNA, 19 nt, Homo sapiens
ugguuugacucaucuuaua

SEQ ID NO: 409250 - RNA, 19 nt, Homo sapiens
gguucauucuucagauaua

SEQ ID NO: 409251 - RNA, 19 nt, Homo sapiens
guaugaagccaaauauuag

SEQ ID NO: 409252 - RNA, 19 nt, Homo sapiens
ucaagaagacuuuaggaau

SEQ ID NO: 409253 - RNA, 19 nt, Homo sapiens
uuacugugauguuugugua

SEQ ID NO: 409254 - RNA, 19 nt, Homo sapiens
caaccaagccugcugucuu

SEQ ID NO: 409255 - RNA, 19 nt, Homo sapiens
gaccagauuaaacuucaua

SEQ ID NO: 409256 - RNA, 19 nt, Homo sapiens
ugucggauuucauuaagaa

SEQ ID NO: 409257 - RNA, 19 nt, Homo sapiens
ugaaaccucuucccgaaag

SEQ ID NO: 409258 - RNA, 19 nt, Homo sapiens
ucaaugagcaugguacuug

SEQ ID NO: 409259 - RNA, 19 nt, Homo sapiens
acagucagaugccaguaaa

SEQ ID NO: 409260 - RNA, 19 nt, Homo sapiens
ccacgaugcucaugcucuu

SEQ ID NO: 409261 - RNA, 19 nt, Homo sapiens
ggaaugguucucucaacaa

SEQ ID NO: 409262 - RNA, 19 nt, Homo sapiens
gccuauugauuuaagcuuu

SEQ ID NO: 409263 - RNA, 19 nt, Homo sapiens
caaggcacuucauguaaag

SEQ ID NO: 409264 - RNA, 19 nt, Homo sapiens
caacuucagugucauucuc

SEQ ID NO: 409265 - RNA, 19 nt, Homo sapiens
agcagugagucauaucuua

SEQ ID NO: 409266 - RNA, 19 nt, Homo sapiens
guccauaugcuaauaguga

SEQ ID NO: 409267 - RNA, 19 nt, Homo sapiens
guaaacucaucugaaaugu

SEQ ID NO: 409268 - RNA, 19 nt, Homo sapiens
cauauguaaucucuaggaa

SEQ ID NO: 409269 - RNA, 19 nt, Homo sapiens
cagaccagauuaaacuuca

SEQ ID NO: 409270 - RNA, 19 nt, Homo sapiens
caucagcuccgucauguuc

SEQ ID NO: 409271 - RNA, 19 nt, Homo sapiens
agauccagcugccuauuga

SEQ ID NO: 409272 - RNA, 19 nt, Homo sapiens
cuucauauguaaucucuag

SEQ ID NO: 409273 - RNA, 19 nt, Homo sapiens
gugacuguacuuucuauuu

SEQ ID NO: 409274 - RNA, 19 nt, Homo sapiens
ccuuugaggucaguaguuu

SEQ ID NO: 409275 - RNA, 19 nt, Homo sapiens
caagaugcaacacaaacuu

SEQ ID NO: 409276 - RNA, 19 nt, Homo sapiens
gccaucagcuccgucaugu

SEQ ID NO: 409277 - RNA, 19 nt, Homo sapiens
ucuaggaagucaauaugug

SEQ ID NO: 409278 - RNA, 19 nt, Homo sapiens
uuauauagcaucuggaaga

SEQ ID NO: 409279 - RNA, 19 nt, Homo sapiens
ccauguaugaagccaaaua

SEQ ID NO: 409280 - RNA, 19 nt, Homo sapiens
gaucaagaagacuuuagga

SEQ ID NO: 409281 - RNA, 19 nt, Homo sapiens
gggaguacucucaucacua

SEQ ID NO: 409282 - RNA, 19 nt, Homo sapiens
gaaaacaguguguaaacaa

SEQ ID NO: 409283 - RNA, 19 nt, Homo sapiens
caggucaaguugucagguu

SEQ ID NO: 409284 - RNA, 19 nt, Homo sapiens
uguaaacucaucugaaaug

SEQ ID NO: 409285 - RNA, 19 nt, Homo sapiens
guacguggccauguaugaa

SEQ ID NO: 409286 - RNA, 19 nt, Homo sapiens
gaagauccagcugccuauu

SEQ ID NO: 409287 - RNA, 19 nt, Homo sapiens
cauuuaagcuguggucaag

SEQ ID NO: 409288 - RNA, 19 nt, Homo sapiens
uaauagugaucaagaagac

SEQ ID NO: 409289 - RNA, 19 nt, Homo sapiens
gcaugguacuuggccuuug

SEQ ID NO: 409290 - RNA, 19 nt, Homo sapiens
aauguaaacucagcaucaa

SEQ ID NO: 409291 - RNA, 19 nt, Homo sapiens
cccuuuauuugaacaauga

SEQ ID NO: 409292 - RNA, 19 nt, Homo sapiens
uuagcgaacccuuuauuug

SEQ ID NO: 409293 - RNA, 19 nt, Homo sapiens
cuacuaccguuauacacau

SEQ ID NO: 409294 - RNA, 19 nt, Homo sapiens
ggucaguaguuuaaaaguu

SEQ ID NO: 409295 - RNA, 19 nt, Homo sapiens
caucuuauaugggaaacca

SEQ ID NO: 409296 - RNA, 19 nt, Homo sapiens
gggaacaugguuugacuca

SEQ ID NO: 409297 - RNA, 19 nt, Homo sapiens
cugguucauucuucagaua

SEQ ID NO: 409298 - RNA, 19 nt, Homo sapiens
ggacucaguggguuaacau

SEQ ID NO: 409299 - RNA, 19 nt, Homo sapiens
gaaaaucauaggcaccuuu

SEQ ID NO: 409300 - RNA, 19 nt, Homo sapiens
aaauguaaacucagcauca

SEQ ID NO: 409301 - RNA, 19 nt, Homo sapiens
uguuuggcauguaaaugua

SEQ ID NO: 409302 - RNA, 19 nt, Homo sapiens
ucuaaauguuuggcaugua

SEQ ID NO: 409303 - RNA, 19 nt, Homo sapiens
ccucaucagcccaguggua

SEQ ID NO: 409304 - RNA, 19 nt, Homo sapiens
agcgaacccuuuauuugaa

SEQ ID NO: 409305 - RNA, 19 nt, Homo sapiens
gcuacuaccguuauacaca

SEQ ID NO: 409306 - RNA, 19 nt, Homo sapiens
ugaccgagcugguguucac

SEQ ID NO: 409307 - RNA, 19 nt, Homo sapiens
caaacuuccuguucuacac

SEQ ID NO: 409308 - RNA, 19 nt, Homo sapiens
aacacaagaugcaacacaa

SEQ ID NO: 409309 - RNA, 19 nt, Homo sapiens
gccugcaacuucaguguca

SEQ ID NO: 409310 - RNA, 19 nt, Homo sapiens
gaaugcaacuucuucuuaa

SEQ ID NO: 409311 - RNA, 19 nt, Homo sapiens
gcugaugacuugaagauaa

SEQ ID NO: 409312 - RNA, 19 nt, Homo sapiens
gggacuagcucuucgcaua

SEQ ID NO: 409313 - RNA, 19 nt, Homo sapiens
gacagcagaugaggaauuu

SEQ ID NO: 409314 - RNA, 19 nt, Homo sapiens
ugaaguaucugugaacuau

SEQ ID NO: 409315 - RNA, 19 nt, Homo sapiens
gcuauagaguauuccauaa

SEQ ID NO: 409316 - RNA, 19 nt, Homo sapiens
gcagaaagaaugcaacuuc

SEQ ID NO: 409317 - RNA, 19 nt, Homo sapiens
gcguauacauuaucauaug

SEQ ID NO: 409318 - RNA, 19 nt, Homo sapiens
ggacuagcucuucgcauaa

SEQ ID NO: 409319 - RNA, 19 nt, Homo sapiens
gggcugaccaugacuguuu

SEQ ID NO: 409320 - RNA, 19 nt, Homo sapiens
ggucuccgcuccugauaau

SEQ ID NO: 409321 - RNA, 19 nt, Homo sapiens
ugagauuuauccacauuga

SEQ ID NO: 409322 - RNA, 19 nt, Homo sapiens
gcaagacacacacggagaa

SEQ ID NO: 409323 - RNA, 19 nt, Homo sapiens
gaucuucaaucagacauca

SEQ ID NO: 409324 - RNA, 19 nt, Homo sapiens
acacccaccucccaaacua

SEQ ID NO: 409325 - RNA, 19 nt, Homo sapiens
gaaacacccaccucccaaa

SEQ ID NO: 409326 - RNA, 19 nt, Homo sapiens
gggaugaaguaucugugaa

SEQ ID NO: 409327 - RNA, 19 nt, Homo sapiens
uaaccgcuauagaguauuc

SEQ ID NO: 409328 - RNA, 19 nt, Homo sapiens
gauccuucuucgaaaguuu

SEQ ID NO: 409329 - RNA, 19 nt, Homo sapiens
gagacggccauucagcuua

SEQ ID NO: 409330 - RNA, 19 nt, Homo sapiens
gaagcuccaugacucucuu

SEQ ID NO: 409331 - RNA, 19 nt, Homo sapiens
gaaauuaaaaccugccuuu

SEQ ID NO: 409332 - RNA, 19 nt, Homo sapiens
aaacauggagcucuaaauc

SEQ ID NO: 409333 - RNA, 19 nt, Homo sapiens
gaaacauggagcucuaaau

SEQ ID NO: 409334 - RNA, 19 nt, Homo sapiens
ggguuuaccugcuguuaag

SEQ ID NO: 409335 - RNA, 19 nt, Homo sapiens
cugaugacuugaagauaaa

SEQ ID NO: 409336 - RNA, 19 nt, Homo sapiens
uaccugcuguuaagaaaga

SEQ ID NO: 409337 - RNA, 19 nt, Homo sapiens
acacggagaagcagaaaga

SEQ ID NO: 409338 - RNA, 19 nt, Homo sapiens
uuuaaccgcuauagaguau

SEQ ID NO: 409339 - RNA, 19 nt, Homo sapiens
ccaugcugcucacugguuu

SEQ ID NO: 409340 - RNA, 19 nt, Homo sapiens
aagcuguuauguccuguuu

SEQ ID NO: 409341 - RNA, 19 nt, Homo sapiens
cggagaagcagaaagaaug

SEQ ID NO: 409342 - RNA, 19 nt, Homo sapiens
auggagcucuaaaucguua

SEQ ID NO: 409343 - RNA, 19 nt, Homo sapiens
agacggccauucagcuuau

SEQ ID NO: 409344 - RNA, 19 nt, Homo sapiens
gcaaccuggccaccauuaa

SEQ ID NO: 409345 - RNA, 19 nt, Homo sapiens
cccaaacuauucucuuuua

SEQ ID NO: 409346 - RNA, 19 nt, Homo sapiens
ugacagcagaugaggaauu

SEQ ID NO: 409347 - RNA, 19 nt, Homo sapiens
cucccaaacuauucucuuu

SEQ ID NO: 409348 - RNA, 19 nt, Homo sapiens
gcaacgcacuggccaugcu

SEQ ID NO: 409349 - RNA, 19 nt, Homo sapiens
gcuaagcugaugacuugaa

SEQ ID NO: 409350 - RNA, 19 nt, Homo sapiens
cgaccgagacggccauuca

SEQ ID NO: 409351 - RNA, 19 nt, Homo sapiens
acauggagcucuaaaucgu

SEQ ID NO: 409352 - RNA, 19 nt, Homo sapiens
gaugaaguaucugugaacu

SEQ ID NO: 409353 - RNA, 19 nt, Homo sapiens
cuugagauuuauccacauu

SEQ ID NO: 409354 - RNA, 19 nt, Homo sapiens
gaaguaucugugaacuauu

SEQ ID NO: 409355 - RNA, 19 nt, Homo sapiens
caaccuggccaccauuaag

SEQ ID NO: 409356 - RNA, 19 nt, Homo sapiens
gcaacgggacuagcucuuc

SEQ ID NO: 409357 - RNA, 19 nt, Homo sapiens
gagauuuauccacauugaa

SEQ ID NO: 409358 - RNA, 19 nt, Homo sapiens
caggaucacaucacuggaa

SEQ ID NO: 409359 - RNA, 19 nt, Homo sapiens
ugcaacuucuucuuaauag

SEQ ID NO: 409360 - RNA, 19 nt, Homo sapiens
gcuguuauguccuguuucc

SEQ ID NO: 409361 - RNA, 19 nt, Homo sapiens
gagagcaagcgcaagaagu

SEQ ID NO: 409362 - RNA, 19 nt, Homo sapiens
ggagagcaagcgcaagaag

SEQ ID NO: 409363 - RNA, 19 nt, Homo sapiens
uuucuucgccucugccuuu

SEQ ID NO: 409364 - RNA, 19 nt, Homo sapiens
gggcucuccucguuguuca

SEQ ID NO: 409365 - RNA, 19 nt, Homo sapiens
cgcuauagaguauuccaua

SEQ ID NO: 409366 - RNA, 19 nt, Homo sapiens
auugaaacauggagcucua

SEQ ID NO: 409367 - RNA, 19 nt, Homo sapiens
ucuccgcuccugauaauga

SEQ ID NO: 409368 - RNA, 19 nt, Homo sapiens
ccaaggccacggcaucuca

SEQ ID NO: 409369 - RNA, 19 nt, Homo sapiens
ugaaacauggagcucuaaa

SEQ ID NO: 409370 - RNA, 19 nt, Homo sapiens
caacuucuucuuaauagcu

SEQ ID NO: 409371 - RNA, 19 nt, Homo sapiens
ccucgaagccaacaugaag

SEQ ID NO: 409372 - RNA, 19 nt, Homo sapiens
cuaagcugaugacuugaag

SEQ ID NO: 409373 - RNA, 19 nt, Homo sapiens
acucagagagcaagagaug

SEQ ID NO: 409374 - RNA, 19 nt, Homo sapiens
cgaaaguuuugccagauga

SEQ ID NO: 409375 - RNA, 19 nt, Homo sapiens
uuuaccugcuguuaagaaa

SEQ ID NO: 409376 - RNA, 19 nt, Homo sapiens
ggagaagcagaaagaaugc

SEQ ID NO: 409377 - RNA, 19 nt, Homo sapiens
cgagacggccauucagcuu

SEQ ID NO: 409378 - RNA, 19 nt, Homo sapiens
ucguguaccuguccaagca

SEQ ID NO: 409379 - RNA, 19 nt, Homo sapiens
cccaggacuuggugcaguu

SEQ ID NO: 409380 - RNA, 19 nt, Homo sapiens
gcaagcgcaagaaguccuu

SEQ ID NO: 409381 - RNA, 19 nt, Homo sapiens
cgggagagcaagcgcaaga

SEQ ID NO: 409382 - RNA, 19 nt, Homo sapiens
gcaacuucuucuuaauagc

SEQ ID NO: 409383 - RNA, 19 nt, Homo sapiens
ggaugaaguaucugugaac

SEQ ID NO: 409384 - RNA, 19 nt, Homo sapiens
gaagacucagagagcaaga

SEQ ID NO: 409385 - RNA, 19 nt, Homo sapiens
ucuuggauccuuggguuua

SEQ ID NO: 409386 - RNA, 19 nt, Homo sapiens
agacacacacggagaagca

SEQ ID NO: 409387 - RNA, 19 nt, Homo sapiens
ccuguuuccauacauguuu

SEQ ID NO: 409388 - RNA, 19 nt, Homo sapiens
gaagcuguuauguccuguu

SEQ ID NO: 409389 - RNA, 19 nt, Homo sapiens
gacuagcucuucgcauaac

SEQ ID NO: 409390 - RNA, 19 nt, Homo sapiens
gaaagacagugcucaguaa

SEQ ID NO: 409391 - RNA, 19 nt, Homo sapiens
ggaaagaaauacaguacug

SEQ ID NO: 409392 - RNA, 19 nt, Homo sapiens
gaagacaccaccucacuga

SEQ ID NO: 409393 - RNA, 19 nt, Homo sapiens
guaaagcaauagagaagau

SEQ ID NO: 409394 - RNA, 19 nt, Homo sapiens
caauagagaagaucaaaug

SEQ ID NO: 409395 - RNA, 19 nt, Homo sapiens
gugaaacacugaacuuauc

SEQ ID NO: 409396 - RNA, 19 nt, Homo sapiens
ggacucgucuuugaaggaa

SEQ ID NO: 409397 - RNA, 19 nt, Homo sapiens
caucaaccaugccuauuuc

SEQ ID NO: 409398 - RNA, 19 nt, Homo sapiens
uaagaaauccagcaccauu

SEQ ID NO: 409399 - RNA, 19 nt, Homo sapiens
uauauauccuccugagaaa

SEQ ID NO: 409400 - RNA, 19 nt, Homo sapiens
caaggaaagaaauacagua

SEQ ID NO: 409401 - RNA, 19 nt, Homo sapiens
agaaagacagugcucagua

SEQ ID NO: 409402 - RNA, 19 nt, Homo sapiens
ggacuuugcgaauaucaga

SEQ ID NO: 409403 - RNA, 19 nt, Homo sapiens
guacagcaccuucauucug

SEQ ID NO: 409404 - RNA, 19 nt, Homo sapiens
acauuuagcugugcucaga

SEQ ID NO: 409405 - RNA, 19 nt, Homo sapiens
gaauaucagagaccucaga

SEQ ID NO: 409406 - RNA, 19 nt, Homo sapiens
ugaaggagaucagcaguac

SEQ ID NO: 409407 - RNA, 19 nt, Homo sapiens
ggagcgagaagucaguaaa

SEQ ID NO: 409408 - RNA, 19 nt, Homo sapiens
ccaucaaccaugccuauuu

SEQ ID NO: 409409 - RNA, 19 nt, Homo sapiens
gaguacagcaccuucauuc

SEQ ID NO: 409410 - RNA, 19 nt, Homo sapiens
ccacugagaccggcuuuga

SEQ ID NO: 409411 - RNA, 19 nt, Homo sapiens
cagcaccauucuucacuga

SEQ ID NO: 409412 - RNA, 19 nt, Homo sapiens
acugaggacuuugcgaaua

SEQ ID NO: 409413 - RNA, 19 nt, Homo sapiens
gaguauucgucaaccaguu

SEQ ID NO: 409414 - RNA, 19 nt, Homo sapiens
uuugaaagcuggcaacucu

SEQ ID NO: 409415 - RNA, 19 nt, Homo sapiens
gcaaggaaagaaauacagu

SEQ ID NO: 409416 - RNA, 19 nt, Homo sapiens
cugaggacuuugcgaauau

SEQ ID NO: 409417 - RNA, 19 nt, Homo sapiens
ccgaagauuuggcaguuuc

SEQ ID NO: 409418 - RNA, 19 nt, Homo sapiens
uugagaagccgaagauuug

SEQ ID NO: 409419 - RNA, 19 nt, Homo sapiens
uauaauaggcaaggaaaga

SEQ ID NO: 409420 - RNA, 19 nt, Homo sapiens
gcaauagagaagaucaaau

SEQ ID NO: 409421 - RNA, 19 nt, Homo sapiens
ugaaagcuggcaacucuga

SEQ ID NO: 409422 - RNA, 19 nt, Homo sapiens
ccgaauugcuucugugaac

SEQ ID NO: 409423 - RNA, 19 nt, Homo sapiens
ccaguuauaucagccaagu

SEQ ID NO: 409424 - RNA, 19 nt, Homo sapiens
guagcucgcggcugcagua

SEQ ID NO: 409425 - RNA, 19 nt, Homo sapiens
gcgccgagauccagauggu

SEQ ID NO: 409426 - RNA, 19 nt, Homo sapiens
caaccaugccuauuucuac

SEQ ID NO: 409427 - RNA, 19 nt, Homo sapiens
uaauaggcaaggaaagaaa

SEQ ID NO: 409428 - RNA, 19 nt, Homo sapiens
cuagaccccuggauauaua

SEQ ID NO: 409429 - RNA, 19 nt, Homo sapiens
gaaauccagcaccauucuu

SEQ ID NO: 409430 - RNA, 19 nt, Homo sapiens
gcaccuucauucugcucuu

SEQ ID NO: 409431 - RNA, 19 nt, Homo sapiens
guacaugaagggccaaugg

SEQ ID NO: 409432 - RNA, 19 nt, Homo sapiens
gcucagaagggcuaucauc

SEQ ID NO: 409433 - RNA, 19 nt, Homo sapiens
uauauccuccugagaaaga

SEQ ID NO: 409434 - RNA, 19 nt, Homo sapiens
auauauauccuccugagaa

SEQ ID NO: 409435 - RNA, 19 nt, Homo sapiens
guauauaauaggcaaggaa

SEQ ID NO: 409436 - RNA, 19 nt, Homo sapiens
cuucagcuccuuccucauu

SEQ ID NO: 409437 - RNA, 19 nt, Homo sapiens
gccgaagauuuggcaguuu

SEQ ID NO: 409438 - RNA, 19 nt, Homo sapiens
ucaguaaagcaauagagaa

SEQ ID NO: 409439 - RNA, 19 nt, Homo sapiens
agacugagcaggacaaggu

SEQ ID NO: 409440 - RNA, 19 nt, Homo sapiens
uacuguuucuggacccuua

SEQ ID NO: 409441 - RNA, 19 nt, Homo sapiens
cccgggagcugaaggagau

SEQ ID NO: 409442 - RNA, 19 nt, Homo sapiens
aaauagcgaguaagaaauc

SEQ ID NO: 409443 - RNA, 19 nt, Homo sapiens
aaagacagugcucaguaaa

SEQ ID NO: 409444 - RNA, 19 nt, Homo sapiens
uuugagaagccgaagauuu

SEQ ID NO: 409445 - RNA, 19 nt, Homo sapiens
aguuauaucagccaaguuu

SEQ ID NO: 409446 - RNA, 19 nt, Homo sapiens
auggucaucuuacucauug

SEQ ID NO: 409447 - RNA, 19 nt, Homo sapiens
gaccaucgccacguacaug

SEQ ID NO: 409448 - RNA, 19 nt, Homo sapiens
gcaccgccagccacuauca

SEQ ID NO: 409449 - RNA, 19 nt, Homo sapiens
gcacagccucacaccugaa

SEQ ID NO: 409450 - RNA, 19 nt, Homo sapiens
ucaaccaugccuauuucua

SEQ ID NO: 409451 - RNA, 19 nt, Homo sapiens
agacagugcucaguaaagc

SEQ ID NO: 409452 - RNA, 19 nt, Homo sapiens
gagaaagacagugcucagu

SEQ ID NO: 409453 - RNA, 19 nt, Homo sapiens
aguauucgucaaccaguua

SEQ ID NO: 409454 - RNA, 19 nt, Homo sapiens
ggccaucaaccaugccuau

SEQ ID NO: 409455 - RNA, 19 nt, Homo sapiens
ugcaauagacacauacaug

SEQ ID NO: 409456 - RNA, 19 nt, Homo sapiens
ugaaacacugaacuuauca

SEQ ID NO: 409457 - RNA, 19 nt, Homo sapiens
cgaguacagcaccuucauu

SEQ ID NO: 409458 - RNA, 19 nt, Homo sapiens
gcugggacucgucuuugaa

SEQ ID NO: 409459 - RNA, 19 nt, Homo sapiens
caguaaagcaauagagaag

SEQ ID NO: 409460 - RNA, 19 nt, Homo sapiens
cuacagacccagccuugca

SEQ ID NO: 409461 - RNA, 19 nt, Homo sapiens
aaccaugccuauuucuaca

SEQ ID NO: 409462 - RNA, 19 nt, Homo sapiens
gggacucgucuuugaagga

SEQ ID NO: 409463 - RNA, 19 nt, Homo sapiens
cggugaccaucgccacgua

SEQ ID NO: 409464 - RNA, 19 nt, Homo sapiens
gugucuuacugguggauga

SEQ ID NO: 409465 - RNA, 19 nt, Homo sapiens
uugcaggccauccgaauug

SEQ ID NO: 409466 - RNA, 19 nt, Homo sapiens
agccgaagauuuggcaguu

SEQ ID NO: 409467 - RNA, 19 nt, Homo sapiens
gagcgagaagucaguaaaa

SEQ ID NO: 409468 - RNA, 19 nt, Homo sapiens
ucaauucguccgccuccuu

SEQ ID NO: 409469 - RNA, 19 nt, Homo sapiens
gagcuuaucugucuuauuu

SEQ ID NO: 409470 - RNA, 19 nt, Homo sapiens
uuaaauaccuguagccuaa

SEQ ID NO: 409471 - RNA, 19 nt, Homo sapiens
uaggaaaucuggugaagua

SEQ ID NO: 409472 - RNA, 19 nt, Homo sapiens
gaggagaucuugcaacaug

SEQ ID NO: 409473 - RNA, 19 nt, Homo sapiens
ggagaugacuugagugguu

SEQ ID NO: 409474 - RNA, 19 nt, Homo sapiens
guacaaugcuucuaugaau

SEQ ID NO: 409475 - RNA, 19 nt, Homo sapiens
gucaucagcuuacauauuu

SEQ ID NO: 409476 - RNA, 19 nt, Homo sapiens
gauguuaacccaagaagua

SEQ ID NO: 409477 - RNA, 19 nt, Homo sapiens
gagagcagguucauuaaau

SEQ ID NO: 409478 - RNA, 19 nt, Homo sapiens
ggaaaucauucucuggaaa

SEQ ID NO: 409479 - RNA, 19 nt, Homo sapiens
ggaagguaguccugcuuua

SEQ ID NO: 409480 - RNA, 19 nt, Homo sapiens
uaucagagauuuagacaga

SEQ ID NO: 409481 - RNA, 19 nt, Homo sapiens
gaaggcauaucagagauuu

SEQ ID NO: 409482 - RNA, 19 nt, Homo sapiens
gcagaauucuugcuguauu

SEQ ID NO: 409483 - RNA, 19 nt, Homo sapiens
ggagaggcauggagaagaa

SEQ ID NO: 409484 - RNA, 19 nt, Homo sapiens
caaggcagaucucaucauu

SEQ ID NO: 409485 - RNA, 19 nt, Homo sapiens
cagcugcgcuucuuucaaa

SEQ ID NO: 409486 - RNA, 19 nt, Homo sapiens
gcuaguguguuucuucuuu

SEQ ID NO: 409487 - RNA, 19 nt, Homo sapiens
gcacauugaugggcaacua

SEQ ID NO: 409488 - RNA, 19 nt, Homo sapiens
guugagagcagguucauua

SEQ ID NO: 409489 - RNA, 19 nt, Homo sapiens
ggacugccuacauuuauua

SEQ ID NO: 409490 - RNA, 19 nt, Homo sapiens
uaagacauguuuggcaaua

SEQ ID NO: 409491 - RNA, 19 nt, Homo sapiens
caagaugucuggacugcaa

SEQ ID NO: 409492 - RNA, 19 nt, Homo sapiens
acuaggagaucaagagaua

SEQ ID NO: 409493 - RNA, 19 nt, Homo sapiens
gaacaauuccaaacagcua

SEQ ID NO: 409494 - RNA, 19 nt, Homo sapiens
ccacaacaauguccaugaa

SEQ ID NO: 409495 - RNA, 19 nt, Homo sapiens
ccuugaggcuucuaaauaa

SEQ ID NO: 409496 - RNA, 19 nt, Homo sapiens
gaucaccgcucuguagcua

SEQ ID NO: 409497 - RNA, 19 nt, Homo sapiens
caacacagaagacaucaaa

SEQ ID NO: 409498 - RNA, 19 nt, Homo sapiens
ggaaaccugugaaacaaca

SEQ ID NO: 409499 - RNA, 19 nt, Homo sapiens
gcaaugcaaucacaggaau

SEQ ID NO: 409500 - RNA, 19 nt, Homo sapiens
gcagugugauggccauuga

SEQ ID NO: 409501 - RNA, 19 nt, Homo sapiens
ggagaucaagagauaauaa

SEQ ID NO: 409502 - RNA, 19 nt, Homo sapiens
gaagcuacaugccaaugau

SEQ ID NO: 409503 - RNA, 19 nt, Homo sapiens
gagcuuaguuccauuaaaa

SEQ ID NO: 409504 - RNA, 19 nt, Homo sapiens
ucuauaagcuugccaguca

SEQ ID NO: 409505 - RNA, 19 nt, Homo sapiens
aggcagaucucaucauuug

SEQ ID NO: 409506 - RNA, 19 nt, Homo sapiens
cuaggucuaucagaaauua

SEQ ID NO: 409507 - RNA, 19 nt, Homo sapiens
gcaauccuaucuagaaugg

SEQ ID NO: 409508 - RNA, 19 nt, Homo sapiens
gguuaucuauguuaucuga

SEQ ID NO: 409509 - RNA, 19 nt, Homo sapiens
uuacauauuugggagcuua

SEQ ID NO: 409510 - RNA, 19 nt, Homo sapiens
gauuucagauucucuagga

SEQ ID NO: 409511 - RNA, 19 nt, Homo sapiens
gagcagguucauuaaauuu

SEQ ID NO: 409512 - RNA, 19 nt, Homo sapiens
caaauaaacaggauaacug

SEQ ID NO: 409513 - RNA, 19 nt, Homo sapiens
gcagagaaaucagcaagca

SEQ ID NO: 409514 - RNA, 19 nt, Homo sapiens
caggauaacuguacauuuu

SEQ ID NO: 409515 - RNA, 19 nt, Homo sapiens
caauguccaugaacaauuc

SEQ ID NO: 409516 - RNA, 19 nt, Homo sapiens
caaagacuaucugcagcua

SEQ ID NO: 409517 - RNA, 19 nt, Homo sapiens
aaugauaggugcaaagaau

SEQ ID NO: 409518 - RNA, 19 nt, Homo sapiens
gcagguucauuaaauuugu

SEQ ID NO: 409519 - RNA, 19 nt, Homo sapiens
agacauguuuggcaauauu

SEQ ID NO: 409520 - RNA, 19 nt, Homo sapiens
gugggaaucuugucaaaca

SEQ ID NO: 409521 - RNA, 19 nt, Homo sapiens
guaguccugcuuuauaaua

SEQ ID NO: 409522 - RNA, 19 nt, Homo sapiens
caaacucuaccauggauaa

SEQ ID NO: 409523 - RNA, 19 nt, Homo sapiens
ccauagcaguauuuguaua

SEQ ID NO: 409524 - RNA, 19 nt, Homo sapiens
caacauggaaucaaaucuu

SEQ ID NO: 409525 - RNA, 19 nt, Homo sapiens
gcucuuagcccuugguguu

SEQ ID NO: 409526 - RNA, 19 nt, Homo sapiens
aaaccggcuuuccguauuu

SEQ ID NO: 409527 - RNA, 19 nt, Homo sapiens
ggaggguuaucuauguuau

SEQ ID NO: 409528 - RNA, 19 nt, Homo sapiens
gaagguaguccugcuuuau

SEQ ID NO: 409529 - RNA, 19 nt, Homo sapiens
ggcaauauuucaguuaguu

SEQ ID NO: 409530 - RNA, 19 nt, Homo sapiens
ggagcuuaguuccauuaaa

SEQ ID NO: 409531 - RNA, 19 nt, Homo sapiens
cagaauucuugcuguauug

SEQ ID NO: 409532 - RNA, 19 nt, Homo sapiens
cagcagagaauuuauuuca

SEQ ID NO: 409533 - RNA, 19 nt, Homo sapiens
uuaugaaggucgauuguug

SEQ ID NO: 409534 - RNA, 19 nt, Homo sapiens
ccaagaaguagacaucaaa

SEQ ID NO: 409535 - RNA, 19 nt, Homo sapiens
gaguguugaugucuuguga

SEQ ID NO: 409536 - RNA, 19 nt, Homo sapiens
ucagaugguuuauuugcuu

SEQ ID NO: 409537 - RNA, 19 nt, Homo sapiens
caaauuguccuaggucuau

SEQ ID NO: 409538 - RNA, 19 nt, Homo sapiens
guaagauggcauauucuaa

SEQ ID NO: 409539 - RNA, 19 nt, Homo sapiens
cuaguguguuucuucuuua

SEQ ID NO: 409540 - RNA, 19 nt, Homo sapiens
uauaacaaccucugcauau

SEQ ID NO: 409541 - RNA, 19 nt, Homo sapiens
ggucuaaugccucuacuug

SEQ ID NO: 409542 - RNA, 19 nt, Homo sapiens
gcagaucucaucauuugga

SEQ ID NO: 409543 - RNA, 19 nt, Homo sapiens
ggucaugacacccagaauu

SEQ ID NO: 409544 - RNA, 19 nt, Homo sapiens
ggagugagagagaugugua

SEQ ID NO: 409545 - RNA, 19 nt, Homo sapiens
uaacaaccucugcauauuc

SEQ ID NO: 409546 - RNA, 19 nt, Homo sapiens
gcccauuucugguuacaau

SEQ ID NO: 409547 - RNA, 19 nt, Homo sapiens
uuaggaggguuaucuaugu

SEQ ID NO: 409548 - RNA, 19 nt, Homo sapiens
auaaauggcagaauucuug

SEQ ID NO: 409549 - RNA, 19 nt, Homo sapiens
acaauuaacuaggagauca

SEQ ID NO: 409550 - RNA, 19 nt, Homo sapiens
gaauuacagcaguuucaaa

SEQ ID NO: 409551 - RNA, 19 nt, Homo sapiens
cagaauucaugaugguuug

SEQ ID NO: 409552 - RNA, 19 nt, Homo sapiens
ugaagauacuauugucaga

SEQ ID NO: 409553 - RNA, 19 nt, Homo sapiens
uaaugugugucuccuguau

SEQ ID NO: 409554 - RNA, 19 nt, Homo sapiens
uggcagaauucuugcugua

SEQ ID NO: 409555 - RNA, 19 nt, Homo sapiens
cagagaacaucuuaaugca

SEQ ID NO: 409556 - RNA, 19 nt, Homo sapiens
caacaauguccaugaacaa

SEQ ID NO: 409557 - RNA, 19 nt, Homo sapiens
gauccgcuuugaccaauca

SEQ ID NO: 409558 - RNA, 19 nt, Homo sapiens
gcaaggcuuuaaggaguga

SEQ ID NO: 409559 - RNA, 19 nt, Homo sapiens
agaagaaacucucauucag

SEQ ID NO: 409560 - RNA, 19 nt, Homo sapiens
ggccugggaugacaagaug

SEQ ID NO: 409561 - RNA, 19 nt, Homo sapiens
uuuguaagauggcauauuc

SEQ ID NO: 409562 - RNA, 19 nt, Homo sapiens
agagcagguucauuaaauu

SEQ ID NO: 409563 - RNA, 19 nt, Homo sapiens
gcccauucuugucacauuu

SEQ ID NO: 409564 - RNA, 19 nt, Homo sapiens
gcacagacaaggcagaucu

SEQ ID NO: 409565 - RNA, 19 nt, Homo sapiens
acacagaagacaucaaaga

SEQ ID NO: 409566 - RNA, 19 nt, Homo sapiens
aagaauggauccgcuuuga

SEQ ID NO: 409567 - RNA, 19 nt, Homo sapiens
ggccauguguacugacuug

SEQ ID NO: 409568 - RNA, 19 nt, Homo sapiens
uguccuaggucuaucagaa

SEQ ID NO: 409569 - RNA, 19 nt, Homo sapiens
ggacagaggaaacguuuau

SEQ ID NO: 409570 - RNA, 19 nt, Homo sapiens
gaaugguucucucaaaaua

SEQ ID NO: 409571 - RNA, 19 nt, Homo sapiens
gcaggaaccucaccuacgu

SEQ ID NO: 409572 - RNA, 19 nt, Homo sapiens
gacaugugcuugguacaaa

SEQ ID NO: 409573 - RNA, 19 nt, Homo sapiens
gaccugggauggcggauuc

SEQ ID NO: 409574 - RNA, 19 nt, Homo sapiens
aaaccacaguuauuggaaa

SEQ ID NO: 409575 - RNA, 19 nt, Homo sapiens
ccaucucauugucuaaaua

SEQ ID NO: 409576 - RNA, 19 nt, Homo sapiens
cauugugggugaugacgua

SEQ ID NO: 409577 - RNA, 19 nt, Homo sapiens
ggacaugugcuugguacaa

SEQ ID NO: 409578 - RNA, 19 nt, Homo sapiens
ccauccaucucauugucua

SEQ ID NO: 409579 - RNA, 19 nt, Homo sapiens
gaagagagugagggacaga

SEQ ID NO: 409580 - RNA, 19 nt, Homo sapiens
cuaccaagccacuccaaga

SEQ ID NO: 409581 - RNA, 19 nt, Homo sapiens
uccaaucugcguccacuua

SEQ ID NO: 409582 - RNA, 19 nt, Homo sapiens
ugacguaggacaugugcuu

SEQ ID NO: 409583 - RNA, 19 nt, Homo sapiens
gcugcuggcucugggaaga

SEQ ID NO: 409584 - RNA, 19 nt, Homo sapiens
ggagcugcgugccuuuguc

SEQ ID NO: 409585 - RNA, 19 nt, Homo sapiens
uuuagaaggcggagaaguu

SEQ ID NO: 409586 - RNA, 19 nt, Homo sapiens
guaggacaugugcuuggua

SEQ ID NO: 409587 - RNA, 19 nt, Homo sapiens
gacaggagccagaaaauca

SEQ ID NO: 409588 - RNA, 19 nt, Homo sapiens
ugugaucucugcccugucu

SEQ ID NO: 409589 - RNA, 19 nt, Homo sapiens
gugaugacguaggacaugu

SEQ ID NO: 409590 - RNA, 19 nt, Homo sapiens
ccucugcuccugugggaaa

SEQ ID NO: 409591 - RNA, 19 nt, Homo sapiens
ccacggagacucgcagaca

SEQ ID NO: 409592 - RNA, 19 nt, Homo sapiens
cccugggucuucauccuuu

SEQ ID NO: 409593 - RNA, 19 nt, Homo sapiens
ugacagcagcagugagaug

SEQ ID NO: 409594 - RNA, 19 nt, Homo sapiens
ccugacagcagcagugaga

SEQ ID NO: 409595 - RNA, 19 nt, Homo sapiens
gcugauggcugcggaugcu

SEQ ID NO: 409596 - RNA, 19 nt, Homo sapiens
agaggcuucuguacaguca

SEQ ID NO: 409597 - RNA, 19 nt, Homo sapiens
gggacagaggaaacguuua

SEQ ID NO: 409598 - RNA, 19 nt, Homo sapiens
ccacuuaggaggcccaacu

SEQ ID NO: 409599 - RNA, 19 nt, Homo sapiens
gagggacagaggaaacguu

SEQ ID NO: 409600 - RNA, 19 nt, Homo sapiens
gccaacaccagcaguacug

SEQ ID NO: 409601 - RNA, 19 nt, Homo sapiens
ggugaugacguaggacaug

SEQ ID NO: 409602 - RNA, 19 nt, Homo sapiens
ccaccagcacccugauguu

SEQ ID NO: 409603 - RNA, 19 nt, Homo sapiens
gcaaauggcuggagaguua

SEQ ID NO: 409604 - RNA, 19 nt, Homo sapiens
ggaaacggcugaagaauua

SEQ ID NO: 409605 - RNA, 19 nt, Homo sapiens
gaaacaggcucugagauuu

SEQ ID NO: 409606 - RNA, 19 nt, Homo sapiens
gaaacaugcugaaaucuau

SEQ ID NO: 409607 - RNA, 19 nt, Homo sapiens
ggaauacucuuucuuucuu

SEQ ID NO: 409608 - RNA, 19 nt, Homo sapiens
gaagcacggugacaucuuu

SEQ ID NO: 409609 - RNA, 19 nt, Homo sapiens
cuaaugaaguguuuccuua

SEQ ID NO: 409610 - RNA, 19 nt, Homo sapiens
gaaccacagucauuaguga

SEQ ID NO: 409611 - RNA, 19 nt, Homo sapiens
gcggagagcucgagaguau

SEQ ID NO: 409612 - RNA, 19 nt, Homo sapiens
ggacauauguuaggaauac

SEQ ID NO: 409613 - RNA, 19 nt, Homo sapiens
ggacaauucuucucgacuu

SEQ ID NO: 409614 - RNA, 19 nt, Homo sapiens
ccacucagcugaugucuuc

SEQ ID NO: 409615 - RNA, 19 nt, Homo sapiens
agacggaguuucacgcuua

SEQ ID NO: 409616 - RNA, 19 nt, Homo sapiens
ggaaacaugcugaaaucua

SEQ ID NO: 409617 - RNA, 19 nt, Homo sapiens
ccaaguagcugagauuaca

SEQ ID NO: 409618 - RNA, 19 nt, Homo sapiens
gacucugucucaauaaaua

SEQ ID NO: 409619 - RNA, 19 nt, Homo sapiens
ggugacaucuuuacuauac

SEQ ID NO: 409620 - RNA, 19 nt, Homo sapiens
gaagcaagccggcagaaau

SEQ ID NO: 409621 - RNA, 19 nt, Homo sapiens
gcuaugcgcuaguuaggaa

SEQ ID NO: 409622 - RNA, 19 nt, Homo sapiens
ccaauaauccuuaaacuag

SEQ ID NO: 409623 - RNA, 19 nt, Homo sapiens
cuaagagggugaacaaaga

SEQ ID NO: 409624 - RNA, 19 nt, Homo sapiens
caacagcaucaaacaauuu

SEQ ID NO: 409625 - RNA, 19 nt, Homo sapiens
gaucucagcucaccacaac

SEQ ID NO: 409626 - RNA, 19 nt, Homo sapiens
gagcaacuccuguucuuug

SEQ ID NO: 409627 - RNA, 19 nt, Homo sapiens
ggaguggaguucucuguuc

SEQ ID NO: 409628 - RNA, 19 nt, Homo sapiens
gagauaagcaaguguuaga

SEQ ID NO: 409629 - RNA, 19 nt, Homo sapiens
ccagagagacgcugugauu

SEQ ID NO: 409630 - RNA, 19 nt, Homo sapiens
ucacgaggaugaaggagaa

SEQ ID NO: 409631 - RNA, 19 nt, Homo sapiens
gcugaagaauuacaacaug

SEQ ID NO: 409632 - RNA, 19 nt, Homo sapiens
gaucagagaagaaagacuu

SEQ ID NO: 409633 - RNA, 19 nt, Homo sapiens
gcugaaaucuauuaaacca

SEQ ID NO: 409634 - RNA, 19 nt, Homo sapiens
gaauuacacucaaggaaaa

SEQ ID NO: 409635 - RNA, 19 nt, Homo sapiens
ggaugaaacugacucuucu

SEQ ID NO: 409636 - RNA, 19 nt, Homo sapiens
gggaaacggcugaagaauu

SEQ ID NO: 409637 - RNA, 19 nt, Homo sapiens
cuucaucccuugcuuaaga

SEQ ID NO: 409638 - RNA, 19 nt, Homo sapiens
cacagucauuagugaauua

SEQ ID NO: 409639 - RNA, 19 nt, Homo sapiens
ucacaggucuugcccaaag

SEQ ID NO: 409640 - RNA, 19 nt, Homo sapiens
ugccucagcuucccaagua

SEQ ID NO: 409641 - RNA, 19 nt, Homo sapiens
gcucaggagacgauuauuu

SEQ ID NO: 409642 - RNA, 19 nt, Homo sapiens
ugaaagcucuauggauuau

SEQ ID NO: 409643 - RNA, 19 nt, Homo sapiens
gaccacaugugcaguguca

SEQ ID NO: 409644 - RNA, 19 nt, Homo sapiens
ccggcuaccugacucuuua

SEQ ID NO: 409645 - RNA, 19 nt, Homo sapiens
guggaaacaugcugaaauc

SEQ ID NO: 409646 - RNA, 19 nt, Homo sapiens
cguauaacauugucaagug

SEQ ID NO: 409647 - RNA, 19 nt, Homo sapiens
gcacucagguagggagcua

SEQ ID NO: 409648 - RNA, 19 nt, Homo sapiens
ucaacagcaucaaacaauu

SEQ ID NO: 409649 - RNA, 19 nt, Homo sapiens
gaguagcagugauuguuau

SEQ ID NO: 409650 - RNA, 19 nt, Homo sapiens
agaaauagcuauggaaggu

SEQ ID NO: 409651 - RNA, 19 nt, Homo sapiens
auugaaagcucuauggauu

SEQ ID NO: 409652 - RNA, 19 nt, Homo sapiens
ggagaaacaggcucugaga

SEQ ID NO: 409653 - RNA, 19 nt, Homo sapiens
aauagaaagugaccaugaa

SEQ ID NO: 409654 - RNA, 19 nt, Homo sapiens
caccacacccggcuaauuu

SEQ ID NO: 409655 - RNA, 19 nt, Homo sapiens
ccucacagcaucucuauga

SEQ ID NO: 409656 - RNA, 19 nt, Homo sapiens
ccagagagacccagaaauc

SEQ ID NO: 409657 - RNA, 19 nt, Homo sapiens
cgaccacucucccacagaa

SEQ ID NO: 409658 - RNA, 19 nt, Homo sapiens
gcagguaugucaccguucu

SEQ ID NO: 409659 - RNA, 19 nt, Homo sapiens
cuacacagacccagaggua

SEQ ID NO: 409660 - RNA, 19 nt, Homo sapiens
cagaagccauguauaccaa

SEQ ID NO: 409661 - RNA, 19 nt, Homo sapiens
agaaacaggcucugagauu

SEQ ID NO: 409662 - RNA, 19 nt, Homo sapiens
uuaccuggaugccauugua

SEQ ID NO: 409663 - RNA, 19 nt, Homo sapiens
ugaauuacacucaaggaaa

SEQ ID NO: 409664 - RNA, 19 nt, Homo sapiens
ccacagucauuagugaauu

SEQ ID NO: 409665 - RNA, 19 nt, Homo sapiens
ucuuagaagugacauugua

SEQ ID NO: 409666 - RNA, 19 nt, Homo sapiens
gcaccaggcucgacuucca

SEQ ID NO: 409667 - RNA, 19 nt, Homo sapiens
gacagaagcaggaguaagu

SEQ ID NO: 409668 - RNA, 19 nt, Homo sapiens
ccaaagugcugggauuaca

SEQ ID NO: 409669 - RNA, 19 nt, Homo sapiens
caaaauuacuggacauaug

SEQ ID NO: 409670 - RNA, 19 nt, Homo sapiens
gagagacccuacagacagu

SEQ ID NO: 409671 - RNA, 19 nt, Homo sapiens
caacgcagauguggagauc

SEQ ID NO: 409672 - RNA, 19 nt, Homo sapiens
gagaugaguggguuagcua

SEQ ID NO: 409673 - RNA, 19 nt, Homo sapiens
aagcaagccggcagaaaua

SEQ ID NO: 409674 - RNA, 19 nt, Homo sapiens
caauucaccucguuacucu

SEQ ID NO: 409675 - RNA, 19 nt, Homo sapiens
gauaagcaaguguuagaau

SEQ ID NO: 409676 - RNA, 19 nt, Homo sapiens
ccaccacgcccaacugauu

SEQ ID NO: 409677 - RNA, 19 nt, Homo sapiens
ucacagaagccauguauac

SEQ ID NO: 409678 - RNA, 19 nt, Homo sapiens
cucaggagacgauuauuua

SEQ ID NO: 409679 - RNA, 19 nt, Homo sapiens
aaacuuggguacaucuugu

SEQ ID NO: 409680 - RNA, 19 nt, Homo sapiens
guuaggaaguuaccuggau

SEQ ID NO: 409681 - RNA, 19 nt, Homo sapiens
gcuguuaccugagauacug

SEQ ID NO: 409682 - RNA, 19 nt, Homo sapiens
ugaguagcagugauuguua

SEQ ID NO: 409683 - RNA, 19 nt, Homo sapiens
uaagcaaguguuagaauug

SEQ ID NO: 409684 - RNA, 19 nt, Homo sapiens
gcaccagaauugcuugaac

SEQ ID NO: 409685 - RNA, 19 nt, Homo sapiens
gaggugggcggaucacuug

SEQ ID NO: 409686 - RNA, 19 nt, Homo sapiens
gauuauccacugcaaaguu

SEQ ID NO: 409687 - RNA, 19 nt, Homo sapiens
caucuuuacuauacugguu

SEQ ID NO: 409688 - RNA, 19 nt, Homo sapiens
caggagacgauuauuuaaa

SEQ ID NO: 409689 - RNA, 19 nt, Homo sapiens
gaagacacagcccagacaa

SEQ ID NO: 409690 - RNA, 19 nt, Homo sapiens
gcuaagagggugaacaaag

SEQ ID NO: 409691 - RNA, 19 nt, Homo sapiens
caauaguggauaacaugua

SEQ ID NO: 409692 - RNA, 19 nt, Homo sapiens
ccaaagugcuaggauuaca

SEQ ID NO: 409693 - RNA, 19 nt, Homo sapiens
gccauuguauuucuucauc

SEQ ID NO: 409694 - RNA, 19 nt, Homo sapiens
ggaggguugugcccacuuc

SEQ ID NO: 409695 - RNA, 19 nt, Homo sapiens
aaaagaaggugccgauuuc

SEQ ID NO: 409696 - RNA, 19 nt, Homo sapiens
gugcuagcauuaccacuuc

SEQ ID NO: 409697 - RNA, 19 nt, Homo sapiens
gaugggaaacggcugaaga

SEQ ID NO: 409698 - RNA, 19 nt, Homo sapiens
acacagacccagagguauu

SEQ ID NO: 409699 - RNA, 19 nt, Homo sapiens
ccacaugugcagugucaaa

SEQ ID NO: 409700 - RNA, 19 nt, Homo sapiens
ggucuugcccaaagucauu

SEQ ID NO: 409701 - RNA, 19 nt, Homo sapiens
aaauagaaagugaccauga

SEQ ID NO: 409702 - RNA, 19 nt, Homo sapiens
cuccugaccucgugauuug

SEQ ID NO: 409703 - RNA, 19 nt, Homo sapiens
uaacauaccugaacgaaga

SEQ ID NO: 409704 - RNA, 19 nt, Homo sapiens
guaagaagcugcaggaugu

SEQ ID NO: 409705 - RNA, 19 nt, Homo sapiens
agacaaagcugaugugaau

SEQ ID NO: 409706 - RNA, 19 nt, Homo sapiens
gaagagaucugugagugaa

SEQ ID NO: 409707 - RNA, 19 nt, Homo sapiens
gaaauacagcuuaugcaua

SEQ ID NO: 409708 - RNA, 19 nt, Homo sapiens
ggaaaucuguuaagaagag

SEQ ID NO: 409709 - RNA, 19 nt, Homo sapiens
aaacagauauugucagagu

SEQ ID NO: 409710 - RNA, 19 nt, Homo sapiens
gaaaacagauauugucaga

SEQ ID NO: 409711 - RNA, 19 nt, Homo sapiens
agacauggcuaaaguuaug

SEQ ID NO: 409712 - RNA, 19 nt, Homo sapiens
gaaaacaucugaacucgau

SEQ ID NO: 409713 - RNA, 19 nt, Homo sapiens
uagaauggcugcguaagaa

SEQ ID NO: 409714 - RNA, 19 nt, Homo sapiens
gaugggaaaucuguuaaga

SEQ ID NO: 409715 - RNA, 19 nt, Homo sapiens
caacaauacaugcugcuaa

SEQ ID NO: 409716 - RNA, 19 nt, Homo sapiens
aaagacauggcuaaaguua

SEQ ID NO: 409717 - RNA, 19 nt, Homo sapiens
caaacuacauguaauccau

SEQ ID NO: 409718 - RNA, 19 nt, Homo sapiens
cuauuaagauuuccaagug

SEQ ID NO: 409719 - RNA, 19 nt, Homo sapiens
caaaagacauggcuaaagu

SEQ ID NO: 409720 - RNA, 19 nt, Homo sapiens
caaagcugaugugaaugua

SEQ ID NO: 409721 - RNA, 19 nt, Homo sapiens
aagcugaugugaauguauu

SEQ ID NO: 409722 - RNA, 19 nt, Homo sapiens
agcaucagcuacuaacaua

SEQ ID NO: 409723 - RNA, 19 nt, Homo sapiens
ugggaaaucuguuaagaag

SEQ ID NO: 409724 - RNA, 19 nt, Homo sapiens
caauacaugcugcuaauuc

SEQ ID NO: 409725 - RNA, 19 nt, Homo sapiens
ugagugaaauacagcuuau

SEQ ID NO: 409726 - RNA, 19 nt, Homo sapiens
guuaagaagagaucuguga

SEQ ID NO: 409727 - RNA, 19 nt, Homo sapiens
uggcuaaaguuaugauugu

SEQ ID NO: 409728 - RNA, 19 nt, Homo sapiens
guagaauggcugcguaaga

SEQ ID NO: 409729 - RNA, 19 nt, Homo sapiens
aaagcuaaaucccagugaa

SEQ ID NO: 409730 - RNA, 19 nt, Homo sapiens
gaaaucuguuaagaagaga

SEQ ID NO: 409731 - RNA, 19 nt, Homo sapiens
acgaagaucuuguucuaag

SEQ ID NO: 409732 - RNA, 19 nt, Homo sapiens
ugaagaugauaccugcaaa

SEQ ID NO: 409733 - RNA, 19 nt, Homo sapiens
caagugccaauauuucuga

SEQ ID NO: 409734 - RNA, 19 nt, Homo sapiens
guucugcucuagacagugu

SEQ ID NO: 409735 - RNA, 19 nt, Homo sapiens
aacaauacaugcugcuaau

SEQ ID NO: 409736 - RNA, 19 nt, Homo sapiens
aauacaugcugcuaauuca

SEQ ID NO: 409737 - RNA, 19 nt, Homo sapiens
gcagacaaagcugauguga

SEQ ID NO: 409738 - RNA, 19 nt, Homo sapiens
gugagugaaauacagcuua

SEQ ID NO: 409739 - RNA, 19 nt, Homo sapiens
gaugauaccugcaaaagac

SEQ ID NO: 409740 - RNA, 19 nt, Homo sapiens
gccaugauaacugcaauuu

SEQ ID NO: 409741 - RNA, 19 nt, Homo sapiens
cauuguaugugaagaugau

SEQ ID NO: 409742 - RNA, 19 nt, Homo sapiens
gcaacaauacaugcugcua

SEQ ID NO: 409743 - RNA, 19 nt, Homo sapiens
gaguagaauggcugcguaa

SEQ ID NO: 409744 - RNA, 19 nt, Homo sapiens
acaaagcugaugugaaugu

SEQ ID NO: 409745 - RNA, 19 nt, Homo sapiens
ugaaauacagcuuaugcau

SEQ ID NO: 409746 - RNA, 19 nt, Homo sapiens
gcuaaaguuaugauuguca

SEQ ID NO: 409747 - RNA, 19 nt, Homo sapiens
gaguucugcucuagacagu

SEQ ID NO: 409748 - RNA, 19 nt, Homo sapiens
gagaucugugagugaaaua

SEQ ID NO: 409749 - RNA, 19 nt, Homo sapiens
agagaucugugagugaaau

SEQ ID NO: 409750 - RNA, 19 nt, Homo sapiens
uacauguaauccaucacua

SEQ ID NO: 409751 - RNA, 19 nt, Homo sapiens
gugaagaugauaccugcaa

SEQ ID NO: 409752 - RNA, 19 nt, Homo sapiens
ucggaugggaaaucuguua

SEQ ID NO: 409753 - RNA, 19 nt, Homo sapiens
ucacuagccaugauaacug

SEQ ID NO: 409754 - RNA, 19 nt, Homo sapiens
aagcuaaaucccagugaaa

SEQ ID NO: 409755 - RNA, 19 nt, Homo sapiens
gaucugugagugaaauaca

SEQ ID NO: 409756 - RNA, 19 nt, Homo sapiens
cagcaucagcuacuaacau

SEQ ID NO: 409757 - RNA, 19 nt, Homo sapiens
uacaugcugcuaauucaaa

SEQ ID NO: 409758 - RNA, 19 nt, Homo sapiens
agaagagaucugugaguga

SEQ ID NO: 409759 - RNA, 19 nt, Homo sapiens
gaagaugauaccugcaaaa

SEQ ID NO: 409760 - RNA, 19 nt, Homo sapiens
uaagaagagaucugugagu

SEQ ID NO: 409761 - RNA, 19 nt, Homo sapiens
cagacaaagcugaugugaa

SEQ ID NO: 409762 - RNA, 19 nt, Homo sapiens
acagauauugucagaguuc

SEQ ID NO: 409763 - RNA, 19 nt, Homo sapiens
gcugaugugaauguauuaa

SEQ ID NO: 409764 - RNA, 19 nt, Homo sapiens
gcuacuaacauaccugaac

SEQ ID NO: 409765 - RNA, 19 nt, Homo sapiens
gauggagagaguagaaugg

SEQ ID NO: 409766 - RNA, 19 nt, Homo sapiens
uuuccaagugccaauauuu

SEQ ID NO: 409767 - RNA, 19 nt, Homo sapiens
gauuuccaagugccaauau

SEQ ID NO: 409768 - RNA, 19 nt, Homo sapiens
uaaagcuaaaucccaguga

SEQ ID NO: 409769 - RNA, 19 nt, Homo sapiens
ucauguuggcaauuuguuu

SEQ ID NO: 409770 - RNA, 19 nt, Homo sapiens
ccugaacgaagaucuuguu

SEQ ID NO: 409771 - RNA, 19 nt, Homo sapiens
gacaguguagggcaacaau

SEQ ID NO: 409772 - RNA, 19 nt, Homo sapiens
cgauggagagaguagaaug

SEQ ID NO: 409773 - RNA, 19 nt, Homo sapiens
gggaaaucuguuaagaaga

SEQ ID NO: 409774 - RNA, 19 nt, Homo sapiens
gaaaucugcuagaaaguua

SEQ ID NO: 409775 - RNA, 19 nt, Homo sapiens
gcuaauaccucuuacuuug

SEQ ID NO: 409776 - RNA, 19 nt, Homo sapiens
gaacauggcuagccuuucu

SEQ ID NO: 409777 - RNA, 19 nt, Homo sapiens
gcacacaguuauuuaauca

SEQ ID NO: 409778 - RNA, 19 nt, Homo sapiens
ggaaacugcucccaucauu

SEQ ID NO: 409779 - RNA, 19 nt, Homo sapiens
ggaauuguauggagacauu

SEQ ID NO: 409780 - RNA, 19 nt, Homo sapiens
gaggugggcuuuaacauug

SEQ ID NO: 409781 - RNA, 19 nt, Homo sapiens
gaaagcuucuucagaguga

SEQ ID NO: 409782 - RNA, 19 nt, Homo sapiens
gaugaaaucugcuagaaag

SEQ ID NO: 409783 - RNA, 19 nt, Homo sapiens
gaagagcuauggcccagaa

SEQ ID NO: 409784 - RNA, 19 nt, Homo sapiens
gguauaaucuccauuucaa

SEQ ID NO: 409785 - RNA, 19 nt, Homo sapiens
gaagaaacuuugccucaag

SEQ ID NO: 409786 - RNA, 19 nt, Homo sapiens
ugaaaggccucaagaacaa

SEQ ID NO: 409787 - RNA, 19 nt, Homo sapiens
cagcagaguuggaggaauu

SEQ ID NO: 409788 - RNA, 19 nt, Homo sapiens
acagugcgcuccaaccuua

SEQ ID NO: 409789 - RNA, 19 nt, Homo sapiens
gaacauggaccaccacauc

SEQ ID NO: 409790 - RNA, 19 nt, Homo sapiens
gauccacacuuugggcuua

SEQ ID NO: 409791 - RNA, 19 nt, Homo sapiens
caagagguuuggcaugaaa

SEQ ID NO: 409792 - RNA, 19 nt, Homo sapiens
ggagauggcagcagaguug

SEQ ID NO: 409793 - RNA, 19 nt, Homo sapiens
ggaccuggcuccggaauuc

SEQ ID NO: 409794 - RNA, 19 nt, Homo sapiens
gacaaacagaccauaaaua

SEQ ID NO: 409795 - RNA, 19 nt, Homo sapiens
uaaaucaguuggaguuugu

SEQ ID NO: 409796 - RNA, 19 nt, Homo sapiens
gcaccaaccucauguuugc

SEQ ID NO: 409797 - RNA, 19 nt, Homo sapiens
ucaggaagcucucuuaaaa

SEQ ID NO: 409798 - RNA, 19 nt, Homo sapiens
gagcugcaccugauuaguu

SEQ ID NO: 409799 - RNA, 19 nt, Homo sapiens
gcagacaaacagaccauaa

SEQ ID NO: 409800 - RNA, 19 nt, Homo sapiens
gcaucuggcugucuagaau

SEQ ID NO: 409801 - RNA, 19 nt, Homo sapiens
gcaaagggaaacaggcuaa

SEQ ID NO: 409802 - RNA, 19 nt, Homo sapiens
gggauggguuccagaggua

SEQ ID NO: 409803 - RNA, 19 nt, Homo sapiens
gaaagagcacccucgagaa

SEQ ID NO: 409804 - RNA, 19 nt, Homo sapiens
aggaaacgaugaaauaaga

SEQ ID NO: 409805 - RNA, 19 nt, Homo sapiens
gcuagagguugcagcauga

SEQ ID NO: 409806 - RNA, 19 nt, Homo sapiens
cuuuaagucucacccauua

SEQ ID NO: 409807 - RNA, 19 nt, Homo sapiens
gagugugacuucccuucua

SEQ ID NO: 409808 - RNA, 19 nt, Homo sapiens
caaccuagaaugucagauu

SEQ ID NO: 409809 - RNA, 19 nt, Homo sapiens
ccagaaugcugaacuccuu

SEQ ID NO: 409810 - RNA, 19 nt, Homo sapiens
gcaagagguuuggcaugaa

SEQ ID NO: 409811 - RNA, 19 nt, Homo sapiens
uuacagagcauacaacaga

SEQ ID NO: 409812 - RNA, 19 nt, Homo sapiens
gcccaucacuguauagaca

SEQ ID NO: 409813 - RNA, 19 nt, Homo sapiens
ccacauuuauggagacaau

SEQ ID NO: 409814 - RNA, 19 nt, Homo sapiens
agacuuugcuuaguauuga

SEQ ID NO: 409815 - RNA, 19 nt, Homo sapiens
gguagacuuugcuuaguau

SEQ ID NO: 409816 - RNA, 19 nt, Homo sapiens
cagacacccucuccuuaaa

SEQ ID NO: 409817 - RNA, 19 nt, Homo sapiens
ccucauguuugccuucuuu

SEQ ID NO: 409818 - RNA, 19 nt, Homo sapiens
uaacaucuacaaucaguug

SEQ ID NO: 409819 - RNA, 19 nt, Homo sapiens
gcucguaucccaaaucugu

SEQ ID NO: 409820 - RNA, 19 nt, Homo sapiens
cagugaagaugcaaucaga

SEQ ID NO: 409821 - RNA, 19 nt, Homo sapiens
gagcuuguguccuguccuu

SEQ ID NO: 409822 - RNA, 19 nt, Homo sapiens
aaacagaccauaaauaagg

SEQ ID NO: 409823 - RNA, 19 nt, Homo sapiens
ugaagugcgugguauaauc

SEQ ID NO: 409824 - RNA, 19 nt, Homo sapiens
gugauucuguuuauucuuc

SEQ ID NO: 409825 - RNA, 19 nt, Homo sapiens
caagaccugucccuacguu

SEQ ID NO: 409826 - RNA, 19 nt, Homo sapiens
aaacuuugccucaagacua

SEQ ID NO: 409827 - RNA, 19 nt, Homo sapiens
gaaucccuguuguuacuau

SEQ ID NO: 409828 - RNA, 19 nt, Homo sapiens
gcacugcccuuuucaggaa

SEQ ID NO: 409829 - RNA, 19 nt, Homo sapiens
ccagaacaguggcucguau

SEQ ID NO: 409830 - RNA, 19 nt, Homo sapiens
ucuccaacgugagcuauua

SEQ ID NO: 409831 - RNA, 19 nt, Homo sapiens
gauucaaaguguuguguuc

SEQ ID NO: 409832 - RNA, 19 nt, Homo sapiens
gauuucugguugauuugua

SEQ ID NO: 409833 - RNA, 19 nt, Homo sapiens
gcagcugaguggcuauuuc

SEQ ID NO: 409834 - RNA, 19 nt, Homo sapiens
gaagguauuuuguagaugu

SEQ ID NO: 409835 - RNA, 19 nt, Homo sapiens
gaauuccucuuuugcuuaa

SEQ ID NO: 409836 - RNA, 19 nt, Homo sapiens
ucagacacccucuccuuaa

SEQ ID NO: 409837 - RNA, 19 nt, Homo sapiens
ggccagggcugauggucuu

SEQ ID NO: 409838 - RNA, 19 nt, Homo sapiens
gcuguucgguguccaguuc

SEQ ID NO: 409839 - RNA, 19 nt, Homo sapiens
uaucaacugcggcucuuua

SEQ ID NO: 409840 - RNA, 19 nt, Homo sapiens
cagcagugaguaaucaaua

SEQ ID NO: 409841 - RNA, 19 nt, Homo sapiens
uggcagcuguuucucauga

SEQ ID NO: 409842 - RNA, 19 nt, Homo sapiens
ggugcuggauggagaaaug

SEQ ID NO: 409843 - RNA, 19 nt, Homo sapiens
gcucugacguagaaagauc

SEQ ID NO: 409844 - RNA, 19 nt, Homo sapiens
caguugcucugacguagaa

SEQ ID NO: 409845 - RNA, 19 nt, Homo sapiens
ggacagagggguaagauga

SEQ ID NO: 409846 - RNA, 19 nt, Homo sapiens
caacucagcacaugacuac

SEQ ID NO: 409847 - RNA, 19 nt, Homo sapiens
ggacacagcagugaguaau

SEQ ID NO: 409848 - RNA, 19 nt, Homo sapiens
gauauucaggcuacucauu

SEQ ID NO: 409849 - RNA, 19 nt, Homo sapiens
ggccugaucuugccugucu

SEQ ID NO: 409850 - RNA, 19 nt, Homo sapiens
aggaagcucucuuaaaaua

SEQ ID NO: 409851 - RNA, 19 nt, Homo sapiens
ucagugagauaucauagag

SEQ ID NO: 409852 - RNA, 19 nt, Homo sapiens
gggagaguaugauagagau

SEQ ID NO: 409853 - RNA, 19 nt, Homo sapiens
cgcaagagguuuggcauga

SEQ ID NO: 409854 - RNA, 19 nt, Homo sapiens
gcauugccauggaguucaa

SEQ ID NO: 409855 - RNA, 19 nt, Homo sapiens
gcuauuuccugcagcugaa

SEQ ID NO: 409856 - RNA, 19 nt, Homo sapiens
aaaugcaagugccuagauu

SEQ ID NO: 409857 - RNA, 19 nt, Homo sapiens
acacagcagugaguaauca

SEQ ID NO: 409858 - RNA, 19 nt, Homo sapiens
ccuggaagauauaacauuc

SEQ ID NO: 409859 - RNA, 19 nt, Homo sapiens
aaccuagaaugucagauuu

SEQ ID NO: 409860 - RNA, 19 nt, Homo sapiens
uaggagugguucucauuug

SEQ ID NO: 409861 - RNA, 19 nt, Homo sapiens
ccaaagggaagaagcaguu

SEQ ID NO: 409862 - RNA, 19 nt, Homo sapiens
gaagaugcaaucagacaag

SEQ ID NO: 409863 - RNA, 19 nt, Homo sapiens
cgaggugggcuuuaacauu

SEQ ID NO: 409864 - RNA, 19 nt, Homo sapiens
gcggcgaggugggcuuuaa

SEQ ID NO: 409865 - RNA, 19 nt, Homo sapiens
gugaaucccuguuguuacu

SEQ ID NO: 409866 - RNA, 19 nt, Homo sapiens
gcuacgagcaguucuuguu

SEQ ID NO: 409867 - RNA, 19 nt, Homo sapiens
gaaccaaagggaagaagca

SEQ ID NO: 409868 - RNA, 19 nt, Homo sapiens
agaagaaacuuugccucaa

SEQ ID NO: 409869 - RNA, 19 nt, Homo sapiens
gacacaagcacuuuaaugg

SEQ ID NO: 409870 - RNA, 19 nt, Homo sapiens
ccucuuacuuugcuugaga

SEQ ID NO: 409871 - RNA, 19 nt, Homo sapiens
cagugaaucccuguuguua

SEQ ID NO: 409872 - RNA, 19 nt, Homo sapiens
gauuggugauucaaagugu

SEQ ID NO: 409873 - RNA, 19 nt, Homo sapiens
uaacacagucauucuagga

SEQ ID NO: 409874 - RNA, 19 nt, Homo sapiens
gaaaucugcuagaaaguua

SEQ ID NO: 409875 - RNA, 19 nt, Homo sapiens
gcuaauaccucuuacuuug

SEQ ID NO: 409876 - RNA, 19 nt, Homo sapiens
gaacauggcuagccuuucu

SEQ ID NO: 409877 - RNA, 19 nt, Homo sapiens
gcacacaguuauuuaauca

SEQ ID NO: 409878 - RNA, 19 nt, Homo sapiens
ggaaacugcucccaucauu

SEQ ID NO: 409879 - RNA, 19 nt, Homo sapiens
ggaauuguauggagacauu

SEQ ID NO: 409880 - RNA, 19 nt, Homo sapiens
gaggugggcuuuaacauug

SEQ ID NO: 409881 - RNA, 19 nt, Homo sapiens
gaaagcuucuucagaguga

SEQ ID NO: 409882 - RNA, 19 nt, Homo sapiens
gaugaaaucugcuagaaag

SEQ ID NO: 409883 - RNA, 19 nt, Homo sapiens
gaagagcuauggcccagaa

SEQ ID NO: 409884 - RNA, 19 nt, Homo sapiens
gguauaaucuccauuucaa

SEQ ID NO: 409885 - RNA, 19 nt, Homo sapiens
gaagaaacuuugccucaag

SEQ ID NO: 409886 - RNA, 19 nt, Homo sapiens
ugaaaggccucaagaacaa

SEQ ID NO: 409887 - RNA, 19 nt, Homo sapiens
cagcagaguuggaggaauu

SEQ ID NO: 409888 - RNA, 19 nt, Homo sapiens
acagugcgcuccaaccuua

SEQ ID NO: 409889 - RNA, 19 nt, Homo sapiens
gaacauggaccaccacauc

SEQ ID NO: 409890 - RNA, 19 nt, Homo sapiens
gauccacacuuugggcuua

SEQ ID NO: 409891 - RNA, 19 nt, Homo sapiens
caagagguuuggcaugaaa

SEQ ID NO: 409892 - RNA, 19 nt, Homo sapiens
ggagauggcagcagaguug

SEQ ID NO: 409893 - RNA, 19 nt, Homo sapiens
ggaccuggcuccggaauuc

SEQ ID NO: 409894 - RNA, 19 nt, Homo sapiens
gacaaacagaccauaaaua

SEQ ID NO: 409895 - RNA, 19 nt, Homo sapiens
uaaaucaguuggaguuugu

SEQ ID NO: 409896 - RNA, 19 nt, Homo sapiens
gcaccaaccucauguuugc

SEQ ID NO: 409897 - RNA, 19 nt, Homo sapiens
ucaggaagcucucuuaaaa

SEQ ID NO: 409898 - RNA, 19 nt, Homo sapiens
gagcugcaccugauuaguu

SEQ ID NO: 409899 - RNA, 19 nt, Homo sapiens
gcagacaaacagaccauaa

SEQ ID NO: 409900 - RNA, 19 nt, Homo sapiens
gcaucuggcugucuagaau

SEQ ID NO: 409901 - RNA, 19 nt, Homo sapiens
gcaaagggaaacaggcuaa

SEQ ID NO: 409902 - RNA, 19 nt, Homo sapiens
gggauggguuccagaggua

SEQ ID NO: 409903 - RNA, 19 nt, Homo sapiens
gaaagagcacccucgagaa

SEQ ID NO: 409904 - RNA, 19 nt, Homo sapiens
aggaaacgaugaaauaaga

SEQ ID NO: 409905 - RNA, 19 nt, Homo sapiens
gcuagagguugcagcauga

SEQ ID NO: 409906 - RNA, 19 nt, Homo sapiens
cuuuaagucucacccauua

SEQ ID NO: 409907 - RNA, 19 nt, Homo sapiens
gagugugacuucccuucua

SEQ ID NO: 409908 - RNA, 19 nt, Homo sapiens
caaccuagaaugucagauu

SEQ ID NO: 409909 - RNA, 19 nt, Homo sapiens
ccagaaugcugaacuccuu

SEQ ID NO: 409910 - RNA, 19 nt, Homo sapiens
gcaagagguuuggcaugaa

SEQ ID NO: 409911 - RNA, 19 nt, Homo sapiens
uuacagagcauacaacaga

SEQ ID NO: 409912 - RNA, 19 nt, Homo sapiens
gcccaucacuguauagaca

SEQ ID NO: 409913 - RNA, 19 nt, Homo sapiens
ccacauuuauggagacaau

SEQ ID NO: 409914 - RNA, 19 nt, Homo sapiens
agacuuugcuuaguauuga

SEQ ID NO: 409915 - RNA, 19 nt, Homo sapiens
gguagacuuugcuuaguau

SEQ ID NO: 409916 - RNA, 19 nt, Homo sapiens
cagacacccucuccuuaaa

SEQ ID NO: 409917 - RNA, 19 nt, Homo sapiens
ccucauguuugccuucuuu

SEQ ID NO: 409918 - RNA, 19 nt, Homo sapiens
uaacaucuacaaucaguug

SEQ ID NO: 409919 - RNA, 19 nt, Homo sapiens
gcucguaucccaaaucugu

SEQ ID NO: 409920 - RNA, 19 nt, Homo sapiens
cagugaagaugcaaucaga

SEQ ID NO: 409921 - RNA, 19 nt, Homo sapiens
gagcuuguguccuguccuu

SEQ ID NO: 409922 - RNA, 19 nt, Homo sapiens
aaacagaccauaaauaagg

SEQ ID NO: 409923 - RNA, 19 nt, Homo sapiens
ugaagugcgugguauaauc

SEQ ID NO: 409924 - RNA, 19 nt, Homo sapiens
gugauucuguuuauucuuc

SEQ ID NO: 409925 - RNA, 19 nt, Homo sapiens
caagaccugucccuacguu

SEQ ID NO: 409926 - RNA, 19 nt, Homo sapiens
aaacuuugccucaagacua

SEQ ID NO: 409927 - RNA, 19 nt, Homo sapiens
gaaucccuguuguuacuau

SEQ ID NO: 409928 - RNA, 19 nt, Homo sapiens
gcacugcccuuuucaggaa

SEQ ID NO: 409929 - RNA, 19 nt, Homo sapiens
ccagaacaguggcucguau

SEQ ID NO: 409930 - RNA, 19 nt, Homo sapiens
ucuccaacgugagcuauua

SEQ ID NO: 409931 - RNA, 19 nt, Homo sapiens
gauucaaaguguuguguuc

SEQ ID NO: 409932 - RNA, 19 nt, Homo sapiens
gauuucugguugauuugua

SEQ ID NO: 409933 - RNA, 19 nt, Homo sapiens
gcagcugaguggcuauuuc

SEQ ID NO: 409934 - RNA, 19 nt, Homo sapiens
gaagguauuuuguagaugu

SEQ ID NO: 409935 - RNA, 19 nt, Homo sapiens
gaauuccucuuuugcuuaa

SEQ ID NO: 409936 - RNA, 19 nt, Homo sapiens
ucagacacccucuccuuaa

SEQ ID NO: 409937 - RNA, 19 nt, Homo sapiens
ggccagggcugauggucuu

SEQ ID NO: 409938 - RNA, 19 nt, Homo sapiens
gcuguucgguguccaguuc

SEQ ID NO: 409939 - RNA, 19 nt, Homo sapiens
uaucaacugcggcucuuua

SEQ ID NO: 409940 - RNA, 19 nt, Homo sapiens
cagcagugaguaaucaaua

SEQ ID NO: 409941 - RNA, 19 nt, Homo sapiens
uggcagcuguuucucauga

SEQ ID NO: 409942 - RNA, 19 nt, Homo sapiens
ggugcuggauggagaaaug

SEQ ID NO: 409943 - RNA, 19 nt, Homo sapiens
gcucugacguagaaagauc

SEQ ID NO: 409944 - RNA, 19 nt, Homo sapiens
caguugcucugacguagaa

SEQ ID NO: 409945 - RNA, 19 nt, Homo sapiens
ggacagagggguaagauga

SEQ ID NO: 409946 - RNA, 19 nt, Homo sapiens
caacucagcacaugacuac

SEQ ID NO: 409947 - RNA, 19 nt, Homo sapiens
ggacacagcagugaguaau

SEQ ID NO: 409948 - RNA, 19 nt, Homo sapiens
gauauucaggcuacucauu

SEQ ID NO: 409949 - RNA, 19 nt, Homo sapiens
ggccugaucuugccugucu

SEQ ID NO: 409950 - RNA, 19 nt, Homo sapiens
aggaagcucucuuaaaaua

SEQ ID NO: 409951 - RNA, 19 nt, Homo sapiens
ucagugagauaucauagag

SEQ ID NO: 409952 - RNA, 19 nt, Homo sapiens
gggagaguaugauagagau

SEQ ID NO: 409953 - RNA, 19 nt, Homo sapiens
cgcaagagguuuggcauga

SEQ ID NO: 409954 - RNA, 19 nt, Homo sapiens
gcauugccauggaguucaa

SEQ ID NO: 409955 - RNA, 19 nt, Homo sapiens
gcuauuuccugcagcugaa

SEQ ID NO: 409956 - RNA, 19 nt, Homo sapiens
aaaugcaagugccuagauu

SEQ ID NO: 409957 - RNA, 19 nt, Homo sapiens
acacagcagugaguaauca

SEQ ID NO: 409958 - RNA, 19 nt, Homo sapiens
ccuggaagauauaacauuc

SEQ ID NO: 409959 - RNA, 19 nt, Homo sapiens
aaccuagaaugucagauuu

SEQ ID NO: 409960 - RNA, 19 nt, Homo sapiens
uaggagugguucucauuug

SEQ ID NO: 409961 - RNA, 19 nt, Homo sapiens
ccaaagggaagaagcaguu

SEQ ID NO: 409962 - RNA, 19 nt, Homo sapiens
gaagaugcaaucagacaag

SEQ ID NO: 409963 - RNA, 19 nt, Homo sapiens
cgaggugggcuuuaacauu

SEQ ID NO: 409964 - RNA, 19 nt, Homo sapiens
gcggcgaggugggcuuuaa

SEQ ID NO: 409965 - RNA, 19 nt, Homo sapiens
gugaaucccuguuguuacu

SEQ ID NO: 409966 - RNA, 19 nt, Homo sapiens
gaaccaaagggaagaagca

SEQ ID NO: 409967 - RNA, 19 nt, Homo sapiens
agaagaaacuuugccucaa

SEQ ID NO: 409968 - RNA, 19 nt, Homo sapiens
gacacaagcacuuuaaugg

SEQ ID NO: 409969 - RNA, 19 nt, Homo sapiens
ccucuuacuuugcuugaga

SEQ ID NO: 409970 - RNA, 19 nt, Homo sapiens
cagugaaucccuguuguua

SEQ ID NO: 409971 - RNA, 19 nt, Homo sapiens
gauuggugauucaaagugu

SEQ ID NO: 409972 - RNA, 19 nt, Homo sapiens
uaacacagucauucuagga

SEQ ID NO: 409973 - RNA, 19 nt, Homo sapiens
gcuuaaaucaguuggaguu

SEQ ID NO: 409974 - RNA, 19 nt, Homo sapiens
ggaaguccauccaagauuu

SEQ ID NO: 409975 - RNA, 19 nt, Homo sapiens
gugaccaucuucauaauuu

SEQ ID NO: 409976 - RNA, 19 nt, Homo sapiens
gagaacugcuggccagauu

SEQ ID NO: 409977 - RNA, 19 nt, Homo sapiens
caagacaccugggaagaaa

SEQ ID NO: 409978 - RNA, 19 nt, Homo sapiens
acacaugccuuaaauuugu

SEQ ID NO: 409979 - RNA, 19 nt, Homo sapiens
ggagcucgauucacgguaa

SEQ ID NO: 409980 - RNA, 19 nt, Homo sapiens
ggacaaaccuagaauuuuc

SEQ ID NO: 409981 - RNA, 19 nt, Homo sapiens
cuaacaagguggagacgua

SEQ ID NO: 409982 - RNA, 19 nt, Homo sapiens
gaacugcuggccagauuaa

SEQ ID NO: 409983 - RNA, 19 nt, Homo sapiens
caacaucaauccuuuacca

SEQ ID NO: 409984 - RNA, 19 nt, Homo sapiens
guaaacacacuacuuauca

SEQ ID NO: 409985 - RNA, 19 nt, Homo sapiens
gaaguccauccaagauuua

SEQ ID NO: 409986 - RNA, 19 nt, Homo sapiens
gaugagggcagauaccuaa

SEQ ID NO: 409987 - RNA, 19 nt, Homo sapiens
gggagaauauagaagcauu

SEQ ID NO: 409988 - RNA, 19 nt, Homo sapiens
uuaccacucuaccaaauaa

SEQ ID NO: 409989 - RNA, 19 nt, Homo sapiens
agaacagcaucaugucaua

SEQ ID NO: 409990 - RNA, 19 nt, Homo sapiens
acacacuacuuaucauuga

SEQ ID NO: 409991 - RNA, 19 nt, Homo sapiens
gaacagcaucaugucauaa

SEQ ID NO: 409992 - RNA, 19 nt, Homo sapiens
gcuagugaccaucuucaua

SEQ ID NO: 409993 - RNA, 19 nt, Homo sapiens
ugacagagaauaacucaga

SEQ ID NO: 409994 - RNA, 19 nt, Homo sapiens
caaaagagcugugucugaa

SEQ ID NO: 409995 - RNA, 19 nt, Homo sapiens
cagagaauaacucagaaua

SEQ ID NO: 409996 - RNA, 19 nt, Homo sapiens
gaauauugucugccuuaaa

SEQ ID NO: 409997 - RNA, 19 nt, Homo sapiens
aacaucagcuccuccauga

SEQ ID NO: 409998 - RNA, 19 nt, Homo sapiens
ggaagcgccucugauuugu

SEQ ID NO: 409999 - RNA, 19 nt, Homo sapiens
cuagugaccaucuucauaa

SEQ ID NO: 410000 - RNA, 19 nt, Homo sapiens
gcaaggagcaggaaaagaa

SEQ ID NO: 410001 - RNA, 19 nt, Homo sapiens
aagcgccucugauuuguuu

SEQ ID NO: 410002 - RNA, 19 nt, Homo sapiens
aauauugucugccuuaaag

SEQ ID NO: 410003 - RNA, 19 nt, Homo sapiens
gacagagaauaacucagaa

SEQ ID NO: 410004 - RNA, 19 nt, Homo sapiens
gaaauccacacagcugaaa

SEQ ID NO: 410005 - RNA, 19 nt, Homo sapiens
agaaagcacaguuggagua

SEQ ID NO: 410006 - RNA, 19 nt, Homo sapiens
ucugagccauucacacuuu

SEQ ID NO: 410007 - RNA, 19 nt, Homo sapiens
caucaugucauaaacgauu

SEQ ID NO: 410008 - RNA, 19 nt, Homo sapiens
auaauuugcuggagaagug

SEQ ID NO: 410009 - RNA, 19 nt, Homo sapiens
cacccaacaucaauccuuu

SEQ ID NO: 410010 - RNA, 19 nt, Homo sapiens
ccagauuaauuagacauug

SEQ ID NO: 410011 - RNA, 19 nt, Homo sapiens
aaagagcugugucugaaca

SEQ ID NO: 410012 - RNA, 19 nt, Homo sapiens
ggagaauauagaagcauuu

SEQ ID NO: 410013 - RNA, 19 nt, Homo sapiens
gagaauauagaagcauuug

SEQ ID NO: 410014 - RNA, 19 nt, Homo sapiens
cugcuggccagauuaauua

SEQ ID NO: 410015 - RNA, 19 nt, Homo sapiens
ggcaaacuuucuucagugu

SEQ ID NO: 410016 - RNA, 19 nt, Homo sapiens
gcagaacagcaucauguca

SEQ ID NO: 410017 - RNA, 19 nt, Homo sapiens
aaacgauucugagccauuc

SEQ ID NO: 410018 - RNA, 19 nt, Homo sapiens
cuacaaacacugcagaaca

SEQ ID NO: 410019 - RNA, 19 nt, Homo sapiens
gaaccaccccguccgauuu

SEQ ID NO: 410020 - RNA, 19 nt, Homo sapiens
gggaaguccauccaagauu

SEQ ID NO: 410021 - RNA, 19 nt, Homo sapiens
aggaagcgccucugauuug

SEQ ID NO: 410022 - RNA, 19 nt, Homo sapiens
ucacuucaagggagaauau

SEQ ID NO: 410023 - RNA, 19 nt, Homo sapiens
uaacucaggaaacuaacaa

SEQ ID NO: 410024 - RNA, 19 nt, Homo sapiens
guguagcaauugacagaga

SEQ ID NO: 410025 - RNA, 19 nt, Homo sapiens
uaaacgauucugagccauu

SEQ ID NO: 410026 - RNA, 19 nt, Homo sapiens
guaucucuaucgauugugu

SEQ ID NO: 410027 - RNA, 19 nt, Homo sapiens
gaacucgcucugccugguu

SEQ ID NO: 410028 - RNA, 19 nt, Homo sapiens
gagggcagauaccuaacuc

SEQ ID NO: 410029 - RNA, 19 nt, Homo sapiens
gcugugugguuuggagaaa

SEQ ID NO: 410030 - RNA, 19 nt, Homo sapiens
gauuugggucugaugauga

SEQ ID NO: 410031 - RNA, 19 nt, Homo sapiens
caucagcuccuccaugaca

SEQ ID NO: 410032 - RNA, 19 nt, Homo sapiens
gaaagcacaguuggaguag

SEQ ID NO: 410033 - RNA, 19 nt, Homo sapiens
uacaaacacugcagaacag

SEQ ID NO: 410034 - RNA, 19 nt, Homo sapiens
ucaagacaccugggaagaa

SEQ ID NO: 410035 - RNA, 19 nt, Homo sapiens
ucacaccugggcaaacuuu

SEQ ID NO: 410036 - RNA, 19 nt, Homo sapiens
ugaccaucuucauaauuug

SEQ ID NO: 410037 - RNA, 19 nt, Homo sapiens
agaauauugucugccuuaa

SEQ ID NO: 410038 - RNA, 19 nt, Homo sapiens
cgauuugggucugaugaug

SEQ ID NO: 410039 - RNA, 19 nt, Homo sapiens
caagcccucucccaacaca

SEQ ID NO: 410040 - RNA, 19 nt, Homo sapiens
gaagcgccucugauuuguu

SEQ ID NO: 410041 - RNA, 19 nt, Homo sapiens
uaacuuacaaggauauagg

SEQ ID NO: 410042 - RNA, 19 nt, Homo sapiens
cagauuaauuagacauugc

SEQ ID NO: 410043 - RNA, 19 nt, Homo sapiens
uguagcaauugacagagaa

SEQ ID NO: 410044 - RNA, 19 nt, Homo sapiens
uuggacaaaccuagaauuu

SEQ ID NO: 410045 - RNA, 19 nt, Homo sapiens
gagcugugucugaacauca

SEQ ID NO: 410046 - RNA, 19 nt, Homo sapiens
gcaaacuuucuucaguguu

SEQ ID NO: 410047 - RNA, 19 nt, Homo sapiens
gcaauugacagagaauaac

SEQ ID NO: 410048 - RNA, 19 nt, Homo sapiens
ugggcaaacuuucuucagu

SEQ ID NO: 410049 - RNA, 19 nt, Homo sapiens
ggaggcgguuagcccuguu

SEQ ID NO: 410050 - RNA, 19 nt, Homo sapiens
gccgguugcuaaauaaguc

SEQ ID NO: 410051 - RNA, 19 nt, Homo sapiens
gaaacgcaaggagcaggaa

SEQ ID NO: 410052 - RNA, 19 nt, Homo sapiens
uccaagcccucucccaaca

SEQ ID NO: 410053 - RNA, 19 nt, Homo sapiens
cacaugccuuaaauuuguu

SEQ ID NO: 410054 - RNA, 19 nt, Homo sapiens
cagaacagcaucaugucau

SEQ ID NO: 410055 - RNA, 19 nt, Homo sapiens
cugcagaacagcaucaugu

SEQ ID NO: 410056 - RNA, 19 nt, Homo sapiens
uagugaccaucuucauaau

SEQ ID NO: 410057 - RNA, 19 nt, Homo sapiens
gccucugauuuguuucuuu

SEQ ID NO: 410058 - RNA, 19 nt, Homo sapiens
cuuacaaggauauagguuu

SEQ ID NO: 410059 - RNA, 19 nt, Homo sapiens
ucuaccagcucauacaaaa

SEQ ID NO: 410060 - RNA, 19 nt, Homo sapiens
ccucugauuuguuucuuuu

SEQ ID NO: 410061 - RNA, 19 nt, Homo sapiens
gaucgcagaaauccacaca

SEQ ID NO: 410062 - RNA, 19 nt, Homo sapiens
cuaggguaaugccguagga

SEQ ID NO: 410063 - RNA, 19 nt, Homo sapiens
uguaaacacacuacuuauc

SEQ ID NO: 410064 - RNA, 19 nt, Homo sapiens
ucaauccuuuaccacucua

SEQ ID NO: 410065 - RNA, 19 nt, Homo sapiens
gauucuuccuucaccaucu

SEQ ID NO: 410066 - RNA, 19 nt, Homo sapiens
caagauuuacggcgacgau

SEQ ID NO: 410067 - RNA, 19 nt, Homo sapiens
uaccagcucauacaaaaua

SEQ ID NO: 410068 - RNA, 19 nt, Homo sapiens
ggagaacugcuggccagau

SEQ ID NO: 410069 - RNA, 19 nt, Homo sapiens
cuucaagggagaauauaga

SEQ ID NO: 410070 - RNA, 19 nt, Homo sapiens
ucugacaccuccacaacgu

SEQ ID NO: 410071 - RNA, 19 nt, Homo sapiens
auaccuaacucaggaaacu

SEQ ID NO: 410072 - RNA, 19 nt, Homo sapiens
aacagcaucaugucauaaa

SEQ ID NO: 410073 - RNA, 19 nt, Homo sapiens
agaacugcuggccagauua

SEQ ID NO: 410074 - RNA, 19 nt, Homo sapiens
ucaaauuucucaccaauga

SEQ ID NO: 410075 - RNA, 19 nt, Homo sapiens
gcugugaccuucuuccuuu

SEQ ID NO: 410076 - RNA, 19 nt, Homo sapiens
cagcgagugugucaaauuu

SEQ ID NO: 410077 - RNA, 19 nt, Homo sapiens
ggacuacauuuaugacuuc

SEQ ID NO: 410078 - RNA, 19 nt, Homo sapiens
aaagaugggugguugaaug

SEQ ID NO: 410079 - RNA, 19 nt, Homo sapiens
gaugggugguugaaugauu

SEQ ID NO: 410080 - RNA, 19 nt, Homo sapiens
gggaagcccaggaaagaua

SEQ ID NO: 410081 - RNA, 19 nt, Homo sapiens
ggcuggaccugcugacaua

SEQ ID NO: 410082 - RNA, 19 nt, Homo sapiens
aagcugagaucaagaaauc

SEQ ID NO: 410083 - RNA, 19 nt, Homo sapiens
gcaaucauauacuguuucu

SEQ ID NO: 410084 - RNA, 19 nt, Homo sapiens
gcaacuacauccacaugca

SEQ ID NO: 410085 - RNA, 19 nt, Homo sapiens
gcagaggccagccagcaua

SEQ ID NO: 410086 - RNA, 19 nt, Homo sapiens
cauaguggauggacagaug

SEQ ID NO: 410087 - RNA, 19 nt, Homo sapiens
cgucaugacuaaagaggaa

SEQ ID NO: 410088 - RNA, 19 nt, Homo sapiens
ccacuacauugucuucaug

SEQ ID NO: 410089 - RNA, 19 nt, Homo sapiens
gguacaagcugagaucaag

SEQ ID NO: 410090 - RNA, 19 nt, Homo sapiens
ggaagcccaggaaagauaa

SEQ ID NO: 410091 - RNA, 19 nt, Homo sapiens
caaggacgcugugcucuac

SEQ ID NO: 410092 - RNA, 19 nt, Homo sapiens
gggaagcucuacccugagu

SEQ ID NO: 410093 - RNA, 19 nt, Homo sapiens
acuaugagaugcucuucaa

SEQ ID NO: 410094 - RNA, 19 nt, Homo sapiens
gcgagugugucaaauuucu

SEQ ID NO: 410095 - RNA, 19 nt, Homo sapiens
cuacagcgagugugucaaa

SEQ ID NO: 410096 - RNA, 19 nt, Homo sapiens
ucgcaaucauauacuguuu

SEQ ID NO: 410097 - RNA, 19 nt, Homo sapiens
gagcuacccuggccaacac

SEQ ID NO: 410098 - RNA, 19 nt, Homo sapiens
caccguagcugugcucauc

SEQ ID NO: 410099 - RNA, 19 nt, Homo sapiens
ugucaaauuucucaccaau

SEQ ID NO: 410100 - RNA, 19 nt, Homo sapiens
gcacagccucaucuucaug

SEQ ID NO: 410101 - RNA, 19 nt, Homo sapiens
ccagaugcacuaugagaug

SEQ ID NO: 410102 - RNA, 19 nt, Homo sapiens
uucauccucuucaucaaua

SEQ ID NO: 410103 - RNA, 19 nt, Homo sapiens
cggacuacauuuaugacuu

SEQ ID NO: 410104 - RNA, 19 nt, Homo sapiens
gcacugcacgcgcaacuac

SEQ ID NO: 410105 - RNA, 19 nt, Homo sapiens
cagggaagcccaggaaaga

SEQ ID NO: 410106 - RNA, 19 nt, Homo sapiens
gaagagugggagacaguca

SEQ ID NO: 410107 - RNA, 19 nt, Homo sapiens
gacuugagcuccgggaaca

SEQ ID NO: 410108 - RNA, 19 nt, Homo sapiens
cuucauggccuucuucuca

SEQ ID NO: 410109 - RNA, 19 nt, Homo sapiens
gcucauccuggccuacuuu

SEQ ID NO: 410110 - RNA, 19 nt, Homo sapiens
ggacgugggccaacuacag

SEQ ID NO: 410111 - RNA, 19 nt, Homo sapiens
gcucaggcccagugcgaaa

SEQ ID NO: 410112 - RNA, 19 nt, Homo sapiens
gaggccagccagcauaaug

SEQ ID NO: 410113 - RNA, 19 nt, Homo sapiens
ucaaggacgcugugcucua

SEQ ID NO: 410114 - RNA, 19 nt, Homo sapiens
accggaagcugcucaaauc

SEQ ID NO: 410115 - RNA, 19 nt, Homo sapiens
caacuucauccucuucauc

SEQ ID NO: 410116 - RNA, 19 nt, Homo sapiens
aaguccagaugcacuauga

SEQ ID NO: 410117 - RNA, 19 nt, Homo sapiens
ccauugugcucaacuucau

SEQ ID NO: 410118 - RNA, 19 nt, Homo sapiens
cauaauggaaucagacaag

SEQ ID NO: 410119 - RNA, 19 nt, Homo sapiens
ucaacuccuuccagggauu

SEQ ID NO: 410120 - RNA, 19 nt, Homo sapiens
ccagcauaauggaaucaga

SEQ ID NO: 410121 - RNA, 19 nt, Homo sapiens
caucagggaagcccaggaa

SEQ ID NO: 410122 - RNA, 19 nt, Homo sapiens
ggacagauggaccaaaaga

SEQ ID NO: 410123 - RNA, 19 nt, Homo sapiens
gacuaaagaggaacagauc

SEQ ID NO: 410124 - RNA, 19 nt, Homo sapiens
gcgcaacuacauccacaug

SEQ ID NO: 410125 - RNA, 19 nt, Homo sapiens
caccaacuacuacuggauu

SEQ ID NO: 410126 - RNA, 19 nt, Homo sapiens
gaagcucuacccugagucu

SEQ ID NO: 410127 - RNA, 19 nt, Homo sapiens
cagaggccagccagcauaa

SEQ ID NO: 410128 - RNA, 19 nt, Homo sapiens
ugacuaaagaggaacagau

SEQ ID NO: 410129 - RNA, 19 nt, Homo sapiens
guacaagcugagaucaaga

SEQ ID NO: 410130 - RNA, 19 nt, Homo sapiens
gaccuucuuccuuuacuuc

SEQ ID NO: 410131 - RNA, 19 nt, Homo sapiens
augggugguugaaugauuu

SEQ ID NO: 410132 - RNA, 19 nt, Homo sapiens
caacuccuuccagggauuu

SEQ ID NO: 410133 - RNA, 19 nt, Homo sapiens
cagggacgcucuggcaagu

SEQ ID NO: 410134 - RNA, 19 nt, Homo sapiens
cugcacagccucaucuuca

SEQ ID NO: 410135 - RNA, 19 nt, Homo sapiens
gcaggguggcugugaccuu

SEQ ID NO: 410136 - RNA, 19 nt, Homo sapiens
gugaacgggagguguuuga

SEQ ID NO: 410137 - RNA, 19 nt, Homo sapiens
uugaaugauuucccacuca

SEQ ID NO: 410138 - RNA, 19 nt, Homo sapiens
ccuguccggacuacauuua

SEQ ID NO: 410139 - RNA, 19 nt, Homo sapiens
gcugguggaugcagaugac

SEQ ID NO: 410140 - RNA, 19 nt, Homo sapiens
uguccggacuacauuuaug

SEQ ID NO: 410141 - RNA, 19 nt, Homo sapiens
ggacacuggcacuggacuu

SEQ ID NO: 410142 - RNA, 19 nt, Homo sapiens
cauccuggccuccauugug

SEQ ID NO: 410143 - RNA, 19 nt, Homo sapiens
aagaugggugguugaauga

SEQ ID NO: 410144 - RNA, 19 nt, Homo sapiens
gcaaguccagaugcacuau

SEQ ID NO: 410145 - RNA, 19 nt, Homo sapiens
ggcaaguccagaugcacua

SEQ ID NO: 410146 - RNA, 19 nt, Homo sapiens
gcucaacuucauccucuuc

SEQ ID NO: 410147 - RNA, 19 nt, Homo sapiens
ucauggccuucuucucaga

SEQ ID NO: 410148 - RNA, 19 nt, Homo sapiens
ugaccuucuuccuuuacuu

SEQ ID NO: 410149 - RNA, 19 nt, Homo sapiens
acagcgagugugucaaauu

SEQ ID NO: 410150 - RNA, 19 nt, Homo sapiens
ccaacuacagcgagugugu

SEQ ID NO: 410151 - RNA, 19 nt, Homo sapiens
guccggacuacauuuauga

SEQ ID NO: 410152 - RNA, 19 nt, Homo sapiens
gugggagacagucauguga

SEQ ID NO: 410153 - RNA, 19 nt, Homo sapiens
uacaagcugagaucaagaa

SEQ ID NO: 410154 - RNA, 19 nt, Homo sapiens
guccagaugcacuaugaga

SEQ ID NO: 410155 - RNA, 19 nt, Homo sapiens
gugacacacggcagcagua

SEQ ID NO: 410156 - RNA, 19 nt, Homo sapiens
ggguggcugugaccuucuu

SEQ ID NO: 410157 - RNA, 19 nt, Homo sapiens
gaccgccugggcaugauuu

SEQ ID NO: 410158 - RNA, 19 nt, Homo sapiens
gagugugucaaauuucuca

SEQ ID NO: 410159 - RNA, 19 nt, Homo sapiens
gcauaauggaaucagacaa

SEQ ID NO: 410160 - RNA, 19 nt, Homo sapiens
cacuggacuucaagcgaaa

SEQ ID NO: 410161 - RNA, 19 nt, Homo sapiens
caagcugagaucaagaaau

SEQ ID NO: 410162 - RNA, 19 nt, Homo sapiens
cgagguacaagcugagauc

SEQ ID NO: 410163 - RNA, 19 nt, Homo sapiens
ccagccagcauaauggaau

SEQ ID NO: 410164 - RNA, 19 nt, Homo sapiens
caacuacuacuggauucug

SEQ ID NO: 410165 - RNA, 19 nt, Homo sapiens
cugugaccuucuuccuuua

SEQ ID NO: 410166 - RNA, 19 nt, Homo sapiens
gcagggagaugauauucua

SEQ ID NO: 410167 - RNA, 19 nt, Homo sapiens
gagcuggagucccuaauaa

SEQ ID NO: 410168 - RNA, 19 nt, Homo sapiens
ugaauuggcuccuguaaau

SEQ ID NO: 410169 - RNA, 19 nt, Homo sapiens
caagauugcuguugugaug

SEQ ID NO: 410170 - RNA, 19 nt, Homo sapiens
gagaugauauucuaaugga

SEQ ID NO: 410171 - RNA, 19 nt, Homo sapiens
ggacaaaucacaauauauc

SEQ ID NO: 410172 - RNA, 19 nt, Homo sapiens
gagcccagcuggauucuga

SEQ ID NO: 410173 - RNA, 19 nt, Homo sapiens
gggauggacucauuuguug

SEQ ID NO: 410174 - RNA, 19 nt, Homo sapiens
ccucaggucuucacucuuu

SEQ ID NO: 410175 - RNA, 19 nt, Homo sapiens
gcucugugauuguucauuu

SEQ ID NO: 410176 - RNA, 19 nt, Homo sapiens
ugagagggcuuggcugaua

SEQ ID NO: 410177 - RNA, 19 nt, Homo sapiens
guggacaaaucacaauaua

SEQ ID NO: 410178 - RNA, 19 nt, Homo sapiens
guacuucuaucacugcauu

SEQ ID NO: 410179 - RNA, 19 nt, Homo sapiens
caacuucuguggacaaauc

SEQ ID NO: 410180 - RNA, 19 nt, Homo sapiens
gcgaggugcugggaacuua

SEQ ID NO: 410181 - RNA, 19 nt, Homo sapiens
gcagccagauaucagcaua

SEQ ID NO: 410182 - RNA, 19 nt, Homo sapiens
gagcuugugucugcaaauu

SEQ ID NO: 410183 - RNA, 19 nt, Homo sapiens
gaacgccucuauguaaugu

SEQ ID NO: 410184 - RNA, 19 nt, Homo sapiens
aaacaugggccaauuauuc

SEQ ID NO: 410185 - RNA, 19 nt, Homo sapiens
uuaguuggcuggacauuga

SEQ ID NO: 410186 - RNA, 19 nt, Homo sapiens
gaucuaagaacaaguacuu

SEQ ID NO: 410187 - RNA, 19 nt, Homo sapiens
ggacauuuguggcugacuu

SEQ ID NO: 410188 - RNA, 19 nt, Homo sapiens
ggagacaucaaguggauuu

SEQ ID NO: 410189 - RNA, 19 nt, Homo sapiens
guagcuuucucucauauau

SEQ ID NO: 410190 - RNA, 19 nt, Homo sapiens
ggaacuauauccacaugca

SEQ ID NO: 410191 - RNA, 19 nt, Homo sapiens
caucauugguuacuucaga

SEQ ID NO: 410192 - RNA, 19 nt, Homo sapiens
gggagaagguaauuguuuc

SEQ ID NO: 410193 - RNA, 19 nt, Homo sapiens
gguauuugcucugugauug

SEQ ID NO: 410194 - RNA, 19 nt, Homo sapiens
gcacuuauuugugucuuuc

SEQ ID NO: 410195 - RNA, 19 nt, Homo sapiens
guaauuguuucccugaaug

SEQ ID NO: 410196 - RNA, 19 nt, Homo sapiens
gcuugugucugcaaauuga

SEQ ID NO: 410197 - RNA, 19 nt, Homo sapiens
gcuguagcuuucucucaua

SEQ ID NO: 410198 - RNA, 19 nt, Homo sapiens
acaggaaacuggccaaauc

SEQ ID NO: 410199 - RNA, 19 nt, Homo sapiens
ggagcuggagucccuaaua

SEQ ID NO: 410200 - RNA, 19 nt, Homo sapiens
ccagauaucagcauaggaa

SEQ ID NO: 410201 - RNA, 19 nt, Homo sapiens
gaaaguacaaugugaacuc

SEQ ID NO: 410202 - RNA, 19 nt, Homo sapiens
ccaggccuauggaaucuaa

SEQ ID NO: 410203 - RNA, 19 nt, Homo sapiens
gggagaugauauucuaaug

SEQ ID NO: 410204 - RNA, 19 nt, Homo sapiens
caaggaagcaauacaggaa

SEQ ID NO: 410205 - RNA, 19 nt, Homo sapiens
caauauaucgggugcaaga

SEQ ID NO: 410206 - RNA, 19 nt, Homo sapiens
gguaauuguuucccugaau

SEQ ID NO: 410207 - RNA, 19 nt, Homo sapiens
ggagggagaagguaauugu

SEQ ID NO: 410208 - RNA, 19 nt, Homo sapiens
gaaagcgaaaguacaaugu

SEQ ID NO: 410209 - RNA, 19 nt, Homo sapiens
gacaucaaguggauuuauc

SEQ ID NO: 410210 - RNA, 19 nt, Homo sapiens
gcugaaagcgaaaguacaa

SEQ ID NO: 410211 - RNA, 19 nt, Homo sapiens
ggucuucacucuuucuucu

SEQ ID NO: 410212 - RNA, 19 nt, Homo sapiens
gaauuggcuccuguaaaua

SEQ ID NO: 410213 - RNA, 19 nt, Homo sapiens
ugacagccacaucacuuua

SEQ ID NO: 410214 - RNA, 19 nt, Homo sapiens
aggcagaggugaagaagau

SEQ ID NO: 410215 - RNA, 19 nt, Homo sapiens
uauaucgggugcaagauug

SEQ ID NO: 410216 - RNA, 19 nt, Homo sapiens
uuucacacaucccuucuuu

SEQ ID NO: 410217 - RNA, 19 nt, Homo sapiens
gaggagaccaaggaagaua

SEQ ID NO: 410218 - RNA, 19 nt, Homo sapiens
aagcgaaaguacaauguga

SEQ ID NO: 410219 - RNA, 19 nt, Homo sapiens
ugcauaaucucaucuuugu

SEQ ID NO: 410220 - RNA, 19 nt, Homo sapiens
gcaugugggaucaauuaaa

SEQ ID NO: 410221 - RNA, 19 nt, Homo sapiens
uaugguauuugcucuguga

SEQ ID NO: 410222 - RNA, 19 nt, Homo sapiens
gcauugcacuaggaacuau

SEQ ID NO: 410223 - RNA, 19 nt, Homo sapiens
uggcaugugggaucaauua

SEQ ID NO: 410224 - RNA, 19 nt, Homo sapiens
cuacugcaauggagagguu

SEQ ID NO: 410225 - RNA, 19 nt, Homo sapiens
caaguggauuuaucaagca

SEQ ID NO: 410226 - RNA, 19 nt, Homo sapiens
gcuguugugauguuuauuu

SEQ ID NO: 410227 - RNA, 19 nt, Homo sapiens
aguaguccaugcucacaua

SEQ ID NO: 410228 - RNA, 19 nt, Homo sapiens
gcauaggaaagcaagaauu

SEQ ID NO: 410229 - RNA, 19 nt, Homo sapiens
gcaucaaguuuuccucuaa

SEQ ID NO: 410230 - RNA, 19 nt, Homo sapiens
uggaguaguuuauuaccuu

SEQ ID NO: 410231 - RNA, 19 nt, Homo sapiens
gaaggaugccaaggagaaa

SEQ ID NO: 410232 - RNA, 19 nt, Homo sapiens
acugugagcucuucuucaa

SEQ ID NO: 410233 - RNA, 19 nt, Homo sapiens
gcuggagucccuaauaaug

SEQ ID NO: 410234 - RNA, 19 nt, Homo sapiens
gcuauugggcugaauuuua

SEQ ID NO: 410235 - RNA, 19 nt, Homo sapiens
gcuauucucaucauugguu

SEQ ID NO: 410236 - RNA, 19 nt, Homo sapiens
ugaaggaugccaaggagaa

SEQ ID NO: 410237 - RNA, 19 nt, Homo sapiens
caacaucacagcucaacuc

SEQ ID NO: 410238 - RNA, 19 nt, Homo sapiens
uuugaacgccucuauguaa

SEQ ID NO: 410239 - RNA, 19 nt, Homo sapiens
cauaggaaagcaagaauuc

SEQ ID NO: 410240 - RNA, 19 nt, Homo sapiens
uugaauggccucuuuguga

SEQ ID NO: 410241 - RNA, 19 nt, Homo sapiens
ucaacuccuuucaggguuu

SEQ ID NO: 410242 - RNA, 19 nt, Homo sapiens
gaacuuagugcuggagaca

SEQ ID NO: 410243 - RNA, 19 nt, Homo sapiens
uccaugcccuccuuauauu

SEQ ID NO: 410244 - RNA, 19 nt, Homo sapiens
caugugggaucaauuaaaa

SEQ ID NO: 410245 - RNA, 19 nt, Homo sapiens
gaagaucuuuuagugugua

SEQ ID NO: 410246 - RNA, 19 nt, Homo sapiens
gugcuuaucucuggcaaag

SEQ ID NO: 410247 - RNA, 19 nt, Homo sapiens
caugcccuccuuauauuua

SEQ ID NO: 410248 - RNA, 19 nt, Homo sapiens
acacaucccuucuuuugaa

SEQ ID NO: 410249 - RNA, 19 nt, Homo sapiens
gcuggacauugauaaaaua

SEQ ID NO: 410250 - RNA, 19 nt, Homo sapiens
gcacugugagcucuucuuc

SEQ ID NO: 410251 - RNA, 19 nt, Homo sapiens
uguaaauacuaacgacaug

SEQ ID NO: 410252 - RNA, 19 nt, Homo sapiens
ggagaugauauucuaaugg

SEQ ID NO: 410253 - RNA, 19 nt, Homo sapiens
aaaguacaaugugaacuca

SEQ ID NO: 410254 - RNA, 19 nt, Homo sapiens
cacaauauaucgggugcaa

SEQ ID NO: 410255 - RNA, 19 nt, Homo sapiens
ugacuucaaccauaaagga

SEQ ID NO: 410256 - RNA, 19 nt, Homo sapiens
guuccaugcccuccuuaua

SEQ ID NO: 410257 - RNA, 19 nt, Homo sapiens
ucuucacucuuucuucuuu

SEQ ID NO: 410258 - RNA, 19 nt, Homo sapiens
gagagggcuuggcugauac

SEQ ID NO: 410259 - RNA, 19 nt, Homo sapiens
cugaggauguucucugaau

SEQ ID NO: 410260 - RNA, 19 nt, Homo sapiens
aaucuaacccagacacuga

SEQ ID NO: 410261 - RNA, 19 nt, Homo sapiens
ucucaucauugguuacuuc

SEQ ID NO: 410262 - RNA, 19 nt, Homo sapiens
uuugagcuguuacuacauu

SEQ ID NO: 410263 - RNA, 19 nt, Homo sapiens
ccucuaaauuaauguaugg

SEQ ID NO: 410264 - RNA, 19 nt, Homo sapiens
ggaggcagggagaugauau

SEQ ID NO: 410265 - RNA, 19 nt, Homo sapiens
cuuccuggcuacaaauuau

SEQ ID NO: 410266 - RNA, 19 nt, Homo sapiens
gaagagcgauuauauguua

SEQ ID NO: 410267 - RNA, 19 nt, Homo sapiens
gaauauggcugaccuaaua

SEQ ID NO: 410268 - RNA, 19 nt, Homo sapiens
gaaguuggguugucuagaa

SEQ ID NO: 410269 - RNA, 19 nt, Homo sapiens
gaagaacaaugauguaauc

SEQ ID NO: 410270 - RNA, 19 nt, Homo sapiens
cuacaaagcuuccaaagga

SEQ ID NO: 410271 - RNA, 19 nt, Homo sapiens
ggaaauugcuuugaaguug

SEQ ID NO: 410272 - RNA, 19 nt, Homo sapiens
gaacuuggacgauguauug

SEQ ID NO: 410273 - RNA, 19 nt, Homo sapiens
gaagauaagccaacuuuga

SEQ ID NO: 410274 - RNA, 19 nt, Homo sapiens
gguucaagcuggauuauuu

SEQ ID NO: 410275 - RNA, 19 nt, Homo sapiens
gaaggaaucaguuaccuaa

SEQ ID NO: 410276 - RNA, 19 nt, Homo sapiens
ggaggacucuacaguauug

SEQ ID NO: 410277 - RNA, 19 nt, Homo sapiens
gaaauacaguuuggaucua

SEQ ID NO: 410278 - RNA, 19 nt, Homo sapiens
guacagcucuugcauaucu

SEQ ID NO: 410279 - RNA, 19 nt, Homo sapiens
agagauagcugaucaagug

SEQ ID NO: 410280 - RNA, 19 nt, Homo sapiens
uaacuaacccuuccuugua

SEQ ID NO: 410281 - RNA, 19 nt, Homo sapiens
ggugacaucuuaauuccua

SEQ ID NO: 410282 - RNA, 19 nt, Homo sapiens
ggacauugcugcucggaau

SEQ ID NO: 410283 - RNA, 19 nt, Homo sapiens
ggaagaauauaaugaacug

SEQ ID NO: 410284 - RNA, 19 nt, Homo sapiens
caucagaccucagaaagaa

SEQ ID NO: 410285 - RNA, 19 nt, Homo sapiens
caucaaggcauuuauauga

SEQ ID NO: 410286 - RNA, 19 nt, Homo sapiens
gaaaagaagucuaacuaug

SEQ ID NO: 410287 - RNA, 19 nt, Homo sapiens
caagaagccuuaacaaugc

SEQ ID NO: 410288 - RNA, 19 nt, Homo sapiens
ccacacaucuugcugacuu

SEQ ID NO: 410289 - RNA, 19 nt, Homo sapiens
ggaacuagcuguagaacac

SEQ ID NO: 410290 - RNA, 19 nt, Homo sapiens
ucaagaagccuuaacaaug

SEQ ID NO: 410291 - RNA, 19 nt, Homo sapiens
guacaucaaggcauuuaua

SEQ ID NO: 410292 - RNA, 19 nt, Homo sapiens
gaaccucgcagucauuuau

SEQ ID NO: 410293 - RNA, 19 nt, Homo sapiens
gauaaggaaugcuucaagu

SEQ ID NO: 410294 - RNA, 19 nt, Homo sapiens
gaggagagcaugaagcaaa

SEQ ID NO: 410295 - RNA, 19 nt, Homo sapiens
cuacagauuugauaaggaa

SEQ ID NO: 410296 - RNA, 19 nt, Homo sapiens
caacgagggugucaagcuu

SEQ ID NO: 410297 - RNA, 19 nt, Homo sapiens
gauguaaucggucgaauug

SEQ ID NO: 410298 - RNA, 19 nt, Homo sapiens
guggauaugugaagcauug

SEQ ID NO: 410299 - RNA, 19 nt, Homo sapiens
ccuaagaguuuacuggauu

SEQ ID NO: 410300 - RNA, 19 nt, Homo sapiens
gcgauuauauguuagagau

SEQ ID NO: 410301 - RNA, 19 nt, Homo sapiens
guggaaauaugaauugaga

SEQ ID NO: 410302 - RNA, 19 nt, Homo sapiens
aaagccauguugacuauuu

SEQ ID NO: 410303 - RNA, 19 nt, Homo sapiens
gaacgggcuuugccaucaa

SEQ ID NO: 410304 - RNA, 19 nt, Homo sapiens
uaacaaugcgucaguuuga

SEQ ID NO: 410305 - RNA, 19 nt, Homo sapiens
caguuacuuugaccuauua

SEQ ID NO: 410306 - RNA, 19 nt, Homo sapiens
uuaaagccauguugacuau

SEQ ID NO: 410307 - RNA, 19 nt, Homo sapiens
caaacugcauugaggagaa

SEQ ID NO: 410308 - RNA, 19 nt, Homo sapiens
uaguacagcucuugcauau

SEQ ID NO: 410309 - RNA, 19 nt, Homo sapiens
gggcaucauucagaagaua

SEQ ID NO: 410310 - RNA, 19 nt, Homo sapiens
gcuaaucccacuuuacaaa

SEQ ID NO: 410311 - RNA, 19 nt, Homo sapiens
aaaggaaugcuacaacuaa

SEQ ID NO: 410312 - RNA, 19 nt, Homo sapiens
cagaagaaggaaucaguua

SEQ ID NO: 410313 - RNA, 19 nt, Homo sapiens
ucugaaaccugaugugaga

SEQ ID NO: 410314 - RNA, 19 nt, Homo sapiens
guggaggacucuacaguau

SEQ ID NO: 410315 - RNA, 19 nt, Homo sapiens
agagaaggcucagcaagaa

SEQ ID NO: 410316 - RNA, 19 nt, Homo sapiens
ggaaauacaguuuggaucu

SEQ ID NO: 410317 - RNA, 19 nt, Homo sapiens
guaaggaaauacaguuugg

SEQ ID NO: 410318 - RNA, 19 nt, Homo sapiens
gaagucuaacuaugaagua

SEQ ID NO: 410319 - RNA, 19 nt, Homo sapiens
gauaagccaacuuugaauu

SEQ ID NO: 410320 - RNA, 19 nt, Homo sapiens
ggacauuauuggccacugu

SEQ ID NO: 410321 - RNA, 19 nt, Homo sapiens
gcaaugcacuagaaaagaa

SEQ ID NO: 410322 - RNA, 19 nt, Homo sapiens
ccagaggaguggaaauaug

SEQ ID NO: 410323 - RNA, 19 nt, Homo sapiens
gagcaugaagcaaagaauu

SEQ ID NO: 410324 - RNA, 19 nt, Homo sapiens
gcacagaagcuauugaacu

SEQ ID NO: 410325 - RNA, 19 nt, Homo sapiens
uguaaucggucgaauugaa

SEQ ID NO: 410326 - RNA, 19 nt, Homo sapiens
guuuggaucuagcaucuuu

SEQ ID NO: 410327 - RNA, 19 nt, Homo sapiens
ggaguggaaauaugaauug

SEQ ID NO: 410328 - RNA, 19 nt, Homo sapiens
gcaauggagcgaguauuaa

SEQ ID NO: 410329 - RNA, 19 nt, Homo sapiens
ggaauuugguuuucuuuug

SEQ ID NO: 410330 - RNA, 19 nt, Homo sapiens
agacuugaguuauuucaga

SEQ ID NO: 410331 - RNA, 19 nt, Homo sapiens
gcacuuacagcuccaacuu

SEQ ID NO: 410332 - RNA, 19 nt, Homo sapiens
ugggugagcucaucaacaa

SEQ ID NO: 410333 - RNA, 19 nt, Homo sapiens
ugucagaaacagaugauua

SEQ ID NO: 410334 - RNA, 19 nt, Homo sapiens
gcuccagagucaaucaauu

SEQ ID NO: 410335 - RNA, 19 nt, Homo sapiens
aaccagggauuaugagauu

SEQ ID NO: 410336 - RNA, 19 nt, Homo sapiens
gaaauacggcgaucauacu

SEQ ID NO: 410337 - RNA, 19 nt, Homo sapiens
gugaagagcgauuauaugu

SEQ ID NO: 410338 - RNA, 19 nt, Homo sapiens
gccaaggggugacaucuua

SEQ ID NO: 410339 - RNA, 19 nt, Homo sapiens
uauaucagccuguggguaa

SEQ ID NO: 410340 - RNA, 19 nt, Homo sapiens
gcagucauuuaucaucaga

SEQ ID NO: 410341 - RNA, 19 nt, Homo sapiens
caagcuggauuauuucagu

SEQ ID NO: 410342 - RNA, 19 nt, Homo sapiens
caauuugccaaccuuaaua

SEQ ID NO: 410343 - RNA, 19 nt, Homo sapiens
guuggguugucuagaaaua

SEQ ID NO: 410344 - RNA, 19 nt, Homo sapiens
gauaguggacagucacaaa

SEQ ID NO: 410345 - RNA, 19 nt, Homo sapiens
caauggagcgaguauuaaa

SEQ ID NO: 410346 - RNA, 19 nt, Homo sapiens
gcagaaaugcuuuguacca

SEQ ID NO: 410347 - RNA, 19 nt, Homo sapiens
ugaaagcugucaucgagau

SEQ ID NO: 410348 - RNA, 19 nt, Homo sapiens
uaccucagcuagugacgua

SEQ ID NO: 410349 - RNA, 19 nt, Homo sapiens
augcugagauuauagauga

SEQ ID NO: 410350 - RNA, 19 nt, Homo sapiens
gcaaaccauucaguauuca

SEQ ID NO: 410351 - RNA, 19 nt, Homo sapiens
acaccaaauucgaguacua

SEQ ID NO: 410352 - RNA, 19 nt, Homo sapiens
ggaguggaguggcaugauc

SEQ ID NO: 410353 - RNA, 19 nt, Homo sapiens
ccaagaggcugagaauucu

SEQ ID NO: 410354 - RNA, 19 nt, Homo sapiens
aaacuaccuuagcugcaua

SEQ ID NO: 410355 - RNA, 19 nt, Homo sapiens
gagaauauggcugaccuaa

SEQ ID NO: 410356 - RNA, 19 nt, Homo sapiens
gauccugucuccagucuac

SEQ ID NO: 410357 - RNA, 19 nt, Homo sapiens
uaagaaaacugauccaaca

SEQ ID NO: 410358 - RNA, 19 nt, Homo sapiens
gaacacccuucaguugcaa

SEQ ID NO: 410359 - RNA, 19 nt, Homo sapiens
aaacuuacucgaugucauu

SEQ ID NO: 410360 - RNA, 19 nt, Homo sapiens
agauugagauggcacagaa

SEQ ID NO: 410361 - RNA, 19 nt, Homo sapiens
gauaagguguacgagaaug

SEQ ID NO: 410362 - RNA, 19 nt, Homo sapiens
guucugguguccucaaaug

SEQ ID NO: 410363 - RNA, 19 nt, Homo sapiens
uagcaucuuugauccugua

SEQ ID NO: 410364 - RNA, 19 nt, Homo sapiens
ggacacacgccgucucugu

SEQ ID NO: 410365 - RNA, 19 nt, Homo sapiens
gugcaaaccauucaguauu

SEQ ID NO: 410366 - RNA, 19 nt, Homo sapiens
gaagagcgauuauauguua

SEQ ID NO: 410367 - RNA, 19 nt, Homo sapiens
gaauauggcugaccuaaua

SEQ ID NO: 410368 - RNA, 19 nt, Homo sapiens
gaaguuggguugucuagaa

SEQ ID NO: 410369 - RNA, 19 nt, Homo sapiens
gaagaacaaugauguaauc

SEQ ID NO: 410370 - RNA, 19 nt, Homo sapiens
cuacaaagcuuccaaagga

SEQ ID NO: 410371 - RNA, 19 nt, Homo sapiens
ggaaauugcuuugaaguug

SEQ ID NO: 410372 - RNA, 19 nt, Homo sapiens
gaacuuggacgauguauug

SEQ ID NO: 410373 - RNA, 19 nt, Homo sapiens
gaagauaagccaacuuuga

SEQ ID NO: 410374 - RNA, 19 nt, Homo sapiens
gguucaagcuggauuauuu

SEQ ID NO: 410375 - RNA, 19 nt, Homo sapiens
gaaggaaucaguuaccuaa

SEQ ID NO: 410376 - RNA, 19 nt, Homo sapiens
ggaggacucuacaguauug

SEQ ID NO: 410377 - RNA, 19 nt, Homo sapiens
gaaauacaguuuggaucua

SEQ ID NO: 410378 - RNA, 19 nt, Homo sapiens
guacagcucuugcauaucu

SEQ ID NO: 410379 - RNA, 19 nt, Homo sapiens
agagauagcugaucaagug

SEQ ID NO: 410380 - RNA, 19 nt, Homo sapiens
uaacuaacccuuccuugua

SEQ ID NO: 410381 - RNA, 19 nt, Homo sapiens
ggugacaucuuaauuccua

SEQ ID NO: 410382 - RNA, 19 nt, Homo sapiens
ggacauugcugcucggaau

SEQ ID NO: 410383 - RNA, 19 nt, Homo sapiens
ggaagaauauaaugaacug

SEQ ID NO: 410384 - RNA, 19 nt, Homo sapiens
caucagaccucagaaagaa

SEQ ID NO: 410385 - RNA, 19 nt, Homo sapiens
caucaaggcauuuauauga

SEQ ID NO: 410386 - RNA, 19 nt, Homo sapiens
gaaaagaagucuaacuaug

SEQ ID NO: 410387 - RNA, 19 nt, Homo sapiens
caagaagccuuaacaaugc

SEQ ID NO: 410388 - RNA, 19 nt, Homo sapiens
ccacacaucuugcugacuu

SEQ ID NO: 410389 - RNA, 19 nt, Homo sapiens
ggaacuagcuguagaacac

SEQ ID NO: 410390 - RNA, 19 nt, Homo sapiens
ucaagaagccuuaacaaug

SEQ ID NO: 410391 - RNA, 19 nt, Homo sapiens
guacaucaaggcauuuaua

SEQ ID NO: 410392 - RNA, 19 nt, Homo sapiens
gaaccucgcagucauuuau

SEQ ID NO: 410393 - RNA, 19 nt, Homo sapiens
gaagggagaauaugacaga

SEQ ID NO: 410394 - RNA, 19 nt, Homo sapiens
gauaaggaaugcuucaagu

SEQ ID NO: 410395 - RNA, 19 nt, Homo sapiens
ccagagcuccucaagaaua

SEQ ID NO: 410396 - RNA, 19 nt, Homo sapiens
gaggagagcaugaagcaaa

SEQ ID NO: 410397 - RNA, 19 nt, Homo sapiens
cuacagauuugauaaggaa

SEQ ID NO: 410398 - RNA, 19 nt, Homo sapiens
caacgagggugucaagcuu

SEQ ID NO: 410399 - RNA, 19 nt, Homo sapiens
gauguaaucggucgaauug

SEQ ID NO: 410400 - RNA, 19 nt, Homo sapiens
guggauaugugaagcauug

SEQ ID NO: 410401 - RNA, 19 nt, Homo sapiens
ccuaagaguuuacuggauu

SEQ ID NO: 410402 - RNA, 19 nt, Homo sapiens
gcgauuauauguuagagau

SEQ ID NO: 410403 - RNA, 19 nt, Homo sapiens
guggaaauaugaauugaga

SEQ ID NO: 410404 - RNA, 19 nt, Homo sapiens
aaagccauguugacuauuu

SEQ ID NO: 410405 - RNA, 19 nt, Homo sapiens
gaacgggcuuugccaucaa

SEQ ID NO: 410406 - RNA, 19 nt, Homo sapiens
uaacaaugcgucaguuuga

SEQ ID NO: 410407 - RNA, 19 nt, Homo sapiens
caguuacuuugaccuauua

SEQ ID NO: 410408 - RNA, 19 nt, Homo sapiens
uuaaagccauguugacuau

SEQ ID NO: 410409 - RNA, 19 nt, Homo sapiens
caaacugcauugaggagaa

SEQ ID NO: 410410 - RNA, 19 nt, Homo sapiens
cagagcuccucaagaauaa

SEQ ID NO: 410411 - RNA, 19 nt, Homo sapiens
uaguacagcucuugcauau

SEQ ID NO: 410412 - RNA, 19 nt, Homo sapiens
gggcaucauucagaagaua

SEQ ID NO: 410413 - RNA, 19 nt, Homo sapiens
gcuaaucccacuuuacaaa

SEQ ID NO: 410414 - RNA, 19 nt, Homo sapiens
aaaggaaugcuacaacuaa

SEQ ID NO: 410415 - RNA, 19 nt, Homo sapiens
cagaagaaggaaucaguua

SEQ ID NO: 410416 - RNA, 19 nt, Homo sapiens
ucugaaaccugaugugaga

SEQ ID NO: 410417 - RNA, 19 nt, Homo sapiens
guggaggacucuacaguau

SEQ ID NO: 410418 - RNA, 19 nt, Homo sapiens
agagaaggcucagcaagaa

SEQ ID NO: 410419 - RNA, 19 nt, Homo sapiens
ggaaauacaguuuggaucu

SEQ ID NO: 410420 - RNA, 19 nt, Homo sapiens
guaaggaaauacaguuugg

SEQ ID NO: 410421 - RNA, 19 nt, Homo sapiens
gaagucuaacuaugaagua

SEQ ID NO: 410422 - RNA, 19 nt, Homo sapiens
gauaagccaacuuugaauu

SEQ ID NO: 410423 - RNA, 19 nt, Homo sapiens
gggagaauaugacagauac

SEQ ID NO: 410424 - RNA, 19 nt, Homo sapiens
ggacauuauuggccacugu

SEQ ID NO: 410425 - RNA, 19 nt, Homo sapiens
gcaaugcacuagaaaagaa

SEQ ID NO: 410426 - RNA, 19 nt, Homo sapiens
ccagaggaguggaaauaug

SEQ ID NO: 410427 - RNA, 19 nt, Homo sapiens
gagcaugaagcaaagaauu

SEQ ID NO: 410428 - RNA, 19 nt, Homo sapiens
gcacagaagcuauugaacu

SEQ ID NO: 410429 - RNA, 19 nt, Homo sapiens
uguaaucggucgaauugaa

SEQ ID NO: 410430 - RNA, 19 nt, Homo sapiens
guuuggaucuagcaucuuu

SEQ ID NO: 410431 - RNA, 19 nt, Homo sapiens
ggaguggaaauaugaauug

SEQ ID NO: 410432 - RNA, 19 nt, Homo sapiens
gcaauggagcgaguauuaa

SEQ ID NO: 410433 - RNA, 19 nt, Homo sapiens
ggaauuugguuuucuuuug

SEQ ID NO: 410434 - RNA, 19 nt, Homo sapiens
agacuugaguuauuucaga

SEQ ID NO: 410435 - RNA, 19 nt, Homo sapiens
gcacuuacagcuccaacuu

SEQ ID NO: 410436 - RNA, 19 nt, Homo sapiens
ugggugagcucaucaacaa

SEQ ID NO: 410437 - RNA, 19 nt, Homo sapiens
ugucagaaacagaugauua

SEQ ID NO: 410438 - RNA, 19 nt, Homo sapiens
gcuccagagucaaucaauu

SEQ ID NO: 410439 - RNA, 19 nt, Homo sapiens
aaccagggauuaugagauu

SEQ ID NO: 410440 - RNA, 19 nt, Homo sapiens
gaaauacggcgaucauacu

SEQ ID NO: 410441 - RNA, 19 nt, Homo sapiens
gugaagagcgauuauaugu

SEQ ID NO: 410442 - RNA, 19 nt, Homo sapiens
gccaaggggugacaucuua

SEQ ID NO: 410443 - RNA, 19 nt, Homo sapiens
uauaucagccuguggguaa

SEQ ID NO: 410444 - RNA, 19 nt, Homo sapiens
gcagucauuuaucaucaga

SEQ ID NO: 410445 - RNA, 19 nt, Homo sapiens
caagcuggauuauuucagu

SEQ ID NO: 410446 - RNA, 19 nt, Homo sapiens
caauuugccaaccuuaaua

SEQ ID NO: 410447 - RNA, 19 nt, Homo sapiens
guuggguugucuagaaaua

SEQ ID NO: 410448 - RNA, 19 nt, Homo sapiens
gauaguggacagucacaaa

SEQ ID NO: 410449 - RNA, 19 nt, Homo sapiens
caauggagcgaguauuaaa

SEQ ID NO: 410450 - RNA, 19 nt, Homo sapiens
gcagaaaugcuuuguacca

SEQ ID NO: 410451 - RNA, 19 nt, Homo sapiens
ugaaagcugucaucgagau

SEQ ID NO: 410452 - RNA, 19 nt, Homo sapiens
uaccucagcuagugacgua

SEQ ID NO: 410453 - RNA, 19 nt, Homo sapiens
augcugagauuauagauga

SEQ ID NO: 410454 - RNA, 19 nt, Homo sapiens
gcaaaccauucaguauuca

SEQ ID NO: 410455 - RNA, 19 nt, Homo sapiens
acaccaaauucgaguacua

SEQ ID NO: 410456 - RNA, 19 nt, Homo sapiens
ccaagaggcugagaauucu

SEQ ID NO: 410457 - RNA, 19 nt, Homo sapiens
aaacuaccuuagcugcaua

SEQ ID NO: 410458 - RNA, 19 nt, Homo sapiens
gagaauauggcugaccuaa

SEQ ID NO: 410459 - RNA, 19 nt, Homo sapiens
gauccugucuccagucuac

SEQ ID NO: 410460 - RNA, 19 nt, Homo sapiens
uaagaaaacugauccaaca

SEQ ID NO: 410461 - RNA, 19 nt, Homo sapiens
gaacacccuucaguugcaa

SEQ ID NO: 410462 - RNA, 19 nt, Homo sapiens
aaacuuacucgaugucauu

SEQ ID NO: 410463 - RNA, 19 nt, Homo sapiens
agauugagauggcacagaa

SEQ ID NO: 410464 - RNA, 19 nt, Homo sapiens
gauaagguguacgagaaug

SEQ ID NO: 410465 - RNA, 19 nt, Homo sapiens
guucugguguccucaaaug

SEQ ID NO: 410466 - RNA, 19 nt, Homo sapiens
caggaaagguucacaaaug

SEQ ID NO: 410467 - RNA, 19 nt, Homo sapiens
gagaaaguccugcccguuu

SEQ ID NO: 410468 - RNA, 19 nt, Homo sapiens
ggacgcucauguaaauuug

SEQ ID NO: 410469 - RNA, 19 nt, Homo sapiens
cauccaugguuaagucaua

SEQ ID NO: 410470 - RNA, 19 nt, Homo sapiens
ugaagaagcugcggcacaa

SEQ ID NO: 410471 - RNA, 19 nt, Homo sapiens
ccgcgacucugaugagaaa

SEQ ID NO: 410472 - RNA, 19 nt, Homo sapiens
gggacgcucauguaaauuu

SEQ ID NO: 410473 - RNA, 19 nt, Homo sapiens
ugcccgagcuugugaacua

SEQ ID NO: 410474 - RNA, 19 nt, Homo sapiens
ggugaugggugcaggaaag

SEQ ID NO: 410475 - RNA, 19 nt, Homo sapiens
ggccauuacuccaccaaau

SEQ ID NO: 410476 - RNA, 19 nt, Homo sapiens
ucgggacgcucauguaaau

SEQ ID NO: 410477 - RNA, 19 nt, Homo sapiens
gcucgggacgcucauguaa

SEQ ID NO: 410478 - RNA, 19 nt, Homo sapiens
gcaggaaagguucacaaau

SEQ ID NO: 410479 - RNA, 19 nt, Homo sapiens
uggcugagggcauguguua

SEQ ID NO: 410480 - RNA, 19 nt, Homo sapiens
gaaaccccgucucuacuaa

SEQ ID NO: 410481 - RNA, 19 nt, Homo sapiens
ucucuuucauccaugguua

SEQ ID NO: 410482 - RNA, 19 nt, Homo sapiens
ugacucaccugaaaguuuu

SEQ ID NO: 410483 - RNA, 19 nt, Homo sapiens
aggaaagguucacaaaugu

SEQ ID NO: 410484 - RNA, 19 nt, Homo sapiens
ggaaaacacccucugcaaa

SEQ ID NO: 410485 - RNA, 19 nt, Homo sapiens
gcagcagacuggugugaac

SEQ ID NO: 410486 - RNA, 19 nt, Homo sapiens
ggguccagguggccauuaa

SEQ ID NO: 410487 - RNA, 19 nt, Homo sapiens
cuugagagcuuggccuuau

SEQ ID NO: 410488 - RNA, 19 nt, Homo sapiens
gcucauguaaauuugguuu

SEQ ID NO: 410489 - RNA, 19 nt, Homo sapiens
gaaaacacccucugcaaag

SEQ ID NO: 410490 - RNA, 19 nt, Homo sapiens
gcccuucucuacugucugu

SEQ ID NO: 410491 - RNA, 19 nt, Homo sapiens
uaccuggagucgcagaauu

SEQ ID NO: 410492 - RNA, 19 nt, Homo sapiens
ggugauuucucgagacaac

SEQ ID NO: 410493 - RNA, 19 nt, Homo sapiens
cgacagagcgagacuccau

SEQ ID NO: 410494 - RNA, 19 nt, Homo sapiens
gaagccagcagaggucaga

SEQ ID NO: 410495 - RNA, 19 nt, Homo sapiens
gaagaagcugcggcacaaa

SEQ ID NO: 410496 - RNA, 19 nt, Homo sapiens
gaagccgagugccgacuac

SEQ ID NO: 410497 - RNA, 19 nt, Homo sapiens
gucaggagaucgacaccau

SEQ ID NO: 410498 - RNA, 19 nt, Homo sapiens
ccuguaaucccagcacuuu

SEQ ID NO: 410499 - RNA, 19 nt, Homo sapiens
cuguuugucuugugucuug

SEQ ID NO: 410500 - RNA, 19 nt, Homo sapiens
gaugggugcaggaaagguu

SEQ ID NO: 410501 - RNA, 19 nt, Homo sapiens
acaagcugaugcugacaug

SEQ ID NO: 410502 - RNA, 19 nt, Homo sapiens
aaacacccucugcaaaguu

SEQ ID NO: 410503 - RNA, 19 nt, Homo sapiens
uuucggagcugcuggacau

SEQ ID NO: 410504 - RNA, 19 nt, Homo sapiens
ggagugucugcguccaaua

SEQ ID NO: 410505 - RNA, 19 nt, Homo sapiens
ggagauccaggccaugaag

SEQ ID NO: 410506 - RNA, 19 nt, Homo sapiens
uuucauccaugguuaaguc

SEQ ID NO: 410507 - RNA, 19 nt, Homo sapiens
ugagagcuuggccuuauga

SEQ ID NO: 410508 - RNA, 19 nt, Homo sapiens
gguguuucuuuccuguuug

SEQ ID NO: 410509 - RNA, 19 nt, Homo sapiens
cgucugguccuuugggauu

SEQ ID NO: 410510 - RNA, 19 nt, Homo sapiens
ucgacaccauccuggcuaa

SEQ ID NO: 410511 - RNA, 19 nt, Homo sapiens
ugaacgaggcgguguccuu

SEQ ID NO: 410512 - RNA, 19 nt, Homo sapiens
gguuuugacucaccugaaa

SEQ ID NO: 410513 - RNA, 19 nt, Homo sapiens
gcucuucccaguucagcuu

SEQ ID NO: 410514 - RNA, 19 nt, Homo sapiens
gcuuauugguuuugguuuu

SEQ ID NO: 410515 - RNA, 19 nt, Homo sapiens
cgaggcgccagcucaguuu

SEQ ID NO: 410516 - RNA, 19 nt, Homo sapiens
agguguuucuuuccuguuu

SEQ ID NO: 410517 - RNA, 19 nt, Homo sapiens
gggcagguguuucuuuccu

SEQ ID NO: 410518 - RNA, 19 nt, Homo sapiens
gaucagggucagcgagaag

SEQ ID NO: 410519 - RNA, 19 nt, Homo sapiens
gccauuacuccaccaaauc

SEQ ID NO: 410520 - RNA, 19 nt, Homo sapiens
ggccuuaugaccagugaga

SEQ ID NO: 410521 - RNA, 19 nt, Homo sapiens
acgucuaccucucccauga

SEQ ID NO: 410522 - RNA, 19 nt, Homo sapiens
gagguggagcuugcaguga

SEQ ID NO: 410523 - RNA, 19 nt, Homo sapiens
gagauccaggccaugaaga

SEQ ID NO: 410524 - RNA, 19 nt, Homo sapiens
uugacucaccugaaaguuu

SEQ ID NO: 410525 - RNA, 19 nt, Homo sapiens
uuucccaccuucaccuuug

SEQ ID NO: 410526 - RNA, 19 nt, Homo sapiens
aaggugauuucucgagaca

SEQ ID NO: 410527 - RNA, 19 nt, Homo sapiens
ccucucccaugaccacaau

SEQ ID NO: 410528 - RNA, 19 nt, Homo sapiens
aacacccucugcaaaguug

SEQ ID NO: 410529 - RNA, 19 nt, Homo sapiens
caucaucacggagcucaug

SEQ ID NO: 410530 - RNA, 19 nt, Homo sapiens
ucuugugucuugagagcuu

SEQ ID NO: 410531 - RNA, 19 nt, Homo sapiens
gcaggcagaugaugaagua

SEQ ID NO: 410532 - RNA, 19 nt, Homo sapiens
gagagaagcccacuauuaa

SEQ ID NO: 410533 - RNA, 19 nt, Homo sapiens
ccacucaucugccaacuuu

SEQ ID NO: 410534 - RNA, 19 nt, Homo sapiens
cgagagaagcccacuauua

SEQ ID NO: 410535 - RNA, 19 nt, Homo sapiens
cagcagagauccaagaaga

SEQ ID NO: 410536 - RNA, 19 nt, Homo sapiens
ucgcugcucucaauaaaua

SEQ ID NO: 410537 - RNA, 19 nt, Homo sapiens
ggagggaguuggagauguu

SEQ ID NO: 410538 - RNA, 19 nt, Homo sapiens
ggcaacagcugcaacauca

SEQ ID NO: 410539 - RNA, 19 nt, Homo sapiens
gaagacaugccgcuauuug

SEQ ID NO: 410540 - RNA, 19 nt, Homo sapiens
gcaaggauguguacaacag

SEQ ID NO: 410541 - RNA, 19 nt, Homo sapiens
gcauggaguuugacaagga

SEQ ID NO: 410542 - RNA, 19 nt, Homo sapiens
gcuuugagcugggcaguuu

SEQ ID NO: 410543 - RNA, 19 nt, Homo sapiens
gggcaaacccggcuacuug

SEQ ID NO: 410544 - RNA, 19 nt, Homo sapiens
gagcugguguuggccaaua

SEQ ID NO: 410545 - RNA, 19 nt, Homo sapiens
gcagagacccugguacuug

SEQ ID NO: 410546 - RNA, 19 nt, Homo sapiens
gaacuucaccuugagcauu

SEQ ID NO: 410547 - RNA, 19 nt, Homo sapiens
cagcacaagugauaagaug

SEQ ID NO: 410548 - RNA, 19 nt, Homo sapiens
gggaugagcuggguuugug

SEQ ID NO: 410549 - RNA, 19 nt, Homo sapiens
uagcagagauugaagacau

SEQ ID NO: 410550 - RNA, 19 nt, Homo sapiens
caauauugcugaaagugau

SEQ ID NO: 410551 - RNA, 19 nt, Homo sapiens
ccgcagagccacaguguuu

SEQ ID NO: 410552 - RNA, 19 nt, Homo sapiens
gcaagcccguguccaagug

SEQ ID NO: 410553 - RNA, 19 nt, Homo sapiens
ugaugucacuggagaagaa

SEQ ID NO: 410554 - RNA, 19 nt, Homo sapiens
gcacacaggguuaaugagu

SEQ ID NO: 410555 - RNA, 19 nt, Homo sapiens
ugaagagccugcagagcaa

SEQ ID NO: 410556 - RNA, 19 nt, Homo sapiens
gagaagcccacuauuaagu

SEQ ID NO: 410557 - RNA, 19 nt, Homo sapiens
gagcauagugggcuguauu

SEQ ID NO: 410558 - RNA, 19 nt, Homo sapiens
gcuguggccuacaucauug

SEQ ID NO: 410559 - RNA, 19 nt, Homo sapiens
acacuucguugccacauug

SEQ ID NO: 410560 - RNA, 19 nt, Homo sapiens
ugggagaccucaagcaguu

SEQ ID NO: 410561 - RNA, 19 nt, Homo sapiens
ccaagcggcugcagaagca

SEQ ID NO: 410562 - RNA, 19 nt, Homo sapiens
gagggugacuucucuacca

SEQ ID NO: 410563 - RNA, 19 nt, Homo sapiens
cagagugggugacagacaa

SEQ ID NO: 410564 - RNA, 19 nt, Homo sapiens
gggcacacaggguuaauga

SEQ ID NO: 410565 - RNA, 19 nt, Homo sapiens
gggaguuccuuaauauucu

SEQ ID NO: 410566 - RNA, 19 nt, Homo sapiens
gagaugacgcuggcaacua

SEQ ID NO: 410567 - RNA, 19 nt, Homo sapiens
agccagaacuucaccuuga

SEQ ID NO: 410568 - RNA, 19 nt, Homo sapiens
ggacuuggcugcgcguaac

SEQ ID NO: 410569 - RNA, 19 nt, Homo sapiens
cagagacccugguacuugu

SEQ ID NO: 410570 - RNA, 19 nt, Homo sapiens
ggagggugggccauccuua

SEQ ID NO: 410571 - RNA, 19 nt, Homo sapiens
cgccacagcacaagugaua

SEQ ID NO: 410572 - RNA, 19 nt, Homo sapiens
aaugggaccuugcgcauca

SEQ ID NO: 410573 - RNA, 19 nt, Homo sapiens
aaacccggcuacuuggauu

SEQ ID NO: 410574 - RNA, 19 nt, Homo sapiens
gaggaggccauguuccauu

SEQ ID NO: 410575 - RNA, 19 nt, Homo sapiens
caaacucuaucggcugaug

SEQ ID NO: 410576 - RNA, 19 nt, Homo sapiens
augaaguacuggcagauuu

SEQ ID NO: 410577 - RNA, 19 nt, Homo sapiens
ggacaugguaccguuguau

SEQ ID NO: 410578 - RNA, 19 nt, Homo sapiens
ucaacagcguggaggugua

SEQ ID NO: 410579 - RNA, 19 nt, Homo sapiens
uugaagacaugccgcuauu

SEQ ID NO: 410580 - RNA, 19 nt, Homo sapiens
gguaugaggaggccauguu

SEQ ID NO: 410581 - RNA, 19 nt, Homo sapiens
gcugaugugggaaguguuu

SEQ ID NO: 410582 - RNA, 19 nt, Homo sapiens
gcacaagugauaagaugca

SEQ ID NO: 410583 - RNA, 19 nt, Homo sapiens
gcagagauccaagaagaag

SEQ ID NO: 410584 - RNA, 19 nt, Homo sapiens
gcgaggagccagagaugga

SEQ ID NO: 410585 - RNA, 19 nt, Homo sapiens
ccaauauugcugaaaguga

SEQ ID NO: 410586 - RNA, 19 nt, Homo sapiens
gccaacgccuccuucaaca

SEQ ID NO: 410587 - RNA, 19 nt, Homo sapiens
cauguuccauugccaguuc

SEQ ID NO: 410588 - RNA, 19 nt, Homo sapiens
gaugaaguacuggcagauu

SEQ ID NO: 410589 - RNA, 19 nt, Homo sapiens
gcaagaagcgcugcaaagc

SEQ ID NO: 410590 - RNA, 19 nt, Homo sapiens
acacuugcauugccuccaa

SEQ ID NO: 410591 - RNA, 19 nt, Homo sapiens
gggacaugguaccguugua

SEQ ID NO: 410592 - RNA, 19 nt, Homo sapiens
aaccuacaguugucuggua

SEQ ID NO: 410593 - RNA, 19 nt, Homo sapiens
ccuggcagaugaaggaguu

SEQ ID NO: 410594 - RNA, 19 nt, Homo sapiens
gggagguguuccuggcaaa

SEQ ID NO: 410595 - RNA, 19 nt, Homo sapiens
augcacaucuuccagaaug

SEQ ID NO: 410596 - RNA, 19 nt, Homo sapiens
caacgccuccuucaacauc

SEQ ID NO: 410597 - RNA, 19 nt, Homo sapiens
uacacucgcugcucucaau

SEQ ID NO: 410598 - RNA, 19 nt, Homo sapiens
guuuacacauggagagaug

SEQ ID NO: 410599 - RNA, 19 nt, Homo sapiens
aagaugauccagaccauug

SEQ ID NO: 410600 - RNA, 19 nt, Homo sapiens
ggcagcagccugagcuuug

SEQ ID NO: 410601 - RNA, 19 nt, Homo sapiens
gggcuaggcuugggaugag

SEQ ID NO: 410602 - RNA, 19 nt, Homo sapiens
ggcagaugaugaaguacug

SEQ ID NO: 410603 - RNA, 19 nt, Homo sapiens
caacagcugcaacaucaag

SEQ ID NO: 410604 - RNA, 19 nt, Homo sapiens
acucgcugcucucaauaaa

SEQ ID NO: 410605 - RNA, 19 nt, Homo sapiens
acacaggguuaaugagucu

SEQ ID NO: 410606 - RNA, 19 nt, Homo sapiens
aggcauugcugaggucuga

SEQ ID NO: 410607 - RNA, 19 nt, Homo sapiens
ugaaguacuggcagauuug

SEQ ID NO: 410608 - RNA, 19 nt, Homo sapiens
gugcugaugugggaagugu

SEQ ID NO: 410609 - RNA, 19 nt, Homo sapiens
cagcaaggauguguacaac

SEQ ID NO: 410610 - RNA, 19 nt, Homo sapiens
acuacauggugcuggaaua

SEQ ID NO: 410611 - RNA, 19 nt, Homo sapiens
ccucaacggugggccuuug

SEQ ID NO: 410612 - RNA, 19 nt, Homo sapiens
gcucccuggugauccauga

SEQ ID NO: 410613 - RNA, 19 nt, Homo sapiens
agaugacgcuggcaacuac

SEQ ID NO: 410614 - RNA, 19 nt, Homo sapiens
gccgagagaagcccacuau

SEQ ID NO: 410615 - RNA, 19 nt, Homo sapiens
caacagcguggagguguau

SEQ ID NO: 410616 - RNA, 19 nt, Homo sapiens
gcaaacccggcuacuugga

SEQ ID NO: 410617 - RNA, 19 nt, Homo sapiens
ucaccuagcagagauugaa

SEQ ID NO: 410618 - RNA, 19 nt, Homo sapiens
ggaguuccuuaauauucuc

SEQ ID NO: 410619 - RNA, 19 nt, Homo sapiens
cagcugguccugagcauag

SEQ ID NO: 410620 - RNA, 19 nt, Homo sapiens
ggccuucggugugcugaug

SEQ ID NO: 410621 - RNA, 19 nt, Homo sapiens
ggccaauauugcugaaagu

SEQ ID NO: 410622 - RNA, 19 nt, Homo sapiens
aggaggccauguuccauug

SEQ ID NO: 410623 - RNA, 19 nt, Homo sapiens
uagaggacacagcaaguga

SEQ ID NO: 410624 - RNA, 19 nt, Homo sapiens
cccaauuucuggccuucaa

SEQ ID NO: 410625 - RNA, 19 nt, Homo sapiens
aaccagagcguacgacugu

SEQ ID NO: 410626 - RNA, 19 nt, Homo sapiens
uguaugaugggacauggua

SEQ ID NO: 410627 - RNA, 19 nt, Homo sapiens
cauugcugaugaaagcuuu

SEQ ID NO: 410628 - RNA, 19 nt, Homo sapiens
gcuggaauauguggaucug

SEQ ID NO: 410629 - RNA, 19 nt, Homo sapiens
aagaagaaguggccuugac

SEQ ID NO: 410630 - RNA, 19 nt, Homo sapiens
guggggaguuccuuaauau

SEQ ID NO: 410631 - RNA, 19 nt, Homo sapiens
gcaggcagaugaugaagua

SEQ ID NO: 410632 - RNA, 19 nt, Homo sapiens
ccacucaucugccaacuuu

SEQ ID NO: 410633 - RNA, 19 nt, Homo sapiens
cagcagagauccaagaaga

SEQ ID NO: 410634 - RNA, 19 nt, Homo sapiens
ucgcugcucucaauaaaua

SEQ ID NO: 410635 - RNA, 19 nt, Homo sapiens
ggagggaguuggagauguu

SEQ ID NO: 410636 - RNA, 19 nt, Homo sapiens
ggcaacagcugcaacauca

SEQ ID NO: 410637 - RNA, 19 nt, Homo sapiens
gaagacaugccgcuauuug

SEQ ID NO: 410638 - RNA, 19 nt, Homo sapiens
gcaaggauguguacaacag

SEQ ID NO: 410639 - RNA, 19 nt, Homo sapiens
gcuuugagcugggcaguuu

SEQ ID NO: 410640 - RNA, 19 nt, Homo sapiens
gggcaaacccggcuacuug

SEQ ID NO: 410641 - RNA, 19 nt, Homo sapiens
gagcugguguuggccaaua

SEQ ID NO: 410642 - RNA, 19 nt, Homo sapiens
gcagagacccugguacuug

SEQ ID NO: 410643 - RNA, 19 nt, Homo sapiens
gaacuucaccuugagcauu

SEQ ID NO: 410644 - RNA, 19 nt, Homo sapiens
cagcacaagugauaagaug

SEQ ID NO: 410645 - RNA, 19 nt, Homo sapiens
gggaugagcuggguuugug

SEQ ID NO: 410646 - RNA, 19 nt, Homo sapiens
uagcagagauugaagacau

SEQ ID NO: 410647 - RNA, 19 nt, Homo sapiens
caauauugcugaaagugau

SEQ ID NO: 410648 - RNA, 19 nt, Homo sapiens
ccgcagagccacaguguuu

SEQ ID NO: 410649 - RNA, 19 nt, Homo sapiens
gcaagcccguguccaagug

SEQ ID NO: 410650 - RNA, 19 nt, Homo sapiens
ugaugucacuggagaagaa

SEQ ID NO: 410651 - RNA, 19 nt, Homo sapiens
gcacacaggguuaaugagu

SEQ ID NO: 410652 - RNA, 19 nt, Homo sapiens
ugaagagccugcagagcaa

SEQ ID NO: 410653 - RNA, 19 nt, Homo sapiens
gagcauagugggcuguauu

SEQ ID NO: 410654 - RNA, 19 nt, Homo sapiens
gcuguggccuacaucauug

SEQ ID NO: 410655 - RNA, 19 nt, Homo sapiens
acacuucguugccacauug

SEQ ID NO: 410656 - RNA, 19 nt, Homo sapiens
ugggagaccucaagcaguu

SEQ ID NO: 410657 - RNA, 19 nt, Homo sapiens
ccaagcggcugcagaagca

SEQ ID NO: 410658 - RNA, 19 nt, Homo sapiens
gagggugacuucucuacca

SEQ ID NO: 410659 - RNA, 19 nt, Homo sapiens
cagagugggugacagacaa

SEQ ID NO: 410660 - RNA, 19 nt, Homo sapiens
gggcacacaggguuaauga

SEQ ID NO: 410661 - RNA, 19 nt, Homo sapiens
gggaguuccuuaauauucu

SEQ ID NO: 410662 - RNA, 19 nt, Homo sapiens
gagaugacgcuggcaacua

SEQ ID NO: 410663 - RNA, 19 nt, Homo sapiens
agccagaacuucaccuuga

SEQ ID NO: 410664 - RNA, 19 nt, Homo sapiens
ggacuuggcugcgcguaac

SEQ ID NO: 410665 - RNA, 19 nt, Homo sapiens
cagagacccugguacuugu

SEQ ID NO: 410666 - RNA, 19 nt, Homo sapiens
ggagggugggccauccuua

SEQ ID NO: 410667 - RNA, 19 nt, Homo sapiens
cgccacagcacaagugaua

SEQ ID NO: 410668 - RNA, 19 nt, Homo sapiens
aaugggaccuugcgcauca

SEQ ID NO: 410669 - RNA, 19 nt, Homo sapiens
aaacccggcuacuuggauu

SEQ ID NO: 410670 - RNA, 19 nt, Homo sapiens
gaggaggccauguuccauu

SEQ ID NO: 410671 - RNA, 19 nt, Homo sapiens
caaacucuaucggcugaug

SEQ ID NO: 410672 - RNA, 19 nt, Homo sapiens
augaaguacuggcagauuu

SEQ ID NO: 410673 - RNA, 19 nt, Homo sapiens
ggacaugguaccguuguau

SEQ ID NO: 410674 - RNA, 19 nt, Homo sapiens
ucaacagcguggaggugua

SEQ ID NO: 410675 - RNA, 19 nt, Homo sapiens
uugaagacaugccgcuauu

SEQ ID NO: 410676 - RNA, 19 nt, Homo sapiens
gguaugaggaggccauguu

SEQ ID NO: 410677 - RNA, 19 nt, Homo sapiens
gcugaugugggaaguguuu

SEQ ID NO: 410678 - RNA, 19 nt, Homo sapiens
gcacaagugauaagaugca

SEQ ID NO: 410679 - RNA, 19 nt, Homo sapiens
gcagagauccaagaagaag

SEQ ID NO: 410680 - RNA, 19 nt, Homo sapiens
gcgaggagccagagaugga

SEQ ID NO: 410681 - RNA, 19 nt, Homo sapiens
ccaauauugcugaaaguga

SEQ ID NO: 410682 - RNA, 19 nt, Homo sapiens
gccaacgccuccuucaaca

SEQ ID NO: 410683 - RNA, 19 nt, Homo sapiens
cauguuccauugccaguuc

SEQ ID NO: 410684 - RNA, 19 nt, Homo sapiens
gaugaaguacuggcagauu

SEQ ID NO: 410685 - RNA, 19 nt, Homo sapiens
gcaagaagcgcugcaaagc

SEQ ID NO: 410686 - RNA, 19 nt, Homo sapiens
acacuugcauugccuccaa

SEQ ID NO: 410687 - RNA, 19 nt, Homo sapiens
gggacaugguaccguugua

SEQ ID NO: 410688 - RNA, 19 nt, Homo sapiens
aaccuacaguugucuggua

SEQ ID NO: 410689 - RNA, 19 nt, Homo sapiens
ccuggcagaugaaggaguu

SEQ ID NO: 410690 - RNA, 19 nt, Homo sapiens
gggagguguuccuggcaaa

SEQ ID NO: 410691 - RNA, 19 nt, Homo sapiens
augcacaucuuccagaaug

SEQ ID NO: 410692 - RNA, 19 nt, Homo sapiens
caacgccuccuucaacauc

SEQ ID NO: 410693 - RNA, 19 nt, Homo sapiens
uacacucgcugcucucaau

SEQ ID NO: 410694 - RNA, 19 nt, Homo sapiens
guuuacacauggagagaug

SEQ ID NO: 410695 - RNA, 19 nt, Homo sapiens
ggcagcagccugagcuuug

SEQ ID NO: 410696 - RNA, 19 nt, Homo sapiens
aagaugauccagaccauug

SEQ ID NO: 410697 - RNA, 19 nt, Homo sapiens
gggcuaggcuugggaugag

SEQ ID NO: 410698 - RNA, 19 nt, Homo sapiens
ggcagaugaugaaguacug

SEQ ID NO: 410699 - RNA, 19 nt, Homo sapiens
caacagcugcaacaucaag

SEQ ID NO: 410700 - RNA, 19 nt, Homo sapiens
acucgcugcucucaauaaa

SEQ ID NO: 410701 - RNA, 19 nt, Homo sapiens
acacaggguuaaugagucu

SEQ ID NO: 410702 - RNA, 19 nt, Homo sapiens
aggcauugcugaggucuga

SEQ ID NO: 410703 - RNA, 19 nt, Homo sapiens
ugaaguacuggcagauuug

SEQ ID NO: 410704 - RNA, 19 nt, Homo sapiens
gugcugaugugggaagugu

SEQ ID NO: 410705 - RNA, 19 nt, Homo sapiens
cagcaaggauguguacaac

SEQ ID NO: 410706 - RNA, 19 nt, Homo sapiens
acuacauggugcuggaaua

SEQ ID NO: 410707 - RNA, 19 nt, Homo sapiens
ccucaacggugggccuuug

SEQ ID NO: 410708 - RNA, 19 nt, Homo sapiens
gcucccuggugauccauga

SEQ ID NO: 410709 - RNA, 19 nt, Homo sapiens
agaugacgcuggcaacuac

SEQ ID NO: 410710 - RNA, 19 nt, Homo sapiens
caacagcguggagguguau

SEQ ID NO: 410711 - RNA, 19 nt, Homo sapiens
gcaaacccggcuacuugga

SEQ ID NO: 410712 - RNA, 19 nt, Homo sapiens
ucaccuagcagagauugaa

SEQ ID NO: 410713 - RNA, 19 nt, Homo sapiens
ggaguuccuuaauauucuc

SEQ ID NO: 410714 - RNA, 19 nt, Homo sapiens
ggccuucggugugcugaug

SEQ ID NO: 410715 - RNA, 19 nt, Homo sapiens
cagcugguccugagcauag

SEQ ID NO: 410716 - RNA, 19 nt, Homo sapiens
ggccaauauugcugaaagu

SEQ ID NO: 410717 - RNA, 19 nt, Homo sapiens
aggaggccauguuccauug

SEQ ID NO: 410718 - RNA, 19 nt, Homo sapiens
uagaggacacagcaaguga

SEQ ID NO: 410719 - RNA, 19 nt, Homo sapiens
cccaauuucuggccuucaa

SEQ ID NO: 410720 - RNA, 19 nt, Homo sapiens
aaccagagcguacgacugu

SEQ ID NO: 410721 - RNA, 19 nt, Homo sapiens
uguaugaugggacauggua

SEQ ID NO: 410722 - RNA, 19 nt, Homo sapiens
cauugcugaugaaagcuuu

SEQ ID NO: 410723 - RNA, 19 nt, Homo sapiens
gcuggaauauguggaucug

SEQ ID NO: 410724 - RNA, 19 nt, Homo sapiens
aagaagaaguggccuugac

SEQ ID NO: 410725 - RNA, 19 nt, Homo sapiens
guggggaguuccuuaauau

SEQ ID NO: 410726 - RNA, 19 nt, Homo sapiens
ccacagcacaagugauaag

SEQ ID NO: 410727 - RNA, 19 nt, Homo sapiens
acaagaugauccagaccau

SEQ ID NO: 410728 - RNA, 19 nt, Homo sapiens
gaauggcucccuggugauc

SEQ ID NO: 410729 - RNA, 19 nt, Homo sapiens
gggcagcagccugagcuuu

SEQ ID NO: 410730 - RNA, 19 nt, Homo sapiens
gcucaucucagaggacuca

SEQ ID NO: 410731 - RNA, 19 nt, Homo sapiens
gcaggcagaugaugaagua

SEQ ID NO: 410732 - RNA, 19 nt, Homo sapiens
ccacucaucugccaacuuu

SEQ ID NO: 410733 - RNA, 19 nt, Homo sapiens
cagcagagauccaagaaga

SEQ ID NO: 410734 - RNA, 19 nt, Homo sapiens
ucgcugcucucaauaaaua

SEQ ID NO: 410735 - RNA, 19 nt, Homo sapiens
ggagggaguuggagauguu

SEQ ID NO: 410736 - RNA, 19 nt, Homo sapiens
ggcaacagcugcaacauca

SEQ ID NO: 410737 - RNA, 19 nt, Homo sapiens
gaagacaugccgcuauuug

SEQ ID NO: 410738 - RNA, 19 nt, Homo sapiens
gcaaggauguguacaacag

SEQ ID NO: 410739 - RNA, 19 nt, Homo sapiens
gcuuugagcugggcaguuu

SEQ ID NO: 410740 - RNA, 19 nt, Homo sapiens
gagcugguguuggccaaua

SEQ ID NO: 410741 - RNA, 19 nt, Homo sapiens
gcagagacccugguacuug

SEQ ID NO: 410742 - RNA, 19 nt, Homo sapiens
gaacuucaccuugagcauu

SEQ ID NO: 410743 - RNA, 19 nt, Homo sapiens
caacaucacuguggccaau

SEQ ID NO: 410744 - RNA, 19 nt, Homo sapiens
cagcacaagugauaagaug

SEQ ID NO: 410745 - RNA, 19 nt, Homo sapiens
gggaugagcuggguuugug

SEQ ID NO: 410746 - RNA, 19 nt, Homo sapiens
uagcagagauugaagacau

SEQ ID NO: 410747 - RNA, 19 nt, Homo sapiens
caauauugcugaaagugau

SEQ ID NO: 410748 - RNA, 19 nt, Homo sapiens
ccgcagagccacaguguuu

SEQ ID NO: 410749 - RNA, 19 nt, Homo sapiens
ugaugucacuggagaagaa

SEQ ID NO: 410750 - RNA, 19 nt, Homo sapiens
gcacacaggguuaaugagu

SEQ ID NO: 410751 - RNA, 19 nt, Homo sapiens
ugaagagccugcagagcaa

SEQ ID NO: 410752 - RNA, 19 nt, Homo sapiens
gagcauagugggcuguauu

SEQ ID NO: 410753 - RNA, 19 nt, Homo sapiens
gcuguggccuacaucauug

SEQ ID NO: 410754 - RNA, 19 nt, Homo sapiens
acacuucguugccacauug

SEQ ID NO: 410755 - RNA, 19 nt, Homo sapiens
ugggagaccucaagcaguu

SEQ ID NO: 410756 - RNA, 19 nt, Homo sapiens
ccaagcggcugcagaagca

SEQ ID NO: 410757 - RNA, 19 nt, Homo sapiens
gagggugacuucucuacca

SEQ ID NO: 410758 - RNA, 19 nt, Homo sapiens
cagagugggugacagacaa

SEQ ID NO: 410759 - RNA, 19 nt, Homo sapiens
gggcacacaggguuaauga

SEQ ID NO: 410760 - RNA, 19 nt, Homo sapiens
gggaguuccuuaauauucu

SEQ ID NO: 410761 - RNA, 19 nt, Homo sapiens
gagaugacgcuggcaacua

SEQ ID NO: 410762 - RNA, 19 nt, Homo sapiens
agccagaacuucaccuuga

SEQ ID NO: 410763 - RNA, 19 nt, Homo sapiens
ggacuuggcugcgcguaac

SEQ ID NO: 410764 - RNA, 19 nt, Homo sapiens
cagagacccugguacuugu

SEQ ID NO: 410765 - RNA, 19 nt, Homo sapiens
ggagggugggccauccuua

SEQ ID NO: 410766 - RNA, 19 nt, Homo sapiens
cgccacagcacaagugaua

SEQ ID NO: 410767 - RNA, 19 nt, Homo sapiens
gaggaggccauguuccauu

SEQ ID NO: 410768 - RNA, 19 nt, Homo sapiens
caaacucuaucggcugaug

SEQ ID NO: 410769 - RNA, 19 nt, Homo sapiens
augaaguacuggcagauuu

SEQ ID NO: 410770 - RNA, 19 nt, Homo sapiens
uugaagacaugccgcuauu

SEQ ID NO: 410771 - RNA, 19 nt, Homo sapiens
gguaugaggaggccauguu

SEQ ID NO: 410772 - RNA, 19 nt, Homo sapiens
gcugaugugggaaguguuu

SEQ ID NO: 410773 - RNA, 19 nt, Homo sapiens
gcacaagugauaagaugca

SEQ ID NO: 410774 - RNA, 19 nt, Homo sapiens
gcagagauccaagaagaag

SEQ ID NO: 410775 - RNA, 19 nt, Homo sapiens
gcgaggagccagagaugga

SEQ ID NO: 410776 - RNA, 19 nt, Homo sapiens
ccaauauugcugaaaguga

SEQ ID NO: 410777 - RNA, 19 nt, Homo sapiens
cauguuccauugccaguuc

SEQ ID NO: 410778 - RNA, 19 nt, Homo sapiens
gccaacgccuccuucaaca

SEQ ID NO: 410779 - RNA, 19 nt, Homo sapiens
gaugaaguacuggcagauu

SEQ ID NO: 410780 - RNA, 19 nt, Homo sapiens
gcaagaagcgcugcaaagc

SEQ ID NO: 410781 - RNA, 19 nt, Homo sapiens
acacuugcauugccuccaa

SEQ ID NO: 410782 - RNA, 19 nt, Homo sapiens
ccuggcagaugaaggaguu

SEQ ID NO: 410783 - RNA, 19 nt, Homo sapiens
gggagguguuccuggcaaa

SEQ ID NO: 410784 - RNA, 19 nt, Homo sapiens
caacgccuccuucaacauc

SEQ ID NO: 410785 - RNA, 19 nt, Homo sapiens
augcacaucuuccagaaug

SEQ ID NO: 410786 - RNA, 19 nt, Homo sapiens
uacacucgcugcucucaau

SEQ ID NO: 410787 - RNA, 19 nt, Homo sapiens
ggcagcagccugagcuuug

SEQ ID NO: 410788 - RNA, 19 nt, Homo sapiens
guuuacacauggagagaug

SEQ ID NO: 410789 - RNA, 19 nt, Homo sapiens
aagaugauccagaccauug

SEQ ID NO: 410790 - RNA, 19 nt, Homo sapiens
gggcuaggcuugggaugag

SEQ ID NO: 410791 - RNA, 19 nt, Homo sapiens
ggcagaugaugaaguacug

SEQ ID NO: 410792 - RNA, 19 nt, Homo sapiens
caacagcugcaacaucaag

SEQ ID NO: 410793 - RNA, 19 nt, Homo sapiens
acucgcugcucucaauaaa

SEQ ID NO: 410794 - RNA, 19 nt, Homo sapiens
acacaggguuaaugagucu

SEQ ID NO: 410795 - RNA, 19 nt, Homo sapiens
aggcauugcugaggucuga

SEQ ID NO: 410796 - RNA, 19 nt, Homo sapiens
ugaaguacuggcagauuug

SEQ ID NO: 410797 - RNA, 19 nt, Homo sapiens
gugcugaugugggaagugu

SEQ ID NO: 410798 - RNA, 19 nt, Homo sapiens
cagcaaggauguguacaac

SEQ ID NO: 410799 - RNA, 19 nt, Homo sapiens
acuacauggugcuggaaua

SEQ ID NO: 410800 - RNA, 19 nt, Homo sapiens
ccucaacggugggccuuug

SEQ ID NO: 410801 - RNA, 19 nt, Homo sapiens
gcucccuggugauccauga

SEQ ID NO: 410802 - RNA, 19 nt, Homo sapiens
agaugacgcuggcaacuac

SEQ ID NO: 410803 - RNA, 19 nt, Homo sapiens
ucaccuagcagagauugaa

SEQ ID NO: 410804 - RNA, 19 nt, Homo sapiens
ggaguuccuuaauauucuc

SEQ ID NO: 410805 - RNA, 19 nt, Homo sapiens
ggccuucggugugcugaug

SEQ ID NO: 410806 - RNA, 19 nt, Homo sapiens
ggccaauauugcugaaagu

SEQ ID NO: 410807 - RNA, 19 nt, Homo sapiens
aggaggccauguuccauug

SEQ ID NO: 410808 - RNA, 19 nt, Homo sapiens
cagcugguccugagcauag

SEQ ID NO: 410809 - RNA, 19 nt, Homo sapiens
uagaggacacagcaaguga

SEQ ID NO: 410810 - RNA, 19 nt, Homo sapiens
cccaauuucuggccuucaa

SEQ ID NO: 410811 - RNA, 19 nt, Homo sapiens
aaccagagcguacgacugu

SEQ ID NO: 410812 - RNA, 19 nt, Homo sapiens
cauugcugaugaaagcuuu

SEQ ID NO: 410813 - RNA, 19 nt, Homo sapiens
gcuggaauauguggaucug

SEQ ID NO: 410814 - RNA, 19 nt, Homo sapiens
aagaagaaguggccuugac

SEQ ID NO: 410815 - RNA, 19 nt, Homo sapiens
gggcagcagccugagcuuu

SEQ ID NO: 410816 - RNA, 19 nt, Homo sapiens
guggggaguuccuuaauau

SEQ ID NO: 410817 - RNA, 19 nt, Homo sapiens
ccacagcacaagugauaag

SEQ ID NO: 410818 - RNA, 19 nt, Homo sapiens
acaagaugauccagaccau

SEQ ID NO: 410819 - RNA, 19 nt, Homo sapiens
gaauggcucccuggugauc

SEQ ID NO: 410820 - RNA, 19 nt, Homo sapiens
aacuucaccuugagcauug

SEQ ID NO: 410821 - RNA, 19 nt, Homo sapiens
ccacagguaaccccaauuu

SEQ ID NO: 410822 - RNA, 19 nt, Homo sapiens
ucagcaaggauguguacaa

SEQ ID NO: 410823 - RNA, 19 nt, Homo sapiens
gcagaagguggcccuaugc

SEQ ID NO: 410824 - RNA, 19 nt, Homo sapiens
caagaugauccagaccauu

SEQ ID NO: 410825 - RNA, 19 nt, Homo sapiens
guccaacucugccacucau

SEQ ID NO: 410826 - RNA, 19 nt, Homo sapiens
ggucagugcccagagacaa

SEQ ID NO: 410827 - RNA, 19 nt, Homo sapiens
cuacauggugcuggaauau

SEQ ID NO: 410828 - RNA, 19 nt, Homo sapiens
gcagcagccugagcuuugc

SEQ ID NO: 410829 - RNA, 19 nt, Homo sapiens
ccagauucgugcccauguc

SEQ ID NO: 410830 - RNA, 19 nt, Homo sapiens
gcagccagaacuucaccuu

SEQ ID NO: 410831 - RNA, 19 nt, Homo sapiens
gcaggcagaugaugaagua

SEQ ID NO: 410832 - RNA, 19 nt, Homo sapiens
gagagaagcccacuauuaa

SEQ ID NO: 410833 - RNA, 19 nt, Homo sapiens
ccacucaucugccaacuuu

SEQ ID NO: 410834 - RNA, 19 nt, Homo sapiens
cgagagaagcccacuauua

SEQ ID NO: 410835 - RNA, 19 nt, Homo sapiens
cagcagagauccaagaaga

SEQ ID NO: 410836 - RNA, 19 nt, Homo sapiens
ucgcugcucucaauaaaua

SEQ ID NO: 410837 - RNA, 19 nt, Homo sapiens
ggagggaguuggagauguu

SEQ ID NO: 410838 - RNA, 19 nt, Homo sapiens
gaagacaugccgcuauuug

SEQ ID NO: 410839 - RNA, 19 nt, Homo sapiens
gcaaggauguguacaacag

SEQ ID NO: 410840 - RNA, 19 nt, Homo sapiens
gcauggaguuugacaagga

SEQ ID NO: 410841 - RNA, 19 nt, Homo sapiens
gcuuugagcugggcaguuu

SEQ ID NO: 410842 - RNA, 19 nt, Homo sapiens
gggcaaacccggcuacuug

SEQ ID NO: 410843 - RNA, 19 nt, Homo sapiens
gagcugguguuggccaaua

SEQ ID NO: 410844 - RNA, 19 nt, Homo sapiens
gcagagacccugguacuug

SEQ ID NO: 410845 - RNA, 19 nt, Homo sapiens
gaacuucaccuugagcauu

SEQ ID NO: 410846 - RNA, 19 nt, Homo sapiens
cagcacaagugauaagaug

SEQ ID NO: 410847 - RNA, 19 nt, Homo sapiens
gggaugagcuggguuugug

SEQ ID NO: 410848 - RNA, 19 nt, Homo sapiens
uagcagagauugaagacau

SEQ ID NO: 410849 - RNA, 19 nt, Homo sapiens
caauauugcugaaagugau

SEQ ID NO: 410850 - RNA, 19 nt, Homo sapiens
ccgcagagccacaguguuu

SEQ ID NO: 410851 - RNA, 19 nt, Homo sapiens
gcaagcccguguccaagug

SEQ ID NO: 410852 - RNA, 19 nt, Homo sapiens
ugaugucacuggagaagaa

SEQ ID NO: 410853 - RNA, 19 nt, Homo sapiens
gcacacaggguuaaugagu

SEQ ID NO: 410854 - RNA, 19 nt, Homo sapiens
ugaagagccugcagagcaa

SEQ ID NO: 410855 - RNA, 19 nt, Homo sapiens
gagaagcccacuauuaagu

SEQ ID NO: 410856 - RNA, 19 nt, Homo sapiens
gagcauagugggcuguauu

SEQ ID NO: 410857 - RNA, 19 nt, Homo sapiens
gcuguggccuacaucauug

SEQ ID NO: 410858 - RNA, 19 nt, Homo sapiens
acacuucguugccacauug

SEQ ID NO: 410859 - RNA, 19 nt, Homo sapiens
ugggagaccucaagcaguu

SEQ ID NO: 410860 - RNA, 19 nt, Homo sapiens
ccaagcggcugcagaagca

SEQ ID NO: 410861 - RNA, 19 nt, Homo sapiens
gagggugacuucucuacca

SEQ ID NO: 410862 - RNA, 19 nt, Homo sapiens
cagagugggugacagacaa

SEQ ID NO: 410863 - RNA, 19 nt, Homo sapiens
gggcacacaggguuaauga

SEQ ID NO: 410864 - RNA, 19 nt, Homo sapiens
gggaguuccuuaauauucu

SEQ ID NO: 410865 - RNA, 19 nt, Homo sapiens
gagaugacgcuggcaacua

SEQ ID NO: 410866 - RNA, 19 nt, Homo sapiens
agccagaacuucaccuuga

SEQ ID NO: 410867 - RNA, 19 nt, Homo sapiens
ggacuuggcugcgcguaac

SEQ ID NO: 410868 - RNA, 19 nt, Homo sapiens
cagagacccugguacuugu

SEQ ID NO: 410869 - RNA, 19 nt, Homo sapiens
ggagggugggccauccuua

SEQ ID NO: 410870 - RNA, 19 nt, Homo sapiens
cgccacagcacaagugaua

SEQ ID NO: 410871 - RNA, 19 nt, Homo sapiens
aaugggaccuugcgcauca

SEQ ID NO: 410872 - RNA, 19 nt, Homo sapiens
aaacccggcuacuuggauu

SEQ ID NO: 410873 - RNA, 19 nt, Homo sapiens
gaggaggccauguuccauu

SEQ ID NO: 410874 - RNA, 19 nt, Homo sapiens
caaacucuaucggcugaug

SEQ ID NO: 410875 - RNA, 19 nt, Homo sapiens
augaaguacuggcagauuu

SEQ ID NO: 410876 - RNA, 19 nt, Homo sapiens
ggacaugguaccguuguau

SEQ ID NO: 410877 - RNA, 19 nt, Homo sapiens
ucaacagcguggaggugua

SEQ ID NO: 410878 - RNA, 19 nt, Homo sapiens
uugaagacaugccgcuauu

SEQ ID NO: 410879 - RNA, 19 nt, Homo sapiens
gguaugaggaggccauguu

SEQ ID NO: 410880 - RNA, 19 nt, Homo sapiens
gcugaugugggaaguguuu

SEQ ID NO: 410881 - RNA, 19 nt, Homo sapiens
gcacaagugauaagaugca

SEQ ID NO: 410882 - RNA, 19 nt, Homo sapiens
gcagagauccaagaagaag

SEQ ID NO: 410883 - RNA, 19 nt, Homo sapiens
gcgaggagccagagaugga

SEQ ID NO: 410884 - RNA, 19 nt, Homo sapiens
ccaauauugcugaaaguga

SEQ ID NO: 410885 - RNA, 19 nt, Homo sapiens
gccaacgccuccuucaaca

SEQ ID NO: 410886 - RNA, 19 nt, Homo sapiens
cauguuccauugccaguuc

SEQ ID NO: 410887 - RNA, 19 nt, Homo sapiens
gaugaaguacuggcagauu

SEQ ID NO: 410888 - RNA, 19 nt, Homo sapiens
gcaagaagcgcugcaaagc

SEQ ID NO: 410889 - RNA, 19 nt, Homo sapiens
acacuugcauugccuccaa

SEQ ID NO: 410890 - RNA, 19 nt, Homo sapiens
gggacaugguaccguugua

SEQ ID NO: 410891 - RNA, 19 nt, Homo sapiens
aaccuacaguugucuggua

SEQ ID NO: 410892 - RNA, 19 nt, Homo sapiens
ccuggcagaugaaggaguu

SEQ ID NO: 410893 - RNA, 19 nt, Homo sapiens
gggagguguuccuggcaaa

SEQ ID NO: 410894 - RNA, 19 nt, Homo sapiens
caacgccuccuucaacauc

SEQ ID NO: 410895 - RNA, 19 nt, Homo sapiens
uacacucgcugcucucaau

SEQ ID NO: 410896 - RNA, 19 nt, Homo sapiens
guuuacacauggagagaug

SEQ ID NO: 410897 - RNA, 19 nt, Homo sapiens
aagaugauccagaccauug

SEQ ID NO: 410898 - RNA, 19 nt, Homo sapiens
ggcagcagccugagcuuug

SEQ ID NO: 410899 - RNA, 19 nt, Homo sapiens
gggcuaggcuugggaugag

SEQ ID NO: 410900 - RNA, 19 nt, Homo sapiens
ggcagaugaugaaguacug

SEQ ID NO: 410901 - RNA, 19 nt, Homo sapiens
acucgcugcucucaauaaa

SEQ ID NO: 410902 - RNA, 19 nt, Homo sapiens
acacaggguuaaugagucu

SEQ ID NO: 410903 - RNA, 19 nt, Homo sapiens
aggcauugcugaggucuga

SEQ ID NO: 410904 - RNA, 19 nt, Homo sapiens
ugaaguacuggcagauuug

SEQ ID NO: 410905 - RNA, 19 nt, Homo sapiens
gugcugaugugggaagugu

SEQ ID NO: 410906 - RNA, 19 nt, Homo sapiens
cagcaaggauguguacaac

SEQ ID NO: 410907 - RNA, 19 nt, Homo sapiens
acuacauggugcuggaaua

SEQ ID NO: 410908 - RNA, 19 nt, Homo sapiens
ccucaacggugggccuuug

SEQ ID NO: 410909 - RNA, 19 nt, Homo sapiens
agaugacgcuggcaacuac

SEQ ID NO: 410910 - RNA, 19 nt, Homo sapiens
gccgagagaagcccacuau

SEQ ID NO: 410911 - RNA, 19 nt, Homo sapiens
caacagcguggagguguau

SEQ ID NO: 410912 - RNA, 19 nt, Homo sapiens
gcaaacccggcuacuugga

SEQ ID NO: 410913 - RNA, 19 nt, Homo sapiens
ucaccuagcagagauugaa

SEQ ID NO: 410914 - RNA, 19 nt, Homo sapiens
ggaguuccuuaauauucuc

SEQ ID NO: 410915 - RNA, 19 nt, Homo sapiens
ggccuucggugugcugaug

SEQ ID NO: 410916 - RNA, 19 nt, Homo sapiens
cagcugguccugagcauag

SEQ ID NO: 410917 - RNA, 19 nt, Homo sapiens
ggccaauauugcugaaagu

SEQ ID NO: 410918 - RNA, 19 nt, Homo sapiens
aggaggccauguuccauug

SEQ ID NO: 410919 - RNA, 19 nt, Homo sapiens
uagaggacacagcaaguga

SEQ ID NO: 410920 - RNA, 19 nt, Homo sapiens
cccaauuucuggccuucaa

SEQ ID NO: 410921 - RNA, 19 nt, Homo sapiens
aaccagagcguacgacugu

SEQ ID NO: 410922 - RNA, 19 nt, Homo sapiens
uguaugaugggacauggua

SEQ ID NO: 410923 - RNA, 19 nt, Homo sapiens
cauugcugaugaaagcuuu

SEQ ID NO: 410924 - RNA, 19 nt, Homo sapiens
gcuggaauauguggaucug

SEQ ID NO: 410925 - RNA, 19 nt, Homo sapiens
aagaagaaguggccuugac

SEQ ID NO: 410926 - RNA, 19 nt, Homo sapiens
guggggaguuccuuaauau

SEQ ID NO: 410927 - RNA, 19 nt, Homo sapiens
ccacagcacaagugauaag

SEQ ID NO: 410928 - RNA, 19 nt, Homo sapiens
acaagaugauccagaccau

SEQ ID NO: 410929 - RNA, 19 nt, Homo sapiens
gcucaucucagaggacuca

SEQ ID NO: 410930 - RNA, 19 nt, Homo sapiens
gggcagcagccugagcuuu

SEQ ID NO: 410931 - RNA, 19 nt, Homo sapiens
gcaggcagaugaugaagua

SEQ ID NO: 410932 - RNA, 19 nt, Homo sapiens
gagagaagcccacuauuaa

SEQ ID NO: 410933 - RNA, 19 nt, Homo sapiens
ccacucaucugccaacuuu

SEQ ID NO: 410934 - RNA, 19 nt, Homo sapiens
cgagagaagcccacuauua

SEQ ID NO: 410935 - RNA, 19 nt, Homo sapiens
cagcagagauccaagaaga

SEQ ID NO: 410936 - RNA, 19 nt, Homo sapiens
ucgcugcucucaauaaaua

SEQ ID NO: 410937 - RNA, 19 nt, Homo sapiens
ggcaacagcugcaacauca

SEQ ID NO: 410938 - RNA, 19 nt, Homo sapiens
gaagacaugccgcuauuug

SEQ ID NO: 410939 - RNA, 19 nt, Homo sapiens
gcaaggauguguacaacag

SEQ ID NO: 410940 - RNA, 19 nt, Homo sapiens
gcauggaguuugacaagga

SEQ ID NO: 410941 - RNA, 19 nt, Homo sapiens
gcuuugagcugggcaguuu

SEQ ID NO: 410942 - RNA, 19 nt, Homo sapiens
gggcaaacccggcuacuug

SEQ ID NO: 410943 - RNA, 19 nt, Homo sapiens
gagcugguguuggccaaua

SEQ ID NO: 410944 - RNA, 19 nt, Homo sapiens
gaacuucaccuugagcauu

SEQ ID NO: 410945 - RNA, 19 nt, Homo sapiens
cagcacaagugauaagaug

SEQ ID NO: 410946 - RNA, 19 nt, Homo sapiens
gggaugagcuggguuugug

SEQ ID NO: 410947 - RNA, 19 nt, Homo sapiens
uagcagagauugaagacau

SEQ ID NO: 410948 - RNA, 19 nt, Homo sapiens
caauauugcugaaagugau

SEQ ID NO: 410949 - RNA, 19 nt, Homo sapiens
ccgcagagccacaguguuu

SEQ ID NO: 410950 - RNA, 19 nt, Homo sapiens
gcaagcccguguccaagug

SEQ ID NO: 410951 - RNA, 19 nt, Homo sapiens
ugaugucacuggagaagaa

SEQ ID NO: 410952 - RNA, 19 nt, Homo sapiens
gcacacaggguuaaugagu

SEQ ID NO: 410953 - RNA, 19 nt, Homo sapiens
gagaagcccacuauuaagu

SEQ ID NO: 410954 - RNA, 19 nt, Homo sapiens
gagcauagugggcuguauu

SEQ ID NO: 410955 - RNA, 19 nt, Homo sapiens
gcuguggccuacaucauug

SEQ ID NO: 410956 - RNA, 19 nt, Homo sapiens
acacuucguugccacauug

SEQ ID NO: 410957 - RNA, 19 nt, Homo sapiens
ccaagcggcugcagaagca

SEQ ID NO: 410958 - RNA, 19 nt, Homo sapiens
gagggugacuucucuacca

SEQ ID NO: 410959 - RNA, 19 nt, Homo sapiens
cagagugggugacagacaa

SEQ ID NO: 410960 - RNA, 19 nt, Homo sapiens
gggcacacaggguuaauga

SEQ ID NO: 410961 - RNA, 19 nt, Homo sapiens
gggaguuccuuaauauucu

SEQ ID NO: 410962 - RNA, 19 nt, Homo sapiens
gagaugacgcuggcaacua

SEQ ID NO: 410963 - RNA, 19 nt, Homo sapiens
agccagaacuucaccuuga

SEQ ID NO: 410964 - RNA, 19 nt, Homo sapiens
ggacuuggcugcgcguaac

SEQ ID NO: 410965 - RNA, 19 nt, Homo sapiens
ggagggugggccauccuua

SEQ ID NO: 410966 - RNA, 19 nt, Homo sapiens
cgccacagcacaagugaua

SEQ ID NO: 410967 - RNA, 19 nt, Homo sapiens
aaugggaccuugcgcauca

SEQ ID NO: 410968 - RNA, 19 nt, Homo sapiens
aaacccggcuacuuggauu

SEQ ID NO: 410969 - RNA, 19 nt, Homo sapiens
gaggaggccauguuccauu

SEQ ID NO: 410970 - RNA, 19 nt, Homo sapiens
caaacucuaucggcugaug

SEQ ID NO: 410971 - RNA, 19 nt, Homo sapiens
augaaguacuggcagauuu

SEQ ID NO: 410972 - RNA, 19 nt, Homo sapiens
ggacaugguaccguuguau

SEQ ID NO: 410973 - RNA, 19 nt, Homo sapiens
ucaacagcguggaggugua

SEQ ID NO: 410974 - RNA, 19 nt, Homo sapiens
uugaagacaugccgcuauu

SEQ ID NO: 410975 - RNA, 19 nt, Homo sapiens
gguaugaggaggccauguu

SEQ ID NO: 410976 - RNA, 19 nt, Homo sapiens
gcugaugugggaaguguuu

SEQ ID NO: 410977 - RNA, 19 nt, Homo sapiens
gcacaagugauaagaugca

SEQ ID NO: 410978 - RNA, 19 nt, Homo sapiens
gcagagauccaagaagaag

SEQ ID NO: 410979 - RNA, 19 nt, Homo sapiens
gcgaggagccagagaugga

SEQ ID NO: 410980 - RNA, 19 nt, Homo sapiens
ccaauauugcugaaaguga

SEQ ID NO: 410981 - RNA, 19 nt, Homo sapiens
gccaacgccuccuucaaca

SEQ ID NO: 410982 - RNA, 19 nt, Homo sapiens
ggggagaccucaagcaguu

SEQ ID NO: 410983 - RNA, 19 nt, Homo sapiens
cauguuccauugccaguuc

SEQ ID NO: 410984 - RNA, 19 nt, Homo sapiens
gaugaaguacuggcagauu

SEQ ID NO: 410985 - RNA, 19 nt, Homo sapiens
gcaagaagcgcugcaaagc

SEQ ID NO: 410986 - RNA, 19 nt, Homo sapiens
acacuugcauugccuccaa

SEQ ID NO: 410987 - RNA, 19 nt, Homo sapiens
gggacaugguaccguugua

SEQ ID NO: 410988 - RNA, 19 nt, Homo sapiens
aaccuacaguugucuggua

SEQ ID NO: 410989 - RNA, 19 nt, Homo sapiens
ccuggcagaugaaggaguu

SEQ ID NO: 410990 - RNA, 19 nt, Homo sapiens
augcacaucuuccagaaug

SEQ ID NO: 410991 - RNA, 19 nt, Homo sapiens
caacgccuccuucaacauc

SEQ ID NO: 410992 - RNA, 19 nt, Homo sapiens
uacacucgcugcucucaau

SEQ ID NO: 410993 - RNA, 19 nt, Homo sapiens
guuuacacauggagagaug

SEQ ID NO: 410994 - RNA, 19 nt, Homo sapiens
aagaugauccagaccauug

SEQ ID NO: 410995 - RNA, 19 nt, Homo sapiens
ggcagcagccugagcuuug

SEQ ID NO: 410996 - RNA, 19 nt, Homo sapiens
gggcuaggcuugggaugag

SEQ ID NO: 410997 - RNA, 19 nt, Homo sapiens
ggcagaugaugaaguacug

SEQ ID NO: 410998 - RNA, 19 nt, Homo sapiens
caacagcugcaacaucaag

SEQ ID NO: 410999 - RNA, 19 nt, Homo sapiens
acucgcugcucucaauaaa

SEQ ID NO: 411000 - RNA, 19 nt, Homo sapiens
acacaggguuaaugagucu

SEQ ID NO: 411001 - RNA, 19 nt, Homo sapiens
aggcauugcugaggucuga

SEQ ID NO: 411002 - RNA, 19 nt, Homo sapiens
ugaaguacuggcagauuug

SEQ ID NO: 411003 - RNA, 19 nt, Homo sapiens
gugcugaugugggaagugu

SEQ ID NO: 411004 - RNA, 19 nt, Homo sapiens
cagcaaggauguguacaac

SEQ ID NO: 411005 - RNA, 19 nt, Homo sapiens
ccucaacggugggccuuug

SEQ ID NO: 411006 - RNA, 19 nt, Homo sapiens
gcucccuggugauccauga

SEQ ID NO: 411007 - RNA, 19 nt, Homo sapiens
agaugacgcuggcaacuac

SEQ ID NO: 411008 - RNA, 19 nt, Homo sapiens
gccgagagaagcccacuau

SEQ ID NO: 411009 - RNA, 19 nt, Homo sapiens
caacagcguggagguguau

SEQ ID NO: 411010 - RNA, 19 nt, Homo sapiens
gcaaacccggcuacuugga

SEQ ID NO: 411011 - RNA, 19 nt, Homo sapiens
ucaccuagcagagauugaa

SEQ ID NO: 411012 - RNA, 19 nt, Homo sapiens
ggaguuccuuaauauucuc

SEQ ID NO: 411013 - RNA, 19 nt, Homo sapiens
ggccuucggugugcugaug

SEQ ID NO: 411014 - RNA, 19 nt, Homo sapiens
cagcugguccugagcauag

SEQ ID NO: 411015 - RNA, 19 nt, Homo sapiens
ggccaauauugcugaaagu

SEQ ID NO: 411016 - RNA, 19 nt, Homo sapiens
aggaggccauguuccauug

SEQ ID NO: 411017 - RNA, 19 nt, Homo sapiens
uagaggacacagcaaguga

SEQ ID NO: 411018 - RNA, 19 nt, Homo sapiens
cccaauuucuggccuucaa

SEQ ID NO: 411019 - RNA, 19 nt, Homo sapiens
aaccagagcguacgacugu

SEQ ID NO: 411020 - RNA, 19 nt, Homo sapiens
uguaugaugggacauggua

SEQ ID NO: 411021 - RNA, 19 nt, Homo sapiens
cauugcugaugaaagcuuu

SEQ ID NO: 411022 - RNA, 19 nt, Homo sapiens
aagaagaaguggccuugac

SEQ ID NO: 411023 - RNA, 19 nt, Homo sapiens
guggggaguuccuuaauau

SEQ ID NO: 411024 - RNA, 19 nt, Homo sapiens
ccacagcacaagugauaag

SEQ ID NO: 411025 - RNA, 19 nt, Homo sapiens
acaagaugauccagaccau

SEQ ID NO: 411026 - RNA, 19 nt, Homo sapiens
gaauggcucccuggugauc

SEQ ID NO: 411027 - RNA, 19 nt, Homo sapiens
gcucaucucagaggacuca

SEQ ID NO: 411028 - RNA, 19 nt, Homo sapiens
gggcagcagccugagcuuu

SEQ ID NO: 411029 - RNA, 19 nt, Homo sapiens
aacuucaccuugagcauug

SEQ ID NO: 411030 - RNA, 19 nt, Homo sapiens
ccacagguaaccccaauuu

SEQ ID NO: 411031 - RNA, 19 nt, Homo sapiens
ggaccaggcuagaguauuu

SEQ ID NO: 411032 - RNA, 19 nt, Homo sapiens
gaagaacuacgacagauua

SEQ ID NO: 411033 - RNA, 19 nt, Homo sapiens
gugaagcacucauuucuaa

SEQ ID NO: 411034 - RNA, 19 nt, Homo sapiens
gagcaacucugaagaagga

SEQ ID NO: 411035 - RNA, 19 nt, Homo sapiens
caggagaacugaaaucauu

SEQ ID NO: 411036 - RNA, 19 nt, Homo sapiens
ggaguagcauuucccauuu

SEQ ID NO: 411037 - RNA, 19 nt, Homo sapiens
caaagaggauucccaagga

SEQ ID NO: 411038 - RNA, 19 nt, Homo sapiens
caaacaaccaugcuauaua

SEQ ID NO: 411039 - RNA, 19 nt, Homo sapiens
auaccuagauggugaauaa

SEQ ID NO: 411040 - RNA, 19 nt, Homo sapiens
gguaauauaugcaccuuuc

SEQ ID NO: 411041 - RNA, 19 nt, Homo sapiens
gcuagaaauuguagaaaga

SEQ ID NO: 411042 - RNA, 19 nt, Homo sapiens
ugaaguauuuggaacagua

SEQ ID NO: 411043 - RNA, 19 nt, Homo sapiens
gaagacucaugauuucuau

SEQ ID NO: 411044 - RNA, 19 nt, Homo sapiens
guauaaacauucccaugaa

SEQ ID NO: 411045 - RNA, 19 nt, Homo sapiens
ucaaugagguacagacuga

SEQ ID NO: 411046 - RNA, 19 nt, Homo sapiens
uaacguagauaaacaccuu

SEQ ID NO: 411047 - RNA, 19 nt, Homo sapiens
gaaggagacuauuuagagu

SEQ ID NO: 411048 - RNA, 19 nt, Homo sapiens
uuagaaagaucgagauaga

SEQ ID NO: 411049 - RNA, 19 nt, Homo sapiens
gcaagagccauaacuuuga

SEQ ID NO: 411050 - RNA, 19 nt, Homo sapiens
gaaagucugaugucucaaa

SEQ ID NO: 411051 - RNA, 19 nt, Homo sapiens
uaagagagcggaugcugua

SEQ ID NO: 411052 - RNA, 19 nt, Homo sapiens
gaaauuuguguucgaguaa

SEQ ID NO: 411053 - RNA, 19 nt, Homo sapiens
uagaaagucugaugucuca

SEQ ID NO: 411054 - RNA, 19 nt, Homo sapiens
gaaagacaacuacaaaugg

SEQ ID NO: 411055 - RNA, 19 nt, Homo sapiens
gagagcggaugcuguauuc

SEQ ID NO: 411056 - RNA, 19 nt, Homo sapiens
gcagcagucuuuuauauuu

SEQ ID NO: 411057 - RNA, 19 nt, Homo sapiens
gaucaugucugcaacuuuu

SEQ ID NO: 411058 - RNA, 19 nt, Homo sapiens
uaacucaucguuuacagua

SEQ ID NO: 411059 - RNA, 19 nt, Homo sapiens
gcacucauuucuaaaccuu

SEQ ID NO: 411060 - RNA, 19 nt, Homo sapiens
gaaaaggguucaacauaau

SEQ ID NO: 411061 - RNA, 19 nt, Homo sapiens
ggacaaacaaccaugcuau

SEQ ID NO: 411062 - RNA, 19 nt, Homo sapiens
agaaauuuguguucgagua

SEQ ID NO: 411063 - RNA, 19 nt, Homo sapiens
gugaagauguuaaagagau

SEQ ID NO: 411064 - RNA, 19 nt, Homo sapiens
gcaguuggaaauagauaua

SEQ ID NO: 411065 - RNA, 19 nt, Homo sapiens
gggcaaauuguguucuuua

SEQ ID NO: 411066 - RNA, 19 nt, Homo sapiens
ccaagcaagugaagauguu

SEQ ID NO: 411067 - RNA, 19 nt, Homo sapiens
ugaaaucauuccauguuga

SEQ ID NO: 411068 - RNA, 19 nt, Homo sapiens
ccaugaaggagacuauuua

SEQ ID NO: 411069 - RNA, 19 nt, Homo sapiens
ggauuaugauuccuuuguu

SEQ ID NO: 411070 - RNA, 19 nt, Homo sapiens
caggauuucugaugacauu

SEQ ID NO: 411071 - RNA, 19 nt, Homo sapiens
aaacugaagcuacuacuga

SEQ ID NO: 411072 - RNA, 19 nt, Homo sapiens
ggauucagcucguuaccau

SEQ ID NO: 411073 - RNA, 19 nt, Homo sapiens
caacaaauacagaacugaa

SEQ ID NO: 411074 - RNA, 19 nt, Homo sapiens
gacaaacaaccaugcuaua

SEQ ID NO: 411075 - RNA, 19 nt, Homo sapiens
guuacaaccuagagagauu

SEQ ID NO: 411076 - RNA, 19 nt, Homo sapiens
aaagacaacuacaaaugga

SEQ ID NO: 411077 - RNA, 19 nt, Homo sapiens
gagcggaugcuguauucua

SEQ ID NO: 411078 - RNA, 19 nt, Homo sapiens
caacacaacaaauacagaa

SEQ ID NO: 411079 - RNA, 19 nt, Homo sapiens
caagugaagauguuaaaga

SEQ ID NO: 411080 - RNA, 19 nt, Homo sapiens
caagagccgucugcuagaa

SEQ ID NO: 411081 - RNA, 19 nt, Homo sapiens
ggagcuagaacacuuaaug

SEQ ID NO: 411082 - RNA, 19 nt, Homo sapiens
agaaaaggguucaacauaa

SEQ ID NO: 411083 - RNA, 19 nt, Homo sapiens
cugcagacuuccuuuauga

SEQ ID NO: 411084 - RNA, 19 nt, Homo sapiens
ggaagaacuacgacagauu

SEQ ID NO: 411085 - RNA, 19 nt, Homo sapiens
gaagacuaccugucaugaa

SEQ ID NO: 411086 - RNA, 19 nt, Homo sapiens
ugaguugacugcagacuuc

SEQ ID NO: 411087 - RNA, 19 nt, Homo sapiens
auagaagacucaugauuuc

SEQ ID NO: 411088 - RNA, 19 nt, Homo sapiens
gaacuacgacagauuaaaa

SEQ ID NO: 411089 - RNA, 19 nt, Homo sapiens
cacccaaauuauugcauua

SEQ ID NO: 411090 - RNA, 19 nt, Homo sapiens
caauaauguugcacuuguu

SEQ ID NO: 411091 - RNA, 19 nt, Homo sapiens
ggcaaauuguguucuuuau

SEQ ID NO: 411092 - RNA, 19 nt, Homo sapiens
ugaagcuacuacugauuaa

SEQ ID NO: 411093 - RNA, 19 nt, Homo sapiens
gaacaguaaaggaagaugu

SEQ ID NO: 411094 - RNA, 19 nt, Homo sapiens
ccagaucauucucauguuc

SEQ ID NO: 411095 - RNA, 19 nt, Homo sapiens
cauuaucaguuacaaccua

SEQ ID NO: 411096 - RNA, 19 nt, Homo sapiens
agagggagcuagaacacuu

SEQ ID NO: 411097 - RNA, 19 nt, Homo sapiens
gaaauagagggagcuagaa

SEQ ID NO: 411098 - RNA, 19 nt, Homo sapiens
gucaucacauuaaacauug

SEQ ID NO: 411099 - RNA, 19 nt, Homo sapiens
agaaagacaacuacaaaug

SEQ ID NO: 411100 - RNA, 19 nt, Homo sapiens
ugacaauaauguugcacuu

SEQ ID NO: 411101 - RNA, 19 nt, Homo sapiens
gccauaacuuugaggcauu

SEQ ID NO: 411102 - RNA, 19 nt, Homo sapiens
ggaagacuaccugucauga

SEQ ID NO: 411103 - RNA, 19 nt, Homo sapiens
uguuaaaccugcugcaaga

SEQ ID NO: 411104 - RNA, 19 nt, Homo sapiens
ugaaauagagggagcuaga

SEQ ID NO: 411105 - RNA, 19 nt, Homo sapiens
ccucauauuucuuugauac

SEQ ID NO: 411106 - RNA, 19 nt, Homo sapiens
cugaagcuacuacugauua

SEQ ID NO: 411107 - RNA, 19 nt, Homo sapiens
ggauguaauuagaaagauc

SEQ ID NO: 411108 - RNA, 19 nt, Homo sapiens
ccaaggauucagcucguua

SEQ ID NO: 411109 - RNA, 19 nt, Homo sapiens
gaaguauuuggaacaguaa

SEQ ID NO: 411110 - RNA, 19 nt, Homo sapiens
ugaaggagacuauuuagag

SEQ ID NO: 411111 - RNA, 19 nt, Homo sapiens
uagaauaauuguggguuga

SEQ ID NO: 411112 - RNA, 19 nt, Homo sapiens
aagaggaauucgaagacua

SEQ ID NO: 411113 - RNA, 19 nt, Homo sapiens
gaguagcauuucccauuuc

SEQ ID NO: 411114 - RNA, 19 nt, Homo sapiens
ucgaguaaguaaagcauau

SEQ ID NO: 411115 - RNA, 19 nt, Homo sapiens
gcaagagccgucugcuaga

SEQ ID NO: 411116 - RNA, 19 nt, Homo sapiens
gaggaagaacuacgacaga

SEQ ID NO: 411117 - RNA, 19 nt, Homo sapiens
gacugcagcugaggaagaa

SEQ ID NO: 411118 - RNA, 19 nt, Homo sapiens
gugaugcauuuguuauaga

SEQ ID NO: 411119 - RNA, 19 nt, Homo sapiens
acacccaaauuauugcauu

SEQ ID NO: 411120 - RNA, 19 nt, Homo sapiens
ccauaacuuugaggcauuu

SEQ ID NO: 411121 - RNA, 19 nt, Homo sapiens
gaaaaugagcaacuuguga

SEQ ID NO: 411122 - RNA, 19 nt, Homo sapiens
caaauacagaacugaaaga

SEQ ID NO: 411123 - RNA, 19 nt, Homo sapiens
gaauaauuguggguugaca

SEQ ID NO: 411124 - RNA, 19 nt, Homo sapiens
gagcuagaacacuuaaugu

SEQ ID NO: 411125 - RNA, 19 nt, Homo sapiens
gcaaauuguguucuuuauc

SEQ ID NO: 411126 - RNA, 19 nt, Homo sapiens
uuucuauacugcaggauuu

SEQ ID NO: 411127 - RNA, 19 nt, Homo sapiens
gcauuaaaauugcagauca

SEQ ID NO: 411128 - RNA, 19 nt, Homo sapiens
ggacagaaagaccuuaaaa

SEQ ID NO: 411129 - RNA, 19 nt, Homo sapiens
ugacugcagacuuccuuua

SEQ ID NO: 411130 - RNA, 19 nt, Homo sapiens
uguauaaacauucccauga

SEQ ID NO: 411131 - RNA, 19 nt, Homo sapiens
ucuaugaaguugcuguuua

SEQ ID NO: 411132 - RNA, 19 nt, Homo sapiens
ggaggaggguggagaugaa

SEQ ID NO: 411133 - RNA, 19 nt, Homo sapiens
ggugugaccauguucauua

SEQ ID NO: 411134 - RNA, 19 nt, Homo sapiens
gaagaaggaaguuguggaa

SEQ ID NO: 411135 - RNA, 19 nt, Homo sapiens
gugaccauguucauuauaa

SEQ ID NO: 411136 - RNA, 19 nt, Homo sapiens
gcaggaggcugacaaugag

SEQ ID NO: 411137 - RNA, 19 nt, Homo sapiens
guaguugguuuguaugaga

SEQ ID NO: 411138 - RNA, 19 nt, Homo sapiens
gaaggaaguuguggaagag

SEQ ID NO: 411139 - RNA, 19 nt, Homo sapiens
agaaggaaguuguggaaga

SEQ ID NO: 411140 - RNA, 19 nt, Homo sapiens
gaggaugacuagacagcaa

SEQ ID NO: 411141 - RNA, 19 nt, Homo sapiens
ccaaggacuuaaaggagaa

SEQ ID NO: 411142 - RNA, 19 nt, Homo sapiens
gacaccagcuccgaaauca

SEQ ID NO: 411143 - RNA, 19 nt, Homo sapiens
cuaugaaguugcuguuuau

SEQ ID NO: 411144 - RNA, 19 nt, Homo sapiens
gcgggcagcugaagaugau

SEQ ID NO: 411145 - RNA, 19 nt, Homo sapiens
ggaagaagaaggugauggu

SEQ ID NO: 411146 - RNA, 19 nt, Homo sapiens
uaaaggagaagaaggaagu

SEQ ID NO: 411147 - RNA, 19 nt, Homo sapiens
gcuccgaaaucaccaccaa

SEQ ID NO: 411148 - RNA, 19 nt, Homo sapiens
ggccaaagauaaaagguuu

SEQ ID NO: 411149 - RNA, 19 nt, Homo sapiens
ggaagaggaggaggaagaa

SEQ ID NO: 411150 - RNA, 19 nt, Homo sapiens
uaacgggaaugcuaaugag

SEQ ID NO: 411151 - RNA, 19 nt, Homo sapiens
gaagagacgccccugcuaa

SEQ ID NO: 411152 - RNA, 19 nt, Homo sapiens
acccaaaccaugagaauuu

SEQ ID NO: 411153 - RNA, 19 nt, Homo sapiens
ggaagaagguggggaggaa

SEQ ID NO: 411154 - RNA, 19 nt, Homo sapiens
ccugaacucucgcuuucuu

SEQ ID NO: 411155 - RNA, 19 nt, Homo sapiens
guagacaccagcuccgaaa

SEQ ID NO: 411156 - RNA, 19 nt, Homo sapiens
ccaccaaggacuuaaagga

SEQ ID NO: 411157 - RNA, 19 nt, Homo sapiens
guccaacaauaaacaggaa

SEQ ID NO: 411158 - RNA, 19 nt, Homo sapiens
ggaggaagaagaaggugau

SEQ ID NO: 411159 - RNA, 19 nt, Homo sapiens
cgggaaugcuaaugaggaa

SEQ ID NO: 411160 - RNA, 19 nt, Homo sapiens
ggagaagaaggaaguugug

SEQ ID NO: 411161 - RNA, 19 nt, Homo sapiens
ugauguaugugugaaacaa

SEQ ID NO: 411162 - RNA, 19 nt, Homo sapiens
ggaggaagaggaggaggaa

SEQ ID NO: 411163 - RNA, 19 nt, Homo sapiens
caacccaaaccaugagaau

SEQ ID NO: 411164 - RNA, 19 nt, Homo sapiens
ggguggagaugaagaugag

SEQ ID NO: 411165 - RNA, 19 nt, Homo sapiens
ccaacaauaaacaggaauu

SEQ ID NO: 411166 - RNA, 19 nt, Homo sapiens
ccacuucccgucucagaau

SEQ ID NO: 411167 - RNA, 19 nt, Homo sapiens
gcaagcgggcagcugaaga

SEQ ID NO: 411168 - RNA, 19 nt, Homo sapiens
cuaacgggaaugcuaauga

SEQ ID NO: 411169 - RNA, 19 nt, Homo sapiens
ggacuuaaaggagaagaag

SEQ ID NO: 411170 - RNA, 19 nt, Homo sapiens
gugugaccauguucauuau

SEQ ID NO: 411171 - RNA, 19 nt, Homo sapiens
ucccugaacucucgcuuuc

SEQ ID NO: 411172 - RNA, 19 nt, Homo sapiens
gacuuuacuugugguguga

SEQ ID NO: 411173 - RNA, 19 nt, Homo sapiens
uguccuacuucugacuuua

SEQ ID NO: 411174 - RNA, 19 nt, Homo sapiens
uaaacguggucaccuucga

SEQ ID NO: 411175 - RNA, 19 nt, Homo sapiens
ggaggaggaagaagaaggu

SEQ ID NO: 411176 - RNA, 19 nt, Homo sapiens
cuacuucugacuuuacuug

SEQ ID NO: 411177 - RNA, 19 nt, Homo sapiens
gaccauguucauuauaauc

SEQ ID NO: 411178 - RNA, 19 nt, Homo sapiens
ggaggcugacaaugaggua

SEQ ID NO: 411179 - RNA, 19 nt, Homo sapiens
cugaagaugaugaggauga

SEQ ID NO: 411180 - RNA, 19 nt, Homo sapiens
gggcagcugaagaugauga

SEQ ID NO: 411181 - RNA, 19 nt, Homo sapiens
caagcgggcagcugaagau

SEQ ID NO: 411182 - RNA, 19 nt, Homo sapiens
ggacuccggcagcuuuauc

SEQ ID NO: 411183 - RNA, 19 nt, Homo sapiens
ccuauucacccuccacuuc

SEQ ID NO: 411184 - RNA, 19 nt, Homo sapiens
aaucaccaccaaggacuua

SEQ ID NO: 411185 - RNA, 19 nt, Homo sapiens
agcaggaggcugacaauga

SEQ ID NO: 411186 - RNA, 19 nt, Homo sapiens
ggaaugcuaaugaggaaaa

SEQ ID NO: 411187 - RNA, 19 nt, Homo sapiens
ggaggguggagaugaagau

SEQ ID NO: 411188 - RNA, 19 nt, Homo sapiens
aagaggaggaggaagaaga

SEQ ID NO: 411189 - RNA, 19 nt, Homo sapiens
ggagcaggaggcugacaau

SEQ ID NO: 411190 - RNA, 19 nt, Homo sapiens
agaggaggaggaagaagaa

SEQ ID NO: 411191 - RNA, 19 nt, Homo sapiens
guguauguacuuagcugua

SEQ ID NO: 411192 - RNA, 19 nt, Homo sapiens
cacccaacccaaaccauga

SEQ ID NO: 411193 - RNA, 19 nt, Homo sapiens
guuuguaugagaugguuaa

SEQ ID NO: 411194 - RNA, 19 nt, Homo sapiens
guggucaccuucgaguaga

SEQ ID NO: 411195 - RNA, 19 nt, Homo sapiens
aggaagaggaggaggaaga

SEQ ID NO: 411196 - RNA, 19 nt, Homo sapiens
gagcaggaggcugacaaug

SEQ ID NO: 411197 - RNA, 19 nt, Homo sapiens
aaucuuauuccgagcauuc

SEQ ID NO: 411198 - RNA, 19 nt, Homo sapiens
ucaccaccaaggacuuaaa

SEQ ID NO: 411199 - RNA, 19 nt, Homo sapiens
ggaagagacgccccugcua

SEQ ID NO: 411200 - RNA, 19 nt, Homo sapiens
gaagagagcugccgaagag

SEQ ID NO: 411201 - RNA, 19 nt, Homo sapiens
ggaaagagcgaaagaaaga

SEQ ID NO: 411202 - RNA, 19 nt, Homo sapiens
ccaaggaccugaaggagaa

SEQ ID NO: 411203 - RNA, 19 nt, Homo sapiens
ggaagaagaagaugaggaa

SEQ ID NO: 411204 - RNA, 19 nt, Homo sapiens
agaagaagaugaggaagaa

SEQ ID NO: 411205 - RNA, 19 nt, Homo sapiens
gaaauggucgcgcuucugu

SEQ ID NO: 411206 - RNA, 19 nt, Homo sapiens
gguagccucucccaccuaa

SEQ ID NO: 411207 - RNA, 19 nt, Homo sapiens
ggaagaagaagaagaggau

SEQ ID NO: 411208 - RNA, 19 nt, Homo sapiens
agaagaaacugccgaggau

SEQ ID NO: 411209 - RNA, 19 nt, Homo sapiens
ggagaaggcaagccggaaa

SEQ ID NO: 411210 - RNA, 19 nt, Homo sapiens
gaacggggcugaggaggaa

SEQ ID NO: 411211 - RNA, 19 nt, Homo sapiens
ccaaacggcagaagacaga

SEQ ID NO: 411212 - RNA, 19 nt, Homo sapiens
ggaggaagaagaagaaacu

SEQ ID NO: 411213 - RNA, 19 nt, Homo sapiens
ugaaggagaagaaggagaa

SEQ ID NO: 411214 - RNA, 19 nt, Homo sapiens
aggagaagguggaggagaa

SEQ ID NO: 411215 - RNA, 19 nt, Homo sapiens
agaagaagaggaugaugaa

SEQ ID NO: 411216 - RNA, 19 nt, Homo sapiens
gaaagagcgaaagaaagaa

SEQ ID NO: 411217 - RNA, 19 nt, Homo sapiens
gggcugaggaggaagaaga

SEQ ID NO: 411218 - RNA, 19 nt, Homo sapiens
aagaagaagaggaugauga

SEQ ID NO: 411219 - RNA, 19 nt, Homo sapiens
ccggaaagagcgaaagaaa

SEQ ID NO: 411220 - RNA, 19 nt, Homo sapiens
ugaggaggaagaagaagaa

SEQ ID NO: 411221 - RNA, 19 nt, Homo sapiens
aauggucgcgcuucuguuu

SEQ ID NO: 411222 - RNA, 19 nt, Homo sapiens
gaagaagaagaggaugaug

SEQ ID NO: 411223 - RNA, 19 nt, Homo sapiens
gaucccaaacggcagaaga

SEQ ID NO: 411224 - RNA, 19 nt, Homo sapiens
aagaagaugaggaagaaga

SEQ ID NO: 411225 - RNA, 19 nt, Homo sapiens
aagaagaagaugaggaaga

SEQ ID NO: 411226 - RNA, 19 nt, Homo sapiens
cccaauugcuccucucucu

SEQ ID NO: 411227 - RNA, 19 nt, Homo sapiens
gagcugccacccucuucuu

SEQ ID NO: 411228 - RNA, 19 nt, Homo sapiens
ugaagagagcugccgaaga

SEQ ID NO: 411229 - RNA, 19 nt, Homo sapiens
cuaccagccucauucuucu

SEQ ID NO: 411230 - RNA, 19 nt, Homo sapiens
aagaagaagaagaggauga

SEQ ID NO: 411231 - RNA, 19 nt, Homo sapiens
gcgccaaggaccugaagga

SEQ ID NO: 411232 - RNA, 19 nt, Homo sapiens
ccuaccagccucauucuuc

SEQ ID NO: 411233 - RNA, 19 nt, Homo sapiens
caauugcuccucucucucu

SEQ ID NO: 411234 - RNA, 19 nt, Homo sapiens
agaagaugaggaagaagaa

SEQ ID NO: 411235 - RNA, 19 nt, Homo sapiens
gcuccucucucucuuugcu

SEQ ID NO: 411236 - RNA, 19 nt, Homo sapiens
gagaaggcaagccggaaag

SEQ ID NO: 411237 - RNA, 19 nt, Homo sapiens
ugaggaagaagaagaagag

SEQ ID NO: 411238 - RNA, 19 nt, Homo sapiens
cacccucacucugccauug

SEQ ID NO: 411239 - RNA, 19 nt, Homo sapiens
ggauggagaggaggaagau

SEQ ID NO: 411240 - RNA, 19 nt, Homo sapiens
ccaaguccagccacucuuc

SEQ ID NO: 411241 - RNA, 19 nt, Homo sapiens
aaacggcagaagacagaaa

SEQ ID NO: 411242 - RNA, 19 nt, Homo sapiens
gaaggcaagccggaaagag

SEQ ID NO: 411243 - RNA, 19 nt, Homo sapiens
ucucuuugcucucuuucuc

SEQ ID NO: 411244 - RNA, 19 nt, Homo sapiens
uugcuccucucucucuuug

SEQ ID NO: 411245 - RNA, 19 nt, Homo sapiens
gaagaagaggaugaugaag

SEQ ID NO: 411246 - RNA, 19 nt, Homo sapiens
aagaugaggaagaagaaga

SEQ ID NO: 411247 - RNA, 19 nt, Homo sapiens
gaagaugaggaagaagaag

SEQ ID NO: 411248 - RNA, 19 nt, Homo sapiens
cuccugaccugcuccaucu

SEQ ID NO: 411249 - RNA, 19 nt, Homo sapiens
gaggaggaagaagaagaaa

SEQ ID NO: 411250 - RNA, 19 nt, Homo sapiens
uuaauaagcuucccaauca

SEQ ID NO: 411251 - RNA, 19 nt, Homo sapiens
aggagaagaugcuggauua

SEQ ID NO: 411252 - RNA, 19 nt, Homo sapiens
gcccaaaccucaagcagaa

SEQ ID NO: 411253 - RNA, 19 nt, Homo sapiens
gaagaaagagaaaccagaa

SEQ ID NO: 411254 - RNA, 19 nt, Homo sapiens
caggaucaguuaacuauug

SEQ ID NO: 411255 - RNA, 19 nt, Homo sapiens
cagcaaacaggaucaguua

SEQ ID NO: 411256 - RNA, 19 nt, Homo sapiens
gcaagaaacaggagaagau

SEQ ID NO: 411257 - RNA, 19 nt, Homo sapiens
ggaagaaagagaccaguga

SEQ ID NO: 411258 - RNA, 19 nt, Homo sapiens
gaaagagaccagugaguca

SEQ ID NO: 411259 - RNA, 19 nt, Homo sapiens
gagaagaugcuggauuaaa

SEQ ID NO: 411260 - RNA, 19 nt, Homo sapiens
gaauggcaguggagugugu

SEQ ID NO: 411261 - RNA, 19 nt, Homo sapiens
gagaggacguuuccaacuc

SEQ ID NO: 411262 - RNA, 19 nt, Homo sapiens
caagcagaaucuaagaaga

SEQ ID NO: 411263 - RNA, 19 nt, Homo sapiens
gcaacuggaagaagcaauu

SEQ ID NO: 411264 - RNA, 19 nt, Homo sapiens
ggagcugagugcaagcaaa

SEQ ID NO: 411265 - RNA, 19 nt, Homo sapiens
gaagcgagcccugcacaau

SEQ ID NO: 411266 - RNA, 19 nt, Homo sapiens
ugucaccuguggaacauaa

SEQ ID NO: 411267 - RNA, 19 nt, Homo sapiens
aaucagcucucgagugcaa

SEQ ID NO: 411268 - RNA, 19 nt, Homo sapiens
gcaaacaggaucaguuaac

SEQ ID NO: 411269 - RNA, 19 nt, Homo sapiens
agaagaugcuggauuaaaa

SEQ ID NO: 411270 - RNA, 19 nt, Homo sapiens
gggagaaugugaccugaac

SEQ ID NO: 411271 - RNA, 19 nt, Homo sapiens
caaacaggaucaguuaacu

SEQ ID NO: 411272 - RNA, 19 nt, Homo sapiens
cagaaucuaagaagaagaa

SEQ ID NO: 411273 - RNA, 19 nt, Homo sapiens
gcagcagcgucgaaaauuu

SEQ ID NO: 411274 - RNA, 19 nt, Homo sapiens
gagaauggcaguggagugu

SEQ ID NO: 411275 - RNA, 19 nt, Homo sapiens
aaacaggaucaguuaacua

SEQ ID NO: 411276 - RNA, 19 nt, Homo sapiens
ggacaucagcaaacaggau

SEQ ID NO: 411277 - RNA, 19 nt, Homo sapiens
ggacuggagcugagugcaa

SEQ ID NO: 411278 - RNA, 19 nt, Homo sapiens
aagcagaaucuaagaagaa

SEQ ID NO: 411279 - RNA, 19 nt, Homo sapiens
uaccguaggcuuuguauuc

SEQ ID NO: 411280 - RNA, 19 nt, Homo sapiens
aaagaugucaccuguggaa

SEQ ID NO: 411281 - RNA, 19 nt, Homo sapiens
caacuggaagaagcaauuu

SEQ ID NO: 411282 - RNA, 19 nt, Homo sapiens
ccagagaggacguuuccaa

SEQ ID NO: 411283 - RNA, 19 nt, Homo sapiens
ggagaagaugcuggauuaa

SEQ ID NO: 411284 - RNA, 19 nt, Homo sapiens
aaaugcaggcucaacagua

SEQ ID NO: 411285 - RNA, 19 nt, Homo sapiens
ggagagaggggaagaaaga

SEQ ID NO: 411286 - RNA, 19 nt, Homo sapiens
caagaaacaggagaagaug

SEQ ID NO: 411287 - RNA, 19 nt, Homo sapiens
gauguaagauccccugcaa

SEQ ID NO: 411288 - RNA, 19 nt, Homo sapiens
ggagugcaaauaccaguuc

SEQ ID NO: 411289 - RNA, 19 nt, Homo sapiens
ugaagacccagagauguaa

SEQ ID NO: 411290 - RNA, 19 nt, Homo sapiens
ccaugaagacccagagaug

SEQ ID NO: 411291 - RNA, 19 nt, Homo sapiens
gcaagcaaaccaugaagac

SEQ ID NO: 411292 - RNA, 19 nt, Homo sapiens
agaggacguuuccaacuca

SEQ ID NO: 411293 - RNA, 19 nt, Homo sapiens
gaagcagggaagaaagaga

SEQ ID NO: 411294 - RNA, 19 nt, Homo sapiens
uauauguaccguaggcuuu

SEQ ID NO: 411295 - RNA, 19 nt, Homo sapiens
gcuaaguacacaauaagca

SEQ ID NO: 411296 - RNA, 19 nt, Homo sapiens
ucaaaggcaggaucagguu

SEQ ID NO: 411297 - RNA, 19 nt, Homo sapiens
cuaaguacacaauaagcaa

SEQ ID NO: 411298 - RNA, 19 nt, Homo sapiens
gaggacguuuccaacucaa

SEQ ID NO: 411299 - RNA, 19 nt, Homo sapiens
aacaggaucaguuaacuau

SEQ ID NO: 411300 - RNA, 19 nt, Homo sapiens
gaugcuggauuaaaagaug

SEQ ID NO: 411301 - RNA, 19 nt, Homo sapiens
caggagaagaugcuggauu

SEQ ID NO: 411302 - RNA, 19 nt, Homo sapiens
ucagcaaacaggaucaguu

SEQ ID NO: 411303 - RNA, 19 nt, Homo sapiens
augaagacccagagaugua

SEQ ID NO: 411304 - RNA, 19 nt, Homo sapiens
ucaagcagaaucuaagaag

SEQ ID NO: 411305 - RNA, 19 nt, Homo sapiens
ucucaucccucccauucuc

SEQ ID NO: 411306 - RNA, 19 nt, Homo sapiens
aagcagggaagaaagagaa

SEQ ID NO: 411307 - RNA, 19 nt, Homo sapiens
gaccaagcccaaaccucaa

SEQ ID NO: 411308 - RNA, 19 nt, Homo sapiens
aaugcaggcucaacaguac

SEQ ID NO: 411309 - RNA, 19 nt, Homo sapiens
ccucucaucccucccauuc

SEQ ID NO: 411310 - RNA, 19 nt, Homo sapiens
ucccucccauucuccauuu

SEQ ID NO: 411311 - RNA, 19 nt, Homo sapiens
gagcugagugcaagcaaac

SEQ ID NO: 411312 - RNA, 19 nt, Homo sapiens
gagcagaggaaaauccaaa

SEQ ID NO: 411313 - RNA, 19 nt, Homo sapiens
caaacugaccaagcccaaa

SEQ ID NO: 411314 - RNA, 19 nt, Homo sapiens
caagcccuguggcaaacug

SEQ ID NO: 411315 - RNA, 19 nt, Homo sapiens
gccagaagacugucaccau

SEQ ID NO: 411316 - RNA, 19 nt, Homo sapiens
ccgaaugccagaagacugu

SEQ ID NO: 411317 - RNA, 19 nt, Homo sapiens
gcagacugagcgccagaga

SEQ ID NO: 411318 - RNA, 19 nt, Homo sapiens
auuugcagcugccuucuug

SEQ ID NO: 411319 - RNA, 19 nt, Homo sapiens
ugucagggcguaauugagu

SEQ ID NO: 411320 - RNA, 19 nt, Homo sapiens
agaagacugucaccaucuc

SEQ ID NO: 411321 - RNA, 19 nt, Homo sapiens
gagugcaagcaaaccauga

SEQ ID NO: 411322 - RNA, 19 nt, Homo sapiens
gaucaguuaacuauugcau

SEQ ID NO: 411323 - RNA, 19 nt, Homo sapiens
ggacguuuccaacucaaaa

SEQ ID NO: 411324 - RNA, 19 nt, Homo sapiens
aaaaggacaucagcaaaca

SEQ ID NO: 411325 - RNA, 19 nt, Homo sapiens
uuuaauaagcuucccaauc

SEQ ID NO: 411326 - RNA, 19 nt, Homo sapiens
caugaagacccagagaugu

SEQ ID NO: 411327 - RNA, 19 nt, Homo sapiens
ugagucauccguccagaag

SEQ ID NO: 411328 - RNA, 19 nt, Homo sapiens
ccaaaccucaagcagaauc

SEQ ID NO: 411329 - RNA, 19 nt, Homo sapiens
uaauaagcuucccaaucag

SEQ ID NO: 411330 - RNA, 19 nt, Homo sapiens
caagauagcucccacuguu

SEQ ID NO: 411331 - RNA, 19 nt, Homo sapiens
ggagauugauggauucuuu

SEQ ID NO: 411332 - RNA, 19 nt, Homo sapiens
gaauggaacuccucacuag

SEQ ID NO: 411333 - RNA, 19 nt, Homo sapiens
ggacagagagcuccuuuga

SEQ ID NO: 411334 - RNA, 19 nt, Homo sapiens
ggagggaugugcagaaugu

SEQ ID NO: 411335 - RNA, 19 nt, Homo sapiens
gaauccagguccuucuaua

SEQ ID NO: 411336 - RNA, 19 nt, Homo sapiens
cuacauggcugaccuggaa

SEQ ID NO: 411337 - RNA, 19 nt, Homo sapiens
guaccuggcucugaucuuu

SEQ ID NO: 411338 - RNA, 19 nt, Homo sapiens
ggagguguguggaauaaau

SEQ ID NO: 411339 - RNA, 19 nt, Homo sapiens
uggcagagcuucagaggaa

SEQ ID NO: 411340 - RNA, 19 nt, Homo sapiens
gcagggugcugaacacaga

SEQ ID NO: 411341 - RNA, 19 nt, Homo sapiens
acagagagcuccuuugaca

SEQ ID NO: 411342 - RNA, 19 nt, Homo sapiens
ccaagaaggugaacuggau

SEQ ID NO: 411343 - RNA, 19 nt, Homo sapiens
ggugggaccugacgaguug

SEQ ID NO: 411344 - RNA, 19 nt, Homo sapiens
ggaaggaugugggucucua

SEQ ID NO: 411345 - RNA, 19 nt, Homo sapiens
uggcuuagcugcaggagaa

SEQ ID NO: 411346 - RNA, 19 nt, Homo sapiens
ggaauggaacuccucacua

SEQ ID NO: 411347 - RNA, 19 nt, Homo sapiens
cgagaaauaacgaagagua

SEQ ID NO: 411348 - RNA, 19 nt, Homo sapiens
gugaaugaauggcucaaga

SEQ ID NO: 411349 - RNA, 19 nt, Homo sapiens
ggauagaagugggcagguu

SEQ ID NO: 411350 - RNA, 19 nt, Homo sapiens
ggaggagauugauggauuc

SEQ ID NO: 411351 - RNA, 19 nt, Homo sapiens
ccaagcagcuggucgacau

SEQ ID NO: 411352 - RNA, 19 nt, Homo sapiens
uggaggagauugauggauu

SEQ ID NO: 411353 - RNA, 19 nt, Homo sapiens
gaaauaaaauucccuacag

SEQ ID NO: 411354 - RNA, 19 nt, Homo sapiens
ucaagaggcagaagagaaa

SEQ ID NO: 411355 - RNA, 19 nt, Homo sapiens
ucaaggccuuuaccaagaa

SEQ ID NO: 411356 - RNA, 19 nt, Homo sapiens
ggucaaugcucgccuugca

SEQ ID NO: 411357 - RNA, 19 nt, Homo sapiens
ccaauguggugagaaaguu

SEQ ID NO: 411358 - RNA, 19 nt, Homo sapiens
agacugcgcuagccacuuc

SEQ ID NO: 411359 - RNA, 19 nt, Homo sapiens
cucagucccuggccucuua

SEQ ID NO: 411360 - RNA, 19 nt, Homo sapiens
ggaaagagggugccguucu

SEQ ID NO: 411361 - RNA, 19 nt, Homo sapiens
ugucuucucucuccagguu

SEQ ID NO: 411362 - RNA, 19 nt, Homo sapiens
gcaacaucauccuggacuu

SEQ ID NO: 411363 - RNA, 19 nt, Homo sapiens
aaccacugcuaacaagaua

SEQ ID NO: 411364 - RNA, 19 nt, Homo sapiens
cuagaagugugggaaauuc

SEQ ID NO: 411365 - RNA, 19 nt, Homo sapiens
gugagaaaguuugguguca

SEQ ID NO: 411366 - RNA, 19 nt, Homo sapiens
ugggugggcuggaauggaa

SEQ ID NO: 411367 - RNA, 19 nt, Homo sapiens
ugggagguguguggaauaa

SEQ ID NO: 411368 - RNA, 19 nt, Homo sapiens
ggaauccagguccuucuau

SEQ ID NO: 411369 - RNA, 19 nt, Homo sapiens
uagcaccacauuccuguuu

SEQ ID NO: 411370 - RNA, 19 nt, Homo sapiens
gagcuggaaagccggaauu

SEQ ID NO: 411371 - RNA, 19 nt, Homo sapiens
ucccuacaguuucuuuaaa

SEQ ID NO: 411372 - RNA, 19 nt, Homo sapiens
cuacuuccaggccaagaua

SEQ ID NO: 411373 - RNA, 19 nt, Homo sapiens
gcaggcagcucggcaaaau

SEQ ID NO: 411374 - RNA, 19 nt, Homo sapiens
gcaccaaccacugcuaaca

SEQ ID NO: 411375 - RNA, 19 nt, Homo sapiens
caagauaagggcccugaag

SEQ ID NO: 411376 - RNA, 19 nt, Homo sapiens
acaaugaacgccuggaugu

SEQ ID NO: 411377 - RNA, 19 nt, Homo sapiens
gcccuggagucccaucaug

SEQ ID NO: 411378 - RNA, 19 nt, Homo sapiens
caaccacugcuaacaagau

SEQ ID NO: 411379 - RNA, 19 nt, Homo sapiens
ccgcuuaccugcagagacu

SEQ ID NO: 411380 - RNA, 19 nt, Homo sapiens
gagaaauaacgaagaguac

SEQ ID NO: 411381 - RNA, 19 nt, Homo sapiens
uucaaggccuuuaccaaga

SEQ ID NO: 411382 - RNA, 19 nt, Homo sapiens
ggaagccugagaugaugaa

SEQ ID NO: 411383 - RNA, 19 nt, Homo sapiens
gagguguguggaauaaauu

SEQ ID NO: 411384 - RNA, 19 nt, Homo sapiens
cuccuugucuggccuagaa

SEQ ID NO: 411385 - RNA, 19 nt, Homo sapiens
ugagggaccugaggcaagu

SEQ ID NO: 411386 - RNA, 19 nt, Homo sapiens
gcagugcuggccaaguauu

SEQ ID NO: 411387 - RNA, 19 nt, Homo sapiens
aggccaauguggugagaaa

SEQ ID NO: 411388 - RNA, 19 nt, Homo sapiens
ccuuacacaugcuugauuc

SEQ ID NO: 411389 - RNA, 19 nt, Homo sapiens
cuggaaagccggaauucaa

SEQ ID NO: 411390 - RNA, 19 nt, Homo sapiens
gagauugauggauucuuug

SEQ ID NO: 411391 - RNA, 19 nt, Homo sapiens
cugccaagcuggaggagau

SEQ ID NO: 411392 - RNA, 19 nt, Homo sapiens
gcucuggucuagccacaac

SEQ ID NO: 411393 - RNA, 19 nt, Homo sapiens
gaaauaacgaagaguaccu

SEQ ID NO: 411394 - RNA, 19 nt, Homo sapiens
gagagcuccuuugacacaa

SEQ ID NO: 411395 - RNA, 19 nt, Homo sapiens
gcagagcuucagaggaaug

SEQ ID NO: 411396 - RNA, 19 nt, Homo sapiens
caacaucauccuggacuuc

SEQ ID NO: 411397 - RNA, 19 nt, Homo sapiens
caagaaggugaacuggauu

SEQ ID NO: 411398 - RNA, 19 nt, Homo sapiens
cugcagagacuucaacauc

SEQ ID NO: 411399 - RNA, 19 nt, Homo sapiens
ucucuuaccuggacaucag

SEQ ID NO: 411400 - RNA, 19 nt, Homo sapiens
agaggcagaagagaaauaa

SEQ ID NO: 411401 - RNA, 19 nt, Homo sapiens
caauguggugagaaaguuu

SEQ ID NO: 411402 - RNA, 19 nt, Homo sapiens
uugaaguccugccucauuc

SEQ ID NO: 411403 - RNA, 19 nt, Homo sapiens
agagagcuccuuugacaca

SEQ ID NO: 411404 - RNA, 19 nt, Homo sapiens
ucuauucccuguccuucau

SEQ ID NO: 411405 - RNA, 19 nt, Homo sapiens
gcacauggcagagcuucag

SEQ ID NO: 411406 - RNA, 19 nt, Homo sapiens
agccugagaugaugaaguc

SEQ ID NO: 411407 - RNA, 19 nt, Homo sapiens
gaaggaugugggucucuag

SEQ ID NO: 411408 - RNA, 19 nt, Homo sapiens
gaaagccggaauucaacuc

SEQ ID NO: 411409 - RNA, 19 nt, Homo sapiens
uggcagaucgcuccaagau

SEQ ID NO: 411410 - RNA, 19 nt, Homo sapiens
uaccugcuguuccggaaug

SEQ ID NO: 411411 - RNA, 19 nt, Homo sapiens
caaugaagaagccuuugca

SEQ ID NO: 411412 - RNA, 19 nt, Homo sapiens
gccuagaagugugggaaau

SEQ ID NO: 411413 - RNA, 19 nt, Homo sapiens
ugggaagccugagaugaug

SEQ ID NO: 411414 - RNA, 19 nt, Homo sapiens
agauagcucccacuguuug

SEQ ID NO: 411415 - RNA, 19 nt, Homo sapiens
caccaaccacugcuaacaa

SEQ ID NO: 411416 - RNA, 19 nt, Homo sapiens
aagaggcagaagagaaaua

SEQ ID NO: 411417 - RNA, 19 nt, Homo sapiens
caugguugcugggcuguag

SEQ ID NO: 411418 - RNA, 19 nt, Homo sapiens
aaacgaguugcuccaguga

SEQ ID NO: 411419 - RNA, 19 nt, Homo sapiens
guccagggcugagaagaac

SEQ ID NO: 411420 - RNA, 19 nt, Homo sapiens
ggaaagccggaauucaacu

SEQ ID NO: 411421 - RNA, 19 nt, Homo sapiens
ccggagggaugugcagaau

SEQ ID NO: 411422 - RNA, 19 nt, Homo sapiens
ccuagaagugugggaaauu

SEQ ID NO: 411423 - RNA, 19 nt, Homo sapiens
uagggugaguggcuugcuu

SEQ ID NO: 411424 - RNA, 19 nt, Homo sapiens
uuugaaguccugccucauu

SEQ ID NO: 411425 - RNA, 19 nt, Homo sapiens
aagauagcucccacuguuu

SEQ ID NO: 411426 - RNA, 19 nt, Homo sapiens
gggcauagggcagcucagu

SEQ ID NO: 411427 - RNA, 19 nt, Homo sapiens
acgaguugcuccagugaag

SEQ ID NO: 411428 - RNA, 19 nt, Homo sapiens
gggaagccugagaugauga

SEQ ID NO: 411429 - RNA, 19 nt, Homo sapiens
gccaauguggugagaaagu

SEQ ID NO: 411430 - RNA, 19 nt, Homo sapiens
caaaggaguuacauucuua

SEQ ID NO: 411431 - RNA, 19 nt, Homo sapiens
gaucgaaggugccaaauuc

SEQ ID NO: 411432 - RNA, 19 nt, Homo sapiens
gcacaauacuggccacaaa

SEQ ID NO: 411433 - RNA, 19 nt, Homo sapiens
gaucuuacauuuccacuau

SEQ ID NO: 411434 - RNA, 19 nt, Homo sapiens
aaacuuugaucucugcuua

SEQ ID NO: 411435 - RNA, 19 nt, Homo sapiens
ggauuaaacuacaucaaga

SEQ ID NO: 411436 - RNA, 19 nt, Homo sapiens
cugaagaccuccacauuaa

SEQ ID NO: 411437 - RNA, 19 nt, Homo sapiens
uaacauugaucucugaaga

SEQ ID NO: 411438 - RNA, 19 nt, Homo sapiens
cugaagauaucaagucaua

SEQ ID NO: 411439 - RNA, 19 nt, Homo sapiens
ccaagaaacucgagagauc

SEQ ID NO: 411440 - RNA, 19 nt, Homo sapiens
ggacguugguucugcacua

SEQ ID NO: 411441 - RNA, 19 nt, Homo sapiens
gaucucugcuuacuaaugu

SEQ ID NO: 411442 - RNA, 19 nt, Homo sapiens
ucaagacacugaaguuaga

SEQ ID NO: 411443 - RNA, 19 nt, Homo sapiens
guaagcaguuguuauuuag

SEQ ID NO: 411444 - RNA, 19 nt, Homo sapiens
gaagagacccaggaggaua

SEQ ID NO: 411445 - RNA, 19 nt, Homo sapiens
ucaagaaagugcuguuaga

SEQ ID NO: 411446 - RNA, 19 nt, Homo sapiens
ggagaaagguucguuaaaa

SEQ ID NO: 411447 - RNA, 19 nt, Homo sapiens
gaugugagauuacuuuguc

SEQ ID NO: 411448 - RNA, 19 nt, Homo sapiens
agaaagugcuguuagaaau

SEQ ID NO: 411449 - RNA, 19 nt, Homo sapiens
gaaaccacacuucuugaaa

SEQ ID NO: 411450 - RNA, 19 nt, Homo sapiens
gaaaugagaaacuuugauc

SEQ ID NO: 411451 - RNA, 19 nt, Homo sapiens
uaacacaugcggucacuuu

SEQ ID NO: 411452 - RNA, 19 nt, Homo sapiens
ccaaaggaguuacauucuu

SEQ ID NO: 411453 - RNA, 19 nt, Homo sapiens
ucacgacucuuccugcaaa

SEQ ID NO: 411454 - RNA, 19 nt, Homo sapiens
gaagaagcccaaaggaguu

SEQ ID NO: 411455 - RNA, 19 nt, Homo sapiens
gccagugacuucccaugua

SEQ ID NO: 411456 - RNA, 19 nt, Homo sapiens
gagcaacucuccacuccau

SEQ ID NO: 411457 - RNA, 19 nt, Homo sapiens
ggaaggaggacgguuguaa

SEQ ID NO: 411458 - RNA, 19 nt, Homo sapiens
uggccaagcuuccuaagaa

SEQ ID NO: 411459 - RNA, 19 nt, Homo sapiens
gcagcuggcucuccaccuu

SEQ ID NO: 411460 - RNA, 19 nt, Homo sapiens
gagcugggcuuguuguuuu

SEQ ID NO: 411461 - RNA, 19 nt, Homo sapiens
gugagaagauagaacaaug

SEQ ID NO: 411462 - RNA, 19 nt, Homo sapiens
uuagugauauuguggguaa

SEQ ID NO: 411463 - RNA, 19 nt, Homo sapiens
caucaagggcuuuaucaaa

SEQ ID NO: 411464 - RNA, 19 nt, Homo sapiens
aaauggacguacugguuua

SEQ ID NO: 411465 - RNA, 19 nt, Homo sapiens
ggaaaccacacuucuugaa

SEQ ID NO: 411466 - RNA, 19 nt, Homo sapiens
acucuccacuccauauuua

SEQ ID NO: 411467 - RNA, 19 nt, Homo sapiens
gaaagugcuguuagaaaug

SEQ ID NO: 411468 - RNA, 19 nt, Homo sapiens
cucgagagaucuuacauuu

SEQ ID NO: 411469 - RNA, 19 nt, Homo sapiens
gagcagaccgugauuugga

SEQ ID NO: 411470 - RNA, 19 nt, Homo sapiens
uuugaucucugcuuacuaa

SEQ ID NO: 411471 - RNA, 19 nt, Homo sapiens
cgagagaucuuacauuucc

SEQ ID NO: 411472 - RNA, 19 nt, Homo sapiens
cauguaaggucuucuugug

SEQ ID NO: 411473 - RNA, 19 nt, Homo sapiens
aauaaauccucagguagua

SEQ ID NO: 411474 - RNA, 19 nt, Homo sapiens
aaagugcuguuagaaauga

SEQ ID NO: 411475 - RNA, 19 nt, Homo sapiens
gaacacguggguauuuaau

SEQ ID NO: 411476 - RNA, 19 nt, Homo sapiens
ucaccagccucauucuuga

SEQ ID NO: 411477 - RNA, 19 nt, Homo sapiens
gaagaccuccacauuaagu

SEQ ID NO: 411478 - RNA, 19 nt, Homo sapiens
guuguaagcaguuguuauu

SEQ ID NO: 411479 - RNA, 19 nt, Homo sapiens
gagaaagguucguuaaaau

SEQ ID NO: 411480 - RNA, 19 nt, Homo sapiens
guuuggguguguauauaua

SEQ ID NO: 411481 - RNA, 19 nt, Homo sapiens
gugccaggcuguaagcauu

SEQ ID NO: 411482 - RNA, 19 nt, Homo sapiens
gcaauagggugcaguuuuc

SEQ ID NO: 411483 - RNA, 19 nt, Homo sapiens
gauaaagacugccccauca

SEQ ID NO: 411484 - RNA, 19 nt, Homo sapiens
ccacauggccugacuuugg

SEQ ID NO: 411485 - RNA, 19 nt, Homo sapiens
gagaggcaccugcuggaaa

SEQ ID NO: 411486 - RNA, 19 nt, Homo sapiens
uuacaauggccauggaaua

SEQ ID NO: 411487 - RNA, 19 nt, Homo sapiens
gcacuagcauuuucuugaa

SEQ ID NO: 411488 - RNA, 19 nt, Homo sapiens
gcaacucuccacuccauau

SEQ ID NO: 411489 - RNA, 19 nt, Homo sapiens
gaaagcaugagucaagaca

SEQ ID NO: 411490 - RNA, 19 nt, Homo sapiens
gaaggugccaaauucauca

SEQ ID NO: 411491 - RNA, 19 nt, Homo sapiens
caagaaagugcuguuagaa

SEQ ID NO: 411492 - RNA, 19 nt, Homo sapiens
gauggagaaagguucguua

SEQ ID NO: 411493 - RNA, 19 nt, Homo sapiens
gggaucagccuccgccauu

SEQ ID NO: 411494 - RNA, 19 nt, Homo sapiens
ugccuuaagccaauauuua

SEQ ID NO: 411495 - RNA, 19 nt, Homo sapiens
guagaagccaguacagaga

SEQ ID NO: 411496 - RNA, 19 nt, Homo sapiens
acugaagaccuccacauua

SEQ ID NO: 411497 - RNA, 19 nt, Homo sapiens
gaacugaagaccuccacau

SEQ ID NO: 411498 - RNA, 19 nt, Homo sapiens
ggaaaugcagggaguucuu

SEQ ID NO: 411499 - RNA, 19 nt, Homo sapiens
ccagugacuucccauguag

SEQ ID NO: 411500 - RNA, 19 nt, Homo sapiens
gacguugguucugcacuaa

SEQ ID NO: 411501 - RNA, 19 nt, Homo sapiens
ucaacagagugauggagaa

SEQ ID NO: 411502 - RNA, 19 nt, Homo sapiens
cuauaugccuuaagccaau

SEQ ID NO: 411503 - RNA, 19 nt, Homo sapiens
gaccauagucggauuaaac

SEQ ID NO: 411504 - RNA, 19 nt, Homo sapiens
gcccaaaggaguuacauuc

SEQ ID NO: 411505 - RNA, 19 nt, Homo sapiens
uaguuuggguguguauaua

SEQ ID NO: 411506 - RNA, 19 nt, Homo sapiens
aaaccacacuucuugaaac

SEQ ID NO: 411507 - RNA, 19 nt, Homo sapiens
gaaggaggacgguuguaag

SEQ ID NO: 411508 - RNA, 19 nt, Homo sapiens
uaauaaauccucagguagu

SEQ ID NO: 411509 - RNA, 19 nt, Homo sapiens
caacagagugauggagaaa

SEQ ID NO: 411510 - RNA, 19 nt, Homo sapiens
uacaauggccauggaauaa

SEQ ID NO: 411511 - RNA, 19 nt, Homo sapiens
gaaugcauguaaggucuuc

SEQ ID NO: 411512 - RNA, 19 nt, Homo sapiens
caugaugugagauuacuuu

SEQ ID NO: 411513 - RNA, 19 nt, Homo sapiens
gcucugcuauaugccuuaa

SEQ ID NO: 411514 - RNA, 19 nt, Homo sapiens
gccuguugcugaagucauu

SEQ ID NO: 411515 - RNA, 19 nt, Homo sapiens
uggguaacgugagaagaua

SEQ ID NO: 411516 - RNA, 19 nt, Homo sapiens
ggacgguuguaagcaguug

SEQ ID NO: 411517 - RNA, 19 nt, Homo sapiens
cuaccuggcugugaucgaa

SEQ ID NO: 411518 - RNA, 19 nt, Homo sapiens
caauggccauggaauaaac

SEQ ID NO: 411519 - RNA, 19 nt, Homo sapiens
caggauauccgacaugaag

SEQ ID NO: 411520 - RNA, 19 nt, Homo sapiens
aagcaguuguuauuuagug

SEQ ID NO: 411521 - RNA, 19 nt, Homo sapiens
gaaaugcagggaguucuuc

SEQ ID NO: 411522 - RNA, 19 nt, Homo sapiens
aagaaagugcuguuagaaa

SEQ ID NO: 411523 - RNA, 19 nt, Homo sapiens
uaucaagaaagugcuguua

SEQ ID NO: 411524 - RNA, 19 nt, Homo sapiens
cacauggccugacuuugga

SEQ ID NO: 411525 - RNA, 19 nt, Homo sapiens
guaguuuggguguguauau

SEQ ID NO: 411526 - RNA, 19 nt, Homo sapiens
ccuaauuccuggcaugaca

SEQ ID NO: 411527 - RNA, 19 nt, Homo sapiens
augaacacguggguauuua

SEQ ID NO: 411528 - RNA, 19 nt, Homo sapiens
gcgcuuaccucugcuacag

SEQ ID NO: 411529 - RNA, 19 nt, Homo sapiens
guaguaguuugggugugua

SEQ ID NO: 411530 - RNA, 19 nt, Homo sapiens
gaaacaggauucaguguga

SEQ ID NO: 411531 - RNA, 19 nt, Homo sapiens
gaugugaagucguauuaua

SEQ ID NO: 411532 - RNA, 19 nt, Homo sapiens
cagaauaggucuagaagaa

SEQ ID NO: 411533 - RNA, 19 nt, Homo sapiens
gaaagaaucgguuaaaugu

SEQ ID NO: 411534 - RNA, 19 nt, Homo sapiens
acaaaggaguuacaucuua

SEQ ID NO: 411535 - RNA, 19 nt, Homo sapiens
aaagggagauucuaguaua

SEQ ID NO: 411536 - RNA, 19 nt, Homo sapiens
caaaggaguuacaucuuaa

SEQ ID NO: 411537 - RNA, 19 nt, Homo sapiens
aaacagaaaucgaaacaga

SEQ ID NO: 411538 - RNA, 19 nt, Homo sapiens
cagaagaugugaagucgua

SEQ ID NO: 411539 - RNA, 19 nt, Homo sapiens
gcaguuagaaguuggaaua

SEQ ID NO: 411540 - RNA, 19 nt, Homo sapiens
gcaagcuucugcacuagua

SEQ ID NO: 411541 - RNA, 19 nt, Homo sapiens
gaauaggucuagaagaaga

SEQ ID NO: 411542 - RNA, 19 nt, Homo sapiens
gagaugcuguuuaaagaaa

SEQ ID NO: 411543 - RNA, 19 nt, Homo sapiens
gaauagacaucaaccagau

SEQ ID NO: 411544 - RNA, 19 nt, Homo sapiens
agacuuaucuccugccuuu

SEQ ID NO: 411545 - RNA, 19 nt, Homo sapiens
gaacagaauaggucuagaa

SEQ ID NO: 411546 - RNA, 19 nt, Homo sapiens
guaugucgauugaauugua

SEQ ID NO: 411547 - RNA, 19 nt, Homo sapiens
guaaauggcugucuaaaau

SEQ ID NO: 411548 - RNA, 19 nt, Homo sapiens
ccagcaagcuucugcacua

SEQ ID NO: 411549 - RNA, 19 nt, Homo sapiens
gaaguuggaauaagcaauu

SEQ ID NO: 411550 - RNA, 19 nt, Homo sapiens
aaacagaggcuaaaugaga

SEQ ID NO: 411551 - RNA, 19 nt, Homo sapiens
gagaaagaaucgguuaaau

SEQ ID NO: 411552 - RNA, 19 nt, Homo sapiens
cgaaacagauacagagaug

SEQ ID NO: 411553 - RNA, 19 nt, Homo sapiens
cagcuucauuucucaauuu

SEQ ID NO: 411554 - RNA, 19 nt, Homo sapiens
ccagauaagugauauuuac

SEQ ID NO: 411555 - RNA, 19 nt, Homo sapiens
caacaucucaggacucuug

SEQ ID NO: 411556 - RNA, 19 nt, Homo sapiens
ggugaaaccagaacaauau

SEQ ID NO: 411557 - RNA, 19 nt, Homo sapiens
accaagagaugcuguuuaa

SEQ ID NO: 411558 - RNA, 19 nt, Homo sapiens
gaccaaagcaguugucaug

SEQ ID NO: 411559 - RNA, 19 nt, Homo sapiens
gcacaaaggaguuacaucu

SEQ ID NO: 411560 - RNA, 19 nt, Homo sapiens
gcacuugauauaagcaaua

SEQ ID NO: 411561 - RNA, 19 nt, Homo sapiens
ugacagugcuacauuaauc

SEQ ID NO: 411562 - RNA, 19 nt, Homo sapiens
ggagaaagaaucgguuaaa

SEQ ID NO: 411563 - RNA, 19 nt, Homo sapiens
gauguaagcccauaugauc

SEQ ID NO: 411564 - RNA, 19 nt, Homo sapiens
gauaugagcaguuagaagu

SEQ ID NO: 411565 - RNA, 19 nt, Homo sapiens
ugaaacagaggcuaaauga

SEQ ID NO: 411566 - RNA, 19 nt, Homo sapiens
uauacuaccuggccagauu

SEQ ID NO: 411567 - RNA, 19 nt, Homo sapiens
ggcaaccuauucucacuaa

SEQ ID NO: 411568 - RNA, 19 nt, Homo sapiens
aagagaugcuguuuaaaga

SEQ ID NO: 411569 - RNA, 19 nt, Homo sapiens
caagagaugcuguuuaaag

SEQ ID NO: 411570 - RNA, 19 nt, Homo sapiens
aaaguaagaagcagcauuu

SEQ ID NO: 411571 - RNA, 19 nt, Homo sapiens
gugugaagcucuugucaga

SEQ ID NO: 411572 - RNA, 19 nt, Homo sapiens
gcacaguacuggccaacag

SEQ ID NO: 411573 - RNA, 19 nt, Homo sapiens
guaaacaguuggucaagac

SEQ ID NO: 411574 - RNA, 19 nt, Homo sapiens
gaacaauaucucacuuuca

SEQ ID NO: 411575 - RNA, 19 nt, Homo sapiens
guacaucuacuacaauuag

SEQ ID NO: 411576 - RNA, 19 nt, Homo sapiens
caguuuaguugacauagaa

SEQ ID NO: 411577 - RNA, 19 nt, Homo sapiens
gaggcuaucuggauuuuaa

SEQ ID NO: 411578 - RNA, 19 nt, Homo sapiens
ucucauacauggcuauaau

SEQ ID NO: 411579 - RNA, 19 nt, Homo sapiens
acagaaaucgaaacagaua

SEQ ID NO: 411580 - RNA, 19 nt, Homo sapiens
gaaccgcauuguggagaaa

SEQ ID NO: 411581 - RNA, 19 nt, Homo sapiens
gcagaagaccaaagcaguu

SEQ ID NO: 411582 - RNA, 19 nt, Homo sapiens
gcaguagaauagacaucaa

SEQ ID NO: 411583 - RNA, 19 nt, Homo sapiens
uaugaucacagucguguua

SEQ ID NO: 411584 - RNA, 19 nt, Homo sapiens
gguagauuaugauuuagga

SEQ ID NO: 411585 - RNA, 19 nt, Homo sapiens
gguaaacaguuggucaaga

SEQ ID NO: 411586 - RNA, 19 nt, Homo sapiens
uuacugggauagucaggua

SEQ ID NO: 411587 - RNA, 19 nt, Homo sapiens
gugaagcucuugucagaag

SEQ ID NO: 411588 - RNA, 19 nt, Homo sapiens
gaccaagagaugcuguuua

SEQ ID NO: 411589 - RNA, 19 nt, Homo sapiens
ggguuuaugucagucauuu

SEQ ID NO: 411590 - RNA, 19 nt, Homo sapiens
gaagaggcacaaaggaguu

SEQ ID NO: 411591 - RNA, 19 nt, Homo sapiens
agacugaaguuuugaagua

SEQ ID NO: 411592 - RNA, 19 nt, Homo sapiens
caaccuauucucacuaaga

SEQ ID NO: 411593 - RNA, 19 nt, Homo sapiens
cagaaacgauggaaagaac

SEQ ID NO: 411594 - RNA, 19 nt, Homo sapiens
uaaagaaacaggauucagu

SEQ ID NO: 411595 - RNA, 19 nt, Homo sapiens
caacauugagauauccuuu

SEQ ID NO: 411596 - RNA, 19 nt, Homo sapiens
agaaagaaucgguuaaaug

SEQ ID NO: 411597 - RNA, 19 nt, Homo sapiens
uaacacaugcugccauuuc

SEQ ID NO: 411598 - RNA, 19 nt, Homo sapiens
ugaccaacauugagauauc

SEQ ID NO: 411599 - RNA, 19 nt, Homo sapiens
gaaacgauggaaagaacuu

SEQ ID NO: 411600 - RNA, 19 nt, Homo sapiens
caacagaugaccaagagau

SEQ ID NO: 411601 - RNA, 19 nt, Homo sapiens
gccaacagaugaccaagag

SEQ ID NO: 411602 - RNA, 19 nt, Homo sapiens
gaagcagcauuuuaugauu

SEQ ID NO: 411603 - RNA, 19 nt, Homo sapiens
ggaauaagcaauuucuacu

SEQ ID NO: 411604 - RNA, 19 nt, Homo sapiens
gaagaugugaagucguauu

SEQ ID NO: 411605 - RNA, 19 nt, Homo sapiens
gguuaaaugugcacaguac

SEQ ID NO: 411606 - RNA, 19 nt, Homo sapiens
ccuaacacaugcugccauu

SEQ ID NO: 411607 - RNA, 19 nt, Homo sapiens
gaggcuaaaugagaaugaa

SEQ ID NO: 411608 - RNA, 19 nt, Homo sapiens
caauggaggagaacaguga

SEQ ID NO: 411609 - RNA, 19 nt, Homo sapiens
agaacaauaucucacuuuc

SEQ ID NO: 411610 - RNA, 19 nt, Homo sapiens
ccagaacaauaucucacuu

SEQ ID NO: 411611 - RNA, 19 nt, Homo sapiens
ugggguagauuaugauuua

SEQ ID NO: 411612 - RNA, 19 nt, Homo sapiens
guaagaagcagcauuuuau

SEQ ID NO: 411613 - RNA, 19 nt, Homo sapiens
uaaccugcacuugauauaa

SEQ ID NO: 411614 - RNA, 19 nt, Homo sapiens
caaaaugcccuauaaacaa

SEQ ID NO: 411615 - RNA, 19 nt, Homo sapiens
acagagauguaagcccaua

SEQ ID NO: 411616 - RNA, 19 nt, Homo sapiens
gcaaaaugcccuauaaaca

SEQ ID NO: 411617 - RNA, 19 nt, Homo sapiens
gagaaucuggcuccuugaa

SEQ ID NO: 411618 - RNA, 19 nt, Homo sapiens
ccaguuuaguugacauaga

SEQ ID NO: 411619 - RNA, 19 nt, Homo sapiens
guuagaaguuggaauaagc

SEQ ID NO: 411620 - RNA, 19 nt, Homo sapiens
acaugggcaucaacacuuu

SEQ ID NO: 411621 - RNA, 19 nt, Homo sapiens
uaaagggagauucuaguau

SEQ ID NO: 411622 - RNA, 19 nt, Homo sapiens
aagaugugaagucguauua

SEQ ID NO: 411623 - RNA, 19 nt, Homo sapiens
gauagucagguaaacaguu

SEQ ID NO: 411624 - RNA, 19 nt, Homo sapiens
cuuaagcauuucaggguaa

SEQ ID NO: 411625 - RNA, 19 nt, Homo sapiens
cuacguuauuggaaagaaa

SEQ ID NO: 411626 - RNA, 19 nt, Homo sapiens
aacagaggcuaaaugagaa

SEQ ID NO: 411627 - RNA, 19 nt, Homo sapiens
aagauacaauggaggagaa

SEQ ID NO: 411628 - RNA, 19 nt, Homo sapiens
aacaguuggucaagacuuu

SEQ ID NO: 411629 - RNA, 19 nt, Homo sapiens
cuucugcacuaguaacuga

SEQ ID NO: 411630 - RNA, 19 nt, Homo sapiens
guagaaagauguacaagaa

SEQ ID NO: 411631 - RNA, 19 nt, Homo sapiens
gaaacaggauucaguguga

SEQ ID NO: 411632 - RNA, 19 nt, Homo sapiens
gaugugaagucguauuaua

SEQ ID NO: 411633 - RNA, 19 nt, Homo sapiens
cagaauaggucuagaagaa

SEQ ID NO: 411634 - RNA, 19 nt, Homo sapiens
gaaagaaucgguuaaaugu

SEQ ID NO: 411635 - RNA, 19 nt, Homo sapiens
acaaaggaguuacaucuua

SEQ ID NO: 411636 - RNA, 19 nt, Homo sapiens
aaagggagauucuaguaua

SEQ ID NO: 411637 - RNA, 19 nt, Homo sapiens
caaaggaguuacaucuuaa

SEQ ID NO: 411638 - RNA, 19 nt, Homo sapiens
aaacagaaaucgaaacaga

SEQ ID NO: 411639 - RNA, 19 nt, Homo sapiens
cagaagaugugaagucgua

SEQ ID NO: 411640 - RNA, 19 nt, Homo sapiens
uaggagagauuacuuugua

SEQ ID NO: 411641 - RNA, 19 nt, Homo sapiens
gaauaggucuagaagaaga

SEQ ID NO: 411642 - RNA, 19 nt, Homo sapiens
gagaugcuguuuaaagaaa

SEQ ID NO: 411643 - RNA, 19 nt, Homo sapiens
agacuuaucuccugccuuu

SEQ ID NO: 411644 - RNA, 19 nt, Homo sapiens
gaacagaauaggucuagaa

SEQ ID NO: 411645 - RNA, 19 nt, Homo sapiens
ccucacaguuguuuguuua

SEQ ID NO: 411646 - RNA, 19 nt, Homo sapiens
aaacagaggcuaaaugaga

SEQ ID NO: 411647 - RNA, 19 nt, Homo sapiens
gagaaagaaucgguuaaau

SEQ ID NO: 411648 - RNA, 19 nt, Homo sapiens
cgaaacagauacagagaug

SEQ ID NO: 411649 - RNA, 19 nt, Homo sapiens
cagcuucauuucucaauuu

SEQ ID NO: 411650 - RNA, 19 nt, Homo sapiens
ggugaaaccagaacaauau

SEQ ID NO: 411651 - RNA, 19 nt, Homo sapiens
accaagagaugcuguuuaa

SEQ ID NO: 411652 - RNA, 19 nt, Homo sapiens
gaccaaagcaguugucaug

SEQ ID NO: 411653 - RNA, 19 nt, Homo sapiens
gcacaaaggaguuacaucu

SEQ ID NO: 411654 - RNA, 19 nt, Homo sapiens
ugacagacaccuaauauuc

SEQ ID NO: 411655 - RNA, 19 nt, Homo sapiens
ggagaaagaaucgguuaaa

SEQ ID NO: 411656 - RNA, 19 nt, Homo sapiens
gauguaagcccauaugauc

SEQ ID NO: 411657 - RNA, 19 nt, Homo sapiens
ugaaacagaggcuaaauga

SEQ ID NO: 411658 - RNA, 19 nt, Homo sapiens
uauacuaccuggccagauu

SEQ ID NO: 411659 - RNA, 19 nt, Homo sapiens
gcagaaccuuuaauuggau

SEQ ID NO: 411660 - RNA, 19 nt, Homo sapiens
guacugccauuccuacugu

SEQ ID NO: 411661 - RNA, 19 nt, Homo sapiens
aagagaugcuguuuaaaga

SEQ ID NO: 411662 - RNA, 19 nt, Homo sapiens
caagagaugcuguuuaaag

SEQ ID NO: 411663 - RNA, 19 nt, Homo sapiens
gugugaagcucuugucaga

SEQ ID NO: 411664 - RNA, 19 nt, Homo sapiens
gcacaguacuggccaacag

SEQ ID NO: 411665 - RNA, 19 nt, Homo sapiens
gaacaauaucucacuuuca

SEQ ID NO: 411666 - RNA, 19 nt, Homo sapiens
guacaucuacuacaauuag

SEQ ID NO: 411667 - RNA, 19 nt, Homo sapiens
caguuuaguugacauagaa

SEQ ID NO: 411668 - RNA, 19 nt, Homo sapiens
ucucauacauggcuauaau

SEQ ID NO: 411669 - RNA, 19 nt, Homo sapiens
gaaccgcauuguggagaaa

SEQ ID NO: 411670 - RNA, 19 nt, Homo sapiens
gcagaagaccaaagcaguu

SEQ ID NO: 411671 - RNA, 19 nt, Homo sapiens
acagaaaucgaaacagaua

SEQ ID NO: 411672 - RNA, 19 nt, Homo sapiens
gagagauuacuuuguauug

SEQ ID NO: 411673 - RNA, 19 nt, Homo sapiens
ggagagauuacuuuguauu

SEQ ID NO: 411674 - RNA, 19 nt, Homo sapiens
uaugaucacagucguguua

SEQ ID NO: 411675 - RNA, 19 nt, Homo sapiens
gcagaagacuuugcagaac

SEQ ID NO: 411676 - RNA, 19 nt, Homo sapiens
gugaagcucuugucagaag

SEQ ID NO: 411677 - RNA, 19 nt, Homo sapiens
gaccaagagaugcuguuua

SEQ ID NO: 411678 - RNA, 19 nt, Homo sapiens
gaagaggcacaaaggaguu

SEQ ID NO: 411679 - RNA, 19 nt, Homo sapiens
cagaaacgauggaaagaac

SEQ ID NO: 411680 - RNA, 19 nt, Homo sapiens
uaaagaaacaggauucagu

SEQ ID NO: 411681 - RNA, 19 nt, Homo sapiens
caccuaauauucaugacuu

SEQ ID NO: 411682 - RNA, 19 nt, Homo sapiens
agaaagaaucgguuaaaug

SEQ ID NO: 411683 - RNA, 19 nt, Homo sapiens
uaacacaugcugccauuuc

SEQ ID NO: 411684 - RNA, 19 nt, Homo sapiens
gacagacaccuaauauuca

SEQ ID NO: 411685 - RNA, 19 nt, Homo sapiens
gaaacgauggaaagaacuu

SEQ ID NO: 411686 - RNA, 19 nt, Homo sapiens
caacagaugaccaagagau

SEQ ID NO: 411687 - RNA, 19 nt, Homo sapiens
gccaacagaugaccaagag

SEQ ID NO: 411688 - RNA, 19 nt, Homo sapiens
agacuuugcagaaccuuua

SEQ ID NO: 411689 - RNA, 19 nt, Homo sapiens
gaagaugugaagucguauu

SEQ ID NO: 411690 - RNA, 19 nt, Homo sapiens
gguuaaaugugcacaguac

SEQ ID NO: 411691 - RNA, 19 nt, Homo sapiens
ccuaacacaugcugccauu

SEQ ID NO: 411692 - RNA, 19 nt, Homo sapiens
ccauugaugugcaaagcaa

SEQ ID NO: 411693 - RNA, 19 nt, Homo sapiens
gaggcuaaaugagaaugaa

SEQ ID NO: 411694 - RNA, 19 nt, Homo sapiens
caauggaggagaacaguga

SEQ ID NO: 411695 - RNA, 19 nt, Homo sapiens
agaacaauaucucacuuuc

SEQ ID NO: 411696 - RNA, 19 nt, Homo sapiens
ccagaacaauaucucacuu

SEQ ID NO: 411697 - RNA, 19 nt, Homo sapiens
gauugacagacaccuaaua

SEQ ID NO: 411698 - RNA, 19 nt, Homo sapiens
ugccauuccuacuguauuu

SEQ ID NO: 411699 - RNA, 19 nt, Homo sapiens
uagauugccucacaguugu

SEQ ID NO: 411700 - RNA, 19 nt, Homo sapiens
acagagauguaagcccaua

SEQ ID NO: 411701 - RNA, 19 nt, Homo sapiens
uuggauguguuaaguguuu

SEQ ID NO: 411702 - RNA, 19 nt, Homo sapiens
ugcagaaccuuuaauugga

SEQ ID NO: 411703 - RNA, 19 nt, Homo sapiens
gagaaucuggcuccuugaa

SEQ ID NO: 411704 - RNA, 19 nt, Homo sapiens
ccaguuuaguugacauaga

SEQ ID NO: 411705 - RNA, 19 nt, Homo sapiens
cuagauugccucacaguug

SEQ ID NO: 411706 - RNA, 19 nt, Homo sapiens
uaaagggagauucuaguau

SEQ ID NO: 411707 - RNA, 19 nt, Homo sapiens
aagaugugaagucguauua

SEQ ID NO: 411708 - RNA, 19 nt, Homo sapiens
ucgcuaacccucuagauug

SEQ ID NO: 411709 - RNA, 19 nt, Homo sapiens
aacagaggcuaaaugagaa

SEQ ID NO: 411710 - RNA, 19 nt, Homo sapiens
aagauacaauggaggagaa

SEQ ID NO: 411711 - RNA, 19 nt, Homo sapiens
caagauugacagacaccua

SEQ ID NO: 411712 - RNA, 19 nt, Homo sapiens
cagaacaauaucucacuuu

SEQ ID NO: 411713 - RNA, 19 nt, Homo sapiens
gagauguaagcccauauga

SEQ ID NO: 411714 - RNA, 19 nt, Homo sapiens
cagaugaaacagaggcuaa

SEQ ID NO: 411715 - RNA, 19 nt, Homo sapiens
gcaaaaugcugagaaugau

SEQ ID NO: 411716 - RNA, 19 nt, Homo sapiens
auaaagggagauucuagua

SEQ ID NO: 411717 - RNA, 19 nt, Homo sapiens
ccagcuucauuucucaauu

SEQ ID NO: 411718 - RNA, 19 nt, Homo sapiens
ucauagaguggccaaguuu

SEQ ID NO: 411719 - RNA, 19 nt, Homo sapiens
gaaggugcagcagaugaaa

SEQ ID NO: 411720 - RNA, 19 nt, Homo sapiens
gugcaaagcaagaccugaa

SEQ ID NO: 411721 - RNA, 19 nt, Homo sapiens
gaauauucugcagcuauaa

SEQ ID NO: 411722 - RNA, 19 nt, Homo sapiens
guacuuggaaauucgaaau

SEQ ID NO: 411723 - RNA, 19 nt, Homo sapiens
guggagaaagaaucgguua

SEQ ID NO: 411724 - RNA, 19 nt, Homo sapiens
gaaaacagaaaucgaaaca

SEQ ID NO: 411725 - RNA, 19 nt, Homo sapiens
acagacaccuaauauucau

SEQ ID NO: 411726 - RNA, 19 nt, Homo sapiens
guauaaagggagauucuag

SEQ ID NO: 411727 - RNA, 19 nt, Homo sapiens
gaaaccagaacaauaucuc

SEQ ID NO: 411728 - RNA, 19 nt, Homo sapiens
ggaacagaauaggucuaga

SEQ ID NO: 411729 - RNA, 19 nt, Homo sapiens
ggacuuuccucuaaaaugc

SEQ ID NO: 411730 - RNA, 19 nt, Homo sapiens
guagaaagauguacaagaa

SEQ ID NO: 411731 - RNA, 19 nt, Homo sapiens
gaaacaggauucaguguga

SEQ ID NO: 411732 - RNA, 19 nt, Homo sapiens
gaugugaagucguauuaua

SEQ ID NO: 411733 - RNA, 19 nt, Homo sapiens
cagaauaggucuagaagaa

SEQ ID NO: 411734 - RNA, 19 nt, Homo sapiens
gaaagaaucgguuaaaugu

SEQ ID NO: 411735 - RNA, 19 nt, Homo sapiens
acaaaggaguuacaucuua

SEQ ID NO: 411736 - RNA, 19 nt, Homo sapiens
aaagggagauucuaguaua

SEQ ID NO: 411737 - RNA, 19 nt, Homo sapiens
caaaggaguuacaucuuaa

SEQ ID NO: 411738 - RNA, 19 nt, Homo sapiens
aaacagaaaucgaaacaga

SEQ ID NO: 411739 - RNA, 19 nt, Homo sapiens
cagaagaugugaagucgua

SEQ ID NO: 411740 - RNA, 19 nt, Homo sapiens
uaggagagauuacuuugua

SEQ ID NO: 411741 - RNA, 19 nt, Homo sapiens
gaauaggucuagaagaaga

SEQ ID NO: 411742 - RNA, 19 nt, Homo sapiens
gagaugcuguuuaaagaaa

SEQ ID NO: 411743 - RNA, 19 nt, Homo sapiens
agacuuaucuccugccuuu

SEQ ID NO: 411744 - RNA, 19 nt, Homo sapiens
gaacagaauaggucuagaa

SEQ ID NO: 411745 - RNA, 19 nt, Homo sapiens
ccucacaguuguuuguuua

SEQ ID NO: 411746 - RNA, 19 nt, Homo sapiens
gagaaagaaucgguuaaau

SEQ ID NO: 411747 - RNA, 19 nt, Homo sapiens
cgaaacagauacagagaug

SEQ ID NO: 411748 - RNA, 19 nt, Homo sapiens
cagcuucauuucucaauuu

SEQ ID NO: 411749 - RNA, 19 nt, Homo sapiens
ggugaaaccagaacaauau

SEQ ID NO: 411750 - RNA, 19 nt, Homo sapiens
accaagagaugcuguuuaa

SEQ ID NO: 411751 - RNA, 19 nt, Homo sapiens
gaccaaagcaguugucaug

SEQ ID NO: 411752 - RNA, 19 nt, Homo sapiens
gcacaaaggaguuacaucu

SEQ ID NO: 411753 - RNA, 19 nt, Homo sapiens
ugacagacaccuaauauuc

SEQ ID NO: 411754 - RNA, 19 nt, Homo sapiens
ggagaaagaaucgguuaaa

SEQ ID NO: 411755 - RNA, 19 nt, Homo sapiens
gauguaagcccauaugauc

SEQ ID NO: 411756 - RNA, 19 nt, Homo sapiens
uauacuaccuggccagauu

SEQ ID NO: 411757 - RNA, 19 nt, Homo sapiens
gcagaaccuuuaauuggau

SEQ ID NO: 411758 - RNA, 19 nt, Homo sapiens
guacugccauuccuacugu

SEQ ID NO: 411759 - RNA, 19 nt, Homo sapiens
aagagaugcuguuuaaaga

SEQ ID NO: 411760 - RNA, 19 nt, Homo sapiens
caagagaugcuguuuaaag

SEQ ID NO: 411761 - RNA, 19 nt, Homo sapiens
gugugaagcucuugucaga

SEQ ID NO: 411762 - RNA, 19 nt, Homo sapiens
gcacaguacuggccaacag

SEQ ID NO: 411763 - RNA, 19 nt, Homo sapiens
gaacaauaucucacuuuca

SEQ ID NO: 411764 - RNA, 19 nt, Homo sapiens
guacaucuacuacaauuag

SEQ ID NO: 411765 - RNA, 19 nt, Homo sapiens
caguuuaguugacauagaa

SEQ ID NO: 411766 - RNA, 19 nt, Homo sapiens
ucucauacauggcuauaau

SEQ ID NO: 411767 - RNA, 19 nt, Homo sapiens
gaaccgcauuguggagaaa

SEQ ID NO: 411768 - RNA, 19 nt, Homo sapiens
gcagaagaccaaagcaguu

SEQ ID NO: 411769 - RNA, 19 nt, Homo sapiens
acagaaaucgaaacagaua

SEQ ID NO: 411770 - RNA, 19 nt, Homo sapiens
gagagauuacuuuguauug

SEQ ID NO: 411771 - RNA, 19 nt, Homo sapiens
ggagagauuacuuuguauu

SEQ ID NO: 411772 - RNA, 19 nt, Homo sapiens
uaugaucacagucguguua

SEQ ID NO: 411773 - RNA, 19 nt, Homo sapiens
gcagaagacuuugcagaac

SEQ ID NO: 411774 - RNA, 19 nt, Homo sapiens
gugaagcucuugucagaag

SEQ ID NO: 411775 - RNA, 19 nt, Homo sapiens
gaccaagagaugcuguuua

SEQ ID NO: 411776 - RNA, 19 nt, Homo sapiens
gaagaggcacaaaggaguu

SEQ ID NO: 411777 - RNA, 19 nt, Homo sapiens
cagaaacgauggaaagaac

SEQ ID NO: 411778 - RNA, 19 nt, Homo sapiens
uaaagaaacaggauucagu

SEQ ID NO: 411779 - RNA, 19 nt, Homo sapiens
caccuaauauucaugacuu

SEQ ID NO: 411780 - RNA, 19 nt, Homo sapiens
agaaagaaucgguuaaaug

SEQ ID NO: 411781 - RNA, 19 nt, Homo sapiens
uaacacaugcugccauuuc

SEQ ID NO: 411782 - RNA, 19 nt, Homo sapiens
gacagacaccuaauauuca

SEQ ID NO: 411783 - RNA, 19 nt, Homo sapiens
gaaacgauggaaagaacuu

SEQ ID NO: 411784 - RNA, 19 nt, Homo sapiens
caacagaugaccaagagau

SEQ ID NO: 411785 - RNA, 19 nt, Homo sapiens
gccaacagaugaccaagag

SEQ ID NO: 411786 - RNA, 19 nt, Homo sapiens
agacuuugcagaaccuuua

SEQ ID NO: 411787 - RNA, 19 nt, Homo sapiens
gaagaugugaagucguauu

SEQ ID NO: 411788 - RNA, 19 nt, Homo sapiens
gguuaaaugugcacaguac

SEQ ID NO: 411789 - RNA, 19 nt, Homo sapiens
ccuaacacaugcugccauu

SEQ ID NO: 411790 - RNA, 19 nt, Homo sapiens
ccauugaugugcaaagcaa

SEQ ID NO: 411791 - RNA, 19 nt, Homo sapiens
caauggaggagaacaguga

SEQ ID NO: 411792 - RNA, 19 nt, Homo sapiens
agaacaauaucucacuuuc

SEQ ID NO: 411793 - RNA, 19 nt, Homo sapiens
ccagaacaauaucucacuu

SEQ ID NO: 411794 - RNA, 19 nt, Homo sapiens
gauugacagacaccuaaua

SEQ ID NO: 411795 - RNA, 19 nt, Homo sapiens
ugccauuccuacuguauuu

SEQ ID NO: 411796 - RNA, 19 nt, Homo sapiens
uagauugccucacaguugu

SEQ ID NO: 411797 - RNA, 19 nt, Homo sapiens
acagagauguaagcccaua

SEQ ID NO: 411798 - RNA, 19 nt, Homo sapiens
uuggauguguuaaguguuu

SEQ ID NO: 411799 - RNA, 19 nt, Homo sapiens
ugcagaaccuuuaauugga

SEQ ID NO: 411800 - RNA, 19 nt, Homo sapiens
gagaaucuggcuccuugaa

SEQ ID NO: 411801 - RNA, 19 nt, Homo sapiens
ccaguuuaguugacauaga

SEQ ID NO: 411802 - RNA, 19 nt, Homo sapiens
cuagauugccucacaguug

SEQ ID NO: 411803 - RNA, 19 nt, Homo sapiens
uaaagggagauucuaguau

SEQ ID NO: 411804 - RNA, 19 nt, Homo sapiens
aagaugugaagucguauua

SEQ ID NO: 411805 - RNA, 19 nt, Homo sapiens
ucgcuaacccucuagauug

SEQ ID NO: 411806 - RNA, 19 nt, Homo sapiens
aagauacaauggaggagaa

SEQ ID NO: 411807 - RNA, 19 nt, Homo sapiens
gagauguaagcccauauga

SEQ ID NO: 411808 - RNA, 19 nt, Homo sapiens
caagauugacagacaccua

SEQ ID NO: 411809 - RNA, 19 nt, Homo sapiens
cagaacaauaucucacuuu

SEQ ID NO: 411810 - RNA, 19 nt, Homo sapiens
auaaagggagauucuagua

SEQ ID NO: 411811 - RNA, 19 nt, Homo sapiens
ccagcuucauuucucaauu

SEQ ID NO: 411812 - RNA, 19 nt, Homo sapiens
ucauagaguggccaaguuu

SEQ ID NO: 411813 - RNA, 19 nt, Homo sapiens
gcaaaaugcugagaaugau

SEQ ID NO: 411814 - RNA, 19 nt, Homo sapiens
gugcaaagcaagaccugaa

SEQ ID NO: 411815 - RNA, 19 nt, Homo sapiens
gaauauucugcagcuauaa

SEQ ID NO: 411816 - RNA, 19 nt, Homo sapiens
guacuuggaaauucgaaau

SEQ ID NO: 411817 - RNA, 19 nt, Homo sapiens
guggagaaagaaucgguua

SEQ ID NO: 411818 - RNA, 19 nt, Homo sapiens
acagacaccuaauauucau

SEQ ID NO: 411819 - RNA, 19 nt, Homo sapiens
guauaaagggagauucuag

SEQ ID NO: 411820 - RNA, 19 nt, Homo sapiens
gaaaccagaacaauaucuc

SEQ ID NO: 411821 - RNA, 19 nt, Homo sapiens
gaaaacagaaaucgaaaca

SEQ ID NO: 411822 - RNA, 19 nt, Homo sapiens
ggaacagaauaggucuaga

SEQ ID NO: 411823 - RNA, 19 nt, Homo sapiens
acagugagaggccaagauu

SEQ ID NO: 411824 - RNA, 19 nt, Homo sapiens
ggacuuuccucuaaaaugc

SEQ ID NO: 411825 - RNA, 19 nt, Homo sapiens
ugaucacagucguguuaaa

SEQ ID NO: 411826 - RNA, 19 nt, Homo sapiens
acacaggguccacuuccua

SEQ ID NO: 411827 - RNA, 19 nt, Homo sapiens
agugagaggccaagauuga

SEQ ID NO: 411828 - RNA, 19 nt, Homo sapiens
ugaccgauguacaggacuu

SEQ ID NO: 411829 - RNA, 19 nt, Homo sapiens
gaaggagcaaaauguauaa

SEQ ID NO: 411830 - RNA, 19 nt, Homo sapiens
guacagaccuuuaaaguua

SEQ ID NO: 411831 - RNA, 19 nt, Homo sapiens
guagggaucugcacaauuu

SEQ ID NO: 411832 - RNA, 19 nt, Homo sapiens
gagaaaugcuggucacaaa

SEQ ID NO: 411833 - RNA, 19 nt, Homo sapiens
cagauaaccuugcaaauga

SEQ ID NO: 411834 - RNA, 19 nt, Homo sapiens
gcaauuauggcaucauuua

SEQ ID NO: 411835 - RNA, 19 nt, Homo sapiens
gaaaagagcuucuaguaau

SEQ ID NO: 411836 - RNA, 19 nt, Homo sapiens
gaucagaaguugucacuca

SEQ ID NO: 411837 - RNA, 19 nt, Homo sapiens
gcagggaaaugaagauuau

SEQ ID NO: 411838 - RNA, 19 nt, Homo sapiens
gcaacaagauggugugguu

SEQ ID NO: 411839 - RNA, 19 nt, Homo sapiens
agaggaaccugcccauuua

SEQ ID NO: 411840 - RNA, 19 nt, Homo sapiens
gaucaaaucguguuaauca

SEQ ID NO: 411841 - RNA, 19 nt, Homo sapiens
ggaaacggaagauguauuu

SEQ ID NO: 411842 - RNA, 19 nt, Homo sapiens
auaaagaugugcugccuua

SEQ ID NO: 411843 - RNA, 19 nt, Homo sapiens
gagaggaaccugcccauuu

SEQ ID NO: 411844 - RNA, 19 nt, Homo sapiens
ggacggugcugauccaguu

SEQ ID NO: 411845 - RNA, 19 nt, Homo sapiens
ggacuggaaucaccgacua

SEQ ID NO: 411846 - RNA, 19 nt, Homo sapiens
gaagaagguuuaguccaaa

SEQ ID NO: 411847 - RNA, 19 nt, Homo sapiens
caaaugaaaugaccuacau

SEQ ID NO: 411848 - RNA, 19 nt, Homo sapiens
agacagcgauucugaaguu

SEQ ID NO: 411849 - RNA, 19 nt, Homo sapiens
ugaagaagguuuaguccaa

SEQ ID NO: 411850 - RNA, 19 nt, Homo sapiens
gcagauaaccuugcaaaug

SEQ ID NO: 411851 - RNA, 19 nt, Homo sapiens
guagauaagcaugcaauua

SEQ ID NO: 411852 - RNA, 19 nt, Homo sapiens
cauaggaacugguguagau

SEQ ID NO: 411853 - RNA, 19 nt, Homo sapiens
gugaauaccguguuaaauu

SEQ ID NO: 411854 - RNA, 19 nt, Homo sapiens
gaaaagauaucguguacau

SEQ ID NO: 411855 - RNA, 19 nt, Homo sapiens
ggaguuacccaaagagaaa

SEQ ID NO: 411856 - RNA, 19 nt, Homo sapiens
gaacugguguagauaagca

SEQ ID NO: 411857 - RNA, 19 nt, Homo sapiens
caaauuaccguugaguaua

SEQ ID NO: 411858 - RNA, 19 nt, Homo sapiens
caaguuacgugaacaugga

SEQ ID NO: 411859 - RNA, 19 nt, Homo sapiens
caaaucguguuaaucaaug

SEQ ID NO: 411860 - RNA, 19 nt, Homo sapiens
gcggacaccugcauuccua

SEQ ID NO: 411861 - RNA, 19 nt, Homo sapiens
guacuacugugacaagaau

SEQ ID NO: 411862 - RNA, 19 nt, Homo sapiens
gaaacagccaugugccuaa

SEQ ID NO: 411863 - RNA, 19 nt, Homo sapiens
caacugaagauggauauuu

SEQ ID NO: 411864 - RNA, 19 nt, Homo sapiens
gaccaaaugucaccaguac

SEQ ID NO: 411865 - RNA, 19 nt, Homo sapiens
gaacgagggcggaccaaau

SEQ ID NO: 411866 - RNA, 19 nt, Homo sapiens
aagaugugcugccuuauga

SEQ ID NO: 411867 - RNA, 19 nt, Homo sapiens
aaaccaggcacuuguauuu

SEQ ID NO: 411868 - RNA, 19 nt, Homo sapiens
cagcgagccucuccuaguu

SEQ ID NO: 411869 - RNA, 19 nt, Homo sapiens
ggacagcgagccucuccua

SEQ ID NO: 411870 - RNA, 19 nt, Homo sapiens
gaaugagucucuguaugga

SEQ ID NO: 411871 - RNA, 19 nt, Homo sapiens
aaagcuaccugacccagaa

SEQ ID NO: 411872 - RNA, 19 nt, Homo sapiens
ccaacacacugcagcaaga

SEQ ID NO: 411873 - RNA, 19 nt, Homo sapiens
ucuaagaacaccaucauuu

SEQ ID NO: 411874 - RNA, 19 nt, Homo sapiens
gggaucaaaucguguuaau

SEQ ID NO: 411875 - RNA, 19 nt, Homo sapiens
gcaaagccaucaggaagca

SEQ ID NO: 411876 - RNA, 19 nt, Homo sapiens
gcagcaagaggaaccagua

SEQ ID NO: 411877 - RNA, 19 nt, Homo sapiens
gaacacacagugacacauc

SEQ ID NO: 411878 - RNA, 19 nt, Homo sapiens
gaaaugcuggucacaaaca

SEQ ID NO: 411879 - RNA, 19 nt, Homo sapiens
acaggauuguagcaaauua

SEQ ID NO: 411880 - RNA, 19 nt, Homo sapiens
uaaagaaugagucucugua

SEQ ID NO: 411881 - RNA, 19 nt, Homo sapiens
cagaaguugucacucauug

SEQ ID NO: 411882 - RNA, 19 nt, Homo sapiens
acaaguacaucgccacuca

SEQ ID NO: 411883 - RNA, 19 nt, Homo sapiens
ugacaccacccggguauua

SEQ ID NO: 411884 - RNA, 19 nt, Homo sapiens
aaagauaucguguacauag

SEQ ID NO: 411885 - RNA, 19 nt, Homo sapiens
ugacacaucuccaguacgu

SEQ ID NO: 411886 - RNA, 19 nt, Homo sapiens
ggugacagcuacuuagucu

SEQ ID NO: 411887 - RNA, 19 nt, Homo sapiens
acaagacacuggccagguu

SEQ ID NO: 411888 - RNA, 19 nt, Homo sapiens
ugacaggauuguagcaaau

SEQ ID NO: 411889 - RNA, 19 nt, Homo sapiens
gugguuaucuugggucauu

SEQ ID NO: 411890 - RNA, 19 nt, Homo sapiens
gaucagcagcucuuagaug

SEQ ID NO: 411891 - RNA, 19 nt, Homo sapiens
ugacaagaaugauaauggu

SEQ ID NO: 411892 - RNA, 19 nt, Homo sapiens
guaauugaaccaugggaaa

SEQ ID NO: 411893 - RNA, 19 nt, Homo sapiens
cuggucaucuuguggcuua

SEQ ID NO: 411894 - RNA, 19 nt, Homo sapiens
gauaucguguacauaggaa

SEQ ID NO: 411895 - RNA, 19 nt, Homo sapiens
ugacagcuacuuagucuug

SEQ ID NO: 411896 - RNA, 19 nt, Homo sapiens
aggaaacccugacguaugu

SEQ ID NO: 411897 - RNA, 19 nt, Homo sapiens
cuaaggaaacccugacgua

SEQ ID NO: 411898 - RNA, 19 nt, Homo sapiens
gguacagaccuuuaaaguu

SEQ ID NO: 411899 - RNA, 19 nt, Homo sapiens
cuaaugccuucuucccuaa

SEQ ID NO: 411900 - RNA, 19 nt, Homo sapiens
gaaagccacgccacucuuc

SEQ ID NO: 411901 - RNA, 19 nt, Homo sapiens
caucaagccaguacaaguu

SEQ ID NO: 411902 - RNA, 19 nt, Homo sapiens
ggaccaaaugucaccagua

SEQ ID NO: 411903 - RNA, 19 nt, Homo sapiens
gugacaggauuguagcaaa

SEQ ID NO: 411904 - RNA, 19 nt, Homo sapiens
ccagcgacuuccaauauuc

SEQ ID NO: 411905 - RNA, 19 nt, Homo sapiens
gcaaagcugccucaaaauu

SEQ ID NO: 411906 - RNA, 19 nt, Homo sapiens
gcacuuagaaaccaagagu

SEQ ID NO: 411907 - RNA, 19 nt, Homo sapiens
ccaauauucauguuucuga

SEQ ID NO: 411908 - RNA, 19 nt, Homo sapiens
uaucuugggucauuuggau

SEQ ID NO: 411909 - RNA, 19 nt, Homo sapiens
ggaagaacacacagugaca

SEQ ID NO: 411910 - RNA, 19 nt, Homo sapiens
ggacugcaccaucgccuau

SEQ ID NO: 411911 - RNA, 19 nt, Homo sapiens
guugacgacucucacagaa

SEQ ID NO: 411912 - RNA, 19 nt, Homo sapiens
uugagcaacucuacagaaa

SEQ ID NO: 411913 - RNA, 19 nt, Homo sapiens
agguggagcuggaacaauu

SEQ ID NO: 411914 - RNA, 19 nt, Homo sapiens
caacaagauggugugguua

SEQ ID NO: 411915 - RNA, 19 nt, Homo sapiens
gcacuuuaaacuucuauag

SEQ ID NO: 411916 - RNA, 19 nt, Homo sapiens
guuaugaccucccgguuac

SEQ ID NO: 411917 - RNA, 19 nt, Homo sapiens
gaaguugucacucauuguc

SEQ ID NO: 411918 - RNA, 19 nt, Homo sapiens
aaaccgauauaaagaugug

SEQ ID NO: 411919 - RNA, 19 nt, Homo sapiens
caucauccaggcuaucuuu

SEQ ID NO: 411920 - RNA, 19 nt, Homo sapiens
ccucggaguuacccaaaga

SEQ ID NO: 411921 - RNA, 19 nt, Homo sapiens
gcaaaugaaaugaccuaca

SEQ ID NO: 411922 - RNA, 19 nt, Homo sapiens
gucgguaaauaaccaauau

SEQ ID NO: 411923 - RNA, 19 nt, Homo sapiens
gaacauauuguggccuuca

SEQ ID NO: 411924 - RNA, 19 nt, Homo sapiens
uaacaaaagucgaaucucu

SEQ ID NO: 411925 - RNA, 19 nt, Homo sapiens
agagaaaacucgaucagaa

SEQ ID NO: 411926 - RNA, 19 nt, Homo sapiens
gacuauaauucuuccauac

SEQ ID NO: 411927 - RNA, 19 nt, Homo sapiens
uaacucagcagugguucua

SEQ ID NO: 411928 - RNA, 19 nt, Homo sapiens
gaagaacaaaugugugcau

SEQ ID NO: 411929 - RNA, 19 nt, Homo sapiens
aagaaugagucucuguaug

SEQ ID NO: 411930 - RNA, 19 nt, Homo sapiens
gaacaaggcuccucuaugg

SEQ ID NO: 411931 - RNA, 19 nt, Homo sapiens
gcacggaaauuaauggauu

SEQ ID NO: 411932 - RNA, 19 nt, Homo sapiens
gaacaguccugacacaguu

SEQ ID NO: 411933 - RNA, 19 nt, Homo sapiens
gcaacaagaucuagaaagu

SEQ ID NO: 411934 - RNA, 19 nt, Homo sapiens
gaagaaggcuuuguuaaac

SEQ ID NO: 411935 - RNA, 19 nt, Homo sapiens
caagagggcuggcaaggaa

SEQ ID NO: 411936 - RNA, 19 nt, Homo sapiens
acagagauauuucgccuua

SEQ ID NO: 411937 - RNA, 19 nt, Homo sapiens
ggaaccaaauucauuauuc

SEQ ID NO: 411938 - RNA, 19 nt, Homo sapiens
caggaggaauucugauuua

SEQ ID NO: 411939 - RNA, 19 nt, Homo sapiens
caagguggcuggauccaaa

SEQ ID NO: 411940 - RNA, 19 nt, Homo sapiens
caggcuaccucucagauua

SEQ ID NO: 411941 - RNA, 19 nt, Homo sapiens
ugacugagcaggacuauuu

SEQ ID NO: 411942 - RNA, 19 nt, Homo sapiens
aaacacagcacguaccuua

SEQ ID NO: 411943 - RNA, 19 nt, Homo sapiens
gaagacuguuucaugcuuu

SEQ ID NO: 411944 - RNA, 19 nt, Homo sapiens
ggaggaauucugauuuaua

SEQ ID NO: 411945 - RNA, 19 nt, Homo sapiens
gaagaugccugugauugug

SEQ ID NO: 411946 - RNA, 19 nt, Homo sapiens
cgagugacuuucuagauuu

SEQ ID NO: 411947 - RNA, 19 nt, Homo sapiens
ggaagaugacccuauuuaa

SEQ ID NO: 411948 - RNA, 19 nt, Homo sapiens
gcagaugacuugggaacaa

SEQ ID NO: 411949 - RNA, 19 nt, Homo sapiens
gcaugaaucuagagaaaca

SEQ ID NO: 411950 - RNA, 19 nt, Homo sapiens
gcacguaccuuagaacucu

SEQ ID NO: 411951 - RNA, 19 nt, Homo sapiens
ugaagaaggcuuuguuaaa

SEQ ID NO: 411952 - RNA, 19 nt, Homo sapiens
ccaaacaccuagucaauac

SEQ ID NO: 411953 - RNA, 19 nt, Homo sapiens
ccacacacuuguacagauu

SEQ ID NO: 411954 - RNA, 19 nt, Homo sapiens
ggaccaaguuguacugauc

SEQ ID NO: 411955 - RNA, 19 nt, Homo sapiens
gaaguaguaagcagaaauu

SEQ ID NO: 411956 - RNA, 19 nt, Homo sapiens
gaaauuaugauuggaguga

SEQ ID NO: 411957 - RNA, 19 nt, Homo sapiens
gcugaugauuccacagaua

SEQ ID NO: 411958 - RNA, 19 nt, Homo sapiens
gaaggaaacacugccuaua

SEQ ID NO: 411959 - RNA, 19 nt, Homo sapiens
gauccaaacaaaccaauaa

SEQ ID NO: 411960 - RNA, 19 nt, Homo sapiens
ucaggaagaugacccuauu

SEQ ID NO: 411961 - RNA, 19 nt, Homo sapiens
gaacguggcagaguuaaau

SEQ ID NO: 411962 - RNA, 19 nt, Homo sapiens
ccaaauuaccucagaauau

SEQ ID NO: 411963 - RNA, 19 nt, Homo sapiens
gaccuaaugcuguauauga

SEQ ID NO: 411964 - RNA, 19 nt, Homo sapiens
caagcgaaguguuuguaaa

SEQ ID NO: 411965 - RNA, 19 nt, Homo sapiens
ugacugagcuccucuugca

SEQ ID NO: 411966 - RNA, 19 nt, Homo sapiens
ccacaggcaguucaucuua

SEQ ID NO: 411967 - RNA, 19 nt, Homo sapiens
gcgaaguguuuguaaauca

SEQ ID NO: 411968 - RNA, 19 nt, Homo sapiens
gcaaagaaaaggcaaauaa

SEQ ID NO: 411969 - RNA, 19 nt, Homo sapiens
gaaaagaauugcaugaauc

SEQ ID NO: 411970 - RNA, 19 nt, Homo sapiens
gaagaugacccuauuuaac

SEQ ID NO: 411971 - RNA, 19 nt, Homo sapiens
uauggaugcuaccaaguua

SEQ ID NO: 411972 - RNA, 19 nt, Homo sapiens
gaucagaagaugccuguga

SEQ ID NO: 411973 - RNA, 19 nt, Homo sapiens
gagaaacauuauugggauu

SEQ ID NO: 411974 - RNA, 19 nt, Homo sapiens
ggaguugaauuccacuaug

SEQ ID NO: 411975 - RNA, 19 nt, Homo sapiens
gaacaggguacgaaugaau

SEQ ID NO: 411976 - RNA, 19 nt, Homo sapiens
ggagugaugucaggaggaa

SEQ ID NO: 411977 - RNA, 19 nt, Homo sapiens
gaucagaguaacaaugaaa

SEQ ID NO: 411978 - RNA, 19 nt, Homo sapiens
ggacgcggcugugauauac

SEQ ID NO: 411979 - RNA, 19 nt, Homo sapiens
ggaagaacccguuguuguc

SEQ ID NO: 411980 - RNA, 19 nt, Homo sapiens
caaacgcugcccaggauua

SEQ ID NO: 411981 - RNA, 19 nt, Homo sapiens
guaguaagcagaaauucaa

SEQ ID NO: 411982 - RNA, 19 nt, Homo sapiens
caaacaaaccaauaaggaa

SEQ ID NO: 411983 - RNA, 19 nt, Homo sapiens
gcaggacuauuuugguuua

SEQ ID NO: 411984 - RNA, 19 nt, Homo sapiens
ggauaacacuguacaagcu

SEQ ID NO: 411985 - RNA, 19 nt, Homo sapiens
gagccagauuuccaguaua

SEQ ID NO: 411986 - RNA, 19 nt, Homo sapiens
cagguugugcuguuuauua

SEQ ID NO: 411987 - RNA, 19 nt, Homo sapiens
ucagagaucuccgucauca

SEQ ID NO: 411988 - RNA, 19 nt, Homo sapiens
gcaaauaaagacaggguau

SEQ ID NO: 411989 - RNA, 19 nt, Homo sapiens
gaccucacguuuccgauug

SEQ ID NO: 411990 - RNA, 19 nt, Homo sapiens
guaaugaccucacguuucc

SEQ ID NO: 411991 - RNA, 19 nt, Homo sapiens
ucgagugacuuucuagauu

SEQ ID NO: 411992 - RNA, 19 nt, Homo sapiens
caucgaaauucuacauuca

SEQ ID NO: 411993 - RNA, 19 nt, Homo sapiens
guggaaagcauguguagaa

SEQ ID NO: 411994 - RNA, 19 nt, Homo sapiens
gaucagguugugcuguuua

SEQ ID NO: 411995 - RNA, 19 nt, Homo sapiens
gggaggauaugaucagaag

SEQ ID NO: 411996 - RNA, 19 nt, Homo sapiens
caagaucuagaaagucaua

SEQ ID NO: 411997 - RNA, 19 nt, Homo sapiens
caagaagaauauacaaggu

SEQ ID NO: 411998 - RNA, 19 nt, Homo sapiens
ccaacaaguuacaagaaga

SEQ ID NO: 411999 - RNA, 19 nt, Homo sapiens
gggaucagaguaacaauga

SEQ ID NO: 412000 - RNA, 19 nt, Homo sapiens
ccaaacaaaccaauaagga

SEQ ID NO: 412001 - RNA, 19 nt, Homo sapiens
ucagcacuguugcacuuua

SEQ ID NO: 412002 - RNA, 19 nt, Homo sapiens
aaacugcuuucccuuaugu

SEQ ID NO: 412003 - RNA, 19 nt, Homo sapiens
uaagaacaaugagagauca

SEQ ID NO: 412004 - RNA, 19 nt, Homo sapiens
gaaacagccaugugucuca

SEQ ID NO: 412005 - RNA, 19 nt, Homo sapiens
ggaacaaggcuccucuaug

SEQ ID NO: 412006 - RNA, 19 nt, Homo sapiens
aauguccugugccaaauua

SEQ ID NO: 412007 - RNA, 19 nt, Homo sapiens
ggaaucaucaccaucacaa

SEQ ID NO: 412008 - RNA, 19 nt, Homo sapiens
caucuucaguuggucauuu

SEQ ID NO: 412009 - RNA, 19 nt, Homo sapiens
caacaaguuacaagaagaa

SEQ ID NO: 412010 - RNA, 19 nt, Homo sapiens
ucacucagauccaguacau

SEQ ID NO: 412011 - RNA, 19 nt, Homo sapiens
caucaaugcgaacuauaua

SEQ ID NO: 412012 - RNA, 19 nt, Homo sapiens
aacaagaucuagaaaguca

SEQ ID NO: 412013 - RNA, 19 nt, Homo sapiens
gacuuuguguggacaguaa

SEQ ID NO: 412014 - RNA, 19 nt, Homo sapiens
aagaggagguggagaagga

SEQ ID NO: 412015 - RNA, 19 nt, Homo sapiens
gagggaggaggaagagaua

SEQ ID NO: 412016 - RNA, 19 nt, Homo sapiens
agagauauuucgccuuaug

SEQ ID NO: 412017 - RNA, 19 nt, Homo sapiens
uauaugauguaguggaaga

SEQ ID NO: 412018 - RNA, 19 nt, Homo sapiens
gaaugaaaccugaugaaaa

SEQ ID NO: 412019 - RNA, 19 nt, Homo sapiens
cacaaacgcugcccaggau

SEQ ID NO: 412020 - RNA, 19 nt, Homo sapiens
gaaacacugccuauaucuu

SEQ ID NO: 412021 - RNA, 19 nt, Homo sapiens
cuacaucaaugcgaacuau

SEQ ID NO: 412022 - RNA, 19 nt, Homo sapiens
gagaaagccccacuagaua

SEQ ID NO: 412023 - RNA, 19 nt, Homo sapiens
gcauuguucuggaaucauc

SEQ ID NO: 412024 - RNA, 19 nt, Homo sapiens
uaauagcauuguucuggaa

SEQ ID NO: 412025 - RNA, 19 nt, Homo sapiens
uuacgaccaucuucaguug

SEQ ID NO: 412026 - RNA, 19 nt, Homo sapiens
gaacuccuaaucaucgaaa

SEQ ID NO: 412027 - RNA, 19 nt, Homo sapiens
gcccuuggcacggaaauua

SEQ ID NO: 412028 - RNA, 19 nt, Homo sapiens
ccaauaaggaagcagcuaa

SEQ ID NO: 412029 - RNA, 19 nt, Homo sapiens
caucaucucuguuauacac

SEQ ID NO: 412030 - RNA, 19 nt, Homo sapiens
ugacagagcugguggagua

SEQ ID NO: 412031 - RNA, 19 nt, Homo sapiens
gggaggaguuugagaguuu

SEQ ID NO: 412032 - RNA, 19 nt, Homo sapiens
gcaagaaccgcuacaagaa

SEQ ID NO: 412033 - RNA, 19 nt, Homo sapiens
gaacaaaugcgucccauac

SEQ ID NO: 412034 - RNA, 19 nt, Homo sapiens
ccaagggccuggacuguga

SEQ ID NO: 412035 - RNA, 19 nt, Homo sapiens
gagaaaggccggaacaaau

SEQ ID NO: 412036 - RNA, 19 nt, Homo sapiens
ugacacaaccgaauacaaa

SEQ ID NO: 412037 - RNA, 19 nt, Homo sapiens
ggauuucuaugaccuguau

SEQ ID NO: 412038 - RNA, 19 nt, Homo sapiens
gggaucaggugacccauau

SEQ ID NO: 412039 - RNA, 19 nt, Homo sapiens
ggagaaaggccggaacaaa

SEQ ID NO: 412040 - RNA, 19 nt, Homo sapiens
cuucuccucuuguaaauaa

SEQ ID NO: 412041 - RNA, 19 nt, Homo sapiens
ggacaauggagaccugauu

SEQ ID NO: 412042 - RNA, 19 nt, Homo sapiens
caacccuucuccucuugua

SEQ ID NO: 412043 - RNA, 19 nt, Homo sapiens
ggaagcauuucgcgaugga

SEQ ID NO: 412044 - RNA, 19 nt, Homo sapiens
gaacaagagggaggagaaa

SEQ ID NO: 412045 - RNA, 19 nt, Homo sapiens
gcacaggcaccaucauugu

SEQ ID NO: 412046 - RNA, 19 nt, Homo sapiens
augagaaccugcacacuaa

SEQ ID NO: 412047 - RNA, 19 nt, Homo sapiens
acaaggaggauguguauga

SEQ ID NO: 412048 - RNA, 19 nt, Homo sapiens
ggcaagaaccgcuacaaga

SEQ ID NO: 412049 - RNA, 19 nt, Homo sapiens
uaugagaaccugcacacua

SEQ ID NO: 412050 - RNA, 19 nt, Homo sapiens
gagcugcaucugaggcuua

SEQ ID NO: 412051 - RNA, 19 nt, Homo sapiens
gggagaaguuugcgacucu

SEQ ID NO: 412052 - RNA, 19 nt, Homo sapiens
gcuccgaucccacuaguga

SEQ ID NO: 412053 - RNA, 19 nt, Homo sapiens
gaucaggugacccauauuc

SEQ ID NO: 412054 - RNA, 19 nt, Homo sapiens
auacaaacuccguaccuua

SEQ ID NO: 412055 - RNA, 19 nt, Homo sapiens
ggaacaaaugcgucccaua

SEQ ID NO: 412056 - RNA, 19 nt, Homo sapiens
cuacaucaaugccaacuac

SEQ ID NO: 412057 - RNA, 19 nt, Homo sapiens
acaaaugcgucccauacug

SEQ ID NO: 412058 - RNA, 19 nt, Homo sapiens
ccaacuacaucaagaacca

SEQ ID NO: 412059 - RNA, 19 nt, Homo sapiens
ggccaacccuucuccucuu

SEQ ID NO: 412060 - RNA, 19 nt, Homo sapiens
gagcaugacacaaccgaau

SEQ ID NO: 412061 - RNA, 19 nt, Homo sapiens
gggaggagaaagugaagaa

SEQ ID NO: 412062 - RNA, 19 nt, Homo sapiens
ggccuggacugugacauug

SEQ ID NO: 412063 - RNA, 19 nt, Homo sapiens
agaaaggccggaacaaaug

SEQ ID NO: 412064 - RNA, 19 nt, Homo sapiens
gcuaggcccugaugagaac

SEQ ID NO: 412065 - RNA, 19 nt, Homo sapiens
ucaaguacccgcugaacug

SEQ ID NO: 412066 - RNA, 19 nt, Homo sapiens
aaauaaagcccugggauca

SEQ ID NO: 412067 - RNA, 19 nt, Homo sapiens
gcaagaaccagggugacuu

SEQ ID NO: 412068 - RNA, 19 nt, Homo sapiens
ggaggaguuugagaguuug

SEQ ID NO: 412069 - RNA, 19 nt, Homo sapiens
cagagcugguggaguacua

SEQ ID NO: 412070 - RNA, 19 nt, Homo sapiens
aggaggauguguaugagaa

SEQ ID NO: 412071 - RNA, 19 nt, Homo sapiens
ggagaacagccgugucauc

SEQ ID NO: 412072 - RNA, 19 nt, Homo sapiens
ucauugaaaccacuaagaa

SEQ ID NO: 412073 - RNA, 19 nt, Homo sapiens
ggccaucgcccaguucauu

SEQ ID NO: 412074 - RNA, 19 nt, Homo sapiens
gacauugacauccagaaga

SEQ ID NO: 412075 - RNA, 19 nt, Homo sapiens
gagaaccugcacacuaaga

SEQ ID NO: 412076 - RNA, 19 nt, Homo sapiens
agacggaggcgcaguacaa

SEQ ID NO: 412077 - RNA, 19 nt, Homo sapiens
gaacucaggggauuucuau

SEQ ID NO: 412078 - RNA, 19 nt, Homo sapiens
uaugggcccuacucuguga

SEQ ID NO: 412079 - RNA, 19 nt, Homo sapiens
gcaugcagcgugcuuaugg

SEQ ID NO: 412080 - RNA, 19 nt, Homo sapiens
gcaccaucauugucaucga

SEQ ID NO: 412081 - RNA, 19 nt, Homo sapiens
aagaaccgcuacaagaaca

SEQ ID NO: 412082 - RNA, 19 nt, Homo sapiens
gaaccgcuacaagaacauu

SEQ ID NO: 412083 - RNA, 19 nt, Homo sapiens
aagcaggaguccgaggaua

SEQ ID NO: 412084 - RNA, 19 nt, Homo sapiens
caaggaggauguguaugag

SEQ ID NO: 412085 - RNA, 19 nt, Homo sapiens
caagaaccagggugacuuc

SEQ ID NO: 412086 - RNA, 19 nt, Homo sapiens
gaaguuugcgacucugaca

SEQ ID NO: 412087 - RNA, 19 nt, Homo sapiens
gccaacccuucuccucuug

SEQ ID NO: 412088 - RNA, 19 nt, Homo sapiens
ccaaacacaaggaggaugu

SEQ ID NO: 412089 - RNA, 19 nt, Homo sapiens
gcaccucguccaaacacaa

SEQ ID NO: 412090 - RNA, 19 nt, Homo sapiens
gggccuggacugugacauu

SEQ ID NO: 412091 - RNA, 19 nt, Homo sapiens
agcaggaggugaagaacuu

SEQ ID NO: 412092 - RNA, 19 nt, Homo sapiens
gcuacacagugggugguuu

SEQ ID NO: 412093 - RNA, 19 nt, Homo sapiens
gcaccaucauccaccucaa

SEQ ID NO: 412094 - RNA, 19 nt, Homo sapiens
ggacugugacauugacauc

SEQ ID NO: 412095 - RNA, 19 nt, Homo sapiens
caggagaacagccguguca

SEQ ID NO: 412096 - RNA, 19 nt, Homo sapiens
ggucagcagacaaggagaa

SEQ ID NO: 412097 - RNA, 19 nt, Homo sapiens
uucgggagaucuggcauua

SEQ ID NO: 412098 - RNA, 19 nt, Homo sapiens
gacaauggagaccugauuc

SEQ ID NO: 412099 - RNA, 19 nt, Homo sapiens
agaagcaggaggugaagaa

SEQ ID NO: 412100 - RNA, 19 nt, Homo sapiens
aggagaaagugaagaagca

SEQ ID NO: 412101 - RNA, 19 nt, Homo sapiens
ugaaaccacuaagaagaag

SEQ ID NO: 412102 - RNA, 19 nt, Homo sapiens
cggaggcgcaguacaaguu

SEQ ID NO: 412103 - RNA, 19 nt, Homo sapiens
gcccugaugagaacgcuaa

SEQ ID NO: 412104 - RNA, 19 nt, Homo sapiens
caagagggaggagaaagug

SEQ ID NO: 412105 - RNA, 19 nt, Homo sapiens
gcaguacaaguucaucuac

SEQ ID NO: 412106 - RNA, 19 nt, Homo sapiens
gagaaguuugcgacucuga

SEQ ID NO: 412107 - RNA, 19 nt, Homo sapiens
aauacaaacuccguaccuu

SEQ ID NO: 412108 - RNA, 19 nt, Homo sapiens
gaaaggccggaacaaaugc

SEQ ID NO: 412109 - RNA, 19 nt, Homo sapiens
caucaaugccaacuacauc

SEQ ID NO: 412110 - RNA, 19 nt, Homo sapiens
gacagacucacaaccugaa

SEQ ID NO: 412111 - RNA, 19 nt, Homo sapiens
uagcugcaccuccucauuc

SEQ ID NO: 412112 - RNA, 19 nt, Homo sapiens
guacgggaacaucaccuau

SEQ ID NO: 412113 - RNA, 19 nt, Homo sapiens
cccgagagguggagaaagg

SEQ ID NO: 412114 - RNA, 19 nt, Homo sapiens
caagaaccgcuacaagaac

SEQ ID NO: 412115 - RNA, 19 nt, Homo sapiens
gaaccgaguguuggaacug

SEQ ID NO: 412116 - RNA, 19 nt, Homo sapiens
gcgauggacagacucacaa

SEQ ID NO: 412117 - RNA, 19 nt, Homo sapiens
caaacuccguaccuuacag

SEQ ID NO: 412118 - RNA, 19 nt, Homo sapiens
gaauacaaacuccguaccu

SEQ ID NO: 412119 - RNA, 19 nt, Homo sapiens
gaagcaggaguccgaggau

SEQ ID NO: 412120 - RNA, 19 nt, Homo sapiens
agaacaagagggaggagaa

SEQ ID NO: 412121 - RNA, 19 nt, Homo sapiens
ccgcacaggcaccaucauu

SEQ ID NO: 412122 - RNA, 19 nt, Homo sapiens
gggcaagaaccgcuacaag

SEQ ID NO: 412123 - RNA, 19 nt, Homo sapiens
gcaggaguccgaggauaca

SEQ ID NO: 412124 - RNA, 19 nt, Homo sapiens
ccaggauggugaggugguu

SEQ ID NO: 412125 - RNA, 19 nt, Homo sapiens
uugaaaccacuaagaagaa

SEQ ID NO: 412126 - RNA, 19 nt, Homo sapiens
caucaagaaccagcugcua

SEQ ID NO: 412127 - RNA, 19 nt, Homo sapiens
caucauccaccucaaguac

SEQ ID NO: 412128 - RNA, 19 nt, Homo sapiens
gggcaugcagcgugcuuau

SEQ ID NO: 412129 - RNA, 19 nt, Homo sapiens
cagcagacaaggagaagag

SEQ ID NO: 412130 - RNA, 19 nt, Homo sapiens
ggaaguggcugauuacuga

SEQ ID NO: 412131 - RNA, 19 nt, Homo sapiens
ugacagagcugguggagua

SEQ ID NO: 412132 - RNA, 19 nt, Homo sapiens
gggaggaguuugagaguuu

SEQ ID NO: 412133 - RNA, 19 nt, Homo sapiens
gcaagaaccgcuacaagaa

SEQ ID NO: 412134 - RNA, 19 nt, Homo sapiens
gaacaaaugcgucccauac

SEQ ID NO: 412135 - RNA, 19 nt, Homo sapiens
ccaagggccuggacuguga

SEQ ID NO: 412136 - RNA, 19 nt, Homo sapiens
gagaaaggccggaacaaau

SEQ ID NO: 412137 - RNA, 19 nt, Homo sapiens
ugacacaaccgaauacaaa

SEQ ID NO: 412138 - RNA, 19 nt, Homo sapiens
ggauuucuaugaccuguau

SEQ ID NO: 412139 - RNA, 19 nt, Homo sapiens
gggaucaggugacccauau

SEQ ID NO: 412140 - RNA, 19 nt, Homo sapiens
ggagaaaggccggaacaaa

SEQ ID NO: 412141 - RNA, 19 nt, Homo sapiens
aggaggaaguggcugauua

SEQ ID NO: 412142 - RNA, 19 nt, Homo sapiens
cuucuccucuuguaaauaa

SEQ ID NO: 412143 - RNA, 19 nt, Homo sapiens
ggacaauggagaccugauu

SEQ ID NO: 412144 - RNA, 19 nt, Homo sapiens
caacccuucuccucuugua

SEQ ID NO: 412145 - RNA, 19 nt, Homo sapiens
ggaagcauuucgcgaugga

SEQ ID NO: 412146 - RNA, 19 nt, Homo sapiens
gaacaagagggaggagaaa

SEQ ID NO: 412147 - RNA, 19 nt, Homo sapiens
gcacaggcaccaucauugu

SEQ ID NO: 412148 - RNA, 19 nt, Homo sapiens
augagaaccugcacacuaa

SEQ ID NO: 412149 - RNA, 19 nt, Homo sapiens
acaaggaggauguguauga

SEQ ID NO: 412150 - RNA, 19 nt, Homo sapiens
ggcaagaaccgcuacaaga

SEQ ID NO: 412151 - RNA, 19 nt, Homo sapiens
uaugagaaccugcacacua

SEQ ID NO: 412152 - RNA, 19 nt, Homo sapiens
gggagaaguuugcgacucu

SEQ ID NO: 412153 - RNA, 19 nt, Homo sapiens
gcuccgaucccacuaguga

SEQ ID NO: 412154 - RNA, 19 nt, Homo sapiens
gaucaggugacccauauuc

SEQ ID NO: 412155 - RNA, 19 nt, Homo sapiens
auacaaacuccguaccuua

SEQ ID NO: 412156 - RNA, 19 nt, Homo sapiens
ggaacaaaugcgucccaua

SEQ ID NO: 412157 - RNA, 19 nt, Homo sapiens
cuacaucaaugccaacuac

SEQ ID NO: 412158 - RNA, 19 nt, Homo sapiens
acaaaugcgucccauacug

SEQ ID NO: 412159 - RNA, 19 nt, Homo sapiens
ccaacuacaucaagaacca

SEQ ID NO: 412160 - RNA, 19 nt, Homo sapiens
ggccaacccuucuccucuu

SEQ ID NO: 412161 - RNA, 19 nt, Homo sapiens
gagcaugacacaaccgaau

SEQ ID NO: 412162 - RNA, 19 nt, Homo sapiens
gggaggagaaagugaagaa

SEQ ID NO: 412163 - RNA, 19 nt, Homo sapiens
ggccuggacugugacauug

SEQ ID NO: 412164 - RNA, 19 nt, Homo sapiens
agaaaggccggaacaaaug

SEQ ID NO: 412165 - RNA, 19 nt, Homo sapiens
gcuaggcccugaugagaac

SEQ ID NO: 412166 - RNA, 19 nt, Homo sapiens
ucaaguacccgcugaacug

SEQ ID NO: 412167 - RNA, 19 nt, Homo sapiens
aaauaaagcccugggauca

SEQ ID NO: 412168 - RNA, 19 nt, Homo sapiens
gcaagaaccagggugacuu

SEQ ID NO: 412169 - RNA, 19 nt, Homo sapiens
ggaggaguuugagaguuug

SEQ ID NO: 412170 - RNA, 19 nt, Homo sapiens
cagagcugguggaguacua

SEQ ID NO: 412171 - RNA, 19 nt, Homo sapiens
aggaggauguguaugagaa

SEQ ID NO: 412172 - RNA, 19 nt, Homo sapiens
ggagaacagccgugucauc

SEQ ID NO: 412173 - RNA, 19 nt, Homo sapiens
ucauugaaaccacuaagaa

SEQ ID NO: 412174 - RNA, 19 nt, Homo sapiens
ggccaucgcccaguucauu

SEQ ID NO: 412175 - RNA, 19 nt, Homo sapiens
gacauugacauccagaaga

SEQ ID NO: 412176 - RNA, 19 nt, Homo sapiens
gagaaccugcacacuaaga

SEQ ID NO: 412177 - RNA, 19 nt, Homo sapiens
agacggaggcgcaguacaa

SEQ ID NO: 412178 - RNA, 19 nt, Homo sapiens
uaugggcccuacucuguga

SEQ ID NO: 412179 - RNA, 19 nt, Homo sapiens
gaacucaggggauuucuau

SEQ ID NO: 412180 - RNA, 19 nt, Homo sapiens
gcaugcagcgugcuuaugg

SEQ ID NO: 412181 - RNA, 19 nt, Homo sapiens
gcaccaucauugucaucga

SEQ ID NO: 412182 - RNA, 19 nt, Homo sapiens
aagaaccgcuacaagaaca

SEQ ID NO: 412183 - RNA, 19 nt, Homo sapiens
gaaccgcuacaagaacauu

SEQ ID NO: 412184 - RNA, 19 nt, Homo sapiens
aagcaggaguccgaggaua

SEQ ID NO: 412185 - RNA, 19 nt, Homo sapiens
caaggaggauguguaugag

SEQ ID NO: 412186 - RNA, 19 nt, Homo sapiens
caagaaccagggugacuuc

SEQ ID NO: 412187 - RNA, 19 nt, Homo sapiens
gaaguuugcgacucugaca

SEQ ID NO: 412188 - RNA, 19 nt, Homo sapiens
gccaacccuucuccucuug

SEQ ID NO: 412189 - RNA, 19 nt, Homo sapiens
ccaaacacaaggaggaugu

SEQ ID NO: 412190 - RNA, 19 nt, Homo sapiens
gcaccucguccaaacacaa

SEQ ID NO: 412191 - RNA, 19 nt, Homo sapiens
gggccuggacugugacauu

SEQ ID NO: 412192 - RNA, 19 nt, Homo sapiens
agcaggaggugaagaacuu

SEQ ID NO: 412193 - RNA, 19 nt, Homo sapiens
gcuacacagugggugguuu

SEQ ID NO: 412194 - RNA, 19 nt, Homo sapiens
gcaccaucauccaccucaa

SEQ ID NO: 412195 - RNA, 19 nt, Homo sapiens
ggacugugacauugacauc

SEQ ID NO: 412196 - RNA, 19 nt, Homo sapiens
ggaggaaguggcugauuac

SEQ ID NO: 412197 - RNA, 19 nt, Homo sapiens
caggagaacagccguguca

SEQ ID NO: 412198 - RNA, 19 nt, Homo sapiens
ggucagcagacaaggagaa

SEQ ID NO: 412199 - RNA, 19 nt, Homo sapiens
uucgggagaucuggcauua

SEQ ID NO: 412200 - RNA, 19 nt, Homo sapiens
gacaauggagaccugauuc

SEQ ID NO: 412201 - RNA, 19 nt, Homo sapiens
agaagcaggaggugaagaa

SEQ ID NO: 412202 - RNA, 19 nt, Homo sapiens
aggagaaagugaagaagca

SEQ ID NO: 412203 - RNA, 19 nt, Homo sapiens
ugaaaccacuaagaagaag

SEQ ID NO: 412204 - RNA, 19 nt, Homo sapiens
cggaggcgcaguacaaguu

SEQ ID NO: 412205 - RNA, 19 nt, Homo sapiens
gcccugaugagaacgcuaa

SEQ ID NO: 412206 - RNA, 19 nt, Homo sapiens
caagagggaggagaaagug

SEQ ID NO: 412207 - RNA, 19 nt, Homo sapiens
gcaguacaaguucaucuac

SEQ ID NO: 412208 - RNA, 19 nt, Homo sapiens
gagaaguuugcgacucuga

SEQ ID NO: 412209 - RNA, 19 nt, Homo sapiens
aauacaaacuccguaccuu

SEQ ID NO: 412210 - RNA, 19 nt, Homo sapiens
gaaaggccggaacaaaugc

SEQ ID NO: 412211 - RNA, 19 nt, Homo sapiens
caucaaugccaacuacauc

SEQ ID NO: 412212 - RNA, 19 nt, Homo sapiens
gacagacucacaaccugaa

SEQ ID NO: 412213 - RNA, 19 nt, Homo sapiens
guacgggaacaucaccuau

SEQ ID NO: 412214 - RNA, 19 nt, Homo sapiens
cccgagagguggagaaagg

SEQ ID NO: 412215 - RNA, 19 nt, Homo sapiens
caagaaccgcuacaagaac

SEQ ID NO: 412216 - RNA, 19 nt, Homo sapiens
gaaccgaguguuggaacug

SEQ ID NO: 412217 - RNA, 19 nt, Homo sapiens
gcgauggacagacucacaa

SEQ ID NO: 412218 - RNA, 19 nt, Homo sapiens
caaacuccguaccuuacag

SEQ ID NO: 412219 - RNA, 19 nt, Homo sapiens
gaauacaaacuccguaccu

SEQ ID NO: 412220 - RNA, 19 nt, Homo sapiens
gaagcaggaguccgaggau

SEQ ID NO: 412221 - RNA, 19 nt, Homo sapiens
agaacaagagggaggagaa

SEQ ID NO: 412222 - RNA, 19 nt, Homo sapiens
ccgcacaggcaccaucauu

SEQ ID NO: 412223 - RNA, 19 nt, Homo sapiens
gggcaagaaccgcuacaag

SEQ ID NO: 412224 - RNA, 19 nt, Homo sapiens
gcaggaguccgaggauaca

SEQ ID NO: 412225 - RNA, 19 nt, Homo sapiens
uugaaaccacuaagaagaa

SEQ ID NO: 412226 - RNA, 19 nt, Homo sapiens
caucaagaaccagcugcua

SEQ ID NO: 412227 - RNA, 19 nt, Homo sapiens
caucauccaccucaaguac

SEQ ID NO: 412228 - RNA, 19 nt, Homo sapiens
gggcaugcagcgugcuuau

SEQ ID NO: 412229 - RNA, 19 nt, Homo sapiens
cagcagacaaggagaagag

SEQ ID NO: 412230 - RNA, 19 nt, Homo sapiens
ugacagagcugguggagua

SEQ ID NO: 412231 - RNA, 19 nt, Homo sapiens
gggaggaguuugagaguuu

SEQ ID NO: 412232 - RNA, 19 nt, Homo sapiens
gcaagaaccgcuacaagaa

SEQ ID NO: 412233 - RNA, 19 nt, Homo sapiens
gaacaaaugcgucccauac

SEQ ID NO: 412234 - RNA, 19 nt, Homo sapiens
ccaagggccuggacuguga

SEQ ID NO: 412235 - RNA, 19 nt, Homo sapiens
gagaaaggccggaacaaau

SEQ ID NO: 412236 - RNA, 19 nt, Homo sapiens
ugacacaaccgaauacaaa

SEQ ID NO: 412237 - RNA, 19 nt, Homo sapiens
ggauuucuaugaccuguau

SEQ ID NO: 412238 - RNA, 19 nt, Homo sapiens
gggaucaggugacccauau

SEQ ID NO: 412239 - RNA, 19 nt, Homo sapiens
ggagaaaggccggaacaaa

SEQ ID NO: 412240 - RNA, 19 nt, Homo sapiens
cuucuccucuuguaaauaa

SEQ ID NO: 412241 - RNA, 19 nt, Homo sapiens
ggacaauggagaccugauu

SEQ ID NO: 412242 - RNA, 19 nt, Homo sapiens
caacccuucuccucuugua

SEQ ID NO: 412243 - RNA, 19 nt, Homo sapiens
ggaagcauuucgcgaugga

SEQ ID NO: 412244 - RNA, 19 nt, Homo sapiens
gaacaagagggaggagaaa

SEQ ID NO: 412245 - RNA, 19 nt, Homo sapiens
gcacaggcaccaucauugu

SEQ ID NO: 412246 - RNA, 19 nt, Homo sapiens
augagaaccugcacacuaa

SEQ ID NO: 412247 - RNA, 19 nt, Homo sapiens
acaaggaggauguguauga

SEQ ID NO: 412248 - RNA, 19 nt, Homo sapiens
ggcaagaaccgcuacaaga

SEQ ID NO: 412249 - RNA, 19 nt, Homo sapiens
uaugagaaccugcacacua

SEQ ID NO: 412250 - RNA, 19 nt, Homo sapiens
gagcugcaucugaggcuua

SEQ ID NO: 412251 - RNA, 19 nt, Homo sapiens
gggagaaguuugcgacucu

SEQ ID NO: 412252 - RNA, 19 nt, Homo sapiens
gcuccgaucccacuaguga

SEQ ID NO: 412253 - RNA, 19 nt, Homo sapiens
gaucaggugacccauauuc

SEQ ID NO: 412254 - RNA, 19 nt, Homo sapiens
auacaaacuccguaccuua

SEQ ID NO: 412255 - RNA, 19 nt, Homo sapiens
ggaacaaaugcgucccaua

SEQ ID NO: 412256 - RNA, 19 nt, Homo sapiens
cuacaucaaugccaacuac

SEQ ID NO: 412257 - RNA, 19 nt, Homo sapiens
acaaaugcgucccauacug

SEQ ID NO: 412258 - RNA, 19 nt, Homo sapiens
ccaacuacaucaagaacca

SEQ ID NO: 412259 - RNA, 19 nt, Homo sapiens
ggccaacccuucuccucuu

SEQ ID NO: 412260 - RNA, 19 nt, Homo sapiens
gagcaugacacaaccgaau

SEQ ID NO: 412261 - RNA, 19 nt, Homo sapiens
gggaggagaaagugaagaa

SEQ ID NO: 412262 - RNA, 19 nt, Homo sapiens
ggccuggacugugacauug

SEQ ID NO: 412263 - RNA, 19 nt, Homo sapiens
agaaaggccggaacaaaug

SEQ ID NO: 412264 - RNA, 19 nt, Homo sapiens
gcuaggcccugaugagaac

SEQ ID NO: 412265 - RNA, 19 nt, Homo sapiens
ucaaguacccgcugaacug

SEQ ID NO: 412266 - RNA, 19 nt, Homo sapiens
aaauaaagcccugggauca

SEQ ID NO: 412267 - RNA, 19 nt, Homo sapiens
gcaagaaccagggugacuu

SEQ ID NO: 412268 - RNA, 19 nt, Homo sapiens
ggaggaguuugagaguuug

SEQ ID NO: 412269 - RNA, 19 nt, Homo sapiens
cagagcugguggaguacua

SEQ ID NO: 412270 - RNA, 19 nt, Homo sapiens
aggaggauguguaugagaa

SEQ ID NO: 412271 - RNA, 19 nt, Homo sapiens
ggagaacagccgugucauc

SEQ ID NO: 412272 - RNA, 19 nt, Homo sapiens
ucauugaaaccacuaagaa

SEQ ID NO: 412273 - RNA, 19 nt, Homo sapiens
ggccaucgcccaguucauu

SEQ ID NO: 412274 - RNA, 19 nt, Homo sapiens
gacauugacauccagaaga

SEQ ID NO: 412275 - RNA, 19 nt, Homo sapiens
gagaaccugcacacuaaga

SEQ ID NO: 412276 - RNA, 19 nt, Homo sapiens
gcagacacaaggaggaugu

SEQ ID NO: 412277 - RNA, 19 nt, Homo sapiens
gaacucaggggauuucuau

SEQ ID NO: 412278 - RNA, 19 nt, Homo sapiens
agacggaggcgcaguacaa

SEQ ID NO: 412279 - RNA, 19 nt, Homo sapiens
uaugggcccuacucuguga

SEQ ID NO: 412280 - RNA, 19 nt, Homo sapiens
gcaugcagcgugcuuaugg

SEQ ID NO: 412281 - RNA, 19 nt, Homo sapiens
gcaccaucauugucaucga

SEQ ID NO: 412282 - RNA, 19 nt, Homo sapiens
aagaaccgcuacaagaaca

SEQ ID NO: 412283 - RNA, 19 nt, Homo sapiens
gaaccgcuacaagaacauu

SEQ ID NO: 412284 - RNA, 19 nt, Homo sapiens
aagcaggaguccgaggaua

SEQ ID NO: 412285 - RNA, 19 nt, Homo sapiens
caaggaggauguguaugag

SEQ ID NO: 412286 - RNA, 19 nt, Homo sapiens
caagaaccagggugacuuc

SEQ ID NO: 412287 - RNA, 19 nt, Homo sapiens
gaaguuugcgacucugaca

SEQ ID NO: 412288 - RNA, 19 nt, Homo sapiens
gccaacccuucuccucuug

SEQ ID NO: 412289 - RNA, 19 nt, Homo sapiens
gggccuggacugugacauu

SEQ ID NO: 412290 - RNA, 19 nt, Homo sapiens
agcaggaggugaagaacuu

SEQ ID NO: 412291 - RNA, 19 nt, Homo sapiens
gcuacacagugggugguuu

SEQ ID NO: 412292 - RNA, 19 nt, Homo sapiens
gcaccaucauccaccucaa

SEQ ID NO: 412293 - RNA, 19 nt, Homo sapiens
ggacugugacauugacauc

SEQ ID NO: 412294 - RNA, 19 nt, Homo sapiens
caggagaacagccguguca

SEQ ID NO: 412295 - RNA, 19 nt, Homo sapiens
ggucagcagacaaggagaa

SEQ ID NO: 412296 - RNA, 19 nt, Homo sapiens
gcaccaacugccuguacuu

SEQ ID NO: 412297 - RNA, 19 nt, Homo sapiens
uucgggagaucuggcauua

SEQ ID NO: 412298 - RNA, 19 nt, Homo sapiens
gacaauggagaccugauuc

SEQ ID NO: 412299 - RNA, 19 nt, Homo sapiens
agaagcaggaggugaagaa

SEQ ID NO: 412300 - RNA, 19 nt, Homo sapiens
aggagaaagugaagaagca

SEQ ID NO: 412301 - RNA, 19 nt, Homo sapiens
ugaaaccacuaagaagaag

SEQ ID NO: 412302 - RNA, 19 nt, Homo sapiens
cggaggcgcaguacaaguu

SEQ ID NO: 412303 - RNA, 19 nt, Homo sapiens
gcccugaugagaacgcuaa

SEQ ID NO: 412304 - RNA, 19 nt, Homo sapiens
caagagggaggagaaagug

SEQ ID NO: 412305 - RNA, 19 nt, Homo sapiens
gcaccucguccaagagcuu

SEQ ID NO: 412306 - RNA, 19 nt, Homo sapiens
gcaguacaaguucaucuac

SEQ ID NO: 412307 - RNA, 19 nt, Homo sapiens
gagaaguuugcgacucuga

SEQ ID NO: 412308 - RNA, 19 nt, Homo sapiens
aauacaaacuccguaccuu

SEQ ID NO: 412309 - RNA, 19 nt, Homo sapiens
gaaaggccggaacaaaugc

SEQ ID NO: 412310 - RNA, 19 nt, Homo sapiens
caucaaugccaacuacauc

SEQ ID NO: 412311 - RNA, 19 nt, Homo sapiens
gacagacucacaaccugaa

SEQ ID NO: 412312 - RNA, 19 nt, Homo sapiens
uagcugcaccuccucauuc

SEQ ID NO: 412313 - RNA, 19 nt, Homo sapiens
guacgggaacaucaccuau

SEQ ID NO: 412314 - RNA, 19 nt, Homo sapiens
cccgagagguggagaaagg

SEQ ID NO: 412315 - RNA, 19 nt, Homo sapiens
caagaaccgcuacaagaac

SEQ ID NO: 412316 - RNA, 19 nt, Homo sapiens
gaaccgaguguuggaacug

SEQ ID NO: 412317 - RNA, 19 nt, Homo sapiens
gcgauggacagacucacaa

SEQ ID NO: 412318 - RNA, 19 nt, Homo sapiens
caaacuccguaccuuacag

SEQ ID NO: 412319 - RNA, 19 nt, Homo sapiens
gaauacaaacuccguaccu

SEQ ID NO: 412320 - RNA, 19 nt, Homo sapiens
gaagcaggaguccgaggau

SEQ ID NO: 412321 - RNA, 19 nt, Homo sapiens
agaacaagagggaggagaa

SEQ ID NO: 412322 - RNA, 19 nt, Homo sapiens
ccgcacaggcaccaucauu

SEQ ID NO: 412323 - RNA, 19 nt, Homo sapiens
gggcaagaaccgcuacaag

SEQ ID NO: 412324 - RNA, 19 nt, Homo sapiens
gcaggaguccgaggauaca

SEQ ID NO: 412325 - RNA, 19 nt, Homo sapiens
ccaggauggugaggugguu

SEQ ID NO: 412326 - RNA, 19 nt, Homo sapiens
uugaaaccacuaagaagaa

SEQ ID NO: 412327 - RNA, 19 nt, Homo sapiens
caucauccaccucaaguac

SEQ ID NO: 412328 - RNA, 19 nt, Homo sapiens
caucaagaaccagcugcua

SEQ ID NO: 412329 - RNA, 19 nt, Homo sapiens
ucccgcaccucguccaaga

SEQ ID NO: 412330 - RNA, 19 nt, Homo sapiens
ggacggagauuacaucaau

SEQ ID NO: 412331 - RNA, 19 nt, Homo sapiens
gaacccaucugcucuguga

SEQ ID NO: 412332 - RNA, 19 nt, Homo sapiens
gacaggagcuggcauuuau

SEQ ID NO: 412333 - RNA, 19 nt, Homo sapiens
cuagagagcuuggcuguuu

SEQ ID NO: 412334 - RNA, 19 nt, Homo sapiens
caaugucucucugaacuua

SEQ ID NO: 412335 - RNA, 19 nt, Homo sapiens
ccugacagcugccuugaua

SEQ ID NO: 412336 - RNA, 19 nt, Homo sapiens
ggagaaauguguccacuac

SEQ ID NO: 412337 - RNA, 19 nt, Homo sapiens
uuccauggcucaaauaaua

SEQ ID NO: 412338 - RNA, 19 nt, Homo sapiens
ucaguuuccuguucuauaa

SEQ ID NO: 412339 - RNA, 19 nt, Homo sapiens
ccaagcaacuggaagaaga

SEQ ID NO: 412340 - RNA, 19 nt, Homo sapiens
ggaggucacccuacacuuu

SEQ ID NO: 412341 - RNA, 19 nt, Homo sapiens
gcacagccguugaccuugu

SEQ ID NO: 412342 - RNA, 19 nt, Homo sapiens
gaggaugauuucccuaaug

SEQ ID NO: 412343 - RNA, 19 nt, Homo sapiens
gaacaaggacucugguuac

SEQ ID NO: 412344 - RNA, 19 nt, Homo sapiens
ugaaagagugcccagaaua

SEQ ID NO: 412345 - RNA, 19 nt, Homo sapiens
gcugaaagcccgaggagaa

SEQ ID NO: 412346 - RNA, 19 nt, Homo sapiens
gaagaacacgcagugcuaa

SEQ ID NO: 412347 - RNA, 19 nt, Homo sapiens
gagcacagccguugaccuu

SEQ ID NO: 412348 - RNA, 19 nt, Homo sapiens
gcacaggccagaugcaaga

SEQ ID NO: 412349 - RNA, 19 nt, Homo sapiens
gaaagugggccgagugauc

SEQ ID NO: 412350 - RNA, 19 nt, Homo sapiens
gaaagagugcccagaauac

SEQ ID NO: 412351 - RNA, 19 nt, Homo sapiens
gguacaagcuccagaacag

SEQ ID NO: 412352 - RNA, 19 nt, Homo sapiens
ccacccaugugucauaaga

SEQ ID NO: 412353 - RNA, 19 nt, Homo sapiens
gaaggagaaggucuacauu

SEQ ID NO: 412354 - RNA, 19 nt, Homo sapiens
gagacuggcugcccauucu

SEQ ID NO: 412355 - RNA, 19 nt, Homo sapiens
ggaaggagaaggucuacau

SEQ ID NO: 412356 - RNA, 19 nt, Homo sapiens
gcaacuggaagaagaauuc

SEQ ID NO: 412357 - RNA, 19 nt, Homo sapiens
ccacagaagaggaaaccua

SEQ ID NO: 412358 - RNA, 19 nt, Homo sapiens
gaagugucccucauuguca

SEQ ID NO: 412359 - RNA, 19 nt, Homo sapiens
ggaagcagcagcaguaagg

SEQ ID NO: 412360 - RNA, 19 nt, Homo sapiens
agaaauguguccacuacug

SEQ ID NO: 412361 - RNA, 19 nt, Homo sapiens
ccagaacaguaaccaagug

SEQ ID NO: 412362 - RNA, 19 nt, Homo sapiens
ggaagugucccucauuguc

SEQ ID NO: 412363 - RNA, 19 nt, Homo sapiens
gaguacaccuagagagcuu

SEQ ID NO: 412364 - RNA, 19 nt, Homo sapiens
agaacaaggacucugguua

SEQ ID NO: 412365 - RNA, 19 nt, Homo sapiens
acaggaagcagcagcagua

SEQ ID NO: 412366 - RNA, 19 nt, Homo sapiens
ugaagaacacgcagugcua

SEQ ID NO: 412367 - RNA, 19 nt, Homo sapiens
ggaaaagucugguccugau

SEQ ID NO: 412368 - RNA, 19 nt, Homo sapiens
cggcagagcaguaccaguu

SEQ ID NO: 412369 - RNA, 19 nt, Homo sapiens
uuacaucaaugccaacuac

SEQ ID NO: 412370 - RNA, 19 nt, Homo sapiens
agacaggagcuggcauuua

SEQ ID NO: 412371 - RNA, 19 nt, Homo sapiens
gaugauuucccuaaugcuu

SEQ ID NO: 412372 - RNA, 19 nt, Homo sapiens
gcuaagcagucucuguuuu

SEQ ID NO: 412373 - RNA, 19 nt, Homo sapiens
gcaguugaaaucucuggaa

SEQ ID NO: 412374 - RNA, 19 nt, Homo sapiens
caugaaagagugcccagaa

SEQ ID NO: 412375 - RNA, 19 nt, Homo sapiens
ggaguuggaucuggagaac

SEQ ID NO: 412376 - RNA, 19 nt, Homo sapiens
ggucauaaccauccaugca

SEQ ID NO: 412377 - RNA, 19 nt, Homo sapiens
gccaggaggacggagauua

SEQ ID NO: 412378 - RNA, 19 nt, Homo sapiens
ggagcuggcauuuaugaca

SEQ ID NO: 412379 - RNA, 19 nt, Homo sapiens
gaacgccacaccucaggau

SEQ ID NO: 412380 - RNA, 19 nt, Homo sapiens
gcaggacccacuauaccuu

SEQ ID NO: 412381 - RNA, 19 nt, Homo sapiens
aaagggugauuccaagauc

SEQ ID NO: 412382 - RNA, 19 nt, Homo sapiens
gagagggcaaggagaaaug

SEQ ID NO: 412383 - RNA, 19 nt, Homo sapiens
guaaccaagugggaaaaua

SEQ ID NO: 412384 - RNA, 19 nt, Homo sapiens
gagaggcacgacugucuau

SEQ ID NO: 412385 - RNA, 19 nt, Homo sapiens
gaggucacccuacacuuuc

SEQ ID NO: 412386 - RNA, 19 nt, Homo sapiens
uaccagcucucuguggaaa

SEQ ID NO: 412387 - RNA, 19 nt, Homo sapiens
caucucagcaucaacacaa

SEQ ID NO: 412388 - RNA, 19 nt, Homo sapiens
uaugacagacaaagaaaga

SEQ ID NO: 412389 - RNA, 19 nt, Homo sapiens
gaaagcccgaggagaagug

SEQ ID NO: 412390 - RNA, 19 nt, Homo sapiens
caggccagaugcaagaaug

SEQ ID NO: 412391 - RNA, 19 nt, Homo sapiens
gcuaugacgggaaggagaa

SEQ ID NO: 412392 - RNA, 19 nt, Homo sapiens
ggaggacggagauuacauc

SEQ ID NO: 412393 - RNA, 19 nt, Homo sapiens
gcuccaauguggcucugau

SEQ ID NO: 412394 - RNA, 19 nt, Homo sapiens
uacaagcuccagaacagua

SEQ ID NO: 412395 - RNA, 19 nt, Homo sapiens
gaggguacaagcuccagaa

SEQ ID NO: 412396 - RNA, 19 nt, Homo sapiens
ugaggaugauuucccuaau

SEQ ID NO: 412397 - RNA, 19 nt, Homo sapiens
agacagaccgacagacaga

SEQ ID NO: 412398 - RNA, 19 nt, Homo sapiens
cacuauaccuugcauuugc

SEQ ID NO: 412399 - RNA, 19 nt, Homo sapiens
guaugcaggacccacuaua

SEQ ID NO: 412400 - RNA, 19 nt, Homo sapiens
ucugagacacucuuuguga

SEQ ID NO: 412401 - RNA, 19 nt, Homo sapiens
caggagcuggcauuuauga

SEQ ID NO: 412402 - RNA, 19 nt, Homo sapiens
aaagacagaccgacagaca

SEQ ID NO: 412403 - RNA, 19 nt, Homo sapiens
gggaaagugggccgaguga

SEQ ID NO: 412404 - RNA, 19 nt, Homo sapiens
caacuacauccgaggcuau

SEQ ID NO: 412405 - RNA, 19 nt, Homo sapiens
aaagacaggagcuggcauu

SEQ ID NO: 412406 - RNA, 19 nt, Homo sapiens
ccuccaaugucucucugaa

SEQ ID NO: 412407 - RNA, 19 nt, Homo sapiens
cagaagaggaaaccuaugg

SEQ ID NO: 412408 - RNA, 19 nt, Homo sapiens
caaucagggucauaaccau

SEQ ID NO: 412409 - RNA, 19 nt, Homo sapiens
ucaaagacagaccgacaga

SEQ ID NO: 412410 - RNA, 19 nt, Homo sapiens
ccacuauaccuugcauuug

SEQ ID NO: 412411 - RNA, 19 nt, Homo sapiens
gaaggugggucuggggaaa

SEQ ID NO: 412412 - RNA, 19 nt, Homo sapiens
gcauccaggacaugaaaga

SEQ ID NO: 412413 - RNA, 19 nt, Homo sapiens
gggagaugguguggcaaga

SEQ ID NO: 412414 - RNA, 19 nt, Homo sapiens
caagcaacuggaagaagaa

SEQ ID NO: 412415 - RNA, 19 nt, Homo sapiens
gaaaaguaaugagagaagu

SEQ ID NO: 412416 - RNA, 19 nt, Homo sapiens
uaaccaagugggaaaauaa

SEQ ID NO: 412417 - RNA, 19 nt, Homo sapiens
ccaagucucaacauccuau

SEQ ID NO: 412418 - RNA, 19 nt, Homo sapiens
gaaccuccaaugucucucu

SEQ ID NO: 412419 - RNA, 19 nt, Homo sapiens
caucaaugccaacuacauc

SEQ ID NO: 412420 - RNA, 19 nt, Homo sapiens
cucaacauccuaucaguga

SEQ ID NO: 412421 - RNA, 19 nt, Homo sapiens
cacagaagaggaaaccuau

SEQ ID NO: 412422 - RNA, 19 nt, Homo sapiens
ccguugaccuugucuuugg

SEQ ID NO: 412423 - RNA, 19 nt, Homo sapiens
ggacuacucagaggcaaag

SEQ ID NO: 412424 - RNA, 19 nt, Homo sapiens
gacggagauuacaucaaug

SEQ ID NO: 412425 - RNA, 19 nt, Homo sapiens
uggcauuuaugacagacaa

SEQ ID NO: 412426 - RNA, 19 nt, Homo sapiens
gaccaucagacaccagaau

SEQ ID NO: 412427 - RNA, 19 nt, Homo sapiens
caguaaagcacauccucuu

SEQ ID NO: 412428 - RNA, 19 nt, Homo sapiens
aggagaaggucuacauugc

SEQ ID NO: 412429 - RNA, 19 nt, Homo sapiens
aaggagaaggucuacauug

SEQ ID NO: 412430 - RNA, 19 nt, Homo sapiens
ggacggagauuacaucaau

SEQ ID NO: 412431 - RNA, 19 nt, Homo sapiens
gaacccaucugcucuguga

SEQ ID NO: 412432 - RNA, 19 nt, Homo sapiens
gacaggagcuggcauuuau

SEQ ID NO: 412433 - RNA, 19 nt, Homo sapiens
ccaaauagauccuguccuu

SEQ ID NO: 412434 - RNA, 19 nt, Homo sapiens
cuagagagcuuggcuguuu

SEQ ID NO: 412435 - RNA, 19 nt, Homo sapiens
caaugucucucugaacuua

SEQ ID NO: 412436 - RNA, 19 nt, Homo sapiens
ccugacagcugccuugaua

SEQ ID NO: 412437 - RNA, 19 nt, Homo sapiens
ggagaaauguguccacuac

SEQ ID NO: 412438 - RNA, 19 nt, Homo sapiens
uuccauggcucaaauaaua

SEQ ID NO: 412439 - RNA, 19 nt, Homo sapiens
ucaguuuccuguucuauaa

SEQ ID NO: 412440 - RNA, 19 nt, Homo sapiens
ccaagcaacuggaagaaga

SEQ ID NO: 412441 - RNA, 19 nt, Homo sapiens
ggaggucacccuacacuuu

SEQ ID NO: 412442 - RNA, 19 nt, Homo sapiens
gcacagccguugaccuugu

SEQ ID NO: 412443 - RNA, 19 nt, Homo sapiens
gaggaugauuucccuaaug

SEQ ID NO: 412444 - RNA, 19 nt, Homo sapiens
gaacaaggacucugguuac

SEQ ID NO: 412445 - RNA, 19 nt, Homo sapiens
ugaaagagugcccagaaua

SEQ ID NO: 412446 - RNA, 19 nt, Homo sapiens
gcugaaagcccgaggagaa

SEQ ID NO: 412447 - RNA, 19 nt, Homo sapiens
gaagaacacgcagugcuaa

SEQ ID NO: 412448 - RNA, 19 nt, Homo sapiens
gcacaggccagaugcaaga

SEQ ID NO: 412449 - RNA, 19 nt, Homo sapiens
gagcacagccguugaccuu

SEQ ID NO: 412450 - RNA, 19 nt, Homo sapiens
gaaagugggccgagugauc

SEQ ID NO: 412451 - RNA, 19 nt, Homo sapiens
gaaagagugcccagaauac

SEQ ID NO: 412452 - RNA, 19 nt, Homo sapiens
gguacaagcuccagaacag

SEQ ID NO: 412453 - RNA, 19 nt, Homo sapiens
ccacccaugugucauaaga

SEQ ID NO: 412454 - RNA, 19 nt, Homo sapiens
gaaggagaaggucuacauu

SEQ ID NO: 412455 - RNA, 19 nt, Homo sapiens
cacaaucucuacccuuuau

SEQ ID NO: 412456 - RNA, 19 nt, Homo sapiens
gagacuggcugcccauucu

SEQ ID NO: 412457 - RNA, 19 nt, Homo sapiens
ggaaggagaaggucuacau

SEQ ID NO: 412458 - RNA, 19 nt, Homo sapiens
gcaacuggaagaagaauuc

SEQ ID NO: 412459 - RNA, 19 nt, Homo sapiens
ccacagaagaggaaaccua

SEQ ID NO: 412460 - RNA, 19 nt, Homo sapiens
gaagugucccucauuguca

SEQ ID NO: 412461 - RNA, 19 nt, Homo sapiens
ggaagcagcagcaguaagg

SEQ ID NO: 412462 - RNA, 19 nt, Homo sapiens
agaaauguguccacuacug

SEQ ID NO: 412463 - RNA, 19 nt, Homo sapiens
ccagaacaguaaccaagug

SEQ ID NO: 412464 - RNA, 19 nt, Homo sapiens
ggaagugucccucauuguc

SEQ ID NO: 412465 - RNA, 19 nt, Homo sapiens
gaguacaccuagagagcuu

SEQ ID NO: 412466 - RNA, 19 nt, Homo sapiens
agaacaaggacucugguua

SEQ ID NO: 412467 - RNA, 19 nt, Homo sapiens
acaggaagcagcagcagua

SEQ ID NO: 412468 - RNA, 19 nt, Homo sapiens
ugaagaacacgcagugcua

SEQ ID NO: 412469 - RNA, 19 nt, Homo sapiens
ccacaaucucuacccuuua

SEQ ID NO: 412470 - RNA, 19 nt, Homo sapiens
ggaaaagucugguccugau

SEQ ID NO: 412471 - RNA, 19 nt, Homo sapiens
cggcagagcaguaccaguu

SEQ ID NO: 412472 - RNA, 19 nt, Homo sapiens
uuacaucaaugccaacuac

SEQ ID NO: 412473 - RNA, 19 nt, Homo sapiens
uccacaaucucuacccuuu

SEQ ID NO: 412474 - RNA, 19 nt, Homo sapiens
agacaggagcuggcauuua

SEQ ID NO: 412475 - RNA, 19 nt, Homo sapiens
ggagggcccugucuuucag

SEQ ID NO: 412476 - RNA, 19 nt, Homo sapiens
gaugauuucccuaaugcuu

SEQ ID NO: 412477 - RNA, 19 nt, Homo sapiens
gcuaagcagucucuguuuu

SEQ ID NO: 412478 - RNA, 19 nt, Homo sapiens
gcaguugaaaucucuggaa

SEQ ID NO: 412479 - RNA, 19 nt, Homo sapiens
caugaaagagugcccagaa

SEQ ID NO: 412480 - RNA, 19 nt, Homo sapiens
ggaguuggaucuggagaac

SEQ ID NO: 412481 - RNA, 19 nt, Homo sapiens
ggucauaaccauccaugca

SEQ ID NO: 412482 - RNA, 19 nt, Homo sapiens
gccaggaggacggagauua

SEQ ID NO: 412483 - RNA, 19 nt, Homo sapiens
ggagcuggcauuuaugaca

SEQ ID NO: 412484 - RNA, 19 nt, Homo sapiens
gaacgccacaccucaggau

SEQ ID NO: 412485 - RNA, 19 nt, Homo sapiens
gcaggacccacuauaccuu

SEQ ID NO: 412486 - RNA, 19 nt, Homo sapiens
aaagggugauuccaagauc

SEQ ID NO: 412487 - RNA, 19 nt, Homo sapiens
gagagggcaaggagaaaug

SEQ ID NO: 412488 - RNA, 19 nt, Homo sapiens
guaaccaagugggaaaaua

SEQ ID NO: 412489 - RNA, 19 nt, Homo sapiens
gagaggcacgacugucuau

SEQ ID NO: 412490 - RNA, 19 nt, Homo sapiens
uaccagcucucuguggaaa

SEQ ID NO: 412491 - RNA, 19 nt, Homo sapiens
caucucagcaucaacacaa

SEQ ID NO: 412492 - RNA, 19 nt, Homo sapiens
uaugacagacaaagaaaga

SEQ ID NO: 412493 - RNA, 19 nt, Homo sapiens
gaaagcccgaggagaagug

SEQ ID NO: 412494 - RNA, 19 nt, Homo sapiens
gaggucacccuacacuuuc

SEQ ID NO: 412495 - RNA, 19 nt, Homo sapiens
caggccagaugcaagaaug

SEQ ID NO: 412496 - RNA, 19 nt, Homo sapiens
gcuaugacgggaaggagaa

SEQ ID NO: 412497 - RNA, 19 nt, Homo sapiens
ggaggacggagauuacauc

SEQ ID NO: 412498 - RNA, 19 nt, Homo sapiens
uacaagcuccagaacagua

SEQ ID NO: 412499 - RNA, 19 nt, Homo sapiens
gaggguacaagcuccagaa

SEQ ID NO: 412500 - RNA, 19 nt, Homo sapiens
ugaggaugauuucccuaau

SEQ ID NO: 412501 - RNA, 19 nt, Homo sapiens
cacuauaccuugcauuugc

SEQ ID NO: 412502 - RNA, 19 nt, Homo sapiens
guaugcaggacccacuaua

SEQ ID NO: 412503 - RNA, 19 nt, Homo sapiens
ucugagacacucuuuguga

SEQ ID NO: 412504 - RNA, 19 nt, Homo sapiens
caggagcuggcauuuauga

SEQ ID NO: 412505 - RNA, 19 nt, Homo sapiens
gggaaagugggccgaguga

SEQ ID NO: 412506 - RNA, 19 nt, Homo sapiens
ggggaaggcccacugguua

SEQ ID NO: 412507 - RNA, 19 nt, Homo sapiens
caacuacauccgaggcuau

SEQ ID NO: 412508 - RNA, 19 nt, Homo sapiens
gcuccaauguggcucugau

SEQ ID NO: 412509 - RNA, 19 nt, Homo sapiens
gaguggaacagcagcaguu

SEQ ID NO: 412510 - RNA, 19 nt, Homo sapiens
gauggcuucugcgugcuuu

SEQ ID NO: 412511 - RNA, 19 nt, Homo sapiens
aaagacaggagcuggcauu

SEQ ID NO: 412512 - RNA, 19 nt, Homo sapiens
ccuccaaugucucucugaa

SEQ ID NO: 412513 - RNA, 19 nt, Homo sapiens
cagaagaggaaaccuaugg

SEQ ID NO: 412514 - RNA, 19 nt, Homo sapiens
caaucagggucauaaccau

SEQ ID NO: 412515 - RNA, 19 nt, Homo sapiens
ccacuauaccuugcauuug

SEQ ID NO: 412516 - RNA, 19 nt, Homo sapiens
gaaggugggucuggggaaa

SEQ ID NO: 412517 - RNA, 19 nt, Homo sapiens
gcauccaggacaugaaaga

SEQ ID NO: 412518 - RNA, 19 nt, Homo sapiens
gggagaugguguggcaaga

SEQ ID NO: 412519 - RNA, 19 nt, Homo sapiens
gaaaaguaaugagagaagu

SEQ ID NO: 412520 - RNA, 19 nt, Homo sapiens
caagcaacuggaagaagaa

SEQ ID NO: 412521 - RNA, 19 nt, Homo sapiens
gauccuguccuucccuuag

SEQ ID NO: 412522 - RNA, 19 nt, Homo sapiens
uccuagagaacacauauuu

SEQ ID NO: 412523 - RNA, 19 nt, Homo sapiens
uaaccaagugggaaaauaa

SEQ ID NO: 412524 - RNA, 19 nt, Homo sapiens
ccaagucucaacauccuau

SEQ ID NO: 412525 - RNA, 19 nt, Homo sapiens
gaaccuccaaugucucucu

SEQ ID NO: 412526 - RNA, 19 nt, Homo sapiens
caucaaugccaacuacauc

SEQ ID NO: 412527 - RNA, 19 nt, Homo sapiens
cucaacauccuaucaguga

SEQ ID NO: 412528 - RNA, 19 nt, Homo sapiens
uggauucuuuccuaucuuc

SEQ ID NO: 412529 - RNA, 19 nt, Homo sapiens
cacagaagaggaaaccuau

SEQ ID NO: 412530 - RNA, 19 nt, Homo sapiens
ggacggagauuacaucaau

SEQ ID NO: 412531 - RNA, 19 nt, Homo sapiens
gaacccaucugcucuguga

SEQ ID NO: 412532 - RNA, 19 nt, Homo sapiens
gacaggagcuggcauuuau

SEQ ID NO: 412533 - RNA, 19 nt, Homo sapiens
cuagagagcuuggcuguuu

SEQ ID NO: 412534 - RNA, 19 nt, Homo sapiens
caaugucucucugaacuua

SEQ ID NO: 412535 - RNA, 19 nt, Homo sapiens
ccugacagcugccuugaua

SEQ ID NO: 412536 - RNA, 19 nt, Homo sapiens
ggagaaauguguccacuac

SEQ ID NO: 412537 - RNA, 19 nt, Homo sapiens
uuccauggcucaaauaaua

SEQ ID NO: 412538 - RNA, 19 nt, Homo sapiens
ucaguuuccuguucuauaa

SEQ ID NO: 412539 - RNA, 19 nt, Homo sapiens
ccaagcaacuggaagaaga

SEQ ID NO: 412540 - RNA, 19 nt, Homo sapiens
ggaggucacccuacacuuu

SEQ ID NO: 412541 - RNA, 19 nt, Homo sapiens
gcacagccguugaccuugu

SEQ ID NO: 412542 - RNA, 19 nt, Homo sapiens
gaggaugauuucccuaaug

SEQ ID NO: 412543 - RNA, 19 nt, Homo sapiens
gaacaaggacucugguuac

SEQ ID NO: 412544 - RNA, 19 nt, Homo sapiens
ugaaagagugcccagaaua

SEQ ID NO: 412545 - RNA, 19 nt, Homo sapiens
gcugaaagcccgaggagaa

SEQ ID NO: 412546 - RNA, 19 nt, Homo sapiens
gaagaacacgcagugcuaa

SEQ ID NO: 412547 - RNA, 19 nt, Homo sapiens
gagcacagccguugaccuu

SEQ ID NO: 412548 - RNA, 19 nt, Homo sapiens
gcacaggccagaugcaaga

SEQ ID NO: 412549 - RNA, 19 nt, Homo sapiens
gaaagagugcccagaauac

SEQ ID NO: 412550 - RNA, 19 nt, Homo sapiens
gguacaagcuccagaacag

SEQ ID NO: 412551 - RNA, 19 nt, Homo sapiens
ccacccaugugucauaaga

SEQ ID NO: 412552 - RNA, 19 nt, Homo sapiens
gaaggagaaggucuacauu

SEQ ID NO: 412553 - RNA, 19 nt, Homo sapiens
gagacuggcugcccauucu

SEQ ID NO: 412554 - RNA, 19 nt, Homo sapiens
ggaaggagaaggucuacau

SEQ ID NO: 412555 - RNA, 19 nt, Homo sapiens
gcaacuggaagaagaauuc

SEQ ID NO: 412556 - RNA, 19 nt, Homo sapiens
ccacagaagaggaaaccua

SEQ ID NO: 412557 - RNA, 19 nt, Homo sapiens
gaagugucccucauuguca

SEQ ID NO: 412558 - RNA, 19 nt, Homo sapiens
ggaagcagcagcaguaagg

SEQ ID NO: 412559 - RNA, 19 nt, Homo sapiens
agaaauguguccacuacug

SEQ ID NO: 412560 - RNA, 19 nt, Homo sapiens
ccagaacaguaaccaagug

SEQ ID NO: 412561 - RNA, 19 nt, Homo sapiens
ggaagugucccucauuguc

SEQ ID NO: 412562 - RNA, 19 nt, Homo sapiens
gaguacaccuagagagcuu

SEQ ID NO: 412563 - RNA, 19 nt, Homo sapiens
agaacaaggacucugguua

SEQ ID NO: 412564 - RNA, 19 nt, Homo sapiens
acaggaagcagcagcagua

SEQ ID NO: 412565 - RNA, 19 nt, Homo sapiens
ugaagaacacgcagugcua

SEQ ID NO: 412566 - RNA, 19 nt, Homo sapiens
ggaaaagucugguccugau

SEQ ID NO: 412567 - RNA, 19 nt, Homo sapiens
cggcagagcaguaccaguu

SEQ ID NO: 412568 - RNA, 19 nt, Homo sapiens
uuacaucaaugccaacuac

SEQ ID NO: 412569 - RNA, 19 nt, Homo sapiens
agacaggagcuggcauuua

SEQ ID NO: 412570 - RNA, 19 nt, Homo sapiens
gaugauuucccuaaugcuu

SEQ ID NO: 412571 - RNA, 19 nt, Homo sapiens
gcuaagcagucucuguuuu

SEQ ID NO: 412572 - RNA, 19 nt, Homo sapiens
gcaguugaaaucucuggaa

SEQ ID NO: 412573 - RNA, 19 nt, Homo sapiens
caugaaagagugcccagaa

SEQ ID NO: 412574 - RNA, 19 nt, Homo sapiens
ggaguuggaucuggagaac

SEQ ID NO: 412575 - RNA, 19 nt, Homo sapiens
ggucauaaccauccaugca

SEQ ID NO: 412576 - RNA, 19 nt, Homo sapiens
gccaggaggacggagauua

SEQ ID NO: 412577 - RNA, 19 nt, Homo sapiens
ggagcuggcauuuaugaca

SEQ ID NO: 412578 - RNA, 19 nt, Homo sapiens
gaacgccacaccucaggau

SEQ ID NO: 412579 - RNA, 19 nt, Homo sapiens
gcaggacccacuauaccuu

SEQ ID NO: 412580 - RNA, 19 nt, Homo sapiens
aaagggugauuccaagauc

SEQ ID NO: 412581 - RNA, 19 nt, Homo sapiens
ccucaagccugggaaguca

SEQ ID NO: 412582 - RNA, 19 nt, Homo sapiens
gagagggcaaggagaaaug

SEQ ID NO: 412583 - RNA, 19 nt, Homo sapiens
guaaccaagugggaaaaua

SEQ ID NO: 412584 - RNA, 19 nt, Homo sapiens
gagaggcacgacugucuau

SEQ ID NO: 412585 - RNA, 19 nt, Homo sapiens
uaccagcucucuguggaaa

SEQ ID NO: 412586 - RNA, 19 nt, Homo sapiens
caucucagcaucaacacaa

SEQ ID NO: 412587 - RNA, 19 nt, Homo sapiens
gaggucacccuacacuuuc

SEQ ID NO: 412588 - RNA, 19 nt, Homo sapiens
uaugacagacaaagaaaga

SEQ ID NO: 412589 - RNA, 19 nt, Homo sapiens
gaaagcccgaggagaagug

SEQ ID NO: 412590 - RNA, 19 nt, Homo sapiens
caggccagaugcaagaaug

SEQ ID NO: 412591 - RNA, 19 nt, Homo sapiens
gcuaugacgggaaggagaa

SEQ ID NO: 412592 - RNA, 19 nt, Homo sapiens
ggaggacggagauuacauc

SEQ ID NO: 412593 - RNA, 19 nt, Homo sapiens
uacaagcuccagaacagua

SEQ ID NO: 412594 - RNA, 19 nt, Homo sapiens
gaggguacaagcuccagaa

SEQ ID NO: 412595 - RNA, 19 nt, Homo sapiens
ugaggaugauuucccuaau

SEQ ID NO: 412596 - RNA, 19 nt, Homo sapiens
agacagaccgacagacaga

SEQ ID NO: 412597 - RNA, 19 nt, Homo sapiens
cacuauaccuugcauuugc

SEQ ID NO: 412598 - RNA, 19 nt, Homo sapiens
guaugcaggacccacuaua

SEQ ID NO: 412599 - RNA, 19 nt, Homo sapiens
ucugagacacucuuuguga

SEQ ID NO: 412600 - RNA, 19 nt, Homo sapiens
caggagcuggcauuuauga

SEQ ID NO: 412601 - RNA, 19 nt, Homo sapiens
aaagacagaccgacagaca

SEQ ID NO: 412602 - RNA, 19 nt, Homo sapiens
gcuccaauguggcucugau

SEQ ID NO: 412603 - RNA, 19 nt, Homo sapiens
caacuacauccgaggcuau

SEQ ID NO: 412604 - RNA, 19 nt, Homo sapiens
aaagacaggagcuggcauu

SEQ ID NO: 412605 - RNA, 19 nt, Homo sapiens
ccuccaaugucucucugaa

SEQ ID NO: 412606 - RNA, 19 nt, Homo sapiens
cagaagaggaaaccuaugg

SEQ ID NO: 412607 - RNA, 19 nt, Homo sapiens
caaucagggucauaaccau

SEQ ID NO: 412608 - RNA, 19 nt, Homo sapiens
ucaaagacagaccgacaga

SEQ ID NO: 412609 - RNA, 19 nt, Homo sapiens
ccacuauaccuugcauuug

SEQ ID NO: 412610 - RNA, 19 nt, Homo sapiens
gcauccaggacaugaaaga

SEQ ID NO: 412611 - RNA, 19 nt, Homo sapiens
gggagaugguguggcaaga

SEQ ID NO: 412612 - RNA, 19 nt, Homo sapiens
caagcaacuggaagaagaa

SEQ ID NO: 412613 - RNA, 19 nt, Homo sapiens
gaaaaguaaugagagaagu

SEQ ID NO: 412614 - RNA, 19 nt, Homo sapiens
uaaccaagugggaaaauaa

SEQ ID NO: 412615 - RNA, 19 nt, Homo sapiens
ccaagucucaacauccuau

SEQ ID NO: 412616 - RNA, 19 nt, Homo sapiens
gaaccuccaaugucucucu

SEQ ID NO: 412617 - RNA, 19 nt, Homo sapiens
caucaaugccaacuacauc

SEQ ID NO: 412618 - RNA, 19 nt, Homo sapiens
ccguugaccuugucuuugg

SEQ ID NO: 412619 - RNA, 19 nt, Homo sapiens
cucaacauccuaucaguga

SEQ ID NO: 412620 - RNA, 19 nt, Homo sapiens
cacagaagaggaaaccuau

SEQ ID NO: 412621 - RNA, 19 nt, Homo sapiens
ggacuacucagaggcaaag

SEQ ID NO: 412622 - RNA, 19 nt, Homo sapiens
gacggagauuacaucaaug

SEQ ID NO: 412623 - RNA, 19 nt, Homo sapiens
uggcauuuaugacagacaa

SEQ ID NO: 412624 - RNA, 19 nt, Homo sapiens
gaccaucagacaccagaau

SEQ ID NO: 412625 - RNA, 19 nt, Homo sapiens
caguaaagcacauccucuu

SEQ ID NO: 412626 - RNA, 19 nt, Homo sapiens
aggagaaggucuacauugc

SEQ ID NO: 412627 - RNA, 19 nt, Homo sapiens
aaggagaaggucuacauug

SEQ ID NO: 412628 - RNA, 19 nt, Homo sapiens
cccacuauaccuugcauuu

SEQ ID NO: 412629 - RNA, 19 nt, Homo sapiens
ccuccacccaugugucaua

SEQ ID NO: 412630 - RNA, 19 nt, Homo sapiens
gaucagaccucaauaauuu

SEQ ID NO: 412631 - RNA, 19 nt, Homo sapiens
ggagaggauucaaauauua

SEQ ID NO: 412632 - RNA, 19 nt, Homo sapiens
guaauaagcucuuugaaug

SEQ ID NO: 412633 - RNA, 19 nt, Homo sapiens
gaacggagcgaauaauaua

SEQ ID NO: 412634 - RNA, 19 nt, Homo sapiens
gagaauaccuaucgugauu

SEQ ID NO: 412635 - RNA, 19 nt, Homo sapiens
ggaauggacugguguuuau

SEQ ID NO: 412636 - RNA, 19 nt, Homo sapiens
gaauguggcugucaaguuc

SEQ ID NO: 412637 - RNA, 19 nt, Homo sapiens
ccaagcacguuuauaagua

SEQ ID NO: 412638 - RNA, 19 nt, Homo sapiens
ggacaccgcugagccuaua

SEQ ID NO: 412639 - RNA, 19 nt, Homo sapiens
aaacaacgcuagaaauuca

SEQ ID NO: 412640 - RNA, 19 nt, Homo sapiens
guacgaaucuuagaaggaa

SEQ ID NO: 412641 - RNA, 19 nt, Homo sapiens
gggagaggauucaaauauu

SEQ ID NO: 412642 - RNA, 19 nt, Homo sapiens
gaaccucccuccuccuuuc

SEQ ID NO: 412643 - RNA, 19 nt, Homo sapiens
ugaagaaggugcugauugu

SEQ ID NO: 412644 - RNA, 19 nt, Homo sapiens
ggacugguguuuaucuaug

SEQ ID NO: 412645 - RNA, 19 nt, Homo sapiens
gaucaugucuccucuuguc

SEQ ID NO: 412646 - RNA, 19 nt, Homo sapiens
ugaggaauaugaagacauu

SEQ ID NO: 412647 - RNA, 19 nt, Homo sapiens
ccaagaauguauuaguuug

SEQ ID NO: 412648 - RNA, 19 nt, Homo sapiens
gaauaccuaucgugauuuc

SEQ ID NO: 412649 - RNA, 19 nt, Homo sapiens
aaauugaucucgccacuug

SEQ ID NO: 412650 - RNA, 19 nt, Homo sapiens
ucgaagagauuaacaagug

SEQ ID NO: 412651 - RNA, 19 nt, Homo sapiens
ucagacagauuacaucaau

SEQ ID NO: 412652 - RNA, 19 nt, Homo sapiens
cagcauggauuucccuuau

SEQ ID NO: 412653 - RNA, 19 nt, Homo sapiens
gaaaacaacgcuagaaauu

SEQ ID NO: 412654 - RNA, 19 nt, Homo sapiens
ggaccaaacuagagugaag

SEQ ID NO: 412655 - RNA, 19 nt, Homo sapiens
gcaaucgguacgaaucuua

SEQ ID NO: 412656 - RNA, 19 nt, Homo sapiens
cauacucucucuuugcuuu

SEQ ID NO: 412657 - RNA, 19 nt, Homo sapiens
caaacuagagugaagcuaa

SEQ ID NO: 412658 - RNA, 19 nt, Homo sapiens
gaaggaaggcauuguaaag

SEQ ID NO: 412659 - RNA, 19 nt, Homo sapiens
gaaagggccaguagcaaug

SEQ ID NO: 412660 - RNA, 19 nt, Homo sapiens
gcaagaaaguccuaaaccu

SEQ ID NO: 412661 - RNA, 19 nt, Homo sapiens
cuagauaaauguggugaaa

SEQ ID NO: 412662 - RNA, 19 nt, Homo sapiens
gcaaggaaucuaugaggaa

SEQ ID NO: 412663 - RNA, 19 nt, Homo sapiens
ggaaggaaggcauuguaaa

SEQ ID NO: 412664 - RNA, 19 nt, Homo sapiens
ccaagcaguuucucgaaga

SEQ ID NO: 412665 - RNA, 19 nt, Homo sapiens
guagcaauguguucuuaau

SEQ ID NO: 412666 - RNA, 19 nt, Homo sapiens
gagcuuggcacccuuaaug

SEQ ID NO: 412667 - RNA, 19 nt, Homo sapiens
gagaaaguguggccaguac

SEQ ID NO: 412668 - RNA, 19 nt, Homo sapiens
gaaucuaugaggaauauga

SEQ ID NO: 412669 - RNA, 19 nt, Homo sapiens
ggacaguucaguacaaugu

SEQ ID NO: 412670 - RNA, 19 nt, Homo sapiens
caaguuacauauucuagag

SEQ ID NO: 412671 - RNA, 19 nt, Homo sapiens
gcuaucaaacugugccuua

SEQ ID NO: 412672 - RNA, 19 nt, Homo sapiens
gaaauugccacuagaaagg

SEQ ID NO: 412673 - RNA, 19 nt, Homo sapiens
uggaucaacuucuuucuug

SEQ ID NO: 412674 - RNA, 19 nt, Homo sapiens
ggaauguggcugucaaguu

SEQ ID NO: 412675 - RNA, 19 nt, Homo sapiens
caaaugcaaucgguacgaa

SEQ ID NO: 412676 - RNA, 19 nt, Homo sapiens
acauuuacuuggccaauuu

SEQ ID NO: 412677 - RNA, 19 nt, Homo sapiens
ggaacggagcgaauaauau

SEQ ID NO: 412678 - RNA, 19 nt, Homo sapiens
gccauacucagacagauua

SEQ ID NO: 412679 - RNA, 19 nt, Homo sapiens
caaauuguggcuauugauu

SEQ ID NO: 412680 - RNA, 19 nt, Homo sapiens
caguagcaauguguucuua

SEQ ID NO: 412681 - RNA, 19 nt, Homo sapiens
gcuagaaauucacaacaca

SEQ ID NO: 412682 - RNA, 19 nt, Homo sapiens
gaagacauucgucgugaga

SEQ ID NO: 412683 - RNA, 19 nt, Homo sapiens
cuaauuaugccaacuuuga

SEQ ID NO: 412684 - RNA, 19 nt, Homo sapiens
ugacaugugugguucuaau

SEQ ID NO: 412685 - RNA, 19 nt, Homo sapiens
aucaaacugugccuuauua

SEQ ID NO: 412686 - RNA, 19 nt, Homo sapiens
ccagaucccuucgaugaga

SEQ ID NO: 412687 - RNA, 19 nt, Homo sapiens
caaacugugccuuauuaaa

SEQ ID NO: 412688 - RNA, 19 nt, Homo sapiens
cagcuucccucauugacuu

SEQ ID NO: 412689 - RNA, 19 nt, Homo sapiens
gugaucaugucuccucuug

SEQ ID NO: 412690 - RNA, 19 nt, Homo sapiens
caagcacguuuauaaguag

SEQ ID NO: 412691 - RNA, 19 nt, Homo sapiens
caacuucuuucuugugucu

SEQ ID NO: 412692 - RNA, 19 nt, Homo sapiens
caaggaaucuaugaggaau

SEQ ID NO: 412693 - RNA, 19 nt, Homo sapiens
gcugaucagaccucaauaa

SEQ ID NO: 412694 - RNA, 19 nt, Homo sapiens
ggagaaaguguggccagua

SEQ ID NO: 412695 - RNA, 19 nt, Homo sapiens
gguggguucugugucaaua

SEQ ID NO: 412696 - RNA, 19 nt, Homo sapiens
gccaagaauguauuaguuu

SEQ ID NO: 412697 - RNA, 19 nt, Homo sapiens
gucaguaacucuccuacga

SEQ ID NO: 412698 - RNA, 19 nt, Homo sapiens
guggauagcuuugaaacuc

SEQ ID NO: 412699 - RNA, 19 nt, Homo sapiens
acaguucaguacaauguuu

SEQ ID NO: 412700 - RNA, 19 nt, Homo sapiens
uaauaucaauggacugagu

SEQ ID NO: 412701 - RNA, 19 nt, Homo sapiens
aguaaugacuuaucuccuu

SEQ ID NO: 412702 - RNA, 19 nt, Homo sapiens
gaggaaggcggcaggagaa

SEQ ID NO: 412703 - RNA, 19 nt, Homo sapiens
caugugugguucuaauuau

SEQ ID NO: 412704 - RNA, 19 nt, Homo sapiens
gaagaggacacacacacau

SEQ ID NO: 412705 - RNA, 19 nt, Homo sapiens
gagguuugaugagcauuug

SEQ ID NO: 412706 - RNA, 19 nt, Homo sapiens
uuacaucaaugccaguuuc

SEQ ID NO: 412707 - RNA, 19 nt, Homo sapiens
cgaaguggccauacucaga

SEQ ID NO: 412708 - RNA, 19 nt, Homo sapiens
cgagugcccuauuccauca

SEQ ID NO: 412709 - RNA, 19 nt, Homo sapiens
uagaauuguuccacuccua

SEQ ID NO: 412710 - RNA, 19 nt, Homo sapiens
gcccagguaugagaaagaa

SEQ ID NO: 412711 - RNA, 19 nt, Homo sapiens
ucuuggacccuacuauuua

SEQ ID NO: 412712 - RNA, 19 nt, Homo sapiens
uaagcucuuugaaugugua

SEQ ID NO: 412713 - RNA, 19 nt, Homo sapiens
caaacuggguggguucugu

SEQ ID NO: 412714 - RNA, 19 nt, Homo sapiens
guagagaugaacucacuga

SEQ ID NO: 412715 - RNA, 19 nt, Homo sapiens
ggguagagaugaacucacu

SEQ ID NO: 412716 - RNA, 19 nt, Homo sapiens
ugugugcacuuauguguau

SEQ ID NO: 412717 - RNA, 19 nt, Homo sapiens
gaaggcggcaggagaaagu

SEQ ID NO: 412718 - RNA, 19 nt, Homo sapiens
acaagucaguccaacaugu

SEQ ID NO: 412719 - RNA, 19 nt, Homo sapiens
gaugagcauuugccuuucu

SEQ ID NO: 412720 - RNA, 19 nt, Homo sapiens
gaaaguguggccaguacug

SEQ ID NO: 412721 - RNA, 19 nt, Homo sapiens
gcuggaugguuccuuuaug

SEQ ID NO: 412722 - RNA, 19 nt, Homo sapiens
gcuacagagugguggaaga

SEQ ID NO: 412723 - RNA, 19 nt, Homo sapiens
gggagugucuuccagaaaa

SEQ ID NO: 412724 - RNA, 19 nt, Homo sapiens
cgggagaggauucaaauau

SEQ ID NO: 412725 - RNA, 19 nt, Homo sapiens
gacugguguuuaucuauga

SEQ ID NO: 412726 - RNA, 19 nt, Homo sapiens
gcucuuugaauguguauau

SEQ ID NO: 412727 - RNA, 19 nt, Homo sapiens
aauaagcucuuugaaugug

SEQ ID NO: 412728 - RNA, 19 nt, Homo sapiens
ggaagaggacacacacaca

SEQ ID NO: 412729 - RNA, 19 nt, Homo sapiens
gaucaacuucuuucuugug

SEQ ID NO: 412730 - RNA, 19 nt, Homo sapiens
gaaagaagcagagaaauua

SEQ ID NO: 412731 - RNA, 19 nt, Homo sapiens
gaaaucaucucuacaaugu

SEQ ID NO: 412732 - RNA, 19 nt, Homo sapiens
gaacaucacgggcaauuaa

SEQ ID NO: 412733 - RNA, 19 nt, Homo sapiens
gcaagaaaguuuaugugaa

SEQ ID NO: 412734 - RNA, 19 nt, Homo sapiens
gcagagaaauuauuaacug

SEQ ID NO: 412735 - RNA, 19 nt, Homo sapiens
gaacacuggugauuacuau

SEQ ID NO: 412736 - RNA, 19 nt, Homo sapiens
gaagacagaauuuggauuu

SEQ ID NO: 412737 - RNA, 19 nt, Homo sapiens
gaagaaaucaucucuacaa

SEQ ID NO: 412738 - RNA, 19 nt, Homo sapiens
gaaaccaagugcaacaauu

SEQ ID NO: 412739 - RNA, 19 nt, Homo sapiens
agaaauagauguggacuuu

SEQ ID NO: 412740 - RNA, 19 nt, Homo sapiens
ggaaagaagcagagaaauu

SEQ ID NO: 412741 - RNA, 19 nt, Homo sapiens
gaagcacaguaccgauuua

SEQ ID NO: 412742 - RNA, 19 nt, Homo sapiens
gagcuuaaauauccucuga

SEQ ID NO: 412743 - RNA, 19 nt, Homo sapiens
ggagaaauuugccacuuug

SEQ ID NO: 412744 - RNA, 19 nt, Homo sapiens
caagaaaguuuaugugaag

SEQ ID NO: 412745 - RNA, 19 nt, Homo sapiens
gcucaugacuauacgcuaa

SEQ ID NO: 412746 - RNA, 19 nt, Homo sapiens
ugacagaucuuguggaaca

SEQ ID NO: 412747 - RNA, 19 nt, Homo sapiens
caacaggagugcaaacuuc

SEQ ID NO: 412748 - RNA, 19 nt, Homo sapiens
ggagaugguuucacccaaa

SEQ ID NO: 412749 - RNA, 19 nt, Homo sapiens
caucaugccugaauuugaa

SEQ ID NO: 412750 - RNA, 19 nt, Homo sapiens
gaccacagauaaagucaaa

SEQ ID NO: 412751 - RNA, 19 nt, Homo sapiens
gggcacgaauauacaaaua

SEQ ID NO: 412752 - RNA, 19 nt, Homo sapiens
guaaaugugucaaauacug

SEQ ID NO: 412753 - RNA, 19 nt, Homo sapiens
gggagaaauuugccacuuu

SEQ ID NO: 412754 - RNA, 19 nt, Homo sapiens
ggacguucauugugauuga

SEQ ID NO: 412755 - RNA, 19 nt, Homo sapiens
ccaaugagccuguuucaga

SEQ ID NO: 412756 - RNA, 19 nt, Homo sapiens
ggaagaauuugagacacua

SEQ ID NO: 412757 - RNA, 19 nt, Homo sapiens
gcaaugacggcaagucuaa

SEQ ID NO: 412758 - RNA, 19 nt, Homo sapiens
ggaaagggcacgaauauac

SEQ ID NO: 412759 - RNA, 19 nt, Homo sapiens
gaguaaaugugucaaauac

SEQ ID NO: 412760 - RNA, 19 nt, Homo sapiens
cagauuacaucaaugcaaa

SEQ ID NO: 412761 - RNA, 19 nt, Homo sapiens
gaacagacgcaagaaaguu

SEQ ID NO: 412762 - RNA, 19 nt, Homo sapiens
ggacaucucucugggaaag

SEQ ID NO: 412763 - RNA, 19 nt, Homo sapiens
ugaggaagcaguuaaauug

SEQ ID NO: 412764 - RNA, 19 nt, Homo sapiens
gaggaaagggcacgaauau

SEQ ID NO: 412765 - RNA, 19 nt, Homo sapiens
ggacagggacguucauugu

SEQ ID NO: 412766 - RNA, 19 nt, Homo sapiens
gagaugucauugagcuuaa

SEQ ID NO: 412767 - RNA, 19 nt, Homo sapiens
uggaggaggugcaccauaa

SEQ ID NO: 412768 - RNA, 19 nt, Homo sapiens
ggagaugucauugagcuua

SEQ ID NO: 412769 - RNA, 19 nt, Homo sapiens
gaaauugaggaagcaguua

SEQ ID NO: 412770 - RNA, 19 nt, Homo sapiens
aaauagauguggacuuuca

SEQ ID NO: 412771 - RNA, 19 nt, Homo sapiens
gaagaauccuaugguggaa

SEQ ID NO: 412772 - RNA, 19 nt, Homo sapiens
aauaccugcuucccaauua

SEQ ID NO: 412773 - RNA, 19 nt, Homo sapiens
gaaauagaaagcagaguuc

SEQ ID NO: 412774 - RNA, 19 nt, Homo sapiens
ggaaacauuggguacagua

SEQ ID NO: 412775 - RNA, 19 nt, Homo sapiens
cugaguugguccaguauua

SEQ ID NO: 412776 - RNA, 19 nt, Homo sapiens
gcacaguaccgauuuaucu

SEQ ID NO: 412777 - RNA, 19 nt, Homo sapiens
ggaaagaguaaauguguca

SEQ ID NO: 412778 - RNA, 19 nt, Homo sapiens
gaggaaagaguaaaugugu

SEQ ID NO: 412779 - RNA, 19 nt, Homo sapiens
uagcugagaccacagauaa

SEQ ID NO: 412780 - RNA, 19 nt, Homo sapiens
uuacucauuuccucagaua

SEQ ID NO: 412781 - RNA, 19 nt, Homo sapiens
gguguugacugcgauauug

SEQ ID NO: 412782 - RNA, 19 nt, Homo sapiens
agagaacggucuggcaaua

SEQ ID NO: 412783 - RNA, 19 nt, Homo sapiens
gaggagaacgguuugauuc

SEQ ID NO: 412784 - RNA, 19 nt, Homo sapiens
gaaaguuuaugugaagaca

SEQ ID NO: 412785 - RNA, 19 nt, Homo sapiens
aaacuucagcacagaaaua

SEQ ID NO: 412786 - RNA, 19 nt, Homo sapiens
gaaagggcacgaauauaca

SEQ ID NO: 412787 - RNA, 19 nt, Homo sapiens
caguaccgauuuaucuaua

SEQ ID NO: 412788 - RNA, 19 nt, Homo sapiens
cagaucuuguggaacauua

SEQ ID NO: 412789 - RNA, 19 nt, Homo sapiens
uaaagugacccauguuaug

SEQ ID NO: 412790 - RNA, 19 nt, Homo sapiens
ccuggagacuucacacuuu

SEQ ID NO: 412791 - RNA, 19 nt, Homo sapiens
acagggacguucauuguga

SEQ ID NO: 412792 - RNA, 19 nt, Homo sapiens
gacagaauuuggauuugga

SEQ ID NO: 412793 - RNA, 19 nt, Homo sapiens
gcgcacuggugaugacaaa

SEQ ID NO: 412794 - RNA, 19 nt, Homo sapiens
ucagaacacuggugauuac

SEQ ID NO: 412795 - RNA, 19 nt, Homo sapiens
gcauuaaagagucauagaa

SEQ ID NO: 412796 - RNA, 19 nt, Homo sapiens
ugacugcgauauugacguu

SEQ ID NO: 412797 - RNA, 19 nt, Homo sapiens
gacggcaagucuaaaguga

SEQ ID NO: 412798 - RNA, 19 nt, Homo sapiens
ucauugagcuuaaauaucc

SEQ ID NO: 412799 - RNA, 19 nt, Homo sapiens
gagaugguuucacccaaau

SEQ ID NO: 412800 - RNA, 19 nt, Homo sapiens
aagaagaaaucaucucuac

SEQ ID NO: 412801 - RNA, 19 nt, Homo sapiens
gagaaaaccugccaaaacu

SEQ ID NO: 412802 - RNA, 19 nt, Homo sapiens
gugcagaaaugagagaaga

SEQ ID NO: 412803 - RNA, 19 nt, Homo sapiens
caaugagccuguuucagau

SEQ ID NO: 412804 - RNA, 19 nt, Homo sapiens
ggaggagaacgguuugauu

SEQ ID NO: 412805 - RNA, 19 nt, Homo sapiens
uuaaauauccucugaacug

SEQ ID NO: 412806 - RNA, 19 nt, Homo sapiens
gguccagcauuauauugaa

SEQ ID NO: 412807 - RNA, 19 nt, Homo sapiens
guaccgauuuaucuauaug

SEQ ID NO: 412808 - RNA, 19 nt, Homo sapiens
guuaggaacgucaaagaaa

SEQ ID NO: 412809 - RNA, 19 nt, Homo sapiens
gaucuuguggaacauuaua

SEQ ID NO: 412810 - RNA, 19 nt, Homo sapiens
uggcugaguugguccagua

SEQ ID NO: 412811 - RNA, 19 nt, Homo sapiens
agaacaaucucauuuacca

SEQ ID NO: 412812 - RNA, 19 nt, Homo sapiens
gggauucaaauucuaguaa

SEQ ID NO: 412813 - RNA, 19 nt, Homo sapiens
cgacguugguggaggagaa

SEQ ID NO: 412814 - RNA, 19 nt, Homo sapiens
uaaauauccucugaacugu

SEQ ID NO: 412815 - RNA, 19 nt, Homo sapiens
auauggcgguccagcauua

SEQ ID NO: 412816 - RNA, 19 nt, Homo sapiens
ugaaauagaaagcagaguu

SEQ ID NO: 412817 - RNA, 19 nt, Homo sapiens
aaaugcugcugaaauagaa

SEQ ID NO: 412818 - RNA, 19 nt, Homo sapiens
uaaaugcugcugaaauaga

SEQ ID NO: 412819 - RNA, 19 nt, Homo sapiens
gcagaaaaccuacuguuga

SEQ ID NO: 412820 - RNA, 19 nt, Homo sapiens
caagaacagacgcaagaaa

SEQ ID NO: 412821 - RNA, 19 nt, Homo sapiens
gggaagaauuugagacacu

SEQ ID NO: 412822 - RNA, 19 nt, Homo sapiens
guauaaaugcugcugaaau

SEQ ID NO: 412823 - RNA, 19 nt, Homo sapiens
ggaacaucacgggcaauua

SEQ ID NO: 412824 - RNA, 19 nt, Homo sapiens
gagagaagacagugcuaga

SEQ ID NO: 412825 - RNA, 19 nt, Homo sapiens
guggagagaggaaagagua

SEQ ID NO: 412826 - RNA, 19 nt, Homo sapiens
cggaugguguuccaagaaa

SEQ ID NO: 412827 - RNA, 19 nt, Homo sapiens
caaugcaaauaucaucaug

SEQ ID NO: 412828 - RNA, 19 nt, Homo sapiens
gggaugaugagaagaaaug

SEQ ID NO: 412829 - RNA, 19 nt, Homo sapiens
gagaggaaagaguaaaugu

SEQ ID NO: 412830 - RNA, 19 nt, Homo sapiens
gaaagaagcagagaaauua

SEQ ID NO: 412831 - RNA, 19 nt, Homo sapiens
gaacaucacgggcaauuaa

SEQ ID NO: 412832 - RNA, 19 nt, Homo sapiens
gcagagaaauuauuaacug

SEQ ID NO: 412833 - RNA, 19 nt, Homo sapiens
gaacacuggugauuacuau

SEQ ID NO: 412834 - RNA, 19 nt, Homo sapiens
caccagaaguugugcauua

SEQ ID NO: 412835 - RNA, 19 nt, Homo sapiens
gaaaccaagugcaacaauu

SEQ ID NO: 412836 - RNA, 19 nt, Homo sapiens
ggaaagaagcagagaaauu

SEQ ID NO: 412837 - RNA, 19 nt, Homo sapiens
gagcuuaaauauccucuga

SEQ ID NO: 412838 - RNA, 19 nt, Homo sapiens
ggagaaauuugccacuuug

SEQ ID NO: 412839 - RNA, 19 nt, Homo sapiens
gcucaugacuauacgcuaa

SEQ ID NO: 412840 - RNA, 19 nt, Homo sapiens
ugacagaucuuguggaaca

SEQ ID NO: 412841 - RNA, 19 nt, Homo sapiens
caacaggagugcaaacuuc

SEQ ID NO: 412842 - RNA, 19 nt, Homo sapiens
ggagaugguuucacccaaa

SEQ ID NO: 412843 - RNA, 19 nt, Homo sapiens
caucaugccugaauuugaa

SEQ ID NO: 412844 - RNA, 19 nt, Homo sapiens
gaccacagauaaagucaaa

SEQ ID NO: 412845 - RNA, 19 nt, Homo sapiens
guaaaugugucaaauacug

SEQ ID NO: 412846 - RNA, 19 nt, Homo sapiens
gggagaaauuugccacuuu

SEQ ID NO: 412847 - RNA, 19 nt, Homo sapiens
ccaaugagccuguuucaga

SEQ ID NO: 412848 - RNA, 19 nt, Homo sapiens
ggaagaauuugagacacua

SEQ ID NO: 412849 - RNA, 19 nt, Homo sapiens
gcaaugacggcaagucuaa

SEQ ID NO: 412850 - RNA, 19 nt, Homo sapiens
gaguaaaugugucaaauac

SEQ ID NO: 412851 - RNA, 19 nt, Homo sapiens
cagauuacaucaaugcaaa

SEQ ID NO: 412852 - RNA, 19 nt, Homo sapiens
ggacaucucucugggaaag

SEQ ID NO: 412853 - RNA, 19 nt, Homo sapiens
gagaugucauugagcuuaa

SEQ ID NO: 412854 - RNA, 19 nt, Homo sapiens
uggaggaggugcaccauaa

SEQ ID NO: 412855 - RNA, 19 nt, Homo sapiens
ggagaugucauugagcuua

SEQ ID NO: 412856 - RNA, 19 nt, Homo sapiens
gcauagagcaacugcauug

SEQ ID NO: 412857 - RNA, 19 nt, Homo sapiens
gaagaauccuaugguggaa

SEQ ID NO: 412858 - RNA, 19 nt, Homo sapiens
gaaauagaaagcagaguuc

SEQ ID NO: 412859 - RNA, 19 nt, Homo sapiens
ggaaacauuggguacagua

SEQ ID NO: 412860 - RNA, 19 nt, Homo sapiens
cugaguugguccaguauua

SEQ ID NO: 412861 - RNA, 19 nt, Homo sapiens
ggaaagaguaaauguguca

SEQ ID NO: 412862 - RNA, 19 nt, Homo sapiens
gaggaaagaguaaaugugu

SEQ ID NO: 412863 - RNA, 19 nt, Homo sapiens
uagcugagaccacagauaa

SEQ ID NO: 412864 - RNA, 19 nt, Homo sapiens
agagaacggucuggcaaua

SEQ ID NO: 412865 - RNA, 19 nt, Homo sapiens
gaggagaacgguuugauuc

SEQ ID NO: 412866 - RNA, 19 nt, Homo sapiens
cagaucuuguggaacauua

SEQ ID NO: 412867 - RNA, 19 nt, Homo sapiens
uaaagugacccauguuaug

SEQ ID NO: 412868 - RNA, 19 nt, Homo sapiens
ccuggagacuucacacuuu

SEQ ID NO: 412869 - RNA, 19 nt, Homo sapiens
gcgcacuggugaugacaaa

SEQ ID NO: 412870 - RNA, 19 nt, Homo sapiens
ucagaacacuggugauuac

SEQ ID NO: 412871 - RNA, 19 nt, Homo sapiens
gagaugguuucacccaaau

SEQ ID NO: 412872 - RNA, 19 nt, Homo sapiens
gacggcaagucuaaaguga

SEQ ID NO: 412873 - RNA, 19 nt, Homo sapiens
ucauugagcuuaaauaucc

SEQ ID NO: 412874 - RNA, 19 nt, Homo sapiens
caaugagccuguuucagau

SEQ ID NO: 412875 - RNA, 19 nt, Homo sapiens
ggaggagaacgguuugauu

SEQ ID NO: 412876 - RNA, 19 nt, Homo sapiens
uuaaauauccucugaacug

SEQ ID NO: 412877 - RNA, 19 nt, Homo sapiens
guuaggaacgucaaagaaa

SEQ ID NO: 412878 - RNA, 19 nt, Homo sapiens
gaucuuguggaacauuaua

SEQ ID NO: 412879 - RNA, 19 nt, Homo sapiens
uggcugaguugguccagua

SEQ ID NO: 412880 - RNA, 19 nt, Homo sapiens
cgacguugguggaggagaa

SEQ ID NO: 412881 - RNA, 19 nt, Homo sapiens
uaaauauccucugaacugu

SEQ ID NO: 412882 - RNA, 19 nt, Homo sapiens
gcagaaaaccuacuguuga

SEQ ID NO: 412883 - RNA, 19 nt, Homo sapiens
ugaaauagaaagcagaguu

SEQ ID NO: 412884 - RNA, 19 nt, Homo sapiens
aaaugcugcugaaauagaa

SEQ ID NO: 412885 - RNA, 19 nt, Homo sapiens
uaaaugcugcugaaauaga

SEQ ID NO: 412886 - RNA, 19 nt, Homo sapiens
gggaagaauuugagacacu

SEQ ID NO: 412887 - RNA, 19 nt, Homo sapiens
guauaaaugcugcugaaau

SEQ ID NO: 412888 - RNA, 19 nt, Homo sapiens
ggaacaucacgggcaauua

SEQ ID NO: 412889 - RNA, 19 nt, Homo sapiens
guggagagaggaaagagua

SEQ ID NO: 412890 - RNA, 19 nt, Homo sapiens
cggaugguguuccaagaaa

SEQ ID NO: 412891 - RNA, 19 nt, Homo sapiens
caaugcaaauaucaucaug

SEQ ID NO: 412892 - RNA, 19 nt, Homo sapiens
gcaacaugcucaguuaaaa

SEQ ID NO: 412893 - RNA, 19 nt, Homo sapiens
gagaggaaagaguaaaugu

SEQ ID NO: 412894 - RNA, 19 nt, Homo sapiens
aguauuacauggaacauca

SEQ ID NO: 412895 - RNA, 19 nt, Homo sapiens
ugauuacuaugaccuguau

SEQ ID NO: 412896 - RNA, 19 nt, Homo sapiens
ucaaauacuggccugauga

SEQ ID NO: 412897 - RNA, 19 nt, Homo sapiens
gcuuaaauauccucugaac

SEQ ID NO: 412898 - RNA, 19 nt, Homo sapiens
ggcaacaugcucaguuaaa

SEQ ID NO: 412899 - RNA, 19 nt, Homo sapiens
acuccuagcucuuuaacug

SEQ ID NO: 412900 - RNA, 19 nt, Homo sapiens
ggagagaggaaagaguaaa

SEQ ID NO: 412901 - RNA, 19 nt, Homo sapiens
ccaagugcaacaauucaaa

SEQ ID NO: 412902 - RNA, 19 nt, Homo sapiens
aaagugacccauguuauga

SEQ ID NO: 412903 - RNA, 19 nt, Homo sapiens
ucuaaagugacccauguua

SEQ ID NO: 412904 - RNA, 19 nt, Homo sapiens
gagccacccuggagauuuu

SEQ ID NO: 412905 - RNA, 19 nt, Homo sapiens
gagagaggaaagaguaaau

SEQ ID NO: 412906 - RNA, 19 nt, Homo sapiens
agaguuacauugccacaca

SEQ ID NO: 412907 - RNA, 19 nt, Homo sapiens
ccacagauaaagucaaaca

SEQ ID NO: 412908 - RNA, 19 nt, Homo sapiens
ucacccacaucaagauuca

SEQ ID NO: 412909 - RNA, 19 nt, Homo sapiens
gucaaauacuggccugaug

SEQ ID NO: 412910 - RNA, 19 nt, Homo sapiens
gaugguuucacccaaauau

SEQ ID NO: 412911 - RNA, 19 nt, Homo sapiens
uaucaucaugccugaauuu

SEQ ID NO: 412912 - RNA, 19 nt, Homo sapiens
ggucuggcaauaccacuuu

SEQ ID NO: 412913 - RNA, 19 nt, Homo sapiens
cagaaguugugcauuaaac

SEQ ID NO: 412914 - RNA, 19 nt, Homo sapiens
aaaagaauauggcgucaug

SEQ ID NO: 412915 - RNA, 19 nt, Homo sapiens
uuaggaacgucaaagaaag

SEQ ID NO: 412916 - RNA, 19 nt, Homo sapiens
gaaguggagagaggaaaga

SEQ ID NO: 412917 - RNA, 19 nt, Homo sapiens
aaaccaagugcaacaauuc

SEQ ID NO: 412918 - RNA, 19 nt, Homo sapiens
uuugacagaucuuguggaa

SEQ ID NO: 412919 - RNA, 19 nt, Homo sapiens
ggaacugaaauacgacguu

SEQ ID NO: 412920 - RNA, 19 nt, Homo sapiens
ugaguaugcucuaaaagaa

SEQ ID NO: 412921 - RNA, 19 nt, Homo sapiens
agucuaaagugacccaugu

SEQ ID NO: 412922 - RNA, 19 nt, Homo sapiens
gacuucacacuuuccguua

SEQ ID NO: 412923 - RNA, 19 nt, Homo sapiens
acacuggugauuacuauga

SEQ ID NO: 412924 - RNA, 19 nt, Homo sapiens
augagccuguuucagauua

SEQ ID NO: 412925 - RNA, 19 nt, Homo sapiens
gaacgguuugauucuuuga

SEQ ID NO: 412926 - RNA, 19 nt, Homo sapiens
auggcaacaugcucaguua

SEQ ID NO: 412927 - RNA, 19 nt, Homo sapiens
ucgagaacuaagcaaauua

SEQ ID NO: 412928 - RNA, 19 nt, Homo sapiens
guggaacauuauaagaaga

SEQ ID NO: 412929 - RNA, 19 nt, Homo sapiens
cuaaagugacccauguuau

SEQ ID NO: 412930 - RNA, 19 nt, Homo sapiens
ggaauuaaguucagaucua

SEQ ID NO: 412931 - RNA, 19 nt, Homo sapiens
uaucagagaucaaagauug

SEQ ID NO: 412932 - RNA, 19 nt, Homo sapiens
gaaggcaauuccucagaua

SEQ ID NO: 412933 - RNA, 19 nt, Homo sapiens
cagcagaccucaacagaaa

SEQ ID NO: 412934 - RNA, 19 nt, Homo sapiens
gaagauugucuaccaaaua

SEQ ID NO: 412935 - RNA, 19 nt, Homo sapiens
ggaaauaucaagaacauga

SEQ ID NO: 412936 - RNA, 19 nt, Homo sapiens
gaacagauacaaggacaua

SEQ ID NO: 412937 - RNA, 19 nt, Homo sapiens
gaagaguccugaccacaau

SEQ ID NO: 412938 - RNA, 19 nt, Homo sapiens
aaacaaaggagcaauauga

SEQ ID NO: 412939 - RNA, 19 nt, Homo sapiens
gaagauguuccuauuugua

SEQ ID NO: 412940 - RNA, 19 nt, Homo sapiens
caacagaagccacagauau

SEQ ID NO: 412941 - RNA, 19 nt, Homo sapiens
caagagagaacaaauauca

SEQ ID NO: 412942 - RNA, 19 nt, Homo sapiens
ugaaagaacuccugaaucg

SEQ ID NO: 412943 - RNA, 19 nt, Homo sapiens
gaggaaauaucaagaacau

SEQ ID NO: 412944 - RNA, 19 nt, Homo sapiens
gaacucaagugggauuaga

SEQ ID NO: 412945 - RNA, 19 nt, Homo sapiens
gcauaugguuucaucagaa

SEQ ID NO: 412946 - RNA, 19 nt, Homo sapiens
ggagcaauaugaacuuguu

SEQ ID NO: 412947 - RNA, 19 nt, Homo sapiens
ccagaggaauuuaauguau

SEQ ID NO: 412948 - RNA, 19 nt, Homo sapiens
uaacagcaguguagauugu

SEQ ID NO: 412949 - RNA, 19 nt, Homo sapiens
gaaagccagauuuauagua

SEQ ID NO: 412950 - RNA, 19 nt, Homo sapiens
ccacugaaagccagauuua

SEQ ID NO: 412951 - RNA, 19 nt, Homo sapiens
ccagaagaaucccagaauu

SEQ ID NO: 412952 - RNA, 19 nt, Homo sapiens
acaaaggcauucugcagua

SEQ ID NO: 412953 - RNA, 19 nt, Homo sapiens
ggagcuagaagacacuuua

SEQ ID NO: 412954 - RNA, 19 nt, Homo sapiens
ugaaacaccugaucuugug

SEQ ID NO: 412955 - RNA, 19 nt, Homo sapiens
gaugagaaaggacauguaa

SEQ ID NO: 412956 - RNA, 19 nt, Homo sapiens
ccagaccgcuugccucuug

SEQ ID NO: 412957 - RNA, 19 nt, Homo sapiens
guaauggccugccgagaau

SEQ ID NO: 412958 - RNA, 19 nt, Homo sapiens
uaagugccuuggaacaaua

SEQ ID NO: 412959 - RNA, 19 nt, Homo sapiens
ggugauacuucccagaauu

SEQ ID NO: 412960 - RNA, 19 nt, Homo sapiens
caagaaaugagaacacaaa

SEQ ID NO: 412961 - RNA, 19 nt, Homo sapiens
ucucuuagcuugugugugu

SEQ ID NO: 412962 - RNA, 19 nt, Homo sapiens
uaaacuugcuggauucaug

SEQ ID NO: 412963 - RNA, 19 nt, Homo sapiens
ugacaagagagaacaaaua

SEQ ID NO: 412964 - RNA, 19 nt, Homo sapiens
gaucacagccgaguuaaau

SEQ ID NO: 412965 - RNA, 19 nt, Homo sapiens
caaagccaguguugcauau

SEQ ID NO: 412966 - RNA, 19 nt, Homo sapiens
ggaacaauauugaauucuc

SEQ ID NO: 412967 - RNA, 19 nt, Homo sapiens
gacaagagagaacaaauau

SEQ ID NO: 412968 - RNA, 19 nt, Homo sapiens
gauuauacguggaauuuac

SEQ ID NO: 412969 - RNA, 19 nt, Homo sapiens
gcuuguguguguuucuuua

SEQ ID NO: 412970 - RNA, 19 nt, Homo sapiens
gaagaacaggugccauuug

SEQ ID NO: 412971 - RNA, 19 nt, Homo sapiens
caagagauccaccuucaga

SEQ ID NO: 412972 - RNA, 19 nt, Homo sapiens
cuaauccacuucacucuga

SEQ ID NO: 412973 - RNA, 19 nt, Homo sapiens
guaagugccuuggaacaau

SEQ ID NO: 412974 - RNA, 19 nt, Homo sapiens
gcaggacaaugauagauac

SEQ ID NO: 412975 - RNA, 19 nt, Homo sapiens
gacaugauaagcuuaauga

SEQ ID NO: 412976 - RNA, 19 nt, Homo sapiens
ucaggacacucuuacuuga

SEQ ID NO: 412977 - RNA, 19 nt, Homo sapiens
cagacuauaucaaugcaaa

SEQ ID NO: 412978 - RNA, 19 nt, Homo sapiens
uaaagacuccuucacaaga

SEQ ID NO: 412979 - RNA, 19 nt, Homo sapiens
ggacaaugauagauaccau

SEQ ID NO: 412980 - RNA, 19 nt, Homo sapiens
agucagagauucaguaagu

SEQ ID NO: 412981 - RNA, 19 nt, Homo sapiens
cauaacguuugcaccauuu

SEQ ID NO: 412982 - RNA, 19 nt, Homo sapiens
gcagccagcuuugcagguu

SEQ ID NO: 412983 - RNA, 19 nt, Homo sapiens
ggaagaacaggugccauuu

SEQ ID NO: 412984 - RNA, 19 nt, Homo sapiens
ucacaagauucagacuaua

SEQ ID NO: 412985 - RNA, 19 nt, Homo sapiens
cgggagguauucacuauga

SEQ ID NO: 412986 - RNA, 19 nt, Homo sapiens
uuaagaagauugucuacca

SEQ ID NO: 412987 - RNA, 19 nt, Homo sapiens
acugaaagccagauuuaua

SEQ ID NO: 412988 - RNA, 19 nt, Homo sapiens
gauaacacuucaccacucu

SEQ ID NO: 412989 - RNA, 19 nt, Homo sapiens
ugauuuaucugaaggcaau

SEQ ID NO: 412990 - RNA, 19 nt, Homo sapiens
uaagaagauugucuaccaa

SEQ ID NO: 412991 - RNA, 19 nt, Homo sapiens
uaaaucugcuucaccuugu

SEQ ID NO: 412992 - RNA, 19 nt, Homo sapiens
ggaacacacuuuugaauag

SEQ ID NO: 412993 - RNA, 19 nt, Homo sapiens
acuaaaagcugggaaaaua

SEQ ID NO: 412994 - RNA, 19 nt, Homo sapiens
gcuauuggccuuuguaugg

SEQ ID NO: 412995 - RNA, 19 nt, Homo sapiens
gauaugggaguauaauguu

SEQ ID NO: 412996 - RNA, 19 nt, Homo sapiens
uaauauagcaggaacaaca

SEQ ID NO: 412997 - RNA, 19 nt, Homo sapiens
guaacguggucauuucaug

SEQ ID NO: 412998 - RNA, 19 nt, Homo sapiens
cauguaacguggucauuuc

SEQ ID NO: 412999 - RNA, 19 nt, Homo sapiens
gaccucaacagaaacuaua

SEQ ID NO: 413000 - RNA, 19 nt, Homo sapiens
ggacacucuuacuugaauu

SEQ ID NO: 413001 - RNA, 19 nt, Homo sapiens
ggaguauaauguugugauc

SEQ ID NO: 413002 - RNA, 19 nt, Homo sapiens
aaagaacuccugaaucguu

SEQ ID NO: 413003 - RNA, 19 nt, Homo sapiens
guaacacaaucaaacaaag

SEQ ID NO: 413004 - RNA, 19 nt, Homo sapiens
ccauuugugccauagauua

SEQ ID NO: 413005 - RNA, 19 nt, Homo sapiens
aagaacaggugccauuugu

SEQ ID NO: 413006 - RNA, 19 nt, Homo sapiens
ccauaacguuugcaccauu

SEQ ID NO: 413007 - RNA, 19 nt, Homo sapiens
uagaauguccaccuacuuu

SEQ ID NO: 413008 - RNA, 19 nt, Homo sapiens
gaugaaagaaacucugaug

SEQ ID NO: 413009 - RNA, 19 nt, Homo sapiens
uguguggacugcaguguaa

SEQ ID NO: 413010 - RNA, 19 nt, Homo sapiens
ccaaagccaguguugcaua

SEQ ID NO: 413011 - RNA, 19 nt, Homo sapiens
gaacuggccagaccaugau

SEQ ID NO: 413012 - RNA, 19 nt, Homo sapiens
ggcuguaucaguuucauua

SEQ ID NO: 413013 - RNA, 19 nt, Homo sapiens
guacagggcaaguagguau

SEQ ID NO: 413014 - RNA, 19 nt, Homo sapiens
ccacccaucuugacaccuu

SEQ ID NO: 413015 - RNA, 19 nt, Homo sapiens
augaagauguuccuauuug

SEQ ID NO: 413016 - RNA, 19 nt, Homo sapiens
ggaggaugauaugggagua

SEQ ID NO: 413017 - RNA, 19 nt, Homo sapiens
caguguagauuguuaccuu

SEQ ID NO: 413018 - RNA, 19 nt, Homo sapiens
guuagcaagugaacauaau

SEQ ID NO: 413019 - RNA, 19 nt, Homo sapiens
caccuuguauagcugauaa

SEQ ID NO: 413020 - RNA, 19 nt, Homo sapiens
acaaggacauacugccauu

SEQ ID NO: 413021 - RNA, 19 nt, Homo sapiens
aagcauauguagcaacuca

SEQ ID NO: 413022 - RNA, 19 nt, Homo sapiens
ugaauucucuuagcuugug

SEQ ID NO: 413023 - RNA, 19 nt, Homo sapiens
ccaucuaccugccuuauac

SEQ ID NO: 413024 - RNA, 19 nt, Homo sapiens
acagcaguguagauuguua

SEQ ID NO: 413025 - RNA, 19 nt, Homo sapiens
ucacagccgaguuaaauug

SEQ ID NO: 413026 - RNA, 19 nt, Homo sapiens
aaugauagauaccauccaa

SEQ ID NO: 413027 - RNA, 19 nt, Homo sapiens
ggacauacugccauuugau

SEQ ID NO: 413028 - RNA, 19 nt, Homo sapiens
ggcaggacaaugauagaua

SEQ ID NO: 413029 - RNA, 19 nt, Homo sapiens
gcugauggagugaaugaaa

SEQ ID NO: 413030 - RNA, 19 nt, Homo sapiens
gcaccaaucuuguuuauag

SEQ ID NO: 413031 - RNA, 19 nt, Homo sapiens
gauguuaucuugaaaguga

SEQ ID NO: 413032 - RNA, 19 nt, Homo sapiens
gaaggcaacuuaauuaauc

SEQ ID NO: 413033 - RNA, 19 nt, Homo sapiens
gaacaaaccaugaagauuc

SEQ ID NO: 413034 - RNA, 19 nt, Homo sapiens
gaaagaagaaccaaagaaa

SEQ ID NO: 413035 - RNA, 19 nt, Homo sapiens
ggaaagaagaguucguuua

SEQ ID NO: 413036 - RNA, 19 nt, Homo sapiens
gaagguggcuauaucaaug

SEQ ID NO: 413037 - RNA, 19 nt, Homo sapiens
gaagaaauaugggcuguau

SEQ ID NO: 413038 - RNA, 19 nt, Homo sapiens
gcauugaugugcuuucuaa

SEQ ID NO: 413039 - RNA, 19 nt, Homo sapiens
cagaucagcuuuccuguaa

SEQ ID NO: 413040 - RNA, 19 nt, Homo sapiens
gaaguagaacuccucauua

SEQ ID NO: 413041 - RNA, 19 nt, Homo sapiens
gaauggagccucuuugaaa

SEQ ID NO: 413042 - RNA, 19 nt, Homo sapiens
gccaaagacugacagaaua

SEQ ID NO: 413043 - RNA, 19 nt, Homo sapiens
ccaagaagcugaaguuauc

SEQ ID NO: 413044 - RNA, 19 nt, Homo sapiens
gaagaugugacacuuguua

SEQ ID NO: 413045 - RNA, 19 nt, Homo sapiens
caugaugacucaagaagua

SEQ ID NO: 413046 - RNA, 19 nt, Homo sapiens
caacucaggucaaagacua

SEQ ID NO: 413047 - RNA, 19 nt, Homo sapiens
caaagucuguugcgaguuu

SEQ ID NO: 413048 - RNA, 19 nt, Homo sapiens
gcaaugacccuugaagaua

SEQ ID NO: 413049 - RNA, 19 nt, Homo sapiens
gaagagagaacagaagaua

SEQ ID NO: 413050 - RNA, 19 nt, Homo sapiens
caucagaccuuucuuaaca

SEQ ID NO: 413051 - RNA, 19 nt, Homo sapiens
ucaaagaggucugcuguuu

SEQ ID NO: 413052 - RNA, 19 nt, Homo sapiens
gaugaaaccuuaagucaag

SEQ ID NO: 413053 - RNA, 19 nt, Homo sapiens
gaaggaagaacagauauaa

SEQ ID NO: 413054 - RNA, 19 nt, Homo sapiens
ccucagagccaaccuauua

SEQ ID NO: 413055 - RNA, 19 nt, Homo sapiens
gcuaucaagucauccuuua

SEQ ID NO: 413056 - RNA, 19 nt, Homo sapiens
gaauggcugugaagaauau

SEQ ID NO: 413057 - RNA, 19 nt, Homo sapiens
gcccuuggcuucaucauuu

SEQ ID NO: 413058 - RNA, 19 nt, Homo sapiens
gcaaacauaucaaauucga

SEQ ID NO: 413059 - RNA, 19 nt, Homo sapiens
gcaaauguuuacuguauca

SEQ ID NO: 413060 - RNA, 19 nt, Homo sapiens
gacagaggaucaauauauu

SEQ ID NO: 413061 - RNA, 19 nt, Homo sapiens
gagaauugguuguuauguu

SEQ ID NO: 413062 - RNA, 19 nt, Homo sapiens
cauaguaucuucaccagaa

SEQ ID NO: 413063 - RNA, 19 nt, Homo sapiens
uaacagagcauuagacaug

SEQ ID NO: 413064 - RNA, 19 nt, Homo sapiens
gaagagacaguuacaguga

SEQ ID NO: 413065 - RNA, 19 nt, Homo sapiens
gggaacugcuccagaagua

SEQ ID NO: 413066 - RNA, 19 nt, Homo sapiens
gcaagcauauguucuagau

SEQ ID NO: 413067 - RNA, 19 nt, Homo sapiens
ccaugaagauucugauaaa

SEQ ID NO: 413068 - RNA, 19 nt, Homo sapiens
gaagacugaugaugaugaa

SEQ ID NO: 413069 - RNA, 19 nt, Homo sapiens
ccagguacauuaaagauga

SEQ ID NO: 413070 - RNA, 19 nt, Homo sapiens
gaaguuaucagaagagaga

SEQ ID NO: 413071 - RNA, 19 nt, Homo sapiens
gaagaugacauuuaugaug

SEQ ID NO: 413072 - RNA, 19 nt, Homo sapiens
ggaaguagaacuccucauu

SEQ ID NO: 413073 - RNA, 19 nt, Homo sapiens
gaacugaccugugauacca

SEQ ID NO: 413074 - RNA, 19 nt, Homo sapiens
uaacuucucucucagaugu

SEQ ID NO: 413075 - RNA, 19 nt, Homo sapiens
aaagaugaaugggaaguua

SEQ ID NO: 413076 - RNA, 19 nt, Homo sapiens
gcaagacagugcuauagau

SEQ ID NO: 413077 - RNA, 19 nt, Homo sapiens
ccaaagccacuguuaauuu

SEQ ID NO: 413078 - RNA, 19 nt, Homo sapiens
uagcuacccucaaagauaa

SEQ ID NO: 413079 - RNA, 19 nt, Homo sapiens
cuaaggagcuggagaaucu

SEQ ID NO: 413080 - RNA, 19 nt, Homo sapiens
cuaguucgauggauaagua

SEQ ID NO: 413081 - RNA, 19 nt, Homo sapiens
cagcaaacauaucaaauuc

SEQ ID NO: 413082 - RNA, 19 nt, Homo sapiens
caaccaagaugcccaagau

SEQ ID NO: 413083 - RNA, 19 nt, Homo sapiens
gaugauagcagacauuguu

SEQ ID NO: 413084 - RNA, 19 nt, Homo sapiens
gaucauuccuuucugacaa

SEQ ID NO: 413085 - RNA, 19 nt, Homo sapiens
ggaaguauagccuuggaua

SEQ ID NO: 413086 - RNA, 19 nt, Homo sapiens
caucaaagauacacaagau

SEQ ID NO: 413087 - RNA, 19 nt, Homo sapiens
uggacgaguucuagaauua

SEQ ID NO: 413088 - RNA, 19 nt, Homo sapiens
gaaaacaacucaggucaaa

SEQ ID NO: 413089 - RNA, 19 nt, Homo sapiens
gugaauacauccaacaaga

SEQ ID NO: 413090 - RNA, 19 nt, Homo sapiens
uaagagaaauugcccuaga

SEQ ID NO: 413091 - RNA, 19 nt, Homo sapiens
caaugacccuugaagauau

SEQ ID NO: 413092 - RNA, 19 nt, Homo sapiens
gaaagaagaguucguuuac

SEQ ID NO: 413093 - RNA, 19 nt, Homo sapiens
uaacaaagggcuuaguaaa

SEQ ID NO: 413094 - RNA, 19 nt, Homo sapiens
gagaagaagucacaaacag

SEQ ID NO: 413095 - RNA, 19 nt, Homo sapiens
ggacauggugagucuauuu

SEQ ID NO: 413096 - RNA, 19 nt, Homo sapiens
gaagaguucguuuacauug

SEQ ID NO: 413097 - RNA, 19 nt, Homo sapiens
ccaggucaaugguuucuuu

SEQ ID NO: 413098 - RNA, 19 nt, Homo sapiens
ggaaagaagaaccaaagaa

SEQ ID NO: 413099 - RNA, 19 nt, Homo sapiens
auacacgggugccaacuua

SEQ ID NO: 413100 - RNA, 19 nt, Homo sapiens
aaagaggucugcuguuuca

SEQ ID NO: 413101 - RNA, 19 nt, Homo sapiens
gaacuccucauuacccuaa

SEQ ID NO: 413102 - RNA, 19 nt, Homo sapiens
gaagauaccauuuguacca

SEQ ID NO: 413103 - RNA, 19 nt, Homo sapiens
ucaagaagauaccauuugu

SEQ ID NO: 413104 - RNA, 19 nt, Homo sapiens
gaacugcuccagaaguauu

SEQ ID NO: 413105 - RNA, 19 nt, Homo sapiens
caaagaagaguuacccaaa

SEQ ID NO: 413106 - RNA, 19 nt, Homo sapiens
cgagaucgauugcgaggaa

SEQ ID NO: 413107 - RNA, 19 nt, Homo sapiens
gacugaugaugaugaaaua

SEQ ID NO: 413108 - RNA, 19 nt, Homo sapiens
caaaggcaaucagagaauu

SEQ ID NO: 413109 - RNA, 19 nt, Homo sapiens
guggaaacacugagaaaua

SEQ ID NO: 413110 - RNA, 19 nt, Homo sapiens
caaaggugaucgcguccua

SEQ ID NO: 413111 - RNA, 19 nt, Homo sapiens
gauaacagcuuggggauaa

SEQ ID NO: 413112 - RNA, 19 nt, Homo sapiens
gaaaggaggaaacaugaau

SEQ ID NO: 413113 - RNA, 19 nt, Homo sapiens
aagaagaguuacccaaauu

SEQ ID NO: 413114 - RNA, 19 nt, Homo sapiens
cgaaggaaaguaaacauaa

SEQ ID NO: 413115 - RNA, 19 nt, Homo sapiens
gaaacagccaugacucaaa

SEQ ID NO: 413116 - RNA, 19 nt, Homo sapiens
acaaagggcuuaguaaauc

SEQ ID NO: 413117 - RNA, 19 nt, Homo sapiens
gaguggagaagaugacuua

SEQ ID NO: 413118 - RNA, 19 nt, Homo sapiens
gcacaaguacuuccaaaca

SEQ ID NO: 413119 - RNA, 19 nt, Homo sapiens
gacaaucuccaacaucuaa

SEQ ID NO: 413120 - RNA, 19 nt, Homo sapiens
gaaucuuccucuucaguga

SEQ ID NO: 413121 - RNA, 19 nt, Homo sapiens
cauggugugucuuacuuua

SEQ ID NO: 413122 - RNA, 19 nt, Homo sapiens
ugaugagacuuccuuauug

SEQ ID NO: 413123 - RNA, 19 nt, Homo sapiens
gaucagcuuuccuguaaca

SEQ ID NO: 413124 - RNA, 19 nt, Homo sapiens
cauguucuccucuaucuua

SEQ ID NO: 413125 - RNA, 19 nt, Homo sapiens
agacagaggaucaauauau

SEQ ID NO: 413126 - RNA, 19 nt, Homo sapiens
aaagaagacugaugaugau

SEQ ID NO: 413127 - RNA, 19 nt, Homo sapiens
ggaaguuaacagagcauua

SEQ ID NO: 413128 - RNA, 19 nt, Homo sapiens
ggaggaaacaugaaucaga

SEQ ID NO: 413129 - RNA, 19 nt, Homo sapiens
gaaaggaugcacugugaug

SEQ ID NO: 413130 - RNA, 19 nt, Homo sapiens
gcaccaaucuuguuuauag

SEQ ID NO: 413131 - RNA, 19 nt, Homo sapiens
gauguuaucuugaaaguga

SEQ ID NO: 413132 - RNA, 19 nt, Homo sapiens
gaaggcaacuuaauuaauc

SEQ ID NO: 413133 - RNA, 19 nt, Homo sapiens
gaacaaaccaugaagauuc

SEQ ID NO: 413134 - RNA, 19 nt, Homo sapiens
gaaagaagaaccaaagaaa

SEQ ID NO: 413135 - RNA, 19 nt, Homo sapiens
ggaaagaagaguucguuua

SEQ ID NO: 413136 - RNA, 19 nt, Homo sapiens
gaagguggcuauaucaaug

SEQ ID NO: 413137 - RNA, 19 nt, Homo sapiens
gaagaaauaugggcuguau

SEQ ID NO: 413138 - RNA, 19 nt, Homo sapiens
gcauugaugugcuuucuaa

SEQ ID NO: 413139 - RNA, 19 nt, Homo sapiens
cagaucagcuuuccuguaa

SEQ ID NO: 413140 - RNA, 19 nt, Homo sapiens
gaaguagaacuccucauua

SEQ ID NO: 413141 - RNA, 19 nt, Homo sapiens
gaauggagccucuuugaaa

SEQ ID NO: 413142 - RNA, 19 nt, Homo sapiens
gccaaagacugacagaaua

SEQ ID NO: 413143 - RNA, 19 nt, Homo sapiens
ccaagaagcugaaguuauc

SEQ ID NO: 413144 - RNA, 19 nt, Homo sapiens
gaagaugugacacuuguua

SEQ ID NO: 413145 - RNA, 19 nt, Homo sapiens
caugaugacucaagaagua

SEQ ID NO: 413146 - RNA, 19 nt, Homo sapiens
caacucaggucaaagacua

SEQ ID NO: 413147 - RNA, 19 nt, Homo sapiens
caaagucuguugcgaguuu

SEQ ID NO: 413148 - RNA, 19 nt, Homo sapiens
gcaaugacccuugaagaua

SEQ ID NO: 413149 - RNA, 19 nt, Homo sapiens
gaagagagaacagaagaua

SEQ ID NO: 413150 - RNA, 19 nt, Homo sapiens
caucagaccuuucuuaaca

SEQ ID NO: 413151 - RNA, 19 nt, Homo sapiens
ucaaagaggucugcuguuu

SEQ ID NO: 413152 - RNA, 19 nt, Homo sapiens
gaugaaaccuuaagucaag

SEQ ID NO: 413153 - RNA, 19 nt, Homo sapiens
gaaggaagaacagauauaa

SEQ ID NO: 413154 - RNA, 19 nt, Homo sapiens
ccucagagccaaccuauua

SEQ ID NO: 413155 - RNA, 19 nt, Homo sapiens
gcuaucaagucauccuuua

SEQ ID NO: 413156 - RNA, 19 nt, Homo sapiens
gaauggcugugaagaauau

SEQ ID NO: 413157 - RNA, 19 nt, Homo sapiens
gcccuuggcuucaucauuu

SEQ ID NO: 413158 - RNA, 19 nt, Homo sapiens
gcaaacauaucaaauucga

SEQ ID NO: 413159 - RNA, 19 nt, Homo sapiens
gcaagcauauguucuagga

SEQ ID NO: 413160 - RNA, 19 nt, Homo sapiens
gcaaauguuuacuguauca

SEQ ID NO: 413161 - RNA, 19 nt, Homo sapiens
gacagaggaucaauauauu

SEQ ID NO: 413162 - RNA, 19 nt, Homo sapiens
gagaauugguuguuauguu

SEQ ID NO: 413163 - RNA, 19 nt, Homo sapiens
cauaguaucuucaccagaa

SEQ ID NO: 413164 - RNA, 19 nt, Homo sapiens
uaacagagcauuagacaug

SEQ ID NO: 413165 - RNA, 19 nt, Homo sapiens
gaagagacaguuacaguga

SEQ ID NO: 413166 - RNA, 19 nt, Homo sapiens
gggaacugcuccagaagua

SEQ ID NO: 413167 - RNA, 19 nt, Homo sapiens
ccaugaagauucugauaaa

SEQ ID NO: 413168 - RNA, 19 nt, Homo sapiens
gaagacugaugaugaugaa

SEQ ID NO: 413169 - RNA, 19 nt, Homo sapiens
ccagguacauuaaagauga

SEQ ID NO: 413170 - RNA, 19 nt, Homo sapiens
gaaguuaucagaagagaga

SEQ ID NO: 413171 - RNA, 19 nt, Homo sapiens
gaagaugacauuuaugaug

SEQ ID NO: 413172 - RNA, 19 nt, Homo sapiens
ggaaguagaacuccucauu

SEQ ID NO: 413173 - RNA, 19 nt, Homo sapiens
gaacugaccugugauacca

SEQ ID NO: 413174 - RNA, 19 nt, Homo sapiens
uaacuucucucucagaugu

SEQ ID NO: 413175 - RNA, 19 nt, Homo sapiens
aaagaugaaugggaaguua

SEQ ID NO: 413176 - RNA, 19 nt, Homo sapiens
gcaagacagugcuauagau

SEQ ID NO: 413177 - RNA, 19 nt, Homo sapiens
ccaaagccacuguuaauuu

SEQ ID NO: 413178 - RNA, 19 nt, Homo sapiens
uagcuacccucaaagauaa

SEQ ID NO: 413179 - RNA, 19 nt, Homo sapiens
cuaaggagcuggagaaucu

SEQ ID NO: 413180 - RNA, 19 nt, Homo sapiens
cuaguucgauggauaagua

SEQ ID NO: 413181 - RNA, 19 nt, Homo sapiens
cagcaaacauaucaaauuc

SEQ ID NO: 413182 - RNA, 19 nt, Homo sapiens
caaccaagaugcccaagau

SEQ ID NO: 413183 - RNA, 19 nt, Homo sapiens
gaugauagcagacauuguu

SEQ ID NO: 413184 - RNA, 19 nt, Homo sapiens
gaucauuccuuucugacaa

SEQ ID NO: 413185 - RNA, 19 nt, Homo sapiens
ggaaguauagccuuggaua

SEQ ID NO: 413186 - RNA, 19 nt, Homo sapiens
caucaaagauacacaagau

SEQ ID NO: 413187 - RNA, 19 nt, Homo sapiens
uggacgaguucuagaauua

SEQ ID NO: 413188 - RNA, 19 nt, Homo sapiens
gaaaacaacucaggucaaa

SEQ ID NO: 413189 - RNA, 19 nt, Homo sapiens
gugaauacauccaacaaga

SEQ ID NO: 413190 - RNA, 19 nt, Homo sapiens
uaagagaaauugcccuaga

SEQ ID NO: 413191 - RNA, 19 nt, Homo sapiens
caaugacccuugaagauau

SEQ ID NO: 413192 - RNA, 19 nt, Homo sapiens
gaaagaagaguucguuuac

SEQ ID NO: 413193 - RNA, 19 nt, Homo sapiens
uaacaaagggcuuaguaaa

SEQ ID NO: 413194 - RNA, 19 nt, Homo sapiens
gagaagaagucacaaacag

SEQ ID NO: 413195 - RNA, 19 nt, Homo sapiens
ggacauggugagucuauuu

SEQ ID NO: 413196 - RNA, 19 nt, Homo sapiens
gaagaguucguuuacauug

SEQ ID NO: 413197 - RNA, 19 nt, Homo sapiens
ccaggucaaugguuucuuu

SEQ ID NO: 413198 - RNA, 19 nt, Homo sapiens
ggaaagaagaaccaaagaa

SEQ ID NO: 413199 - RNA, 19 nt, Homo sapiens
auacacgggugccaacuua

SEQ ID NO: 413200 - RNA, 19 nt, Homo sapiens
aaagaggucugcuguuuca

SEQ ID NO: 413201 - RNA, 19 nt, Homo sapiens
gaacuccucauuacccuaa

SEQ ID NO: 413202 - RNA, 19 nt, Homo sapiens
gaagauaccauuuguacca

SEQ ID NO: 413203 - RNA, 19 nt, Homo sapiens
ucaagaagauaccauuugu

SEQ ID NO: 413204 - RNA, 19 nt, Homo sapiens
gaacugcuccagaaguauu

SEQ ID NO: 413205 - RNA, 19 nt, Homo sapiens
caaagaagaguuacccaaa

SEQ ID NO: 413206 - RNA, 19 nt, Homo sapiens
cgagaucgauugcgaggaa

SEQ ID NO: 413207 - RNA, 19 nt, Homo sapiens
gacugaugaugaugaaaua

SEQ ID NO: 413208 - RNA, 19 nt, Homo sapiens
caaaggcaaucagagaauu

SEQ ID NO: 413209 - RNA, 19 nt, Homo sapiens
guggaaacacugagaaaua

SEQ ID NO: 413210 - RNA, 19 nt, Homo sapiens
caaaggugaucgcguccua

SEQ ID NO: 413211 - RNA, 19 nt, Homo sapiens
gauaacagcuuggggauaa

SEQ ID NO: 413212 - RNA, 19 nt, Homo sapiens
gaaaggaggaaacaugaau

SEQ ID NO: 413213 - RNA, 19 nt, Homo sapiens
aagaagaguuacccaaauu

SEQ ID NO: 413214 - RNA, 19 nt, Homo sapiens
cgaaggaaaguaaacauaa

SEQ ID NO: 413215 - RNA, 19 nt, Homo sapiens
gaaacagccaugacucaaa

SEQ ID NO: 413216 - RNA, 19 nt, Homo sapiens
acaaagggcuuaguaaauc

SEQ ID NO: 413217 - RNA, 19 nt, Homo sapiens
gaguggagaagaugacuua

SEQ ID NO: 413218 - RNA, 19 nt, Homo sapiens
gcacaaguacuuccaaaca

SEQ ID NO: 413219 - RNA, 19 nt, Homo sapiens
gacaaucuccaacaucuaa

SEQ ID NO: 413220 - RNA, 19 nt, Homo sapiens
gaaucuuccucuucaguga

SEQ ID NO: 413221 - RNA, 19 nt, Homo sapiens
cauggugugucuuacuuua

SEQ ID NO: 413222 - RNA, 19 nt, Homo sapiens
ugaugagacuuccuuauug

SEQ ID NO: 413223 - RNA, 19 nt, Homo sapiens
gaucagcuuuccuguaaca

SEQ ID NO: 413224 - RNA, 19 nt, Homo sapiens
cauguucuccucuaucuua

SEQ ID NO: 413225 - RNA, 19 nt, Homo sapiens
agacagaggaucaauauau

SEQ ID NO: 413226 - RNA, 19 nt, Homo sapiens
aaagaagacugaugaugau

SEQ ID NO: 413227 - RNA, 19 nt, Homo sapiens
ggaaguuaacagagcauua

SEQ ID NO: 413228 - RNA, 19 nt, Homo sapiens
ggaggaaacaugaaucaga

SEQ ID NO: 413229 - RNA, 19 nt, Homo sapiens
gaaaggaugcacugugaug

SEQ ID NO: 413230 - RNA, 19 nt, Homo sapiens
gcaccaaucuuguuuauag

SEQ ID NO: 413231 - RNA, 19 nt, Homo sapiens
gauguuaucuugaaaguga

SEQ ID NO: 413232 - RNA, 19 nt, Homo sapiens
gaaggcaacuuaauuaauc

SEQ ID NO: 413233 - RNA, 19 nt, Homo sapiens
gaacaaaccaugaagauuc

SEQ ID NO: 413234 - RNA, 19 nt, Homo sapiens
gaaagaagaaccaaagaaa

SEQ ID NO: 413235 - RNA, 19 nt, Homo sapiens
ggaaagaagaguucguuua

SEQ ID NO: 413236 - RNA, 19 nt, Homo sapiens
gaagguggcuauaucaaug

SEQ ID NO: 413237 - RNA, 19 nt, Homo sapiens
gaagaaauaugggcuguau

SEQ ID NO: 413238 - RNA, 19 nt, Homo sapiens
gcauugaugugcuuucuaa

SEQ ID NO: 413239 - RNA, 19 nt, Homo sapiens
cagaucagcuuuccuguaa

SEQ ID NO: 413240 - RNA, 19 nt, Homo sapiens
gaaguagaacuccucauua

SEQ ID NO: 413241 - RNA, 19 nt, Homo sapiens
gaauggagccucuuugaaa

SEQ ID NO: 413242 - RNA, 19 nt, Homo sapiens
gccaaagacugacagaaua

SEQ ID NO: 413243 - RNA, 19 nt, Homo sapiens
ccaagaagcugaaguuauc

SEQ ID NO: 413244 - RNA, 19 nt, Homo sapiens
gaagaugugacacuuguua

SEQ ID NO: 413245 - RNA, 19 nt, Homo sapiens
caugaugacucaagaagua

SEQ ID NO: 413246 - RNA, 19 nt, Homo sapiens
caacucaggucaaagacua

SEQ ID NO: 413247 - RNA, 19 nt, Homo sapiens
gcaaugacccuugaagaua

SEQ ID NO: 413248 - RNA, 19 nt, Homo sapiens
gaagagagaacagaagaua

SEQ ID NO: 413249 - RNA, 19 nt, Homo sapiens
caucagaccuuucuuaaca

SEQ ID NO: 413250 - RNA, 19 nt, Homo sapiens
ucaaagaggucugcuguuu

SEQ ID NO: 413251 - RNA, 19 nt, Homo sapiens
gaugaaaccuuaagucaag

SEQ ID NO: 413252 - RNA, 19 nt, Homo sapiens
gaaggaagaacagauauaa

SEQ ID NO: 413253 - RNA, 19 nt, Homo sapiens
ccucagagccaaccuauua

SEQ ID NO: 413254 - RNA, 19 nt, Homo sapiens
gcuaucaagucauccuuua

SEQ ID NO: 413255 - RNA, 19 nt, Homo sapiens
gaauggcugugaagaauau

SEQ ID NO: 413256 - RNA, 19 nt, Homo sapiens
gcccuuggcuucaucauuu

SEQ ID NO: 413257 - RNA, 19 nt, Homo sapiens
gcaaacauaucaaauucga

SEQ ID NO: 413258 - RNA, 19 nt, Homo sapiens
gcaaauguuuacuguauca

SEQ ID NO: 413259 - RNA, 19 nt, Homo sapiens
gacagaggaucaauauauu

SEQ ID NO: 413260 - RNA, 19 nt, Homo sapiens
gagaauugguuguuauguu

SEQ ID NO: 413261 - RNA, 19 nt, Homo sapiens
cauaguaucuucaccagaa

SEQ ID NO: 413262 - RNA, 19 nt, Homo sapiens
uaacagagcauuagacaug

SEQ ID NO: 413263 - RNA, 19 nt, Homo sapiens
gaagagacaguuacaguga

SEQ ID NO: 413264 - RNA, 19 nt, Homo sapiens
gggaacugcuccagaagua

SEQ ID NO: 413265 - RNA, 19 nt, Homo sapiens
ccaugaagauucugauaaa

SEQ ID NO: 413266 - RNA, 19 nt, Homo sapiens
gaagacugaugaugaugaa

SEQ ID NO: 413267 - RNA, 19 nt, Homo sapiens
ccagguacauuaaagauga

SEQ ID NO: 413268 - RNA, 19 nt, Homo sapiens
gaaguuaucagaagagaga

SEQ ID NO: 413269 - RNA, 19 nt, Homo sapiens
gaagaugacauuuaugaug

SEQ ID NO: 413270 - RNA, 19 nt, Homo sapiens
ggaaguagaacuccucauu

SEQ ID NO: 413271 - RNA, 19 nt, Homo sapiens
gaacugaccugugauacca

SEQ ID NO: 413272 - RNA, 19 nt, Homo sapiens
uaacuucucucucagaugu

SEQ ID NO: 413273 - RNA, 19 nt, Homo sapiens
aaagaugaaugggaaguua

SEQ ID NO: 413274 - RNA, 19 nt, Homo sapiens
gcaagacagugcuauagau

SEQ ID NO: 413275 - RNA, 19 nt, Homo sapiens
ccaaagccacuguuaauuu

SEQ ID NO: 413276 - RNA, 19 nt, Homo sapiens
uagcuacccucaaagauaa

SEQ ID NO: 413277 - RNA, 19 nt, Homo sapiens
cuaaggagcuggagaaucu

SEQ ID NO: 413278 - RNA, 19 nt, Homo sapiens
cuaguucgauggauaagua

SEQ ID NO: 413279 - RNA, 19 nt, Homo sapiens
cagcaaacauaucaaauuc

SEQ ID NO: 413280 - RNA, 19 nt, Homo sapiens
caaccaagaugcccaagau

SEQ ID NO: 413281 - RNA, 19 nt, Homo sapiens
gaugauagcagacauuguu

SEQ ID NO: 413282 - RNA, 19 nt, Homo sapiens
gaucauuccuuucugacaa

SEQ ID NO: 413283 - RNA, 19 nt, Homo sapiens
ggaaguauagccuuggaua

SEQ ID NO: 413284 - RNA, 19 nt, Homo sapiens
caucaaagauacacaagau

SEQ ID NO: 413285 - RNA, 19 nt, Homo sapiens
uggacgaguucuagaauua

SEQ ID NO: 413286 - RNA, 19 nt, Homo sapiens
gaaaacaacucaggucaaa

SEQ ID NO: 413287 - RNA, 19 nt, Homo sapiens
gugaauacauccaacaaga

SEQ ID NO: 413288 - RNA, 19 nt, Homo sapiens
uaagagaaauugcccuaga

SEQ ID NO: 413289 - RNA, 19 nt, Homo sapiens
caaugacccuugaagauau

SEQ ID NO: 413290 - RNA, 19 nt, Homo sapiens
gaaagaagaguucguuuac

SEQ ID NO: 413291 - RNA, 19 nt, Homo sapiens
uaacaaagggcuuaguaaa

SEQ ID NO: 413292 - RNA, 19 nt, Homo sapiens
gagaagaagucacaaacag

SEQ ID NO: 413293 - RNA, 19 nt, Homo sapiens
ggacauggugagucuauuu

SEQ ID NO: 413294 - RNA, 19 nt, Homo sapiens
gaagaguucguuuacauug

SEQ ID NO: 413295 - RNA, 19 nt, Homo sapiens
ccaggucaaugguuucuuu

SEQ ID NO: 413296 - RNA, 19 nt, Homo sapiens
ggaaagaagaaccaaagaa

SEQ ID NO: 413297 - RNA, 19 nt, Homo sapiens
auacacgggugccaacuua

SEQ ID NO: 413298 - RNA, 19 nt, Homo sapiens
aaagaggucugcuguuuca

SEQ ID NO: 413299 - RNA, 19 nt, Homo sapiens
gaacuccucauuacccuaa

SEQ ID NO: 413300 - RNA, 19 nt, Homo sapiens
gaagauaccauuuguacca

SEQ ID NO: 413301 - RNA, 19 nt, Homo sapiens
ucaagaagauaccauuugu

SEQ ID NO: 413302 - RNA, 19 nt, Homo sapiens
gaacugcuccagaaguauu

SEQ ID NO: 413303 - RNA, 19 nt, Homo sapiens
caaagaagaguuacccaaa

SEQ ID NO: 413304 - RNA, 19 nt, Homo sapiens
cgagaucgauugcgaggaa

SEQ ID NO: 413305 - RNA, 19 nt, Homo sapiens
gacugaugaugaugaaaua

SEQ ID NO: 413306 - RNA, 19 nt, Homo sapiens
caaaggcaaucagagaauu

SEQ ID NO: 413307 - RNA, 19 nt, Homo sapiens
guggaaacacugagaaaua

SEQ ID NO: 413308 - RNA, 19 nt, Homo sapiens
caaaggugaucgcguccua

SEQ ID NO: 413309 - RNA, 19 nt, Homo sapiens
gauaacagcuuggggauaa

SEQ ID NO: 413310 - RNA, 19 nt, Homo sapiens
aagaagaguuacccaaauu

SEQ ID NO: 413311 - RNA, 19 nt, Homo sapiens
cgaaggaaaguaaacauaa

SEQ ID NO: 413312 - RNA, 19 nt, Homo sapiens
gaaacagccaugacucaaa

SEQ ID NO: 413313 - RNA, 19 nt, Homo sapiens
acaaagggcuuaguaaauc

SEQ ID NO: 413314 - RNA, 19 nt, Homo sapiens
gaguggagaagaugacuua

SEQ ID NO: 413315 - RNA, 19 nt, Homo sapiens
gcacaaguacuuccaaaca

SEQ ID NO: 413316 - RNA, 19 nt, Homo sapiens
gacaaucuccaacaucuaa

SEQ ID NO: 413317 - RNA, 19 nt, Homo sapiens
gaaucuuccucuucaguga

SEQ ID NO: 413318 - RNA, 19 nt, Homo sapiens
cauggugugucuuacuuua

SEQ ID NO: 413319 - RNA, 19 nt, Homo sapiens
ugaugagacuuccuuauug

SEQ ID NO: 413320 - RNA, 19 nt, Homo sapiens
gaucagcuuuccuguaaca

SEQ ID NO: 413321 - RNA, 19 nt, Homo sapiens
cauguucuccucuaucuua

SEQ ID NO: 413322 - RNA, 19 nt, Homo sapiens
agacagaggaucaauauau

SEQ ID NO: 413323 - RNA, 19 nt, Homo sapiens
aaagaagacugaugaugau

SEQ ID NO: 413324 - RNA, 19 nt, Homo sapiens
ggaaguuaacagagcauua

SEQ ID NO: 413325 - RNA, 19 nt, Homo sapiens
gaaaggaugcacugugaug

SEQ ID NO: 413326 - RNA, 19 nt, Homo sapiens
gauaaccgaaggaaaguaa

SEQ ID NO: 413327 - RNA, 19 nt, Homo sapiens
gcaagauacucagauggaa

SEQ ID NO: 413328 - RNA, 19 nt, Homo sapiens
caggagagacugccacaua

SEQ ID NO: 413329 - RNA, 19 nt, Homo sapiens
ggaguuaucaguuaucugu

SEQ ID NO: 413330 - RNA, 19 nt, Homo sapiens
gcaccaaucuuguuuauag

SEQ ID NO: 413331 - RNA, 19 nt, Homo sapiens
gauguuaucuugaaaguga

SEQ ID NO: 413332 - RNA, 19 nt, Homo sapiens
gaaggcaacuuaauuaauc

SEQ ID NO: 413333 - RNA, 19 nt, Homo sapiens
gaacaaaccaugaagauuc

SEQ ID NO: 413334 - RNA, 19 nt, Homo sapiens
gaaagaagaaccaaagaaa

SEQ ID NO: 413335 - RNA, 19 nt, Homo sapiens
ggaaagaagaguucguuua

SEQ ID NO: 413336 - RNA, 19 nt, Homo sapiens
gaagguggcuauaucaaug

SEQ ID NO: 413337 - RNA, 19 nt, Homo sapiens
gaagaaauaugggcuguau

SEQ ID NO: 413338 - RNA, 19 nt, Homo sapiens
gcauugaugugcuuucuaa

SEQ ID NO: 413339 - RNA, 19 nt, Homo sapiens
cagaucagcuuuccuguaa

SEQ ID NO: 413340 - RNA, 19 nt, Homo sapiens
gaaguagaacuccucauua

SEQ ID NO: 413341 - RNA, 19 nt, Homo sapiens
gaauggagccucuuugaaa

SEQ ID NO: 413342 - RNA, 19 nt, Homo sapiens
gccaaagacugacagaaua

SEQ ID NO: 413343 - RNA, 19 nt, Homo sapiens
ccaagaagcugaaguuauc

SEQ ID NO: 413344 - RNA, 19 nt, Homo sapiens
gaagaugugacacuuguua

SEQ ID NO: 413345 - RNA, 19 nt, Homo sapiens
caugaugacucaagaagua

SEQ ID NO: 413346 - RNA, 19 nt, Homo sapiens
caacucaggucaaagacua

SEQ ID NO: 413347 - RNA, 19 nt, Homo sapiens
caaagucuguugcgaguuu

SEQ ID NO: 413348 - RNA, 19 nt, Homo sapiens
gcaaugacccuugaagaua

SEQ ID NO: 413349 - RNA, 19 nt, Homo sapiens
gaagagagaacagaagaua

SEQ ID NO: 413350 - RNA, 19 nt, Homo sapiens
caucagaccuuucuuaaca

SEQ ID NO: 413351 - RNA, 19 nt, Homo sapiens
ucaaagaggucugcuguuu

SEQ ID NO: 413352 - RNA, 19 nt, Homo sapiens
gaugaaaccuuaagucaag

SEQ ID NO: 413353 - RNA, 19 nt, Homo sapiens
gaaggaagaacagauauaa

SEQ ID NO: 413354 - RNA, 19 nt, Homo sapiens
ccucagagccaaccuauua

SEQ ID NO: 413355 - RNA, 19 nt, Homo sapiens
gcuaucaagucauccuuua

SEQ ID NO: 413356 - RNA, 19 nt, Homo sapiens
gaauggcugugaagaauau

SEQ ID NO: 413357 - RNA, 19 nt, Homo sapiens
gcccuuggcuucaucauuu

SEQ ID NO: 413358 - RNA, 19 nt, Homo sapiens
gcaaacauaucaaauucga

SEQ ID NO: 413359 - RNA, 19 nt, Homo sapiens
gcaagcauauguucuagga

SEQ ID NO: 413360 - RNA, 19 nt, Homo sapiens
gcaaauguuuacuguauca

SEQ ID NO: 413361 - RNA, 19 nt, Homo sapiens
gacagaggaucaauauauu

SEQ ID NO: 413362 - RNA, 19 nt, Homo sapiens
gagaauugguuguuauguu

SEQ ID NO: 413363 - RNA, 19 nt, Homo sapiens
cauaguaucuucaccagaa

SEQ ID NO: 413364 - RNA, 19 nt, Homo sapiens
uaacagagcauuagacaug

SEQ ID NO: 413365 - RNA, 19 nt, Homo sapiens
gaagagacaguuacaguga

SEQ ID NO: 413366 - RNA, 19 nt, Homo sapiens
gggaacugcuccagaagua

SEQ ID NO: 413367 - RNA, 19 nt, Homo sapiens
ccaugaagauucugauaaa

SEQ ID NO: 413368 - RNA, 19 nt, Homo sapiens
gaagacugaugaugaugaa

SEQ ID NO: 413369 - RNA, 19 nt, Homo sapiens
ccagguacauuaaagauga

SEQ ID NO: 413370 - RNA, 19 nt, Homo sapiens
gaaguuaucagaagagaga

SEQ ID NO: 413371 - RNA, 19 nt, Homo sapiens
gaagaugacauuuaugaug

SEQ ID NO: 413372 - RNA, 19 nt, Homo sapiens
ggaaguagaacuccucauu

SEQ ID NO: 413373 - RNA, 19 nt, Homo sapiens
gaacugaccugugauacca

SEQ ID NO: 413374 - RNA, 19 nt, Homo sapiens
uaacuucucucucagaugu

SEQ ID NO: 413375 - RNA, 19 nt, Homo sapiens
aaagaugaaugggaaguua

SEQ ID NO: 413376 - RNA, 19 nt, Homo sapiens
gcaagacagugcuauagau

SEQ ID NO: 413377 - RNA, 19 nt, Homo sapiens
ccaaagccacuguuaauuu

SEQ ID NO: 413378 - RNA, 19 nt, Homo sapiens
uagcuacccucaaagauaa

SEQ ID NO: 413379 - RNA, 19 nt, Homo sapiens
cuaaggagcuggagaaucu

SEQ ID NO: 413380 - RNA, 19 nt, Homo sapiens
cuaguucgauggauaagua

SEQ ID NO: 413381 - RNA, 19 nt, Homo sapiens
cagcaaacauaucaaauuc

SEQ ID NO: 413382 - RNA, 19 nt, Homo sapiens
caaccaagaugcccaagau

SEQ ID NO: 413383 - RNA, 19 nt, Homo sapiens
gaugauagcagacauuguu

SEQ ID NO: 413384 - RNA, 19 nt, Homo sapiens
gaucauuccuuucugacaa

SEQ ID NO: 413385 - RNA, 19 nt, Homo sapiens
ggaaguauagccuuggaua

SEQ ID NO: 413386 - RNA, 19 nt, Homo sapiens
caucaaagauacacaagau

SEQ ID NO: 413387 - RNA, 19 nt, Homo sapiens
uggacgaguucuagaauua

SEQ ID NO: 413388 - RNA, 19 nt, Homo sapiens
gaaaacaacucaggucaaa

SEQ ID NO: 413389 - RNA, 19 nt, Homo sapiens
gugaauacauccaacaaga

SEQ ID NO: 413390 - RNA, 19 nt, Homo sapiens
uaagagaaauugcccuaga

SEQ ID NO: 413391 - RNA, 19 nt, Homo sapiens
caaugacccuugaagauau

SEQ ID NO: 413392 - RNA, 19 nt, Homo sapiens
gaaagaagaguucguuuac

SEQ ID NO: 413393 - RNA, 19 nt, Homo sapiens
uaacaaagggcuuaguaaa

SEQ ID NO: 413394 - RNA, 19 nt, Homo sapiens
gagaagaagucacaaacag

SEQ ID NO: 413395 - RNA, 19 nt, Homo sapiens
ggacauggugagucuauuu

SEQ ID NO: 413396 - RNA, 19 nt, Homo sapiens
gaagaguucguuuacauug

SEQ ID NO: 413397 - RNA, 19 nt, Homo sapiens
ccaggucaaugguuucuuu

SEQ ID NO: 413398 - RNA, 19 nt, Homo sapiens
ggaaagaagaaccaaagaa

SEQ ID NO: 413399 - RNA, 19 nt, Homo sapiens
auacacgggugccaacuua

SEQ ID NO: 413400 - RNA, 19 nt, Homo sapiens
aaagaggucugcuguuuca

SEQ ID NO: 413401 - RNA, 19 nt, Homo sapiens
gaacuccucauuacccuaa

SEQ ID NO: 413402 - RNA, 19 nt, Homo sapiens
gaagauaccauuuguacca

SEQ ID NO: 413403 - RNA, 19 nt, Homo sapiens
ucaagaagauaccauuugu

SEQ ID NO: 413404 - RNA, 19 nt, Homo sapiens
gaacugcuccagaaguauu

SEQ ID NO: 413405 - RNA, 19 nt, Homo sapiens
caaagaagaguuacccaaa

SEQ ID NO: 413406 - RNA, 19 nt, Homo sapiens
cgagaucgauugcgaggaa

SEQ ID NO: 413407 - RNA, 19 nt, Homo sapiens
gacugaugaugaugaaaua

SEQ ID NO: 413408 - RNA, 19 nt, Homo sapiens
caaaggcaaucagagaauu

SEQ ID NO: 413409 - RNA, 19 nt, Homo sapiens
guggaaacacugagaaaua

SEQ ID NO: 413410 - RNA, 19 nt, Homo sapiens
caaaggugaucgcguccua

SEQ ID NO: 413411 - RNA, 19 nt, Homo sapiens
gauaacagcuuggggauaa

SEQ ID NO: 413412 - RNA, 19 nt, Homo sapiens
gaaaggaggaaacaugaau

SEQ ID NO: 413413 - RNA, 19 nt, Homo sapiens
aagaagaguuacccaaauu

SEQ ID NO: 413414 - RNA, 19 nt, Homo sapiens
cgaaggaaaguaaacauaa

SEQ ID NO: 413415 - RNA, 19 nt, Homo sapiens
gaaacagccaugacucaaa

SEQ ID NO: 413416 - RNA, 19 nt, Homo sapiens
acaaagggcuuaguaaauc

SEQ ID NO: 413417 - RNA, 19 nt, Homo sapiens
gaguggagaagaugacuua

SEQ ID NO: 413418 - RNA, 19 nt, Homo sapiens
gcacaaguacuuccaaaca

SEQ ID NO: 413419 - RNA, 19 nt, Homo sapiens
gacaaucuccaacaucuaa

SEQ ID NO: 413420 - RNA, 19 nt, Homo sapiens
gaaucuuccucuucaguga

SEQ ID NO: 413421 - RNA, 19 nt, Homo sapiens
cauggugugucuuacuuua

SEQ ID NO: 413422 - RNA, 19 nt, Homo sapiens
ugaugagacuuccuuauug

SEQ ID NO: 413423 - RNA, 19 nt, Homo sapiens
gaucagcuuuccuguaaca

SEQ ID NO: 413424 - RNA, 19 nt, Homo sapiens
cauguucuccucuaucuua

SEQ ID NO: 413425 - RNA, 19 nt, Homo sapiens
agacagaggaucaauauau

SEQ ID NO: 413426 - RNA, 19 nt, Homo sapiens
aaagaagacugaugaugau

SEQ ID NO: 413427 - RNA, 19 nt, Homo sapiens
ggaaguuaacagagcauua

SEQ ID NO: 413428 - RNA, 19 nt, Homo sapiens
ggaggaaacaugaaucaga

SEQ ID NO: 413429 - RNA, 19 nt, Homo sapiens
gaaaggaugcacugugaug

SEQ ID NO: 413430 - RNA, 19 nt, Homo sapiens
gaagggcgauuacgaugua

SEQ ID NO: 413431 - RNA, 19 nt, Homo sapiens
gaacagaauuggaagacaa

SEQ ID NO: 413432 - RNA, 19 nt, Homo sapiens
gaagaaacaucuggacaaa

SEQ ID NO: 413433 - RNA, 19 nt, Homo sapiens
ggagaaaccucugaagaaa

SEQ ID NO: 413434 - RNA, 19 nt, Homo sapiens
agaaacaucuggacaaauu

SEQ ID NO: 413435 - RNA, 19 nt, Homo sapiens
gaagacaagcgguaauaua

SEQ ID NO: 413436 - RNA, 19 nt, Homo sapiens
gagcacaggugauagugua

SEQ ID NO: 413437 - RNA, 19 nt, Homo sapiens
gaauaucacucauaacaag

SEQ ID NO: 413438 - RNA, 19 nt, Homo sapiens
gaagacagcauuauagaga

SEQ ID NO: 413439 - RNA, 19 nt, Homo sapiens
gaagaagccuuguauugca

SEQ ID NO: 413440 - RNA, 19 nt, Homo sapiens
caaacaggcucucugaaga

SEQ ID NO: 413441 - RNA, 19 nt, Homo sapiens
gaaugguguucacagaaua

SEQ ID NO: 413442 - RNA, 19 nt, Homo sapiens
ccaagauuauucacacaua

SEQ ID NO: 413443 - RNA, 19 nt, Homo sapiens
ggaaugguguucacagaau

SEQ ID NO: 413444 - RNA, 19 nt, Homo sapiens
gagcagaggauguucauga

SEQ ID NO: 413445 - RNA, 19 nt, Homo sapiens
gaacggauucuguuugcua

SEQ ID NO: 413446 - RNA, 19 nt, Homo sapiens
cagaggaacccaaagaaua

SEQ ID NO: 413447 - RNA, 19 nt, Homo sapiens
ggacagcucuccggugguu

SEQ ID NO: 413448 - RNA, 19 nt, Homo sapiens
ggacaaucauggaaacugu

SEQ ID NO: 413449 - RNA, 19 nt, Homo sapiens
ccacaagauaucaguauua

SEQ ID NO: 413450 - RNA, 19 nt, Homo sapiens
gcaagaggccacaagauau

SEQ ID NO: 413451 - RNA, 19 nt, Homo sapiens
ggaagagaaucgaguugau

SEQ ID NO: 413452 - RNA, 19 nt, Homo sapiens
gaucaggaaucuagagaag

SEQ ID NO: 413453 - RNA, 19 nt, Homo sapiens
caaugaaguugaacguuug

SEQ ID NO: 413454 - RNA, 19 nt, Homo sapiens
gaaugaagaagccuuguau

SEQ ID NO: 413455 - RNA, 19 nt, Homo sapiens
gaagacaguagccaagauu

SEQ ID NO: 413456 - RNA, 19 nt, Homo sapiens
gguguggcauuuacaauau

SEQ ID NO: 413457 - RNA, 19 nt, Homo sapiens
ucacacggaugauaucgaa

SEQ ID NO: 413458 - RNA, 19 nt, Homo sapiens
ugucauggcuucagcaaga

SEQ ID NO: 413459 - RNA, 19 nt, Homo sapiens
uuucugagcugaugaucua

SEQ ID NO: 413460 - RNA, 19 nt, Homo sapiens
gaaaggacgguguggcauu

SEQ ID NO: 413461 - RNA, 19 nt, Homo sapiens
gggaauaucacucauaaca

SEQ ID NO: 413462 - RNA, 19 nt, Homo sapiens
guauauuucucgguuguuu

SEQ ID NO: 413463 - RNA, 19 nt, Homo sapiens
cauaacaagucgaccauuc

SEQ ID NO: 413464 - RNA, 19 nt, Homo sapiens
cagagaguaugugcuauuu

SEQ ID NO: 413465 - RNA, 19 nt, Homo sapiens
gcaaacaggcucucugaag

SEQ ID NO: 413466 - RNA, 19 nt, Homo sapiens
gagcagggagugaauguga

SEQ ID NO: 413467 - RNA, 19 nt, Homo sapiens
ggaaugaagaagccuugua

SEQ ID NO: 413468 - RNA, 19 nt, Homo sapiens
uggaggagcugacccagaa

SEQ ID NO: 413469 - RNA, 19 nt, Homo sapiens
agaaaccucugaagaaaca

SEQ ID NO: 413470 - RNA, 19 nt, Homo sapiens
gcacggcccacaugcuuaa

SEQ ID NO: 413471 - RNA, 19 nt, Homo sapiens
ggauggauuuggacaggaa

SEQ ID NO: 413472 - RNA, 19 nt, Homo sapiens
gaagguagcccaagaacac

SEQ ID NO: 413473 - RNA, 19 nt, Homo sapiens
uaguggagcucaucaacaa

SEQ ID NO: 413474 - RNA, 19 nt, Homo sapiens
gcacagcucagccaccuau

SEQ ID NO: 413475 - RNA, 19 nt, Homo sapiens
cacagaauaugagcaaauu

SEQ ID NO: 413476 - RNA, 19 nt, Homo sapiens
agaggaacccaaagaauaa

SEQ ID NO: 413477 - RNA, 19 nt, Homo sapiens
acaacagccuggacuuaaa

SEQ ID NO: 413478 - RNA, 19 nt, Homo sapiens
gggagaagauggaguacag

SEQ ID NO: 413479 - RNA, 19 nt, Homo sapiens
ggugagcacuacucggaaa

SEQ ID NO: 413480 - RNA, 19 nt, Homo sapiens
gcuaaugagccuuugcuuu

SEQ ID NO: 413481 - RNA, 19 nt, Homo sapiens
ggaaagcacagggcaagaa

SEQ ID NO: 413482 - RNA, 19 nt, Homo sapiens
aaaggacgguguggcauuu

SEQ ID NO: 413483 - RNA, 19 nt, Homo sapiens
ggaagagugugagcaaugg

SEQ ID NO: 413484 - RNA, 19 nt, Homo sapiens
gaagagaaucgaguugaug

SEQ ID NO: 413485 - RNA, 19 nt, Homo sapiens
gaagaggccgcugauguug

SEQ ID NO: 413486 - RNA, 19 nt, Homo sapiens
gacaguagccaagauuauu

SEQ ID NO: 413487 - RNA, 19 nt, Homo sapiens
gaaacuagaagagggaaug

SEQ ID NO: 413488 - RNA, 19 nt, Homo sapiens
ggaauaucacucauaacaa

SEQ ID NO: 413489 - RNA, 19 nt, Homo sapiens
ggaaugacauggggaauau

SEQ ID NO: 413490 - RNA, 19 nt, Homo sapiens
uaaaggacaaucauggaaa

SEQ ID NO: 413491 - RNA, 19 nt, Homo sapiens
aagcugaacugauguacau

SEQ ID NO: 413492 - RNA, 19 nt, Homo sapiens
gagacuauaaucaguuuga

SEQ ID NO: 413493 - RNA, 19 nt, Homo sapiens
gcacuacuuuggccuuugg

SEQ ID NO: 413494 - RNA, 19 nt, Homo sapiens
ugagcaaauuccaaagaaa

SEQ ID NO: 413495 - RNA, 19 nt, Homo sapiens
ucacaacagccuggacuua

SEQ ID NO: 413496 - RNA, 19 nt, Homo sapiens
uaacaagucgaccauucua

SEQ ID NO: 413497 - RNA, 19 nt, Homo sapiens
guaaaggacaaucauggaa

SEQ ID NO: 413498 - RNA, 19 nt, Homo sapiens
gagaguaugugcuauuucc

SEQ ID NO: 413499 - RNA, 19 nt, Homo sapiens
gaaagcacagggcaagaau

SEQ ID NO: 413500 - RNA, 19 nt, Homo sapiens
gaagaagaaacuagaagag

SEQ ID NO: 413501 - RNA, 19 nt, Homo sapiens
ucaggaaucuagagaagca

SEQ ID NO: 413502 - RNA, 19 nt, Homo sapiens
gcgagagacgcacuacuuu

SEQ ID NO: 413503 - RNA, 19 nt, Homo sapiens
gccacaagauaucaguauu

SEQ ID NO: 413504 - RNA, 19 nt, Homo sapiens
ggacaaauucgcuaaugag

SEQ ID NO: 413505 - RNA, 19 nt, Homo sapiens
gaugaucuacugcuuggaa

SEQ ID NO: 413506 - RNA, 19 nt, Homo sapiens
gcugauaccaaccaaagaa

SEQ ID NO: 413507 - RNA, 19 nt, Homo sapiens
cagaagaggccgcugaugu

SEQ ID NO: 413508 - RNA, 19 nt, Homo sapiens
gaacccgaccugacuagug

SEQ ID NO: 413509 - RNA, 19 nt, Homo sapiens
gcucuccggugguucauca

SEQ ID NO: 413510 - RNA, 19 nt, Homo sapiens
agcagaagcugaacugaug

SEQ ID NO: 413511 - RNA, 19 nt, Homo sapiens
gcgauuacgauguacauug

SEQ ID NO: 413512 - RNA, 19 nt, Homo sapiens
gagagucaccuccagacaa

SEQ ID NO: 413513 - RNA, 19 nt, Homo sapiens
gauguuggcagcauugaau

SEQ ID NO: 413514 - RNA, 19 nt, Homo sapiens
gaccagaggaacccaaaga

SEQ ID NO: 413515 - RNA, 19 nt, Homo sapiens
gcuacaacguccugagcaa

SEQ ID NO: 413516 - RNA, 19 nt, Homo sapiens
gacaagcgguaauauacag

SEQ ID NO: 413517 - RNA, 19 nt, Homo sapiens
ggcagaauggcacuacaua

SEQ ID NO: 413518 - RNA, 19 nt, Homo sapiens
cccaaagaauaauguggua

SEQ ID NO: 413519 - RNA, 19 nt, Homo sapiens
cauguaagcagcuaucuuc

SEQ ID NO: 413520 - RNA, 19 nt, Homo sapiens
uggagacuauaaucaguuu

SEQ ID NO: 413521 - RNA, 19 nt, Homo sapiens
uggagaaaccucugaagaa

SEQ ID NO: 413522 - RNA, 19 nt, Homo sapiens
caagauuauucacacauac

SEQ ID NO: 413523 - RNA, 19 nt, Homo sapiens
cagcaaacaggcucucuga

SEQ ID NO: 413524 - RNA, 19 nt, Homo sapiens
gcagggagugaaugugauu

SEQ ID NO: 413525 - RNA, 19 nt, Homo sapiens
gagcugauaccaaccaaag

SEQ ID NO: 413526 - RNA, 19 nt, Homo sapiens
caaggaagagugugagcaa

SEQ ID NO: 413527 - RNA, 19 nt, Homo sapiens
gugcagcucucggugaaga

SEQ ID NO: 413528 - RNA, 19 nt, Homo sapiens
caacacccaugccuacaac

SEQ ID NO: 413529 - RNA, 19 nt, Homo sapiens
ggaagacaagcgguaauau

SEQ ID NO: 413530 - RNA, 19 nt, Homo sapiens
gaacguggcuuccagauaa

SEQ ID NO: 413531 - RNA, 19 nt, Homo sapiens
gaagugaccucucuagaaa

SEQ ID NO: 413532 - RNA, 19 nt, Homo sapiens
guaaacaucuugccuuaug

SEQ ID NO: 413533 - RNA, 19 nt, Homo sapiens
gaaauuaaccggagaaugg

SEQ ID NO: 413534 - RNA, 19 nt, Homo sapiens
ggaauuaaauagugugaug

SEQ ID NO: 413535 - RNA, 19 nt, Homo sapiens
gaagaaacggugaaugauu

SEQ ID NO: 413536 - RNA, 19 nt, Homo sapiens
caucaacgguuaccaagaa

SEQ ID NO: 413537 - RNA, 19 nt, Homo sapiens
caacaaugcuaccacaguu

SEQ ID NO: 413538 - RNA, 19 nt, Homo sapiens
gguaauggaugaugcaguu

SEQ ID NO: 413539 - RNA, 19 nt, Homo sapiens
aagaaacggugaaugauuu

SEQ ID NO: 413540 - RNA, 19 nt, Homo sapiens
gcaguggucugauaugugu

SEQ ID NO: 413541 - RNA, 19 nt, Homo sapiens
ccaggaggauugccuuuaa

SEQ ID NO: 413542 - RNA, 19 nt, Homo sapiens
ggaagugaccucucuagaa

SEQ ID NO: 413543 - RNA, 19 nt, Homo sapiens
cuagugaucguguuuauua

SEQ ID NO: 413544 - RNA, 19 nt, Homo sapiens
guaaauguguuagcacuga

SEQ ID NO: 413545 - RNA, 19 nt, Homo sapiens
ucucagagcucucgaggaa

SEQ ID NO: 413546 - RNA, 19 nt, Homo sapiens
gaacgcauccuuuauugau

SEQ ID NO: 413547 - RNA, 19 nt, Homo sapiens
gaacagcaagcaccaauuc

SEQ ID NO: 413548 - RNA, 19 nt, Homo sapiens
guaccaccaugcacuguaa

SEQ ID NO: 413549 - RNA, 19 nt, Homo sapiens
aggcuucuauuaccuauua

SEQ ID NO: 413550 - RNA, 19 nt, Homo sapiens
gaggauugccuuuaauauu

SEQ ID NO: 413551 - RNA, 19 nt, Homo sapiens
gcucggcaguggucugaua

SEQ ID NO: 413552 - RNA, 19 nt, Homo sapiens
gcauuacaauuucaccaaa

SEQ ID NO: 413553 - RNA, 19 nt, Homo sapiens
gaugaugcaguucaaauaa

SEQ ID NO: 413554 - RNA, 19 nt, Homo sapiens
gaaagggcaugaucagcau

SEQ ID NO: 413555 - RNA, 19 nt, Homo sapiens
ggaugaugcaguucaaaua

SEQ ID NO: 413556 - RNA, 19 nt, Homo sapiens
gaggacuucuggcgaauga

SEQ ID NO: 413557 - RNA, 19 nt, Homo sapiens
gauuagaggaggaguuuaa

SEQ ID NO: 413558 - RNA, 19 nt, Homo sapiens
ggacguguauggcuuugug

SEQ ID NO: 413559 - RNA, 19 nt, Homo sapiens
ggaggaguuuaagaaguua

SEQ ID NO: 413560 - RNA, 19 nt, Homo sapiens
aaaccgauaugcaguaugu

SEQ ID NO: 413561 - RNA, 19 nt, Homo sapiens
gcaaaccgauaugcaguau

SEQ ID NO: 413562 - RNA, 19 nt, Homo sapiens
gaaauccucagccgagaaa

SEQ ID NO: 413563 - RNA, 19 nt, Homo sapiens
gcgaagagaauacagacua

SEQ ID NO: 413564 - RNA, 19 nt, Homo sapiens
gaagaagaaccguguuuua

SEQ ID NO: 413565 - RNA, 19 nt, Homo sapiens
gagaugagacaccaauuau

SEQ ID NO: 413566 - RNA, 19 nt, Homo sapiens
gacaagaggugacacaacu

SEQ ID NO: 413567 - RNA, 19 nt, Homo sapiens
agagugaucauuccaguua

SEQ ID NO: 413568 - RNA, 19 nt, Homo sapiens
gaccagcaacaauggauua

SEQ ID NO: 413569 - RNA, 19 nt, Homo sapiens
gagaauggcagacgacaau

SEQ ID NO: 413570 - RNA, 19 nt, Homo sapiens
uaaauagugugauguuugg

SEQ ID NO: 413571 - RNA, 19 nt, Homo sapiens
gugaacgcauccuuuauug

SEQ ID NO: 413572 - RNA, 19 nt, Homo sapiens
gagaauacagacuauguga

SEQ ID NO: 413573 - RNA, 19 nt, Homo sapiens
cagccaacaugaagaagaa

SEQ ID NO: 413574 - RNA, 19 nt, Homo sapiens
gaauggcagacgacaauaa

SEQ ID NO: 413575 - RNA, 19 nt, Homo sapiens
guauauugaugcauucuca

SEQ ID NO: 413576 - RNA, 19 nt, Homo sapiens
ggagaagugugcccaguac

SEQ ID NO: 413577 - RNA, 19 nt, Homo sapiens
cgaagagaauacagacuau

SEQ ID NO: 413578 - RNA, 19 nt, Homo sapiens
caaauucauugcugcacaa

SEQ ID NO: 413579 - RNA, 19 nt, Homo sapiens
acauucagcccaaauauaa

SEQ ID NO: 413580 - RNA, 19 nt, Homo sapiens
ucaaauaacuaaggacaca

SEQ ID NO: 413581 - RNA, 19 nt, Homo sapiens
ggagcaaacuggcacuaag

SEQ ID NO: 413582 - RNA, 19 nt, Homo sapiens
gaggaggaguuuaagaagu

SEQ ID NO: 413583 - RNA, 19 nt, Homo sapiens
gaagagaugagacaccaau

SEQ ID NO: 413584 - RNA, 19 nt, Homo sapiens
uaacuaaggacacauguuc

SEQ ID NO: 413585 - RNA, 19 nt, Homo sapiens
ggaugacaaucaccaggaa

SEQ ID NO: 413586 - RNA, 19 nt, Homo sapiens
ggacagaagagaugagaca

SEQ ID NO: 413587 - RNA, 19 nt, Homo sapiens
uaaccacugucaauucuuc

SEQ ID NO: 413588 - RNA, 19 nt, Homo sapiens
caagaggugacacaacuaa

SEQ ID NO: 413589 - RNA, 19 nt, Homo sapiens
cggaugaucugggaacaaa

SEQ ID NO: 413590 - RNA, 19 nt, Homo sapiens
aagaagaaacggugaauga

SEQ ID NO: 413591 - RNA, 19 nt, Homo sapiens
caaccacuccagaaacuuu

SEQ ID NO: 413592 - RNA, 19 nt, Homo sapiens
gagcugaaccgaggagauu

SEQ ID NO: 413593 - RNA, 19 nt, Homo sapiens
agagaugagacaccaauua

SEQ ID NO: 413594 - RNA, 19 nt, Homo sapiens
cagaaccaguuaaagaaga

SEQ ID NO: 413595 - RNA, 19 nt, Homo sapiens
gaagaaggaggaggaaugu

SEQ ID NO: 413596 - RNA, 19 nt, Homo sapiens
gaguggaaauccugcucua

SEQ ID NO: 413597 - RNA, 19 nt, Homo sapiens
gcagcaaccacuccagaaa

SEQ ID NO: 413598 - RNA, 19 nt, Homo sapiens
gcaagcaccaauucuauag

SEQ ID NO: 413599 - RNA, 19 nt, Homo sapiens
ccagguagcucggcaccaa

SEQ ID NO: 413600 - RNA, 19 nt, Homo sapiens
uaaacaucuugccuuauga

SEQ ID NO: 413601 - RNA, 19 nt, Homo sapiens
gcugggagccauuccaauu

SEQ ID NO: 413602 - RNA, 19 nt, Homo sapiens
gggacuaucagguaauaaa

SEQ ID NO: 413603 - RNA, 19 nt, Homo sapiens
ugugauguuuggauugaua

SEQ ID NO: 413604 - RNA, 19 nt, Homo sapiens
ggaguauauugaugcauuc

SEQ ID NO: 413605 - RNA, 19 nt, Homo sapiens
acaagguggugcaggagua

SEQ ID NO: 413606 - RNA, 19 nt, Homo sapiens
uaugugaacgcauccuuua

SEQ ID NO: 413607 - RNA, 19 nt, Homo sapiens
gaauacagacuaugugaac

SEQ ID NO: 413608 - RNA, 19 nt, Homo sapiens
gacaagaugcggacuggaa

SEQ ID NO: 413609 - RNA, 19 nt, Homo sapiens
guaccuuugucgucauuga

SEQ ID NO: 413610 - RNA, 19 nt, Homo sapiens
caacauucagcccaaauau

SEQ ID NO: 413611 - RNA, 19 nt, Homo sapiens
ucagagcucucgaggaaag

SEQ ID NO: 413612 - RNA, 19 nt, Homo sapiens
ggaggauugccuuuaauau

SEQ ID NO: 413613 - RNA, 19 nt, Homo sapiens
uuacagaucauuccauaug

SEQ ID NO: 413614 - RNA, 19 nt, Homo sapiens
aggaggaguuuaagaaguu

SEQ ID NO: 413615 - RNA, 19 nt, Homo sapiens
cagcaacaauggauuagag

SEQ ID NO: 413616 - RNA, 19 nt, Homo sapiens
ggacaugaugcauacagaa

SEQ ID NO: 413617 - RNA, 19 nt, Homo sapiens
cuucauucaucaacgguua

SEQ ID NO: 413618 - RNA, 19 nt, Homo sapiens
gacaaugggaccacaagaa

SEQ ID NO: 413619 - RNA, 19 nt, Homo sapiens
ggacccaccuauuuaacca

SEQ ID NO: 413620 - RNA, 19 nt, Homo sapiens
aauccaacuucuucacuaa

SEQ ID NO: 413621 - RNA, 19 nt, Homo sapiens
aaauccaacuucuucacua

SEQ ID NO: 413622 - RNA, 19 nt, Homo sapiens
uagggacuaucagguaaua

SEQ ID NO: 413623 - RNA, 19 nt, Homo sapiens
cauaugaauucaacagagu

SEQ ID NO: 413624 - RNA, 19 nt, Homo sapiens
ggcagaaccaguuaaagaa

SEQ ID NO: 413625 - RNA, 19 nt, Homo sapiens
aaggacacauguucaaaga

SEQ ID NO: 413626 - RNA, 19 nt, Homo sapiens
cggcagaaccaguuaaaga

SEQ ID NO: 413627 - RNA, 19 nt, Homo sapiens
uugaugcauucucagauua

SEQ ID NO: 413628 - RNA, 19 nt, Homo sapiens
aggaguauauugaugcauu

SEQ ID NO: 413629 - RNA, 19 nt, Homo sapiens
gagugaucauuccaguuaa

SEQ ID NO: 413630 - RNA, 19 nt, Homo sapiens
gaacguggcuuccagauaa

SEQ ID NO: 413631 - RNA, 19 nt, Homo sapiens
gaagugaccucucuagaaa

SEQ ID NO: 413632 - RNA, 19 nt, Homo sapiens
guaaacaucuugccuuaug

SEQ ID NO: 413633 - RNA, 19 nt, Homo sapiens
gaaauuaaccggagaaugg

SEQ ID NO: 413634 - RNA, 19 nt, Homo sapiens
ggaauuaaauagugugaug

SEQ ID NO: 413635 - RNA, 19 nt, Homo sapiens
gaagaaacggugaaugauu

SEQ ID NO: 413636 - RNA, 19 nt, Homo sapiens
caucaacgguuaccaagaa

SEQ ID NO: 413637 - RNA, 19 nt, Homo sapiens
caacaaugcuaccacaguu

SEQ ID NO: 413638 - RNA, 19 nt, Homo sapiens
gguaauggaugaugcaguu

SEQ ID NO: 413639 - RNA, 19 nt, Homo sapiens
aagaaacggugaaugauuu

SEQ ID NO: 413640 - RNA, 19 nt, Homo sapiens
gcaguggucugauaugugu

SEQ ID NO: 413641 - RNA, 19 nt, Homo sapiens
ccaggaggauugccuuuaa

SEQ ID NO: 413642 - RNA, 19 nt, Homo sapiens
ggaagugaccucucuagaa

SEQ ID NO: 413643 - RNA, 19 nt, Homo sapiens
cuagugaucguguuuauua

SEQ ID NO: 413644 - RNA, 19 nt, Homo sapiens
guaaauguguuagcacuga

SEQ ID NO: 413645 - RNA, 19 nt, Homo sapiens
ucucagagcucucgaggaa

SEQ ID NO: 413646 - RNA, 19 nt, Homo sapiens
gaacgcauccuuuauugau

SEQ ID NO: 413647 - RNA, 19 nt, Homo sapiens
gaacagcaagcaccaauuc

SEQ ID NO: 413648 - RNA, 19 nt, Homo sapiens
guaccaccaugcacuguaa

SEQ ID NO: 413649 - RNA, 19 nt, Homo sapiens
aggcuucuauuaccuauua

SEQ ID NO: 413650 - RNA, 19 nt, Homo sapiens
gaggauugccuuuaauauu

SEQ ID NO: 413651 - RNA, 19 nt, Homo sapiens
gcucggcaguggucugaua

SEQ ID NO: 413652 - RNA, 19 nt, Homo sapiens
gaugaugcaguucaaauaa

SEQ ID NO: 413653 - RNA, 19 nt, Homo sapiens
gcauuacaauuucaccaaa

SEQ ID NO: 413654 - RNA, 19 nt, Homo sapiens
gaaagggcaugaucagcau

SEQ ID NO: 413655 - RNA, 19 nt, Homo sapiens
ggaugaugcaguucaaaua

SEQ ID NO: 413656 - RNA, 19 nt, Homo sapiens
gaggacuucuggcgaauga

SEQ ID NO: 413657 - RNA, 19 nt, Homo sapiens
gauuagaggaggaguuuaa

SEQ ID NO: 413658 - RNA, 19 nt, Homo sapiens
ggacguguauggcuuugug

SEQ ID NO: 413659 - RNA, 19 nt, Homo sapiens
ggaggaguuuaagaaguua

SEQ ID NO: 413660 - RNA, 19 nt, Homo sapiens
aaaccgauaugcaguaugu

SEQ ID NO: 413661 - RNA, 19 nt, Homo sapiens
gcaaaccgauaugcaguau

SEQ ID NO: 413662 - RNA, 19 nt, Homo sapiens
gaaauccucagccgagaaa

SEQ ID NO: 413663 - RNA, 19 nt, Homo sapiens
gcgaagagaauacagacua

SEQ ID NO: 413664 - RNA, 19 nt, Homo sapiens
gaagaagaaccguguuuua

SEQ ID NO: 413665 - RNA, 19 nt, Homo sapiens
agagugaucauuccaguua

SEQ ID NO: 413666 - RNA, 19 nt, Homo sapiens
gaccagcaacaauggauua

SEQ ID NO: 413667 - RNA, 19 nt, Homo sapiens
gagaauggcagacgacaau

SEQ ID NO: 413668 - RNA, 19 nt, Homo sapiens
ucagaugagacaccaauua

SEQ ID NO: 413669 - RNA, 19 nt, Homo sapiens
uaaauagugugauguuugg

SEQ ID NO: 413670 - RNA, 19 nt, Homo sapiens
gugaacgcauccuuuauug

SEQ ID NO: 413671 - RNA, 19 nt, Homo sapiens
gagaauacagacuauguga

SEQ ID NO: 413672 - RNA, 19 nt, Homo sapiens
cagccaacaugaagaagaa

SEQ ID NO: 413673 - RNA, 19 nt, Homo sapiens
gaauggcagacgacaauaa

SEQ ID NO: 413674 - RNA, 19 nt, Homo sapiens
guauauugaugcauucuca

SEQ ID NO: 413675 - RNA, 19 nt, Homo sapiens
ggagaagugugcccaguac

SEQ ID NO: 413676 - RNA, 19 nt, Homo sapiens
ucaaauaacuaaggacaca

SEQ ID NO: 413677 - RNA, 19 nt, Homo sapiens
cgaagagaauacagacuau

SEQ ID NO: 413678 - RNA, 19 nt, Homo sapiens
caaauucauugcugcacaa

SEQ ID NO: 413679 - RNA, 19 nt, Homo sapiens
acauucagcccaaauauaa

SEQ ID NO: 413680 - RNA, 19 nt, Homo sapiens
uaacuaaggacacauguuc

SEQ ID NO: 413681 - RNA, 19 nt, Homo sapiens
gaggaggaguuuaagaagu

SEQ ID NO: 413682 - RNA, 19 nt, Homo sapiens
uaaccacugucaauucuuc

SEQ ID NO: 413683 - RNA, 19 nt, Homo sapiens
cggaugaucugggaacaaa

SEQ ID NO: 413684 - RNA, 19 nt, Homo sapiens
aagaagaaacggugaauga

SEQ ID NO: 413685 - RNA, 19 nt, Homo sapiens
caaccacuccagaaacuuu

SEQ ID NO: 413686 - RNA, 19 nt, Homo sapiens
cagaaccaguuaaagaaga

SEQ ID NO: 413687 - RNA, 19 nt, Homo sapiens
gaagaaggaggaggaaugu

SEQ ID NO: 413688 - RNA, 19 nt, Homo sapiens
gaguggaaauccugcucua

SEQ ID NO: 413689 - RNA, 19 nt, Homo sapiens
gcagcaaccacuccagaaa

SEQ ID NO: 413690 - RNA, 19 nt, Homo sapiens
gcaagcaccaauucuauag

SEQ ID NO: 413691 - RNA, 19 nt, Homo sapiens
ccagguagcucggcaccaa

SEQ ID NO: 413692 - RNA, 19 nt, Homo sapiens
uaaacaucuugccuuauga

SEQ ID NO: 413693 - RNA, 19 nt, Homo sapiens
gcugggagccauuccaauu

SEQ ID NO: 413694 - RNA, 19 nt, Homo sapiens
gggacuaucagguaauaaa

SEQ ID NO: 413695 - RNA, 19 nt, Homo sapiens
ugugauguuuggauugaua

SEQ ID NO: 413696 - RNA, 19 nt, Homo sapiens
ggaguauauugaugcauuc

SEQ ID NO: 413697 - RNA, 19 nt, Homo sapiens
acaagguggugcaggagua

SEQ ID NO: 413698 - RNA, 19 nt, Homo sapiens
uaugugaacgcauccuuua

SEQ ID NO: 413699 - RNA, 19 nt, Homo sapiens
gaauacagacuaugugaac

SEQ ID NO: 413700 - RNA, 19 nt, Homo sapiens
gacaagaugcggacuggaa

SEQ ID NO: 413701 - RNA, 19 nt, Homo sapiens
guaccuuugucgucauuga

SEQ ID NO: 413702 - RNA, 19 nt, Homo sapiens
caacauucagcccaaauau

SEQ ID NO: 413703 - RNA, 19 nt, Homo sapiens
ucagagcucucgaggaaag

SEQ ID NO: 413704 - RNA, 19 nt, Homo sapiens
ggaggauugccuuuaauau

SEQ ID NO: 413705 - RNA, 19 nt, Homo sapiens
uuacagaucauuccauaug

SEQ ID NO: 413706 - RNA, 19 nt, Homo sapiens
aggaggaguuuaagaaguu

SEQ ID NO: 413707 - RNA, 19 nt, Homo sapiens
cagcaacaauggauuagag

SEQ ID NO: 413708 - RNA, 19 nt, Homo sapiens
ggacaugaugcauacagaa

SEQ ID NO: 413709 - RNA, 19 nt, Homo sapiens
cuucauucaucaacgguua

SEQ ID NO: 413710 - RNA, 19 nt, Homo sapiens
gacaaugggaccacaagaa

SEQ ID NO: 413711 - RNA, 19 nt, Homo sapiens
ggacccaccuauuuaacca

SEQ ID NO: 413712 - RNA, 19 nt, Homo sapiens
aauccaacuucuucacuaa

SEQ ID NO: 413713 - RNA, 19 nt, Homo sapiens
aaauccaacuucuucacua

SEQ ID NO: 413714 - RNA, 19 nt, Homo sapiens
uagggacuaucagguaaua

SEQ ID NO: 413715 - RNA, 19 nt, Homo sapiens
aaggacacauguucaaaga

SEQ ID NO: 413716 - RNA, 19 nt, Homo sapiens
cauaugaauucaacagagu

SEQ ID NO: 413717 - RNA, 19 nt, Homo sapiens
ggcagaaccaguuaaagaa

SEQ ID NO: 413718 - RNA, 19 nt, Homo sapiens
cggcagaaccaguuaaaga

SEQ ID NO: 413719 - RNA, 19 nt, Homo sapiens
uugaugcauucucagauua

SEQ ID NO: 413720 - RNA, 19 nt, Homo sapiens
aggaguauauugaugcauu

SEQ ID NO: 413721 - RNA, 19 nt, Homo sapiens
gagugaucauuccaguuaa

SEQ ID NO: 413722 - RNA, 19 nt, Homo sapiens
gaugcggacuggaaaccuu

SEQ ID NO: 413723 - RNA, 19 nt, Homo sapiens
cagaugagacaccaauuau

SEQ ID NO: 413724 - RNA, 19 nt, Homo sapiens
gugcaggaguauauugaug

SEQ ID NO: 413725 - RNA, 19 nt, Homo sapiens
gguguccuauggagauauu

SEQ ID NO: 413726 - RNA, 19 nt, Homo sapiens
uagaggaggaguuuaagaa

SEQ ID NO: 413727 - RNA, 19 nt, Homo sapiens
aaugauuucuggcggauga

SEQ ID NO: 413728 - RNA, 19 nt, Homo sapiens
cuauaggcauuacaauuuc

SEQ ID NO: 413729 - RNA, 19 nt, Homo sapiens
ccaacauucagcccaaaua

SEQ ID NO: 413730 - RNA, 19 nt, Homo sapiens
gaacguggcuuccagauaa

SEQ ID NO: 413731 - RNA, 19 nt, Homo sapiens
gaagugaccucucuagaaa

SEQ ID NO: 413732 - RNA, 19 nt, Homo sapiens
guaaacaucuugccuuaug

SEQ ID NO: 413733 - RNA, 19 nt, Homo sapiens
gaaauuaaccggagaaugg

SEQ ID NO: 413734 - RNA, 19 nt, Homo sapiens
ggaauuaaauagugugaug

SEQ ID NO: 413735 - RNA, 19 nt, Homo sapiens
gaagaaacggugaaugauu

SEQ ID NO: 413736 - RNA, 19 nt, Homo sapiens
gguaauggaugaugcaguu

SEQ ID NO: 413737 - RNA, 19 nt, Homo sapiens
caucaacgguuaccaagaa

SEQ ID NO: 413738 - RNA, 19 nt, Homo sapiens
caacaaugcuaccacaguu

SEQ ID NO: 413739 - RNA, 19 nt, Homo sapiens
aagaaacggugaaugauuu

SEQ ID NO: 413740 - RNA, 19 nt, Homo sapiens
gcaguggucugauaugugu

SEQ ID NO: 413741 - RNA, 19 nt, Homo sapiens
ccaggaggauugccuuuaa

SEQ ID NO: 413742 - RNA, 19 nt, Homo sapiens
ggaagugaccucucuagaa

SEQ ID NO: 413743 - RNA, 19 nt, Homo sapiens
cuagugaucguguuuauua

SEQ ID NO: 413744 - RNA, 19 nt, Homo sapiens
guaaauguguuagcacuga

SEQ ID NO: 413745 - RNA, 19 nt, Homo sapiens
ucucagagcucucgaggaa

SEQ ID NO: 413746 - RNA, 19 nt, Homo sapiens
gaacgcauccuuuauugau

SEQ ID NO: 413747 - RNA, 19 nt, Homo sapiens
gaacagcaagcaccaauuc

SEQ ID NO: 413748 - RNA, 19 nt, Homo sapiens
guaccaccaugcacuguaa

SEQ ID NO: 413749 - RNA, 19 nt, Homo sapiens
aggcuucuauuaccuauua

SEQ ID NO: 413750 - RNA, 19 nt, Homo sapiens
gaggauugccuuuaauauu

SEQ ID NO: 413751 - RNA, 19 nt, Homo sapiens
gcucggcaguggucugaua

SEQ ID NO: 413752 - RNA, 19 nt, Homo sapiens
gaugaugcaguucaaauaa

SEQ ID NO: 413753 - RNA, 19 nt, Homo sapiens
gcauuacaauuucaccaaa

SEQ ID NO: 413754 - RNA, 19 nt, Homo sapiens
ggaugaugcaguucaaaua

SEQ ID NO: 413755 - RNA, 19 nt, Homo sapiens
gaaagggcaugaucagcau

SEQ ID NO: 413756 - RNA, 19 nt, Homo sapiens
gaggacuucuggcgaauga

SEQ ID NO: 413757 - RNA, 19 nt, Homo sapiens
gauuagaggaggaguuuaa

SEQ ID NO: 413758 - RNA, 19 nt, Homo sapiens
ggacguguauggcuuugug

SEQ ID NO: 413759 - RNA, 19 nt, Homo sapiens
ggaggaguuuaagaaguua

SEQ ID NO: 413760 - RNA, 19 nt, Homo sapiens
aaaccgauaugcaguaugu

SEQ ID NO: 413761 - RNA, 19 nt, Homo sapiens
gcaaaccgauaugcaguau

SEQ ID NO: 413762 - RNA, 19 nt, Homo sapiens
gaaauccucagccgagaaa

SEQ ID NO: 413763 - RNA, 19 nt, Homo sapiens
gcgaagagaauacagacua

SEQ ID NO: 413764 - RNA, 19 nt, Homo sapiens
gaagaagaaccguguuuua

SEQ ID NO: 413765 - RNA, 19 nt, Homo sapiens
agagugaucauuccaguua

SEQ ID NO: 413766 - RNA, 19 nt, Homo sapiens
gaccagcaacaauggauua

SEQ ID NO: 413767 - RNA, 19 nt, Homo sapiens
gagaauggcagacgacaau

SEQ ID NO: 413768 - RNA, 19 nt, Homo sapiens
ucagaugagacaccaauua

SEQ ID NO: 413769 - RNA, 19 nt, Homo sapiens
uaaauagugugauguuugg

SEQ ID NO: 413770 - RNA, 19 nt, Homo sapiens
gugaacgcauccuuuauug

SEQ ID NO: 413771 - RNA, 19 nt, Homo sapiens
gagaauacagacuauguga

SEQ ID NO: 413772 - RNA, 19 nt, Homo sapiens
cagccaacaugaagaagaa

SEQ ID NO: 413773 - RNA, 19 nt, Homo sapiens
uucagaagcuugccaguuu

SEQ ID NO: 413774 - RNA, 19 nt, Homo sapiens
gaauggcagacgacaauaa

SEQ ID NO: 413775 - RNA, 19 nt, Homo sapiens
ucaaauaacuaaggacaca

SEQ ID NO: 413776 - RNA, 19 nt, Homo sapiens
guauauugaugcauucuca

SEQ ID NO: 413777 - RNA, 19 nt, Homo sapiens
ggagaagugugcccaguac

SEQ ID NO: 413778 - RNA, 19 nt, Homo sapiens
cgaagagaauacagacuau

SEQ ID NO: 413779 - RNA, 19 nt, Homo sapiens
caaauucauugcugcacaa

SEQ ID NO: 413780 - RNA, 19 nt, Homo sapiens
acauucagcccaaauauaa

SEQ ID NO: 413781 - RNA, 19 nt, Homo sapiens
uaacuaaggacacauguuc

SEQ ID NO: 413782 - RNA, 19 nt, Homo sapiens
gaggaggaguuuaagaagu

SEQ ID NO: 413783 - RNA, 19 nt, Homo sapiens
uaaccacugucaauucuuc

SEQ ID NO: 413784 - RNA, 19 nt, Homo sapiens
cggaugaucugggaacaaa

SEQ ID NO: 413785 - RNA, 19 nt, Homo sapiens
aagaagaaacggugaauga

SEQ ID NO: 413786 - RNA, 19 nt, Homo sapiens
caaccacuccagaaacuuu

SEQ ID NO: 413787 - RNA, 19 nt, Homo sapiens
cagaaccaguuaaagaaga

SEQ ID NO: 413788 - RNA, 19 nt, Homo sapiens
gaagaaggaggaggaaugu

SEQ ID NO: 413789 - RNA, 19 nt, Homo sapiens
gaguggaaauccugcucua

SEQ ID NO: 413790 - RNA, 19 nt, Homo sapiens
gcagcaaccacuccagaaa

SEQ ID NO: 413791 - RNA, 19 nt, Homo sapiens
gcaagcaccaauucuauag

SEQ ID NO: 413792 - RNA, 19 nt, Homo sapiens
ccagguagcucggcaccaa

SEQ ID NO: 413793 - RNA, 19 nt, Homo sapiens
uaaacaucuugccuuauga

SEQ ID NO: 413794 - RNA, 19 nt, Homo sapiens
gcugggagccauuccaauu

SEQ ID NO: 413795 - RNA, 19 nt, Homo sapiens
gggacuaucagguaauaaa

SEQ ID NO: 413796 - RNA, 19 nt, Homo sapiens
ugugauguuuggauugaua

SEQ ID NO: 413797 - RNA, 19 nt, Homo sapiens
ggaguauauugaugcauuc

SEQ ID NO: 413798 - RNA, 19 nt, Homo sapiens
acaagguggugcaggagua

SEQ ID NO: 413799 - RNA, 19 nt, Homo sapiens
uaugugaacgcauccuuua

SEQ ID NO: 413800 - RNA, 19 nt, Homo sapiens
gaauacagacuaugugaac

SEQ ID NO: 413801 - RNA, 19 nt, Homo sapiens
gacaagaugcggacuggaa

SEQ ID NO: 413802 - RNA, 19 nt, Homo sapiens
guaccuuugucgucauuga

SEQ ID NO: 413803 - RNA, 19 nt, Homo sapiens
caacauucagcccaaauau

SEQ ID NO: 413804 - RNA, 19 nt, Homo sapiens
ucagagcucucgaggaaag

SEQ ID NO: 413805 - RNA, 19 nt, Homo sapiens
ggaggauugccuuuaauau

SEQ ID NO: 413806 - RNA, 19 nt, Homo sapiens
uuacagaucauuccauaug

SEQ ID NO: 413807 - RNA, 19 nt, Homo sapiens
aggaggaguuuaagaaguu

SEQ ID NO: 413808 - RNA, 19 nt, Homo sapiens
cagcaacaauggauuagag

SEQ ID NO: 413809 - RNA, 19 nt, Homo sapiens
ggacaugaugcauacagaa

SEQ ID NO: 413810 - RNA, 19 nt, Homo sapiens
cuucauucaucaacgguua

SEQ ID NO: 413811 - RNA, 19 nt, Homo sapiens
gacaaugggaccacaagaa

SEQ ID NO: 413812 - RNA, 19 nt, Homo sapiens
ggacccaccuauuuaacca

SEQ ID NO: 413813 - RNA, 19 nt, Homo sapiens
aauccaacuucuucacuaa

SEQ ID NO: 413814 - RNA, 19 nt, Homo sapiens
aaauccaacuucuucacua

SEQ ID NO: 413815 - RNA, 19 nt, Homo sapiens
uagggacuaucagguaaua

SEQ ID NO: 413816 - RNA, 19 nt, Homo sapiens
aaggacacauguucaaaga

SEQ ID NO: 413817 - RNA, 19 nt, Homo sapiens
cauaugaauucaacagagu

SEQ ID NO: 413818 - RNA, 19 nt, Homo sapiens
ggcagaaccaguuaaagaa

SEQ ID NO: 413819 - RNA, 19 nt, Homo sapiens
cggcagaaccaguuaaaga

SEQ ID NO: 413820 - RNA, 19 nt, Homo sapiens
uugaugcauucucagauua

SEQ ID NO: 413821 - RNA, 19 nt, Homo sapiens
aggaguauauugaugcauu

SEQ ID NO: 413822 - RNA, 19 nt, Homo sapiens
gagugaucauuccaguuaa

SEQ ID NO: 413823 - RNA, 19 nt, Homo sapiens
gaugcggacuggaaaccuu

SEQ ID NO: 413824 - RNA, 19 nt, Homo sapiens
cagaugagacaccaauuau

SEQ ID NO: 413825 - RNA, 19 nt, Homo sapiens
gugcaggaguauauugaug

SEQ ID NO: 413826 - RNA, 19 nt, Homo sapiens
gguguccuauggagauauu

SEQ ID NO: 413827 - RNA, 19 nt, Homo sapiens
uagaggaggaguuuaagaa

SEQ ID NO: 413828 - RNA, 19 nt, Homo sapiens
aaugauuucuggcggauga

SEQ ID NO: 413829 - RNA, 19 nt, Homo sapiens
cuauaggcauuacaauuuc

SEQ ID NO: 413830 - RNA, 19 nt, Homo sapiens
gcaaagaccuccuggaaau

SEQ ID NO: 413831 - RNA, 19 nt, Homo sapiens
gauguaaccuucaagauuu

SEQ ID NO: 413832 - RNA, 19 nt, Homo sapiens
gacaaagccugacaagaua

SEQ ID NO: 413833 - RNA, 19 nt, Homo sapiens
ggacaaagccugacaagau

SEQ ID NO: 413834 - RNA, 19 nt, Homo sapiens
gaaaguacuucauggaaug

SEQ ID NO: 413835 - RNA, 19 nt, Homo sapiens
gagaauacauugucacuca

SEQ ID NO: 413836 - RNA, 19 nt, Homo sapiens
caaggaauccagaguauua

SEQ ID NO: 413837 - RNA, 19 nt, Homo sapiens
ucacagagauccagucuau

SEQ ID NO: 413838 - RNA, 19 nt, Homo sapiens
uuacacagcucuuugauga

SEQ ID NO: 413839 - RNA, 19 nt, Homo sapiens
cugaagagcuccuggauaa

SEQ ID NO: 413840 - RNA, 19 nt, Homo sapiens
cauaugaggugcaauuauu

SEQ ID NO: 413841 - RNA, 19 nt, Homo sapiens
caagaaagcuacggaguga

SEQ ID NO: 413842 - RNA, 19 nt, Homo sapiens
gagcagagauggagagcuu

SEQ ID NO: 413843 - RNA, 19 nt, Homo sapiens
gagugaagcucuccaaugu

SEQ ID NO: 413844 - RNA, 19 nt, Homo sapiens
gaaaacuucuuguccaaua

SEQ ID NO: 413845 - RNA, 19 nt, Homo sapiens
guggagaucucagcaauaa

SEQ ID NO: 413846 - RNA, 19 nt, Homo sapiens
gaugaggucucuuguagug

SEQ ID NO: 413847 - RNA, 19 nt, Homo sapiens
caaagacucuguggacauu

SEQ ID NO: 413848 - RNA, 19 nt, Homo sapiens
ccagagagauguaacuuca

SEQ ID NO: 413849 - RNA, 19 nt, Homo sapiens
caaagccacucuauucaga

SEQ ID NO: 413850 - RNA, 19 nt, Homo sapiens
gaguaacggugaacaauuc

SEQ ID NO: 413851 - RNA, 19 nt, Homo sapiens
ccaauucucuccugauuuc

SEQ ID NO: 413852 - RNA, 19 nt, Homo sapiens
gaagacagcacuaucacaa

SEQ ID NO: 413853 - RNA, 19 nt, Homo sapiens
acaaggagacguagaauuu

SEQ ID NO: 413854 - RNA, 19 nt, Homo sapiens
gaaaggaagaaacacagua

SEQ ID NO: 413855 - RNA, 19 nt, Homo sapiens
ucacaaagccacucuauuc

SEQ ID NO: 413856 - RNA, 19 nt, Homo sapiens
auacagcaguuauuccuua

SEQ ID NO: 413857 - RNA, 19 nt, Homo sapiens
gcaaccgaguaucgauuua

SEQ ID NO: 413858 - RNA, 19 nt, Homo sapiens
ccaaagaugccaaagaauu

SEQ ID NO: 413859 - RNA, 19 nt, Homo sapiens
cuggaaauguggauucuua

SEQ ID NO: 413860 - RNA, 19 nt, Homo sapiens
ggauguaaccuucaagauu

SEQ ID NO: 413861 - RNA, 19 nt, Homo sapiens
cuacagaggugccagcuau

SEQ ID NO: 413862 - RNA, 19 nt, Homo sapiens
ccagaaagguaaccggaaa

SEQ ID NO: 413863 - RNA, 19 nt, Homo sapiens
accauuaucuguccacuua

SEQ ID NO: 413864 - RNA, 19 nt, Homo sapiens
ccacuaagcaacacaaauu

SEQ ID NO: 413865 - RNA, 19 nt, Homo sapiens
gaucuaacauugcgcaaca

SEQ ID NO: 413866 - RNA, 19 nt, Homo sapiens
gagguaacauugucucaug

SEQ ID NO: 413867 - RNA, 19 nt, Homo sapiens
gaagaaacacaguauguca

SEQ ID NO: 413868 - RNA, 19 nt, Homo sapiens
gcaaacagauccuuuaccu

SEQ ID NO: 413869 - RNA, 19 nt, Homo sapiens
gaguaaagugugaccauua

SEQ ID NO: 413870 - RNA, 19 nt, Homo sapiens
ccaacuaccuucuauccaa

SEQ ID NO: 413871 - RNA, 19 nt, Homo sapiens
ggguguaucagacuaauua

SEQ ID NO: 413872 - RNA, 19 nt, Homo sapiens
gcaaggaagcccagacuga

SEQ ID NO: 413873 - RNA, 19 nt, Homo sapiens
uaugauauccugcuucuaa

SEQ ID NO: 413874 - RNA, 19 nt, Homo sapiens
gcaugccacuggagacuuu

SEQ ID NO: 413875 - RNA, 19 nt, Homo sapiens
acaagucacucuccaaaga

SEQ ID NO: 413876 - RNA, 19 nt, Homo sapiens
ccaauggagcugugaaaua

SEQ ID NO: 413877 - RNA, 19 nt, Homo sapiens
ccagggagauccuaucaau

SEQ ID NO: 413878 - RNA, 19 nt, Homo sapiens
gaaaauacauggcuacagu

SEQ ID NO: 413879 - RNA, 19 nt, Homo sapiens
ggauagacaacaccacaua

SEQ ID NO: 413880 - RNA, 19 nt, Homo sapiens
uguaagagauguccucaga

SEQ ID NO: 413881 - RNA, 19 nt, Homo sapiens
ucaaccggcuugcauguuu

SEQ ID NO: 413882 - RNA, 19 nt, Homo sapiens
caauggagcugugaaauac

SEQ ID NO: 413883 - RNA, 19 nt, Homo sapiens
ggacagugccugacaaagu

SEQ ID NO: 413884 - RNA, 19 nt, Homo sapiens
gaacagucccuuccagugu

SEQ ID NO: 413885 - RNA, 19 nt, Homo sapiens
ggaaugaccaguagucugu

SEQ ID NO: 413886 - RNA, 19 nt, Homo sapiens
caaggaauacgaggaguua

SEQ ID NO: 413887 - RNA, 19 nt, Homo sapiens
gaaaaggaugugcuaauua

SEQ ID NO: 413888 - RNA, 19 nt, Homo sapiens
caacacaaauuugaagauc

SEQ ID NO: 413889 - RNA, 19 nt, Homo sapiens
gaacagugccugcccaagu

SEQ ID NO: 413890 - RNA, 19 nt, Homo sapiens
ggaaccaucuauaacuuca

SEQ ID NO: 413891 - RNA, 19 nt, Homo sapiens
gaacaauuccggucguaau

SEQ ID NO: 413892 - RNA, 19 nt, Homo sapiens
gcuacagucaccaguauua

SEQ ID NO: 413893 - RNA, 19 nt, Homo sapiens
caacaucacugugggaaag

SEQ ID NO: 413894 - RNA, 19 nt, Homo sapiens
gaacauuuccagacaaagu

SEQ ID NO: 413895 - RNA, 19 nt, Homo sapiens
gcagaacauuuccagacaa

SEQ ID NO: 413896 - RNA, 19 nt, Homo sapiens
gaggugcaauuauuugaug

SEQ ID NO: 413897 - RNA, 19 nt, Homo sapiens
gaacuguggucuugcaaac

SEQ ID NO: 413898 - RNA, 19 nt, Homo sapiens
ggguaggacuggaaccuuu

SEQ ID NO: 413899 - RNA, 19 nt, Homo sapiens
gugaagcucuccaauguag

SEQ ID NO: 413900 - RNA, 19 nt, Homo sapiens
auucuugucuugacgauua

SEQ ID NO: 413901 - RNA, 19 nt, Homo sapiens
ccggagauguggauaacua

SEQ ID NO: 413902 - RNA, 19 nt, Homo sapiens
cagaacauuuccagacaaa

SEQ ID NO: 413903 - RNA, 19 nt, Homo sapiens
gaaccuuuauugcauugga

SEQ ID NO: 413904 - RNA, 19 nt, Homo sapiens
uaacaccaggcaagaaaua

SEQ ID NO: 413905 - RNA, 19 nt, Homo sapiens
acuaugaagucaccauuaa

SEQ ID NO: 413906 - RNA, 19 nt, Homo sapiens
gaaauguggauucuuacaa

SEQ ID NO: 413907 - RNA, 19 nt, Homo sapiens
agagagaacuguggucuug

SEQ ID NO: 413908 - RNA, 19 nt, Homo sapiens
gaaaccacccagucucuga

SEQ ID NO: 413909 - RNA, 19 nt, Homo sapiens
uuuaugagcugauucucua

SEQ ID NO: 413910 - RNA, 19 nt, Homo sapiens
gcacugaggacuugcaugu

SEQ ID NO: 413911 - RNA, 19 nt, Homo sapiens
gggcucacccuguaacuuu

SEQ ID NO: 413912 - RNA, 19 nt, Homo sapiens
agacagcacuaucacaaug

SEQ ID NO: 413913 - RNA, 19 nt, Homo sapiens
gcgggucccugaagaauca

SEQ ID NO: 413914 - RNA, 19 nt, Homo sapiens
ggaguaacggugaacaauu

SEQ ID NO: 413915 - RNA, 19 nt, Homo sapiens
caaagaugccaaagaauuc

SEQ ID NO: 413916 - RNA, 19 nt, Homo sapiens
ugucaaacaugccaaugaa

SEQ ID NO: 413917 - RNA, 19 nt, Homo sapiens
ggaagucauuguugagagu

SEQ ID NO: 413918 - RNA, 19 nt, Homo sapiens
caaacaugcuacuuccuau

SEQ ID NO: 413919 - RNA, 19 nt, Homo sapiens
ggaccaggauucccucuac

SEQ ID NO: 413920 - RNA, 19 nt, Homo sapiens
ucguagggaucgaccauua

SEQ ID NO: 413921 - RNA, 19 nt, Homo sapiens
caguauuaguggagacuua

SEQ ID NO: 413922 - RNA, 19 nt, Homo sapiens
cuccaaagaugccaaagaa

SEQ ID NO: 413923 - RNA, 19 nt, Homo sapiens
ggagaucucagcaauaaag

SEQ ID NO: 413924 - RNA, 19 nt, Homo sapiens
guggauaacuaugagguaa

SEQ ID NO: 413925 - RNA, 19 nt, Homo sapiens
guauuagcaccuuggauua

SEQ ID NO: 413926 - RNA, 19 nt, Homo sapiens
gauaaagggauccuaguuc

SEQ ID NO: 413927 - RNA, 19 nt, Homo sapiens
guucaugacuuguucuaca

SEQ ID NO: 413928 - RNA, 19 nt, Homo sapiens
aagacucuguggacauuua

SEQ ID NO: 413929 - RNA, 19 nt, Homo sapiens
uaagauaugcggugaggaa

SEQ ID NO: 413930 - RNA, 19 nt, Homo sapiens
gaaauacucugguuagaaa

SEQ ID NO: 413931 - RNA, 19 nt, Homo sapiens
gaacagaaagccacaguua

SEQ ID NO: 413932 - RNA, 19 nt, Homo sapiens
gaagauugcugaugaagga

SEQ ID NO: 413933 - RNA, 19 nt, Homo sapiens
gaaaagauccugcaauuua

SEQ ID NO: 413934 - RNA, 19 nt, Homo sapiens
ccucaaagaucauuucaua

SEQ ID NO: 413935 - RNA, 19 nt, Homo sapiens
cagcaaagcuaaauguuaa

SEQ ID NO: 413936 - RNA, 19 nt, Homo sapiens
gaaaugaccucaagauguc

SEQ ID NO: 413937 - RNA, 19 nt, Homo sapiens
gaacaagugugcagaauac

SEQ ID NO: 413938 - RNA, 19 nt, Homo sapiens
gaaaugagucgcauaagaa

SEQ ID NO: 413939 - RNA, 19 nt, Homo sapiens
gaacaagcaucacaagagu

SEQ ID NO: 413940 - RNA, 19 nt, Homo sapiens
gaaccuauaucggaauuga

SEQ ID NO: 413941 - RNA, 19 nt, Homo sapiens
gaagugaauuugucugaau

SEQ ID NO: 413942 - RNA, 19 nt, Homo sapiens
gaauugcgauuuccgugua

SEQ ID NO: 413943 - RNA, 19 nt, Homo sapiens
gaacugacacgcagacauu

SEQ ID NO: 413944 - RNA, 19 nt, Homo sapiens
ggacgcaugcuguuucuua

SEQ ID NO: 413945 - RNA, 19 nt, Homo sapiens
gguauacaguggauuaauu

SEQ ID NO: 413946 - RNA, 19 nt, Homo sapiens
ucaaagaacccaggaaaua

SEQ ID NO: 413947 - RNA, 19 nt, Homo sapiens
gcacaucaaggaguaauua

SEQ ID NO: 413948 - RNA, 19 nt, Homo sapiens
gaacugagacauuccaaga

SEQ ID NO: 413949 - RNA, 19 nt, Homo sapiens
ggacacagcacauuggaaa

SEQ ID NO: 413950 - RNA, 19 nt, Homo sapiens
guaaagagagugagcauga

SEQ ID NO: 413951 - RNA, 19 nt, Homo sapiens
gaugauuucuggaggauga

SEQ ID NO: 413952 - RNA, 19 nt, Homo sapiens
gaaauacauugcugcacaa

SEQ ID NO: 413953 - RNA, 19 nt, Homo sapiens
cagaagagguaguggauau

SEQ ID NO: 413954 - RNA, 19 nt, Homo sapiens
ggaaaucugugcucaguac

SEQ ID NO: 413955 - RNA, 19 nt, Homo sapiens
ggaugaaacuguugaugau

SEQ ID NO: 413956 - RNA, 19 nt, Homo sapiens
gcaaagaugcccaguguuc

SEQ ID NO: 413957 - RNA, 19 nt, Homo sapiens
cagcaaagaugcccagugu

SEQ ID NO: 413958 - RNA, 19 nt, Homo sapiens
gaaccaagcaaauacauca

SEQ ID NO: 413959 - RNA, 19 nt, Homo sapiens
cagauuacaucauucagaa

SEQ ID NO: 413960 - RNA, 19 nt, Homo sapiens
cuacauaaaugccagcuau

SEQ ID NO: 413961 - RNA, 19 nt, Homo sapiens
gcauaagaauugcgauuuc

SEQ ID NO: 413962 - RNA, 19 nt, Homo sapiens
guacagacguaugcuuauu

SEQ ID NO: 413963 - RNA, 19 nt, Homo sapiens
gguaaaagcucuacgcaaa

SEQ ID NO: 413964 - RNA, 19 nt, Homo sapiens
ggaaaugaguaaagagagu

SEQ ID NO: 413965 - RNA, 19 nt, Homo sapiens
agaggaagauugcugauga

SEQ ID NO: 413966 - RNA, 19 nt, Homo sapiens
caacuucuuuguaaucguu

SEQ ID NO: 413967 - RNA, 19 nt, Homo sapiens
gaaccaauauuuguagaag

SEQ ID NO: 413968 - RNA, 19 nt, Homo sapiens
aaacaaccaucaagaagau

SEQ ID NO: 413969 - RNA, 19 nt, Homo sapiens
gagaaggaaagcaaacaua

SEQ ID NO: 413970 - RNA, 19 nt, Homo sapiens
aaacagaagugaauuuguc

SEQ ID NO: 413971 - RNA, 19 nt, Homo sapiens
ggaacaagugugcagaaua

SEQ ID NO: 413972 - RNA, 19 nt, Homo sapiens
agaaaugagucgcauaaga

SEQ ID NO: 413973 - RNA, 19 nt, Homo sapiens
gaagagguaguggauauuu

SEQ ID NO: 413974 - RNA, 19 nt, Homo sapiens
ccagagacuuccuucauau

SEQ ID NO: 413975 - RNA, 19 nt, Homo sapiens
augcauaguucccauguua

SEQ ID NO: 413976 - RNA, 19 nt, Homo sapiens
gaaagacacagacaaaucu

SEQ ID NO: 413977 - RNA, 19 nt, Homo sapiens
caaaguggauguuuauggu

SEQ ID NO: 413978 - RNA, 19 nt, Homo sapiens
gaaauuguuccucgucuga

SEQ ID NO: 413979 - RNA, 19 nt, Homo sapiens
gaaacaauacuugcacaaa

SEQ ID NO: 413980 - RNA, 19 nt, Homo sapiens
gaccacaacuucucuuagu

SEQ ID NO: 413981 - RNA, 19 nt, Homo sapiens
uaaaugcagcgaaccaaua

SEQ ID NO: 413982 - RNA, 19 nt, Homo sapiens
ccagcuauauugaugguuu

SEQ ID NO: 413983 - RNA, 19 nt, Homo sapiens
gaagugaagcugcacauca

SEQ ID NO: 413984 - RNA, 19 nt, Homo sapiens
guacaccucuacucauuca

SEQ ID NO: 413985 - RNA, 19 nt, Homo sapiens
ggaaauacucugguuagaa

SEQ ID NO: 413986 - RNA, 19 nt, Homo sapiens
uuacaugccuacaucauug

SEQ ID NO: 413987 - RNA, 19 nt, Homo sapiens
agagaauucuuucaaguga

SEQ ID NO: 413988 - RNA, 19 nt, Homo sapiens
gauaugaccauguauuugu

SEQ ID NO: 413989 - RNA, 19 nt, Homo sapiens
gaauggacaaguaaagaaa

SEQ ID NO: 413990 - RNA, 19 nt, Homo sapiens
ccaaggaauuaaucucuau

SEQ ID NO: 413991 - RNA, 19 nt, Homo sapiens
gagaaacagaagugaauuu

SEQ ID NO: 413992 - RNA, 19 nt, Homo sapiens
gccaauccaugcagauauu

SEQ ID NO: 413993 - RNA, 19 nt, Homo sapiens
cuaaggcacugauagcauu

SEQ ID NO: 413994 - RNA, 19 nt, Homo sapiens
gaaguugaagcuggaaaua

SEQ ID NO: 413995 - RNA, 19 nt, Homo sapiens
gauaauaguaugcauguca

SEQ ID NO: 413996 - RNA, 19 nt, Homo sapiens
caggagagccucagauuau

SEQ ID NO: 413997 - RNA, 19 nt, Homo sapiens
uaagugugacucagaaaua

SEQ ID NO: 413998 - RNA, 19 nt, Homo sapiens
ucagaugccuaccuuaaug

SEQ ID NO: 413999 - RNA, 19 nt, Homo sapiens
gaaaggacgcaugcuguuu

SEQ ID NO: 414000 - RNA, 19 nt, Homo sapiens
gcaccuacccugcucagaa

SEQ ID NO: 414001 - RNA, 19 nt, Homo sapiens
cgagcaauaucaauuccua

SEQ ID NO: 414002 - RNA, 19 nt, Homo sapiens
gaaguugaccugaaagaca

SEQ ID NO: 414003 - RNA, 19 nt, Homo sapiens
ugacagugauucagaggaa

SEQ ID NO: 414004 - RNA, 19 nt, Homo sapiens
caucuaagccaacauguga

SEQ ID NO: 414005 - RNA, 19 nt, Homo sapiens
gagagagaauucuuucaag

SEQ ID NO: 414006 - RNA, 19 nt, Homo sapiens
gaaggaaagcaaacauaug

SEQ ID NO: 414007 - RNA, 19 nt, Homo sapiens
ggaauacaaucaguuugga

SEQ ID NO: 414008 - RNA, 19 nt, Homo sapiens
gaaggaaacaggaacaagu

SEQ ID NO: 414009 - RNA, 19 nt, Homo sapiens
gauagcauuucuggcauuu

SEQ ID NO: 414010 - RNA, 19 nt, Homo sapiens
ccaugaacguuaccauuug

SEQ ID NO: 414011 - RNA, 19 nt, Homo sapiens
guauaagugugacucagaa

SEQ ID NO: 414012 - RNA, 19 nt, Homo sapiens
uggaagcgcugucauuuca

SEQ ID NO: 414013 - RNA, 19 nt, Homo sapiens
ucacaccacugcauucuca

SEQ ID NO: 414014 - RNA, 19 nt, Homo sapiens
ucagcaaguuuccuauaaa

SEQ ID NO: 414015 - RNA, 19 nt, Homo sapiens
caaacaaugaggugcauaa

SEQ ID NO: 414016 - RNA, 19 nt, Homo sapiens
acagaaagccacaguuauu

SEQ ID NO: 414017 - RNA, 19 nt, Homo sapiens
gggaugaaacuguugauga

SEQ ID NO: 414018 - RNA, 19 nt, Homo sapiens
gaggaagauugcugaugaa

SEQ ID NO: 414019 - RNA, 19 nt, Homo sapiens
caauagcccugcuuguugu

SEQ ID NO: 414020 - RNA, 19 nt, Homo sapiens
ggagagccucagauuauuu

SEQ ID NO: 414021 - RNA, 19 nt, Homo sapiens
aaacaggaauucuaauguc

SEQ ID NO: 414022 - RNA, 19 nt, Homo sapiens
cauuggaaaucaagaagaa

SEQ ID NO: 414023 - RNA, 19 nt, Homo sapiens
gagauguuguuguaaagau

SEQ ID NO: 414024 - RNA, 19 nt, Homo sapiens
gcagaauacuggccgucaa

SEQ ID NO: 414025 - RNA, 19 nt, Homo sapiens
ucagugugguaauaugaua

SEQ ID NO: 414026 - RNA, 19 nt, Homo sapiens
gugcauaaccuuacagaau

SEQ ID NO: 414027 - RNA, 19 nt, Homo sapiens
ccacagguguuucaucagu

SEQ ID NO: 414028 - RNA, 19 nt, Homo sapiens
gcauaguucccauguuaaa

SEQ ID NO: 414029 - RNA, 19 nt, Homo sapiens
ccuguuagcuguuauuucu

SEQ ID NO: 414030 - RNA, 19 nt, Homo sapiens
gaaauacucugguuagaaa

SEQ ID NO: 414031 - RNA, 19 nt, Homo sapiens
gaacagaaagccacaguua

SEQ ID NO: 414032 - RNA, 19 nt, Homo sapiens
gaagauugcugaugaagga

SEQ ID NO: 414033 - RNA, 19 nt, Homo sapiens
gaaaagauccugcaauuua

SEQ ID NO: 414034 - RNA, 19 nt, Homo sapiens
ccucaaagaucauuucaua

SEQ ID NO: 414035 - RNA, 19 nt, Homo sapiens
cagcaaagcuaaauguuaa

SEQ ID NO: 414036 - RNA, 19 nt, Homo sapiens
gaaaugaccucaagauguc

SEQ ID NO: 414037 - RNA, 19 nt, Homo sapiens
gaacaagugugcagaauac

SEQ ID NO: 414038 - RNA, 19 nt, Homo sapiens
gaaaugagucgcauaagaa

SEQ ID NO: 414039 - RNA, 19 nt, Homo sapiens
gaacaagcaucacaagagu

SEQ ID NO: 414040 - RNA, 19 nt, Homo sapiens
gaaccuauaucggaauuga

SEQ ID NO: 414041 - RNA, 19 nt, Homo sapiens
gaagugaauuugucugaau

SEQ ID NO: 414042 - RNA, 19 nt, Homo sapiens
gaauugcgauuuccgugua

SEQ ID NO: 414043 - RNA, 19 nt, Homo sapiens
ggacgcaugcuguuucuua

SEQ ID NO: 414044 - RNA, 19 nt, Homo sapiens
gguauacaguggauuaauu

SEQ ID NO: 414045 - RNA, 19 nt, Homo sapiens
ucaaagaacccaggaaaua

SEQ ID NO: 414046 - RNA, 19 nt, Homo sapiens
gcacaucaaggaguaauua

SEQ ID NO: 414047 - RNA, 19 nt, Homo sapiens
gaacugagacauuccaaga

SEQ ID NO: 414048 - RNA, 19 nt, Homo sapiens
ggacacagcacauuggaaa

SEQ ID NO: 414049 - RNA, 19 nt, Homo sapiens
guaaagagagugagcauga

SEQ ID NO: 414050 - RNA, 19 nt, Homo sapiens
gaugauuucuggaggauga

SEQ ID NO: 414051 - RNA, 19 nt, Homo sapiens
gaaauacauugcugcacaa

SEQ ID NO: 414052 - RNA, 19 nt, Homo sapiens
cagaagagguaguggauau

SEQ ID NO: 414053 - RNA, 19 nt, Homo sapiens
ggaaaucugugcucaguac

SEQ ID NO: 414054 - RNA, 19 nt, Homo sapiens
ggaugaaacuguugaugau

SEQ ID NO: 414055 - RNA, 19 nt, Homo sapiens
gaaccaagcaaauacauca

SEQ ID NO: 414056 - RNA, 19 nt, Homo sapiens
cagauuacaucauucagaa

SEQ ID NO: 414057 - RNA, 19 nt, Homo sapiens
cuacauaaaugccagcuau

SEQ ID NO: 414058 - RNA, 19 nt, Homo sapiens
gcauaagaauugcgauuuc

SEQ ID NO: 414059 - RNA, 19 nt, Homo sapiens
guacagacguaugcuuauu

SEQ ID NO: 414060 - RNA, 19 nt, Homo sapiens
gguaaaagcucuacgcaaa

SEQ ID NO: 414061 - RNA, 19 nt, Homo sapiens
ggaaaugaguaaagagagu

SEQ ID NO: 414062 - RNA, 19 nt, Homo sapiens
agaggaagauugcugauga

SEQ ID NO: 414063 - RNA, 19 nt, Homo sapiens
caacuucuuuguaaucguu

SEQ ID NO: 414064 - RNA, 19 nt, Homo sapiens
gaaccaauauuuguagaag

SEQ ID NO: 414065 - RNA, 19 nt, Homo sapiens
aaacaaccaucaagaagau

SEQ ID NO: 414066 - RNA, 19 nt, Homo sapiens
gagaaggaaagcaaacaua

SEQ ID NO: 414067 - RNA, 19 nt, Homo sapiens
aaacagaagugaauuuguc

SEQ ID NO: 414068 - RNA, 19 nt, Homo sapiens
ggaacaagugugcagaaua

SEQ ID NO: 414069 - RNA, 19 nt, Homo sapiens
agaaaugagucgcauaaga

SEQ ID NO: 414070 - RNA, 19 nt, Homo sapiens
gaagagguaguggauauuu

SEQ ID NO: 414071 - RNA, 19 nt, Homo sapiens
ccagagacuuccuucauau

SEQ ID NO: 414072 - RNA, 19 nt, Homo sapiens
augcauaguucccauguua

SEQ ID NO: 414073 - RNA, 19 nt, Homo sapiens
gaaagacacagacaaaucu

SEQ ID NO: 414074 - RNA, 19 nt, Homo sapiens
caaaguggauguuuauggu

SEQ ID NO: 414075 - RNA, 19 nt, Homo sapiens
gaaauuguuccucgucuga

SEQ ID NO: 414076 - RNA, 19 nt, Homo sapiens
gaaacaauacuugcacaaa

SEQ ID NO: 414077 - RNA, 19 nt, Homo sapiens
uaaaugcagcgaaccaaua

SEQ ID NO: 414078 - RNA, 19 nt, Homo sapiens
ccagcuauauugaugguuu

SEQ ID NO: 414079 - RNA, 19 nt, Homo sapiens
gaagugaagcugcacauca

SEQ ID NO: 414080 - RNA, 19 nt, Homo sapiens
guacaccucuacucauuca

SEQ ID NO: 414081 - RNA, 19 nt, Homo sapiens
ggaaauacucugguuagaa

SEQ ID NO: 414082 - RNA, 19 nt, Homo sapiens
uuacaugccuacaucauug

SEQ ID NO: 414083 - RNA, 19 nt, Homo sapiens
agagaauucuuucaaguga

SEQ ID NO: 414084 - RNA, 19 nt, Homo sapiens
gaauggacaaguaaagaaa

SEQ ID NO: 414085 - RNA, 19 nt, Homo sapiens
ccaaggaauuaaucucuau

SEQ ID NO: 414086 - RNA, 19 nt, Homo sapiens
gaaaggacgcaugcuguuu

SEQ ID NO: 414087 - RNA, 19 nt, Homo sapiens
gauaugaccauguauuugu

SEQ ID NO: 414088 - RNA, 19 nt, Homo sapiens
gagaaacagaagugaauuu

SEQ ID NO: 414089 - RNA, 19 nt, Homo sapiens
gccaauccaugcagauauu

SEQ ID NO: 414090 - RNA, 19 nt, Homo sapiens
cuaaggcacugauagcauu

SEQ ID NO: 414091 - RNA, 19 nt, Homo sapiens
gaaguugaagcuggaaaua

SEQ ID NO: 414092 - RNA, 19 nt, Homo sapiens
gauaauaguaugcauguca

SEQ ID NO: 414093 - RNA, 19 nt, Homo sapiens
caggagagccucagauuau

SEQ ID NO: 414094 - RNA, 19 nt, Homo sapiens
uaagugugacucagaaaua

SEQ ID NO: 414095 - RNA, 19 nt, Homo sapiens
gcaccuacccugcucagaa

SEQ ID NO: 414096 - RNA, 19 nt, Homo sapiens
cgagcaauaucaauuccua

SEQ ID NO: 414097 - RNA, 19 nt, Homo sapiens
gaaguugaccugaaagaca

SEQ ID NO: 414098 - RNA, 19 nt, Homo sapiens
ugacagugauucagaggaa

SEQ ID NO: 414099 - RNA, 19 nt, Homo sapiens
caucuaagccaacauguga

SEQ ID NO: 414100 - RNA, 19 nt, Homo sapiens
gagagagaauucuuucaag

SEQ ID NO: 414101 - RNA, 19 nt, Homo sapiens
gaaggaaagcaaacauaug

SEQ ID NO: 414102 - RNA, 19 nt, Homo sapiens
ggaauacaaucaguuugga

SEQ ID NO: 414103 - RNA, 19 nt, Homo sapiens
gaaggaaacaggaacaagu

SEQ ID NO: 414104 - RNA, 19 nt, Homo sapiens
gauagcauuucuggcauuu

SEQ ID NO: 414105 - RNA, 19 nt, Homo sapiens
ccaugaacguuaccauuug

SEQ ID NO: 414106 - RNA, 19 nt, Homo sapiens
guauaagugugacucagaa

SEQ ID NO: 414107 - RNA, 19 nt, Homo sapiens
uggaagcgcugucauuuca

SEQ ID NO: 414108 - RNA, 19 nt, Homo sapiens
ucagcaaguuuccuauaaa

SEQ ID NO: 414109 - RNA, 19 nt, Homo sapiens
caaacaaugaggugcauaa

SEQ ID NO: 414110 - RNA, 19 nt, Homo sapiens
acagaaagccacaguuauu

SEQ ID NO: 414111 - RNA, 19 nt, Homo sapiens
gggaugaaacuguugauga

SEQ ID NO: 414112 - RNA, 19 nt, Homo sapiens
gaggaagauugcugaugaa

SEQ ID NO: 414113 - RNA, 19 nt, Homo sapiens
caauagcccugcuuguugu

SEQ ID NO: 414114 - RNA, 19 nt, Homo sapiens
ggagagccucagauuauuu

SEQ ID NO: 414115 - RNA, 19 nt, Homo sapiens
aaacaggaauucuaauguc

SEQ ID NO: 414116 - RNA, 19 nt, Homo sapiens
cauuggaaaucaagaagaa

SEQ ID NO: 414117 - RNA, 19 nt, Homo sapiens
gagauguuguuguaaagau

SEQ ID NO: 414118 - RNA, 19 nt, Homo sapiens
gcagaauacuggccgucaa

SEQ ID NO: 414119 - RNA, 19 nt, Homo sapiens
ccacugaugccuaccuuaa

SEQ ID NO: 414120 - RNA, 19 nt, Homo sapiens
ucagugugguaauaugaua

SEQ ID NO: 414121 - RNA, 19 nt, Homo sapiens
gugcauaaccuuacagaau

SEQ ID NO: 414122 - RNA, 19 nt, Homo sapiens
gcauaguucccauguuaaa

SEQ ID NO: 414123 - RNA, 19 nt, Homo sapiens
ccuguuagcuguuauuucu

SEQ ID NO: 414124 - RNA, 19 nt, Homo sapiens
ggaacaagcaucacaagag

SEQ ID NO: 414125 - RNA, 19 nt, Homo sapiens
aagcaaacauauggagaua

SEQ ID NO: 414126 - RNA, 19 nt, Homo sapiens
aaacugagaaggagaguga

SEQ ID NO: 414127 - RNA, 19 nt, Homo sapiens
uuucuggcauuucugauua

SEQ ID NO: 414128 - RNA, 19 nt, Homo sapiens
caaacaucacuguggauua

SEQ ID NO: 414129 - RNA, 19 nt, Homo sapiens
ccagugagcuuaucaugcu

SEQ ID NO: 414130 - RNA, 19 nt, Homo sapiens
gaaauacucugguuagaaa

SEQ ID NO: 414131 - RNA, 19 nt, Homo sapiens
gaacagaaagccacaguua

SEQ ID NO: 414132 - RNA, 19 nt, Homo sapiens
gaagauugcugaugaagga

SEQ ID NO: 414133 - RNA, 19 nt, Homo sapiens
gaaaagauccugcaauuua

SEQ ID NO: 414134 - RNA, 19 nt, Homo sapiens
ccucaaagaucauuucaua

SEQ ID NO: 414135 - RNA, 19 nt, Homo sapiens
cagcaaagcuaaauguuaa

SEQ ID NO: 414136 - RNA, 19 nt, Homo sapiens
gaaaugaccucaagauguc

SEQ ID NO: 414137 - RNA, 19 nt, Homo sapiens
gaacaagugugcagaauac

SEQ ID NO: 414138 - RNA, 19 nt, Homo sapiens
gaaaugagucgcauaagaa

SEQ ID NO: 414139 - RNA, 19 nt, Homo sapiens
gaacaagcaucacaagagu

SEQ ID NO: 414140 - RNA, 19 nt, Homo sapiens
gaaccuauaucggaauuga

SEQ ID NO: 414141 - RNA, 19 nt, Homo sapiens
gaagugaauuugucugaau

SEQ ID NO: 414142 - RNA, 19 nt, Homo sapiens
gaauugcgauuuccgugua

SEQ ID NO: 414143 - RNA, 19 nt, Homo sapiens
gaacugacacgcagacauu

SEQ ID NO: 414144 - RNA, 19 nt, Homo sapiens
ggacgcaugcuguuucuua

SEQ ID NO: 414145 - RNA, 19 nt, Homo sapiens
gguauacaguggauuaauu

SEQ ID NO: 414146 - RNA, 19 nt, Homo sapiens
ucaaagaacccaggaaaua

SEQ ID NO: 414147 - RNA, 19 nt, Homo sapiens
gcacaucaaggaguaauua

SEQ ID NO: 414148 - RNA, 19 nt, Homo sapiens
gaacugagacauuccaaga

SEQ ID NO: 414149 - RNA, 19 nt, Homo sapiens
ggacacagcacauuggaaa

SEQ ID NO: 414150 - RNA, 19 nt, Homo sapiens
guaaagagagugagcauga

SEQ ID NO: 414151 - RNA, 19 nt, Homo sapiens
gaugauuucuggaggauga

SEQ ID NO: 414152 - RNA, 19 nt, Homo sapiens
gaaauacauugcugcacaa

SEQ ID NO: 414153 - RNA, 19 nt, Homo sapiens
cagaagagguaguggauau

SEQ ID NO: 414154 - RNA, 19 nt, Homo sapiens
ggaaaucugugcucaguac

SEQ ID NO: 414155 - RNA, 19 nt, Homo sapiens
ggaugaaacuguugaugau

SEQ ID NO: 414156 - RNA, 19 nt, Homo sapiens
gcaaagaugcccaguguuc

SEQ ID NO: 414157 - RNA, 19 nt, Homo sapiens
cagcaaagaugcccagugu

SEQ ID NO: 414158 - RNA, 19 nt, Homo sapiens
gaaccaagcaaauacauca

SEQ ID NO: 414159 - RNA, 19 nt, Homo sapiens
cagauuacaucauucagaa

SEQ ID NO: 414160 - RNA, 19 nt, Homo sapiens
cuacauaaaugccagcuau

SEQ ID NO: 414161 - RNA, 19 nt, Homo sapiens
gcauaagaauugcgauuuc

SEQ ID NO: 414162 - RNA, 19 nt, Homo sapiens
guacagacguaugcuuauu

SEQ ID NO: 414163 - RNA, 19 nt, Homo sapiens
gguaaaagcucuacgcaaa

SEQ ID NO: 414164 - RNA, 19 nt, Homo sapiens
ggaaaugaguaaagagagu

SEQ ID NO: 414165 - RNA, 19 nt, Homo sapiens
agaggaagauugcugauga

SEQ ID NO: 414166 - RNA, 19 nt, Homo sapiens
caacuucuuuguaaucguu

SEQ ID NO: 414167 - RNA, 19 nt, Homo sapiens
gaaccaauauuuguagaag

SEQ ID NO: 414168 - RNA, 19 nt, Homo sapiens
aaacaaccaucaagaagau

SEQ ID NO: 414169 - RNA, 19 nt, Homo sapiens
gagaaggaaagcaaacaua

SEQ ID NO: 414170 - RNA, 19 nt, Homo sapiens
aaacagaagugaauuuguc

SEQ ID NO: 414171 - RNA, 19 nt, Homo sapiens
ggaacaagugugcagaaua

SEQ ID NO: 414172 - RNA, 19 nt, Homo sapiens
agaaaugagucgcauaaga

SEQ ID NO: 414173 - RNA, 19 nt, Homo sapiens
gaagagguaguggauauuu

SEQ ID NO: 414174 - RNA, 19 nt, Homo sapiens
ccagagacuuccuucauau

SEQ ID NO: 414175 - RNA, 19 nt, Homo sapiens
augcauaguucccauguua

SEQ ID NO: 414176 - RNA, 19 nt, Homo sapiens
gaaagacacagacaaaucu

SEQ ID NO: 414177 - RNA, 19 nt, Homo sapiens
caaaguggauguuuauggu

SEQ ID NO: 414178 - RNA, 19 nt, Homo sapiens
gaaauuguuccucgucuga

SEQ ID NO: 414179 - RNA, 19 nt, Homo sapiens
gaaacaauacuugcacaaa

SEQ ID NO: 414180 - RNA, 19 nt, Homo sapiens
gaccacaacuucucuuagu

SEQ ID NO: 414181 - RNA, 19 nt, Homo sapiens
uaaaugcagcgaaccaaua

SEQ ID NO: 414182 - RNA, 19 nt, Homo sapiens
ccagcuauauugaugguuu

SEQ ID NO: 414183 - RNA, 19 nt, Homo sapiens
gaagugaagcugcacauca

SEQ ID NO: 414184 - RNA, 19 nt, Homo sapiens
guacaccucuacucauuca

SEQ ID NO: 414185 - RNA, 19 nt, Homo sapiens
ggaaauacucugguuagaa

SEQ ID NO: 414186 - RNA, 19 nt, Homo sapiens
uuacaugccuacaucauug

SEQ ID NO: 414187 - RNA, 19 nt, Homo sapiens
agagaauucuuucaaguga

SEQ ID NO: 414188 - RNA, 19 nt, Homo sapiens
gauaugaccauguauuugu

SEQ ID NO: 414189 - RNA, 19 nt, Homo sapiens
gaauggacaaguaaagaaa

SEQ ID NO: 414190 - RNA, 19 nt, Homo sapiens
ccaaggaauuaaucucuau

SEQ ID NO: 414191 - RNA, 19 nt, Homo sapiens
gagaaacagaagugaauuu

SEQ ID NO: 414192 - RNA, 19 nt, Homo sapiens
gccaauccaugcagauauu

SEQ ID NO: 414193 - RNA, 19 nt, Homo sapiens
cuaaggcacugauagcauu

SEQ ID NO: 414194 - RNA, 19 nt, Homo sapiens
gaaguugaagcuggaaaua

SEQ ID NO: 414195 - RNA, 19 nt, Homo sapiens
gauaauaguaugcauguca

SEQ ID NO: 414196 - RNA, 19 nt, Homo sapiens
caggagagccucagauuau

SEQ ID NO: 414197 - RNA, 19 nt, Homo sapiens
uaagugugacucagaaaua

SEQ ID NO: 414198 - RNA, 19 nt, Homo sapiens
ucagaugccuaccuuaaug

SEQ ID NO: 414199 - RNA, 19 nt, Homo sapiens
gaaaggacgcaugcuguuu

SEQ ID NO: 414200 - RNA, 19 nt, Homo sapiens
gcaccuacccugcucagaa

SEQ ID NO: 414201 - RNA, 19 nt, Homo sapiens
cgagcaauaucaauuccua

SEQ ID NO: 414202 - RNA, 19 nt, Homo sapiens
gaaguugaccugaaagaca

SEQ ID NO: 414203 - RNA, 19 nt, Homo sapiens
ugacagugauucagaggaa

SEQ ID NO: 414204 - RNA, 19 nt, Homo sapiens
caucuaagccaacauguga

SEQ ID NO: 414205 - RNA, 19 nt, Homo sapiens
gagagagaauucuuucaag

SEQ ID NO: 414206 - RNA, 19 nt, Homo sapiens
gaaggaaagcaaacauaug

SEQ ID NO: 414207 - RNA, 19 nt, Homo sapiens
ggaauacaaucaguuugga

SEQ ID NO: 414208 - RNA, 19 nt, Homo sapiens
gaaggaaacaggaacaagu

SEQ ID NO: 414209 - RNA, 19 nt, Homo sapiens
gauagcauuucuggcauuu

SEQ ID NO: 414210 - RNA, 19 nt, Homo sapiens
ccaugaacguuaccauuug

SEQ ID NO: 414211 - RNA, 19 nt, Homo sapiens
guauaagugugacucagaa

SEQ ID NO: 414212 - RNA, 19 nt, Homo sapiens
uggaagcgcugucauuuca

SEQ ID NO: 414213 - RNA, 19 nt, Homo sapiens
ucacaccacugcauucuca

SEQ ID NO: 414214 - RNA, 19 nt, Homo sapiens
ucagcaaguuuccuauaaa

SEQ ID NO: 414215 - RNA, 19 nt, Homo sapiens
caaacaaugaggugcauaa

SEQ ID NO: 414216 - RNA, 19 nt, Homo sapiens
acagaaagccacaguuauu

SEQ ID NO: 414217 - RNA, 19 nt, Homo sapiens
gggaugaaacuguugauga

SEQ ID NO: 414218 - RNA, 19 nt, Homo sapiens
gaggaagauugcugaugaa

SEQ ID NO: 414219 - RNA, 19 nt, Homo sapiens
caauagcccugcuuguugu

SEQ ID NO: 414220 - RNA, 19 nt, Homo sapiens
ggagagccucagauuauuu

SEQ ID NO: 414221 - RNA, 19 nt, Homo sapiens
aaacaggaauucuaauguc

SEQ ID NO: 414222 - RNA, 19 nt, Homo sapiens
cauuggaaaucaagaagaa

SEQ ID NO: 414223 - RNA, 19 nt, Homo sapiens
gagauguuguuguaaagau

SEQ ID NO: 414224 - RNA, 19 nt, Homo sapiens
gcagaauacuggccgucaa

SEQ ID NO: 414225 - RNA, 19 nt, Homo sapiens
ucagugugguaauaugaua

SEQ ID NO: 414226 - RNA, 19 nt, Homo sapiens
gugcauaaccuuacagaau

SEQ ID NO: 414227 - RNA, 19 nt, Homo sapiens
ccacagguguuucaucagu

SEQ ID NO: 414228 - RNA, 19 nt, Homo sapiens
gcauaguucccauguuaaa

SEQ ID NO: 414229 - RNA, 19 nt, Homo sapiens
ccuguuagcuguuauuucu

SEQ ID NO: 414230 - RNA, 19 nt, Homo sapiens
guuaacagcugucuaugua

SEQ ID NO: 414231 - RNA, 19 nt, Homo sapiens
gacauucacuuguucuuaa

SEQ ID NO: 414232 - RNA, 19 nt, Homo sapiens
ggacgcaugcuguuucuua

SEQ ID NO: 414233 - RNA, 19 nt, Homo sapiens
gauaacagauuugcauaug

SEQ ID NO: 414234 - RNA, 19 nt, Homo sapiens
acacagagaugcugcaaau

SEQ ID NO: 414235 - RNA, 19 nt, Homo sapiens
gcauuaagaagguaaguaa

SEQ ID NO: 414236 - RNA, 19 nt, Homo sapiens
uaacguacauucaacagau

SEQ ID NO: 414237 - RNA, 19 nt, Homo sapiens
cagagaugcugcaaauaaa

SEQ ID NO: 414238 - RNA, 19 nt, Homo sapiens
uaacagcugucuauguaug

SEQ ID NO: 414239 - RNA, 19 nt, Homo sapiens
gaaauuguuccucgucuga

SEQ ID NO: 414240 - RNA, 19 nt, Homo sapiens
caacagaucaugaaauugg

SEQ ID NO: 414241 - RNA, 19 nt, Homo sapiens
uaacagauuugcauauguc

SEQ ID NO: 414242 - RNA, 19 nt, Homo sapiens
acagagaugcugcaaauaa

SEQ ID NO: 414243 - RNA, 19 nt, Homo sapiens
ccacugguaagaauuaaua

SEQ ID NO: 414244 - RNA, 19 nt, Homo sapiens
gacaguaaaucacacaaca

SEQ ID NO: 414245 - RNA, 19 nt, Homo sapiens
gaaaggacgcaugcuguuu

SEQ ID NO: 414246 - RNA, 19 nt, Homo sapiens
gauaugaccauguauuugu

SEQ ID NO: 414247 - RNA, 19 nt, Homo sapiens
guaaaucacacaacagguu

SEQ ID NO: 414248 - RNA, 19 nt, Homo sapiens
caacagguuucuacucucu

SEQ ID NO: 414249 - RNA, 19 nt, Homo sapiens
caacuaacguacauucaac

SEQ ID NO: 414250 - RNA, 19 nt, Homo sapiens
gagaugcugcaaauaaauu

SEQ ID NO: 414251 - RNA, 19 nt, Homo sapiens
gcauuuggcuuugccuuuc

SEQ ID NO: 414252 - RNA, 19 nt, Homo sapiens
cagauaugaccauguauuu

SEQ ID NO: 414253 - RNA, 19 nt, Homo sapiens
gaagguaaguaaaacaaug

SEQ ID NO: 414254 - RNA, 19 nt, Homo sapiens
ggcuuaaacucuuggcauu

SEQ ID NO: 414255 - RNA, 19 nt, Homo sapiens
uaucacaucacuuaacuga

SEQ ID NO: 414256 - RNA, 19 nt, Homo sapiens
caaauucuacugaacacuu

SEQ ID NO: 414257 - RNA, 19 nt, Homo sapiens
gagugauucuugacauuca

SEQ ID NO: 414258 - RNA, 19 nt, Homo sapiens
guagauaacagauuugcau

SEQ ID NO: 414259 - RNA, 19 nt, Homo sapiens
ugacauucacuuguucuua

SEQ ID NO: 414260 - RNA, 19 nt, Homo sapiens
cacaacagguuucuacucu

SEQ ID NO: 414261 - RNA, 19 nt, Homo sapiens
uaaaucacacaacagguuu

SEQ ID NO: 414262 - RNA, 19 nt, Homo sapiens
cuuaaacucuuggcauuug

SEQ ID NO: 414263 - RNA, 19 nt, Homo sapiens
uuccagauaugaccaugua

SEQ ID NO: 414264 - RNA, 19 nt, Homo sapiens
gguuaaauaucacaucacu

SEQ ID NO: 414265 - RNA, 19 nt, Homo sapiens
ccagauaugaccauguauu

SEQ ID NO: 414266 - RNA, 19 nt, Homo sapiens
acagguuucuacucucuuu

SEQ ID NO: 414267 - RNA, 19 nt, Homo sapiens
agacaacaguggagaaagg

SEQ ID NO: 414268 - RNA, 19 nt, Homo sapiens
uucccaaacuugacaguaa

SEQ ID NO: 414269 - RNA, 19 nt, Homo sapiens
ccaacuaacguacauucaa

SEQ ID NO: 414270 - RNA, 19 nt, Homo sapiens
uaagacaacaguggagaaa

SEQ ID NO: 414271 - RNA, 19 nt, Homo sapiens
aaugcacaauuccaacuaa

SEQ ID NO: 414272 - RNA, 19 nt, Homo sapiens
ccauguauuuguggcuuaa

SEQ ID NO: 414273 - RNA, 19 nt, Homo sapiens
acacuucaauaguccuuau

SEQ ID NO: 414274 - RNA, 19 nt, Homo sapiens
cagauuugcauaugucuau

SEQ ID NO: 414275 - RNA, 19 nt, Homo sapiens
gaacacuucaauaguccuu

SEQ ID NO: 414276 - RNA, 19 nt, Homo sapiens
cagguuaacagcugucuau

SEQ ID NO: 414277 - RNA, 19 nt, Homo sapiens
aauuguuccucgucugaua

SEQ ID NO: 414278 - RNA, 19 nt, Homo sapiens
gcagaugguuaaauaucac

SEQ ID NO: 414279 - RNA, 19 nt, Homo sapiens
cuuugagacuauugagaua

SEQ ID NO: 414280 - RNA, 19 nt, Homo sapiens
caaacuugacaguaaauca

SEQ ID NO: 414281 - RNA, 19 nt, Homo sapiens
ucccaaacuugacaguaaa

SEQ ID NO: 414282 - RNA, 19 nt, Homo sapiens
gcacaauuccaacuaacgu

SEQ ID NO: 414283 - RNA, 19 nt, Homo sapiens
guucuuaaacuuucugcuu

SEQ ID NO: 414284 - RNA, 19 nt, Homo sapiens
cggcugacuuccagauaug

SEQ ID NO: 414285 - RNA, 19 nt, Homo sapiens
ucacacaacagguuucuac

SEQ ID NO: 414286 - RNA, 19 nt, Homo sapiens
gaucaugaaauuggguuau

SEQ ID NO: 414287 - RNA, 19 nt, Homo sapiens
caguaugcauuaagaaggu

SEQ ID NO: 414288 - RNA, 19 nt, Homo sapiens
ugcagaugguuaaauauca

SEQ ID NO: 414289 - RNA, 19 nt, Homo sapiens
acuuucugcuuauacguua

SEQ ID NO: 414290 - RNA, 19 nt, Homo sapiens
caugagugauucuugacau

SEQ ID NO: 414291 - RNA, 19 nt, Homo sapiens
aaauucuacugaacacuuc

SEQ ID NO: 414292 - RNA, 19 nt, Homo sapiens
gacgcaugcuguuucuuag

SEQ ID NO: 414293 - RNA, 19 nt, Homo sapiens
uaaugcacaauuccaacua

SEQ ID NO: 414294 - RNA, 19 nt, Homo sapiens
gguugacaguaugcauuaa

SEQ ID NO: 414295 - RNA, 19 nt, Homo sapiens
aaucauaugguugacagua

SEQ ID NO: 414296 - RNA, 19 nt, Homo sapiens
gcuuaaacucuuggcauuu

SEQ ID NO: 414297 - RNA, 19 nt, Homo sapiens
gguuaacagcugucuaugu

SEQ ID NO: 414298 - RNA, 19 nt, Homo sapiens
uaaacuuucugcuuauacg

SEQ ID NO: 414299 - RNA, 19 nt, Homo sapiens
gacaguaugcauuaagaag

SEQ ID NO: 414300 - RNA, 19 nt, Homo sapiens
agaaaggacgcaugcuguu

SEQ ID NO: 414301 - RNA, 19 nt, Homo sapiens
aaaggacgcaugcuguuuc

SEQ ID NO: 414302 - RNA, 19 nt, Homo sapiens
acucuuggcauuuggcuuu

SEQ ID NO: 414303 - RNA, 19 nt, Homo sapiens
cagcugucuauguauguua

SEQ ID NO: 414304 - RNA, 19 nt, Homo sapiens
uugacaguaugcauuaaga

SEQ ID NO: 414305 - RNA, 19 nt, Homo sapiens
ugguugacaguaugcauua

SEQ ID NO: 414306 - RNA, 19 nt, Homo sapiens
ugacaguaugcauuaagaa

SEQ ID NO: 414307 - RNA, 19 nt, Homo sapiens
guauuuuccugcauaauca

SEQ ID NO: 414308 - RNA, 19 nt, Homo sapiens
cacaauuccaacuaacgua

SEQ ID NO: 414309 - RNA, 19 nt, Homo sapiens
acggcugacuuccagauau

SEQ ID NO: 414310 - RNA, 19 nt, Homo sapiens
guacauucaacagaucaug

SEQ ID NO: 414311 - RNA, 19 nt, Homo sapiens
guaaugcacaauuccaacu

SEQ ID NO: 414312 - RNA, 19 nt, Homo sapiens
augagugauucuugacauu

SEQ ID NO: 414313 - RNA, 19 nt, Homo sapiens
gaauggagcucgaauuuaa

SEQ ID NO: 414314 - RNA, 19 nt, Homo sapiens
gaagaaaucucgcgggaaa

SEQ ID NO: 414315 - RNA, 19 nt, Homo sapiens
gaagaucacuuuacagcua

SEQ ID NO: 414316 - RNA, 19 nt, Homo sapiens
ggagagaaguugaauuaaa

SEQ ID NO: 414317 - RNA, 19 nt, Homo sapiens
cgucauagaugccauguua

SEQ ID NO: 414318 - RNA, 19 nt, Homo sapiens
gaaagcaaaugacaacuug

SEQ ID NO: 414319 - RNA, 19 nt, Homo sapiens
ccaaacagcuuauacuauu

SEQ ID NO: 414320 - RNA, 19 nt, Homo sapiens
gaucaagggugaaguguga

SEQ ID NO: 414321 - RNA, 19 nt, Homo sapiens
gaauaugucuucuuugugu

SEQ ID NO: 414322 - RNA, 19 nt, Homo sapiens
gaaagaaagucagcaauca

SEQ ID NO: 414323 - RNA, 19 nt, Homo sapiens
gaaaguccuugauuuaguu

SEQ ID NO: 414324 - RNA, 19 nt, Homo sapiens
gaacuggucuacaaagaug

SEQ ID NO: 414325 - RNA, 19 nt, Homo sapiens
caacuuggauggcaugauu

SEQ ID NO: 414326 - RNA, 19 nt, Homo sapiens
gaggauaucaggugcauua

SEQ ID NO: 414327 - RNA, 19 nt, Homo sapiens
gcagaaauaucagcuagaa

SEQ ID NO: 414328 - RNA, 19 nt, Homo sapiens
gauaucaggugcauuaugu

SEQ ID NO: 414329 - RNA, 19 nt, Homo sapiens
gaacacaauuccaccauag

SEQ ID NO: 414330 - RNA, 19 nt, Homo sapiens
gaaaugugcuagaacugaa

SEQ ID NO: 414331 - RNA, 19 nt, Homo sapiens
caacaacaauggucguauu

SEQ ID NO: 414332 - RNA, 19 nt, Homo sapiens
gcagugacuuguggaaaua

SEQ ID NO: 414333 - RNA, 19 nt, Homo sapiens
ccaaaguggucaagaauau

SEQ ID NO: 414334 - RNA, 19 nt, Homo sapiens
gagagaaguugaauuaaag

SEQ ID NO: 414335 - RNA, 19 nt, Homo sapiens
gaagaaaugugcuagaacu

SEQ ID NO: 414336 - RNA, 19 nt, Homo sapiens
gaggagcccuucagauuga

SEQ ID NO: 414337 - RNA, 19 nt, Homo sapiens
gaaaucacuugguuuaaag

SEQ ID NO: 414338 - RNA, 19 nt, Homo sapiens
ugacaagccucacgagauu

SEQ ID NO: 414339 - RNA, 19 nt, Homo sapiens
gaacacccgugggaucuaa

SEQ ID NO: 414340 - RNA, 19 nt, Homo sapiens
uagaugagcugcuuaagga

SEQ ID NO: 414341 - RNA, 19 nt, Homo sapiens
ggaauuagaugagcugcuu

SEQ ID NO: 414342 - RNA, 19 nt, Homo sapiens
ggagaggagcaacgaauua

SEQ ID NO: 414343 - RNA, 19 nt, Homo sapiens
ccagaaaucacuugguuua

SEQ ID NO: 414344 - RNA, 19 nt, Homo sapiens
gugccaaucuuccauguaa

SEQ ID NO: 414345 - RNA, 19 nt, Homo sapiens
gaaguaaacaaaccaaaga

SEQ ID NO: 414346 - RNA, 19 nt, Homo sapiens
ccaaguauacccuucuuua

SEQ ID NO: 414347 - RNA, 19 nt, Homo sapiens
ccauguaacuuuaaugaga

SEQ ID NO: 414348 - RNA, 19 nt, Homo sapiens
acacagaaguuaauuguca

SEQ ID NO: 414349 - RNA, 19 nt, Homo sapiens
gguagaggcugucaacuca

SEQ ID NO: 414350 - RNA, 19 nt, Homo sapiens
ucagagauuugagguaaua

SEQ ID NO: 414351 - RNA, 19 nt, Homo sapiens
ggagaaggauuuauugacu

SEQ ID NO: 414352 - RNA, 19 nt, Homo sapiens
gggaggagauggugaagga

SEQ ID NO: 414353 - RNA, 19 nt, Homo sapiens
uaaacagcauggccagaua

SEQ ID NO: 414354 - RNA, 19 nt, Homo sapiens
ccaaggauauagaguuuau

SEQ ID NO: 414355 - RNA, 19 nt, Homo sapiens
uaagacagucagcaaauua

SEQ ID NO: 414356 - RNA, 19 nt, Homo sapiens
gggaugaggccauuuauga

SEQ ID NO: 414357 - RNA, 19 nt, Homo sapiens
gaccugugcuucauuucua

SEQ ID NO: 414358 - RNA, 19 nt, Homo sapiens
cuucuuaacuucuagcuaa

SEQ ID NO: 414359 - RNA, 19 nt, Homo sapiens
gcaguggucuuuaucaucu

SEQ ID NO: 414360 - RNA, 19 nt, Homo sapiens
cagaugaaauggaauuaga

SEQ ID NO: 414361 - RNA, 19 nt, Homo sapiens
gcucacccgugcccaauaa

SEQ ID NO: 414362 - RNA, 19 nt, Homo sapiens
caaauaaugugggagaaau

SEQ ID NO: 414363 - RNA, 19 nt, Homo sapiens
gaacuggagucuucauaac

SEQ ID NO: 414364 - RNA, 19 nt, Homo sapiens
ggaauggagcucgaauuua

SEQ ID NO: 414365 - RNA, 19 nt, Homo sapiens
gagagaaugucacaggaau

SEQ ID NO: 414366 - RNA, 19 nt, Homo sapiens
cgaauguaaucgcauauga

SEQ ID NO: 414367 - RNA, 19 nt, Homo sapiens
guaagacagucagcaaauu

SEQ ID NO: 414368 - RNA, 19 nt, Homo sapiens
caacaauggucguauuaag

SEQ ID NO: 414369 - RNA, 19 nt, Homo sapiens
agaaggaucugauuacauc

SEQ ID NO: 414370 - RNA, 19 nt, Homo sapiens
gaacugaggcgccuuaacu

SEQ ID NO: 414371 - RNA, 19 nt, Homo sapiens
gagaaggauuuauugacuu

SEQ ID NO: 414372 - RNA, 19 nt, Homo sapiens
gaauagauacgcgaaugua

SEQ ID NO: 414373 - RNA, 19 nt, Homo sapiens
ccaacuggauucccucaaa

SEQ ID NO: 414374 - RNA, 19 nt, Homo sapiens
ggaguugccucuuucaucu

SEQ ID NO: 414375 - RNA, 19 nt, Homo sapiens
ggaagugacuaugugaaug

SEQ ID NO: 414376 - RNA, 19 nt, Homo sapiens
ugaagagucugaccaagga

SEQ ID NO: 414377 - RNA, 19 nt, Homo sapiens
gauuugagguaauagaguu

SEQ ID NO: 414378 - RNA, 19 nt, Homo sapiens
gaaagaaugagauaugaag

SEQ ID NO: 414379 - RNA, 19 nt, Homo sapiens
gaacaugcagagucuaaga

SEQ ID NO: 414380 - RNA, 19 nt, Homo sapiens
gagcaacgaauuaccauug

SEQ ID NO: 414381 - RNA, 19 nt, Homo sapiens
gaauguguggccucaaaua

SEQ ID NO: 414382 - RNA, 19 nt, Homo sapiens
caagauaccaguacuuugu

SEQ ID NO: 414383 - RNA, 19 nt, Homo sapiens
cagauaccauugccaacua

SEQ ID NO: 414384 - RNA, 19 nt, Homo sapiens
gaacaagcucugaaagugu

SEQ ID NO: 414385 - RNA, 19 nt, Homo sapiens
gaugauaugccaauaggaa

SEQ ID NO: 414386 - RNA, 19 nt, Homo sapiens
gaacacaacgaccagcuau

SEQ ID NO: 414387 - RNA, 19 nt, Homo sapiens
gagagaaaugucaccaaua

SEQ ID NO: 414388 - RNA, 19 nt, Homo sapiens
ugggagagaaguugaauua

SEQ ID NO: 414389 - RNA, 19 nt, Homo sapiens
gaaccugagucugaaacaa

SEQ ID NO: 414390 - RNA, 19 nt, Homo sapiens
ggaaagaaagucagcaauc

SEQ ID NO: 414391 - RNA, 19 nt, Homo sapiens
ugaaggaguuguagauauc

SEQ ID NO: 414392 - RNA, 19 nt, Homo sapiens
gaagcugacacaaauagaa

SEQ ID NO: 414393 - RNA, 19 nt, Homo sapiens
guucgaacauuugcacuuu

SEQ ID NO: 414394 - RNA, 19 nt, Homo sapiens
uuaaggagauaucuaggaa

SEQ ID NO: 414395 - RNA, 19 nt, Homo sapiens
gcugaccugugcuucauuu

SEQ ID NO: 414396 - RNA, 19 nt, Homo sapiens
gaaaugggcagagagaaau

SEQ ID NO: 414397 - RNA, 19 nt, Homo sapiens
uauccaugaugcacuguua

SEQ ID NO: 414398 - RNA, 19 nt, Homo sapiens
ggugaagugugaccaguau

SEQ ID NO: 414399 - RNA, 19 nt, Homo sapiens
ccaggaauaugagucaauu

SEQ ID NO: 414400 - RNA, 19 nt, Homo sapiens
gcagcauaccgaacaauaa

SEQ ID NO: 414401 - RNA, 19 nt, Homo sapiens
ugaaguaccugcaaaugag

SEQ ID NO: 414402 - RNA, 19 nt, Homo sapiens
cuucagggcuaccgucuaa

SEQ ID NO: 414403 - RNA, 19 nt, Homo sapiens
ggacacauuuggaccucuu

SEQ ID NO: 414404 - RNA, 19 nt, Homo sapiens
cuacucggauuaugaauuc

SEQ ID NO: 414405 - RNA, 19 nt, Homo sapiens
agagaaaugucaccaauac

SEQ ID NO: 414406 - RNA, 19 nt, Homo sapiens
ggaguuggccggacugguu

SEQ ID NO: 414407 - RNA, 19 nt, Homo sapiens
cauuugcacuuuacaagaa

SEQ ID NO: 414408 - RNA, 19 nt, Homo sapiens
gaacauuugcacuuuacaa

SEQ ID NO: 414409 - RNA, 19 nt, Homo sapiens
uaacgcugcuugauacugu

SEQ ID NO: 414410 - RNA, 19 nt, Homo sapiens
gaagcaaaaugccuauauu

SEQ ID NO: 414411 - RNA, 19 nt, Homo sapiens
gauauggagccacuuacua

SEQ ID NO: 414412 - RNA, 19 nt, Homo sapiens
cuagaaccaugcagucaaa

SEQ ID NO: 414413 - RNA, 19 nt, Homo sapiens
gaauggagcucgaauuuaa

SEQ ID NO: 414414 - RNA, 19 nt, Homo sapiens
gaagaaaucucgcgggaaa

SEQ ID NO: 414415 - RNA, 19 nt, Homo sapiens
gaagaucacuuuacagcua

SEQ ID NO: 414416 - RNA, 19 nt, Homo sapiens
ggagagaaguugaauuaaa

SEQ ID NO: 414417 - RNA, 19 nt, Homo sapiens
cgucauagaugccauguua

SEQ ID NO: 414418 - RNA, 19 nt, Homo sapiens
gaaagcaaaugacaacuug

SEQ ID NO: 414419 - RNA, 19 nt, Homo sapiens
ccaaacagcuuauacuauu

SEQ ID NO: 414420 - RNA, 19 nt, Homo sapiens
gaucaagggugaaguguga

SEQ ID NO: 414421 - RNA, 19 nt, Homo sapiens
gaauaugucuucuuugugu

SEQ ID NO: 414422 - RNA, 19 nt, Homo sapiens
gaaagaaagucagcaauca

SEQ ID NO: 414423 - RNA, 19 nt, Homo sapiens
gaaaguccuugauuuaguu

SEQ ID NO: 414424 - RNA, 19 nt, Homo sapiens
gaacuggucuacaaagaug

SEQ ID NO: 414425 - RNA, 19 nt, Homo sapiens
caacuuggauggcaugauu

SEQ ID NO: 414426 - RNA, 19 nt, Homo sapiens
gaggauaucaggugcauua

SEQ ID NO: 414427 - RNA, 19 nt, Homo sapiens
gcagaaauaucagcuagaa

SEQ ID NO: 414428 - RNA, 19 nt, Homo sapiens
gauaucaggugcauuaugu

SEQ ID NO: 414429 - RNA, 19 nt, Homo sapiens
gaacacaauuccaccauag

SEQ ID NO: 414430 - RNA, 19 nt, Homo sapiens
gaaaugugcuagaacugaa

SEQ ID NO: 414431 - RNA, 19 nt, Homo sapiens
caacaacaauggucguauu

SEQ ID NO: 414432 - RNA, 19 nt, Homo sapiens
gcagugacuuguggaaaua

SEQ ID NO: 414433 - RNA, 19 nt, Homo sapiens
ccaaaguggucaagaauau

SEQ ID NO: 414434 - RNA, 19 nt, Homo sapiens
gagagaaguugaauuaaag

SEQ ID NO: 414435 - RNA, 19 nt, Homo sapiens
gaagaaaugugcuagaacu

SEQ ID NO: 414436 - RNA, 19 nt, Homo sapiens
gaaaucacuugguuuaaag

SEQ ID NO: 414437 - RNA, 19 nt, Homo sapiens
ugacaagccucacgagauu

SEQ ID NO: 414438 - RNA, 19 nt, Homo sapiens
gaacacccgugggaucuaa

SEQ ID NO: 414439 - RNA, 19 nt, Homo sapiens
uagaugagcugcuuaagga

SEQ ID NO: 414440 - RNA, 19 nt, Homo sapiens
ggaauuagaugagcugcuu

SEQ ID NO: 414441 - RNA, 19 nt, Homo sapiens
ggagaggagcaacgaauua

SEQ ID NO: 414442 - RNA, 19 nt, Homo sapiens
ccagaaaucacuugguuua

SEQ ID NO: 414443 - RNA, 19 nt, Homo sapiens
gugccaaucuuccauguaa

SEQ ID NO: 414444 - RNA, 19 nt, Homo sapiens
gaaguaaacaaaccaaaga

SEQ ID NO: 414445 - RNA, 19 nt, Homo sapiens
ccaaguauacccuucuuua

SEQ ID NO: 414446 - RNA, 19 nt, Homo sapiens
ccauguaacuuuaaugaga

SEQ ID NO: 414447 - RNA, 19 nt, Homo sapiens
acacagaaguuaauuguca

SEQ ID NO: 414448 - RNA, 19 nt, Homo sapiens
gguagaggcugucaacuca

SEQ ID NO: 414449 - RNA, 19 nt, Homo sapiens
ucagagauuugagguaaua

SEQ ID NO: 414450 - RNA, 19 nt, Homo sapiens
ggagaaggauuuauugacu

SEQ ID NO: 414451 - RNA, 19 nt, Homo sapiens
gggaggagauggugaagga

SEQ ID NO: 414452 - RNA, 19 nt, Homo sapiens
uaaacagcauggccagaua

SEQ ID NO: 414453 - RNA, 19 nt, Homo sapiens
ccaaggauauagaguuuau

SEQ ID NO: 414454 - RNA, 19 nt, Homo sapiens
uaagacagucagcaaauua

SEQ ID NO: 414455 - RNA, 19 nt, Homo sapiens
gggaugaggccauuuauga

SEQ ID NO: 414456 - RNA, 19 nt, Homo sapiens
gaccugugcuucauuucua

SEQ ID NO: 414457 - RNA, 19 nt, Homo sapiens
cuucuuaacuucuagcuaa

SEQ ID NO: 414458 - RNA, 19 nt, Homo sapiens
gcaguggucuuuaucaucu

SEQ ID NO: 414459 - RNA, 19 nt, Homo sapiens
cagaugaaauggaauuaga

SEQ ID NO: 414460 - RNA, 19 nt, Homo sapiens
gcucacccgugcccaauaa

SEQ ID NO: 414461 - RNA, 19 nt, Homo sapiens
caaauaaugugggagaaau

SEQ ID NO: 414462 - RNA, 19 nt, Homo sapiens
gaacuggagucuucauaac

SEQ ID NO: 414463 - RNA, 19 nt, Homo sapiens
ggaauggagcucgaauuua

SEQ ID NO: 414464 - RNA, 19 nt, Homo sapiens
gagagaaugucacaggaau

SEQ ID NO: 414465 - RNA, 19 nt, Homo sapiens
cgaauguaaucgcauauga

SEQ ID NO: 414466 - RNA, 19 nt, Homo sapiens
guaagacagucagcaaauu

SEQ ID NO: 414467 - RNA, 19 nt, Homo sapiens
caacaauggucguauuaag

SEQ ID NO: 414468 - RNA, 19 nt, Homo sapiens
agaaggaucugauuacauc

SEQ ID NO: 414469 - RNA, 19 nt, Homo sapiens
gaacugaggcgccuuaacu

SEQ ID NO: 414470 - RNA, 19 nt, Homo sapiens
gagaaggauuuauugacuu

SEQ ID NO: 414471 - RNA, 19 nt, Homo sapiens
gaauagauacgcgaaugua

SEQ ID NO: 414472 - RNA, 19 nt, Homo sapiens
ccaacuggauucccucaaa

SEQ ID NO: 414473 - RNA, 19 nt, Homo sapiens
ggaguugccucuuucaucu

SEQ ID NO: 414474 - RNA, 19 nt, Homo sapiens
ggaagugacuaugugaaug

SEQ ID NO: 414475 - RNA, 19 nt, Homo sapiens
ugaagagucugaccaagga

SEQ ID NO: 414476 - RNA, 19 nt, Homo sapiens
caggagcccuucagauuga

SEQ ID NO: 414477 - RNA, 19 nt, Homo sapiens
gauuugagguaauagaguu

SEQ ID NO: 414478 - RNA, 19 nt, Homo sapiens
gaaagaaugagauaugaag

SEQ ID NO: 414479 - RNA, 19 nt, Homo sapiens
gaacaugcagagucuaaga

SEQ ID NO: 414480 - RNA, 19 nt, Homo sapiens
gagcaacgaauuaccauug

SEQ ID NO: 414481 - RNA, 19 nt, Homo sapiens
gaauguguggccucaaaua

SEQ ID NO: 414482 - RNA, 19 nt, Homo sapiens
caagauaccaguacuuugu

SEQ ID NO: 414483 - RNA, 19 nt, Homo sapiens
cagauaccauugccaacua

SEQ ID NO: 414484 - RNA, 19 nt, Homo sapiens
gaacaagcucugaaagugu

SEQ ID NO: 414485 - RNA, 19 nt, Homo sapiens
gaugauaugccaauaggaa

SEQ ID NO: 414486 - RNA, 19 nt, Homo sapiens
gaacacaacgaccagcuau

SEQ ID NO: 414487 - RNA, 19 nt, Homo sapiens
gagagaaaugucaccaaua

SEQ ID NO: 414488 - RNA, 19 nt, Homo sapiens
ugggagagaaguugaauua

SEQ ID NO: 414489 - RNA, 19 nt, Homo sapiens
gaaccugagucugaaacaa

SEQ ID NO: 414490 - RNA, 19 nt, Homo sapiens
ggaaagaaagucagcaauc

SEQ ID NO: 414491 - RNA, 19 nt, Homo sapiens
ugaaggaguuguagauauc

SEQ ID NO: 414492 - RNA, 19 nt, Homo sapiens
gaagcugacacaaauagaa

SEQ ID NO: 414493 - RNA, 19 nt, Homo sapiens
guucgaacauuugcacuuu

SEQ ID NO: 414494 - RNA, 19 nt, Homo sapiens
uuaaggagauaucuaggaa

SEQ ID NO: 414495 - RNA, 19 nt, Homo sapiens
gcugaccugugcuucauuu

SEQ ID NO: 414496 - RNA, 19 nt, Homo sapiens
gaaaugggcagagagaaau

SEQ ID NO: 414497 - RNA, 19 nt, Homo sapiens
uauccaugaugcacuguua

SEQ ID NO: 414498 - RNA, 19 nt, Homo sapiens
ggugaagugugaccaguau

SEQ ID NO: 414499 - RNA, 19 nt, Homo sapiens
ccaggaauaugagucaauu

SEQ ID NO: 414500 - RNA, 19 nt, Homo sapiens
gcagcauaccgaacaauaa

SEQ ID NO: 414501 - RNA, 19 nt, Homo sapiens
ugaaguaccugcaaaugag

SEQ ID NO: 414502 - RNA, 19 nt, Homo sapiens
cuucagggcuaccgucuaa

SEQ ID NO: 414503 - RNA, 19 nt, Homo sapiens
ggacacauuuggaccucuu

SEQ ID NO: 414504 - RNA, 19 nt, Homo sapiens
cuacucggauuaugaauuc

SEQ ID NO: 414505 - RNA, 19 nt, Homo sapiens
agagaaaugucaccaauac

SEQ ID NO: 414506 - RNA, 19 nt, Homo sapiens
ggaguuggccggacugguu

SEQ ID NO: 414507 - RNA, 19 nt, Homo sapiens
cauuugcacuuuacaagaa

SEQ ID NO: 414508 - RNA, 19 nt, Homo sapiens
gaacauuugcacuuuacaa

SEQ ID NO: 414509 - RNA, 19 nt, Homo sapiens
uaacgcugcuugauacugu

SEQ ID NO: 414510 - RNA, 19 nt, Homo sapiens
gaagcaaaaugccuauauu

SEQ ID NO: 414511 - RNA, 19 nt, Homo sapiens
gauauggagccacuuacua

SEQ ID NO: 414512 - RNA, 19 nt, Homo sapiens
cuagaaccaugcagucaaa

SEQ ID NO: 414513 - RNA, 19 nt, Homo sapiens
gaauggagcucgaauuuaa

SEQ ID NO: 414514 - RNA, 19 nt, Homo sapiens
gaagaaaucucgcgggaaa

SEQ ID NO: 414515 - RNA, 19 nt, Homo sapiens
gaagaucacuuuacagcua

SEQ ID NO: 414516 - RNA, 19 nt, Homo sapiens
ggagagaaguugaauuaaa

SEQ ID NO: 414517 - RNA, 19 nt, Homo sapiens
cgucauagaugccauguua

SEQ ID NO: 414518 - RNA, 19 nt, Homo sapiens
gaaagcaaaugacaacuug

SEQ ID NO: 414519 - RNA, 19 nt, Homo sapiens
ccaaacagcuuauacuauu

SEQ ID NO: 414520 - RNA, 19 nt, Homo sapiens
gaucaagggugaaguguga

SEQ ID NO: 414521 - RNA, 19 nt, Homo sapiens
gaauaugucuucuuugugu

SEQ ID NO: 414522 - RNA, 19 nt, Homo sapiens
gaaagaaagucagcaauca

SEQ ID NO: 414523 - RNA, 19 nt, Homo sapiens
gaaaguccuugauuuaguu

SEQ ID NO: 414524 - RNA, 19 nt, Homo sapiens
gaacuggucuacaaagaug

SEQ ID NO: 414525 - RNA, 19 nt, Homo sapiens
caacuuggauggcaugauu

SEQ ID NO: 414526 - RNA, 19 nt, Homo sapiens
gaggauaucaggugcauua

SEQ ID NO: 414527 - RNA, 19 nt, Homo sapiens
gcagaaauaucagcuagaa

SEQ ID NO: 414528 - RNA, 19 nt, Homo sapiens
gauaucaggugcauuaugu

SEQ ID NO: 414529 - RNA, 19 nt, Homo sapiens
gaacacaauuccaccauag

SEQ ID NO: 414530 - RNA, 19 nt, Homo sapiens
gcacaggacaugaucauuu

SEQ ID NO: 414531 - RNA, 19 nt, Homo sapiens
gaaaugugcuagaacugaa

SEQ ID NO: 414532 - RNA, 19 nt, Homo sapiens
caacaacaauggucguauu

SEQ ID NO: 414533 - RNA, 19 nt, Homo sapiens
gcagugacuuguggaaaua

SEQ ID NO: 414534 - RNA, 19 nt, Homo sapiens
ccaaaguggucaagaauau

SEQ ID NO: 414535 - RNA, 19 nt, Homo sapiens
gagagaaguugaauuaaag

SEQ ID NO: 414536 - RNA, 19 nt, Homo sapiens
gaagaaaugugcuagaacu

SEQ ID NO: 414537 - RNA, 19 nt, Homo sapiens
gaggagcccuucagauuga

SEQ ID NO: 414538 - RNA, 19 nt, Homo sapiens
gaaaucacuugguuuaaag

SEQ ID NO: 414539 - RNA, 19 nt, Homo sapiens
ugacaagccucacgagauu

SEQ ID NO: 414540 - RNA, 19 nt, Homo sapiens
gaacacccgugggaucuaa

SEQ ID NO: 414541 - RNA, 19 nt, Homo sapiens
uagaugagcugcuuaagga

SEQ ID NO: 414542 - RNA, 19 nt, Homo sapiens
ggaauuagaugagcugcuu

SEQ ID NO: 414543 - RNA, 19 nt, Homo sapiens
ggagaggagcaacgaauua

SEQ ID NO: 414544 - RNA, 19 nt, Homo sapiens
ccagaaaucacuugguuua

SEQ ID NO: 414545 - RNA, 19 nt, Homo sapiens
gugccaaucuuccauguaa

SEQ ID NO: 414546 - RNA, 19 nt, Homo sapiens
gaaguaaacaaaccaaaga

SEQ ID NO: 414547 - RNA, 19 nt, Homo sapiens
ccaaguauacccuucuuua

SEQ ID NO: 414548 - RNA, 19 nt, Homo sapiens
ccauguaacuuuaaugaga

SEQ ID NO: 414549 - RNA, 19 nt, Homo sapiens
acacagaaguuaauuguca

SEQ ID NO: 414550 - RNA, 19 nt, Homo sapiens
gguagaggcugucaacuca

SEQ ID NO: 414551 - RNA, 19 nt, Homo sapiens
ucagagauuugagguaaua

SEQ ID NO: 414552 - RNA, 19 nt, Homo sapiens
ggagaaggauuuauugacu

SEQ ID NO: 414553 - RNA, 19 nt, Homo sapiens
gggaggagauggugaagga

SEQ ID NO: 414554 - RNA, 19 nt, Homo sapiens
uaaacagcauggccagaua

SEQ ID NO: 414555 - RNA, 19 nt, Homo sapiens
ccaaggauauagaguuuau

SEQ ID NO: 414556 - RNA, 19 nt, Homo sapiens
uaagacagucagcaaauua

SEQ ID NO: 414557 - RNA, 19 nt, Homo sapiens
gggaugaggccauuuauga

SEQ ID NO: 414558 - RNA, 19 nt, Homo sapiens
gaccugugcuucauuucua

SEQ ID NO: 414559 - RNA, 19 nt, Homo sapiens
cuucuuaacuucuagcuaa

SEQ ID NO: 414560 - RNA, 19 nt, Homo sapiens
gcaguggucuuuaucaucu

SEQ ID NO: 414561 - RNA, 19 nt, Homo sapiens
cagaugaaauggaauuaga

SEQ ID NO: 414562 - RNA, 19 nt, Homo sapiens
gcucacccgugcccaauaa

SEQ ID NO: 414563 - RNA, 19 nt, Homo sapiens
caaauaaugugggagaaau

SEQ ID NO: 414564 - RNA, 19 nt, Homo sapiens
gaacuggagucuucauaac

SEQ ID NO: 414565 - RNA, 19 nt, Homo sapiens
ggaauggagcucgaauuua

SEQ ID NO: 414566 - RNA, 19 nt, Homo sapiens
gagagaaugucacaggaau

SEQ ID NO: 414567 - RNA, 19 nt, Homo sapiens
cgaauguaaucgcauauga

SEQ ID NO: 414568 - RNA, 19 nt, Homo sapiens
guaagacagucagcaaauu

SEQ ID NO: 414569 - RNA, 19 nt, Homo sapiens
caacaauggucguauuaag

SEQ ID NO: 414570 - RNA, 19 nt, Homo sapiens
agaaggaucugauuacauc

SEQ ID NO: 414571 - RNA, 19 nt, Homo sapiens
gaacugaggcgccuuaacu

SEQ ID NO: 414572 - RNA, 19 nt, Homo sapiens
gagaaggauuuauugacuu

SEQ ID NO: 414573 - RNA, 19 nt, Homo sapiens
gaauagauacgcgaaugua

SEQ ID NO: 414574 - RNA, 19 nt, Homo sapiens
ccaacuggauucccucaaa

SEQ ID NO: 414575 - RNA, 19 nt, Homo sapiens
ggaguugccucuuucaucu

SEQ ID NO: 414576 - RNA, 19 nt, Homo sapiens
ggaagugacuaugugaaug

SEQ ID NO: 414577 - RNA, 19 nt, Homo sapiens
ugaagagucugaccaagga

SEQ ID NO: 414578 - RNA, 19 nt, Homo sapiens
gauuugagguaauagaguu

SEQ ID NO: 414579 - RNA, 19 nt, Homo sapiens
gaaagaaugagauaugaag

SEQ ID NO: 414580 - RNA, 19 nt, Homo sapiens
gaacaugcagagucuaaga

SEQ ID NO: 414581 - RNA, 19 nt, Homo sapiens
gagcaacgaauuaccauug

SEQ ID NO: 414582 - RNA, 19 nt, Homo sapiens
gaauguguggccucaaaua

SEQ ID NO: 414583 - RNA, 19 nt, Homo sapiens
caagauaccaguacuuugu

SEQ ID NO: 414584 - RNA, 19 nt, Homo sapiens
gaacaagcucugaaagugu

SEQ ID NO: 414585 - RNA, 19 nt, Homo sapiens
cagauaccauugccaacua

SEQ ID NO: 414586 - RNA, 19 nt, Homo sapiens
gaugauaugccaauaggaa

SEQ ID NO: 414587 - RNA, 19 nt, Homo sapiens
gaacacaacgaccagcuau

SEQ ID NO: 414588 - RNA, 19 nt, Homo sapiens
gagagaaaugucaccaaua

SEQ ID NO: 414589 - RNA, 19 nt, Homo sapiens
ugggagagaaguugaauua

SEQ ID NO: 414590 - RNA, 19 nt, Homo sapiens
gaaccugagucugaaacaa

SEQ ID NO: 414591 - RNA, 19 nt, Homo sapiens
ggaaagaaagucagcaauc

SEQ ID NO: 414592 - RNA, 19 nt, Homo sapiens
ugaaggaguuguagauauc

SEQ ID NO: 414593 - RNA, 19 nt, Homo sapiens
gaagcugacacaaauagaa

SEQ ID NO: 414594 - RNA, 19 nt, Homo sapiens
guucgaacauuugcacuuu

SEQ ID NO: 414595 - RNA, 19 nt, Homo sapiens
uuaaggagauaucuaggaa

SEQ ID NO: 414596 - RNA, 19 nt, Homo sapiens
gcugaccugugcuucauuu

SEQ ID NO: 414597 - RNA, 19 nt, Homo sapiens
gaaaugggcagagagaaau

SEQ ID NO: 414598 - RNA, 19 nt, Homo sapiens
uauccaugaugcacuguua

SEQ ID NO: 414599 - RNA, 19 nt, Homo sapiens
ggugaagugugaccaguau

SEQ ID NO: 414600 - RNA, 19 nt, Homo sapiens
ccaggaauaugagucaauu

SEQ ID NO: 414601 - RNA, 19 nt, Homo sapiens
gcagcauaccgaacaauaa

SEQ ID NO: 414602 - RNA, 19 nt, Homo sapiens
ugaaguaccugcaaaugag

SEQ ID NO: 414603 - RNA, 19 nt, Homo sapiens
cuucagggcuaccgucuaa

SEQ ID NO: 414604 - RNA, 19 nt, Homo sapiens
ggacacauuuggaccucuu

SEQ ID NO: 414605 - RNA, 19 nt, Homo sapiens
cuacucggauuaugaauuc

SEQ ID NO: 414606 - RNA, 19 nt, Homo sapiens
agagaaaugucaccaauac

SEQ ID NO: 414607 - RNA, 19 nt, Homo sapiens
ggaguuggccggacugguu

SEQ ID NO: 414608 - RNA, 19 nt, Homo sapiens
cauuugcacuuuacaagaa

SEQ ID NO: 414609 - RNA, 19 nt, Homo sapiens
gaacauuugcacuuuacaa

SEQ ID NO: 414610 - RNA, 19 nt, Homo sapiens
uaacgcugcuugauacugu

SEQ ID NO: 414611 - RNA, 19 nt, Homo sapiens
gaagcaaaaugccuauauu

SEQ ID NO: 414612 - RNA, 19 nt, Homo sapiens
gauauggagccacuuacua

SEQ ID NO: 414613 - RNA, 19 nt, Homo sapiens
gaauggagcucgaauuuaa

SEQ ID NO: 414614 - RNA, 19 nt, Homo sapiens
gaagaaaucucgcgggaaa

SEQ ID NO: 414615 - RNA, 19 nt, Homo sapiens
ggagagaaguugaauuaaa

SEQ ID NO: 414616 - RNA, 19 nt, Homo sapiens
cgucauagaugccauguua

SEQ ID NO: 414617 - RNA, 19 nt, Homo sapiens
gaaagcaaaugacaacuug

SEQ ID NO: 414618 - RNA, 19 nt, Homo sapiens
ccaaacagcuuauacuauu

SEQ ID NO: 414619 - RNA, 19 nt, Homo sapiens
gaucaagggugaaguguga

SEQ ID NO: 414620 - RNA, 19 nt, Homo sapiens
gaauaugucuucuuugugu

SEQ ID NO: 414621 - RNA, 19 nt, Homo sapiens
gaaagaaagucagcaauca

SEQ ID NO: 414622 - RNA, 19 nt, Homo sapiens
gaaaguccuugauuuaguu

SEQ ID NO: 414623 - RNA, 19 nt, Homo sapiens
gaacuggucuacaaagaug

SEQ ID NO: 414624 - RNA, 19 nt, Homo sapiens
caacuuggauggcaugauu

SEQ ID NO: 414625 - RNA, 19 nt, Homo sapiens
gcagaaauaucagcuagaa

SEQ ID NO: 414626 - RNA, 19 nt, Homo sapiens
gaacacaauuccaccauag

SEQ ID NO: 414627 - RNA, 19 nt, Homo sapiens
gaaaugugcuagaacugaa

SEQ ID NO: 414628 - RNA, 19 nt, Homo sapiens
caacaacaauggucguauu

SEQ ID NO: 414629 - RNA, 19 nt, Homo sapiens
gcagugacuuguggaaaua

SEQ ID NO: 414630 - RNA, 19 nt, Homo sapiens
ccaaaguggucaagaauau

SEQ ID NO: 414631 - RNA, 19 nt, Homo sapiens
gagagaaguugaauuaaag

SEQ ID NO: 414632 - RNA, 19 nt, Homo sapiens
gaagaaaugugcuagaacu

SEQ ID NO: 414633 - RNA, 19 nt, Homo sapiens
gaggagcccuucagauuga

SEQ ID NO: 414634 - RNA, 19 nt, Homo sapiens
gaaaucacuugguuuaaag

SEQ ID NO: 414635 - RNA, 19 nt, Homo sapiens
gaacacccgugggaucuaa

SEQ ID NO: 414636 - RNA, 19 nt, Homo sapiens
uagaugagcugcuuaagga

SEQ ID NO: 414637 - RNA, 19 nt, Homo sapiens
ggaauuagaugagcugcuu

SEQ ID NO: 414638 - RNA, 19 nt, Homo sapiens
ggagaggagcaacgaauua

SEQ ID NO: 414639 - RNA, 19 nt, Homo sapiens
ccagaaaucacuugguuua

SEQ ID NO: 414640 - RNA, 19 nt, Homo sapiens
gugccaaucuuccauguaa

SEQ ID NO: 414641 - RNA, 19 nt, Homo sapiens
gaaguaaacaaaccaaaga

SEQ ID NO: 414642 - RNA, 19 nt, Homo sapiens
ccauguaacuuuaaugaga

SEQ ID NO: 414643 - RNA, 19 nt, Homo sapiens
acacagaaguuaauuguca

SEQ ID NO: 414644 - RNA, 19 nt, Homo sapiens
ucagagauuugagguaaua

SEQ ID NO: 414645 - RNA, 19 nt, Homo sapiens
ggagaaggauuuauugacu

SEQ ID NO: 414646 - RNA, 19 nt, Homo sapiens
ccaaggauauagaguuuau

SEQ ID NO: 414647 - RNA, 19 nt, Homo sapiens
uaagacagucagcaaauua

SEQ ID NO: 414648 - RNA, 19 nt, Homo sapiens
gggaugaggccauuuauga

SEQ ID NO: 414649 - RNA, 19 nt, Homo sapiens
gaccugugcuucauuucua

SEQ ID NO: 414650 - RNA, 19 nt, Homo sapiens
cuucuuaacuucuagcuaa

SEQ ID NO: 414651 - RNA, 19 nt, Homo sapiens
gcaguggucuuuaucaucu

SEQ ID NO: 414652 - RNA, 19 nt, Homo sapiens
cagaugaaauggaauuaga

SEQ ID NO: 414653 - RNA, 19 nt, Homo sapiens
caaauaaugugggagaaau

SEQ ID NO: 414654 - RNA, 19 nt, Homo sapiens
gaacuggagucuucauaac

SEQ ID NO: 414655 - RNA, 19 nt, Homo sapiens
ggaauggagcucgaauuua

SEQ ID NO: 414656 - RNA, 19 nt, Homo sapiens
gagagaaugucacaggaau

SEQ ID NO: 414657 - RNA, 19 nt, Homo sapiens
cgaauguaaucgcauauga

SEQ ID NO: 414658 - RNA, 19 nt, Homo sapiens
guaagacagucagcaaauu

SEQ ID NO: 414659 - RNA, 19 nt, Homo sapiens
caacaauggucguauuaag

SEQ ID NO: 414660 - RNA, 19 nt, Homo sapiens
agaaggaucugauuacauc

SEQ ID NO: 414661 - RNA, 19 nt, Homo sapiens
gaacugaggcgccuuaacu

SEQ ID NO: 414662 - RNA, 19 nt, Homo sapiens
gagaaggauuuauugacuu

SEQ ID NO: 414663 - RNA, 19 nt, Homo sapiens
gaauagauacgcgaaugua

SEQ ID NO: 414664 - RNA, 19 nt, Homo sapiens
ggaguugccucuuucaucu

SEQ ID NO: 414665 - RNA, 19 nt, Homo sapiens
ggaagugacuaugugaaug

SEQ ID NO: 414666 - RNA, 19 nt, Homo sapiens
ugaagagucugaccaagga

SEQ ID NO: 414667 - RNA, 19 nt, Homo sapiens
gauuugagguaauagaguu

SEQ ID NO: 414668 - RNA, 19 nt, Homo sapiens
gaaagaaugagauaugaag

SEQ ID NO: 414669 - RNA, 19 nt, Homo sapiens
gaacaugcagagucuaaga

SEQ ID NO: 414670 - RNA, 19 nt, Homo sapiens
gagcaacgaauuaccauug

SEQ ID NO: 414671 - RNA, 19 nt, Homo sapiens
gaauguguggccucaaaua

SEQ ID NO: 414672 - RNA, 19 nt, Homo sapiens
caagauaccaguacuuugu

SEQ ID NO: 414673 - RNA, 19 nt, Homo sapiens
gaacaagcucugaaagugu

SEQ ID NO: 414674 - RNA, 19 nt, Homo sapiens
cagauaccauugccaacua

SEQ ID NO: 414675 - RNA, 19 nt, Homo sapiens
gaugauaugccaauaggaa

SEQ ID NO: 414676 - RNA, 19 nt, Homo sapiens
gaacacaacgaccagcuau

SEQ ID NO: 414677 - RNA, 19 nt, Homo sapiens
gagagaaaugucaccaaua

SEQ ID NO: 414678 - RNA, 19 nt, Homo sapiens
ugggagagaaguugaauua

SEQ ID NO: 414679 - RNA, 19 nt, Homo sapiens
gaaccugagucugaaacaa

SEQ ID NO: 414680 - RNA, 19 nt, Homo sapiens
ggaaagaaagucagcaauc

SEQ ID NO: 414681 - RNA, 19 nt, Homo sapiens
ugaaggaguuguagauauc

SEQ ID NO: 414682 - RNA, 19 nt, Homo sapiens
gaagcugacacaaauagaa

SEQ ID NO: 414683 - RNA, 19 nt, Homo sapiens
guucgaacauuugcacuuu

SEQ ID NO: 414684 - RNA, 19 nt, Homo sapiens
uuaaggagauaucuaggaa

SEQ ID NO: 414685 - RNA, 19 nt, Homo sapiens
gcugaccugugcuucauuu

SEQ ID NO: 414686 - RNA, 19 nt, Homo sapiens
gaaaugggcagagagaaau

SEQ ID NO: 414687 - RNA, 19 nt, Homo sapiens
uauccaugaugcacuguua

SEQ ID NO: 414688 - RNA, 19 nt, Homo sapiens
ggugaagugugaccaguau

SEQ ID NO: 414689 - RNA, 19 nt, Homo sapiens
ccaggaauaugagucaauu

SEQ ID NO: 414690 - RNA, 19 nt, Homo sapiens
gcagcauaccgaacaauaa

SEQ ID NO: 414691 - RNA, 19 nt, Homo sapiens
ugaaguaccugcaaaugag

SEQ ID NO: 414692 - RNA, 19 nt, Homo sapiens
cuacucggauuaugaauuc

SEQ ID NO: 414693 - RNA, 19 nt, Homo sapiens
agagaaaugucaccaauac

SEQ ID NO: 414694 - RNA, 19 nt, Homo sapiens
ggaguuggccggacugguu

SEQ ID NO: 414695 - RNA, 19 nt, Homo sapiens
cauuugcacuuuacaagaa

SEQ ID NO: 414696 - RNA, 19 nt, Homo sapiens
gaacauuugcacuuuacaa

SEQ ID NO: 414697 - RNA, 19 nt, Homo sapiens
uaacgcugcuugauacugu

SEQ ID NO: 414698 - RNA, 19 nt, Homo sapiens
gaagcaaaaugccuauauu

SEQ ID NO: 414699 - RNA, 19 nt, Homo sapiens
uaaagaacaagcucugaaa

SEQ ID NO: 414700 - RNA, 19 nt, Homo sapiens
gaguagaaggaucugauua

SEQ ID NO: 414701 - RNA, 19 nt, Homo sapiens
uaccaagccugccuucauu

SEQ ID NO: 414702 - RNA, 19 nt, Homo sapiens
ugucaaagccuuacccaaa

SEQ ID NO: 414703 - RNA, 19 nt, Homo sapiens
ggucaccaaugccuuaugu

SEQ ID NO: 414704 - RNA, 19 nt, Homo sapiens
gaaagucagcaaucagaga

SEQ ID NO: 414705 - RNA, 19 nt, Homo sapiens
agacagaggaucaauauca

SEQ ID NO: 414706 - RNA, 19 nt, Homo sapiens
cagaacacccuacaccuuu

SEQ ID NO: 414707 - RNA, 19 nt, Homo sapiens
gaagagagaagugagacaa

SEQ ID NO: 414708 - RNA, 19 nt, Homo sapiens
gaagggaucccaggaagug

SEQ ID NO: 414709 - RNA, 19 nt, Homo sapiens
aaucacggaugaagaagaa

SEQ ID NO: 414710 - RNA, 19 nt, Homo sapiens
caagcauuaugguggauuu

SEQ ID NO: 414711 - RNA, 19 nt, Homo sapiens
cugagccuguuucuuauua

SEQ ID NO: 414712 - RNA, 19 nt, Homo sapiens
gcuacaagcaucacacuga

SEQ ID NO: 414713 - RNA, 19 nt, Homo sapiens
ccacagacaaugaccuuga

SEQ ID NO: 414714 - RNA, 19 nt, Homo sapiens
gcucugcccugcaccuuag

SEQ ID NO: 414715 - RNA, 19 nt, Homo sapiens
cugaggcccugcugaguga

SEQ ID NO: 414716 - RNA, 19 nt, Homo sapiens
guucccaaguccaugugua

SEQ ID NO: 414717 - RNA, 19 nt, Homo sapiens
ggaaggcgagcagcaaugu

SEQ ID NO: 414718 - RNA, 19 nt, Homo sapiens
gcaucaggcaaccauuuga

SEQ ID NO: 414719 - RNA, 19 nt, Homo sapiens
caucaggcaaccauuugaa

SEQ ID NO: 414720 - RNA, 19 nt, Homo sapiens
ugaggaagccagagacagu

SEQ ID NO: 414721 - RNA, 19 nt, Homo sapiens
gagcaggacacagacuaug

SEQ ID NO: 414722 - RNA, 19 nt, Homo sapiens
ggcaucaggcaaccauuug

SEQ ID NO: 414723 - RNA, 19 nt, Homo sapiens
aggaugagcaggacacaga

SEQ ID NO: 414724 - RNA, 19 nt, Homo sapiens
gggaaggcgagcagcaaug

SEQ ID NO: 414725 - RNA, 19 nt, Homo sapiens
gagcugggguccacagaca

SEQ ID NO: 414726 - RNA, 19 nt, Homo sapiens
ccagcucugucaccguugu

SEQ ID NO: 414727 - RNA, 19 nt, Homo sapiens
ugaccaugccucagacugu

SEQ ID NO: 414728 - RNA, 19 nt, Homo sapiens
gaagccagagacagugaca

SEQ ID NO: 414729 - RNA, 19 nt, Homo sapiens
cuacauagaugguuacaaa

SEQ ID NO: 414730 - RNA, 19 nt, Homo sapiens
caucaaugcuuccuacaua

SEQ ID NO: 414731 - RNA, 19 nt, Homo sapiens
gcgaacagguacauucaua

SEQ ID NO: 414732 - RNA, 19 nt, Homo sapiens
gaauggaaaucccacacua

SEQ ID NO: 414733 - RNA, 19 nt, Homo sapiens
gauaaaugcuaccaguauu

SEQ ID NO: 414734 - RNA, 19 nt, Homo sapiens
cgauugagauaaagaauga

SEQ ID NO: 414735 - RNA, 19 nt, Homo sapiens
gaagguggauguguuugaa

SEQ ID NO: 414736 - RNA, 19 nt, Homo sapiens
aaacagauaucccaacauc

SEQ ID NO: 414737 - RNA, 19 nt, Homo sapiens
gaagauuccugccuuaaaa

SEQ ID NO: 414738 - RNA, 19 nt, Homo sapiens
caucaacgcauccuucaua

SEQ ID NO: 414739 - RNA, 19 nt, Homo sapiens
gaaaaggggucaagaauac

SEQ ID NO: 414740 - RNA, 19 nt, Homo sapiens
ggucaaauaauaucccaua

SEQ ID NO: 414741 - RNA, 19 nt, Homo sapiens
ggaauucccuguucagacu

SEQ ID NO: 414742 - RNA, 19 nt, Homo sapiens
gcuauacaguuguuaaauc

SEQ ID NO: 414743 - RNA, 19 nt, Homo sapiens
ggauaaaugcuaccaguau

SEQ ID NO: 414744 - RNA, 19 nt, Homo sapiens
acaaagugguacaagauuu

SEQ ID NO: 414745 - RNA, 19 nt, Homo sapiens
ggagaaauaacgauugaga

SEQ ID NO: 414746 - RNA, 19 nt, Homo sapiens
gaaagaaaggaaagaggaa

SEQ ID NO: 414747 - RNA, 19 nt, Homo sapiens
ggaaacgguuaacgacuuc

SEQ ID NO: 414748 - RNA, 19 nt, Homo sapiens
ccaacauccuucccaauga

SEQ ID NO: 414749 - RNA, 19 nt, Homo sapiens
cgagugauccuuuccauga

SEQ ID NO: 414750 - RNA, 19 nt, Homo sapiens
ccucagggcccaagaagua

SEQ ID NO: 414751 - RNA, 19 nt, Homo sapiens
gcuacaaagugguacaaga

SEQ ID NO: 414752 - RNA, 19 nt, Homo sapiens
gaggaggaguucaggaaau

SEQ ID NO: 414753 - RNA, 19 nt, Homo sapiens
gcagaagguggauguguuu

SEQ ID NO: 414754 - RNA, 19 nt, Homo sapiens
ggagagagagcaggauaaa

SEQ ID NO: 414755 - RNA, 19 nt, Homo sapiens
gaggacuucuggaggauga

SEQ ID NO: 414756 - RNA, 19 nt, Homo sapiens
agagagagcaggauaaaug

SEQ ID NO: 414757 - RNA, 19 nt, Homo sapiens
acaaauguccggaucauga

SEQ ID NO: 414758 - RNA, 19 nt, Homo sapiens
ucaggaaauugacaaaugu

SEQ ID NO: 414759 - RNA, 19 nt, Homo sapiens
ccauugggaugcugaaguu

SEQ ID NO: 414760 - RNA, 19 nt, Homo sapiens
guucaucuaccaagccuua

SEQ ID NO: 414761 - RNA, 19 nt, Homo sapiens
ugcaaacccuggaacagua

SEQ ID NO: 414762 - RNA, 19 nt, Homo sapiens
gaagaugcccaacggaauc

SEQ ID NO: 414763 - RNA, 19 nt, Homo sapiens
ugaaguuccucaagaaagu

SEQ ID NO: 414764 - RNA, 19 nt, Homo sapiens
aaugaagauuccugccuua

SEQ ID NO: 414765 - RNA, 19 nt, Homo sapiens
gaaugauacccuuucagaa

SEQ ID NO: 414766 - RNA, 19 nt, Homo sapiens
gacuauagccuucacuuuc

SEQ ID NO: 414767 - RNA, 19 nt, Homo sapiens
gauaugcaguacacguuca

SEQ ID NO: 414768 - RNA, 19 nt, Homo sapiens
ggauggaauucccuguuca

SEQ ID NO: 414769 - RNA, 19 nt, Homo sapiens
cgacuucagagaccacaua

SEQ ID NO: 414770 - RNA, 19 nt, Homo sapiens
ggagcugggcgaacaggua

SEQ ID NO: 414771 - RNA, 19 nt, Homo sapiens
gagugauccuuuccaugaa

SEQ ID NO: 414772 - RNA, 19 nt, Homo sapiens
gaauuugugucucgaaucc

SEQ ID NO: 414773 - RNA, 19 nt, Homo sapiens
ccaaacaggaaacgguuaa

SEQ ID NO: 414774 - RNA, 19 nt, Homo sapiens
ggaggaugaucugggaaug

SEQ ID NO: 414775 - RNA, 19 nt, Homo sapiens
gaagaaggccagggucauc

SEQ ID NO: 414776 - RNA, 19 nt, Homo sapiens
ggaggaggaguucaggaaa

SEQ ID NO: 414777 - RNA, 19 nt, Homo sapiens
ggauguguuugaauuugug

SEQ ID NO: 414778 - RNA, 19 nt, Homo sapiens
uuaaaggccaccugcuaua

SEQ ID NO: 414779 - RNA, 19 nt, Homo sapiens
gaggaguucaggaaauuga

SEQ ID NO: 414780 - RNA, 19 nt, Homo sapiens
ggacgggcaccuucauugu

SEQ ID NO: 414781 - RNA, 19 nt, Homo sapiens
gaaguuccucaagaaagua

SEQ ID NO: 414782 - RNA, 19 nt, Homo sapiens
ccggacaaauuuccugcua

SEQ ID NO: 414783 - RNA, 19 nt, Homo sapiens
ugaagauuccugccuuaaa

SEQ ID NO: 414784 - RNA, 19 nt, Homo sapiens
agaaugauacccuuucaga

SEQ ID NO: 414785 - RNA, 19 nt, Homo sapiens
caaggcugcuggaccuaug

SEQ ID NO: 414786 - RNA, 19 nt, Homo sapiens
agaauggucugggagcaaa

SEQ ID NO: 414787 - RNA, 19 nt, Homo sapiens
cuuccuacauagaugguua

SEQ ID NO: 414788 - RNA, 19 nt, Homo sapiens
guaugaauucugcuacaaa

SEQ ID NO: 414789 - RNA, 19 nt, Homo sapiens
aaacggauaugcaguacac

SEQ ID NO: 414790 - RNA, 19 nt, Homo sapiens
guaaucagcgcccucagau

SEQ ID NO: 414791 - RNA, 19 nt, Homo sapiens
guggauguguuugaauuug

SEQ ID NO: 414792 - RNA, 19 nt, Homo sapiens
ugugaucgaugccaugaug

SEQ ID NO: 414793 - RNA, 19 nt, Homo sapiens
guggaggacugcgugguuu

SEQ ID NO: 414794 - RNA, 19 nt, Homo sapiens
caacgcauccuucauagac

SEQ ID NO: 414795 - RNA, 19 nt, Homo sapiens
caaauguccggaucaugaa

SEQ ID NO: 414796 - RNA, 19 nt, Homo sapiens
cauagaugguuacaaagag

SEQ ID NO: 414797 - RNA, 19 nt, Homo sapiens
caacauccuucccaaugac

SEQ ID NO: 414798 - RNA, 19 nt, Homo sapiens
cuacaaagugguacaagau

SEQ ID NO: 414799 - RNA, 19 nt, Homo sapiens
ggaggagcagguccgagua

SEQ ID NO: 414800 - RNA, 19 nt, Homo sapiens
gagacuuucuggucacucu

SEQ ID NO: 414801 - RNA, 19 nt, Homo sapiens
ggaaaucccacacuaucgu

SEQ ID NO: 414802 - RNA, 19 nt, Homo sapiens
gaugaucugggaauggaaa

SEQ ID NO: 414803 - RNA, 19 nt, Homo sapiens
cgacagaaggacuauuuca

SEQ ID NO: 414804 - RNA, 19 nt, Homo sapiens
aggaaacgguuaacgacuu

SEQ ID NO: 414805 - RNA, 19 nt, Homo sapiens
ggacacauacaaggaacuu

SEQ ID NO: 414806 - RNA, 19 nt, Homo sapiens
uaugaauucugcuacaaag

SEQ ID NO: 414807 - RNA, 19 nt, Homo sapiens
gaacagguacauucauagc

SEQ ID NO: 414808 - RNA, 19 nt, Homo sapiens
gagaaauaacgauugagau

SEQ ID NO: 414809 - RNA, 19 nt, Homo sapiens
gaauacacagacuacauca

SEQ ID NO: 414810 - RNA, 19 nt, Homo sapiens
gcaguacacguucaucuac

SEQ ID NO: 414811 - RNA, 19 nt, Homo sapiens
gaacuggcaaauaaagaag

SEQ ID NO: 414812 - RNA, 19 nt, Homo sapiens
ugaacuggcaaauaaagaa

SEQ ID NO: 414813 - RNA, 19 nt, Homo sapiens
ugaauucugcuacaaagug

SEQ ID NO: 414814 - RNA, 19 nt, Homo sapiens
gcaaacccuggaacaguau

SEQ ID NO: 414815 - RNA, 19 nt, Homo sapiens
caggagagagagcaggaua

SEQ ID NO: 414816 - RNA, 19 nt, Homo sapiens
aggaggaguucaggaaauu

SEQ ID NO: 414817 - RNA, 19 nt, Homo sapiens
gcaccuucauugugaucga

SEQ ID NO: 414818 - RNA, 19 nt, Homo sapiens
ggucaagaauacacagacu

SEQ ID NO: 414819 - RNA, 19 nt, Homo sapiens
uucaggaaauugacaaaug

SEQ ID NO: 414820 - RNA, 19 nt, Homo sapiens
gcugaaguuccucaagaaa

SEQ ID NO: 414821 - RNA, 19 nt, Homo sapiens
gggcucaguuacucaugga

SEQ ID NO: 414822 - RNA, 19 nt, Homo sapiens
agaagcaccugcagaccau

SEQ ID NO: 414823 - RNA, 19 nt, Homo sapiens
gcgaccaucgucauguuaa

SEQ ID NO: 414824 - RNA, 19 nt, Homo sapiens
acgggcaccuucauuguga

SEQ ID NO: 414825 - RNA, 19 nt, Homo sapiens
acaaggaacuuuugaacug

SEQ ID NO: 414826 - RNA, 19 nt, Homo sapiens
cuucagagaccacauaugg

SEQ ID NO: 414827 - RNA, 19 nt, Homo sapiens
cgagggacuuuuagaugua

SEQ ID NO: 414828 - RNA, 19 nt, Homo sapiens
acagaaggacuauuucauc

SEQ ID NO: 414829 - RNA, 19 nt, Homo sapiens
cuacauagaugguuacaaa

SEQ ID NO: 414830 - RNA, 19 nt, Homo sapiens
caucaaugcuuccuacaua

SEQ ID NO: 414831 - RNA, 19 nt, Homo sapiens
gcgaacagguacauucaua

SEQ ID NO: 414832 - RNA, 19 nt, Homo sapiens
gaauggaaaucccacacua

SEQ ID NO: 414833 - RNA, 19 nt, Homo sapiens
gauaaaugcuaccaguauu

SEQ ID NO: 414834 - RNA, 19 nt, Homo sapiens
cgauugagauaaagaauga

SEQ ID NO: 414835 - RNA, 19 nt, Homo sapiens
gaagguggauguguuugaa

SEQ ID NO: 414836 - RNA, 19 nt, Homo sapiens
aaacagauaucccaacauc

SEQ ID NO: 414837 - RNA, 19 nt, Homo sapiens
gaagauuccugccuuaaaa

SEQ ID NO: 414838 - RNA, 19 nt, Homo sapiens
caucaacgcauccuucaua

SEQ ID NO: 414839 - RNA, 19 nt, Homo sapiens
gaaaaggggucaagaauac

SEQ ID NO: 414840 - RNA, 19 nt, Homo sapiens
ggucaaauaauaucccaua

SEQ ID NO: 414841 - RNA, 19 nt, Homo sapiens
ggaauucccuguucagacu

SEQ ID NO: 414842 - RNA, 19 nt, Homo sapiens
gcuauacaguuguuaaauc

SEQ ID NO: 414843 - RNA, 19 nt, Homo sapiens
ggauaaaugcuaccaguau

SEQ ID NO: 414844 - RNA, 19 nt, Homo sapiens
acaaagugguacaagauuu

SEQ ID NO: 414845 - RNA, 19 nt, Homo sapiens
ggagaaauaacgauugaga

SEQ ID NO: 414846 - RNA, 19 nt, Homo sapiens
gaaagaaaggaaagaggaa

SEQ ID NO: 414847 - RNA, 19 nt, Homo sapiens
ggaaacgguuaacgacuuc

SEQ ID NO: 414848 - RNA, 19 nt, Homo sapiens
ccaacauccuucccaauga

SEQ ID NO: 414849 - RNA, 19 nt, Homo sapiens
cgagugauccuuuccauga

SEQ ID NO: 414850 - RNA, 19 nt, Homo sapiens
ccucagggcccaagaagua

SEQ ID NO: 414851 - RNA, 19 nt, Homo sapiens
gcuacaaagugguacaaga

SEQ ID NO: 414852 - RNA, 19 nt, Homo sapiens
gaggaggaguucaggaaau

SEQ ID NO: 414853 - RNA, 19 nt, Homo sapiens
gcagaagguggauguguuu

SEQ ID NO: 414854 - RNA, 19 nt, Homo sapiens
ggagagagagcaggauaaa

SEQ ID NO: 414855 - RNA, 19 nt, Homo sapiens
gaggacuucuggaggauga

SEQ ID NO: 414856 - RNA, 19 nt, Homo sapiens
agagagagcaggauaaaug

SEQ ID NO: 414857 - RNA, 19 nt, Homo sapiens
acaaauguccggaucauga

SEQ ID NO: 414858 - RNA, 19 nt, Homo sapiens
ucaggaaauugacaaaugu

SEQ ID NO: 414859 - RNA, 19 nt, Homo sapiens
ccauugggaugcugaaguu

SEQ ID NO: 414860 - RNA, 19 nt, Homo sapiens
guucaucuaccaagccuua

SEQ ID NO: 414861 - RNA, 19 nt, Homo sapiens
ugcaaacccuggaacagua

SEQ ID NO: 414862 - RNA, 19 nt, Homo sapiens
gaagaugcccaacggaauc

SEQ ID NO: 414863 - RNA, 19 nt, Homo sapiens
ugaaguuccucaagaaagu

SEQ ID NO: 414864 - RNA, 19 nt, Homo sapiens
aaugaagauuccugccuua

SEQ ID NO: 414865 - RNA, 19 nt, Homo sapiens
gaaugauacccuuucagaa

SEQ ID NO: 414866 - RNA, 19 nt, Homo sapiens
gauaugcaguacacguuca

SEQ ID NO: 414867 - RNA, 19 nt, Homo sapiens
ggauggaauucccuguuca

SEQ ID NO: 414868 - RNA, 19 nt, Homo sapiens
cgacuucagagaccacaua

SEQ ID NO: 414869 - RNA, 19 nt, Homo sapiens
ggagcugggcgaacaggua

SEQ ID NO: 414870 - RNA, 19 nt, Homo sapiens
gagugauccuuuccaugaa

SEQ ID NO: 414871 - RNA, 19 nt, Homo sapiens
gaauuugugucucgaaucc

SEQ ID NO: 414872 - RNA, 19 nt, Homo sapiens
ccaaacaggaaacgguuaa

SEQ ID NO: 414873 - RNA, 19 nt, Homo sapiens
gccaugagcaacaggagua

SEQ ID NO: 414874 - RNA, 19 nt, Homo sapiens
ggaggaugaucugggaaug

SEQ ID NO: 414875 - RNA, 19 nt, Homo sapiens
gaagaaggccagggucauc

SEQ ID NO: 414876 - RNA, 19 nt, Homo sapiens
ggaggaggaguucaggaaa

SEQ ID NO: 414877 - RNA, 19 nt, Homo sapiens
ggauguguuugaauuugug

SEQ ID NO: 414878 - RNA, 19 nt, Homo sapiens
uuaaaggccaccugcuaua

SEQ ID NO: 414879 - RNA, 19 nt, Homo sapiens
gaggaguucaggaaauuga

SEQ ID NO: 414880 - RNA, 19 nt, Homo sapiens
ggacgggcaccuucauugu

SEQ ID NO: 414881 - RNA, 19 nt, Homo sapiens
gaaguuccucaagaaagua

SEQ ID NO: 414882 - RNA, 19 nt, Homo sapiens
ugaagauuccugccuuaaa

SEQ ID NO: 414883 - RNA, 19 nt, Homo sapiens
agaaugauacccuuucaga

SEQ ID NO: 414884 - RNA, 19 nt, Homo sapiens
caaggcugcuggaccuaug

SEQ ID NO: 414885 - RNA, 19 nt, Homo sapiens
agaauggucugggagcaaa

SEQ ID NO: 414886 - RNA, 19 nt, Homo sapiens
cuuccuacauagaugguua

SEQ ID NO: 414887 - RNA, 19 nt, Homo sapiens
guaugaauucugcuacaaa

SEQ ID NO: 414888 - RNA, 19 nt, Homo sapiens
aaacggauaugcaguacac

SEQ ID NO: 414889 - RNA, 19 nt, Homo sapiens
guaaucagcgcccucagau

SEQ ID NO: 414890 - RNA, 19 nt, Homo sapiens
guggauguguuugaauuug

SEQ ID NO: 414891 - RNA, 19 nt, Homo sapiens
ugugaucgaugccaugaug

SEQ ID NO: 414892 - RNA, 19 nt, Homo sapiens
guggaggacugcgugguuu

SEQ ID NO: 414893 - RNA, 19 nt, Homo sapiens
caacgcauccuucauagac

SEQ ID NO: 414894 - RNA, 19 nt, Homo sapiens
caaauguccggaucaugaa

SEQ ID NO: 414895 - RNA, 19 nt, Homo sapiens
gagcaacaggaguagcuuu

SEQ ID NO: 414896 - RNA, 19 nt, Homo sapiens
cauagaugguuacaaagag

SEQ ID NO: 414897 - RNA, 19 nt, Homo sapiens
caacauccuucccaaugac

SEQ ID NO: 414898 - RNA, 19 nt, Homo sapiens
cuacaaagugguacaagau

SEQ ID NO: 414899 - RNA, 19 nt, Homo sapiens
ggaggagcagguccgagua

SEQ ID NO: 414900 - RNA, 19 nt, Homo sapiens
gagacuuucuggucacucu

SEQ ID NO: 414901 - RNA, 19 nt, Homo sapiens
ggaaaucccacacuaucgu

SEQ ID NO: 414902 - RNA, 19 nt, Homo sapiens
gaugaucugggaauggaaa

SEQ ID NO: 414903 - RNA, 19 nt, Homo sapiens
cgacagaaggacuauuuca

SEQ ID NO: 414904 - RNA, 19 nt, Homo sapiens
ggacacauacaaggaacuu

SEQ ID NO: 414905 - RNA, 19 nt, Homo sapiens
aggaaacgguuaacgacuu

SEQ ID NO: 414906 - RNA, 19 nt, Homo sapiens
uaugaauucugcuacaaag

SEQ ID NO: 414907 - RNA, 19 nt, Homo sapiens
gaacagguacauucauagc

SEQ ID NO: 414908 - RNA, 19 nt, Homo sapiens
gagaaauaacgauugagau

SEQ ID NO: 414909 - RNA, 19 nt, Homo sapiens
ugaacuggcaaauaaagaa

SEQ ID NO: 414910 - RNA, 19 nt, Homo sapiens
gaacuggcaaauaaagaag

SEQ ID NO: 414911 - RNA, 19 nt, Homo sapiens
gaauacacagacuacauca

SEQ ID NO: 414912 - RNA, 19 nt, Homo sapiens
gcaguacacguucaucuac

SEQ ID NO: 414913 - RNA, 19 nt, Homo sapiens
ugaauucugcuacaaagug

SEQ ID NO: 414914 - RNA, 19 nt, Homo sapiens
gcaaacccuggaacaguau

SEQ ID NO: 414915 - RNA, 19 nt, Homo sapiens
caggagagagagcaggaua

SEQ ID NO: 414916 - RNA, 19 nt, Homo sapiens
aggaggaguucaggaaauu

SEQ ID NO: 414917 - RNA, 19 nt, Homo sapiens
gcaccuucauugugaucga

SEQ ID NO: 414918 - RNA, 19 nt, Homo sapiens
ggucaagaauacacagacu

SEQ ID NO: 414919 - RNA, 19 nt, Homo sapiens
uucaggaaauugacaaaug

SEQ ID NO: 414920 - RNA, 19 nt, Homo sapiens
gcugaaguuccucaagaaa

SEQ ID NO: 414921 - RNA, 19 nt, Homo sapiens
gggcucaguuacucaugga

SEQ ID NO: 414922 - RNA, 19 nt, Homo sapiens
agaagcaccugcagaccau

SEQ ID NO: 414923 - RNA, 19 nt, Homo sapiens
gcgaccaucgucauguuaa

SEQ ID NO: 414924 - RNA, 19 nt, Homo sapiens
acaaggaacuuuugaacug

SEQ ID NO: 414925 - RNA, 19 nt, Homo sapiens
acgggcaccuucauuguga

SEQ ID NO: 414926 - RNA, 19 nt, Homo sapiens
cuucagagaccacauaugg

SEQ ID NO: 414927 - RNA, 19 nt, Homo sapiens
cgagggacuuuuagaugua

SEQ ID NO: 414928 - RNA, 19 nt, Homo sapiens
acagaaggacuauuucauc

SEQ ID NO: 414929 - RNA, 19 nt, Homo sapiens
gcaaaccugucuucauuaa

SEQ ID NO: 414930 - RNA, 19 nt, Homo sapiens
cagcaaaccugucuucauu

SEQ ID NO: 414931 - RNA, 19 nt, Homo sapiens
gaacaucccugggcaagug

SEQ ID NO: 414932 - RNA, 19 nt, Homo sapiens
gcauaauucuugaugguaa

SEQ ID NO: 414933 - RNA, 19 nt, Homo sapiens
gaggagaagucccggguaa

SEQ ID NO: 414934 - RNA, 19 nt, Homo sapiens
gcaaagacucgguugauug

SEQ ID NO: 414935 - RNA, 19 nt, Homo sapiens
gagaccaccuacuccguua

SEQ ID NO: 414936 - RNA, 19 nt, Homo sapiens
gacacccgcuuuacccuua

SEQ ID NO: 414937 - RNA, 19 nt, Homo sapiens
gaccagcacuucacaguca

SEQ ID NO: 414938 - RNA, 19 nt, Homo sapiens
caacacagaguacucguuu

SEQ ID NO: 414939 - RNA, 19 nt, Homo sapiens
gaucacagcguuucaggaa

SEQ ID NO: 414940 - RNA, 19 nt, Homo sapiens
gagauccuguuucagcuaa

SEQ ID NO: 414941 - RNA, 19 nt, Homo sapiens
ugacacggcuggaggagaa

SEQ ID NO: 414942 - RNA, 19 nt, Homo sapiens
uaagucagcugugcccuuu

SEQ ID NO: 414943 - RNA, 19 nt, Homo sapiens
ggagggcucugacuacauc

SEQ ID NO: 414944 - RNA, 19 nt, Homo sapiens
gaacuccacugcugugcau

SEQ ID NO: 414945 - RNA, 19 nt, Homo sapiens
ccgaggagcucaccaagga

SEQ ID NO: 414946 - RNA, 19 nt, Homo sapiens
caagacuacuggacuucua

SEQ ID NO: 414947 - RNA, 19 nt, Homo sapiens
gcaguauggugugguguuu

SEQ ID NO: 414948 - RNA, 19 nt, Homo sapiens
gagcacaauuccaccauca

SEQ ID NO: 414949 - RNA, 19 nt, Homo sapiens
cagaaggccuacauagcua

SEQ ID NO: 414950 - RNA, 19 nt, Homo sapiens
caucaugcccuacgaauug

SEQ ID NO: 414951 - RNA, 19 nt, Homo sapiens
cuacuggacuucuaucaau

SEQ ID NO: 414952 - RNA, 19 nt, Homo sapiens
ccauggagcucgaguucaa

SEQ ID NO: 414953 - RNA, 19 nt, Homo sapiens
caacaucgagcgccucaaa

SEQ ID NO: 414954 - RNA, 19 nt, Homo sapiens
cagcaucauugcauaauuc

SEQ ID NO: 414955 - RNA, 19 nt, Homo sapiens
aaaccugucuucauuaaag

SEQ ID NO: 414956 - RNA, 19 nt, Homo sapiens
gcugugcccuuuaagauuc

SEQ ID NO: 414957 - RNA, 19 nt, Homo sapiens
agaagacgguggacaucua

SEQ ID NO: 414958 - RNA, 19 nt, Homo sapiens
gaagccaucuaugagugua

SEQ ID NO: 414959 - RNA, 19 nt, Homo sapiens
gggagugacuacaucaaug

SEQ ID NO: 414960 - RNA, 19 nt, Homo sapiens
cagacgagauccuguuuca

SEQ ID NO: 414961 - RNA, 19 nt, Homo sapiens
gcagacagaggaccaguau

SEQ ID NO: 414962 - RNA, 19 nt, Homo sapiens
gaacaucaugcccuacgaa

SEQ ID NO: 414963 - RNA, 19 nt, Homo sapiens
acuccaagaugcccucaua

SEQ ID NO: 414964 - RNA, 19 nt, Homo sapiens
aagaguggcuccagugaga

SEQ ID NO: 414965 - RNA, 19 nt, Homo sapiens
caucauugcauaauucuug

SEQ ID NO: 414966 - RNA, 19 nt, Homo sapiens
gaagggugcauagcuguuu

SEQ ID NO: 414967 - RNA, 19 nt, Homo sapiens
ugaccacuaugcaacguaa

SEQ ID NO: 414968 - RNA, 19 nt, Homo sapiens
gcagaaggccuacauagcu

SEQ ID NO: 414969 - RNA, 19 nt, Homo sapiens
guucuacauuguuguggua

SEQ ID NO: 414970 - RNA, 19 nt, Homo sapiens
gugaggaguucgagaagga

SEQ ID NO: 414971 - RNA, 19 nt, Homo sapiens
ccacugcugugcaugucua

SEQ ID NO: 414972 - RNA, 19 nt, Homo sapiens
gugccaagcuacaggagaa

SEQ ID NO: 414973 - RNA, 19 nt, Homo sapiens
gcccuuggcuucugcuuca

SEQ ID NO: 414974 - RNA, 19 nt, Homo sapiens
ggagaaaugccaccaguac

SEQ ID NO: 414975 - RNA, 19 nt, Homo sapiens
guacucuaaucaguccuua

SEQ ID NO: 414976 - RNA, 19 nt, Homo sapiens
gaacguugccacaccaauc

SEQ ID NO: 414977 - RNA, 19 nt, Homo sapiens
cgagaccuguggccuuauu

SEQ ID NO: 414978 - RNA, 19 nt, Homo sapiens
ccuuuaagauucuguacaa

SEQ ID NO: 414979 - RNA, 19 nt, Homo sapiens
gaccacgucuaccacagaa

SEQ ID NO: 414980 - RNA, 19 nt, Homo sapiens
uguaugaacugguguacug

SEQ ID NO: 414981 - RNA, 19 nt, Homo sapiens
agugaaagcucuuccaaag

SEQ ID NO: 414982 - RNA, 19 nt, Homo sapiens
ggcaaggcauuccucauca

SEQ ID NO: 414983 - RNA, 19 nt, Homo sapiens
agacagaggaccaguauca

SEQ ID NO: 414984 - RNA, 19 nt, Homo sapiens
caaagacucgguugauugu

SEQ ID NO: 414985 - RNA, 19 nt, Homo sapiens
gagcggaucaucauguaug

SEQ ID NO: 414986 - RNA, 19 nt, Homo sapiens
gcacagccaccaugcuaug

SEQ ID NO: 414987 - RNA, 19 nt, Homo sapiens
cuacaucaaugccaacuac

SEQ ID NO: 414988 - RNA, 19 nt, Homo sapiens
agucagcugugcccuuuaa

SEQ ID NO: 414989 - RNA, 19 nt, Homo sapiens
ucaggugccuugcagauag

SEQ ID NO: 414990 - RNA, 19 nt, Homo sapiens
ucagcuaaaugcagggaaa

SEQ ID NO: 414991 - RNA, 19 nt, Homo sapiens
gaagacgguggacaucuau

SEQ ID NO: 414992 - RNA, 19 nt, Homo sapiens
ucaccgaccuggcggacaa

SEQ ID NO: 414993 - RNA, 19 nt, Homo sapiens
agacaccacuuacgacauc

SEQ ID NO: 414994 - RNA, 19 nt, Homo sapiens
gaugggcagucaaggacaa

SEQ ID NO: 414995 - RNA, 19 nt, Homo sapiens
gaagcaaagacucgguuga

SEQ ID NO: 414996 - RNA, 19 nt, Homo sapiens
caaccuguaugcccacauc

SEQ ID NO: 414997 - RNA, 19 nt, Homo sapiens
gcuucgaggucauugaguu

SEQ ID NO: 414998 - RNA, 19 nt, Homo sapiens
gaucacagaggaacuacau

SEQ ID NO: 414999 - RNA, 19 nt, Homo sapiens
ggagaauggugugggaaca

SEQ ID NO: 415000 - RNA, 19 nt, Homo sapiens
uuaagauucuguacaaugg

SEQ ID NO: 415001 - RNA, 19 nt, Homo sapiens
ggacugaccacgucuacca

SEQ ID NO: 415002 - RNA, 19 nt, Homo sapiens
gcaaggaugaccagcacuu

SEQ ID NO: 415003 - RNA, 19 nt, Homo sapiens
uaucaaugguacucuaauc

SEQ ID NO: 415004 - RNA, 19 nt, Homo sapiens
ggacaggaugggccuauca

SEQ ID NO: 415005 - RNA, 19 nt, Homo sapiens
gcucugcucgcuaccagua

SEQ ID NO: 415006 - RNA, 19 nt, Homo sapiens
ugaccaagcuucgggagau

SEQ ID NO: 415007 - RNA, 19 nt, Homo sapiens
gcacaauuccaccaucauc

SEQ ID NO: 415008 - RNA, 19 nt, Homo sapiens
ggacuucuggcgcaugcua

SEQ ID NO: 415009 - RNA, 19 nt, Homo sapiens
cgaauugacccgugugugu

SEQ ID NO: 415010 - RNA, 19 nt, Homo sapiens
cgugauugaugccauguug

SEQ ID NO: 415011 - RNA, 19 nt, Homo sapiens
aacaggagcugcagaacau

SEQ ID NO: 415012 - RNA, 19 nt, Homo sapiens
caacaggagcugcagaaca

SEQ ID NO: 415013 - RNA, 19 nt, Homo sapiens
ggacuuccuuccuguagac

SEQ ID NO: 415014 - RNA, 19 nt, Homo sapiens
caaugguacucuaaucagu

SEQ ID NO: 415015 - RNA, 19 nt, Homo sapiens
ccucaucaccaucguguuu

SEQ ID NO: 415016 - RNA, 19 nt, Homo sapiens
gggcguggucgacauguuu

SEQ ID NO: 415017 - RNA, 19 nt, Homo sapiens
gcaagcagaaugccuacau

SEQ ID NO: 415018 - RNA, 19 nt, Homo sapiens
cccagaaggugaugugugu

SEQ ID NO: 415019 - RNA, 19 nt, Homo sapiens
gacccaaccuccuccuaca

SEQ ID NO: 415020 - RNA, 19 nt, Homo sapiens
caucguguuugcaaagguu

SEQ ID NO: 415021 - RNA, 19 nt, Homo sapiens
gaagauagggaacacucau

SEQ ID NO: 415022 - RNA, 19 nt, Homo sapiens
gcugaaggacagaacauug

SEQ ID NO: 415023 - RNA, 19 nt, Homo sapiens
gggauucauugacuucauc

SEQ ID NO: 415024 - RNA, 19 nt, Homo sapiens
gcacuggugaugcuugguu

SEQ ID NO: 415025 - RNA, 19 nt, Homo sapiens
ucacgugggagaauucaaa

SEQ ID NO: 415026 - RNA, 19 nt, Homo sapiens
gaacgucugaagccauaug

SEQ ID NO: 415027 - RNA, 19 nt, Homo sapiens
ucaggugguucuacauugu

SEQ ID NO: 415028 - RNA, 19 nt, Homo sapiens
cauccaagacgucaugcua

SEQ ID NO: 415029 - RNA, 19 nt, Homo sapiens
gcaaaccugucuucauuaa

SEQ ID NO: 415030 - RNA, 19 nt, Homo sapiens
cagcaaaccugucuucauu

SEQ ID NO: 415031 - RNA, 19 nt, Homo sapiens
gaacaucccugggcaagug

SEQ ID NO: 415032 - RNA, 19 nt, Homo sapiens
gcauaauucuugaugguaa

SEQ ID NO: 415033 - RNA, 19 nt, Homo sapiens
gaggagaagucccggguaa

SEQ ID NO: 415034 - RNA, 19 nt, Homo sapiens
gcaaagacucgguugauug

SEQ ID NO: 415035 - RNA, 19 nt, Homo sapiens
gagaccaccuacuccguua

SEQ ID NO: 415036 - RNA, 19 nt, Homo sapiens
gacacccgcuuuacccuua

SEQ ID NO: 415037 - RNA, 19 nt, Homo sapiens
gaccagcacuucacaguca

SEQ ID NO: 415038 - RNA, 19 nt, Homo sapiens
caacacagaguacucguuu

SEQ ID NO: 415039 - RNA, 19 nt, Homo sapiens
gaucacagcguuucaggaa

SEQ ID NO: 415040 - RNA, 19 nt, Homo sapiens
gagauccuguuucagcuaa

SEQ ID NO: 415041 - RNA, 19 nt, Homo sapiens
ugacacggcuggaggagaa

SEQ ID NO: 415042 - RNA, 19 nt, Homo sapiens
uaagucagcugugcccuuu

SEQ ID NO: 415043 - RNA, 19 nt, Homo sapiens
ggagggcucugacuacauc

SEQ ID NO: 415044 - RNA, 19 nt, Homo sapiens
gaacuccacugcugugcau

SEQ ID NO: 415045 - RNA, 19 nt, Homo sapiens
ccgaggagcucaccaagga

SEQ ID NO: 415046 - RNA, 19 nt, Homo sapiens
caagacuacuggacuucua

SEQ ID NO: 415047 - RNA, 19 nt, Homo sapiens
gcaguauggugugguguuu

SEQ ID NO: 415048 - RNA, 19 nt, Homo sapiens
gagcacaauuccaccauca

SEQ ID NO: 415049 - RNA, 19 nt, Homo sapiens
cagaaggccuacauagcua

SEQ ID NO: 415050 - RNA, 19 nt, Homo sapiens
caucaugcccuacgaauug

SEQ ID NO: 415051 - RNA, 19 nt, Homo sapiens
cuacuggacuucuaucaau

SEQ ID NO: 415052 - RNA, 19 nt, Homo sapiens
ccauggagcucgaguucaa

SEQ ID NO: 415053 - RNA, 19 nt, Homo sapiens
caacaucgagcgccucaaa

SEQ ID NO: 415054 - RNA, 19 nt, Homo sapiens
cagcaucauugcauaauuc

SEQ ID NO: 415055 - RNA, 19 nt, Homo sapiens
aaaccugucuucauuaaag

SEQ ID NO: 415056 - RNA, 19 nt, Homo sapiens
gcugugcccuuuaagauuc

SEQ ID NO: 415057 - RNA, 19 nt, Homo sapiens
agaagacgguggacaucua

SEQ ID NO: 415058 - RNA, 19 nt, Homo sapiens
gaagccaucuaugagugua

SEQ ID NO: 415059 - RNA, 19 nt, Homo sapiens
gggagugacuacaucaaug

SEQ ID NO: 415060 - RNA, 19 nt, Homo sapiens
cagacgagauccuguuuca

SEQ ID NO: 415061 - RNA, 19 nt, Homo sapiens
gcagacagaggaccaguau

SEQ ID NO: 415062 - RNA, 19 nt, Homo sapiens
gaacaucaugcccuacgaa

SEQ ID NO: 415063 - RNA, 19 nt, Homo sapiens
acuccaagaugcccucaua

SEQ ID NO: 415064 - RNA, 19 nt, Homo sapiens
aagaguggcuccagugaga

SEQ ID NO: 415065 - RNA, 19 nt, Homo sapiens
caucauugcauaauucuug

SEQ ID NO: 415066 - RNA, 19 nt, Homo sapiens
gaagggugcauagcuguuu

SEQ ID NO: 415067 - RNA, 19 nt, Homo sapiens
ugaccacuaugcaacguaa

SEQ ID NO: 415068 - RNA, 19 nt, Homo sapiens
gcagaaggccuacauagcu

SEQ ID NO: 415069 - RNA, 19 nt, Homo sapiens
guucuacauuguuguggua

SEQ ID NO: 415070 - RNA, 19 nt, Homo sapiens
gugaggaguucgagaagga

SEQ ID NO: 415071 - RNA, 19 nt, Homo sapiens
ccacugcugugcaugucua

SEQ ID NO: 415072 - RNA, 19 nt, Homo sapiens
gugccaagcuacaggagaa

SEQ ID NO: 415073 - RNA, 19 nt, Homo sapiens
gcccuuggcuucugcuuca

SEQ ID NO: 415074 - RNA, 19 nt, Homo sapiens
ggagaaaugccaccaguac

SEQ ID NO: 415075 - RNA, 19 nt, Homo sapiens
guacucuaaucaguccuua

SEQ ID NO: 415076 - RNA, 19 nt, Homo sapiens
gaacguugccacaccaauc

SEQ ID NO: 415077 - RNA, 19 nt, Homo sapiens
cgagaccuguggccuuauu

SEQ ID NO: 415078 - RNA, 19 nt, Homo sapiens
ccuuuaagauucuguacaa

SEQ ID NO: 415079 - RNA, 19 nt, Homo sapiens
gaccacgucuaccacagaa

SEQ ID NO: 415080 - RNA, 19 nt, Homo sapiens
uguaugaacugguguacug

SEQ ID NO: 415081 - RNA, 19 nt, Homo sapiens
agugaaagcucuuccaaag

SEQ ID NO: 415082 - RNA, 19 nt, Homo sapiens
ggcaaggcauuccucauca

SEQ ID NO: 415083 - RNA, 19 nt, Homo sapiens
agacagaggaccaguauca

SEQ ID NO: 415084 - RNA, 19 nt, Homo sapiens
caaagacucgguugauugu

SEQ ID NO: 415085 - RNA, 19 nt, Homo sapiens
gagcggaucaucauguaug

SEQ ID NO: 415086 - RNA, 19 nt, Homo sapiens
gcacagccaccaugcuaug

SEQ ID NO: 415087 - RNA, 19 nt, Homo sapiens
cuacaucaaugccaacuac

SEQ ID NO: 415088 - RNA, 19 nt, Homo sapiens
agucagcugugcccuuuaa

SEQ ID NO: 415089 - RNA, 19 nt, Homo sapiens
ucaggugccuugcagauag

SEQ ID NO: 415090 - RNA, 19 nt, Homo sapiens
ucagcuaaaugcagggaaa

SEQ ID NO: 415091 - RNA, 19 nt, Homo sapiens
gaagacgguggacaucuau

SEQ ID NO: 415092 - RNA, 19 nt, Homo sapiens
ucaccgaccuggcggacaa

SEQ ID NO: 415093 - RNA, 19 nt, Homo sapiens
agacaccacuuacgacauc

SEQ ID NO: 415094 - RNA, 19 nt, Homo sapiens
gaugggcagucaaggacaa

SEQ ID NO: 415095 - RNA, 19 nt, Homo sapiens
gaagcaaagacucgguuga

SEQ ID NO: 415096 - RNA, 19 nt, Homo sapiens
caaccuguaugcccacauc

SEQ ID NO: 415097 - RNA, 19 nt, Homo sapiens
gcuucgaggucauugaguu

SEQ ID NO: 415098 - RNA, 19 nt, Homo sapiens
gaucacagaggaacuacau

SEQ ID NO: 415099 - RNA, 19 nt, Homo sapiens
ggagaauggugugggaaca

SEQ ID NO: 415100 - RNA, 19 nt, Homo sapiens
uuaagauucuguacaaugg

SEQ ID NO: 415101 - RNA, 19 nt, Homo sapiens
ggacugaccacgucuacca

SEQ ID NO: 415102 - RNA, 19 nt, Homo sapiens
gcaaggaugaccagcacuu

SEQ ID NO: 415103 - RNA, 19 nt, Homo sapiens
uaucaaugguacucuaauc

SEQ ID NO: 415104 - RNA, 19 nt, Homo sapiens
ggacaggaugggccuauca

SEQ ID NO: 415105 - RNA, 19 nt, Homo sapiens
gcucugcucgcuaccagua

SEQ ID NO: 415106 - RNA, 19 nt, Homo sapiens
ugaccaagcuucgggagau

SEQ ID NO: 415107 - RNA, 19 nt, Homo sapiens
gcacaauuccaccaucauc

SEQ ID NO: 415108 - RNA, 19 nt, Homo sapiens
ggacuucuggcgcaugcua

SEQ ID NO: 415109 - RNA, 19 nt, Homo sapiens
cgaauugacccgugugugu

SEQ ID NO: 415110 - RNA, 19 nt, Homo sapiens
cgugauugaugccauguug

SEQ ID NO: 415111 - RNA, 19 nt, Homo sapiens
aacaggagcugcagaacau

SEQ ID NO: 415112 - RNA, 19 nt, Homo sapiens
caacaggagcugcagaaca

SEQ ID NO: 415113 - RNA, 19 nt, Homo sapiens
ggacuuccuuccuguagac

SEQ ID NO: 415114 - RNA, 19 nt, Homo sapiens
caaugguacucuaaucagu

SEQ ID NO: 415115 - RNA, 19 nt, Homo sapiens
ccucaucaccaucguguuu

SEQ ID NO: 415116 - RNA, 19 nt, Homo sapiens
gggcguggucgacauguuu

SEQ ID NO: 415117 - RNA, 19 nt, Homo sapiens
gcaagcagaaugccuacau

SEQ ID NO: 415118 - RNA, 19 nt, Homo sapiens
cccagaaggugaugugugu

SEQ ID NO: 415119 - RNA, 19 nt, Homo sapiens
gacccaaccuccuccuaca

SEQ ID NO: 415120 - RNA, 19 nt, Homo sapiens
caucguguuugcaaagguu

SEQ ID NO: 415121 - RNA, 19 nt, Homo sapiens
gaagauagggaacacucau

SEQ ID NO: 415122 - RNA, 19 nt, Homo sapiens
gcugaaggacagaacauug

SEQ ID NO: 415123 - RNA, 19 nt, Homo sapiens
gggauucauugacuucauc

SEQ ID NO: 415124 - RNA, 19 nt, Homo sapiens
gcacuggugaugcuugguu

SEQ ID NO: 415125 - RNA, 19 nt, Homo sapiens
ucacgugggagaauucaaa

SEQ ID NO: 415126 - RNA, 19 nt, Homo sapiens
gaacgucugaagccauaug

SEQ ID NO: 415127 - RNA, 19 nt, Homo sapiens
ucaggugguucuacauugu

SEQ ID NO: 415128 - RNA, 19 nt, Homo sapiens
cauccaagacgucaugcua

SEQ ID NO: 415129 - RNA, 19 nt, Homo sapiens
gaacaucccuuauuaguua

SEQ ID NO: 415130 - RNA, 19 nt, Homo sapiens
caaacuauguugaugguua

SEQ ID NO: 415131 - RNA, 19 nt, Homo sapiens
gaagauuucuggaggauga

SEQ ID NO: 415132 - RNA, 19 nt, Homo sapiens
gaaaggaacagauuacauu

SEQ ID NO: 415133 - RNA, 19 nt, Homo sapiens
gaaagaguguaacaaagaa

SEQ ID NO: 415134 - RNA, 19 nt, Homo sapiens
aaacaccucuggaaugaua

SEQ ID NO: 415135 - RNA, 19 nt, Homo sapiens
gaagacagcagauuuauca

SEQ ID NO: 415136 - RNA, 19 nt, Homo sapiens
gaacaucacugcagagcau

SEQ ID NO: 415137 - RNA, 19 nt, Homo sapiens
gaaguuagaaggcuuaaga

SEQ ID NO: 415138 - RNA, 19 nt, Homo sapiens
gcagauuuaucacuguuaa

SEQ ID NO: 415139 - RNA, 19 nt, Homo sapiens
cgacaugacagacuucuua

SEQ ID NO: 415140 - RNA, 19 nt, Homo sapiens
aaagggcacuuaauuugua

SEQ ID NO: 415141 - RNA, 19 nt, Homo sapiens
acagaagccucuaaaguuu

SEQ ID NO: 415142 - RNA, 19 nt, Homo sapiens
caaugagucuucuaacaaa

SEQ ID NO: 415143 - RNA, 19 nt, Homo sapiens
gagaagacguuuacaaagg

SEQ ID NO: 415144 - RNA, 19 nt, Homo sapiens
gacauuccaugacgacaua

SEQ ID NO: 415145 - RNA, 19 nt, Homo sapiens
ggaaagacacgacuggaaa

SEQ ID NO: 415146 - RNA, 19 nt, Homo sapiens
gacagaagccucuaaaguu

SEQ ID NO: 415147 - RNA, 19 nt, Homo sapiens
gcaagaacuuauucaacaa

SEQ ID NO: 415148 - RNA, 19 nt, Homo sapiens
aaagauuucuggcgaauga

SEQ ID NO: 415149 - RNA, 19 nt, Homo sapiens
ucggugagcucuauucuaa

SEQ ID NO: 415150 - RNA, 19 nt, Homo sapiens
gaaccguguugguggauuu

SEQ ID NO: 415151 - RNA, 19 nt, Homo sapiens
ggcaagaacuuauucaaca

SEQ ID NO: 415152 - RNA, 19 nt, Homo sapiens
gcuaauaccacucgaauau

SEQ ID NO: 415153 - RNA, 19 nt, Homo sapiens
ccaguuccgugcuccauua

SEQ ID NO: 415154 - RNA, 19 nt, Homo sapiens
gacucuagguuauacaaua

SEQ ID NO: 415155 - RNA, 19 nt, Homo sapiens
gaaaggagacugaaguauc

SEQ ID NO: 415156 - RNA, 19 nt, Homo sapiens
ggacaauucugcacuggau

SEQ ID NO: 415157 - RNA, 19 nt, Homo sapiens
gcacggaggcaagaacuua

SEQ ID NO: 415158 - RNA, 19 nt, Homo sapiens
gugaaggucuuuguuauga

SEQ ID NO: 415159 - RNA, 19 nt, Homo sapiens
gaaugaaaggaacagauua

SEQ ID NO: 415160 - RNA, 19 nt, Homo sapiens
gaacaggcaccuauauugu

SEQ ID NO: 415161 - RNA, 19 nt, Homo sapiens
gcacagcgacuacauuaau

SEQ ID NO: 415162 - RNA, 19 nt, Homo sapiens
uggaguaucugagaaauaa

SEQ ID NO: 415163 - RNA, 19 nt, Homo sapiens
uauuacagcuuucccagua

SEQ ID NO: 415164 - RNA, 19 nt, Homo sapiens
agagaucccuuaagaaguu

SEQ ID NO: 415165 - RNA, 19 nt, Homo sapiens
guuacugccuauaaucuua

SEQ ID NO: 415166 - RNA, 19 nt, Homo sapiens
ggaauguuaugugcccuua

SEQ ID NO: 415167 - RNA, 19 nt, Homo sapiens
ggaugacuaugucuuagaa

SEQ ID NO: 415168 - RNA, 19 nt, Homo sapiens
ggaaugaaaggaacagauu

SEQ ID NO: 415169 - RNA, 19 nt, Homo sapiens
ugaggaauauggaaacauu

SEQ ID NO: 415170 - RNA, 19 nt, Homo sapiens
ggacagaagccucuaaagu

SEQ ID NO: 415171 - RNA, 19 nt, Homo sapiens
ugaaacaguuccauuuaug

SEQ ID NO: 415172 - RNA, 19 nt, Homo sapiens
aguaguaccuuugaacuua

SEQ ID NO: 415173 - RNA, 19 nt, Homo sapiens
caauaccaguucaucuaua

SEQ ID NO: 415174 - RNA, 19 nt, Homo sapiens
ggacagcgacaaagacuug

SEQ ID NO: 415175 - RNA, 19 nt, Homo sapiens
gacaaugagucuucuaaca

SEQ ID NO: 415176 - RNA, 19 nt, Homo sapiens
gaaagggcacuuaauuugu

SEQ ID NO: 415177 - RNA, 19 nt, Homo sapiens
ugaaagggcacuuaauuug

SEQ ID NO: 415178 - RNA, 19 nt, Homo sapiens
gaaggucuuuguuaugaca

SEQ ID NO: 415179 - RNA, 19 nt, Homo sapiens
gcgacuacauuaaugcaaa

SEQ ID NO: 415180 - RNA, 19 nt, Homo sapiens
cuuaagaacugcuucaugu

SEQ ID NO: 415181 - RNA, 19 nt, Homo sapiens
ugaacuacaugaucuccua

SEQ ID NO: 415182 - RNA, 19 nt, Homo sapiens
gacugugccucucuaauga

SEQ ID NO: 415183 - RNA, 19 nt, Homo sapiens
uuagaaggcuuaagaacug

SEQ ID NO: 415184 - RNA, 19 nt, Homo sapiens
ucagaaagaguguaacaaa

SEQ ID NO: 415185 - RNA, 19 nt, Homo sapiens
caagggaccagaauaguga

SEQ ID NO: 415186 - RNA, 19 nt, Homo sapiens
cgacauacaugcuacuuuu

SEQ ID NO: 415187 - RNA, 19 nt, Homo sapiens
uaugaggccuggaguauuc

SEQ ID NO: 415188 - RNA, 19 nt, Homo sapiens
acaggcaccuauauuguaa

SEQ ID NO: 415189 - RNA, 19 nt, Homo sapiens
ucagacugcucauuucuau

SEQ ID NO: 415190 - RNA, 19 nt, Homo sapiens
aaauggugcuguucuuauu

SEQ ID NO: 415191 - RNA, 19 nt, Homo sapiens
caaauggccuaacccagau

SEQ ID NO: 415192 - RNA, 19 nt, Homo sapiens
aagaauccaugaacuguga

SEQ ID NO: 415193 - RNA, 19 nt, Homo sapiens
gcagagcauuccaaucauc

SEQ ID NO: 415194 - RNA, 19 nt, Homo sapiens
aaaggagacugaaguaucu

SEQ ID NO: 415195 - RNA, 19 nt, Homo sapiens
gaacagugaggaauaugga

SEQ ID NO: 415196 - RNA, 19 nt, Homo sapiens
ggcccgaaaugccaucuaa

SEQ ID NO: 415197 - RNA, 19 nt, Homo sapiens
caaaggacagcgacaaaga

SEQ ID NO: 415198 - RNA, 19 nt, Homo sapiens
ccucugagauccuuugugu

SEQ ID NO: 415199 - RNA, 19 nt, Homo sapiens
cuguaugccuucuguauuu

SEQ ID NO: 415200 - RNA, 19 nt, Homo sapiens
gaacuuaucaacgucauca

SEQ ID NO: 415201 - RNA, 19 nt, Homo sapiens
gcagaacaggcaccuauau

SEQ ID NO: 415202 - RNA, 19 nt, Homo sapiens
uaagaacugcuucauguga

SEQ ID NO: 415203 - RNA, 19 nt, Homo sapiens
ucugagauccuuuguguuu

SEQ ID NO: 415204 - RNA, 19 nt, Homo sapiens
ucaagucgguggaguaucu

SEQ ID NO: 415205 - RNA, 19 nt, Homo sapiens
gagguuuccuguugagaug

SEQ ID NO: 415206 - RNA, 19 nt, Homo sapiens
gagugggucuugcaccauu

SEQ ID NO: 415207 - RNA, 19 nt, Homo sapiens
uauguuaacagcauccuua

SEQ ID NO: 415208 - RNA, 19 nt, Homo sapiens
ccaagggucgucagaauga

SEQ ID NO: 415209 - RNA, 19 nt, Homo sapiens
gaaaaugugaucaguauug

SEQ ID NO: 415210 - RNA, 19 nt, Homo sapiens
aagcacagcgacuacauua

SEQ ID NO: 415211 - RNA, 19 nt, Homo sapiens
ucauugcugugcucguuua

SEQ ID NO: 415212 - RNA, 19 nt, Homo sapiens
gagaaggagaagacguuua

SEQ ID NO: 415213 - RNA, 19 nt, Homo sapiens
agaaagaguguaacaaaga

SEQ ID NO: 415214 - RNA, 19 nt, Homo sapiens
cagaaagaguguaacaaag

SEQ ID NO: 415215 - RNA, 19 nt, Homo sapiens
gagaggguguaacaaaaua

SEQ ID NO: 415216 - RNA, 19 nt, Homo sapiens
agaagacguuuacaaagga

SEQ ID NO: 415217 - RNA, 19 nt, Homo sapiens
cagugaaggucuuuguuau

SEQ ID NO: 415218 - RNA, 19 nt, Homo sapiens
ccacauacuacgaaagauu

SEQ ID NO: 415219 - RNA, 19 nt, Homo sapiens
cagagaacagugaggaaua

SEQ ID NO: 415220 - RNA, 19 nt, Homo sapiens
acacaucggugagcucuau

SEQ ID NO: 415221 - RNA, 19 nt, Homo sapiens
ccgaucggcucucuccuuu

SEQ ID NO: 415222 - RNA, 19 nt, Homo sapiens
gagaucccuuaagaaguua

SEQ ID NO: 415223 - RNA, 19 nt, Homo sapiens
acagugaaggucuuuguua

SEQ ID NO: 415224 - RNA, 19 nt, Homo sapiens
guaguaccuuugaacuuau

SEQ ID NO: 415225 - RNA, 19 nt, Homo sapiens
gcgcuguacugcugauaug

SEQ ID NO: 415226 - RNA, 19 nt, Homo sapiens
ggagaagacguuuacaaag

SEQ ID NO: 415227 - RNA, 19 nt, Homo sapiens
ggagccagccggagacuau

SEQ ID NO: 415228 - RNA, 19 nt, Homo sapiens
ugaagggugucguacauca

SEQ ID NO: 415229 - RNA, 19 nt, Homo sapiens
gaacggaagucacguauuu

SEQ ID NO: 415230 - RNA, 19 nt, Homo sapiens
gaacacaacugcaaugaca

SEQ ID NO: 415231 - RNA, 19 nt, Homo sapiens
ggaaagaaucgcuauaaua

SEQ ID NO: 415232 - RNA, 19 nt, Homo sapiens
ggaaagaugcaaagaauaa

SEQ ID NO: 415233 - RNA, 19 nt, Homo sapiens
gaaaagggaucuaugauuu

SEQ ID NO: 415234 - RNA, 19 nt, Homo sapiens
gaggaaagaugcaaagaau

SEQ ID NO: 415235 - RNA, 19 nt, Homo sapiens
ggagaucuuugcacaagua

SEQ ID NO: 415236 - RNA, 19 nt, Homo sapiens
gaaauaaccaccaaccaaa

SEQ ID NO: 415237 - RNA, 19 nt, Homo sapiens
gaagucacguauuugaauu

SEQ ID NO: 415238 - RNA, 19 nt, Homo sapiens
gcaugaagcugcauaugau

SEQ ID NO: 415239 - RNA, 19 nt, Homo sapiens
ggagggagcuggcaauucu

SEQ ID NO: 415240 - RNA, 19 nt, Homo sapiens
caacugcaaugacaaucua

SEQ ID NO: 415241 - RNA, 19 nt, Homo sapiens
ggagacagauucuuccaau

SEQ ID NO: 415242 - RNA, 19 nt, Homo sapiens
cugcagauguccugaaaua

SEQ ID NO: 415243 - RNA, 19 nt, Homo sapiens
gaucuuaucuaccagaaca

SEQ ID NO: 415244 - RNA, 19 nt, Homo sapiens
gcaaugacaaucuaugaaa

SEQ ID NO: 415245 - RNA, 19 nt, Homo sapiens
gcacuuucauugccauuga

SEQ ID NO: 415246 - RNA, 19 nt, Homo sapiens
gaacagggaagaaccaaau

SEQ ID NO: 415247 - RNA, 19 nt, Homo sapiens
ugacauaccucauaagaac

SEQ ID NO: 415248 - RNA, 19 nt, Homo sapiens
gagcagccaugaugcagaa

SEQ ID NO: 415249 - RNA, 19 nt, Homo sapiens
ccaaugugaucuuaacuug

SEQ ID NO: 415250 - RNA, 19 nt, Homo sapiens
gagcaaaucaucugcauuc

SEQ ID NO: 415251 - RNA, 19 nt, Homo sapiens
gcagaauccuuucauaaac

SEQ ID NO: 415252 - RNA, 19 nt, Homo sapiens
guacugaaucucauaauug

SEQ ID NO: 415253 - RNA, 19 nt, Homo sapiens
gaggaaagaaucgcuauaa

SEQ ID NO: 415254 - RNA, 19 nt, Homo sapiens
ccgaguaugucuaccauuu

SEQ ID NO: 415255 - RNA, 19 nt, Homo sapiens
gagaagacaauuacuguug

SEQ ID NO: 415256 - RNA, 19 nt, Homo sapiens
caaagccuaugcugucauu

SEQ ID NO: 415257 - RNA, 19 nt, Homo sapiens
gacaaaugcuauucagguu

SEQ ID NO: 415258 - RNA, 19 nt, Homo sapiens
gauacaaugccaccguuua

SEQ ID NO: 415259 - RNA, 19 nt, Homo sapiens
agacauaacuguggcaaug

SEQ ID NO: 415260 - RNA, 19 nt, Homo sapiens
gaauggcacugaguauaga

SEQ ID NO: 415261 - RNA, 19 nt, Homo sapiens
uguaugggauuguguauga

SEQ ID NO: 415262 - RNA, 19 nt, Homo sapiens
gagaauagaggaaagaauc

SEQ ID NO: 415263 - RNA, 19 nt, Homo sapiens
gagaauggcacugaguaua

SEQ ID NO: 415264 - RNA, 19 nt, Homo sapiens
gaucagcaguacagcagaa

SEQ ID NO: 415265 - RNA, 19 nt, Homo sapiens
ggagaaagaagaggaaaga

SEQ ID NO: 415266 - RNA, 19 nt, Homo sapiens
ccagauggauccccuaaua

SEQ ID NO: 415267 - RNA, 19 nt, Homo sapiens
gaaccaaaugugaggagua

SEQ ID NO: 415268 - RNA, 19 nt, Homo sapiens
uaaucagaguggagaauuu

SEQ ID NO: 415269 - RNA, 19 nt, Homo sapiens
gcagauguccugaaauaca

SEQ ID NO: 415270 - RNA, 19 nt, Homo sapiens
ggaagucacguauuugaau

SEQ ID NO: 415271 - RNA, 19 nt, Homo sapiens
ugucuaccauuuagucaua

SEQ ID NO: 415272 - RNA, 19 nt, Homo sapiens
ugacggugcuuccgaguau

SEQ ID NO: 415273 - RNA, 19 nt, Homo sapiens
cagcagaauccuuucauaa

SEQ ID NO: 415274 - RNA, 19 nt, Homo sapiens
aagaacaccugaacaagga

SEQ ID NO: 415275 - RNA, 19 nt, Homo sapiens
caucaaccaugguguaaca

SEQ ID NO: 415276 - RNA, 19 nt, Homo sapiens
guucugcccuaugauauuu

SEQ ID NO: 415277 - RNA, 19 nt, Homo sapiens
ggccggaagucauucugua

SEQ ID NO: 415278 - RNA, 19 nt, Homo sapiens
gaguaugucuaccauuuag

SEQ ID NO: 415279 - RNA, 19 nt, Homo sapiens
ggaaccaaguauugcuuug

SEQ ID NO: 415280 - RNA, 19 nt, Homo sapiens
ggagaucccagagucauaa

SEQ ID NO: 415281 - RNA, 19 nt, Homo sapiens
gcagacagaggaccaguau

SEQ ID NO: 415282 - RNA, 19 nt, Homo sapiens
gaaguguccuuuucucaaa

SEQ ID NO: 415283 - RNA, 19 nt, Homo sapiens
cagcaacgcaacacaagua

SEQ ID NO: 415284 - RNA, 19 nt, Homo sapiens
caccacagcagcaacuuua

SEQ ID NO: 415285 - RNA, 19 nt, Homo sapiens
cuccaucacuccaggaaua

SEQ ID NO: 415286 - RNA, 19 nt, Homo sapiens
caaccaugguguaacauca

SEQ ID NO: 415287 - RNA, 19 nt, Homo sapiens
caacgauaguuuaagaaca

SEQ ID NO: 415288 - RNA, 19 nt, Homo sapiens
ggcaaugacaucagaaauu

SEQ ID NO: 415289 - RNA, 19 nt, Homo sapiens
caagcaggcucaggacuau

SEQ ID NO: 415290 - RNA, 19 nt, Homo sapiens
ccaaaugugaggaguauug

SEQ ID NO: 415291 - RNA, 19 nt, Homo sapiens
cagaauccuuucauaaaca

SEQ ID NO: 415292 - RNA, 19 nt, Homo sapiens
gaaauugacguugggaaug

SEQ ID NO: 415293 - RNA, 19 nt, Homo sapiens
caccaucucuccagaagug

SEQ ID NO: 415294 - RNA, 19 nt, Homo sapiens
ccacaagccugacccugau

SEQ ID NO: 415295 - RNA, 19 nt, Homo sapiens
ccauagaguucaggacaaa

SEQ ID NO: 415296 - RNA, 19 nt, Homo sapiens
caaccaaugugaucuuaac

SEQ ID NO: 415297 - RNA, 19 nt, Homo sapiens
auaauguucugcccuauga

SEQ ID NO: 415298 - RNA, 19 nt, Homo sapiens
gaagaucugaagcuuguug

SEQ ID NO: 415299 - RNA, 19 nt, Homo sapiens
gagcuugucugaaguuuug

SEQ ID NO: 415300 - RNA, 19 nt, Homo sapiens
gaauaggcaaugagacuug

SEQ ID NO: 415301 - RNA, 19 nt, Homo sapiens
caauuacuguugugcauca

SEQ ID NO: 415302 - RNA, 19 nt, Homo sapiens
ccgaauggguuuucuauuu

SEQ ID NO: 415303 - RNA, 19 nt, Homo sapiens
uguguuggguugaauauau

SEQ ID NO: 415304 - RNA, 19 nt, Homo sapiens
guacagauccugcguccau

SEQ ID NO: 415305 - RNA, 19 nt, Homo sapiens
gaaccaaguauugcuuuga

SEQ ID NO: 415306 - RNA, 19 nt, Homo sapiens
gaugcagaaucauuucaga

SEQ ID NO: 415307 - RNA, 19 nt, Homo sapiens
gaacaugugccuuuucuga

SEQ ID NO: 415308 - RNA, 19 nt, Homo sapiens
ccagaaagacucaaaagua

SEQ ID NO: 415309 - RNA, 19 nt, Homo sapiens
gcagaguccucccgaaucg

SEQ ID NO: 415310 - RNA, 19 nt, Homo sapiens
aaauugacguugggaauga

SEQ ID NO: 415311 - RNA, 19 nt, Homo sapiens
ccuacugccuucuuauuga

SEQ ID NO: 415312 - RNA, 19 nt, Homo sapiens
caaaugcuauucagguuuu

SEQ ID NO: 415313 - RNA, 19 nt, Homo sapiens
aaugugaucuuaacuugga

SEQ ID NO: 415314 - RNA, 19 nt, Homo sapiens
ggcaugaagcugcauauga

SEQ ID NO: 415315 - RNA, 19 nt, Homo sapiens
acagcagaauccuuucaua

SEQ ID NO: 415316 - RNA, 19 nt, Homo sapiens
gaaaagggacguucucaga

SEQ ID NO: 415317 - RNA, 19 nt, Homo sapiens
auuaauaccuggcucauca

SEQ ID NO: 415318 - RNA, 19 nt, Homo sapiens
uuacaucgccuaauuccaa

SEQ ID NO: 415319 - RNA, 19 nt, Homo sapiens
gaaauuguucuuccggaau

SEQ ID NO: 415320 - RNA, 19 nt, Homo sapiens
gaccuuuaccgaacacuuu

SEQ ID NO: 415321 - RNA, 19 nt, Homo sapiens
gcagaacuggcugagaaua

SEQ ID NO: 415322 - RNA, 19 nt, Homo sapiens
acgaagaucugaagcuugu

SEQ ID NO: 415323 - RNA, 19 nt, Homo sapiens
ugaaauaguuccaaaagga

SEQ ID NO: 415324 - RNA, 19 nt, Homo sapiens
uaucauugguggcuuguuc

SEQ ID NO: 415325 - RNA, 19 nt, Homo sapiens
caacccguaucuucuacaa

SEQ ID NO: 415326 - RNA, 19 nt, Homo sapiens
acucaagacucaagacuuc

SEQ ID NO: 415327 - RNA, 19 nt, Homo sapiens
ucauauguauucuccauca

SEQ ID NO: 415328 - RNA, 19 nt, Homo sapiens
ggaaggacgggcacuuuca

SEQ ID NO: 415329 - RNA, 19 nt, Homo sapiens
gaagaaaccuguccaucua

SEQ ID NO: 415330 - RNA, 19 nt, Homo sapiens
caacauaacuuuaguccaa

SEQ ID NO: 415331 - RNA, 19 nt, Homo sapiens
ggagauuaguguaugauua

SEQ ID NO: 415332 - RNA, 19 nt, Homo sapiens
ccaaagacauuaaagauug

SEQ ID NO: 415333 - RNA, 19 nt, Homo sapiens
gaacgacacucacugcauu

SEQ ID NO: 415334 - RNA, 19 nt, Homo sapiens
gaacauagccuuuaagcau

SEQ ID NO: 415335 - RNA, 19 nt, Homo sapiens
gcaauguucuuuauaguga

SEQ ID NO: 415336 - RNA, 19 nt, Homo sapiens
ggagaaagcacauuauauu

SEQ ID NO: 415337 - RNA, 19 nt, Homo sapiens
gagaucagcuauagcagua

SEQ ID NO: 415338 - RNA, 19 nt, Homo sapiens
gaagcaauguucuuuauag

SEQ ID NO: 415339 - RNA, 19 nt, Homo sapiens
gcaauugggucuuuuaaua

SEQ ID NO: 415340 - RNA, 19 nt, Homo sapiens
gaaagcugaugaaucuuaa

SEQ ID NO: 415341 - RNA, 19 nt, Homo sapiens
uaucucagcuccaacuuua

SEQ ID NO: 415342 - RNA, 19 nt, Homo sapiens
gccaaagacucaaguguaa

SEQ ID NO: 415343 - RNA, 19 nt, Homo sapiens
ccacguagcuguaacuuca

SEQ ID NO: 415344 - RNA, 19 nt, Homo sapiens
gaaguagaguaccgaauga

SEQ ID NO: 415345 - RNA, 19 nt, Homo sapiens
gaaacugccaccacaauaa

SEQ ID NO: 415346 - RNA, 19 nt, Homo sapiens
gaauguaugucuuguucaa

SEQ ID NO: 415347 - RNA, 19 nt, Homo sapiens
ugaaauccgugaaguuaaa

SEQ ID NO: 415348 - RNA, 19 nt, Homo sapiens
gcaauaccguuucugcuau

SEQ ID NO: 415349 - RNA, 19 nt, Homo sapiens
gauaugcaaucuaacaaga

SEQ ID NO: 415350 - RNA, 19 nt, Homo sapiens
gcaaccagcugcuuucauc

SEQ ID NO: 415351 - RNA, 19 nt, Homo sapiens
caaaguaacguguguagaa

SEQ ID NO: 415352 - RNA, 19 nt, Homo sapiens
uaaaggaccucuugccaau

SEQ ID NO: 415353 - RNA, 19 nt, Homo sapiens
guaauugacuaaagcauuc

SEQ ID NO: 415354 - RNA, 19 nt, Homo sapiens
cgaacuggcugcuacauug

SEQ ID NO: 415355 - RNA, 19 nt, Homo sapiens
ucuccuaguugucauauua

SEQ ID NO: 415356 - RNA, 19 nt, Homo sapiens
uaucagugcuuaucagauu

SEQ ID NO: 415357 - RNA, 19 nt, Homo sapiens
caaauggaaucaucacuca

SEQ ID NO: 415358 - RNA, 19 nt, Homo sapiens
ucaagagccucauuaucua

SEQ ID NO: 415359 - RNA, 19 nt, Homo sapiens
uguacaugcuugugaauua

SEQ ID NO: 415360 - RNA, 19 nt, Homo sapiens
gaauagacucccagacuaa

SEQ ID NO: 415361 - RNA, 19 nt, Homo sapiens
ugaaccaucugccaccuua

SEQ ID NO: 415362 - RNA, 19 nt, Homo sapiens
guacaugcuugugaauuaa

SEQ ID NO: 415363 - RNA, 19 nt, Homo sapiens
gaaccagauugaaaugaga

SEQ ID NO: 415364 - RNA, 19 nt, Homo sapiens
gcugaagacugcaguauag

SEQ ID NO: 415365 - RNA, 19 nt, Homo sapiens
gagaggguguuguugauau

SEQ ID NO: 415366 - RNA, 19 nt, Homo sapiens
aaugaaagcugaugaaucu

SEQ ID NO: 415367 - RNA, 19 nt, Homo sapiens
caacauuucaugccacaua

SEQ ID NO: 415368 - RNA, 19 nt, Homo sapiens
aaaccgauauggaaacauu

SEQ ID NO: 415369 - RNA, 19 nt, Homo sapiens
uguagcagaucucuauaua

SEQ ID NO: 415370 - RNA, 19 nt, Homo sapiens
gguaauauuugaagcugaa

SEQ ID NO: 415371 - RNA, 19 nt, Homo sapiens
gcugacaacuugcacaaug

SEQ ID NO: 415372 - RNA, 19 nt, Homo sapiens
uaaagugcauccaugaaga

SEQ ID NO: 415373 - RNA, 19 nt, Homo sapiens
caucaaugcugcucuuaug

SEQ ID NO: 415374 - RNA, 19 nt, Homo sapiens
ggaaccacuugcugaauau

SEQ ID NO: 415375 - RNA, 19 nt, Homo sapiens
caacuuuaccugacuauga

SEQ ID NO: 415376 - RNA, 19 nt, Homo sapiens
cuacagggcugcuuuccuu

SEQ ID NO: 415377 - RNA, 19 nt, Homo sapiens
gagaccaagucauuacauu

SEQ ID NO: 415378 - RNA, 19 nt, Homo sapiens
gcacauuaaucucaugaag

SEQ ID NO: 415379 - RNA, 19 nt, Homo sapiens
gaaggagagugaagagaca

SEQ ID NO: 415380 - RNA, 19 nt, Homo sapiens
ugaaagcugaugaaucuua

SEQ ID NO: 415381 - RNA, 19 nt, Homo sapiens
gcagaaagauuuuaaugug

SEQ ID NO: 415382 - RNA, 19 nt, Homo sapiens
ggagugcccuaccaugcua

SEQ ID NO: 415383 - RNA, 19 nt, Homo sapiens
gaagacaucagacagcuau

SEQ ID NO: 415384 - RNA, 19 nt, Homo sapiens
caaaggugcuccuaucagu

SEQ ID NO: 415385 - RNA, 19 nt, Homo sapiens
ggaucuguaugaugacuuu

SEQ ID NO: 415386 - RNA, 19 nt, Homo sapiens
gaaaagcugugcaaauuca

SEQ ID NO: 415387 - RNA, 19 nt, Homo sapiens
gaagggaugcuacgauaug

SEQ ID NO: 415388 - RNA, 19 nt, Homo sapiens
agaauagacucccagacua

SEQ ID NO: 415389 - RNA, 19 nt, Homo sapiens
gaaguuaaacaguuccauu

SEQ ID NO: 415390 - RNA, 19 nt, Homo sapiens
gaugauccuuccucagauu

SEQ ID NO: 415391 - RNA, 19 nt, Homo sapiens
caggguagcugauuuacug

SEQ ID NO: 415392 - RNA, 19 nt, Homo sapiens
cuaagaacaucaaucauag

SEQ ID NO: 415393 - RNA, 19 nt, Homo sapiens
gacacucacugcauugauu

SEQ ID NO: 415394 - RNA, 19 nt, Homo sapiens
ggaagcaauguucuuuaua

SEQ ID NO: 415395 - RNA, 19 nt, Homo sapiens
gaacagcaagccaaacaug

SEQ ID NO: 415396 - RNA, 19 nt, Homo sapiens
gcuugaaacuucucccaaa

SEQ ID NO: 415397 - RNA, 19 nt, Homo sapiens
uggaaccacuugcugaaua

SEQ ID NO: 415398 - RNA, 19 nt, Homo sapiens
agaacaaucugcuugcauu

SEQ ID NO: 415399 - RNA, 19 nt, Homo sapiens
gagagugaagagacaauua

SEQ ID NO: 415400 - RNA, 19 nt, Homo sapiens
gagauccgaguucuacuua

SEQ ID NO: 415401 - RNA, 19 nt, Homo sapiens
ggauuuguaucgcugugua

SEQ ID NO: 415402 - RNA, 19 nt, Homo sapiens
aaacugaccaggauuugua

SEQ ID NO: 415403 - RNA, 19 nt, Homo sapiens
gagacgaaauggagaagau

SEQ ID NO: 415404 - RNA, 19 nt, Homo sapiens
gaaaugagaacguauuggu

SEQ ID NO: 415405 - RNA, 19 nt, Homo sapiens
caaggaaccaugacaagaa

SEQ ID NO: 415406 - RNA, 19 nt, Homo sapiens
gaucucggcguauuaauau

SEQ ID NO: 415407 - RNA, 19 nt, Homo sapiens
guacacaccaugucuuuau

SEQ ID NO: 415408 - RNA, 19 nt, Homo sapiens
ggaaucaucacucaauaug

SEQ ID NO: 415409 - RNA, 19 nt, Homo sapiens
ccaagguuccuauaugaua

SEQ ID NO: 415410 - RNA, 19 nt, Homo sapiens
gauccuuccucagauuaua

SEQ ID NO: 415411 - RNA, 19 nt, Homo sapiens
gagcaaggcagacuguuug

SEQ ID NO: 415412 - RNA, 19 nt, Homo sapiens
acaggaagguuaucugaug

SEQ ID NO: 415413 - RNA, 19 nt, Homo sapiens
ucaauggacugugauguga

SEQ ID NO: 415414 - RNA, 19 nt, Homo sapiens
guuaaacaguuccauuuca

SEQ ID NO: 415415 - RNA, 19 nt, Homo sapiens
gaaaauagcaggaauuagu

SEQ ID NO: 415416 - RNA, 19 nt, Homo sapiens
caaaggauacaacaucuau

SEQ ID NO: 415417 - RNA, 19 nt, Homo sapiens
uggagaagauauaccagua

SEQ ID NO: 415418 - RNA, 19 nt, Homo sapiens
gugguuauauugccauuga

SEQ ID NO: 415419 - RNA, 19 nt, Homo sapiens
gcauuccaguguccucuuu

SEQ ID NO: 415420 - RNA, 19 nt, Homo sapiens
aaaacaagauggcaacaua

SEQ ID NO: 415421 - RNA, 19 nt, Homo sapiens
ggaccaacauaacuuuagu

SEQ ID NO: 415422 - RNA, 19 nt, Homo sapiens
ugugauaaaucuccucauu

SEQ ID NO: 415423 - RNA, 19 nt, Homo sapiens
guacugaguuauccuugug

SEQ ID NO: 415424 - RNA, 19 nt, Homo sapiens
gcagguggcuguacuuuug

SEQ ID NO: 415425 - RNA, 19 nt, Homo sapiens
ugagcaaacuguaaacugu

SEQ ID NO: 415426 - RNA, 19 nt, Homo sapiens
gaacguauugguguuugua

SEQ ID NO: 415427 - RNA, 19 nt, Homo sapiens
agaagugccuggauccaaa

SEQ ID NO: 415428 - RNA, 19 nt, Homo sapiens
caagaccacaggaagguua

SEQ ID NO: 415429 - RNA, 19 nt, Homo sapiens
gcaauuauaucgaugguua

SEQ ID NO: 415430 - RNA, 19 nt, Homo sapiens
gagcacaacuauauucuua

SEQ ID NO: 415431 - RNA, 19 nt, Homo sapiens
ggacuugccuggcgacuuu

SEQ ID NO: 415432 - RNA, 19 nt, Homo sapiens
ugaaggagguguuggaaua

SEQ ID NO: 415433 - RNA, 19 nt, Homo sapiens
ucacuaaccugucaccaua

SEQ ID NO: 415434 - RNA, 19 nt, Homo sapiens
ggaaguaccuuugaagaga

SEQ ID NO: 415435 - RNA, 19 nt, Homo sapiens
caaguuaggucucuguauu

SEQ ID NO: 415436 - RNA, 19 nt, Homo sapiens
cgacagaaaucuuaaagug

SEQ ID NO: 415437 - RNA, 19 nt, Homo sapiens
ggagacugguccuggauua

SEQ ID NO: 415438 - RNA, 19 nt, Homo sapiens
ggaagaacguccucgaaga

SEQ ID NO: 415439 - RNA, 19 nt, Homo sapiens
cuacuuugcugcagaauuu

SEQ ID NO: 415440 - RNA, 19 nt, Homo sapiens
gcacaacuauauucuuaug

SEQ ID NO: 415441 - RNA, 19 nt, Homo sapiens
guaaacagcucugcaaaca

SEQ ID NO: 415442 - RNA, 19 nt, Homo sapiens
gcaaacaaucccuuucaua

SEQ ID NO: 415443 - RNA, 19 nt, Homo sapiens
aaaggaaacuggccaagaa

SEQ ID NO: 415444 - RNA, 19 nt, Homo sapiens
guagacagcugguaaacug

SEQ ID NO: 415445 - RNA, 19 nt, Homo sapiens
cgacgaggcuuucucauuc

SEQ ID NO: 415446 - RNA, 19 nt, Homo sapiens
aaacagcucugcaaacaau

SEQ ID NO: 415447 - RNA, 19 nt, Homo sapiens
uaagaaagaugagaacaga

SEQ ID NO: 415448 - RNA, 19 nt, Homo sapiens
gggcagaacuggccauuag

SEQ ID NO: 415449 - RNA, 19 nt, Homo sapiens
ggaaagccaagaacucaua

SEQ ID NO: 415450 - RNA, 19 nt, Homo sapiens
gaaguaagcugggauacag

SEQ ID NO: 415451 - RNA, 19 nt, Homo sapiens
gccaagacguuccauggua

SEQ ID NO: 415452 - RNA, 19 nt, Homo sapiens
gaaguaccuuugaagagaa

SEQ ID NO: 415453 - RNA, 19 nt, Homo sapiens
ccacaguacuggccagaaa

SEQ ID NO: 415454 - RNA, 19 nt, Homo sapiens
gaagaacguccucgaagaa

SEQ ID NO: 415455 - RNA, 19 nt, Homo sapiens
uauaugagaucaccuacaa

SEQ ID NO: 415456 - RNA, 19 nt, Homo sapiens
ggucaaaucucggcaaauc

SEQ ID NO: 415457 - RNA, 19 nt, Homo sapiens
ggaguuguguugguaauga

SEQ ID NO: 415458 - RNA, 19 nt, Homo sapiens
ucaaacauaugguguaauc

SEQ ID NO: 415459 - RNA, 19 nt, Homo sapiens
gaagaaguaagcugggaua

SEQ ID NO: 415460 - RNA, 19 nt, Homo sapiens
ccacuacuguuaccaaguu

SEQ ID NO: 415461 - RNA, 19 nt, Homo sapiens
gaagagcacaacuauauuc

SEQ ID NO: 415462 - RNA, 19 nt, Homo sapiens
uuaggucucuguauuauga

SEQ ID NO: 415463 - RNA, 19 nt, Homo sapiens
gacacaaacucagacuaua

SEQ ID NO: 415464 - RNA, 19 nt, Homo sapiens
ggaaaguaccgcugcauga

SEQ ID NO: 415465 - RNA, 19 nt, Homo sapiens
gaacuggccauuaguacuu

SEQ ID NO: 415466 - RNA, 19 nt, Homo sapiens
cagaacuacuggcagaaua

SEQ ID NO: 415467 - RNA, 19 nt, Homo sapiens
gagaaccaacucaaacaua

SEQ ID NO: 415468 - RNA, 19 nt, Homo sapiens
caaacgagaugcuggaaag

SEQ ID NO: 415469 - RNA, 19 nt, Homo sapiens
ggaauccuaucuggaauau

SEQ ID NO: 415470 - RNA, 19 nt, Homo sapiens
ugacuaaaccgacuucuga

SEQ ID NO: 415471 - RNA, 19 nt, Homo sapiens
gcaaauacuggccagauga

SEQ ID NO: 415472 - RNA, 19 nt, Homo sapiens
gaugagaacagaaugaaga

SEQ ID NO: 415473 - RNA, 19 nt, Homo sapiens
gaacguccucgaagaacua

SEQ ID NO: 415474 - RNA, 19 nt, Homo sapiens
gaacuugagacaccuuuga

SEQ ID NO: 415475 - RNA, 19 nt, Homo sapiens
gcagaacuggccauuagua

SEQ ID NO: 415476 - RNA, 19 nt, Homo sapiens
gaacaacaagcccaacaug

SEQ ID NO: 415477 - RNA, 19 nt, Homo sapiens
ucuaagcgcuccuucuuga

SEQ ID NO: 415478 - RNA, 19 nt, Homo sapiens
caucaaugcugcccucaug

SEQ ID NO: 415479 - RNA, 19 nt, Homo sapiens
aaagagaggugugcaugaa

SEQ ID NO: 415480 - RNA, 19 nt, Homo sapiens
gaauaucauugcauacgau

SEQ ID NO: 415481 - RNA, 19 nt, Homo sapiens
ggaauaucauugcauacga

SEQ ID NO: 415482 - RNA, 19 nt, Homo sapiens
ggaauacgagagcuucuuu

SEQ ID NO: 415483 - RNA, 19 nt, Homo sapiens
cauaugguguaaucacuuu

SEQ ID NO: 415484 - RNA, 19 nt, Homo sapiens
gaggagcaguauguguuua

SEQ ID NO: 415485 - RNA, 19 nt, Homo sapiens
caaauacacugagcacauc

SEQ ID NO: 415486 - RNA, 19 nt, Homo sapiens
agacagaccauacaguuaa

SEQ ID NO: 415487 - RNA, 19 nt, Homo sapiens
gauaacuucuggacaucaa

SEQ ID NO: 415488 - RNA, 19 nt, Homo sapiens
aaacagaggagcaguaugu

SEQ ID NO: 415489 - RNA, 19 nt, Homo sapiens
cagaauaugugauaagaac

SEQ ID NO: 415490 - RNA, 19 nt, Homo sapiens
gagugaggcugcagacaau

SEQ ID NO: 415491 - RNA, 19 nt, Homo sapiens
agaaccaacucaaacauau

SEQ ID NO: 415492 - RNA, 19 nt, Homo sapiens
ucagguggcugccucuuug

SEQ ID NO: 415493 - RNA, 19 nt, Homo sapiens
caaacuggauccacagaca

SEQ ID NO: 415494 - RNA, 19 nt, Homo sapiens
gaucagacaguuucacuuc

SEQ ID NO: 415495 - RNA, 19 nt, Homo sapiens
guacuacuuugcugcagaa

SEQ ID NO: 415496 - RNA, 19 nt, Homo sapiens
gcaggauauuccgcauuua

SEQ ID NO: 415497 - RNA, 19 nt, Homo sapiens
auaaacagccuucagcuuu

SEQ ID NO: 415498 - RNA, 19 nt, Homo sapiens
gcugggagccauuuggaua

SEQ ID NO: 415499 - RNA, 19 nt, Homo sapiens
gaggucaaaucucggcaaa

SEQ ID NO: 415500 - RNA, 19 nt, Homo sapiens
ggaggacucaguucacaaa

SEQ ID NO: 415501 - RNA, 19 nt, Homo sapiens
ccaagacguuccaugguau

SEQ ID NO: 415502 - RNA, 19 nt, Homo sapiens
caaacacagugaaagacuu

SEQ ID NO: 415503 - RNA, 19 nt, Homo sapiens
ugaccaaucuuguggaagu

SEQ ID NO: 415504 - RNA, 19 nt, Homo sapiens
ggacucggcuaagaaagau

SEQ ID NO: 415505 - RNA, 19 nt, Homo sapiens
gacagaccauacaguuaaa

SEQ ID NO: 415506 - RNA, 19 nt, Homo sapiens
gugaacaccuugacuaaac

SEQ ID NO: 415507 - RNA, 19 nt, Homo sapiens
ugacccagauacagaauau

SEQ ID NO: 415508 - RNA, 19 nt, Homo sapiens
cugaagagcacaacuauau

SEQ ID NO: 415509 - RNA, 19 nt, Homo sapiens
caaacaaucccuuucauac

SEQ ID NO: 415510 - RNA, 19 nt, Homo sapiens
ggacaucaucagcaggaua

SEQ ID NO: 415511 - RNA, 19 nt, Homo sapiens
guaguuaugcuaaaugaug

SEQ ID NO: 415512 - RNA, 19 nt, Homo sapiens
ggcagaauaugugauaaga

SEQ ID NO: 415513 - RNA, 19 nt, Homo sapiens
gacauuaaaguuacccuaa

SEQ ID NO: 415514 - RNA, 19 nt, Homo sapiens
ggucaaaugcugcaaauac

SEQ ID NO: 415515 - RNA, 19 nt, Homo sapiens
ggacucaguucacaaaaug

SEQ ID NO: 415516 - RNA, 19 nt, Homo sapiens
ggacaaguggcaagaggaa

SEQ ID NO: 415517 - RNA, 19 nt, Homo sapiens
gcaaacagaggagcaguau

SEQ ID NO: 415518 - RNA, 19 nt, Homo sapiens
gaugaaacccacacaaugg

SEQ ID NO: 415519 - RNA, 19 nt, Homo sapiens
gggaccacauacuccuuua

SEQ ID NO: 415520 - RNA, 19 nt, Homo sapiens
ugaaacugauccucaugaa

SEQ ID NO: 415521 - RNA, 19 nt, Homo sapiens
aaacugaagagcacaacua

SEQ ID NO: 415522 - RNA, 19 nt, Homo sapiens
gccaucagguucucucaug

SEQ ID NO: 415523 - RNA, 19 nt, Homo sapiens
ugaagacacugaggaacaa

SEQ ID NO: 415524 - RNA, 19 nt, Homo sapiens
gagcagcaacuacaucaau

SEQ ID NO: 415525 - RNA, 19 nt, Homo sapiens
gaugacacagagauauaua

SEQ ID NO: 415526 - RNA, 19 nt, Homo sapiens
cagaugacacagagauaua

SEQ ID NO: 415527 - RNA, 19 nt, Homo sapiens
uaucaucgacccaaucauu

SEQ ID NO: 415528 - RNA, 19 nt, Homo sapiens
aagaacagauacgggaaua

SEQ ID NO: 415529 - RNA, 19 nt, Homo sapiens
gaauaaaguuaguguguug

SEQ ID NO: 415530 - RNA, 19 nt, Homo sapiens
gcaggaaggugaacaagug

SEQ ID NO: 415531 - RNA, 19 nt, Homo sapiens
gaaaggacauggguagcaa

SEQ ID NO: 415532 - RNA, 19 nt, Homo sapiens
ggaggcagcugcaguccuu

SEQ ID NO: 415533 - RNA, 19 nt, Homo sapiens
ggacauggguagcaauucu

SEQ ID NO: 415534 - RNA, 19 nt, Homo sapiens
ggugaagucugaacuggaa

SEQ ID NO: 415535 - RNA, 19 nt, Homo sapiens
gaaccggcauccugacuuc

SEQ ID NO: 415536 - RNA, 19 nt, Homo sapiens
agacagggcuccaaaucuu

SEQ ID NO: 415537 - RNA, 19 nt, Homo sapiens
gcccacggcugucuauuug

SEQ ID NO: 415538 - RNA, 19 nt, Homo sapiens
gagugaagcugcuggagau

SEQ ID NO: 415539 - RNA, 19 nt, Homo sapiens
gcucugcucucaccuggaa

SEQ ID NO: 415540 - RNA, 19 nt, Homo sapiens
gagcagaaccugucuuugg

SEQ ID NO: 415541 - RNA, 19 nt, Homo sapiens
gcacagacagggcuccaaa

SEQ ID NO: 415542 - RNA, 19 nt, Homo sapiens
gcaccuacauccucaucga

SEQ ID NO: 415543 - RNA, 19 nt, Homo sapiens
acgaugaccucacccagua

SEQ ID NO: 415544 - RNA, 19 nt, Homo sapiens
caacucaugucccaaggau

SEQ ID NO: 415545 - RNA, 19 nt, Homo sapiens
ggaagucuguauucaggau

SEQ ID NO: 415546 - RNA, 19 nt, Homo sapiens
ucaggcagcuucaucaaca

SEQ ID NO: 415547 - RNA, 19 nt, Homo sapiens
guaccagugugaauaaagu

SEQ ID NO: 415548 - RNA, 19 nt, Homo sapiens
gacacaugauucuggcaua

SEQ ID NO: 415549 - RNA, 19 nt, Homo sapiens
gcccaagggugcaggaaga

SEQ ID NO: 415550 - RNA, 19 nt, Homo sapiens
gcucuaaggaccaguuuga

SEQ ID NO: 415551 - RNA, 19 nt, Homo sapiens
uaaggaccaguuugaauuu

SEQ ID NO: 415552 - RNA, 19 nt, Homo sapiens
cuaaggaccaguuugaauu

SEQ ID NO: 415553 - RNA, 19 nt, Homo sapiens
gaaccugucuuuggcugau

SEQ ID NO: 415554 - RNA, 19 nt, Homo sapiens
uggcauacauggaggauca

SEQ ID NO: 415555 - RNA, 19 nt, Homo sapiens
aagcagggcuggugaaguc

SEQ ID NO: 415556 - RNA, 19 nt, Homo sapiens
caucgucacugaucagaag

SEQ ID NO: 415557 - RNA, 19 nt, Homo sapiens
gcccggagcucggaaagau

SEQ ID NO: 415558 - RNA, 19 nt, Homo sapiens
ggaaggugaacaagugcua

SEQ ID NO: 415559 - RNA, 19 nt, Homo sapiens
gauccuggcugagcaugug

SEQ ID NO: 415560 - RNA, 19 nt, Homo sapiens
caguuuggcucccgugaug

SEQ ID NO: 415561 - RNA, 19 nt, Homo sapiens
gaagagucaggaagggaaa

SEQ ID NO: 415562 - RNA, 19 nt, Homo sapiens
agaggaauauggcuacauc

SEQ ID NO: 415563 - RNA, 19 nt, Homo sapiens
guaaauguuggagcugaua

SEQ ID NO: 415564 - RNA, 19 nt, Homo sapiens
ccacgaaguccuuguucaa

SEQ ID NO: 415565 - RNA, 19 nt, Homo sapiens
gugaauaaaguuagugugu

SEQ ID NO: 415566 - RNA, 19 nt, Homo sapiens
uauucaggauggcuuguuu

SEQ ID NO: 415567 - RNA, 19 nt, Homo sapiens
gguggaggauggugucaag

SEQ ID NO: 415568 - RNA, 19 nt, Homo sapiens
caagcccugucuccucuga

SEQ ID NO: 415569 - RNA, 19 nt, Homo sapiens
ggaaaggacauggguagca

SEQ ID NO: 415570 - RNA, 19 nt, Homo sapiens
cccaguaugugaucucuca

SEQ ID NO: 415571 - RNA, 19 nt, Homo sapiens
gagcugauaucaagaaaac

SEQ ID NO: 415572 - RNA, 19 nt, Homo sapiens
uguuggagcugauaucaag

SEQ ID NO: 415573 - RNA, 19 nt, Homo sapiens
acucugggcugcucuaucu

SEQ ID NO: 415574 - RNA, 19 nt, Homo sapiens
caaaaggagugaaggagau

SEQ ID NO: 415575 - RNA, 19 nt, Homo sapiens
ccacguauaugaggugaac

SEQ ID NO: 415576 - RNA, 19 nt, Homo sapiens
gcccagcagcagaggaaua

SEQ ID NO: 415577 - RNA, 19 nt, Homo sapiens
caccuguccugcuagagaa

SEQ ID NO: 415578 - RNA, 19 nt, Homo sapiens
gccacgaaguccuuguuca

SEQ ID NO: 415579 - RNA, 19 nt, Homo sapiens
acucaugucccaaggauug

SEQ ID NO: 415580 - RNA, 19 nt, Homo sapiens
gcagaggaauauggcuaca

SEQ ID NO: 415581 - RNA, 19 nt, Homo sapiens
caagggugcaggaagaaau

SEQ ID NO: 415582 - RNA, 19 nt, Homo sapiens
caagucaccuccccaguuc

SEQ ID NO: 415583 - RNA, 19 nt, Homo sapiens
gaccgcuacuggccagaug

SEQ ID NO: 415584 - RNA, 19 nt, Homo sapiens
gcccuucucggagcgauua

SEQ ID NO: 415585 - RNA, 19 nt, Homo sapiens
cagccucugucccucuuug

SEQ ID NO: 415586 - RNA, 19 nt, Homo sapiens
uggcugaugugacccaaca

SEQ ID NO: 415587 - RNA, 19 nt, Homo sapiens
gcuacaucgucacugauca

SEQ ID NO: 415588 - RNA, 19 nt, Homo sapiens
ggugugcuccgacaacuca

SEQ ID NO: 415589 - RNA, 19 nt, Homo sapiens
uggccuggcucuccuguag

SEQ ID NO: 415590 - RNA, 19 nt, Homo sapiens
gacauggguagcaauucua

SEQ ID NO: 415591 - RNA, 19 nt, Homo sapiens
ccacggcugucuauuugac

SEQ ID NO: 415592 - RNA, 19 nt, Homo sapiens
uaaaguuaguguguugucu

SEQ ID NO: 415593 - RNA, 19 nt, Homo sapiens
gugugagcaucucugugua

SEQ ID NO: 415594 - RNA, 19 nt, Homo sapiens
ggagugaaggagauugaca

SEQ ID NO: 415595 - RNA, 19 nt, Homo sapiens
ucggaugccagccuacaua

SEQ ID NO: 415596 - RNA, 19 nt, Homo sapiens
cugacuuccugcccuauga

SEQ ID NO: 415597 - RNA, 19 nt, Homo sapiens
gugacacuaccuuugagua

SEQ ID NO: 415598 - RNA, 19 nt, Homo sapiens
gacagggcuccaaaucuug

SEQ ID NO: 415599 - RNA, 19 nt, Homo sapiens
cagggcuggugaagucuga

SEQ ID NO: 415600 - RNA, 19 nt, Homo sapiens
gcaagucaccuccccaguu

SEQ ID NO: 415601 - RNA, 19 nt, Homo sapiens
gcagccaggaggagaggaa

SEQ ID NO: 415602 - RNA, 19 nt, Homo sapiens
gcaguguguccucccaguu

SEQ ID NO: 415603 - RNA, 19 nt, Homo sapiens
gaggagaggaaaggacaug

SEQ ID NO: 415604 - RNA, 19 nt, Homo sapiens
ucaucgacaugguccugaa

SEQ ID NO: 415605 - RNA, 19 nt, Homo sapiens
gaugaccucacccaguaug

SEQ ID NO: 415606 - RNA, 19 nt, Homo sapiens
ucuaaggaccaguuugaau

SEQ ID NO: 415607 - RNA, 19 nt, Homo sapiens
caucuggugcgaggacuuu

SEQ ID NO: 415608 - RNA, 19 nt, Homo sapiens
ucggagcgauuacaucaac

SEQ ID NO: 415609 - RNA, 19 nt, Homo sapiens
ucucggagcgauuacauca

SEQ ID NO: 415610 - RNA, 19 nt, Homo sapiens
ccacgggacacaugauucu

SEQ ID NO: 415611 - RNA, 19 nt, Homo sapiens
acaccuguccugcuagaga

SEQ ID NO: 415612 - RNA, 19 nt, Homo sapiens
ccucugagccucccaaagc

SEQ ID NO: 415613 - RNA, 19 nt, Homo sapiens
ugugugagcaucucugugu

SEQ ID NO: 415614 - RNA, 19 nt, Homo sapiens
acacuaccuuugaguacca

SEQ ID NO: 415615 - RNA, 19 nt, Homo sapiens
ucaccuggaagucuguauu

SEQ ID NO: 415616 - RNA, 19 nt, Homo sapiens
gggagggguuguaaauguu

SEQ ID NO: 415617 - RNA, 19 nt, Homo sapiens
agagggcuaugagaaggaa

SEQ ID NO: 415618 - RNA, 19 nt, Homo sapiens
cagcaucggcuuccacaac

SEQ ID NO: 415619 - RNA, 19 nt, Homo sapiens
aaggaccaguuugaauuug

SEQ ID NO: 415620 - RNA, 19 nt, Homo sapiens
acacaugauucuggcauac

SEQ ID NO: 415621 - RNA, 19 nt, Homo sapiens
cauggugacacuaccuuug

SEQ ID NO: 415622 - RNA, 19 nt, Homo sapiens
acagacagggcuccaaauc

SEQ ID NO: 415623 - RNA, 19 nt, Homo sapiens
uggagcugauaucaagaaa

SEQ ID NO: 415624 - RNA, 19 nt, Homo sapiens
guuugaauuugcccugaca

SEQ ID NO: 415625 - RNA, 19 nt, Homo sapiens
gagugaaggagauugacau

SEQ ID NO: 415626 - RNA, 19 nt, Homo sapiens
ugacacuaccuuugaguac

SEQ ID NO: 415627 - RNA, 19 nt, Homo sapiens
cuaccuguuccaccaguuu

SEQ ID NO: 415628 - RNA, 19 nt, Homo sapiens
cagcagcagaggaauaugg

SEQ ID NO: 415629 - RNA, 19 nt, Homo sapiens
gaacaaaucugggcauuga

SEQ ID NO: 415630 - RNA, 19 nt, Homo sapiens
gcagugaccuucaaaguga

SEQ ID NO: 415631 - RNA, 19 nt, Homo sapiens
ggagacagcuuuccagaug

SEQ ID NO: 415632 - RNA, 19 nt, Homo sapiens
ggaaaccucuggacugaaa

SEQ ID NO: 415633 - RNA, 19 nt, Homo sapiens
ggugugagauauacaaaua

SEQ ID NO: 415634 - RNA, 19 nt, Homo sapiens
ggaaucgguucaucaauuu

SEQ ID NO: 415635 - RNA, 19 nt, Homo sapiens
ccacgggucucgacucuua

SEQ ID NO: 415636 - RNA, 19 nt, Homo sapiens
gugaggagcuucuaucuga

SEQ ID NO: 415637 - RNA, 19 nt, Homo sapiens
gggaaucgguucaucaauu

SEQ ID NO: 415638 - RNA, 19 nt, Homo sapiens
caaaggugcuaaagagauu

SEQ ID NO: 415639 - RNA, 19 nt, Homo sapiens
ggacgacgaugauagacuu

SEQ ID NO: 415640 - RNA, 19 nt, Homo sapiens
gaugaaggcuccaaucucu

SEQ ID NO: 415641 - RNA, 19 nt, Homo sapiens
ggagagggcugcgagcauu

SEQ ID NO: 415642 - RNA, 19 nt, Homo sapiens
gaucugacuuuaauugugu

SEQ ID NO: 415643 - RNA, 19 nt, Homo sapiens
cagaugagcucagcccuaa

SEQ ID NO: 415644 - RNA, 19 nt, Homo sapiens
aaagagagauuuguggaaa

SEQ ID NO: 415645 - RNA, 19 nt, Homo sapiens
caagaagacuccaccaagu

SEQ ID NO: 415646 - RNA, 19 nt, Homo sapiens
ccacggauguugucaggaa

SEQ ID NO: 415647 - RNA, 19 nt, Homo sapiens
ugaagaaccugcagaccaa

SEQ ID NO: 415648 - RNA, 19 nt, Homo sapiens
gcugauggcuggccugaug

SEQ ID NO: 415649 - RNA, 19 nt, Homo sapiens
ggaaucaugaucugacuuu

SEQ ID NO: 415650 - RNA, 19 nt, Homo sapiens
gaaauaggacaauucacuu

SEQ ID NO: 415651 - RNA, 19 nt, Homo sapiens
guagagaugauucggauuu

SEQ ID NO: 415652 - RNA, 19 nt, Homo sapiens
gaaucaugaucugacuuua

SEQ ID NO: 415653 - RNA, 19 nt, Homo sapiens
cgaaggagcaguuugaguu

SEQ ID NO: 415654 - RNA, 19 nt, Homo sapiens
ggccaaaggugcuaaagag

SEQ ID NO: 415655 - RNA, 19 nt, Homo sapiens
ggacagugguguggacaga

SEQ ID NO: 415656 - RNA, 19 nt, Homo sapiens
cagcgcaguuuagcaguua

SEQ ID NO: 415657 - RNA, 19 nt, Homo sapiens
ugugaacgauggaguguuu

SEQ ID NO: 415658 - RNA, 19 nt, Homo sapiens
gggccguucuuguccaaua

SEQ ID NO: 415659 - RNA, 19 nt, Homo sapiens
agagaaaccuccgguguga

SEQ ID NO: 415660 - RNA, 19 nt, Homo sapiens
ugagagaguuuaucauugg

SEQ ID NO: 415661 - RNA, 19 nt, Homo sapiens
caaggcacguuuggcauuu

SEQ ID NO: 415662 - RNA, 19 nt, Homo sapiens
cgugaaugcuuaccuguga

SEQ ID NO: 415663 - RNA, 19 nt, Homo sapiens
cgacaugguucucaacaag

SEQ ID NO: 415664 - RNA, 19 nt, Homo sapiens
gaagggaagugagaaacca

SEQ ID NO: 415665 - RNA, 19 nt, Homo sapiens
gcaccuacguccugaucga

SEQ ID NO: 415666 - RNA, 19 nt, Homo sapiens
gaacagccacagccacuca

SEQ ID NO: 415667 - RNA, 19 nt, Homo sapiens
caagagguccaucgucuga

SEQ ID NO: 415668 - RNA, 19 nt, Homo sapiens
gauggagcacggauucaua

SEQ ID NO: 415669 - RNA, 19 nt, Homo sapiens
gaggagaacgugcccaaga

SEQ ID NO: 415670 - RNA, 19 nt, Homo sapiens
gcaggacgacgaugauaga

SEQ ID NO: 415671 - RNA, 19 nt, Homo sapiens
gagacagcuuuccagauga

SEQ ID NO: 415672 - RNA, 19 nt, Homo sapiens
gaccagcagugaccuucaa

SEQ ID NO: 415673 - RNA, 19 nt, Homo sapiens
ugaccaggaugaucacaug

SEQ ID NO: 415674 - RNA, 19 nt, Homo sapiens
ucaacaagauggccaaagg

SEQ ID NO: 415675 - RNA, 19 nt, Homo sapiens
ggaagagugugcuugucau

SEQ ID NO: 415676 - RNA, 19 nt, Homo sapiens
gcagaaaaguaaacaagug

SEQ ID NO: 415677 - RNA, 19 nt, Homo sapiens
gcuccaaucucuaccacau

SEQ ID NO: 415678 - RNA, 19 nt, Homo sapiens
ccaggaugaucacauggaa

SEQ ID NO: 415679 - RNA, 19 nt, Homo sapiens
gccagaagguuccggcaau

SEQ ID NO: 415680 - RNA, 19 nt, Homo sapiens
cuacugagcggacagaaug

SEQ ID NO: 415681 - RNA, 19 nt, Homo sapiens
gauagaugguacucuccaa

SEQ ID NO: 415682 - RNA, 19 nt, Homo sapiens
uaggacaauucacuucauu

SEQ ID NO: 415683 - RNA, 19 nt, Homo sapiens
ccagacguauuccaaagau

SEQ ID NO: 415684 - RNA, 19 nt, Homo sapiens
ucuaacuccuuauguuuga

SEQ ID NO: 415685 - RNA, 19 nt, Homo sapiens
gaaggagcaguuugaguuc

SEQ ID NO: 415686 - RNA, 19 nt, Homo sapiens
gccaaaauauugcuuaugu

SEQ ID NO: 415687 - RNA, 19 nt, Homo sapiens
cagcauuccuccaucuuag

SEQ ID NO: 415688 - RNA, 19 nt, Homo sapiens
ccagaaauaggacaauuca

SEQ ID NO: 415689 - RNA, 19 nt, Homo sapiens
cggcauggcugagcugaug

SEQ ID NO: 415690 - RNA, 19 nt, Homo sapiens
caagaaugcccaggccuuu

SEQ ID NO: 415691 - RNA, 19 nt, Homo sapiens
gagagcauccugaccuaug

SEQ ID NO: 415692 - RNA, 19 nt, Homo sapiens
acagaaugaugccaaaaua

SEQ ID NO: 415693 - RNA, 19 nt, Homo sapiens
uaaagcacccguucaccuu

SEQ ID NO: 415694 - RNA, 19 nt, Homo sapiens
ucacguggcaggaugacua

SEQ ID NO: 415695 - RNA, 19 nt, Homo sapiens
ggccguucuuguccaauaa

SEQ ID NO: 415696 - RNA, 19 nt, Homo sapiens
augcuuaccugugagauaa

SEQ ID NO: 415697 - RNA, 19 nt, Homo sapiens
agacgaaggagcaguuuga

SEQ ID NO: 415698 - RNA, 19 nt, Homo sapiens
cagcgacccuggagcacuu

SEQ ID NO: 415699 - RNA, 19 nt, Homo sapiens
gggagagucuggagaacag

SEQ ID NO: 415700 - RNA, 19 nt, Homo sapiens
caggaugacuauacucagu

SEQ ID NO: 415701 - RNA, 19 nt, Homo sapiens
ccacagcauuccuccaucu

SEQ ID NO: 415702 - RNA, 19 nt, Homo sapiens
caugaucugacuuuaauug

SEQ ID NO: 415703 - RNA, 19 nt, Homo sapiens
gucaagagccagacguauu

SEQ ID NO: 415704 - RNA, 19 nt, Homo sapiens
ugugugggcugcagauuuc

SEQ ID NO: 415705 - RNA, 19 nt, Homo sapiens
uaaagagagauuuguggaa

SEQ ID NO: 415706 - RNA, 19 nt, Homo sapiens
gauguugucaggaaucaug

SEQ ID NO: 415707 - RNA, 19 nt, Homo sapiens
gcacuugagggaccagaga

SEQ ID NO: 415708 - RNA, 19 nt, Homo sapiens
aggagaacgugcccaagaa

SEQ ID NO: 415709 - RNA, 19 nt, Homo sapiens
gcgacggccugcaauugga

SEQ ID NO: 415710 - RNA, 19 nt, Homo sapiens
ccaaaggugcuaaagagau

SEQ ID NO: 415711 - RNA, 19 nt, Homo sapiens
agaaccggcuggagaagga

SEQ ID NO: 415712 - RNA, 19 nt, Homo sapiens
ucaagagccagacguauuc

SEQ ID NO: 415713 - RNA, 19 nt, Homo sapiens
caaccaggaagaacaaauc

SEQ ID NO: 415714 - RNA, 19 nt, Homo sapiens
ccacaaccaggaagaacaa

SEQ ID NO: 415715 - RNA, 19 nt, Homo sapiens
agucuucccugucuucaga

SEQ ID NO: 415716 - RNA, 19 nt, Homo sapiens
uugagagaguuuaucauug

SEQ ID NO: 415717 - RNA, 19 nt, Homo sapiens
gcacacaaggcacguuugg

SEQ ID NO: 415718 - RNA, 19 nt, Homo sapiens
guucaucaauuuucacuug

SEQ ID NO: 415719 - RNA, 19 nt, Homo sapiens
ccagaagguuccggcaaug

SEQ ID NO: 415720 - RNA, 19 nt, Homo sapiens
gugcuaaagagauugauau

SEQ ID NO: 415721 - RNA, 19 nt, Homo sapiens
ccgagagcauccugaccua

SEQ ID NO: 415722 - RNA, 19 nt, Homo sapiens
ccgcacacgucacgcauca

SEQ ID NO: 415723 - RNA, 19 nt, Homo sapiens
ccucuggccucaucuacug

SEQ ID NO: 415724 - RNA, 19 nt, Homo sapiens
gagccagacguauuccaaa

SEQ ID NO: 415725 - RNA, 19 nt, Homo sapiens
ugauagacuuuaccaagag

SEQ ID NO: 415726 - RNA, 19 nt, Homo sapiens
ccuuauguuugaagagaaa

SEQ ID NO: 415727 - RNA, 19 nt, Homo sapiens
cuuaaugaaccacguguuu

SEQ ID NO: 415728 - RNA, 19 nt, Homo sapiens
gguugaaguuguguuaaca

SEQ ID NO: 415729 - RNA, 19 nt, Homo sapiens
gaacaaaucugggcauuga

SEQ ID NO: 415730 - RNA, 19 nt, Homo sapiens
gcagugaccuucaaaguga

SEQ ID NO: 415731 - RNA, 19 nt, Homo sapiens
ggagacagcuuuccagaug

SEQ ID NO: 415732 - RNA, 19 nt, Homo sapiens
ggaaaccucuggacugaaa

SEQ ID NO: 415733 - RNA, 19 nt, Homo sapiens
ggugugagauauacaaaua

SEQ ID NO: 415734 - RNA, 19 nt, Homo sapiens
ggaaucgguucaucaauuu

SEQ ID NO: 415735 - RNA, 19 nt, Homo sapiens
ccacgggucucgacucuua

SEQ ID NO: 415736 - RNA, 19 nt, Homo sapiens
gugaggagcuucuaucuga

SEQ ID NO: 415737 - RNA, 19 nt, Homo sapiens
gggaaucgguucaucaauu

SEQ ID NO: 415738 - RNA, 19 nt, Homo sapiens
caaaggugcuaaagagauu

SEQ ID NO: 415739 - RNA, 19 nt, Homo sapiens
ggacgacgaugauagacuu

SEQ ID NO: 415740 - RNA, 19 nt, Homo sapiens
gaugaaggcuccaaucucu

SEQ ID NO: 415741 - RNA, 19 nt, Homo sapiens
ggagagggcugcgagcauu

SEQ ID NO: 415742 - RNA, 19 nt, Homo sapiens
gaucugacuuuaauugugu

SEQ ID NO: 415743 - RNA, 19 nt, Homo sapiens
cagaugagcucagcccuaa

SEQ ID NO: 415744 - RNA, 19 nt, Homo sapiens
aaagagagauuuguggaaa

SEQ ID NO: 415745 - RNA, 19 nt, Homo sapiens
caagaagacuccaccaagu

SEQ ID NO: 415746 - RNA, 19 nt, Homo sapiens
ccacggauguugucaggaa

SEQ ID NO: 415747 - RNA, 19 nt, Homo sapiens
ugaagaaccugcagaccaa

SEQ ID NO: 415748 - RNA, 19 nt, Homo sapiens
gcugauggcuggccugaug

SEQ ID NO: 415749 - RNA, 19 nt, Homo sapiens
ggaaucaugaucugacuuu

SEQ ID NO: 415750 - RNA, 19 nt, Homo sapiens
gaaauaggacaauucacuu

SEQ ID NO: 415751 - RNA, 19 nt, Homo sapiens
guagagaugauucggauuu

SEQ ID NO: 415752 - RNA, 19 nt, Homo sapiens
gaaucaugaucugacuuua

SEQ ID NO: 415753 - RNA, 19 nt, Homo sapiens
cgaaggagcaguuugaguu

SEQ ID NO: 415754 - RNA, 19 nt, Homo sapiens
ggccaaaggugcuaaagag

SEQ ID NO: 415755 - RNA, 19 nt, Homo sapiens
ggacagugguguggacaga

SEQ ID NO: 415756 - RNA, 19 nt, Homo sapiens
cagcgcaguuuagcaguua

SEQ ID NO: 415757 - RNA, 19 nt, Homo sapiens
gggccguucuuguccaaua

SEQ ID NO: 415758 - RNA, 19 nt, Homo sapiens
agagaaaccuccgguguga

SEQ ID NO: 415759 - RNA, 19 nt, Homo sapiens
ugagagaguuuaucauugg

SEQ ID NO: 415760 - RNA, 19 nt, Homo sapiens
caaggcacguuuggcauuu

SEQ ID NO: 415761 - RNA, 19 nt, Homo sapiens
cgugaaugcuuaccuguga

SEQ ID NO: 415762 - RNA, 19 nt, Homo sapiens
cgacaugguucucaacaag

SEQ ID NO: 415763 - RNA, 19 nt, Homo sapiens
gaagggaagugagaaacca

SEQ ID NO: 415764 - RNA, 19 nt, Homo sapiens
gcaccuacguccugaucga

SEQ ID NO: 415765 - RNA, 19 nt, Homo sapiens
gaacagccacagccacuca

SEQ ID NO: 415766 - RNA, 19 nt, Homo sapiens
caagagguccaucgucuga

SEQ ID NO: 415767 - RNA, 19 nt, Homo sapiens
gauggagcacggauucaua

SEQ ID NO: 415768 - RNA, 19 nt, Homo sapiens
gaggagaacgugcccaaga

SEQ ID NO: 415769 - RNA, 19 nt, Homo sapiens
gcaggacgacgaugauaga

SEQ ID NO: 415770 - RNA, 19 nt, Homo sapiens
gagacagcuuuccagauga

SEQ ID NO: 415771 - RNA, 19 nt, Homo sapiens
gaccagcagugaccuucaa

SEQ ID NO: 415772 - RNA, 19 nt, Homo sapiens
ugaccaggaugaucacaug

SEQ ID NO: 415773 - RNA, 19 nt, Homo sapiens
ucaacaagauggccaaagg

SEQ ID NO: 415774 - RNA, 19 nt, Homo sapiens
ggaagagugugcuugucau

SEQ ID NO: 415775 - RNA, 19 nt, Homo sapiens
gcagaaaaguaaacaagug

SEQ ID NO: 415776 - RNA, 19 nt, Homo sapiens
gcuccaaucucuaccacau

SEQ ID NO: 415777 - RNA, 19 nt, Homo sapiens
ccaggaugaucacauggaa

SEQ ID NO: 415778 - RNA, 19 nt, Homo sapiens
gccagaagguuccggcaau

SEQ ID NO: 415779 - RNA, 19 nt, Homo sapiens
cuacugagcggacagaaug

SEQ ID NO: 415780 - RNA, 19 nt, Homo sapiens
gauagaugguacucuccaa

SEQ ID NO: 415781 - RNA, 19 nt, Homo sapiens
uaggacaauucacuucauu

SEQ ID NO: 415782 - RNA, 19 nt, Homo sapiens
ccagacguauuccaaagau

SEQ ID NO: 415783 - RNA, 19 nt, Homo sapiens
gcgucuggauggaguguuu

SEQ ID NO: 415784 - RNA, 19 nt, Homo sapiens
ucuaacuccuuauguuuga

SEQ ID NO: 415785 - RNA, 19 nt, Homo sapiens
gaaggagcaguuugaguuc

SEQ ID NO: 415786 - RNA, 19 nt, Homo sapiens
gccaaaauauugcuuaugu

SEQ ID NO: 415787 - RNA, 19 nt, Homo sapiens
cagcauuccuccaucuuag

SEQ ID NO: 415788 - RNA, 19 nt, Homo sapiens
ccagaaauaggacaauuca

SEQ ID NO: 415789 - RNA, 19 nt, Homo sapiens
caagaaugcccaggccuuu

SEQ ID NO: 415790 - RNA, 19 nt, Homo sapiens
gagagcauccugaccuaug

SEQ ID NO: 415791 - RNA, 19 nt, Homo sapiens
acagaaugaugccaaaaua

SEQ ID NO: 415792 - RNA, 19 nt, Homo sapiens
uaaagcacccguucaccuu

SEQ ID NO: 415793 - RNA, 19 nt, Homo sapiens
ggccguucuuguccaauaa

SEQ ID NO: 415794 - RNA, 19 nt, Homo sapiens
ucacguggcaggaugacua

SEQ ID NO: 415795 - RNA, 19 nt, Homo sapiens
augcuuaccugugagauaa

SEQ ID NO: 415796 - RNA, 19 nt, Homo sapiens
agacgaaggagcaguuuga

SEQ ID NO: 415797 - RNA, 19 nt, Homo sapiens
cagcgacccuggagcacuu

SEQ ID NO: 415798 - RNA, 19 nt, Homo sapiens
gggagagucuggagaacag

SEQ ID NO: 415799 - RNA, 19 nt, Homo sapiens
ccacagcauuccuccaucu

SEQ ID NO: 415800 - RNA, 19 nt, Homo sapiens
caugaucugacuuuaauug

SEQ ID NO: 415801 - RNA, 19 nt, Homo sapiens
caggaugacuauacucagu

SEQ ID NO: 415802 - RNA, 19 nt, Homo sapiens
gucaagagccagacguauu

SEQ ID NO: 415803 - RNA, 19 nt, Homo sapiens
ugugugggcugcagauuuc

SEQ ID NO: 415804 - RNA, 19 nt, Homo sapiens
uaaagagagauuuguggaa

SEQ ID NO: 415805 - RNA, 19 nt, Homo sapiens
gauguugucaggaaucaug

SEQ ID NO: 415806 - RNA, 19 nt, Homo sapiens
gcacuugagggaccagaga

SEQ ID NO: 415807 - RNA, 19 nt, Homo sapiens
aggagaacgugcccaagaa

SEQ ID NO: 415808 - RNA, 19 nt, Homo sapiens
gcgacggccugcaauugga

SEQ ID NO: 415809 - RNA, 19 nt, Homo sapiens
ccaaaggugcuaaagagau

SEQ ID NO: 415810 - RNA, 19 nt, Homo sapiens
agaaccggcuggagaagga

SEQ ID NO: 415811 - RNA, 19 nt, Homo sapiens
ucaagagccagacguauuc

SEQ ID NO: 415812 - RNA, 19 nt, Homo sapiens
caaccaggaagaacaaauc

SEQ ID NO: 415813 - RNA, 19 nt, Homo sapiens
ccacaaccaggaagaacaa

SEQ ID NO: 415814 - RNA, 19 nt, Homo sapiens
agucuucccugucuucaga

SEQ ID NO: 415815 - RNA, 19 nt, Homo sapiens
uugagagaguuuaucauug

SEQ ID NO: 415816 - RNA, 19 nt, Homo sapiens
gcacacaaggcacguuugg

SEQ ID NO: 415817 - RNA, 19 nt, Homo sapiens
guucaucaauuuucacuug

SEQ ID NO: 415818 - RNA, 19 nt, Homo sapiens
ccagaagguuccggcaaug

SEQ ID NO: 415819 - RNA, 19 nt, Homo sapiens
ccgagagcauccugaccua

SEQ ID NO: 415820 - RNA, 19 nt, Homo sapiens
gugcuaaagagauugauau

SEQ ID NO: 415821 - RNA, 19 nt, Homo sapiens
ccgcacacgucacgcauca

SEQ ID NO: 415822 - RNA, 19 nt, Homo sapiens
ccucuggccucaucuacug

SEQ ID NO: 415823 - RNA, 19 nt, Homo sapiens
gagccagacguauuccaaa

SEQ ID NO: 415824 - RNA, 19 nt, Homo sapiens
ugauagacuuuaccaagag

SEQ ID NO: 415825 - RNA, 19 nt, Homo sapiens
ccuuauguuugaagagaaa

SEQ ID NO: 415826 - RNA, 19 nt, Homo sapiens
cuuaaugaaccacguguuu

SEQ ID NO: 415827 - RNA, 19 nt, Homo sapiens
gguugaaguuguguuaaca

SEQ ID NO: 415828 - RNA, 19 nt, Homo sapiens
acaagaaccggcuggagaa

SEQ ID NO: 415829 - RNA, 19 nt, Homo sapiens
gaacaaaucugggcauuga

SEQ ID NO: 415830 - RNA, 19 nt, Homo sapiens
gcagugaccuucaaaguga

SEQ ID NO: 415831 - RNA, 19 nt, Homo sapiens
ggagacagcuuuccagaug

SEQ ID NO: 415832 - RNA, 19 nt, Homo sapiens
ggaaaccucuggacugaaa

SEQ ID NO: 415833 - RNA, 19 nt, Homo sapiens
ggugugagauauacaaaua

SEQ ID NO: 415834 - RNA, 19 nt, Homo sapiens
ggaaucgguucaucaauuu

SEQ ID NO: 415835 - RNA, 19 nt, Homo sapiens
ccacgggucucgacucuua

SEQ ID NO: 415836 - RNA, 19 nt, Homo sapiens
gugaggagcuucuaucuga

SEQ ID NO: 415837 - RNA, 19 nt, Homo sapiens
gggaaucgguucaucaauu

SEQ ID NO: 415838 - RNA, 19 nt, Homo sapiens
caaaggugcuaaagagauu

SEQ ID NO: 415839 - RNA, 19 nt, Homo sapiens
ggacgacgaugauagacuu

SEQ ID NO: 415840 - RNA, 19 nt, Homo sapiens
gaugaaggcuccaaucucu

SEQ ID NO: 415841 - RNA, 19 nt, Homo sapiens
ggagagggcugcgagcauu

SEQ ID NO: 415842 - RNA, 19 nt, Homo sapiens
gaucugacuuuaauugugu

SEQ ID NO: 415843 - RNA, 19 nt, Homo sapiens
cagaugagcucagcccuaa

SEQ ID NO: 415844 - RNA, 19 nt, Homo sapiens
aaagagagauuuguggaaa

SEQ ID NO: 415845 - RNA, 19 nt, Homo sapiens
caagaagacuccaccaagu

SEQ ID NO: 415846 - RNA, 19 nt, Homo sapiens
ccacggauguugucaggaa

SEQ ID NO: 415847 - RNA, 19 nt, Homo sapiens
ugaagaaccugcagaccaa

SEQ ID NO: 415848 - RNA, 19 nt, Homo sapiens
gcugauggcuggccugaug

SEQ ID NO: 415849 - RNA, 19 nt, Homo sapiens
ggaaucaugaucugacuuu

SEQ ID NO: 415850 - RNA, 19 nt, Homo sapiens
gaaauaggacaauucacuu

SEQ ID NO: 415851 - RNA, 19 nt, Homo sapiens
guagagaugauucggauuu

SEQ ID NO: 415852 - RNA, 19 nt, Homo sapiens
gaaucaugaucugacuuua

SEQ ID NO: 415853 - RNA, 19 nt, Homo sapiens
cgaaggagcaguuugaguu

SEQ ID NO: 415854 - RNA, 19 nt, Homo sapiens
ggccaaaggugcuaaagag

SEQ ID NO: 415855 - RNA, 19 nt, Homo sapiens
ggacagugguguggacaga

SEQ ID NO: 415856 - RNA, 19 nt, Homo sapiens
cagcgcaguuuagcaguua

SEQ ID NO: 415857 - RNA, 19 nt, Homo sapiens
ugugaacgauggaguguuu

SEQ ID NO: 415858 - RNA, 19 nt, Homo sapiens
gggccguucuuguccaaua

SEQ ID NO: 415859 - RNA, 19 nt, Homo sapiens
agagaaaccuccgguguga

SEQ ID NO: 415860 - RNA, 19 nt, Homo sapiens
ugagagaguuuaucauugg

SEQ ID NO: 415861 - RNA, 19 nt, Homo sapiens
caaggcacguuuggcauuu

SEQ ID NO: 415862 - RNA, 19 nt, Homo sapiens
cgugaaugcuuaccuguga

SEQ ID NO: 415863 - RNA, 19 nt, Homo sapiens
cgacaugguucucaacaag

SEQ ID NO: 415864 - RNA, 19 nt, Homo sapiens
gaagggaagugagaaacca

SEQ ID NO: 415865 - RNA, 19 nt, Homo sapiens
gcaccuacguccugaucga

SEQ ID NO: 415866 - RNA, 19 nt, Homo sapiens
gaacagccacagccacuca

SEQ ID NO: 415867 - RNA, 19 nt, Homo sapiens
caagagguccaucgucuga

SEQ ID NO: 415868 - RNA, 19 nt, Homo sapiens
gauggagcacggauucaua

SEQ ID NO: 415869 - RNA, 19 nt, Homo sapiens
gaggagaacgugcccaaga

SEQ ID NO: 415870 - RNA, 19 nt, Homo sapiens
gcaggacgacgaugauaga

SEQ ID NO: 415871 - RNA, 19 nt, Homo sapiens
gagacagcuuuccagauga

SEQ ID NO: 415872 - RNA, 19 nt, Homo sapiens
gaccagcagugaccuucaa

SEQ ID NO: 415873 - RNA, 19 nt, Homo sapiens
ugaccaggaugaucacaug

SEQ ID NO: 415874 - RNA, 19 nt, Homo sapiens
ucaacaagauggccaaagg

SEQ ID NO: 415875 - RNA, 19 nt, Homo sapiens
ggaagagugugcuugucau

SEQ ID NO: 415876 - RNA, 19 nt, Homo sapiens
gcagaaaaguaaacaagug

SEQ ID NO: 415877 - RNA, 19 nt, Homo sapiens
gcuccaaucucuaccacau

SEQ ID NO: 415878 - RNA, 19 nt, Homo sapiens
ccaggaugaucacauggaa

SEQ ID NO: 415879 - RNA, 19 nt, Homo sapiens
gccagaagguuccggcaau

SEQ ID NO: 415880 - RNA, 19 nt, Homo sapiens
cuacugagcggacagaaug

SEQ ID NO: 415881 - RNA, 19 nt, Homo sapiens
gauagaugguacucuccaa

SEQ ID NO: 415882 - RNA, 19 nt, Homo sapiens
uaggacaauucacuucauu

SEQ ID NO: 415883 - RNA, 19 nt, Homo sapiens
ccagacguauuccaaagau

SEQ ID NO: 415884 - RNA, 19 nt, Homo sapiens
ucuaacuccuuauguuuga

SEQ ID NO: 415885 - RNA, 19 nt, Homo sapiens
gaaggagcaguuugaguuc

SEQ ID NO: 415886 - RNA, 19 nt, Homo sapiens
gccaaaauauugcuuaugu

SEQ ID NO: 415887 - RNA, 19 nt, Homo sapiens
cagcauuccuccaucuuag

SEQ ID NO: 415888 - RNA, 19 nt, Homo sapiens
ccagaaauaggacaauuca

SEQ ID NO: 415889 - RNA, 19 nt, Homo sapiens
cggcauggcugagcugaug

SEQ ID NO: 415890 - RNA, 19 nt, Homo sapiens
caagaaugcccaggccuuu

SEQ ID NO: 415891 - RNA, 19 nt, Homo sapiens
gagagcauccugaccuaug

SEQ ID NO: 415892 - RNA, 19 nt, Homo sapiens
acagaaugaugccaaaaua

SEQ ID NO: 415893 - RNA, 19 nt, Homo sapiens
uaaagcacccguucaccuu

SEQ ID NO: 415894 - RNA, 19 nt, Homo sapiens
ucacguggcaggaugacua

SEQ ID NO: 415895 - RNA, 19 nt, Homo sapiens
ggccguucuuguccaauaa

SEQ ID NO: 415896 - RNA, 19 nt, Homo sapiens
augcuuaccugugagauaa

SEQ ID NO: 415897 - RNA, 19 nt, Homo sapiens
agacgaaggagcaguuuga

SEQ ID NO: 415898 - RNA, 19 nt, Homo sapiens
cagcgacccuggagcacuu

SEQ ID NO: 415899 - RNA, 19 nt, Homo sapiens
gggagagucuggagaacag

SEQ ID NO: 415900 - RNA, 19 nt, Homo sapiens
caggaugacuauacucagu

SEQ ID NO: 415901 - RNA, 19 nt, Homo sapiens
ccacagcauuccuccaucu

SEQ ID NO: 415902 - RNA, 19 nt, Homo sapiens
caugaucugacuuuaauug

SEQ ID NO: 415903 - RNA, 19 nt, Homo sapiens
gucaagagccagacguauu

SEQ ID NO: 415904 - RNA, 19 nt, Homo sapiens
ugugugggcugcagauuuc

SEQ ID NO: 415905 - RNA, 19 nt, Homo sapiens
uaaagagagauuuguggaa

SEQ ID NO: 415906 - RNA, 19 nt, Homo sapiens
gauguugucaggaaucaug

SEQ ID NO: 415907 - RNA, 19 nt, Homo sapiens
gcacuugagggaccagaga

SEQ ID NO: 415908 - RNA, 19 nt, Homo sapiens
aggagaacgugcccaagaa

SEQ ID NO: 415909 - RNA, 19 nt, Homo sapiens
gcgacggccugcaauugga

SEQ ID NO: 415910 - RNA, 19 nt, Homo sapiens
ccaaaggugcuaaagagau

SEQ ID NO: 415911 - RNA, 19 nt, Homo sapiens
agaaccggcuggagaagga

SEQ ID NO: 415912 - RNA, 19 nt, Homo sapiens
ucaagagccagacguauuc

SEQ ID NO: 415913 - RNA, 19 nt, Homo sapiens
caaccaggaagaacaaauc

SEQ ID NO: 415914 - RNA, 19 nt, Homo sapiens
ccacaaccaggaagaacaa

SEQ ID NO: 415915 - RNA, 19 nt, Homo sapiens
agucuucccugucuucaga

SEQ ID NO: 415916 - RNA, 19 nt, Homo sapiens
uugagagaguuuaucauug

SEQ ID NO: 415917 - RNA, 19 nt, Homo sapiens
gcacacaaggcacguuugg

SEQ ID NO: 415918 - RNA, 19 nt, Homo sapiens
guucaucaauuuucacuug

SEQ ID NO: 415919 - RNA, 19 nt, Homo sapiens
ccagaagguuccggcaaug

SEQ ID NO: 415920 - RNA, 19 nt, Homo sapiens
gugcuaaagagauugauau

SEQ ID NO: 415921 - RNA, 19 nt, Homo sapiens
ccgagagcauccugaccua

SEQ ID NO: 415922 - RNA, 19 nt, Homo sapiens
ccgcacacgucacgcauca

SEQ ID NO: 415923 - RNA, 19 nt, Homo sapiens
ccucuggccucaucuacug

SEQ ID NO: 415924 - RNA, 19 nt, Homo sapiens
gagccagacguauuccaaa

SEQ ID NO: 415925 - RNA, 19 nt, Homo sapiens
ugauagacuuuaccaagag

SEQ ID NO: 415926 - RNA, 19 nt, Homo sapiens
ccuuauguuugaagagaaa

SEQ ID NO: 415927 - RNA, 19 nt, Homo sapiens
cuuaaugaaccacguguuu

SEQ ID NO: 415928 - RNA, 19 nt, Homo sapiens
gguugaaguuguguuaaca

SEQ ID NO: 415929 - RNA, 19 nt, Homo sapiens
ccaaagagcugggaauuua

SEQ ID NO: 415930 - RNA, 19 nt, Homo sapiens
gaagagaacuuuacugaau

SEQ ID NO: 415931 - RNA, 19 nt, Homo sapiens
gggaguagcugauuucuuu

SEQ ID NO: 415932 - RNA, 19 nt, Homo sapiens
uaacaucguugucucauua

SEQ ID NO: 415933 - RNA, 19 nt, Homo sapiens
ggaaaucacuucuguggaa

SEQ ID NO: 415934 - RNA, 19 nt, Homo sapiens
ggacaaugcuauauaaaga

SEQ ID NO: 415935 - RNA, 19 nt, Homo sapiens
gaucaacuguguaaucuuu

SEQ ID NO: 415936 - RNA, 19 nt, Homo sapiens
caaagacucugacuauaaa

SEQ ID NO: 415937 - RNA, 19 nt, Homo sapiens
gaaggaaccugggaaauau

SEQ ID NO: 415938 - RNA, 19 nt, Homo sapiens
caacaaaagucucagauua

SEQ ID NO: 415939 - RNA, 19 nt, Homo sapiens
gaaaguauccugcaguuug

SEQ ID NO: 415940 - RNA, 19 nt, Homo sapiens
gaagauaacuggugaaucc

SEQ ID NO: 415941 - RNA, 19 nt, Homo sapiens
gaauugagcugcugugaca

SEQ ID NO: 415942 - RNA, 19 nt, Homo sapiens
ccaggaauguguuauagua

SEQ ID NO: 415943 - RNA, 19 nt, Homo sapiens
ugaagaagcacaugaauuu

SEQ ID NO: 415944 - RNA, 19 nt, Homo sapiens
caacugauguggaugaaga

SEQ ID NO: 415945 - RNA, 19 nt, Homo sapiens
gagcaaaggucccaugauc

SEQ ID NO: 415946 - RNA, 19 nt, Homo sapiens
acacaaacauccuaccaua

SEQ ID NO: 415947 - RNA, 19 nt, Homo sapiens
ucaaaugucucuauggauu

SEQ ID NO: 415948 - RNA, 19 nt, Homo sapiens
ugugagagcuauuucuuua

SEQ ID NO: 415949 - RNA, 19 nt, Homo sapiens
ucacuucuguggaauauuu

SEQ ID NO: 415950 - RNA, 19 nt, Homo sapiens
caaguuggcuccagucaga

SEQ ID NO: 415951 - RNA, 19 nt, Homo sapiens
gagaagagaacuuuacuga

SEQ ID NO: 415952 - RNA, 19 nt, Homo sapiens
ccaacuauauuccuggaua

SEQ ID NO: 415953 - RNA, 19 nt, Homo sapiens
ccacaggaauaaaggauuu

SEQ ID NO: 415954 - RNA, 19 nt, Homo sapiens
caacuaugcugacgagaug

SEQ ID NO: 415955 - RNA, 19 nt, Homo sapiens
ccaaagacucugacuauaa

SEQ ID NO: 415956 - RNA, 19 nt, Homo sapiens
gaaaauacgugguugaaau

SEQ ID NO: 415957 - RNA, 19 nt, Homo sapiens
uaaccaguguuuccauaua

SEQ ID NO: 415958 - RNA, 19 nt, Homo sapiens
uaucuguacuccaacauua

SEQ ID NO: 415959 - RNA, 19 nt, Homo sapiens
gaaauagcagcaacuguuu

SEQ ID NO: 415960 - RNA, 19 nt, Homo sapiens
aaaguacccuuguugagua

SEQ ID NO: 415961 - RNA, 19 nt, Homo sapiens
uaacgaguguaacuaguaa

SEQ ID NO: 415962 - RNA, 19 nt, Homo sapiens
gaguguaacuaguaacauu

SEQ ID NO: 415963 - RNA, 19 nt, Homo sapiens
cagaggcccugcuuuguaa

SEQ ID NO: 415964 - RNA, 19 nt, Homo sapiens
guguggagcugguacauuu

SEQ ID NO: 415965 - RNA, 19 nt, Homo sapiens
gcacucaggugaacucaag

SEQ ID NO: 415966 - RNA, 19 nt, Homo sapiens
aauaagaggugaugacaug

SEQ ID NO: 415967 - RNA, 19 nt, Homo sapiens
ggagaugauuucagaggaa

SEQ ID NO: 415968 - RNA, 19 nt, Homo sapiens
gaaauugauuggacuggau

SEQ ID NO: 415969 - RNA, 19 nt, Homo sapiens
gguaaagacuuccggacaa

SEQ ID NO: 415970 - RNA, 19 nt, Homo sapiens
gaacucuguugcugucuga

SEQ ID NO: 415971 - RNA, 19 nt, Homo sapiens
uaauucagcuucaaaguag

SEQ ID NO: 415972 - RNA, 19 nt, Homo sapiens
caacaaugguuacagagau

SEQ ID NO: 415973 - RNA, 19 nt, Homo sapiens
gaacgagaagagaacuuua

SEQ ID NO: 415974 - RNA, 19 nt, Homo sapiens
gaaauucccucgggcaaca

SEQ ID NO: 415975 - RNA, 19 nt, Homo sapiens
caagcaaaccuauuauuga

SEQ ID NO: 415976 - RNA, 19 nt, Homo sapiens
aaaggagggugaaauguga

SEQ ID NO: 415977 - RNA, 19 nt, Homo sapiens
caaacauccuaccauauga

SEQ ID NO: 415978 - RNA, 19 nt, Homo sapiens
ugaaggaaccugggaaaua

SEQ ID NO: 415979 - RNA, 19 nt, Homo sapiens
gcacagaacugccccuuau

SEQ ID NO: 415980 - RNA, 19 nt, Homo sapiens
gauaacuggugaauccaaa

SEQ ID NO: 415981 - RNA, 19 nt, Homo sapiens
cuacaucaaugccaacuau

SEQ ID NO: 415982 - RNA, 19 nt, Homo sapiens
gggaagacuuagccuuaaa

SEQ ID NO: 415983 - RNA, 19 nt, Homo sapiens
gccaaagacucugacuaua

SEQ ID NO: 415984 - RNA, 19 nt, Homo sapiens
uuaaggauauggccaaaga

SEQ ID NO: 415985 - RNA, 19 nt, Homo sapiens
ugacuuugaugccuauauu

SEQ ID NO: 415986 - RNA, 19 nt, Homo sapiens
gcugauuucuuugaaguuu

SEQ ID NO: 415987 - RNA, 19 nt, Homo sapiens
ucagaagagugucaaguug

SEQ ID NO: 415988 - RNA, 19 nt, Homo sapiens
gaccaccuacuaugaaaua

SEQ ID NO: 415989 - RNA, 19 nt, Homo sapiens
gagaucacaagauacaaua

SEQ ID NO: 415990 - RNA, 19 nt, Homo sapiens
gcugggaauuuaugaaguu

SEQ ID NO: 415991 - RNA, 19 nt, Homo sapiens
ccauguaacuguccaagau

SEQ ID NO: 415992 - RNA, 19 nt, Homo sapiens
gagcagagaggacaugaug

SEQ ID NO: 415993 - RNA, 19 nt, Homo sapiens
ggucauaccggaugucuau

SEQ ID NO: 415994 - RNA, 19 nt, Homo sapiens
caagaaugcuacagcuuuc

SEQ ID NO: 415995 - RNA, 19 nt, Homo sapiens
gcagauggcuagggagugu

SEQ ID NO: 415996 - RNA, 19 nt, Homo sapiens
ugaaauagcagcaacuguu

SEQ ID NO: 415997 - RNA, 19 nt, Homo sapiens
gaaaauaacaguacacuca

SEQ ID NO: 415998 - RNA, 19 nt, Homo sapiens
gaaaacacuuugaguugaa

SEQ ID NO: 415999 - RNA, 19 nt, Homo sapiens
gggaauuuaugaaguuaug

SEQ ID NO: 416000 - RNA, 19 nt, Homo sapiens
ggccacacaugaagaaaug

SEQ ID NO: 416001 - RNA, 19 nt, Homo sapiens
cagaaaguauccugcaguu

SEQ ID NO: 416002 - RNA, 19 nt, Homo sapiens
ggaagaugguccugcaaca

SEQ ID NO: 416003 - RNA, 19 nt, Homo sapiens
ucaagacgcucuccaaagg

SEQ ID NO: 416004 - RNA, 19 nt, Homo sapiens
aaacagaggcccugcuuug

SEQ ID NO: 416005 - RNA, 19 nt, Homo sapiens
gaccauuacuggccauuca

SEQ ID NO: 416006 - RNA, 19 nt, Homo sapiens
cgacaucuauaaccucuca

SEQ ID NO: 416007 - RNA, 19 nt, Homo sapiens
cuauaaaccuucuccugaa

SEQ ID NO: 416008 - RNA, 19 nt, Homo sapiens
gaagcaccgggaagacuua

SEQ ID NO: 416009 - RNA, 19 nt, Homo sapiens
gaacucaagcaaaccuauu

SEQ ID NO: 416010 - RNA, 19 nt, Homo sapiens
uucaugagaucacaagaua

SEQ ID NO: 416011 - RNA, 19 nt, Homo sapiens
ggccaaagacucugacuau

SEQ ID NO: 416012 - RNA, 19 nt, Homo sapiens
guaacugcuuguacugaaa

SEQ ID NO: 416013 - RNA, 19 nt, Homo sapiens
auacgugguugaaauguuu

SEQ ID NO: 416014 - RNA, 19 nt, Homo sapiens
gagaguggauugaagaacu

SEQ ID NO: 416015 - RNA, 19 nt, Homo sapiens
gaugguggaugaagaagca

SEQ ID NO: 416016 - RNA, 19 nt, Homo sapiens
guaaagacuuccggacaau

SEQ ID NO: 416017 - RNA, 19 nt, Homo sapiens
uauaaaccuucuccugaaa

SEQ ID NO: 416018 - RNA, 19 nt, Homo sapiens
guuaucauggccuuuauua

SEQ ID NO: 416019 - RNA, 19 nt, Homo sapiens
uaauguuacuguccaaguu

SEQ ID NO: 416020 - RNA, 19 nt, Homo sapiens
gaguuuaguuggcccuuug

SEQ ID NO: 416021 - RNA, 19 nt, Homo sapiens
uguaauauguggccaagga

SEQ ID NO: 416022 - RNA, 19 nt, Homo sapiens
ugauguggaugaagaagaa

SEQ ID NO: 416023 - RNA, 19 nt, Homo sapiens
gcaaaggucccaugaucau

SEQ ID NO: 416024 - RNA, 19 nt, Homo sapiens
gcugguacauuugucaauu

SEQ ID NO: 416025 - RNA, 19 nt, Homo sapiens
guucauagccgucucaaca

SEQ ID NO: 416026 - RNA, 19 nt, Homo sapiens
gaagagggaguagcugauu

SEQ ID NO: 416027 - RNA, 19 nt, Homo sapiens
ucaagaaugcuacagcuuu

SEQ ID NO: 416028 - RNA, 19 nt, Homo sapiens
gaacuacaacagcaccauu

SEQ ID NO: 416029 - RNA, 19 nt, Homo sapiens
ccaaagagcugggaauuua

SEQ ID NO: 416030 - RNA, 19 nt, Homo sapiens
gaagagaacuuuacugaau

SEQ ID NO: 416031 - RNA, 19 nt, Homo sapiens
gggaguagcugauuucuuu

SEQ ID NO: 416032 - RNA, 19 nt, Homo sapiens
uaacaucguugucucauua

SEQ ID NO: 416033 - RNA, 19 nt, Homo sapiens
ggaaaucacuucuguggaa

SEQ ID NO: 416034 - RNA, 19 nt, Homo sapiens
ggacaaugcuauauaaaga

SEQ ID NO: 416035 - RNA, 19 nt, Homo sapiens
gaucaacuguguaaucuuu

SEQ ID NO: 416036 - RNA, 19 nt, Homo sapiens
caaagacucugacuauaaa

SEQ ID NO: 416037 - RNA, 19 nt, Homo sapiens
gaaggaaccugggaaauau

SEQ ID NO: 416038 - RNA, 19 nt, Homo sapiens
caacaaaagucucagauua

SEQ ID NO: 416039 - RNA, 19 nt, Homo sapiens
gaaaguauccugcaguuug

SEQ ID NO: 416040 - RNA, 19 nt, Homo sapiens
gaagauaacuggugaaucc

SEQ ID NO: 416041 - RNA, 19 nt, Homo sapiens
gaauugagcugcugugaca

SEQ ID NO: 416042 - RNA, 19 nt, Homo sapiens
ccaggaauguguuauagua

SEQ ID NO: 416043 - RNA, 19 nt, Homo sapiens
ugaagaagcacaugaauuu

SEQ ID NO: 416044 - RNA, 19 nt, Homo sapiens
caacugauguggaugaaga

SEQ ID NO: 416045 - RNA, 19 nt, Homo sapiens
gagcaaaggucccaugauc

SEQ ID NO: 416046 - RNA, 19 nt, Homo sapiens
acacaaacauccuaccaua

SEQ ID NO: 416047 - RNA, 19 nt, Homo sapiens
ucaaaugucucuauggauu

SEQ ID NO: 416048 - RNA, 19 nt, Homo sapiens
ugugagagcuauuucuuua

SEQ ID NO: 416049 - RNA, 19 nt, Homo sapiens
ucacuucuguggaauauuu

SEQ ID NO: 416050 - RNA, 19 nt, Homo sapiens
caaguuggcuccagucaga

SEQ ID NO: 416051 - RNA, 19 nt, Homo sapiens
gagaagagaacuuuacuga

SEQ ID NO: 416052 - RNA, 19 nt, Homo sapiens
ccaacuauauuccuggaua

SEQ ID NO: 416053 - RNA, 19 nt, Homo sapiens
ccacaggaauaaaggauuu

SEQ ID NO: 416054 - RNA, 19 nt, Homo sapiens
caacuaugcugacgagaug

SEQ ID NO: 416055 - RNA, 19 nt, Homo sapiens
ccaaagacucugacuauaa

SEQ ID NO: 416056 - RNA, 19 nt, Homo sapiens
gaaaauacgugguugaaau

SEQ ID NO: 416057 - RNA, 19 nt, Homo sapiens
uaaccaguguuuccauaua

SEQ ID NO: 416058 - RNA, 19 nt, Homo sapiens
uaucuguacuccaacauua

SEQ ID NO: 416059 - RNA, 19 nt, Homo sapiens
gaaauagcagcaacuguuu

SEQ ID NO: 416060 - RNA, 19 nt, Homo sapiens
aaaguacccuuguugagua

SEQ ID NO: 416061 - RNA, 19 nt, Homo sapiens
uaacgaguguaacuaguaa

SEQ ID NO: 416062 - RNA, 19 nt, Homo sapiens
gaguguaacuaguaacauu

SEQ ID NO: 416063 - RNA, 19 nt, Homo sapiens
cagaggcccugcuuuguaa

SEQ ID NO: 416064 - RNA, 19 nt, Homo sapiens
guguggagcugguacauuu

SEQ ID NO: 416065 - RNA, 19 nt, Homo sapiens
gcacucaggugaacucaag

SEQ ID NO: 416066 - RNA, 19 nt, Homo sapiens
aauaagaggugaugacaug

SEQ ID NO: 416067 - RNA, 19 nt, Homo sapiens
ggagaugauuucagaggaa

SEQ ID NO: 416068 - RNA, 19 nt, Homo sapiens
gaaauugauuggacuggau

SEQ ID NO: 416069 - RNA, 19 nt, Homo sapiens
gguaaagacuuccggacaa

SEQ ID NO: 416070 - RNA, 19 nt, Homo sapiens
gaacucuguugcugucuga

SEQ ID NO: 416071 - RNA, 19 nt, Homo sapiens
uaauucagcuucaaaguag

SEQ ID NO: 416072 - RNA, 19 nt, Homo sapiens
caacaaugguuacagagau

SEQ ID NO: 416073 - RNA, 19 nt, Homo sapiens
gaacgagaagagaacuuua

SEQ ID NO: 416074 - RNA, 19 nt, Homo sapiens
gaaauucccucgggcaaca

SEQ ID NO: 416075 - RNA, 19 nt, Homo sapiens
caagcaaaccuauuauuga

SEQ ID NO: 416076 - RNA, 19 nt, Homo sapiens
aaaggagggugaaauguga

SEQ ID NO: 416077 - RNA, 19 nt, Homo sapiens
caaacauccuaccauauga

SEQ ID NO: 416078 - RNA, 19 nt, Homo sapiens
ugaaggaaccugggaaaua

SEQ ID NO: 416079 - RNA, 19 nt, Homo sapiens
gcacagaacugccccuuau

SEQ ID NO: 416080 - RNA, 19 nt, Homo sapiens
gauaacuggugaauccaaa

SEQ ID NO: 416081 - RNA, 19 nt, Homo sapiens
cuacaucaaugccaacuau

SEQ ID NO: 416082 - RNA, 19 nt, Homo sapiens
gggaagacuuagccuuaaa

SEQ ID NO: 416083 - RNA, 19 nt, Homo sapiens
gccaaagacucugacuaua

SEQ ID NO: 416084 - RNA, 19 nt, Homo sapiens
uuaaggauauggccaaaga

SEQ ID NO: 416085 - RNA, 19 nt, Homo sapiens
ugacuuugaugccuauauu

SEQ ID NO: 416086 - RNA, 19 nt, Homo sapiens
gcugauuucuuugaaguuu

SEQ ID NO: 416087 - RNA, 19 nt, Homo sapiens
ucagaagagugucaaguug

SEQ ID NO: 416088 - RNA, 19 nt, Homo sapiens
gaccaccuacuaugaaaua

SEQ ID NO: 416089 - RNA, 19 nt, Homo sapiens
gagaucacaagauacaaua

SEQ ID NO: 416090 - RNA, 19 nt, Homo sapiens
gcugggaauuuaugaaguu

SEQ ID NO: 416091 - RNA, 19 nt, Homo sapiens
ccauguaacuguccaagau

SEQ ID NO: 416092 - RNA, 19 nt, Homo sapiens
gagcagagaggacaugaug

SEQ ID NO: 416093 - RNA, 19 nt, Homo sapiens
ggucauaccggaugucuau

SEQ ID NO: 416094 - RNA, 19 nt, Homo sapiens
caagaaugcuacagcuuuc

SEQ ID NO: 416095 - RNA, 19 nt, Homo sapiens
guaggaguauauuugcuuu

SEQ ID NO: 416096 - RNA, 19 nt, Homo sapiens
gcagauggcuagggagugu

SEQ ID NO: 416097 - RNA, 19 nt, Homo sapiens
ugaaauagcagcaacuguu

SEQ ID NO: 416098 - RNA, 19 nt, Homo sapiens
gaaaauaacaguacacuca

SEQ ID NO: 416099 - RNA, 19 nt, Homo sapiens
gaaaacacuuugaguugaa

SEQ ID NO: 416100 - RNA, 19 nt, Homo sapiens
gggaauuuaugaaguuaug

SEQ ID NO: 416101 - RNA, 19 nt, Homo sapiens
ggccacacaugaagaaaug

SEQ ID NO: 416102 - RNA, 19 nt, Homo sapiens
cagaaaguauccugcaguu

SEQ ID NO: 416103 - RNA, 19 nt, Homo sapiens
ggaagaugguccugcaaca

SEQ ID NO: 416104 - RNA, 19 nt, Homo sapiens
ucaagacgcucuccaaagg

SEQ ID NO: 416105 - RNA, 19 nt, Homo sapiens
aaacagaggcccugcuuug

SEQ ID NO: 416106 - RNA, 19 nt, Homo sapiens
gaccauuacuggccauuca

SEQ ID NO: 416107 - RNA, 19 nt, Homo sapiens
cgacaucuauaaccucuca

SEQ ID NO: 416108 - RNA, 19 nt, Homo sapiens
cuauaaaccuucuccugaa

SEQ ID NO: 416109 - RNA, 19 nt, Homo sapiens
gaagcaccgggaagacuua

SEQ ID NO: 416110 - RNA, 19 nt, Homo sapiens
ccauacaacuggcguagga

SEQ ID NO: 416111 - RNA, 19 nt, Homo sapiens
gaacucaagcaaaccuauu

SEQ ID NO: 416112 - RNA, 19 nt, Homo sapiens
uucaugagaucacaagaua

SEQ ID NO: 416113 - RNA, 19 nt, Homo sapiens
ggccaaagacucugacuau

SEQ ID NO: 416114 - RNA, 19 nt, Homo sapiens
guaacugcuuguacugaaa

SEQ ID NO: 416115 - RNA, 19 nt, Homo sapiens
auacgugguugaaauguuu

SEQ ID NO: 416116 - RNA, 19 nt, Homo sapiens
gagaguggauugaagaacu

SEQ ID NO: 416117 - RNA, 19 nt, Homo sapiens
gaugguggaugaagaagca

SEQ ID NO: 416118 - RNA, 19 nt, Homo sapiens
guaaagacuuccggacaau

SEQ ID NO: 416119 - RNA, 19 nt, Homo sapiens
uauaaaccuucuccugaaa

SEQ ID NO: 416120 - RNA, 19 nt, Homo sapiens
guuaucauggccuuuauua

SEQ ID NO: 416121 - RNA, 19 nt, Homo sapiens
uaauguuacuguccaaguu

SEQ ID NO: 416122 - RNA, 19 nt, Homo sapiens
gaguuuaguuggcccuuug

SEQ ID NO: 416123 - RNA, 19 nt, Homo sapiens
uguaauauguggccaagga

SEQ ID NO: 416124 - RNA, 19 nt, Homo sapiens
ugauguggaugaagaagaa

SEQ ID NO: 416125 - RNA, 19 nt, Homo sapiens
gcaaaggucccaugaucau

SEQ ID NO: 416126 - RNA, 19 nt, Homo sapiens
gcugguacauuugucaauu

SEQ ID NO: 416127 - RNA, 19 nt, Homo sapiens
guucauagccgucucaaca

SEQ ID NO: 416128 - RNA, 19 nt, Homo sapiens
gaagagggaguagcugauu

SEQ ID NO: 416129 - RNA, 19 nt, Homo sapiens
ccaaagagcugggaauuua

SEQ ID NO: 416130 - RNA, 19 nt, Homo sapiens
gggaguagcugauuucuuu

SEQ ID NO: 416131 - RNA, 19 nt, Homo sapiens
gaucaacuguguaaucuuu

SEQ ID NO: 416132 - RNA, 19 nt, Homo sapiens
caaagacucugacuauaaa

SEQ ID NO: 416133 - RNA, 19 nt, Homo sapiens
caacaaaagucucagauua

SEQ ID NO: 416134 - RNA, 19 nt, Homo sapiens
gaaaguauccugcaguuug

SEQ ID NO: 416135 - RNA, 19 nt, Homo sapiens
caacugauguggaugaaga

SEQ ID NO: 416136 - RNA, 19 nt, Homo sapiens
gagcaaaggucccaugauc

SEQ ID NO: 416137 - RNA, 19 nt, Homo sapiens
acacaaacauccuaccaua

SEQ ID NO: 416138 - RNA, 19 nt, Homo sapiens
ucaaaugucucuauggauu

SEQ ID NO: 416139 - RNA, 19 nt, Homo sapiens
ugugagagcuauuucuuua

SEQ ID NO: 416140 - RNA, 19 nt, Homo sapiens
gcucuuaccuaccuauauu

SEQ ID NO: 416141 - RNA, 19 nt, Homo sapiens
caaguuggcuccagucaga

SEQ ID NO: 416142 - RNA, 19 nt, Homo sapiens
ccaacuauauuccuggaua

SEQ ID NO: 416143 - RNA, 19 nt, Homo sapiens
caacuaugcugacgagaug

SEQ ID NO: 416144 - RNA, 19 nt, Homo sapiens
ccaaagacucugacuauaa

SEQ ID NO: 416145 - RNA, 19 nt, Homo sapiens
uaucuguacuccaacauua

SEQ ID NO: 416146 - RNA, 19 nt, Homo sapiens
uaacgaguguaacuaguaa

SEQ ID NO: 416147 - RNA, 19 nt, Homo sapiens
gaguguaacuaguaacauu

SEQ ID NO: 416148 - RNA, 19 nt, Homo sapiens
gaagaaagaauacacuuag

SEQ ID NO: 416149 - RNA, 19 nt, Homo sapiens
cagaggcccugcuuuguaa

SEQ ID NO: 416150 - RNA, 19 nt, Homo sapiens
guguggagcugguacauuu

SEQ ID NO: 416151 - RNA, 19 nt, Homo sapiens
aauaagaggugaugacaug

SEQ ID NO: 416152 - RNA, 19 nt, Homo sapiens
ggagaugauuucagaggaa

SEQ ID NO: 416153 - RNA, 19 nt, Homo sapiens
gaaauugauuggacuggau

SEQ ID NO: 416154 - RNA, 19 nt, Homo sapiens
gaacucuguugcugucuga

SEQ ID NO: 416155 - RNA, 19 nt, Homo sapiens
uaauucagcuucaaaguag

SEQ ID NO: 416156 - RNA, 19 nt, Homo sapiens
caacaaugguuacagagau

SEQ ID NO: 416157 - RNA, 19 nt, Homo sapiens
aaaggagggugaaauguga

SEQ ID NO: 416158 - RNA, 19 nt, Homo sapiens
caaacauccuaccauauga

SEQ ID NO: 416159 - RNA, 19 nt, Homo sapiens
cuacaucaaugccaacuau

SEQ ID NO: 416160 - RNA, 19 nt, Homo sapiens
gggaagacuuagccuuaaa

SEQ ID NO: 416161 - RNA, 19 nt, Homo sapiens
gccaaagacucugacuaua

SEQ ID NO: 416162 - RNA, 19 nt, Homo sapiens
uuaaggauauggccaaaga

SEQ ID NO: 416163 - RNA, 19 nt, Homo sapiens
ugacuuugaugccuauauu

SEQ ID NO: 416164 - RNA, 19 nt, Homo sapiens
gcugauuucuuugaaguuu

SEQ ID NO: 416165 - RNA, 19 nt, Homo sapiens
ucagaagagugucaaguug

SEQ ID NO: 416166 - RNA, 19 nt, Homo sapiens
gcugggaauuuaugaaguu

SEQ ID NO: 416167 - RNA, 19 nt, Homo sapiens
gagcagagaggacaugaug

SEQ ID NO: 416168 - RNA, 19 nt, Homo sapiens
ggucauaccggaugucuau

SEQ ID NO: 416169 - RNA, 19 nt, Homo sapiens
gcagauggcuagggagugu

SEQ ID NO: 416170 - RNA, 19 nt, Homo sapiens
gaaaacacuuugaguugaa

SEQ ID NO: 416171 - RNA, 19 nt, Homo sapiens
gggaauuuaugaaguuaug

SEQ ID NO: 416172 - RNA, 19 nt, Homo sapiens
ggccacacaugaagaaaug

SEQ ID NO: 416173 - RNA, 19 nt, Homo sapiens
cagaaaguauccugcaguu

SEQ ID NO: 416174 - RNA, 19 nt, Homo sapiens
ggaagaugguccugcaaca

SEQ ID NO: 416175 - RNA, 19 nt, Homo sapiens
ucaagacgcucuccaaagg

SEQ ID NO: 416176 - RNA, 19 nt, Homo sapiens
aaacagaggcccugcuuug

SEQ ID NO: 416177 - RNA, 19 nt, Homo sapiens
gaccauuacuggccauuca

SEQ ID NO: 416178 - RNA, 19 nt, Homo sapiens
gaagcaccgggaagacuua

SEQ ID NO: 416179 - RNA, 19 nt, Homo sapiens
ggccaaagacucugacuau

SEQ ID NO: 416180 - RNA, 19 nt, Homo sapiens
uaauguuacuguccaaguu

SEQ ID NO: 416181 - RNA, 19 nt, Homo sapiens
gaguuuaguuggcccuuug

SEQ ID NO: 416182 - RNA, 19 nt, Homo sapiens
uguaauauguggccaagga

SEQ ID NO: 416183 - RNA, 19 nt, Homo sapiens
ugauguggaugaagaagaa

SEQ ID NO: 416184 - RNA, 19 nt, Homo sapiens
gcaaaggucccaugaucau

SEQ ID NO: 416185 - RNA, 19 nt, Homo sapiens
gcugguacauuugucaauu

SEQ ID NO: 416186 - RNA, 19 nt, Homo sapiens
guucauagccgucucaaca

SEQ ID NO: 416187 - RNA, 19 nt, Homo sapiens
gaagagggaguagcugauu

SEQ ID NO: 416188 - RNA, 19 nt, Homo sapiens
gaaauugagccagcacuau

SEQ ID NO: 416189 - RNA, 19 nt, Homo sapiens
uauucugccuuccaaguua

SEQ ID NO: 416190 - RNA, 19 nt, Homo sapiens
ucagugaugucauauacga

SEQ ID NO: 416191 - RNA, 19 nt, Homo sapiens
agaaccagcuccacccaaa

SEQ ID NO: 416192 - RNA, 19 nt, Homo sapiens
caaaggcaauauaaagucu

SEQ ID NO: 416193 - RNA, 19 nt, Homo sapiens
gucacuuccugauaaauaa

SEQ ID NO: 416194 - RNA, 19 nt, Homo sapiens
ugacauugauggcauugug

SEQ ID NO: 416195 - RNA, 19 nt, Homo sapiens
gggcuggugucagaaauga

SEQ ID NO: 416196 - RNA, 19 nt, Homo sapiens
cugcagaucuuccacugaa

SEQ ID NO: 416197 - RNA, 19 nt, Homo sapiens
gugaugacauggauauaca

SEQ ID NO: 416198 - RNA, 19 nt, Homo sapiens
gauuguguauugugacaug

SEQ ID NO: 416199 - RNA, 19 nt, Homo sapiens
ugucaaaugucucuaugga

SEQ ID NO: 416200 - RNA, 19 nt, Homo sapiens
ggacggacaggaacauuca

SEQ ID NO: 416201 - RNA, 19 nt, Homo sapiens
gcaaaugcugcagaaagua

SEQ ID NO: 416202 - RNA, 19 nt, Homo sapiens
ggaccaaauucaacagaac

SEQ ID NO: 416203 - RNA, 19 nt, Homo sapiens
acaaacauccuaccauaug

SEQ ID NO: 416204 - RNA, 19 nt, Homo sapiens
ggaaccaguugcuguuucu

SEQ ID NO: 416205 - RNA, 19 nt, Homo sapiens
ugagagcuauuucuuuaag

SEQ ID NO: 416206 - RNA, 19 nt, Homo sapiens
gcauacaugugagagcuau

SEQ ID NO: 416207 - RNA, 19 nt, Homo sapiens
caucaaugccaacuauauu

SEQ ID NO: 416208 - RNA, 19 nt, Homo sapiens
gaagaugguccugcaacaa

SEQ ID NO: 416209 - RNA, 19 nt, Homo sapiens
acacuuugcugcagaucuu

SEQ ID NO: 416210 - RNA, 19 nt, Homo sapiens
ccauacaacuggaguaaaa

SEQ ID NO: 416211 - RNA, 19 nt, Homo sapiens
uaauuggacuguugcuugu

SEQ ID NO: 416212 - RNA, 19 nt, Homo sapiens
ucucaacaaugguuacaga

SEQ ID NO: 416213 - RNA, 19 nt, Homo sapiens
ugacauggauauacaacag

SEQ ID NO: 416214 - RNA, 19 nt, Homo sapiens
ugugaagccuguuacuuug

SEQ ID NO: 416215 - RNA, 19 nt, Homo sapiens
ccgggaagacuuagccuua

SEQ ID NO: 416216 - RNA, 19 nt, Homo sapiens
gaaagaagaaagaauacac

SEQ ID NO: 416217 - RNA, 19 nt, Homo sapiens
cuucagccgugugagauua

SEQ ID NO: 416218 - RNA, 19 nt, Homo sapiens
uuaaagaagaggaaacuga

SEQ ID NO: 416219 - RNA, 19 nt, Homo sapiens
agagagggauggaaagcuu

SEQ ID NO: 416220 - RNA, 19 nt, Homo sapiens
gaugaaucccaauguggua

SEQ ID NO: 416221 - RNA, 19 nt, Homo sapiens
aaaguauccugcaguuugu

SEQ ID NO: 416222 - RNA, 19 nt, Homo sapiens
caaaugcugcagaaaguau

SEQ ID NO: 416223 - RNA, 19 nt, Homo sapiens
ggaugacuuugaugccuau

SEQ ID NO: 416224 - RNA, 19 nt, Homo sapiens
ggucaagacgcucuccaaa

SEQ ID NO: 416225 - RNA, 19 nt, Homo sapiens
gaagacuuagccuuaaaga

SEQ ID NO: 416226 - RNA, 19 nt, Homo sapiens
ugaagaagaagcagcaguu

SEQ ID NO: 416227 - RNA, 19 nt, Homo sapiens
augcuucaccugcuuauua

SEQ ID NO: 416228 - RNA, 19 nt, Homo sapiens
caucagauuauaccucauu

SEQ ID NO: 416229 - RNA, 19 nt, Homo sapiens
ccaaagagcugggaauuua

SEQ ID NO: 416230 - RNA, 19 nt, Homo sapiens
gggaguagcugauuucuuu

SEQ ID NO: 416231 - RNA, 19 nt, Homo sapiens
gaucaacuguguaaucuuu

SEQ ID NO: 416232 - RNA, 19 nt, Homo sapiens
caaagacucugacuauaaa

SEQ ID NO: 416233 - RNA, 19 nt, Homo sapiens
caacaaaagucucagauua

SEQ ID NO: 416234 - RNA, 19 nt, Homo sapiens
gaaaguauccugcaguuug

SEQ ID NO: 416235 - RNA, 19 nt, Homo sapiens
caacugauguggaugaaga

SEQ ID NO: 416236 - RNA, 19 nt, Homo sapiens
gagcaaaggucccaugauc

SEQ ID NO: 416237 - RNA, 19 nt, Homo sapiens
acacaaacauccuaccaua

SEQ ID NO: 416238 - RNA, 19 nt, Homo sapiens
ucaaaugucucuauggauu

SEQ ID NO: 416239 - RNA, 19 nt, Homo sapiens
ugugagagcuauuucuuua

SEQ ID NO: 416240 - RNA, 19 nt, Homo sapiens
gcucuuaccuaccuauauu

SEQ ID NO: 416241 - RNA, 19 nt, Homo sapiens
caaguuggcuccagucaga

SEQ ID NO: 416242 - RNA, 19 nt, Homo sapiens
ccaacuauauuccuggaua

SEQ ID NO: 416243 - RNA, 19 nt, Homo sapiens
caacuaugcugacgagaug

SEQ ID NO: 416244 - RNA, 19 nt, Homo sapiens
ccaaagacucugacuauaa

SEQ ID NO: 416245 - RNA, 19 nt, Homo sapiens
uaucuguacuccaacauua

SEQ ID NO: 416246 - RNA, 19 nt, Homo sapiens
uaacgaguguaacuaguaa

SEQ ID NO: 416247 - RNA, 19 nt, Homo sapiens
gaguguaacuaguaacauu

SEQ ID NO: 416248 - RNA, 19 nt, Homo sapiens
gaagaaagaauacacuuag

SEQ ID NO: 416249 - RNA, 19 nt, Homo sapiens
cagaggcccugcuuuguaa

SEQ ID NO: 416250 - RNA, 19 nt, Homo sapiens
guguggagcugguacauuu

SEQ ID NO: 416251 - RNA, 19 nt, Homo sapiens
aauaagaggugaugacaug

SEQ ID NO: 416252 - RNA, 19 nt, Homo sapiens
ggagaugauuucagaggaa

SEQ ID NO: 416253 - RNA, 19 nt, Homo sapiens
gaaauugauuggacuggau

SEQ ID NO: 416254 - RNA, 19 nt, Homo sapiens
gaacucuguugcugucuga

SEQ ID NO: 416255 - RNA, 19 nt, Homo sapiens
uaauucagcuucaaaguag

SEQ ID NO: 416256 - RNA, 19 nt, Homo sapiens
caacaaugguuacagagau

SEQ ID NO: 416257 - RNA, 19 nt, Homo sapiens
aaaggagggugaaauguga

SEQ ID NO: 416258 - RNA, 19 nt, Homo sapiens
caaacauccuaccauauga

SEQ ID NO: 416259 - RNA, 19 nt, Homo sapiens
cuacaucaaugccaacuau

SEQ ID NO: 416260 - RNA, 19 nt, Homo sapiens
gggaagacuuagccuuaaa

SEQ ID NO: 416261 - RNA, 19 nt, Homo sapiens
gccaaagacucugacuaua

SEQ ID NO: 416262 - RNA, 19 nt, Homo sapiens
uuaaggauauggccaaaga

SEQ ID NO: 416263 - RNA, 19 nt, Homo sapiens
ugacuuugaugccuauauu

SEQ ID NO: 416264 - RNA, 19 nt, Homo sapiens
gcugauuucuuugaaguuu

SEQ ID NO: 416265 - RNA, 19 nt, Homo sapiens
ucagaagagugucaaguug

SEQ ID NO: 416266 - RNA, 19 nt, Homo sapiens
gcugggaauuuaugaaguu

SEQ ID NO: 416267 - RNA, 19 nt, Homo sapiens
gagcagagaggacaugaug

SEQ ID NO: 416268 - RNA, 19 nt, Homo sapiens
ggucauaccggaugucuau

SEQ ID NO: 416269 - RNA, 19 nt, Homo sapiens
guaggaguauauuugcuuu

SEQ ID NO: 416270 - RNA, 19 nt, Homo sapiens
gcagauggcuagggagugu

SEQ ID NO: 416271 - RNA, 19 nt, Homo sapiens
gaaaacacuuugaguugaa

SEQ ID NO: 416272 - RNA, 19 nt, Homo sapiens
gggaauuuaugaaguuaug

SEQ ID NO: 416273 - RNA, 19 nt, Homo sapiens
ggccacacaugaagaaaug

SEQ ID NO: 416274 - RNA, 19 nt, Homo sapiens
cagaaaguauccugcaguu

SEQ ID NO: 416275 - RNA, 19 nt, Homo sapiens
ggaagaugguccugcaaca

SEQ ID NO: 416276 - RNA, 19 nt, Homo sapiens
ucaagacgcucuccaaagg

SEQ ID NO: 416277 - RNA, 19 nt, Homo sapiens
aaacagaggcccugcuuug

SEQ ID NO: 416278 - RNA, 19 nt, Homo sapiens
gaccauuacuggccauuca

SEQ ID NO: 416279 - RNA, 19 nt, Homo sapiens
gaagcaccgggaagacuua

SEQ ID NO: 416280 - RNA, 19 nt, Homo sapiens
ccauacaacuggcguagga

SEQ ID NO: 416281 - RNA, 19 nt, Homo sapiens
ggccaaagacucugacuau

SEQ ID NO: 416282 - RNA, 19 nt, Homo sapiens
uaauguuacuguccaaguu

SEQ ID NO: 416283 - RNA, 19 nt, Homo sapiens
gaguuuaguuggcccuuug

SEQ ID NO: 416284 - RNA, 19 nt, Homo sapiens
uguaauauguggccaagga

SEQ ID NO: 416285 - RNA, 19 nt, Homo sapiens
ugauguggaugaagaagaa

SEQ ID NO: 416286 - RNA, 19 nt, Homo sapiens
gcaaaggucccaugaucau

SEQ ID NO: 416287 - RNA, 19 nt, Homo sapiens
gcugguacauuugucaauu

SEQ ID NO: 416288 - RNA, 19 nt, Homo sapiens
guucauagccgucucaaca

SEQ ID NO: 416289 - RNA, 19 nt, Homo sapiens
gaagagggaguagcugauu

SEQ ID NO: 416290 - RNA, 19 nt, Homo sapiens
gaaauugagccagcacuau

SEQ ID NO: 416291 - RNA, 19 nt, Homo sapiens
uauucugccuuccaaguua

SEQ ID NO: 416292 - RNA, 19 nt, Homo sapiens
ucagugaugucauauacga

SEQ ID NO: 416293 - RNA, 19 nt, Homo sapiens
ccucaugucuuuggacuga

SEQ ID NO: 416294 - RNA, 19 nt, Homo sapiens
cugcuacccucaugucuuu

SEQ ID NO: 416295 - RNA, 19 nt, Homo sapiens
caaaggcaauauaaagucu

SEQ ID NO: 416296 - RNA, 19 nt, Homo sapiens
agaaccagcuccacccaaa

SEQ ID NO: 416297 - RNA, 19 nt, Homo sapiens
gucacuuccugauaaauaa

SEQ ID NO: 416298 - RNA, 19 nt, Homo sapiens
ugacauugauggcauugug

SEQ ID NO: 416299 - RNA, 19 nt, Homo sapiens
gggcuggugucagaaauga

SEQ ID NO: 416300 - RNA, 19 nt, Homo sapiens
cugcagaucuuccacugaa

SEQ ID NO: 416301 - RNA, 19 nt, Homo sapiens
caacuggcguaggaguaua

SEQ ID NO: 416302 - RNA, 19 nt, Homo sapiens
gugaugacauggauauaca

SEQ ID NO: 416303 - RNA, 19 nt, Homo sapiens
gauuguguauugugacaug

SEQ ID NO: 416304 - RNA, 19 nt, Homo sapiens
ugucaaaugucucuaugga

SEQ ID NO: 416305 - RNA, 19 nt, Homo sapiens
ggacggacaggaacauuca

SEQ ID NO: 416306 - RNA, 19 nt, Homo sapiens
gcaaaugcugcagaaagua

SEQ ID NO: 416307 - RNA, 19 nt, Homo sapiens
ggaccaaauucaacagaac

SEQ ID NO: 416308 - RNA, 19 nt, Homo sapiens
acaaacauccuaccauaug

SEQ ID NO: 416309 - RNA, 19 nt, Homo sapiens
ggaaccaguugcuguuucu

SEQ ID NO: 416310 - RNA, 19 nt, Homo sapiens
ugagagcuauuucuuuaag

SEQ ID NO: 416311 - RNA, 19 nt, Homo sapiens
gcauacaugugagagcuau

SEQ ID NO: 416312 - RNA, 19 nt, Homo sapiens
caucaaugccaacuauauu

SEQ ID NO: 416313 - RNA, 19 nt, Homo sapiens
gaagaugguccugcaacaa

SEQ ID NO: 416314 - RNA, 19 nt, Homo sapiens
acacuuugcugcagaucuu

SEQ ID NO: 416315 - RNA, 19 nt, Homo sapiens
uaauuggacuguugcuugu

SEQ ID NO: 416316 - RNA, 19 nt, Homo sapiens
ucucaacaaugguuacaga

SEQ ID NO: 416317 - RNA, 19 nt, Homo sapiens
ugacauggauauacaacag

SEQ ID NO: 416318 - RNA, 19 nt, Homo sapiens
ugugaagccuguuacuuug

SEQ ID NO: 416319 - RNA, 19 nt, Homo sapiens
gaaagaagaaagaauacac

SEQ ID NO: 416320 - RNA, 19 nt, Homo sapiens
ccgggaagacuuagccuua

SEQ ID NO: 416321 - RNA, 19 nt, Homo sapiens
cuucagccgugugagauua

SEQ ID NO: 416322 - RNA, 19 nt, Homo sapiens
uuaaagaagaggaaacuga

SEQ ID NO: 416323 - RNA, 19 nt, Homo sapiens
agagagggauggaaagcuu

SEQ ID NO: 416324 - RNA, 19 nt, Homo sapiens
gaugaaucccaauguggua

SEQ ID NO: 416325 - RNA, 19 nt, Homo sapiens
aaaguauccugcaguuugu

SEQ ID NO: 416326 - RNA, 19 nt, Homo sapiens
caaaugcugcagaaaguau

SEQ ID NO: 416327 - RNA, 19 nt, Homo sapiens
ggaugacuuugaugccuau

SEQ ID NO: 416328 - RNA, 19 nt, Homo sapiens
ggucaagacgcucuccaaa

SEQ ID NO: 416329 - RNA, 19 nt, Homo sapiens
ccaaagagcugggaauuua

SEQ ID NO: 416330 - RNA, 19 nt, Homo sapiens
gggaguagcugauuucuuu

SEQ ID NO: 416331 - RNA, 19 nt, Homo sapiens
gaucaacuguguaaucuuu

SEQ ID NO: 416332 - RNA, 19 nt, Homo sapiens
caaagacucugacuauaaa

SEQ ID NO: 416333 - RNA, 19 nt, Homo sapiens
ugaagacacuuguaacaua

SEQ ID NO: 416334 - RNA, 19 nt, Homo sapiens
acaguaaucugcccauuua

SEQ ID NO: 416335 - RNA, 19 nt, Homo sapiens
caacaaaagucucagauua

SEQ ID NO: 416336 - RNA, 19 nt, Homo sapiens
gaaaguauccugcaguuug

SEQ ID NO: 416337 - RNA, 19 nt, Homo sapiens
gaagacacuuguaacauau

SEQ ID NO: 416338 - RNA, 19 nt, Homo sapiens
gagcagugguggagcaaua

SEQ ID NO: 416339 - RNA, 19 nt, Homo sapiens
ccacgaguguucagucuua

SEQ ID NO: 416340 - RNA, 19 nt, Homo sapiens
caacugauguggaugaaga

SEQ ID NO: 416341 - RNA, 19 nt, Homo sapiens
gagcaaaggucccaugauc

SEQ ID NO: 416342 - RNA, 19 nt, Homo sapiens
acacaaacauccuaccaua

SEQ ID NO: 416343 - RNA, 19 nt, Homo sapiens
ucaaaugucucuauggauu

SEQ ID NO: 416344 - RNA, 19 nt, Homo sapiens
ugugagagcuauuucuuua

SEQ ID NO: 416345 - RNA, 19 nt, Homo sapiens
gcucuuaccuaccuauauu

SEQ ID NO: 416346 - RNA, 19 nt, Homo sapiens
caaguuggcuccagucaga

SEQ ID NO: 416347 - RNA, 19 nt, Homo sapiens
ccaacuauauuccuggaua

SEQ ID NO: 416348 - RNA, 19 nt, Homo sapiens
caacuaugcugacgagaug

SEQ ID NO: 416349 - RNA, 19 nt, Homo sapiens
ccaaagacucugacuauaa

SEQ ID NO: 416350 - RNA, 19 nt, Homo sapiens
uaucuguacuccaacauua

SEQ ID NO: 416351 - RNA, 19 nt, Homo sapiens
cuagauaucuugugcaaau

SEQ ID NO: 416352 - RNA, 19 nt, Homo sapiens
uaacgaguguaacuaguaa

SEQ ID NO: 416353 - RNA, 19 nt, Homo sapiens
gaguguaacuaguaacauu

SEQ ID NO: 416354 - RNA, 19 nt, Homo sapiens
ccagaacccuaaauuauuc

SEQ ID NO: 416355 - RNA, 19 nt, Homo sapiens
gaagaaagaauacacuuag

SEQ ID NO: 416356 - RNA, 19 nt, Homo sapiens
cagaggcccugcuuuguaa

SEQ ID NO: 416357 - RNA, 19 nt, Homo sapiens
aaacaacagugacaauaga

SEQ ID NO: 416358 - RNA, 19 nt, Homo sapiens
guguggagcugguacauuu

SEQ ID NO: 416359 - RNA, 19 nt, Homo sapiens
aauaagaggugaugacaug

SEQ ID NO: 416360 - RNA, 19 nt, Homo sapiens
ggagaugauuucagaggaa

SEQ ID NO: 416361 - RNA, 19 nt, Homo sapiens
gaaauugauuggacuggau

SEQ ID NO: 416362 - RNA, 19 nt, Homo sapiens
gaacucuguugcugucuga

SEQ ID NO: 416363 - RNA, 19 nt, Homo sapiens
uaauucagcuucaaaguag

SEQ ID NO: 416364 - RNA, 19 nt, Homo sapiens
caacaaugguuacagagau

SEQ ID NO: 416365 - RNA, 19 nt, Homo sapiens
aaaggagggugaaauguga

SEQ ID NO: 416366 - RNA, 19 nt, Homo sapiens
caaacauccuaccauauga

SEQ ID NO: 416367 - RNA, 19 nt, Homo sapiens
agacagagacaaacaaauu

SEQ ID NO: 416368 - RNA, 19 nt, Homo sapiens
gcaguagccauuuguauug

SEQ ID NO: 416369 - RNA, 19 nt, Homo sapiens
cuacaucaaugccaacuau

SEQ ID NO: 416370 - RNA, 19 nt, Homo sapiens
gggaagacuuagccuuaaa

SEQ ID NO: 416371 - RNA, 19 nt, Homo sapiens
gccaaagacucugacuaua

SEQ ID NO: 416372 - RNA, 19 nt, Homo sapiens
uuaaggauauggccaaaga

SEQ ID NO: 416373 - RNA, 19 nt, Homo sapiens
acaauagagucucaggaua

SEQ ID NO: 416374 - RNA, 19 nt, Homo sapiens
ugacuucacaugaguauuu

SEQ ID NO: 416375 - RNA, 19 nt, Homo sapiens
ugacuuugaugccuauauu

SEQ ID NO: 416376 - RNA, 19 nt, Homo sapiens
gcugauuucuuugaaguuu

SEQ ID NO: 416377 - RNA, 19 nt, Homo sapiens
ucagaagagugucaaguug

SEQ ID NO: 416378 - RNA, 19 nt, Homo sapiens
caauggagcaggaaggaua

SEQ ID NO: 416379 - RNA, 19 nt, Homo sapiens
gauuagcacugcaccucua

SEQ ID NO: 416380 - RNA, 19 nt, Homo sapiens
gcugggaauuuaugaaguu

SEQ ID NO: 416381 - RNA, 19 nt, Homo sapiens
agagaaagaugcacagauc

SEQ ID NO: 416382 - RNA, 19 nt, Homo sapiens
gaaagucugggaagcauau

SEQ ID NO: 416383 - RNA, 19 nt, Homo sapiens
ggucauaccggaugucuau

SEQ ID NO: 416384 - RNA, 19 nt, Homo sapiens
gcagauggcuagggagugu

SEQ ID NO: 416385 - RNA, 19 nt, Homo sapiens
gaaaacacuuugaguugaa

SEQ ID NO: 416386 - RNA, 19 nt, Homo sapiens
gggaauuuaugaaguuaug

SEQ ID NO: 416387 - RNA, 19 nt, Homo sapiens
ggccacacaugaagaaaug

SEQ ID NO: 416388 - RNA, 19 nt, Homo sapiens
gaaagacagagacaaacaa

SEQ ID NO: 416389 - RNA, 19 nt, Homo sapiens
aaagaaagacagagacaaa

SEQ ID NO: 416390 - RNA, 19 nt, Homo sapiens
cuacauccaucaagagaga

SEQ ID NO: 416391 - RNA, 19 nt, Homo sapiens
cagaaaguauccugcaguu

SEQ ID NO: 416392 - RNA, 19 nt, Homo sapiens
ggaagaugguccugcaaca

SEQ ID NO: 416393 - RNA, 19 nt, Homo sapiens
ucaagacgcucuccaaagg

SEQ ID NO: 416394 - RNA, 19 nt, Homo sapiens
aaacagaggcccugcuuug

SEQ ID NO: 416395 - RNA, 19 nt, Homo sapiens
gaccauuacuggccauuca

SEQ ID NO: 416396 - RNA, 19 nt, Homo sapiens
gaagcaccgggaagacuua

SEQ ID NO: 416397 - RNA, 19 nt, Homo sapiens
uaugugagcccuuauuuga

SEQ ID NO: 416398 - RNA, 19 nt, Homo sapiens
ggccaaagacucugacuau

SEQ ID NO: 416399 - RNA, 19 nt, Homo sapiens
uaauguuacuguccaaguu

SEQ ID NO: 416400 - RNA, 19 nt, Homo sapiens
gaguuuaguuggcccuuug

SEQ ID NO: 416401 - RNA, 19 nt, Homo sapiens
uguaauauguggccaagga

SEQ ID NO: 416402 - RNA, 19 nt, Homo sapiens
uagcagaucuuugaguuuc

SEQ ID NO: 416403 - RNA, 19 nt, Homo sapiens
ggagaaacaaguacuguag

SEQ ID NO: 416404 - RNA, 19 nt, Homo sapiens
ugauguggaugaagaagaa

SEQ ID NO: 416405 - RNA, 19 nt, Homo sapiens
gcaaaggucccaugaucau

SEQ ID NO: 416406 - RNA, 19 nt, Homo sapiens
gcugguacauuugucaauu

SEQ ID NO: 416407 - RNA, 19 nt, Homo sapiens
guucauagccgucucaaca

SEQ ID NO: 416408 - RNA, 19 nt, Homo sapiens
gaagagggaguagcugauu

SEQ ID NO: 416409 - RNA, 19 nt, Homo sapiens
gaaauugagccagcacuau

SEQ ID NO: 416410 - RNA, 19 nt, Homo sapiens
gcacagaucaacccacauc

SEQ ID NO: 416411 - RNA, 19 nt, Homo sapiens
gacagagacaaacaaauuu

SEQ ID NO: 416412 - RNA, 19 nt, Homo sapiens
uauucugccuuccaaguua

SEQ ID NO: 416413 - RNA, 19 nt, Homo sapiens
ccauuuguauugacucuga

SEQ ID NO: 416414 - RNA, 19 nt, Homo sapiens
caaaggcaauauaaagucu

SEQ ID NO: 416415 - RNA, 19 nt, Homo sapiens
agaaccagcuccacccaaa

SEQ ID NO: 416416 - RNA, 19 nt, Homo sapiens
guaaucugcccauuuaguu

SEQ ID NO: 416417 - RNA, 19 nt, Homo sapiens
ucagugaugucauauacga

SEQ ID NO: 416418 - RNA, 19 nt, Homo sapiens
gucacuuccugauaaauaa

SEQ ID NO: 416419 - RNA, 19 nt, Homo sapiens
ugacauugauggcauugug

SEQ ID NO: 416420 - RNA, 19 nt, Homo sapiens
ggaggcagcacacagagaa

SEQ ID NO: 416421 - RNA, 19 nt, Homo sapiens
gggcuggugucagaaauga

SEQ ID NO: 416422 - RNA, 19 nt, Homo sapiens
cugcagaucuuccacugaa

SEQ ID NO: 416423 - RNA, 19 nt, Homo sapiens
gugaugacauggauauaca

SEQ ID NO: 416424 - RNA, 19 nt, Homo sapiens
gauuguguauugugacaug

SEQ ID NO: 416425 - RNA, 19 nt, Homo sapiens
ugucaaaugucucuaugga

SEQ ID NO: 416426 - RNA, 19 nt, Homo sapiens
ucacagggagaaacaagua

SEQ ID NO: 416427 - RNA, 19 nt, Homo sapiens
ggacggacaggaacauuca

SEQ ID NO: 416428 - RNA, 19 nt, Homo sapiens
gcaaaugcugcagaaagua

SEQ ID NO: 416429 - RNA, 19 nt, Homo sapiens
ccaaagagcugggaauuua

SEQ ID NO: 416430 - RNA, 19 nt, Homo sapiens
gggaguagcugauuucuuu

SEQ ID NO: 416431 - RNA, 19 nt, Homo sapiens
gaucaacuguguaaucuuu

SEQ ID NO: 416432 - RNA, 19 nt, Homo sapiens
caaagacucugacuauaaa

SEQ ID NO: 416433 - RNA, 19 nt, Homo sapiens
ugaagacacuuguaacaua

SEQ ID NO: 416434 - RNA, 19 nt, Homo sapiens
acaguaaucugcccauuua

SEQ ID NO: 416435 - RNA, 19 nt, Homo sapiens
caacaaaagucucagauua

SEQ ID NO: 416436 - RNA, 19 nt, Homo sapiens
gaaaguauccugcaguuug

SEQ ID NO: 416437 - RNA, 19 nt, Homo sapiens
gaagacacuuguaacauau

SEQ ID NO: 416438 - RNA, 19 nt, Homo sapiens
gagcagugguggagcaaua

SEQ ID NO: 416439 - RNA, 19 nt, Homo sapiens
ccacgaguguucagucuua

SEQ ID NO: 416440 - RNA, 19 nt, Homo sapiens
caacugauguggaugaaga

SEQ ID NO: 416441 - RNA, 19 nt, Homo sapiens
gagcaaaggucccaugauc

SEQ ID NO: 416442 - RNA, 19 nt, Homo sapiens
acacaaacauccuaccaua

SEQ ID NO: 416443 - RNA, 19 nt, Homo sapiens
ucaaaugucucuauggauu

SEQ ID NO: 416444 - RNA, 19 nt, Homo sapiens
ugugagagcuauuucuuua

SEQ ID NO: 416445 - RNA, 19 nt, Homo sapiens
gcucuuaccuaccuauauu

SEQ ID NO: 416446 - RNA, 19 nt, Homo sapiens
caaguuggcuccagucaga

SEQ ID NO: 416447 - RNA, 19 nt, Homo sapiens
ccaacuauauuccuggaua

SEQ ID NO: 416448 - RNA, 19 nt, Homo sapiens
caacuaugcugacgagaug

SEQ ID NO: 416449 - RNA, 19 nt, Homo sapiens
ccaaagacucugacuauaa

SEQ ID NO: 416450 - RNA, 19 nt, Homo sapiens
uaucuguacuccaacauua

SEQ ID NO: 416451 - RNA, 19 nt, Homo sapiens
cuagauaucuugugcaaau

SEQ ID NO: 416452 - RNA, 19 nt, Homo sapiens
uaacgaguguaacuaguaa

SEQ ID NO: 416453 - RNA, 19 nt, Homo sapiens
gaguguaacuaguaacauu

SEQ ID NO: 416454 - RNA, 19 nt, Homo sapiens
ccagaacccuaaauuauuc

SEQ ID NO: 416455 - RNA, 19 nt, Homo sapiens
gaagaaagaauacacuuag

SEQ ID NO: 416456 - RNA, 19 nt, Homo sapiens
cagaggcccugcuuuguaa

SEQ ID NO: 416457 - RNA, 19 nt, Homo sapiens
aaacaacagugacaauaga

SEQ ID NO: 416458 - RNA, 19 nt, Homo sapiens
guguggagcugguacauuu

SEQ ID NO: 416459 - RNA, 19 nt, Homo sapiens
aauaagaggugaugacaug

SEQ ID NO: 416460 - RNA, 19 nt, Homo sapiens
ggagaugauuucagaggaa

SEQ ID NO: 416461 - RNA, 19 nt, Homo sapiens
gaaauugauuggacuggau

SEQ ID NO: 416462 - RNA, 19 nt, Homo sapiens
gaacucuguugcugucuga

SEQ ID NO: 416463 - RNA, 19 nt, Homo sapiens
uaauucagcuucaaaguag

SEQ ID NO: 416464 - RNA, 19 nt, Homo sapiens
caacaaugguuacagagau

SEQ ID NO: 416465 - RNA, 19 nt, Homo sapiens
aaaggagggugaaauguga

SEQ ID NO: 416466 - RNA, 19 nt, Homo sapiens
caaacauccuaccauauga

SEQ ID NO: 416467 - RNA, 19 nt, Homo sapiens
agacagagacaaacaaauu

SEQ ID NO: 416468 - RNA, 19 nt, Homo sapiens
gcaguagccauuuguauug

SEQ ID NO: 416469 - RNA, 19 nt, Homo sapiens
cuacaucaaugccaacuau

SEQ ID NO: 416470 - RNA, 19 nt, Homo sapiens
gggaagacuuagccuuaaa

SEQ ID NO: 416471 - RNA, 19 nt, Homo sapiens
gccaaagacucugacuaua

SEQ ID NO: 416472 - RNA, 19 nt, Homo sapiens
uuaaggauauggccaaaga

SEQ ID NO: 416473 - RNA, 19 nt, Homo sapiens
acaauagagucucaggaua

SEQ ID NO: 416474 - RNA, 19 nt, Homo sapiens
ugacuucacaugaguauuu

SEQ ID NO: 416475 - RNA, 19 nt, Homo sapiens
ugacuuugaugccuauauu

SEQ ID NO: 416476 - RNA, 19 nt, Homo sapiens
gcugauuucuuugaaguuu

SEQ ID NO: 416477 - RNA, 19 nt, Homo sapiens
ucagaagagugucaaguug

SEQ ID NO: 416478 - RNA, 19 nt, Homo sapiens
caauggagcaggaaggaua

SEQ ID NO: 416479 - RNA, 19 nt, Homo sapiens
gauuagcacugcaccucua

SEQ ID NO: 416480 - RNA, 19 nt, Homo sapiens
gcugggaauuuaugaaguu

SEQ ID NO: 416481 - RNA, 19 nt, Homo sapiens
agagaaagaugcacagauc

SEQ ID NO: 416482 - RNA, 19 nt, Homo sapiens
gaaagucugggaagcauau

SEQ ID NO: 416483 - RNA, 19 nt, Homo sapiens
ggucauaccggaugucuau

SEQ ID NO: 416484 - RNA, 19 nt, Homo sapiens
guaggaguauauuugcuuu

SEQ ID NO: 416485 - RNA, 19 nt, Homo sapiens
gcagauggcuagggagugu

SEQ ID NO: 416486 - RNA, 19 nt, Homo sapiens
gaaaacacuuugaguugaa

SEQ ID NO: 416487 - RNA, 19 nt, Homo sapiens
gggaauuuaugaaguuaug

SEQ ID NO: 416488 - RNA, 19 nt, Homo sapiens
ggccacacaugaagaaaug

SEQ ID NO: 416489 - RNA, 19 nt, Homo sapiens
gaaagacagagacaaacaa

SEQ ID NO: 416490 - RNA, 19 nt, Homo sapiens
aaagaaagacagagacaaa

SEQ ID NO: 416491 - RNA, 19 nt, Homo sapiens
cuacauccaucaagagaga

SEQ ID NO: 416492 - RNA, 19 nt, Homo sapiens
cagaaaguauccugcaguu

SEQ ID NO: 416493 - RNA, 19 nt, Homo sapiens
ggaagaugguccugcaaca

SEQ ID NO: 416494 - RNA, 19 nt, Homo sapiens
ucaagacgcucuccaaagg

SEQ ID NO: 416495 - RNA, 19 nt, Homo sapiens
aaacagaggcccugcuuug

SEQ ID NO: 416496 - RNA, 19 nt, Homo sapiens
gaccauuacuggccauuca

SEQ ID NO: 416497 - RNA, 19 nt, Homo sapiens
gaagcaccgggaagacuua

SEQ ID NO: 416498 - RNA, 19 nt, Homo sapiens
uaugugagcccuuauuuga

SEQ ID NO: 416499 - RNA, 19 nt, Homo sapiens
ccauacaacuggcguagga

SEQ ID NO: 416500 - RNA, 19 nt, Homo sapiens
ggccaaagacucugacuau

SEQ ID NO: 416501 - RNA, 19 nt, Homo sapiens
uaauguuacuguccaaguu

SEQ ID NO: 416502 - RNA, 19 nt, Homo sapiens
gaguuuaguuggcccuuug

SEQ ID NO: 416503 - RNA, 19 nt, Homo sapiens
uguaauauguggccaagga

SEQ ID NO: 416504 - RNA, 19 nt, Homo sapiens
uagcagaucuuugaguuuc

SEQ ID NO: 416505 - RNA, 19 nt, Homo sapiens
ggagaaacaaguacuguag

SEQ ID NO: 416506 - RNA, 19 nt, Homo sapiens
ugauguggaugaagaagaa

SEQ ID NO: 416507 - RNA, 19 nt, Homo sapiens
gcaaaggucccaugaucau

SEQ ID NO: 416508 - RNA, 19 nt, Homo sapiens
gcugguacauuugucaauu

SEQ ID NO: 416509 - RNA, 19 nt, Homo sapiens
guucauagccgucucaaca

SEQ ID NO: 416510 - RNA, 19 nt, Homo sapiens
gaagagggaguagcugauu

SEQ ID NO: 416511 - RNA, 19 nt, Homo sapiens
gaaauugagccagcacuau

SEQ ID NO: 416512 - RNA, 19 nt, Homo sapiens
gcacagaucaacccacauc

SEQ ID NO: 416513 - RNA, 19 nt, Homo sapiens
gacagagacaaacaaauuu

SEQ ID NO: 416514 - RNA, 19 nt, Homo sapiens
uauucugccuuccaaguua

SEQ ID NO: 416515 - RNA, 19 nt, Homo sapiens
ccauuuguauugacucuga

SEQ ID NO: 416516 - RNA, 19 nt, Homo sapiens
caaaggcaauauaaagucu

SEQ ID NO: 416517 - RNA, 19 nt, Homo sapiens
agaaccagcuccacccaaa

SEQ ID NO: 416518 - RNA, 19 nt, Homo sapiens
guaaucugcccauuuaguu

SEQ ID NO: 416519 - RNA, 19 nt, Homo sapiens
ucagugaugucauauacga

SEQ ID NO: 416520 - RNA, 19 nt, Homo sapiens
ccucaugucuuuggacuga

SEQ ID NO: 416521 - RNA, 19 nt, Homo sapiens
cugcuacccucaugucuuu

SEQ ID NO: 416522 - RNA, 19 nt, Homo sapiens
gucacuuccugauaaauaa

SEQ ID NO: 416523 - RNA, 19 nt, Homo sapiens
ugacauugauggcauugug

SEQ ID NO: 416524 - RNA, 19 nt, Homo sapiens
ggaggcagcacacagagaa

SEQ ID NO: 416525 - RNA, 19 nt, Homo sapiens
gggcuggugucagaaauga

SEQ ID NO: 416526 - RNA, 19 nt, Homo sapiens
cugcagaucuuccacugaa

SEQ ID NO: 416527 - RNA, 19 nt, Homo sapiens
caacuggcguaggaguaua

SEQ ID NO: 416528 - RNA, 19 nt, Homo sapiens
gugaugacauggauauaca

SEQ ID NO: 416529 - RNA, 19 nt, Homo sapiens
gauauaaucugucccauuu

SEQ ID NO: 416530 - RNA, 19 nt, Homo sapiens
caacguaucucuuacauug

SEQ ID NO: 416531 - RNA, 19 nt, Homo sapiens
ggaagccgguauucauuua

SEQ ID NO: 416532 - RNA, 19 nt, Homo sapiens
gcaccuacauuaaugcuaa

SEQ ID NO: 416533 - RNA, 19 nt, Homo sapiens
gcacaucaaucgccucauu

SEQ ID NO: 416534 - RNA, 19 nt, Homo sapiens
gcaaauggauguaaacaag

SEQ ID NO: 416535 - RNA, 19 nt, Homo sapiens
ggaaaugugucuugauaau

SEQ ID NO: 416536 - RNA, 19 nt, Homo sapiens
gcuauuaccuuucucaguu

SEQ ID NO: 416537 - RNA, 19 nt, Homo sapiens
gaaucucucucucaacaaa

SEQ ID NO: 416538 - RNA, 19 nt, Homo sapiens
caaagugaauucauggaaa

SEQ ID NO: 416539 - RNA, 19 nt, Homo sapiens
guucuucguucacuuaaua

SEQ ID NO: 416540 - RNA, 19 nt, Homo sapiens
gcugaagacauucguauua

SEQ ID NO: 416541 - RNA, 19 nt, Homo sapiens
gaaagaagaacaguauuga

SEQ ID NO: 416542 - RNA, 19 nt, Homo sapiens
guaaacaagcugaacauaa

SEQ ID NO: 416543 - RNA, 19 nt, Homo sapiens
gaaucuugcugcuaaaguu

SEQ ID NO: 416544 - RNA, 19 nt, Homo sapiens
ggaaagaagaacaguauug

SEQ ID NO: 416545 - RNA, 19 nt, Homo sapiens
uagcaacucugaaguauca

SEQ ID NO: 416546 - RNA, 19 nt, Homo sapiens
gagaagaggguccaacgua

SEQ ID NO: 416547 - RNA, 19 nt, Homo sapiens
gagaagagccuggauauag

SEQ ID NO: 416548 - RNA, 19 nt, Homo sapiens
uaaacaagcugaacauaac

SEQ ID NO: 416549 - RNA, 19 nt, Homo sapiens
gaaagaagaaggaguugug

SEQ ID NO: 416550 - RNA, 19 nt, Homo sapiens
guauaugccuucaggaaug

SEQ ID NO: 416551 - RNA, 19 nt, Homo sapiens
gaagugcuauuaccuuucu

SEQ ID NO: 416552 - RNA, 19 nt, Homo sapiens
gucaacagcugaaagaaga

SEQ ID NO: 416553 - RNA, 19 nt, Homo sapiens
cccaacaugugaagcauua

SEQ ID NO: 416554 - RNA, 19 nt, Homo sapiens
ucauugagcaccuacauua

SEQ ID NO: 416555 - RNA, 19 nt, Homo sapiens
gcagcaauguugacuuugu

SEQ ID NO: 416556 - RNA, 19 nt, Homo sapiens
gcaagugauugauaaugga

SEQ ID NO: 416557 - RNA, 19 nt, Homo sapiens
uaauagcacuuuaccugaa

SEQ ID NO: 416558 - RNA, 19 nt, Homo sapiens
uagcuguucugcucauaua

SEQ ID NO: 416559 - RNA, 19 nt, Homo sapiens
ccagugagcaguaugaauu

SEQ ID NO: 416560 - RNA, 19 nt, Homo sapiens
caaagguacugaauguugu

SEQ ID NO: 416561 - RNA, 19 nt, Homo sapiens
aggaguggcugcagcuuua

SEQ ID NO: 416562 - RNA, 19 nt, Homo sapiens
gaagaagacagacuugcuu

SEQ ID NO: 416563 - RNA, 19 nt, Homo sapiens
ucacaagacuccagacagu

SEQ ID NO: 416564 - RNA, 19 nt, Homo sapiens
gauuucagcuuuccuuaag

SEQ ID NO: 416565 - RNA, 19 nt, Homo sapiens
uguguuagaugcuuuaaug

SEQ ID NO: 416566 - RNA, 19 nt, Homo sapiens
ccaaagaaauugauauucc

SEQ ID NO: 416567 - RNA, 19 nt, Homo sapiens
cguggcaaguucacauuua

SEQ ID NO: 416568 - RNA, 19 nt, Homo sapiens
gagguggaauuucacuuug

SEQ ID NO: 416569 - RNA, 19 nt, Homo sapiens
uaacuacccucagcaaaca

SEQ ID NO: 416570 - RNA, 19 nt, Homo sapiens
gcagaugguuuggcaggaa

SEQ ID NO: 416571 - RNA, 19 nt, Homo sapiens
ucaacaccguggaugauuu

SEQ ID NO: 416572 - RNA, 19 nt, Homo sapiens
gaagguagcaauggaguau

SEQ ID NO: 416573 - RNA, 19 nt, Homo sapiens
ccaaagguacugaauguug

SEQ ID NO: 416574 - RNA, 19 nt, Homo sapiens
ccagaacucuauccacugu

SEQ ID NO: 416575 - RNA, 19 nt, Homo sapiens
ccacacagaauguauguau

SEQ ID NO: 416576 - RNA, 19 nt, Homo sapiens
agacugggcaacauauuua

SEQ ID NO: 416577 - RNA, 19 nt, Homo sapiens
gaaaagagagggauauaug

SEQ ID NO: 416578 - RNA, 19 nt, Homo sapiens
gcagucagccagccgaauu

SEQ ID NO: 416579 - RNA, 19 nt, Homo sapiens
ucugaaguaucaagaguuu

SEQ ID NO: 416580 - RNA, 19 nt, Homo sapiens
gggagaagguagcaaugga

SEQ ID NO: 416581 - RNA, 19 nt, Homo sapiens
cguguuugaugauucuuua

SEQ ID NO: 416582 - RNA, 19 nt, Homo sapiens
cucagcaucuuuguuauua

SEQ ID NO: 416583 - RNA, 19 nt, Homo sapiens
gcaauuaaucagaagaaga

SEQ ID NO: 416584 - RNA, 19 nt, Homo sapiens
gguuaucaguguaaaugaa

SEQ ID NO: 416585 - RNA, 19 nt, Homo sapiens
gaacauugaacccuuugug

SEQ ID NO: 416586 - RNA, 19 nt, Homo sapiens
ccggagagguggaauuuca

SEQ ID NO: 416587 - RNA, 19 nt, Homo sapiens
cuauuaccuuucucaguua

SEQ ID NO: 416588 - RNA, 19 nt, Homo sapiens
cauaggacuucaagagaga

SEQ ID NO: 416589 - RNA, 19 nt, Homo sapiens
auaguaacguguuugauga

SEQ ID NO: 416590 - RNA, 19 nt, Homo sapiens
gcgcugugccugcuccuua

SEQ ID NO: 416591 - RNA, 19 nt, Homo sapiens
gucauuggguauauaugua

SEQ ID NO: 416592 - RNA, 19 nt, Homo sapiens
auggaaaugugucuugaua

SEQ ID NO: 416593 - RNA, 19 nt, Homo sapiens
agaaaugugugcuauacug

SEQ ID NO: 416594 - RNA, 19 nt, Homo sapiens
uggcauggauuguggaaga

SEQ ID NO: 416595 - RNA, 19 nt, Homo sapiens
ggaaggagaagcucugaag

SEQ ID NO: 416596 - RNA, 19 nt, Homo sapiens
agagagggauauauggaaa

SEQ ID NO: 416597 - RNA, 19 nt, Homo sapiens
cacauuuacuccaaaguga
